United States Patent 7,341,835 (METHODS OF ANALYSIS OF ALTERNATIVE SPLICING IN MOUSE) - sequence listing, part 19

SEQ ID NO: 718496 - DNA, 25 bp, Mus musculus
ggtccagaaggacatcctcactcag

SEQ ID NO: 718497 - DNA, 25 bp, Mus musculus
ggtccagaaggagatcctcactcag

SEQ ID NO: 718498 - DNA, 25 bp, Mus musculus
ggtccagcatgtcccgcattatcag

SEQ ID NO: 718499 - DNA, 25 bp, Mus musculus
ggtccagcatgtgccgcattatcag

SEQ ID NO: 718500 - DNA, 25 bp, Mus musculus
ggtccagcccttcaggcaacgtctt

SEQ ID NO: 718501 - DNA, 25 bp, Mus musculus
ggtccagcccttgaggcaacgtctt

SEQ ID NO: 718502 - DNA, 25 bp, Mus musculus
ggtccagcctggaacatcctgatgt

SEQ ID NO: 718503 - DNA, 25 bp, Mus musculus
ggtccagcctggtacatcctgatgt

SEQ ID NO: 718504 - DNA, 25 bp, Mus musculus
ggtccagctgctccttattcgagat

SEQ ID NO: 718505 - DNA, 25 bp, Mus musculus
ggtccagctgctgcttattcgagat

SEQ ID NO: 718506 - DNA, 25 bp, Mus musculus
ggtccagcttgccattcagactctg

SEQ ID NO: 718507 - DNA, 25 bp, Mus musculus
ggtccagcttgcgattcagactctg

SEQ ID NO: 718508 - DNA, 25 bp, Mus musculus
ggtccaggacacataccagatcatg

SEQ ID NO: 718509 - DNA, 25 bp, Mus musculus
ggtccaggacacttaccagatcatg

SEQ ID NO: 718510 - DNA, 25 bp, Mus musculus
ggtccaggacagctcatttcttcct

SEQ ID NO: 718511 - DNA, 25 bp, Mus musculus
ggtccaggacaggtcatttcttcct

SEQ ID NO: 718512 - DNA, 25 bp, Mus musculus
ggtccaggacctactgaaccacgat

SEQ ID NO: 718513 - DNA, 25 bp, Mus musculus
ggtccaggaccttctgaaccacgat

SEQ ID NO: 718514 - DNA, 25 bp, Mus musculus
ggtccaggagctaaactgcctcttg

SEQ ID NO: 718515 - DNA, 25 bp, Mus musculus
ggtccaggagctagctcacgagctg

SEQ ID NO: 718516 - DNA, 25 bp, Mus musculus
ggtccaggagcttaactgcctcttg

SEQ ID NO: 718517 - DNA, 25 bp, Mus musculus
ggtccaggagcttgctcacgagctg

SEQ ID NO: 718518 - DNA, 25 bp, Mus musculus
ggtccaggcctgagcatatgtgagt

SEQ ID NO: 718519 - DNA, 25 bp, Mus musculus
ggtccaggcctgtgcatatgtgagt

SEQ ID NO: 718520 - DNA, 25 bp, Mus musculus
ggtccaggcgtcacaggctcgccag

SEQ ID NO: 718521 - DNA, 25 bp, Mus musculus
ggtccaggcgtctcaggctcgccag

SEQ ID NO: 718522 - DNA, 25 bp, Mus musculus
ggtccagtccatagctgtgcccaga

SEQ ID NO: 718523 - DNA, 25 bp, Mus musculus
ggtccagtccattgctgtgcccaga

SEQ ID NO: 718524 - DNA, 25 bp, Mus musculus
ggtccagtggccacatttgcagcgt

SEQ ID NO: 718525 - DNA, 25 bp, Mus musculus
ggtccagtggcctcatttgcagcgt

SEQ ID NO: 718526 - DNA, 25 bp, Mus musculus
ggtccagttcatcgagaaaacctgc

SEQ ID NO: 718527 - DNA, 25 bp, Mus musculus
ggtccagttcatggagaaaacctgc

SEQ ID NO: 718528 - DNA, 25 bp, Mus musculus
ggtccagttgttcgatgcctcctga

SEQ ID NO: 718529 - DNA, 25 bp, Mus musculus
ggtccagttgttggatgcctcctga

SEQ ID NO: 718530 - DNA, 25 bp, Mus musculus
ggtccagtttgacgacgattcccag

SEQ ID NO: 718531 - DNA, 25 bp, Mus musculus
ggtccagtttgaggacgattcccag

SEQ ID NO: 718532 - DNA, 25 bp, Mus musculus
ggtccataagttataaacatcggta

SEQ ID NO: 718533 - DNA, 25 bp, Mus musculus
ggtccataagttttaaacatcggta

SEQ ID NO: 718534 - DNA, 25 bp, Mus musculus
ggtccatcacgcagatcaagtataa

SEQ ID NO: 718535 - DNA, 25 bp, Mus musculus
ggtccatcacgctgatcaagtataa

SEQ ID NO: 718536 - DNA, 25 bp, Mus musculus
ggtccatccatgcacatagtgaaac

SEQ ID NO: 718537 - DNA, 25 bp, Mus musculus
ggtccatccatggacatagtgaaac

SEQ ID NO: 718538 - DNA, 25 bp, Mus musculus
ggtccatgaactactgggcataaac

SEQ ID NO: 718539 - DNA, 25 bp, Mus musculus
ggtccatgaacttctgggcataaac

SEQ ID NO: 718540 - DNA, 25 bp, Mus musculus
ggtccatgtctcctctaggtcagcg

SEQ ID NO: 718541 - DNA, 25 bp, Mus musculus
ggtccatgtctcgtctaggtcagcg

SEQ ID NO: 718542 - DNA, 25 bp, Mus musculus
ggtccatgttcacgcgagctctgga

SEQ ID NO: 718543 - DNA, 25 bp, Mus musculus
ggtccatgttcaggcgagctctgga

SEQ ID NO: 718544 - DNA, 25 bp, Mus musculus
ggtccattcagaaccgtgcttacag

SEQ ID NO: 718545 - DNA, 25 bp, Mus musculus
ggtccattcagatccgtgcttacag

SEQ ID NO: 718546 - DNA, 25 bp, Mus musculus
ggtccattgactagggagcctgtcc

SEQ ID NO: 718547 - DNA, 25 bp, Mus musculus
ggtccattgacttgggagcctgtcc

SEQ ID NO: 718548 - DNA, 25 bp, Mus musculus
ggtccattgggaccgacagctacct

SEQ ID NO: 718549 - DNA, 25 bp, Mus musculus
ggtccattgggagcgacagctacct

SEQ ID NO: 718550 - DNA, 25 bp, Mus musculus
ggtccatttggaagcccatttgagg

SEQ ID NO: 718551 - DNA, 25 bp, Mus musculus
ggtccatttggatgcccatttgagg

SEQ ID NO: 718552 - DNA, 25 bp, Mus musculus
ggtcccaaagccagatgcactcaag

SEQ ID NO: 718553 - DNA, 25 bp, Mus musculus
ggtcccaaagcctgatgcactcaag

SEQ ID NO: 718554 - DNA, 25 bp, Mus musculus
ggtcccaagtgtctataagaacttg

SEQ ID NO: 718555 - DNA, 25 bp, Mus musculus
ggtcccaagtgtgtataagaacttg

SEQ ID NO: 718556 - DNA, 25 bp, Mus musculus
ggtcccacctggcatctctcaagaa

SEQ ID NO: 718557 - DNA, 25 bp, Mus musculus
ggtcccacctgggatctctcaagaa

SEQ ID NO: 718558 - DNA, 25 bp, Mus musculus
ggtcccacggaccttatgtgatgcg

SEQ ID NO: 718559 - DNA, 25 bp, Mus musculus
ggtcccacggacgttatgtgatgcg

SEQ ID NO: 718560 - DNA, 25 bp, Mus musculus
ggtcccagaagcagcgcagctcgct

SEQ ID NO: 718561 - DNA, 25 bp, Mus musculus
ggtcccagaagctgcgcagctcgct

SEQ ID NO: 718562 - DNA, 25 bp, Mus musculus
ggtcccagactaaaaccagctaaag

SEQ ID NO: 718563 - DNA, 25 bp, Mus musculus
ggtcccagactataaccagctaaag

SEQ ID NO: 718564 - DNA, 25 bp, Mus musculus
ggtcccagagggacactccaccttt

SEQ ID NO: 718565 - DNA, 25 bp, Mus musculus
ggtcccagagggtcactccaccttt

SEQ ID NO: 718566 - DNA, 25 bp, Mus musculus
ggtcccagatgcatcggcatatgcg

SEQ ID NO: 718567 - DNA, 25 bp, Mus musculus
ggtcccagatgcttcggcatatgcg

SEQ ID NO: 718568 - DNA, 25 bp, Mus musculus
ggtcccagcacgctacgtaggtgaa

SEQ ID NO: 718569 - DNA, 25 bp, Mus musculus
ggtcccagcacggtacgtaggtgaa

SEQ ID NO: 718570 - DNA, 25 bp, Mus musculus
ggtcccagccctaggatagtgagaa

SEQ ID NO: 718571 - DNA, 25 bp, Mus musculus
ggtcccagcccttggatagtgagaa

SEQ ID NO: 718572 - DNA, 25 bp, Mus musculus
ggtcccaggctcacaaaatagtgca

SEQ ID NO: 718573 - DNA, 25 bp, Mus musculus
ggtcccaggctctcaaaatagtgca

SEQ ID NO: 718574 - DNA, 25 bp, Mus musculus
ggtcccagtgctagtccacactagt

SEQ ID NO: 718575 - DNA, 25 bp, Mus musculus
ggtcccagtgcttgtccacactagt

SEQ ID NO: 718576 - DNA, 25 bp, Mus musculus
ggtcccatctggacgtttcctccaa

SEQ ID NO: 718577 - DNA, 25 bp, Mus musculus
ggtcccatctggtcgtttcctccaa

SEQ ID NO: 718578 - DNA, 25 bp, Mus musculus
ggtcccatctgtccgtttgctggaa

SEQ ID NO: 718579 - DNA, 25 bp, Mus musculus
ggtcccatctgtgcgtttgctggaa

SEQ ID NO: 718580 - DNA, 25 bp, Mus musculus
ggtccccaaaacaatagtatccagc

SEQ ID NO: 718581 - DNA, 25 bp, Mus musculus
ggtccccaaaactatagtatccagc

SEQ ID NO: 718582 - DNA, 25 bp, Mus musculus
ggtccccatctcagtcacgggcatt

SEQ ID NO: 718583 - DNA, 25 bp, Mus musculus
ggtccccatctctgtcacgggcatt

SEQ ID NO: 718584 - DNA, 25 bp, Mus musculus
ggtccccatggaaggcattaaagga

SEQ ID NO: 718585 - DNA, 25 bp, Mus musculus
ggtccccatggatggcattaaagga

SEQ ID NO: 718586 - DNA, 25 bp, Mus musculus
ggtcccctacatcatcatgctcatt

SEQ ID NO: 718587 - DNA, 25 bp, Mus musculus
ggtcccctacatgatcatgctcatt

SEQ ID NO: 718588 - DNA, 25 bp, Mus musculus
ggtcccctggaacagacctatattg

SEQ ID NO: 718589 - DNA, 25 bp, Mus musculus
ggtcccctggaagagacctatattg

SEQ ID NO: 718590 - DNA, 25 bp, Mus musculus
ggtccccttggcacatccaaaagct

SEQ ID NO: 718591 - DNA, 25 bp, Mus musculus
ggtccccttggctcatccaaaagct

SEQ ID NO: 718592 - DNA, 25 bp, Mus musculus
ggtcccgaggcaaccaacatctgtg

SEQ ID NO: 718593 - DNA, 25 bp, Mus musculus
ggtcccgaggcatccaacatctgtg

SEQ ID NO: 718594 - DNA, 25 bp, Mus musculus
ggtcccgagtgacccatacatagtc

SEQ ID NO: 718595 - DNA, 25 bp, Mus musculus
ggtcccgagtgagccatacatagtc

SEQ ID NO: 718596 - DNA, 25 bp, Mus musculus
ggtcccgcaaaacttgaatgaatct

SEQ ID NO: 718597 - DNA, 25 bp, Mus musculus
ggtcccgcaaaagttgaatgaatct

SEQ ID NO: 718598 - DNA, 25 bp, Mus musculus
ggtcccgcctacagccaacatttta

SEQ ID NO: 718599 - DNA, 25 bp, Mus musculus
ggtcccgcctactgccaacatttta

SEQ ID NO: 718600 - DNA, 25 bp, Mus musculus
ggtcccgcctgcatttttctccgaa

SEQ ID NO: 718601 - DNA, 25 bp, Mus musculus
ggtcccgcctgcttttttctccgaa

SEQ ID NO: 718602 - DNA, 25 bp, Mus musculus
ggtcccggccatcctgttttccttg

SEQ ID NO: 718603 - DNA, 25 bp, Mus musculus
ggtcccggccatgctgttttccttg

SEQ ID NO: 718604 - DNA, 25 bp, Mus musculus
ggtcccgtcctgagaaactcttccg

SEQ ID NO: 718605 - DNA, 25 bp, Mus musculus
ggtcccgtcctgtgaaactcttccg

SEQ ID NO: 718606 - DNA, 25 bp, Mus musculus
ggtccctagaccctcaaaatgacgg

SEQ ID NO: 718607 - DNA, 25 bp, Mus musculus
ggtccctagaccgtcaaaatgacgg

SEQ ID NO: 718608 - DNA, 25 bp, Mus musculus
ggtccctcgcgcacacagtgcattg

SEQ ID NO: 718609 - DNA, 25 bp, Mus musculus
ggtccctcgcgctcacagtgcattg

SEQ ID NO: 718610 - DNA, 25 bp, Mus musculus
ggtccctcttgtagctgaccacaag

SEQ ID NO: 718611 - DNA, 25 bp, Mus musculus
ggtccctcttgttgctgaccacaag

SEQ ID NO: 718612 - DNA, 25 bp, Mus musculus
ggtccctgaatcaaaaggccctcgg

SEQ ID NO: 718613 - DNA, 25 bp, Mus musculus
ggtccctgaatctaaaggccctcgg

SEQ ID NO: 718614 - DNA, 25 bp, Mus musculus
ggtccctgaggtcacacttcgaggt

SEQ ID NO: 718615 - DNA, 25 bp, Mus musculus
ggtccctgaggtgacacttcgaggt

SEQ ID NO: 718616 - DNA, 25 bp, Mus musculus
ggtccctgcatgaggtgtctccagc

SEQ ID NO: 718617 - DNA, 25 bp, Mus musculus
ggtccctgcatgtggtgtctccagc

SEQ ID NO: 718618 - DNA, 25 bp, Mus musculus
ggtccctggagtccattttctaagt

SEQ ID NO: 718619 - DNA, 25 bp, Mus musculus
ggtccctggagtgcattttctaagt

SEQ ID NO: 718620 - DNA, 25 bp, Mus musculus
ggtccctggctgagtgaatgagaaa

SEQ ID NO: 718621 - DNA, 25 bp, Mus musculus
ggtccctggctgtgtgaatgagaaa

SEQ ID NO: 718622 - DNA, 25 bp, Mus musculus
ggtccctgggaccttggacccatga

SEQ ID NO: 718623 - DNA, 25 bp, Mus musculus
ggtccctgggacgttggacccatga

SEQ ID NO: 718624 - DNA, 25 bp, Mus musculus
ggtccctgggagagagccatctcac

SEQ ID NO: 718625 - DNA, 25 bp, Mus musculus
ggtccctgggagtgagccatctcac

SEQ ID NO: 718626 - DNA, 25 bp, Mus musculus
ggtcccttagttacttgcccttgtg

SEQ ID NO: 718627 - DNA, 25 bp, Mus musculus
ggtcccttagtttcttgcccttgtg

SEQ ID NO: 718628 - DNA, 25 bp, Mus musculus
ggtcccttttgcagtgacagagcag

SEQ ID NO: 718629 - DNA, 25 bp, Mus musculus
ggtcccttttgctgtgacagagcag

SEQ ID NO: 718630 - DNA, 25 bp, Mus musculus
ggtccgaaaggacaaccctgtccag

SEQ ID NO: 718631 - DNA, 25 bp, Mus musculus
ggtccgaaaggagaaccctgtccag

SEQ ID NO: 718632 - DNA, 25 bp, Mus musculus
ggtccgaatctccaggtccaaagct

SEQ ID NO: 718633 - DNA, 25 bp, Mus musculus
ggtccgaatctcgaggtccaaagct

SEQ ID NO: 718634 - DNA, 25 bp, Mus musculus
ggtccgacagccaatttatccctag

SEQ ID NO: 718635 - DNA, 25 bp, Mus musculus
ggtccgacagcctatttatccctag

SEQ ID NO: 718636 - DNA, 25 bp, Mus musculus
ggtccgacccagagtgtggcgctca

SEQ ID NO: 718637 - DNA, 25 bp, Mus musculus
ggtccgacccagtgtgtggcgctca

SEQ ID NO: 718638 - DNA, 25 bp, Mus musculus
ggtccgcagagccaacagtggcttc

SEQ ID NO: 718639 - DNA, 25 bp, Mus musculus
ggtccgcagagcgaacagtggcttc

SEQ ID NO: 718640 - DNA, 25 bp, Mus musculus
ggtccgcagagtccacggcagcttt

SEQ ID NO: 718641 - DNA, 25 bp, Mus musculus
ggtccgcagagtgcacggcagcttt

SEQ ID NO: 718642 - DNA, 25 bp, Mus musculus
ggtccgcagtggaggccatgtttct

SEQ ID NO: 718643 - DNA, 25 bp, Mus musculus
ggtccgcagtggtggccatgtttct

SEQ ID NO: 718644 - DNA, 25 bp, Mus musculus
ggtccgctgcaaaccgaatggcttt

SEQ ID NO: 718645 - DNA, 25 bp, Mus musculus
ggtccgctgcaatccgaatggcttt

SEQ ID NO: 718646 - DNA, 25 bp, Mus musculus
ggtccgctggagcaaatcgcataag

SEQ ID NO: 718647 - DNA, 25 bp, Mus musculus
ggtccgctggaggaaatcgcataag

SEQ ID NO: 718648 - DNA, 25 bp, Mus musculus
ggtccgcttggaagttgcacgctcg

SEQ ID NO: 718649 - DNA, 25 bp, Mus musculus
ggtccgcttggatgttgcacgctcg

SEQ ID NO: 718650 - DNA, 25 bp, Mus musculus
ggtccggagacgctgtatccctttg

SEQ ID NO: 718651 - DNA, 25 bp, Mus musculus
ggtccggagacggtgtatccctttg

SEQ ID NO: 718652 - DNA, 25 bp, Mus musculus
ggtccggatcaacccagtgttctct

SEQ ID NO: 718653 - DNA, 25 bp, Mus musculus
ggtccggatcaagccagtgttctct

SEQ ID NO: 718654 - DNA, 25 bp, Mus musculus
ggtccggcgggcactgttcctgact

SEQ ID NO: 718655 - DNA, 25 bp, Mus musculus
ggtccggcgggctctgttcctgact

SEQ ID NO: 718656 - DNA, 25 bp, Mus musculus
ggtccgtaatcgacccatgtcgtgc

SEQ ID NO: 718657 - DNA, 25 bp, Mus musculus
ggtccgtaatcgtcccatgtcgtgc

SEQ ID NO: 718658 - DNA, 25 bp, Mus musculus
ggtccgtgtattagacacacctcct

SEQ ID NO: 718659 - DNA, 25 bp, Mus musculus
ggtccgtgtatttgacacacctcct

SEQ ID NO: 718660 - DNA, 25 bp, Mus musculus
ggtccgtgtcctcattttgagcact

SEQ ID NO: 718661 - DNA, 25 bp, Mus musculus
ggtccgtgtcctgattttgagcact

SEQ ID NO: 718662 - DNA, 25 bp, Mus musculus
ggtcctaaccaaagctggcacggag

SEQ ID NO: 718663 - DNA, 25 bp, Mus musculus
ggtcctaaccaatgctggcacggag

SEQ ID NO: 718664 - DNA, 25 bp, Mus musculus
ggtcctaccgctcgactctgtagtc

SEQ ID NO: 718665 - DNA, 25 bp, Mus musculus
ggtcctaccgctggactctgtagtc

SEQ ID NO: 718666 - DNA, 25 bp, Mus musculus
ggtcctacttgacccacaggccttt

SEQ ID NO: 718667 - DNA, 25 bp, Mus musculus
ggtcctacttgagccacaggccttt

SEQ ID NO: 718668 - DNA, 25 bp, Mus musculus
ggtcctagcaaaataaaccgccgct

SEQ ID NO: 718669 - DNA, 25 bp, Mus musculus
ggtcctagcaaattaaaccgccgct

SEQ ID NO: 718670 - DNA, 25 bp, Mus musculus
ggtcctagctgtattctcagctgtg

SEQ ID NO: 718671 - DNA, 25 bp, Mus musculus
ggtcctagctgttttctcagctgtg

SEQ ID NO: 718672 - DNA, 25 bp, Mus musculus
ggtcctagtaacaggcacttcatgc

SEQ ID NO: 718673 - DNA, 25 bp, Mus musculus
ggtcctagtaactggcacttcatgc

SEQ ID NO: 718674 - DNA, 25 bp, Mus musculus
ggtcctagtaggaaaggattgtcac

SEQ ID NO: 718675 - DNA, 25 bp, Mus musculus
ggtcctagtaggtaaggattgtcac

SEQ ID NO: 718676 - DNA, 25 bp, Mus musculus
ggtcctataaggctagcagcagcac

SEQ ID NO: 718677 - DNA, 25 bp, Mus musculus
ggtcctataagggtagcagcagcac

SEQ ID NO: 718678 - DNA, 25 bp, Mus musculus
ggtcctatgaggagacctcagattc

SEQ ID NO: 718679 - DNA, 25 bp, Mus musculus
ggtcctatgaggtgacctcagattc

SEQ ID NO: 718680 - DNA, 25 bp, Mus musculus
ggtcctatgtgtctgcctcagctca

SEQ ID NO: 718681 - DNA, 25 bp, Mus musculus
ggtcctatgtgtgtgcctcagctca

SEQ ID NO: 718682 - DNA, 25 bp, Mus musculus
ggtcctcaaggaagatgctccccga

SEQ ID NO: 718683 - DNA, 25 bp, Mus musculus
ggtcctcaaggatgatgctccccga

SEQ ID NO: 718684 - DNA, 25 bp, Mus musculus
ggtcctcatcgtaaaactgctcaac

SEQ ID NO: 718685 - DNA, 25 bp, Mus musculus
ggtcctcatcgtcctttcgattcta

SEQ ID NO: 718686 - DNA, 25 bp, Mus musculus
ggtcctcatcgtgctttcgattcta

SEQ ID NO: 718687 - DNA, 25 bp, Mus musculus
ggtcctcatcgttaaactgctcaac

SEQ ID NO: 718688 - DNA, 25 bp, Mus musculus
ggtcctcatcttcagctcccatgta

SEQ ID NO: 718689 - DNA, 25 bp, Mus musculus
ggtcctcatcttgagctcccatgta

SEQ ID NO: 718690 - DNA, 25 bp, Mus musculus
ggtcctcattagcatctcaggttca

SEQ ID NO: 718691 - DNA, 25 bp, Mus musculus
ggtcctcattaggatctcaggttca

SEQ ID NO: 718692 - DNA, 25 bp, Mus musculus
ggtcctccctaaactactcaaagca

SEQ ID NO: 718693 - DNA, 25 bp, Mus musculus
ggtcctccctaatctactcaaagca

SEQ ID NO: 718694 - DNA, 25 bp, Mus musculus
ggtcctccctgacagtcttaaggca

SEQ ID NO: 718695 - DNA, 25 bp, Mus musculus
ggtcctccctgagagtcttaaggca

SEQ ID NO: 718696 - DNA, 25 bp, Mus musculus
ggtcctcctgttatgcgcccggagt

SEQ ID NO: 718697 - DNA, 25 bp, Mus musculus
ggtcctcctgttttgcgcccggagt

SEQ ID NO: 718698 - DNA, 25 bp, Mus musculus
ggtcctcgacctcttcatgttgtat

SEQ ID NO: 718699 - DNA, 25 bp, Mus musculus
ggtcctcgacctgttcatgttgtat

SEQ ID NO: 718700 - DNA, 25 bp, Mus musculus
ggtcctcgagggatctatggcacat

SEQ ID NO: 718701 - DNA, 25 bp, Mus musculus
ggtcctcgagggttctatggcacat

SEQ ID NO: 718702 - DNA, 25 bp, Mus musculus
ggtcctcgcagcaccatttcagtca

SEQ ID NO: 718703 - DNA, 25 bp, Mus musculus
ggtcctcgcagctccatttcagtca

SEQ ID NO: 718704 - DNA, 25 bp, Mus musculus
ggtcctctcaaaagaatattctatt

SEQ ID NO: 718705 - DNA, 25 bp, Mus musculus
ggtcctctcaaatgaatattctatt

SEQ ID NO: 718706 - DNA, 25 bp, Mus musculus
ggtcctctgactcataccaacatga

SEQ ID NO: 718707 - DNA, 25 bp, Mus musculus
ggtcctctgactgataccaacatga

SEQ ID NO: 718708 - DNA, 25 bp, Mus musculus
ggtcctctgggaactttgcactgca

SEQ ID NO: 718709 - DNA, 25 bp, Mus musculus
ggtcctctgggatctttgcactgca

SEQ ID NO: 718710 - DNA, 25 bp, Mus musculus
ggtcctgaagcaaaaagtgaagata

SEQ ID NO: 718711 - DNA, 25 bp, Mus musculus
ggtcctgaagcataaagtgaagata

SEQ ID NO: 718712 - DNA, 25 bp, Mus musculus
ggtcctgacactcagcgcatctatg

SEQ ID NO: 718713 - DNA, 25 bp, Mus musculus
ggtcctgacactgagcgcatctatg

SEQ ID NO: 718714 - DNA, 25 bp, Mus musculus
ggtcctgacctgctgagacagttct

SEQ ID NO: 718715 - DNA, 25 bp, Mus musculus
ggtcctgacctggtgagacagttct

SEQ ID NO: 718716 - DNA, 25 bp, Mus musculus
ggtcctgaccttagccctggatggg

SEQ ID NO: 718717 - DNA, 25 bp, Mus musculus
ggtcctgacctttgccctggatggg

SEQ ID NO: 718718 - DNA, 25 bp, Mus musculus
ggtcctgagctactagctgacagca

SEQ ID NO: 718719 - DNA, 25 bp, Mus musculus
ggtcctgagctagtagctgacagca

SEQ ID NO: 718720 - DNA, 25 bp, Mus musculus
ggtcctgatgcacgcctgtctccag

SEQ ID NO: 718721 - DNA, 25 bp, Mus musculus
ggtcctgatgcaggcctgtctccag

SEQ ID NO: 718722 - DNA, 25 bp, Mus musculus
ggtcctgattcgagagctaaagcgg

SEQ ID NO: 718723 - DNA, 25 bp, Mus musculus
ggtcctgattcgtgagctaaagcgg

SEQ ID NO: 718724 - DNA, 25 bp, Mus musculus
ggtcctgcacccagcagactttgca

SEQ ID NO: 718725 - DNA, 25 bp, Mus musculus
ggtcctgcaccctgcagactttgca

SEQ ID NO: 718726 - DNA, 25 bp, Mus musculus
ggtcctgcatctatagaacacgatt

SEQ ID NO: 718727 - DNA, 25 bp, Mus musculus
ggtcctgcatctttagaacacgatt

SEQ ID NO: 718728 - DNA, 25 bp, Mus musculus
ggtcctgccccaccagggtttgcaa

SEQ ID NO: 718729 - DNA, 25 bp, Mus musculus
ggtcctgccccagcagggtttgcaa

SEQ ID NO: 718730 - DNA, 25 bp, Mus musculus
ggtcctgcccttccaagagctgcag

SEQ ID NO: 718731 - DNA, 25 bp, Mus musculus
ggtcctgcccttgcaagagctgcag

SEQ ID NO: 718732 - DNA, 25 bp, Mus musculus
ggtcctgcgacacaggcttcacaag

SEQ ID NO: 718733 - DNA, 25 bp, Mus musculus
ggtcctgcgacagaggcttcacaag

SEQ ID NO: 718734 - DNA, 25 bp, Mus musculus
ggtcctgcgccacctgattgtccag

SEQ ID NO: 718735 - DNA, 25 bp, Mus musculus
ggtcctgcgccagctgattgtccag

SEQ ID NO: 718736 - DNA, 25 bp, Mus musculus
ggtcctgctattagcatctgcaaga

SEQ ID NO: 718737 - DNA, 25 bp, Mus musculus
ggtcctgctatttgcatctgcaaga

SEQ ID NO: 718738 - DNA, 25 bp, Mus musculus
ggtcctgctttgcaatttgtgcaga

SEQ ID NO: 718739 - DNA, 25 bp, Mus musculus
ggtcctgctttggaatttgtgcaga

SEQ ID NO: 718740 - DNA, 25 bp, Mus musculus
ggtcctggacctactacttcatctg

SEQ ID NO: 718741 - DNA, 25 bp, Mus musculus
ggtcctggacctatcctacctgctt

SEQ ID NO: 718742 - DNA, 25 bp, Mus musculus
ggtcctggacctcagagataaggca

SEQ ID NO: 718743 - DNA, 25 bp, Mus musculus
ggtcctggacctgagagataaggca

SEQ ID NO: 718744 - DNA, 25 bp, Mus musculus
ggtcctggaccttctacttcatctg

SEQ ID NO: 718745 - DNA, 25 bp, Mus musculus
ggtcctggacctttcctacctgctt

SEQ ID NO: 718746 - DNA, 25 bp, Mus musculus
ggtcctggatccctgagcgctttgc

SEQ ID NO: 718747 - DNA, 25 bp, Mus musculus
ggtcctggatccgtgagcgctttgc

SEQ ID NO: 718748 - DNA, 25 bp, Mus musculus
ggtcctggcaacagacacggcgtcc

SEQ ID NO: 718749 - DNA, 25 bp, Mus musculus
ggtcctggcaactgacacggcgtcc

SEQ ID NO: 718750 - DNA, 25 bp, Mus musculus
ggtcctggcaccaagaaggttcatg

SEQ ID NO: 718751 - DNA, 25 bp, Mus musculus
ggtcctggcacctagaaggttcatg

SEQ ID NO: 718752 - DNA, 25 bp, Mus musculus
ggtcctggtgaaagctatcatcaac

SEQ ID NO: 718753 - DNA, 25 bp, Mus musculus
ggtcctggtgaatgctatcatcaac

SEQ ID NO: 718754 - DNA, 25 bp, Mus musculus
ggtcctgtaacaatggctaccttga

SEQ ID NO: 718755 - DNA, 25 bp, Mus musculus
ggtcctgtaacattggctaccttga

SEQ ID NO: 718756 - DNA, 25 bp, Mus musculus
ggtcctgtacaactattggttcctt

SEQ ID NO: 718757 - DNA, 25 bp, Mus musculus
ggtcctgtacaagtattggttcctt

SEQ ID NO: 718758 - DNA, 25 bp, Mus musculus
ggtcctgtataacacagaactgagc

SEQ ID NO: 718759 - DNA, 25 bp, Mus musculus
ggtcctgtataagacagaactgagc

SEQ ID NO: 718760 - DNA, 25 bp, Mus musculus
ggtcctgtatatcaaggaaaagatt

SEQ ID NO: 718761 - DNA, 25 bp, Mus musculus
ggtcctgtatatgaaggaaaagatt

SEQ ID NO: 718762 - DNA, 25 bp, Mus musculus
ggtcctgtcaaaataccccagacaa

SEQ ID NO: 718763 - DNA, 25 bp, Mus musculus
ggtcctgtcaaattaccccagacaa

SEQ ID NO: 718764 - DNA, 25 bp, Mus musculus
ggtcctgtcagaagtggactttgaa

SEQ ID NO: 718765 - DNA, 25 bp, Mus musculus
ggtcctgtcagatgtggactttgaa

SEQ ID NO: 718766 - DNA, 25 bp, Mus musculus
ggtcctgtccctactcggatgatca

SEQ ID NO: 718767 - DNA, 25 bp, Mus musculus
ggtcctgtcccttctcggatgatca

SEQ ID NO: 718768 - DNA, 25 bp, Mus musculus
ggtcctgtcctcactgaagcactta

SEQ ID NO: 718769 - DNA, 25 bp, Mus musculus
ggtcctgtcctctctgaagcactta

SEQ ID NO: 718770 - DNA, 25 bp, Mus musculus
ggtccttaccttcttcctggcgctg

SEQ ID NO: 718771 - DNA, 25 bp, Mus musculus
ggtccttaccttgttcctggcgctg

SEQ ID NO: 718772 - DNA, 25 bp, Mus musculus
ggtccttatgtgaggccatcttctc

SEQ ID NO: 718773 - DNA, 25 bp, Mus musculus
ggtccttatgtgtggccatcttctc

SEQ ID NO: 718774 - DNA, 25 bp, Mus musculus
ggtccttcaggtatgcttggatgcc

SEQ ID NO: 718775 - DNA, 25 bp, Mus musculus
ggtccttcaggtttgcttggatgcc

SEQ ID NO: 718776 - DNA, 25 bp, Mus musculus
ggtccttcctgaccccttgcttgtg

SEQ ID NO: 718777 - DNA, 25 bp, Mus musculus
ggtccttcctgagcccttgcttgtg

SEQ ID NO: 718778 - DNA, 25 bp, Mus musculus
ggtccttcgctaacaactctggctt

SEQ ID NO: 718779 - DNA, 25 bp, Mus musculus
ggtccttcgctatcaactctggctt

SEQ ID NO: 718780 - DNA, 25 bp, Mus musculus
ggtccttctcgaacggaaactggtg

SEQ ID NO: 718781 - DNA, 25 bp, Mus musculus
ggtccttctcgatcggaaactggtg

SEQ ID NO: 718782 - DNA, 25 bp, Mus musculus
ggtccttctgggacacctcggccga

SEQ ID NO: 718783 - DNA, 25 bp, Mus musculus
ggtccttctgggtcacctcggccga

SEQ ID NO: 718784 - DNA, 25 bp, Mus musculus
ggtccttctgtccatcgcccagtgg

SEQ ID NO: 718785 - DNA, 25 bp, Mus musculus
ggtccttctgtcgatcgcccagtgg

SEQ ID NO: 718786 - DNA, 25 bp, Mus musculus
ggtccttctgttcctcaccctgcat

SEQ ID NO: 718787 - DNA, 25 bp, Mus musculus
ggtccttctgttgctcaccctgcat

SEQ ID NO: 718788 - DNA, 25 bp, Mus musculus
ggtccttgcccaaatattcgccgga

SEQ ID NO: 718789 - DNA, 25 bp, Mus musculus
ggtccttgcccatatattcgccgga

SEQ ID NO: 718790 - DNA, 25 bp, Mus musculus
ggtccttggcagcacgtagttctca

SEQ ID NO: 718791 - DNA, 25 bp, Mus musculus
ggtccttggcaggacgtagttctca

SEQ ID NO: 718792 - DNA, 25 bp, Mus musculus
ggtcctttacagagatgccaactga

SEQ ID NO: 718793 - DNA, 25 bp, Mus musculus
ggtcctttacagtgatgccaactga

SEQ ID NO: 718794 - DNA, 25 bp, Mus musculus
ggtcctttacctacaggccgcgaga

SEQ ID NO: 718795 - DNA, 25 bp, Mus musculus
ggtcctttaccttcaggccgcgaga

SEQ ID NO: 718796 - DNA, 25 bp, Mus musculus
ggtcctttcagtatccagccatgca

SEQ ID NO: 718797 - DNA, 25 bp, Mus musculus
ggtcctttcagtttccagccatgca

SEQ ID NO: 718798 - DNA, 25 bp, Mus musculus
ggtcctttgcctcattcgcccagga

SEQ ID NO: 718799 - DNA, 25 bp, Mus musculus
ggtcctttgcctgattcgcccagga

SEQ ID NO: 718800 - DNA, 25 bp, Mus musculus
ggtcgaaattggcatccagcccagc

SEQ ID NO: 718801 - DNA, 25 bp, Mus musculus
ggtcgaaattgggatccagcccagc

SEQ ID NO: 718802 - DNA, 25 bp, Mus musculus
ggtcgaacgagaacgcaagaagctg

SEQ ID NO: 718803 - DNA, 25 bp, Mus musculus
ggtcgaacgagatcgcaagaagctg

SEQ ID NO: 718804 - DNA, 25 bp, Mus musculus
ggtcgaatccaaacataagtccgat

SEQ ID NO: 718805 - DNA, 25 bp, Mus musculus
ggtcgaatccaatcataagtccgat

SEQ ID NO: 718806 - DNA, 25 bp, Mus musculus
ggtcgaattacacacgcaagactgg

SEQ ID NO: 718807 - DNA, 25 bp, Mus musculus
ggtcgaattacagacgcaagactgg

SEQ ID NO: 718808 - DNA, 25 bp, Mus musculus
ggtcgacaaatcagaaccaattggg

SEQ ID NO: 718809 - DNA, 25 bp, Mus musculus
ggtcgacaaatctgaaccaattggg

SEQ ID NO: 718810 - DNA, 25 bp, Mus musculus
ggtcgacatgatatacttctggaag

SEQ ID NO: 718811 - DNA, 25 bp, Mus musculus
ggtcgacatgatttacttctggaag

SEQ ID NO: 718812 - DNA, 25 bp, Mus musculus
ggtcgacatgttaaaacgggtcagc

SEQ ID NO: 718813 - DNA, 25 bp, Mus musculus
ggtcgacatgtttaaacgggtcagc

SEQ ID NO: 718814 - DNA, 25 bp, Mus musculus
ggtcgacctcctccgctacatgttt

SEQ ID NO: 718815 - DNA, 25 bp, Mus musculus
ggtcgacctcctgcgctacatgttt

SEQ ID NO: 718816 - DNA, 25 bp, Mus musculus
ggtcgacctggtaccccaggacctg

SEQ ID NO: 718817 - DNA, 25 bp, Mus musculus
ggtcgacctggttccccaggacctg

SEQ ID NO: 718818 - DNA, 25 bp, Mus musculus
ggtcgacgagaacactccatggaca

SEQ ID NO: 718819 - DNA, 25 bp, Mus musculus
ggtcgacgagaagactccatggaca

SEQ ID NO: 718820 - DNA, 25 bp, Mus musculus
ggtcgacgtttgctctaccggaaca

SEQ ID NO: 718821 - DNA, 25 bp, Mus musculus
ggtcgacgtttggtctaccggaaca

SEQ ID NO: 718822 - DNA, 25 bp, Mus musculus
ggtcgactcattacgccacctttct

SEQ ID NO: 718823 - DNA, 25 bp, Mus musculus
ggtcgactcatttcgccacctttct

SEQ ID NO: 718824 - DNA, 25 bp, Mus musculus
ggtcgagctccccattgtagacagc

SEQ ID NO: 718825 - DNA, 25 bp, Mus musculus
ggtcgagctcccgattgtagacagc

SEQ ID NO: 718826 - DNA, 25 bp, Mus musculus
ggtcgaggcctcagtctacttttac

SEQ ID NO: 718827 - DNA, 25 bp, Mus musculus
ggtcgaggcctctgtctacttttac

SEQ ID NO: 718828 - DNA, 25 bp, Mus musculus
ggtcgaggctccatggctgtcccct

SEQ ID NO: 718829 - DNA, 25 bp, Mus musculus
ggtcgaggctccttggctgtcccct

SEQ ID NO: 718830 - DNA, 25 bp, Mus musculus
ggtcgagtactccacagtaactaca

SEQ ID NO: 718831 - DNA, 25 bp, Mus musculus
ggtcgagtactcgacagtaactaca

SEQ ID NO: 718832 - DNA, 25 bp, Mus musculus
ggtcgagttctgctcaatgatgccc

SEQ ID NO: 718833 - DNA, 25 bp, Mus musculus
ggtcgagttctggtcaatgatgccc

SEQ ID NO: 718834 - DNA, 25 bp, Mus musculus
ggtcgcaaggaaaaagagtccctgc

SEQ ID NO: 718835 - DNA, 25 bp, Mus musculus
ggtcgcaaggaataagagtccctgc

SEQ ID NO: 718836 - DNA, 25 bp, Mus musculus
ggtcgcacgcagctcctatgaggtc

SEQ ID NO: 718837 - DNA, 25 bp, Mus musculus
ggtcgcacgcaggtcctatgaggtc

SEQ ID NO: 718838 - DNA, 25 bp, Mus musculus
ggtcgcactgagacatctcattcat

SEQ ID NO: 718839 - DNA, 25 bp, Mus musculus
ggtcgcactgagtcatctcattcat

SEQ ID NO: 718840 - DNA, 25 bp, Mus musculus
ggtcgccaagtacttcctgcggcag

SEQ ID NO: 718841 - DNA, 25 bp, Mus musculus
ggtcgccaagtagttcctgcggcag

SEQ ID NO: 718842 - DNA, 25 bp, Mus musculus
ggtcgccatcaacgccatcaatgaa

SEQ ID NO: 718843 - DNA, 25 bp, Mus musculus
ggtcgccatcaaggccatcaatgaa

SEQ ID NO: 718844 - DNA, 25 bp, Mus musculus
ggtcgccctggcaatagagtgagtt

SEQ ID NO: 718845 - DNA, 25 bp, Mus musculus
ggtcgccctggctatagagtgagtt

SEQ ID NO: 718846 - DNA, 25 bp, Mus musculus
ggtcgccggcatcttcttccacgaa

SEQ ID NO: 718847 - DNA, 25 bp, Mus musculus
ggtcgccggcatgttcttccacgaa

SEQ ID NO: 718848 - DNA, 25 bp, Mus musculus
ggtcgcctctccagggcagtgacat

SEQ ID NO: 718849 - DNA, 25 bp, Mus musculus
ggtcgcctctcctgggcagtgacat

SEQ ID NO: 718850 - DNA, 25 bp, Mus musculus
ggtcgcctgacgcaactccggacat

SEQ ID NO: 718851 - DNA, 25 bp, Mus musculus
ggtcgcctgacggaactccggacat

SEQ ID NO: 718852 - DNA, 25 bp, Mus musculus
ggtcgcctgactcccatcgagtggt

SEQ ID NO: 718853 - DNA, 25 bp, Mus musculus
ggtcgcctgactgccatcgagtggt

SEQ ID NO: 718854 - DNA, 25 bp, Mus musculus
ggtcgcctgcctatctcatagccgt

SEQ ID NO: 718855 - DNA, 25 bp, Mus musculus
ggtcgcctgcctttctcatagccgt

SEQ ID NO: 718856 - DNA, 25 bp, Mus musculus
ggtcgcctgcgaatcacttcaaaag

SEQ ID NO: 718857 - DNA, 25 bp, Mus musculus
ggtcgcctgcgattcacttcaaaag

SEQ ID NO: 718858 - DNA, 25 bp, Mus musculus
ggtcgcctgttccaggaactagaca

SEQ ID NO: 718859 - DNA, 25 bp, Mus musculus
ggtcgcctgttcgaggaactagaca

SEQ ID NO: 718860 - DNA, 25 bp, Mus musculus
ggtcgccttgtgcaaacgcaaagac

SEQ ID NO: 718861 - DNA, 25 bp, Mus musculus
ggtcgccttgtggaaacgcaaagac

SEQ ID NO: 718862 - DNA, 25 bp, Mus musculus
ggtcgcgacctacacccgggaagat

SEQ ID NO: 718863 - DNA, 25 bp, Mus musculus
ggtcgcgacctagacccgggaagat

SEQ ID NO: 718864 - DNA, 25 bp, Mus musculus
ggtcgcgcccgaagtgtaacacttt

SEQ ID NO: 718865 - DNA, 25 bp, Mus musculus
ggtcgcgcccgatgtgtaacacttt

SEQ ID NO: 718866 - DNA, 25 bp, Mus musculus
ggtcgcggccccacaggatggatcc

SEQ ID NO: 718867 - DNA, 25 bp, Mus musculus
ggtcgcggcccctcaggatggatcc

SEQ ID NO: 718868 - DNA, 25 bp, Mus musculus
ggtcgcggtgtcacccagcagcatg

SEQ ID NO: 718869 - DNA, 25 bp, Mus musculus
ggtcgcggtgtctcccagcagcatg

SEQ ID NO: 718870 - DNA, 25 bp, Mus musculus
ggtcgctcaggaatgaaagactggt

SEQ ID NO: 718871 - DNA, 25 bp, Mus musculus
ggtcgctcaggattgaaagactggt

SEQ ID NO: 718872 - DNA, 25 bp, Mus musculus
ggtcgctgagcaaacctcggtcata

SEQ ID NO: 718873 - DNA, 25 bp, Mus musculus
ggtcgctgagcatacctcggtcata

SEQ ID NO: 718874 - DNA, 25 bp, Mus musculus
ggtcgctggtcaccccaatctttgg

SEQ ID NO: 718875 - DNA, 25 bp, Mus musculus
ggtcgctggtcagcccaatctttgg

SEQ ID NO: 718876 - DNA, 25 bp, Mus musculus
ggtcgcttcctgagccgctgctggc

SEQ ID NO: 718877 - DNA, 25 bp, Mus musculus
ggtcgcttcctgtgccgctgctggc

SEQ ID NO: 718878 - DNA, 25 bp, Mus musculus
ggtcgctttgatcccttccagttgt

SEQ ID NO: 718879 - DNA, 25 bp, Mus musculus
ggtcgctttgatgccttccagttgt

SEQ ID NO: 718880 - DNA, 25 bp, Mus musculus
ggtcgcttttatcgaccacatacgg

SEQ ID NO: 718881 - DNA, 25 bp, Mus musculus
ggtcgcttttatggaccacatacgg

SEQ ID NO: 718882 - DNA, 25 bp, Mus musculus
ggtcggaaacgcacacctgcggctc

SEQ ID NO: 718883 - DNA, 25 bp, Mus musculus
ggtcggaaacgctcacctgcggctc

SEQ ID NO: 718884 - DNA, 25 bp, Mus musculus
ggtcggaagccaacaccagtggtct

SEQ ID NO: 718885 - DNA, 25 bp, Mus musculus
ggtcggaagccatcaccagtggtct

SEQ ID NO: 718886 - DNA, 25 bp, Mus musculus
ggtcggaagccgaaggccaactgat

SEQ ID NO: 718887 - DNA, 25 bp, Mus musculus
ggtcggaagccgtaggccaactgat

SEQ ID NO: 718888 - DNA, 25 bp, Mus musculus
ggtcggactgtgcttctgactttag

SEQ ID NO: 718889 - DNA, 25 bp, Mus musculus
ggtcggactgtggttctgactttag

SEQ ID NO: 718890 - DNA, 25 bp, Mus musculus
ggtcggagccagaacccttaaggag

SEQ ID NO: 718891 - DNA, 25 bp, Mus musculus
ggtcggagccagtacccttaaggag

SEQ ID NO: 718892 - DNA, 25 bp, Mus musculus
ggtcggataaaacagatccactgtg

SEQ ID NO: 718893 - DNA, 25 bp, Mus musculus
ggtcggataaaagagatccactgtg

SEQ ID NO: 718894 - DNA, 25 bp, Mus musculus
ggtcggccagtgctagccaacatcg

SEQ ID NO: 718895 - DNA, 25 bp, Mus musculus
ggtcggccagtggtagccaacatcg

SEQ ID NO: 718896 - DNA, 25 bp, Mus musculus
ggtcggcggtccactcaacctgttc

SEQ ID NO: 718897 - DNA, 25 bp, Mus musculus
ggtcggcggtcctctcaacctgttc

SEQ ID NO: 718898 - DNA, 25 bp, Mus musculus
ggtcggctgtttatctggagagtta

SEQ ID NO: 718899 - DNA, 25 bp, Mus musculus
ggtcggctgtttttctggagagtta

SEQ ID NO: 718900 - DNA, 25 bp, Mus musculus
ggtcggcttccaacgtcgcgcctgt

SEQ ID NO: 718901 - DNA, 25 bp, Mus musculus
ggtcggcttccatcgtcgcgcctgt

SEQ ID NO: 718902 - DNA, 25 bp, Mus musculus
ggtcgggaaatcagcctctgggaac

SEQ ID NO: 718903 - DNA, 25 bp, Mus musculus
ggtcgggaaatctgcctctgggaac

SEQ ID NO: 718904 - DNA, 25 bp, Mus musculus
ggtcggtcgggtaagaacagctcca

SEQ ID NO: 718905 - DNA, 25 bp, Mus musculus
ggtcggtcgggttagaacagctcca

SEQ ID NO: 718906 - DNA, 25 bp, Mus musculus
ggtcggtggaggcactctcccttca

SEQ ID NO: 718907 - DNA, 25 bp, Mus musculus
ggtcggtggagggactctcccttca

SEQ ID NO: 718908 - DNA, 25 bp, Mus musculus
ggtcggttccttctgcgtcgtctcc

SEQ ID NO: 718909 - DNA, 25 bp, Mus musculus
ggtcggttccttgtgcgtcgtctcc

SEQ ID NO: 718910 - DNA, 25 bp, Mus musculus
ggtcgtaaacaacttcatcaagcaa

SEQ ID NO: 718911 - DNA, 25 bp, Mus musculus
ggtcgtaaacaagttcatcaagcaa

SEQ ID NO: 718912 - DNA, 25 bp, Mus musculus
ggtcgtattggcctatcttctctga

SEQ ID NO: 718913 - DNA, 25 bp, Mus musculus
ggtcgtattggcgtatcttctctga

SEQ ID NO: 718914 - DNA, 25 bp, Mus musculus
ggtcgtcagaatagtacacattcct

SEQ ID NO: 718915 - DNA, 25 bp, Mus musculus
ggtcgtcagaattgtacacattcct

SEQ ID NO: 718916 - DNA, 25 bp, Mus musculus
ggtcgtctcgacatcacacgtctgg

SEQ ID NO: 718917 - DNA, 25 bp, Mus musculus
ggtcgtctcgacttcacacgtctgg

SEQ ID NO: 718918 - DNA, 25 bp, Mus musculus
ggtcgtgctgatcctcttcctagtg

SEQ ID NO: 718919 - DNA, 25 bp, Mus musculus
ggtcgtgctgatgctcttcctagtg

SEQ ID NO: 718920 - DNA, 25 bp, Mus musculus
ggtcgtgctgctcacgttccttgca

SEQ ID NO: 718921 - DNA, 25 bp, Mus musculus
ggtcgtgctgctgacgttccttgca

SEQ ID NO: 718922 - DNA, 25 bp, Mus musculus
ggtcgtggcagcactgctctccagc

SEQ ID NO: 718923 - DNA, 25 bp, Mus musculus
ggtcgtggcagctctgctctccagc

SEQ ID NO: 718924 - DNA, 25 bp, Mus musculus
ggtcgtgggcagaacgagtttcata

SEQ ID NO: 718925 - DNA, 25 bp, Mus musculus
ggtcgtgggcagtacgagtttcata

SEQ ID NO: 718926 - DNA, 25 bp, Mus musculus
ggtcgtgtccccaacccaagacctg

SEQ ID NO: 718927 - DNA, 25 bp, Mus musculus
ggtcgtgtcccctacccaagacctg

SEQ ID NO: 718928 - DNA, 25 bp, Mus musculus
ggtcgtgtgagcacctcattatggt

SEQ ID NO: 718929 - DNA, 25 bp, Mus musculus
ggtcgtgtgagctcctcattatggt

SEQ ID NO: 718930 - DNA, 25 bp, Mus musculus
ggtcgttctggcctcgttgaatccg

SEQ ID NO: 718931 - DNA, 25 bp, Mus musculus
ggtcgttctggcgtcgttgaatccg

SEQ ID NO: 718932 - DNA, 25 bp, Mus musculus
ggtctaaaccgaaagccagtgagtg

SEQ ID NO: 718933 - DNA, 25 bp, Mus musculus
ggtctaaaccgatagccagtgagtg

SEQ ID NO: 718934 - DNA, 25 bp, Mus musculus
ggtctaacctctatcgggtctgcta

SEQ ID NO: 718935 - DNA, 25 bp, Mus musculus
ggtctaacctctttcgggtctgcta

SEQ ID NO: 718936 - DNA, 25 bp, Mus musculus
ggtctaatcctgaagatcccgcaga

SEQ ID NO: 718937 - DNA, 25 bp, Mus musculus
ggtctaatcctgtagatcccgcaga

SEQ ID NO: 718938 - DNA, 25 bp, Mus musculus
ggtctaattggcctcctccttctag

SEQ ID NO: 718939 - DNA, 25 bp, Mus musculus
ggtctaattggcgtcctccttctag

SEQ ID NO: 718940 - DNA, 25 bp, Mus musculus
ggtctaccatttcaccttggagaag

SEQ ID NO: 718941 - DNA, 25 bp, Mus musculus
ggtctaccatttgaccttggagaag

SEQ ID NO: 718942 - DNA, 25 bp, Mus musculus
ggtctacctgaacctaggaggcaaa

SEQ ID NO: 718943 - DNA, 25 bp, Mus musculus
ggtctacctgaagctaggaggcaaa

SEQ ID NO: 718944 - DNA, 25 bp, Mus musculus
ggtctacctgcacagacctcaaaag

SEQ ID NO: 718945 - DNA, 25 bp, Mus musculus
ggtctacctgcagagacctcaaaag

SEQ ID NO: 718946 - DNA, 25 bp, Mus musculus
ggtctacgagaacatgaagcaggct

SEQ ID NO: 718947 - DNA, 25 bp, Mus musculus
ggtctacgagaagatgaagcaggct

SEQ ID NO: 718948 - DNA, 25 bp, Mus musculus
ggtctacgctcacctgtgcaacgtg

SEQ ID NO: 718949 - DNA, 25 bp, Mus musculus
ggtctacgctcagctgtgcaacgtg

SEQ ID NO: 718950 - DNA, 25 bp, Mus musculus
ggtctacggagtccaccttgggcca

SEQ ID NO: 718951 - DNA, 25 bp, Mus musculus
ggtctacggagtgcaccttgggcca

SEQ ID NO: 718952 - DNA, 25 bp, Mus musculus
ggtctacgggcactgtctaatcact

SEQ ID NO: 718953 - DNA, 25 bp, Mus musculus
ggtctacgggcagtgtctaatcact

SEQ ID NO: 718954 - DNA, 25 bp, Mus musculus
ggtctactacttcggcccttgtggg

SEQ ID NO: 718955 - DNA, 25 bp, Mus musculus
ggtctactacttgggcccttgtggg

SEQ ID NO: 718956 - DNA, 25 bp, Mus musculus
ggtctactagctctccctaaggctg

SEQ ID NO: 718957 - DNA, 25 bp, Mus musculus
ggtctactagctgtccctaaggctg

SEQ ID NO: 718958 - DNA, 25 bp, Mus musculus
ggtctactttgcagaatactttatc

SEQ ID NO: 718959 - DNA, 25 bp, Mus musculus
ggtctactttgcctactaccatggc

SEQ ID NO: 718960 - DNA, 25 bp, Mus musculus
ggtctactttgcgtactaccatggc

SEQ ID NO: 718961 - DNA, 25 bp, Mus musculus
ggtctactttgctgaatactttatc

SEQ ID NO: 718962 - DNA, 25 bp, Mus musculus
ggtctagctccccaggtggccgatc

SEQ ID NO: 718963 - DNA, 25 bp, Mus musculus
ggtctagctcccgaggtggccgatc

SEQ ID NO: 718964 - DNA, 25 bp, Mus musculus
ggtctagggctccaaaggctgccaa

SEQ ID NO: 718965 - DNA, 25 bp, Mus musculus
ggtctagggctcgaaaggctgccaa

SEQ ID NO: 718966 - DNA, 25 bp, Mus musculus
ggtctagggctgattttcatcttcg

SEQ ID NO: 718967 - DNA, 25 bp, Mus musculus
ggtctagggctgtttttcatcttcg

SEQ ID NO: 718968 - DNA, 25 bp, Mus musculus
ggtctaggtcgccagctgcttcaga

SEQ ID NO: 718969 - DNA, 25 bp, Mus musculus
ggtctaggtcgcgagctgcttcaga

SEQ ID NO: 718970 - DNA, 25 bp, Mus musculus
ggtctaggttacattgctggctcca

SEQ ID NO: 718971 - DNA, 25 bp, Mus musculus
ggtctaggttactttgctggctcca

SEQ ID NO: 718972 - DNA, 25 bp, Mus musculus
ggtctagttgatagtgatggaaaag

SEQ ID NO: 718973 - DNA, 25 bp, Mus musculus
ggtctagttgattgtgatggaaaag

SEQ ID NO: 718974 - DNA, 25 bp, Mus musculus
ggtctataaacgctaccagatggtt

SEQ ID NO: 718975 - DNA, 25 bp, Mus musculus
ggtctataaacggtaccagatggtt

SEQ ID NO: 718976 - DNA, 25 bp, Mus musculus
ggtctataggtccagctccagtaca

SEQ ID NO: 718977 - DNA, 25 bp, Mus musculus
ggtctataggtcgagctccagtaca

SEQ ID NO: 718978 - DNA, 25 bp, Mus musculus
ggtctatcagatctttgacactttc

SEQ ID NO: 718979 - DNA, 25 bp, Mus musculus
ggtctatcagatgtttgacactttc

SEQ ID NO: 718980 - DNA, 25 bp, Mus musculus
ggtctatctgtgcatcctgagaggc

SEQ ID NO: 718981 - DNA, 25 bp, Mus musculus
ggtctatctgtggatcctgagaggc

SEQ ID NO: 718982 - DNA, 25 bp, Mus musculus
ggtctatgacgcatctaacagcgag

SEQ ID NO: 718983 - DNA, 25 bp, Mus musculus
ggtctatgacgcttctaacagcgag

SEQ ID NO: 718984 - DNA, 25 bp, Mus musculus
ggtctatgctttcaagctcaagggt

SEQ ID NO: 718985 - DNA, 25 bp, Mus musculus
ggtctatgctttgaagctcaagggt

SEQ ID NO: 718986 - DNA, 25 bp, Mus musculus
ggtctatgtctccacccctgcttgg

SEQ ID NO: 718987 - DNA, 25 bp, Mus musculus
ggtctatgtctcgacccctgcttgg

SEQ ID NO: 718988 - DNA, 25 bp, Mus musculus
ggtctattaattcgctccaacttcc

SEQ ID NO: 718989 - DNA, 25 bp, Mus musculus
ggtctattaattggctccaacttcc

SEQ ID NO: 718990 - DNA, 25 bp, Mus musculus
ggtctattctcacgactagcccagc

SEQ ID NO: 718991 - DNA, 25 bp, Mus musculus
ggtctattctcaggactagcccagc

SEQ ID NO: 718992 - DNA, 25 bp, Mus musculus
ggtctatttcaccacgtcactgcct

SEQ ID NO: 718993 - DNA, 25 bp, Mus musculus
ggtctatttcacgacgtcactgcct

SEQ ID NO: 718994 - DNA, 25 bp, Mus musculus
ggtctcaagcgccatcatactggat

SEQ ID NO: 718995 - DNA, 25 bp, Mus musculus
ggtctcaagcgcgatcatactggat

SEQ ID NO: 718996 - DNA, 25 bp, Mus musculus
ggtctcaaggccaggctagtcccgc

SEQ ID NO: 718997 - DNA, 25 bp, Mus musculus
ggtctcaaggcctggctagtcccgc

SEQ ID NO: 718998 - DNA, 25 bp, Mus musculus
ggtctcacggcactgacaatacggg

SEQ ID NO: 718999 - DNA, 25 bp, Mus musculus
ggtctcacggcagtgacaatacggg

SEQ ID NO: 719000 - DNA, 25 bp, Mus musculus
ggtctcactactatattttgcctgg

SEQ ID NO: 719001 - DNA, 25 bp, Mus musculus
ggtctcactactttattttgcctgg

SEQ ID NO: 719002 - DNA, 25 bp, Mus musculus
ggtctcactccaagtcgcttcactg

SEQ ID NO: 719003 - DNA, 25 bp, Mus musculus
ggtctcactccatgtcgcttcactg

SEQ ID NO: 719004 - DNA, 25 bp, Mus musculus
ggtctcagagaccagcagttattgg

SEQ ID NO: 719005 - DNA, 25 bp, Mus musculus
ggtctcagagacgagcagttattgg

SEQ ID NO: 719006 - DNA, 25 bp, Mus musculus
ggtctcagcagtcaagcctccatag

SEQ ID NO: 719007 - DNA, 25 bp, Mus musculus
ggtctcagcagtgaagcctccatag

SEQ ID NO: 719008 - DNA, 25 bp, Mus musculus
ggtctcagccctattcagcaaccag

SEQ ID NO: 719009 - DNA, 25 bp, Mus musculus
ggtctcagcccttttcagcaaccag

SEQ ID NO: 719010 - DNA, 25 bp, Mus musculus
ggtctcagctttcatttcttggccc

SEQ ID NO: 719011 - DNA, 25 bp, Mus musculus
ggtctcagctttgatttcttggccc

SEQ ID NO: 719012 - DNA, 25 bp, Mus musculus
ggtctcaggcccagaaaagcgaccg

SEQ ID NO: 719013 - DNA, 25 bp, Mus musculus
ggtctcaggccctgaaaagcgaccg

SEQ ID NO: 719014 - DNA, 25 bp, Mus musculus
ggtctcatatgtagacctagctggg

SEQ ID NO: 719015 - DNA, 25 bp, Mus musculus
ggtctcatatgttgacctagctggg

SEQ ID NO: 719016 - DNA, 25 bp, Mus musculus
ggtctcatgcaaactgattctcagg

SEQ ID NO: 719017 - DNA, 25 bp, Mus musculus
ggtctcatgcaatctgattctcagg

SEQ ID NO: 719018 - DNA, 25 bp, Mus musculus
ggtctcatgccaattgtcctgtgca

SEQ ID NO: 719019 - DNA, 25 bp, Mus musculus
ggtctcatgccatttgtcctgtgca

SEQ ID NO: 719020 - DNA, 25 bp, Mus musculus
ggtctccacggaccagggctctgca

SEQ ID NO: 719021 - DNA, 25 bp, Mus musculus
ggtctccacggagcagggctctgca

SEQ ID NO: 719022 - DNA, 25 bp, Mus musculus
ggtctccactcaatggctcagcaca

SEQ ID NO: 719023 - DNA, 25 bp, Mus musculus
ggtctccactcattggctcagcaca

SEQ ID NO: 719024 - DNA, 25 bp, Mus musculus
ggtctccaggcaaaccagggaaact

SEQ ID NO: 719025 - DNA, 25 bp, Mus musculus
ggtctccaggcataccagggaaact

SEQ ID NO: 719026 - DNA, 25 bp, Mus musculus
ggtctccagggcaagacactgccaa

SEQ ID NO: 719027 - DNA, 25 bp, Mus musculus
ggtctccagggctagacactgccaa

SEQ ID NO: 719028 - DNA, 25 bp, Mus musculus
ggtctccagtctacagtgccatgtt

SEQ ID NO: 719029 - DNA, 25 bp, Mus musculus
ggtctccagtcttcagtgccatgtt

SEQ ID NO: 719030 - DNA, 25 bp, Mus musculus
ggtctccatgcacgcatcaagcaga

SEQ ID NO: 719031 - DNA, 25 bp, Mus musculus
ggtctccatgcaggcatcaagcaga

SEQ ID NO: 719032 - DNA, 25 bp, Mus musculus
ggtctcccataaagccctgctggtg

SEQ ID NO: 719033 - DNA, 25 bp, Mus musculus
ggtctcccataatgccctgctggtg

SEQ ID NO: 719034 - DNA, 25 bp, Mus musculus
ggtctccctaggcactgctgtggct

SEQ ID NO: 719035 - DNA, 25 bp, Mus musculus
ggtctccctagggactgctgtggct

SEQ ID NO: 719036 - DNA, 25 bp, Mus musculus
ggtctccctgatccaccatgttagg

SEQ ID NO: 719037 - DNA, 25 bp, Mus musculus
ggtctccctgatgcaccatgttagg

SEQ ID NO: 719038 - DNA, 25 bp, Mus musculus
ggtctccggtccatgctgcagcgtg

SEQ ID NO: 719039 - DNA, 25 bp, Mus musculus
ggtctccggtccttgctgcagcgtg

SEQ ID NO: 719040 - DNA, 25 bp, Mus musculus
ggtctccggtgactcctagtcctta

SEQ ID NO: 719041 - DNA, 25 bp, Mus musculus
ggtctccggtgagtcctagtcctta

SEQ ID NO: 719042 - DNA, 25 bp, Mus musculus
ggtctcctatgcctgaacattatgt

SEQ ID NO: 719043 - DNA, 25 bp, Mus musculus
ggtctcctatgcgtgaacattatgt

SEQ ID NO: 719044 - DNA, 25 bp, Mus musculus
ggtctcctctctccatgaggcatgc

SEQ ID NO: 719045 - DNA, 25 bp, Mus musculus
ggtctcctctctgcatgaggcatgc

SEQ ID NO: 719046 - DNA, 25 bp, Mus musculus
ggtctcctgacgagctggcgtcctc

SEQ ID NO: 719047 - DNA, 25 bp, Mus musculus
ggtctcctgacgtgctggcgtcctc

SEQ ID NO: 719048 - DNA, 25 bp, Mus musculus
ggtctccttggtagtcagtcctccg

SEQ ID NO: 719049 - DNA, 25 bp, Mus musculus
ggtctccttggttgtcagtcctccg

SEQ ID NO: 719050 - DNA, 25 bp, Mus musculus
ggtctcgctggcagagttacagact

SEQ ID NO: 719051 - DNA, 25 bp, Mus musculus
ggtctcgctggctgagttacagact

SEQ ID NO: 719052 - DNA, 25 bp, Mus musculus
ggtctcggagctccagactactcaa

SEQ ID NO: 719053 - DNA, 25 bp, Mus musculus
ggtctcggagctgcagactactcaa

SEQ ID NO: 719054 - DNA, 25 bp, Mus musculus
ggtctcggcttcaggagaagaattc

SEQ ID NO: 719055 - DNA, 25 bp, Mus musculus
ggtctcggcttctggagaagaattc

SEQ ID NO: 719056 - DNA, 25 bp, Mus musculus
ggtctcgttcagagctgttctgtcg

SEQ ID NO: 719057 - DNA, 25 bp, Mus musculus
ggtctcgttcagtgctgttctgtcg

SEQ ID NO: 719058 - DNA, 25 bp, Mus musculus
ggtctctaccacacctctgttagca

SEQ ID NO: 719059 - DNA, 25 bp, Mus musculus
ggtctctaccactcctctgttagca

SEQ ID NO: 719060 - DNA, 25 bp, Mus musculus
ggtctctacggcagtgtgatcgtag

SEQ ID NO: 719061 - DNA, 25 bp, Mus musculus
ggtctctacggctgtgtgatcgtag

SEQ ID NO: 719062 - DNA, 25 bp, Mus musculus
ggtctctcagacatgcataatgaag

SEQ ID NO: 719063 - DNA, 25 bp, Mus musculus
ggtctctcagacttgcataatgaag

SEQ ID NO: 719064 - DNA, 25 bp, Mus musculus
ggtctctccacaagctgctgtgcac

SEQ ID NO: 719065 - DNA, 25 bp, Mus musculus
ggtctctccacatgctgctgtgcac

SEQ ID NO: 719066 - DNA, 25 bp, Mus musculus
ggtctctccggacgacattactatg

SEQ ID NO: 719067 - DNA, 25 bp, Mus musculus
ggtctctccggaggacattactatg

SEQ ID NO: 719068 - DNA, 25 bp, Mus musculus
ggtctctgcggtcacaggacattca

SEQ ID NO: 719069 - DNA, 25 bp, Mus musculus
ggtctctgcggtgacaggacattca

SEQ ID NO: 719070 - DNA, 25 bp, Mus musculus
ggtctctgctgcatcatgatatttc

SEQ ID NO: 719071 - DNA, 25 bp, Mus musculus
ggtctctgctgcttcatgatatttc

SEQ ID NO: 719072 - DNA, 25 bp, Mus musculus
ggtctctgtcagaatcccactcaca

SEQ ID NO: 719073 - DNA, 25 bp, Mus musculus
ggtctctgtcagtatcccactcaca

SEQ ID NO: 719074 - DNA, 25 bp, Mus musculus
ggtctctgtcccatttgtccaaatt

SEQ ID NO: 719075 - DNA, 25 bp, Mus musculus
ggtctctgtcccttttgtccaaatt

SEQ ID NO: 719076 - DNA, 25 bp, Mus musculus
ggtctctgtgtcagcagccaccctg

SEQ ID NO: 719077 - DNA, 25 bp, Mus musculus
ggtctctgtgtctgcagccaccctg

SEQ ID NO: 719078 - DNA, 25 bp, Mus musculus
ggtctcttagggatgtctgggtact

SEQ ID NO: 719079 - DNA, 25 bp, Mus musculus
ggtctcttagggttgtctgggtact

SEQ ID NO: 719080 - DNA, 25 bp, Mus musculus
ggtctcttcccacccagtagtggct

SEQ ID NO: 719081 - DNA, 25 bp, Mus musculus
ggtctcttcccagccagtagtggct

SEQ ID NO: 719082 - DNA, 25 bp, Mus musculus
ggtctcttcgacaaatacctgggag

SEQ ID NO: 719083 - DNA, 25 bp, Mus musculus
ggtctcttcgactaatacctgggag

SEQ ID NO: 719084 - DNA, 25 bp, Mus musculus
ggtctcttctgcacactcacgggtg

SEQ ID NO: 719085 - DNA, 25 bp, Mus musculus
ggtctcttctgctcactcacgggtg

SEQ ID NO: 719086 - DNA, 25 bp, Mus musculus
ggtctcttgtctctttaaccctgag

SEQ ID NO: 719087 - DNA, 25 bp, Mus musculus
ggtctcttgtctgtttaaccctgag

SEQ ID NO: 719088 - DNA, 25 bp, Mus musculus
ggtctcttgtggaacatcatccctc

SEQ ID NO: 719089 - DNA, 25 bp, Mus musculus
ggtctcttgtggtacatcatccctc

SEQ ID NO: 719090 - DNA, 25 bp, Mus musculus
ggtctgaaatctcgttgacgcagtc

SEQ ID NO: 719091 - DNA, 25 bp, Mus musculus
ggtctgaaatctggttgacgcagtc

SEQ ID NO: 719092 - DNA, 25 bp, Mus musculus
ggtctgaaccaaccttccagtgact

SEQ ID NO: 719093 - DNA, 25 bp, Mus musculus
ggtctgaaccaagcttccagtgact

SEQ ID NO: 719094 - DNA, 25 bp, Mus musculus
ggtctgaaccttcctgggccccact

SEQ ID NO: 719095 - DNA, 25 bp, Mus musculus
ggtctgaaccttgctgggccccact

SEQ ID NO: 719096 - DNA, 25 bp, Mus musculus
ggtctgacatggctcacctgatgac

SEQ ID NO: 719097 - DNA, 25 bp, Mus musculus
ggtctgacatgggtcacctgatgac

SEQ ID NO: 719098 - DNA, 25 bp, Mus musculus
ggtctgaccagcaataaagactcat

SEQ ID NO: 719099 - DNA, 25 bp, Mus musculus
ggtctgaccagctataaagactcat

SEQ ID NO: 719100 - DNA, 25 bp, Mus musculus
ggtctgacgacgacatcactggctg

SEQ ID NO: 719101 - DNA, 25 bp, Mus musculus
ggtctgacgacgtcatcactggctg

SEQ ID NO: 719102 - DNA, 25 bp, Mus musculus
ggtctgagcaaactcagcccctcta

SEQ ID NO: 719103 - DNA, 25 bp, Mus musculus
ggtctgagcaaagtcagcccctcta

SEQ ID NO: 719104 - DNA, 25 bp, Mus musculus
ggtctgagcctcatgaactttctgg

SEQ ID NO: 719105 - DNA, 25 bp, Mus musculus
ggtctgagcctcttgaactttctgg

SEQ ID NO: 719106 - DNA, 25 bp, Mus musculus
ggtctgatccaacaaatctacagag

SEQ ID NO: 719107 - DNA, 25 bp, Mus musculus
ggtctgatccaagaaatctacagag

SEQ ID NO: 719108 - DNA, 25 bp, Mus musculus
ggtctgatccgacatttcaggccag

SEQ ID NO: 719109 - DNA, 25 bp, Mus musculus
ggtctgatccgagatttcaggccag

SEQ ID NO: 719110 - DNA, 25 bp, Mus musculus
ggtctgattcagctggtcttcccca

SEQ ID NO: 719111 - DNA, 25 bp, Mus musculus
ggtctgattcaggtggtcttcccca

SEQ ID NO: 719112 - DNA, 25 bp, Mus musculus
ggtctgatttcgcattctgtcccca

SEQ ID NO: 719113 - DNA, 25 bp, Mus musculus
ggtctgatttcggattctgtcccca

SEQ ID NO: 719114 - DNA, 25 bp, Mus musculus
ggtctgcaccgtcgcttccaactgt

SEQ ID NO: 719115 - DNA, 25 bp, Mus musculus
ggtctgcaccgtggcttccaactgt

SEQ ID NO: 719116 - DNA, 25 bp, Mus musculus
ggtctgcatagtagcatctttccca

SEQ ID NO: 719117 - DNA, 25 bp, Mus musculus
ggtctgcatagttgcatctttccca

SEQ ID NO: 719118 - DNA, 25 bp, Mus musculus
ggtctgccaccgagctggtacaagg

SEQ ID NO: 719119 - DNA, 25 bp, Mus musculus
ggtctgccaccgtgctggtacaagg

SEQ ID NO: 719120 - DNA, 25 bp, Mus musculus
ggtctgccacgaccagcagagactg

SEQ ID NO: 719121 - DNA, 25 bp, Mus musculus
ggtctgccacgagcagcagagactg

SEQ ID NO: 719122 - DNA, 25 bp, Mus musculus
ggtctgccatcccaatgaagatccg

SEQ ID NO: 719123 - DNA, 25 bp, Mus musculus
ggtctgccatccgaatgaagatccg

SEQ ID NO: 719124 - DNA, 25 bp, Mus musculus
ggtctgccgcacaccgcagcatggg

SEQ ID NO: 719125 - DNA, 25 bp, Mus musculus
ggtctgccgcactccgcagcatggg

SEQ ID NO: 719126 - DNA, 25 bp, Mus musculus
ggtctgcctattcgcttctccttgc

SEQ ID NO: 719127 - DNA, 25 bp, Mus musculus
ggtctgcctattggcttctccttgc

SEQ ID NO: 719128 - DNA, 25 bp, Mus musculus
ggtctgcgagctataccgacgggaa

SEQ ID NO: 719129 - DNA, 25 bp, Mus musculus
ggtctgcgagctttaccgacgggaa

SEQ ID NO: 719130 - DNA, 25 bp, Mus musculus
ggtctgcgctaaacaactcaacgag

SEQ ID NO: 719131 - DNA, 25 bp, Mus musculus
ggtctgcgctaatcaactcaacgag

SEQ ID NO: 719132 - DNA, 25 bp, Mus musculus
ggtctgcgtcctaggatgtactgag

SEQ ID NO: 719133 - DNA, 25 bp, Mus musculus
ggtctgcgtccttggatgtactgag

SEQ ID NO: 719134 - DNA, 25 bp, Mus musculus
ggtctgctaaatatatacgctgtgc

SEQ ID NO: 719135 - DNA, 25 bp, Mus musculus
ggtctgctaaatttatacgctgtgc

SEQ ID NO: 719136 - DNA, 25 bp, Mus musculus
ggtctgctcatcaacgtcctctaca

SEQ ID NO: 719137 - DNA, 25 bp, Mus musculus
ggtctgctcatctacgtcctctaca

SEQ ID NO: 719138 - DNA, 25 bp, Mus musculus
ggtctgctcgacatcaaataccggg

SEQ ID NO: 719139 - DNA, 25 bp, Mus musculus
ggtctgctcgacttcaaataccggg

SEQ ID NO: 719140 - DNA, 25 bp, Mus musculus
ggtctgctgagcatgatggctccgc

SEQ ID NO: 719141 - DNA, 25 bp, Mus musculus
ggtctgctgagcttgatggctccgc

SEQ ID NO: 719142 - DNA, 25 bp, Mus musculus
ggtctgctgcccctaagtaattatg

SEQ ID NO: 719143 - DNA, 25 bp, Mus musculus
ggtctgctgcccgtaagtaattatg

SEQ ID NO: 719144 - DNA, 25 bp, Mus musculus
ggtctgcttggaacagtcattgaag

SEQ ID NO: 719145 - DNA, 25 bp, Mus musculus
ggtctgcttggatcagtcattgaag

SEQ ID NO: 719146 - DNA, 25 bp, Mus musculus
ggtctggaagtgatctcaatcacag

SEQ ID NO: 719147 - DNA, 25 bp, Mus musculus
ggtctggaagtgttctcaatcacag

SEQ ID NO: 719148 - DNA, 25 bp, Mus musculus
ggtctggaccacatcgctgagaaca

SEQ ID NO: 719149 - DNA, 25 bp, Mus musculus
ggtctggaccacttcgctgagaaca

SEQ ID NO: 719150 - DNA, 25 bp, Mus musculus
ggtctggacccaaacgctgtccaca

SEQ ID NO: 719151 - DNA, 25 bp, Mus musculus
ggtctggacccatacgctgtccaca

SEQ ID NO: 719152 - DNA, 25 bp, Mus musculus
ggtctggacgctcatgccaccggtc

SEQ ID NO: 719153 - DNA, 25 bp, Mus musculus
ggtctggacgctgatgccaccggtc

SEQ ID NO: 719154 - DNA, 25 bp, Mus musculus
ggtctggagcacacgaacctggaca

SEQ ID NO: 719155 - DNA, 25 bp, Mus musculus
ggtctggagcactcgaacctggaca

SEQ ID NO: 719156 - DNA, 25 bp, Mus musculus
ggtctggaggctcgacagttcatca

SEQ ID NO: 719157 - DNA, 25 bp, Mus musculus
ggtctggaggctggacagttcatca

SEQ ID NO: 719158 - DNA, 25 bp, Mus musculus
ggtctggatgtgagccctctctggt

SEQ ID NO: 719159 - DNA, 25 bp, Mus musculus
ggtctggatgtgtgccctctctggt

SEQ ID NO: 719160 - DNA, 25 bp, Mus musculus
ggtctggcaagcaaaccggcagttc

SEQ ID NO: 719161 - DNA, 25 bp, Mus musculus
ggtctggcaagcagagcagcctgtt

SEQ ID NO: 719162 - DNA, 25 bp, Mus musculus
ggtctggcaagctaaccggcagttc

SEQ ID NO: 719163 - DNA, 25 bp, Mus musculus
ggtctggcaagctgagcagcctgtt

SEQ ID NO: 719164 - DNA, 25 bp, Mus musculus
ggtctggccctcaacttctctgtgt

SEQ ID NO: 719165 - DNA, 25 bp, Mus musculus
ggtctggccctctacttctctgtgt

SEQ ID NO: 719166 - DNA, 25 bp, Mus musculus
ggtctggccggtctcctgacatgaa

SEQ ID NO: 719167 - DNA, 25 bp, Mus musculus
ggtctggccggtgtcctgacatgaa

SEQ ID NO: 719168 - DNA, 25 bp, Mus musculus
ggtctggctgatctacagaatctac

SEQ ID NO: 719169 - DNA, 25 bp, Mus musculus
ggtctggctgatgtacagaatctac

SEQ ID NO: 719170 - DNA, 25 bp, Mus musculus
ggtctggcttcaaatttggaaaatc

SEQ ID NO: 719171 - DNA, 25 bp, Mus musculus
ggtctggcttcatatttggaaaatc

SEQ ID NO: 719172 - DNA, 25 bp, Mus musculus
ggtctgggacccaggcaatgtcaga

SEQ ID NO: 719173 - DNA, 25 bp, Mus musculus
ggtctgggaccctggcaatgtcaga

SEQ ID NO: 719174 - DNA, 25 bp, Mus musculus
ggtctggtggagaaggcccacaccc

SEQ ID NO: 719175 - DNA, 25 bp, Mus musculus
ggtctggtggagtaggcccacaccc

SEQ ID NO: 719176 - DNA, 25 bp, Mus musculus
ggtctggttcagcatcccacgaagg

SEQ ID NO: 719177 - DNA, 25 bp, Mus musculus
ggtctggttcaggatcccacgaagg

SEQ ID NO: 719178 - DNA, 25 bp, Mus musculus
ggtctgtaaaacctcaggcgccgca

SEQ ID NO: 719179 - DNA, 25 bp, Mus musculus
ggtctgtaaaacgtcaggcgccgca

SEQ ID NO: 719180 - DNA, 25 bp, Mus musculus
ggtctgtaaagaatccattggctta

SEQ ID NO: 719181 - DNA, 25 bp, Mus musculus
ggtctgtaaagattccattggctta

SEQ ID NO: 719182 - DNA, 25 bp, Mus musculus
ggtctgtactggagttgttaaccct

SEQ ID NO: 719183 - DNA, 25 bp, Mus musculus
ggtctgtactggtgttgttaaccct

SEQ ID NO: 719184 - DNA, 25 bp, Mus musculus
ggtctgtagcacacttctaaagtga

SEQ ID NO: 719185 - DNA, 25 bp, Mus musculus
ggtctgtagcactcttctaaagtga

SEQ ID NO: 719186 - DNA, 25 bp, Mus musculus
ggtctgtatattcgctcccgggcca

SEQ ID NO: 719187 - DNA, 25 bp, Mus musculus
ggtctgtatattggctcccgggcca

SEQ ID NO: 719188 - DNA, 25 bp, Mus musculus
ggtctgtatgctcggcaaccgtacc

SEQ ID NO: 719189 - DNA, 25 bp, Mus musculus
ggtctgtatgctgggcaaccgtacc

SEQ ID NO: 719190 - DNA, 25 bp, Mus musculus
ggtctgtcagcaaacacacccagag

SEQ ID NO: 719191 - DNA, 25 bp, Mus musculus
ggtctgtcagcatacacacccagag

SEQ ID NO: 719192 - DNA, 25 bp, Mus musculus
ggtctgtcagttagagttgacgaaa

SEQ ID NO: 719193 - DNA, 25 bp, Mus musculus
ggtctgtcagtttgagttgacgaaa

SEQ ID NO: 719194 - DNA, 25 bp, Mus musculus
ggtctgtccaccatggtctccagtt

SEQ ID NO: 719195 - DNA, 25 bp, Mus musculus
ggtctgtccaccttggtctccagtt

SEQ ID NO: 719196 - DNA, 25 bp, Mus musculus
ggtctgtcctgtccatgttccacag

SEQ ID NO: 719197 - DNA, 25 bp, Mus musculus
ggtctgtcctgtgcatgttccacag

SEQ ID NO: 719198 - DNA, 25 bp, Mus musculus
ggtctgtgatgacaacggctctaag

SEQ ID NO: 719199 - DNA, 25 bp, Mus musculus
ggtctgtgatgagaacggctctaag

SEQ ID NO: 719200 - DNA, 25 bp, Mus musculus
ggtctgtgctggctctttacgtttc

SEQ ID NO: 719201 - DNA, 25 bp, Mus musculus
ggtctgtgctgggtctttacgtttc

SEQ ID NO: 719202 - DNA, 25 bp, Mus musculus
ggtctgtgtcttcaaaggcccgcaa

SEQ ID NO: 719203 - DNA, 25 bp, Mus musculus
ggtctgtgtcttgaaaggcccgcaa

SEQ ID NO: 719204 - DNA, 25 bp, Mus musculus
ggtctgttctgactgctgcagccgt

SEQ ID NO: 719205 - DNA, 25 bp, Mus musculus
ggtctgttctgagtgctgcagccgt

SEQ ID NO: 719206 - DNA, 25 bp, Mus musculus
ggtctgtttccgactacaggccccg

SEQ ID NO: 719207 - DNA, 25 bp, Mus musculus
ggtctgtttccgtctacaggccccg

SEQ ID NO: 719208 - DNA, 25 bp, Mus musculus
ggtctgttttagatgtgagcctagc

SEQ ID NO: 719209 - DNA, 25 bp, Mus musculus
ggtctgttttagttgtgagcctagc

SEQ ID NO: 719210 - DNA, 25 bp, Mus musculus
ggtcttacacgcctggagctagcca

SEQ ID NO: 719211 - DNA, 25 bp, Mus musculus
ggtcttacacgcgtggagctagcca

SEQ ID NO: 719212 - DNA, 25 bp, Mus musculus
ggtcttacaggcagaattacattta

SEQ ID NO: 719213 - DNA, 25 bp, Mus musculus
ggtcttacaggctgaattacattta

SEQ ID NO: 719214 - DNA, 25 bp, Mus musculus
ggtcttacccctcctgtaaccattg

SEQ ID NO: 719215 - DNA, 25 bp, Mus musculus
ggtcttacccctgctgtaaccattg

SEQ ID NO: 719216 - DNA, 25 bp, Mus musculus
ggtcttaccgtgagcgccgtgcact

SEQ ID NO: 719217 - DNA, 25 bp, Mus musculus
ggtcttaccgtgtgcgccgtgcact

SEQ ID NO: 719218 - DNA, 25 bp, Mus musculus
ggtcttactccacaagccggagtca

SEQ ID NO: 719219 - DNA, 25 bp, Mus musculus
ggtcttactccagaagccggagtca

SEQ ID NO: 719220 - DNA, 25 bp, Mus musculus
ggtcttaggacgagggcattcttcc

SEQ ID NO: 719221 - DNA, 25 bp, Mus musculus
ggtcttaggacgtgggcattcttcc

SEQ ID NO: 719222 - DNA, 25 bp, Mus musculus
ggtcttaggcaaaccacttggcgag

SEQ ID NO: 719223 - DNA, 25 bp, Mus musculus
ggtcttaggcaatccacttggcgag

SEQ ID NO: 719224 - DNA, 25 bp, Mus musculus
ggtcttaggcagacacaaagaaagc

SEQ ID NO: 719225 - DNA, 25 bp, Mus musculus
ggtcttaggcagtcacaaagaaagc

SEQ ID NO: 719226 - DNA, 25 bp, Mus musculus
ggtcttatcgctcggctggccctga

SEQ ID NO: 719227 - DNA, 25 bp, Mus musculus
ggtcttatcgctgggctggccctga

SEQ ID NO: 719228 - DNA, 25 bp, Mus musculus
ggtcttatgacaatggcatggcctg

SEQ ID NO: 719229 - DNA, 25 bp, Mus musculus
ggtcttatgacattggcatggcctg

SEQ ID NO: 719230 - DNA, 25 bp, Mus musculus
ggtcttcagcttagccacggtcaca

SEQ ID NO: 719231 - DNA, 25 bp, Mus musculus
ggtcttcagctttgccacggtcaca

SEQ ID NO: 719232 - DNA, 25 bp, Mus musculus
ggtcttcatcttccagtttggaatc

SEQ ID NO: 719233 - DNA, 25 bp, Mus musculus
ggtcttcatcttgcagtttggaatc

SEQ ID NO: 719234 - DNA, 25 bp, Mus musculus
ggtcttccagacagactatgggcag

SEQ ID NO: 719235 - DNA, 25 bp, Mus musculus
ggtcttccagactgactatgggcag

SEQ ID NO: 719236 - DNA, 25 bp, Mus musculus
ggtcttcccaccaaacatctgggag

SEQ ID NO: 719237 - DNA, 25 bp, Mus musculus
ggtcttcccacctaacatctgggag

SEQ ID NO: 719238 - DNA, 25 bp, Mus musculus
ggtcttcccgtgaagctgccatgga

SEQ ID NO: 719239 - DNA, 25 bp, Mus musculus
ggtcttcccgtgtagctgccatgga

SEQ ID NO: 719240 - DNA, 25 bp, Mus musculus
ggtcttccctacctgctctatggag

SEQ ID NO: 719241 - DNA, 25 bp, Mus musculus
ggtcttccctacgtgctctatggag

SEQ ID NO: 719242 - DNA, 25 bp, Mus musculus
ggtcttccctagcagcgccataggt

SEQ ID NO: 719243 - DNA, 25 bp, Mus musculus
ggtcttccctaggagcgccataggt

SEQ ID NO: 719244 - DNA, 25 bp, Mus musculus
ggtcttccgcagcattgcgaagttc

SEQ ID NO: 719245 - DNA, 25 bp, Mus musculus
ggtcttccgcaggattgcgaagttc

SEQ ID NO: 719246 - DNA, 25 bp, Mus musculus
ggtcttcctggaacaagcacggcac

SEQ ID NO: 719247 - DNA, 25 bp, Mus musculus
ggtcttcctggatcaagcacggcac

SEQ ID NO: 719248 - DNA, 25 bp, Mus musculus
ggtcttcctggcaaagagctaccca

SEQ ID NO: 719249 - DNA, 25 bp, Mus musculus
ggtcttcctggctaagagctaccca

SEQ ID NO: 719250 - DNA, 25 bp, Mus musculus
ggtcttccttctaccacactattta

SEQ ID NO: 719251 - DNA, 25 bp, Mus musculus
ggtcttccttcttccacactattta

SEQ ID NO: 719252 - DNA, 25 bp, Mus musculus
ggtcttcgattacccccaagtgctg

SEQ ID NO: 719253 - DNA, 25 bp, Mus musculus
ggtcttcgattagccccaagtgctg

SEQ ID NO: 719254 - DNA, 25 bp, Mus musculus
ggtcttctttatcggcagtgtacgg

SEQ ID NO: 719255 - DNA, 25 bp, Mus musculus
ggtcttctttatgggcagtgtacgg

SEQ ID NO: 719256 - DNA, 25 bp, Mus musculus
ggtcttctttgtcccgcccgggtgt

SEQ ID NO: 719257 - DNA, 25 bp, Mus musculus
ggtcttctttgtgccgcccgggtgt

SEQ ID NO: 719258 - DNA, 25 bp, Mus musculus
ggtcttgaaaacaacccagtctggg

SEQ ID NO: 719259 - DNA, 25 bp, Mus musculus
ggtcttgaaaactacccagtctggg

SEQ ID NO: 719260 - DNA, 25 bp, Mus musculus
ggtcttgaccaaagatcctatctag

SEQ ID NO: 719261 - DNA, 25 bp, Mus musculus
ggtcttgaccaatgatcctatctag

SEQ ID NO: 719262 - DNA, 25 bp, Mus musculus
ggtcttgagcaacagtacccggcat

SEQ ID NO: 719263 - DNA, 25 bp, Mus musculus
ggtcttgagcaagagtacccggcat

SEQ ID NO: 719264 - DNA, 25 bp, Mus musculus
ggtcttgattccatcaccttctaca

SEQ ID NO: 719265 - DNA, 25 bp, Mus musculus
ggtcttgattccttcaccttctaca

SEQ ID NO: 719266 - DNA, 25 bp, Mus musculus
ggtcttgcggctcctctatgaggaa

SEQ ID NO: 719267 - DNA, 25 bp, Mus musculus
ggtcttgcggctgctctatgaggaa

SEQ ID NO: 719268 - DNA, 25 bp, Mus musculus
ggtcttgctcacatatcccaagtca

SEQ ID NO: 719269 - DNA, 25 bp, Mus musculus
ggtcttgctcacttatcccaagtca

SEQ ID NO: 719270 - DNA, 25 bp, Mus musculus
ggtcttgctcagaactcggtttgca

SEQ ID NO: 719271 - DNA, 25 bp, Mus musculus
ggtcttgctcagtactcggtttgca

SEQ ID NO: 719272 - DNA, 25 bp, Mus musculus
ggtcttggagcgctccatctacagt

SEQ ID NO: 719273 - DNA, 25 bp, Mus musculus
ggtcttggagcggtccatctacagt

SEQ ID NO: 719274 - DNA, 25 bp, Mus musculus
ggtcttggctgactgagtcctaccc

SEQ ID NO: 719275 - DNA, 25 bp, Mus musculus
ggtcttggctgagtgagtcctaccc

SEQ ID NO: 719276 - DNA, 25 bp, Mus musculus
ggtcttggctttacctgagaaaagt

SEQ ID NO: 719277 - DNA, 25 bp, Mus musculus
ggtcttggcttttcctgagaaaagt

SEQ ID NO: 719278 - DNA, 25 bp, Mus musculus
ggtctttaaagccttcgggacagat

SEQ ID NO: 719279 - DNA, 25 bp, Mus musculus
ggtctttaaagcgttcgggacagat

SEQ ID NO: 719280 - DNA, 25 bp, Mus musculus
ggtctttactacaatgacccaaaat

SEQ ID NO: 719281 - DNA, 25 bp, Mus musculus
ggtctttactactatgacccaaaat

SEQ ID NO: 719282 - DNA, 25 bp, Mus musculus
ggtctttccctaattgcctgatcag

SEQ ID NO: 719283 - DNA, 25 bp, Mus musculus
ggtctttccctatttgcctgatcag

SEQ ID NO: 719284 - DNA, 25 bp, Mus musculus
ggtctttgacaacctgatgcaacag

SEQ ID NO: 719285 - DNA, 25 bp, Mus musculus
ggtctttgacaagctgatgcaacag

SEQ ID NO: 719286 - DNA, 25 bp, Mus musculus
ggtctttgagatcttagcctccgaa

SEQ ID NO: 719287 - DNA, 25 bp, Mus musculus
ggtctttgagatgttagcctccgaa

SEQ ID NO: 719288 - DNA, 25 bp, Mus musculus
ggtctttgattacctgcatgcgaca

SEQ ID NO: 719289 - DNA, 25 bp, Mus musculus
ggtctttgattagctgcatgcgaca

SEQ ID NO: 719290 - DNA, 25 bp, Mus musculus
ggtctttgcagcactgataaagcag

SEQ ID NO: 719291 - DNA, 25 bp, Mus musculus
ggtctttgcagctctgataaagcag

SEQ ID NO: 719292 - DNA, 25 bp, Mus musculus
ggtctttgccatcaggcccttgcag

SEQ ID NO: 719293 - DNA, 25 bp, Mus musculus
ggtctttgccatgaggcccttgcag

SEQ ID NO: 719294 - DNA, 25 bp, Mus musculus
ggtctttgctggcactgtcctacta

SEQ ID NO: 719295 - DNA, 25 bp, Mus musculus
ggtctttgctgggactgtcctacta

SEQ ID NO: 719296 - DNA, 25 bp, Mus musculus
ggtctttgggatcaacactttccta

SEQ ID NO: 719297 - DNA, 25 bp, Mus musculus
ggtctttgggatgaacactttccta

SEQ ID NO: 719298 - DNA, 25 bp, Mus musculus
ggtctttgggcactaccagcagcac

SEQ ID NO: 719299 - DNA, 25 bp, Mus musculus
ggtctttgggcagtaccagcagcac

SEQ ID NO: 719300 - DNA, 25 bp, Mus musculus
ggtctttgtgctctatgagctctca

SEQ ID NO: 719301 - DNA, 25 bp, Mus musculus
ggtctttgtgctgtatgagctctca

SEQ ID NO: 719302 - DNA, 25 bp, Mus musculus
ggtcttttcttaatggcctctgtcc

SEQ ID NO: 719303 - DNA, 25 bp, Mus musculus
ggtcttttcttattggcctctgtcc

SEQ ID NO: 719304 - DNA, 25 bp, Mus musculus
ggtctttttggcaaggaattacaca

SEQ ID NO: 719305 - DNA, 25 bp, Mus musculus
ggtctttttggctaggaattacaca

SEQ ID NO: 719306 - DNA, 25 bp, Mus musculus
ggtgaaaattacagacggatctcct

SEQ ID NO: 719307 - DNA, 25 bp, Mus musculus
ggtgaaaattactgacggatctcct

SEQ ID NO: 719308 - DNA, 25 bp, Mus musculus
ggtgaaacaagtcctcttggcacaa

SEQ ID NO: 719309 - DNA, 25 bp, Mus musculus
ggtgaaacaagtgctcttggcacaa

SEQ ID NO: 719310 - DNA, 25 bp, Mus musculus
ggtgaaacagaccatcgcgcaccag

SEQ ID NO: 719311 - DNA, 25 bp, Mus musculus
ggtgaaacagacgatcgcgcaccag

SEQ ID NO: 719312 - DNA, 25 bp, Mus musculus
ggtgaaacaggacagcaagcagatc

SEQ ID NO: 719313 - DNA, 25 bp, Mus musculus
ggtgaaacaggagagcaagcagatc

SEQ ID NO: 719314 - DNA, 25 bp, Mus musculus
ggtgaaaccaaacgtgcccctgtcg

SEQ ID NO: 719315 - DNA, 25 bp, Mus musculus
ggtgaaaccaaaggtgcccctgtcg

SEQ ID NO: 719316 - DNA, 25 bp, Mus musculus
ggtgaaacctatcttgccaagcaag

SEQ ID NO: 719317 - DNA, 25 bp, Mus musculus
ggtgaaacctatgttgccaagcaag

SEQ ID NO: 719318 - DNA, 25 bp, Mus musculus
ggtgaaagacttcatgacaactccc

SEQ ID NO: 719319 - DNA, 25 bp, Mus musculus
ggtgaaagacttgatgacaactccc

SEQ ID NO: 719320 - DNA, 25 bp, Mus musculus
ggtgaaagatgtcttcatttctgca

SEQ ID NO: 719321 - DNA, 25 bp, Mus musculus
ggtgaaagatgtgttcatttctgca

SEQ ID NO: 719322 - DNA, 25 bp, Mus musculus
ggtgaaagattcagatgatgtgcca

SEQ ID NO: 719323 - DNA, 25 bp, Mus musculus
ggtgaaagattctgatgatgtgcca

SEQ ID NO: 719324 - DNA, 25 bp, Mus musculus
ggtgaaagctgccatcctgatgcat

SEQ ID NO: 719325 - DNA, 25 bp, Mus musculus
ggtgaaagctgcgatcctgatgcat

SEQ ID NO: 719326 - DNA, 25 bp, Mus musculus
ggtgaaagtattagctccatatgcc

SEQ ID NO: 719327 - DNA, 25 bp, Mus musculus
ggtgaaagtatttgctccatatgcc

SEQ ID NO: 719328 - DNA, 25 bp, Mus musculus
ggtgaaataatcacgacctgtgcct

SEQ ID NO: 719329 - DNA, 25 bp, Mus musculus
ggtgaaataatctcgacctgtgcct

SEQ ID NO: 719330 - DNA, 25 bp, Mus musculus
ggtgaaatggaaactgaacccaaac

SEQ ID NO: 719331 - DNA, 25 bp, Mus musculus
ggtgaaatggaatctgaacccaaac

SEQ ID NO: 719332 - DNA, 25 bp, Mus musculus
ggtgaaattctactgttagaccact

SEQ ID NO: 719333 - DNA, 25 bp, Mus musculus
ggtgaaattctagtgttagaccact

SEQ ID NO: 719334 - DNA, 25 bp, Mus musculus
ggtgaacaacatcaaacctgacatc

SEQ ID NO: 719335 - DNA, 25 bp, Mus musculus
ggtgaacaacatgaaacctgacatc

SEQ ID NO: 719336 - DNA, 25 bp, Mus musculus
ggtgaacaaggcagactagactctt

SEQ ID NO: 719337 - DNA, 25 bp, Mus musculus
ggtgaacaaggcagccgacgctgtc

SEQ ID NO: 719338 - DNA, 25 bp, Mus musculus
ggtgaacaaggctgactagactctt

SEQ ID NO: 719339 - DNA, 25 bp, Mus musculus
ggtgaacaaggctgccgacgctgtc

SEQ ID NO: 719340 - DNA, 25 bp, Mus musculus
ggtgaacagtggatcagaagccaac

SEQ ID NO: 719341 - DNA, 25 bp, Mus musculus
ggtgaacagtggttcagaagccaac

SEQ ID NO: 719342 - DNA, 25 bp, Mus musculus
ggtgaacattgtaccaggctttggg

SEQ ID NO: 719343 - DNA, 25 bp, Mus musculus
ggtgaacattgttccaggctttggg

SEQ ID NO: 719344 - DNA, 25 bp, Mus musculus
ggtgaaccagacagtgttcctggct

SEQ ID NO: 719345 - DNA, 25 bp, Mus musculus
ggtgaaccagactgtgttcctggct

SEQ ID NO: 719346 - DNA, 25 bp, Mus musculus
ggtgaaccagtgaccagctctgatg

SEQ ID NO: 719347 - DNA, 25 bp, Mus musculus
ggtgaaccagtgtccagctctgatg

SEQ ID NO: 719348 - DNA, 25 bp, Mus musculus
ggtgaacccaccagtgaggattact

SEQ ID NO: 719349 - DNA, 25 bp, Mus musculus
ggtgaacccacctgtgaggattact

SEQ ID NO: 719350 - DNA, 25 bp, Mus musculus
ggtgaaccggccacccaggagcagc

SEQ ID NO: 719351 - DNA, 25 bp, Mus musculus
ggtgaaccggcctcccaggagcagc

SEQ ID NO: 719352 - DNA, 25 bp, Mus musculus
ggtgaacctgcgagatgaccttctt

SEQ ID NO: 719353 - DNA, 25 bp, Mus musculus
ggtgaacctgcgtgatgaccttctt

SEQ ID NO: 719354 - DNA, 25 bp, Mus musculus
ggtgaacgaagaaggcactgcctgt

SEQ ID NO: 719355 - DNA, 25 bp, Mus musculus
ggtgaacgaagatggcactgcctgt

SEQ ID NO: 719356 - DNA, 25 bp, Mus musculus
ggtgaacgacacaatagcctttgtg

SEQ ID NO: 719357 - DNA, 25 bp, Mus musculus
ggtgaacgacactatagcctttgtg

SEQ ID NO: 719358 - DNA, 25 bp, Mus musculus
ggtgaacgacgactactgcgactgt

SEQ ID NO: 719359 - DNA, 25 bp, Mus musculus
ggtgaacgacgagtactgcgactgt

SEQ ID NO: 719360 - DNA, 25 bp, Mus musculus
ggtgaacgctttaagcctctgcact

SEQ ID NO: 719361 - DNA, 25 bp, Mus musculus
ggtgaacgcttttagcctctgcact

SEQ ID NO: 719362 - DNA, 25 bp, Mus musculus
ggtgaacgtaatagaaccatggctc

SEQ ID NO: 719363 - DNA, 25 bp, Mus musculus
ggtgaacgtaattgaaccatggctc

SEQ ID NO: 719364 - DNA, 25 bp, Mus musculus
ggtgaacgtgcgagtccatcaccct

SEQ ID NO: 719365 - DNA, 25 bp, Mus musculus
ggtgaacgtgcgtgtccatcaccct

SEQ ID NO: 719366 - DNA, 25 bp, Mus musculus
ggtgaactagccacctatgatatgc

SEQ ID NO: 719367 - DNA, 25 bp, Mus musculus
ggtgaactagcctcctatgatatgc

SEQ ID NO: 719368 - DNA, 25 bp, Mus musculus
ggtgaactccgcagagagcagttag

SEQ ID NO: 719369 - DNA, 25 bp, Mus musculus
ggtgaactccgctgagagcagttag

SEQ ID NO: 719370 - DNA, 25 bp, Mus musculus
ggtgaactgacccagatgcccacta

SEQ ID NO: 719371 - DNA, 25 bp, Mus musculus
ggtgaactgaccgagatgcccacta

SEQ ID NO: 719372 - DNA, 25 bp, Mus musculus
ggtgaactggtgagagacaacagcc

SEQ ID NO: 719373 - DNA, 25 bp, Mus musculus
ggtgaactggtgtgagacaacagcc

SEQ ID NO: 719374 - DNA, 25 bp, Mus musculus
ggtgaacttgaccaaaccacgttgc

SEQ ID NO: 719375 - DNA, 25 bp, Mus musculus
ggtgaacttgacgaaaccacgttgc

SEQ ID NO: 719376 - DNA, 25 bp, Mus musculus
ggtgaacttggaagctctctccaag

SEQ ID NO: 719377 - DNA, 25 bp, Mus musculus
ggtgaacttggaatcttttgagcag

SEQ ID NO: 719378 - DNA, 25 bp, Mus musculus
ggtgaacttggatgctctctccaag

SEQ ID NO: 719379 - DNA, 25 bp, Mus musculus
ggtgaacttggattcttttgagcag

SEQ ID NO: 719380 - DNA, 25 bp, Mus musculus
ggtgaactttagaaccaaatagcta

SEQ ID NO: 719381 - DNA, 25 bp, Mus musculus
ggtgaactttagtaccaaatagcta

SEQ ID NO: 719382 - DNA, 25 bp, Mus musculus
ggtgaagaaccaatttacacaggcc

SEQ ID NO: 719383 - DNA, 25 bp, Mus musculus
ggtgaagaaccattttacacaggcc

SEQ ID NO: 719384 - DNA, 25 bp, Mus musculus
ggtgaagaattacatgcagcggccc

SEQ ID NO: 719385 - DNA, 25 bp, Mus musculus
ggtgaagaattagatgcagcggccc

SEQ ID NO: 719386 - DNA, 25 bp, Mus musculus
ggtgaagactatcgaggcacaacca

SEQ ID NO: 719387 - DNA, 25 bp, Mus musculus
ggtgaagactatggaggcacaacca

SEQ ID NO: 719388 - DNA, 25 bp, Mus musculus
ggtgaagatgcacacctttccagac

SEQ ID NO: 719389 - DNA, 25 bp, Mus musculus
ggtgaagatgcagacctttccagac

SEQ ID NO: 719390 - DNA, 25 bp, Mus musculus
ggtgaagattccaacaactgagttt

SEQ ID NO: 719391 - DNA, 25 bp, Mus musculus
ggtgaagattcctacaactgagttt

SEQ ID NO: 719392 - DNA, 25 bp, Mus musculus
ggtgaagcaccgaaacaaaaagcca

SEQ ID NO: 719393 - DNA, 25 bp, Mus musculus
ggtgaagcaccgtaacaaaaagcca

SEQ ID NO: 719394 - DNA, 25 bp, Mus musculus
ggtgaagcacttatgtcccaacgtg

SEQ ID NO: 719395 - DNA, 25 bp, Mus musculus
ggtgaagcacttttgtcccaacgtg

SEQ ID NO: 719396 - DNA, 25 bp, Mus musculus
ggtgaagcataaacttatagcgtgg

SEQ ID NO: 719397 - DNA, 25 bp, Mus musculus
ggtgaagcataatcttatagcgtgg

SEQ ID NO: 719398 - DNA, 25 bp, Mus musculus
ggtgaagcattaacgaatcttccgt

SEQ ID NO: 719399 - DNA, 25 bp, Mus musculus
ggtgaagcattatcgaatcttccgt

SEQ ID NO: 719400 - DNA, 25 bp, Mus musculus
ggtgaagccaaacagagcaacgtct

SEQ ID NO: 719401 - DNA, 25 bp, Mus musculus
ggtgaagccaaagagagcaacgtct

SEQ ID NO: 719402 - DNA, 25 bp, Mus musculus
ggtgaagcccggcagaccaaagcct

SEQ ID NO: 719403 - DNA, 25 bp, Mus musculus
ggtgaagcccgggagaccaaagcct

SEQ ID NO: 719404 - DNA, 25 bp, Mus musculus
ggtgaagctaaaccagatcgagcac

SEQ ID NO: 719405 - DNA, 25 bp, Mus musculus
ggtgaagctaaagcagatcgagcac

SEQ ID NO: 719406 - DNA, 25 bp, Mus musculus
ggtgaagctcttcaaccacgccaac

SEQ ID NO: 719407 - DNA, 25 bp, Mus musculus
ggtgaagctcttcgcctctacaact

SEQ ID NO: 719408 - DNA, 25 bp, Mus musculus
ggtgaagctcttgaaccacgccaac

SEQ ID NO: 719409 - DNA, 25 bp, Mus musculus
ggtgaagctcttggcctctacaact

SEQ ID NO: 719410 - DNA, 25 bp, Mus musculus
ggtgaaggaagtcagtcagtttcca

SEQ ID NO: 719411 - DNA, 25 bp, Mus musculus
ggtgaaggaagtgagtcagtttcca

SEQ ID NO: 719412 - DNA, 25 bp, Mus musculus
ggtgaaggaccccaactccggcctg

SEQ ID NO: 719413 - DNA, 25 bp, Mus musculus
ggtgaaggacccgaactccggcctg

SEQ ID NO: 719414 - DNA, 25 bp, Mus musculus
ggtgaaggagatcatccagcactgc

SEQ ID NO: 719415 - DNA, 25 bp, Mus musculus
ggtgaaggagatgatccagcactgc

SEQ ID NO: 719416 - DNA, 25 bp, Mus musculus
ggtgaaggcagtcccttgctgtccc

SEQ ID NO: 719417 - DNA, 25 bp, Mus musculus
ggtgaaggcagtgccttgctgtccc

SEQ ID NO: 719418 - DNA, 25 bp, Mus musculus
ggtgaaggccatatataccttgggc

SEQ ID NO: 719419 - DNA, 25 bp, Mus musculus
ggtgaaggccatttataccttgggc

SEQ ID NO: 719420 - DNA, 25 bp, Mus musculus
ggtgaaggccctctacacagtcggc

SEQ ID NO: 719421 - DNA, 25 bp, Mus musculus
ggtgaaggccctgtacacagtcggc

SEQ ID NO: 719422 - DNA, 25 bp, Mus musculus
ggtgaaggcgacaatctggatgact

SEQ ID NO: 719423 - DNA, 25 bp, Mus musculus
ggtgaaggcgactatctggatgact

SEQ ID NO: 719424 - DNA, 25 bp, Mus musculus
ggtgaaggctgcagtgactctgtta

SEQ ID NO: 719425 - DNA, 25 bp, Mus musculus
ggtgaaggctgctgtgactctgtta

SEQ ID NO: 719426 - DNA, 25 bp, Mus musculus
ggtgaagggactccgccacatactt

SEQ ID NO: 719427 - DNA, 25 bp, Mus musculus
ggtgaagggactgcgccacatactt

SEQ ID NO: 719428 - DNA, 25 bp, Mus musculus
ggtgaagggccaagatctatccagc

SEQ ID NO: 719429 - DNA, 25 bp, Mus musculus
ggtgaagggccatgatctatccagc

SEQ ID NO: 719430 - DNA, 25 bp, Mus musculus
ggtgaagtatgacccgcacacactc

SEQ ID NO: 719431 - DNA, 25 bp, Mus musculus
ggtgaagtatgagccgcacacactc

SEQ ID NO: 719432 - DNA, 25 bp, Mus musculus
ggtgaagtgctaaaacagttaacag

SEQ ID NO: 719433 - DNA, 25 bp, Mus musculus
ggtgaagtgctataacagttaacag

SEQ ID NO: 719434 - DNA, 25 bp, Mus musculus
ggtgaagtggccaattttgctgcat

SEQ ID NO: 719435 - DNA, 25 bp, Mus musculus
ggtgaagtggcctattttgctgcat

SEQ ID NO: 719436 - DNA, 25 bp, Mus musculus
ggtgaagttcaactgcccgtcgagt

SEQ ID NO: 719437 - DNA, 25 bp, Mus musculus
ggtgaagttcaagtgcccgtcgagt

SEQ ID NO: 719438 - DNA, 25 bp, Mus musculus
ggtgaagttcacagttcaaaccaag

SEQ ID NO: 719439 - DNA, 25 bp, Mus musculus
ggtgaagttcactgttcaaaccaag

SEQ ID NO: 719440 - DNA, 25 bp, Mus musculus
ggtgaataagtcagtcagccagggc

SEQ ID NO: 719441 - DNA, 25 bp, Mus musculus
ggtgaataagtcatctcagttcctg

SEQ ID NO: 719442 - DNA, 25 bp, Mus musculus
ggtgaataagtctgtcagccagggc

SEQ ID NO: 719443 - DNA, 25 bp, Mus musculus
ggtgaataagtcttctcagttcctg

SEQ ID NO: 719444 - DNA, 25 bp, Mus musculus
ggtgaataccagactaatgatgtct

SEQ ID NO: 719445 - DNA, 25 bp, Mus musculus
ggtgaataccagtctaatgatgtct

SEQ ID NO: 719446 - DNA, 25 bp, Mus musculus
ggtgaatcattacctggcatttcag

SEQ ID NO: 719447 - DNA, 25 bp, Mus musculus
ggtgaatcattagctggcatttcag

SEQ ID NO: 719448 - DNA, 25 bp, Mus musculus
ggtgaatctattctttaccagtggg

SEQ ID NO: 719449 - DNA, 25 bp, Mus musculus
ggtgaatctattgtttaccagtggg

SEQ ID NO: 719450 - DNA, 25 bp, Mus musculus
ggtgaatgaacgagacactgaaaac

SEQ ID NO: 719451 - DNA, 25 bp, Mus musculus
ggtgaatgaacgtgacactgaaaac

SEQ ID NO: 719452 - DNA, 25 bp, Mus musculus
ggtgaatgaaggatgacagctacgc

SEQ ID NO: 719453 - DNA, 25 bp, Mus musculus
ggtgaatgaaggttgacagctacgc

SEQ ID NO: 719454 - DNA, 25 bp, Mus musculus
ggtgaatgagagactccgggacaca

SEQ ID NO: 719455 - DNA, 25 bp, Mus musculus
ggtgaatgagagtctccgggacaca

SEQ ID NO: 719456 - DNA, 25 bp, Mus musculus
ggtgaatgcactaccctgagcttca

SEQ ID NO: 719457 - DNA, 25 bp, Mus musculus
ggtgaatgcacttccctgagcttca

SEQ ID NO: 719458 - DNA, 25 bp, Mus musculus
ggtgaatgccctcaacttttcagtg

SEQ ID NO: 719459 - DNA, 25 bp, Mus musculus
ggtgaatgccctgaacttttcagtg

SEQ ID NO: 719460 - DNA, 25 bp, Mus musculus
ggtgaatgcctcctcaagtatcagc

SEQ ID NO: 719461 - DNA, 25 bp, Mus musculus
ggtgaatgcctcgtcaagtatcagc

SEQ ID NO: 719462 - DNA, 25 bp, Mus musculus
ggtgaatggattctctaacaactac

SEQ ID NO: 719463 - DNA, 25 bp, Mus musculus
ggtgaatggattgtctaacaactac

SEQ ID NO: 719464 - DNA, 25 bp, Mus musculus
ggtgaatgtcacctcggaaagactg

SEQ ID NO: 719465 - DNA, 25 bp, Mus musculus
ggtgaatgtcacgtcggaaagactg

SEQ ID NO: 719466 - DNA, 25 bp, Mus musculus
ggtgaatgtgcccaaaatacctaca

SEQ ID NO: 719467 - DNA, 25 bp, Mus musculus
ggtgaatgtgccgaaaatacctaca

SEQ ID NO: 719468 - DNA, 25 bp, Mus musculus
ggtgaatgttctcagtcttggagca

SEQ ID NO: 719469 - DNA, 25 bp, Mus musculus
ggtgaatgttctgagtcttggagca

SEQ ID NO: 719470 - DNA, 25 bp, Mus musculus
ggtgaatgttgcattaaacctcagt

SEQ ID NO: 719471 - DNA, 25 bp, Mus musculus
ggtgaatgttgctttaaacctcagt

SEQ ID NO: 719472 - DNA, 25 bp, Mus musculus
ggtgaattatttagctaaaagtaag

SEQ ID NO: 719473 - DNA, 25 bp, Mus musculus
ggtgaattattttgctaaaagtaag

SEQ ID NO: 719474 - DNA, 25 bp, Mus musculus
ggtgaattggaacatgaatccctaa

SEQ ID NO: 719475 - DNA, 25 bp, Mus musculus
ggtgaattggaagatgaatccctaa

SEQ ID NO: 719476 - DNA, 25 bp, Mus musculus
ggtgaatttttgctgcgttatgccc

SEQ ID NO: 719477 - DNA, 25 bp, Mus musculus
ggtgaatttttggtgcgttatgccc

SEQ ID NO: 719478 - DNA, 25 bp, Mus musculus
ggtgacaaggaacaacctgtgtccc

SEQ ID NO: 719479 - DNA, 25 bp, Mus musculus
ggtgacaaggaagaacctgtgtccc

SEQ ID NO: 719480 - DNA, 25 bp, Mus musculus
ggtgacaaggcacatcatgaaccca

SEQ ID NO: 719481 - DNA, 25 bp, Mus musculus
ggtgacaaggcagatcatgaaccca

SEQ ID NO: 719482 - DNA, 25 bp, Mus musculus
ggtgacaatgacagacagccttgtg

SEQ ID NO: 719483 - DNA, 25 bp, Mus musculus
ggtgacaatgactgacagccttgtg

SEQ ID NO: 719484 - DNA, 25 bp, Mus musculus
ggtgacacacagatctactgacctg

SEQ ID NO: 719485 - DNA, 25 bp, Mus musculus
ggtgacacacagttctactgacctg

SEQ ID NO: 719486 - DNA, 25 bp, Mus musculus
ggtgacacagttcgacgcagtccgc

SEQ ID NO: 719487 - DNA, 25 bp, Mus musculus
ggtgacacagttggacgcagtccgc

SEQ ID NO: 719488 - DNA, 25 bp, Mus musculus
ggtgacaccaacaatgcctggccca

SEQ ID NO: 719489 - DNA, 25 bp, Mus musculus
ggtgacaccaactatgcctggccca

SEQ ID NO: 719490 - DNA, 25 bp, Mus musculus
ggtgacaccagcatcagagctcatg

SEQ ID NO: 719491 - DNA, 25 bp, Mus musculus
ggtgacaccagcttcagagctcatg

SEQ ID NO: 719492 - DNA, 25 bp, Mus musculus
ggtgacacccacattgaccaacttc

SEQ ID NO: 719493 - DNA, 25 bp, Mus musculus
ggtgacacccactttgaccaacttc

SEQ ID NO: 719494 - DNA, 25 bp, Mus musculus
ggtgacaccgtgcaggaagctttct

SEQ ID NO: 719495 - DNA, 25 bp, Mus musculus
ggtgacaccgtggaggaagctttct

SEQ ID NO: 719496 - DNA, 25 bp, Mus musculus
ggtgacacttctacatgcgtgctct

SEQ ID NO: 719497 - DNA, 25 bp, Mus musculus
ggtgacacttcttcatgcgtgctct

SEQ ID NO: 719498 - DNA, 25 bp, Mus musculus
ggtgacacttgtacccttaatgagt

SEQ ID NO: 719499 - DNA, 25 bp, Mus musculus
ggtgacacttgttcccttaatgagt

SEQ ID NO: 719500 - DNA, 25 bp, Mus musculus
ggtgacagaaaccttaccctctact

SEQ ID NO: 719501 - DNA, 25 bp, Mus musculus
ggtgacagaaacgttaccctctact

SEQ ID NO: 719502 - DNA, 25 bp, Mus musculus
ggtgacagaagcactgcggtcgttc

SEQ ID NO: 719503 - DNA, 25 bp, Mus musculus
ggtgacagaagctctgcggtcgttc

SEQ ID NO: 719504 - DNA, 25 bp, Mus musculus
ggtgacagcatgcagtccctctttc

SEQ ID NO: 719505 - DNA, 25 bp, Mus musculus
ggtgacagcatggagtccctctttc

SEQ ID NO: 719506 - DNA, 25 bp, Mus musculus
ggtgacagccgtaacattgcaaaca

SEQ ID NO: 719507 - DNA, 25 bp, Mus musculus
ggtgacagccgtcaccgccatcgtg

SEQ ID NO: 719508 - DNA, 25 bp, Mus musculus
ggtgacagccgtgaccgccatcgtg

SEQ ID NO: 719509 - DNA, 25 bp, Mus musculus
ggtgacagccgttacattgcaaaca

SEQ ID NO: 719510 - DNA, 25 bp, Mus musculus
ggtgacagcctcaatatatttaaag

SEQ ID NO: 719511 - DNA, 25 bp, Mus musculus
ggtgacagcctctatatatttaaag

SEQ ID NO: 719512 - DNA, 25 bp, Mus musculus
ggtgacagctctatccggtattttg

SEQ ID NO: 719513 - DNA, 25 bp, Mus musculus
ggtgacagctctttccggtattttg

SEQ ID NO: 719514 - DNA, 25 bp, Mus musculus
ggtgacagtactcgagtcctagagt

SEQ ID NO: 719515 - DNA, 25 bp, Mus musculus
ggtgacagtactggagtcctagagt

SEQ ID NO: 719516 - DNA, 25 bp, Mus musculus
ggtgacagtgccatcggattttctg

SEQ ID NO: 719517 - DNA, 25 bp, Mus musculus
ggtgacagtgccttcggattttctg

SEQ ID NO: 719518 - DNA, 25 bp, Mus musculus
ggtgacagtggaaactcctgcgtgc

SEQ ID NO: 719519 - DNA, 25 bp, Mus musculus
ggtgacagtggatactcctgcgtgc

SEQ ID NO: 719520 - DNA, 25 bp, Mus musculus
ggtgacatctgcaaccaaggcctgt

SEQ ID NO: 719521 - DNA, 25 bp, Mus musculus
ggtgacatctgctaccaaggcctgt

SEQ ID NO: 719522 - DNA, 25 bp, Mus musculus
ggtgacatctgtcccatgaagtatt

SEQ ID NO: 719523 - DNA, 25 bp, Mus musculus
ggtgacatctgtgccatgaagtatt

SEQ ID NO: 719524 - DNA, 25 bp, Mus musculus
ggtgaccacaaacgcgtcaagggac

SEQ ID NO: 719525 - DNA, 25 bp, Mus musculus
ggtgaccacaaaggcgtcaagggac

SEQ ID NO: 719526 - DNA, 25 bp, Mus musculus
ggtgaccacactactctatttatta

SEQ ID NO: 719527 - DNA, 25 bp, Mus musculus
ggtgaccacacttctctatttatta

SEQ ID NO: 719528 - DNA, 25 bp, Mus musculus
ggtgaccaggtcctgaatctcacta

SEQ ID NO: 719529 - DNA, 25 bp, Mus musculus
ggtgaccaggtcgtgaatctcacta

SEQ ID NO: 719530 - DNA, 25 bp, Mus musculus
ggtgaccatcccaaaaaacagccat

SEQ ID NO: 719531 - DNA, 25 bp, Mus musculus
ggtgaccatccctaaaaacagccat

SEQ ID NO: 719532 - DNA, 25 bp, Mus musculus
ggtgaccattaaacgttctgctcga

SEQ ID NO: 719533 - DNA, 25 bp, Mus musculus
ggtgaccattaatcgttctgctcga

SEQ ID NO: 719534 - DNA, 25 bp, Mus musculus
ggtgacccagcgcaaccctgtggaa

SEQ ID NO: 719535 - DNA, 25 bp, Mus musculus
ggtgacccagcggaaccctgtggaa

SEQ ID NO: 719536 - DNA, 25 bp, Mus musculus
ggtgacccaggccagtgtatgccat

SEQ ID NO: 719537 - DNA, 25 bp, Mus musculus
ggtgacccaggcgagtgtatgccat

SEQ ID NO: 719538 - DNA, 25 bp, Mus musculus
ggtgaccccagtatttgtccatgga

SEQ ID NO: 719539 - DNA, 25 bp, Mus musculus
ggtgaccccagtttttgtccatgga

SEQ ID NO: 719540 - DNA, 25 bp, Mus musculus
ggtgaccccatcactatcattgagg

SEQ ID NO: 719541 - DNA, 25 bp, Mus musculus
ggtgaccccatctctatcattgagg

SEQ ID NO: 719542 - DNA, 25 bp, Mus musculus
ggtgacccctccaatcgagcctttg

SEQ ID NO: 719543 - DNA, 25 bp, Mus musculus
ggtgacccctccaattgagccagtg

SEQ ID NO: 719544 - DNA, 25 bp, Mus musculus
ggtgacccctcctatcgagcctttg

SEQ ID NO: 719545 - DNA, 25 bp, Mus musculus
ggtgacccctcctattgagccagtg

SEQ ID NO: 719546 - DNA, 25 bp, Mus musculus
ggtgacccggacaaactagcatgtg

SEQ ID NO: 719547 - DNA, 25 bp, Mus musculus
ggtgacccggactaactagcatgtg

SEQ ID NO: 719548 - DNA, 25 bp, Mus musculus
ggtgaccctggacctaaaggagaca

SEQ ID NO: 719549 - DNA, 25 bp, Mus musculus
ggtgaccctggagctaaaggagaca

SEQ ID NO: 719550 - DNA, 25 bp, Mus musculus
ggtgaccctggtaactctgcgcttc

SEQ ID NO: 719551 - DNA, 25 bp, Mus musculus
ggtgaccctggttactctgcgcttc

SEQ ID NO: 719552 - DNA, 25 bp, Mus musculus
ggtgaccctgtgatgaacaattgag

SEQ ID NO: 719553 - DNA, 25 bp, Mus musculus
ggtgaccctgtgttgaacaattgag

SEQ ID NO: 719554 - DNA, 25 bp, Mus musculus
ggtgacccttcgctgccagccatgt

SEQ ID NO: 719555 - DNA, 25 bp, Mus musculus
ggtgacccttcggtgccagccatgt

SEQ ID NO: 719556 - DNA, 25 bp, Mus musculus
ggtgaccgcattcttctccgttgcc

SEQ ID NO: 719557 - DNA, 25 bp, Mus musculus
ggtgaccgcattgttctccgttgcc

SEQ ID NO: 719558 - DNA, 25 bp, Mus musculus
ggtgaccgcgctagccagcactcgg

SEQ ID NO: 719559 - DNA, 25 bp, Mus musculus
ggtgaccgcgcttgccagcactcgg

SEQ ID NO: 719560 - DNA, 25 bp, Mus musculus
ggtgaccggaatcccaactgctgtg

SEQ ID NO: 719561 - DNA, 25 bp, Mus musculus
ggtgaccggaatgccaactgctgtg

SEQ ID NO: 719562 - DNA, 25 bp, Mus musculus
ggtgacctaaatcctcggacggacg

SEQ ID NO: 719563 - DNA, 25 bp, Mus musculus
ggtgacctaaatgctcggacggacg

SEQ ID NO: 719564 - DNA, 25 bp, Mus musculus
ggtgacctgcttattggctgatatc

SEQ ID NO: 719565 - DNA, 25 bp, Mus musculus
ggtgacctgctttttggctgatatc

SEQ ID NO: 719566 - DNA, 25 bp, Mus musculus
ggtgacgcaaccagattccatggga

SEQ ID NO: 719567 - DNA, 25 bp, Mus musculus
ggtgacgcaacctgattccatggga

SEQ ID NO: 719568 - DNA, 25 bp, Mus musculus
ggtgacggccgcacatacggcagaa

SEQ ID NO: 719569 - DNA, 25 bp, Mus musculus
ggtgacggccgcagctttcctttgc

SEQ ID NO: 719570 - DNA, 25 bp, Mus musculus
ggtgacggccgctcatacggcagaa

SEQ ID NO: 719571 - DNA, 25 bp, Mus musculus
ggtgacggccgctgctttcctttgc

SEQ ID NO: 719572 - DNA, 25 bp, Mus musculus
ggtgacggtctgcaaccaaaccagt

SEQ ID NO: 719573 - DNA, 25 bp, Mus musculus
ggtgacggtctggaaccaaaccagt

SEQ ID NO: 719574 - DNA, 25 bp, Mus musculus
ggtgacgtaatgacgggcctcagcc

SEQ ID NO: 719575 - DNA, 25 bp, Mus musculus
ggtgacgtaatgtcgggcctcagcc

SEQ ID NO: 719576 - DNA, 25 bp, Mus musculus
ggtgactacacacgctacatcgagt

SEQ ID NO: 719577 - DNA, 25 bp, Mus musculus
ggtgactacacaggctacatcgagt

SEQ ID NO: 719578 - DNA, 25 bp, Mus musculus
ggtgactactctcgaggcaccaacc

SEQ ID NO: 719579 - DNA, 25 bp, Mus musculus
ggtgactactctggaggcaccaacc

SEQ ID NO: 719580 - DNA, 25 bp, Mus musculus
ggtgactcaaaactagccgcatcgg

SEQ ID NO: 719581 - DNA, 25 bp, Mus musculus
ggtgactcaaaagtagccgcatcgg

SEQ ID NO: 719582 - DNA, 25 bp, Mus musculus
ggtgactcaactcctaaaagagctg

SEQ ID NO: 719583 - DNA, 25 bp, Mus musculus
ggtgactcaactgctaaaagagctg

SEQ ID NO: 719584 - DNA, 25 bp, Mus musculus
ggtgactcagcacctgtccaagtct

SEQ ID NO: 719585 - DNA, 25 bp, Mus musculus
ggtgactcagcagctgtccaagtct

SEQ ID NO: 719586 - DNA, 25 bp, Mus musculus
ggtgactcggccacgtgtacctcca

SEQ ID NO: 719587 - DNA, 25 bp, Mus musculus
ggtgactcggcctcgtgtacctcca

SEQ ID NO: 719588 - DNA, 25 bp, Mus musculus
ggtgactctgatactcatagctgtc

SEQ ID NO: 719589 - DNA, 25 bp, Mus musculus
ggtgactctgattctcatagctgtc

SEQ ID NO: 719590 - DNA, 25 bp, Mus musculus
ggtgactctgccaagcacatgctca

SEQ ID NO: 719591 - DNA, 25 bp, Mus musculus
ggtgactctgcctagcacatgctca

SEQ ID NO: 719592 - DNA, 25 bp, Mus musculus
ggtgactgactgagtttggaagcct

SEQ ID NO: 719593 - DNA, 25 bp, Mus musculus
ggtgactgactgtgtttggaagcct

SEQ ID NO: 719594 - DNA, 25 bp, Mus musculus
ggtgacttaagcagacagttgcgtg

SEQ ID NO: 719595 - DNA, 25 bp, Mus musculus
ggtgacttaagctgacagttgcgtg

SEQ ID NO: 719596 - DNA, 25 bp, Mus musculus
ggtgacttcaccagcctcaaaggag

SEQ ID NO: 719597 - DNA, 25 bp, Mus musculus
ggtgacttcacctgcctcaaaggag

SEQ ID NO: 719598 - DNA, 25 bp, Mus musculus
ggtgacttccatcatgatccaggtg

SEQ ID NO: 719599 - DNA, 25 bp, Mus musculus
ggtgacttccatgatgatccaggtg

SEQ ID NO: 719600 - DNA, 25 bp, Mus musculus
ggtgacttctccctacgcatcgatg

SEQ ID NO: 719601 - DNA, 25 bp, Mus musculus
ggtgacttctccgtacgcatcgatg

SEQ ID NO: 719602 - DNA, 25 bp, Mus musculus
ggtgacttcttgcatcctccacgtt

SEQ ID NO: 719603 - DNA, 25 bp, Mus musculus
ggtgacttcttggatcctccacgtt

SEQ ID NO: 719604 - DNA, 25 bp, Mus musculus
ggtgacttttgaccgcagtgttaac

SEQ ID NO: 719605 - DNA, 25 bp, Mus musculus
ggtgacttttgagcgcagtgttaac

SEQ ID NO: 719606 - DNA, 25 bp, Mus musculus
ggtgagaaaagtccaaggcaccaac

SEQ ID NO: 719607 - DNA, 25 bp, Mus musculus
ggtgagaaaagtgcaaggcaccaac

SEQ ID NO: 719608 - DNA, 25 bp, Mus musculus
ggtgagaaatcacgacacctaaccc

SEQ ID NO: 719609 - DNA, 25 bp, Mus musculus
ggtgagaaatcaggacacctaaccc

SEQ ID NO: 719610 - DNA, 25 bp, Mus musculus
ggtgagaacacaagaattgcccagc

SEQ ID NO: 719611 - DNA, 25 bp, Mus musculus
ggtgagaacacatgaattgcccagc

SEQ ID NO: 719612 - DNA, 25 bp, Mus musculus
ggtgagaatcaaagaaacggctctg

SEQ ID NO: 719613 - DNA, 25 bp, Mus musculus
ggtgagaatcaatgaaacggctctg

SEQ ID NO: 719614 - DNA, 25 bp, Mus musculus
ggtgagacccctctctttaagcagt

SEQ ID NO: 719615 - DNA, 25 bp, Mus musculus
ggtgagacccctgtctttaagcagt

SEQ ID NO: 719616 - DNA, 25 bp, Mus musculus
ggtgagacctgtcttttcggttaca

SEQ ID NO: 719617 - DNA, 25 bp, Mus musculus
ggtgagacctgtgttttcggttaca

SEQ ID NO: 719618 - DNA, 25 bp, Mus musculus
ggtgagactagcatcgaaaggcata

SEQ ID NO: 719619 - DNA, 25 bp, Mus musculus
ggtgagactagcttcgaaaggcata

SEQ ID NO: 719620 - DNA, 25 bp, Mus musculus
ggtgagacttccaacatccgagtgt

SEQ ID NO: 719621 - DNA, 25 bp, Mus musculus
ggtgagacttcctacatccgagtgt

SEQ ID NO: 719622 - DNA, 25 bp, Mus musculus
ggtgagagctctacgatgtcgccct

SEQ ID NO: 719623 - DNA, 25 bp, Mus musculus
ggtgagagctcttcgatgtcgccct

SEQ ID NO: 719624 - DNA, 25 bp, Mus musculus
ggtgagagtcgaagatgaaatgcct

SEQ ID NO: 719625 - DNA, 25 bp, Mus musculus
ggtgagagtcgatgatgaaatgcct

SEQ ID NO: 719626 - DNA, 25 bp, Mus musculus
ggtgagagtgcaactcctgggcaca

SEQ ID NO: 719627 - DNA, 25 bp, Mus musculus
ggtgagagtgcatctcctgggcaca

SEQ ID NO: 719628 - DNA, 25 bp, Mus musculus
ggtgagagttcacaccacagctgtc

SEQ ID NO: 719629 - DNA, 25 bp, Mus musculus
ggtgagagttcagaccacagctgtc

SEQ ID NO: 719630 - DNA, 25 bp, Mus musculus
ggtgagcaaagccaagaaggatctt

SEQ ID NO: 719631 - DNA, 25 bp, Mus musculus
ggtgagcaaagcgaagaaggatctt

SEQ ID NO: 719632 - DNA, 25 bp, Mus musculus
ggtgagcaccccagtcacgtgctgt

SEQ ID NO: 719633 - DNA, 25 bp, Mus musculus
ggtgagcacccctgtcacgtgctgt

SEQ ID NO: 719634 - DNA, 25 bp, Mus musculus
ggtgagcagactactccatttgcac

SEQ ID NO: 719635 - DNA, 25 bp, Mus musculus
ggtgagcagacttctccatttgcac

SEQ ID NO: 719636 - DNA, 25 bp, Mus musculus
ggtgagcagggacgatcacactccc

SEQ ID NO: 719637 - DNA, 25 bp, Mus musculus
ggtgagcagggaggatcacactccc

SEQ ID NO: 719638 - DNA, 25 bp, Mus musculus
ggtgagcatcgcagatgttttgcac

SEQ ID NO: 719639 - DNA, 25 bp, Mus musculus
ggtgagcatcgctgatgttttgcac

SEQ ID NO: 719640 - DNA, 25 bp, Mus musculus
ggtgagccaaagaactacccggtgg

SEQ ID NO: 719641 - DNA, 25 bp, Mus musculus
ggtgagccaaagtactacccggtgg

SEQ ID NO: 719642 - DNA, 25 bp, Mus musculus
ggtgagccagggataccgatcgctc

SEQ ID NO: 719643 - DNA, 25 bp, Mus musculus
ggtgagccagggttaccgatcgctc

SEQ ID NO: 719644 - DNA, 25 bp, Mus musculus
ggtgagccagttagacatccaggaa

SEQ ID NO: 719645 - DNA, 25 bp, Mus musculus
ggtgagccagtttgacatccaggaa

SEQ ID NO: 719646 - DNA, 25 bp, Mus musculus
ggtgagcccctacctctcagatctt

SEQ ID NO: 719647 - DNA, 25 bp, Mus musculus
ggtgagcccctagctctcagatctt

SEQ ID NO: 719648 - DNA, 25 bp, Mus musculus
ggtgagccgagaattgccaggacac

SEQ ID NO: 719649 - DNA, 25 bp, Mus musculus
ggtgagccgagatttgccaggacac

SEQ ID NO: 719650 - DNA, 25 bp, Mus musculus
ggtgagcctgaactgataggccttt

SEQ ID NO: 719651 - DNA, 25 bp, Mus musculus
ggtgagcctgaagtgataggccttt

SEQ ID NO: 719652 - DNA, 25 bp, Mus musculus
ggtgagcctgtaagtaatgcctgcg

SEQ ID NO: 719653 - DNA, 25 bp, Mus musculus
ggtgagcctgtatgtaatgcctgcg

SEQ ID NO: 719654 - DNA, 25 bp, Mus musculus
ggtgagcggtcacgatgctaatcca

SEQ ID NO: 719655 - DNA, 25 bp, Mus musculus
ggtgagcggtcaggatgctaatcca

SEQ ID NO: 719656 - DNA, 25 bp, Mus musculus
ggtgagctgcccatctttgtgacca

SEQ ID NO: 719657 - DNA, 25 bp, Mus musculus
ggtgagctgcccttctttgtgacca

SEQ ID NO: 719658 - DNA, 25 bp, Mus musculus
ggtgagcttcttctccttgaagtca

SEQ ID NO: 719659 - DNA, 25 bp, Mus musculus
ggtgagcttcttgtccttgaagtca

SEQ ID NO: 719660 - DNA, 25 bp, Mus musculus
ggtgaggcctcacgactttgagaat

SEQ ID NO: 719661 - DNA, 25 bp, Mus musculus
ggtgaggcctcaggactttgagaat

SEQ ID NO: 719662 - DNA, 25 bp, Mus musculus
ggtgaggcgtccctacgcctacatg

SEQ ID NO: 719663 - DNA, 25 bp, Mus musculus
ggtgaggcgtccgtacgcctacatg

SEQ ID NO: 719664 - DNA, 25 bp, Mus musculus
ggtgagggcatcacgtggcacaaca

SEQ ID NO: 719665 - DNA, 25 bp, Mus musculus
ggtgagggcatctcgtggcacaaca

SEQ ID NO: 719666 - DNA, 25 bp, Mus musculus
ggtgaggtcaccacacccttacggg

SEQ ID NO: 719667 - DNA, 25 bp, Mus musculus
ggtgaggtcacctcacccttacggg

SEQ ID NO: 719668 - DNA, 25 bp, Mus musculus
ggtgagtaaggaaagaccctttgct

SEQ ID NO: 719669 - DNA, 25 bp, Mus musculus
ggtgagtaaggatagaccctttgct

SEQ ID NO: 719670 - DNA, 25 bp, Mus musculus
ggtgagtaatctattgaggaatcgg

SEQ ID NO: 719671 - DNA, 25 bp, Mus musculus
ggtgagtaatcttttgaggaatcgg

SEQ ID NO: 719672 - DNA, 25 bp, Mus musculus
ggtgagtacccgacttccattctca

SEQ ID NO: 719673 - DNA, 25 bp, Mus musculus
ggtgagtacccgtcttccattctca

SEQ ID NO: 719674 - DNA, 25 bp, Mus musculus
ggtgagtatctcatgtgctctctga

SEQ ID NO: 719675 - DNA, 25 bp, Mus musculus
ggtgagtatctcttgtgctctctga

SEQ ID NO: 719676 - DNA, 25 bp, Mus musculus
ggtgagtctcctagcaatcctgtga

SEQ ID NO: 719677 - DNA, 25 bp, Mus musculus
ggtgagtctccttgcaatcctgtga

SEQ ID NO: 719678 - DNA, 25 bp, Mus musculus
ggtgagtctgaactcggccatacga

SEQ ID NO: 719679 - DNA, 25 bp, Mus musculus
ggtgagtctgaagtcggccatacga

SEQ ID NO: 719680 - DNA, 25 bp, Mus musculus
ggtgagtgaggcatttctgcttctt

SEQ ID NO: 719681 - DNA, 25 bp, Mus musculus
ggtgagtgaggcttttctgcttctt

SEQ ID NO: 719682 - DNA, 25 bp, Mus musculus
ggtgagtggcccatagcctgagaca

SEQ ID NO: 719683 - DNA, 25 bp, Mus musculus
ggtgagtggcccttagcctgagaca

SEQ ID NO: 719684 - DNA, 25 bp, Mus musculus
ggtgagtgtcagacatccctagggc

SEQ ID NO: 719685 - DNA, 25 bp, Mus musculus
ggtgagtgtcagtcatccctagggc

SEQ ID NO: 719686 - DNA, 25 bp, Mus musculus
ggtgagttggtgaaaacagaagact

SEQ ID NO: 719687 - DNA, 25 bp, Mus musculus
ggtgagttggtgtaaacagaagact

SEQ ID NO: 719688 - DNA, 25 bp, Mus musculus
ggtgagttttgcactccctaatcca

SEQ ID NO: 719689 - DNA, 25 bp, Mus musculus
ggtgagttttgctctccctaatcca

SEQ ID NO: 719690 - DNA, 25 bp, Mus musculus
ggtgataatcataaaatagtcagag

SEQ ID NO: 719691 - DNA, 25 bp, Mus musculus
ggtgataatcattaaatagtcagag

SEQ ID NO: 719692 - DNA, 25 bp, Mus musculus
ggtgatacaacgctcagagttcgct

SEQ ID NO: 719693 - DNA, 25 bp, Mus musculus
ggtgatacaacggtcagagttcgct

SEQ ID NO: 719694 - DNA, 25 bp, Mus musculus
ggtgatacacagcagaatcgttagc

SEQ ID NO: 719695 - DNA, 25 bp, Mus musculus
ggtgatacacaggagaatcgttagc

SEQ ID NO: 719696 - DNA, 25 bp, Mus musculus
ggtgataccactaaaagaagtgcac

SEQ ID NO: 719697 - DNA, 25 bp, Mus musculus
ggtgataccacttaaagaagtgcac

SEQ ID NO: 719698 - DNA, 25 bp, Mus musculus
ggtgatacccatagaagaatttcaa

SEQ ID NO: 719699 - DNA, 25 bp, Mus musculus
ggtgatacccattgaagaatttcaa

SEQ ID NO: 719700 - DNA, 25 bp, Mus musculus
ggtgatacctccctgaggatattca

SEQ ID NO: 719701 - DNA, 25 bp, Mus musculus
ggtgatacctccgtgaggatattca

SEQ ID NO: 719702 - DNA, 25 bp, Mus musculus
ggtgatagatgacacctccagtggt

SEQ ID NO: 719703 - DNA, 25 bp, Mus musculus
ggtgatagatgagacctccagtggt

SEQ ID NO: 719704 - DNA, 25 bp, Mus musculus
ggtgatagctctctctccatgtgtc

SEQ ID NO: 719705 - DNA, 25 bp, Mus musculus
ggtgatagctctgtctccatgtgtc

SEQ ID NO: 719706 - DNA, 25 bp, Mus musculus
ggtgatatcatcaggcttgcccctc

SEQ ID NO: 719707 - DNA, 25 bp, Mus musculus
ggtgatatcatctggcttgcccctc

SEQ ID NO: 719708 - DNA, 25 bp, Mus musculus
ggtgatatccagctgacccacgtgc

SEQ ID NO: 719709 - DNA, 25 bp, Mus musculus
ggtgatatccaggtgacccacgtgc

SEQ ID NO: 719710 - DNA, 25 bp, Mus musculus
ggtgatcaaaacatctacccgacag

SEQ ID NO: 719711 - DNA, 25 bp, Mus musculus
ggtgatcaaaacttctacccgacag

SEQ ID NO: 719712 - DNA, 25 bp, Mus musculus
ggtgatcaccgactgtgcctccatt

SEQ ID NO: 719713 - DNA, 25 bp, Mus musculus
ggtgatcaccgagtgtgcctccatt

SEQ ID NO: 719714 - DNA, 25 bp, Mus musculus
ggtgatcaccgcatttggtccagga

SEQ ID NO: 719715 - DNA, 25 bp, Mus musculus
ggtgatcaccgcttttggtccagga

SEQ ID NO: 719716 - DNA, 25 bp, Mus musculus
ggtgatcatcaaagacgacctggat

SEQ ID NO: 719717 - DNA, 25 bp, Mus musculus
ggtgatcatcaatgacgacctggat

SEQ ID NO: 719718 - DNA, 25 bp, Mus musculus
ggtgatcatgcaacagctgctttgg

SEQ ID NO: 719719 - DNA, 25 bp, Mus musculus
ggtgatcatgcatcagctgctttgg

SEQ ID NO: 719720 - DNA, 25 bp, Mus musculus
ggtgatcattatacaggcatgccgt

SEQ ID NO: 719721 - DNA, 25 bp, Mus musculus
ggtgatcattattcaggcatgccgt

SEQ ID NO: 719722 - DNA, 25 bp, Mus musculus
ggtgatcatttgatcttctcaggct

SEQ ID NO: 719723 - DNA, 25 bp, Mus musculus
ggtgatcatttgttcttctcaggct

SEQ ID NO: 719724 - DNA, 25 bp, Mus musculus
ggtgatcccgagagtgccctatctc

SEQ ID NO: 719725 - DNA, 25 bp, Mus musculus
ggtgatcccgagtgtgccctatctc

SEQ ID NO: 719726 - DNA, 25 bp, Mus musculus
ggtgatccgagcacacatcttaggc

SEQ ID NO: 719727 - DNA, 25 bp, Mus musculus
ggtgatccgagctcacatcttaggc

SEQ ID NO: 719728 - DNA, 25 bp, Mus musculus
ggtgatccgggcctccttttctcag

SEQ ID NO: 719729 - DNA, 25 bp, Mus musculus
ggtgatccgggcgtccttttctcag

SEQ ID NO: 719730 - DNA, 25 bp, Mus musculus
ggtgatcctcccagagtctctgtgt

SEQ ID NO: 719731 - DNA, 25 bp, Mus musculus
ggtgatcctccctgagtctctgtgt

SEQ ID NO: 719732 - DNA, 25 bp, Mus musculus
ggtgatcgatgccaaacccatctgg

SEQ ID NO: 719733 - DNA, 25 bp, Mus musculus
ggtgatcgatgcgaaacccatctgg

SEQ ID NO: 719734 - DNA, 25 bp, Mus musculus
ggtgatcgggaacaacatccagctg

SEQ ID NO: 719735 - DNA, 25 bp, Mus musculus
ggtgatcgggaagaacatccagctg

SEQ ID NO: 719736 - DNA, 25 bp, Mus musculus
ggtgatcgtcgaccaaggatgcttc

SEQ ID NO: 719737 - DNA, 25 bp, Mus musculus
ggtgatcgtcgagcaaggatgcttc

SEQ ID NO: 719738 - DNA, 25 bp, Mus musculus
ggtgatcgttttacatgacagtgac

SEQ ID NO: 719739 - DNA, 25 bp, Mus musculus
ggtgatcgtttttcatgacagtgac

SEQ ID NO: 719740 - DNA, 25 bp, Mus musculus
ggtgatctaatcaagcacgagagga

SEQ ID NO: 719741 - DNA, 25 bp, Mus musculus
ggtgatctaatctagcacgagagga

SEQ ID NO: 719742 - DNA, 25 bp, Mus musculus
ggtgatctctaacaagacgaaggaa

SEQ ID NO: 719743 - DNA, 25 bp, Mus musculus
ggtgatctctaagaagacgaaggaa

SEQ ID NO: 719744 - DNA, 25 bp, Mus musculus
ggtgatctgattccctgcaaaggct

SEQ ID NO: 719745 - DNA, 25 bp, Mus musculus
ggtgatctgattgcctgcaaaggct

SEQ ID NO: 719746 - DNA, 25 bp, Mus musculus
ggtgatctgcatctgctgcccttgg

SEQ ID NO: 719747 - DNA, 25 bp, Mus musculus
ggtgatctgcatgtgctgcccttgg

SEQ ID NO: 719748 - DNA, 25 bp, Mus musculus
ggtgatctgccacgtggagcaccct

SEQ ID NO: 719749 - DNA, 25 bp, Mus musculus
ggtgatctgccaggtggagcaccct

SEQ ID NO: 719750 - DNA, 25 bp, Mus musculus
ggtgatctgcttagcctgtttcctc

SEQ ID NO: 719751 - DNA, 25 bp, Mus musculus
ggtgatctgctttgcctgtttcctc

SEQ ID NO: 719752 - DNA, 25 bp, Mus musculus
ggtgatcttcacctacattcgaggt

SEQ ID NO: 719753 - DNA, 25 bp, Mus musculus
ggtgatcttcacgtacattcgaggt

SEQ ID NO: 719754 - DNA, 25 bp, Mus musculus
ggtgatctttcccagtcctgctgag

SEQ ID NO: 719755 - DNA, 25 bp, Mus musculus
ggtgatctttccgagtcctgctgag

SEQ ID NO: 719756 - DNA, 25 bp, Mus musculus
ggtgatctttgtcaagtccgtgcag

SEQ ID NO: 719757 - DNA, 25 bp, Mus musculus
ggtgatctttgtgaagtccgtgcag

SEQ ID NO: 719758 - DNA, 25 bp, Mus musculus
ggtgatgaagctaatcggaagacac

SEQ ID NO: 719759 - DNA, 25 bp, Mus musculus
ggtgatgaagcttatcggaagacac

SEQ ID NO: 719760 - DNA, 25 bp, Mus musculus
ggtgatgacagaagccctcgtgagc

SEQ ID NO: 719761 - DNA, 25 bp, Mus musculus
ggtgatgacagatgccctcgtgagc

SEQ ID NO: 719762 - DNA, 25 bp, Mus musculus
ggtgatgaccttactcttcaggagc

SEQ ID NO: 719763 - DNA, 25 bp, Mus musculus
ggtgatgacctttctcttcaggagc

SEQ ID NO: 719764 - DNA, 25 bp, Mus musculus
ggtgatgagcagagccacacgtgac

SEQ ID NO: 719765 - DNA, 25 bp, Mus musculus
ggtgatgagcagtgccacacgtgac

SEQ ID NO: 719766 - DNA, 25 bp, Mus musculus
ggtgatgatggaagactataaggat

SEQ ID NO: 719767 - DNA, 25 bp, Mus musculus
ggtgatgatggatgactataaggat

SEQ ID NO: 719768 - DNA, 25 bp, Mus musculus
ggtgatgatttaacaacagccattc

SEQ ID NO: 719769 - DNA, 25 bp, Mus musculus
ggtgatgatttatcaacagccattc

SEQ ID NO: 719770 - DNA, 25 bp, Mus musculus
ggtgatgcctctctgtatcccaggc

SEQ ID NO: 719771 - DNA, 25 bp, Mus musculus
ggtgatgcctctgtgtatcccaggc

SEQ ID NO: 719772 - DNA, 25 bp, Mus musculus
ggtgatgctcatacccacggtcatg

SEQ ID NO: 719773 - DNA, 25 bp, Mus musculus
ggtgatgctcattcccacggtcatg

SEQ ID NO: 719774 - DNA, 25 bp, Mus musculus
ggtgatgctcctccccagggactag

SEQ ID NO: 719775 - DNA, 25 bp, Mus musculus
ggtgatgctcctgcccagggactag

SEQ ID NO: 719776 - DNA, 25 bp, Mus musculus
ggtgatgctgacagggacactgtct

SEQ ID NO: 719777 - DNA, 25 bp, Mus musculus
ggtgatgctgactgggacactgtct

SEQ ID NO: 719778 - DNA, 25 bp, Mus musculus
ggtgatgctgcccaactcccctgag

SEQ ID NO: 719779 - DNA, 25 bp, Mus musculus
ggtgatgctgccgaactcccctgag

SEQ ID NO: 719780 - DNA, 25 bp, Mus musculus
ggtgatgcttccagcccaagagacg

SEQ ID NO: 719781 - DNA, 25 bp, Mus musculus
ggtgatgcttcccactccagtgctc

SEQ ID NO: 719782 - DNA, 25 bp, Mus musculus
ggtgatgcttccgactccagtgctc

SEQ ID NO: 719783 - DNA, 25 bp, Mus musculus
ggtgatgcttcctgcccaagagacg

SEQ ID NO: 719784 - DNA, 25 bp, Mus musculus
ggtgatggcaccacctcagtgaccc

SEQ ID NO: 719785 - DNA, 25 bp, Mus musculus
ggtgatggcacctcctcagtgaccc

SEQ ID NO: 719786 - DNA, 25 bp, Mus musculus
ggtgatggcccgagcacactcgaat

SEQ ID NO: 719787 - DNA, 25 bp, Mus musculus
ggtgatggcccgtgcacactcgaat

SEQ ID NO: 719788 - DNA, 25 bp, Mus musculus
ggtgatggtcacacgtagcctatgt

SEQ ID NO: 719789 - DNA, 25 bp, Mus musculus
ggtgatggtcactcgtagcctatgt

SEQ ID NO: 719790 - DNA, 25 bp, Mus musculus
ggtgatgtaacaattctacctaaat

SEQ ID NO: 719791 - DNA, 25 bp, Mus musculus
ggtgatgtaacatttctacctaaat

SEQ ID NO: 719792 - DNA, 25 bp, Mus musculus
ggtgatgtatgaaggaaagaaaatc

SEQ ID NO: 719793 - DNA, 25 bp, Mus musculus
ggtgatgtatgatggaaagaaaatc

SEQ ID NO: 719794 - DNA, 25 bp, Mus musculus
ggtgatgtccagattacctgtgaga

SEQ ID NO: 719795 - DNA, 25 bp, Mus musculus
ggtgatgtccagtttacctgtgaga

SEQ ID NO: 719796 - DNA, 25 bp, Mus musculus
ggtgatgtcggccatcacagtgatc

SEQ ID NO: 719797 - DNA, 25 bp, Mus musculus
ggtgatgtcggcgatcacagtgatc

SEQ ID NO: 719798 - DNA, 25 bp, Mus musculus
ggtgatgttcaaaccctccttgaag

SEQ ID NO: 719799 - DNA, 25 bp, Mus musculus
ggtgatgttcaatccctccttgaag

SEQ ID NO: 719800 - DNA, 25 bp, Mus musculus
ggtgatgtttgtctctgtgttctgc

SEQ ID NO: 719801 - DNA, 25 bp, Mus musculus
ggtgatgtttgtgtctgtgttctgc

SEQ ID NO: 719802 - DNA, 25 bp, Mus musculus
ggtgattacattccggtgaatccac

SEQ ID NO: 719803 - DNA, 25 bp, Mus musculus
ggtgattacattgcggtgaatccac

SEQ ID NO: 719804 - DNA, 25 bp, Mus musculus
ggtgattactatccctgtgcccggt

SEQ ID NO: 719805 - DNA, 25 bp, Mus musculus
ggtgattactatgcctgtgcccggt

SEQ ID NO: 719806 - DNA, 25 bp, Mus musculus
ggtgattatcacatccgtctatgtt

SEQ ID NO: 719807 - DNA, 25 bp, Mus musculus
ggtgattatcacttccgtctatgtt

SEQ ID NO: 719808 - DNA, 25 bp, Mus musculus
ggtgattatgctactaggcaacaag

SEQ ID NO: 719809 - DNA, 25 bp, Mus musculus
ggtgattatgcttctaggcaacaag

SEQ ID NO: 719810 - DNA, 25 bp, Mus musculus
ggtgattcagcaagccgctctctct

SEQ ID NO: 719811 - DNA, 25 bp, Mus musculus
ggtgattcagcatgccgctctctct

SEQ ID NO: 719812 - DNA, 25 bp, Mus musculus
ggtgattccataaatccaccacacc

SEQ ID NO: 719813 - DNA, 25 bp, Mus musculus
ggtgattccatatatccaccacacc

SEQ ID NO: 719814 - DNA, 25 bp, Mus musculus
ggtgattcctgaacccgtcagctgt

SEQ ID NO: 719815 - DNA, 25 bp, Mus musculus
ggtgattcctgatcccgtcagctgt

SEQ ID NO: 719816 - DNA, 25 bp, Mus musculus
ggtgattctgctcctgaccaattct

SEQ ID NO: 719817 - DNA, 25 bp, Mus musculus
ggtgattctgctgctgaccaattct

SEQ ID NO: 719818 - DNA, 25 bp, Mus musculus
ggtgattgaaaaacgggctctaaaa

SEQ ID NO: 719819 - DNA, 25 bp, Mus musculus
ggtgattgaaaatcgggctctaaaa

SEQ ID NO: 719820 - DNA, 25 bp, Mus musculus
ggtgattgacctcgaacgggcctac

SEQ ID NO: 719821 - DNA, 25 bp, Mus musculus
ggtgattgacctggaacgggcctac

SEQ ID NO: 719822 - DNA, 25 bp, Mus musculus
ggtgatttcccaccagttcagaagc

SEQ ID NO: 719823 - DNA, 25 bp, Mus musculus
ggtgatttcccagcagttcagaagc

SEQ ID NO: 719824 - DNA, 25 bp, Mus musculus
ggtgcaaagttaccagccgccctgg

SEQ ID NO: 719825 - DNA, 25 bp, Mus musculus
ggtgcaaagttagcagccgccctgg

SEQ ID NO: 719826 - DNA, 25 bp, Mus musculus
ggtgcaaatgcaactgtccgcgcta

SEQ ID NO: 719827 - DNA, 25 bp, Mus musculus
ggtgcaaatgcatctgtccgcgcta

SEQ ID NO: 719828 - DNA, 25 bp, Mus musculus
ggtgcaacccgcatacgaggcggtc

SEQ ID NO: 719829 - DNA, 25 bp, Mus musculus
ggtgcaacccgcttacgaggcggtc

SEQ ID NO: 719830 - DNA, 25 bp, Mus musculus
ggtgcaactctcatcttcggaaggc

SEQ ID NO: 719831 - DNA, 25 bp, Mus musculus
ggtgcaactctcttcttcggaaggc

SEQ ID NO: 719832 - DNA, 25 bp, Mus musculus
ggtgcaactggactttgattagcag

SEQ ID NO: 719833 - DNA, 25 bp, Mus musculus
ggtgcaactggagtttgattagcag

SEQ ID NO: 719834 - DNA, 25 bp, Mus musculus
ggtgcaatggacacgacatatggag

SEQ ID NO: 719835 - DNA, 25 bp, Mus musculus
ggtgcaatggactcgacatatggag

SEQ ID NO: 719836 - DNA, 25 bp, Mus musculus
ggtgcaattgaaacccaagcaccag

SEQ ID NO: 719837 - DNA, 25 bp, Mus musculus
ggtgcaattgaatcccaagcaccag

SEQ ID NO: 719838 - DNA, 25 bp, Mus musculus
ggtgcacaagatcacgtggaaacgt

SEQ ID NO: 719839 - DNA, 25 bp, Mus musculus
ggtgcacaagatgacgtggaaacgt

SEQ ID NO: 719840 - DNA, 25 bp, Mus musculus
ggtgcacaatttcttccctgaggct

SEQ ID NO: 719841 - DNA, 25 bp, Mus musculus
ggtgcacaatttgttccctgaggct

SEQ ID NO: 719842 - DNA, 25 bp, Mus musculus
ggtgcacacctcaccttgccaaata

SEQ ID NO: 719843 - DNA, 25 bp, Mus musculus
ggtgcacacctctccttgccaaata

SEQ ID NO: 719844 - DNA, 25 bp, Mus musculus
ggtgcacagtgcacttctgaccggc

SEQ ID NO: 719845 - DNA, 25 bp, Mus musculus
ggtgcacagtgctcttctgaccggc

SEQ ID NO: 719846 - DNA, 25 bp, Mus musculus
ggtgcacatcgcctgccacaagaag

SEQ ID NO: 719847 - DNA, 25 bp, Mus musculus
ggtgcacatcgcgtgccacaagaag

SEQ ID NO: 719848 - DNA, 25 bp, Mus musculus
ggtgcacatctcattctgtctccag

SEQ ID NO: 719849 - DNA, 25 bp, Mus musculus
ggtgcacatctctttctgtctccag

SEQ ID NO: 719850 - DNA, 25 bp, Mus musculus
ggtgcacatgcaaggacttcctgag

SEQ ID NO: 719851 - DNA, 25 bp, Mus musculus
ggtgcacatgcatggacttcctgag

SEQ ID NO: 719852 - DNA, 25 bp, Mus musculus
ggtgcacccttgagaacttcacctt

SEQ ID NO: 719853 - DNA, 25 bp, Mus musculus
ggtgcacccttgtgaacttcacctt

SEQ ID NO: 719854 - DNA, 25 bp, Mus musculus
ggtgcaccgcgacctgaaacccgag

SEQ ID NO: 719855 - DNA, 25 bp, Mus musculus
ggtgcaccgcgagctgaaacccgag

SEQ ID NO: 719856 - DNA, 25 bp, Mus musculus
ggtgcaccgtatcctactagagaaa

SEQ ID NO: 719857 - DNA, 25 bp, Mus musculus
ggtgcaccgtatgctactagagaaa

SEQ ID NO: 719858 - DNA, 25 bp, Mus musculus
ggtgcaccgtggaagagccatgtct

SEQ ID NO: 719859 - DNA, 25 bp, Mus musculus
ggtgcaccgtggtagagccatgtct

SEQ ID NO: 719860 - DNA, 25 bp, Mus musculus
ggtgcacctttcaacacaacctaca

SEQ ID NO: 719861 - DNA, 25 bp, Mus musculus
ggtgcacctttctacacaacctaca

SEQ ID NO: 719862 - DNA, 25 bp, Mus musculus
ggtgcacgggctctttgacagttca

SEQ ID NO: 719863 - DNA, 25 bp, Mus musculus
ggtgcacgggctgtttgacagttca

SEQ ID NO: 719864 - DNA, 25 bp, Mus musculus
ggtgcacgtccgagttctggcctca

SEQ ID NO: 719865 - DNA, 25 bp, Mus musculus
ggtgcacgtccgtgttctggcctca

SEQ ID NO: 719866 - DNA, 25 bp, Mus musculus
ggtgcacttcaacgaaacccagttt

SEQ ID NO: 719867 - DNA, 25 bp, Mus musculus
ggtgcacttcaaggaaacccagttt

SEQ ID NO: 719868 - DNA, 25 bp, Mus musculus
ggtgcagaacataacatcccggttg

SEQ ID NO: 719869 - DNA, 25 bp, Mus musculus
ggtgcagaacattacatcccggttg

SEQ ID NO: 719870 - DNA, 25 bp, Mus musculus
ggtgcagaatataggtggtatcttc

SEQ ID NO: 719871 - DNA, 25 bp, Mus musculus
ggtgcagaatattggtggtatcttc

SEQ ID NO: 719872 - DNA, 25 bp, Mus musculus
ggtgcagaatctattgttaacgaga

SEQ ID NO: 719873 - DNA, 25 bp, Mus musculus
ggtgcagaatcttttgttaacgaga

SEQ ID NO: 719874 - DNA, 25 bp, Mus musculus
ggtgcagacagccagtctcacgcac

SEQ ID NO: 719875 - DNA, 25 bp, Mus musculus
ggtgcagacagcgagtctcacgcac

SEQ ID NO: 719876 - DNA, 25 bp, Mus musculus
ggtgcagaccccacagtcgatgcca

SEQ ID NO: 719877 - DNA, 25 bp, Mus musculus
ggtgcagacccctcagtcgatgcca

SEQ ID NO: 719878 - DNA, 25 bp, Mus musculus
ggtgcagactgaaaccctttgtaac

SEQ ID NO: 719879 - DNA, 25 bp, Mus musculus
ggtgcagactgataccctttgtaac

SEQ ID NO: 719880 - DNA, 25 bp, Mus musculus
ggtgcagagattccgtccagacttc

SEQ ID NO: 719881 - DNA, 25 bp, Mus musculus
ggtgcagagattgcgtccagacttc

SEQ ID NO: 719882 - DNA, 25 bp, Mus musculus
ggtgcagatcacacaggacagcgag

SEQ ID NO: 719883 - DNA, 25 bp, Mus musculus
ggtgcagatcactcaggacagcgag

SEQ ID NO: 719884 - DNA, 25 bp, Mus musculus
ggtgcagatccccagcttctaggaa

SEQ ID NO: 719885 - DNA, 25 bp, Mus musculus
ggtgcagatcccgagcttctaggaa

SEQ ID NO: 719886 - DNA, 25 bp, Mus musculus
ggtgcagcagctcgactctcacgtg

SEQ ID NO: 719887 - DNA, 25 bp, Mus musculus
ggtgcagcagctggactctcacgtg

SEQ ID NO: 719888 - DNA, 25 bp, Mus musculus
ggtgcagcctagactatctttaggc

SEQ ID NO: 719889 - DNA, 25 bp, Mus musculus
ggtgcagcctagtctatctttaggc

SEQ ID NO: 719890 - DNA, 25 bp, Mus musculus
ggtgcagccttacggaattctaggt

SEQ ID NO: 719891 - DNA, 25 bp, Mus musculus
ggtgcagccttagggaattctaggt

SEQ ID NO: 719892 - DNA, 25 bp, Mus musculus
ggtgcagcgttaagtggcctgtcac

SEQ ID NO: 719893 - DNA, 25 bp, Mus musculus
ggtgcagcgttatgtggcctgtcac

SEQ ID NO: 719894 - DNA, 25 bp, Mus musculus
ggtgcagctcatcatggatgcttat

SEQ ID NO: 719895 - DNA, 25 bp, Mus musculus
ggtgcagctcatgatggatgcttat

SEQ ID NO: 719896 - DNA, 25 bp, Mus musculus
ggtgcagctgacagacatatcagaa

SEQ ID NO: 719897 - DNA, 25 bp, Mus musculus
ggtgcagctgactgacatatcagaa

SEQ ID NO: 719898 - DNA, 25 bp, Mus musculus
ggtgcagctgtaaatatacccagag

SEQ ID NO: 719899 - DNA, 25 bp, Mus musculus
ggtgcagctgtatatatacccagag

SEQ ID NO: 719900 - DNA, 25 bp, Mus musculus
ggtgcagctttcagaaaactcgagt

SEQ ID NO: 719901 - DNA, 25 bp, Mus musculus
ggtgcagctttctgaaaactcgagt

SEQ ID NO: 719902 - DNA, 25 bp, Mus musculus
ggtgcaggaccaataaccaaagtca

SEQ ID NO: 719903 - DNA, 25 bp, Mus musculus
ggtgcaggaccattaaccaaagtca

SEQ ID NO: 719904 - DNA, 25 bp, Mus musculus
ggtgcaggagtacccgaccctcaag

SEQ ID NO: 719905 - DNA, 25 bp, Mus musculus
ggtgcaggagtagccgaccctcaag

SEQ ID NO: 719906 - DNA, 25 bp, Mus musculus
ggtgcaggtcagagctaaggagcca

SEQ ID NO: 719907 - DNA, 25 bp, Mus musculus
ggtgcaggtcagtgctaaggagcca

SEQ ID NO: 719908 - DNA, 25 bp, Mus musculus
ggtgcaggtggcatgtccacgcctc

SEQ ID NO: 719909 - DNA, 25 bp, Mus musculus
ggtgcaggtggcttgtccacgcctc

SEQ ID NO: 719910 - DNA, 25 bp, Mus musculus
ggtgcagtgctactttatggccttc

SEQ ID NO: 719911 - DNA, 25 bp, Mus musculus
ggtgcagtgctagtttatggccttc

SEQ ID NO: 719912 - DNA, 25 bp, Mus musculus
ggtgcagtggcaacagctgacagtt

SEQ ID NO: 719913 - DNA, 25 bp, Mus musculus
ggtgcagtggcatcagctgacagtt

SEQ ID NO: 719914 - DNA, 25 bp, Mus musculus
ggtgcagtgtccatatgggcccaaa

SEQ ID NO: 719915 - DNA, 25 bp, Mus musculus
ggtgcagtgtccttatgggcccaaa

SEQ ID NO: 719916 - DNA, 25 bp, Mus musculus
ggtgcagttcagcaacaagtcagca

SEQ ID NO: 719917 - DNA, 25 bp, Mus musculus
ggtgcagttcaggaacaagtcagca

SEQ ID NO: 719918 - DNA, 25 bp, Mus musculus
ggtgcatagcaaatcccaggaatct

SEQ ID NO: 719919 - DNA, 25 bp, Mus musculus
ggtgcatagcaattcccaggaatct

SEQ ID NO: 719920 - DNA, 25 bp, Mus musculus
ggtgcatatgtgacacacctgagta

SEQ ID NO: 719921 - DNA, 25 bp, Mus musculus
ggtgcatatgtgtcacacctgagta

SEQ ID NO: 719922 - DNA, 25 bp, Mus musculus
ggtgcatcaacaaggaaggctcctt

SEQ ID NO: 719923 - DNA, 25 bp, Mus musculus
ggtgcatcaacatggaaggctcctt

SEQ ID NO: 719924 - DNA, 25 bp, Mus musculus
ggtgcatcaagcattgaaccacgat

SEQ ID NO: 719925 - DNA, 25 bp, Mus musculus
ggtgcatcaagccacggtcacagtc

SEQ ID NO: 719926 - DNA, 25 bp, Mus musculus
ggtgcatcaagcgacggtcacagtc

SEQ ID NO: 719927 - DNA, 25 bp, Mus musculus
ggtgcatcaagctttgaaccacgat

SEQ ID NO: 719928 - DNA, 25 bp, Mus musculus
ggtgcatcaataccagccctggctt

SEQ ID NO: 719929 - DNA, 25 bp, Mus musculus
ggtgcatcaatagcagccctggctt

SEQ ID NO: 719930 - DNA, 25 bp, Mus musculus
ggtgcatcagtgcatcgcagttgca

SEQ ID NO: 719931 - DNA, 25 bp, Mus musculus
ggtgcatcagtggatcgcagttgca

SEQ ID NO: 719932 - DNA, 25 bp, Mus musculus
ggtgcatccatcagtacacttgctg

SEQ ID NO: 719933 - DNA, 25 bp, Mus musculus
ggtgcatccatctgtacacttgctg

SEQ ID NO: 719934 - DNA, 25 bp, Mus musculus
ggtgcatcttcaaaggcctgggaga

SEQ ID NO: 719935 - DNA, 25 bp, Mus musculus
ggtgcatcttcataggcctgggaga

SEQ ID NO: 719936 - DNA, 25 bp, Mus musculus
ggtgcatgtattcaaggagtcgttc

SEQ ID NO: 719937 - DNA, 25 bp, Mus musculus
ggtgcatgtattgaaggagtcgttc

SEQ ID NO: 719938 - DNA, 25 bp, Mus musculus
ggtgcatgtcaacaaggccctcaaa

SEQ ID NO: 719939 - DNA, 25 bp, Mus musculus
ggtgcatgtcaagaaggccctcaaa

SEQ ID NO: 719940 - DNA, 25 bp, Mus musculus
ggtgcattcagcctttggtgatcct

SEQ ID NO: 719941 - DNA, 25 bp, Mus musculus
ggtgcattcagcgtttggtgatcct

SEQ ID NO: 719942 - DNA, 25 bp, Mus musculus
ggtgcattgctcagaccccattacc

SEQ ID NO: 719943 - DNA, 25 bp, Mus musculus
ggtgcattgctctgaccccattacc

SEQ ID NO: 719944 - DNA, 25 bp, Mus musculus
ggtgcattgtggcaaactcctgagc

SEQ ID NO: 719945 - DNA, 25 bp, Mus musculus
ggtgcattgtgggaaactcctgagc

SEQ ID NO: 719946 - DNA, 25 bp, Mus musculus
ggtgcatttcaaactgattctgcag

SEQ ID NO: 719947 - DNA, 25 bp, Mus musculus
ggtgcatttcaatctgattctgcag

SEQ ID NO: 719948 - DNA, 25 bp, Mus musculus
ggtgccaaaaagaaaagtccctgct

SEQ ID NO: 719949 - DNA, 25 bp, Mus musculus
ggtgccaaaaagtaaagtccctgct

SEQ ID NO: 719950 - DNA, 25 bp, Mus musculus
ggtgccaaagatcgctgaatttacg

SEQ ID NO: 719951 - DNA, 25 bp, Mus musculus
ggtgccaaagatggctgaatttacg

SEQ ID NO: 719952 - DNA, 25 bp, Mus musculus
ggtgccaaaggaacaggtctatgct

SEQ ID NO: 719953 - DNA, 25 bp, Mus musculus
ggtgccaaaggatcaggtctatgct

SEQ ID NO: 719954 - DNA, 25 bp, Mus musculus
ggtgccaacactcgtatacctggtc

SEQ ID NO: 719955 - DNA, 25 bp, Mus musculus
ggtgccaacactggtatacctggtc

SEQ ID NO: 719956 - DNA, 25 bp, Mus musculus
ggtgccaaccagaggatcaagttta

SEQ ID NO: 719957 - DNA, 25 bp, Mus musculus
ggtgccaaccagtggatcaagttta

SEQ ID NO: 719958 - DNA, 25 bp, Mus musculus
ggtgccaacccactccaggtggaaa

SEQ ID NO: 719959 - DNA, 25 bp, Mus musculus
ggtgccaacccagtccaggtggaaa

SEQ ID NO: 719960 - DNA, 25 bp, Mus musculus
ggtgccaacgtaaccttcttccaaa

SEQ ID NO: 719961 - DNA, 25 bp, Mus musculus
ggtgccaacgtatccttcttccaaa

SEQ ID NO: 719962 - DNA, 25 bp, Mus musculus
ggtgccaagctcaggcctcagaagg

SEQ ID NO: 719963 - DNA, 25 bp, Mus musculus
ggtgccaagctctggcctcagaagg

SEQ ID NO: 719964 - DNA, 25 bp, Mus musculus
ggtgccaagctgctctacgcgttcg

SEQ ID NO: 719965 - DNA, 25 bp, Mus musculus
ggtgccaagctggtctacgcgttcg

SEQ ID NO: 719966 - DNA, 25 bp, Mus musculus
ggtgccaatcaaaatacctttcatc

SEQ ID NO: 719967 - DNA, 25 bp, Mus musculus
ggtgccaatcaatatacctttcatc

SEQ ID NO: 719968 - DNA, 25 bp, Mus musculus
ggtgccacaagaattggtggctctt

SEQ ID NO: 719969 - DNA, 25 bp, Mus musculus
ggtgccacaagatttggtggctctt

SEQ ID NO: 719970 - DNA, 25 bp, Mus musculus
ggtgccacaagtaacctgggaagat

SEQ ID NO: 719971 - DNA, 25 bp, Mus musculus
ggtgccacaagttacctgggaagat

SEQ ID NO: 719972 - DNA, 25 bp, Mus musculus
ggtgccacagagagtatcagtccca

SEQ ID NO: 719973 - DNA, 25 bp, Mus musculus
ggtgccacagagtgtatcagtccca

SEQ ID NO: 719974 - DNA, 25 bp, Mus musculus
ggtgccacaggtcttgcttgcgcca

SEQ ID NO: 719975 - DNA, 25 bp, Mus musculus
ggtgccacaggtgttgcttgcgcca

SEQ ID NO: 719976 - DNA, 25 bp, Mus musculus
ggtgccaccgcccataatgaagtcc

SEQ ID NO: 719977 - DNA, 25 bp, Mus musculus
ggtgccaccgccgataatgaagtcc

SEQ ID NO: 719978 - DNA, 25 bp, Mus musculus
ggtgccacttccatttctaactcta

SEQ ID NO: 719979 - DNA, 25 bp, Mus musculus
ggtgccacttccttttctaactcta

SEQ ID NO: 719980 - DNA, 25 bp, Mus musculus
ggtgccagacgtatagcccgtagtc

SEQ ID NO: 719981 - DNA, 25 bp, Mus musculus
ggtgccagacgtttagcccgtagtc

SEQ ID NO: 719982 - DNA, 25 bp, Mus musculus
ggtgccagcaacaagctgcatatgg

SEQ ID NO: 719983 - DNA, 25 bp, Mus musculus
ggtgccagcaactagctgcatatgg

SEQ ID NO: 719984 - DNA, 25 bp, Mus musculus
ggtgccagcactcagggaccccgtt

SEQ ID NO: 719985 - DNA, 25 bp, Mus musculus
ggtgccagcactgagggaccccgtt

SEQ ID NO: 719986 - DNA, 25 bp, Mus musculus
ggtgccagtgcccatgcacggctat

SEQ ID NO: 719987 - DNA, 25 bp, Mus musculus
ggtgccagtgccgatgcacggctat

SEQ ID NO: 719988 - DNA, 25 bp, Mus musculus
ggtgccatatgacaaaatcaggacg

SEQ ID NO: 719989 - DNA, 25 bp, Mus musculus
ggtgccatatgagaaaatcaggacg

SEQ ID NO: 719990 - DNA, 25 bp, Mus musculus
ggtgccatcactcctgctggtgcat

SEQ ID NO: 719991 - DNA, 25 bp, Mus musculus
ggtgccatcactgctgctggtgcat

SEQ ID NO: 719992 - DNA, 25 bp, Mus musculus
ggtgccatgataacaagtcccgact

SEQ ID NO: 719993 - DNA, 25 bp, Mus musculus
ggtgccatgatatcaagtcccgact

SEQ ID NO: 719994 - DNA, 25 bp, Mus musculus
ggtgccattgagctggtccaagaca

SEQ ID NO: 719995 - DNA, 25 bp, Mus musculus
ggtgccattgaggtggtccaagaca

SEQ ID NO: 719996 - DNA, 25 bp, Mus musculus
ggtgccattggcaaattcacagctc

SEQ ID NO: 719997 - DNA, 25 bp, Mus musculus
ggtgccattggctaattcacagctc

SEQ ID NO: 719998 - DNA, 25 bp, Mus musculus
ggtgccatttctactatagttcttc

SEQ ID NO: 719999 - DNA, 25 bp, Mus musculus
ggtgccatttcttctatagttcttc

SEQ ID NO: 720000 - DNA, 25 bp, Mus musculus
ggtgcccaacatcatgtcctacagc

SEQ ID NO: 720001 - DNA, 25 bp, Mus musculus
ggtgcccaacatgatgtcctacagc

SEQ ID NO: 720002 - DNA, 25 bp, Mus musculus
ggtgcccaagcgacgtcaggctgcc

SEQ ID NO: 720003 - DNA, 25 bp, Mus musculus
ggtgcccaagcgtcgtcaggctgcc

SEQ ID NO: 720004 - DNA, 25 bp, Mus musculus
ggtgcccacagtctacatgaaggtg

SEQ ID NO: 720005 - DNA, 25 bp, Mus musculus
ggtgcccacagtgtacatgaaggtg

SEQ ID NO: 720006 - DNA, 25 bp, Mus musculus
ggtgcccaccatctacaggcaaaca

SEQ ID NO: 720007 - DNA, 25 bp, Mus musculus
ggtgcccaccatgtacaggcaaaca

SEQ ID NO: 720008 - DNA, 25 bp, Mus musculus
ggtgcccaccctctttcagagtctg

SEQ ID NO: 720009 - DNA, 25 bp, Mus musculus
ggtgcccaccctgtttcagagtctg

SEQ ID NO: 720010 - DNA, 25 bp, Mus musculus
ggtgcccacgggaactgtatcagct

SEQ ID NO: 720011 - DNA, 25 bp, Mus musculus
ggtgcccacgggtactgtatcagct

SEQ ID NO: 720012 - DNA, 25 bp, Mus musculus
ggtgcccagtctctccaagctgctg

SEQ ID NO: 720013 - DNA, 25 bp, Mus musculus
ggtgcccagtctgtccaagctgctg

SEQ ID NO: 720014 - DNA, 25 bp, Mus musculus
ggtgcccatccaccgagttgcagac

SEQ ID NO: 720015 - DNA, 25 bp, Mus musculus
ggtgcccatccagcgagttgcagac

SEQ ID NO: 720016 - DNA, 25 bp, Mus musculus
ggtgcccctactacctggctcgata

SEQ ID NO: 720017 - DNA, 25 bp, Mus musculus
ggtgcccctacttcctggctcgata

SEQ ID NO: 720018 - DNA, 25 bp, Mus musculus
ggtgcccctcgcatgtcctgggagc

SEQ ID NO: 720019 - DNA, 25 bp, Mus musculus
ggtgcccctcgcttgtcctgggagc

SEQ ID NO: 720020 - DNA, 25 bp, Mus musculus
ggtgcccctgagcaaagaccttgtg

SEQ ID NO: 720021 - DNA, 25 bp, Mus musculus
ggtgcccctgaggaaagaccttgtg

SEQ ID NO: 720022 - DNA, 25 bp, Mus musculus
ggtgcccctggtcactatttcaaga

SEQ ID NO: 720023 - DNA, 25 bp, Mus musculus
ggtgcccctggtgactatttcaaga

SEQ ID NO: 720024 - DNA, 25 bp, Mus musculus
ggtgcccctgtcatgaatgtcgtca

SEQ ID NO: 720025 - DNA, 25 bp, Mus musculus
ggtgcccctgtcttgaatgtcgtca

SEQ ID NO: 720026 - DNA, 25 bp, Mus musculus
ggtgccccttctcggacattttcaa

SEQ ID NO: 720027 - DNA, 25 bp, Mus musculus
ggtgccccttctgggacattttcaa

SEQ ID NO: 720028 - DNA, 25 bp, Mus musculus
ggtgcccgcccaatcctaaggatgc

SEQ ID NO: 720029 - DNA, 25 bp, Mus musculus
ggtgcccgcccattcctaaggatgc

SEQ ID NO: 720030 - DNA, 25 bp, Mus musculus
ggtgcccgcgcacaagttctcagcg

SEQ ID NO: 720031 - DNA, 25 bp, Mus musculus
ggtgcccgcgcagaagttctcagcg

SEQ ID NO: 720032 - DNA, 25 bp, Mus musculus
ggtgcccgctgcaccctacgtcacc

SEQ ID NO: 720033 - DNA, 25 bp, Mus musculus
ggtgcccgctgctccctacgtcacc

SEQ ID NO: 720034 - DNA, 25 bp, Mus musculus
ggtgcccgtgcaaaagccatcggat

SEQ ID NO: 720035 - DNA, 25 bp, Mus musculus
ggtgcccgtgcataagccatcggat

SEQ ID NO: 720036 - DNA, 25 bp, Mus musculus
ggtgccctcgtaatatacttcatag

SEQ ID NO: 720037 - DNA, 25 bp, Mus musculus
ggtgccctcgtattatacttcatag

SEQ ID NO: 720038 - DNA, 25 bp, Mus musculus
ggtgccctctccaaacggtactggg

SEQ ID NO: 720039 - DNA, 25 bp, Mus musculus
ggtgccctctcctaacggtactggg

SEQ ID NO: 720040 - DNA, 25 bp, Mus musculus
ggtgccctgaagaatacagactact

SEQ ID NO: 720041 - DNA, 25 bp, Mus musculus
ggtgccctgaagtatacagactact

SEQ ID NO: 720042 - DNA, 25 bp, Mus musculus
ggtgccctgcgtcgagtctgttcct

SEQ ID NO: 720043 - DNA, 25 bp, Mus musculus
ggtgccctgcgtggagtctgttcct

SEQ ID NO: 720044 - DNA, 25 bp, Mus musculus
ggtgccctgtggcatcatggaccaa

SEQ ID NO: 720045 - DNA, 25 bp, Mus musculus
ggtgccctgtgggatcatggaccaa

SEQ ID NO: 720046 - DNA, 25 bp, Mus musculus
ggtgcccttcgaaggcatgtggctc

SEQ ID NO: 720047 - DNA, 25 bp, Mus musculus
ggtgcccttcgatggcatgtggctc

SEQ ID NO: 720048 - DNA, 25 bp, Mus musculus
ggtgccctttttcttttccatccat

SEQ ID NO: 720049 - DNA, 25 bp, Mus musculus
ggtgccctttttgttttccatccat

SEQ ID NO: 720050 - DNA, 25 bp, Mus musculus
ggtgccgacagaatcacagtactgt

SEQ ID NO: 720051 - DNA, 25 bp, Mus musculus
ggtgccgacagattcacagtactgt

SEQ ID NO: 720052 - DNA, 25 bp, Mus musculus
ggtgccgactctctgctgctgaatg

SEQ ID NO: 720053 - DNA, 25 bp, Mus musculus
ggtgccgactctgtgctgctgaatg

SEQ ID NO: 720054 - DNA, 25 bp, Mus musculus
ggtgccgatgctccctacgtctttg

SEQ ID NO: 720055 - DNA, 25 bp, Mus musculus
ggtgccgatgctgcctacgtctttg

SEQ ID NO: 720056 - DNA, 25 bp, Mus musculus
ggtgccgcctgaacagtactattgg

SEQ ID NO: 720057 - DNA, 25 bp, Mus musculus
ggtgccgcctgatcagtactattgg

SEQ ID NO: 720058 - DNA, 25 bp, Mus musculus
ggtgccgcctttactcagactcgaa

SEQ ID NO: 720059 - DNA, 25 bp, Mus musculus
ggtgccgccttttctcagactcgaa

SEQ ID NO: 720060 - DNA, 25 bp, Mus musculus
ggtgccgggtggagtccatttactt

SEQ ID NO: 720061 - DNA, 25 bp, Mus musculus
ggtgccgggtggtgtccatttactt

SEQ ID NO: 720062 - DNA, 25 bp, Mus musculus
ggtgcctaccacaatgctgtctatt

SEQ ID NO: 720063 - DNA, 25 bp, Mus musculus
ggtgcctaccactatgctgtctatt

SEQ ID NO: 720064 - DNA, 25 bp, Mus musculus
ggtgcctaggcaccggaatccaatt

SEQ ID NO: 720065 - DNA, 25 bp, Mus musculus
ggtgcctaggcagcggaatccaatt

SEQ ID NO: 720066 - DNA, 25 bp, Mus musculus
ggtgcctatctgcacaaggagagat

SEQ ID NO: 720067 - DNA, 25 bp, Mus musculus
ggtgcctatctggacaaggagagat

SEQ ID NO: 720068 - DNA, 25 bp, Mus musculus
ggtgcctattacattttccagatca

SEQ ID NO: 720069 - DNA, 25 bp, Mus musculus
ggtgcctattactttttccagatca

SEQ ID NO: 720070 - DNA, 25 bp, Mus musculus
ggtgcctcaccaaattataaaggcg

SEQ ID NO: 720071 - DNA, 25 bp, Mus musculus
ggtgcctcaccatattataaaggcg

SEQ ID NO: 720072 - DNA, 25 bp, Mus musculus
ggtgcctcagccaactggtggaacc

SEQ ID NO: 720073 - DNA, 25 bp, Mus musculus
ggtgcctcagcctactggtggaacc

SEQ ID NO: 720074 - DNA, 25 bp, Mus musculus
ggtgcctctgtcatctcagggctca

SEQ ID NO: 720075 - DNA, 25 bp, Mus musculus
ggtgcctctgtcttctcagggctca

SEQ ID NO: 720076 - DNA, 25 bp, Mus musculus
ggtgcctgacatcccaatacataat

SEQ ID NO: 720077 - DNA, 25 bp, Mus musculus
ggtgcctgacatgccaatacataat

SEQ ID NO: 720078 - DNA, 25 bp, Mus musculus
ggtgcctgagaaagacttcaacctc

SEQ ID NO: 720079 - DNA, 25 bp, Mus musculus
ggtgcctgagaatgacttcaacctc

SEQ ID NO: 720080 - DNA, 25 bp, Mus musculus
ggtgcctgagtcatcctaactaggg

SEQ ID NO: 720081 - DNA, 25 bp, Mus musculus
ggtgcctgagtcttcctaactaggg

SEQ ID NO: 720082 - DNA, 25 bp, Mus musculus
ggtgcctgcagactcttagacatgg

SEQ ID NO: 720083 - DNA, 25 bp, Mus musculus
ggtgcctgcagagtcttagacatgg

SEQ ID NO: 720084 - DNA, 25 bp, Mus musculus
ggtgcctgctgtacctaacatcctc

SEQ ID NO: 720085 - DNA, 25 bp, Mus musculus
ggtgcctgctgttcctaacatcctc

SEQ ID NO: 720086 - DNA, 25 bp, Mus musculus
ggtgcctggcgccagacaatccaat

SEQ ID NO: 720087 - DNA, 25 bp, Mus musculus
ggtgcctggcgcgagacaatccaat

SEQ ID NO: 720088 - DNA, 25 bp, Mus musculus
ggtgcctggctcaggccactcatga

SEQ ID NO: 720089 - DNA, 25 bp, Mus musculus
ggtgcctggctctggccactcatga

SEQ ID NO: 720090 - DNA, 25 bp, Mus musculus
ggtgcctggtctctccaccatggtc

SEQ ID NO: 720091 - DNA, 25 bp, Mus musculus
ggtgcctggtctgtccaccatggtc

SEQ ID NO: 720092 - DNA, 25 bp, Mus musculus
ggtgcctggttcagaccctttcctc

SEQ ID NO: 720093 - DNA, 25 bp, Mus musculus
ggtgcctggttctgaccctttcctc

SEQ ID NO: 720094 - DNA, 25 bp, Mus musculus
ggtgcctgtcctctcggatgactcc

SEQ ID NO: 720095 - DNA, 25 bp, Mus musculus
ggtgcctgtcctgtcggatgactcc

SEQ ID NO: 720096 - DNA, 25 bp, Mus musculus
ggtgcctgtgctcacgagactagca

SEQ ID NO: 720097 - DNA, 25 bp, Mus musculus
ggtgcctgtgctgacgagactagca

SEQ ID NO: 720098 - DNA, 25 bp, Mus musculus
ggtgccttaactctgggacgtgtac

SEQ ID NO: 720099 - DNA, 25 bp, Mus musculus
ggtgccttaactgtgggacgtgtac

SEQ ID NO: 720100 - DNA, 25 bp, Mus musculus
ggtgccttgcttacatactggacaa

SEQ ID NO: 720101 - DNA, 25 bp, Mus musculus
ggtgccttgctttcatactggacaa

SEQ ID NO: 720102 - DNA, 25 bp, Mus musculus
ggtgccttggcaaagcttaaagaaa

SEQ ID NO: 720103 - DNA, 25 bp, Mus musculus
ggtgccttggcatagcttaaagaaa

SEQ ID NO: 720104 - DNA, 25 bp, Mus musculus
ggtgcctttatcctgagagattcga

SEQ ID NO: 720105 - DNA, 25 bp, Mus musculus
ggtgcctttatcgtgagagattcga

SEQ ID NO: 720106 - DNA, 25 bp, Mus musculus
ggtgcctttgtaaagccatcagctg

SEQ ID NO: 720107 - DNA, 25 bp, Mus musculus
ggtgcctttgtatagccatcagctg

SEQ ID NO: 720108 - DNA, 25 bp, Mus musculus
ggtgcgagatccacagctagtgcgc

SEQ ID NO: 720109 - DNA, 25 bp, Mus musculus
ggtgcgagatcctcagctagtgcgc

SEQ ID NO: 720110 - DNA, 25 bp, Mus musculus
ggtgcgagatgcatacatcctcact

SEQ ID NO: 720111 - DNA, 25 bp, Mus musculus
ggtgcgagatgcttacatcctcact

SEQ ID NO: 720112 - DNA, 25 bp, Mus musculus
ggtgcgagcctaaatccagagcctg

SEQ ID NO: 720113 - DNA, 25 bp, Mus musculus
ggtgcgagcctatatccagagcctg

SEQ ID NO: 720114 - DNA, 25 bp, Mus musculus
ggtgcgatcgttaccacttcaaata

SEQ ID NO: 720115 - DNA, 25 bp, Mus musculus
ggtgcgatcgtttccacttcaaata

SEQ ID NO: 720116 - DNA, 25 bp, Mus musculus
ggtgcgcatctgagacttcgggaac

SEQ ID NO: 720117 - DNA, 25 bp, Mus musculus
ggtgcgcatctgtgacttcgggaac

SEQ ID NO: 720118 - DNA, 25 bp, Mus musculus
ggtgcgctatcccttttgattctat

SEQ ID NO: 720119 - DNA, 25 bp, Mus musculus
ggtgcgctatccgttttgattctat

SEQ ID NO: 720120 - DNA, 25 bp, Mus musculus
ggtgcggaacttaatccagaaagac

SEQ ID NO: 720121 - DNA, 25 bp, Mus musculus
ggtgcggaactttatccagaaagac

SEQ ID NO: 720122 - DNA, 25 bp, Mus musculus
ggtgcggagttgaggttacacacat

SEQ ID NO: 720123 - DNA, 25 bp, Mus musculus
ggtgcggagttgtggttacacacat

SEQ ID NO: 720124 - DNA, 25 bp, Mus musculus
ggtgcggatcctacaggccctggat

SEQ ID NO: 720125 - DNA, 25 bp, Mus musculus
ggtgcggatccttcaggccctggat

SEQ ID NO: 720126 - DNA, 25 bp, Mus musculus
ggtgcggcagttactaagctgtttc

SEQ ID NO: 720127 - DNA, 25 bp, Mus musculus
ggtgcggcagtttctaagctgtttc

SEQ ID NO: 720128 - DNA, 25 bp, Mus musculus
ggtgcgggtcttaaagagcgttcct

SEQ ID NO: 720129 - DNA, 25 bp, Mus musculus
ggtgcgggtctttaagagcgttcct

SEQ ID NO: 720130 - DNA, 25 bp, Mus musculus
ggtgctaacagacctggtgtctaag

SEQ ID NO: 720131 - DNA, 25 bp, Mus musculus
ggtgctaacagagctggtgtctaag

SEQ ID NO: 720132 - DNA, 25 bp, Mus musculus
ggtgctaacatacatttaactgaat

SEQ ID NO: 720133 - DNA, 25 bp, Mus musculus
ggtgctaacatagatttaactgaat

SEQ ID NO: 720134 - DNA, 25 bp, Mus musculus
ggtgctaactaaagtggcttccctg

SEQ ID NO: 720135 - DNA, 25 bp, Mus musculus
ggtgctaactaatgtggcttccctg

SEQ ID NO: 720136 - DNA, 25 bp, Mus musculus
ggtgctaaggagatctgctatgccc

SEQ ID NO: 720137 - DNA, 25 bp, Mus musculus
ggtgctaaggagttctgctatgccc

SEQ ID NO: 720138 - DNA, 25 bp, Mus musculus
ggtgctacacaacaaaccgcagtgt

SEQ ID NO: 720139 - DNA, 25 bp, Mus musculus
ggtgctacacaagaaaccgcagtgt

SEQ ID NO: 720140 - DNA, 25 bp, Mus musculus
ggtgctacatccagattcacggcaa

SEQ ID NO: 720141 - DNA, 25 bp, Mus musculus
ggtgctacatcctgattcacggcaa

SEQ ID NO: 720142 - DNA, 25 bp, Mus musculus
ggtgctaccatgcagactggccagc

SEQ ID NO: 720143 - DNA, 25 bp, Mus musculus
ggtgctaccatggagactggccagc

SEQ ID NO: 720144 - DNA, 25 bp, Mus musculus
ggtgctacctttatatagggtgcgg

SEQ ID NO: 720145 - DNA, 25 bp, Mus musculus
ggtgctacctttttatagggtgcgg

SEQ ID NO: 720146 - DNA, 25 bp, Mus musculus
ggtgctactgatagctcaagagaag

SEQ ID NO: 720147 - DNA, 25 bp, Mus musculus
ggtgctactgattgctcaagagaag

SEQ ID NO: 720148 - DNA, 25 bp, Mus musculus
ggtgctagcctgataaccactgctc

SEQ ID NO: 720149 - DNA, 25 bp, Mus musculus
ggtgctagcctgttaaccactgctc

SEQ ID NO: 720150 - DNA, 25 bp, Mus musculus
ggtgctaggtggagactgtctcctc

SEQ ID NO: 720151 - DNA, 25 bp, Mus musculus
ggtgctaggtggtgactgtctcctc

SEQ ID NO: 720152 - DNA, 25 bp, Mus musculus
ggtgctatcactcacaccttctgtg

SEQ ID NO: 720153 - DNA, 25 bp, Mus musculus
ggtgctatcactgacaccttctgtg

SEQ ID NO: 720154 - DNA, 25 bp, Mus musculus
ggtgctatccctcgtattagggctt

SEQ ID NO: 720155 - DNA, 25 bp, Mus musculus
ggtgctatccctggtattagggctt

SEQ ID NO: 720156 - DNA, 25 bp, Mus musculus
ggtgctatgataaaatacctgatac

SEQ ID NO: 720157 - DNA, 25 bp, Mus musculus
ggtgctatgatataatacctgatac

SEQ ID NO: 720158 - DNA, 25 bp, Mus musculus
ggtgctatgcgtcgtcctcctcggc

SEQ ID NO: 720159 - DNA, 25 bp, Mus musculus
ggtgctatgcgtggtcctcctcggc

SEQ ID NO: 720160 - DNA, 25 bp, Mus musculus
ggtgctcaagatctccacggaagag

SEQ ID NO: 720161 - DNA, 25 bp, Mus musculus
ggtgctcaagatgtccacggaagag

SEQ ID NO: 720162 - DNA, 25 bp, Mus musculus
ggtgctcactgccatggacactaca

SEQ ID NO: 720163 - DNA, 25 bp, Mus musculus
ggtgctcactgcgatggacactaca

SEQ ID NO: 720164 - DNA, 25 bp, Mus musculus
ggtgctcagaccagcatctcttaga

SEQ ID NO: 720165 - DNA, 25 bp, Mus musculus
ggtgctcagacctgcatctcttaga

SEQ ID NO: 720166 - DNA, 25 bp, Mus musculus
ggtgctcaggaacatggctttgtcc

SEQ ID NO: 720167 - DNA, 25 bp, Mus musculus
ggtgctcaggaagatggctttgtcc

SEQ ID NO: 720168 - DNA, 25 bp, Mus musculus
ggtgctcagtagagttctcatgggc

SEQ ID NO: 720169 - DNA, 25 bp, Mus musculus
ggtgctcagtagtgttctcatgggc

SEQ ID NO: 720170 - DNA, 25 bp, Mus musculus
ggtgctccacgacgacgaaaccacg

SEQ ID NO: 720171 - DNA, 25 bp, Mus musculus
ggtgctccacgaggacgaaaccacg

SEQ ID NO: 720172 - DNA, 25 bp, Mus musculus
ggtgctccagctaatgaacctgaca

SEQ ID NO: 720173 - DNA, 25 bp, Mus musculus
ggtgctccagcttatgaacctgaca

SEQ ID NO: 720174 - DNA, 25 bp, Mus musculus
ggtgctccaggaacagaatcaagat

SEQ ID NO: 720175 - DNA, 25 bp, Mus musculus
ggtgctccaggatcagaatcaagat

SEQ ID NO: 720176 - DNA, 25 bp, Mus musculus
ggtgctcccaagaggcttgccacca

SEQ ID NO: 720177 - DNA, 25 bp, Mus musculus
ggtgctcccaagtggcttgccacca

SEQ ID NO: 720178 - DNA, 25 bp, Mus musculus
ggtgctcctgcgatcagcttctgaa

SEQ ID NO: 720179 - DNA, 25 bp, Mus musculus
ggtgctcctgcgttcagcttctgaa

SEQ ID NO: 720180 - DNA, 25 bp, Mus musculus
ggtgctcgactactcccaagccaga

SEQ ID NO: 720181 - DNA, 25 bp, Mus musculus
ggtgctcgactagtcccaagccaga

SEQ ID NO: 720182 - DNA, 25 bp, Mus musculus
ggtgctcgtcagaggagtttgttct

SEQ ID NO: 720183 - DNA, 25 bp, Mus musculus
ggtgctcgtcagtggagtttgttct

SEQ ID NO: 720184 - DNA, 25 bp, Mus musculus
ggtgctctagctcctagtgccttag

SEQ ID NO: 720185 - DNA, 25 bp, Mus musculus
ggtgctctagctgctagtgccttag

SEQ ID NO: 720186 - DNA, 25 bp, Mus musculus
ggtgctctcctcactgtaggaggaa

SEQ ID NO: 720187 - DNA, 25 bp, Mus musculus
ggtgctctcctctctgtaggaggaa

SEQ ID NO: 720188 - DNA, 25 bp, Mus musculus
ggtgctctccttccggaaacctgat

SEQ ID NO: 720189 - DNA, 25 bp, Mus musculus
ggtgctctccttgcggaaacctgat

SEQ ID NO: 720190 - DNA, 25 bp, Mus musculus
ggtgctctcgatcaagaactattat

SEQ ID NO: 720191 - DNA, 25 bp, Mus musculus
ggtgctctcgatgaagaactattat

SEQ ID NO: 720192 - DNA, 25 bp, Mus musculus
ggtgctctgaacaccaacgatgcct

SEQ ID NO: 720193 - DNA, 25 bp, Mus musculus
ggtgctctgaactccaacgatgcct

SEQ ID NO: 720194 - DNA, 25 bp, Mus musculus
ggtgctctgatgcacgacaatcaga

SEQ ID NO: 720195 - DNA, 25 bp, Mus musculus
ggtgctctgatggacgacaatcaga

SEQ ID NO: 720196 - DNA, 25 bp, Mus musculus
ggtgctctggcaaactagcccagta

SEQ ID NO: 720197 - DNA, 25 bp, Mus musculus
ggtgctctggcatactagcccagta

SEQ ID NO: 720198 - DNA, 25 bp, Mus musculus
ggtgctcttagcagacatccttccc

SEQ ID NO: 720199 - DNA, 25 bp, Mus musculus
ggtgctcttagctgacatccttccc

SEQ ID NO: 720200 - DNA, 25 bp, Mus musculus
ggtgctcttaggaaggagtatagaa

SEQ ID NO: 720201 - DNA, 25 bp, Mus musculus
ggtgctcttaggtaggagtatagaa

SEQ ID NO: 720202 - DNA, 25 bp, Mus musculus
ggtgctgaatctccaatcagctcat

SEQ ID NO: 720203 - DNA, 25 bp, Mus musculus
ggtgctgaatctgcaatcagctcat

SEQ ID NO: 720204 - DNA, 25 bp, Mus musculus
ggtgctgaccaccaactacgacaac

SEQ ID NO: 720205 - DNA, 25 bp, Mus musculus
ggtgctgaccacgaactacgacaac

SEQ ID NO: 720206 - DNA, 25 bp, Mus musculus
ggtgctgaccatccgggaaaaaatc

SEQ ID NO: 720207 - DNA, 25 bp, Mus musculus
ggtgctgaccatgcgggaaaaaatc

SEQ ID NO: 720208 - DNA, 25 bp, Mus musculus
ggtgctgaccgcatctatgacctca

SEQ ID NO: 720209 - DNA, 25 bp, Mus musculus
ggtgctgaccgcttctatgacctca

SEQ ID NO: 720210 - DNA, 25 bp, Mus musculus
ggtgctgaccttctgcctgctgtcc

SEQ ID NO: 720211 - DNA, 25 bp, Mus musculus
ggtgctgaccttgtgcctgctgtcc

SEQ ID NO: 720212 - DNA, 25 bp, Mus musculus
ggtgctgacgtcaatgcaaaggata

SEQ ID NO: 720213 - DNA, 25 bp, Mus musculus
ggtgctgacgtctatgcaaaggata

SEQ ID NO: 720214 - DNA, 25 bp, Mus musculus
ggtgctgacttgcactggcctcgct

SEQ ID NO: 720215 - DNA, 25 bp, Mus musculus
ggtgctgacttggactggcctcgct

SEQ ID NO: 720216 - DNA, 25 bp, Mus musculus
ggtgctgaggaacggccaaacatct

SEQ ID NO: 720217 - DNA, 25 bp, Mus musculus
ggtgctgaggaagggccaaacatct

SEQ ID NO: 720218 - DNA, 25 bp, Mus musculus
ggtgctgagtcacacctcggatttc

SEQ ID NO: 720219 - DNA, 25 bp, Mus musculus
ggtgctgagtcagacctcggatttc

SEQ ID NO: 720220 - DNA, 25 bp, Mus musculus
ggtgctgatgatcgccatccagctg

SEQ ID NO: 720221 - DNA, 25 bp, Mus musculus
ggtgctgatgatggccatccagctg

SEQ ID NO: 720222 - DNA, 25 bp, Mus musculus
ggtgctgcagaacaaatccatttta

SEQ ID NO: 720223 - DNA, 25 bp, Mus musculus
ggtgctgcagaagaaatccatttta

SEQ ID NO: 720224 - DNA, 25 bp, Mus musculus
ggtgctgcagttagggttttgctta

SEQ ID NO: 720225 - DNA, 25 bp, Mus musculus
ggtgctgcagtttgggttttgctta

SEQ ID NO: 720226 - DNA, 25 bp, Mus musculus
ggtgctgcctgacagtggacaacca

SEQ ID NO: 720227 - DNA, 25 bp, Mus musculus
ggtgctgcctgagagtggacaacca

SEQ ID NO: 720228 - DNA, 25 bp, Mus musculus
ggtgctgcgggtagcaatcctgcta

SEQ ID NO: 720229 - DNA, 25 bp, Mus musculus
ggtgctgcgggttgcaatcctgcta

SEQ ID NO: 720230 - DNA, 25 bp, Mus musculus
ggtgctgctgatctccttacaggaa

SEQ ID NO: 720231 - DNA, 25 bp, Mus musculus
ggtgctgctgatgtccttacaggaa

SEQ ID NO: 720232 - DNA, 25 bp, Mus musculus
ggtgctgctggaaatagtgaatgtt

SEQ ID NO: 720233 - DNA, 25 bp, Mus musculus
ggtgctgctggatatagtgaatgtt

SEQ ID NO: 720234 - DNA, 25 bp, Mus musculus
ggtgctggacgccaataactgcgac

SEQ ID NO: 720235 - DNA, 25 bp, Mus musculus
ggtgctggacgcgaataactgcgac

SEQ ID NO: 720236 - DNA, 25 bp, Mus musculus
ggtgctgggctcatgtcatcctttg

SEQ ID NO: 720237 - DNA, 25 bp, Mus musculus
ggtgctgggctcttgtcatcctttg

SEQ ID NO: 720238 - DNA, 25 bp, Mus musculus
ggtgctggtctactttgcagaatac

SEQ ID NO: 720239 - DNA, 25 bp, Mus musculus
ggtgctggtctagtttgcagaatac

SEQ ID NO: 720240 - DNA, 25 bp, Mus musculus
ggtgctgtagatctctccgatccaa

SEQ ID NO: 720241 - DNA, 25 bp, Mus musculus
ggtgctgtagatgtctccgatccaa

SEQ ID NO: 720242 - DNA, 25 bp, Mus musculus
ggtgctgtatccatgggccgaaaat

SEQ ID NO: 720243 - DNA, 25 bp, Mus musculus
ggtgctgtatccttgggccgaaaat

SEQ ID NO: 720244 - DNA, 25 bp, Mus musculus
ggtgctgtatctctgatattctcac

SEQ ID NO: 720245 - DNA, 25 bp, Mus musculus
ggtgctgtatctgtgatattctcac

SEQ ID NO: 720246 - DNA, 25 bp, Mus musculus
ggtgctgtcagtcagagttctgcct

SEQ ID NO: 720247 - DNA, 25 bp, Mus musculus
ggtgctgtcagtgagagttctgcct

SEQ ID NO: 720248 - DNA, 25 bp, Mus musculus
ggtgctgtccaaccctgtggcgggc

SEQ ID NO: 720249 - DNA, 25 bp, Mus musculus
ggtgctgtccaagcctgtggcgggc

SEQ ID NO: 720250 - DNA, 25 bp, Mus musculus
ggtgctgtccacaggctacctcgtg

SEQ ID NO: 720251 - DNA, 25 bp, Mus musculus
ggtgctgtccactggctacctcgtg

SEQ ID NO: 720252 - DNA, 25 bp, Mus musculus
ggtgctgtccctcttaattctttgt

SEQ ID NO: 720253 - DNA, 25 bp, Mus musculus
ggtgctgtccctgttaattctttgt

SEQ ID NO: 720254 - DNA, 25 bp, Mus musculus
ggtgctgtctacatttacaatggcc

SEQ ID NO: 720255 - DNA, 25 bp, Mus musculus
ggtgctgtctacttttacaatggcc

SEQ ID NO: 720256 - DNA, 25 bp, Mus musculus
ggtgctgtctttcggatactgctga

SEQ ID NO: 720257 - DNA, 25 bp, Mus musculus
ggtgctgtctttgggatactgctga

SEQ ID NO: 720258 - DNA, 25 bp, Mus musculus
ggtgctgtgcaaactgaaaccccag

SEQ ID NO: 720259 - DNA, 25 bp, Mus musculus
ggtgctgtgcaatctgaaaccccag

SEQ ID NO: 720260 - DNA, 25 bp, Mus musculus
ggtgctgttcatcacgggaattatc

SEQ ID NO: 720261 - DNA, 25 bp, Mus musculus
ggtgctgttcatgacgggaattatc

SEQ ID NO: 720262 - DNA, 25 bp, Mus musculus
ggtgctgtttacctatgacaatgct

SEQ ID NO: 720263 - DNA, 25 bp, Mus musculus
ggtgctgtttacgtatgacaatgct

SEQ ID NO: 720264 - DNA, 25 bp, Mus musculus
ggtgctgtttcgctccgggactctt

SEQ ID NO: 720265 - DNA, 25 bp, Mus musculus
ggtgctgtttcggtccgggactctt

SEQ ID NO: 720266 - DNA, 25 bp, Mus musculus
ggtgctgttttccttatcatcctct

SEQ ID NO: 720267 - DNA, 25 bp, Mus musculus
ggtgctgttttcgttatcatcctct

SEQ ID NO: 720268 - DNA, 25 bp, Mus musculus
ggtgcttaccaaccaagaccaggtt

SEQ ID NO: 720269 - DNA, 25 bp, Mus musculus
ggtgcttaccaagcaagaccaggtt

SEQ ID NO: 720270 - DNA, 25 bp, Mus musculus
ggtgcttactataaaaaggccaaag

SEQ ID NO: 720271 - DNA, 25 bp, Mus musculus
ggtgcttactatacctcagtcccct

SEQ ID NO: 720272 - DNA, 25 bp, Mus musculus
ggtgcttactattaaaaggccaaag

SEQ ID NO: 720273 - DNA, 25 bp, Mus musculus
ggtgcttactattcctcagtcccct

SEQ ID NO: 720274 - DNA, 25 bp, Mus musculus
ggtgcttactgtaccctgtggtcca

SEQ ID NO: 720275 - DNA, 25 bp, Mus musculus
ggtgcttactgttccctgtggtcca

SEQ ID NO: 720276 - DNA, 25 bp, Mus musculus
ggtgcttcaaaccatgtgagatcag

SEQ ID NO: 720277 - DNA, 25 bp, Mus musculus
ggtgcttcaaacgatgtgagatcag

SEQ ID NO: 720278 - DNA, 25 bp, Mus musculus
ggtgcttcatgactgtgaccctgag

SEQ ID NO: 720279 - DNA, 25 bp, Mus musculus
ggtgcttcatgagtgtgaccctgag

SEQ ID NO: 720280 - DNA, 25 bp, Mus musculus
ggtgcttccagacacctaagaacca

SEQ ID NO: 720281 - DNA, 25 bp, Mus musculus
ggtgcttccagagacctaagaacca

SEQ ID NO: 720282 - DNA, 25 bp, Mus musculus
ggtgcttcggtcatcagcagcgata

SEQ ID NO: 720283 - DNA, 25 bp, Mus musculus
ggtgcttcggtcttcagcagcgata

SEQ ID NO: 720284 - DNA, 25 bp, Mus musculus
ggtgcttctcctagccggtgttcag

SEQ ID NO: 720285 - DNA, 25 bp, Mus musculus
ggtgcttctccttgccggtgttcag

SEQ ID NO: 720286 - DNA, 25 bp, Mus musculus
ggtgcttcttttagaaattcttcga

SEQ ID NO: 720287 - DNA, 25 bp, Mus musculus
ggtgcttctttttgaaattcttcga

SEQ ID NO: 720288 - DNA, 25 bp, Mus musculus
ggtgcttgccaacccagagcatgag

SEQ ID NO: 720289 - DNA, 25 bp, Mus musculus
ggtgcttgccaagccagagcatgag

SEQ ID NO: 720290 - DNA, 25 bp, Mus musculus
ggtgcttggacaataattcatccgt

SEQ ID NO: 720291 - DNA, 25 bp, Mus musculus
ggtgcttggacattaattcatccgt

SEQ ID NO: 720292 - DNA, 25 bp, Mus musculus
ggtgcttgttcccttagtctgggac

SEQ ID NO: 720293 - DNA, 25 bp, Mus musculus
ggtgcttgttccgttagtctgggac

SEQ ID NO: 720294 - DNA, 25 bp, Mus musculus
ggtgctttcaacattgacaaggaga

SEQ ID NO: 720295 - DNA, 25 bp, Mus musculus
ggtgctttcaactttgacaaggaga

SEQ ID NO: 720296 - DNA, 25 bp, Mus musculus
ggtgctttccgcaccgtttctacgt

SEQ ID NO: 720297 - DNA, 25 bp, Mus musculus
ggtgctttccgctccgtttctacgt

SEQ ID NO: 720298 - DNA, 25 bp, Mus musculus
ggtggaaaaaggagagactcgattt

SEQ ID NO: 720299 - DNA, 25 bp, Mus musculus
ggtggaaaaaggtgagactcgattt

SEQ ID NO: 720300 - DNA, 25 bp, Mus musculus
ggtggaaacatcagatgaggagatc

SEQ ID NO: 720301 - DNA, 25 bp, Mus musculus
ggtggaaacatctgatgaggagatc

SEQ ID NO: 720302 - DNA, 25 bp, Mus musculus
ggtggaaacttcagtcatctgatct

SEQ ID NO: 720303 - DNA, 25 bp, Mus musculus
ggtggaaacttctgtcatctgatct

SEQ ID NO: 720304 - DNA, 25 bp, Mus musculus
ggtggaacacttcttccgacaagga

SEQ ID NO: 720305 - DNA, 25 bp, Mus musculus
ggtggaacacttgttccgacaagga

SEQ ID NO: 720306 - DNA, 25 bp, Mus musculus
ggtggaaccacccacatttccaaca

SEQ ID NO: 720307 - DNA, 25 bp, Mus musculus
ggtggaaccaccgacatttccaaca

SEQ ID NO: 720308 - DNA, 25 bp, Mus musculus
ggtggaaccctactcagaacgttag

SEQ ID NO: 720309 - DNA, 25 bp, Mus musculus
ggtggaaccctagtcagaacgttag

SEQ ID NO: 720310 - DNA, 25 bp, Mus musculus
ggtggaactactctgccgtggttaa

SEQ ID NO: 720311 - DNA, 25 bp, Mus musculus
ggtggaactactgtgccgtggttaa

SEQ ID NO: 720312 - DNA, 25 bp, Mus musculus
ggtggaactatgaggccaagaactt

SEQ ID NO: 720313 - DNA, 25 bp, Mus musculus
ggtggaactatgtggccaagaactt

SEQ ID NO: 720314 - DNA, 25 bp, Mus musculus
ggtggaactcacaggcagagcagtc

SEQ ID NO: 720315 - DNA, 25 bp, Mus musculus
ggtggaactcactggcagagcagtc

SEQ ID NO: 720316 - DNA, 25 bp, Mus musculus
ggtggaactcttcagcgtgtgctct

SEQ ID NO: 720317 - DNA, 25 bp, Mus musculus
ggtggaactcttgagcgtgtgctct

SEQ ID NO: 720318 - DNA, 25 bp, Mus musculus
ggtggaacttcaatttgccatggac

SEQ ID NO: 720319 - DNA, 25 bp, Mus musculus
ggtggaacttcattttgccatggac

SEQ ID NO: 720320 - DNA, 25 bp, Mus musculus
ggtggaagagaacagcatcgacctc

SEQ ID NO: 720321 - DNA, 25 bp, Mus musculus
ggtggaagagaagagcatcgacctc

SEQ ID NO: 720322 - DNA, 25 bp, Mus musculus
ggtggaagccaaattcctgaacgtc

SEQ ID NO: 720323 - DNA, 25 bp, Mus musculus
ggtggaagccaatttcctgaacgtc

SEQ ID NO: 720324 - DNA, 25 bp, Mus musculus
ggtggaagctctacccggatgaaca

SEQ ID NO: 720325 - DNA, 25 bp, Mus musculus
ggtggaagctcttcccggatgaaca

SEQ ID NO: 720326 - DNA, 25 bp, Mus musculus
ggtggaagctgtatccgactctggc

SEQ ID NO: 720327 - DNA, 25 bp, Mus musculus
ggtggaagctgtttccgactctggc

SEQ ID NO: 720328 - DNA, 25 bp, Mus musculus
ggtggaaggaacatccaggctgctc

SEQ ID NO: 720329 - DNA, 25 bp, Mus musculus
ggtggaaggaacttccaggctgctc

SEQ ID NO: 720330 - DNA, 25 bp, Mus musculus
ggtggaagtctcatccctcacagtt

SEQ ID NO: 720331 - DNA, 25 bp, Mus musculus
ggtggaagtctcttccctcacagtt

SEQ ID NO: 720332 - DNA, 25 bp, Mus musculus
ggtggaatacaaagtgtccttccca

SEQ ID NO: 720333 - DNA, 25 bp, Mus musculus
ggtggaatacaatgtgtccttccca

SEQ ID NO: 720334 - DNA, 25 bp, Mus musculus
ggtggaatagtcattccattctgta

SEQ ID NO: 720335 - DNA, 25 bp, Mus musculus
ggtggaatagtctttccattctgta

SEQ ID NO: 720336 - DNA, 25 bp, Mus musculus
ggtggaatgcaacgatcacttgcgt

SEQ ID NO: 720337 - DNA, 25 bp, Mus musculus
ggtggaatgcaaggatcacttgcgt

SEQ ID NO: 720338 - DNA, 25 bp, Mus musculus
ggtggaatgcttccaaaagatatcc

SEQ ID NO: 720339 - DNA, 25 bp, Mus musculus
ggtggaatgcttgcaaaagatatcc

SEQ ID NO: 720340 - DNA, 25 bp, Mus musculus
ggtggaattactctgtattgacaag

SEQ ID NO: 720341 - DNA, 25 bp, Mus musculus
ggtggaattactgtgtattgacaag

SEQ ID NO: 720342 - DNA, 25 bp, Mus musculus
ggtggacaacacagtcagaatcatc

SEQ ID NO: 720343 - DNA, 25 bp, Mus musculus
ggtggacaacactgtcagaatcatc

SEQ ID NO: 720344 - DNA, 25 bp, Mus musculus
ggtggacaagctcacattaacatct

SEQ ID NO: 720345 - DNA, 25 bp, Mus musculus
ggtggacaagctgacattaacatct

SEQ ID NO: 720346 - DNA, 25 bp, Mus musculus
ggtggacaccatagaacaggagacc

SEQ ID NO: 720347 - DNA, 25 bp, Mus musculus
ggtggacaccattgaacaggagacc

SEQ ID NO: 720348 - DNA, 25 bp, Mus musculus
ggtggacagaagacactgtaaccta

SEQ ID NO: 720349 - DNA, 25 bp, Mus musculus
ggtggacagaagtcactgtaaccta

SEQ ID NO: 720350 - DNA, 25 bp, Mus musculus
ggtggacatctaccagaagcgctgt

SEQ ID NO: 720351 - DNA, 25 bp, Mus musculus
ggtggacatctagcagaagcgctgt

SEQ ID NO: 720352 - DNA, 25 bp, Mus musculus
ggtggacatctgaggacatctggcc

SEQ ID NO: 720353 - DNA, 25 bp, Mus musculus
ggtggacatctgtggacatctggcc

SEQ ID NO: 720354 - DNA, 25 bp, Mus musculus
ggtggaccctagctaagaacaacag

SEQ ID NO: 720355 - DNA, 25 bp, Mus musculus
ggtggaccctaggtaagaacaacag

SEQ ID NO: 720356 - DNA, 25 bp, Mus musculus
ggtggacctggaagctacttctggc

SEQ ID NO: 720357 - DNA, 25 bp, Mus musculus
ggtggacctggatgctacttctggc

SEQ ID NO: 720358 - DNA, 25 bp, Mus musculus
ggtggacgagtgctcacctaacccc

SEQ ID NO: 720359 - DNA, 25 bp, Mus musculus
ggtggacgagtggtcacctaacccc

SEQ ID NO: 720360 - DNA, 25 bp, Mus musculus
ggtggacgctgcacccaccgtggac

SEQ ID NO: 720361 - DNA, 25 bp, Mus musculus
ggtggacgctgctcccaccgtggac

SEQ ID NO: 720362 - DNA, 25 bp, Mus musculus
ggtggactacctccaccggaacaaa

SEQ ID NO: 720363 - DNA, 25 bp, Mus musculus
ggtggactacctgcaccggaacaaa

SEQ ID NO: 720364 - DNA, 25 bp, Mus musculus
ggtggactatcaacccctgaaaggt

SEQ ID NO: 720365 - DNA, 25 bp, Mus musculus
ggtggactatcatcccctgaaaggt

SEQ ID NO: 720366 - DNA, 25 bp, Mus musculus
ggtggactcaccacagcttgccaca

SEQ ID NO: 720367 - DNA, 25 bp, Mus musculus
ggtggactcacctcagcttgccaca

SEQ ID NO: 720368 - DNA, 25 bp, Mus musculus
ggtggactcctaagtgacctgttct

SEQ ID NO: 720369 - DNA, 25 bp, Mus musculus
ggtggactcctatgtgacctgttct

SEQ ID NO: 720370 - DNA, 25 bp, Mus musculus
ggtggactgctgacctccagcataa

SEQ ID NO: 720371 - DNA, 25 bp, Mus musculus
ggtggactgctgtcctccagcataa

SEQ ID NO: 720372 - DNA, 25 bp, Mus musculus
ggtggacttcgacaacataccatac

SEQ ID NO: 720373 - DNA, 25 bp, Mus musculus
ggtggacttcgagaacataccatac

SEQ ID NO: 720374 - DNA, 25 bp, Mus musculus
ggtggagaaaataagagatgctctg

SEQ ID NO: 720375 - DNA, 25 bp, Mus musculus
ggtggagaaaattagagatgctctg

SEQ ID NO: 720376 - DNA, 25 bp, Mus musculus
ggtggagaacaacaacgttcctctg

SEQ ID NO: 720377 - DNA, 25 bp, Mus musculus
ggtggagaacaacgaagacctgatt

SEQ ID NO: 720378 - DNA, 25 bp, Mus musculus
ggtggagaacaagaacgttcctctg

SEQ ID NO: 720379 - DNA, 25 bp, Mus musculus
ggtggagaacaaggaagacctgatt

SEQ ID NO: 720380 - DNA, 25 bp, Mus musculus
ggtggagaagaaatcccttctatgc

SEQ ID NO: 720381 - DNA, 25 bp, Mus musculus
ggtggagaagaattcccttctatgc

SEQ ID NO: 720382 - DNA, 25 bp, Mus musculus
ggtggagaccccaagggcgatcatt

SEQ ID NO: 720383 - DNA, 25 bp, Mus musculus
ggtggagacccctagggcgatcatt

SEQ ID NO: 720384 - DNA, 25 bp, Mus musculus
ggtggagaccgcagcgtccgtccct

SEQ ID NO: 720385 - DNA, 25 bp, Mus musculus
ggtggagaccgctgcgtccgtccct

SEQ ID NO: 720386 - DNA, 25 bp, Mus musculus
ggtggagactggatcacctcccgca

SEQ ID NO: 720387 - DNA, 25 bp, Mus musculus
ggtggagactggttcacctcccgca

SEQ ID NO: 720388 - DNA, 25 bp, Mus musculus
ggtggagagcaaccgtacccgcatc

SEQ ID NO: 720389 - DNA, 25 bp, Mus musculus
ggtggagagcaagcgtacccgcatc

SEQ ID NO: 720390 - DNA, 25 bp, Mus musculus
ggtggagagctgatcatctctgccg

SEQ ID NO: 720391 - DNA, 25 bp, Mus musculus
ggtggagagctgttcatctctgccg

SEQ ID NO: 720392 - DNA, 25 bp, Mus musculus
ggtggagatcctcaaccaataccca

SEQ ID NO: 720393 - DNA, 25 bp, Mus musculus
ggtggagatcctgaaccaataccca

SEQ ID NO: 720394 - DNA, 25 bp, Mus musculus
ggtggagccacactcctgctagcta

SEQ ID NO: 720395 - DNA, 25 bp, Mus musculus
ggtggagccacagtcctgctagcta

SEQ ID NO: 720396 - DNA, 25 bp, Mus musculus
ggtggagcccatcctgaactgcagc

SEQ ID NO: 720397 - DNA, 25 bp, Mus musculus
ggtggagcccatgctgaactgcagc

SEQ ID NO: 720398 - DNA, 25 bp, Mus musculus
ggtggagcctgtcccggcttcccaa

SEQ ID NO: 720399 - DNA, 25 bp, Mus musculus
ggtggagcctgtgccggcttcccaa

SEQ ID NO: 720400 - DNA, 25 bp, Mus musculus
ggtggagctacccaaattgaattgg

SEQ ID NO: 720401 - DNA, 25 bp, Mus musculus
ggtggagctaccgaaattgaattgg

SEQ ID NO: 720402 - DNA, 25 bp, Mus musculus
ggtggagctcttatctaccaggaag

SEQ ID NO: 720403 - DNA, 25 bp, Mus musculus
ggtggagctcttttctaccaggaag

SEQ ID NO: 720404 - DNA, 25 bp, Mus musculus
ggtggagctggcaccggacatccac

SEQ ID NO: 720405 - DNA, 25 bp, Mus musculus
ggtggagctggctccggacatccac

SEQ ID NO: 720406 - DNA, 25 bp, Mus musculus
ggtggaggagcacaacttactacag

SEQ ID NO: 720407 - DNA, 25 bp, Mus musculus
ggtggaggagcagaacttactacag

SEQ ID NO: 720408 - DNA, 25 bp, Mus musculus
ggtggaggcagcaccaggtacctcc

SEQ ID NO: 720409 - DNA, 25 bp, Mus musculus
ggtggaggcagctccaggtacctcc

SEQ ID NO: 720410 - DNA, 25 bp, Mus musculus
ggtggaggcgcacccaaccacactg

SEQ ID NO: 720411 - DNA, 25 bp, Mus musculus
ggtggaggcgcagccaaccacactg

SEQ ID NO: 720412 - DNA, 25 bp, Mus musculus
ggtggaggctcaagcccaggtctcc

SEQ ID NO: 720413 - DNA, 25 bp, Mus musculus
ggtggaggctcatgcccaggtctcc

SEQ ID NO: 720414 - DNA, 25 bp, Mus musculus
ggtggaggctccagtgacatttgtc

SEQ ID NO: 720415 - DNA, 25 bp, Mus musculus
ggtggaggctcctgtgacatttgtc

SEQ ID NO: 720416 - DNA, 25 bp, Mus musculus
ggtggaggtcaaagagtgcacctct

SEQ ID NO: 720417 - DNA, 25 bp, Mus musculus
ggtggaggtcaatgagtgcacctct

SEQ ID NO: 720418 - DNA, 25 bp, Mus musculus
ggtggagtccagactcgctctgtct

SEQ ID NO: 720419 - DNA, 25 bp, Mus musculus
ggtggagtccagtctcgctctgtct

SEQ ID NO: 720420 - DNA, 25 bp, Mus musculus
ggtggagtccatcaccctgtcccag

SEQ ID NO: 720421 - DNA, 25 bp, Mus musculus
ggtggagtccatgaccctgtcccag

SEQ ID NO: 720422 - DNA, 25 bp, Mus musculus
ggtggagtccccagccaaagtgcat

SEQ ID NO: 720423 - DNA, 25 bp, Mus musculus
ggtggagtcccctgccaaagtgcat

SEQ ID NO: 720424 - DNA, 25 bp, Mus musculus
ggtggagtccctcttctattccatg

SEQ ID NO: 720425 - DNA, 25 bp, Mus musculus
ggtggagtccctgttctattccatg

SEQ ID NO: 720426 - DNA, 25 bp, Mus musculus
ggtggagtgatcagggacccctaaa

SEQ ID NO: 720427 - DNA, 25 bp, Mus musculus
ggtggagtgatctgggacccctaaa

SEQ ID NO: 720428 - DNA, 25 bp, Mus musculus
ggtggataacacaagactcctgtct

SEQ ID NO: 720429 - DNA, 25 bp, Mus musculus
ggtggataacactagactcctgtct

SEQ ID NO: 720430 - DNA, 25 bp, Mus musculus
ggtggatacctcaattgactcagtg

SEQ ID NO: 720431 - DNA, 25 bp, Mus musculus
ggtggatacctctattgactcagtg

SEQ ID NO: 720432 - DNA, 25 bp, Mus musculus
ggtggatatgatatcaaaactggtc

SEQ ID NO: 720433 - DNA, 25 bp, Mus musculus
ggtggatatgatttcaaaactggtc

SEQ ID NO: 720434 - DNA, 25 bp, Mus musculus
ggtggatccattcacctcctaaaga

SEQ ID NO: 720435 - DNA, 25 bp, Mus musculus
ggtggatccattgacctcctaaaga

SEQ ID NO: 720436 - DNA, 25 bp, Mus musculus
ggtggatctgaaagcatttgaaaac

SEQ ID NO: 720437 - DNA, 25 bp, Mus musculus
ggtggatctgaatgcatttgaaaac

SEQ ID NO: 720438 - DNA, 25 bp, Mus musculus
ggtggatctgttcgcccatgcatga

SEQ ID NO: 720439 - DNA, 25 bp, Mus musculus
ggtggatctgttggcccatgcatga

SEQ ID NO: 720440 - DNA, 25 bp, Mus musculus
ggtggatgaagaacccactggaaac

SEQ ID NO: 720441 - DNA, 25 bp, Mus musculus
ggtggatgaagatcccactggaaac

SEQ ID NO: 720442 - DNA, 25 bp, Mus musculus
ggtggatgacctcgcaagtgtgtgg

SEQ ID NO: 720443 - DNA, 25 bp, Mus musculus
ggtggatgacctggcaagtgtgtgg

SEQ ID NO: 720444 - DNA, 25 bp, Mus musculus
ggtggatgagcactcatacagattt

SEQ ID NO: 720445 - DNA, 25 bp, Mus musculus
ggtggatgagcagtcatacagattt

SEQ ID NO: 720446 - DNA, 25 bp, Mus musculus
ggtggatgcagaaaagctgaagcca

SEQ ID NO: 720447 - DNA, 25 bp, Mus musculus
ggtggatgcagataagctgaagcca

SEQ ID NO: 720448 - DNA, 25 bp, Mus musculus
ggtggatgccgcctcatcagaaata

SEQ ID NO: 720449 - DNA, 25 bp, Mus musculus
ggtggatgccgcgtcatcagaaata

SEQ ID NO: 720450 - DNA, 25 bp, Mus musculus
ggtggatgcgtacactcgaccaacc

SEQ ID NO: 720451 - DNA, 25 bp, Mus musculus
ggtggatgcgtagactcgaccaacc

SEQ ID NO: 720452 - DNA, 25 bp, Mus musculus
ggtggatgctgtcagccagaaccca

SEQ ID NO: 720453 - DNA, 25 bp, Mus musculus
ggtggatgctgtgagccagaaccca

SEQ ID NO: 720454 - DNA, 25 bp, Mus musculus
ggtggatgcttcagctgctctccct

SEQ ID NO: 720455 - DNA, 25 bp, Mus musculus
ggtggatgcttctgctgctctccct

SEQ ID NO: 720456 - DNA, 25 bp, Mus musculus
ggtggatggatccttcctgctctga

SEQ ID NO: 720457 - DNA, 25 bp, Mus musculus
ggtggatggatcgttcctgctctga

SEQ ID NO: 720458 - DNA, 25 bp, Mus musculus
ggtggatgtcctatctttcgattca

SEQ ID NO: 720459 - DNA, 25 bp, Mus musculus
ggtggatgtcctttctttcgattca

SEQ ID NO: 720460 - DNA, 25 bp, Mus musculus
ggtggatgtgttaggaaattacgtc

SEQ ID NO: 720461 - DNA, 25 bp, Mus musculus
ggtggatgtgtttggaaattacgtc

SEQ ID NO: 720462 - DNA, 25 bp, Mus musculus
ggtggattacagactaggtacaagt

SEQ ID NO: 720463 - DNA, 25 bp, Mus musculus
ggtggattacagtctaggtacaagt

SEQ ID NO: 720464 - DNA, 25 bp, Mus musculus
ggtggattctgtcttggctatcaga

SEQ ID NO: 720465 - DNA, 25 bp, Mus musculus
ggtggattctgtgttggctatcaga

SEQ ID NO: 720466 - DNA, 25 bp, Mus musculus
ggtggattgtccagtgtgcaaacag

SEQ ID NO: 720467 - DNA, 25 bp, Mus musculus
ggtggattgtcctgtgtgcaaacag

SEQ ID NO: 720468 - DNA, 25 bp, Mus musculus
ggtggcaaactcaacctcatcctgg

SEQ ID NO: 720469 - DNA, 25 bp, Mus musculus
ggtggcaaactctacctcatcctgg

SEQ ID NO: 720470 - DNA, 25 bp, Mus musculus
ggtggcaactcaaggacagccatgg

SEQ ID NO: 720471 - DNA, 25 bp, Mus musculus
ggtggcaactcatggacagccatgg

SEQ ID NO: 720472 - DNA, 25 bp, Mus musculus
ggtggcaatagtatccaaatcattt

SEQ ID NO: 720473 - DNA, 25 bp, Mus musculus
ggtggcaatagtttccaaatcattt

SEQ ID NO: 720474 - DNA, 25 bp, Mus musculus
ggtggcacagaaaccgtgggcacca

SEQ ID NO: 720475 - DNA, 25 bp, Mus musculus
ggtggcacagaatccgtgggcacca

SEQ ID NO: 720476 - DNA, 25 bp, Mus musculus
ggtggcaccagaagtccaaattgaa

SEQ ID NO: 720477 - DNA, 25 bp, Mus musculus
ggtggcaccagatgtccaaattgaa

SEQ ID NO: 720478 - DNA, 25 bp, Mus musculus
ggtggcaccattattggcagtgccc

SEQ ID NO: 720479 - DNA, 25 bp, Mus musculus
ggtggcaccatttttggcagtgccc

SEQ ID NO: 720480 - DNA, 25 bp, Mus musculus
ggtggcaccgagaccgcttgctact

SEQ ID NO: 720481 - DNA, 25 bp, Mus musculus
ggtggcaccgagtccgcttgctact

SEQ ID NO: 720482 - DNA, 25 bp, Mus musculus
ggtggcacgtctcggccacagtcct

SEQ ID NO: 720483 - DNA, 25 bp, Mus musculus
ggtggcacgtctgggccacagtcct

SEQ ID NO: 720484 - DNA, 25 bp, Mus musculus
ggtggcactctcatgttggaacttc

SEQ ID NO: 720485 - DNA, 25 bp, Mus musculus
ggtggcactctcttgttggaacttc

SEQ ID NO: 720486 - DNA, 25 bp, Mus musculus
ggtggcactgttcaatcgccttcgg

SEQ ID NO: 720487 - DNA, 25 bp, Mus musculus
ggtggcactgttgaatcgccttcgg

SEQ ID NO: 720488 - DNA, 25 bp, Mus musculus
ggtggcagaactaagggtcaaagca

SEQ ID NO: 720489 - DNA, 25 bp, Mus musculus
ggtggcagaacttagggtcaaagca

SEQ ID NO: 720490 - DNA, 25 bp, Mus musculus
ggtggcagaatcaatgggcattgct

SEQ ID NO: 720491 - DNA, 25 bp, Mus musculus
ggtggcagaatctatgggcattgct

SEQ ID NO: 720492 - DNA, 25 bp, Mus musculus
ggtggcagatacaagaggcctgttt

SEQ ID NO: 720493 - DNA, 25 bp, Mus musculus
ggtggcagatactagaggcctgttt

SEQ ID NO: 720494 - DNA, 25 bp, Mus musculus
ggtggcagatgacgtgacccggccc

SEQ ID NO: 720495 - DNA, 25 bp, Mus musculus
ggtggcagatgaggtgacccggccc

SEQ ID NO: 720496 - DNA, 25 bp, Mus musculus
ggtggcagctggaattgatatcttc

SEQ ID NO: 720497 - DNA, 25 bp, Mus musculus
ggtggcagctggtattgatatcttc

SEQ ID NO: 720498 - DNA, 25 bp, Mus musculus
ggtggcagtgtgaacacagaagaca

SEQ ID NO: 720499 - DNA, 25 bp, Mus musculus
ggtggcagtgtgtacacagaagaca

SEQ ID NO: 720500 - DNA, 25 bp, Mus musculus
ggtggcatcatcacaccccttgtga

SEQ ID NO: 720501 - DNA, 25 bp, Mus musculus
ggtggcatcatctcaccccttgtga

SEQ ID NO: 720502 - DNA, 25 bp, Mus musculus
ggtggcatcttgcaccctgacagcg

SEQ ID NO: 720503 - DNA, 25 bp, Mus musculus
ggtggcatcttggaccctgacagcg

SEQ ID NO: 720504 - DNA, 25 bp, Mus musculus
ggtggcatgatcacttcctttctca

SEQ ID NO: 720505 - DNA, 25 bp, Mus musculus
ggtggcatgatctcttcctttctca

SEQ ID NO: 720506 - DNA, 25 bp, Mus musculus
ggtggcatgattcgctctttttctg

SEQ ID NO: 720507 - DNA, 25 bp, Mus musculus
ggtggcatgattggctctttttctg

SEQ ID NO: 720508 - DNA, 25 bp, Mus musculus
ggtggcatgtccacgcctctccatt

SEQ ID NO: 720509 - DNA, 25 bp, Mus musculus
ggtggcatgtcctcgcctctccatt

SEQ ID NO: 720510 - DNA, 25 bp, Mus musculus
ggtggccaaatcctccatccttttg

SEQ ID NO: 720511 - DNA, 25 bp, Mus musculus
ggtggccaaatcgtccatccttttg

SEQ ID NO: 720512 - DNA, 25 bp, Mus musculus
ggtggccaacctactgctatgtatg

SEQ ID NO: 720513 - DNA, 25 bp, Mus musculus
ggtggccaaccttctgctatgtatg

SEQ ID NO: 720514 - DNA, 25 bp, Mus musculus
ggtggccacactccattacaaaaag

SEQ ID NO: 720515 - DNA, 25 bp, Mus musculus
ggtggccacactgcattacaaaaag

SEQ ID NO: 720516 - DNA, 25 bp, Mus musculus
ggtggccacatacacttgtgatcag

SEQ ID NO: 720517 - DNA, 25 bp, Mus musculus
ggtggccacatagacttgtgatcag

SEQ ID NO: 720518 - DNA, 25 bp, Mus musculus
ggtggccaccgtcgctcagagtttt

SEQ ID NO: 720519 - DNA, 25 bp, Mus musculus
ggtggccaccgtggctcagagtttt

SEQ ID NO: 720520 - DNA, 25 bp, Mus musculus
ggtggccacggaaatccgttctctt

SEQ ID NO: 720521 - DNA, 25 bp, Mus musculus
ggtggccacggatatccgttctctt

SEQ ID NO: 720522 - DNA, 25 bp, Mus musculus
ggtggccacggtcatctgtaactcc

SEQ ID NO: 720523 - DNA, 25 bp, Mus musculus
ggtggccacggtgatctgtaactcc

SEQ ID NO: 720524 - DNA, 25 bp, Mus musculus
ggtggccacgtgcattttgatgact

SEQ ID NO: 720525 - DNA, 25 bp, Mus musculus
ggtggccacgtggattttgatgact

SEQ ID NO: 720526 - DNA, 25 bp, Mus musculus
ggtggccaggacaaaattagacctt

SEQ ID NO: 720527 - DNA, 25 bp, Mus musculus
ggtggccaggactaaattagacctt

SEQ ID NO: 720528 - DNA, 25 bp, Mus musculus
ggtggccatcctcattccacacagg

SEQ ID NO: 720529 - DNA, 25 bp, Mus musculus
ggtggccatcctgattccacacagg

SEQ ID NO: 720530 - DNA, 25 bp, Mus musculus
ggtggccccaaacgacatgacattt

SEQ ID NO: 720531 - DNA, 25 bp, Mus musculus
ggtggccccaaaggacatgacattt

SEQ ID NO: 720532 - DNA, 25 bp, Mus musculus
ggtggccctagacaacaagattgag

SEQ ID NO: 720533 - DNA, 25 bp, Mus musculus
ggtggccctagagaacaagattgag

SEQ ID NO: 720534 - DNA, 25 bp, Mus musculus
ggtggccctgaaccaaaaaagagct

SEQ ID NO: 720535 - DNA, 25 bp, Mus musculus
ggtggccctgaagcaaaaaagagct

SEQ ID NO: 720536 - DNA, 25 bp, Mus musculus
ggtggccctggccaaacgcttccag

SEQ ID NO: 720537 - DNA, 25 bp, Mus musculus
ggtggccctggcgaaacgcttccag

SEQ ID NO: 720538 - DNA, 25 bp, Mus musculus
ggtggcccttaccaaatcacgggtg

SEQ ID NO: 720539 - DNA, 25 bp, Mus musculus
ggtggcccttacgaaatcacgggtg

SEQ ID NO: 720540 - DNA, 25 bp, Mus musculus
ggtggcccttgcataataaagattc

SEQ ID NO: 720541 - DNA, 25 bp, Mus musculus
ggtggcccttgcttaataaagattc

SEQ ID NO: 720542 - DNA, 25 bp, Mus musculus
ggtggcccttgtcaggacagaacac

SEQ ID NO: 720543 - DNA, 25 bp, Mus musculus
ggtggcccttgtgaggacagaacac

SEQ ID NO: 720544 - DNA, 25 bp, Mus musculus
ggtggccgaagacccgagtctcggg

SEQ ID NO: 720545 - DNA, 25 bp, Mus musculus
ggtggccgaagagccgagtctcggg

SEQ ID NO: 720546 - DNA, 25 bp, Mus musculus
ggtggccgactgctcagccaccagt

SEQ ID NO: 720547 - DNA, 25 bp, Mus musculus
ggtggccgactggtcagccaccagt

SEQ ID NO: 720548 - DNA, 25 bp, Mus musculus
ggtggccgagctaccttccggatag

SEQ ID NO: 720549 - DNA, 25 bp, Mus musculus
ggtggccgagcttccttccggatag

SEQ ID NO: 720550 - DNA, 25 bp, Mus musculus
ggtggccgcactccagaactcggat

SEQ ID NO: 720551 - DNA, 25 bp, Mus musculus
ggtggccgcactgcagaactcggat

SEQ ID NO: 720552 - DNA, 25 bp, Mus musculus
ggtggccgctggatttgatgccctc

SEQ ID NO: 720553 - DNA, 25 bp, Mus musculus
ggtggccgctggttttgatgccctc

SEQ ID NO: 720554 - DNA, 25 bp, Mus musculus
ggtggcctaggccaaggtcaccctt

SEQ ID NO: 720555 - DNA, 25 bp, Mus musculus
ggtggcctaggcgaaggtcaccctt

SEQ ID NO: 720556 - DNA, 25 bp, Mus musculus
ggtggcctcaagcataggcgctccc

SEQ ID NO: 720557 - DNA, 25 bp, Mus musculus
ggtggcctcaaggataggcgctccc

SEQ ID NO: 720558 - DNA, 25 bp, Mus musculus
ggtggcctgactcctgttcttgctg

SEQ ID NO: 720559 - DNA, 25 bp, Mus musculus
ggtggcctgactgctgttcttgctg

SEQ ID NO: 720560 - DNA, 25 bp, Mus musculus
ggtggccttctgagttgaggactac

SEQ ID NO: 720561 - DNA, 25 bp, Mus musculus
ggtggccttctgtgttgaggactac

SEQ ID NO: 720562 - DNA, 25 bp, Mus musculus
ggtggccttgctactgcactacagc

SEQ ID NO: 720563 - DNA, 25 bp, Mus musculus
ggtggccttgcttctgcactacagc

SEQ ID NO: 720564 - DNA, 25 bp, Mus musculus
ggtggccttggcatcatccctgtga

SEQ ID NO: 720565 - DNA, 25 bp, Mus musculus
ggtggccttggcttcatccctgtga

SEQ ID NO: 720566 - DNA, 25 bp, Mus musculus
ggtggcgaagcaaattataccaagg

SEQ ID NO: 720567 - DNA, 25 bp, Mus musculus
ggtggcgaagcatattataccaagg

SEQ ID NO: 720568 - DNA, 25 bp, Mus musculus
ggtggcgacagaacctatagcagag

SEQ ID NO: 720569 - DNA, 25 bp, Mus musculus
ggtggcgacagatcctatagcagag

SEQ ID NO: 720570 - DNA, 25 bp, Mus musculus
ggtggcgagatgatctcccacctac

SEQ ID NO: 720571 - DNA, 25 bp, Mus musculus
ggtggcgagatgttctcccacctac

SEQ ID NO: 720572 - DNA, 25 bp, Mus musculus
ggtggcgaggatcatgacatcttca

SEQ ID NO: 720573 - DNA, 25 bp, Mus musculus
ggtggcgaggatgatgacatcttca

SEQ ID NO: 720574 - DNA, 25 bp, Mus musculus
ggtggcgatcttagaaccttcagga

SEQ ID NO: 720575 - DNA, 25 bp, Mus musculus
ggtggcgatctttgaaccttcagga

SEQ ID NO: 720576 - DNA, 25 bp, Mus musculus
ggtggcggccggaaatacatgtacc

SEQ ID NO: 720577 - DNA, 25 bp, Mus musculus
ggtggcggccggtaatacatgtacc

SEQ ID NO: 720578 - DNA, 25 bp, Mus musculus
ggtggctaacttcctgcttgtcaac

SEQ ID NO: 720579 - DNA, 25 bp, Mus musculus
ggtggctaacttgctgcttgtcaac

SEQ ID NO: 720580 - DNA, 25 bp, Mus musculus
ggtggctaatatattggaccccaga

SEQ ID NO: 720581 - DNA, 25 bp, Mus musculus
ggtggctaatattttggaccccaga

SEQ ID NO: 720582 - DNA, 25 bp, Mus musculus
ggtggctacactctccgaaatgttg

SEQ ID NO: 720583 - DNA, 25 bp, Mus musculus
ggtggctacactgtccgaaatgttg

SEQ ID NO: 720584 - DNA, 25 bp, Mus musculus
ggtggctataaacccctggccggct

SEQ ID NO: 720585 - DNA, 25 bp, Mus musculus
ggtggctataaagccctggccggct

SEQ ID NO: 720586 - DNA, 25 bp, Mus musculus
ggtggctataacctccgtgccctgg

SEQ ID NO: 720587 - DNA, 25 bp, Mus musculus
ggtggctataacgtccgtgccctgg

SEQ ID NO: 720588 - DNA, 25 bp, Mus musculus
ggtggctatggccacacgtcgacct

SEQ ID NO: 720589 - DNA, 25 bp, Mus musculus
ggtggctatggcgacacgtcgacct

SEQ ID NO: 720590 - DNA, 25 bp, Mus musculus
ggtggctattctagcatctgtcgtc

SEQ ID NO: 720591 - DNA, 25 bp, Mus musculus
ggtggctattcttgcatctgtcgtc

SEQ ID NO: 720592 - DNA, 25 bp, Mus musculus
ggtggctattgactccttgacatct

SEQ ID NO: 720593 - DNA, 25 bp, Mus musculus
ggtggctattgagtccttgacatct

SEQ ID NO: 720594 - DNA, 25 bp, Mus musculus
ggtggctattttctgcctgcagttc

SEQ ID NO: 720595 - DNA, 25 bp, Mus musculus
ggtggctattttgtgcctgcagttc

SEQ ID NO: 720596 - DNA, 25 bp, Mus musculus
ggtggctcatatcctatattcacaa

SEQ ID NO: 720597 - DNA, 25 bp, Mus musculus
ggtggctcatatgctatattcacaa

SEQ ID NO: 720598 - DNA, 25 bp, Mus musculus
ggtggctccagtacccactctggtg

SEQ ID NO: 720599 - DNA, 25 bp, Mus musculus
ggtggctccagttcccactctggtg

SEQ ID NO: 720600 - DNA, 25 bp, Mus musculus
ggtggctccttcataagtacacgtg

SEQ ID NO: 720601 - DNA, 25 bp, Mus musculus
ggtggctccttcttaagtacacgtg

SEQ ID NO: 720602 - DNA, 25 bp, Mus musculus
ggtggctccttgctttctctccgtg

SEQ ID NO: 720603 - DNA, 25 bp, Mus musculus
ggtggctccttggtttctctccgtg

SEQ ID NO: 720604 - DNA, 25 bp, Mus musculus
ggtggctcgagaagtgccccgccac

SEQ ID NO: 720605 - DNA, 25 bp, Mus musculus
ggtggctcgagatgtgccccgccac

SEQ ID NO: 720606 - DNA, 25 bp, Mus musculus
ggtggctcgcgaagaagcaaaagct

SEQ ID NO: 720607 - DNA, 25 bp, Mus musculus
ggtggctcgcgatgaagcaaaagct

SEQ ID NO: 720608 - DNA, 25 bp, Mus musculus
ggtggctcggcacttcaacctgatc

SEQ ID NO: 720609 - DNA, 25 bp, Mus musculus
ggtggctcggcagttcaacctgatc

SEQ ID NO: 720610 - DNA, 25 bp, Mus musculus
ggtggctcgtcaacgaccgcaaggt

SEQ ID NO: 720611 - DNA, 25 bp, Mus musculus
ggtggctcgtcatcgaccgcaaggt

SEQ ID NO: 720612 - DNA, 25 bp, Mus musculus
ggtggctctacgcagaattcaatga

SEQ ID NO: 720613 - DNA, 25 bp, Mus musculus
ggtggctctacggagaattcaatga

SEQ ID NO: 720614 - DNA, 25 bp, Mus musculus
ggtggctctgagaaccattttgacc

SEQ ID NO: 720615 - DNA, 25 bp, Mus musculus
ggtggctctgagtaccattttgacc

SEQ ID NO: 720616 - DNA, 25 bp, Mus musculus
ggtggctctgatctgctttcgagaa

SEQ ID NO: 720617 - DNA, 25 bp, Mus musculus
ggtggctctgatgtgctttcgagaa

SEQ ID NO: 720618 - DNA, 25 bp, Mus musculus
ggtggctcttgtacgtaccggtagc

SEQ ID NO: 720619 - DNA, 25 bp, Mus musculus
ggtggctcttgttcgtaccggtagc

SEQ ID NO: 720620 - DNA, 25 bp, Mus musculus
ggtggctgaaggaggtctcaattct

SEQ ID NO: 720621 - DNA, 25 bp, Mus musculus
ggtggctgaaggtggtctcaattct

SEQ ID NO: 720622 - DNA, 25 bp, Mus musculus
ggtggctgagtacaccttccgccag

SEQ ID NO: 720623 - DNA, 25 bp, Mus musculus
ggtggctgagtagaccttccgccag

SEQ ID NO: 720624 - DNA, 25 bp, Mus musculus
ggtggctgatataccctgtatctgc

SEQ ID NO: 720625 - DNA, 25 bp, Mus musculus
ggtggctgatattccctgtatctgc

SEQ ID NO: 720626 - DNA, 25 bp, Mus musculus
ggtggctgatctcaataagcaggcc

SEQ ID NO: 720627 - DNA, 25 bp, Mus musculus
ggtggctgatctgaataagcaggcc

SEQ ID NO: 720628 - DNA, 25 bp, Mus musculus
ggtggctgcatcaccacaccctgtg

SEQ ID NO: 720629 - DNA, 25 bp, Mus musculus
ggtggctgcatctccacaccctgtg

SEQ ID NO: 720630 - DNA, 25 bp, Mus musculus
ggtggctgtgaccttatgctcctgt

SEQ ID NO: 720631 - DNA, 25 bp, Mus musculus
ggtggctgtgacgttatgctcctgt

SEQ ID NO: 720632 - DNA, 25 bp, Mus musculus
ggtggcttacctaggactgttcatg

SEQ ID NO: 720633 - DNA, 25 bp, Mus musculus
ggtggcttaccttggactgttcatg

SEQ ID NO: 720634 - DNA, 25 bp, Mus musculus
ggtggctttactctcctgcatgcag

SEQ ID NO: 720635 - DNA, 25 bp, Mus musculus
ggtggctttactgtcctgcatgcag

SEQ ID NO: 720636 - DNA, 25 bp, Mus musculus
ggtggctttaggcaacattgccagt

SEQ ID NO: 720637 - DNA, 25 bp, Mus musculus
ggtggctttagggaacattgccagt

SEQ ID NO: 720638 - DNA, 25 bp, Mus musculus
ggtgggaacaaacaactgactgtga

SEQ ID NO: 720639 - DNA, 25 bp, Mus musculus
ggtgggaacaaagaactgactgtga

SEQ ID NO: 720640 - DNA, 25 bp, Mus musculus
ggtgggaccaatattgcctattgga

SEQ ID NO: 720641 - DNA, 25 bp, Mus musculus
ggtgggaccaattttgcctattgga

SEQ ID NO: 720642 - DNA, 25 bp, Mus musculus
ggtgggagacctatttgtttgccgc

SEQ ID NO: 720643 - DNA, 25 bp, Mus musculus
ggtgggagacctttttgtttgccgc

SEQ ID NO: 720644 - DNA, 25 bp, Mus musculus
ggtgggaggctcacactcttccttg

SEQ ID NO: 720645 - DNA, 25 bp, Mus musculus
ggtgggaggctctcactcttccttg

SEQ ID NO: 720646 - DNA, 25 bp, Mus musculus
ggtgggagtcatacacatttatggg

SEQ ID NO: 720647 - DNA, 25 bp, Mus musculus
ggtgggagtcattcacatttatggg

SEQ ID NO: 720648 - DNA, 25 bp, Mus musculus
ggtgggataagacccaaatattgcc

SEQ ID NO: 720649 - DNA, 25 bp, Mus musculus
ggtgggataagagccaaatattgcc

SEQ ID NO: 720650 - DNA, 25 bp, Mus musculus
ggtgggatcatcactatcaatattg

SEQ ID NO: 720651 - DNA, 25 bp, Mus musculus
ggtgggatcatctctatcaatattg

SEQ ID NO: 720652 - DNA, 25 bp, Mus musculus
ggtgggatgcgcagagtccacacca

SEQ ID NO: 720653 - DNA, 25 bp, Mus musculus
ggtgggatgcgctgagtccacacca

SEQ ID NO: 720654 - DNA, 25 bp, Mus musculus
ggtgggcagcgtacaaaagtccaca

SEQ ID NO: 720655 - DNA, 25 bp, Mus musculus
ggtgggcagcgttcaaaagtccaca

SEQ ID NO: 720656 - DNA, 25 bp, Mus musculus
ggtgggcataatagatctttagggc

SEQ ID NO: 720657 - DNA, 25 bp, Mus musculus
ggtgggcataattgatctttagggc

SEQ ID NO: 720658 - DNA, 25 bp, Mus musculus
ggtgggcatctccataggcgaatct

SEQ ID NO: 720659 - DNA, 25 bp, Mus musculus
ggtgggcatctcgataggcgaatct

SEQ ID NO: 720660 - DNA, 25 bp, Mus musculus
ggtgggccaccaccaactactttgt

SEQ ID NO: 720661 - DNA, 25 bp, Mus musculus
ggtgggccaccagcaactactttgt

SEQ ID NO: 720662 - DNA, 25 bp, Mus musculus
ggtgggcctctcatacttaatgaaa

SEQ ID NO: 720663 - DNA, 25 bp, Mus musculus
ggtgggcctctcttacttaatgaaa

SEQ ID NO: 720664 - DNA, 25 bp, Mus musculus
ggtgggcgacaactccggagtcttc

SEQ ID NO: 720665 - DNA, 25 bp, Mus musculus
ggtgggcgacaagtccggagtcttc

SEQ ID NO: 720666 - DNA, 25 bp, Mus musculus
ggtgggctactgattgccattgaca

SEQ ID NO: 720667 - DNA, 25 bp, Mus musculus
ggtgggctactgtttgccattgaca

SEQ ID NO: 720668 - DNA, 25 bp, Mus musculus
ggtgggctctacatcgtcacagagt

SEQ ID NO: 720669 - DNA, 25 bp, Mus musculus
ggtgggctctacttcgtcacagagt

SEQ ID NO: 720670 - DNA, 25 bp, Mus musculus
ggtgggcttctcctactcggatgac

SEQ ID NO: 720671 - DNA, 25 bp, Mus musculus
ggtgggcttctcgtactcggatgac

SEQ ID NO: 720672 - DNA, 25 bp, Mus musculus
ggtgggctttccagctcagcgtctc

SEQ ID NO: 720673 - DNA, 25 bp, Mus musculus
ggtgggctttcctgctcagcgtctc

SEQ ID NO: 720674 - DNA, 25 bp, Mus musculus
ggtggggcacgcactgcacaatgac

SEQ ID NO: 720675 - DNA, 25 bp, Mus musculus
ggtggggcacgctctgcacaatgac

SEQ ID NO: 720676 - DNA, 25 bp, Mus musculus
ggtgggggccctcttactctacatg

SEQ ID NO: 720677 - DNA, 25 bp, Mus musculus
ggtgggggccctgttactctacatg

SEQ ID NO: 720678 - DNA, 25 bp, Mus musculus
ggtgggtcatcaccagccagctcca

SEQ ID NO: 720679 - DNA, 25 bp, Mus musculus
ggtgggtcatcagcagccagctcca

SEQ ID NO: 720680 - DNA, 25 bp, Mus musculus
ggtgggtctactacgacacatcctg

SEQ ID NO: 720681 - DNA, 25 bp, Mus musculus
ggtgggtctacttcgacacatcctg

SEQ ID NO: 720682 - DNA, 25 bp, Mus musculus
ggtgggtgatctcgaagacatcaat

SEQ ID NO: 720683 - DNA, 25 bp, Mus musculus
ggtgggtgatctggaagacatcaat

SEQ ID NO: 720684 - DNA, 25 bp, Mus musculus
ggtgggttattgcaagccttgctct

SEQ ID NO: 720685 - DNA, 25 bp, Mus musculus
ggtgggttattggaagccttgctct

SEQ ID NO: 720686 - DNA, 25 bp, Mus musculus
ggtgggttcactattcaaggccaga

SEQ ID NO: 720687 - DNA, 25 bp, Mus musculus
ggtgggttcacttttcaaggccaga

SEQ ID NO: 720688 - DNA, 25 bp, Mus musculus
ggtgggtttcacatgatggatgata

SEQ ID NO: 720689 - DNA, 25 bp, Mus musculus
ggtgggtttcacttgatggatgata

SEQ ID NO: 720690 - DNA, 25 bp, Mus musculus
ggtggtaaaccaaccagactcctcg

SEQ ID NO: 720691 - DNA, 25 bp, Mus musculus
ggtggtaaaccatccagactcctcg

SEQ ID NO: 720692 - DNA, 25 bp, Mus musculus
ggtggtaactttcacagaagctagg

SEQ ID NO: 720693 - DNA, 25 bp, Mus musculus
ggtggtaactttgacagaagctagg

SEQ ID NO: 720694 - DNA, 25 bp, Mus musculus
ggtggtaatccaattgcgtccttag

SEQ ID NO: 720695 - DNA, 25 bp, Mus musculus
ggtggtaatccatttgcgtccttag

SEQ ID NO: 720696 - DNA, 25 bp, Mus musculus
ggtggtaatccccttcctgacagaa

SEQ ID NO: 720697 - DNA, 25 bp, Mus musculus
ggtggtaatcccgttcctgacagaa

SEQ ID NO: 720698 - DNA, 25 bp, Mus musculus
ggtggtacacatcttcagtctcggc

SEQ ID NO: 720699 - DNA, 25 bp, Mus musculus
ggtggtacacatgttcagtctcggc

SEQ ID NO: 720700 - DNA, 25 bp, Mus musculus
ggtggtacctgaccccataagcatt

SEQ ID NO: 720701 - DNA, 25 bp, Mus musculus
ggtggtacctgagcccataagcatt

SEQ ID NO: 720702 - DNA, 25 bp, Mus musculus
ggtggtagaaaacatgagcaagaaa

SEQ ID NO: 720703 - DNA, 25 bp, Mus musculus
ggtggtagaaaagatgagcaagaaa

SEQ ID NO: 720704 - DNA, 25 bp, Mus musculus
ggtggtagcagtactatactgcttc

SEQ ID NO: 720705 - DNA, 25 bp, Mus musculus
ggtggtagcagtcaatgacccattc

SEQ ID NO: 720706 - DNA, 25 bp, Mus musculus
ggtggtagcagtgaatgacccattc

SEQ ID NO: 720707 - DNA, 25 bp, Mus musculus
ggtggtagcagttctatactgcttc

SEQ ID NO: 720708 - DNA, 25 bp, Mus musculus
ggtggtagccagccccattgctgcc

SEQ ID NO: 720709 - DNA, 25 bp, Mus musculus
ggtggtagccaggcccattgctgcc

SEQ ID NO: 720710 - DNA, 25 bp, Mus musculus
ggtggtagccgaagcgaggagagca

SEQ ID NO: 720711 - DNA, 25 bp, Mus musculus
ggtggtagccgatgcgaggagagca

SEQ ID NO: 720712 - DNA, 25 bp, Mus musculus
ggtggtatccgtacaatcatcctgc

SEQ ID NO: 720713 - DNA, 25 bp, Mus musculus
ggtggtatccgttcaatcatcctgc

SEQ ID NO: 720714 - DNA, 25 bp, Mus musculus
ggtggtatcttaccaagcctcagca

SEQ ID NO: 720715 - DNA, 25 bp, Mus musculus
ggtggtatcttagcaagcctcagca

SEQ ID NO: 720716 - DNA, 25 bp, Mus musculus
ggtggtatttgtagacaactacatc

SEQ ID NO: 720717 - DNA, 25 bp, Mus musculus
ggtggtatttgttgacaactacatc

SEQ ID NO: 720718 - DNA, 25 bp, Mus musculus
ggtggtcaagcactctacgttgatg

SEQ ID NO: 720719 - DNA, 25 bp, Mus musculus
ggtggtcaagcagtctacgttgatg

SEQ ID NO: 720720 - DNA, 25 bp, Mus musculus
ggtggtcacaccacaccttgggcgg

SEQ ID NO: 720721 - DNA, 25 bp, Mus musculus
ggtggtcacaccagatcctgttcct

SEQ ID NO: 720722 - DNA, 25 bp, Mus musculus
ggtggtcacacctcaccttgggcgg

SEQ ID NO: 720723 - DNA, 25 bp, Mus musculus
ggtggtcacacctgatcctgttcct

SEQ ID NO: 720724 - DNA, 25 bp, Mus musculus
ggtggtcaccatcgagcactctgcg

SEQ ID NO: 720725 - DNA, 25 bp, Mus musculus
ggtggtcaccatggagcactctgcg

SEQ ID NO: 720726 - DNA, 25 bp, Mus musculus
ggtggtcaccttcctatgccgggaa

SEQ ID NO: 720727 - DNA, 25 bp, Mus musculus
ggtggtcaccttgctatgccgggaa

SEQ ID NO: 720728 - DNA, 25 bp, Mus musculus
ggtggtcagcagctttctcaaggca

SEQ ID NO: 720729 - DNA, 25 bp, Mus musculus
ggtggtcagcaggtttctcaaggca

SEQ ID NO: 720730 - DNA, 25 bp, Mus musculus
ggtggtcagtgcattaaagaaatca

SEQ ID NO: 720731 - DNA, 25 bp, Mus musculus
ggtggtcagtgctttaaagaaatca

SEQ ID NO: 720732 - DNA, 25 bp, Mus musculus
ggtggtcatcgaatacacaccctac

SEQ ID NO: 720733 - DNA, 25 bp, Mus musculus
ggtggtcatcgattacacaccctac

SEQ ID NO: 720734 - DNA, 25 bp, Mus musculus
ggtggtccacatagccccagaatct

SEQ ID NO: 720735 - DNA, 25 bp, Mus musculus
ggtggtccacattgccccagaatct

SEQ ID NO: 720736 - DNA, 25 bp, Mus musculus
ggtggtccgcttcctacagctatcc

SEQ ID NO: 720737 - DNA, 25 bp, Mus musculus
ggtggtccgcttgctacagctatcc

SEQ ID NO: 720738 - DNA, 25 bp, Mus musculus
ggtggtcctaacctggtttctatcg

SEQ ID NO: 720739 - DNA, 25 bp, Mus musculus
ggtggtcctaacgtggtttctatcg

SEQ ID NO: 720740 - DNA, 25 bp, Mus musculus
ggtggtcgtggcagctctgctctcc

SEQ ID NO: 720741 - DNA, 25 bp, Mus musculus
ggtggtcgtggctgctctgctctcc

SEQ ID NO: 720742 - DNA, 25 bp, Mus musculus
ggtggtctactacctctccctaagg

SEQ ID NO: 720743 - DNA, 25 bp, Mus musculus
ggtggtctactagctctccctaagg

SEQ ID NO: 720744 - DNA, 25 bp, Mus musculus
ggtggtctccaaacaacacgtttct

SEQ ID NO: 720745 - DNA, 25 bp, Mus musculus
ggtggtctccaatcaacacgtttct

SEQ ID NO: 720746 - DNA, 25 bp, Mus musculus
ggtggtctccaccaagacctgaaaa

SEQ ID NO: 720747 - DNA, 25 bp, Mus musculus
ggtggtctccacgaagacctgaaaa

SEQ ID NO: 720748 - DNA, 25 bp, Mus musculus
ggtggtctctctattagcctcaagt

SEQ ID NO: 720749 - DNA, 25 bp, Mus musculus
ggtggtctctcttttagcctcaagt

SEQ ID NO: 720750 - DNA, 25 bp, Mus musculus
ggtggtctgtagcactcttctaaag

SEQ ID NO: 720751 - DNA, 25 bp, Mus musculus
ggtggtctgtaggactcttctaaag

SEQ ID NO: 720752 - DNA, 25 bp, Mus musculus
ggtggtgaacctccccattgtagag

SEQ ID NO: 720753 - DNA, 25 bp, Mus musculus
ggtggtgaacctgcccattgtagag

SEQ ID NO: 720754 - DNA, 25 bp, Mus musculus
ggtggtgaacgcatttagcctctgc

SEQ ID NO: 720755 - DNA, 25 bp, Mus musculus
ggtggtgaacgcttttagcctctgc

SEQ ID NO: 720756 - DNA, 25 bp, Mus musculus
ggtggtgaagtcatccgttgcctgc

SEQ ID NO: 720757 - DNA, 25 bp, Mus musculus
ggtggtgaagtcttccgttgcctgc

SEQ ID NO: 720758 - DNA, 25 bp, Mus musculus
ggtggtgaataactcatctcagttc

SEQ ID NO: 720759 - DNA, 25 bp, Mus musculus
ggtggtgaataagtcatctcagttc

SEQ ID NO: 720760 - DNA, 25 bp, Mus musculus
ggtggtgaatcaatacctggcattt

SEQ ID NO: 720761 - DNA, 25 bp, Mus musculus
ggtggtgaatcattacctggcattt

SEQ ID NO: 720762 - DNA, 25 bp, Mus musculus
ggtggtgacccacactacactctaa

SEQ ID NO: 720763 - DNA, 25 bp, Mus musculus
ggtggtgacccagactacactctaa

SEQ ID NO: 720764 - DNA, 25 bp, Mus musculus
ggtggtgagatgatcactcacctct

SEQ ID NO: 720765 - DNA, 25 bp, Mus musculus
ggtggtgagatgttcactcacctct

SEQ ID NO: 720766 - DNA, 25 bp, Mus musculus
ggtggtgatctcagccatcctggcc

SEQ ID NO: 720767 - DNA, 25 bp, Mus musculus
ggtggtgatctctgccatcctggcc

SEQ ID NO: 720768 - DNA, 25 bp, Mus musculus
ggtggtgatgcgaaccccttccatt

SEQ ID NO: 720769 - DNA, 25 bp, Mus musculus
ggtggtgatgcgtaccccttccatt

SEQ ID NO: 720770 - DNA, 25 bp, Mus musculus
ggtggtgccaagatccatttggaat

SEQ ID NO: 720771 - DNA, 25 bp, Mus musculus
ggtggtgccaagttccatttggaat

SEQ ID NO: 720772 - DNA, 25 bp, Mus musculus
ggtggtgccatcaccaacaccgctg

SEQ ID NO: 720773 - DNA, 25 bp, Mus musculus
ggtggtgccatctccaacaccgctg

SEQ ID NO: 720774 - DNA, 25 bp, Mus musculus
ggtggtgcccacagtgtacatgaag

SEQ ID NO: 720775 - DNA, 25 bp, Mus musculus
ggtggtgcccactgtgtacatgaag

SEQ ID NO: 720776 - DNA, 25 bp, Mus musculus
ggtggtgcccatcgtccatcaaaag

SEQ ID NO: 720777 - DNA, 25 bp, Mus musculus
ggtggtgcccatggtccatcaaaag

SEQ ID NO: 720778 - DNA, 25 bp, Mus musculus
ggtggtgcccgccaaaatgtctcac

SEQ ID NO: 720779 - DNA, 25 bp, Mus musculus
ggtggtgcccgcgaaaatgtctcac

SEQ ID NO: 720780 - DNA, 25 bp, Mus musculus
ggtggtgctgcgctccatcctcagc

SEQ ID NO: 720781 - DNA, 25 bp, Mus musculus
ggtggtgctgcggtccatcctcagc

SEQ ID NO: 720782 - DNA, 25 bp, Mus musculus
ggtggtgctgtcaatgtgtgtccct

SEQ ID NO: 720783 - DNA, 25 bp, Mus musculus
ggtggtgctgtctatgtgtgtccct

SEQ ID NO: 720784 - DNA, 25 bp, Mus musculus
ggtggtgctttcactgaacaaattc

SEQ ID NO: 720785 - DNA, 25 bp, Mus musculus
ggtggtgctttctctgaacaaattc

SEQ ID NO: 720786 - DNA, 25 bp, Mus musculus
ggtggtggaagccaatttcctgaac

SEQ ID NO: 720787 - DNA, 25 bp, Mus musculus
ggtggtggaagcgaatttcctgaac

SEQ ID NO: 720788 - DNA, 25 bp, Mus musculus
ggtggtggaggccttcagtgaagag

SEQ ID NO: 720789 - DNA, 25 bp, Mus musculus
ggtggtggaggcgttcagtgaagag

SEQ ID NO: 720790 - DNA, 25 bp, Mus musculus
ggtggtggctacactgtccgaaatg

SEQ ID NO: 720791 - DNA, 25 bp, Mus musculus
ggtggtggctactctgtccgaaatg

SEQ ID NO: 720792 - DNA, 25 bp, Mus musculus
ggtggtgtctgtcgacatcagccac

SEQ ID NO: 720793 - DNA, 25 bp, Mus musculus
ggtggtgtctgtggacatcagccac

SEQ ID NO: 720794 - DNA, 25 bp, Mus musculus
ggtggttcagaaagtgtccgtcatc

SEQ ID NO: 720795 - DNA, 25 bp, Mus musculus
ggtggttcagaatgtgtccgtcatc

SEQ ID NO: 720796 - DNA, 25 bp, Mus musculus
ggtggttcaggtaaaagcttcctgg

SEQ ID NO: 720797 - DNA, 25 bp, Mus musculus
ggtggttcaggttaaagcttcctgg

SEQ ID NO: 720798 - DNA, 25 bp, Mus musculus
ggtggttccgaaacagacatcagtg

SEQ ID NO: 720799 - DNA, 25 bp, Mus musculus
ggtggttccgaatcagacatcagtg

SEQ ID NO: 720800 - DNA, 25 bp, Mus musculus
ggtggttcgctccagcaaattccgc

SEQ ID NO: 720801 - DNA, 25 bp, Mus musculus
ggtggttcgctcgagcaaattccgc

SEQ ID NO: 720802 - DNA, 25 bp, Mus musculus
ggtggttctgatctctctgtctcct

SEQ ID NO: 720803 - DNA, 25 bp, Mus musculus
ggtggttctgatgtctctgtctcct

SEQ ID NO: 720804 - DNA, 25 bp, Mus musculus
ggtggttctgggaggcatacttcca

SEQ ID NO: 720805 - DNA, 25 bp, Mus musculus
ggtggttctgggtggcatacttcca

SEQ ID NO: 720806 - DNA, 25 bp, Mus musculus
ggtggttgaactatgatctgaagac

SEQ ID NO: 720807 - DNA, 25 bp, Mus musculus
ggtggttgaactttgatctgaagac

SEQ ID NO: 720808 - DNA, 25 bp, Mus musculus
ggtggttgacccaactccagagcaa

SEQ ID NO: 720809 - DNA, 25 bp, Mus musculus
ggtggttgaccctactccagagcaa

SEQ ID NO: 720810 - DNA, 25 bp, Mus musculus
ggtggttggagaccaagcacctcat

SEQ ID NO: 720811 - DNA, 25 bp, Mus musculus
ggtggttggagagcaagcacctcat

SEQ ID NO: 720812 - DNA, 25 bp, Mus musculus
ggtggttggtgcacctccgtcagcc

SEQ ID NO: 720813 - DNA, 25 bp, Mus musculus
ggtggttggtgctcctccgtcagcc

SEQ ID NO: 720814 - DNA, 25 bp, Mus musculus
ggtggtttccgtacagacagaggcc

SEQ ID NO: 720815 - DNA, 25 bp, Mus musculus
ggtggtttccgttcagacagaggcc

SEQ ID NO: 720816 - DNA, 25 bp, Mus musculus
ggtggttttggcacacccatggata

SEQ ID NO: 720817 - DNA, 25 bp, Mus musculus
ggtggttttggctcacccatggata

SEQ ID NO: 720818 - DNA, 25 bp, Mus musculus
ggtgtaaacagacccagcaaaggag

SEQ ID NO: 720819 - DNA, 25 bp, Mus musculus
ggtgtaaacagagccagcaaaggag

SEQ ID NO: 720820 - DNA, 25 bp, Mus musculus
ggtgtaacaaagcactatctcttag

SEQ ID NO: 720821 - DNA, 25 bp, Mus musculus
ggtgtaacaaaggactatctcttag

SEQ ID NO: 720822 - DNA, 25 bp, Mus musculus
ggtgtaaccgctcatgatgtaaaga

SEQ ID NO: 720823 - DNA, 25 bp, Mus musculus
ggtgtaaccgctgatgatgtaaaga

SEQ ID NO: 720824 - DNA, 25 bp, Mus musculus
ggtgtaacttacagcacatagcttt

SEQ ID NO: 720825 - DNA, 25 bp, Mus musculus
ggtgtaacttactgcacatagcttt

SEQ ID NO: 720826 - DNA, 25 bp, Mus musculus
ggtgtaacttctagcgccagcggct

SEQ ID NO: 720827 - DNA, 25 bp, Mus musculus
ggtgtaacttcttgcgccagcggct

SEQ ID NO: 720828 - DNA, 25 bp, Mus musculus
ggtgtaagctggcactcctctcttt

SEQ ID NO: 720829 - DNA, 25 bp, Mus musculus
ggtgtaagctgggactcctctcttt

SEQ ID NO: 720830 - DNA, 25 bp, Mus musculus
ggtgtaatgaatcttctggagcact

SEQ ID NO: 720831 - DNA, 25 bp, Mus musculus
ggtgtaatgaatgttctggagcact

SEQ ID NO: 720832 - DNA, 25 bp, Mus musculus
ggtgtaatgtctcggcaaccaaaac

SEQ ID NO: 720833 - DNA, 25 bp, Mus musculus
ggtgtaatgtctgggcaaccaaaac

SEQ ID NO: 720834 - DNA, 25 bp, Mus musculus
ggtgtacacaatagcatccagattt

SEQ ID NO: 720835 - DNA, 25 bp, Mus musculus
ggtgtacacaattgcatccagattt

SEQ ID NO: 720836 - DNA, 25 bp, Mus musculus
ggtgtacacagcagcacgagaagcc

SEQ ID NO: 720837 - DNA, 25 bp, Mus musculus
ggtgtacacagctgcacgagaagcc

SEQ ID NO: 720838 - DNA, 25 bp, Mus musculus
ggtgtacaccccacgctgtggctca

SEQ ID NO: 720839 - DNA, 25 bp, Mus musculus
ggtgtacacccctcgctgtggctca

SEQ ID NO: 720840 - DNA, 25 bp, Mus musculus
ggtgtacacctgcaacctgcaccat

SEQ ID NO: 720841 - DNA, 25 bp, Mus musculus
ggtgtacacctggaacctgcaccat

SEQ ID NO: 720842 - DNA, 25 bp, Mus musculus
ggtgtacaccttcaactccgtgcgc

SEQ ID NO: 720843 - DNA, 25 bp, Mus musculus
ggtgtacaccttgaactccgtgcgc

SEQ ID NO: 720844 - DNA, 25 bp, Mus musculus
ggtgtacagttcagaggcctgtact

SEQ ID NO: 720845 - DNA, 25 bp, Mus musculus
ggtgtacagttctgaggcctgtact

SEQ ID NO: 720846 - DNA, 25 bp, Mus musculus
ggtgtacccaccatccgtggaacag

SEQ ID NO: 720847 - DNA, 25 bp, Mus musculus
ggtgtacccaccttccgtggaacag

SEQ ID NO: 720848 - DNA, 25 bp, Mus musculus
ggtgtacccatgacacagaagcaaa

SEQ ID NO: 720849 - DNA, 25 bp, Mus musculus
ggtgtacccatgtcacagaagcaaa

SEQ ID NO: 720850 - DNA, 25 bp, Mus musculus
ggtgtaccccacaatacctgtctgg

SEQ ID NO: 720851 - DNA, 25 bp, Mus musculus
ggtgtaccccactatacctgtctgg

SEQ ID NO: 720852 - DNA, 25 bp, Mus musculus
ggtgtaccctatctctgcatcaaag

SEQ ID NO: 720853 - DNA, 25 bp, Mus musculus
ggtgtaccctatgtctgcatcaaag

SEQ ID NO: 720854 - DNA, 25 bp, Mus musculus
ggtgtacctcatcatccgggcctgt

SEQ ID NO: 720855 - DNA, 25 bp, Mus musculus
ggtgtacctcatgatccgggcctgt

SEQ ID NO: 720856 - DNA, 25 bp, Mus musculus
ggtgtacctcgactacctgaggaga

SEQ ID NO: 720857 - DNA, 25 bp, Mus musculus
ggtgtacctcgagtacctgaggaga

SEQ ID NO: 720858 - DNA, 25 bp, Mus musculus
ggtgtacctgggactcgtggatttc

SEQ ID NO: 720859 - DNA, 25 bp, Mus musculus
ggtgtacctgggtctcgtggatttc

SEQ ID NO: 720860 - DNA, 25 bp, Mus musculus
ggtgtactaactaccccacagatgg

SEQ ID NO: 720861 - DNA, 25 bp, Mus musculus
ggtgtactaacttccccacagatgg

SEQ ID NO: 720862 - DNA, 25 bp, Mus musculus
ggtgtactactacgacgatgtcaga

SEQ ID NO: 720863 - DNA, 25 bp, Mus musculus
ggtgtactactaggacgatgtcaga

SEQ ID NO: 720864 - DNA, 25 bp, Mus musculus
ggtgtacttccgagatggctacatg

SEQ ID NO: 720865 - DNA, 25 bp, Mus musculus
ggtgtacttccgtgatggctacatg

SEQ ID NO: 720866 - DNA, 25 bp, Mus musculus
ggtgtagaaaacaagttaacaccat

SEQ ID NO: 720867 - DNA, 25 bp, Mus musculus
ggtgtagaaaactagttaacaccat

SEQ ID NO: 720868 - DNA, 25 bp, Mus musculus
ggtgtagaatcacagctcccttaag

SEQ ID NO: 720869 - DNA, 25 bp, Mus musculus
ggtgtagaatcagagctcccttaag

SEQ ID NO: 720870 - DNA, 25 bp, Mus musculus
ggtgtagaatttatatctaagcata

SEQ ID NO: 720871 - DNA, 25 bp, Mus musculus
ggtgtagaatttttatctaagcata

SEQ ID NO: 720872 - DNA, 25 bp, Mus musculus
ggtgtagccactacataaggtgcca

SEQ ID NO: 720873 - DNA, 25 bp, Mus musculus
ggtgtagccacttcataaggtgcca

SEQ ID NO: 720874 - DNA, 25 bp, Mus musculus
ggtgtagcgtccagggctgacctct

SEQ ID NO: 720875 - DNA, 25 bp, Mus musculus
ggtgtagcgtcctgggctgacctct

SEQ ID NO: 720876 - DNA, 25 bp, Mus musculus
ggtgtagctcagcacttcatcaaag

SEQ ID NO: 720877 - DNA, 25 bp, Mus musculus
ggtgtagctcaggacttcatcaaag

SEQ ID NO: 720878 - DNA, 25 bp, Mus musculus
ggtgtagtgactaccaaagcccaag

SEQ ID NO: 720879 - DNA, 25 bp, Mus musculus
ggtgtagtgacttccaaagcccaag

SEQ ID NO: 720880 - DNA, 25 bp, Mus musculus
ggtgtataccttccctccattgcct

SEQ ID NO: 720881 - DNA, 25 bp, Mus musculus
ggtgtataccttgcctccattgcct

SEQ ID NO: 720882 - DNA, 25 bp, Mus musculus
ggtgtatactgtcaaatcaacacgg

SEQ ID NO: 720883 - DNA, 25 bp, Mus musculus
ggtgtatactgtgaaatcaacacgg

SEQ ID NO: 720884 - DNA, 25 bp, Mus musculus
ggtgtatattcaagagccgctgact

SEQ ID NO: 720885 - DNA, 25 bp, Mus musculus
ggtgtatattcatgagccgctgact

SEQ ID NO: 720886 - DNA, 25 bp, Mus musculus
ggtgtatcaccacataaattgcctg

SEQ ID NO: 720887 - DNA, 25 bp, Mus musculus
ggtgtatcaccagataaattgcctg

SEQ ID NO: 720888 - DNA, 25 bp, Mus musculus
ggtgtatcagcaacagcagtatggc

SEQ ID NO: 720889 - DNA, 25 bp, Mus musculus
ggtgtatcagcatcagcagtatggc

SEQ ID NO: 720890 - DNA, 25 bp, Mus musculus
ggtgtatgcgtcactagaagcgtac

SEQ ID NO: 720891 - DNA, 25 bp, Mus musculus
ggtgtatgcgtctctagaagcgtac

SEQ ID NO: 720892 - DNA, 25 bp, Mus musculus
ggtgtatgtggcaacagcctctcct

SEQ ID NO: 720893 - DNA, 25 bp, Mus musculus
ggtgtatgtggctacagcctctcct

SEQ ID NO: 720894 - DNA, 25 bp, Mus musculus
ggtgtattccctacttaaggagcaa

SEQ ID NO: 720895 - DNA, 25 bp, Mus musculus
ggtgtattcccttcttaaggagcaa

SEQ ID NO: 720896 - DNA, 25 bp, Mus musculus
ggtgtatttatgcacaaaagggctc

SEQ ID NO: 720897 - DNA, 25 bp, Mus musculus
ggtgtatttatggacaaaagggctc

SEQ ID NO: 720898 - DNA, 25 bp, Mus musculus
ggtgtattttagcacagggcagtcc

SEQ ID NO: 720899 - DNA, 25 bp, Mus musculus
ggtgtattttaggacagggcagtcc

SEQ ID NO: 720900 - DNA, 25 bp, Mus musculus
ggtgtcaaatggagcagacccgcct

SEQ ID NO: 720901 - DNA, 25 bp, Mus musculus
ggtgtcaaatggtgcagacccgcct

SEQ ID NO: 720902 - DNA, 25 bp, Mus musculus
ggtgtcaccgaacgctacaatggga

SEQ ID NO: 720903 - DNA, 25 bp, Mus musculus
ggtgtcaccgaaggctacaatggga

SEQ ID NO: 720904 - DNA, 25 bp, Mus musculus
ggtgtcactgcactcagttgctggc

SEQ ID NO: 720905 - DNA, 25 bp, Mus musculus
ggtgtcactgcagtcagttgctggc

SEQ ID NO: 720906 - DNA, 25 bp, Mus musculus
ggtgtcacttatagagaaagcatac

SEQ ID NO: 720907 - DNA, 25 bp, Mus musculus
ggtgtcacttattgagaaagcatac

SEQ ID NO: 720908 - DNA, 25 bp, Mus musculus
ggtgtcagactccacctacgacgaa

SEQ ID NO: 720909 - DNA, 25 bp, Mus musculus
ggtgtcagactcgacctacgacgaa

SEQ ID NO: 720910 - DNA, 25 bp, Mus musculus
ggtgtcagagaacgagtttaacttt

SEQ ID NO: 720911 - DNA, 25 bp, Mus musculus
ggtgtcagagaaggagtttaacttt

SEQ ID NO: 720912 - DNA, 25 bp, Mus musculus
ggtgtcagatcaaaccccgaggctc

SEQ ID NO: 720913 - DNA, 25 bp, Mus musculus
ggtgtcagatcataccccgaggctc

SEQ ID NO: 720914 - DNA, 25 bp, Mus musculus
ggtgtcagatgtcactgtcactcat

SEQ ID NO: 720915 - DNA, 25 bp, Mus musculus
ggtgtcagatgtgactgtcactcat

SEQ ID NO: 720916 - DNA, 25 bp, Mus musculus
ggtgtcagcccactttcccatcgat

SEQ ID NO: 720917 - DNA, 25 bp, Mus musculus
ggtgtcagcccagtttcccatcgat

SEQ ID NO: 720918 - DNA, 25 bp, Mus musculus
ggtgtcagcggcaccaattttctgc

SEQ ID NO: 720919 - DNA, 25 bp, Mus musculus
ggtgtcagcggctccaattttctgc

SEQ ID NO: 720920 - DNA, 25 bp, Mus musculus
ggtgtcaggctgaatgtatcctcca

SEQ ID NO: 720921 - DNA, 25 bp, Mus musculus
ggtgtcaggctgtatgtatcctcca

SEQ ID NO: 720922 - DNA, 25 bp, Mus musculus
ggtgtcagtctcactagtcagttcc

SEQ ID NO: 720923 - DNA, 25 bp, Mus musculus
ggtgtcagtctctctagtcagttcc

SEQ ID NO: 720924 - DNA, 25 bp, Mus musculus
ggtgtcatcagtcggcctctccttg

SEQ ID NO: 720925 - DNA, 25 bp, Mus musculus
ggtgtcatcagtgggcctctccttg

SEQ ID NO: 720926 - DNA, 25 bp, Mus musculus
ggtgtcatctccagagcacccacag

SEQ ID NO: 720927 - DNA, 25 bp, Mus musculus
ggtgtcatctcctgagcacccacag

SEQ ID NO: 720928 - DNA, 25 bp, Mus musculus
ggtgtcattacacggagttccttcc

SEQ ID NO: 720929 - DNA, 25 bp, Mus musculus
ggtgtcattacagggagttccttcc

SEQ ID NO: 720930 - DNA, 25 bp, Mus musculus
ggtgtcattccaacattggtttaca

SEQ ID NO: 720931 - DNA, 25 bp, Mus musculus
ggtgtcattccatcattggtttaca

SEQ ID NO: 720932 - DNA, 25 bp, Mus musculus
ggtgtcattctgctaaggttctcgg

SEQ ID NO: 720933 - DNA, 25 bp, Mus musculus
ggtgtcattctggtaaggttctcgg

SEQ ID NO: 720934 - DNA, 25 bp, Mus musculus
ggtgtccaacctctatgtcatctcc

SEQ ID NO: 720935 - DNA, 25 bp, Mus musculus
ggtgtccaacctgtatgtcatctcc

SEQ ID NO: 720936 - DNA, 25 bp, Mus musculus
ggtgtccaagctcacgtcgctccag

SEQ ID NO: 720937 - DNA, 25 bp, Mus musculus
ggtgtccaagctgacgtcgctccag

SEQ ID NO: 720938 - DNA, 25 bp, Mus musculus
ggtgtccacactcgatgctgctttg

SEQ ID NO: 720939 - DNA, 25 bp, Mus musculus
ggtgtccacactggatgctgctttg

SEQ ID NO: 720940 - DNA, 25 bp, Mus musculus
ggtgtccacataagatagcagttta

SEQ ID NO: 720941 - DNA, 25 bp, Mus musculus
ggtgtccacatatgatagcagttta

SEQ ID NO: 720942 - DNA, 25 bp, Mus musculus
ggtgtccacccacatgacagcggga

SEQ ID NO: 720943 - DNA, 25 bp, Mus musculus
ggtgtccacccagatgacagcggga

SEQ ID NO: 720944 - DNA, 25 bp, Mus musculus
ggtgtccacgcacgcacaattaaca

SEQ ID NO: 720945 - DNA, 25 bp, Mus musculus
ggtgtccacgcaggcacaattaaca

SEQ ID NO: 720946 - DNA, 25 bp, Mus musculus
ggtgtccagttccaaaaccaaagtg

SEQ ID NO: 720947 - DNA, 25 bp, Mus musculus
ggtgtccagttcgaaaaccaaagtg

SEQ ID NO: 720948 - DNA, 25 bp, Mus musculus
ggtgtccatcccactgaacaaggtg

SEQ ID NO: 720949 - DNA, 25 bp, Mus musculus
ggtgtccatccctctgaacaaggtg

SEQ ID NO: 720950 - DNA, 25 bp, Mus musculus
ggtgtccatttgagttctcatcctc

SEQ ID NO: 720951 - DNA, 25 bp, Mus musculus
ggtgtccatttgtgttctcatcctc

SEQ ID NO: 720952 - DNA, 25 bp, Mus musculus
ggtgtcccaaccatgcgtgagagct

SEQ ID NO: 720953 - DNA, 25 bp, Mus musculus
ggtgtcccaaccttgcgtgagagct

SEQ ID NO: 720954 - DNA, 25 bp, Mus musculus
ggtgtcccaggtctgagcatagtcc

SEQ ID NO: 720955 - DNA, 25 bp, Mus musculus
ggtgtcccaggtgtgagcatagtcc

SEQ ID NO: 720956 - DNA, 25 bp, Mus musculus
ggtgtccccacaaccttggttgccg

SEQ ID NO: 720957 - DNA, 25 bp, Mus musculus
ggtgtccccacaatgatgaagtcat

SEQ ID NO: 720958 - DNA, 25 bp, Mus musculus
ggtgtccccacatccttggttgccg

SEQ ID NO: 720959 - DNA, 25 bp, Mus musculus
ggtgtccccacattgatgaagtcat

SEQ ID NO: 720960 - DNA, 25 bp, Mus musculus
ggtgtccccacccactgaataggga

SEQ ID NO: 720961 - DNA, 25 bp, Mus musculus
ggtgtccccaccgactgaataggga

SEQ ID NO: 720962 - DNA, 25 bp, Mus musculus
ggtgtccccgacctggactctgtca

SEQ ID NO: 720963 - DNA, 25 bp, Mus musculus
ggtgtccccgacgtggactctgtca

SEQ ID NO: 720964 - DNA, 25 bp, Mus musculus
ggtgtccctattcatctcttcatgg

SEQ ID NO: 720965 - DNA, 25 bp, Mus musculus
ggtgtccctattgatctcttcatgg

SEQ ID NO: 720966 - DNA, 25 bp, Mus musculus
ggtgtccctcccactggcatttgag

SEQ ID NO: 720967 - DNA, 25 bp, Mus musculus
ggtgtccctccctctggcatttgag

SEQ ID NO: 720968 - DNA, 25 bp, Mus musculus
ggtgtccctgatcacctgctctact

SEQ ID NO: 720969 - DNA, 25 bp, Mus musculus
ggtgtccctgatgacctgctctact

SEQ ID NO: 720970 - DNA, 25 bp, Mus musculus
ggtgtccctgtactgggaatcccac

SEQ ID NO: 720971 - DNA, 25 bp, Mus musculus
ggtgtccctgtagtgggaatcccac

SEQ ID NO: 720972 - DNA, 25 bp, Mus musculus
ggtgtccgcctacagtttccagcag

SEQ ID NO: 720973 - DNA, 25 bp, Mus musculus
ggtgtccgcctagagtttccagcag

SEQ ID NO: 720974 - DNA, 25 bp, Mus musculus
ggtgtccgtcaccagtcagtgtagc

SEQ ID NO: 720975 - DNA, 25 bp, Mus musculus
ggtgtccgtcacgagtcagtgtagc

SEQ ID NO: 720976 - DNA, 25 bp, Mus musculus
ggtgtccgtcagacaggaactgcta

SEQ ID NO: 720977 - DNA, 25 bp, Mus musculus
ggtgtccgtcagtcaggaactgcta

SEQ ID NO: 720978 - DNA, 25 bp, Mus musculus
ggtgtccgtctgcagatccctgcct

SEQ ID NO: 720979 - DNA, 25 bp, Mus musculus
ggtgtccgtctggagatccctgcct

SEQ ID NO: 720980 - DNA, 25 bp, Mus musculus
ggtgtcctaaagacaggagagaagc

SEQ ID NO: 720981 - DNA, 25 bp, Mus musculus
ggtgtcctaaagtcaggagagaagc

SEQ ID NO: 720982 - DNA, 25 bp, Mus musculus
ggtgtcctgatgcaactgcaagact

SEQ ID NO: 720983 - DNA, 25 bp, Mus musculus
ggtgtcctgatggaactgcaagact

SEQ ID NO: 720984 - DNA, 25 bp, Mus musculus
ggtgtcctgcatctgtcctacagcg

SEQ ID NO: 720985 - DNA, 25 bp, Mus musculus
ggtgtcctgcatgtgtcctacagcg

SEQ ID NO: 720986 - DNA, 25 bp, Mus musculus
ggtgtcctgtaaccctcaataaagc

SEQ ID NO: 720987 - DNA, 25 bp, Mus musculus
ggtgtcctgtaagcctcaataaagc

SEQ ID NO: 720988 - DNA, 25 bp, Mus musculus
ggtgtcctgttcctgttgcatatgt

SEQ ID NO: 720989 - DNA, 25 bp, Mus musculus
ggtgtcctgttcgtgttgcatatgt

SEQ ID NO: 720990 - DNA, 25 bp, Mus musculus
ggtgtcgaacatcccatggccaaca

SEQ ID NO: 720991 - DNA, 25 bp, Mus musculus
ggtgtcgaacatgccatggccaaca

SEQ ID NO: 720992 - DNA, 25 bp, Mus musculus
ggtgtcgctgcgcttgtcaccatca

SEQ ID NO: 720993 - DNA, 25 bp, Mus musculus
ggtgtcgctgcggttgtcaccatca

SEQ ID NO: 720994 - DNA, 25 bp, Mus musculus
ggtgtcgtagtcactcttcagcaca

SEQ ID NO: 720995 - DNA, 25 bp, Mus musculus
ggtgtcgtagtctctcttcagcaca

SEQ ID NO: 720996 - DNA, 25 bp, Mus musculus
ggtgtcgttaccatagatgagttca

SEQ ID NO: 720997 - DNA, 25 bp, Mus musculus
ggtgtcgttaccttagatgagttca

SEQ ID NO: 720998 - DNA, 25 bp, Mus musculus
ggtgtctaagatccgtgacatgcag

SEQ ID NO: 720999 - DNA, 25 bp, Mus musculus
ggtgtctaagatgcgtgacatgcag

SEQ ID NO: 721000 - DNA, 25 bp, Mus musculus
ggtgtctattctcgacagctatcaa

SEQ ID NO: 721001 - DNA, 25 bp, Mus musculus
ggtgtctattctggacagctatcaa

SEQ ID NO: 721002 - DNA, 25 bp, Mus musculus
ggtgtctgagaacctacgtgatgtc

SEQ ID NO: 721003 - DNA, 25 bp, Mus musculus
ggtgtctgagaagctacgtgatgtc

SEQ ID NO: 721004 - DNA, 25 bp, Mus musculus
ggtgtctgccatagtacgcaccatg

SEQ ID NO: 721005 - DNA, 25 bp, Mus musculus
ggtgtctgccattgtacgcaccatg

SEQ ID NO: 721006 - DNA, 25 bp, Mus musculus
ggtgtctgctctcaatggtgcccac

SEQ ID NO: 721007 - DNA, 25 bp, Mus musculus
ggtgtctgctctgaatggtgcccac

SEQ ID NO: 721008 - DNA, 25 bp, Mus musculus
ggtgtctggcccagcttactatgtg

SEQ ID NO: 721009 - DNA, 25 bp, Mus musculus
ggtgtctggccctgcttactatgtg

SEQ ID NO: 721010 - DNA, 25 bp, Mus musculus
ggtgtctgggacaacatcacatgct

SEQ ID NO: 721011 - DNA, 25 bp, Mus musculus
ggtgtctgggactacatcacatgct

SEQ ID NO: 721012 - DNA, 25 bp, Mus musculus
ggtgtctgtggacatcagccacact

SEQ ID NO: 721013 - DNA, 25 bp, Mus musculus
ggtgtctgtggagatcagccacact

SEQ ID NO: 721014 - DNA, 25 bp, Mus musculus
ggtgtcttcccactgctacatgtgc

SEQ ID NO: 721015 - DNA, 25 bp, Mus musculus
ggtgtcttcccagtgctacatgtgc

SEQ ID NO: 721016 - DNA, 25 bp, Mus musculus
ggtgtcttggttcccaatctaaagg

SEQ ID NO: 721017 - DNA, 25 bp, Mus musculus
ggtgtcttggttgccaatctaaagg

SEQ ID NO: 721018 - DNA, 25 bp, Mus musculus
ggtgtcttgtgtccgcttctccccg

SEQ ID NO: 721019 - DNA, 25 bp, Mus musculus
ggtgtcttgtgtgcgcttctccccg

SEQ ID NO: 721020 - DNA, 25 bp, Mus musculus
ggtgtctttgtcaacgggcggccac

SEQ ID NO: 721021 - DNA, 25 bp, Mus musculus
ggtgtctttgtctacgggcggccac

SEQ ID NO: 721022 - DNA, 25 bp, Mus musculus
ggtgtcttttaaagtttccaggagc

SEQ ID NO: 721023 - DNA, 25 bp, Mus musculus
ggtgtcttttaatgtttccaggagc

SEQ ID NO: 721024 - DNA, 25 bp, Mus musculus
ggtgtgaatttccactttctcggag

SEQ ID NO: 721025 - DNA, 25 bp, Mus musculus
ggtgtgaatttcgactttctcggag

SEQ ID NO: 721026 - DNA, 25 bp, Mus musculus
ggtgtgacaatgcaactcaggtgac

SEQ ID NO: 721027 - DNA, 25 bp, Mus musculus
ggtgtgacaatggaactcaggtgac

SEQ ID NO: 721028 - DNA, 25 bp, Mus musculus
ggtgtgacattgaaagaagcaaatg

SEQ ID NO: 721029 - DNA, 25 bp, Mus musculus
ggtgtgacattgtaagaagcaaatg

SEQ ID NO: 721030 - DNA, 25 bp, Mus musculus
ggtgtgaccagcatgtacttttcag

SEQ ID NO: 721031 - DNA, 25 bp, Mus musculus
ggtgtgaccagcttgtacttttcag

SEQ ID NO: 721032 - DNA, 25 bp, Mus musculus
ggtgtgacgtgcatcattttcatcg

SEQ ID NO: 721033 - DNA, 25 bp, Mus musculus
ggtgtgacgtgcttcattttcatcg

SEQ ID NO: 721034 - DNA, 25 bp, Mus musculus
ggtgtgactgagagttacgaatgtc

SEQ ID NO: 721035 - DNA, 25 bp, Mus musculus
ggtgtgactgagtgttacgaatgtc

SEQ ID NO: 721036 - DNA, 25 bp, Mus musculus
ggtgtgagcacacacacctctaact

SEQ ID NO: 721037 - DNA, 25 bp, Mus musculus
ggtgtgagcacagacacctctaact

SEQ ID NO: 721038 - DNA, 25 bp, Mus musculus
ggtgtgatccagcacaaagaaaaat

SEQ ID NO: 721039 - DNA, 25 bp, Mus musculus
ggtgtgatccaggacaaagaaaaat

SEQ ID NO: 721040 - DNA, 25 bp, Mus musculus
ggtgtgatgcgcactgctatgcctt

SEQ ID NO: 721041 - DNA, 25 bp, Mus musculus
ggtgtgatgcgctctgctatgcctt

SEQ ID NO: 721042 - DNA, 25 bp, Mus musculus
ggtgtgattgcccatccccagataa

SEQ ID NO: 721043 - DNA, 25 bp, Mus musculus
ggtgtgattgccgatccccagataa

SEQ ID NO: 721044 - DNA, 25 bp, Mus musculus
ggtgtgcaccatcaacgacggtccc

SEQ ID NO: 721045 - DNA, 25 bp, Mus musculus
ggtgtgcaccatcgcaccttgccaa

SEQ ID NO: 721046 - DNA, 25 bp, Mus musculus
ggtgtgcaccatgaacgacggtccc

SEQ ID NO: 721047 - DNA, 25 bp, Mus musculus
ggtgtgcaccatggcaccttgccaa

SEQ ID NO: 721048 - DNA, 25 bp, Mus musculus
ggtgtgcagattatagtgttcccag

SEQ ID NO: 721049 - DNA, 25 bp, Mus musculus
ggtgtgcagattttagtgttcccag

SEQ ID NO: 721050 - DNA, 25 bp, Mus musculus
ggtgtgcattttactgagtctctca

SEQ ID NO: 721051 - DNA, 25 bp, Mus musculus
ggtgtgcatttttctgagtctctca

SEQ ID NO: 721052 - DNA, 25 bp, Mus musculus
ggtgtgccaatcagggatcctaaca

SEQ ID NO: 721053 - DNA, 25 bp, Mus musculus
ggtgtgccaatctgggatcctaaca

SEQ ID NO: 721054 - DNA, 25 bp, Mus musculus
ggtgtgccagacaagagccatgaag

SEQ ID NO: 721055 - DNA, 25 bp, Mus musculus
ggtgtgccagactagagccatgaag

SEQ ID NO: 721056 - DNA, 25 bp, Mus musculus
ggtgtgccccgacggcaagagcagt

SEQ ID NO: 721057 - DNA, 25 bp, Mus musculus
ggtgtgccccgagggcaagagcagt

SEQ ID NO: 721058 - DNA, 25 bp, Mus musculus
ggtgtgccgcgtcggtccagaggct

SEQ ID NO: 721059 - DNA, 25 bp, Mus musculus
ggtgtgccgcgtgggtccagaggct

SEQ ID NO: 721060 - DNA, 25 bp, Mus musculus
ggtgtgcctgagcatgctataccac

SEQ ID NO: 721061 - DNA, 25 bp, Mus musculus
ggtgtgcctgaggatgctataccac

SEQ ID NO: 721062 - DNA, 25 bp, Mus musculus
ggtgtgcgaccacatcgaacttcga

SEQ ID NO: 721063 - DNA, 25 bp, Mus musculus
ggtgtgcgaccagatcgaacttcga

SEQ ID NO: 721064 - DNA, 25 bp, Mus musculus
ggtgtgcgatggcagccccgagtgc

SEQ ID NO: 721065 - DNA, 25 bp, Mus musculus
ggtgtgcgatgggagccccgagtgc

SEQ ID NO: 721066 - DNA, 25 bp, Mus musculus
ggtgtgcgtcttcttgttcgctgcc

SEQ ID NO: 721067 - DNA, 25 bp, Mus musculus
ggtgtgcgtcttgttgttcgctgcc

SEQ ID NO: 721068 - DNA, 25 bp, Mus musculus
ggtgtgctaactacgtcaatgggaa

SEQ ID NO: 721069 - DNA, 25 bp, Mus musculus
ggtgtgctaacttcgtcaatgggaa

SEQ ID NO: 721070 - DNA, 25 bp, Mus musculus
ggtgtgctacaccatctagcatcca

SEQ ID NO: 721071 - DNA, 25 bp, Mus musculus
ggtgtgctacacgatctagcatcca

SEQ ID NO: 721072 - DNA, 25 bp, Mus musculus
ggtgtgctgcacctcgattgtgtac

SEQ ID NO: 721073 - DNA, 25 bp, Mus musculus
ggtgtgctgcacgtcgattgtgtac

SEQ ID NO: 721074 - DNA, 25 bp, Mus musculus
ggtgtgctgccccacttcgggttct

SEQ ID NO: 721075 - DNA, 25 bp, Mus musculus
ggtgtgctgcccgacttcgggttct

SEQ ID NO: 721076 - DNA, 25 bp, Mus musculus
ggtgtgctgccgctgtgccccaacc

SEQ ID NO: 721077 - DNA, 25 bp, Mus musculus
ggtgtgctgccggtgtgccccaacc

SEQ ID NO: 721078 - DNA, 25 bp, Mus musculus
ggtgtgctgtgcatagcccatggct

SEQ ID NO: 721079 - DNA, 25 bp, Mus musculus
ggtgtgctgtgcttagcccatggct

SEQ ID NO: 721080 - DNA, 25 bp, Mus musculus
ggtgtgcttagcaacaaggctctgc

SEQ ID NO: 721081 - DNA, 25 bp, Mus musculus
ggtgtgcttagctacaaggctctgc

SEQ ID NO: 721082 - DNA, 25 bp, Mus musculus
ggtgtggaaagcaacagccatccca

SEQ ID NO: 721083 - DNA, 25 bp, Mus musculus
ggtgtggaaagctacagccatccca

SEQ ID NO: 721084 - DNA, 25 bp, Mus musculus
ggtgtggaacttccccatcgatgtg

SEQ ID NO: 721085 - DNA, 25 bp, Mus musculus
ggtgtggaacttgcccatcgatgtg

SEQ ID NO: 721086 - DNA, 25 bp, Mus musculus
ggtgtggacgtgaatatccggaaca

SEQ ID NO: 721087 - DNA, 25 bp, Mus musculus
ggtgtggacgtgtatatccggaaca

SEQ ID NO: 721088 - DNA, 25 bp, Mus musculus
ggtgtggactcgatctaccttgaga

SEQ ID NO: 721089 - DNA, 25 bp, Mus musculus
ggtgtggactcgttctaccttgaga

SEQ ID NO: 721090 - DNA, 25 bp, Mus musculus
ggtgtggactgccatggcttttcca

SEQ ID NO: 721091 - DNA, 25 bp, Mus musculus
ggtgtggactgcgatggcttttcca

SEQ ID NO: 721092 - DNA, 25 bp, Mus musculus
ggtgtggagaggacccaagaaacat

SEQ ID NO: 721093 - DNA, 25 bp, Mus musculus
ggtgtggagaggtcccaagaaacat

SEQ ID NO: 721094 - DNA, 25 bp, Mus musculus
ggtgtggcactcaacctgctacctg

SEQ ID NO: 721095 - DNA, 25 bp, Mus musculus
ggtgtggcactctacctgctacctg

SEQ ID NO: 721096 - DNA, 25 bp, Mus musculus
ggtgtggccacaacaccgatacttg

SEQ ID NO: 721097 - DNA, 25 bp, Mus musculus
ggtgtggccacatcaccgatacttg

SEQ ID NO: 721098 - DNA, 25 bp, Mus musculus
ggtgtggccattccagcacctccgt

SEQ ID NO: 721099 - DNA, 25 bp, Mus musculus
ggtgtggccattgcagcacctccgt

SEQ ID NO: 721100 - DNA, 25 bp, Mus musculus
ggtgtggcccacagtaaatctagca

SEQ ID NO: 721101 - DNA, 25 bp, Mus musculus
ggtgtggcccactgtaaatctagca

SEQ ID NO: 721102 - DNA, 25 bp, Mus musculus
ggtgtggccttcattcctggaatgt

SEQ ID NO: 721103 - DNA, 25 bp, Mus musculus
ggtgtggccttctttcctggaatgt

SEQ ID NO: 721104 - DNA, 25 bp, Mus musculus
ggtgtggcgtccctgaacagctact

SEQ ID NO: 721105 - DNA, 25 bp, Mus musculus
ggtgtggcgtccgtgaacagctact

SEQ ID NO: 721106 - DNA, 25 bp, Mus musculus
ggtgtggcttttccccgtctctcaa

SEQ ID NO: 721107 - DNA, 25 bp, Mus musculus
ggtgtggcttttgcccgtctctcaa

SEQ ID NO: 721108 - DNA, 25 bp, Mus musculus
ggtgtgggctgtccaattccactct

SEQ ID NO: 721109 - DNA, 25 bp, Mus musculus
ggtgtgggctgtgcaattccactct

SEQ ID NO: 721110 - DNA, 25 bp, Mus musculus
ggtgtggtcaatacggtcttcacgt

SEQ ID NO: 721111 - DNA, 25 bp, Mus musculus
ggtgtggtcaattcggtcttcacgt

SEQ ID NO: 721112 - DNA, 25 bp, Mus musculus
ggtgtggtctggacagtccccgcct

SEQ ID NO: 721113 - DNA, 25 bp, Mus musculus
ggtgtggtctggtcagtccccgcct

SEQ ID NO: 721114 - DNA, 25 bp, Mus musculus
ggtgtggtgcgtcggcaacgaggcc

SEQ ID NO: 721115 - DNA, 25 bp, Mus musculus
ggtgtggtgcgtgggcaacgaggcc

SEQ ID NO: 721116 - DNA, 25 bp, Mus musculus
ggtgtggtggctattgacctttgcc

SEQ ID NO: 721117 - DNA, 25 bp, Mus musculus
ggtgtggtggcttttgacctttgcc

SEQ ID NO: 721118 - DNA, 25 bp, Mus musculus
ggtgtggtgtccacatatgatagca

SEQ ID NO: 721119 - DNA, 25 bp, Mus musculus
ggtgtggtgtcctcatatgatagca

SEQ ID NO: 721120 - DNA, 25 bp, Mus musculus
ggtgtggtgtctagcattcacatca

SEQ ID NO: 721121 - DNA, 25 bp, Mus musculus
ggtgtggtgtcttgcattcacatca

SEQ ID NO: 721122 - DNA, 25 bp, Mus musculus
ggtgtgtaacatcttcagctctcaa

SEQ ID NO: 721123 - DNA, 25 bp, Mus musculus
ggtgtgtaacatgttcagctctcaa

SEQ ID NO: 721124 - DNA, 25 bp, Mus musculus
ggtgtgtaagaaccgctcagatagt

SEQ ID NO: 721125 - DNA, 25 bp, Mus musculus
ggtgtgtaagaagcgctcagatagt

SEQ ID NO: 721126 - DNA, 25 bp, Mus musculus
ggtgtgtagccgcattcagcatctc

SEQ ID NO: 721127 - DNA, 25 bp, Mus musculus
ggtgtgtagccggattcagcatctc

SEQ ID NO: 721128 - DNA, 25 bp, Mus musculus
ggtgtgtaggatccgccaagatccc

SEQ ID NO: 721129 - DNA, 25 bp, Mus musculus
ggtgtgtaggatgcgccaagatccc

SEQ ID NO: 721130 - DNA, 25 bp, Mus musculus
ggtgtgtatatgagccagccagccc

SEQ ID NO: 721131 - DNA, 25 bp, Mus musculus
ggtgtgtatatgtgccagccagccc

SEQ ID NO: 721132 - DNA, 25 bp, Mus musculus
ggtgtgtatgaacccctgaaagacg

SEQ ID NO: 721133 - DNA, 25 bp, Mus musculus
ggtgtgtatgaagccctgaaagacg

SEQ ID NO: 721134 - DNA, 25 bp, Mus musculus
ggtgtgtatgagctcagcctttgcc

SEQ ID NO: 721135 - DNA, 25 bp, Mus musculus
ggtgtgtatgaggtcagcctttgcc

SEQ ID NO: 721136 - DNA, 25 bp, Mus musculus
ggtgtgtattttctcgttgcctgcc

SEQ ID NO: 721137 - DNA, 25 bp, Mus musculus
ggtgtgtattttgtcgttgcctgcc

SEQ ID NO: 721138 - DNA, 25 bp, Mus musculus
ggtgtgtccaccacagacctcgtgg

SEQ ID NO: 721139 - DNA, 25 bp, Mus musculus
ggtgtgtccacctcagacctcgtgg

SEQ ID NO: 721140 - DNA, 25 bp, Mus musculus
ggtgtgtccccacgatcatttctgg

SEQ ID NO: 721141 - DNA, 25 bp, Mus musculus
ggtgtgtccccaggatcatttctgg

SEQ ID NO: 721142 - DNA, 25 bp, Mus musculus
ggtgtgtcctgcctaccaggcctac

SEQ ID NO: 721143 - DNA, 25 bp, Mus musculus
ggtgtgtcctgcgtaccaggcctac

SEQ ID NO: 721144 - DNA, 25 bp, Mus musculus
ggtgtgtgccctacaaatagactga

SEQ ID NO: 721145 - DNA, 25 bp, Mus musculus
ggtgtgtgcccttcaaatagactga

SEQ ID NO: 721146 - DNA, 25 bp, Mus musculus
ggtgtgtgtgagcaactaacctatg

SEQ ID NO: 721147 - DNA, 25 bp, Mus musculus
ggtgtgtgtgaggaactaacctatg

SEQ ID NO: 721148 - DNA, 25 bp, Mus musculus
ggtgtgtgtgccactttgtctcaga

SEQ ID NO: 721149 - DNA, 25 bp, Mus musculus
ggtgtgtgtgcctctttgtctcaga

SEQ ID NO: 721150 - DNA, 25 bp, Mus musculus
ggtgtgttacaccaaatggaagacc

SEQ ID NO: 721151 - DNA, 25 bp, Mus musculus
ggtgtgttacacgaaatggaagacc

SEQ ID NO: 721152 - DNA, 25 bp, Mus musculus
ggtgtgttcgcccagcgctactcac

SEQ ID NO: 721153 - DNA, 25 bp, Mus musculus
ggtgtgttcgccgagcgctactcac

SEQ ID NO: 721154 - DNA, 25 bp, Mus musculus
ggtgtgttcttcatctgtccgctca

SEQ ID NO: 721155 - DNA, 25 bp, Mus musculus
ggtgtgttcttcttctgtccgctca

SEQ ID NO: 721156 - DNA, 25 bp, Mus musculus
ggtgtgttgcttaggaagctcctgc

SEQ ID NO: 721157 - DNA, 25 bp, Mus musculus
ggtgtgttgctttggaagctcctgc

SEQ ID NO: 721158 - DNA, 25 bp, Mus musculus
ggtgtgtttaacattgtcaacaaag

SEQ ID NO: 721159 - DNA, 25 bp, Mus musculus
ggtgtgtttaactttgtcaacaaag

SEQ ID NO: 721160 - DNA, 25 bp, Mus musculus
ggtgtgtttgacctggacaagaaaa

SEQ ID NO: 721161 - DNA, 25 bp, Mus musculus
ggtgtgtttgacgtggacaagaaaa

SEQ ID NO: 721162 - DNA, 25 bp, Mus musculus
ggtgtgttttacaaagcatcgtctt

SEQ ID NO: 721163 - DNA, 25 bp, Mus musculus
ggtgtgttttactaagcatcgtctt

SEQ ID NO: 721164 - DNA, 25 bp, Mus musculus
ggtgttaaaactctcccaaataatg

SEQ ID NO: 721165 - DNA, 25 bp, Mus musculus
ggtgttaaaactgtcccaaataatg

SEQ ID NO: 721166 - DNA, 25 bp, Mus musculus
ggtgttaacaccacggacaaagaga

SEQ ID NO: 721167 - DNA, 25 bp, Mus musculus
ggtgttaacacctcggacaaagaga

SEQ ID NO: 721168 - DNA, 25 bp, Mus musculus
ggtgttaaccatcacatccggacag

SEQ ID NO: 721169 - DNA, 25 bp, Mus musculus
ggtgttaaccatgacatccggacag

SEQ ID NO: 721170 - DNA, 25 bp, Mus musculus
ggtgttaacctcaagtgtaatgctg

SEQ ID NO: 721171 - DNA, 25 bp, Mus musculus
ggtgttaacctctagtgtaatgctg

SEQ ID NO: 721172 - DNA, 25 bp, Mus musculus
ggtgttaatgctcaaagtatcagac

SEQ ID NO: 721173 - DNA, 25 bp, Mus musculus
ggtgttaatgctgaaagtatcagac

SEQ ID NO: 721174 - DNA, 25 bp, Mus musculus
ggtgttacaacaaacatgggtccta

SEQ ID NO: 721175 - DNA, 25 bp, Mus musculus
ggtgttacaacatacatgggtccta

SEQ ID NO: 721176 - DNA, 25 bp, Mus musculus
ggtgttagacatactcccgtactgt

SEQ ID NO: 721177 - DNA, 25 bp, Mus musculus
ggtgttagacattctcccgtactgt

SEQ ID NO: 721178 - DNA, 25 bp, Mus musculus
ggtgttaggcaccatcttgtagccc

SEQ ID NO: 721179 - DNA, 25 bp, Mus musculus
ggtgttaggcacgatcttgtagccc

SEQ ID NO: 721180 - DNA, 25 bp, Mus musculus
ggtgttatgcttccagcaaagaagt

SEQ ID NO: 721181 - DNA, 25 bp, Mus musculus
ggtgttatgcttgcagcaaagaagt

SEQ ID NO: 721182 - DNA, 25 bp, Mus musculus
ggtgttcaaccccaacaaccatgac

SEQ ID NO: 721183 - DNA, 25 bp, Mus musculus
ggtgttcaacccgaacaaccatgac

SEQ ID NO: 721184 - DNA, 25 bp, Mus musculus
ggtgttcacactacggctcatccac

SEQ ID NO: 721185 - DNA, 25 bp, Mus musculus
ggtgttcacacttcggctcatccac

SEQ ID NO: 721186 - DNA, 25 bp, Mus musculus
ggtgttcaggataaacccagtcgga

SEQ ID NO: 721187 - DNA, 25 bp, Mus musculus
ggtgttcaggattaacccagtcgga

SEQ ID NO: 721188 - DNA, 25 bp, Mus musculus
ggtgttcaggttctgactgcttaag

SEQ ID NO: 721189 - DNA, 25 bp, Mus musculus
ggtgttcaggttgtgactgcttaag

SEQ ID NO: 721190 - DNA, 25 bp, Mus musculus
ggtgttcagttcatttgcacatgca

SEQ ID NO: 721191 - DNA, 25 bp, Mus musculus
ggtgttcagttcttttgcacatgca

SEQ ID NO: 721192 - DNA, 25 bp, Mus musculus
ggtgttcatagtacccagccctggg

SEQ ID NO: 721193 - DNA, 25 bp, Mus musculus
ggtgttcatagttcccagccctggg

SEQ ID NO: 721194 - DNA, 25 bp, Mus musculus
ggtgttcatgcacacgggttacaac

SEQ ID NO: 721195 - DNA, 25 bp, Mus musculus
ggtgttcatgcaccgtctactcaga

SEQ ID NO: 721196 - DNA, 25 bp, Mus musculus
ggtgttcatgcagacgggttacaac

SEQ ID NO: 721197 - DNA, 25 bp, Mus musculus
ggtgttcatgcagcgtctactcaga

SEQ ID NO: 721198 - DNA, 25 bp, Mus musculus
ggtgttccagttcaacttgctttct

SEQ ID NO: 721199 - DNA, 25 bp, Mus musculus
ggtgttccagttgaacttgctttct

SEQ ID NO: 721200 - DNA, 25 bp, Mus musculus
ggtgttcccgcacccatattgtatt

SEQ ID NO: 721201 - DNA, 25 bp, Mus musculus
ggtgttcccgcagccatattgtatt

SEQ ID NO: 721202 - DNA, 25 bp, Mus musculus
ggtgttccgtcacttccggcgagcc

SEQ ID NO: 721203 - DNA, 25 bp, Mus musculus
ggtgttccgtcagttccggcgagcc

SEQ ID NO: 721204 - DNA, 25 bp, Mus musculus
ggtgttcctggcagagcttgttgct

SEQ ID NO: 721205 - DNA, 25 bp, Mus musculus
ggtgttcctggctgagcttgttgct

SEQ ID NO: 721206 - DNA, 25 bp, Mus musculus
ggtgttcgacagaccactgcactag

SEQ ID NO: 721207 - DNA, 25 bp, Mus musculus
ggtgttcgacagctacgcccagttt

SEQ ID NO: 721208 - DNA, 25 bp, Mus musculus
ggtgttcgacaggtacgcccagttt

SEQ ID NO: 721209 - DNA, 25 bp, Mus musculus
ggtgttcgacagtccactgcactag

SEQ ID NO: 721210 - DNA, 25 bp, Mus musculus
ggtgttcgcatcatcaatggccaaa

SEQ ID NO: 721211 - DNA, 25 bp, Mus musculus
ggtgttcgcatcttcaatggccaaa

SEQ ID NO: 721212 - DNA, 25 bp, Mus musculus
ggtgttcgccgcacagctcctgtcg

SEQ ID NO: 721213 - DNA, 25 bp, Mus musculus
ggtgttcgccgctcagctcctgtcg

SEQ ID NO: 721214 - DNA, 25 bp, Mus musculus
ggtgttcgcttgaatttccctgttg

SEQ ID NO: 721215 - DNA, 25 bp, Mus musculus
ggtgttcgcttgtatttccctgttg

SEQ ID NO: 721216 - DNA, 25 bp, Mus musculus
ggtgttcgtgtcagagaatgtgaca

SEQ ID NO: 721217 - DNA, 25 bp, Mus musculus
ggtgttcgtgtctgagaatgtgaca

SEQ ID NO: 721218 - DNA, 25 bp, Mus musculus
ggtgttctacagaaatgacctgtga

SEQ ID NO: 721219 - DNA, 25 bp, Mus musculus
ggtgttctacagtaatgacctgtga

SEQ ID NO: 721220 - DNA, 25 bp, Mus musculus
ggtgttctatggaaccgagaaagat

SEQ ID NO: 721221 - DNA, 25 bp, Mus musculus
ggtgttctatggtaccgagaaagat

SEQ ID NO: 721222 - DNA, 25 bp, Mus musculus
ggtgttctccccatcatttggctaa

SEQ ID NO: 721223 - DNA, 25 bp, Mus musculus
ggtgttctccccttcatttggctaa

SEQ ID NO: 721224 - DNA, 25 bp, Mus musculus
ggtgttctggaacctctgagacctg

SEQ ID NO: 721225 - DNA, 25 bp, Mus musculus
ggtgttctggaagctctgagacctg

SEQ ID NO: 721226 - DNA, 25 bp, Mus musculus
ggtgttctggacatttatggctttg

SEQ ID NO: 721227 - DNA, 25 bp, Mus musculus
ggtgttctggacttttatggctttg

SEQ ID NO: 721228 - DNA, 25 bp, Mus musculus
ggtgttcttcagagcttgagagtcc

SEQ ID NO: 721229 - DNA, 25 bp, Mus musculus
ggtgttcttcagtgcttgagagtcc

SEQ ID NO: 721230 - DNA, 25 bp, Mus musculus
ggtgttctttaaagatctcaccagc

SEQ ID NO: 721231 - DNA, 25 bp, Mus musculus
ggtgttctttaatgatctcaccagc

SEQ ID NO: 721232 - DNA, 25 bp, Mus musculus
ggtgttgaatgtagcgttctgtcct

SEQ ID NO: 721233 - DNA, 25 bp, Mus musculus
ggtgttgaatgttgcgttctgtcct

SEQ ID NO: 721234 - DNA, 25 bp, Mus musculus
ggtgttgacagaaggccaggcagta

SEQ ID NO: 721235 - DNA, 25 bp, Mus musculus
ggtgttgacagatggccaggcagta

SEQ ID NO: 721236 - DNA, 25 bp, Mus musculus
ggtgttgccagaaactttccttgcc

SEQ ID NO: 721237 - DNA, 25 bp, Mus musculus
ggtgttgccagatactttccttgcc

SEQ ID NO: 721238 - DNA, 25 bp, Mus musculus
ggtgttgcccaacctagaatgcatg

SEQ ID NO: 721239 - DNA, 25 bp, Mus musculus
ggtgttgcccaagctagaatgcatg

SEQ ID NO: 721240 - DNA, 25 bp, Mus musculus
ggtgttgccgggacatggcatttct

SEQ ID NO: 721241 - DNA, 25 bp, Mus musculus
ggtgttgccgggtcatggcatttct

SEQ ID NO: 721242 - DNA, 25 bp, Mus musculus
ggtgttgccttaaccctctcgactg

SEQ ID NO: 721243 - DNA, 25 bp, Mus musculus
ggtgttgccttatccctctcgactg

SEQ ID NO: 721244 - DNA, 25 bp, Mus musculus
ggtgttgctttcacacaaagccccg

SEQ ID NO: 721245 - DNA, 25 bp, Mus musculus
ggtgttgctttctcacaaagccccg

SEQ ID NO: 721246 - DNA, 25 bp, Mus musculus
ggtgttggacacctatgacttcgtg

SEQ ID NO: 721247 - DNA, 25 bp, Mus musculus
ggtgttggacacgtatgacttcgtg

SEQ ID NO: 721248 - DNA, 25 bp, Mus musculus
ggtgttggatgcattaatcaagatc

SEQ ID NO: 721249 - DNA, 25 bp, Mus musculus
ggtgttggatgctttaatcaagatc

SEQ ID NO: 721250 - DNA, 25 bp, Mus musculus
ggtgttggcctcctctgcatgatgt

SEQ ID NO: 721251 - DNA, 25 bp, Mus musculus
ggtgttggcctcgtctgcatgatgt

SEQ ID NO: 721252 - DNA, 25 bp, Mus musculus
ggtgttggcgctcattgcagtcatc

SEQ ID NO: 721253 - DNA, 25 bp, Mus musculus
ggtgttggcgctgattgcagtcatc

SEQ ID NO: 721254 - DNA, 25 bp, Mus musculus
ggtgttggctatctgcccattgcag

SEQ ID NO: 721255 - DNA, 25 bp, Mus musculus
ggtgttggctatgtgcccattgcag

SEQ ID NO: 721256 - DNA, 25 bp, Mus musculus
ggtgttgggctcatctttagtttca

SEQ ID NO: 721257 - DNA, 25 bp, Mus musculus
ggtgttgggctcttctttagtttca

SEQ ID NO: 721258 - DNA, 25 bp, Mus musculus
ggtgttggtaaaacacttctgtgaa

SEQ ID NO: 721259 - DNA, 25 bp, Mus musculus
ggtgttggtaaatcacttctgtgaa

SEQ ID NO: 721260 - DNA, 25 bp, Mus musculus
ggtgttggtgcacacgactctgccc

SEQ ID NO: 721261 - DNA, 25 bp, Mus musculus
ggtgttggtgcagacgactctgccc

SEQ ID NO: 721262 - DNA, 25 bp, Mus musculus
ggtgttgtcattaataagcccattg

SEQ ID NO: 721263 - DNA, 25 bp, Mus musculus
ggtgttgtcatttataagcccattg

SEQ ID NO: 721264 - DNA, 25 bp, Mus musculus
ggtgtttagttcctacagctatgac

SEQ ID NO: 721265 - DNA, 25 bp, Mus musculus
ggtgtttagttcgtacagctatgac

SEQ ID NO: 721266 - DNA, 25 bp, Mus musculus
ggtgtttcatcccatttctgtgaac

SEQ ID NO: 721267 - DNA, 25 bp, Mus musculus
ggtgtttcatccgatttctgtgaac

SEQ ID NO: 721268 - DNA, 25 bp, Mus musculus
ggtgtttccacacgtcaatgtcatc

SEQ ID NO: 721269 - DNA, 25 bp, Mus musculus
ggtgtttccacaggtcaatgtcatc

SEQ ID NO: 721270 - DNA, 25 bp, Mus musculus
ggtgtttcccagcaccatatgcggg

SEQ ID NO: 721271 - DNA, 25 bp, Mus musculus
ggtgtttcccaggaccatatgcggg

SEQ ID NO: 721272 - DNA, 25 bp, Mus musculus
ggtgtttccgcacccttgctgcctt

SEQ ID NO: 721273 - DNA, 25 bp, Mus musculus
ggtgtttccgcagccttgctgcctt

SEQ ID NO: 721274 - DNA, 25 bp, Mus musculus
ggtgtttcgtatctcccattggcca

SEQ ID NO: 721275 - DNA, 25 bp, Mus musculus
ggtgtttcgtatgtcccattggcca

SEQ ID NO: 721276 - DNA, 25 bp, Mus musculus
ggtgtttctaaaaggttacagcaca

SEQ ID NO: 721277 - DNA, 25 bp, Mus musculus
ggtgtttctaaatggttacagcaca

SEQ ID NO: 721278 - DNA, 25 bp, Mus musculus
ggtgtttctaagcatcccctcagtg

SEQ ID NO: 721279 - DNA, 25 bp, Mus musculus
ggtgtttctaaggatcccctcagtg

SEQ ID NO: 721280 - DNA, 25 bp, Mus musculus
ggtgtttgaaccagggcatcctaga

SEQ ID NO: 721281 - DNA, 25 bp, Mus musculus
ggtgtttgaacctgggcatcctaga

SEQ ID NO: 721282 - DNA, 25 bp, Mus musculus
ggtgtttgatgcagcttcactaaaa

SEQ ID NO: 721283 - DNA, 25 bp, Mus musculus
ggtgtttgatgctgcttcactaaaa

SEQ ID NO: 721284 - DNA, 25 bp, Mus musculus
ggtgtttgattacctagtggcccat

SEQ ID NO: 721285 - DNA, 25 bp, Mus musculus
ggtgtttgattagctagtggcccat

SEQ ID NO: 721286 - DNA, 25 bp, Mus musculus
ggtgtttgccatcctatgcttgctc

SEQ ID NO: 721287 - DNA, 25 bp, Mus musculus
ggtgtttgccatgctatgcttgctc

SEQ ID NO: 721288 - DNA, 25 bp, Mus musculus
ggtgtttgctttacagatgggcttt

SEQ ID NO: 721289 - DNA, 25 bp, Mus musculus
ggtgtttgctttcatgttcctacaa

SEQ ID NO: 721290 - DNA, 25 bp, Mus musculus
ggtgtttgctttgatgttcctacaa

SEQ ID NO: 721291 - DNA, 25 bp, Mus musculus
ggtgtttgcttttcagatgggcttt

SEQ ID NO: 721292 - DNA, 25 bp, Mus musculus
ggtgtttggaaacatgacagatagt

SEQ ID NO: 721293 - DNA, 25 bp, Mus musculus
ggtgtttggaaagatgacagatagt

SEQ ID NO: 721294 - DNA, 25 bp, Mus musculus
ggtgtttggttaagggtccctcatc

SEQ ID NO: 721295 - DNA, 25 bp, Mus musculus
ggtgtttggttatgggtccctcatc

SEQ ID NO: 721296 - DNA, 25 bp, Mus musculus
ggtgtttgtctaccccggactgacg

SEQ ID NO: 721297 - DNA, 25 bp, Mus musculus
ggtgtttgtctagcccggactgacg

SEQ ID NO: 721298 - DNA, 25 bp, Mus musculus
ggtgttttcacgctctcatctctca

SEQ ID NO: 721299 - DNA, 25 bp, Mus musculus
ggtgttttcacggtctcatctctca

SEQ ID NO: 721300 - DNA, 25 bp, Mus musculus
ggtgttttcctccaatgccttccaa

SEQ ID NO: 721301 - DNA, 25 bp, Mus musculus
ggtgttttcctcgaatgccttccaa

SEQ ID NO: 721302 - DNA, 25 bp, Mus musculus
ggttaaacaagtcttaggacctgag

SEQ ID NO: 721303 - DNA, 25 bp, Mus musculus
ggttaaacaagtgttaggacctgag

SEQ ID NO: 721304 - DNA, 25 bp, Mus musculus
ggttaaaccagcctcgctttggatt

SEQ ID NO: 721305 - DNA, 25 bp, Mus musculus
ggttaaaccagcgtcgctttggatt

SEQ ID NO: 721306 - DNA, 25 bp, Mus musculus
ggttaaataatgagtcatccccatc

SEQ ID NO: 721307 - DNA, 25 bp, Mus musculus
ggttaaataatgtgtcatccccatc

SEQ ID NO: 721308 - DNA, 25 bp, Mus musculus
ggttaaatctctagaaactggagtt

SEQ ID NO: 721309 - DNA, 25 bp, Mus musculus
ggttaaatctcttgaaactggagtt

SEQ ID NO: 721310 - DNA, 25 bp, Mus musculus
ggttaacccgaaccctagttgagat

SEQ ID NO: 721311 - DNA, 25 bp, Mus musculus
ggttaacccgaagcctagttgagat

SEQ ID NO: 721312 - DNA, 25 bp, Mus musculus
ggttaactctctccttttgttccag

SEQ ID NO: 721313 - DNA, 25 bp, Mus musculus
ggttaactctctgcttttgttccag

SEQ ID NO: 721314 - DNA, 25 bp, Mus musculus
ggttaagaaaatacagcctttagca

SEQ ID NO: 721315 - DNA, 25 bp, Mus musculus
ggttaagaaaattcagcctttagca

SEQ ID NO: 721316 - DNA, 25 bp, Mus musculus
ggttaagcagtacagccccaaaatg

SEQ ID NO: 721317 - DNA, 25 bp, Mus musculus
ggttaagcagtagagccccaaaatg

SEQ ID NO: 721318 - DNA, 25 bp, Mus musculus
ggttaagcatatcttactgtcggag

SEQ ID NO: 721319 - DNA, 25 bp, Mus musculus
ggttaagcatatgttactgtcggag

SEQ ID NO: 721320 - DNA, 25 bp, Mus musculus
ggttaagctattatctcaaagtcac

SEQ ID NO: 721321 - DNA, 25 bp, Mus musculus
ggttaagctattttctcaaagtcac

SEQ ID NO: 721322 - DNA, 25 bp, Mus musculus
ggttaaggagctccgcagtttagaa

SEQ ID NO: 721323 - DNA, 25 bp, Mus musculus
ggttaaggagctgcgcagtttagaa

SEQ ID NO: 721324 - DNA, 25 bp, Mus musculus
ggttaaggaggtctgtctgcacccc

SEQ ID NO: 721325 - DNA, 25 bp, Mus musculus
ggttaaggaggtgtgtctgcacccc

SEQ ID NO: 721326 - DNA, 25 bp, Mus musculus
ggttaatccaaccagttcattggct

SEQ ID NO: 721327 - DNA, 25 bp, Mus musculus
ggttaatccaacgagttcattggct

SEQ ID NO: 721328 - DNA, 25 bp, Mus musculus
ggttaatctcctaatcgcatttttc

SEQ ID NO: 721329 - DNA, 25 bp, Mus musculus
ggttaatctccttatcgcatttttc

SEQ ID NO: 721330 - DNA, 25 bp, Mus musculus
ggttaatgcagcagacgaccccttg

SEQ ID NO: 721331 - DNA, 25 bp, Mus musculus
ggttaatgcagctgacgaccccttg

SEQ ID NO: 721332 - DNA, 25 bp, Mus musculus
ggttaatggagaaggcttctctcct

SEQ ID NO: 721333 - DNA, 25 bp, Mus musculus
ggttaatggagatggcttctctcct

SEQ ID NO: 721334 - DNA, 25 bp, Mus musculus
ggttaatgggcacgcacgcccactg

SEQ ID NO: 721335 - DNA, 25 bp, Mus musculus
ggttaatgggcaggcacgcccactg

SEQ ID NO: 721336 - DNA, 25 bp, Mus musculus
ggttaatgtcctccaacaacaccga

SEQ ID NO: 721337 - DNA, 25 bp, Mus musculus
ggttaatgtcctgcaacaacaccga

SEQ ID NO: 721338 - DNA, 25 bp, Mus musculus
ggttacaaagcccaggagcccaatg

SEQ ID NO: 721339 - DNA, 25 bp, Mus musculus
ggttacaaagccgaggagcccaatg

SEQ ID NO: 721340 - DNA, 25 bp, Mus musculus
ggttacacatcaatttggaatgact

SEQ ID NO: 721341 - DNA, 25 bp, Mus musculus
ggttacacatcattttggaatgact

SEQ ID NO: 721342 - DNA, 25 bp, Mus musculus
ggttacacgggcacccgctgtgaag

SEQ ID NO: 721343 - DNA, 25 bp, Mus musculus
ggttacacgggctcccgctgtgaag

SEQ ID NO: 721344 - DNA, 25 bp, Mus musculus
ggttacagatggatggattttgtaa

SEQ ID NO: 721345 - DNA, 25 bp, Mus musculus
ggttacagatggttggattttgtaa

SEQ ID NO: 721346 - DNA, 25 bp, Mus musculus
ggttacagcttcaacctacgcaata

SEQ ID NO: 721347 - DNA, 25 bp, Mus musculus
ggttacagcttctacctacgcaata

SEQ ID NO: 721348 - DNA, 25 bp, Mus musculus
ggttacaggcacagagaatcagttt

SEQ ID NO: 721349 - DNA, 25 bp, Mus musculus
ggttacaggcacctccaaaacctga

SEQ ID NO: 721350 - DNA, 25 bp, Mus musculus
ggttacaggcacgtccaaaacctga

SEQ ID NO: 721351 - DNA, 25 bp, Mus musculus
ggttacaggcactgagaatcagttt

SEQ ID NO: 721352 - DNA, 25 bp, Mus musculus
ggttacaggccaccatcagagggaa

SEQ ID NO: 721353 - DNA, 25 bp, Mus musculus
ggttacaggccagcatcagagggaa

SEQ ID NO: 721354 - DNA, 25 bp, Mus musculus
ggttacaggtgtcctcccaaaggct

SEQ ID NO: 721355 - DNA, 25 bp, Mus musculus
ggttacaggtgtgctcccaaaggct

SEQ ID NO: 721356 - DNA, 25 bp, Mus musculus
ggttacatgaacctggtacctggtg

SEQ ID NO: 721357 - DNA, 25 bp, Mus musculus
ggttacatgaacgtggtacctggtg

SEQ ID NO: 721358 - DNA, 25 bp, Mus musculus
ggttacatgtagcatcatatctagt

SEQ ID NO: 721359 - DNA, 25 bp, Mus musculus
ggttacatgtaggatcatatctagt

SEQ ID NO: 721360 - DNA, 25 bp, Mus musculus
ggttacattgctcgctccaaagtga

SEQ ID NO: 721361 - DNA, 25 bp, Mus musculus
ggttacattgctggctccaaagtga

SEQ ID NO: 721362 - DNA, 25 bp, Mus musculus
ggttaccacggaagagcaggtcctg

SEQ ID NO: 721363 - DNA, 25 bp, Mus musculus
ggttaccacggatgagcaggtcctg

SEQ ID NO: 721364 - DNA, 25 bp, Mus musculus
ggttaccatcacaatcatgcctact

SEQ ID NO: 721365 - DNA, 25 bp, Mus musculus
ggttaccatcactatcatgcctact

SEQ ID NO: 721366 - DNA, 25 bp, Mus musculus
ggttaccatggcaaggaccagtctg

SEQ ID NO: 721367 - DNA, 25 bp, Mus musculus
ggttaccatggctaggaccagtctg

SEQ ID NO: 721368 - DNA, 25 bp, Mus musculus
ggttaccattggcttgttccctgct

SEQ ID NO: 721369 - DNA, 25 bp, Mus musculus
ggttaccattgggttgttccctgct

SEQ ID NO: 721370 - DNA, 25 bp, Mus musculus
ggttacccctgtcctgaacattcca

SEQ ID NO: 721371 - DNA, 25 bp, Mus musculus
ggttacccctgtgctgaacattcca

SEQ ID NO: 721372 - DNA, 25 bp, Mus musculus
ggttaccctgccactcagtctatga

SEQ ID NO: 721373 - DNA, 25 bp, Mus musculus
ggttaccctgcctctcagtctatga

SEQ ID NO: 721374 - DNA, 25 bp, Mus musculus
ggttacctagttccatgatgcacag

SEQ ID NO: 721375 - DNA, 25 bp, Mus musculus
ggttacctagttgcatgatgcacag

SEQ ID NO: 721376 - DNA, 25 bp, Mus musculus
ggttacctcagcctgtcttagcaca

SEQ ID NO: 721377 - DNA, 25 bp, Mus musculus
ggttacctcagcgtgtcttagcaca

SEQ ID NO: 721378 - DNA, 25 bp, Mus musculus
ggttacctgcctagatgaggcccga

SEQ ID NO: 721379 - DNA, 25 bp, Mus musculus
ggttacctgccttgatgaggcccga

SEQ ID NO: 721380 - DNA, 25 bp, Mus musculus
ggttaccttcacactctcaacatca

SEQ ID NO: 721381 - DNA, 25 bp, Mus musculus
ggttaccttcactctctcaacatca

SEQ ID NO: 721382 - DNA, 25 bp, Mus musculus
ggttacgagatacaccatcaaacag

SEQ ID NO: 721383 - DNA, 25 bp, Mus musculus
ggttacgagatagaccatcaaacag

SEQ ID NO: 721384 - DNA, 25 bp, Mus musculus
ggttactacatcagcacctccagca

SEQ ID NO: 721385 - DNA, 25 bp, Mus musculus
ggttactacatctgcacctccagca

SEQ ID NO: 721386 - DNA, 25 bp, Mus musculus
ggttactatgtacactggagaatgt

SEQ ID NO: 721387 - DNA, 25 bp, Mus musculus
ggttactatgtagactggagaatgt

SEQ ID NO: 721388 - DNA, 25 bp, Mus musculus
ggttactccactcccacgtgactga

SEQ ID NO: 721389 - DNA, 25 bp, Mus musculus
ggttactccactgccacgtgactga

SEQ ID NO: 721390 - DNA, 25 bp, Mus musculus
ggttactgcctcatctacgagtcca

SEQ ID NO: 721391 - DNA, 25 bp, Mus musculus
ggttactgcctcttctacgagtcca

SEQ ID NO: 721392 - DNA, 25 bp, Mus musculus
ggttactgctgaacattcccacgtt

SEQ ID NO: 721393 - DNA, 25 bp, Mus musculus
ggttactgctgatcattcccacgtt

SEQ ID NO: 721394 - DNA, 25 bp, Mus musculus
ggttactgctgtcggtgtgaactct

SEQ ID NO: 721395 - DNA, 25 bp, Mus musculus
ggttactgctgtgggtgtgaactct

SEQ ID NO: 721396 - DNA, 25 bp, Mus musculus
ggttactggctcatgtgcaaaattg

SEQ ID NO: 721397 - DNA, 25 bp, Mus musculus
ggttactggctcttgtgcaaaattg

SEQ ID NO: 721398 - DNA, 25 bp, Mus musculus
ggttactttaaacggcaggaagatg

SEQ ID NO: 721399 - DNA, 25 bp, Mus musculus
ggttactttaaagggcaggaagatg

SEQ ID NO: 721400 - DNA, 25 bp, Mus musculus
ggttagaacaaaagcatgccttgga

SEQ ID NO: 721401 - DNA, 25 bp, Mus musculus
ggttagaacaaatgcatgccttgga

SEQ ID NO: 721402 - DNA, 25 bp, Mus musculus
ggttagaccaccaggaaaagatgct

SEQ ID NO: 721403 - DNA, 25 bp, Mus musculus
ggttagaccacctggaaaagatgct

SEQ ID NO: 721404 - DNA, 25 bp, Mus musculus
ggttagatgaacctcatgcgcagtc

SEQ ID NO: 721405 - DNA, 25 bp, Mus musculus
ggttagatgaacgtcatgcgcagtc

SEQ ID NO: 721406 - DNA, 25 bp, Mus musculus
ggttagcataaaagaatcatctgta

SEQ ID NO: 721407 - DNA, 25 bp, Mus musculus
ggttagcataaatgaatcatctgta

SEQ ID NO: 721408 - DNA, 25 bp, Mus musculus
ggttagccaagacagacagaggaca

SEQ ID NO: 721409 - DNA, 25 bp, Mus musculus
ggttagccaagagagacagaggaca

SEQ ID NO: 721410 - DNA, 25 bp, Mus musculus
ggttagccatttaaatgtggcaaaa

SEQ ID NO: 721411 - DNA, 25 bp, Mus musculus
ggttagccattttaatgtggcaaaa

SEQ ID NO: 721412 - DNA, 25 bp, Mus musculus
ggttaggaaaatagcagccctgtgg

SEQ ID NO: 721413 - DNA, 25 bp, Mus musculus
ggttaggaaaattgcagccctgtgg

SEQ ID NO: 721414 - DNA, 25 bp, Mus musculus
ggttaggaaatccacattgaatccc

SEQ ID NO: 721415 - DNA, 25 bp, Mus musculus
ggttaggaaatcgacattgaatccc

SEQ ID NO: 721416 - DNA, 25 bp, Mus musculus
ggttaggacactccagagctccagt

SEQ ID NO: 721417 - DNA, 25 bp, Mus musculus
ggttaggacactgcagagctccagt

SEQ ID NO: 721418 - DNA, 25 bp, Mus musculus
ggttaggtcaggactcaggctaaac

SEQ ID NO: 721419 - DNA, 25 bp, Mus musculus
ggttaggtcaggtctcaggctaaac

SEQ ID NO: 721420 - DNA, 25 bp, Mus musculus
ggttagttctagaacagatacagtg

SEQ ID NO: 721421 - DNA, 25 bp, Mus musculus
ggttagttctagtacagatacagtg

SEQ ID NO: 721422 - DNA, 25 bp, Mus musculus
ggttataccaacctttgacatggct

SEQ ID NO: 721423 - DNA, 25 bp, Mus musculus
ggttataccaacgtttgacatggct

SEQ ID NO: 721424 - DNA, 25 bp, Mus musculus
ggttatagcagcagccgccaaacac

SEQ ID NO: 721425 - DNA, 25 bp, Mus musculus
ggttatagcagctgccgccaaacac

SEQ ID NO: 721426 - DNA, 25 bp, Mus musculus
ggttatagttcaagcacagccagcc

SEQ ID NO: 721427 - DNA, 25 bp, Mus musculus
ggttatagttcatgcacagccagcc

SEQ ID NO: 721428 - DNA, 25 bp, Mus musculus
ggttatatatccatagagctgagat

SEQ ID NO: 721429 - DNA, 25 bp, Mus musculus
ggttatatatccttagagctgagat

SEQ ID NO: 721430 - DNA, 25 bp, Mus musculus
ggttatattatgatagcaacagaga

SEQ ID NO: 721431 - DNA, 25 bp, Mus musculus
ggttatattatgttagcaacagaga

SEQ ID NO: 721432 - DNA, 25 bp, Mus musculus
ggttatcacagaaaaacaccttgcg

SEQ ID NO: 721433 - DNA, 25 bp, Mus musculus
ggttatcacagataaacaccttgcg

SEQ ID NO: 721434 - DNA, 25 bp, Mus musculus
ggttatcactctcacgaccattgga

SEQ ID NO: 721435 - DNA, 25 bp, Mus musculus
ggttatcactctgacgaccattgga

SEQ ID NO: 721436 - DNA, 25 bp, Mus musculus
ggttatcattcgagagcagacagaa

SEQ ID NO: 721437 - DNA, 25 bp, Mus musculus
ggttatcattcgtgagcagacagaa

SEQ ID NO: 721438 - DNA, 25 bp, Mus musculus
ggttatccagaaccgagtccctaat

SEQ ID NO: 721439 - DNA, 25 bp, Mus musculus
ggttatccagaagcgagtccctaat

SEQ ID NO: 721440 - DNA, 25 bp, Mus musculus
ggttatccccgaaacatctccgaag

SEQ ID NO: 721441 - DNA, 25 bp, Mus musculus
ggttatccccgatacatctccgaag

SEQ ID NO: 721442 - DNA, 25 bp, Mus musculus
ggttatcgtcggcaaatcttcatag

SEQ ID NO: 721443 - DNA, 25 bp, Mus musculus
ggttatcgtcgggaaatcttcatag

SEQ ID NO: 721444 - DNA, 25 bp, Mus musculus
ggttatctgcgcagcccctggtgcg

SEQ ID NO: 721445 - DNA, 25 bp, Mus musculus
ggttatctgcgctgcccctggtgcg

SEQ ID NO: 721446 - DNA, 25 bp, Mus musculus
ggttatgaacctattagccccagca

SEQ ID NO: 721447 - DNA, 25 bp, Mus musculus
ggttatgaaccttttagccccagca

SEQ ID NO: 721448 - DNA, 25 bp, Mus musculus
ggttatgacccaagctcttcagtgg

SEQ ID NO: 721449 - DNA, 25 bp, Mus musculus
ggttatgacccatgctcttcagtgg

SEQ ID NO: 721450 - DNA, 25 bp, Mus musculus
ggttatgaccccatccaccagtgac

SEQ ID NO: 721451 - DNA, 25 bp, Mus musculus
ggttatgaccccttccaccagtgac

SEQ ID NO: 721452 - DNA, 25 bp, Mus musculus
ggttatgactttcgctatttaatca

SEQ ID NO: 721453 - DNA, 25 bp, Mus musculus
ggttatgactttggctatttaatca

SEQ ID NO: 721454 - DNA, 25 bp, Mus musculus
ggttatgagccacatcctaatatag

SEQ ID NO: 721455 - DNA, 25 bp, Mus musculus
ggttatgagccagatcctaatatag

SEQ ID NO: 721456 - DNA, 25 bp, Mus musculus
ggttatgccacaagtcatgacttca

SEQ ID NO: 721457 - DNA, 25 bp, Mus musculus
ggttatgccacacctttttcccgca

SEQ ID NO: 721458 - DNA, 25 bp, Mus musculus
ggttatgccacagctttttcccgca

SEQ ID NO: 721459 - DNA, 25 bp, Mus musculus
ggttatgccacatgtcatgacttca

SEQ ID NO: 721460 - DNA, 25 bp, Mus musculus
ggttatgctggtcccggccatcctg

SEQ ID NO: 721461 - DNA, 25 bp, Mus musculus
ggttatgctggtgccggccatcctg

SEQ ID NO: 721462 - DNA, 25 bp, Mus musculus
ggttatggctccattcaccagcagt

SEQ ID NO: 721463 - DNA, 25 bp, Mus musculus
ggttatggctcctttcaccagcagt

SEQ ID NO: 721464 - DNA, 25 bp, Mus musculus
ggttatgtccttcggagttacctgg

SEQ ID NO: 721465 - DNA, 25 bp, Mus musculus
ggttatgtccttgggagttacctgg

SEQ ID NO: 721466 - DNA, 25 bp, Mus musculus
ggttattactccctcatactgtggg

SEQ ID NO: 721467 - DNA, 25 bp, Mus musculus
ggttattactccgtcatactgtggg

SEQ ID NO: 721468 - DNA, 25 bp, Mus musculus
ggttattatcaacaatccggccgag

SEQ ID NO: 721469 - DNA, 25 bp, Mus musculus
ggttattatcaacttcacaccaaca

SEQ ID NO: 721470 - DNA, 25 bp, Mus musculus
ggttattatcaagaatccggccgag

SEQ ID NO: 721471 - DNA, 25 bp, Mus musculus
ggttattatcaagttcacaccaaca

SEQ ID NO: 721472 - DNA, 25 bp, Mus musculus
ggttattcatgaaaacttcgggatc

SEQ ID NO: 721473 - DNA, 25 bp, Mus musculus
ggttattcatgataacttcgggatc

SEQ ID NO: 721474 - DNA, 25 bp, Mus musculus
ggttattgagatcgtaatggccaca

SEQ ID NO: 721475 - DNA, 25 bp, Mus musculus
ggttattgagatggtaatggccaca

SEQ ID NO: 721476 - DNA, 25 bp, Mus musculus
ggttattgcttcctacgctgctact

SEQ ID NO: 721477 - DNA, 25 bp, Mus musculus
ggttattgcttcgtacgctgctact

SEQ ID NO: 721478 - DNA, 25 bp, Mus musculus
ggttatttgtaacttcacatccacc

SEQ ID NO: 721479 - DNA, 25 bp, Mus musculus
ggttatttgtaagttcacatccacc

SEQ ID NO: 721480 - DNA, 25 bp, Mus musculus
ggttatttttaaagctcagcttcct

SEQ ID NO: 721481 - DNA, 25 bp, Mus musculus
ggttatttttaatgctcagcttcct

SEQ ID NO: 721482 - DNA, 25 bp, Mus musculus
ggttcaaatgcccacgagcaagtcc

SEQ ID NO: 721483 - DNA, 25 bp, Mus musculus
ggttcaaatgccgacgagcaagtcc

SEQ ID NO: 721484 - DNA, 25 bp, Mus musculus
ggttcaacacaaccatccgggactt

SEQ ID NO: 721485 - DNA, 25 bp, Mus musculus
ggttcaacacaagcatccgggactt

SEQ ID NO: 721486 - DNA, 25 bp, Mus musculus
ggttcaacttctctgcagagacggt

SEQ ID NO: 721487 - DNA, 25 bp, Mus musculus
ggttcaacttctgtgcagagacggt

SEQ ID NO: 721488 - DNA, 25 bp, Mus musculus
ggttcaagagcaccgaagcctggaa

SEQ ID NO: 721489 - DNA, 25 bp, Mus musculus
ggttcaagagcagcgaagcctggaa

SEQ ID NO: 721490 - DNA, 25 bp, Mus musculus
ggttcaagagcgcatggcacttctg

SEQ ID NO: 721491 - DNA, 25 bp, Mus musculus
ggttcaagagcggatggcacttctg

SEQ ID NO: 721492 - DNA, 25 bp, Mus musculus
ggttcaagccttcctccgagcagtt

SEQ ID NO: 721493 - DNA, 25 bp, Mus musculus
ggttcaagccttgctccgagcagtt

SEQ ID NO: 721494 - DNA, 25 bp, Mus musculus
ggttcaagctaccagataagccggc

SEQ ID NO: 721495 - DNA, 25 bp, Mus musculus
ggttcaagctacgagataagccggc

SEQ ID NO: 721496 - DNA, 25 bp, Mus musculus
ggttcaagttccatgcttcgctggg

SEQ ID NO: 721497 - DNA, 25 bp, Mus musculus
ggttcaagttccttgcttcgctggg

SEQ ID NO: 721498 - DNA, 25 bp, Mus musculus
ggttcaatatgaccacgccagctgt

SEQ ID NO: 721499 - DNA, 25 bp, Mus musculus
ggttcaatatgagcacgccagctgt

SEQ ID NO: 721500 - DNA, 25 bp, Mus musculus
ggttcacaatcaagtctgacgtatg

SEQ ID NO: 721501 - DNA, 25 bp, Mus musculus
ggttcacaatcatgtctgacgtatg

SEQ ID NO: 721502 - DNA, 25 bp, Mus musculus
ggttcacagactattcactatcctg

SEQ ID NO: 721503 - DNA, 25 bp, Mus musculus
ggttcacagacttttcactatcctg

SEQ ID NO: 721504 - DNA, 25 bp, Mus musculus
ggttcacatccaaagggaaatcact

SEQ ID NO: 721505 - DNA, 25 bp, Mus musculus
ggttcacatccatagggaaatcact

SEQ ID NO: 721506 - DNA, 25 bp, Mus musculus
ggttcaccaattcgtgtccgatcag

SEQ ID NO: 721507 - DNA, 25 bp, Mus musculus
ggttcaccaattggtgtccgatcag

SEQ ID NO: 721508 - DNA, 25 bp, Mus musculus
ggttcacccgcaatgagttcagcca

SEQ ID NO: 721509 - DNA, 25 bp, Mus musculus
ggttcacccgcattgagttcagcca

SEQ ID NO: 721510 - DNA, 25 bp, Mus musculus
ggttcaccctggagtcactgtgcac

SEQ ID NO: 721511 - DNA, 25 bp, Mus musculus
ggttcaccctggtgtcactgtgcac

SEQ ID NO: 721512 - DNA, 25 bp, Mus musculus
ggttcacctggaatctgcagttgcc

SEQ ID NO: 721513 - DNA, 25 bp, Mus musculus
ggttcacctggattctgcagttgcc

SEQ ID NO: 721514 - DNA, 25 bp, Mus musculus
ggttcacctgtaaagtccacacctg

SEQ ID NO: 721515 - DNA, 25 bp, Mus musculus
ggttcacctgtatagtccacacctg

SEQ ID NO: 721516 - DNA, 25 bp, Mus musculus
ggttcactatgaaatctgaggaggc

SEQ ID NO: 721517 - DNA, 25 bp, Mus musculus
ggttcactatgatatctgaggaggc

SEQ ID NO: 721518 - DNA, 25 bp, Mus musculus
ggttcactcaccataggactcctgc

SEQ ID NO: 721519 - DNA, 25 bp, Mus musculus
ggttcactcaccttaggactcctgc

SEQ ID NO: 721520 - DNA, 25 bp, Mus musculus
ggttcactggaacaccaaatatggg

SEQ ID NO: 721521 - DNA, 25 bp, Mus musculus
ggttcactggaagaccaaatatggg

SEQ ID NO: 721522 - DNA, 25 bp, Mus musculus
ggttcagaacctctgcagaaccgtg

SEQ ID NO: 721523 - DNA, 25 bp, Mus musculus
ggttcagaacctgtgcagaaccgtg

SEQ ID NO: 721524 - DNA, 25 bp, Mus musculus
ggttcagaagttagtcacacagtgc

SEQ ID NO: 721525 - DNA, 25 bp, Mus musculus
ggttcagaagtttgtcacacagtgc

SEQ ID NO: 721526 - DNA, 25 bp, Mus musculus
ggttcagaatgtctccgtcatcctc

SEQ ID NO: 721527 - DNA, 25 bp, Mus musculus
ggttcagaatgtgtccgtcatcctc

SEQ ID NO: 721528 - DNA, 25 bp, Mus musculus
ggttcagacctccaagaagtctttt

SEQ ID NO: 721529 - DNA, 25 bp, Mus musculus
ggttcagacctcgaagaagtctttt

SEQ ID NO: 721530 - DNA, 25 bp, Mus musculus
ggttcagagcgtccctctgttgtta

SEQ ID NO: 721531 - DNA, 25 bp, Mus musculus
ggttcagagcgtgcctctgttgtta

SEQ ID NO: 721532 - DNA, 25 bp, Mus musculus
ggttcagatccacagccagtctgag

SEQ ID NO: 721533 - DNA, 25 bp, Mus musculus
ggttcagatccagagccagtctgag

SEQ ID NO: 721534 - DNA, 25 bp, Mus musculus
ggttcagattgacatgctcacagct

SEQ ID NO: 721535 - DNA, 25 bp, Mus musculus
ggttcagattgagatgctcacagct

SEQ ID NO: 721536 - DNA, 25 bp, Mus musculus
ggttcagccatcagcagcagactgt

SEQ ID NO: 721537 - DNA, 25 bp, Mus musculus
ggttcagccatctgcagcagactgt

SEQ ID NO: 721538 - DNA, 25 bp, Mus musculus
ggttcagcctcgaccgtctgcagag

SEQ ID NO: 721539 - DNA, 25 bp, Mus musculus
ggttcagcctcgtccgtctgcagag

SEQ ID NO: 721540 - DNA, 25 bp, Mus musculus
ggttcagcggaaagtgatctgcatc

SEQ ID NO: 721541 - DNA, 25 bp, Mus musculus
ggttcagcggaatgtgatctgcatc

SEQ ID NO: 721542 - DNA, 25 bp, Mus musculus
ggttcagcgggcacctcaatttcca

SEQ ID NO: 721543 - DNA, 25 bp, Mus musculus
ggttcagcgggctcctcaatttcca

SEQ ID NO: 721544 - DNA, 25 bp, Mus musculus
ggttcagctgaaactagtgcgtcct

SEQ ID NO: 721545 - DNA, 25 bp, Mus musculus
ggttcagctgaatctagtgcgtcct

SEQ ID NO: 721546 - DNA, 25 bp, Mus musculus
ggttcaggaaaacaagcggcatcac

SEQ ID NO: 721547 - DNA, 25 bp, Mus musculus
ggttcaggaaaagaagcggcatcac

SEQ ID NO: 721548 - DNA, 25 bp, Mus musculus
ggttcaggaagaataccacggtcac

SEQ ID NO: 721549 - DNA, 25 bp, Mus musculus
ggttcaggaagattaccacggtcac

SEQ ID NO: 721550 - DNA, 25 bp, Mus musculus
ggttcaggaagccttctacctcact

SEQ ID NO: 721551 - DNA, 25 bp, Mus musculus
ggttcaggaagcgttctacctcact

SEQ ID NO: 721552 - DNA, 25 bp, Mus musculus
ggttcaggagacagaactgttagct

SEQ ID NO: 721553 - DNA, 25 bp, Mus musculus
ggttcaggagactgaactgttagct

SEQ ID NO: 721554 - DNA, 25 bp, Mus musculus
ggttcaggagatatgggacccaaag

SEQ ID NO: 721555 - DNA, 25 bp, Mus musculus
ggttcaggagatttgggacccaaag

SEQ ID NO: 721556 - DNA, 25 bp, Mus musculus
ggttcaggataacacagaagtgctg

SEQ ID NO: 721557 - DNA, 25 bp, Mus musculus
ggttcaggataagacagaagtgctg

SEQ ID NO: 721558 - DNA, 25 bp, Mus musculus
ggttcaggatgtattcttgcccact

SEQ ID NO: 721559 - DNA, 25 bp, Mus musculus
ggttcaggatgttttcttgcccact

SEQ ID NO: 721560 - DNA, 25 bp, Mus musculus
ggttcaggcggaacaaaccatcctt

SEQ ID NO: 721561 - DNA, 25 bp, Mus musculus
ggttcaggcggatcaaaccatcctt

SEQ ID NO: 721562 - DNA, 25 bp, Mus musculus
ggttcagtacctacatctcagaggg

SEQ ID NO: 721563 - DNA, 25 bp, Mus musculus
ggttcagtaccttcatctcagaggg

SEQ ID NO: 721564 - DNA, 25 bp, Mus musculus
ggttcagtctccctgaagcgtttgc

SEQ ID NO: 721565 - DNA, 25 bp, Mus musculus
ggttcagtctccgtgaagcgtttgc

SEQ ID NO: 721566 - DNA, 25 bp, Mus musculus
ggttcagtgactctatggcgctact

SEQ ID NO: 721567 - DNA, 25 bp, Mus musculus
ggttcagtgactgtatggcgctact

SEQ ID NO: 721568 - DNA, 25 bp, Mus musculus
ggttcatagttcaacttgtgttggt

SEQ ID NO: 721569 - DNA, 25 bp, Mus musculus
ggttcatagttctacttgtgttggt

SEQ ID NO: 721570 - DNA, 25 bp, Mus musculus
ggttcatatactaacgtcagttgtt

SEQ ID NO: 721571 - DNA, 25 bp, Mus musculus
ggttcatatacttacgtcagttgtt

SEQ ID NO: 721572 - DNA, 25 bp, Mus musculus
ggttcatcaatgctgtctaccagat

SEQ ID NO: 721573 - DNA, 25 bp, Mus musculus
ggttcatcaatggtgtctaccagat

SEQ ID NO: 721574 - DNA, 25 bp, Mus musculus
ggttcatccttgagactcatctgct

SEQ ID NO: 721575 - DNA, 25 bp, Mus musculus
ggttcatccttgtgactcatctgct

SEQ ID NO: 721576 - DNA, 25 bp, Mus musculus
ggttcatctcagacccacctttcag

SEQ ID NO: 721577 - DNA, 25 bp, Mus musculus
ggttcatctcagtcccacctttcag

SEQ ID NO: 721578 - DNA, 25 bp, Mus musculus
ggttcatgcactcattcatccagct

SEQ ID NO: 721579 - DNA, 25 bp, Mus musculus
ggttcatgcactgattcatccagct

SEQ ID NO: 721580 - DNA, 25 bp, Mus musculus
ggttcattaaccaccagccttcgac

SEQ ID NO: 721581 - DNA, 25 bp, Mus musculus
ggttcattaacctccagccttcgac

SEQ ID NO: 721582 - DNA, 25 bp, Mus musculus
ggttcattcccacacaagactgatt

SEQ ID NO: 721583 - DNA, 25 bp, Mus musculus
ggttcattcccagacaagactgatt

SEQ ID NO: 721584 - DNA, 25 bp, Mus musculus
ggttcattgatacacacgctccaca

SEQ ID NO: 721585 - DNA, 25 bp, Mus musculus
ggttcattgatagacacgctccaca

SEQ ID NO: 721586 - DNA, 25 bp, Mus musculus
ggttccaaatgccatcgaatgtcaa

SEQ ID NO: 721587 - DNA, 25 bp, Mus musculus
ggttccaaatgcgatcgaatgtcaa

SEQ ID NO: 721588 - DNA, 25 bp, Mus musculus
ggttccaacaatagtaaagcagtca

SEQ ID NO: 721589 - DNA, 25 bp, Mus musculus
ggttccaacaattgtaaagcagtca

SEQ ID NO: 721590 - DNA, 25 bp, Mus musculus
ggttccaaggccactgcaaacattt

SEQ ID NO: 721591 - DNA, 25 bp, Mus musculus
ggttccaaggcctctgcaaacattt

SEQ ID NO: 721592 - DNA, 25 bp, Mus musculus
ggttccacaactcgagttccatccg

SEQ ID NO: 721593 - DNA, 25 bp, Mus musculus
ggttccacaactggagttccatccg

SEQ ID NO: 721594 - DNA, 25 bp, Mus musculus
ggttccacctggacggacttttgca

SEQ ID NO: 721595 - DNA, 25 bp, Mus musculus
ggttccacctggtcggacttttgca

SEQ ID NO: 721596 - DNA, 25 bp, Mus musculus
ggttccacggcccttgagtacgcgt

SEQ ID NO: 721597 - DNA, 25 bp, Mus musculus
ggttccacggccgttgagtacgcgt

SEQ ID NO: 721598 - DNA, 25 bp, Mus musculus
ggttccacttaccttagctctgcct

SEQ ID NO: 721599 - DNA, 25 bp, Mus musculus
ggttccacttacgttagctctgcct

SEQ ID NO: 721600 - DNA, 25 bp, Mus musculus
ggttccacttcgactgcggctgaag

SEQ ID NO: 721601 - DNA, 25 bp, Mus musculus
ggttccacttcgtctgcggctgaag

SEQ ID NO: 721602 - DNA, 25 bp, Mus musculus
ggttccagacttatggatccgctac

SEQ ID NO: 721603 - DNA, 25 bp, Mus musculus
ggttccagacttttggatccgctac

SEQ ID NO: 721604 - DNA, 25 bp, Mus musculus
ggttccagcacacctgtatcaatga

SEQ ID NO: 721605 - DNA, 25 bp, Mus musculus
ggttccagcacagctgtatcaatga

SEQ ID NO: 721606 - DNA, 25 bp, Mus musculus
ggttccagccatcagctatgtctcc

SEQ ID NO: 721607 - DNA, 25 bp, Mus musculus
ggttccagccatgagctatgtctcc

SEQ ID NO: 721608 - DNA, 25 bp, Mus musculus
ggttccagcctgaaagcattgcttg

SEQ ID NO: 721609 - DNA, 25 bp, Mus musculus
ggttccagcctgtaagcattgcttg

SEQ ID NO: 721610 - DNA, 25 bp, Mus musculus
ggttccaggaataactagagattcg

SEQ ID NO: 721611 - DNA, 25 bp, Mus musculus
ggttccaggaattactagagattcg

SEQ ID NO: 721612 - DNA, 25 bp, Mus musculus
ggttccaggactaggagttctcttg

SEQ ID NO: 721613 - DNA, 25 bp, Mus musculus
ggttccaggacttggagttctcttg

SEQ ID NO: 721614 - DNA, 25 bp, Mus musculus
ggttccaggatgcatcgcgttcagc

SEQ ID NO: 721615 - DNA, 25 bp, Mus musculus
ggttccaggatggatcgcgttcagc

SEQ ID NO: 721616 - DNA, 25 bp, Mus musculus
ggttccagggccagaacctagccag

SEQ ID NO: 721617 - DNA, 25 bp, Mus musculus
ggttccagggcctgaacctagccag

SEQ ID NO: 721618 - DNA, 25 bp, Mus musculus
ggttccataaccacacaacacacat

SEQ ID NO: 721619 - DNA, 25 bp, Mus musculus
ggttccataacctcacaacacacat

SEQ ID NO: 721620 - DNA, 25 bp, Mus musculus
ggttccatccagcataaaggctcca

SEQ ID NO: 721621 - DNA, 25 bp, Mus musculus
ggttccatccaggataaaggctcca

SEQ ID NO: 721622 - DNA, 25 bp, Mus musculus
ggttccatcttaaaagctgttaagc

SEQ ID NO: 721623 - DNA, 25 bp, Mus musculus
ggttccatcttataagctgttaagc

SEQ ID NO: 721624 - DNA, 25 bp, Mus musculus
ggttccatgaacaaatcactgtctg

SEQ ID NO: 721625 - DNA, 25 bp, Mus musculus
ggttccatgaactaatcactgtctg

SEQ ID NO: 721626 - DNA, 25 bp, Mus musculus
ggttccatgacaaagtactgaaagt

SEQ ID NO: 721627 - DNA, 25 bp, Mus musculus
ggttccatgacatagtactgaaagt

SEQ ID NO: 721628 - DNA, 25 bp, Mus musculus
ggttccattccaattccacagcctg

SEQ ID NO: 721629 - DNA, 25 bp, Mus musculus
ggttccattccatttccacagcctg

SEQ ID NO: 721630 - DNA, 25 bp, Mus musculus
ggttccattgctccttgctcctgaa

SEQ ID NO: 721631 - DNA, 25 bp, Mus musculus
ggttccattgctgcttgctcctgaa

SEQ ID NO: 721632 - DNA, 25 bp, Mus musculus
ggttcccaatggatgactgtactaa

SEQ ID NO: 721633 - DNA, 25 bp, Mus musculus
ggttcccaatggttgactgtactaa

SEQ ID NO: 721634 - DNA, 25 bp, Mus musculus
ggttcccactgcaacttggttccca

SEQ ID NO: 721635 - DNA, 25 bp, Mus musculus
ggttcccactgctacttggttccca

SEQ ID NO: 721636 - DNA, 25 bp, Mus musculus
ggttcccacttaatcctttggagag

SEQ ID NO: 721637 - DNA, 25 bp, Mus musculus
ggttcccacttattcctttggagag

SEQ ID NO: 721638 - DNA, 25 bp, Mus musculus
ggttcccacttgaatcctccagtta

SEQ ID NO: 721639 - DNA, 25 bp, Mus musculus
ggttcccacttgtatcctccagtta

SEQ ID NO: 721640 - DNA, 25 bp, Mus musculus
ggttcccagctaactccggaacagg

SEQ ID NO: 721641 - DNA, 25 bp, Mus musculus
ggttcccagctatctccggaacagg

SEQ ID NO: 721642 - DNA, 25 bp, Mus musculus
ggttcccagcttatggcttcggagc

SEQ ID NO: 721643 - DNA, 25 bp, Mus musculus
ggttcccagcttcaccatgttcctg

SEQ ID NO: 721644 - DNA, 25 bp, Mus musculus
ggttcccagcttgaccatgttcctg

SEQ ID NO: 721645 - DNA, 25 bp, Mus musculus
ggttcccagcttttggcttcggagc

SEQ ID NO: 721646 - DNA, 25 bp, Mus musculus
ggttcccaggaaatgtttgcccaga

SEQ ID NO: 721647 - DNA, 25 bp, Mus musculus
ggttcccaggaattgtttgcccaga

SEQ ID NO: 721648 - DNA, 25 bp, Mus musculus
ggttcccagttccacagctagctat

SEQ ID NO: 721649 - DNA, 25 bp, Mus musculus
ggttcccagttcgacagctagctat

SEQ ID NO: 721650 - DNA, 25 bp, Mus musculus
ggttccccagaaatcaacgagacca

SEQ ID NO: 721651 - DNA, 25 bp, Mus musculus
ggttccccagaattcaacgagacca

SEQ ID NO: 721652 - DNA, 25 bp, Mus musculus
ggttccccatctacacggaggcggc

SEQ ID NO: 721653 - DNA, 25 bp, Mus musculus
ggttccccatcttcacggaggcggc

SEQ ID NO: 721654 - DNA, 25 bp, Mus musculus
ggttcccctgcccatggagagaaat

SEQ ID NO: 721655 - DNA, 25 bp, Mus musculus
ggttcccctgccgatggagagaaat

SEQ ID NO: 721656 - DNA, 25 bp, Mus musculus
ggttcccgagcacggccatcaagat

SEQ ID NO: 721657 - DNA, 25 bp, Mus musculus
ggttcccgagcagggccatcaagat

SEQ ID NO: 721658 - DNA, 25 bp, Mus musculus
ggttcccgccgcctatgccatggtt

SEQ ID NO: 721659 - DNA, 25 bp, Mus musculus
ggttcccgccgcgtatgccatggtt

SEQ ID NO: 721660 - DNA, 25 bp, Mus musculus
ggttcccgctgcaccggaccatgta

SEQ ID NO: 721661 - DNA, 25 bp, Mus musculus
ggttcccgctgctccggaccatgta

SEQ ID NO: 721662 - DNA, 25 bp, Mus musculus
ggttcccgtcaaatttgctgagttc

SEQ ID NO: 721663 - DNA, 25 bp, Mus musculus
ggttcccgtcaattttgctgagttc

SEQ ID NO: 721664 - DNA, 25 bp, Mus musculus
ggttccctccggctgtggtgaacat

SEQ ID NO: 721665 - DNA, 25 bp, Mus musculus
ggttccctccgggtgtggtgaacat

SEQ ID NO: 721666 - DNA, 25 bp, Mus musculus
ggttccctgaggacaagatgctgca

SEQ ID NO: 721667 - DNA, 25 bp, Mus musculus
ggttccctgaggtcaagatgctgca

SEQ ID NO: 721668 - DNA, 25 bp, Mus musculus
ggttccctggtcagacaggacctcg

SEQ ID NO: 721669 - DNA, 25 bp, Mus musculus
ggttccctggtctgacaggacctcg

SEQ ID NO: 721670 - DNA, 25 bp, Mus musculus
ggttccctgtaaataagcaggctta

SEQ ID NO: 721671 - DNA, 25 bp, Mus musculus
ggttccctgtaattaagcaggctta

SEQ ID NO: 721672 - DNA, 25 bp, Mus musculus
ggttcccttcagcatcaagcccttg

SEQ ID NO: 721673 - DNA, 25 bp, Mus musculus
ggttcccttcaggatcaagcccttg

SEQ ID NO: 721674 - DNA, 25 bp, Mus musculus
ggttcccttgggactctacactggt

SEQ ID NO: 721675 - DNA, 25 bp, Mus musculus
ggttcccttgggtctctacactggt

SEQ ID NO: 721676 - DNA, 25 bp, Mus musculus
ggttccgagaggcagagatttatca

SEQ ID NO: 721677 - DNA, 25 bp, Mus musculus
ggttccgagagggagagatttatca

SEQ ID NO: 721678 - DNA, 25 bp, Mus musculus
ggttccgagcgcaacgaagccatga

SEQ ID NO: 721679 - DNA, 25 bp, Mus musculus
ggttccgagcgctacgaagccatga

SEQ ID NO: 721680 - DNA, 25 bp, Mus musculus
ggttccgccatgcaatccaacaagg

SEQ ID NO: 721681 - DNA, 25 bp, Mus musculus
ggttccgccatggaatccaacaagg

SEQ ID NO: 721682 - DNA, 25 bp, Mus musculus
ggttccgccgaaacttgcacacgga

SEQ ID NO: 721683 - DNA, 25 bp, Mus musculus
ggttccgccgaatcttgcacacgga

SEQ ID NO: 721684 - DNA, 25 bp, Mus musculus
ggttccggaggcaagacataaggaa

SEQ ID NO: 721685 - DNA, 25 bp, Mus musculus
ggttccggaggctagacataaggaa

SEQ ID NO: 721686 - DNA, 25 bp, Mus musculus
ggttccggcctgcatacaaggcctt

SEQ ID NO: 721687 - DNA, 25 bp, Mus musculus
ggttccggcctggatacaaggcctt

SEQ ID NO: 721688 - DNA, 25 bp, Mus musculus
ggttccgggcccagcacaagctaca

SEQ ID NO: 721689 - DNA, 25 bp, Mus musculus
ggttccgggccctgcacaagctaca

SEQ ID NO: 721690 - DNA, 25 bp, Mus musculus
ggttccgtttaaagaagtgcgatta

SEQ ID NO: 721691 - DNA, 25 bp, Mus musculus
ggttccgtttaatgaagtgcgatta

SEQ ID NO: 721692 - DNA, 25 bp, Mus musculus
ggttcctaaccaaccagcctgtgca

SEQ ID NO: 721693 - DNA, 25 bp, Mus musculus
ggttcctaaccatccagcctgtgca

SEQ ID NO: 721694 - DNA, 25 bp, Mus musculus
ggttcctaagaacagcgtacagcaa

SEQ ID NO: 721695 - DNA, 25 bp, Mus musculus
ggttcctaagaagagcgtacagcaa

SEQ ID NO: 721696 - DNA, 25 bp, Mus musculus
ggttcctaccagagtctctgccctg

SEQ ID NO: 721697 - DNA, 25 bp, Mus musculus
ggttcctaccagtgtctctgccctg

SEQ ID NO: 721698 - DNA, 25 bp, Mus musculus
ggttcctaccgcagcatcctggact

SEQ ID NO: 721699 - DNA, 25 bp, Mus musculus
ggttcctaccgctgcatcctggact

SEQ ID NO: 721700 - DNA, 25 bp, Mus musculus
ggttcctaggcaattcagtcccaag

SEQ ID NO: 721701 - DNA, 25 bp, Mus musculus
ggttcctaggcatttcagtcccaag

SEQ ID NO: 721702 - DNA, 25 bp, Mus musculus
ggttcctcaaggaagactcccagct

SEQ ID NO: 721703 - DNA, 25 bp, Mus musculus
ggttcctcaaggaccagttcactac

SEQ ID NO: 721704 - DNA, 25 bp, Mus musculus
ggttcctcaaggtagactcccagct

SEQ ID NO: 721705 - DNA, 25 bp, Mus musculus
ggttcctcaaggtccagttcactac

SEQ ID NO: 721706 - DNA, 25 bp, Mus musculus
ggttcctccagcactacggctctgg

SEQ ID NO: 721707 - DNA, 25 bp, Mus musculus
ggttcctccagctctacggctctgg

SEQ ID NO: 721708 - DNA, 25 bp, Mus musculus
ggttcctccgctacttctcattctg

SEQ ID NO: 721709 - DNA, 25 bp, Mus musculus
ggttcctccgcttcttctcattctg

SEQ ID NO: 721710 - DNA, 25 bp, Mus musculus
ggttcctctcgcactgcggagactg

SEQ ID NO: 721711 - DNA, 25 bp, Mus musculus
ggttcctctcgctctgcggagactg

SEQ ID NO: 721712 - DNA, 25 bp, Mus musculus
ggttcctgaacaaagagccttactg

SEQ ID NO: 721713 - DNA, 25 bp, Mus musculus
ggttcctgaacatagagccttactg

SEQ ID NO: 721714 - DNA, 25 bp, Mus musculus
ggttcctgacctcagtcatctccag

SEQ ID NO: 721715 - DNA, 25 bp, Mus musculus
ggttcctgacctgagtcatctccag

SEQ ID NO: 721716 - DNA, 25 bp, Mus musculus
ggttcctgagaacgtggacatctcg

SEQ ID NO: 721717 - DNA, 25 bp, Mus musculus
ggttcctgagaaggtggacatctcg

SEQ ID NO: 721718 - DNA, 25 bp, Mus musculus
ggttcctgagctcgacacagttgtc

SEQ ID NO: 721719 - DNA, 25 bp, Mus musculus
ggttcctgagctggacacagttgtc

SEQ ID NO: 721720 - DNA, 25 bp, Mus musculus
ggttcctgcacccatggcatcaaca

SEQ ID NO: 721721 - DNA, 25 bp, Mus musculus
ggttcctgcaccgatggcatcaaca

SEQ ID NO: 721722 - DNA, 25 bp, Mus musculus
ggttcctgccagagcgagctgcacc

SEQ ID NO: 721723 - DNA, 25 bp, Mus musculus
ggttcctgccagtgcgagctgcacc

SEQ ID NO: 721724 - DNA, 25 bp, Mus musculus
ggttcctgcctcctttaactgaaag

SEQ ID NO: 721725 - DNA, 25 bp, Mus musculus
ggttcctgcctcgtttaactgaaag

SEQ ID NO: 721726 - DNA, 25 bp, Mus musculus
ggttcctgcgaaagaaatccaagcc

SEQ ID NO: 721727 - DNA, 25 bp, Mus musculus
ggttcctgcgaatgaaatccaagcc

SEQ ID NO: 721728 - DNA, 25 bp, Mus musculus
ggttcctgcttgagacacctgccta

SEQ ID NO: 721729 - DNA, 25 bp, Mus musculus
ggttcctgcttgtgacacctgccta

SEQ ID NO: 721730 - DNA, 25 bp, Mus musculus
ggttcctggaagatgttaggcatgc

SEQ ID NO: 721731 - DNA, 25 bp, Mus musculus
ggttcctggaagttgttaggcatgc

SEQ ID NO: 721732 - DNA, 25 bp, Mus musculus
ggttcctggatgacaatcagatagt

SEQ ID NO: 721733 - DNA, 25 bp, Mus musculus
ggttcctggatgtcaatcagatagt

SEQ ID NO: 721734 - DNA, 25 bp, Mus musculus
ggttcctggcgtaggattatgctca

SEQ ID NO: 721735 - DNA, 25 bp, Mus musculus
ggttcctggcgttggattatgctca

SEQ ID NO: 721736 - DNA, 25 bp, Mus musculus
ggttcctggcttccagtgagtactg

SEQ ID NO: 721737 - DNA, 25 bp, Mus musculus
ggttcctggcttgcagtgagtactg

SEQ ID NO: 721738 - DNA, 25 bp, Mus musculus
ggttcctgggcacatttccacgcta

SEQ ID NO: 721739 - DNA, 25 bp, Mus musculus
ggttcctgggcagatttccacgcta

SEQ ID NO: 721740 - DNA, 25 bp, Mus musculus
ggttcctggtacattgaggccctca

SEQ ID NO: 721741 - DNA, 25 bp, Mus musculus
ggttcctggtactttgaggccctca

SEQ ID NO: 721742 - DNA, 25 bp, Mus musculus
ggttcctggtgtctccattcgaggc

SEQ ID NO: 721743 - DNA, 25 bp, Mus musculus
ggttcctggtgtgtccattcgaggc

SEQ ID NO: 721744 - DNA, 25 bp, Mus musculus
ggttcctgttgcagagactccttgg

SEQ ID NO: 721745 - DNA, 25 bp, Mus musculus
ggttcctgttgctgagactccttgg

SEQ ID NO: 721746 - DNA, 25 bp, Mus musculus
ggttccttccaaagctacaaggcgc

SEQ ID NO: 721747 - DNA, 25 bp, Mus musculus
ggttccttccaatgctacaaggcgc

SEQ ID NO: 721748 - DNA, 25 bp, Mus musculus
ggttccttgggaccatcgtctcatc

SEQ ID NO: 721749 - DNA, 25 bp, Mus musculus
ggttccttgggagcatcgtctcatc

SEQ ID NO: 721750 - DNA, 25 bp, Mus musculus
ggttcctttacaacccatatctggt

SEQ ID NO: 721751 - DNA, 25 bp, Mus musculus
ggttcctttacatcccatatctggt

SEQ ID NO: 721752 - DNA, 25 bp, Mus musculus
ggttcctttgtaaccctacgctgca

SEQ ID NO: 721753 - DNA, 25 bp, Mus musculus
ggttcctttgtatccctacgctgca

SEQ ID NO: 721754 - DNA, 25 bp, Mus musculus
ggttcgagagcaacacccagagaat

SEQ ID NO: 721755 - DNA, 25 bp, Mus musculus
ggttcgagagcatcacccagagaat

SEQ ID NO: 721756 - DNA, 25 bp, Mus musculus
ggttcgagagttaagcaagctggct

SEQ ID NO: 721757 - DNA, 25 bp, Mus musculus
ggttcgagagtttagcaagctggct

SEQ ID NO: 721758 - DNA, 25 bp, Mus musculus
ggttcgagataaagaccaccctgat

SEQ ID NO: 721759 - DNA, 25 bp, Mus musculus
ggttcgagataatgaccaccctgat

SEQ ID NO: 721760 - DNA, 25 bp, Mus musculus
ggttcgagcgctaaaggatttctgg

SEQ ID NO: 721761 - DNA, 25 bp, Mus musculus
ggttcgagcgcttaaggatttctgg

SEQ ID NO: 721762 - DNA, 25 bp, Mus musculus
ggttcgatgaccataagaacagcac

SEQ ID NO: 721763 - DNA, 25 bp, Mus musculus
ggttcgatgaccttaagaacagcac

SEQ ID NO: 721764 - DNA, 25 bp, Mus musculus
ggttcgccagcacgaagagttcatc

SEQ ID NO: 721765 - DNA, 25 bp, Mus musculus
ggttcgccagcaggaagagttcatc

SEQ ID NO: 721766 - DNA, 25 bp, Mus musculus
ggttcgcccttgcaaatggatgcct

SEQ ID NO: 721767 - DNA, 25 bp, Mus musculus
ggttcgcccttggaaatggatgcct

SEQ ID NO: 721768 - DNA, 25 bp, Mus musculus
ggttcgcctggtctcaaggacactg

SEQ ID NO: 721769 - DNA, 25 bp, Mus musculus
ggttcgcctggtgtcaaggacactg

SEQ ID NO: 721770 - DNA, 25 bp, Mus musculus
ggttcggaaccacgccatggcagat

SEQ ID NO: 721771 - DNA, 25 bp, Mus musculus
ggttcggaaccaggccatggcagat

SEQ ID NO: 721772 - DNA, 25 bp, Mus musculus
ggttcggatgtaagtcgaggcccaa

SEQ ID NO: 721773 - DNA, 25 bp, Mus musculus
ggttcggatgtatgtcgaggcccaa

SEQ ID NO: 721774 - DNA, 25 bp, Mus musculus
ggttcggcgcctatcctcttcctgg

SEQ ID NO: 721775 - DNA, 25 bp, Mus musculus
ggttcggcgcctttcctcttcctgg

SEQ ID NO: 721776 - DNA, 25 bp, Mus musculus
ggttcggcgcggctcttcttcttaa

SEQ ID NO: 721777 - DNA, 25 bp, Mus musculus
ggttcggcgcgggtcttcttcttaa

SEQ ID NO: 721778 - DNA, 25 bp, Mus musculus
ggttcgggtcctcgatgacagaccc

SEQ ID NO: 721779 - DNA, 25 bp, Mus musculus
ggttcgggtcctggatgacagaccc

SEQ ID NO: 721780 - DNA, 25 bp, Mus musculus
ggttcgtcaacacccacttgacttc

SEQ ID NO: 721781 - DNA, 25 bp, Mus musculus
ggttcgtcaacagccacttgacttc

SEQ ID NO: 721782 - DNA, 25 bp, Mus musculus
ggttcgtccaggctgcaacgctgcc

SEQ ID NO: 721783 - DNA, 25 bp, Mus musculus
ggttcgtccagggtgcaacgctgcc

SEQ ID NO: 721784 - DNA, 25 bp, Mus musculus
ggttcgtgactgaaacaagccctcg

SEQ ID NO: 721785 - DNA, 25 bp, Mus musculus
ggttcgtgactgtaacaagccctcg

SEQ ID NO: 721786 - DNA, 25 bp, Mus musculus
ggttctaacgtacctgcaagcctac

SEQ ID NO: 721787 - DNA, 25 bp, Mus musculus
ggttctaacgtagctgcaagcctac

SEQ ID NO: 721788 - DNA, 25 bp, Mus musculus
ggttctacaactacctcatggccga

SEQ ID NO: 721789 - DNA, 25 bp, Mus musculus
ggttctacaacttcctcatggccga

SEQ ID NO: 721790 - DNA, 25 bp, Mus musculus
ggttctacagacaatctgatggatg

SEQ ID NO: 721791 - DNA, 25 bp, Mus musculus
ggttctacagactatctgatggatg

SEQ ID NO: 721792 - DNA, 25 bp, Mus musculus
ggttctacagcaatgctccacagca

SEQ ID NO: 721793 - DNA, 25 bp, Mus musculus
ggttctacagcattgctccacagca

SEQ ID NO: 721794 - DNA, 25 bp, Mus musculus
ggttctacatccaatggcacaaggc

SEQ ID NO: 721795 - DNA, 25 bp, Mus musculus
ggttctacatcctatggcacaaggc

SEQ ID NO: 721796 - DNA, 25 bp, Mus musculus
ggttctaccgagacagctacattcg

SEQ ID NO: 721797 - DNA, 25 bp, Mus musculus
ggttctaccgagtcagctacattcg

SEQ ID NO: 721798 - DNA, 25 bp, Mus musculus
ggttctacgggtccatggagctaca

SEQ ID NO: 721799 - DNA, 25 bp, Mus musculus
ggttctacgggtgcatggagctaca

SEQ ID NO: 721800 - DNA, 25 bp, Mus musculus
ggttctactaatccacagtcaagga

SEQ ID NO: 721801 - DNA, 25 bp, Mus musculus
ggttctactaatgcacagtcaagga

SEQ ID NO: 721802 - DNA, 25 bp, Mus musculus
ggttctagacacatccacactgatt

SEQ ID NO: 721803 - DNA, 25 bp, Mus musculus
ggttctagacacttccacactgatt

SEQ ID NO: 721804 - DNA, 25 bp, Mus musculus
ggttctagacctaacacagagccgc

SEQ ID NO: 721805 - DNA, 25 bp, Mus musculus
ggttctagaccttacacagagccgc

SEQ ID NO: 721806 - DNA, 25 bp, Mus musculus
ggttctagcaaacagcaattgattg

SEQ ID NO: 721807 - DNA, 25 bp, Mus musculus
ggttctagcaaagagcaattgattg

SEQ ID NO: 721808 - DNA, 25 bp, Mus musculus
ggttctaggaatcaatgtttgtggc

SEQ ID NO: 721809 - DNA, 25 bp, Mus musculus
ggttctaggaatgaatgtttgtggc

SEQ ID NO: 721810 - DNA, 25 bp, Mus musculus
ggttctatagagagccctgtccact

SEQ ID NO: 721811 - DNA, 25 bp, Mus musculus
ggttctatagagtgccctgtccact

SEQ ID NO: 721812 - DNA, 25 bp, Mus musculus
ggttctatagatcgtaataaccaac

SEQ ID NO: 721813 - DNA, 25 bp, Mus musculus
ggttctatagatggtaataaccaac

SEQ ID NO: 721814 - DNA, 25 bp, Mus musculus
ggttctatcagaacccccagtggtc

SEQ ID NO: 721815 - DNA, 25 bp, Mus musculus
ggttctatcagatcccccagtggtc

SEQ ID NO: 721816 - DNA, 25 bp, Mus musculus
ggttctatgcaaccactttaccggc

SEQ ID NO: 721817 - DNA, 25 bp, Mus musculus
ggttctatgcaagcactttaccggc

SEQ ID NO: 721818 - DNA, 25 bp, Mus musculus
ggttctatggccctttgaaaggcgt

SEQ ID NO: 721819 - DNA, 25 bp, Mus musculus
ggttctatggccgtttgaaaggcgt

SEQ ID NO: 721820 - DNA, 25 bp, Mus musculus
ggttctcaatcaagaagatgtttca

SEQ ID NO: 721821 - DNA, 25 bp, Mus musculus
ggttctcaatcatgaagatgtttca

SEQ ID NO: 721822 - DNA, 25 bp, Mus musculus
ggttctcaatgaaaaagtcctgtct

SEQ ID NO: 721823 - DNA, 25 bp, Mus musculus
ggttctcaatgataaagtcctgtct

SEQ ID NO: 721824 - DNA, 25 bp, Mus musculus
ggttctcactaaaatgaaggagact

SEQ ID NO: 721825 - DNA, 25 bp, Mus musculus
ggttctcactaatatgaaggagact

SEQ ID NO: 721826 - DNA, 25 bp, Mus musculus
ggttctcagaggactgttttctccc

SEQ ID NO: 721827 - DNA, 25 bp, Mus musculus
ggttctcagaggtctgttttctccc

SEQ ID NO: 721828 - DNA, 25 bp, Mus musculus
ggttctcagcagcttgaacagccca

SEQ ID NO: 721829 - DNA, 25 bp, Mus musculus
ggttctcagcaggttgaacagccca

SEQ ID NO: 721830 - DNA, 25 bp, Mus musculus
ggttctcagccgagccaagagaaga

SEQ ID NO: 721831 - DNA, 25 bp, Mus musculus
ggttctcagccgtgccaagagaaga

SEQ ID NO: 721832 - DNA, 25 bp, Mus musculus
ggttctccaacactggtgaagattg

SEQ ID NO: 721833 - DNA, 25 bp, Mus musculus
ggttctccaacagtggtgaagattg

SEQ ID NO: 721834 - DNA, 25 bp, Mus musculus
ggttctccaaccaggtattgcaggc

SEQ ID NO: 721835 - DNA, 25 bp, Mus musculus
ggttctccaacctggtattgcaggc

SEQ ID NO: 721836 - DNA, 25 bp, Mus musculus
ggttctccaagcaaataagcacggg

SEQ ID NO: 721837 - DNA, 25 bp, Mus musculus
ggttctccaagctaataagcacggg

SEQ ID NO: 721838 - DNA, 25 bp, Mus musculus
ggttctcccgttattgatatttgtg

SEQ ID NO: 721839 - DNA, 25 bp, Mus musculus
ggttctcccgtttttgatatttgtg

SEQ ID NO: 721840 - DNA, 25 bp, Mus musculus
ggttctcgaattcaaatcaaccaaa

SEQ ID NO: 721841 - DNA, 25 bp, Mus musculus
ggttctcgaattgaaatcaaccaaa

SEQ ID NO: 721842 - DNA, 25 bp, Mus musculus
ggttctcgtgaactagatcgaagca

SEQ ID NO: 721843 - DNA, 25 bp, Mus musculus
ggttctcgtgaagtagatcgaagca

SEQ ID NO: 721844 - DNA, 25 bp, Mus musculus
ggttctctacagctccaaccaggac

SEQ ID NO: 721845 - DNA, 25 bp, Mus musculus
ggttctctacaggtccaaccaggac

SEQ ID NO: 721846 - DNA, 25 bp, Mus musculus
ggttctctacttatataggcaggga

SEQ ID NO: 721847 - DNA, 25 bp, Mus musculus
ggttctctacttttataggcaggga

SEQ ID NO: 721848 - DNA, 25 bp, Mus musculus
ggttctctagccatcggagtcccga

SEQ ID NO: 721849 - DNA, 25 bp, Mus musculus
ggttctctagccttcggagtcccga

SEQ ID NO: 721850 - DNA, 25 bp, Mus musculus
ggttctctcaaaccctgcgcaatta

SEQ ID NO: 721851 - DNA, 25 bp, Mus musculus
ggttctctcaaagcctgcgcaatta

SEQ ID NO: 721852 - DNA, 25 bp, Mus musculus
ggttctctgacgattgtgcttcttg

SEQ ID NO: 721853 - DNA, 25 bp, Mus musculus
ggttctctgacgtttgtgcttcttg

SEQ ID NO: 721854 - DNA, 25 bp, Mus musculus
ggttctctgggcaacagcccgctga

SEQ ID NO: 721855 - DNA, 25 bp, Mus musculus
ggttctctgggctacagcccgctga

SEQ ID NO: 721856 - DNA, 25 bp, Mus musculus
ggttctctgtccaaatcctgcggaa

SEQ ID NO: 721857 - DNA, 25 bp, Mus musculus
ggttctctgtcctaatcctgcggaa

SEQ ID NO: 721858 - DNA, 25 bp, Mus musculus
ggttctcttaaacagcagacaacgc

SEQ ID NO: 721859 - DNA, 25 bp, Mus musculus
ggttctcttaaagagcagacaacgc

SEQ ID NO: 721860 - DNA, 25 bp, Mus musculus
ggttctcttacaacgaccgcctaag

SEQ ID NO: 721861 - DNA, 25 bp, Mus musculus
ggttctcttacatcgaccgcctaag

SEQ ID NO: 721862 - DNA, 25 bp, Mus musculus
ggttctctttctcgtccctgcaagg

SEQ ID NO: 721863 - DNA, 25 bp, Mus musculus
ggttctctttctggtccctgcaagg

SEQ ID NO: 721864 - DNA, 25 bp, Mus musculus
ggttctgactacaaacagtatgtgt

SEQ ID NO: 721865 - DNA, 25 bp, Mus musculus
ggttctgactactaacagtatgtgt

SEQ ID NO: 721866 - DNA, 25 bp, Mus musculus
ggttctgagatcactgtcacacaaa

SEQ ID NO: 721867 - DNA, 25 bp, Mus musculus
ggttctgagatctctgtcacacaaa

SEQ ID NO: 721868 - DNA, 25 bp, Mus musculus
ggttctgcaattccctaattactga

SEQ ID NO: 721869 - DNA, 25 bp, Mus musculus
ggttctgcaattgcctaattactga

SEQ ID NO: 721870 - DNA, 25 bp, Mus musculus
ggttctgccctaattgtcacaggag

SEQ ID NO: 721871 - DNA, 25 bp, Mus musculus
ggttctgccctatttgtcacaggag

SEQ ID NO: 721872 - DNA, 25 bp, Mus musculus
ggttctgcgcagagctggcactcag

SEQ ID NO: 721873 - DNA, 25 bp, Mus musculus
ggttctgcgcagtgctggcactcag

SEQ ID NO: 721874 - DNA, 25 bp, Mus musculus
ggttctgctcaaccccatcccaaag

SEQ ID NO: 721875 - DNA, 25 bp, Mus musculus
ggttctgctcaagcccatcccaaag

SEQ ID NO: 721876 - DNA, 25 bp, Mus musculus
ggttctgctttgaacccaacttcat

SEQ ID NO: 721877 - DNA, 25 bp, Mus musculus
ggttctgctttgtacccaacttcat

SEQ ID NO: 721878 - DNA, 25 bp, Mus musculus
ggttctggacagagctgcgatccag

SEQ ID NO: 721879 - DNA, 25 bp, Mus musculus
ggttctggacagtgctgcgatccag

SEQ ID NO: 721880 - DNA, 25 bp, Mus musculus
ggttctggatgtaaagagctatgcg

SEQ ID NO: 721881 - DNA, 25 bp, Mus musculus
ggttctggatgttaagagctatgcg

SEQ ID NO: 721882 - DNA, 25 bp, Mus musculus
ggttctggctggaagtgaattcagt

SEQ ID NO: 721883 - DNA, 25 bp, Mus musculus
ggttctggctggtagtgaattcagt

SEQ ID NO: 721884 - DNA, 25 bp, Mus musculus
ggttctggcttaccggctctctgtg

SEQ ID NO: 721885 - DNA, 25 bp, Mus musculus
ggttctggcttagcggctctctgtg

SEQ ID NO: 721886 - DNA, 25 bp, Mus musculus
ggttctgtatctcatatcattcggc

SEQ ID NO: 721887 - DNA, 25 bp, Mus musculus
ggttctgtatctgatatcattcggc

SEQ ID NO: 721888 - DNA, 25 bp, Mus musculus
ggttctgtcatcacggaagcccaca

SEQ ID NO: 721889 - DNA, 25 bp, Mus musculus
ggttctgtcatctcggaagcccaca

SEQ ID NO: 721890 - DNA, 25 bp, Mus musculus
ggttctgtctggaaaattctcaaag

SEQ ID NO: 721891 - DNA, 25 bp, Mus musculus
ggttctgtctggtaaattctcaaag

SEQ ID NO: 721892 - DNA, 25 bp, Mus musculus
ggttctgtgagccagcctcttgcac

SEQ ID NO: 721893 - DNA, 25 bp, Mus musculus
ggttctgtgagcgagcctcttgcac

SEQ ID NO: 721894 - DNA, 25 bp, Mus musculus
ggttctgtgagtacccaaggccaag

SEQ ID NO: 721895 - DNA, 25 bp, Mus musculus
ggttctgtgagttcccaaggccaag

SEQ ID NO: 721896 - DNA, 25 bp, Mus musculus
ggttctgtgggtcgcccctttcctg

SEQ ID NO: 721897 - DNA, 25 bp, Mus musculus
ggttctgtgggtggcccctttcctg

SEQ ID NO: 721898 - DNA, 25 bp, Mus musculus
ggttctgtgtacacaaccagttctg

SEQ ID NO: 721899 - DNA, 25 bp, Mus musculus
ggttctgtgtactcaaccagttctg

SEQ ID NO: 721900 - DNA, 25 bp, Mus musculus
ggttctgttcagagagagcatatgc

SEQ ID NO: 721901 - DNA, 25 bp, Mus musculus
ggttctgttcagtgagagcatatgc

SEQ ID NO: 721902 - DNA, 25 bp, Mus musculus
ggttctgttcctcagttctgtccca

SEQ ID NO: 721903 - DNA, 25 bp, Mus musculus
ggttctgttcctgagttctgtccca

SEQ ID NO: 721904 - DNA, 25 bp, Mus musculus
ggttctgttggcataccctcgtgga

SEQ ID NO: 721905 - DNA, 25 bp, Mus musculus
ggttctgttggcttaccctcgtgga

SEQ ID NO: 721906 - DNA, 25 bp, Mus musculus
ggttcttcctctcctgagtcccaaa

SEQ ID NO: 721907 - DNA, 25 bp, Mus musculus
ggttcttcctctgctgagtcccaaa

SEQ ID NO: 721908 - DNA, 25 bp, Mus musculus
ggttcttcctgcctcgtcgggctag

SEQ ID NO: 721909 - DNA, 25 bp, Mus musculus
ggttcttcctgcgtcgtcgggctag

SEQ ID NO: 721910 - DNA, 25 bp, Mus musculus
ggttcttcggcaacatcctggacag

SEQ ID NO: 721911 - DNA, 25 bp, Mus musculus
ggttcttcggcatcatcctggacag

SEQ ID NO: 721912 - DNA, 25 bp, Mus musculus
ggttcttctaccacaatattctcag

SEQ ID NO: 721913 - DNA, 25 bp, Mus musculus
ggttcttctacctcaatattctcag

SEQ ID NO: 721914 - DNA, 25 bp, Mus musculus
ggttcttgaacaacgtagctactgc

SEQ ID NO: 721915 - DNA, 25 bp, Mus musculus
ggttcttgaacatcgtagctactgc

SEQ ID NO: 721916 - DNA, 25 bp, Mus musculus
ggttcttgataaactcagaccagaa

SEQ ID NO: 721917 - DNA, 25 bp, Mus musculus
ggttcttgataatctcagaccagaa

SEQ ID NO: 721918 - DNA, 25 bp, Mus musculus
ggttcttgcgcgacgctccccggtt

SEQ ID NO: 721919 - DNA, 25 bp, Mus musculus
ggttcttgcgcgtcgctccccggtt

SEQ ID NO: 721920 - DNA, 25 bp, Mus musculus
ggttcttggaacagaggtatggcaa

SEQ ID NO: 721921 - DNA, 25 bp, Mus musculus
ggttcttggaactgaggtatggcaa

SEQ ID NO: 721922 - DNA, 25 bp, Mus musculus
ggttctttaagccaaaccgcaagcg

SEQ ID NO: 721923 - DNA, 25 bp, Mus musculus
ggttctttaagcgaaaccgcaagcg

SEQ ID NO: 721924 - DNA, 25 bp, Mus musculus
ggttctttagctaccctgcatcatg

SEQ ID NO: 721925 - DNA, 25 bp, Mus musculus
ggttctttagcttccctgcatcatg

SEQ ID NO: 721926 - DNA, 25 bp, Mus musculus
ggttctttggaacgcatttggtgcc

SEQ ID NO: 721927 - DNA, 25 bp, Mus musculus
ggttctttggaaggcatttggtgcc

SEQ ID NO: 721928 - DNA, 25 bp, Mus musculus
ggttgaaaaatacagaccattgaag

SEQ ID NO: 721929 - DNA, 25 bp, Mus musculus
ggttgaaaaatagagaccattgaag

SEQ ID NO: 721930 - DNA, 25 bp, Mus musculus
ggttgaaaacctagatggaccagct

SEQ ID NO: 721931 - DNA, 25 bp, Mus musculus
ggttgaaaaccttgatggaccagct

SEQ ID NO: 721932 - DNA, 25 bp, Mus musculus
ggttgaaatgctcacccattcttgg

SEQ ID NO: 721933 - DNA, 25 bp, Mus musculus
ggttgaaatgctgacccattcttgg

SEQ ID NO: 721934 - DNA, 25 bp, Mus musculus
ggttgaacccaacgtctcccatgtg

SEQ ID NO: 721935 - DNA, 25 bp, Mus musculus
ggttgaacccaaggtctcccatgtg

SEQ ID NO: 721936 - DNA, 25 bp, Mus musculus
ggttgaactcctctaccatgtggaa

SEQ ID NO: 721937 - DNA, 25 bp, Mus musculus
ggttgaactcctgtaccatgtggaa

SEQ ID NO: 721938 - DNA, 25 bp, Mus musculus
ggttgaagctgaagatcaccagggc

SEQ ID NO: 721939 - DNA, 25 bp, Mus musculus
ggttgaagctgatgatcaccagggc

SEQ ID NO: 721940 - DNA, 25 bp, Mus musculus
ggttgaagtctccaccctagagcct

SEQ ID NO: 721941 - DNA, 25 bp, Mus musculus
ggttgaagtctcgaccctagagcct

SEQ ID NO: 721942 - DNA, 25 bp, Mus musculus
ggttgaatccttatcagacttgagc

SEQ ID NO: 721943 - DNA, 25 bp, Mus musculus
ggttgaatccttttcagacttgagc

SEQ ID NO: 721944 - DNA, 25 bp, Mus musculus
ggttgacaacatcacagtaccatca

SEQ ID NO: 721945 - DNA, 25 bp, Mus musculus
ggttgacaacatgacagtaccatca

SEQ ID NO: 721946 - DNA, 25 bp, Mus musculus
ggttgacaggccagacctttgaatc

SEQ ID NO: 721947 - DNA, 25 bp, Mus musculus
ggttgacaggcctgacctttgaatc

SEQ ID NO: 721948 - DNA, 25 bp, Mus musculus
ggttgaccatgtccagatgatagtg

SEQ ID NO: 721949 - DNA, 25 bp, Mus musculus
ggttgaccatgtgcagatgatagtg

SEQ ID NO: 721950 - DNA, 25 bp, Mus musculus
ggttgacccaacaccagagcaactt

SEQ ID NO: 721951 - DNA, 25 bp, Mus musculus
ggttgacccaactccagagcaactt

SEQ ID NO: 721952 - DNA, 25 bp, Mus musculus
ggttgacctaccatgggcaatgagg

SEQ ID NO: 721953 - DNA, 25 bp, Mus musculus
ggttgacctaccttgggcaatgagg

SEQ ID NO: 721954 - DNA, 25 bp, Mus musculus
ggttgacctagtcattcagagttct

SEQ ID NO: 721955 - DNA, 25 bp, Mus musculus
ggttgacctagtgattcagagttct

SEQ ID NO: 721956 - DNA, 25 bp, Mus musculus
ggttgactacgccattctgtctgag

SEQ ID NO: 721957 - DNA, 25 bp, Mus musculus
ggttgactacgcgattctgtctgag

SEQ ID NO: 721958 - DNA, 25 bp, Mus musculus
ggttgactggatcccaagaccgagc

SEQ ID NO: 721959 - DNA, 25 bp, Mus musculus
ggttgactggatgccaagaccgagc

SEQ ID NO: 721960 - DNA, 25 bp, Mus musculus
ggttgagaactgctcttttagtgga

SEQ ID NO: 721961 - DNA, 25 bp, Mus musculus
ggttgagaactggtcttttagtgga

SEQ ID NO: 721962 - DNA, 25 bp, Mus musculus
ggttgagacaacagttgcaagcctc

SEQ ID NO: 721963 - DNA, 25 bp, Mus musculus
ggttgagacaactgttgcaagcctc

SEQ ID NO: 721964 - DNA, 25 bp, Mus musculus
ggttgagacctccaacaaccgtccg

SEQ ID NO: 721965 - DNA, 25 bp, Mus musculus
ggttgagacctcgaacaaccgtccg

SEQ ID NO: 721966 - DNA, 25 bp, Mus musculus
ggttgagatcaaacagaaactcggc

SEQ ID NO: 721967 - DNA, 25 bp, Mus musculus
ggttgagatcaatcagaaactcggc

SEQ ID NO: 721968 - DNA, 25 bp, Mus musculus
ggttgagcagagaacccctgcagca

SEQ ID NO: 721969 - DNA, 25 bp, Mus musculus
ggttgagcagagtacccctgcagca

SEQ ID NO: 721970 - DNA, 25 bp, Mus musculus
ggttgagctccaaaaaatgaaaata

SEQ ID NO: 721971 - DNA, 25 bp, Mus musculus
ggttgagctccataaaatgaaaata

SEQ ID NO: 721972 - DNA, 25 bp, Mus musculus
ggttgaggctcgatgctagagcact

SEQ ID NO: 721973 - DNA, 25 bp, Mus musculus
ggttgaggctcgttgctagagcact

SEQ ID NO: 721974 - DNA, 25 bp, Mus musculus
ggttgaggtcttcacacagttcagt

SEQ ID NO: 721975 - DNA, 25 bp, Mus musculus
ggttgaggtcttgacacagttcagt

SEQ ID NO: 721976 - DNA, 25 bp, Mus musculus
ggttgagtccgaagaagaccctatt

SEQ ID NO: 721977 - DNA, 25 bp, Mus musculus
ggttgagtccgatgaagaccctatt

SEQ ID NO: 721978 - DNA, 25 bp, Mus musculus
ggttgatcacacaaaactgtcagca

SEQ ID NO: 721979 - DNA, 25 bp, Mus musculus
ggttgatcacactaaactgtcagca

SEQ ID NO: 721980 - DNA, 25 bp, Mus musculus
ggttgatccggaaacgatgccttac

SEQ ID NO: 721981 - DNA, 25 bp, Mus musculus
ggttgatccggatacgatgccttac

SEQ ID NO: 721982 - DNA, 25 bp, Mus musculus
ggttgatcgcagcattcagaaagtg

SEQ ID NO: 721983 - DNA, 25 bp, Mus musculus
ggttgatcgcaggattcagaaagtg

SEQ ID NO: 721984 - DNA, 25 bp, Mus musculus
ggttgatctaccagacaacctcagg

SEQ ID NO: 721985 - DNA, 25 bp, Mus musculus
ggttgatctacctgacaacctcagg

SEQ ID NO: 721986 - DNA, 25 bp, Mus musculus
ggttgatctcacagctcaagtggtt

SEQ ID NO: 721987 - DNA, 25 bp, Mus musculus
ggttgatctcactgctcaagtggtt

SEQ ID NO: 721988 - DNA, 25 bp, Mus musculus
ggttgatgatgcacctgttacctct

SEQ ID NO: 721989 - DNA, 25 bp, Mus musculus
ggttgatgatgctcctgttacctct

SEQ ID NO: 721990 - DNA, 25 bp, Mus musculus
ggttgatgcacccagcctgaaagga

SEQ ID NO: 721991 - DNA, 25 bp, Mus musculus
ggttgatgcaccgagcctgaaagga

SEQ ID NO: 721992 - DNA, 25 bp, Mus musculus
ggttgatgccgtcatgatgcttgac

SEQ ID NO: 721993 - DNA, 25 bp, Mus musculus
ggttgatgccgtgatgatgcttgac

SEQ ID NO: 721994 - DNA, 25 bp, Mus musculus
ggttgatgctggaaaagagcctcca

SEQ ID NO: 721995 - DNA, 25 bp, Mus musculus
ggttgatgctggtaaagagcctcca

SEQ ID NO: 721996 - DNA, 25 bp, Mus musculus
ggttgatgtcaacatggccattctg

SEQ ID NO: 721997 - DNA, 25 bp, Mus musculus
ggttgatgtcaagatggccattctg

SEQ ID NO: 721998 - DNA, 25 bp, Mus musculus
ggttgattaatcatgcctcttgtgc

SEQ ID NO: 721999 - DNA, 25 bp, Mus musculus
ggttgattaatcttgcctcttgtgc

SEQ ID NO: 722000 - DNA, 25 bp, Mus musculus
ggttgatttgtcagagctctttgta

SEQ ID NO: 722001 - DNA, 25 bp, Mus musculus
ggttgatttgtctgagctctttgta

SEQ ID NO: 722002 - DNA, 25 bp, Mus musculus
ggttgcaccgtgctcacagccctgg

SEQ ID NO: 722003 - DNA, 25 bp, Mus musculus
ggttgcaccgtggtcacagccctgg

SEQ ID NO: 722004 - DNA, 25 bp, Mus musculus
ggttgcacctccacctaaaggttgg

SEQ ID NO: 722005 - DNA, 25 bp, Mus musculus
ggttgcacctcctcctaaaggttgg

SEQ ID NO: 722006 - DNA, 25 bp, Mus musculus
ggttgcagaacgagatgaggctcaa

SEQ ID NO: 722007 - DNA, 25 bp, Mus musculus
ggttgcagaacgtgatgaggctcaa

SEQ ID NO: 722008 - DNA, 25 bp, Mus musculus
ggttgcagaagacgtagaccacgct

SEQ ID NO: 722009 - DNA, 25 bp, Mus musculus
ggttgcagaagaggtagaccacgct

SEQ ID NO: 722010 - DNA, 25 bp, Mus musculus
ggttgcagcagtactacgtgaaact

SEQ ID NO: 722011 - DNA, 25 bp, Mus musculus
ggttgcagcagttctacgtgaaact

SEQ ID NO: 722012 - DNA, 25 bp, Mus musculus
ggttgcagccaacaatcttctaaac

SEQ ID NO: 722013 - DNA, 25 bp, Mus musculus
ggttgcagccaagaatcttctaaac

SEQ ID NO: 722014 - DNA, 25 bp, Mus musculus
ggttgcagcctaccacctcttatca

SEQ ID NO: 722015 - DNA, 25 bp, Mus musculus
ggttgcagcctagcacctcttatca

SEQ ID NO: 722016 - DNA, 25 bp, Mus musculus
ggttgcaggaacctgaagcctccat

SEQ ID NO: 722017 - DNA, 25 bp, Mus musculus
ggttgcaggaacgtgaagcctccat

SEQ ID NO: 722018 - DNA, 25 bp, Mus musculus
ggttgcagtgctaaaatgcccaggc

SEQ ID NO: 722019 - DNA, 25 bp, Mus musculus
ggttgcagtgcttaaatgcccaggc

SEQ ID NO: 722020 - DNA, 25 bp, Mus musculus
ggttgcagttatctgtccagaaacc

SEQ ID NO: 722021 - DNA, 25 bp, Mus musculus
ggttgcagttatgtgtccagaaacc

SEQ ID NO: 722022 - DNA, 25 bp, Mus musculus
ggttgcatgaaaagcctcctccctc

SEQ ID NO: 722023 - DNA, 25 bp, Mus musculus
ggttgcatgaaatgcctcctccctc

SEQ ID NO: 722024 - DNA, 25 bp, Mus musculus
ggttgcattcgccaagttttacgaa

SEQ ID NO: 722025 - DNA, 25 bp, Mus musculus
ggttgcattcgcgaagttttacgaa

SEQ ID NO: 722026 - DNA, 25 bp, Mus musculus
ggttgccaatacctatgcctgcaag

SEQ ID NO: 722027 - DNA, 25 bp, Mus musculus
ggttgccaatacgtatgcctgcaag

SEQ ID NO: 722028 - DNA, 25 bp, Mus musculus
ggttgccaccctacatagagtttag

SEQ ID NO: 722029 - DNA, 25 bp, Mus musculus
ggttgccacccttcatagagtttag

SEQ ID NO: 722030 - DNA, 25 bp, Mus musculus
ggttgccatctaatgacccatcagg

SEQ ID NO: 722031 - DNA, 25 bp, Mus musculus
ggttgccatctattgacccatcagg

SEQ ID NO: 722032 - DNA, 25 bp, Mus musculus
ggttgcccagcccaaagaggtgtat

SEQ ID NO: 722033 - DNA, 25 bp, Mus musculus
ggttgcccagccgaaagaggtgtat

SEQ ID NO: 722034 - DNA, 25 bp, Mus musculus
ggttgcccatcaaccggcgggacct

SEQ ID NO: 722035 - DNA, 25 bp, Mus musculus
ggttgcccatcatccggcgggacct

SEQ ID NO: 722036 - DNA, 25 bp, Mus musculus
ggttgcccctctcaacattgttttg

SEQ ID NO: 722037 - DNA, 25 bp, Mus musculus
ggttgcccctctgaacattgttttg

SEQ ID NO: 722038 - DNA, 25 bp, Mus musculus
ggttgccctcacagggacatctcta

SEQ ID NO: 722039 - DNA, 25 bp, Mus musculus
ggttgccctcactgggacatctcta

SEQ ID NO: 722040 - DNA, 25 bp, Mus musculus
ggttgccgagtcatgttaattggtg

SEQ ID NO: 722041 - DNA, 25 bp, Mus musculus
ggttgccgagtcttgttaattggtg

SEQ ID NO: 722042 - DNA, 25 bp, Mus musculus
ggttgccgcaccctacatcgagaaa

SEQ ID NO: 722043 - DNA, 25 bp, Mus musculus
ggttgccgcaccgtacatcgagaaa

SEQ ID NO: 722044 - DNA, 25 bp, Mus musculus
ggttgccttagcaccgatccacgag

SEQ ID NO: 722045 - DNA, 25 bp, Mus musculus
ggttgccttagctccgatccacgag

SEQ ID NO: 722046 - DNA, 25 bp, Mus musculus
ggttgcgaggcaacatcgccaaccc

SEQ ID NO: 722047 - DNA, 25 bp, Mus musculus
ggttgcgaggcatcatcgccaaccc

SEQ ID NO: 722048 - DNA, 25 bp, Mus musculus
ggttgcgtcatgatccacagaccac

SEQ ID NO: 722049 - DNA, 25 bp, Mus musculus
ggttgcgtcatgttccacagaccac

SEQ ID NO: 722050 - DNA, 25 bp, Mus musculus
ggttgctaagacactctggctcgct

SEQ ID NO: 722051 - DNA, 25 bp, Mus musculus
ggttgctaagactctctggctcgct

SEQ ID NO: 722052 - DNA, 25 bp, Mus musculus
ggttgctaccgaagagttttggatc

SEQ ID NO: 722053 - DNA, 25 bp, Mus musculus
ggttgctaccgatgagttttggatc

SEQ ID NO: 722054 - DNA, 25 bp, Mus musculus
ggttgctagatcaggctacatttta

SEQ ID NO: 722055 - DNA, 25 bp, Mus musculus
ggttgctagatctggctacatttta

SEQ ID NO: 722056 - DNA, 25 bp, Mus musculus
ggttgctccttaacaaaccctattg

SEQ ID NO: 722057 - DNA, 25 bp, Mus musculus
ggttgctccttatcaaaccctattg

SEQ ID NO: 722058 - DNA, 25 bp, Mus musculus
ggttgctcgaacaccctaaaatctt

SEQ ID NO: 722059 - DNA, 25 bp, Mus musculus
ggttgctcgaactccctaaaatctt

SEQ ID NO: 722060 - DNA, 25 bp, Mus musculus
ggttgctggcacaggccaagttttc

SEQ ID NO: 722061 - DNA, 25 bp, Mus musculus
ggttgctggcactggccaagttttc

SEQ ID NO: 722062 - DNA, 25 bp, Mus musculus
ggttgctgtgcaagcgcgatttctg

SEQ ID NO: 722063 - DNA, 25 bp, Mus musculus
ggttgctgtgcatgcgcgatttctg

SEQ ID NO: 722064 - DNA, 25 bp, Mus musculus
ggttgcttaaagaaatatgacactg

SEQ ID NO: 722065 - DNA, 25 bp, Mus musculus
ggttgcttaaagtaatatgacactg

SEQ ID NO: 722066 - DNA, 25 bp, Mus musculus
ggttgcttcccgaaattttgcaaat

SEQ ID NO: 722067 - DNA, 25 bp, Mus musculus
ggttgcttcccgtaattttgcaaat

SEQ ID NO: 722068 - DNA, 25 bp, Mus musculus
ggttgcttccttcaacatccgaggt

SEQ ID NO: 722069 - DNA, 25 bp, Mus musculus
ggttgcttccttgaacatccgaggt

SEQ ID NO: 722070 - DNA, 25 bp, Mus musculus
ggttgctttcttagtctgaggccgc

SEQ ID NO: 722071 - DNA, 25 bp, Mus musculus
ggttgctttctttgtctgaggccgc

SEQ ID NO: 722072 - DNA, 25 bp, Mus musculus
ggttggaaaccaccacagttctatc

SEQ ID NO: 722073 - DNA, 25 bp, Mus musculus
ggttggaaaccagcacagttctatc

SEQ ID NO: 722074 - DNA, 25 bp, Mus musculus
ggttggaaagtcctgccttctcctt

SEQ ID NO: 722075 - DNA, 25 bp, Mus musculus
ggttggaaagtcgtgccttctcctt

SEQ ID NO: 722076 - DNA, 25 bp, Mus musculus
ggttggaactagaacgaaaggagca

SEQ ID NO: 722077 - DNA, 25 bp, Mus musculus
ggttggaactagtacgaaaggagca

SEQ ID NO: 722078 - DNA, 25 bp, Mus musculus
ggttggaagactacactgctgagcc

SEQ ID NO: 722079 - DNA, 25 bp, Mus musculus
ggttggaagacttcactgctgagcc

SEQ ID NO: 722080 - DNA, 25 bp, Mus musculus
ggttggaatcatagttggcgtcttg

SEQ ID NO: 722081 - DNA, 25 bp, Mus musculus
ggttggaatcattgttggcgtcttg

SEQ ID NO: 722082 - DNA, 25 bp, Mus musculus
ggttggacaataacacgcagtctcc

SEQ ID NO: 722083 - DNA, 25 bp, Mus musculus
ggttggacaatatcacgcagtctcc

SEQ ID NO: 722084 - DNA, 25 bp, Mus musculus
ggttggacagtaatacaacaccggg

SEQ ID NO: 722085 - DNA, 25 bp, Mus musculus
ggttggacagtattacaacaccggg

SEQ ID NO: 722086 - DNA, 25 bp, Mus musculus
ggttggacataaaccaatcctctgt

SEQ ID NO: 722087 - DNA, 25 bp, Mus musculus
ggttggacataatccaatcctctgt

SEQ ID NO: 722088 - DNA, 25 bp, Mus musculus
ggttggacatctcggcatcgctcct

SEQ ID NO: 722089 - DNA, 25 bp, Mus musculus
ggttggacatctgggcatcgctcct

SEQ ID NO: 722090 - DNA, 25 bp, Mus musculus
ggttggaccatcacctgtacagaag

SEQ ID NO: 722091 - DNA, 25 bp, Mus musculus
ggttggaccatctcctgtacagaag

SEQ ID NO: 722092 - DNA, 25 bp, Mus musculus
ggttggatacaccagcgtttgagct

SEQ ID NO: 722093 - DNA, 25 bp, Mus musculus
ggttggatacacgagcgtttgagct

SEQ ID NO: 722094 - DNA, 25 bp, Mus musculus
ggttggatcctcctctctgcaagaa

SEQ ID NO: 722095 - DNA, 25 bp, Mus musculus
ggttggatcctcgtctctgcaagaa

SEQ ID NO: 722096 - DNA, 25 bp, Mus musculus
ggttggcacgtacaagaatttcttc

SEQ ID NO: 722097 - DNA, 25 bp, Mus musculus
ggttggcacgtagaagaatttcttc

SEQ ID NO: 722098 - DNA, 25 bp, Mus musculus
ggttggcactctcacttcctctttg

SEQ ID NO: 722099 - DNA, 25 bp, Mus musculus
ggttggcactctgacttcctctttg

SEQ ID NO: 722100 - DNA, 25 bp, Mus musculus
ggttggccaataccaccatgttcaa

SEQ ID NO: 722101 - DNA, 25 bp, Mus musculus
ggttggccaatagcaccatgttcaa

SEQ ID NO: 722102 - DNA, 25 bp, Mus musculus
ggttggccacttagacccttacaag

SEQ ID NO: 722103 - DNA, 25 bp, Mus musculus
ggttggccactttgacccttacaag

SEQ ID NO: 722104 - DNA, 25 bp, Mus musculus
ggttggccctcacttgctagatgca

SEQ ID NO: 722105 - DNA, 25 bp, Mus musculus
ggttggccctcagttgctagatgca

SEQ ID NO: 722106 - DNA, 25 bp, Mus musculus
ggttggcctgtacatggaagcacaa

SEQ ID NO: 722107 - DNA, 25 bp, Mus musculus
ggttggcctgtagatggaagcacaa

SEQ ID NO: 722108 - DNA, 25 bp, Mus musculus
ggttggcggtgtccgacactccaca

SEQ ID NO: 722109 - DNA, 25 bp, Mus musculus
ggttggcggtgtgcgacactccaca

SEQ ID NO: 722110 - DNA, 25 bp, Mus musculus
ggttggctatccagacttcctgctg

SEQ ID NO: 722111 - DNA, 25 bp, Mus musculus
ggttggctatcctgacttcctgctg

SEQ ID NO: 722112 - DNA, 25 bp, Mus musculus
ggttggctcgctcccttgactggct

SEQ ID NO: 722113 - DNA, 25 bp, Mus musculus
ggttggctcgctgccttgactggct

SEQ ID NO: 722114 - DNA, 25 bp, Mus musculus
ggttggctggaacgccttcatcatc

SEQ ID NO: 722115 - DNA, 25 bp, Mus musculus
ggttggctggaaggccttcatcatc

SEQ ID NO: 722116 - DNA, 25 bp, Mus musculus
ggttggctgtctacccagggttgcc

SEQ ID NO: 722117 - DNA, 25 bp, Mus musculus
ggttggctgtcttcccagggttgcc

SEQ ID NO: 722118 - DNA, 25 bp, Mus musculus
ggttggcttcccctgccagtttcca

SEQ ID NO: 722119 - DNA, 25 bp, Mus musculus
ggttggcttcccgtgccagtttcca

SEQ ID NO: 722120 - DNA, 25 bp, Mus musculus
ggttgggaggtccacaaatcagaac

SEQ ID NO: 722121 - DNA, 25 bp, Mus musculus
ggttgggaggtcgacaaatcagaac

SEQ ID NO: 722122 - DNA, 25 bp, Mus musculus
ggttgggcagctccctcagactcca

SEQ ID NO: 722123 - DNA, 25 bp, Mus musculus
ggttgggcagctgcctcagactcca

SEQ ID NO: 722124 - DNA, 25 bp, Mus musculus
ggttgggcctccatgccggtgctca

SEQ ID NO: 722125 - DNA, 25 bp, Mus musculus
ggttgggcctccttgccggtgctca

SEQ ID NO: 722126 - DNA, 25 bp, Mus musculus
ggttgggcgtttactcgctggctct

SEQ ID NO: 722127 - DNA, 25 bp, Mus musculus
ggttgggcgttttctcgctggctct

SEQ ID NO: 722128 - DNA, 25 bp, Mus musculus
ggttgggctaccagtcccattgtgc

SEQ ID NO: 722129 - DNA, 25 bp, Mus musculus
ggttgggctacctgtcccattgtgc

SEQ ID NO: 722130 - DNA, 25 bp, Mus musculus
ggttgggtttctatgcctgtctgtg

SEQ ID NO: 722131 - DNA, 25 bp, Mus musculus
ggttgggtttctttgcctgtctgtg

SEQ ID NO: 722132 - DNA, 25 bp, Mus musculus
ggttggtaaaggcttctccctagtg

SEQ ID NO: 722133 - DNA, 25 bp, Mus musculus
ggttggtaaagggttctccctagtg

SEQ ID NO: 722134 - DNA, 25 bp, Mus musculus
ggttggtaacccaaacatctgatga

SEQ ID NO: 722135 - DNA, 25 bp, Mus musculus
ggttggtaaccctaacatctgatga

SEQ ID NO: 722136 - DNA, 25 bp, Mus musculus
ggttggtcacaaactgttataggaa

SEQ ID NO: 722137 - DNA, 25 bp, Mus musculus
ggttggtcacaatctgttataggaa

SEQ ID NO: 722138 - DNA, 25 bp, Mus musculus
ggttggtggaagatgccacaatgaa

SEQ ID NO: 722139 - DNA, 25 bp, Mus musculus
ggttggtggaagttgccacaatgaa

SEQ ID NO: 722140 - DNA, 25 bp, Mus musculus
ggttggttcaccatgattctggccc

SEQ ID NO: 722141 - DNA, 25 bp, Mus musculus
ggttggttcaccttgattctggccc

SEQ ID NO: 722142 - DNA, 25 bp, Mus musculus
ggttggttcatgacctctggcaccc

SEQ ID NO: 722143 - DNA, 25 bp, Mus musculus
ggttggttcatgtcctctggcaccc

SEQ ID NO: 722144 - DNA, 25 bp, Mus musculus
ggttgtaagcctagcatatgtacag

SEQ ID NO: 722145 - DNA, 25 bp, Mus musculus
ggttgtaagccttgcatatgtacag

SEQ ID NO: 722146 - DNA, 25 bp, Mus musculus
ggttgtaatgcccacgcctctctcg

SEQ ID NO: 722147 - DNA, 25 bp, Mus musculus
ggttgtaatgccgacgcctctctcg

SEQ ID NO: 722148 - DNA, 25 bp, Mus musculus
ggttgtacactacctttgctccaag

SEQ ID NO: 722149 - DNA, 25 bp, Mus musculus
ggttgtacactagctttgctccaag

SEQ ID NO: 722150 - DNA, 25 bp, Mus musculus
ggttgtaccctaatgaaatcgtgtc

SEQ ID NO: 722151 - DNA, 25 bp, Mus musculus
ggttgtaccctattgaaatcgtgtc

SEQ ID NO: 722152 - DNA, 25 bp, Mus musculus
ggttgtagaaagcagactagctcac

SEQ ID NO: 722153 - DNA, 25 bp, Mus musculus
ggttgtagaaaggagactagctcac

SEQ ID NO: 722154 - DNA, 25 bp, Mus musculus
ggttgtagatggcatatttgctgtc

SEQ ID NO: 722155 - DNA, 25 bp, Mus musculus
ggttgtagatgggatatttgctgtc

SEQ ID NO: 722156 - DNA, 25 bp, Mus musculus
ggttgtagcagtatccataatggga

SEQ ID NO: 722157 - DNA, 25 bp, Mus musculus
ggttgtagcagtttccataatggga

SEQ ID NO: 722158 - DNA, 25 bp, Mus musculus
ggttgtagccccaggactcacatgg

SEQ ID NO: 722159 - DNA, 25 bp, Mus musculus
ggttgtagcccctggactcacatgg

SEQ ID NO: 722160 - DNA, 25 bp, Mus musculus
ggttgtagctccctcagacatgatg

SEQ ID NO: 722161 - DNA, 25 bp, Mus musculus
ggttgtagctccgtcagacatgatg

SEQ ID NO: 722162 - DNA, 25 bp, Mus musculus
ggttgtaggcaccttatcctggcca

SEQ ID NO: 722163 - DNA, 25 bp, Mus musculus
ggttgtaggcacgttatcctggcca

SEQ ID NO: 722164 - DNA, 25 bp, Mus musculus
ggttgtatactgcaaatgctcagat

SEQ ID NO: 722165 - DNA, 25 bp, Mus musculus
ggttgtatactggaaatgctcagat

SEQ ID NO: 722166 - DNA, 25 bp, Mus musculus
ggttgtatcttgcagcccctatgcc

SEQ ID NO: 722167 - DNA, 25 bp, Mus musculus
ggttgtatcttggagcccctatgcc

SEQ ID NO: 722168 - DNA, 25 bp, Mus musculus
ggttgtatggagacaaaattcttga

SEQ ID NO: 722169 - DNA, 25 bp, Mus musculus
ggttgtatggagtcaaaattcttga

SEQ ID NO: 722170 - DNA, 25 bp, Mus musculus
ggttgtattttacccagtaggagtg

SEQ ID NO: 722171 - DNA, 25 bp, Mus musculus
ggttgtattttagccagtaggagtg

SEQ ID NO: 722172 - DNA, 25 bp, Mus musculus
ggttgtcaactccatcacgtggtct

SEQ ID NO: 722173 - DNA, 25 bp, Mus musculus
ggttgtcaactcgatcacgtggtct

SEQ ID NO: 722174 - DNA, 25 bp, Mus musculus
ggttgtcaatgaaatgtgccccaat

SEQ ID NO: 722175 - DNA, 25 bp, Mus musculus
ggttgtcaatgatatgtgccccaat

SEQ ID NO: 722176 - DNA, 25 bp, Mus musculus
ggttgtcacgctactcaatgaactg

SEQ ID NO: 722177 - DNA, 25 bp, Mus musculus
ggttgtcacgcttctcaatgaactg

SEQ ID NO: 722178 - DNA, 25 bp, Mus musculus
ggttgtcagcaacggtacagtgacc

SEQ ID NO: 722179 - DNA, 25 bp, Mus musculus
ggttgtcagcaagggtacagtgacc

SEQ ID NO: 722180 - DNA, 25 bp, Mus musculus
ggttgtcagtccagcttccgggctc

SEQ ID NO: 722181 - DNA, 25 bp, Mus musculus
ggttgtcagtcctgcttccgggctc

SEQ ID NO: 722182 - DNA, 25 bp, Mus musculus
ggttgtcattcactttggagaccac

SEQ ID NO: 722183 - DNA, 25 bp, Mus musculus
ggttgtcattcagtttggagaccac

SEQ ID NO: 722184 - DNA, 25 bp, Mus musculus
ggttgtcggattcaccataatacta

SEQ ID NO: 722185 - DNA, 25 bp, Mus musculus
ggttgtcggattgaccataatacta

SEQ ID NO: 722186 - DNA, 25 bp, Mus musculus
ggttgtcgtctgacagcttggattc

SEQ ID NO: 722187 - DNA, 25 bp, Mus musculus
ggttgtcgtctgtcagcttggattc

SEQ ID NO: 722188 - DNA, 25 bp, Mus musculus
ggttgtctccatctctaggtctctg

SEQ ID NO: 722189 - DNA, 25 bp, Mus musculus
ggttgtctccatgtctaggtctctg

SEQ ID NO: 722190 - DNA, 25 bp, Mus musculus
ggttgtctggtcacccctgtgggct

SEQ ID NO: 722191 - DNA, 25 bp, Mus musculus
ggttgtctggtctcccctgtgggct

SEQ ID NO: 722192 - DNA, 25 bp, Mus musculus
ggttgtgaaatgctacctctcggcc

SEQ ID NO: 722193 - DNA, 25 bp, Mus musculus
ggttgtgaaatggtacctctcggcc

SEQ ID NO: 722194 - DNA, 25 bp, Mus musculus
ggttgtgaagcacgtggaacaccct

SEQ ID NO: 722195 - DNA, 25 bp, Mus musculus
ggttgtgaagcaggtggaacaccct

SEQ ID NO: 722196 - DNA, 25 bp, Mus musculus
ggttgtgaggacagcagaaaacaag

SEQ ID NO: 722197 - DNA, 25 bp, Mus musculus
ggttgtgaggactgcagaaaacaag

SEQ ID NO: 722198 - DNA, 25 bp, Mus musculus
ggttgtgagtgaagctctcccgact

SEQ ID NO: 722199 - DNA, 25 bp, Mus musculus
ggttgtgagtgatgctctcccgact

SEQ ID NO: 722200 - DNA, 25 bp, Mus musculus
ggttgtgatactcccctgaatgtga

SEQ ID NO: 722201 - DNA, 25 bp, Mus musculus
ggttgtgatactgccctgaatgtga

SEQ ID NO: 722202 - DNA, 25 bp, Mus musculus
ggttgtggacaacccacagaagttt

SEQ ID NO: 722203 - DNA, 25 bp, Mus musculus
ggttgtggacaagccacagaagttt

SEQ ID NO: 722204 - DNA, 25 bp, Mus musculus
ggttgtggcagtcagtcccaccaga

SEQ ID NO: 722205 - DNA, 25 bp, Mus musculus
ggttgtggcagtgagtcccaccaga

SEQ ID NO: 722206 - DNA, 25 bp, Mus musculus
ggttgtgggcaacaccatgtgcacc

SEQ ID NO: 722207 - DNA, 25 bp, Mus musculus
ggttgtgggcaagaccatgtgcacc

SEQ ID NO: 722208 - DNA, 25 bp, Mus musculus
ggttgtgtacgaagtcccaagacca

SEQ ID NO: 722209 - DNA, 25 bp, Mus musculus
ggttgtgtacgatgtcccaagacca

SEQ ID NO: 722210 - DNA, 25 bp, Mus musculus
ggttgttatggtcatctgttctgca

SEQ ID NO: 722211 - DNA, 25 bp, Mus musculus
ggttgttatggtgatctgttctgca

SEQ ID NO: 722212 - DNA, 25 bp, Mus musculus
ggttgttcacaacgacccgcctgat

SEQ ID NO: 722213 - DNA, 25 bp, Mus musculus
ggttgttcacaaggacccgcctgat

SEQ ID NO: 722214 - DNA, 25 bp, Mus musculus
ggttgttctcagagatgggcctgct

SEQ ID NO: 722215 - DNA, 25 bp, Mus musculus
ggttgttctcagtgatgggcctgct

SEQ ID NO: 722216 - DNA, 25 bp, Mus musculus
ggttgttgcaggagactagccgcct

SEQ ID NO: 722217 - DNA, 25 bp, Mus musculus
ggttgttgcaggtgactagccgcct

SEQ ID NO: 722218 - DNA, 25 bp, Mus musculus
ggttgttgcgccacttgcgccctgg

SEQ ID NO: 722219 - DNA, 25 bp, Mus musculus
ggttgttgcgcctcttgcgccctgg

SEQ ID NO: 722220 - DNA, 25 bp, Mus musculus
ggttgttgctaacttggtatgattc

SEQ ID NO: 722221 - DNA, 25 bp, Mus musculus
ggttgttgctaagttggtatgattc

SEQ ID NO: 722222 - DNA, 25 bp, Mus musculus
ggttgttgtgacactcttaccagct

SEQ ID NO: 722223 - DNA, 25 bp, Mus musculus
ggttgttgtgactctcttaccagct

SEQ ID NO: 722224 - DNA, 25 bp, Mus musculus
ggttgtttctgacgtgggttcctca

SEQ ID NO: 722225 - DNA, 25 bp, Mus musculus
ggttgtttctgaggtgggttcctca

SEQ ID NO: 722226 - DNA, 25 bp, Mus musculus
ggttgtttgaccaacagctctcccc

SEQ ID NO: 722227 - DNA, 25 bp, Mus musculus
ggttgtttgacctacagctctcccc

SEQ ID NO: 722228 - DNA, 25 bp, Mus musculus
ggtttaaaggcacccctgatccagg

SEQ ID NO: 722229 - DNA, 25 bp, Mus musculus
ggtttaaaggcagccctgatccagg

SEQ ID NO: 722230 - DNA, 25 bp, Mus musculus
ggtttaaggagcagccaagcattct

SEQ ID NO: 722231 - DNA, 25 bp, Mus musculus
ggtttaaggagctgccaagcattct

SEQ ID NO: 722232 - DNA, 25 bp, Mus musculus
ggtttacaaaggcacacccatgcac

SEQ ID NO: 722233 - DNA, 25 bp, Mus musculus
ggtttacaaagggacacccatgcac

SEQ ID NO: 722234 - DNA, 25 bp, Mus musculus
ggtttacaacagaacatctcgggcc

SEQ ID NO: 722235 - DNA, 25 bp, Mus musculus
ggtttacaacagtacatctcgggcc

SEQ ID NO: 722236 - DNA, 25 bp, Mus musculus
ggtttacaatggaatatgaaattcg

SEQ ID NO: 722237 - DNA, 25 bp, Mus musculus
ggtttacaatggtatatgaaattcg

SEQ ID NO: 722238 - DNA, 25 bp, Mus musculus
ggtttacacccacagagggacttca

SEQ ID NO: 722239 - DNA, 25 bp, Mus musculus
ggtttacacccagagagggacttca

SEQ ID NO: 722240 - DNA, 25 bp, Mus musculus
ggtttacatgagcatggcctgagca

SEQ ID NO: 722241 - DNA, 25 bp, Mus musculus
ggtttacatgaggatggcctgagca

SEQ ID NO: 722242 - DNA, 25 bp, Mus musculus
ggtttaccctccagcctgtcaacta

SEQ ID NO: 722243 - DNA, 25 bp, Mus musculus
ggtttaccctcctgcctgtcaacta

SEQ ID NO: 722244 - DNA, 25 bp, Mus musculus
ggtttacgatgaagatgttggcatt

SEQ ID NO: 722245 - DNA, 25 bp, Mus musculus
ggtttacgatgatgatgttggcatt

SEQ ID NO: 722246 - DNA, 25 bp, Mus musculus
ggtttagcagtgaaccttcacagcg

SEQ ID NO: 722247 - DNA, 25 bp, Mus musculus
ggtttagcagtgtaccttcacagcg

SEQ ID NO: 722248 - DNA, 25 bp, Mus musculus
ggtttagctgcaacggtgctccaga

SEQ ID NO: 722249 - DNA, 25 bp, Mus musculus
ggtttagctgcatcggtgctccaga

SEQ ID NO: 722250 - DNA, 25 bp, Mus musculus
ggtttaggctgacaaactgtctgcc

SEQ ID NO: 722251 - DNA, 25 bp, Mus musculus
ggtttaggctgagaaactgtctgcc

SEQ ID NO: 722252 - DNA, 25 bp, Mus musculus
ggtttagtgactacttcaatgtcag

SEQ ID NO: 722253 - DNA, 25 bp, Mus musculus
ggtttagtgacttcttcaatgtcag

SEQ ID NO: 722254 - DNA, 25 bp, Mus musculus
ggtttagtgtctacttcagctgctc

SEQ ID NO: 722255 - DNA, 25 bp, Mus musculus
ggtttagtgtcttcttcagctgctc

SEQ ID NO: 722256 - DNA, 25 bp, Mus musculus
ggtttatcactccatcagttctgga

SEQ ID NO: 722257 - DNA, 25 bp, Mus musculus
ggtttatcactcgatcagttctgga

SEQ ID NO: 722258 - DNA, 25 bp, Mus musculus
ggtttatcagtaacaggtacctcaa

SEQ ID NO: 722259 - DNA, 25 bp, Mus musculus
ggtttatcagtatcaggtacctcaa

SEQ ID NO: 722260 - DNA, 25 bp, Mus musculus
ggtttatcatctacaaagttgggaa

SEQ ID NO: 722261 - DNA, 25 bp, Mus musculus
ggtttatcatcttcaaagttgggaa

SEQ ID NO: 722262 - DNA, 25 bp, Mus musculus
ggtttatcatggaaatgggagccat

SEQ ID NO: 722263 - DNA, 25 bp, Mus musculus
ggtttatcatggtaatgggagccat

SEQ ID NO: 722264 - DNA, 25 bp, Mus musculus
ggtttatggcagacgcatgacaggt

SEQ ID NO: 722265 - DNA, 25 bp, Mus musculus
ggtttatggcagtcgcatgacaggt

SEQ ID NO: 722266 - DNA, 25 bp, Mus musculus
ggtttattataacgcggagctccgc

SEQ ID NO: 722267 - DNA, 25 bp, Mus musculus
ggtttattataaggcggagctccgc

SEQ ID NO: 722268 - DNA, 25 bp, Mus musculus
ggtttattcaacaagaaatggatct

SEQ ID NO: 722269 - DNA, 25 bp, Mus musculus
ggtttattcaactagaaatggatct

SEQ ID NO: 722270 - DNA, 25 bp, Mus musculus
ggtttattcagcacaactggtgacc

SEQ ID NO: 722271 - DNA, 25 bp, Mus musculus
ggtttattcagctcaactggtgacc

SEQ ID NO: 722272 - DNA, 25 bp, Mus musculus
ggtttattccagctcgagatctccc

SEQ ID NO: 722273 - DNA, 25 bp, Mus musculus
ggtttattccaggtcgagatctccc

SEQ ID NO: 722274 - DNA, 25 bp, Mus musculus
ggtttattgcctagaaatgcgggaa

SEQ ID NO: 722275 - DNA, 25 bp, Mus musculus
ggtttattgccttgaaatgcgggaa

SEQ ID NO: 722276 - DNA, 25 bp, Mus musculus
ggtttatttccacaggcctcaggta

SEQ ID NO: 722277 - DNA, 25 bp, Mus musculus
ggtttatttccagaggcctcaggta

SEQ ID NO: 722278 - DNA, 25 bp, Mus musculus
ggtttcaacagcactctggcctgca

SEQ ID NO: 722279 - DNA, 25 bp, Mus musculus
ggtttcaacagctctctggcctgca

SEQ ID NO: 722280 - DNA, 25 bp, Mus musculus
ggtttcaactctcagaacagagttc

SEQ ID NO: 722281 - DNA, 25 bp, Mus musculus
ggtttcaactctgagaacagagttc

SEQ ID NO: 722282 - DNA, 25 bp, Mus musculus
ggtttcaacttcctaaatcatggtg

SEQ ID NO: 722283 - DNA, 25 bp, Mus musculus
ggtttcaacttcgtaaatcatggtg

SEQ ID NO: 722284 - DNA, 25 bp, Mus musculus
ggtttcacaaagatgccccagctgg

SEQ ID NO: 722285 - DNA, 25 bp, Mus musculus
ggtttcacaaagttgccccagctgg

SEQ ID NO: 722286 - DNA, 25 bp, Mus musculus
ggtttcacagagcacgctatggttc

SEQ ID NO: 722287 - DNA, 25 bp, Mus musculus
ggtttcacagaggacgctatggttc

SEQ ID NO: 722288 - DNA, 25 bp, Mus musculus
ggtttcacagcacgtagggctcctt

SEQ ID NO: 722289 - DNA, 25 bp, Mus musculus
ggtttcacagcaggtagggctcctt

SEQ ID NO: 722290 - DNA, 25 bp, Mus musculus
ggtttcacatccctagtggcaaggg

SEQ ID NO: 722291 - DNA, 25 bp, Mus musculus
ggtttcacatccgtagtggcaaggg

SEQ ID NO: 722292 - DNA, 25 bp, Mus musculus
ggtttcaccatgcaaatgaatgcct

SEQ ID NO: 722293 - DNA, 25 bp, Mus musculus
ggtttcaccatggaaatgaatgcct

SEQ ID NO: 722294 - DNA, 25 bp, Mus musculus
ggtttcacgttgaagtctcacctcc

SEQ ID NO: 722295 - DNA, 25 bp, Mus musculus
ggtttcacgttgtagtctcacctcc

SEQ ID NO: 722296 - DNA, 25 bp, Mus musculus
ggtttcagacacaggatcacgaaga

SEQ ID NO: 722297 - DNA, 25 bp, Mus musculus
ggtttcagacactggatcacgaaga

SEQ ID NO: 722298 - DNA, 25 bp, Mus musculus
ggtttcagcttcatcctgttccctg

SEQ ID NO: 722299 - DNA, 25 bp, Mus musculus
ggtttcagcttcttcctgttccctg

SEQ ID NO: 722300 - DNA, 25 bp, Mus musculus
ggtttcaggcccacttgcaggaggt

SEQ ID NO: 722301 - DNA, 25 bp, Mus musculus
ggtttcaggccctcttgcaggaggt

SEQ ID NO: 722302 - DNA, 25 bp, Mus musculus
ggtttcagtgcgactccagcccgtg

SEQ ID NO: 722303 - DNA, 25 bp, Mus musculus
ggtttcagtgcgtctccagcccgtg

SEQ ID NO: 722304 - DNA, 25 bp, Mus musculus
ggtttcagttaaagagcgcatcgac

SEQ ID NO: 722305 - DNA, 25 bp, Mus musculus
ggtttcagttaatgagcgcatcgac

SEQ ID NO: 722306 - DNA, 25 bp, Mus musculus
ggtttcataacacgcctcaagaagg

SEQ ID NO: 722307 - DNA, 25 bp, Mus musculus
ggtttcataacaggcctcaagaagg

SEQ ID NO: 722308 - DNA, 25 bp, Mus musculus
ggtttcatcaagatgtaccccacaa

SEQ ID NO: 722309 - DNA, 25 bp, Mus musculus
ggtttcatcaagttgtaccccacaa

SEQ ID NO: 722310 - DNA, 25 bp, Mus musculus
ggtttcatgccccattccgagccga

SEQ ID NO: 722311 - DNA, 25 bp, Mus musculus
ggtttcatgcccgattccgagccga

SEQ ID NO: 722312 - DNA, 25 bp, Mus musculus
ggtttcattcacatccatccctaga

SEQ ID NO: 722313 - DNA, 25 bp, Mus musculus
ggtttcattcacttccatccctaga

SEQ ID NO: 722314 - DNA, 25 bp, Mus musculus
ggtttcattcgaaggcctcagacac

SEQ ID NO: 722315 - DNA, 25 bp, Mus musculus
ggtttcattcgatggcctcagacac

SEQ ID NO: 722316 - DNA, 25 bp, Mus musculus
ggtttcattgtactaccaaagtgag

SEQ ID NO: 722317 - DNA, 25 bp, Mus musculus
ggtttcattgtagtaccaaagtgag

SEQ ID NO: 722318 - DNA, 25 bp, Mus musculus
ggtttccagaaaactatcccagcat

SEQ ID NO: 722319 - DNA, 25 bp, Mus musculus
ggtttccagaaatctatcccagcat

SEQ ID NO: 722320 - DNA, 25 bp, Mus musculus
ggtttccagcaaattatgtcaaact

SEQ ID NO: 722321 - DNA, 25 bp, Mus musculus
ggtttccagcaatttatgtcaaact

SEQ ID NO: 722322 - DNA, 25 bp, Mus musculus
ggtttccagcagagccgttctcctg

SEQ ID NO: 722323 - DNA, 25 bp, Mus musculus
ggtttccagcagtgccgttctcctg

SEQ ID NO: 722324 - DNA, 25 bp, Mus musculus
ggtttccagccaagtttgtggaggt

SEQ ID NO: 722325 - DNA, 25 bp, Mus musculus
ggtttccagccatgtttgtggaggt

SEQ ID NO: 722326 - DNA, 25 bp, Mus musculus
ggtttccaggtgacagacacgattc

SEQ ID NO: 722327 - DNA, 25 bp, Mus musculus
ggtttccaggtgtcagacacgattc

SEQ ID NO: 722328 - DNA, 25 bp, Mus musculus
ggtttccatagtctcctgaataatc

SEQ ID NO: 722329 - DNA, 25 bp, Mus musculus
ggtttccatagtgtcctgaataatc

SEQ ID NO: 722330 - DNA, 25 bp, Mus musculus
ggtttccattgtccccaagacctgc

SEQ ID NO: 722331 - DNA, 25 bp, Mus musculus
ggtttccattgtgcccaagacctgc

SEQ ID NO: 722332 - DNA, 25 bp, Mus musculus
ggtttcccaagacggcagtcattaa

SEQ ID NO: 722333 - DNA, 25 bp, Mus musculus
ggtttcccaagagggcagtcattaa

SEQ ID NO: 722334 - DNA, 25 bp, Mus musculus
ggtttcccagcccagtccagggact

SEQ ID NO: 722335 - DNA, 25 bp, Mus musculus
ggtttcccagccgagtccagggact

SEQ ID NO: 722336 - DNA, 25 bp, Mus musculus
ggtttcccgagacccagacaaattg

SEQ ID NO: 722337 - DNA, 25 bp, Mus musculus
ggtttcccgagagccagacaaattg

SEQ ID NO: 722338 - DNA, 25 bp, Mus musculus
ggtttccctacgagaaagtggtgca

SEQ ID NO: 722339 - DNA, 25 bp, Mus musculus
ggtttccctacgtgaaagtggtgca

SEQ ID NO: 722340 - DNA, 25 bp, Mus musculus
ggtttccctccaccagtgcttacta

SEQ ID NO: 722341 - DNA, 25 bp, Mus musculus
ggtttccctccagcagtgcttacta

SEQ ID NO: 722342 - DNA, 25 bp, Mus musculus
ggtttccctcttcttagagcctgtg

SEQ ID NO: 722343 - DNA, 25 bp, Mus musculus
ggtttccctcttgttagagcctgtg

SEQ ID NO: 722344 - DNA, 25 bp, Mus musculus
ggtttccgttcacacagaggccagt

SEQ ID NO: 722345 - DNA, 25 bp, Mus musculus
ggtttccgttcagacagaggccagt

SEQ ID NO: 722346 - DNA, 25 bp, Mus musculus
ggtttcctatctcccaggattttgt

SEQ ID NO: 722347 - DNA, 25 bp, Mus musculus
ggtttcctatctgccaggattttgt

SEQ ID NO: 722348 - DNA, 25 bp, Mus musculus
ggtttcctattgagcctctcttcca

SEQ ID NO: 722349 - DNA, 25 bp, Mus musculus
ggtttcctattgtgcctctcttcca

SEQ ID NO: 722350 - DNA, 25 bp, Mus musculus
ggtttcctgaggacgttcacatcag

SEQ ID NO: 722351 - DNA, 25 bp, Mus musculus
ggtttcctgaggtcgttcacatcag

SEQ ID NO: 722352 - DNA, 25 bp, Mus musculus
ggtttcctgcagaaggcgatcccgg

SEQ ID NO: 722353 - DNA, 25 bp, Mus musculus
ggtttcctgcagtaggcgatcccgg

SEQ ID NO: 722354 - DNA, 25 bp, Mus musculus
ggtttcctgtgcaggtgttcttcca

SEQ ID NO: 722355 - DNA, 25 bp, Mus musculus
ggtttcctgtgctggtgttcttcca

SEQ ID NO: 722356 - DNA, 25 bp, Mus musculus
ggtttccttactacaattctggtct

SEQ ID NO: 722357 - DNA, 25 bp, Mus musculus
ggtttccttacttcaattctggtct

SEQ ID NO: 722358 - DNA, 25 bp, Mus musculus
ggtttcgaagacatgtggtgtatat

SEQ ID NO: 722359 - DNA, 25 bp, Mus musculus
ggtttcgaagacttgtggtgtatat

SEQ ID NO: 722360 - DNA, 25 bp, Mus musculus
ggtttcggtagccactgattctcag

SEQ ID NO: 722361 - DNA, 25 bp, Mus musculus
ggtttcggtagcgactgattctcag

SEQ ID NO: 722362 - DNA, 25 bp, Mus musculus
ggtttcggtcacaaagccgagacct

SEQ ID NO: 722363 - DNA, 25 bp, Mus musculus
ggtttcggtcactaagccgagacct

SEQ ID NO: 722364 - DNA, 25 bp, Mus musculus
ggtttcgtgaagcagtgttcacaca

SEQ ID NO: 722365 - DNA, 25 bp, Mus musculus
ggtttcgtgaaggagtgttcacaca

SEQ ID NO: 722366 - DNA, 25 bp, Mus musculus
ggtttctaagtaaggtgacctggcc

SEQ ID NO: 722367 - DNA, 25 bp, Mus musculus
ggtttctaagtatggtgacctggcc

SEQ ID NO: 722368 - DNA, 25 bp, Mus musculus
ggtttctatgacagtcagcgcctct

SEQ ID NO: 722369 - DNA, 25 bp, Mus musculus
ggtttctatgactgtcagcgcctct

SEQ ID NO: 722370 - DNA, 25 bp, Mus musculus
ggtttctccgcgcttcctaccttag

SEQ ID NO: 722371 - DNA, 25 bp, Mus musculus
ggtttctccgcggttcctaccttag

SEQ ID NO: 722372 - DNA, 25 bp, Mus musculus
ggtttctcctcaaaccctctgcata

SEQ ID NO: 722373 - DNA, 25 bp, Mus musculus
ggtttctcctcataccctctgcata

SEQ ID NO: 722374 - DNA, 25 bp, Mus musculus
ggtttctctactccatggcccttta

SEQ ID NO: 722375 - DNA, 25 bp, Mus musculus
ggtttctctactgcatggcccttta

SEQ ID NO: 722376 - DNA, 25 bp, Mus musculus
ggtttctctgtccagggtcagtatg

SEQ ID NO: 722377 - DNA, 25 bp, Mus musculus
ggtttctctgtcgagggtcagtatg

SEQ ID NO: 722378 - DNA, 25 bp, Mus musculus
ggtttctcttttacttctcatctgt

SEQ ID NO: 722379 - DNA, 25 bp, Mus musculus
ggtttctctttttcttctcatctgt

SEQ ID NO: 722380 - DNA, 25 bp, Mus musculus
ggtttctgatgaaaatcataggcat

SEQ ID NO: 722381 - DNA, 25 bp, Mus musculus
ggtttctgatgataatcataggcat

SEQ ID NO: 722382 - DNA, 25 bp, Mus musculus
ggtttctgccaacctggactatcag

SEQ ID NO: 722383 - DNA, 25 bp, Mus musculus
ggtttctgccaagctggactatcag

SEQ ID NO: 722384 - DNA, 25 bp, Mus musculus
ggtttctgcccgcacagaagacaac

SEQ ID NO: 722385 - DNA, 25 bp, Mus musculus
ggtttctgcccggacagaagacaac

SEQ ID NO: 722386 - DNA, 25 bp, Mus musculus
ggtttctgcggtcgcgtcattttct

SEQ ID NO: 722387 - DNA, 25 bp, Mus musculus
ggtttctgcggtggcgtcattttct

SEQ ID NO: 722388 - DNA, 25 bp, Mus musculus
ggtttctgctgaattctgaatctgt

SEQ ID NO: 722389 - DNA, 25 bp, Mus musculus
ggtttctgctgatttctgaatctgt

SEQ ID NO: 722390 - DNA, 25 bp, Mus musculus
ggtttctgctttatcaactcagtag

SEQ ID NO: 722391 - DNA, 25 bp, Mus musculus
ggtttctgctttttcaactcagtag

SEQ ID NO: 722392 - DNA, 25 bp, Mus musculus
ggtttctggagaccacctagcgccg

SEQ ID NO: 722393 - DNA, 25 bp, Mus musculus
ggtttctggagagcacctagcgccg

SEQ ID NO: 722394 - DNA, 25 bp, Mus musculus
ggtttctgggagatctgcaccttca

SEQ ID NO: 722395 - DNA, 25 bp, Mus musculus
ggtttctgggagttctgcaccttca

SEQ ID NO: 722396 - DNA, 25 bp, Mus musculus
ggtttctgttgcatggaaccccaga

SEQ ID NO: 722397 - DNA, 25 bp, Mus musculus
ggtttctgttgcttggaaccccaga

SEQ ID NO: 722398 - DNA, 25 bp, Mus musculus
ggtttcttagtcctgtactgcccga

SEQ ID NO: 722399 - DNA, 25 bp, Mus musculus
ggtttcttagtcgtgtactgcccga

SEQ ID NO: 722400 - DNA, 25 bp, Mus musculus
ggtttcttatccaacttcagtctaa

SEQ ID NO: 722401 - DNA, 25 bp, Mus musculus
ggtttcttatcctacttcagtctaa

SEQ ID NO: 722402 - DNA, 25 bp, Mus musculus
ggtttcttccccagcagccatctat

SEQ ID NO: 722403 - DNA, 25 bp, Mus musculus
ggtttcttcccctgcagccatctat

SEQ ID NO: 722404 - DNA, 25 bp, Mus musculus
ggtttcttgcaaaacgcttctccgg

SEQ ID NO: 722405 - DNA, 25 bp, Mus musculus
ggtttcttgcaatacgcttctccgg

SEQ ID NO: 722406 - DNA, 25 bp, Mus musculus
ggtttgaacgctatggaccagacaa

SEQ ID NO: 722407 - DNA, 25 bp, Mus musculus
ggtttgaacgctttggaccagacaa

SEQ ID NO: 722408 - DNA, 25 bp, Mus musculus
ggtttgaatatgaaggcacacccct

SEQ ID NO: 722409 - DNA, 25 bp, Mus musculus
ggtttgaatatgtaggcacacccct

SEQ ID NO: 722410 - DNA, 25 bp, Mus musculus
ggtttgaatctcagcaccaccaaat

SEQ ID NO: 722411 - DNA, 25 bp, Mus musculus
ggtttgaatctctgcaccaccaaat

SEQ ID NO: 722412 - DNA, 25 bp, Mus musculus
ggtttgacacagacacaactgctat

SEQ ID NO: 722413 - DNA, 25 bp, Mus musculus
ggtttgacacagtcacaactgctat

SEQ ID NO: 722414 - DNA, 25 bp, Mus musculus
ggtttgacctgaattctcagttcca

SEQ ID NO: 722415 - DNA, 25 bp, Mus musculus
ggtttgacctgatttctcagttcca

SEQ ID NO: 722416 - DNA, 25 bp, Mus musculus
ggtttgactaccatggccacatgtg

SEQ ID NO: 722417 - DNA, 25 bp, Mus musculus
ggtttgactaccttggccacatgtg

SEQ ID NO: 722418 - DNA, 25 bp, Mus musculus
ggtttgagctctcgtgcccgcagtc

SEQ ID NO: 722419 - DNA, 25 bp, Mus musculus
ggtttgagctctggtgcccgcagtc

SEQ ID NO: 722420 - DNA, 25 bp, Mus musculus
ggtttgaggtatacaatgccactcg

SEQ ID NO: 722421 - DNA, 25 bp, Mus musculus
ggtttgaggtattcaatgccactcg

SEQ ID NO: 722422 - DNA, 25 bp, Mus musculus
ggtttgatcatgataagagttggtg

SEQ ID NO: 722423 - DNA, 25 bp, Mus musculus
ggtttgatcatgttaagagttggtg

SEQ ID NO: 722424 - DNA, 25 bp, Mus musculus
ggtttgatttccaacatgactatca

SEQ ID NO: 722425 - DNA, 25 bp, Mus musculus
ggtttgatttcctacatgactatca

SEQ ID NO: 722426 - DNA, 25 bp, Mus musculus
ggtttgcacttgaatatgtctttca

SEQ ID NO: 722427 - DNA, 25 bp, Mus musculus
ggtttgcacttgtatatgtctttca

SEQ ID NO: 722428 - DNA, 25 bp, Mus musculus
ggtttgcagaaactaggatctgcac

SEQ ID NO: 722429 - DNA, 25 bp, Mus musculus
ggtttgcagaaagtaggatctgcac

SEQ ID NO: 722430 - DNA, 25 bp, Mus musculus
ggtttgcatagcaaattagcaagca

SEQ ID NO: 722431 - DNA, 25 bp, Mus musculus
ggtttgcatagctaattagcaagca

SEQ ID NO: 722432 - DNA, 25 bp, Mus musculus
ggtttgccagcaagctaaactccca

SEQ ID NO: 722433 - DNA, 25 bp, Mus musculus
ggtttgccagcatgctaaactccca

SEQ ID NO: 722434 - DNA, 25 bp, Mus musculus
ggtttgcctataaccagaaccgtta

SEQ ID NO: 722435 - DNA, 25 bp, Mus musculus
ggtttgcctatatccagaaccgtta

SEQ ID NO: 722436 - DNA, 25 bp, Mus musculus
ggtttgcctggaccgataggtctcc

SEQ ID NO: 722437 - DNA, 25 bp, Mus musculus
ggtttgcctggagcgataggtctcc

SEQ ID NO: 722438 - DNA, 25 bp, Mus musculus
ggtttgctgcccacagtgaccggga

SEQ ID NO: 722439 - DNA, 25 bp, Mus musculus
ggtttgctgccctcagtgaccggga

SEQ ID NO: 722440 - DNA, 25 bp, Mus musculus
ggtttgcttattaaagagtgctgga

SEQ ID NO: 722441 - DNA, 25 bp, Mus musculus
ggtttgcttatttaagagtgctgga

SEQ ID NO: 722442 - DNA, 25 bp, Mus musculus
ggtttggaatataaaaatcaccagc

SEQ ID NO: 722443 - DNA, 25 bp, Mus musculus
ggtttggaatattaaaatcaccagc

SEQ ID NO: 722444 - DNA, 25 bp, Mus musculus
ggtttggaggcacaattcttgaaca

SEQ ID NO: 722445 - DNA, 25 bp, Mus musculus
ggtttggaggcagaattcttgaaca

SEQ ID NO: 722446 - DNA, 25 bp, Mus musculus
ggtttggaggtgatctcttaggcaa

SEQ ID NO: 722447 - DNA, 25 bp, Mus musculus
ggtttggaggtgttctcttaggcaa

SEQ ID NO: 722448 - DNA, 25 bp, Mus musculus
ggtttggatccacctcgagtcaacg

SEQ ID NO: 722449 - DNA, 25 bp, Mus musculus
ggtttggatccagctcgagtcaacg

SEQ ID NO: 722450 - DNA, 25 bp, Mus musculus
ggtttggatctacccgatcaagtcc

SEQ ID NO: 722451 - DNA, 25 bp, Mus musculus
ggtttggatctagccgatcaagtcc

SEQ ID NO: 722452 - DNA, 25 bp, Mus musculus
ggtttggattcacgattcatcccca

SEQ ID NO: 722453 - DNA, 25 bp, Mus musculus
ggtttggattcaggattcatcccca

SEQ ID NO: 722454 - DNA, 25 bp, Mus musculus
ggtttggcaatacccctggacaaaa

SEQ ID NO: 722455 - DNA, 25 bp, Mus musculus
ggtttggcaatagccctggacaaaa

SEQ ID NO: 722456 - DNA, 25 bp, Mus musculus
ggtttggcagaacgaccaaagtgca

SEQ ID NO: 722457 - DNA, 25 bp, Mus musculus
ggtttggcagaaggaccaaagtgca

SEQ ID NO: 722458 - DNA, 25 bp, Mus musculus
ggtttggccgatagcgtcttcccag

SEQ ID NO: 722459 - DNA, 25 bp, Mus musculus
ggtttggccgattgcgtcttcccag

SEQ ID NO: 722460 - DNA, 25 bp, Mus musculus
ggtttggctaccatcgaacacacag

SEQ ID NO: 722461 - DNA, 25 bp, Mus musculus
ggtttggctaccttcgaacacacag

SEQ ID NO: 722462 - DNA, 25 bp, Mus musculus
ggtttggctggccttccgaactcca

SEQ ID NO: 722463 - DNA, 25 bp, Mus musculus
ggtttggctggcgttccgaactcca

SEQ ID NO: 722464 - DNA, 25 bp, Mus musculus
ggtttgggatcaagagaagactcct

SEQ ID NO: 722465 - DNA, 25 bp, Mus musculus
ggtttgggatcatgagaagactcct

SEQ ID NO: 722466 - DNA, 25 bp, Mus musculus
ggtttggtccctagatgtatcaaag

SEQ ID NO: 722467 - DNA, 25 bp, Mus musculus
ggtttggtcccttgatgtatcaaag

SEQ ID NO: 722468 - DNA, 25 bp, Mus musculus
ggtttgtaaggaaggcgataactgt

SEQ ID NO: 722469 - DNA, 25 bp, Mus musculus
ggtttgtaaggatggcgataactgt

SEQ ID NO: 722470 - DNA, 25 bp, Mus musculus
ggtttgtacaccatatgtggagcag

SEQ ID NO: 722471 - DNA, 25 bp, Mus musculus
ggtttgtacaccttatgtggagcag

SEQ ID NO: 722472 - DNA, 25 bp, Mus musculus
ggtttgtcccttactctggtcgtgg

SEQ ID NO: 722473 - DNA, 25 bp, Mus musculus
ggtttgtccctttctctggtcgtgg

SEQ ID NO: 722474 - DNA, 25 bp, Mus musculus
ggtttgtctagcacttgggcccggc

SEQ ID NO: 722475 - DNA, 25 bp, Mus musculus
ggtttgtctagctcttgggcccggc

SEQ ID NO: 722476 - DNA, 25 bp, Mus musculus
ggtttgtctatcacacccctgccag

SEQ ID NO: 722477 - DNA, 25 bp, Mus musculus
ggtttgtctatctcacccctgccag

SEQ ID NO: 722478 - DNA, 25 bp, Mus musculus
ggtttgtgatcacgctcccagggca

SEQ ID NO: 722479 - DNA, 25 bp, Mus musculus
ggtttgtgatcaggctcccagggca

SEQ ID NO: 722480 - DNA, 25 bp, Mus musculus
ggtttgtgatccagcgggttttgct

SEQ ID NO: 722481 - DNA, 25 bp, Mus musculus
ggtttgtgatcctgcgggttttgct

SEQ ID NO: 722482 - DNA, 25 bp, Mus musculus
ggtttgtgccaacacctagcttgtt

SEQ ID NO: 722483 - DNA, 25 bp, Mus musculus
ggtttgtgccaagacctagcttgtt

SEQ ID NO: 722484 - DNA, 25 bp, Mus musculus
ggtttgtggattcgctcaaccagaa

SEQ ID NO: 722485 - DNA, 25 bp, Mus musculus
ggtttgtggattggctcaaccagaa

SEQ ID NO: 722486 - DNA, 25 bp, Mus musculus
ggtttgttaagaaggccttgaccca

SEQ ID NO: 722487 - DNA, 25 bp, Mus musculus
ggtttgttaagatggccttgaccca

SEQ ID NO: 722488 - DNA, 25 bp, Mus musculus
ggtttgttttcaccaagatacagaa

SEQ ID NO: 722489 - DNA, 25 bp, Mus musculus
ggtttgttttcagcaagatacagaa

SEQ ID NO: 722490 - DNA, 25 bp, Mus musculus
ggttttacaccaacggactcacact

SEQ ID NO: 722491 - DNA, 25 bp, Mus musculus
ggttttacaccatcggactcacact

SEQ ID NO: 722492 - DNA, 25 bp, Mus musculus
ggttttacactcaactgatccacag

SEQ ID NO: 722493 - DNA, 25 bp, Mus musculus
ggttttacactctactgatccacag

SEQ ID NO: 722494 - DNA, 25 bp, Mus musculus
ggttttacatcactggattcttcca

SEQ ID NO: 722495 - DNA, 25 bp, Mus musculus
ggttttacatcagtggattcttcca

SEQ ID NO: 722496 - DNA, 25 bp, Mus musculus
ggttttaccaccaacattgtggaca

SEQ ID NO: 722497 - DNA, 25 bp, Mus musculus
ggttttaccacctacattgtggaca

SEQ ID NO: 722498 - DNA, 25 bp, Mus musculus
ggttttacgccaactcctgcaagta

SEQ ID NO: 722499 - DNA, 25 bp, Mus musculus
ggttttacgccatctcctgcaagta

SEQ ID NO: 722500 - DNA, 25 bp, Mus musculus
ggttttactcgactccatgggcata

SEQ ID NO: 722501 - DNA, 25 bp, Mus musculus
ggttttactcgagtccatgggcata

SEQ ID NO: 722502 - DNA, 25 bp, Mus musculus
ggttttaggagaaaactctggcagc

SEQ ID NO: 722503 - DNA, 25 bp, Mus musculus
ggttttaggagataactctggcagc

SEQ ID NO: 722504 - DNA, 25 bp, Mus musculus
ggttttatacgaattagctgttgcc

SEQ ID NO: 722505 - DNA, 25 bp, Mus musculus
ggttttatacgatttagctgttgcc

SEQ ID NO: 722506 - DNA, 25 bp, Mus musculus
ggttttatgaagagacagaatgtag

SEQ ID NO: 722507 - DNA, 25 bp, Mus musculus
ggttttatgaagtgacagaatgtag

SEQ ID NO: 722508 - DNA, 25 bp, Mus musculus
ggttttcaaacaatccccagcttat

SEQ ID NO: 722509 - DNA, 25 bp, Mus musculus
ggttttcaaacattccccagcttat

SEQ ID NO: 722510 - DNA, 25 bp, Mus musculus
ggttttcaaatccatgctgagacag

SEQ ID NO: 722511 - DNA, 25 bp, Mus musculus
ggttttcaaatcgatgctgagacag

SEQ ID NO: 722512 - DNA, 25 bp, Mus musculus
ggttttcaagacatggagtgtgtgc

SEQ ID NO: 722513 - DNA, 25 bp, Mus musculus
ggttttcaagacttggagtgtgtgc

SEQ ID NO: 722514 - DNA, 25 bp, Mus musculus
ggttttcaaggacggccatcccagc

SEQ ID NO: 722515 - DNA, 25 bp, Mus musculus
ggttttcaaggagggccatcccagc

SEQ ID NO: 722516 - DNA, 25 bp, Mus musculus
ggttttcactgacgagatggcacac

SEQ ID NO: 722517 - DNA, 25 bp, Mus musculus
ggttttcactgaggagatggcacac

SEQ ID NO: 722518 - DNA, 25 bp, Mus musculus
ggttttcatcaacccttccaaaatg

SEQ ID NO: 722519 - DNA, 25 bp, Mus musculus
ggttttcatcaagccttccaaaatg

SEQ ID NO: 722520 - DNA, 25 bp, Mus musculus
ggttttcatccactgtgtgatcaat

SEQ ID NO: 722521 - DNA, 25 bp, Mus musculus
ggttttcatccagtgtgtgatcaat

SEQ ID NO: 722522 - DNA, 25 bp, Mus musculus
ggttttccgcatccagctccataca

SEQ ID NO: 722523 - DNA, 25 bp, Mus musculus
ggttttccgcatgcagctccataca

SEQ ID NO: 722524 - DNA, 25 bp, Mus musculus
ggttttcctacacaagaatgagctc

SEQ ID NO: 722525 - DNA, 25 bp, Mus musculus
ggttttcctacagaagaatgagctc

SEQ ID NO: 722526 - DNA, 25 bp, Mus musculus
ggttttcctcagactccacgtacgt

SEQ ID NO: 722527 - DNA, 25 bp, Mus musculus
ggttttcctcagtctccacgtacgt

SEQ ID NO: 722528 - DNA, 25 bp, Mus musculus
ggttttcctggcagccctctttctc

SEQ ID NO: 722529 - DNA, 25 bp, Mus musculus
ggttttcctggctgccctctttctc

SEQ ID NO: 722530 - DNA, 25 bp, Mus musculus
ggttttcgtcacagaagtggttgtt

SEQ ID NO: 722531 - DNA, 25 bp, Mus musculus
ggttttcgtcactgaagtggttgtt

SEQ ID NO: 722532 - DNA, 25 bp, Mus musculus
ggttttctacaacatcatgagggag

SEQ ID NO: 722533 - DNA, 25 bp, Mus musculus
ggttttctacaagatcatgagggag

SEQ ID NO: 722534 - DNA, 25 bp, Mus musculus
ggttttctaccccactgtttgcatc

SEQ ID NO: 722535 - DNA, 25 bp, Mus musculus
ggttttctacccgactgtttgcatc

SEQ ID NO: 722536 - DNA, 25 bp, Mus musculus
ggttttctactcaaggcacagcctg

SEQ ID NO: 722537 - DNA, 25 bp, Mus musculus
ggttttctactcacgggacgccaag

SEQ ID NO: 722538 - DNA, 25 bp, Mus musculus
ggttttctactctaggcacagcctg

SEQ ID NO: 722539 - DNA, 25 bp, Mus musculus
ggttttctactctcgggacgccaag

SEQ ID NO: 722540 - DNA, 25 bp, Mus musculus
ggttttctcaccagaagttgatttg

SEQ ID NO: 722541 - DNA, 25 bp, Mus musculus
ggttttctcacctgaagttgatttg

SEQ ID NO: 722542 - DNA, 25 bp, Mus musculus
ggttttctgaatctccaacagcaag

SEQ ID NO: 722543 - DNA, 25 bp, Mus musculus
ggttttctgaatctgccgtggcgac

SEQ ID NO: 722544 - DNA, 25 bp, Mus musculus
ggttttctgaatgtccaacagcaag

SEQ ID NO: 722545 - DNA, 25 bp, Mus musculus
ggttttctgaatgtgccgtggcgac

SEQ ID NO: 722546 - DNA, 25 bp, Mus musculus
ggttttctgacgagaatcattctta

SEQ ID NO: 722547 - DNA, 25 bp, Mus musculus
ggttttctgacgtgaatcattctta

SEQ ID NO: 722548 - DNA, 25 bp, Mus musculus
ggttttctgaggcaacatcagctga

SEQ ID NO: 722549 - DNA, 25 bp, Mus musculus
ggttttctgagggaacatcagctga

SEQ ID NO: 722550 - DNA, 25 bp, Mus musculus
ggttttctgatgcttgctacttaca

SEQ ID NO: 722551 - DNA, 25 bp, Mus musculus
ggttttctgatggttgctacttaca

SEQ ID NO: 722552 - DNA, 25 bp, Mus musculus
ggttttctgcctcattgcccgattt

SEQ ID NO: 722553 - DNA, 25 bp, Mus musculus
ggttttctgcctgattgcccgattt

SEQ ID NO: 722554 - DNA, 25 bp, Mus musculus
ggttttctggctaaggaattgcaag

SEQ ID NO: 722555 - DNA, 25 bp, Mus musculus
ggttttctggcttaggaattgcaag

SEQ ID NO: 722556 - DNA, 25 bp, Mus musculus
ggttttctgtctactgcaagacagg

SEQ ID NO: 722557 - DNA, 25 bp, Mus musculus
ggttttctgtcttctgcaagacagg

SEQ ID NO: 722558 - DNA, 25 bp, Mus musculus
ggttttcttcgcaggcagtgttctg

SEQ ID NO: 722559 - DNA, 25 bp, Mus musculus
ggttttcttcgctggcagtgttctg

SEQ ID NO: 722560 - DNA, 25 bp, Mus musculus
ggttttgacgctcacacctgggaaa

SEQ ID NO: 722561 - DNA, 25 bp, Mus musculus
ggttttgacgctgacacctgggaaa

SEQ ID NO: 722562 - DNA, 25 bp, Mus musculus
ggttttgactgtattgcaaccaccg

SEQ ID NO: 722563 - DNA, 25 bp, Mus musculus
ggttttgactgttttgcaaccaccg

SEQ ID NO: 722564 - DNA, 25 bp, Mus musculus
ggttttgcactgaaaacaattaaca

SEQ ID NO: 722565 - DNA, 25 bp, Mus musculus
ggttttgcactgtaaacaattaaca

SEQ ID NO: 722566 - DNA, 25 bp, Mus musculus
ggttttgcagacaaccagtacttag

SEQ ID NO: 722567 - DNA, 25 bp, Mus musculus
ggttttgcagactaccagtacttag

SEQ ID NO: 722568 - DNA, 25 bp, Mus musculus
ggttttgccactcactttccttatg

SEQ ID NO: 722569 - DNA, 25 bp, Mus musculus
ggttttgccactgactttccttatg

SEQ ID NO: 722570 - DNA, 25 bp, Mus musculus
ggttttgcccttaatattgatcgag

SEQ ID NO: 722571 - DNA, 25 bp, Mus musculus
ggttttgcccttacatccctatgta

SEQ ID NO: 722572 - DNA, 25 bp, Mus musculus
ggttttgccctttatattgatcgag

SEQ ID NO: 722573 - DNA, 25 bp, Mus musculus
ggttttgccctttcatccctatgta

SEQ ID NO: 722574 - DNA, 25 bp, Mus musculus
ggttttgcttgcacttcgcctggga

SEQ ID NO: 722575 - DNA, 25 bp, Mus musculus
ggttttgcttgctcttcgcctggga

SEQ ID NO: 722576 - DNA, 25 bp, Mus musculus
ggttttgtattacaatgctaaccgg

SEQ ID NO: 722577 - DNA, 25 bp, Mus musculus
ggttttgtattagaatgctaaccgg

SEQ ID NO: 722578 - DNA, 25 bp, Mus musculus
ggttttgtcaccatagccattcatg

SEQ ID NO: 722579 - DNA, 25 bp, Mus musculus
ggttttgtcaccttagccattcatg

SEQ ID NO: 722580 - DNA, 25 bp, Mus musculus
ggttttgtctatcgttgctacgtgg

SEQ ID NO: 722581 - DNA, 25 bp, Mus musculus
ggttttgtctatggttgctacgtgg

SEQ ID NO: 722582 - DNA, 25 bp, Mus musculus
ggttttgtgcatcccaccccatggc

SEQ ID NO: 722583 - DNA, 25 bp, Mus musculus
ggttttgtgcatgccaccccatggc

SEQ ID NO: 722584 - DNA, 25 bp, Mus musculus
ggttttgtgcctatgaaaattgctc

SEQ ID NO: 722585 - DNA, 25 bp, Mus musculus
ggttttgtgcctttgaaaattgctc

SEQ ID NO: 722586 - DNA, 25 bp, Mus musculus
ggtttttagaacaataatatcaaca

SEQ ID NO: 722587 - DNA, 25 bp, Mus musculus
ggtttttagaactataatatcaaca

SEQ ID NO: 722588 - DNA, 25 bp, Mus musculus
ggtttttatcctcttttatccagca

SEQ ID NO: 722589 - DNA, 25 bp, Mus musculus
ggtttttatcctgttttatccagca

SEQ ID NO: 722590 - DNA, 25 bp, Mus musculus
ggtttttcatggctgcagctttcag

SEQ ID NO: 722591 - DNA, 25 bp, Mus musculus
ggtttttcatgggtgcagctttcag

SEQ ID NO: 722592 - DNA, 25 bp, Mus musculus
ggtttttgctcacagaatggataac

SEQ ID NO: 722593 - DNA, 25 bp, Mus musculus
ggtttttgctcagagaatggataac

SEQ ID NO: 722594 - DNA, 25 bp, Mus musculus
ggtttttggcccagccaatctagga

SEQ ID NO: 722595 - DNA, 25 bp, Mus musculus
ggtttttggccctgccaatctagga

SEQ ID NO: 722596 - DNA, 25 bp, Mus musculus
ggttttttatcacagccagctaagc

SEQ ID NO: 722597 - DNA, 25 bp, Mus musculus
ggttttttatcagagccagctaagc

SEQ ID NO: 722598 - DNA, 25 bp, Mus musculus
ggttttttgatcacaggcagtccag

SEQ ID NO: 722599 - DNA, 25 bp, Mus musculus
ggttttttgatctcaggcagtccag

SEQ ID NO: 722600 - DNA, 25 bp, Mus musculus
gtaaaaagcccgcagcagagagcca

SEQ ID NO: 722601 - DNA, 25 bp, Mus musculus
gtaaaaagcccggagcagagagcca

SEQ ID NO: 722602 - DNA, 25 bp, Mus musculus
gtaaaacatccacccttagaaaagg

SEQ ID NO: 722603 - DNA, 25 bp, Mus musculus
gtaaaacatccagccttagaaaagg

SEQ ID NO: 722604 - DNA, 25 bp, Mus musculus
gtaaaacattcactctttggagaag

SEQ ID NO: 722605 - DNA, 25 bp, Mus musculus
gtaaaacattcagtctttggagaag

SEQ ID NO: 722606 - DNA, 25 bp, Mus musculus
gtaaaagagtctcagggtcctgacc

SEQ ID NO: 722607 - DNA, 25 bp, Mus musculus
gtaaaagagtctgagggtcctgacc

SEQ ID NO: 722608 - DNA, 25 bp, Mus musculus
gtaaaaggatgcaatgctcatgttc

SEQ ID NO: 722609 - DNA, 25 bp, Mus musculus
gtaaaaggatgctatgctcatgttc

SEQ ID NO: 722610 - DNA, 25 bp, Mus musculus
gtaaaagtttgtcctaccagctccc

SEQ ID NO: 722611 - DNA, 25 bp, Mus musculus
gtaaaagtttgtgctaccagctccc

SEQ ID NO: 722612 - DNA, 25 bp, Mus musculus
gtaaacaaatgaacctcctccgcat

SEQ ID NO: 722613 - DNA, 25 bp, Mus musculus
gtaaacaaatgatcctcctccgcat

SEQ ID NO: 722614 - DNA, 25 bp, Mus musculus
gtaaacagctgaaactgtcaaactg

SEQ ID NO: 722615 - DNA, 25 bp, Mus musculus
gtaaacagctgatactgtcaaactg

SEQ ID NO: 722616 - DNA, 25 bp, Mus musculus
gtaaacaggccacattccagaatgg

SEQ ID NO: 722617 - DNA, 25 bp, Mus musculus
gtaaacaggccagattccagaatgg

SEQ ID NO: 722618 - DNA, 25 bp, Mus musculus
gtaaaccccagcaacctggtgcctg

SEQ ID NO: 722619 - DNA, 25 bp, Mus musculus
gtaaaccccagctacctggtgcctg

SEQ ID NO: 722620 - DNA, 25 bp, Mus musculus
gtaaacccgaaacggctagatgaag

SEQ ID NO: 722621 - DNA, 25 bp, Mus musculus
gtaaacccgaaagggctagatgaag

SEQ ID NO: 722622 - DNA, 25 bp, Mus musculus
gtaaaccttcatatttcgctgagag

SEQ ID NO: 722623 - DNA, 25 bp, Mus musculus
gtaaaccttcatttttcgctgagag

SEQ ID NO: 722624 - DNA, 25 bp, Mus musculus
gtaaacgtggccctgaattccgctg

SEQ ID NO: 722625 - DNA, 25 bp, Mus musculus
gtaaacgtggccgtgaattccgctg

SEQ ID NO: 722626 - DNA, 25 bp, Mus musculus
gtaaactcagtaaaagaggttcttg

SEQ ID NO: 722627 - DNA, 25 bp, Mus musculus
gtaaactcagtataagaggttcttg

SEQ ID NO: 722628 - DNA, 25 bp, Mus musculus
gtaaactttaaaccatctcttctct

SEQ ID NO: 722629 - DNA, 25 bp, Mus musculus
gtaaactttaaagcatctcttctct

SEQ ID NO: 722630 - DNA, 25 bp, Mus musculus
gtaaagaaattgactaaagccagac

SEQ ID NO: 722631 - DNA, 25 bp, Mus musculus
gtaaagaaattgtctaaagccagac

SEQ ID NO: 722632 - DNA, 25 bp, Mus musculus
gtaaagaagactctgaacatctgat

SEQ ID NO: 722633 - DNA, 25 bp, Mus musculus
gtaaagaagactgtgaacatctgat

SEQ ID NO: 722634 - DNA, 25 bp, Mus musculus
gtaaagaagccgacctcctctccag

SEQ ID NO: 722635 - DNA, 25 bp, Mus musculus
gtaaagaagccgtcctcctctccag

SEQ ID NO: 722636 - DNA, 25 bp, Mus musculus
gtaaagacacccaggccaactgtac

SEQ ID NO: 722637 - DNA, 25 bp, Mus musculus
gtaaagacaccctggccaactgtac

SEQ ID NO: 722638 - DNA, 25 bp, Mus musculus
gtaaagacagctctggcaccaagcc

SEQ ID NO: 722639 - DNA, 25 bp, Mus musculus
gtaaagacagctgtggcaccaagcc

SEQ ID NO: 722640 - DNA, 25 bp, Mus musculus
gtaaagacgattcgcctccgggaag

SEQ ID NO: 722641 - DNA, 25 bp, Mus musculus
gtaaagacgattggcctccgggaag

SEQ ID NO: 722642 - DNA, 25 bp, Mus musculus
gtaaagatgttcaatggcaacagcg

SEQ ID NO: 722643 - DNA, 25 bp, Mus musculus
gtaaagatgttctatggcaacagcg

SEQ ID NO: 722644 - DNA, 25 bp, Mus musculus
gtaaagattttgcacagcagtgatg

SEQ ID NO: 722645 - DNA, 25 bp, Mus musculus
gtaaagattttggacagcagtgatg

SEQ ID NO: 722646 - DNA, 25 bp, Mus musculus
gtaaagcaatctagaaagcacgtgg

SEQ ID NO: 722647 - DNA, 25 bp, Mus musculus
gtaaagcaatcttgaaagcacgtgg

SEQ ID NO: 722648 - DNA, 25 bp, Mus musculus
gtaaagcatccgacattgcttcagg

SEQ ID NO: 722649 - DNA, 25 bp, Mus musculus
gtaaagcatccgtcattgcttcagg

SEQ ID NO: 722650 - DNA, 25 bp, Mus musculus
gtaaagccagcaccgtcatgtgcag

SEQ ID NO: 722651 - DNA, 25 bp, Mus musculus
gtaaagccagcagcgtcatgtgcag

SEQ ID NO: 722652 - DNA, 25 bp, Mus musculus
gtaaagcgacttcgagcacaccctg

SEQ ID NO: 722653 - DNA, 25 bp, Mus musculus
gtaaagcgacttggagcacaccctg

SEQ ID NO: 722654 - DNA, 25 bp, Mus musculus
gtaaagcggcatccctgcttcctca

SEQ ID NO: 722655 - DNA, 25 bp, Mus musculus
gtaaagcggcatgcctgcttcctca

SEQ ID NO: 722656 - DNA, 25 bp, Mus musculus
gtaaagctctacaagaatgctcggg

SEQ ID NO: 722657 - DNA, 25 bp, Mus musculus
gtaaagctctactagaatgctcggg

SEQ ID NO: 722658 - DNA, 25 bp, Mus musculus
gtaaagctggcgaggagatgcacac

SEQ ID NO: 722659 - DNA, 25 bp, Mus musculus
gtaaagctggcgtggagatgcacac

SEQ ID NO: 722660 - DNA, 25 bp, Mus musculus
gtaaagcttcacctcaatggtgttc

SEQ ID NO: 722661 - DNA, 25 bp, Mus musculus
gtaaagcttcacgtcaatggtgttc

SEQ ID NO: 722662 - DNA, 25 bp, Mus musculus
gtaaaggaagctcgacctcccaggg

SEQ ID NO: 722663 - DNA, 25 bp, Mus musculus
gtaaaggaagctggacctcccaggg

SEQ ID NO: 722664 - DNA, 25 bp, Mus musculus
gtaaaggactccacacgccatgtca

SEQ ID NO: 722665 - DNA, 25 bp, Mus musculus
gtaaaggactcctcacgccatgtca

SEQ ID NO: 722666 - DNA, 25 bp, Mus musculus
gtaaaggatgtacggaagcgattcc

SEQ ID NO: 722667 - DNA, 25 bp, Mus musculus
gtaaaggatgtagggaagcgattcc

SEQ ID NO: 722668 - DNA, 25 bp, Mus musculus
gtaaaggtatcaaacaaaagcagat

SEQ ID NO: 722669 - DNA, 25 bp, Mus musculus
gtaaaggtatcatacaaaagcagat

SEQ ID NO: 722670 - DNA, 25 bp, Mus musculus
gtaaagtggatcatctcctcggtgg

SEQ ID NO: 722671 - DNA, 25 bp, Mus musculus
gtaaagtggatcttctcctcggtgg

SEQ ID NO: 722672 - DNA, 25 bp, Mus musculus
gtaaatctagatctgtattccccag

SEQ ID NO: 722673 - DNA, 25 bp, Mus musculus
gtaaatctagatgtgtattccccag

SEQ ID NO: 722674 - DNA, 25 bp, Mus musculus
gtaaatgaagagagcaaactggaat

SEQ ID NO: 722675 - DNA, 25 bp, Mus musculus
gtaaatgaagagtgcaaactggaat

SEQ ID NO: 722676 - DNA, 25 bp, Mus musculus
gtaaatgcccctattatgctgctca

SEQ ID NO: 722677 - DNA, 25 bp, Mus musculus
gtaaatgccccttttatgctgctca

SEQ ID NO: 722678 - DNA, 25 bp, Mus musculus
gtaaatgcttctcccggtccaaggg

SEQ ID NO: 722679 - DNA, 25 bp, Mus musculus
gtaaatgcttctgccggtccaaggg

SEQ ID NO: 722680 - DNA, 25 bp, Mus musculus
gtaaatggagagactatcacttttg

SEQ ID NO: 722681 - DNA, 25 bp, Mus musculus
gtaaatggagagtctatcacttttg

SEQ ID NO: 722682 - DNA, 25 bp, Mus musculus
gtaaatggtgtcactgcagcactgg

SEQ ID NO: 722683 - DNA, 25 bp, Mus musculus
gtaaatggtgtctctgcagcactgg

SEQ ID NO: 722684 - DNA, 25 bp, Mus musculus
gtaaatgtctggattgaaagtcggc

SEQ ID NO: 722685 - DNA, 25 bp, Mus musculus
gtaaatgtctggtttgaaagtcggc

SEQ ID NO: 722686 - DNA, 25 bp, Mus musculus
gtaaattcacctcccactcggagtg

SEQ ID NO: 722687 - DNA, 25 bp, Mus musculus
gtaaattcacctgccactcggagtg

SEQ ID NO: 722688 - DNA, 25 bp, Mus musculus
gtaaattcccttccctcaagtgcct

SEQ ID NO: 722689 - DNA, 25 bp, Mus musculus
gtaaattcccttgcctcaagtgcct

SEQ ID NO: 722690 - DNA, 25 bp, Mus musculus
gtaacaaacagtacatgtctcatga

SEQ ID NO: 722691 - DNA, 25 bp, Mus musculus
gtaacaaacagttcatgtctcatga

SEQ ID NO: 722692 - DNA, 25 bp, Mus musculus
gtaacaatcaggatggctctgtgga

SEQ ID NO: 722693 - DNA, 25 bp, Mus musculus
gtaacaatcaggttggctctgtgga

SEQ ID NO: 722694 - DNA, 25 bp, Mus musculus
gtaacaccattcacagtgaagtccc

SEQ ID NO: 722695 - DNA, 25 bp, Mus musculus
gtaacaccattctcagtgaagtccc

SEQ ID NO: 722696 - DNA, 25 bp, Mus musculus
gtaacactggatcggctcctctcat

SEQ ID NO: 722697 - DNA, 25 bp, Mus musculus
gtaacactggatgggctcctctcat

SEQ ID NO: 722698 - DNA, 25 bp, Mus musculus
gtaacagactacacatcctccagtg

SEQ ID NO: 722699 - DNA, 25 bp, Mus musculus
gtaacagactactcatcctccagtg

SEQ ID NO: 722700 - DNA, 25 bp, Mus musculus
gtaacagcatctccaagtctccggg

SEQ ID NO: 722701 - DNA, 25 bp, Mus musculus
gtaacagcatctgcaagtctccggg

SEQ ID NO: 722702 - DNA, 25 bp, Mus musculus
gtaacagccgacagtctctccagct

SEQ ID NO: 722703 - DNA, 25 bp, Mus musculus
gtaacagccgactgtctctccagct

SEQ ID NO: 722704 - DNA, 25 bp, Mus musculus
gtaacagcgggaacccagctgggtc

SEQ ID NO: 722705 - DNA, 25 bp, Mus musculus
gtaacagcgggatcccagctgggtc

SEQ ID NO: 722706 - DNA, 25 bp, Mus musculus
gtaacatcatgaatgcttcagctga

SEQ ID NO: 722707 - DNA, 25 bp, Mus musculus
gtaacatcatgattgcttcagctga

SEQ ID NO: 722708 - DNA, 25 bp, Mus musculus
gtaacatcgtgtccaaatacttggg

SEQ ID NO: 722709 - DNA, 25 bp, Mus musculus
gtaacatcgtgtgcaaatacttggg

SEQ ID NO: 722710 - DNA, 25 bp, Mus musculus
gtaacatggcctatttgtaccttga

SEQ ID NO: 722711 - DNA, 25 bp, Mus musculus
gtaacatggcctttttgtaccttga

SEQ ID NO: 722712 - DNA, 25 bp, Mus musculus
gtaaccagacagatcaccacaggat

SEQ ID NO: 722713 - DNA, 25 bp, Mus musculus
gtaaccagacagttcaccacaggat

SEQ ID NO: 722714 - DNA, 25 bp, Mus musculus
gtaaccagcagcatcgagccctgca

SEQ ID NO: 722715 - DNA, 25 bp, Mus musculus
gtaaccagcagcttcgagccctgca

SEQ ID NO: 722716 - DNA, 25 bp, Mus musculus
gtaaccagtcagatgagggctcaga

SEQ ID NO: 722717 - DNA, 25 bp, Mus musculus
gtaaccagtcagttgagggctcaga

SEQ ID NO: 722718 - DNA, 25 bp, Mus musculus
gtaaccatagagatgaatgagcctg

SEQ ID NO: 722719 - DNA, 25 bp, Mus musculus
gtaaccatagagttgaatgagcctg

SEQ ID NO: 722720 - DNA, 25 bp, Mus musculus
gtaaccattcaaaaccgcctgggta

SEQ ID NO: 722721 - DNA, 25 bp, Mus musculus
gtaaccattcaataccgcctgggta

SEQ ID NO: 722722 - DNA, 25 bp, Mus musculus
gtaacccctctaaatttctcagtgt

SEQ ID NO: 722723 - DNA, 25 bp, Mus musculus
gtaacccctctatatttctcagtgt

SEQ ID NO: 722724 - DNA, 25 bp, Mus musculus
gtaacccctgatccctgtcgagaag

SEQ ID NO: 722725 - DNA, 25 bp, Mus musculus
gtaacccctgatgcctgtcgagaag

SEQ ID NO: 722726 - DNA, 25 bp, Mus musculus
gtaacccctgcaaccacggagcttg

SEQ ID NO: 722727 - DNA, 25 bp, Mus musculus
gtaacccctgcatccacggagcttg

SEQ ID NO: 722728 - DNA, 25 bp, Mus musculus
gtaaccctggagacttcactctgtc

SEQ ID NO: 722729 - DNA, 25 bp, Mus musculus
gtaaccctggagtcttcactctgtc

SEQ ID NO: 722730 - DNA, 25 bp, Mus musculus
gtaaccgagctcactgttttcttcg

SEQ ID NO: 722731 - DNA, 25 bp, Mus musculus
gtaaccgagctctctgttttcttcg

SEQ ID NO: 722732 - DNA, 25 bp, Mus musculus
gtaaccgagtggacgacctcctccg

SEQ ID NO: 722733 - DNA, 25 bp, Mus musculus
gtaaccgagtggtcgacctcctccg

SEQ ID NO: 722734 - DNA, 25 bp, Mus musculus
gtaacctcccacaagtctgaagcag

SEQ ID NO: 722735 - DNA, 25 bp, Mus musculus
gtaacctcccactagtctgaagcag

SEQ ID NO: 722736 - DNA, 25 bp, Mus musculus
gtaacctcctacaatgacatccagg

SEQ ID NO: 722737 - DNA, 25 bp, Mus musculus
gtaacctcctactatgacatccagg

SEQ ID NO: 722738 - DNA, 25 bp, Mus musculus
gtaacctctccacagatgtgacaga

SEQ ID NO: 722739 - DNA, 25 bp, Mus musculus
gtaacctctccagagatgtgacaga

SEQ ID NO: 722740 - DNA, 25 bp, Mus musculus
gtaacctgctggatgatttgaagaa

SEQ ID NO: 722741 - DNA, 25 bp, Mus musculus
gtaacctgctggttgatttgaagaa

SEQ ID NO: 722742 - DNA, 25 bp, Mus musculus
gtaacctgttttcttgtctctctca

SEQ ID NO: 722743 - DNA, 25 bp, Mus musculus
gtaacctgttttgttgtctctctca

SEQ ID NO: 722744 - DNA, 25 bp, Mus musculus
gtaacctttaagctaaatgaaggca

SEQ ID NO: 722745 - DNA, 25 bp, Mus musculus
gtaacctttaaggtaaatgaaggca

SEQ ID NO: 722746 - DNA, 25 bp, Mus musculus
gtaacgatgctgcaattcggagagc

SEQ ID NO: 722747 - DNA, 25 bp, Mus musculus
gtaacgatgctggaattcggagagc

SEQ ID NO: 722748 - DNA, 25 bp, Mus musculus
gtaacgccagtacaacttcctaact

SEQ ID NO: 722749 - DNA, 25 bp, Mus musculus
gtaacgccagtagaacttcctaact

SEQ ID NO: 722750 - DNA, 25 bp, Mus musculus
gtaacgccatgaaacaccttcctaa

SEQ ID NO: 722751 - DNA, 25 bp, Mus musculus
gtaacgccatgatacaccttcctaa

SEQ ID NO: 722752 - DNA, 25 bp, Mus musculus
gtaacgcctgcgaatcgaccctggg

SEQ ID NO: 722753 - DNA, 25 bp, Mus musculus
gtaacgcctgcgtatcgaccctggg

SEQ ID NO: 722754 - DNA, 25 bp, Mus musculus
gtaacggagccacacctgagaaata

SEQ ID NO: 722755 - DNA, 25 bp, Mus musculus
gtaacggagccagacctgagaaata

SEQ ID NO: 722756 - DNA, 25 bp, Mus musculus
gtaacggagcgccaaaaagtgcact

SEQ ID NO: 722757 - DNA, 25 bp, Mus musculus
gtaacggagcgcgaaaaagtgcact

SEQ ID NO: 722758 - DNA, 25 bp, Mus musculus
gtaacgggcaacactcgcgagaacg

SEQ ID NO: 722759 - DNA, 25 bp, Mus musculus
gtaacgggcaactctcgcgagaacg

SEQ ID NO: 722760 - DNA, 25 bp, Mus musculus
gtaacgggtgctacagaggttttga

SEQ ID NO: 722761 - DNA, 25 bp, Mus musculus
gtaacgggtgcttcagaggttttga

SEQ ID NO: 722762 - DNA, 25 bp, Mus musculus
gtaacgtacttcactattaaatgga

SEQ ID NO: 722763 - DNA, 25 bp, Mus musculus
gtaacgtacttctctattaaatgga

SEQ ID NO: 722764 - DNA, 25 bp, Mus musculus
gtaactaaatggcacaaccctggaa

SEQ ID NO: 722765 - DNA, 25 bp, Mus musculus
gtaactaaatgggacaaccctggaa

SEQ ID NO: 722766 - DNA, 25 bp, Mus musculus
gtaactagttctcccaactgtacag

SEQ ID NO: 722767 - DNA, 25 bp, Mus musculus
gtaactagttctgccaactgtacag

SEQ ID NO: 722768 - DNA, 25 bp, Mus musculus
gtaactcaaagcaggaccccacaca

SEQ ID NO: 722769 - DNA, 25 bp, Mus musculus
gtaactcaaagctggaccccacaca

SEQ ID NO: 722770 - DNA, 25 bp, Mus musculus
gtaactcacctcagtcctatgtcac

SEQ ID NO: 722771 - DNA, 25 bp, Mus musculus
gtaactcacctctgtcctatgtcac

SEQ ID NO: 722772 - DNA, 25 bp, Mus musculus
gtaactccaaataccacaggacctg

SEQ ID NO: 722773 - DNA, 25 bp, Mus musculus
gtaactccaaattccacaggacctg

SEQ ID NO: 722774 - DNA, 25 bp, Mus musculus
gtaactcttttgctcctgaggctgg

SEQ ID NO: 722775 - DNA, 25 bp, Mus musculus
gtaactcttttggtcctgaggctgg

SEQ ID NO: 722776 - DNA, 25 bp, Mus musculus
gtaactgaaaatagcaacttgctag

SEQ ID NO: 722777 - DNA, 25 bp, Mus musculus
gtaactgaaaattgcaacttgctag

SEQ ID NO: 722778 - DNA, 25 bp, Mus musculus
gtaactgagatccttggattcgaag

SEQ ID NO: 722779 - DNA, 25 bp, Mus musculus
gtaactgagatcgttggattcgaag

SEQ ID NO: 722780 - DNA, 25 bp, Mus musculus
gtaactgcccttcgcagaagctcca

SEQ ID NO: 722781 - DNA, 25 bp, Mus musculus
gtaactgcccttggcagaagctcca

SEQ ID NO: 722782 - DNA, 25 bp, Mus musculus
gtaactgccgcaaggtccacatgcc

SEQ ID NO: 722783 - DNA, 25 bp, Mus musculus
gtaactgccgcatggtccacatgcc

SEQ ID NO: 722784 - DNA, 25 bp, Mus musculus
gtaactgcgggcctggccatctacg

SEQ ID NO: 722785 - DNA, 25 bp, Mus musculus
gtaactgcgggcgtggccatctacg

SEQ ID NO: 722786 - DNA, 25 bp, Mus musculus
gtaactgtgaggagcctcggcccag

SEQ ID NO: 722787 - DNA, 25 bp, Mus musculus
gtaactgtgaggtgcctcggcccag

SEQ ID NO: 722788 - DNA, 25 bp, Mus musculus
gtaacttctacaacaagatccggcc

SEQ ID NO: 722789 - DNA, 25 bp, Mus musculus
gtaacttctacatcaagatccggcc

SEQ ID NO: 722790 - DNA, 25 bp, Mus musculus
gtaacttgcacacctgggatggccc

SEQ ID NO: 722791 - DNA, 25 bp, Mus musculus
gtaacttgcacagctgggatggccc

SEQ ID NO: 722792 - DNA, 25 bp, Mus musculus
gtaactttgcctatcctgcctatca

SEQ ID NO: 722793 - DNA, 25 bp, Mus musculus
gtaactttgcctttcctgcctatca

SEQ ID NO: 722794 - DNA, 25 bp, Mus musculus
gtaactttgcggcagagccacagtc

SEQ ID NO: 722795 - DNA, 25 bp, Mus musculus
gtaactttgcgggagagccacagtc

SEQ ID NO: 722796 - DNA, 25 bp, Mus musculus
gtaagaaagttccttcacagactgt

SEQ ID NO: 722797 - DNA, 25 bp, Mus musculus
gtaagaaagttcgttcacagactgt

SEQ ID NO: 722798 - DNA, 25 bp, Mus musculus
gtaagaacaagactctacgctatgg

SEQ ID NO: 722799 - DNA, 25 bp, Mus musculus
gtaagaacaagagtctacgctatgg

SEQ ID NO: 722800 - DNA, 25 bp, Mus musculus
gtaagaagagctcctccgtccactc

SEQ ID NO: 722801 - DNA, 25 bp, Mus musculus
gtaagaagagctgctccgtccactc

SEQ ID NO: 722802 - DNA, 25 bp, Mus musculus
gtaagaagggttacatcttccagat

SEQ ID NO: 722803 - DNA, 25 bp, Mus musculus
gtaagaagggtttcatcttccagat

SEQ ID NO: 722804 - DNA, 25 bp, Mus musculus
gtaagaccacacagacgcagtcagt

SEQ ID NO: 722805 - DNA, 25 bp, Mus musculus
gtaagaccacactgacgcagtcagt

SEQ ID NO: 722806 - DNA, 25 bp, Mus musculus
gtaagactcaagacctggagagggt

SEQ ID NO: 722807 - DNA, 25 bp, Mus musculus
gtaagactcaagtcctggagagggt

SEQ ID NO: 722808 - DNA, 25 bp, Mus musculus
gtaagactccaacaaagctcaatgg

SEQ ID NO: 722809 - DNA, 25 bp, Mus musculus
gtaagactccaagaaagctcaatgg

SEQ ID NO: 722810 - DNA, 25 bp, Mus musculus
gtaagactcgctctcttgggagaag

SEQ ID NO: 722811 - DNA, 25 bp, Mus musculus
gtaagactcgctgtcttgggagaag

SEQ ID NO: 722812 - DNA, 25 bp, Mus musculus
gtaagactttctcccgggctcagat

SEQ ID NO: 722813 - DNA, 25 bp, Mus musculus
gtaagactttctgccgggctcagat

SEQ ID NO: 722814 - DNA, 25 bp, Mus musculus
gtaagagtagaaaaggatccagaac

SEQ ID NO: 722815 - DNA, 25 bp, Mus musculus
gtaagagtagaataggatccagaac

SEQ ID NO: 722816 - DNA, 25 bp, Mus musculus
gtaagagtgtttacagagggacagt

SEQ ID NO: 722817 - DNA, 25 bp, Mus musculus
gtaagagtgttttcagagggacagt

SEQ ID NO: 722818 - DNA, 25 bp, Mus musculus
gtaagatgccccacgtgcagtacat

SEQ ID NO: 722819 - DNA, 25 bp, Mus musculus
gtaagatgcccctcgtgcagtacat

SEQ ID NO: 722820 - DNA, 25 bp, Mus musculus
gtaagatttccgctgacggccgcag

SEQ ID NO: 722821 - DNA, 25 bp, Mus musculus
gtaagatttccggtgacggccgcag

SEQ ID NO: 722822 - DNA, 25 bp, Mus musculus
gtaagcaccggtctctggctcccgg

SEQ ID NO: 722823 - DNA, 25 bp, Mus musculus
gtaagcaccggtgtctggctcccgg

SEQ ID NO: 722824 - DNA, 25 bp, Mus musculus
gtaagcagcaatattcacaccatgt

SEQ ID NO: 722825 - DNA, 25 bp, Mus musculus
gtaagcagcaattttcacaccatgt

SEQ ID NO: 722826 - DNA, 25 bp, Mus musculus
gtaagcagccttatcgacgctttca

SEQ ID NO: 722827 - DNA, 25 bp, Mus musculus
gtaagcagccttttcgacgctttca

SEQ ID NO: 722828 - DNA, 25 bp, Mus musculus
gtaagcagctccactaagtactatg

SEQ ID NO: 722829 - DNA, 25 bp, Mus musculus
gtaagcagctcctctaagtactatg

SEQ ID NO: 722830 - DNA, 25 bp, Mus musculus
gtaagcaggcttccctcaagaggag

SEQ ID NO: 722831 - DNA, 25 bp, Mus musculus
gtaagcaggcttgcctcaagaggag

SEQ ID NO: 722832 - DNA, 25 bp, Mus musculus
gtaagcatttcaccacaaccaccaa

SEQ ID NO: 722833 - DNA, 25 bp, Mus musculus
gtaagcatttcagcacaaccaccaa

SEQ ID NO: 722834 - DNA, 25 bp, Mus musculus
gtaagccactctccatcctgcaaga

SEQ ID NO: 722835 - DNA, 25 bp, Mus musculus
gtaagccactctgcatcctgcaaga

SEQ ID NO: 722836 - DNA, 25 bp, Mus musculus
gtaagccagaggaccgcttgcaggt

SEQ ID NO: 722837 - DNA, 25 bp, Mus musculus
gtaagccagaggtccgcttgcaggt

SEQ ID NO: 722838 - DNA, 25 bp, Mus musculus
gtaagccaggccatagacatcaatg

SEQ ID NO: 722839 - DNA, 25 bp, Mus musculus
gtaagccaggccttagacatcaatg

SEQ ID NO: 722840 - DNA, 25 bp, Mus musculus
gtaagcccctccacatggagtggtg

SEQ ID NO: 722841 - DNA, 25 bp, Mus musculus
gtaagcccctcctcatggagtggtg

SEQ ID NO: 722842 - DNA, 25 bp, Mus musculus
gtaagcccggagacggaagtctagt

SEQ ID NO: 722843 - DNA, 25 bp, Mus musculus
gtaagcccggagtcggaagtctagt

SEQ ID NO: 722844 - DNA, 25 bp, Mus musculus
gtaagcctttctattcccaacggtg

SEQ ID NO: 722845 - DNA, 25 bp, Mus musculus
gtaagcctttcttttcccaacggtg

SEQ ID NO: 722846 - DNA, 25 bp, Mus musculus
gtaagcggcttcagtggcacgagtc

SEQ ID NO: 722847 - DNA, 25 bp, Mus musculus
gtaagcggcttctgtggcacgagtc

SEQ ID NO: 722848 - DNA, 25 bp, Mus musculus
gtaaggaattccagcccggagcctg

SEQ ID NO: 722849 - DNA, 25 bp, Mus musculus
gtaaggaattcctgcccggagcctg

SEQ ID NO: 722850 - DNA, 25 bp, Mus musculus
gtaaggagactcagaacaccgtgtg

SEQ ID NO: 722851 - DNA, 25 bp, Mus musculus
gtaaggagactctgaacaccgtgtg

SEQ ID NO: 722852 - DNA, 25 bp, Mus musculus
gtaaggagctttcccattccgtttg

SEQ ID NO: 722853 - DNA, 25 bp, Mus musculus
gtaaggagctttgccattccgtttg

SEQ ID NO: 722854 - DNA, 25 bp, Mus musculus
gtaaggataactcattcagaatgct

SEQ ID NO: 722855 - DNA, 25 bp, Mus musculus
gtaaggataactgattcagaatgct

SEQ ID NO: 722856 - DNA, 25 bp, Mus musculus
gtaaggatccacaaggccttttggg

SEQ ID NO: 722857 - DNA, 25 bp, Mus musculus
gtaaggatccactaggccttttggg

SEQ ID NO: 722858 - DNA, 25 bp, Mus musculus
gtaaggcaggctagtggatcaacaa

SEQ ID NO: 722859 - DNA, 25 bp, Mus musculus
gtaaggcaggcttgtggatcaacaa

SEQ ID NO: 722860 - DNA, 25 bp, Mus musculus
gtaaggcattttactggtgtactgt

SEQ ID NO: 722861 - DNA, 25 bp, Mus musculus
gtaaggcatttttctggtgtactgt

SEQ ID NO: 722862 - DNA, 25 bp, Mus musculus
gtaaggtttctcctcaaaccctctg

SEQ ID NO: 722863 - DNA, 25 bp, Mus musculus
gtaaggtttctcgtcaaaccctctg

SEQ ID NO: 722864 - DNA, 25 bp, Mus musculus
gtaagtaagtatcgctgaggtcgct

SEQ ID NO: 722865 - DNA, 25 bp, Mus musculus
gtaagtaagtatggctgaggtcgct

SEQ ID NO: 722866 - DNA, 25 bp, Mus musculus
gtaagtatcgctcaggtcgctgatg

SEQ ID NO: 722867 - DNA, 25 bp, Mus musculus
gtaagtatcgctgaggtcgctgatg

SEQ ID NO: 722868 - DNA, 25 bp, Mus musculus
gtaagtcgggctccctttcagccag

SEQ ID NO: 722869 - DNA, 25 bp, Mus musculus
gtaagtcgggctgcctttcagccag

SEQ ID NO: 722870 - DNA, 25 bp, Mus musculus
gtaagtggaacaatgaggacaaagg

SEQ ID NO: 722871 - DNA, 25 bp, Mus musculus
gtaagtggaacattgaggacaaagg

SEQ ID NO: 722872 - DNA, 25 bp, Mus musculus
gtaagttctgatcacttctctctgc

SEQ ID NO: 722873 - DNA, 25 bp, Mus musculus
gtaagttctgatgacttctctctgc

SEQ ID NO: 722874 - DNA, 25 bp, Mus musculus
gtaataaagcaaatgagtccctggc

SEQ ID NO: 722875 - DNA, 25 bp, Mus musculus
gtaataaagcaattgagtccctggc

SEQ ID NO: 722876 - DNA, 25 bp, Mus musculus
gtaataaatggaatgcttggaggct

SEQ ID NO: 722877 - DNA, 25 bp, Mus musculus
gtaataaatggattgcttggaggct

SEQ ID NO: 722878 - DNA, 25 bp, Mus musculus
gtaataatgcgtagtctgtatgaca

SEQ ID NO: 722879 - DNA, 25 bp, Mus musculus
gtaataatgcgttgtctgtatgaca

SEQ ID NO: 722880 - DNA, 25 bp, Mus musculus
gtaatagtgcggaccagccaggcct

SEQ ID NO: 722881 - DNA, 25 bp, Mus musculus
gtaatagtgcggtccagccaggcct

SEQ ID NO: 722882 - DNA, 25 bp, Mus musculus
gtaatcaacaccaggtccagactgc

SEQ ID NO: 722883 - DNA, 25 bp, Mus musculus
gtaatcaacacctggtccagactgc

SEQ ID NO: 722884 - DNA, 25 bp, Mus musculus
gtaatcattgcaccggagcttctga

SEQ ID NO: 722885 - DNA, 25 bp, Mus musculus
gtaatcattgcagcggagcttctga

SEQ ID NO: 722886 - DNA, 25 bp, Mus musculus
gtaatcctaaccactgccccaaaag

SEQ ID NO: 722887 - DNA, 25 bp, Mus musculus
gtaatcctaacctctgccccaaaag

SEQ ID NO: 722888 - DNA, 25 bp, Mus musculus
gtaatcctgatcatagattaagagg

SEQ ID NO: 722889 - DNA, 25 bp, Mus musculus
gtaatcctgatcttagattaagagg

SEQ ID NO: 722890 - DNA, 25 bp, Mus musculus
gtaatctccgagcatgtctgcagcc

SEQ ID NO: 722891 - DNA, 25 bp, Mus musculus
gtaatctccgaggatgtctgcagcc

SEQ ID NO: 722892 - DNA, 25 bp, Mus musculus
gtaatctggcctcggcaccttggca

SEQ ID NO: 722893 - DNA, 25 bp, Mus musculus
gtaatctggcctgggcaccttggca

SEQ ID NO: 722894 - DNA, 25 bp, Mus musculus
gtaatgaatctcaacccagccaaca

SEQ ID NO: 722895 - DNA, 25 bp, Mus musculus
gtaatgaatctctacccagccaaca

SEQ ID NO: 722896 - DNA, 25 bp, Mus musculus
gtaatgacaaagagcggtttgccag

SEQ ID NO: 722897 - DNA, 25 bp, Mus musculus
gtaatgacaaagtgcggtttgccag

SEQ ID NO: 722898 - DNA, 25 bp, Mus musculus
gtaatgaccgtacaacctgggtttg

SEQ ID NO: 722899 - DNA, 25 bp, Mus musculus
gtaatgaccgtagaacctgggtttg

SEQ ID NO: 722900 - DNA, 25 bp, Mus musculus
gtaatgatgaagaccccaagacact

SEQ ID NO: 722901 - DNA, 25 bp, Mus musculus
gtaatgatgaagtccccaagacact

SEQ ID NO: 722902 - DNA, 25 bp, Mus musculus
gtaatgatggctacgtccccacgga

SEQ ID NO: 722903 - DNA, 25 bp, Mus musculus
gtaatgatggcttcgtccccacgga

SEQ ID NO: 722904 - DNA, 25 bp, Mus musculus
gtaatgcagtggatttatcttctct

SEQ ID NO: 722905 - DNA, 25 bp, Mus musculus
gtaatgcagtggttttatcttctct

SEQ ID NO: 722906 - DNA, 25 bp, Mus musculus
gtaatgcatgtcaggactgtgcaaa

SEQ ID NO: 722907 - DNA, 25 bp, Mus musculus
gtaatgcatgtctggactgtgcaaa

SEQ ID NO: 722908 - DNA, 25 bp, Mus musculus
gtaatgcccgctccaacatcatggg

SEQ ID NO: 722909 - DNA, 25 bp, Mus musculus
gtaatgcccgctgcaacatcatggg

SEQ ID NO: 722910 - DNA, 25 bp, Mus musculus
gtaatgcccgggaaactcctctggg

SEQ ID NO: 722911 - DNA, 25 bp, Mus musculus
gtaatgcccgggtaactcctctggg

SEQ ID NO: 722912 - DNA, 25 bp, Mus musculus
gtaatgctgatgcaaaccctccacc

SEQ ID NO: 722913 - DNA, 25 bp, Mus musculus
gtaatgctgatggaaaccctccacc

SEQ ID NO: 722914 - DNA, 25 bp, Mus musculus
gtaatgctgccaagcggaacaccaa

SEQ ID NO: 722915 - DNA, 25 bp, Mus musculus
gtaatgctgccatgcggaacaccaa

SEQ ID NO: 722916 - DNA, 25 bp, Mus musculus
gtaatggaactgacttatacacagg

SEQ ID NO: 722917 - DNA, 25 bp, Mus musculus
gtaatggaactgtcttatacacagg

SEQ ID NO: 722918 - DNA, 25 bp, Mus musculus
gtaatggacaaacttgatgctaatg

SEQ ID NO: 722919 - DNA, 25 bp, Mus musculus
gtaatggacaaagttgatgctaatg

SEQ ID NO: 722920 - DNA, 25 bp, Mus musculus
gtaatggaccttactgggttagaga

SEQ ID NO: 722921 - DNA, 25 bp, Mus musculus
gtaatggacctttctgggttagaga

SEQ ID NO: 722922 - DNA, 25 bp, Mus musculus
gtaatggcaattcgagttctctccc

SEQ ID NO: 722923 - DNA, 25 bp, Mus musculus
gtaatggcaattggagttctctccc

SEQ ID NO: 722924 - DNA, 25 bp, Mus musculus
gtaatggcatttcccaggccccgaa

SEQ ID NO: 722925 - DNA, 25 bp, Mus musculus
gtaatggcatttgccaggccccgaa

SEQ ID NO: 722926 - DNA, 25 bp, Mus musculus
gtaatgtcaacaaccgttagtgggc

SEQ ID NO: 722927 - DNA, 25 bp, Mus musculus
gtaatgtcaacatccgttagtgggc

SEQ ID NO: 722928 - DNA, 25 bp, Mus musculus
gtaattactacacttgccacaccat

SEQ ID NO: 722929 - DNA, 25 bp, Mus musculus
gtaattactacagttgccacaccat

SEQ ID NO: 722930 - DNA, 25 bp, Mus musculus
gtaattctgcttatcttggtagcca

SEQ ID NO: 722931 - DNA, 25 bp, Mus musculus
gtaattctgcttttcttggtagcca

SEQ ID NO: 722932 - DNA, 25 bp, Mus musculus
gtaattgcaaccacagttctacagc

SEQ ID NO: 722933 - DNA, 25 bp, Mus musculus
gtaattgcaacctcagttctacagc

SEQ ID NO: 722934 - DNA, 25 bp, Mus musculus
gtacaaaaacatcagcttcacagtc

SEQ ID NO: 722935 - DNA, 25 bp, Mus musculus
gtacaaaaacatgagcttcacagtc

SEQ ID NO: 722936 - DNA, 25 bp, Mus musculus
gtacaaacggcaacgacagaagcag

SEQ ID NO: 722937 - DNA, 25 bp, Mus musculus
gtacaaacggcatcgacagaagcag

SEQ ID NO: 722938 - DNA, 25 bp, Mus musculus
gtacaaagacccagcgcaacactcg

SEQ ID NO: 722939 - DNA, 25 bp, Mus musculus
gtacaaagaccctgcgcaacactcg

SEQ ID NO: 722940 - DNA, 25 bp, Mus musculus
gtacaaagagaaccaccaccggact

SEQ ID NO: 722941 - DNA, 25 bp, Mus musculus
gtacaaagagaagcaccaccggact

SEQ ID NO: 722942 - DNA, 25 bp, Mus musculus
gtacaaagcaccatgtaatcctgct

SEQ ID NO: 722943 - DNA, 25 bp, Mus musculus
gtacaaagcaccttgtaatcctgct

SEQ ID NO: 722944 - DNA, 25 bp, Mus musculus
gtacaaagccttctaaatccttagt

SEQ ID NO: 722945 - DNA, 25 bp, Mus musculus
gtacaaagccttgtaaatccttagt

SEQ ID NO: 722946 - DNA, 25 bp, Mus musculus
gtacaaaggtgccaccaaagaccaa

SEQ ID NO: 722947 - DNA, 25 bp, Mus musculus
gtacaaaggtgcgaccaaagaccaa

SEQ ID NO: 722948 - DNA, 25 bp, Mus musculus
gtacaaagtgaaatagcttcagcaa

SEQ ID NO: 722949 - DNA, 25 bp, Mus musculus
gtacaaagtgaattagcttcagcaa

SEQ ID NO: 722950 - DNA, 25 bp, Mus musculus
gtacaacaaacacagaatgcctcag

SEQ ID NO: 722951 - DNA, 25 bp, Mus musculus
gtacaacaaacagagaatgcctcag

SEQ ID NO: 722952 - DNA, 25 bp, Mus musculus
gtacaacaccaacgctctgcaaagg

SEQ ID NO: 722953 - DNA, 25 bp, Mus musculus
gtacaacaccaaggctctgcaaagg

SEQ ID NO: 722954 - DNA, 25 bp, Mus musculus
gtacaacccctaagcttggaacctg

SEQ ID NO: 722955 - DNA, 25 bp, Mus musculus
gtacaacccctatgcttggaacctg

SEQ ID NO: 722956 - DNA, 25 bp, Mus musculus
gtacaactctttagccctggcaaca

SEQ ID NO: 722957 - DNA, 25 bp, Mus musculus
gtacaactcttttgccctggcaaca

SEQ ID NO: 722958 - DNA, 25 bp, Mus musculus
gtacaactgggaacgtctcggatct

SEQ ID NO: 722959 - DNA, 25 bp, Mus musculus
gtacaactgggatcgtctcggatct

SEQ ID NO: 722960 - DNA, 25 bp, Mus musculus
gtacaacttccaaggcactgctgag

SEQ ID NO: 722961 - DNA, 25 bp, Mus musculus
gtacaacttccatggcactgctgag

SEQ ID NO: 722962 - DNA, 25 bp, Mus musculus
gtacaacttgccctcctggtgcgac

SEQ ID NO: 722963 - DNA, 25 bp, Mus musculus
gtacaacttgccgtcctggtgcgac

SEQ ID NO: 722964 - DNA, 25 bp, Mus musculus
gtacaagaaaaactcaactgggcat

SEQ ID NO: 722965 - DNA, 25 bp, Mus musculus
gtacaagaaaaagtcaactgggcat

SEQ ID NO: 722966 - DNA, 25 bp, Mus musculus
gtacaagaactcctactgttgaata

SEQ ID NO: 722967 - DNA, 25 bp, Mus musculus
gtacaagaactcgtactgttgaata

SEQ ID NO: 722968 - DNA, 25 bp, Mus musculus
gtacaagaacttcatccagaactat

SEQ ID NO: 722969 - DNA, 25 bp, Mus musculus
gtacaagaacttgatccagaactat

SEQ ID NO: 722970 - DNA, 25 bp, Mus musculus
gtacaagatgctcattcacatccgg

SEQ ID NO: 722971 - DNA, 25 bp, Mus musculus
gtacaagatgctgattcacatccgg

SEQ ID NO: 722972 - DNA, 25 bp, Mus musculus
gtacaagcaataacacagtccttca

SEQ ID NO: 722973 - DNA, 25 bp, Mus musculus
gtacaagcaatatcacagtccttca

SEQ ID NO: 722974 - DNA, 25 bp, Mus musculus
gtacaagccttacgaggaagcgctg

SEQ ID NO: 722975 - DNA, 25 bp, Mus musculus
gtacaagccttaggaggaagcgctg

SEQ ID NO: 722976 - DNA, 25 bp, Mus musculus
gtacaagctctgaagccactccacc

SEQ ID NO: 722977 - DNA, 25 bp, Mus musculus
gtacaagctctgtagccactccacc

SEQ ID NO: 722978 - DNA, 25 bp, Mus musculus
gtacaagtatgaccgcgcctgccct

SEQ ID NO: 722979 - DNA, 25 bp, Mus musculus
gtacaagtatgagcgcgcctgccct

SEQ ID NO: 722980 - DNA, 25 bp, Mus musculus
gtacaagtcctgacccgtcacaagg

SEQ ID NO: 722981 - DNA, 25 bp, Mus musculus
gtacaagtcctgtcccgtcacaagg

SEQ ID NO: 722982 - DNA, 25 bp, Mus musculus
gtacaagtgaaaaacggaggcatat

SEQ ID NO: 722983 - DNA, 25 bp, Mus musculus
gtacaagtgaaatacggaggcatat

SEQ ID NO: 722984 - DNA, 25 bp, Mus musculus
gtacaatccacgaccatccgcttgg

SEQ ID NO: 722985 - DNA, 25 bp, Mus musculus
gtacaatccacgtccatccgcttgg

SEQ ID NO: 722986 - DNA, 25 bp, Mus musculus
gtacaatgaagaactccgggcccag

SEQ ID NO: 722987 - DNA, 25 bp, Mus musculus
gtacaatgaagatctccgggcccag

SEQ ID NO: 722988 - DNA, 25 bp, Mus musculus
gtacaatggaaaagatgaggtctgt

SEQ ID NO: 722989 - DNA, 25 bp, Mus musculus
gtacaatggaaatgatgaggtctgt

SEQ ID NO: 722990 - DNA, 25 bp, Mus musculus
gtacaatggcgtcttggtaaaaaca

SEQ ID NO: 722991 - DNA, 25 bp, Mus musculus
gtacaatggcgtgttggtaaaaaca

SEQ ID NO: 722992 - DNA, 25 bp, Mus musculus
gtacaatttcttcactggctgccct

SEQ ID NO: 722993 - DNA, 25 bp, Mus musculus
gtacaatttcttgactggctgccct

SEQ ID NO: 722994 - DNA, 25 bp, Mus musculus
gtacacaccagaccgcgggtgctgc

SEQ ID NO: 722995 - DNA, 25 bp, Mus musculus
gtacacaccagagcgcgggtgctgc

SEQ ID NO: 722996 - DNA, 25 bp, Mus musculus
gtacacacccctagattatgcattg

SEQ ID NO: 722997 - DNA, 25 bp, Mus musculus
gtacacaccccttgattatgcattg

SEQ ID NO: 722998 - DNA, 25 bp, Mus musculus
gtacacacgcagaggcagctcgcct

SEQ ID NO: 722999 - DNA, 25 bp, Mus musculus
gtacacacgcagtggcagctcgcct

SEQ ID NO: 723000 - DNA, 25 bp, Mus musculus
gtacacagaccccaaggtggtggcc

SEQ ID NO: 723001 - DNA, 25 bp, Mus musculus
gtacacagacccgaaggtggtggcc

SEQ ID NO: 723002 - DNA, 25 bp, Mus musculus
gtacacagcctccagccaacgggag

SEQ ID NO: 723003 - DNA, 25 bp, Mus musculus
gtacacagcctcgagccaacgggag

SEQ ID NO: 723004 - DNA, 25 bp, Mus musculus
gtacaccgaaggaatcctgattctg

SEQ ID NO: 723005 - DNA, 25 bp, Mus musculus
gtacaccgaaggtatcctgattctg

SEQ ID NO: 723006 - DNA, 25 bp, Mus musculus
gtacaccggaacagcgctcacagtg

SEQ ID NO: 723007 - DNA, 25 bp, Mus musculus
gtacaccggaactgcgctcacagtg

SEQ ID NO: 723008 - DNA, 25 bp, Mus musculus
gtacaccggcaacatcgagatctcg

SEQ ID NO: 723009 - DNA, 25 bp, Mus musculus
gtacaccggcaagatcgagatctcg

SEQ ID NO: 723010 - DNA, 25 bp, Mus musculus
gtacacctggatctgcacactcaca

SEQ ID NO: 723011 - DNA, 25 bp, Mus musculus
gtacacctggatgtgcacactcaca

SEQ ID NO: 723012 - DNA, 25 bp, Mus musculus
gtacaccttacgctgctgtccacag

SEQ ID NO: 723013 - DNA, 25 bp, Mus musculus
gtacaccttacggtgctgtccacag

SEQ ID NO: 723014 - DNA, 25 bp, Mus musculus
gtacacctttcaagatgtgaaaaat

SEQ ID NO: 723015 - DNA, 25 bp, Mus musculus
gtacacctttcatgatgtgaaaaat

SEQ ID NO: 723016 - DNA, 25 bp, Mus musculus
gtacacggaagaccagatctgggat

SEQ ID NO: 723017 - DNA, 25 bp, Mus musculus
gtacacggaagagcagatctgggat

SEQ ID NO: 723018 - DNA, 25 bp, Mus musculus
gtacacgttgtcacggagccagacg

SEQ ID NO: 723019 - DNA, 25 bp, Mus musculus
gtacacgttgtctcggagccagacg

SEQ ID NO: 723020 - DNA, 25 bp, Mus musculus
gtacactacgagaactacctgcccg

SEQ ID NO: 723021 - DNA, 25 bp, Mus musculus
gtacactacgagtactacctgcccg

SEQ ID NO: 723022 - DNA, 25 bp, Mus musculus
gtacactcagccagtgtgcttcgca

SEQ ID NO: 723023 - DNA, 25 bp, Mus musculus
gtacactcagcctgtgtgcttcgca

SEQ ID NO: 723024 - DNA, 25 bp, Mus musculus
gtacactccctgagcttgagcggct

SEQ ID NO: 723025 - DNA, 25 bp, Mus musculus
gtacactccctgtgcttgagcggct

SEQ ID NO: 723026 - DNA, 25 bp, Mus musculus
gtacacttgtagcagctcccaccag

SEQ ID NO: 723027 - DNA, 25 bp, Mus musculus
gtacacttgtaggagctcccaccag

SEQ ID NO: 723028 - DNA, 25 bp, Mus musculus
gtacagaaacacactgaaagaatca

SEQ ID NO: 723029 - DNA, 25 bp, Mus musculus
gtacagaaacactctgaaagaatca

SEQ ID NO: 723030 - DNA, 25 bp, Mus musculus
gtacagaaccatcgtatttctattt

SEQ ID NO: 723031 - DNA, 25 bp, Mus musculus
gtacagaaccatggtatttctattt

SEQ ID NO: 723032 - DNA, 25 bp, Mus musculus
gtacagacaattattgctccaccaa

SEQ ID NO: 723033 - DNA, 25 bp, Mus musculus
gtacagacaatttttgctccaccaa

SEQ ID NO: 723034 - DNA, 25 bp, Mus musculus
gtacagagctatcgtgaaccccatg

SEQ ID NO: 723035 - DNA, 25 bp, Mus musculus
gtacagagctatggtgaaccccatg

SEQ ID NO: 723036 - DNA, 25 bp, Mus musculus
gtacagaggcctcgtgcagaacgac

SEQ ID NO: 723037 - DNA, 25 bp, Mus musculus
gtacagaggcctggtgcagaacgac

SEQ ID NO: 723038 - DNA, 25 bp, Mus musculus
gtacagagggtcagtcagtaggcta

SEQ ID NO: 723039 - DNA, 25 bp, Mus musculus
gtacagagggtctgtcagtaggcta

SEQ ID NO: 723040 - DNA, 25 bp, Mus musculus
gtacagcaagctccaccgtgacttc

SEQ ID NO: 723041 - DNA, 25 bp, Mus musculus
gtacagcaagctgcaccgtgacttc

SEQ ID NO: 723042 - DNA, 25 bp, Mus musculus
gtacagccacatactggaatccgag

SEQ ID NO: 723043 - DNA, 25 bp, Mus musculus
gtacagccacattctggaatccgag

SEQ ID NO: 723044 - DNA, 25 bp, Mus musculus
gtacagcccatccagttgaactttg

SEQ ID NO: 723045 - DNA, 25 bp, Mus musculus
gtacagcccatcgagttgaactttg

SEQ ID NO: 723046 - DNA, 25 bp, Mus musculus
gtacagccgaatagccgaggaccca

SEQ ID NO: 723047 - DNA, 25 bp, Mus musculus
gtacagccgaattgccgaggaccca

SEQ ID NO: 723048 - DNA, 25 bp, Mus musculus
gtacagcctccgagtcggcgggctc

SEQ ID NO: 723049 - DNA, 25 bp, Mus musculus
gtacagcctccgtgtcggcgggctc

SEQ ID NO: 723050 - DNA, 25 bp, Mus musculus
gtacagcctttactaactcgtgaag

SEQ ID NO: 723051 - DNA, 25 bp, Mus musculus
gtacagcctttagtaactcgtgaag

SEQ ID NO: 723052 - DNA, 25 bp, Mus musculus
gtacagctaataataggctacatct

SEQ ID NO: 723053 - DNA, 25 bp, Mus musculus
gtacagctaatattaggctacatct

SEQ ID NO: 723054 - DNA, 25 bp, Mus musculus
gtacagctactgcacaaggaatggg

SEQ ID NO: 723055 - DNA, 25 bp, Mus musculus
gtacagctactggacaaggaatggg

SEQ ID NO: 723056 - DNA, 25 bp, Mus musculus
gtacagctagcaaactcttaaactt

SEQ ID NO: 723057 - DNA, 25 bp, Mus musculus
gtacagctagcatactcttaaactt

SEQ ID NO: 723058 - DNA, 25 bp, Mus musculus
gtacagctcattcgcctgcagcaag

SEQ ID NO: 723059 - DNA, 25 bp, Mus musculus
gtacagctcattggcctgcagcaag

SEQ ID NO: 723060 - DNA, 25 bp, Mus musculus
gtacagcttactctgcgctccgaag

SEQ ID NO: 723061 - DNA, 25 bp, Mus musculus
gtacagcttactgtgcgctccgaag

SEQ ID NO: 723062 - DNA, 25 bp, Mus musculus
gtacagctttagaggtttgtcctct

SEQ ID NO: 723063 - DNA, 25 bp, Mus musculus
gtacagctttagtggtttgtcctct

SEQ ID NO: 723064 - DNA, 25 bp, Mus musculus
gtacagtagcccctcttcaaagtgg

SEQ ID NO: 723065 - DNA, 25 bp, Mus musculus
gtacagtagcccgtcttcaaagtgg

SEQ ID NO: 723066 - DNA, 25 bp, Mus musculus
gtacagtattgccaccaaaaacgga

SEQ ID NO: 723067 - DNA, 25 bp, Mus musculus
gtacagtattgcgaccaaaaacgga

SEQ ID NO: 723068 - DNA, 25 bp, Mus musculus
gtacagtccacccttcgatacatgc

SEQ ID NO: 723069 - DNA, 25 bp, Mus musculus
gtacagtccaccgttcgatacatgc

SEQ ID NO: 723070 - DNA, 25 bp, Mus musculus
gtacagtcccgcacagcgccagtgt

SEQ ID NO: 723071 - DNA, 25 bp, Mus musculus
gtacagtcccgctcagcgccagtgt

SEQ ID NO: 723072 - DNA, 25 bp, Mus musculus
gtacagtcctgtcatacaaggtaat

SEQ ID NO: 723073 - DNA, 25 bp, Mus musculus
gtacagtcctgtgatacaaggtaat

SEQ ID NO: 723074 - DNA, 25 bp, Mus musculus
gtacagtgatgtagaccaggagact

SEQ ID NO: 723075 - DNA, 25 bp, Mus musculus
gtacagtgatgttgaccaggagact

SEQ ID NO: 723076 - DNA, 25 bp, Mus musculus
gtacagtgggagcacgcaggcccag

SEQ ID NO: 723077 - DNA, 25 bp, Mus musculus
gtacagtgggaggacgcaggcccag

SEQ ID NO: 723078 - DNA, 25 bp, Mus musculus
gtacagttcaagatcaagaggcaca

SEQ ID NO: 723079 - DNA, 25 bp, Mus musculus
gtacagttcaagttcaagaggcaca

SEQ ID NO: 723080 - DNA, 25 bp, Mus musculus
gtacagttcactagtaaacaccatt

SEQ ID NO: 723081 - DNA, 25 bp, Mus musculus
gtacagttcacttgtaaacaccatt

SEQ ID NO: 723082 - DNA, 25 bp, Mus musculus
gtacagttggaaacattgagtattc

SEQ ID NO: 723083 - DNA, 25 bp, Mus musculus
gtacagttggaatcattgagtattc

SEQ ID NO: 723084 - DNA, 25 bp, Mus musculus
gtacatacacttcactccaaacttc

SEQ ID NO: 723085 - DNA, 25 bp, Mus musculus
gtacatacacttgactccaaacttc

SEQ ID NO: 723086 - DNA, 25 bp, Mus musculus
gtacatatcaaaaacaccatgtagg

SEQ ID NO: 723087 - DNA, 25 bp, Mus musculus
gtacatatcaaatacaccatgtagg

SEQ ID NO: 723088 - DNA, 25 bp, Mus musculus
gtacatatcggccaccaaagactcg

SEQ ID NO: 723089 - DNA, 25 bp, Mus musculus
gtacatatcggcgaccaaagactcg

SEQ ID NO: 723090 - DNA, 25 bp, Mus musculus
gtacatatggaactggtatgaccag

SEQ ID NO: 723091 - DNA, 25 bp, Mus musculus
gtacatatggaagtggtatgaccag

SEQ ID NO: 723092 - DNA, 25 bp, Mus musculus
gtacatccgctcagtggaccctggc

SEQ ID NO: 723093 - DNA, 25 bp, Mus musculus
gtacatccgctctgtggaccctggc

SEQ ID NO: 723094 - DNA, 25 bp, Mus musculus
gtacatcctctccagccgggtcaat

SEQ ID NO: 723095 - DNA, 25 bp, Mus musculus
gtacatcctctcgagccgggtcaat

SEQ ID NO: 723096 - DNA, 25 bp, Mus musculus
gtacatcgcccccatgacagagaag

SEQ ID NO: 723097 - DNA, 25 bp, Mus musculus
gtacatcgccccgatgacagagaag

SEQ ID NO: 723098 - DNA, 25 bp, Mus musculus
gtacatcgtcctaatcctctgcggg

SEQ ID NO: 723099 - DNA, 25 bp, Mus musculus
gtacatcgtccttatcctctgcggg

SEQ ID NO: 723100 - DNA, 25 bp, Mus musculus
gtacatcgtctacaaggagagagtg

SEQ ID NO: 723101 - DNA, 25 bp, Mus musculus
gtacatcgtctagaaggagagagtg

SEQ ID NO: 723102 - DNA, 25 bp, Mus musculus
gtacatctacatcgacaagtccttg

SEQ ID NO: 723103 - DNA, 25 bp, Mus musculus
gtacatctacatggacaagtccttg

SEQ ID NO: 723104 - DNA, 25 bp, Mus musculus
gtacatctggcgcagcaccgtgagc

SEQ ID NO: 723105 - DNA, 25 bp, Mus musculus
gtacatctggcggagcaccgtgagc

SEQ ID NO: 723106 - DNA, 25 bp, Mus musculus
gtacatgcgcaacaccagtaagcag

SEQ ID NO: 723107 - DNA, 25 bp, Mus musculus
gtacatgcgcaagaccagtaagcag

SEQ ID NO: 723108 - DNA, 25 bp, Mus musculus
gtacatgcgccgcaggaagcccgac

SEQ ID NO: 723109 - DNA, 25 bp, Mus musculus
gtacatgcgccggaggaagcccgac

SEQ ID NO: 723110 - DNA, 25 bp, Mus musculus
gtacatggacaaccaccctggagga

SEQ ID NO: 723111 - DNA, 25 bp, Mus musculus
gtacatggacaagcaccctggagga

SEQ ID NO: 723112 - DNA, 25 bp, Mus musculus
gtacatggccctactgtgtacatgg

SEQ ID NO: 723113 - DNA, 25 bp, Mus musculus
gtacatggcccttctgtgtacatgg

SEQ ID NO: 723114 - DNA, 25 bp, Mus musculus
gtacatggtgacagaacgtgcctca

SEQ ID NO: 723115 - DNA, 25 bp, Mus musculus
gtacatggtgactgaacgtgcctca

SEQ ID NO: 723116 - DNA, 25 bp, Mus musculus
gtacatgtatatcaggtactgctgt

SEQ ID NO: 723117 - DNA, 25 bp, Mus musculus
gtacatgtatatgaggtactgctgt

SEQ ID NO: 723118 - DNA, 25 bp, Mus musculus
gtacatgtgccgcatcatagttcat

SEQ ID NO: 723119 - DNA, 25 bp, Mus musculus
gtacatgtgccggatcatagttcat

SEQ ID NO: 723120 - DNA, 25 bp, Mus musculus
gtacattgatgcacgggcaaggcgt

SEQ ID NO: 723121 - DNA, 25 bp, Mus musculus
gtacattgatgctcgggcaaggcgt

SEQ ID NO: 723122 - DNA, 25 bp, Mus musculus
gtacattgggatccggaatgagcaa

SEQ ID NO: 723123 - DNA, 25 bp, Mus musculus
gtacattgggatgcggaatgagcaa

SEQ ID NO: 723124 - DNA, 25 bp, Mus musculus
gtaccaaaacttagatgtcttcatg

SEQ ID NO: 723125 - DNA, 25 bp, Mus musculus
gtaccaaaactttgatgtcttcatg

SEQ ID NO: 723126 - DNA, 25 bp, Mus musculus
gtaccaaagcagacagactcacagc

SEQ ID NO: 723127 - DNA, 25 bp, Mus musculus
gtaccaaagcagtcagactcacagc

SEQ ID NO: 723128 - DNA, 25 bp, Mus musculus
gtaccaaattctattctccctcaag

SEQ ID NO: 723129 - DNA, 25 bp, Mus musculus
gtaccaaattcttttctccctcaag

SEQ ID NO: 723130 - DNA, 25 bp, Mus musculus
gtaccaacatccagtccaagacctg

SEQ ID NO: 723131 - DNA, 25 bp, Mus musculus
gtaccaacatcctgtccaagacctg

SEQ ID NO: 723132 - DNA, 25 bp, Mus musculus
gtaccaagtcacagatcggccttcc

SEQ ID NO: 723133 - DNA, 25 bp, Mus musculus
gtaccaagtcactgatcggccttcc

SEQ ID NO: 723134 - DNA, 25 bp, Mus musculus
gtaccacatggcagtggcctaccgc

SEQ ID NO: 723135 - DNA, 25 bp, Mus musculus
gtaccacatggctgtggcctaccgc

SEQ ID NO: 723136 - DNA, 25 bp, Mus musculus
gtaccacgaagtcgcaagccagctg

SEQ ID NO: 723137 - DNA, 25 bp, Mus musculus
gtaccacgaagtggcaagccagctg

SEQ ID NO: 723138 - DNA, 25 bp, Mus musculus
gtaccacgacagagcgctggccaga

SEQ ID NO: 723139 - DNA, 25 bp, Mus musculus
gtaccacgacagtgcgctggccaga

SEQ ID NO: 723140 - DNA, 25 bp, Mus musculus
gtaccacgcctaagctgaaccactg

SEQ ID NO: 723141 - DNA, 25 bp, Mus musculus
gtaccacgcctatgctgaaccactg

SEQ ID NO: 723142 - DNA, 25 bp, Mus musculus
gtaccactccttaagaactaaagct

SEQ ID NO: 723143 - DNA, 25 bp, Mus musculus
gtaccactcctttagaactaaagct

SEQ ID NO: 723144 - DNA, 25 bp, Mus musculus
gtaccagaaggcaatcgacatctat

SEQ ID NO: 723145 - DNA, 25 bp, Mus musculus
gtaccagaaggctatcgacatctat

SEQ ID NO: 723146 - DNA, 25 bp, Mus musculus
gtaccagctggcctctgccatgggc

SEQ ID NO: 723147 - DNA, 25 bp, Mus musculus
gtaccagctggcgtctgccatgggc

SEQ ID NO: 723148 - DNA, 25 bp, Mus musculus
gtaccaggactacttctacactgcc

SEQ ID NO: 723149 - DNA, 25 bp, Mus musculus
gtaccaggactagttctacactgcc

SEQ ID NO: 723150 - DNA, 25 bp, Mus musculus
gtaccagtaccccaccatggatgag

SEQ ID NO: 723151 - DNA, 25 bp, Mus musculus
gtaccagtacccgaccatggatgag

SEQ ID NO: 723152 - DNA, 25 bp, Mus musculus
gtaccagtgtaaaggtgacacacta

SEQ ID NO: 723153 - DNA, 25 bp, Mus musculus
gtaccagtgtaatggtgacacacta

SEQ ID NO: 723154 - DNA, 25 bp, Mus musculus
gtaccagttctgcacaagtgccact

SEQ ID NO: 723155 - DNA, 25 bp, Mus musculus
gtaccagttctggacaagtgccact

SEQ ID NO: 723156 - DNA, 25 bp, Mus musculus
gtaccagtttgcctcctgctccaag

SEQ ID NO: 723157 - DNA, 25 bp, Mus musculus
gtaccagtttgcgtcctgctccaag

SEQ ID NO: 723158 - DNA, 25 bp, Mus musculus
gtaccataattaaacgatgccccaa

SEQ ID NO: 723159 - DNA, 25 bp, Mus musculus
gtaccataattatacgatgccccaa

SEQ ID NO: 723160 - DNA, 25 bp, Mus musculus
gtaccatcacctcggagaacctggc

SEQ ID NO: 723161 - DNA, 25 bp, Mus musculus
gtaccatcacctgggagaacctggc

SEQ ID NO: 723162 - DNA, 25 bp, Mus musculus
gtaccatcatgtcttacgggcagac

SEQ ID NO: 723163 - DNA, 25 bp, Mus musculus
gtaccatcatgtgttacgggcagac

SEQ ID NO: 723164 - DNA, 25 bp, Mus musculus
gtaccatcggttcttatctgactat

SEQ ID NO: 723165 - DNA, 25 bp, Mus musculus
gtaccatcggttgttatctgactat

SEQ ID NO: 723166 - DNA, 25 bp, Mus musculus
gtacccacacgcagctgtcaacggg

SEQ ID NO: 723167 - DNA, 25 bp, Mus musculus
gtacccacacgctgctgtcaacggg

SEQ ID NO: 723168 - DNA, 25 bp, Mus musculus
gtacccacgacgatctcagcaacag

SEQ ID NO: 723169 - DNA, 25 bp, Mus musculus
gtacccacgacgttctcagcaacag

SEQ ID NO: 723170 - DNA, 25 bp, Mus musculus
gtacccactgacagctatgaccctt

SEQ ID NO: 723171 - DNA, 25 bp, Mus musculus
gtacccactgactgctatgaccctt

SEQ ID NO: 723172 - DNA, 25 bp, Mus musculus
gtacccagtattacgacatgcgctg

SEQ ID NO: 723173 - DNA, 25 bp, Mus musculus
gtacccagtatttcgacatgcgctg

SEQ ID NO: 723174 - DNA, 25 bp, Mus musculus
gtacccataggtccccagctatgtg

SEQ ID NO: 723175 - DNA, 25 bp, Mus musculus
gtacccataggtgcccagctatgtg

SEQ ID NO: 723176 - DNA, 25 bp, Mus musculus
gtacccattgacactctactgccaa

SEQ ID NO: 723177 - DNA, 25 bp, Mus musculus
gtacccattgactctctactgccaa

SEQ ID NO: 723178 - DNA, 25 bp, Mus musculus
gtacccctgcagactccaggatcga

SEQ ID NO: 723179 - DNA, 25 bp, Mus musculus
gtacccctgcagtctccaggatcga

SEQ ID NO: 723180 - DNA, 25 bp, Mus musculus
gtacccgacgttcagagcctaccgt

SEQ ID NO: 723181 - DNA, 25 bp, Mus musculus
gtacccgacgttgagagcctaccgt

SEQ ID NO: 723182 - DNA, 25 bp, Mus musculus
gtacccgtaactacatccacatgaa

SEQ ID NO: 723183 - DNA, 25 bp, Mus musculus
gtacccgtaacttcatccacatgaa

SEQ ID NO: 723184 - DNA, 25 bp, Mus musculus
gtaccctaatttacaactgcgggag

SEQ ID NO: 723185 - DNA, 25 bp, Mus musculus
gtaccctaattttcaactgcgggag

SEQ ID NO: 723186 - DNA, 25 bp, Mus musculus
gtaccctagaaaaaactgcactgca

SEQ ID NO: 723187 - DNA, 25 bp, Mus musculus
gtaccctagaaataactgcactgca

SEQ ID NO: 723188 - DNA, 25 bp, Mus musculus
gtaccctaggcacgcagcagaccag

SEQ ID NO: 723189 - DNA, 25 bp, Mus musculus
gtaccctaggcaggcagcagaccag

SEQ ID NO: 723190 - DNA, 25 bp, Mus musculus
gtaccctccgatcgtggcaactata

SEQ ID NO: 723191 - DNA, 25 bp, Mus musculus
gtaccctccgatggtggcaactata

SEQ ID NO: 723192 - DNA, 25 bp, Mus musculus
gtaccctgacatcagccgccttggg

SEQ ID NO: 723193 - DNA, 25 bp, Mus musculus
gtaccctgacatgagccgccttggg

SEQ ID NO: 723194 - DNA, 25 bp, Mus musculus
gtaccctgtataacctgtgccccgg

SEQ ID NO: 723195 - DNA, 25 bp, Mus musculus
gtaccctgtatatcctgtgccccgg

SEQ ID NO: 723196 - DNA, 25 bp, Mus musculus
gtacccttcaccaatgactcctatg

SEQ ID NO: 723197 - DNA, 25 bp, Mus musculus
gtacccttcacctatgactcctatg

SEQ ID NO: 723198 - DNA, 25 bp, Mus musculus
gtaccgacttgtaccctatggaaat

SEQ ID NO: 723199 - DNA, 25 bp, Mus musculus
gtaccgacttgttccctatggaaat

SEQ ID NO: 723200 - DNA, 25 bp, Mus musculus
gtaccgatacgaccctcggttccag

SEQ ID NO: 723201 - DNA, 25 bp, Mus musculus
gtaccgatacgagcctcggttccag

SEQ ID NO: 723202 - DNA, 25 bp, Mus musculus
gtaccgcacattagtgccagccatg

SEQ ID NO: 723203 - DNA, 25 bp, Mus musculus
gtaccgcacatttgtgccagccatg

SEQ ID NO: 723204 - DNA, 25 bp, Mus musculus
gtaccgcagcccagcaatgtgcgcg

SEQ ID NO: 723205 - DNA, 25 bp, Mus musculus
gtaccgcagccctgcaatgtgcgcg

SEQ ID NO: 723206 - DNA, 25 bp, Mus musculus
gtaccgcccggaacctggcaggcga

SEQ ID NO: 723207 - DNA, 25 bp, Mus musculus
gtaccgcccggatcctggcaggcga

SEQ ID NO: 723208 - DNA, 25 bp, Mus musculus
gtaccgcggagtccgtcccctgatg

SEQ ID NO: 723209 - DNA, 25 bp, Mus musculus
gtaccgcggagtgcgtcccctgatg

SEQ ID NO: 723210 - DNA, 25 bp, Mus musculus
gtaccgctacctcctctgaacggat

SEQ ID NO: 723211 - DNA, 25 bp, Mus musculus
gtaccgctacctgctctgaacggat

SEQ ID NO: 723212 - DNA, 25 bp, Mus musculus
gtaccgggacctctctcaagccatg

SEQ ID NO: 723213 - DNA, 25 bp, Mus musculus
gtaccgggacctgtctcaagccatg

SEQ ID NO: 723214 - DNA, 25 bp, Mus musculus
gtaccgggcgagacgaaagcagttt

SEQ ID NO: 723215 - DNA, 25 bp, Mus musculus
gtaccgggcgagtcgaaagcagttt

SEQ ID NO: 723216 - DNA, 25 bp, Mus musculus
gtaccgttgtcaccacacagcgttc

SEQ ID NO: 723217 - DNA, 25 bp, Mus musculus
gtaccgttgtcagcacacagcgttc

SEQ ID NO: 723218 - DNA, 25 bp, Mus musculus
gtacctatgctgagaatcgtgccaa

SEQ ID NO: 723219 - DNA, 25 bp, Mus musculus
gtacctatgctgtgaatcgtgccaa

SEQ ID NO: 723220 - DNA, 25 bp, Mus musculus
gtacctcacagtcgcattgagcagg

SEQ ID NO: 723221 - DNA, 25 bp, Mus musculus
gtacctcacagtggcattgagcagg

SEQ ID NO: 723222 - DNA, 25 bp, Mus musculus
gtacctcatcacatggcactctctg

SEQ ID NO: 723223 - DNA, 25 bp, Mus musculus
gtacctcatcacttggcactctctg

SEQ ID NO: 723224 - DNA, 25 bp, Mus musculus
gtacctcatccacaaagccagttca

SEQ ID NO: 723225 - DNA, 25 bp, Mus musculus
gtacctcatccagaaagccagttca

SEQ ID NO: 723226 - DNA, 25 bp, Mus musculus
gtacctcatggaaaaccccagcttt

SEQ ID NO: 723227 - DNA, 25 bp, Mus musculus
gtacctcatggataaccccagcttt

SEQ ID NO: 723228 - DNA, 25 bp, Mus musculus
gtacctcctactcggataccatctg

SEQ ID NO: 723229 - DNA, 25 bp, Mus musculus
gtacctcctactgggataccatctg

SEQ ID NO: 723230 - DNA, 25 bp, Mus musculus
gtacctcctgtaagatgtcaacccc

SEQ ID NO: 723231 - DNA, 25 bp, Mus musculus
gtacctcctgtatgatgtcaacccc

SEQ ID NO: 723232 - DNA, 25 bp, Mus musculus
gtacctccttatacatggaacggca

SEQ ID NO: 723233 - DNA, 25 bp, Mus musculus
gtacctccttattcatggaacggca

SEQ ID NO: 723234 - DNA, 25 bp, Mus musculus
gtacctctacatccatcattgtcag

SEQ ID NO: 723235 - DNA, 25 bp, Mus musculus
gtacctctacatgcatcattgtcag

SEQ ID NO: 723236 - DNA, 25 bp, Mus musculus
gtacctgaagctcagcgcacagctg

SEQ ID NO: 723237 - DNA, 25 bp, Mus musculus
gtacctgaagctcctcagttcacag

SEQ ID NO: 723238 - DNA, 25 bp, Mus musculus
gtacctgaagctgagcgcacagctg

SEQ ID NO: 723239 - DNA, 25 bp, Mus musculus
gtacctgaagctgctcagttcacag

SEQ ID NO: 723240 - DNA, 25 bp, Mus musculus
gtacctgagccacgacactgtatcg

SEQ ID NO: 723241 - DNA, 25 bp, Mus musculus
gtacctgagccaggacactgtatcg

SEQ ID NO: 723242 - DNA, 25 bp, Mus musculus
gtacctgctccacctcaacaacctg

SEQ ID NO: 723243 - DNA, 25 bp, Mus musculus
gtacctgctccagctcaacaacctg

SEQ ID NO: 723244 - DNA, 25 bp, Mus musculus
gtacctgctcctcgttaagtgtttg

SEQ ID NO: 723245 - DNA, 25 bp, Mus musculus
gtacctgctcctggttaagtgtttg

SEQ ID NO: 723246 - DNA, 25 bp, Mus musculus
gtacctggaagcagcccaccaaaat

SEQ ID NO: 723247 - DNA, 25 bp, Mus musculus
gtacctggaagctgcccaccaaaat

SEQ ID NO: 723248 - DNA, 25 bp, Mus musculus
gtacctggaggcatgctcttctggg

SEQ ID NO: 723249 - DNA, 25 bp, Mus musculus
gtacctggaggcttgctcttctggg

SEQ ID NO: 723250 - DNA, 25 bp, Mus musculus
gtacctggcgctcgtgtctgccctg

SEQ ID NO: 723251 - DNA, 25 bp, Mus musculus
gtacctggcgctggtgtctgccctg

SEQ ID NO: 723252 - DNA, 25 bp, Mus musculus
gtacctggtcaacctgcccgtatct

SEQ ID NO: 723253 - DNA, 25 bp, Mus musculus
gtacctggtcaagctgcccgtatct

SEQ ID NO: 723254 - DNA, 25 bp, Mus musculus
gtacctggtctacacgagcagcatg

SEQ ID NO: 723255 - DNA, 25 bp, Mus musculus
gtacctggtctagacgagcagcatg

SEQ ID NO: 723256 - DNA, 25 bp, Mus musculus
gtacctgtggaacgacttgactctg

SEQ ID NO: 723257 - DNA, 25 bp, Mus musculus
gtacctgtggaaggacttgactctg

SEQ ID NO: 723258 - DNA, 25 bp, Mus musculus
gtacctgtggtcctcgagggttcta

SEQ ID NO: 723259 - DNA, 25 bp, Mus musculus
gtacctgtggtcgtcgagggttcta

SEQ ID NO: 723260 - DNA, 25 bp, Mus musculus
gtacctgtgtgtacatatggcttca

SEQ ID NO: 723261 - DNA, 25 bp, Mus musculus
gtacctgtgtgttcatatggcttca

SEQ ID NO: 723262 - DNA, 25 bp, Mus musculus
gtaccttactcccaaagctgtcctt

SEQ ID NO: 723263 - DNA, 25 bp, Mus musculus
gtaccttactccgaaagctgtcctt

SEQ ID NO: 723264 - DNA, 25 bp, Mus musculus
gtaccttggctgcagtcatcgatct

SEQ ID NO: 723265 - DNA, 25 bp, Mus musculus
gtaccttggctggagtcatcgatct

SEQ ID NO: 723266 - DNA, 25 bp, Mus musculus
gtacctttacccaagggtgccaatg

SEQ ID NO: 723267 - DNA, 25 bp, Mus musculus
gtacctttaccctagggtgccaatg

SEQ ID NO: 723268 - DNA, 25 bp, Mus musculus
gtacgaataagtaaggagcaagacc

SEQ ID NO: 723269 - DNA, 25 bp, Mus musculus
gtacgaataagttaggagcaagacc

SEQ ID NO: 723270 - DNA, 25 bp, Mus musculus
gtacgaatttgccaaccccagccgt

SEQ ID NO: 723271 - DNA, 25 bp, Mus musculus
gtacgaatttgcgaaccccagccgt

SEQ ID NO: 723272 - DNA, 25 bp, Mus musculus
gtacgacagggcagcagaggttccc

SEQ ID NO: 723273 - DNA, 25 bp, Mus musculus
gtacgacagggctgcagaggttccc

SEQ ID NO: 723274 - DNA, 25 bp, Mus musculus
gtacgacctggtccgctccgtagta

SEQ ID NO: 723275 - DNA, 25 bp, Mus musculus
gtacgacctggtgcgctccgtagta

SEQ ID NO: 723276 - DNA, 25 bp, Mus musculus
gtacgactacatctacccggagcag

SEQ ID NO: 723277 - DNA, 25 bp, Mus musculus
gtacgactacatgtacccggagcag

SEQ ID NO: 723278 - DNA, 25 bp, Mus musculus
gtacgagcatccatcggtcctgagc

SEQ ID NO: 723279 - DNA, 25 bp, Mus musculus
gtacgagcatccttcggtcctgagc

SEQ ID NO: 723280 - DNA, 25 bp, Mus musculus
gtacgagccaacaccaactcactgg

SEQ ID NO: 723281 - DNA, 25 bp, Mus musculus
gtacgagccaactccaactcactgg

SEQ ID NO: 723282 - DNA, 25 bp, Mus musculus
gtacgaggagcgaagcaccacaacc

SEQ ID NO: 723283 - DNA, 25 bp, Mus musculus
gtacgaggagcgtagcaccacaacc

SEQ ID NO: 723284 - DNA, 25 bp, Mus musculus
gtacgaggtcccagaagctgcgcag

SEQ ID NO: 723285 - DNA, 25 bp, Mus musculus
gtacgaggtccctgaagctgcgcag

SEQ ID NO: 723286 - DNA, 25 bp, Mus musculus
gtacgatattaaccgaaagccctgg

SEQ ID NO: 723287 - DNA, 25 bp, Mus musculus
gtacgatattaagcgaaagccctgg

SEQ ID NO: 723288 - DNA, 25 bp, Mus musculus
gtacgatcatgtctgatgaatgcag

SEQ ID NO: 723289 - DNA, 25 bp, Mus musculus
gtacgatcatgtgtgatgaatgcag

SEQ ID NO: 723290 - DNA, 25 bp, Mus musculus
gtacgatgagatcagtgtcctcttc

SEQ ID NO: 723291 - DNA, 25 bp, Mus musculus
gtacgatgagatgagtgtcctcttc

SEQ ID NO: 723292 - DNA, 25 bp, Mus musculus
gtacgcaacggaagaggccctgaag

SEQ ID NO: 723293 - DNA, 25 bp, Mus musculus
gtacgcaacggatgaggccctgaag

SEQ ID NO: 723294 - DNA, 25 bp, Mus musculus
gtacgcaccggtcacgatcggcatc

SEQ ID NO: 723295 - DNA, 25 bp, Mus musculus
gtacgcaccggtgacgatcggcatc

SEQ ID NO: 723296 - DNA, 25 bp, Mus musculus
gtacgcagatgaccgcaagaagcag

SEQ ID NO: 723297 - DNA, 25 bp, Mus musculus
gtacgcagatgagcgcaagaagcag

SEQ ID NO: 723298 - DNA, 25 bp, Mus musculus
gtacgcagggaaaacaggaaattct

SEQ ID NO: 723299 - DNA, 25 bp, Mus musculus
gtacgcagggaatacaggaaattct

SEQ ID NO: 723300 - DNA, 25 bp, Mus musculus
gtacgcctccaaaggcaatctccgg

SEQ ID NO: 723301 - DNA, 25 bp, Mus musculus
gtacgcctccaatggcaatctccgg

SEQ ID NO: 723302 - DNA, 25 bp, Mus musculus
gtacgcgttcatcggacccttggag

SEQ ID NO: 723303 - DNA, 25 bp, Mus musculus
gtacgcgttcatgggacccttggag

SEQ ID NO: 723304 - DNA, 25 bp, Mus musculus
gtacggagaccgcccagtacttggc

SEQ ID NO: 723305 - DNA, 25 bp, Mus musculus
gtacggagaccggccagtacttggc

SEQ ID NO: 723306 - DNA, 25 bp, Mus musculus
gtacggagccgccttcttcacagga

SEQ ID NO: 723307 - DNA, 25 bp, Mus musculus
gtacggagccgcgttcttcacagga

SEQ ID NO: 723308 - DNA, 25 bp, Mus musculus
gtacggcaactaccctcacagtcaa

SEQ ID NO: 723309 - DNA, 25 bp, Mus musculus
gtacggcaactagcctcacagtcaa

SEQ ID NO: 723310 - DNA, 25 bp, Mus musculus
gtacggcatttaagtcatccaccag

SEQ ID NO: 723311 - DNA, 25 bp, Mus musculus
gtacggcatttatgtcatccaccag

SEQ ID NO: 723312 - DNA, 25 bp, Mus musculus
gtacggcctcacagaagctatcgcc

SEQ ID NO: 723313 - DNA, 25 bp, Mus musculus
gtacggcctcactgaagctatcgcc

SEQ ID NO: 723314 - DNA, 25 bp, Mus musculus
gtacggctaccgctttgccaaggag

SEQ ID NO: 723315 - DNA, 25 bp, Mus musculus
gtacggctaccggtttgccaaggag

SEQ ID NO: 723316 - DNA, 25 bp, Mus musculus
gtacggctgaaacaccggaagctcc

SEQ ID NO: 723317 - DNA, 25 bp, Mus musculus
gtacggctgaaagaccggaagctcc

SEQ ID NO: 723318 - DNA, 25 bp, Mus musculus
gtacggtcagaaaagagatgtttcg

SEQ ID NO: 723319 - DNA, 25 bp, Mus musculus
gtacggtcagaatagagatgtttcg

SEQ ID NO: 723320 - DNA, 25 bp, Mus musculus
gtacggtcgcaacaagccgctcatc

SEQ ID NO: 723321 - DNA, 25 bp, Mus musculus
gtacggtcgcaagaagccgctcatc

SEQ ID NO: 723322 - DNA, 25 bp, Mus musculus
gtacggtggcctacggcctggactc

SEQ ID NO: 723323 - DNA, 25 bp, Mus musculus
gtacggtggccttcggcctggactc

SEQ ID NO: 723324 - DNA, 25 bp, Mus musculus
gtacggttctccaggccagagtccg

SEQ ID NO: 723325 - DNA, 25 bp, Mus musculus
gtacggttctcctggccagagtccg

SEQ ID NO: 723326 - DNA, 25 bp, Mus musculus
gtacggtttcggacacaaagccgag

SEQ ID NO: 723327 - DNA, 25 bp, Mus musculus
gtacggtttcggtcacaaagccgag

SEQ ID NO: 723328 - DNA, 25 bp, Mus musculus
gtacgtatatgccacctccgaaggg

SEQ ID NO: 723329 - DNA, 25 bp, Mus musculus
gtacgtatatgcgacctccgaaggg

SEQ ID NO: 723330 - DNA, 25 bp, Mus musculus
gtacgtcaaggaataaaatgtgaag

SEQ ID NO: 723331 - DNA, 25 bp, Mus musculus
gtacgtcaaggattaaaatgtgaag

SEQ ID NO: 723332 - DNA, 25 bp, Mus musculus
gtacgtcccactagggccattcctg

SEQ ID NO: 723333 - DNA, 25 bp, Mus musculus
gtacgtcccacttgggccattcctg

SEQ ID NO: 723334 - DNA, 25 bp, Mus musculus
gtacgtcttccgaactgagaatggg

SEQ ID NO: 723335 - DNA, 25 bp, Mus musculus
gtacgtcttccgtactgagaatggg

SEQ ID NO: 723336 - DNA, 25 bp, Mus musculus
gtacgtgatcacactctggctagca

SEQ ID NO: 723337 - DNA, 25 bp, Mus musculus
gtacgtgatcactctctggctagca

SEQ ID NO: 723338 - DNA, 25 bp, Mus musculus
gtacgtgccctgcaacttccatgaa

SEQ ID NO: 723339 - DNA, 25 bp, Mus musculus
gtacgtgccctggaacttccatgaa

SEQ ID NO: 723340 - DNA, 25 bp, Mus musculus
gtacgtggatcacataaaaatttca

SEQ ID NO: 723341 - DNA, 25 bp, Mus musculus
gtacgtggatcagataaaaatttca

SEQ ID NO: 723342 - DNA, 25 bp, Mus musculus
gtactaaaaccccattctgatcaac

SEQ ID NO: 723343 - DNA, 25 bp, Mus musculus
gtactaaaacccgattctgatcaac

SEQ ID NO: 723344 - DNA, 25 bp, Mus musculus
gtactaaagtgtcatgtgacccaga

SEQ ID NO: 723345 - DNA, 25 bp, Mus musculus
gtactaaagtgtgatgtgacccaga

SEQ ID NO: 723346 - DNA, 25 bp, Mus musculus
gtactaaataaaagaccgcatacag

SEQ ID NO: 723347 - DNA, 25 bp, Mus musculus
gtactaaataaatgaccgcatacag

SEQ ID NO: 723348 - DNA, 25 bp, Mus musculus
gtactaaatcaaacatcccgacttg

SEQ ID NO: 723349 - DNA, 25 bp, Mus musculus
gtactaaatcaatcatcccgacttg

SEQ ID NO: 723350 - DNA, 25 bp, Mus musculus
gtactaagactcaaattcagcaggg

SEQ ID NO: 723351 - DNA, 25 bp, Mus musculus
gtactaagactctaattcagcaggg

SEQ ID NO: 723352 - DNA, 25 bp, Mus musculus
gtactacaagccaggcattctgctg

SEQ ID NO: 723353 - DNA, 25 bp, Mus musculus
gtactacaagcctggcattctgctg

SEQ ID NO: 723354 - DNA, 25 bp, Mus musculus
gtactacaatggctcctatccttcc

SEQ ID NO: 723355 - DNA, 25 bp, Mus musculus
gtactacaatgggtcctatccttcc

SEQ ID NO: 723356 - DNA, 25 bp, Mus musculus
gtactacagctgatgttaccaccca

SEQ ID NO: 723357 - DNA, 25 bp, Mus musculus
gtactacagctgttgttaccaccca

SEQ ID NO: 723358 - DNA, 25 bp, Mus musculus
gtactacatcgtcatcctggcctgg

SEQ ID NO: 723359 - DNA, 25 bp, Mus musculus
gtactacatcgtgatcctggcctgg

SEQ ID NO: 723360 - DNA, 25 bp, Mus musculus
gtactaccgcatagctgcctttggc

SEQ ID NO: 723361 - DNA, 25 bp, Mus musculus
gtactaccgcattgctgcctttggc

SEQ ID NO: 723362 - DNA, 25 bp, Mus musculus
gtactacgacggagagctgcaggcc

SEQ ID NO: 723363 - DNA, 25 bp, Mus musculus
gtactacgacggtgagctgcaggcc

SEQ ID NO: 723364 - DNA, 25 bp, Mus musculus
gtactacgttggcttcaccctcttc

SEQ ID NO: 723365 - DNA, 25 bp, Mus musculus
gtactacgttgggttcaccctcttc

SEQ ID NO: 723366 - DNA, 25 bp, Mus musculus
gtactactccagacaaccaccagga

SEQ ID NO: 723367 - DNA, 25 bp, Mus musculus
gtactactccagtcaaccaccagga

SEQ ID NO: 723368 - DNA, 25 bp, Mus musculus
gtactacttgtcctcggcacactcg

SEQ ID NO: 723369 - DNA, 25 bp, Mus musculus
gtactacttgtcgtcggcacactcg

SEQ ID NO: 723370 - DNA, 25 bp, Mus musculus
gtactagcccaaccatcatcaatga

SEQ ID NO: 723371 - DNA, 25 bp, Mus musculus
gtactagcccaagcatcatcaatga

SEQ ID NO: 723372 - DNA, 25 bp, Mus musculus
gtactaggttcaccttttgacatga

SEQ ID NO: 723373 - DNA, 25 bp, Mus musculus
gtactaggttcagcttttgacatga

SEQ ID NO: 723374 - DNA, 25 bp, Mus musculus
gtactataatgacaaactgcttgat

SEQ ID NO: 723375 - DNA, 25 bp, Mus musculus
gtactataatgagaaactgcttgat

SEQ ID NO: 723376 - DNA, 25 bp, Mus musculus
gtactatctgccaagccgggaggga

SEQ ID NO: 723377 - DNA, 25 bp, Mus musculus
gtactatctgcctagccgggaggga

SEQ ID NO: 723378 - DNA, 25 bp, Mus musculus
gtactatgaactcgcccgcaaggaa

SEQ ID NO: 723379 - DNA, 25 bp, Mus musculus
gtactatgaactggcccgcaaggaa

SEQ ID NO: 723380 - DNA, 25 bp, Mus musculus
gtactatgcctacctcacggacaca

SEQ ID NO: 723381 - DNA, 25 bp, Mus musculus
gtactatgcctagctcacggacaca

SEQ ID NO: 723382 - DNA, 25 bp, Mus musculus
gtactcacacataacacgcaaaggg

SEQ ID NO: 723383 - DNA, 25 bp, Mus musculus
gtactcacacattacacgcaaaggg

SEQ ID NO: 723384 - DNA, 25 bp, Mus musculus
gtactcaccgaaatgcaccacactt

SEQ ID NO: 723385 - DNA, 25 bp, Mus musculus
gtactcaccgaattgcaccacactt

SEQ ID NO: 723386 - DNA, 25 bp, Mus musculus
gtactcactgtaacaagcaccgctc

SEQ ID NO: 723387 - DNA, 25 bp, Mus musculus
gtactcactgtatcaagcaccgctc

SEQ ID NO: 723388 - DNA, 25 bp, Mus musculus
gtactcaggagacctcaagtttgag

SEQ ID NO: 723389 - DNA, 25 bp, Mus musculus
gtactcaggagagctcaagtttgag

SEQ ID NO: 723390 - DNA, 25 bp, Mus musculus
gtactcagttcgagtatcacctcag

SEQ ID NO: 723391 - DNA, 25 bp, Mus musculus
gtactcagttcgtgtatcacctcag

SEQ ID NO: 723392 - DNA, 25 bp, Mus musculus
gtactcatggcgctgagacttcctg

SEQ ID NO: 723393 - DNA, 25 bp, Mus musculus
gtactcatggcggtgagacttcctg

SEQ ID NO: 723394 - DNA, 25 bp, Mus musculus
gtactcatgggcacgtgctcggcca

SEQ ID NO: 723395 - DNA, 25 bp, Mus musculus
gtactcatgggctcgtgctcggcca

SEQ ID NO: 723396 - DNA, 25 bp, Mus musculus
gtactccaatggagaaagacttcat

SEQ ID NO: 723397 - DNA, 25 bp, Mus musculus
gtactccaatggtgaaagacttcat

SEQ ID NO: 723398 - DNA, 25 bp, Mus musculus
gtactccaggacatagataaaaaag

SEQ ID NO: 723399 - DNA, 25 bp, Mus musculus
gtactccaggacttagataaaaaag

SEQ ID NO: 723400 - DNA, 25 bp, Mus musculus
gtactccatgcactcatcgcctaag

SEQ ID NO: 723401 - DNA, 25 bp, Mus musculus
gtactccatgcagtcatcgcctaag

SEQ ID NO: 723402 - DNA, 25 bp, Mus musculus
gtactccgagtgatcgctcctaccg

SEQ ID NO: 723403 - DNA, 25 bp, Mus musculus
gtactccgagtgttcgctcctaccg

SEQ ID NO: 723404 - DNA, 25 bp, Mus musculus
gtactcctactacggcctgtctgtg

SEQ ID NO: 723405 - DNA, 25 bp, Mus musculus
gtactcctactagggcctgtctgtg

SEQ ID NO: 723406 - DNA, 25 bp, Mus musculus
gtactcctgagcactaacacataca

SEQ ID NO: 723407 - DNA, 25 bp, Mus musculus
gtactcctgagctctaacacataca

SEQ ID NO: 723408 - DNA, 25 bp, Mus musculus
gtactcgaacaacactgtccacaga

SEQ ID NO: 723409 - DNA, 25 bp, Mus musculus
gtactcgaacaagactgtccacaga

SEQ ID NO: 723410 - DNA, 25 bp, Mus musculus
gtactcgctgccctggtgagccagc

SEQ ID NO: 723411 - DNA, 25 bp, Mus musculus
gtactcgctgccgtggtgagccagc

SEQ ID NO: 723412 - DNA, 25 bp, Mus musculus
gtactcgtcaccacaccaaatttta

SEQ ID NO: 723413 - DNA, 25 bp, Mus musculus
gtactcgtcacctcaccaaatttta

SEQ ID NO: 723414 - DNA, 25 bp, Mus musculus
gtactgaccctgaggcggcggcact

SEQ ID NO: 723415 - DNA, 25 bp, Mus musculus
gtactgaccctgtggcggcggcact

SEQ ID NO: 723416 - DNA, 25 bp, Mus musculus
gtactgagcaatctgatacctaagg

SEQ ID NO: 723417 - DNA, 25 bp, Mus musculus
gtactgagcaatgtgatacctaagg

SEQ ID NO: 723418 - DNA, 25 bp, Mus musculus
gtactgatgaagatgccattatcgg

SEQ ID NO: 723419 - DNA, 25 bp, Mus musculus
gtactgatgaagttgccattatcgg

SEQ ID NO: 723420 - DNA, 25 bp, Mus musculus
gtactgcaagtcagttggctacccc

SEQ ID NO: 723421 - DNA, 25 bp, Mus musculus
gtactgcaagtctgttggctacccc

SEQ ID NO: 723422 - DNA, 25 bp, Mus musculus
gtactgcccaagagcctctaccgta

SEQ ID NO: 723423 - DNA, 25 bp, Mus musculus
gtactgcccaagtgcctctaccgta

SEQ ID NO: 723424 - DNA, 25 bp, Mus musculus
gtactgccgtttacacaagtgcctg

SEQ ID NO: 723425 - DNA, 25 bp, Mus musculus
gtactgccgttttcacaagtgcctg

SEQ ID NO: 723426 - DNA, 25 bp, Mus musculus
gtactgcctgcgcttcaccactagg

SEQ ID NO: 723427 - DNA, 25 bp, Mus musculus
gtactgcctgcggttcaccactagg

SEQ ID NO: 723428 - DNA, 25 bp, Mus musculus
gtactgcggtttccgtgaagacaac

SEQ ID NO: 723429 - DNA, 25 bp, Mus musculus
gtactgcggtttgcgtgaagacaac

SEQ ID NO: 723430 - DNA, 25 bp, Mus musculus
gtactggaaactaactggatgatgc

SEQ ID NO: 723431 - DNA, 25 bp, Mus musculus
gtactggaaacttactggatgatgc

SEQ ID NO: 723432 - DNA, 25 bp, Mus musculus
gtactggaacacaacctggctgcgg

SEQ ID NO: 723433 - DNA, 25 bp, Mus musculus
gtactggaacactacctggctgcgg

SEQ ID NO: 723434 - DNA, 25 bp, Mus musculus
gtactggagatcaactctgcatctg

SEQ ID NO: 723435 - DNA, 25 bp, Mus musculus
gtactggagatctactctgcatctg

SEQ ID NO: 723436 - DNA, 25 bp, Mus musculus
gtactggagctgaaacagtctgaag

SEQ ID NO: 723437 - DNA, 25 bp, Mus musculus
gtactggagctgtaacagtctgaag

SEQ ID NO: 723438 - DNA, 25 bp, Mus musculus
gtactggcagaaacctatgattcag

SEQ ID NO: 723439 - DNA, 25 bp, Mus musculus
gtactggcagaatcctatgattcag

SEQ ID NO: 723440 - DNA, 25 bp, Mus musculus
gtactggcgtctctcgaccctggac

SEQ ID NO: 723441 - DNA, 25 bp, Mus musculus
gtactggcgtctgtcgaccctggac

SEQ ID NO: 723442 - DNA, 25 bp, Mus musculus
gtactgggactcagggaatgtaact

SEQ ID NO: 723443 - DNA, 25 bp, Mus musculus
gtactgggactctgggaatgtaact

SEQ ID NO: 723444 - DNA, 25 bp, Mus musculus
gtactgtcacagcacctgggcaagc

SEQ ID NO: 723445 - DNA, 25 bp, Mus musculus
gtactgtcacaggacctgggcaagc

SEQ ID NO: 723446 - DNA, 25 bp, Mus musculus
gtactgtccaccatctaaaggttgc

SEQ ID NO: 723447 - DNA, 25 bp, Mus musculus
gtactgtccaccttctaaaggttgc

SEQ ID NO: 723448 - DNA, 25 bp, Mus musculus
gtactgtcccctcaagcagcggcat

SEQ ID NO: 723449 - DNA, 25 bp, Mus musculus
gtactgtcccctgaagcagcggcat

SEQ ID NO: 723450 - DNA, 25 bp, Mus musculus
gtactgtctggtagggacaccccga

SEQ ID NO: 723451 - DNA, 25 bp, Mus musculus
gtactgtctggttgggacaccccga

SEQ ID NO: 723452 - DNA, 25 bp, Mus musculus
gtactgtgaccaaattgtccctcag

SEQ ID NO: 723453 - DNA, 25 bp, Mus musculus
gtactgtgaccatattgtccctcag

SEQ ID NO: 723454 - DNA, 25 bp, Mus musculus
gtactgtggcagacattactgtgac

SEQ ID NO: 723455 - DNA, 25 bp, Mus musculus
gtactgtggcagtcattactgtgac

SEQ ID NO: 723456 - DNA, 25 bp, Mus musculus
gtactgtttggcagcacaccatttg

SEQ ID NO: 723457 - DNA, 25 bp, Mus musculus
gtactgtttggctgcacaccatttg

SEQ ID NO: 723458 - DNA, 25 bp, Mus musculus
gtacttaatgccaaaacgagaatcg

SEQ ID NO: 723459 - DNA, 25 bp, Mus musculus
gtacttaatgcctaaacgagaatcg

SEQ ID NO: 723460 - DNA, 25 bp, Mus musculus
gtacttatcatgagcagccacgtcc

SEQ ID NO: 723461 - DNA, 25 bp, Mus musculus
gtacttatcatgtgcagccacgtcc

SEQ ID NO: 723462 - DNA, 25 bp, Mus musculus
gtacttcaactcctgtgacttacag

SEQ ID NO: 723463 - DNA, 25 bp, Mus musculus
gtacttcaactcgtgtgacttacag

SEQ ID NO: 723464 - DNA, 25 bp, Mus musculus
gtacttcagggaaccaggtgcacca

SEQ ID NO: 723465 - DNA, 25 bp, Mus musculus
gtacttcagggatccaggtgcacca

SEQ ID NO: 723466 - DNA, 25 bp, Mus musculus
gtacttccctttcctgtaaacaatg

SEQ ID NO: 723467 - DNA, 25 bp, Mus musculus
gtacttccctttgctgtaaacaatg

SEQ ID NO: 723468 - DNA, 25 bp, Mus musculus
gtacttccggaacctgtgctcagat

SEQ ID NO: 723469 - DNA, 25 bp, Mus musculus
gtacttccggaagctgtgctcagat

SEQ ID NO: 723470 - DNA, 25 bp, Mus musculus
gtacttcctgcaaggcatgggctac

SEQ ID NO: 723471 - DNA, 25 bp, Mus musculus
gtacttcctgcatggcatgggctac

SEQ ID NO: 723472 - DNA, 25 bp, Mus musculus
gtacttcctggaaggaattctcaag

SEQ ID NO: 723473 - DNA, 25 bp, Mus musculus
gtacttcctggatggaattctcaag

SEQ ID NO: 723474 - DNA, 25 bp, Mus musculus
gtacttcgatcaccagcaccctggt

SEQ ID NO: 723475 - DNA, 25 bp, Mus musculus
gtacttcgatcagcagcaccctggt

SEQ ID NO: 723476 - DNA, 25 bp, Mus musculus
gtacttcgtgcacctgtgcagcgct

SEQ ID NO: 723477 - DNA, 25 bp, Mus musculus
gtacttcgtgcagctgtgcagcgct

SEQ ID NO: 723478 - DNA, 25 bp, Mus musculus
gtacttgccccaccattaagaaggg

SEQ ID NO: 723479 - DNA, 25 bp, Mus musculus
gtacttgccccagcattaagaaggg

SEQ ID NO: 723480 - DNA, 25 bp, Mus musculus
gtacttggcactcctcttctgaggg

SEQ ID NO: 723481 - DNA, 25 bp, Mus musculus
gtacttggcactgctcttctgaggg

SEQ ID NO: 723482 - DNA, 25 bp, Mus musculus
gtactttattggactgaggcacaca

SEQ ID NO: 723483 - DNA, 25 bp, Mus musculus
gtactttattggtctgaggcacaca

SEQ ID NO: 723484 - DNA, 25 bp, Mus musculus
gtactttccaggcactcctgtgaag

SEQ ID NO: 723485 - DNA, 25 bp, Mus musculus
gtactttccagggactcctgtgaag

SEQ ID NO: 723486 - DNA, 25 bp, Mus musculus
gtactttgagacagtgtcagacgtg

SEQ ID NO: 723487 - DNA, 25 bp, Mus musculus
gtactttgagactgtgtcagacgtg

SEQ ID NO: 723488 - DNA, 25 bp, Mus musculus
gtactttgccccagatttcacactc

SEQ ID NO: 723489 - DNA, 25 bp, Mus musculus
gtactttgcccctgatttcacactc

SEQ ID NO: 723490 - DNA, 25 bp, Mus musculus
gtactttggcggagtttcagcgctc

SEQ ID NO: 723491 - DNA, 25 bp, Mus musculus
gtactttggcggtgtttcagcgctc

SEQ ID NO: 723492 - DNA, 25 bp, Mus musculus
gtacttttatgaccaatgtccagca

SEQ ID NO: 723493 - DNA, 25 bp, Mus musculus
gtacttttatgagcaatgtccagca

SEQ ID NO: 723494 - DNA, 25 bp, Mus musculus
gtacttttgaggacagcatatctgt

SEQ ID NO: 723495 - DNA, 25 bp, Mus musculus
gtacttttgaggtcagcatatctgt

SEQ ID NO: 723496 - DNA, 25 bp, Mus musculus
gtactttttgcacggaatgggctac

SEQ ID NO: 723497 - DNA, 25 bp, Mus musculus
gtactttttgcagggaatgggctac

SEQ ID NO: 723498 - DNA, 25 bp, Mus musculus
gtagaaaaggtgcagtcccctgcca

SEQ ID NO: 723499 - DNA, 25 bp, Mus musculus
gtagaaaaggtggagtcccctgcca

SEQ ID NO: 723500 - DNA, 25 bp, Mus musculus
gtagaaacctttccccaccttatag

SEQ ID NO: 723501 - DNA, 25 bp, Mus musculus
gtagaaacctttgcccaccttatag

SEQ ID NO: 723502 - DNA, 25 bp, Mus musculus
gtagaaagtcccacaaggttgacgt

SEQ ID NO: 723503 - DNA, 25 bp, Mus musculus
gtagaaagtccctcaaggttgacgt

SEQ ID NO: 723504 - DNA, 25 bp, Mus musculus
gtagaacaaggtaaatcaagatgaa

SEQ ID NO: 723505 - DNA, 25 bp, Mus musculus
gtagaacaaggttaatcaagatgaa

SEQ ID NO: 723506 - DNA, 25 bp, Mus musculus
gtagaaccccagagccctcatctgg

SEQ ID NO: 723507 - DNA, 25 bp, Mus musculus
gtagaaccccagtgccctcatctgg

SEQ ID NO: 723508 - DNA, 25 bp, Mus musculus
gtagaacccgctccggctgctggaa

SEQ ID NO: 723509 - DNA, 25 bp, Mus musculus
gtagaacccgctgcggctgctggaa

SEQ ID NO: 723510 - DNA, 25 bp, Mus musculus
gtagaacccggtagtcagatctgct

SEQ ID NO: 723511 - DNA, 25 bp, Mus musculus
gtagaacccggttgtcagatctgct

SEQ ID NO: 723512 - DNA, 25 bp, Mus musculus
gtagaacctccacctgactccagga

SEQ ID NO: 723513 - DNA, 25 bp, Mus musculus
gtagaacctccagctgactccagga

SEQ ID NO: 723514 - DNA, 25 bp, Mus musculus
gtagaactaactcagatggaccatc

SEQ ID NO: 723515 - DNA, 25 bp, Mus musculus
gtagaactaactgagatggaccatc

SEQ ID NO: 723516 - DNA, 25 bp, Mus musculus
gtagaactagacctgggagtttcca

SEQ ID NO: 723517 - DNA, 25 bp, Mus musculus
gtagaactagacgtgggagtttcca

SEQ ID NO: 723518 - DNA, 25 bp, Mus musculus
gtagaactcagtcgctaccaaacaa

SEQ ID NO: 723519 - DNA, 25 bp, Mus musculus
gtagaactcagtggctaccaaacaa

SEQ ID NO: 723520 - DNA, 25 bp, Mus musculus
gtagaactgtctctgaggaaaaacc

SEQ ID NO: 723521 - DNA, 25 bp, Mus musculus
gtagaactgtctgtgaggaaaaacc

SEQ ID NO: 723522 - DNA, 25 bp, Mus musculus
gtagaagaaaaaagcccctgactcg

SEQ ID NO: 723523 - DNA, 25 bp, Mus musculus
gtagaagaaaaatgcccctgactcg

SEQ ID NO: 723524 - DNA, 25 bp, Mus musculus
gtagaagaagaacggatacacagtt

SEQ ID NO: 723525 - DNA, 25 bp, Mus musculus
gtagaagaagaagggatacacagtt

SEQ ID NO: 723526 - DNA, 25 bp, Mus musculus
gtagaagatcctatcacgggaaggc

SEQ ID NO: 723527 - DNA, 25 bp, Mus musculus
gtagaagatcctttcacgggaaggc

SEQ ID NO: 723528 - DNA, 25 bp, Mus musculus
gtagaatcatcacgccttcccagca

SEQ ID NO: 723529 - DNA, 25 bp, Mus musculus
gtagaatcatcaggccttcccagca

SEQ ID NO: 723530 - DNA, 25 bp, Mus musculus
gtagaattcgttacccgcgtcccag

SEQ ID NO: 723531 - DNA, 25 bp, Mus musculus
gtagaattcgtttcccgcgtcccag

SEQ ID NO: 723532 - DNA, 25 bp, Mus musculus
gtagaattgctacttccacaacctg

SEQ ID NO: 723533 - DNA, 25 bp, Mus musculus
gtagaattgctagttccacaacctg

SEQ ID NO: 723534 - DNA, 25 bp, Mus musculus
gtagaattttccagtgttgtgcttg

SEQ ID NO: 723535 - DNA, 25 bp, Mus musculus
gtagaattttcctgtgttgtgcttg

SEQ ID NO: 723536 - DNA, 25 bp, Mus musculus
gtagacaacccgctcctggagcgat

SEQ ID NO: 723537 - DNA, 25 bp, Mus musculus
gtagacaacccggtcctggagcgat

SEQ ID NO: 723538 - DNA, 25 bp, Mus musculus
gtagacacaagaatatactgacagc

SEQ ID NO: 723539 - DNA, 25 bp, Mus musculus
gtagacacaagattatactgacagc

SEQ ID NO: 723540 - DNA, 25 bp, Mus musculus
gtagacagtgaactagagctacccc

SEQ ID NO: 723541 - DNA, 25 bp, Mus musculus
gtagacagtgaagtagagctacccc

SEQ ID NO: 723542 - DNA, 25 bp, Mus musculus
gtagacattggcacatttgccccag

SEQ ID NO: 723543 - DNA, 25 bp, Mus musculus
gtagacattggctcatttgccccag

SEQ ID NO: 723544 - DNA, 25 bp, Mus musculus
gtagaccagtcacctttgtagccag

SEQ ID NO: 723545 - DNA, 25 bp, Mus musculus
gtagaccagtcagctttgtagccag

SEQ ID NO: 723546 - DNA, 25 bp, Mus musculus
gtagaccagttaacacttccccaag

SEQ ID NO: 723547 - DNA, 25 bp, Mus musculus
gtagaccagttatcacttccccaag

SEQ ID NO: 723548 - DNA, 25 bp, Mus musculus
gtagaccctcttcactatttctgtt

SEQ ID NO: 723549 - DNA, 25 bp, Mus musculus
gtagaccctcttgactatttctgtt

SEQ ID NO: 723550 - DNA, 25 bp, Mus musculus
gtagacccttctagaaccctctagg

SEQ ID NO: 723551 - DNA, 25 bp, Mus musculus
gtagacccttcttgaaccctctagg

SEQ ID NO: 723552 - DNA, 25 bp, Mus musculus
gtagacctggacaagtaccaccaca

SEQ ID NO: 723553 - DNA, 25 bp, Mus musculus
gtagacctggactagtaccaccaca

SEQ ID NO: 723554 - DNA, 25 bp, Mus musculus
gtagacctgggcacgctggcttacc

SEQ ID NO: 723555 - DNA, 25 bp, Mus musculus
gtagacctgggctcgctggcttacc

SEQ ID NO: 723556 - DNA, 25 bp, Mus musculus
gtagacggccctagctcactgcctg

SEQ ID NO: 723557 - DNA, 25 bp, Mus musculus
gtagacggcccttgctcactgcctg

SEQ ID NO: 723558 - DNA, 25 bp, Mus musculus
gtagactatctgagctccctgggca

SEQ ID NO: 723559 - DNA, 25 bp, Mus musculus
gtagactatctgtgctccctgggca

SEQ ID NO: 723560 - DNA, 25 bp, Mus musculus
gtagactctgacattgacattgatg

SEQ ID NO: 723561 - DNA, 25 bp, Mus musculus
gtagactctgactttgacattgatg

SEQ ID NO: 723562 - DNA, 25 bp, Mus musculus
gtagactggcctccacacaagcttg

SEQ ID NO: 723563 - DNA, 25 bp, Mus musculus
gtagactggcctgcacacaagcttg

SEQ ID NO: 723564 - DNA, 25 bp, Mus musculus
gtagacttcgacaacaacttccagt

SEQ ID NO: 723565 - DNA, 25 bp, Mus musculus
gtagacttcgactacaacttccagt

SEQ ID NO: 723566 - DNA, 25 bp, Mus musculus
gtagacttctataatgctgatgagc

SEQ ID NO: 723567 - DNA, 25 bp, Mus musculus
gtagacttctattatgctgatgagc

SEQ ID NO: 723568 - DNA, 25 bp, Mus musculus
gtagacttgtctatctgtcttaggg

SEQ ID NO: 723569 - DNA, 25 bp, Mus musculus
gtagacttgtctttctgtcttaggg

SEQ ID NO: 723570 - DNA, 25 bp, Mus musculus
gtagagaactctccccaacacaagg

SEQ ID NO: 723571 - DNA, 25 bp, Mus musculus
gtagagaactctgcccaacacaagg

SEQ ID NO: 723572 - DNA, 25 bp, Mus musculus
gtagagaggtcaccatgaagaagaa

SEQ ID NO: 723573 - DNA, 25 bp, Mus musculus
gtagagaggtcagcatgaagaagaa

SEQ ID NO: 723574 - DNA, 25 bp, Mus musculus
gtagagagtacaccccatgggttga

SEQ ID NO: 723575 - DNA, 25 bp, Mus musculus
gtagagagtacagcccatgggttga

SEQ ID NO: 723576 - DNA, 25 bp, Mus musculus
gtagagccctcaaaccacactcagt

SEQ ID NO: 723577 - DNA, 25 bp, Mus musculus
gtagagccctcataccacactcagt

SEQ ID NO: 723578 - DNA, 25 bp, Mus musculus
gtagagcctactcggcagaacccgt

SEQ ID NO: 723579 - DNA, 25 bp, Mus musculus
gtagagcctactgggcagaacccgt

SEQ ID NO: 723580 - DNA, 25 bp, Mus musculus
gtagaggagagccactacccagcca

SEQ ID NO: 723581 - DNA, 25 bp, Mus musculus
gtagaggagagcgactacccagcca

SEQ ID NO: 723582 - DNA, 25 bp, Mus musculus
gtagaggagtcacaactgaagcagc

SEQ ID NO: 723583 - DNA, 25 bp, Mus musculus
gtagaggagtcagaactgaagcagc

SEQ ID NO: 723584 - DNA, 25 bp, Mus musculus
gtagagggtctcacagcccagggat

SEQ ID NO: 723585 - DNA, 25 bp, Mus musculus
gtagagggtctctcagcccagggat

SEQ ID NO: 723586 - DNA, 25 bp, Mus musculus
gtagagtacaccatcgaccgcaatg

SEQ ID NO: 723587 - DNA, 25 bp, Mus musculus
gtagagtacaccttcgaccgcaatg

SEQ ID NO: 723588 - DNA, 25 bp, Mus musculus
gtagataaaacaccatatagaggcc

SEQ ID NO: 723589 - DNA, 25 bp, Mus musculus
gtagataaaacagcatatagaggcc

SEQ ID NO: 723590 - DNA, 25 bp, Mus musculus
gtagataaaggaccatggctgtcca

SEQ ID NO: 723591 - DNA, 25 bp, Mus musculus
gtagataaaggagcatggctgtcca

SEQ ID NO: 723592 - DNA, 25 bp, Mus musculus
gtagataagctgcaggacttcatca

SEQ ID NO: 723593 - DNA, 25 bp, Mus musculus
gtagataagctggaggacttcatca

SEQ ID NO: 723594 - DNA, 25 bp, Mus musculus
gtagatcctactattgacaactcag

SEQ ID NO: 723595 - DNA, 25 bp, Mus musculus
gtagatcctacttttgacaactcag

SEQ ID NO: 723596 - DNA, 25 bp, Mus musculus
gtagatgaaatgatcagagaagcag

SEQ ID NO: 723597 - DNA, 25 bp, Mus musculus
gtagatgaaatgttcagagaagcag

SEQ ID NO: 723598 - DNA, 25 bp, Mus musculus
gtagatgatgctaatggcttcctgg

SEQ ID NO: 723599 - DNA, 25 bp, Mus musculus
gtagatgatgcttatggcttcctgg

SEQ ID NO: 723600 - DNA, 25 bp, Mus musculus
gtagatgccaccctgagtcggctgc

SEQ ID NO: 723601 - DNA, 25 bp, Mus musculus
gtagatgccaccgtgagtcggctgc

SEQ ID NO: 723602 - DNA, 25 bp, Mus musculus
gtagatgctgtgcaacaaaaccagg

SEQ ID NO: 723603 - DNA, 25 bp, Mus musculus
gtagatgctgtggaacaaaaccagg

SEQ ID NO: 723604 - DNA, 25 bp, Mus musculus
gtagatggctccctaatttccagga

SEQ ID NO: 723605 - DNA, 25 bp, Mus musculus
gtagatggctccgtaatttccagga

SEQ ID NO: 723606 - DNA, 25 bp, Mus musculus
gtagatggcttcactgacccctcca

SEQ ID NO: 723607 - DNA, 25 bp, Mus musculus
gtagatggcttctctgacccctcca

SEQ ID NO: 723608 - DNA, 25 bp, Mus musculus
gtagattcctcacccatcatctggg

SEQ ID NO: 723609 - DNA, 25 bp, Mus musculus
gtagattcctcagccatcatctggg

SEQ ID NO: 723610 - DNA, 25 bp, Mus musculus
gtagattggcaaaatataggacact

SEQ ID NO: 723611 - DNA, 25 bp, Mus musculus
gtagattggcaatatataggacact

SEQ ID NO: 723612 - DNA, 25 bp, Mus musculus
gtagatttcttcacagtccctcctg

SEQ ID NO: 723613 - DNA, 25 bp, Mus musculus
gtagatttcttctcagtccctcctg

SEQ ID NO: 723614 - DNA, 25 bp, Mus musculus
gtagcaaaggagagcagcatatatc

SEQ ID NO: 723615 - DNA, 25 bp, Mus musculus
gtagcaaaggagtgcagcatatatc

SEQ ID NO: 723616 - DNA, 25 bp, Mus musculus
gtagcaactgaacaactgctggaga

SEQ ID NO: 723617 - DNA, 25 bp, Mus musculus
gtagcaactgaagaactgctggaga

SEQ ID NO: 723618 - DNA, 25 bp, Mus musculus
gtagcaattctgaaacgccaactag

SEQ ID NO: 723619 - DNA, 25 bp, Mus musculus
gtagcaattctgtaacgccaactag

SEQ ID NO: 723620 - DNA, 25 bp, Mus musculus
gtagcacaagacaagctcaattctg

SEQ ID NO: 723621 - DNA, 25 bp, Mus musculus
gtagcacaagactagctcaattctg

SEQ ID NO: 723622 - DNA, 25 bp, Mus musculus
gtagcacatactaaatgcacatgtg

SEQ ID NO: 723623 - DNA, 25 bp, Mus musculus
gtagcacatacttaatgcacatgtg

SEQ ID NO: 723624 - DNA, 25 bp, Mus musculus
gtagcacattgtcccaacggagaag

SEQ ID NO: 723625 - DNA, 25 bp, Mus musculus
gtagcacattgtgccaacggagaag

SEQ ID NO: 723626 - DNA, 25 bp, Mus musculus
gtagcaccatggcaaccttccaaaa

SEQ ID NO: 723627 - DNA, 25 bp, Mus musculus
gtagcaccatgggaaccttccaaaa

SEQ ID NO: 723628 - DNA, 25 bp, Mus musculus
gtagcacccgccaggtcaactggtc

SEQ ID NO: 723629 - DNA, 25 bp, Mus musculus
gtagcacccgcctggtcaactggtc

SEQ ID NO: 723630 - DNA, 25 bp, Mus musculus
gtagcaccttcccaagtggacagta

SEQ ID NO: 723631 - DNA, 25 bp, Mus musculus
gtagcaccttccgaagtggacagta

SEQ ID NO: 723632 - DNA, 25 bp, Mus musculus
gtagcacgggctattaatcagaagc

SEQ ID NO: 723633 - DNA, 25 bp, Mus musculus
gtagcacgggcttttaatcagaagc

SEQ ID NO: 723634 - DNA, 25 bp, Mus musculus
gtagcacttgccaagaaggctccag

SEQ ID NO: 723635 - DNA, 25 bp, Mus musculus
gtagcacttgcctagaaggctccag

SEQ ID NO: 723636 - DNA, 25 bp, Mus musculus
gtagcagcaagaacctcgaccatgg

SEQ ID NO: 723637 - DNA, 25 bp, Mus musculus
gtagcagcaagatcctcgaccatgg

SEQ ID NO: 723638 - DNA, 25 bp, Mus musculus
gtagcagcagtaaaacgtcctcagt

SEQ ID NO: 723639 - DNA, 25 bp, Mus musculus
gtagcagcagtataacgtcctcagt

SEQ ID NO: 723640 - DNA, 25 bp, Mus musculus
gtagcagcatgaagcgcgtccagac

SEQ ID NO: 723641 - DNA, 25 bp, Mus musculus
gtagcagcatgatgcgcgtccagac

SEQ ID NO: 723642 - DNA, 25 bp, Mus musculus
gtagcagtcggtacccagaccaatg

SEQ ID NO: 723643 - DNA, 25 bp, Mus musculus
gtagcagtcggttcccagaccaatg

SEQ ID NO: 723644 - DNA, 25 bp, Mus musculus
gtagcagttctaaactgcttcctga

SEQ ID NO: 723645 - DNA, 25 bp, Mus musculus
gtagcagttctatactgcttcctga

SEQ ID NO: 723646 - DNA, 25 bp, Mus musculus
gtagcatagaacagccaaaggcaag

SEQ ID NO: 723647 - DNA, 25 bp, Mus musculus
gtagcatagaactgccaaaggcaag

SEQ ID NO: 723648 - DNA, 25 bp, Mus musculus
gtagcatgtcagactccctagtggc

SEQ ID NO: 723649 - DNA, 25 bp, Mus musculus
gtagcatgtcagtctccctagtggc

SEQ ID NO: 723650 - DNA, 25 bp, Mus musculus
gtagcattgccaagacttacacaga

SEQ ID NO: 723651 - DNA, 25 bp, Mus musculus
gtagcattgccatgacttacacaga

SEQ ID NO: 723652 - DNA, 25 bp, Mus musculus
gtagccaaacataccaaaccccagg

SEQ ID NO: 723653 - DNA, 25 bp, Mus musculus
gtagccaaacattccaaaccccagg

SEQ ID NO: 723654 - DNA, 25 bp, Mus musculus
gtagccaagaatctcatcatgttcc

SEQ ID NO: 723655 - DNA, 25 bp, Mus musculus
gtagccaagaatgtcatcatgttcc

SEQ ID NO: 723656 - DNA, 25 bp, Mus musculus
gtagccaagtacatctgaaccattt

SEQ ID NO: 723657 - DNA, 25 bp, Mus musculus
gtagccaagtacttctgaaccattt

SEQ ID NO: 723658 - DNA, 25 bp, Mus musculus
gtagccaatgagactcatggtcatg

SEQ ID NO: 723659 - DNA, 25 bp, Mus musculus
gtagccaatgagtctcatggtcatg

SEQ ID NO: 723660 - DNA, 25 bp, Mus musculus
gtagccaccgctccgctgtgaacaa

SEQ ID NO: 723661 - DNA, 25 bp, Mus musculus
gtagccaccgctgcgctgtgaacaa

SEQ ID NO: 723662 - DNA, 25 bp, Mus musculus
gtagccactgctatgaccactgagg

SEQ ID NO: 723663 - DNA, 25 bp, Mus musculus
gtagccactgctttgaccactgagg

SEQ ID NO: 723664 - DNA, 25 bp, Mus musculus
gtagccagcggtcttggcaacacgc

SEQ ID NO: 723665 - DNA, 25 bp, Mus musculus
gtagccagcggtgttggcaacacgc

SEQ ID NO: 723666 - DNA, 25 bp, Mus musculus
gtagccagctcaccgctggtctctt

SEQ ID NO: 723667 - DNA, 25 bp, Mus musculus
gtagccagctcagcgctggtctctt

SEQ ID NO: 723668 - DNA, 25 bp, Mus musculus
gtagccagtgatcagatcgcccagc

SEQ ID NO: 723669 - DNA, 25 bp, Mus musculus
gtagccagtgatgagatcgcccagc

SEQ ID NO: 723670 - DNA, 25 bp, Mus musculus
gtagccatcgacctcaccaacaaag

SEQ ID NO: 723671 - DNA, 25 bp, Mus musculus
gtagccatcgacgtcaccaacaaag

SEQ ID NO: 723672 - DNA, 25 bp, Mus musculus
gtagcccaactacaagacaacagta

SEQ ID NO: 723673 - DNA, 25 bp, Mus musculus
gtagcccaactagaagacaacagta

SEQ ID NO: 723674 - DNA, 25 bp, Mus musculus
gtagcccaccagaaggagctccagt

SEQ ID NO: 723675 - DNA, 25 bp, Mus musculus
gtagcccaccagtaggagctccagt

SEQ ID NO: 723676 - DNA, 25 bp, Mus musculus
gtagcccaggccagcccgggatagt

SEQ ID NO: 723677 - DNA, 25 bp, Mus musculus
gtagcccaggcctgcccgggatagt

SEQ ID NO: 723678 - DNA, 25 bp, Mus musculus
gtagcccctggaactttgccttcac

SEQ ID NO: 723679 - DNA, 25 bp, Mus musculus
gtagcccctggatctttgccttcac

SEQ ID NO: 723680 - DNA, 25 bp, Mus musculus
gtagccctgagtacccacagccata

SEQ ID NO: 723681 - DNA, 25 bp, Mus musculus
gtagccctgagttcccacagccata

SEQ ID NO: 723682 - DNA, 25 bp, Mus musculus
gtagccctgccactcgaagtcacat

SEQ ID NO: 723683 - DNA, 25 bp, Mus musculus
gtagccctgccagtcgaagtcacat

SEQ ID NO: 723684 - DNA, 25 bp, Mus musculus
gtagcctcagctccaactgccaatg

SEQ ID NO: 723685 - DNA, 25 bp, Mus musculus
gtagcctcagctgcaactgccaatg

SEQ ID NO: 723686 - DNA, 25 bp, Mus musculus
gtagcctctaaaccccaggatccta

SEQ ID NO: 723687 - DNA, 25 bp, Mus musculus
gtagcctctaaagcccaggatccta

SEQ ID NO: 723688 - DNA, 25 bp, Mus musculus
gtagcctggatgactgggccataac

SEQ ID NO: 723689 - DNA, 25 bp, Mus musculus
gtagcctggatgtctgggccataac

SEQ ID NO: 723690 - DNA, 25 bp, Mus musculus
gtagcctggctgcaacggtccatgc

SEQ ID NO: 723691 - DNA, 25 bp, Mus musculus
gtagcctggctggaacggtccatgc

SEQ ID NO: 723692 - DNA, 25 bp, Mus musculus
gtagctacatgccttgtgcccctag

SEQ ID NO: 723693 - DNA, 25 bp, Mus musculus
gtagctacatgcgttgtgcccctag

SEQ ID NO: 723694 - DNA, 25 bp, Mus musculus
gtagctatccgacaggcctatgaag

SEQ ID NO: 723695 - DNA, 25 bp, Mus musculus
gtagctatccgagaggcctatgaag

SEQ ID NO: 723696 - DNA, 25 bp, Mus musculus
gtagctattatgattccaacccaag

SEQ ID NO: 723697 - DNA, 25 bp, Mus musculus
gtagctattatgtttccaacccaag

SEQ ID NO: 723698 - DNA, 25 bp, Mus musculus
gtagctcacagtaagcacctaagga

SEQ ID NO: 723699 - DNA, 25 bp, Mus musculus
gtagctcacagttagcacctaagga

SEQ ID NO: 723700 - DNA, 25 bp, Mus musculus
gtagctctgcggagtagaaaagaaa

SEQ ID NO: 723701 - DNA, 25 bp, Mus musculus
gtagctctgcggtgtagaaaagaaa

SEQ ID NO: 723702 - DNA, 25 bp, Mus musculus
gtagctcttcgcagggcaaaaagaa

SEQ ID NO: 723703 - DNA, 25 bp, Mus musculus
gtagctcttcgctgggcaaaaagaa

SEQ ID NO: 723704 - DNA, 25 bp, Mus musculus
gtagctgacaacagtccccgggtgc

SEQ ID NO: 723705 - DNA, 25 bp, Mus musculus
gtagctgacaactgtccccgggtgc

SEQ ID NO: 723706 - DNA, 25 bp, Mus musculus
gtagctgccactcccggggaagtaa

SEQ ID NO: 723707 - DNA, 25 bp, Mus musculus
gtagctgccactgccggggaagtaa

SEQ ID NO: 723708 - DNA, 25 bp, Mus musculus
gtagctgccccgacgcgtggcttct

SEQ ID NO: 723709 - DNA, 25 bp, Mus musculus
gtagctgccccgtcgcgtggcttct

SEQ ID NO: 723710 - DNA, 25 bp, Mus musculus
gtagctgtgaagatcatcgacaaga

SEQ ID NO: 723711 - DNA, 25 bp, Mus musculus
gtagctgtgaagttcatcgacaaga

SEQ ID NO: 723712 - DNA, 25 bp, Mus musculus
gtagcttatgtgctgttccagaagc

SEQ ID NO: 723713 - DNA, 25 bp, Mus musculus
gtagcttatgtggtgttccagaagc

SEQ ID NO: 723714 - DNA, 25 bp, Mus musculus
gtagcttcactaccggcggcatttt

SEQ ID NO: 723715 - DNA, 25 bp, Mus musculus
gtagcttcactagcggcggcatttt

SEQ ID NO: 723716 - DNA, 25 bp, Mus musculus
gtagcttcttcacatcgcccttggg

SEQ ID NO: 723717 - DNA, 25 bp, Mus musculus
gtagcttcttcagatcgcccttggg

SEQ ID NO: 723718 - DNA, 25 bp, Mus musculus
gtagcttggcttctagtggaaaaaa

SEQ ID NO: 723719 - DNA, 25 bp, Mus musculus
gtagcttggcttgtagtggaaaaaa

SEQ ID NO: 723720 - DNA, 25 bp, Mus musculus
gtagctttagtacactcaggaaaag

SEQ ID NO: 723721 - DNA, 25 bp, Mus musculus
gtagctttagtagactcaggaaaag

SEQ ID NO: 723722 - DNA, 25 bp, Mus musculus
gtagctttatggcacctgcgtaatc

SEQ ID NO: 723723 - DNA, 25 bp, Mus musculus
gtagctttatgggacctgcgtaatc

SEQ ID NO: 723724 - DNA, 25 bp, Mus musculus
gtagctttcagcaagcgccatgcct

SEQ ID NO: 723725 - DNA, 25 bp, Mus musculus
gtagctttcagctagcgccatgcct

SEQ ID NO: 723726 - DNA, 25 bp, Mus musculus
gtagctttggcactttgcgtttctg

SEQ ID NO: 723727 - DNA, 25 bp, Mus musculus
gtagctttggcagtttgcgtttctg

SEQ ID NO: 723728 - DNA, 25 bp, Mus musculus
gtaggacagtccacatcaagtgccc

SEQ ID NO: 723729 - DNA, 25 bp, Mus musculus
gtaggacagtcctcatcaagtgccc

SEQ ID NO: 723730 - DNA, 25 bp, Mus musculus
gtaggaccacagcataaagttagtt

SEQ ID NO: 723731 - DNA, 25 bp, Mus musculus
gtaggaccacaggataaagttagtt

SEQ ID NO: 723732 - DNA, 25 bp, Mus musculus
gtaggaccagaacggtctccaggca

SEQ ID NO: 723733 - DNA, 25 bp, Mus musculus
gtaggaccagaagggtctccaggca

SEQ ID NO: 723734 - DNA, 25 bp, Mus musculus
gtaggagacaaacgcactcagctgt

SEQ ID NO: 723735 - DNA, 25 bp, Mus musculus
gtaggagacaaaggcactcagctgt

SEQ ID NO: 723736 - DNA, 25 bp, Mus musculus
gtaggatatcaaatcttaaagatgc

SEQ ID NO: 723737 - DNA, 25 bp, Mus musculus
gtaggatatcaattcttaaagatgc

SEQ ID NO: 723738 - DNA, 25 bp, Mus musculus
gtaggatcccagatcattgacagtc

SEQ ID NO: 723739 - DNA, 25 bp, Mus musculus
gtaggatcccagttcattgacagtc

SEQ ID NO: 723740 - DNA, 25 bp, Mus musculus
gtaggcaagactcgttccctcttca

SEQ ID NO: 723741 - DNA, 25 bp, Mus musculus
gtaggcaagactggttccctcttca

SEQ ID NO: 723742 - DNA, 25 bp, Mus musculus
gtaggcagcgttattccagaccctg

SEQ ID NO: 723743 - DNA, 25 bp, Mus musculus
gtaggcagcgtttttccagaccctg

SEQ ID NO: 723744 - DNA, 25 bp, Mus musculus
gtaggctccattaaggagagatatg

SEQ ID NO: 723745 - DNA, 25 bp, Mus musculus
gtaggctccatttaggagagatatg

SEQ ID NO: 723746 - DNA, 25 bp, Mus musculus
gtaggctgcccactaacaccaggtt

SEQ ID NO: 723747 - DNA, 25 bp, Mus musculus
gtaggctgcccagtaacaccaggtt

SEQ ID NO: 723748 - DNA, 25 bp, Mus musculus
gtagggacagcaagttcagggctac

SEQ ID NO: 723749 - DNA, 25 bp, Mus musculus
gtagggacagcatgttcagggctac

SEQ ID NO: 723750 - DNA, 25 bp, Mus musculus
gtagggagatgcatgctgcagctct

SEQ ID NO: 723751 - DNA, 25 bp, Mus musculus
gtagggagatgcttgctgcagctct

SEQ ID NO: 723752 - DNA, 25 bp, Mus musculus
gtagggatagctcgagccttgttca

SEQ ID NO: 723753 - DNA, 25 bp, Mus musculus
gtagggatagctggagccttgttca

SEQ ID NO: 723754 - DNA, 25 bp, Mus musculus
gtagggatccccagcagtaacactt

SEQ ID NO: 723755 - DNA, 25 bp, Mus musculus
gtagggatcccctgcagtaacactt

SEQ ID NO: 723756 - DNA, 25 bp, Mus musculus
gtagggatcccgagcctgtcaaaga

SEQ ID NO: 723757 - DNA, 25 bp, Mus musculus
gtagggatcccgtgcctgtcaaaga

SEQ ID NO: 723758 - DNA, 25 bp, Mus musculus
gtagggtgtgcaccctcatcccttg

SEQ ID NO: 723759 - DNA, 25 bp, Mus musculus
gtagggtgtgcagcctcatcccttg

SEQ ID NO: 723760 - DNA, 25 bp, Mus musculus
gtagggttagcccaatgctccccag

SEQ ID NO: 723761 - DNA, 25 bp, Mus musculus
gtagggttagccgaatgctccccag

SEQ ID NO: 723762 - DNA, 25 bp, Mus musculus
gtaggtcccagacaggctcctgagt

SEQ ID NO: 723763 - DNA, 25 bp, Mus musculus
gtaggtcccagagaggctcctgagt

SEQ ID NO: 723764 - DNA, 25 bp, Mus musculus
gtaggtgaagctacgggccccaccg

SEQ ID NO: 723765 - DNA, 25 bp, Mus musculus
gtaggtgaagcttcgggccccaccg

SEQ ID NO: 723766 - DNA, 25 bp, Mus musculus
gtaggtgacatgatctcacagcagc

SEQ ID NO: 723767 - DNA, 25 bp, Mus musculus
gtaggtgacatgttctcacagcagc

SEQ ID NO: 723768 - DNA, 25 bp, Mus musculus
gtaggtgccatgacctggtcccctc

SEQ ID NO: 723769 - DNA, 25 bp, Mus musculus
gtaggtgccatgtcctggtcccctc

SEQ ID NO: 723770 - DNA, 25 bp, Mus musculus
gtaggtgcttctaagccccgggcct

SEQ ID NO: 723771 - DNA, 25 bp, Mus musculus
gtaggtgcttcttagccccgggcct

SEQ ID NO: 723772 - DNA, 25 bp, Mus musculus
gtaggttcagtgaccgctctctctg

SEQ ID NO: 723773 - DNA, 25 bp, Mus musculus
gtaggttcagtgtccgctctctctg

SEQ ID NO: 723774 - DNA, 25 bp, Mus musculus
gtagtaaagatcacagacttcggca

SEQ ID NO: 723775 - DNA, 25 bp, Mus musculus
gtagtaaagatctcagacttcggca

SEQ ID NO: 723776 - DNA, 25 bp, Mus musculus
gtagtaaccctgcagagtcatcccg

SEQ ID NO: 723777 - DNA, 25 bp, Mus musculus
gtagtaaccctggagagtcatcccg

SEQ ID NO: 723778 - DNA, 25 bp, Mus musculus
gtagtacaggacctggccagtgccc

SEQ ID NO: 723779 - DNA, 25 bp, Mus musculus
gtagtacaggacgtggccagtgccc

SEQ ID NO: 723780 - DNA, 25 bp, Mus musculus
gtagtacatatcatccaagccaggg

SEQ ID NO: 723781 - DNA, 25 bp, Mus musculus
gtagtacatatcttccaagccaggg

SEQ ID NO: 723782 - DNA, 25 bp, Mus musculus
gtagtaccgttgacagcacacagcg

SEQ ID NO: 723783 - DNA, 25 bp, Mus musculus
gtagtaccgttgtcagcacacagcg

SEQ ID NO: 723784 - DNA, 25 bp, Mus musculus
gtagtagagctcacctggctgaaga

SEQ ID NO: 723785 - DNA, 25 bp, Mus musculus
gtagtagagctctcctggctgaaga

SEQ ID NO: 723786 - DNA, 25 bp, Mus musculus
gtagtcaaaggccagccctcgcctt

SEQ ID NO: 723787 - DNA, 25 bp, Mus musculus
gtagtcaaaggcgagccctcgcctt

SEQ ID NO: 723788 - DNA, 25 bp, Mus musculus
gtagtcagccgtaacaagctcacgc

SEQ ID NO: 723789 - DNA, 25 bp, Mus musculus
gtagtcagccgttacaagctcacgc

SEQ ID NO: 723790 - DNA, 25 bp, Mus musculus
gtagtcagtactcgcgctttgagga

SEQ ID NO: 723791 - DNA, 25 bp, Mus musculus
gtagtcagtactggcgctttgagga

SEQ ID NO: 723792 - DNA, 25 bp, Mus musculus
gtagtccatacgacatcggccggct

SEQ ID NO: 723793 - DNA, 25 bp, Mus musculus
gtagtccatacgtcatcggccggct

SEQ ID NO: 723794 - DNA, 25 bp, Mus musculus
gtagtcggatcacccgccgccatgg

SEQ ID NO: 723795 - DNA, 25 bp, Mus musculus
gtagtcggatcagccgccgccatgg

SEQ ID NO: 723796 - DNA, 25 bp, Mus musculus
gtagtctagagcctttctccgcacc

SEQ ID NO: 723797 - DNA, 25 bp, Mus musculus
gtagtctagagcgtttctccgcacc

SEQ ID NO: 723798 - DNA, 25 bp, Mus musculus
gtagtctcaaccaagaagatttttt

SEQ ID NO: 723799 - DNA, 25 bp, Mus musculus
gtagtctcaacctagaagatttttt

SEQ ID NO: 723800 - DNA, 25 bp, Mus musculus
gtagtctctatgacccgcagagggc

SEQ ID NO: 723801 - DNA, 25 bp, Mus musculus
gtagtctctatgtcccgcagagggc

SEQ ID NO: 723802 - DNA, 25 bp, Mus musculus
gtagtctgcagaaactaggttttca

SEQ ID NO: 723803 - DNA, 25 bp, Mus musculus
gtagtctgcagatactaggttttca

SEQ ID NO: 723804 - DNA, 25 bp, Mus musculus
gtagtgaacagactccggcgctacc

SEQ ID NO: 723805 - DNA, 25 bp, Mus musculus
gtagtgaacagagtccggcgctacc

SEQ ID NO: 723806 - DNA, 25 bp, Mus musculus
gtagtgacgactcaagatatgcctt

SEQ ID NO: 723807 - DNA, 25 bp, Mus musculus
gtagtgacgactgaagatatgcctt

SEQ ID NO: 723808 - DNA, 25 bp, Mus musculus
gtagtgagctacctgatatgtgtgc

SEQ ID NO: 723809 - DNA, 25 bp, Mus musculus
gtagtgagctacgtgatatgtgtgc

SEQ ID NO: 723810 - DNA, 25 bp, Mus musculus
gtagtgatgaccctgatcagatcag

SEQ ID NO: 723811 - DNA, 25 bp, Mus musculus
gtagtgatgaccgtgatcagatcag

SEQ ID NO: 723812 - DNA, 25 bp, Mus musculus
gtagtgcaaggtacggttctgttcc

SEQ ID NO: 723813 - DNA, 25 bp, Mus musculus
gtagtgcaaggttcggttctgttcc

SEQ ID NO: 723814 - DNA, 25 bp, Mus musculus
gtagtgcctggaagttcgaaaccct

SEQ ID NO: 723815 - DNA, 25 bp, Mus musculus
gtagtgcctggatgttcgaaaccct

SEQ ID NO: 723816 - DNA, 25 bp, Mus musculus
gtagtgctcaaccagctgcgctact

SEQ ID NO: 723817 - DNA, 25 bp, Mus musculus
gtagtgctcaacgagctgcgctact

SEQ ID NO: 723818 - DNA, 25 bp, Mus musculus
gtagtggagccaatacttaaaccca

SEQ ID NO: 723819 - DNA, 25 bp, Mus musculus
gtagtggagccattacttaaaccca

SEQ ID NO: 723820 - DNA, 25 bp, Mus musculus
gtagtggcctcacctcctcatctgt

SEQ ID NO: 723821 - DNA, 25 bp, Mus musculus
gtagtggcctcagctcctcatctgt

SEQ ID NO: 723822 - DNA, 25 bp, Mus musculus
gtagtggcctggctgtcgcaacaca

SEQ ID NO: 723823 - DNA, 25 bp, Mus musculus
gtagtggcctgggtgtcgcaacaca

SEQ ID NO: 723824 - DNA, 25 bp, Mus musculus
gtagtggcttccaatgaggagacca

SEQ ID NO: 723825 - DNA, 25 bp, Mus musculus
gtagtggcttcctatgaggagacca

SEQ ID NO: 723826 - DNA, 25 bp, Mus musculus
gtagtggtccaacgccggctctgac

SEQ ID NO: 723827 - DNA, 25 bp, Mus musculus
gtagtggtccaaggccggctctgac

SEQ ID NO: 723828 - DNA, 25 bp, Mus musculus
gtagttaccttgcaagattgtcttg

SEQ ID NO: 723829 - DNA, 25 bp, Mus musculus
gtagttaccttggaagattgtcttg

SEQ ID NO: 723830 - DNA, 25 bp, Mus musculus
gtagttgcaaccagtctataagctc

SEQ ID NO: 723831 - DNA, 25 bp, Mus musculus
gtagttgcaacctgtctataagctc

SEQ ID NO: 723832 - DNA, 25 bp, Mus musculus
gtagttggggctactacacgggcca

SEQ ID NO: 723833 - DNA, 25 bp, Mus musculus
gtagttggggcttctacacgggcca

SEQ ID NO: 723834 - DNA, 25 bp, Mus musculus
gtagttgtcggaccagaggcccctc

SEQ ID NO: 723835 - DNA, 25 bp, Mus musculus
gtagttgtcggagcagaggcccctc

SEQ ID NO: 723836 - DNA, 25 bp, Mus musculus
gtagttgtgaggacacggagtaaca

SEQ ID NO: 723837 - DNA, 25 bp, Mus musculus
gtagttgtgaggtcacggagtaaca

SEQ ID NO: 723838 - DNA, 25 bp, Mus musculus
gtagtttatttgagttggaatccag

SEQ ID NO: 723839 - DNA, 25 bp, Mus musculus
gtagtttatttgtgttggaatccag

SEQ ID NO: 723840 - DNA, 25 bp, Mus musculus
gtataacctacacgtgtcacccatg

SEQ ID NO: 723841 - DNA, 25 bp, Mus musculus
gtataacctacaggtgtcacccatg

SEQ ID NO: 723842 - DNA, 25 bp, Mus musculus
gtataacctcgcaatcacacttctt

SEQ ID NO: 723843 - DNA, 25 bp, Mus musculus
gtataacctcgctatcacacttctt

SEQ ID NO: 723844 - DNA, 25 bp, Mus musculus
gtataagagcaacggcatctttgtg

SEQ ID NO: 723845 - DNA, 25 bp, Mus musculus
gtataagagcaagggcatctttgtg

SEQ ID NO: 723846 - DNA, 25 bp, Mus musculus
gtataaggcagtatggcttatcttc

SEQ ID NO: 723847 - DNA, 25 bp, Mus musculus
gtataaggcagtttggcttatcttc

SEQ ID NO: 723848 - DNA, 25 bp, Mus musculus
gtataagtagccctgccactcgaag

SEQ ID NO: 723849 - DNA, 25 bp, Mus musculus
gtataagtagccgtgccactcgaag

SEQ ID NO: 723850 - DNA, 25 bp, Mus musculus
gtataatcctctacatgagccaggc

SEQ ID NO: 723851 - DNA, 25 bp, Mus musculus
gtataatcctcttcatgagccaggc

SEQ ID NO: 723852 - DNA, 25 bp, Mus musculus
gtataatcctgacggctagcctagt

SEQ ID NO: 723853 - DNA, 25 bp, Mus musculus
gtataatcctgagggctagcctagt

SEQ ID NO: 723854 - DNA, 25 bp, Mus musculus
gtataatgccaaaacatctgcccag

SEQ ID NO: 723855 - DNA, 25 bp, Mus musculus
gtataatgccaatacatctgcccag

SEQ ID NO: 723856 - DNA, 25 bp, Mus musculus
gtatacaaatgactacgtggctatc

SEQ ID NO: 723857 - DNA, 25 bp, Mus musculus
gtatacaaatgagtacgtggctatc

SEQ ID NO: 723858 - DNA, 25 bp, Mus musculus
gtatacaacaacactgccatcgcca

SEQ ID NO: 723859 - DNA, 25 bp, Mus musculus
gtatacaacaactctgccatcgcca

SEQ ID NO: 723860 - DNA, 25 bp, Mus musculus
gtatacacgaggagcagaacccggt

SEQ ID NO: 723861 - DNA, 25 bp, Mus musculus
gtatacacgaggtgcagaacccggt

SEQ ID NO: 723862 - DNA, 25 bp, Mus musculus
gtatacaggacccaaggacccgctc

SEQ ID NO: 723863 - DNA, 25 bp, Mus musculus
gtatacaggaccgaaggacccgctc

SEQ ID NO: 723864 - DNA, 25 bp, Mus musculus
gtataccaaatcacacggtttgctt

SEQ ID NO: 723865 - DNA, 25 bp, Mus musculus
gtataccaaatctcacggtttgctt

SEQ ID NO: 723866 - DNA, 25 bp, Mus musculus
gtataccaacctacgcacggtcctg

SEQ ID NO: 723867 - DNA, 25 bp, Mus musculus
gtataccaaccttcgcacggtcctg

SEQ ID NO: 723868 - DNA, 25 bp, Mus musculus
gtataccaatagagaattattcccc

SEQ ID NO: 723869 - DNA, 25 bp, Mus musculus
gtataccaatagtgaattattcccc

SEQ ID NO: 723870 - DNA, 25 bp, Mus musculus
gtatacgcgaaaacttgcaagacag

SEQ ID NO: 723871 - DNA, 25 bp, Mus musculus
gtatacgcgaaatcttgcaagacag

SEQ ID NO: 723872 - DNA, 25 bp, Mus musculus
gtatactctggaaaataatgtcctc

SEQ ID NO: 723873 - DNA, 25 bp, Mus musculus
gtatactctggataataatgtcctc

SEQ ID NO: 723874 - DNA, 25 bp, Mus musculus
gtatactgatggcagcagagactct

SEQ ID NO: 723875 - DNA, 25 bp, Mus musculus
gtatactgatgggagcagagactct

SEQ ID NO: 723876 - DNA, 25 bp, Mus musculus
gtatactggcatcgtgatctacgca

SEQ ID NO: 723877 - DNA, 25 bp, Mus musculus
gtatactggcatggtgatctacgca

SEQ ID NO: 723878 - DNA, 25 bp, Mus musculus
gtatactgggacataagaggtagta

SEQ ID NO: 723879 - DNA, 25 bp, Mus musculus
gtatactgggacttaagaggtagta

SEQ ID NO: 723880 - DNA, 25 bp, Mus musculus
gtatacttaggcagacctggtgttt

SEQ ID NO: 723881 - DNA, 25 bp, Mus musculus
gtatacttaggctgacctggtgttt

SEQ ID NO: 723882 - DNA, 25 bp, Mus musculus
gtatagatttagatatctgcctgcc

SEQ ID NO: 723883 - DNA, 25 bp, Mus musculus
gtatagatttagttatctgcctgcc

SEQ ID NO: 723884 - DNA, 25 bp, Mus musculus
gtataggattctaacccggagccag

SEQ ID NO: 723885 - DNA, 25 bp, Mus musculus
gtataggattcttacccggagccag

SEQ ID NO: 723886 - DNA, 25 bp, Mus musculus
gtatagtgacccatatgcagatggg

SEQ ID NO: 723887 - DNA, 25 bp, Mus musculus
gtatagtgacccttatgcagatggg

SEQ ID NO: 723888 - DNA, 25 bp, Mus musculus
gtatagtgccatccgggaccagtac

SEQ ID NO: 723889 - DNA, 25 bp, Mus musculus
gtatagtgccatgcgggaccagtac

SEQ ID NO: 723890 - DNA, 25 bp, Mus musculus
gtatagtggagaaccgttctgtccg

SEQ ID NO: 723891 - DNA, 25 bp, Mus musculus
gtatagtggagatccgttctgtccg

SEQ ID NO: 723892 - DNA, 25 bp, Mus musculus
gtatataaggcgagtcggcgacggc

SEQ ID NO: 723893 - DNA, 25 bp, Mus musculus
gtatataaggcgtgtcggcgacggc

SEQ ID NO: 723894 - DNA, 25 bp, Mus musculus
gtatataatgaccagcggcagaaca

SEQ ID NO: 723895 - DNA, 25 bp, Mus musculus
gtatataatgacgagcggcagaaca

SEQ ID NO: 723896 - DNA, 25 bp, Mus musculus
gtatatattataccaagctccaaag

SEQ ID NO: 723897 - DNA, 25 bp, Mus musculus
gtatatattatagcaagctccaaag

SEQ ID NO: 723898 - DNA, 25 bp, Mus musculus
gtatatcacttcaaaaatcaacctg

SEQ ID NO: 723899 - DNA, 25 bp, Mus musculus
gtatatcacttctaaaatcaacctg

SEQ ID NO: 723900 - DNA, 25 bp, Mus musculus
gtatatcctcagaccttacatcttc

SEQ ID NO: 723901 - DNA, 25 bp, Mus musculus
gtatatcctcagtccttacatcttc

SEQ ID NO: 723902 - DNA, 25 bp, Mus musculus
gtatattcaagaccaaatgaccaag

SEQ ID NO: 723903 - DNA, 25 bp, Mus musculus
gtatattcaagagcaaatgaccaag

SEQ ID NO: 723904 - DNA, 25 bp, Mus musculus
gtatattctaagaactacacaccgg

SEQ ID NO: 723905 - DNA, 25 bp, Mus musculus
gtatattctaagtactacacaccgg

SEQ ID NO: 723906 - DNA, 25 bp, Mus musculus
gtatattcttatcagcactcaggag

SEQ ID NO: 723907 - DNA, 25 bp, Mus musculus
gtatattcttatgagcactcaggag

SEQ ID NO: 723908 - DNA, 25 bp, Mus musculus
gtatcaactcagaaaaccctcccag

SEQ ID NO: 723909 - DNA, 25 bp, Mus musculus
gtatcaactcagtaaaccctcccag

SEQ ID NO: 723910 - DNA, 25 bp, Mus musculus
gtatcaactcctacacctgtctgtg

SEQ ID NO: 723911 - DNA, 25 bp, Mus musculus
gtatcaactccttcacctgtctgtg

SEQ ID NO: 723912 - DNA, 25 bp, Mus musculus
gtatcaattgcaactccaccaggac

SEQ ID NO: 723913 - DNA, 25 bp, Mus musculus
gtatcaattgcatctccaccaggac

SEQ ID NO: 723914 - DNA, 25 bp, Mus musculus
gtatcacatctgattccttctccaa

SEQ ID NO: 723915 - DNA, 25 bp, Mus musculus
gtatcacatctgtttccttctccaa

SEQ ID NO: 723916 - DNA, 25 bp, Mus musculus
gtatcaccttgactgcttcgcctgc

SEQ ID NO: 723917 - DNA, 25 bp, Mus musculus
gtatcaccttgagtgcttcgcctgc

SEQ ID NO: 723918 - DNA, 25 bp, Mus musculus
gtatcagacaagcttcagaacaact

SEQ ID NO: 723919 - DNA, 25 bp, Mus musculus
gtatcagacaaggttcagaacaact

SEQ ID NO: 723920 - DNA, 25 bp, Mus musculus
gtatcagatacgacacagcagccat

SEQ ID NO: 723921 - DNA, 25 bp, Mus musculus
gtatcagatacgtcacagcagccat

SEQ ID NO: 723922 - DNA, 25 bp, Mus musculus
gtatcagatcgccatggtgcactat

SEQ ID NO: 723923 - DNA, 25 bp, Mus musculus
gtatcagatcgcgatggtgcactat

SEQ ID NO: 723924 - DNA, 25 bp, Mus musculus
gtatcagatctcagtgtcaccgcag

SEQ ID NO: 723925 - DNA, 25 bp, Mus musculus
gtatcagatctctgtgtcaccgcag

SEQ ID NO: 723926 - DNA, 25 bp, Mus musculus
gtatcagcatgcagtggtttagaga

SEQ ID NO: 723927 - DNA, 25 bp, Mus musculus
gtatcagcatgctgtggtttagaga

SEQ ID NO: 723928 - DNA, 25 bp, Mus musculus
gtatcagcattacaaaaccacccat

SEQ ID NO: 723929 - DNA, 25 bp, Mus musculus
gtatcagcattagaaaaccacccat

SEQ ID NO: 723930 - DNA, 25 bp, Mus musculus
gtatcaggtccaaaagaaactcagg

SEQ ID NO: 723931 - DNA, 25 bp, Mus musculus
gtatcaggtccataagaaactcagg

SEQ ID NO: 723932 - DNA, 25 bp, Mus musculus
gtatcaggtgcaccccgcctttgga

SEQ ID NO: 723933 - DNA, 25 bp, Mus musculus
gtatcaggtgcagcccgcctttgga

SEQ ID NO: 723934 - DNA, 25 bp, Mus musculus
gtatcatacaccctggtacatggct

SEQ ID NO: 723935 - DNA, 25 bp, Mus musculus
gtatcatacaccgtggtacatggct

SEQ ID NO: 723936 - DNA, 25 bp, Mus musculus
gtatcatagtgcactcaacagacag

SEQ ID NO: 723937 - DNA, 25 bp, Mus musculus
gtatcatagtgctctcaacagacag

SEQ ID NO: 723938 - DNA, 25 bp, Mus musculus
gtatcatgacttcggccttacctgg

SEQ ID NO: 723939 - DNA, 25 bp, Mus musculus
gtatcatgacttgggccttacctgg

SEQ ID NO: 723940 - DNA, 25 bp, Mus musculus
gtatcatggagtccgccacaggaaa

SEQ ID NO: 723941 - DNA, 25 bp, Mus musculus
gtatcatggagtgcgccacaggaaa

SEQ ID NO: 723942 - DNA, 25 bp, Mus musculus
gtatccacgttcaacccatcgatga

SEQ ID NO: 723943 - DNA, 25 bp, Mus musculus
gtatccacgttctacccatcgatga

SEQ ID NO: 723944 - DNA, 25 bp, Mus musculus
gtatccagaggtccccagatgtgag

SEQ ID NO: 723945 - DNA, 25 bp, Mus musculus
gtatccagaggtgcccagatgtgag

SEQ ID NO: 723946 - DNA, 25 bp, Mus musculus
gtatccagtgtacccagctcagcgc

SEQ ID NO: 723947 - DNA, 25 bp, Mus musculus
gtatccagtgtagccagctcagcgc

SEQ ID NO: 723948 - DNA, 25 bp, Mus musculus
gtatccatgacaaagggcacattgc

SEQ ID NO: 723949 - DNA, 25 bp, Mus musculus
gtatccatgacatagggcacattgc

SEQ ID NO: 723950 - DNA, 25 bp, Mus musculus
gtatccatggtgcacagttcttcaa

SEQ ID NO: 723951 - DNA, 25 bp, Mus musculus
gtatccatggtggacagttcttcaa

SEQ ID NO: 723952 - DNA, 25 bp, Mus musculus
gtatcccaaggaatcttccagccct

SEQ ID NO: 723953 - DNA, 25 bp, Mus musculus
gtatcccaaggattcttccagccct

SEQ ID NO: 723954 - DNA, 25 bp, Mus musculus
gtatcccactggctctaaagcagat

SEQ ID NO: 723955 - DNA, 25 bp, Mus musculus
gtatcccactgggtctaaagcagat

SEQ ID NO: 723956 - DNA, 25 bp, Mus musculus
gtatcccctggaagcatgccggcaa

SEQ ID NO: 723957 - DNA, 25 bp, Mus musculus
gtatcccctggatgcatgccggcaa

SEQ ID NO: 723958 - DNA, 25 bp, Mus musculus
gtatcccgaagtctgagtctcaaac

SEQ ID NO: 723959 - DNA, 25 bp, Mus musculus
gtatcccgaagtgtgagtctcaaac

SEQ ID NO: 723960 - DNA, 25 bp, Mus musculus
gtatccggcattatattaccctgag

SEQ ID NO: 723961 - DNA, 25 bp, Mus musculus
gtatccggcattttattaccctgag

SEQ ID NO: 723962 - DNA, 25 bp, Mus musculus
gtatccggccacaggtgccaatggc

SEQ ID NO: 723963 - DNA, 25 bp, Mus musculus
gtatccggccactggtgccaatggc

SEQ ID NO: 723964 - DNA, 25 bp, Mus musculus
gtatcctctgctccccgaagtcatg

SEQ ID NO: 723965 - DNA, 25 bp, Mus musculus
gtatcctctgctgcccgaagtcatg

SEQ ID NO: 723966 - DNA, 25 bp, Mus musculus
gtatcctgagctctacaaggacctg

SEQ ID NO: 723967 - DNA, 25 bp, Mus musculus
gtatcctgagctgtacaaggacctg

SEQ ID NO: 723968 - DNA, 25 bp, Mus musculus
gtatcctgtgttccgagctttcctg

SEQ ID NO: 723969 - DNA, 25 bp, Mus musculus
gtatcctgtgttgcgagctttcctg

SEQ ID NO: 723970 - DNA, 25 bp, Mus musculus
gtatccttcaggatgagccggcagg

SEQ ID NO: 723971 - DNA, 25 bp, Mus musculus
gtatccttcaggttgagccggcagg

SEQ ID NO: 723972 - DNA, 25 bp, Mus musculus
gtatcgaagcgactactacacctgg

SEQ ID NO: 723973 - DNA, 25 bp, Mus musculus
gtatcgaagcgagtactacacctgg

SEQ ID NO: 723974 - DNA, 25 bp, Mus musculus
gtatcgaagctcagaccagcgatta

SEQ ID NO: 723975 - DNA, 25 bp, Mus musculus
gtatcgaagctctgaccagcgatta

SEQ ID NO: 723976 - DNA, 25 bp, Mus musculus
gtatcgaatgtcaggccaaccaggc

SEQ ID NO: 723977 - DNA, 25 bp, Mus musculus
gtatcgaatgtctggccaaccaggc

SEQ ID NO: 723978 - DNA, 25 bp, Mus musculus
gtatcgattcgacggcaccgggttt

SEQ ID NO: 723979 - DNA, 25 bp, Mus musculus
gtatcgattcgagggcaccgggttt

SEQ ID NO: 723980 - DNA, 25 bp, Mus musculus
gtatcgcagggtcgaaagacaatct

SEQ ID NO: 723981 - DNA, 25 bp, Mus musculus
gtatcgcagggtggaaagacaatct

SEQ ID NO: 723982 - DNA, 25 bp, Mus musculus
gtatcgccgggcaggtgtccataga

SEQ ID NO: 723983 - DNA, 25 bp, Mus musculus
gtatcgccgggctggtgtccataga

SEQ ID NO: 723984 - DNA, 25 bp, Mus musculus
gtatcgcgctccagaagcagagctg

SEQ ID NO: 723985 - DNA, 25 bp, Mus musculus
gtatcgcgctcctgaagcagagctg

SEQ ID NO: 723986 - DNA, 25 bp, Mus musculus
gtatcgctttaaccctgacagccat

SEQ ID NO: 723987 - DNA, 25 bp, Mus musculus
gtatcgctttaagcctgacagccat

SEQ ID NO: 723988 - DNA, 25 bp, Mus musculus
gtatcggattcacagtaagtactca

SEQ ID NO: 723989 - DNA, 25 bp, Mus musculus
gtatcggattcagagtaagtactca

SEQ ID NO: 723990 - DNA, 25 bp, Mus musculus
gtatcgggctgtcggacttacgcca

SEQ ID NO: 723991 - DNA, 25 bp, Mus musculus
gtatcgggctgtgggacttacgcca

SEQ ID NO: 723992 - DNA, 25 bp, Mus musculus
gtatcggtcccgctatctcatcctg

SEQ ID NO: 723993 - DNA, 25 bp, Mus musculus
gtatcggtcccggtatctcatcctg

SEQ ID NO: 723994 - DNA, 25 bp, Mus musculus
gtatcgtgatctctttgggaccctt

SEQ ID NO: 723995 - DNA, 25 bp, Mus musculus
gtatcgtgatctgtttgggaccctt

SEQ ID NO: 723996 - DNA, 25 bp, Mus musculus
gtatcgtgcgcccaagctctggaac

SEQ ID NO: 723997 - DNA, 25 bp, Mus musculus
gtatcgtgcgccgaagctctggaac

SEQ ID NO: 723998 - DNA, 25 bp, Mus musculus
gtatcgttacctcgcactcttcaca

SEQ ID NO: 723999 - DNA, 25 bp, Mus musculus
gtatcgttacctggcactcttcaca

SEQ ID NO: 724000 - DNA, 25 bp, Mus musculus
gtatcgttccttctgcaagatcctg

SEQ ID NO: 724001 - DNA, 25 bp, Mus musculus
gtatcgttccttgtgcaagatcctg

SEQ ID NO: 724002 - DNA, 25 bp, Mus musculus
gtatctaaacaaccgcctggccctg

SEQ ID NO: 724003 - DNA, 25 bp, Mus musculus
gtatctaaacaagcgcctggccctg

SEQ ID NO: 724004 - DNA, 25 bp, Mus musculus
gtatctaacaacagacaccttagag

SEQ ID NO: 724005 - DNA, 25 bp, Mus musculus
gtatctaacaactgacaccttagag

SEQ ID NO: 724006 - DNA, 25 bp, Mus musculus
gtatctaatgaaactcaagccttct

SEQ ID NO: 724007 - DNA, 25 bp, Mus musculus
gtatctaatgaatctcaagccttct

SEQ ID NO: 724008 - DNA, 25 bp, Mus musculus
gtatctaattttatggaaccagagt

SEQ ID NO: 724009 - DNA, 25 bp, Mus musculus
gtatctaattttttggaaccagagt

SEQ ID NO: 724010 - DNA, 25 bp, Mus musculus
gtatctagctatcgcggcagtgacc

SEQ ID NO: 724011 - DNA, 25 bp, Mus musculus
gtatctagctatggcggcagtgacc

SEQ ID NO: 724012 - DNA, 25 bp, Mus musculus
gtatctcatgggaggaacctacaga

SEQ ID NO: 724013 - DNA, 25 bp, Mus musculus
gtatctcatgggtggaacctacaga

SEQ ID NO: 724014 - DNA, 25 bp, Mus musculus
gtatctcatgtgctctctgaagcac

SEQ ID NO: 724015 - DNA, 25 bp, Mus musculus
gtatctcatgtggtctctgaagcac

SEQ ID NO: 724016 - DNA, 25 bp, Mus musculus
gtatctccagataaaaggtgccaca

SEQ ID NO: 724017 - DNA, 25 bp, Mus musculus
gtatctccagattaaaggtgccaca

SEQ ID NO: 724018 - DNA, 25 bp, Mus musculus
gtatctccagtgctgtgatgaagct

SEQ ID NO: 724019 - DNA, 25 bp, Mus musculus
gtatctccagtggtgtgatgaagct

SEQ ID NO: 724020 - DNA, 25 bp, Mus musculus
gtatctcccgagcgcgtcacgctgg

SEQ ID NO: 724021 - DNA, 25 bp, Mus musculus
gtatctcccgagggcgtcacgctgg

SEQ ID NO: 724022 - DNA, 25 bp, Mus musculus
gtatctcccggactgaggcagctga

SEQ ID NO: 724023 - DNA, 25 bp, Mus musculus
gtatctcccggagtgaggcagctga

SEQ ID NO: 724024 - DNA, 25 bp, Mus musculus
gtatctcctagccacctagacctgg

SEQ ID NO: 724025 - DNA, 25 bp, Mus musculus
gtatctcctagcgacctagacctgg

SEQ ID NO: 724026 - DNA, 25 bp, Mus musculus
gtatctccttcacgatgcccaagaa

SEQ ID NO: 724027 - DNA, 25 bp, Mus musculus
gtatctccttcaggatgcccaagaa

SEQ ID NO: 724028 - DNA, 25 bp, Mus musculus
gtatctctagctcccttgaatctaa

SEQ ID NO: 724029 - DNA, 25 bp, Mus musculus
gtatctctagctgccttgaatctaa

SEQ ID NO: 724030 - DNA, 25 bp, Mus musculus
gtatctctgcggacttctgggttgg

SEQ ID NO: 724031 - DNA, 25 bp, Mus musculus
gtatctctgcggtcttctgggttgg

SEQ ID NO: 724032 - DNA, 25 bp, Mus musculus
gtatctgagacacaagacctgcaag

SEQ ID NO: 724033 - DNA, 25 bp, Mus musculus
gtatctgagacagaagacctgcaag

SEQ ID NO: 724034 - DNA, 25 bp, Mus musculus
gtatctgcctatcgcccagtctgtg

SEQ ID NO: 724035 - DNA, 25 bp, Mus musculus
gtatctgcctatggcccagtctgtg

SEQ ID NO: 724036 - DNA, 25 bp, Mus musculus
gtatctggattgctctaattaaaga

SEQ ID NO: 724037 - DNA, 25 bp, Mus musculus
gtatctggattggtctaattaaaga

SEQ ID NO: 724038 - DNA, 25 bp, Mus musculus
gtatctgtaacccttgagcccctag

SEQ ID NO: 724039 - DNA, 25 bp, Mus musculus
gtatctgtaaccgttgagcccctag

SEQ ID NO: 724040 - DNA, 25 bp, Mus musculus
gtatctgtatacatggatgtacacg

SEQ ID NO: 724041 - DNA, 25 bp, Mus musculus
gtatctgtatacttggatgtacacg

SEQ ID NO: 724042 - DNA, 25 bp, Mus musculus
gtatctgttcttcaaaactggaaag

SEQ ID NO: 724043 - DNA, 25 bp, Mus musculus
gtatctgttcttgaaaactggaaag

SEQ ID NO: 724044 - DNA, 25 bp, Mus musculus
gtatcttattctcagattggaggcc

SEQ ID NO: 724045 - DNA, 25 bp, Mus musculus
gtatcttattctgagattggaggcc

SEQ ID NO: 724046 - DNA, 25 bp, Mus musculus
gtatcttccaggagaacgcacccat

SEQ ID NO: 724047 - DNA, 25 bp, Mus musculus
gtatcttccaggtgaacgcacccat

SEQ ID NO: 724048 - DNA, 25 bp, Mus musculus
gtatcttcgttgagatgatccaagg

SEQ ID NO: 724049 - DNA, 25 bp, Mus musculus
gtatcttcgttgtgatgatccaagg

SEQ ID NO: 724050 - DNA, 25 bp, Mus musculus
gtatcttgttggatgcacctagaca

SEQ ID NO: 724051 - DNA, 25 bp, Mus musculus
gtatcttgttggttgcacctagaca

SEQ ID NO: 724052 - DNA, 25 bp, Mus musculus
gtatctttacccctatgagtgtgag

SEQ ID NO: 724053 - DNA, 25 bp, Mus musculus
gtatctttacccgtatgagtgtgag

SEQ ID NO: 724054 - DNA, 25 bp, Mus musculus
gtatctttcactcaagctctctggc

SEQ ID NO: 724055 - DNA, 25 bp, Mus musculus
gtatctttcactgaagctctctggc

SEQ ID NO: 724056 - DNA, 25 bp, Mus musculus
gtatctttccctagtggcccgactc

SEQ ID NO: 724057 - DNA, 25 bp, Mus musculus
gtatctttcccttgtggcccgactc

SEQ ID NO: 724058 - DNA, 25 bp, Mus musculus
gtatgaaactctatggaaatccaaa

SEQ ID NO: 724059 - DNA, 25 bp, Mus musculus
gtatgaaactctttggaaatccaaa

SEQ ID NO: 724060 - DNA, 25 bp, Mus musculus
gtatgaaatgttcgcccagacactg

SEQ ID NO: 724061 - DNA, 25 bp, Mus musculus
gtatgaaatgttggcccagacactg

SEQ ID NO: 724062 - DNA, 25 bp, Mus musculus
gtatgaacacaccaatgacaccgca

SEQ ID NO: 724063 - DNA, 25 bp, Mus musculus
gtatgaacacacgaatgacaccgca

SEQ ID NO: 724064 - DNA, 25 bp, Mus musculus
gtatgaacactgctggctcctacaa

SEQ ID NO: 724065 - DNA, 25 bp, Mus musculus
gtatgaacactggtggctcctacaa

SEQ ID NO: 724066 - DNA, 25 bp, Mus musculus
gtatgaagttgtccctacctcctcc

SEQ ID NO: 724067 - DNA, 25 bp, Mus musculus
gtatgaagttgtctggaaacctgaa

SEQ ID NO: 724068 - DNA, 25 bp, Mus musculus
gtatgaagttgtgcctacctcctcc

SEQ ID NO: 724069 - DNA, 25 bp, Mus musculus
gtatgaagttgtgtggaaacctgaa

SEQ ID NO: 724070 - DNA, 25 bp, Mus musculus
gtatgacccataaggcaaagtccta

SEQ ID NO: 724071 - DNA, 25 bp, Mus musculus
gtatgacccatatggcaaagtccta

SEQ ID NO: 724072 - DNA, 25 bp, Mus musculus
gtatgaccctccattggaagatggg

SEQ ID NO: 724073 - DNA, 25 bp, Mus musculus
gtatgaccctcctttggaagatggg

SEQ ID NO: 724074 - DNA, 25 bp, Mus musculus
gtatgaccttctagttaccccacag

SEQ ID NO: 724075 - DNA, 25 bp, Mus musculus
gtatgaccttcttgttaccccacag

SEQ ID NO: 724076 - DNA, 25 bp, Mus musculus
gtatgactatctccctaccactgtg

SEQ ID NO: 724077 - DNA, 25 bp, Mus musculus
gtatgactatctgcctaccactgtg

SEQ ID NO: 724078 - DNA, 25 bp, Mus musculus
gtatgactgttaccagtaaccccaa

SEQ ID NO: 724079 - DNA, 25 bp, Mus musculus
gtatgactgttagcagtaaccccaa

SEQ ID NO: 724080 - DNA, 25 bp, Mus musculus
gtatgagagggaagcaggacaatcc

SEQ ID NO: 724081 - DNA, 25 bp, Mus musculus
gtatgagagggatgcaggacaatcc

SEQ ID NO: 724082 - DNA, 25 bp, Mus musculus
gtatgagcacatcctctcgttcggg

SEQ ID NO: 724083 - DNA, 25 bp, Mus musculus
gtatgagcacatgctctcgttcggg

SEQ ID NO: 724084 - DNA, 25 bp, Mus musculus
gtatgagccgttagaaacacagcag

SEQ ID NO: 724085 - DNA, 25 bp, Mus musculus
gtatgagccgtttgaaacacagcag

SEQ ID NO: 724086 - DNA, 25 bp, Mus musculus
gtatgagctctcaccaatgatggtg

SEQ ID NO: 724087 - DNA, 25 bp, Mus musculus
gtatgagctctctccaatgatggtg

SEQ ID NO: 724088 - DNA, 25 bp, Mus musculus
gtatgaggacctcgttcgggcaccc

SEQ ID NO: 724089 - DNA, 25 bp, Mus musculus
gtatgaggacctggttcgggcaccc

SEQ ID NO: 724090 - DNA, 25 bp, Mus musculus
gtatgaggagatcgccaaccacagc

SEQ ID NO: 724091 - DNA, 25 bp, Mus musculus
gtatgaggagatggccaaccacagc

SEQ ID NO: 724092 - DNA, 25 bp, Mus musculus
gtatgaggagctcttcccggccttc

SEQ ID NO: 724093 - DNA, 25 bp, Mus musculus
gtatgaggagctgttcccggccttc

SEQ ID NO: 724094 - DNA, 25 bp, Mus musculus
gtatgagggattcatttcggctcag

SEQ ID NO: 724095 - DNA, 25 bp, Mus musculus
gtatgagggattgatttcggctcag

SEQ ID NO: 724096 - DNA, 25 bp, Mus musculus
gtatgagtcagacctgtccctgcgg

SEQ ID NO: 724097 - DNA, 25 bp, Mus musculus
gtatgagtcagagctgtccctgcgg

SEQ ID NO: 724098 - DNA, 25 bp, Mus musculus
gtatgagtccccctctacactgctg

SEQ ID NO: 724099 - DNA, 25 bp, Mus musculus
gtatgagtccccgtctacactgctg

SEQ ID NO: 724100 - DNA, 25 bp, Mus musculus
gtatgagttcccagacaaggactgg

SEQ ID NO: 724101 - DNA, 25 bp, Mus musculus
gtatgagttccctgacaaggactgg

SEQ ID NO: 724102 - DNA, 25 bp, Mus musculus
gtatgagtttgaagaccagagcgtc

SEQ ID NO: 724103 - DNA, 25 bp, Mus musculus
gtatgagtttgatgaccagagcgtc

SEQ ID NO: 724104 - DNA, 25 bp, Mus musculus
gtatgatcacaacaaccaagcactt

SEQ ID NO: 724105 - DNA, 25 bp, Mus musculus
gtatgatcacaagaaccaagcactt

SEQ ID NO: 724106 - DNA, 25 bp, Mus musculus
gtatgatcactgctgtgggactgtc

SEQ ID NO: 724107 - DNA, 25 bp, Mus musculus
gtatgatcactggtgtgggactgtc

SEQ ID NO: 724108 - DNA, 25 bp, Mus musculus
gtatgatccttcagaagcagaagcc

SEQ ID NO: 724109 - DNA, 25 bp, Mus musculus
gtatgatccttctgaagcagaagcc

SEQ ID NO: 724110 - DNA, 25 bp, Mus musculus
gtatgatgtcatcagctgcttaaat

SEQ ID NO: 724111 - DNA, 25 bp, Mus musculus
gtatgatgtcatgagctgcttaaat

SEQ ID NO: 724112 - DNA, 25 bp, Mus musculus
gtatgattgtagcagcctctcaggc

SEQ ID NO: 724113 - DNA, 25 bp, Mus musculus
gtatgattgtaggagcctctcaggc

SEQ ID NO: 724114 - DNA, 25 bp, Mus musculus
gtatgcaaggagactgaagactatg

SEQ ID NO: 724115 - DNA, 25 bp, Mus musculus
gtatgcaaggagtctgaagactatg

SEQ ID NO: 724116 - DNA, 25 bp, Mus musculus
gtatgcacatccaaatgccgccctg

SEQ ID NO: 724117 - DNA, 25 bp, Mus musculus
gtatgcacatcctaatgccgccctg

SEQ ID NO: 724118 - DNA, 25 bp, Mus musculus
gtatgcacttgcagcagcccaccag

SEQ ID NO: 724119 - DNA, 25 bp, Mus musculus
gtatgcacttgctgcagcccaccag

SEQ ID NO: 724120 - DNA, 25 bp, Mus musculus
gtatgcagagcactatggtcaccgg

SEQ ID NO: 724121 - DNA, 25 bp, Mus musculus
gtatgcagagcagtatggtcaccgg

SEQ ID NO: 724122 - DNA, 25 bp, Mus musculus
gtatgcattagcagcagctcagcag

SEQ ID NO: 724123 - DNA, 25 bp, Mus musculus
gtatgcattagctgcagctcagcag

SEQ ID NO: 724124 - DNA, 25 bp, Mus musculus
gtatgccaggagaccttccgacgga

SEQ ID NO: 724125 - DNA, 25 bp, Mus musculus
gtatgccaggagtccttccgacgga

SEQ ID NO: 724126 - DNA, 25 bp, Mus musculus
gtatgcccatcactccagcacattg

SEQ ID NO: 724127 - DNA, 25 bp, Mus musculus
gtatgcccatcagtccagcacattg

SEQ ID NO: 724128 - DNA, 25 bp, Mus musculus
gtatgccgtactcagcaacccagag

SEQ ID NO: 724129 - DNA, 25 bp, Mus musculus
gtatgccgtactgagcaacccagag

SEQ ID NO: 724130 - DNA, 25 bp, Mus musculus
gtatgcctacagagacaacagcctg

SEQ ID NO: 724131 - DNA, 25 bp, Mus musculus
gtatgcctacagtgacaacagcctg

SEQ ID NO: 724132 - DNA, 25 bp, Mus musculus
gtatgcctcctacattggacacgat

SEQ ID NO: 724133 - DNA, 25 bp, Mus musculus
gtatgcctcctagattggacacgat

SEQ ID NO: 724134 - DNA, 25 bp, Mus musculus
gtatgcctttgtcaactggataaac

SEQ ID NO: 724135 - DNA, 25 bp, Mus musculus
gtatgcctttgtgaactggataaac

SEQ ID NO: 724136 - DNA, 25 bp, Mus musculus
gtatgcgcaccccatagtatagtca

SEQ ID NO: 724137 - DNA, 25 bp, Mus musculus
gtatgcgcacccgatagtatagtca

SEQ ID NO: 724138 - DNA, 25 bp, Mus musculus
gtatgcgcctctcacagccctgata

SEQ ID NO: 724139 - DNA, 25 bp, Mus musculus
gtatgcgcctctgacagccctgata

SEQ ID NO: 724140 - DNA, 25 bp, Mus musculus
gtatgctcctgacgtgtcaccagag

SEQ ID NO: 724141 - DNA, 25 bp, Mus musculus
gtatgctcctgaggtgtcaccagag

SEQ ID NO: 724142 - DNA, 25 bp, Mus musculus
gtatgctcgtcgacactgtcccctg

SEQ ID NO: 724143 - DNA, 25 bp, Mus musculus
gtatgctcgtcgtcactgtcccctg

SEQ ID NO: 724144 - DNA, 25 bp, Mus musculus
gtatgctgcaaaactttctggatct

SEQ ID NO: 724145 - DNA, 25 bp, Mus musculus
gtatgctgcaaatctttctggatct

SEQ ID NO: 724146 - DNA, 25 bp, Mus musculus
gtatgcttttcactctacttgcaaa

SEQ ID NO: 724147 - DNA, 25 bp, Mus musculus
gtatgcttttcagtctacttgcaaa

SEQ ID NO: 724148 - DNA, 25 bp, Mus musculus
gtatggaacttcaccggagagcagg

SEQ ID NO: 724149 - DNA, 25 bp, Mus musculus
gtatggaacttctccggagagcagg

SEQ ID NO: 724150 - DNA, 25 bp, Mus musculus
gtatggaagactagcaatggaagag

SEQ ID NO: 724151 - DNA, 25 bp, Mus musculus
gtatggaagacttgcaatggaagag

SEQ ID NO: 724152 - DNA, 25 bp, Mus musculus
gtatggaataaacacactctttgtg

SEQ ID NO: 724153 - DNA, 25 bp, Mus musculus
gtatggaataaagacactctttgtg

SEQ ID NO: 724154 - DNA, 25 bp, Mus musculus
gtatggacgcctccttggccatcaa

SEQ ID NO: 724155 - DNA, 25 bp, Mus musculus
gtatggacgcctgcttggccatcaa

SEQ ID NO: 724156 - DNA, 25 bp, Mus musculus
gtatggagacgcagccctgagacag

SEQ ID NO: 724157 - DNA, 25 bp, Mus musculus
gtatggagacgctgccctgagacag

SEQ ID NO: 724158 - DNA, 25 bp, Mus musculus
gtatggagcagtcacccctgcagag

SEQ ID NO: 724159 - DNA, 25 bp, Mus musculus
gtatggagcagtgacccctgcagag

SEQ ID NO: 724160 - DNA, 25 bp, Mus musculus
gtatggatctccatacccttggcct

SEQ ID NO: 724161 - DNA, 25 bp, Mus musculus
gtatggatctccttacccttggcct

SEQ ID NO: 724162 - DNA, 25 bp, Mus musculus
gtatggattccaaggagtcatggac

SEQ ID NO: 724163 - DNA, 25 bp, Mus musculus
gtatggattccatggagtcatggac

SEQ ID NO: 724164 - DNA, 25 bp, Mus musculus
gtatggatttcacacagccagctcc

SEQ ID NO: 724165 - DNA, 25 bp, Mus musculus
gtatggatttcagacagccagctcc

SEQ ID NO: 724166 - DNA, 25 bp, Mus musculus
gtatggcactgcaactcatttgctc

SEQ ID NO: 724167 - DNA, 25 bp, Mus musculus
gtatggcactgctactcatttgctc

SEQ ID NO: 724168 - DNA, 25 bp, Mus musculus
gtatggcatctgaagaacacagtat

SEQ ID NO: 724169 - DNA, 25 bp, Mus musculus
gtatggcatctgtagaacacagtat

SEQ ID NO: 724170 - DNA, 25 bp, Mus musculus
gtatggccacacctcaactctggca

SEQ ID NO: 724171 - DNA, 25 bp, Mus musculus
gtatggccacacgtcaactctggca

SEQ ID NO: 724172 - DNA, 25 bp, Mus musculus
gtatggccagccatggagccagcag

SEQ ID NO: 724173 - DNA, 25 bp, Mus musculus
gtatggccagccttggagccagcag

SEQ ID NO: 724174 - DNA, 25 bp, Mus musculus
gtatggcgccgcaggaaccggctcc

SEQ ID NO: 724175 - DNA, 25 bp, Mus musculus
gtatggcgccgctggaaccggctcc

SEQ ID NO: 724176 - DNA, 25 bp, Mus musculus
gtatggcgtaaaccagctagaagag

SEQ ID NO: 724177 - DNA, 25 bp, Mus musculus
gtatggcgtaaagcagctagaagag

SEQ ID NO: 724178 - DNA, 25 bp, Mus musculus
gtatgggacatccttggtcctctca

SEQ ID NO: 724179 - DNA, 25 bp, Mus musculus
gtatgggacatcgttggtcctctca

SEQ ID NO: 724180 - DNA, 25 bp, Mus musculus
gtatgggcgtctccacagtaaccgc

SEQ ID NO: 724181 - DNA, 25 bp, Mus musculus
gtatgggcgtctgcacagtaaccgc

SEQ ID NO: 724182 - DNA, 25 bp, Mus musculus
gtatggttttctaatcgaagggcca

SEQ ID NO: 724183 - DNA, 25 bp, Mus musculus
gtatggttttcttatcgaagggcca

SEQ ID NO: 724184 - DNA, 25 bp, Mus musculus
gtatgtcaccagatgtttctgaaca

SEQ ID NO: 724185 - DNA, 25 bp, Mus musculus
gtatgtcaccagttgtttctgaaca

SEQ ID NO: 724186 - DNA, 25 bp, Mus musculus
gtatgtcattggaattcaggagggc

SEQ ID NO: 724187 - DNA, 25 bp, Mus musculus
gtatgtcattggtattcaggagggc

SEQ ID NO: 724188 - DNA, 25 bp, Mus musculus
gtatgtccactaactgagcctgcag

SEQ ID NO: 724189 - DNA, 25 bp, Mus musculus
gtatgtccactatctgagcctgcag

SEQ ID NO: 724190 - DNA, 25 bp, Mus musculus
gtatgtcctgcaagttttaaagaaa

SEQ ID NO: 724191 - DNA, 25 bp, Mus musculus
gtatgtcctgcatgttttaaagaaa

SEQ ID NO: 724192 - DNA, 25 bp, Mus musculus
gtatgtcgcgaacgcagccagtgcc

SEQ ID NO: 724193 - DNA, 25 bp, Mus musculus
gtatgtcgcgaaggcagccagtgcc

SEQ ID NO: 724194 - DNA, 25 bp, Mus musculus
gtatgtcgtcgtccatgacccctga

SEQ ID NO: 724195 - DNA, 25 bp, Mus musculus
gtatgtcgtcgtgcatgacccctga

SEQ ID NO: 724196 - DNA, 25 bp, Mus musculus
gtatgtctaacacccactgacgcga

SEQ ID NO: 724197 - DNA, 25 bp, Mus musculus
gtatgtctaacagccactgacgcga

SEQ ID NO: 724198 - DNA, 25 bp, Mus musculus
gtatgtctctacatcgggccttgga

SEQ ID NO: 724199 - DNA, 25 bp, Mus musculus
gtatgtctctacttcgggccttgga

SEQ ID NO: 724200 - DNA, 25 bp, Mus musculus
gtatgtgaccttcccattaaccgcg

SEQ ID NO: 724201 - DNA, 25 bp, Mus musculus
gtatgtgaccttgccattaaccgcg

SEQ ID NO: 724202 - DNA, 25 bp, Mus musculus
gtatgtgatcaacgatctagtccct

SEQ ID NO: 724203 - DNA, 25 bp, Mus musculus
gtatgtgatcaaggatctagtccct

SEQ ID NO: 724204 - DNA, 25 bp, Mus musculus
gtatgtgatgatatcagccgacgct

SEQ ID NO: 724205 - DNA, 25 bp, Mus musculus
gtatgtgatgatttcagccgacgct

SEQ ID NO: 724206 - DNA, 25 bp, Mus musculus
gtatgtgcaggactttgtgagacca

SEQ ID NO: 724207 - DNA, 25 bp, Mus musculus
gtatgtgcaggagtttgtgagacca

SEQ ID NO: 724208 - DNA, 25 bp, Mus musculus
gtatgtgctgtaccgaacaacgctt

SEQ ID NO: 724209 - DNA, 25 bp, Mus musculus
gtatgtgctgtagcgaacaacgctt

SEQ ID NO: 724210 - DNA, 25 bp, Mus musculus
gtatgtggaccgagtgacagagttc

SEQ ID NO: 724211 - DNA, 25 bp, Mus musculus
gtatgtggaccgtgtgacagagttc

SEQ ID NO: 724212 - DNA, 25 bp, Mus musculus
gtatgtgttgagctcatccccgggc

SEQ ID NO: 724213 - DNA, 25 bp, Mus musculus
gtatgtgttgaggtcatccccgggc

SEQ ID NO: 724214 - DNA, 25 bp, Mus musculus
gtatgttccgtcagcgcttcctcta

SEQ ID NO: 724215 - DNA, 25 bp, Mus musculus
gtatgttccgtctgcgcttcctcta

SEQ ID NO: 724216 - DNA, 25 bp, Mus musculus
gtatgtttctcactggtctctccat

SEQ ID NO: 724217 - DNA, 25 bp, Mus musculus
gtatgtttctcagtggtctctccat

SEQ ID NO: 724218 - DNA, 25 bp, Mus musculus
gtattaatagaacccttcctgtcag

SEQ ID NO: 724219 - DNA, 25 bp, Mus musculus
gtattaatagaagccttcctgtcag

SEQ ID NO: 724220 - DNA, 25 bp, Mus musculus
gtattcaattacatctcctgccctg

SEQ ID NO: 724221 - DNA, 25 bp, Mus musculus
gtattcaattacttctcctgccctg

SEQ ID NO: 724222 - DNA, 25 bp, Mus musculus
gtattcaccttgatatcctgaccca

SEQ ID NO: 724223 - DNA, 25 bp, Mus musculus
gtattcaccttgttatcctgaccca

SEQ ID NO: 724224 - DNA, 25 bp, Mus musculus
gtattcatgcctcgaagccccttgg

SEQ ID NO: 724225 - DNA, 25 bp, Mus musculus
gtattcatgcctggaagccccttgg

SEQ ID NO: 724226 - DNA, 25 bp, Mus musculus
gtattccaataactgtaccacctcc

SEQ ID NO: 724227 - DNA, 25 bp, Mus musculus
gtattccaataagtgtaccacctcc

SEQ ID NO: 724228 - DNA, 25 bp, Mus musculus
gtattccagtgcagagaaccaagga

SEQ ID NO: 724229 - DNA, 25 bp, Mus musculus
gtattccagtgctgagaaccaagga

SEQ ID NO: 724230 - DNA, 25 bp, Mus musculus
gtattcccagccaaacaacatgtaa

SEQ ID NO: 724231 - DNA, 25 bp, Mus musculus
gtattcccagcctaacaacatgtaa

SEQ ID NO: 724232 - DNA, 25 bp, Mus musculus
gtattccccagcatatatctcctaa

SEQ ID NO: 724233 - DNA, 25 bp, Mus musculus
gtattccccagcttatatctcctaa

SEQ ID NO: 724234 - DNA, 25 bp, Mus musculus
gtattcccgctgcatcagacgcaag

SEQ ID NO: 724235 - DNA, 25 bp, Mus musculus
gtattcccgctggatcagacgcaag

SEQ ID NO: 724236 - DNA, 25 bp, Mus musculus
gtattccctgtgaacgcgctccggg

SEQ ID NO: 724237 - DNA, 25 bp, Mus musculus
gtattccctgtgtacgcgctccggg

SEQ ID NO: 724238 - DNA, 25 bp, Mus musculus
gtattcctccaccaaaagcgagtta

SEQ ID NO: 724239 - DNA, 25 bp, Mus musculus
gtattcctccacgaaaagcgagtta

SEQ ID NO: 724240 - DNA, 25 bp, Mus musculus
gtattcctgttaaatatgaacggca

SEQ ID NO: 724241 - DNA, 25 bp, Mus musculus
gtattcctgttatatatgaacggca

SEQ ID NO: 724242 - DNA, 25 bp, Mus musculus
gtattccttgctccggtcggagaag

SEQ ID NO: 724243 - DNA, 25 bp, Mus musculus
gtattccttgctgcggtcggagaag

SEQ ID NO: 724244 - DNA, 25 bp, Mus musculus
gtattcgcctctacctgtccgtgct

SEQ ID NO: 724245 - DNA, 25 bp, Mus musculus
gtattcgcctcttcctgtccgtgct

SEQ ID NO: 724246 - DNA, 25 bp, Mus musculus
gtattcgtgtacatcaactctggca

SEQ ID NO: 724247 - DNA, 25 bp, Mus musculus
gtattcgtgtacttcaactctggca

SEQ ID NO: 724248 - DNA, 25 bp, Mus musculus
gtattctaccatctacacgatgttt

SEQ ID NO: 724249 - DNA, 25 bp, Mus musculus
gtattctaccatgtacacgatgttt

SEQ ID NO: 724250 - DNA, 25 bp, Mus musculus
gtattctactttatgagatgtctcc

SEQ ID NO: 724251 - DNA, 25 bp, Mus musculus
gtattctactttttgagatgtctcc

SEQ ID NO: 724252 - DNA, 25 bp, Mus musculus
gtattctcatacacagctgcaattt

SEQ ID NO: 724253 - DNA, 25 bp, Mus musculus
gtattctcatactcagctgcaattt

SEQ ID NO: 724254 - DNA, 25 bp, Mus musculus
gtattctctgaaaccaaatgaccag

SEQ ID NO: 724255 - DNA, 25 bp, Mus musculus
gtattctctgaatccaaatgaccag

SEQ ID NO: 724256 - DNA, 25 bp, Mus musculus
gtattctgccaaccattactaatca

SEQ ID NO: 724257 - DNA, 25 bp, Mus musculus
gtattctgccaagcattactaatca

SEQ ID NO: 724258 - DNA, 25 bp, Mus musculus
gtattctggaggcactgagggccca

SEQ ID NO: 724259 - DNA, 25 bp, Mus musculus
gtattctggagggactgagggccca

SEQ ID NO: 724260 - DNA, 25 bp, Mus musculus
gtattcttgtacatgctgacatcaa

SEQ ID NO: 724261 - DNA, 25 bp, Mus musculus
gtattcttgtacttgctgacatcaa

SEQ ID NO: 724262 - DNA, 25 bp, Mus musculus
gtattgaaagcccagtcttcccttc

SEQ ID NO: 724263 - DNA, 25 bp, Mus musculus
gtattgaaagccgagtcttcccttc

SEQ ID NO: 724264 - DNA, 25 bp, Mus musculus
gtattgaccctcagctgtactcgca

SEQ ID NO: 724265 - DNA, 25 bp, Mus musculus
gtattgaccctctgctgtactcgca

SEQ ID NO: 724266 - DNA, 25 bp, Mus musculus
gtattgccaagtacaacttccatgg

SEQ ID NO: 724267 - DNA, 25 bp, Mus musculus
gtattgccaagttcaacttccatgg

SEQ ID NO: 724268 - DNA, 25 bp, Mus musculus
gtattgcgagtcacccatgaactcc

SEQ ID NO: 724269 - DNA, 25 bp, Mus musculus
gtattgcgagtctcccatgaactcc

SEQ ID NO: 724270 - DNA, 25 bp, Mus musculus
gtattgcgctgacccggatgcagaa

SEQ ID NO: 724271 - DNA, 25 bp, Mus musculus
gtattgcgctgagccggatgcagaa

SEQ ID NO: 724272 - DNA, 25 bp, Mus musculus
gtattgctaataccctagatctcac

SEQ ID NO: 724273 - DNA, 25 bp, Mus musculus
gtattgctaatagcctagatctcac

SEQ ID NO: 724274 - DNA, 25 bp, Mus musculus
gtattggagataccagtggccctgt

SEQ ID NO: 724275 - DNA, 25 bp, Mus musculus
gtattggagatagcagtggccctgt

SEQ ID NO: 724276 - DNA, 25 bp, Mus musculus
gtattgtccagaaccgggacaccac

SEQ ID NO: 724277 - DNA, 25 bp, Mus musculus
gtattgtccagatccgggacaccac

SEQ ID NO: 724278 - DNA, 25 bp, Mus musculus
gtattgtcctgcatagtacagattg

SEQ ID NO: 724279 - DNA, 25 bp, Mus musculus
gtattgtcctgcttagtacagattg

SEQ ID NO: 724280 - DNA, 25 bp, Mus musculus
gtattgtctggcaaccacccagcag

SEQ ID NO: 724281 - DNA, 25 bp, Mus musculus
gtattgtctggctaccacccagcag

SEQ ID NO: 724282 - DNA, 25 bp, Mus musculus
gtattgtgcggcaccagaccgcagg

SEQ ID NO: 724283 - DNA, 25 bp, Mus musculus
gtattgtgcggctccagaccgcagg

SEQ ID NO: 724284 - DNA, 25 bp, Mus musculus
gtattgttccgaccaccacgctctg

SEQ ID NO: 724285 - DNA, 25 bp, Mus musculus
gtattgttccgagcaccacgctctg

SEQ ID NO: 724286 - DNA, 25 bp, Mus musculus
gtatttaatgatcccattcatggcc

SEQ ID NO: 724287 - DNA, 25 bp, Mus musculus
gtatttaatgatgccattcatggcc

SEQ ID NO: 724288 - DNA, 25 bp, Mus musculus
gtatttacttaccttggtgccttgt

SEQ ID NO: 724289 - DNA, 25 bp, Mus musculus
gtatttacttacgttggtgccttgt

SEQ ID NO: 724290 - DNA, 25 bp, Mus musculus
gtatttagagcgcagcgcctgactg

SEQ ID NO: 724291 - DNA, 25 bp, Mus musculus
gtatttagagcggagcgcctgactg

SEQ ID NO: 724292 - DNA, 25 bp, Mus musculus
gtatttattggtcccaatcccctgg

SEQ ID NO: 724293 - DNA, 25 bp, Mus musculus
gtatttattggtgccaatcccctgg

SEQ ID NO: 724294 - DNA, 25 bp, Mus musculus
gtatttcgagcacgctatatagccc

SEQ ID NO: 724295 - DNA, 25 bp, Mus musculus
gtatttcgagcaggctatatagccc

SEQ ID NO: 724296 - DNA, 25 bp, Mus musculus
gtatttctacgaccccgatgtgggc

SEQ ID NO: 724297 - DNA, 25 bp, Mus musculus
gtatttctacgagcccgatgtgggc

SEQ ID NO: 724298 - DNA, 25 bp, Mus musculus
gtatttctatgaccgcagccggcag

SEQ ID NO: 724299 - DNA, 25 bp, Mus musculus
gtatttctatgagcgcagccggcag

SEQ ID NO: 724300 - DNA, 25 bp, Mus musculus
gtatttgctgttcttctctgcagtc

SEQ ID NO: 724301 - DNA, 25 bp, Mus musculus
gtatttgctgttgttctctgcagtc

SEQ ID NO: 724302 - DNA, 25 bp, Mus musculus
gtatttgtcatcatcggcctctgta

SEQ ID NO: 724303 - DNA, 25 bp, Mus musculus
gtatttgtcatcttcggcctctgta

SEQ ID NO: 724304 - DNA, 25 bp, Mus musculus
gtatttgtgtatcggcggtcccgca

SEQ ID NO: 724305 - DNA, 25 bp, Mus musculus
gtatttgtgtatgggcggtcccgca

SEQ ID NO: 724306 - DNA, 25 bp, Mus musculus
gtattttaggcgagctgggcttccc

SEQ ID NO: 724307 - DNA, 25 bp, Mus musculus
gtattttaggcgtgctgggcttccc

SEQ ID NO: 724308 - DNA, 25 bp, Mus musculus
gtattttgaggtccatacccccggg

SEQ ID NO: 724309 - DNA, 25 bp, Mus musculus
gtattttgaggtgcatacccccggg

SEQ ID NO: 724310 - DNA, 25 bp, Mus musculus
gtattttgttgcaccggcggaacgc

SEQ ID NO: 724311 - DNA, 25 bp, Mus musculus
gtattttgttgctccggcggaacgc

SEQ ID NO: 724312 - DNA, 25 bp, Mus musculus
gtatttttagctccagcacctgcct

SEQ ID NO: 724313 - DNA, 25 bp, Mus musculus
gtatttttagctgcagcacctgcct

SEQ ID NO: 724314 - DNA, 25 bp, Mus musculus
gtcaaaaaccgcctgtggaagctgc

SEQ ID NO: 724315 - DNA, 25 bp, Mus musculus
gtcaaaaaccgcgtgtggaagctgc

SEQ ID NO: 724316 - DNA, 25 bp, Mus musculus
gtcaaaacttacatcaagggaagag

SEQ ID NO: 724317 - DNA, 25 bp, Mus musculus
gtcaaaacttacttcaagggaagag

SEQ ID NO: 724318 - DNA, 25 bp, Mus musculus
gtcaaaatacaacactttgccagtg

SEQ ID NO: 724319 - DNA, 25 bp, Mus musculus
gtcaaaatacaagactttgccagtg

SEQ ID NO: 724320 - DNA, 25 bp, Mus musculus
gtcaaaatcgaaaaatacagcagcc

SEQ ID NO: 724321 - DNA, 25 bp, Mus musculus
gtcaaaatcgaataatacagcagcc

SEQ ID NO: 724322 - DNA, 25 bp, Mus musculus
gtcaaacaacttctgctattctctg

SEQ ID NO: 724323 - DNA, 25 bp, Mus musculus
gtcaaacaacttgtgctattctctg

SEQ ID NO: 724324 - DNA, 25 bp, Mus musculus
gtcaaacagcggatggtacccatgg

SEQ ID NO: 724325 - DNA, 25 bp, Mus musculus
gtcaaacagcggttggtacccatgg

SEQ ID NO: 724326 - DNA, 25 bp, Mus musculus
gtcaaaccttaaccggcatcagaag

SEQ ID NO: 724327 - DNA, 25 bp, Mus musculus
gtcaaaccttaagcggcatcagaag

SEQ ID NO: 724328 - DNA, 25 bp, Mus musculus
gtcaaactgatacgcgtgtgcacac

SEQ ID NO: 724329 - DNA, 25 bp, Mus musculus
gtcaaactgataggcgtgtgcacac

SEQ ID NO: 724330 - DNA, 25 bp, Mus musculus
gtcaaagaaattatctgttccagcc

SEQ ID NO: 724331 - DNA, 25 bp, Mus musculus
gtcaaagaaattttctgttccagcc

SEQ ID NO: 724332 - DNA, 25 bp, Mus musculus
gtcaaagaataacaacacagagtca

SEQ ID NO: 724333 - DNA, 25 bp, Mus musculus
gtcaaagaataagaacacagagtca

SEQ ID NO: 724334 - DNA, 25 bp, Mus musculus
gtcaaagacttgctcgccctaggcc

SEQ ID NO: 724335 - DNA, 25 bp, Mus musculus
gtcaaagacttggtcgccctaggcc

SEQ ID NO: 724336 - DNA, 25 bp, Mus musculus
gtcaaagagaaacctgggccgccat

SEQ ID NO: 724337 - DNA, 25 bp, Mus musculus
gtcaaagagaaagctgggccgccat

SEQ ID NO: 724338 - DNA, 25 bp, Mus musculus
gtcaaagccattaccagacccttct

SEQ ID NO: 724339 - DNA, 25 bp, Mus musculus
gtcaaagccatttccagacccttct

SEQ ID NO: 724340 - DNA, 25 bp, Mus musculus
gtcaaaggaaagctaggcagactgc

SEQ ID NO: 724341 - DNA, 25 bp, Mus musculus
gtcaaaggaaaggtaggcagactgc

SEQ ID NO: 724342 - DNA, 25 bp, Mus musculus
gtcaaagtcttcctgctgcccgaca

SEQ ID NO: 724343 - DNA, 25 bp, Mus musculus
gtcaaagtcttcgtgctgcccgaca

SEQ ID NO: 724344 - DNA, 25 bp, Mus musculus
gtcaaagttatgacactttgcccca

SEQ ID NO: 724345 - DNA, 25 bp, Mus musculus
gtcaaagttatgtcactttgcccca

SEQ ID NO: 724346 - DNA, 25 bp, Mus musculus
gtcaaatattttaattgccgatctc

SEQ ID NO: 724347 - DNA, 25 bp, Mus musculus
gtcaaatatttttattgccgatctc

SEQ ID NO: 724348 - DNA, 25 bp, Mus musculus
gtcaaattccgcagtccagctgcag

SEQ ID NO: 724349 - DNA, 25 bp, Mus musculus
gtcaaattccgctgtccagctgcag

SEQ ID NO: 724350 - DNA, 25 bp, Mus musculus
gtcaaattctcacttcctagctgtg

SEQ ID NO: 724351 - DNA, 25 bp, Mus musculus
gtcaaattctcagttcctagctgtg

SEQ ID NO: 724352 - DNA, 25 bp, Mus musculus
gtcaacaacagtcctgattccaaaa

SEQ ID NO: 724353 - DNA, 25 bp, Mus musculus
gtcaacaacagtgctgattccaaaa

SEQ ID NO: 724354 - DNA, 25 bp, Mus musculus
gtcaacaacctcaacggcttcgtgg

SEQ ID NO: 724355 - DNA, 25 bp, Mus musculus
gtcaacaacctctacggcttcgtgg

SEQ ID NO: 724356 - DNA, 25 bp, Mus musculus
gtcaacaactccaatggctcccgta

SEQ ID NO: 724357 - DNA, 25 bp, Mus musculus
gtcaacaactcctatggctcccgta

SEQ ID NO: 724358 - DNA, 25 bp, Mus musculus
gtcaacaagcagctacccgtgaaag

SEQ ID NO: 724359 - DNA, 25 bp, Mus musculus
gtcaacaagcaggtacccgtgaaag

SEQ ID NO: 724360 - DNA, 25 bp, Mus musculus
gtcaacaatatgctgctgactgcag

SEQ ID NO: 724361 - DNA, 25 bp, Mus musculus
gtcaacaatatggtgctgactgcag

SEQ ID NO: 724362 - DNA, 25 bp, Mus musculus
gtcaacacgttcacaattttcaagg

SEQ ID NO: 724363 - DNA, 25 bp, Mus musculus
gtcaacacgttctcaattttcaagg

SEQ ID NO: 724364 - DNA, 25 bp, Mus musculus
gtcaacagagacaagatagggaaat

SEQ ID NO: 724365 - DNA, 25 bp, Mus musculus
gtcaacagagactagatagggaaat

SEQ ID NO: 724366 - DNA, 25 bp, Mus musculus
gtcaacatacttcaatccaccagcg

SEQ ID NO: 724367 - DNA, 25 bp, Mus musculus
gtcaacatacttgaatccaccagcg

SEQ ID NO: 724368 - DNA, 25 bp, Mus musculus
gtcaacatggagcatctgcgggagc

SEQ ID NO: 724369 - DNA, 25 bp, Mus musculus
gtcaacatggaggatctgcgggagc

SEQ ID NO: 724370 - DNA, 25 bp, Mus musculus
gtcaaccagggacaaggaacccact

SEQ ID NO: 724371 - DNA, 25 bp, Mus musculus
gtcaaccagggagaaggaacccact

SEQ ID NO: 724372 - DNA, 25 bp, Mus musculus
gtcaaccagtaacgcaacagctagg

SEQ ID NO: 724373 - DNA, 25 bp, Mus musculus
gtcaaccagtaaggcaacagctagg

SEQ ID NO: 724374 - DNA, 25 bp, Mus musculus
gtcaacccaaacatctccttgcatt

SEQ ID NO: 724375 - DNA, 25 bp, Mus musculus
gtcaacccaaacttctccttgcatt

SEQ ID NO: 724376 - DNA, 25 bp, Mus musculus
gtcaaccccaaacagcccaaggaga

SEQ ID NO: 724377 - DNA, 25 bp, Mus musculus
gtcaaccccaaagagcccaaggaga

SEQ ID NO: 724378 - DNA, 25 bp, Mus musculus
gtcaacccggcaccctcaatggaga

SEQ ID NO: 724379 - DNA, 25 bp, Mus musculus
gtcaacccggcagcctcaatggaga

SEQ ID NO: 724380 - DNA, 25 bp, Mus musculus
gtcaaccgactgagggccggcacta

SEQ ID NO: 724381 - DNA, 25 bp, Mus musculus
gtcaaccgactgtgggccggcacta

SEQ ID NO: 724382 - DNA, 25 bp, Mus musculus
gtcaaccggatgcacatcagtccca

SEQ ID NO: 724383 - DNA, 25 bp, Mus musculus
gtcaaccggatggacatcagtccca

SEQ ID NO: 724384 - DNA, 25 bp, Mus musculus
gtcaacctctccagactgggaaggt

SEQ ID NO: 724385 - DNA, 25 bp, Mus musculus
gtcaacctctcctgactgggaaggt

SEQ ID NO: 724386 - DNA, 25 bp, Mus musculus
gtcaacctgaccatattggagacaa

SEQ ID NO: 724387 - DNA, 25 bp, Mus musculus
gtcaacctgaccttattggagacaa

SEQ ID NO: 724388 - DNA, 25 bp, Mus musculus
gtcaacctgggcaagggacgttaca

SEQ ID NO: 724389 - DNA, 25 bp, Mus musculus
gtcaacctgggctagggacgttaca

SEQ ID NO: 724390 - DNA, 25 bp, Mus musculus
gtcaaccttcctagctcctttcaag

SEQ ID NO: 724391 - DNA, 25 bp, Mus musculus
gtcaaccttccttgctcctttcaag

SEQ ID NO: 724392 - DNA, 25 bp, Mus musculus
gtcaacggctgtagaatgagggcca

SEQ ID NO: 724393 - DNA, 25 bp, Mus musculus
gtcaacggctgttgaatgagggcca

SEQ ID NO: 724394 - DNA, 25 bp, Mus musculus
gtcaacgggagcctcttcccagctg

SEQ ID NO: 724395 - DNA, 25 bp, Mus musculus
gtcaacgggagcgtcttcccagctg

SEQ ID NO: 724396 - DNA, 25 bp, Mus musculus
gtcaacgtgtggaactctgtcaatg

SEQ ID NO: 724397 - DNA, 25 bp, Mus musculus
gtcaacgtgtggtactctgtcaatg

SEQ ID NO: 724398 - DNA, 25 bp, Mus musculus
gtcaactacctacaaaatggcattg

SEQ ID NO: 724399 - DNA, 25 bp, Mus musculus
gtcaactacctagaaaatggcattg

SEQ ID NO: 724400 - DNA, 25 bp, Mus musculus
gtcaactcacagctcccagacaggg

SEQ ID NO: 724401 - DNA, 25 bp, Mus musculus
gtcaactcacaggtcccagacaggg

SEQ ID NO: 724402 - DNA, 25 bp, Mus musculus
gtcaactcagatcaaaacatactct

SEQ ID NO: 724403 - DNA, 25 bp, Mus musculus
gtcaactcagatgaaaacatactct

SEQ ID NO: 724404 - DNA, 25 bp, Mus musculus
gtcaactgtcagactcactgctcct

SEQ ID NO: 724405 - DNA, 25 bp, Mus musculus
gtcaactgtcagtctcactgctcct

SEQ ID NO: 724406 - DNA, 25 bp, Mus musculus
gtcaactgtccacgccactgcagat

SEQ ID NO: 724407 - DNA, 25 bp, Mus musculus
gtcaactgtccaggccactgcagat

SEQ ID NO: 724408 - DNA, 25 bp, Mus musculus
gtcaagaacaggaaagagactctaa

SEQ ID NO: 724409 - DNA, 25 bp, Mus musculus
gtcaagaacaggtaagagactctaa

SEQ ID NO: 724410 - DNA, 25 bp, Mus musculus
gtcaagaaccttaaactgcttccat

SEQ ID NO: 724411 - DNA, 25 bp, Mus musculus
gtcaagaacctttaactgcttccat

SEQ ID NO: 724412 - DNA, 25 bp, Mus musculus
gtcaagacaacaacggcggctgcca

SEQ ID NO: 724413 - DNA, 25 bp, Mus musculus
gtcaagacaacatcggcggctgcca

SEQ ID NO: 724414 - DNA, 25 bp, Mus musculus
gtcaagacttggattctagtgcgca

SEQ ID NO: 724415 - DNA, 25 bp, Mus musculus
gtcaagacttggtttctagtgcgca

SEQ ID NO: 724416 - DNA, 25 bp, Mus musculus
gtcaagagccacagcaaactaccgg

SEQ ID NO: 724417 - DNA, 25 bp, Mus musculus
gtcaagagccactgcaaactaccgg

SEQ ID NO: 724418 - DNA, 25 bp, Mus musculus
gtcaagatccgcaggattcgcgcca

SEQ ID NO: 724419 - DNA, 25 bp, Mus musculus
gtcaagatccgctggattcgcgcca

SEQ ID NO: 724420 - DNA, 25 bp, Mus musculus
gtcaagatctccactgaagttggca

SEQ ID NO: 724421 - DNA, 25 bp, Mus musculus
gtcaagatctcctctgaagttggca

SEQ ID NO: 724422 - DNA, 25 bp, Mus musculus
gtcaagatgtagaggaaaccatatt

SEQ ID NO: 724423 - DNA, 25 bp, Mus musculus
gtcaagatgtagtggaaaccatatt

SEQ ID NO: 724424 - DNA, 25 bp, Mus musculus
gtcaagcactctaacaggctctaag

SEQ ID NO: 724425 - DNA, 25 bp, Mus musculus
gtcaagcactcttacaggctctaag

SEQ ID NO: 724426 - DNA, 25 bp, Mus musculus
gtcaagcattcacaaggaccttctg

SEQ ID NO: 724427 - DNA, 25 bp, Mus musculus
gtcaagcattcagaaggaccttctg

SEQ ID NO: 724428 - DNA, 25 bp, Mus musculus
gtcaagcccaggattctatgagaaa

SEQ ID NO: 724429 - DNA, 25 bp, Mus musculus
gtcaagcccaggtttctatgagaaa

SEQ ID NO: 724430 - DNA, 25 bp, Mus musculus
gtcaagcctcttctggtcccggtgc

SEQ ID NO: 724431 - DNA, 25 bp, Mus musculus
gtcaagcctcttgtggtcccggtgc

SEQ ID NO: 724432 - DNA, 25 bp, Mus musculus
gtcaagctgagcagtcagctcgatt

SEQ ID NO: 724433 - DNA, 25 bp, Mus musculus
gtcaagctgagctgtcagctcgatt

SEQ ID NO: 724434 - DNA, 25 bp, Mus musculus
gtcaaggaacctcagtcaccgtctc

SEQ ID NO: 724435 - DNA, 25 bp, Mus musculus
gtcaaggaacctgagtcaccgtctc

SEQ ID NO: 724436 - DNA, 25 bp, Mus musculus
gtcaaggcaagcatcgcggacgcgc

SEQ ID NO: 724437 - DNA, 25 bp, Mus musculus
gtcaaggcaagcttcgcggacgcgc

SEQ ID NO: 724438 - DNA, 25 bp, Mus musculus
gtcaaggcaccaatctgaatcagag

SEQ ID NO: 724439 - DNA, 25 bp, Mus musculus
gtcaaggcaccattctgaatcagag

SEQ ID NO: 724440 - DNA, 25 bp, Mus musculus
gtcaaggcggtcagcaccggagccc

SEQ ID NO: 724441 - DNA, 25 bp, Mus musculus
gtcaaggcggtctgcaccggagccc

SEQ ID NO: 724442 - DNA, 25 bp, Mus musculus
gtcaaggctttgacatgcaagaggt

SEQ ID NO: 724443 - DNA, 25 bp, Mus musculus
gtcaaggctttgtcatgcaagaggt

SEQ ID NO: 724444 - DNA, 25 bp, Mus musculus
gtcaagggcatcctgcggaacttta

SEQ ID NO: 724445 - DNA, 25 bp, Mus musculus
gtcaagggcatcgtgcggaacttta

SEQ ID NO: 724446 - DNA, 25 bp, Mus musculus
gtcaaggtgggacacccctgtcaga

SEQ ID NO: 724447 - DNA, 25 bp, Mus musculus
gtcaaggtgggagacccctgtcaga

SEQ ID NO: 724448 - DNA, 25 bp, Mus musculus
gtcaagtacctcatggcctcagacc

SEQ ID NO: 724449 - DNA, 25 bp, Mus musculus
gtcaagtacctcttggcctcagacc

SEQ ID NO: 724450 - DNA, 25 bp, Mus musculus
gtcaagtcagagaagggcaagccta

SEQ ID NO: 724451 - DNA, 25 bp, Mus musculus
gtcaagtcagagtagggcaagccta

SEQ ID NO: 724452 - DNA, 25 bp, Mus musculus
gtcaagtccttgctgcacgagggct

SEQ ID NO: 724453 - DNA, 25 bp, Mus musculus
gtcaagtccttggtgcacgagggct

SEQ ID NO: 724454 - DNA, 25 bp, Mus musculus
gtcaagtctctcatagaccggtact

SEQ ID NO: 724455 - DNA, 25 bp, Mus musculus
gtcaagtctctcttagaccggtact

SEQ ID NO: 724456 - DNA, 25 bp, Mus musculus
gtcaagttcaccaaccccagtgagg

SEQ ID NO: 724457 - DNA, 25 bp, Mus musculus
gtcaagttcacctaccccagtgagg

SEQ ID NO: 724458 - DNA, 25 bp, Mus musculus
gtcaagttgcgacccctacatagcg

SEQ ID NO: 724459 - DNA, 25 bp, Mus musculus
gtcaagttgcgagccctacatagcg

SEQ ID NO: 724460 - DNA, 25 bp, Mus musculus
gtcaatatcgttcccggattcggcc

SEQ ID NO: 724461 - DNA, 25 bp, Mus musculus
gtcaatatcgttgccggattcggcc

SEQ ID NO: 724462 - DNA, 25 bp, Mus musculus
gtcaatcaatatcctaagtggtgga

SEQ ID NO: 724463 - DNA, 25 bp, Mus musculus
gtcaatcaatatgctaagtggtgga

SEQ ID NO: 724464 - DNA, 25 bp, Mus musculus
gtcaatcctacaccataaccatggt

SEQ ID NO: 724465 - DNA, 25 bp, Mus musculus
gtcaatcctacagcataaccatggt

SEQ ID NO: 724466 - DNA, 25 bp, Mus musculus
gtcaatcctcagaacagggccgctc

SEQ ID NO: 724467 - DNA, 25 bp, Mus musculus
gtcaatcctcagtacagggccgctc

SEQ ID NO: 724468 - DNA, 25 bp, Mus musculus
gtcaatctgtgtcgacatcagctcc

SEQ ID NO: 724469 - DNA, 25 bp, Mus musculus
gtcaatctgtgtggacatcagctcc

SEQ ID NO: 724470 - DNA, 25 bp, Mus musculus
gtcaatgacatactaattggtatcc

SEQ ID NO: 724471 - DNA, 25 bp, Mus musculus
gtcaatgacatagtaattggtatcc

SEQ ID NO: 724472 - DNA, 25 bp, Mus musculus
gtcaatgctgccagggatcgtctct

SEQ ID NO: 724473 - DNA, 25 bp, Mus musculus
gtcaatgctgcctgggatcgtctct

SEQ ID NO: 724474 - DNA, 25 bp, Mus musculus
gtcaatggaggcagcttcttcccgg

SEQ ID NO: 724475 - DNA, 25 bp, Mus musculus
gtcaatggaggctgcttcttcccgg

SEQ ID NO: 724476 - DNA, 25 bp, Mus musculus
gtcaattaacatctgacgctgcccc

SEQ ID NO: 724477 - DNA, 25 bp, Mus musculus
gtcaattaacatgtgacgctgcccc

SEQ ID NO: 724478 - DNA, 25 bp, Mus musculus
gtcaattaccatcctcggcattacc

SEQ ID NO: 724479 - DNA, 25 bp, Mus musculus
gtcaattaccatgctcggcattacc

SEQ ID NO: 724480 - DNA, 25 bp, Mus musculus
gtcacaaaaagtacctcagcaaata

SEQ ID NO: 724481 - DNA, 25 bp, Mus musculus
gtcacaaaaagttcctcagcaaata

SEQ ID NO: 724482 - DNA, 25 bp, Mus musculus
gtcacaaacagtataaactacattg

SEQ ID NO: 724483 - DNA, 25 bp, Mus musculus
gtcacaaacagtttaaactacattg

SEQ ID NO: 724484 - DNA, 25 bp, Mus musculus
gtcacaaagacacaattggagaaat

SEQ ID NO: 724485 - DNA, 25 bp, Mus musculus
gtcacaaagacagaattggagaaat

SEQ ID NO: 724486 - DNA, 25 bp, Mus musculus
gtcacaaagccgagacctcctttcg

SEQ ID NO: 724487 - DNA, 25 bp, Mus musculus
gtcacaaagccgtgacctcctttcg

SEQ ID NO: 724488 - DNA, 25 bp, Mus musculus
gtcacaagtgcccaacatgcctagc

SEQ ID NO: 724489 - DNA, 25 bp, Mus musculus
gtcacaagtgccgaacatgcctagc

SEQ ID NO: 724490 - DNA, 25 bp, Mus musculus
gtcacaatctgtaataggaaaccat

SEQ ID NO: 724491 - DNA, 25 bp, Mus musculus
gtcacaatctgttataggaaaccat

SEQ ID NO: 724492 - DNA, 25 bp, Mus musculus
gtcacaatggacagcgagttgtgga

SEQ ID NO: 724493 - DNA, 25 bp, Mus musculus
gtcacaatggactgcgagttgtgga

SEQ ID NO: 724494 - DNA, 25 bp, Mus musculus
gtcacacaagctaaagacgggccat

SEQ ID NO: 724495 - DNA, 25 bp, Mus musculus
gtcacacaagcttaagacgggccat

SEQ ID NO: 724496 - DNA, 25 bp, Mus musculus
gtcacaccccaacgtggtgaatctg

SEQ ID NO: 724497 - DNA, 25 bp, Mus musculus
gtcacaccccaaggtggtgaatctg

SEQ ID NO: 724498 - DNA, 25 bp, Mus musculus
gtcacacctgaaatgctttgcctaa

SEQ ID NO: 724499 - DNA, 25 bp, Mus musculus
gtcacacctgaattgctttgcctaa

SEQ ID NO: 724500 - DNA, 25 bp, Mus musculus
gtcacacggagacaaaggccaagct

SEQ ID NO: 724501 - DNA, 25 bp, Mus musculus
gtcacacggagagaaaggccaagct

SEQ ID NO: 724502 - DNA, 25 bp, Mus musculus
gtcacacggttaacctcacagaagg

SEQ ID NO: 724503 - DNA, 25 bp, Mus musculus
gtcacacggttatcctcacagaagg

SEQ ID NO: 724504 - DNA, 25 bp, Mus musculus
gtcacactgaagcaactagcgtgtg

SEQ ID NO: 724505 - DNA, 25 bp, Mus musculus
gtcacactgaaggaactagcgtgtg

SEQ ID NO: 724506 - DNA, 25 bp, Mus musculus
gtcacactgcccaatttccacagtt

SEQ ID NO: 724507 - DNA, 25 bp, Mus musculus
gtcacactgccctatttccacagtt

SEQ ID NO: 724508 - DNA, 25 bp, Mus musculus
gtcacactgtgcctaagaactccaa

SEQ ID NO: 724509 - DNA, 25 bp, Mus musculus
gtcacactgtgcgtaagaactccaa

SEQ ID NO: 724510 - DNA, 25 bp, Mus musculus
gtcacagaaacaccctggaggccgt

SEQ ID NO: 724511 - DNA, 25 bp, Mus musculus
gtcacagaaacagcctggaggccgt

SEQ ID NO: 724512 - DNA, 25 bp, Mus musculus
gtcacagaaactagtcacatgcaca

SEQ ID NO: 724513 - DNA, 25 bp, Mus musculus
gtcacagaaacttgtcacatgcaca

SEQ ID NO: 724514 - DNA, 25 bp, Mus musculus
gtcacagacaccagacttgcttgca

SEQ ID NO: 724515 - DNA, 25 bp, Mus musculus
gtcacagacacctgacttgcttgca

SEQ ID NO: 724516 - DNA, 25 bp, Mus musculus
gtcacagacctgatctaccaagcca

SEQ ID NO: 724517 - DNA, 25 bp, Mus musculus
gtcacagacctgttctaccaagcca

SEQ ID NO: 724518 - DNA, 25 bp, Mus musculus
gtcacagagccacgtgctttgcgga

SEQ ID NO: 724519 - DNA, 25 bp, Mus musculus
gtcacagagccaggtgctttgcgga

SEQ ID NO: 724520 - DNA, 25 bp, Mus musculus
gtcacagcagcacgtcccgggtcgt

SEQ ID NO: 724521 - DNA, 25 bp, Mus musculus
gtcacagcagcaggtcccgggtcgt

SEQ ID NO: 724522 - DNA, 25 bp, Mus musculus
gtcacagcatggatgcaatgcctgg

SEQ ID NO: 724523 - DNA, 25 bp, Mus musculus
gtcacagcatggttgcaatgcctgg

SEQ ID NO: 724524 - DNA, 25 bp, Mus musculus
gtcacagcccctctagaggccgagt

SEQ ID NO: 724525 - DNA, 25 bp, Mus musculus
gtcacagcccctgtagaggccgagt

SEQ ID NO: 724526 - DNA, 25 bp, Mus musculus
gtcacagcctgtcagaaattctcca

SEQ ID NO: 724527 - DNA, 25 bp, Mus musculus
gtcacagcctgtgagaaattctcca

SEQ ID NO: 724528 - DNA, 25 bp, Mus musculus
gtcacagctaggaccgacagccaat

SEQ ID NO: 724529 - DNA, 25 bp, Mus musculus
gtcacagctaggtccgacagccaat

SEQ ID NO: 724530 - DNA, 25 bp, Mus musculus
gtcacagctctgcaacggcaagtct

SEQ ID NO: 724531 - DNA, 25 bp, Mus musculus
gtcacagctctggaacggcaagtct

SEQ ID NO: 724532 - DNA, 25 bp, Mus musculus
gtcacagctgcaacatccacagcat

SEQ ID NO: 724533 - DNA, 25 bp, Mus musculus
gtcacagctgcatcatccacagcat

SEQ ID NO: 724534 - DNA, 25 bp, Mus musculus
gtcacaggctctcttgtcatgaagg

SEQ ID NO: 724535 - DNA, 25 bp, Mus musculus
gtcacaggctctgttgtcatgaagg

SEQ ID NO: 724536 - DNA, 25 bp, Mus musculus
gtcacagtagcgagtcactctggcc

SEQ ID NO: 724537 - DNA, 25 bp, Mus musculus
gtcacagtagcgtgtcactctggcc

SEQ ID NO: 724538 - DNA, 25 bp, Mus musculus
gtcacagtcacaagggaaaacccaa

SEQ ID NO: 724539 - DNA, 25 bp, Mus musculus
gtcacagtcacatgggaaaacccaa

SEQ ID NO: 724540 - DNA, 25 bp, Mus musculus
gtcacagtgcccagccccaaagtat

SEQ ID NO: 724541 - DNA, 25 bp, Mus musculus
gtcacagtgccctgccccaaagtat

SEQ ID NO: 724542 - DNA, 25 bp, Mus musculus
gtcacagtttttccatcccaagccg

SEQ ID NO: 724543 - DNA, 25 bp, Mus musculus
gtcacagtttttgcatcccaagccg

SEQ ID NO: 724544 - DNA, 25 bp, Mus musculus
gtcacatagatgactctgagattca

SEQ ID NO: 724545 - DNA, 25 bp, Mus musculus
gtcacatagatgtctctgagattca

SEQ ID NO: 724546 - DNA, 25 bp, Mus musculus
gtcacatcacaacagatcacaacag

SEQ ID NO: 724547 - DNA, 25 bp, Mus musculus
gtcacatcacaagagatcacaacag

SEQ ID NO: 724548 - DNA, 25 bp, Mus musculus
gtcacatgctggattcaaaaagata

SEQ ID NO: 724549 - DNA, 25 bp, Mus musculus
gtcacatgctggtttcaaaaagata

SEQ ID NO: 724550 - DNA, 25 bp, Mus musculus
gtcacatttgacagcgctgcccaca

SEQ ID NO: 724551 - DNA, 25 bp, Mus musculus
gtcacatttgactgcgctgcccaca

SEQ ID NO: 724552 - DNA, 25 bp, Mus musculus
gtcaccaaagttaccctgtgcccgg

SEQ ID NO: 724553 - DNA, 25 bp, Mus musculus
gtcaccaaagtttccctgtgcccgg

SEQ ID NO: 724554 - DNA, 25 bp, Mus musculus
gtcaccaacaacctcaagtctcttg

SEQ ID NO: 724555 - DNA, 25 bp, Mus musculus
gtcaccaacaacgtcaagtctcttg

SEQ ID NO: 724556 - DNA, 25 bp, Mus musculus
gtcaccaacctaaacaatgcatttg

SEQ ID NO: 724557 - DNA, 25 bp, Mus musculus
gtcaccaacctatacaatgcatttg

SEQ ID NO: 724558 - DNA, 25 bp, Mus musculus
gtcaccaagaatcggcagaagcgag

SEQ ID NO: 724559 - DNA, 25 bp, Mus musculus
gtcaccaagaatgggcagaagcgag

SEQ ID NO: 724560 - DNA, 25 bp, Mus musculus
gtcaccaagccgcaaccggaagcgg

SEQ ID NO: 724561 - DNA, 25 bp, Mus musculus
gtcaccaagccggaaccggaagcgg

SEQ ID NO: 724562 - DNA, 25 bp, Mus musculus
gtcaccaagtacaaatgccttctaa

SEQ ID NO: 724563 - DNA, 25 bp, Mus musculus
gtcaccaagtactaatgccttctaa

SEQ ID NO: 724564 - DNA, 25 bp, Mus musculus
gtcaccacaccaaattttacacaga

SEQ ID NO: 724565 - DNA, 25 bp, Mus musculus
gtcaccacaccatattttacacaga

SEQ ID NO: 724566 - DNA, 25 bp, Mus musculus
gtcaccacagtgacaacccaaggct

SEQ ID NO: 724567 - DNA, 25 bp, Mus musculus
gtcaccacagtgtcaacccaaggct

SEQ ID NO: 724568 - DNA, 25 bp, Mus musculus
gtcaccagaagtacattgttcatag

SEQ ID NO: 724569 - DNA, 25 bp, Mus musculus
gtcaccagaagttcattgttcatag

SEQ ID NO: 724570 - DNA, 25 bp, Mus musculus
gtcaccagctcaccagcaggcaaag

SEQ ID NO: 724571 - DNA, 25 bp, Mus musculus
gtcaccagctcagcagcaggcaaag

SEQ ID NO: 724572 - DNA, 25 bp, Mus musculus
gtcaccaggcttatgagtctccaac

SEQ ID NO: 724573 - DNA, 25 bp, Mus musculus
gtcaccaggcttttgagtctccaac

SEQ ID NO: 724574 - DNA, 25 bp, Mus musculus
gtcaccatcatcaccgtgccaatag

SEQ ID NO: 724575 - DNA, 25 bp, Mus musculus
gtcaccatcatctccgtgccaatag

SEQ ID NO: 724576 - DNA, 25 bp, Mus musculus
gtcaccatccaaagtgactctggct

SEQ ID NO: 724577 - DNA, 25 bp, Mus musculus
gtcaccatccaatgtgactctggct

SEQ ID NO: 724578 - DNA, 25 bp, Mus musculus
gtcaccatccacaatcgactctggt

SEQ ID NO: 724579 - DNA, 25 bp, Mus musculus
gtcaccatccactatcgactctggt

SEQ ID NO: 724580 - DNA, 25 bp, Mus musculus
gtcaccatgagcaatgtcgcagatg

SEQ ID NO: 724581 - DNA, 25 bp, Mus musculus
gtcaccatgagctatgtcgcagatg

SEQ ID NO: 724582 - DNA, 25 bp, Mus musculus
gtcaccatggcaaccttgtccctgg

SEQ ID NO: 724583 - DNA, 25 bp, Mus musculus
gtcaccatggcatccttgtccctgg

SEQ ID NO: 724584 - DNA, 25 bp, Mus musculus
gtcaccatttgccagcacacgtcgt

SEQ ID NO: 724585 - DNA, 25 bp, Mus musculus
gtcaccatttgcgagcacacgtcgt

SEQ ID NO: 724586 - DNA, 25 bp, Mus musculus
gtcacccggatccagagcacgaatt

SEQ ID NO: 724587 - DNA, 25 bp, Mus musculus
gtcacccggatcgagagcacgaatt

SEQ ID NO: 724588 - DNA, 25 bp, Mus musculus
gtcacccgttccaggagggacaagc

SEQ ID NO: 724589 - DNA, 25 bp, Mus musculus
gtcacccgttcctggagggacaagc

SEQ ID NO: 724590 - DNA, 25 bp, Mus musculus
gtcaccgacatcatcattgccaaca

SEQ ID NO: 724591 - DNA, 25 bp, Mus musculus
gtcaccgacatcttcattgccaaca

SEQ ID NO: 724592 - DNA, 25 bp, Mus musculus
gtcaccgcttttcctacgacacttt

SEQ ID NO: 724593 - DNA, 25 bp, Mus musculus
gtcaccgcttttgctacgacacttt

SEQ ID NO: 724594 - DNA, 25 bp, Mus musculus
gtcacctaatccaggtggccgccgg

SEQ ID NO: 724595 - DNA, 25 bp, Mus musculus
gtcacctaatcctggtggccgccgg

SEQ ID NO: 724596 - DNA, 25 bp, Mus musculus
gtcacctacagacagttgaagaaag

SEQ ID NO: 724597 - DNA, 25 bp, Mus musculus
gtcacctacagagagttgaagaaag

SEQ ID NO: 724598 - DNA, 25 bp, Mus musculus
gtcacctaccccagtgtcctgggat

SEQ ID NO: 724599 - DNA, 25 bp, Mus musculus
gtcacctacccctgtgtcctgggat

SEQ ID NO: 724600 - DNA, 25 bp, Mus musculus
gtcacctcaacgactgtagctttag

SEQ ID NO: 724601 - DNA, 25 bp, Mus musculus
gtcacctcaacgtctgtagctttag

SEQ ID NO: 724602 - DNA, 25 bp, Mus musculus
gtcacctgcagtaccagccaaaaag

SEQ ID NO: 724603 - DNA, 25 bp, Mus musculus
gtcacctgcagttccagccaaaaag

SEQ ID NO: 724604 - DNA, 25 bp, Mus musculus
gtcacctggaccctgcttaggaccg

SEQ ID NO: 724605 - DNA, 25 bp, Mus musculus
gtcacctggaccgtgcttaggaccg

SEQ ID NO: 724606 - DNA, 25 bp, Mus musculus
gtcaccttcgtcaccagtagaagtg

SEQ ID NO: 724607 - DNA, 25 bp, Mus musculus
gtcaccttcgtctccagtagaagtg

SEQ ID NO: 724608 - DNA, 25 bp, Mus musculus
gtcacgaacactacaccacagagtt

SEQ ID NO: 724609 - DNA, 25 bp, Mus musculus
gtcacgaacacttcaccacagagtt

SEQ ID NO: 724610 - DNA, 25 bp, Mus musculus
gtcacgaacataatcaaaattgtcg

SEQ ID NO: 724611 - DNA, 25 bp, Mus musculus
gtcacgaacatattcaaaattgtcg

SEQ ID NO: 724612 - DNA, 25 bp, Mus musculus
gtcacgacatcgacttacgcagaag

SEQ ID NO: 724613 - DNA, 25 bp, Mus musculus
gtcacgacatcgtcttacgcagaag

SEQ ID NO: 724614 - DNA, 25 bp, Mus musculus
gtcacgcggtgtataagctcacgta

SEQ ID NO: 724615 - DNA, 25 bp, Mus musculus
gtcacgcggtgtttaagctcacgta

SEQ ID NO: 724616 - DNA, 25 bp, Mus musculus
gtcacgctcacgctgtaacacaagc

SEQ ID NO: 724617 - DNA, 25 bp, Mus musculus
gtcacgctcacggtgtaacacaagc

SEQ ID NO: 724618 - DNA, 25 bp, Mus musculus
gtcacgctggcccacttcaagaacg

SEQ ID NO: 724619 - DNA, 25 bp, Mus musculus
gtcacgctggccgacttcaagaacg

SEQ ID NO: 724620 - DNA, 25 bp, Mus musculus
gtcacggtggttcgctgtgattacc

SEQ ID NO: 724621 - DNA, 25 bp, Mus musculus
gtcacggtggttggctgtgattacc

SEQ ID NO: 724622 - DNA, 25 bp, Mus musculus
gtcacgtgtcttccttttcacccaa

SEQ ID NO: 724623 - DNA, 25 bp, Mus musculus
gtcacgtgtcttgcttttcacccaa

SEQ ID NO: 724624 - DNA, 25 bp, Mus musculus
gtcactaacagcacaggccgtctca

SEQ ID NO: 724625 - DNA, 25 bp, Mus musculus
gtcactaacagctcaggccgtctca

SEQ ID NO: 724626 - DNA, 25 bp, Mus musculus
gtcactacagtgaccccatgtaccg

SEQ ID NO: 724627 - DNA, 25 bp, Mus musculus
gtcactacagtgtccccatgtaccg

SEQ ID NO: 724628 - DNA, 25 bp, Mus musculus
gtcactagaggacaccaaggaacag

SEQ ID NO: 724629 - DNA, 25 bp, Mus musculus
gtcactagaggagaccaaggaacag

SEQ ID NO: 724630 - DNA, 25 bp, Mus musculus
gtcactagctctcaacccagtgcag

SEQ ID NO: 724631 - DNA, 25 bp, Mus musculus
gtcactagctctgaacccagtgcag

SEQ ID NO: 724632 - DNA, 25 bp, Mus musculus
gtcactaggattctggagaaaacta

SEQ ID NO: 724633 - DNA, 25 bp, Mus musculus
gtcactaggattgtggagaaaacta

SEQ ID NO: 724634 - DNA, 25 bp, Mus musculus
gtcactatcgtcctctgcggcctgt

SEQ ID NO: 724635 - DNA, 25 bp, Mus musculus
gtcactatcgtcgtctgcggcctgt

SEQ ID NO: 724636 - DNA, 25 bp, Mus musculus
gtcactatgccaccagcaaccgtag

SEQ ID NO: 724637 - DNA, 25 bp, Mus musculus
gtcactatgccagcagcaaccgtag

SEQ ID NO: 724638 - DNA, 25 bp, Mus musculus
gtcactcatgccagtttttctcagc

SEQ ID NO: 724639 - DNA, 25 bp, Mus musculus
gtcactcatgcctgtttttctcagc

SEQ ID NO: 724640 - DNA, 25 bp, Mus musculus
gtcactccgtgacgcagtggcgaca

SEQ ID NO: 724641 - DNA, 25 bp, Mus musculus
gtcactccgtgaggcagtggcgaca

SEQ ID NO: 724642 - DNA, 25 bp, Mus musculus
gtcactcctcaaccaagtgtttgca

SEQ ID NO: 724643 - DNA, 25 bp, Mus musculus
gtcactcctcaagcaagtgtttgca

SEQ ID NO: 724644 - DNA, 25 bp, Mus musculus
gtcactcctctgactaagaactggg

SEQ ID NO: 724645 - DNA, 25 bp, Mus musculus
gtcactcctctgtctaagaactggg

SEQ ID NO: 724646 - DNA, 25 bp, Mus musculus
gtcactcgagcccacgtctacgtgg

SEQ ID NO: 724647 - DNA, 25 bp, Mus musculus
gtcactcgagccgacgtctacgtgg

SEQ ID NO: 724648 - DNA, 25 bp, Mus musculus
gtcactcggctcctacgaaagcagg

SEQ ID NO: 724649 - DNA, 25 bp, Mus musculus
gtcactcggctcgtacgaaagcagg

SEQ ID NO: 724650 - DNA, 25 bp, Mus musculus
gtcactcgggacacacctttccggg

SEQ ID NO: 724651 - DNA, 25 bp, Mus musculus
gtcactcgggactcacctttccggg

SEQ ID NO: 724652 - DNA, 25 bp, Mus musculus
gtcactcgggataggacagagccag

SEQ ID NO: 724653 - DNA, 25 bp, Mus musculus
gtcactcgggattggacagagccag

SEQ ID NO: 724654 - DNA, 25 bp, Mus musculus
gtcactcgtgcacaaggaaaccctg

SEQ ID NO: 724655 - DNA, 25 bp, Mus musculus
gtcactcgtgcagaaggaaaccctg

SEQ ID NO: 724656 - DNA, 25 bp, Mus musculus
gtcactgacgcacctccagagtgct

SEQ ID NO: 724657 - DNA, 25 bp, Mus musculus
gtcactgacgcagctccagagtgct

SEQ ID NO: 724658 - DNA, 25 bp, Mus musculus
gtcactgagcccagcatcctacggt

SEQ ID NO: 724659 - DNA, 25 bp, Mus musculus
gtcactgagccctgcatcctacggt

SEQ ID NO: 724660 - DNA, 25 bp, Mus musculus
gtcactgcagttcatcatcgatgct

SEQ ID NO: 724661 - DNA, 25 bp, Mus musculus
gtcactgcagttgatcatcgatgct

SEQ ID NO: 724662 - DNA, 25 bp, Mus musculus
gtcactgccactactgccgggaggg

SEQ ID NO: 724663 - DNA, 25 bp, Mus musculus
gtcactgccacttctgccgggaggg

SEQ ID NO: 724664 - DNA, 25 bp, Mus musculus
gtcactgctgcacctgcacaaaaag

SEQ ID NO: 724665 - DNA, 25 bp, Mus musculus
gtcactgctgcagctgcacaaaaag

SEQ ID NO: 724666 - DNA, 25 bp, Mus musculus
gtcactgcttcaagatgaaatctcc

SEQ ID NO: 724667 - DNA, 25 bp, Mus musculus
gtcactgcttcatgatgaaatctcc

SEQ ID NO: 724668 - DNA, 25 bp, Mus musculus
gtcactggatttacacaaggcaaga

SEQ ID NO: 724669 - DNA, 25 bp, Mus musculus
gtcactggattttcacaaggcaaga

SEQ ID NO: 724670 - DNA, 25 bp, Mus musculus
gtcactggcatcacgggctcctgtg

SEQ ID NO: 724671 - DNA, 25 bp, Mus musculus
gtcactggcatctcgggctcctgtg

SEQ ID NO: 724672 - DNA, 25 bp, Mus musculus
gtcactgggattcctgtcgcagcca

SEQ ID NO: 724673 - DNA, 25 bp, Mus musculus
gtcactgggattgctgtcgcagcca

SEQ ID NO: 724674 - DNA, 25 bp, Mus musculus
gtcactgggtcacaacccaacagaa

SEQ ID NO: 724675 - DNA, 25 bp, Mus musculus
gtcactgggtcagaacccaacagaa

SEQ ID NO: 724676 - DNA, 25 bp, Mus musculus
gtcactggtatcaaagcacacactg

SEQ ID NO: 724677 - DNA, 25 bp, Mus musculus
gtcactggtatctaagcacacactg

SEQ ID NO: 724678 - DNA, 25 bp, Mus musculus
gtcactgtccagacgcctgtgtctc

SEQ ID NO: 724679 - DNA, 25 bp, Mus musculus
gtcactgtccagtcgcctgtgtctc

SEQ ID NO: 724680 - DNA, 25 bp, Mus musculus
gtcactgttagaacgattgagtagg

SEQ ID NO: 724681 - DNA, 25 bp, Mus musculus
gtcactgttagatcgattgagtagg

SEQ ID NO: 724682 - DNA, 25 bp, Mus musculus
gtcacttccaaccaccgagcgagtg

SEQ ID NO: 724683 - DNA, 25 bp, Mus musculus
gtcacttccaacgaccgagcgagtg

SEQ ID NO: 724684 - DNA, 25 bp, Mus musculus
gtcacttccaagagacgtggctcgc

SEQ ID NO: 724685 - DNA, 25 bp, Mus musculus
gtcacttccaagtgacgtggctcgc

SEQ ID NO: 724686 - DNA, 25 bp, Mus musculus
gtcactttatttcaaagcaactctg

SEQ ID NO: 724687 - DNA, 25 bp, Mus musculus
gtcactttatttgaaagcaactctg

SEQ ID NO: 724688 - DNA, 25 bp, Mus musculus
gtcactttgcttccctgccacggaa

SEQ ID NO: 724689 - DNA, 25 bp, Mus musculus
gtcactttgcttgcctgccacggaa

SEQ ID NO: 724690 - DNA, 25 bp, Mus musculus
gtcagaaaagccatccgagaccgga

SEQ ID NO: 724691 - DNA, 25 bp, Mus musculus
gtcagaaaagccttccgagaccgga

SEQ ID NO: 724692 - DNA, 25 bp, Mus musculus
gtcagaaaattgctgaatacctttc

SEQ ID NO: 724693 - DNA, 25 bp, Mus musculus
gtcagaaaattggtgaatacctttc

SEQ ID NO: 724694 - DNA, 25 bp, Mus musculus
gtcagaaacgatcgcagccctggca

SEQ ID NO: 724695 - DNA, 25 bp, Mus musculus
gtcagaaacgatggcagccctggca

SEQ ID NO: 724696 - DNA, 25 bp, Mus musculus
gtcagaaagagacccaagaacgcac

SEQ ID NO: 724697 - DNA, 25 bp, Mus musculus
gtcagaaagagagccaagaacgcac

SEQ ID NO: 724698 - DNA, 25 bp, Mus musculus
gtcagaacagatacgggagttaaga

SEQ ID NO: 724699 - DNA, 25 bp, Mus musculus
gtcagaacagattcgggagttaaga

SEQ ID NO: 724700 - DNA, 25 bp, Mus musculus
gtcagaaccagcagctataaccggg

SEQ ID NO: 724701 - DNA, 25 bp, Mus musculus
gtcagaaccagctgctataaccggg

SEQ ID NO: 724702 - DNA, 25 bp, Mus musculus
gtcagaacgttgcagccatccagga

SEQ ID NO: 724703 - DNA, 25 bp, Mus musculus
gtcagaacgttggagccatccagga

SEQ ID NO: 724704 - DNA, 25 bp, Mus musculus
gtcagaacttagagaagccctcgac

SEQ ID NO: 724705 - DNA, 25 bp, Mus musculus
gtcagaacttagtgaagccctcgac

SEQ ID NO: 724706 - DNA, 25 bp, Mus musculus
gtcagaagcgatcggcagattccag

SEQ ID NO: 724707 - DNA, 25 bp, Mus musculus
gtcagaagcgatgggcagattccag

SEQ ID NO: 724708 - DNA, 25 bp, Mus musculus
gtcagaagggacctgtctgcaccgc

SEQ ID NO: 724709 - DNA, 25 bp, Mus musculus
gtcagaagggacgtgtctgcaccgc

SEQ ID NO: 724710 - DNA, 25 bp, Mus musculus
gtcagaatgcacagctccgtgtact

SEQ ID NO: 724711 - DNA, 25 bp, Mus musculus
gtcagaatgcactgctccgtgtact

SEQ ID NO: 724712 - DNA, 25 bp, Mus musculus
gtcagacaactcaggaaggcaccag

SEQ ID NO: 724713 - DNA, 25 bp, Mus musculus
gtcagacaactctggaaggcaccag

SEQ ID NO: 724714 - DNA, 25 bp, Mus musculus
gtcagacacccaccgttttgaggta

SEQ ID NO: 724715 - DNA, 25 bp, Mus musculus
gtcagacacccagcgttttgaggta

SEQ ID NO: 724716 - DNA, 25 bp, Mus musculus
gtcagaccaagccacctactatggc

SEQ ID NO: 724717 - DNA, 25 bp, Mus musculus
gtcagaccaagcgacctactatggc

SEQ ID NO: 724718 - DNA, 25 bp, Mus musculus
gtcagacctcctcatactcgtgcat

SEQ ID NO: 724719 - DNA, 25 bp, Mus musculus
gtcagacctcctgatactcgtgcat

SEQ ID NO: 724720 - DNA, 25 bp, Mus musculus
gtcagactgagaagagaacttgaaa

SEQ ID NO: 724721 - DNA, 25 bp, Mus musculus
gtcagactgagatgagaacttgaaa

SEQ ID NO: 724722 - DNA, 25 bp, Mus musculus
gtcagacttgtaacatcctatccag

SEQ ID NO: 724723 - DNA, 25 bp, Mus musculus
gtcagacttgtatcatcctatccag

SEQ ID NO: 724724 - DNA, 25 bp, Mus musculus
gtcagactttcacgagaagctgagc

SEQ ID NO: 724725 - DNA, 25 bp, Mus musculus
gtcagactttcaggagaagctgagc

SEQ ID NO: 724726 - DNA, 25 bp, Mus musculus
gtcagagatgcacaggcattacgtc

SEQ ID NO: 724727 - DNA, 25 bp, Mus musculus
gtcagagatgcagaggcattacgtc

SEQ ID NO: 724728 - DNA, 25 bp, Mus musculus
gtcagagatggcacctgcccagggt

SEQ ID NO: 724729 - DNA, 25 bp, Mus musculus
gtcagagatggctcctgcccagggt

SEQ ID NO: 724730 - DNA, 25 bp, Mus musculus
gtcagagcagccatacaagcaagta

SEQ ID NO: 724731 - DNA, 25 bp, Mus musculus
gtcagagcagccttacaagcaagta

SEQ ID NO: 724732 - DNA, 25 bp, Mus musculus
gtcagagctcagcacttcagactca

SEQ ID NO: 724733 - DNA, 25 bp, Mus musculus
gtcagagctcaggacttcagactca

SEQ ID NO: 724734 - DNA, 25 bp, Mus musculus
gtcagaggaccaaacctgtgggcgt

SEQ ID NO: 724735 - DNA, 25 bp, Mus musculus
gtcagaggaccatacctgtgggcgt

SEQ ID NO: 724736 - DNA, 25 bp, Mus musculus
gtcagaggccatcacagctgatgtc

SEQ ID NO: 724737 - DNA, 25 bp, Mus musculus
gtcagaggccatgacagctgatgtc

SEQ ID NO: 724738 - DNA, 25 bp, Mus musculus
gtcagaggctcccaggacaactcga

SEQ ID NO: 724739 - DNA, 25 bp, Mus musculus
gtcagaggctccgaggacaactcga

SEQ ID NO: 724740 - DNA, 25 bp, Mus musculus
gtcagagtcttgctgcaggcatgcc

SEQ ID NO: 724741 - DNA, 25 bp, Mus musculus
gtcagagtcttggtgcaggcatgcc

SEQ ID NO: 724742 - DNA, 25 bp, Mus musculus
gtcagagtttctcctatccatctgc

SEQ ID NO: 724743 - DNA, 25 bp, Mus musculus
gtcagagtttctgctatccatctgc

SEQ ID NO: 724744 - DNA, 25 bp, Mus musculus
gtcagatccacgaccagtttatcct

SEQ ID NO: 724745 - DNA, 25 bp, Mus musculus
gtcagatccacgtccagtttatcct

SEQ ID NO: 724746 - DNA, 25 bp, Mus musculus
gtcagatctaacaagagccacccag

SEQ ID NO: 724747 - DNA, 25 bp, Mus musculus
gtcagatctaactagagccacccag

SEQ ID NO: 724748 - DNA, 25 bp, Mus musculus
gtcagatcttcaaaaagctttgctt

SEQ ID NO: 724749 - DNA, 25 bp, Mus musculus
gtcagatcttcataaagctttgctt

SEQ ID NO: 724750 - DNA, 25 bp, Mus musculus
gtcagatcttctcaccttactcttt

SEQ ID NO: 724751 - DNA, 25 bp, Mus musculus
gtcagatcttctgaccttactcttt

SEQ ID NO: 724752 - DNA, 25 bp, Mus musculus
gtcagatgcagacctccgggctgaa

SEQ ID NO: 724753 - DNA, 25 bp, Mus musculus
gtcagatgcagagctccgggctgaa

SEQ ID NO: 724754 - DNA, 25 bp, Mus musculus
gtcagatggcaaaggcaggacgtca

SEQ ID NO: 724755 - DNA, 25 bp, Mus musculus
gtcagatggcaatggcaggacgtca

SEQ ID NO: 724756 - DNA, 25 bp, Mus musculus
gtcagatgtcacagtcactcatccc

SEQ ID NO: 724757 - DNA, 25 bp, Mus musculus
gtcagatgtcactgtcactcatccc

SEQ ID NO: 724758 - DNA, 25 bp, Mus musculus
gtcagatttgtcagcaacttgtcag

SEQ ID NO: 724759 - DNA, 25 bp, Mus musculus
gtcagatttgtctgcaacttgtcag

SEQ ID NO: 724760 - DNA, 25 bp, Mus musculus
gtcagcaaacaacagataacaatcc

SEQ ID NO: 724761 - DNA, 25 bp, Mus musculus
gtcagcaaacaagagataacaatcc

SEQ ID NO: 724762 - DNA, 25 bp, Mus musculus
gtcagcaaggcaatacagcaaataa

SEQ ID NO: 724763 - DNA, 25 bp, Mus musculus
gtcagcaaggcaatgcagcaaccaa

SEQ ID NO: 724764 - DNA, 25 bp, Mus musculus
gtcagcaaggcattacagcaaataa

SEQ ID NO: 724765 - DNA, 25 bp, Mus musculus
gtcagcaaggcattgcagcaaccaa

SEQ ID NO: 724766 - DNA, 25 bp, Mus musculus
gtcagcaaggcccagagacgccact

SEQ ID NO: 724767 - DNA, 25 bp, Mus musculus
gtcagcaaggccgagagacgccact

SEQ ID NO: 724768 - DNA, 25 bp, Mus musculus
gtcagcacatccaaagtgaggcttt

SEQ ID NO: 724769 - DNA, 25 bp, Mus musculus
gtcagcacatcctaagtgaggcttt

SEQ ID NO: 724770 - DNA, 25 bp, Mus musculus
gtcagcactgacacaacaccagagg

SEQ ID NO: 724771 - DNA, 25 bp, Mus musculus
gtcagcactgactcaacaccagagg

SEQ ID NO: 724772 - DNA, 25 bp, Mus musculus
gtcagcatactgacaaccttccttg

SEQ ID NO: 724773 - DNA, 25 bp, Mus musculus
gtcagcatactgtcaaccttccttg

SEQ ID NO: 724774 - DNA, 25 bp, Mus musculus
gtcagcatctgtacttccattgcag

SEQ ID NO: 724775 - DNA, 25 bp, Mus musculus
gtcagcatctgttcttccattgcag

SEQ ID NO: 724776 - DNA, 25 bp, Mus musculus
gtcagccaagcaccggcccgaagat

SEQ ID NO: 724777 - DNA, 25 bp, Mus musculus
gtcagccaagcagcggcccgaagat

SEQ ID NO: 724778 - DNA, 25 bp, Mus musculus
gtcagccaggatatccccatggtcc

SEQ ID NO: 724779 - DNA, 25 bp, Mus musculus
gtcagccaggatttccccatggtcc

SEQ ID NO: 724780 - DNA, 25 bp, Mus musculus
gtcagccgtgccaaccagcacaagg

SEQ ID NO: 724781 - DNA, 25 bp, Mus musculus
gtcagccgtgcctaccagcacaagg

SEQ ID NO: 724782 - DNA, 25 bp, Mus musculus
gtcagcctcactcaaccggatctga

SEQ ID NO: 724783 - DNA, 25 bp, Mus musculus
gtcagcctcactgaaccggatctga

SEQ ID NO: 724784 - DNA, 25 bp, Mus musculus
gtcagcctcattcagaatatcttga

SEQ ID NO: 724785 - DNA, 25 bp, Mus musculus
gtcagcctcattgagaatatcttga

SEQ ID NO: 724786 - DNA, 25 bp, Mus musculus
gtcagcctgaagacgggcctggatc

SEQ ID NO: 724787 - DNA, 25 bp, Mus musculus
gtcagcctgaagtcgggcctggatc

SEQ ID NO: 724788 - DNA, 25 bp, Mus musculus
gtcagcctgagccttttcaaccata

SEQ ID NO: 724789 - DNA, 25 bp, Mus musculus
gtcagcctgagcgttttcaaccata

SEQ ID NO: 724790 - DNA, 25 bp, Mus musculus
gtcagcctgcagaactccatggtca

SEQ ID NO: 724791 - DNA, 25 bp, Mus musculus
gtcagcctgcagtactccatggtca

SEQ ID NO: 724792 - DNA, 25 bp, Mus musculus
gtcagcgaggctcctcactgaggct

SEQ ID NO: 724793 - DNA, 25 bp, Mus musculus
gtcagcgaggctgctcactgaggct

SEQ ID NO: 724794 - DNA, 25 bp, Mus musculus
gtcagcggaaccacgagggtcatga

SEQ ID NO: 724795 - DNA, 25 bp, Mus musculus
gtcagcggaacctcgagggtcatga

SEQ ID NO: 724796 - DNA, 25 bp, Mus musculus
gtcagcggcatccttttccctctag

SEQ ID NO: 724797 - DNA, 25 bp, Mus musculus
gtcagcggcatcgttttccctctag

SEQ ID NO: 724798 - DNA, 25 bp, Mus musculus
gtcagctacaccacaaatgcatcca

SEQ ID NO: 724799 - DNA, 25 bp, Mus musculus
gtcagctacacctcaaatgcatcca

SEQ ID NO: 724800 - DNA, 25 bp, Mus musculus
gtcagctatgaactgcggcctcctg

SEQ ID NO: 724801 - DNA, 25 bp, Mus musculus
gtcagctatgaagtgcggcctcctg

SEQ ID NO: 724802 - DNA, 25 bp, Mus musculus
gtcagctcagatctccaaagccctg

SEQ ID NO: 724803 - DNA, 25 bp, Mus musculus
gtcagctcagatgtccaaagccctg

SEQ ID NO: 724804 - DNA, 25 bp, Mus musculus
gtcagctccggaacgaagtggccat

SEQ ID NO: 724805 - DNA, 25 bp, Mus musculus
gtcagctccggatcgaagtggccat

SEQ ID NO: 724806 - DNA, 25 bp, Mus musculus
gtcagctcgtgtcctgtgaagcccg

SEQ ID NO: 724807 - DNA, 25 bp, Mus musculus
gtcagctcgtgtgctgtgaagcccg

SEQ ID NO: 724808 - DNA, 25 bp, Mus musculus
gtcagctgaagccaaattaaaaaag

SEQ ID NO: 724809 - DNA, 25 bp, Mus musculus
gtcagctgaagcgaaattaaaaaag

SEQ ID NO: 724810 - DNA, 25 bp, Mus musculus
gtcagctgacagagactggcgtcgt

SEQ ID NO: 724811 - DNA, 25 bp, Mus musculus
gtcagctgacagtgactggcgtcgt

SEQ ID NO: 724812 - DNA, 25 bp, Mus musculus
gtcagctgacggagaggctcaccag

SEQ ID NO: 724813 - DNA, 25 bp, Mus musculus
gtcagctgacggtgaggctcaccag

SEQ ID NO: 724814 - DNA, 25 bp, Mus musculus
gtcagctgcacaaaggccagtccta

SEQ ID NO: 724815 - DNA, 25 bp, Mus musculus
gtcagctgcacataggccagtccta

SEQ ID NO: 724816 - DNA, 25 bp, Mus musculus
gtcagctgcccaaccttgatctgct

SEQ ID NO: 724817 - DNA, 25 bp, Mus musculus
gtcagctgcccatccttgatctgct

SEQ ID NO: 724818 - DNA, 25 bp, Mus musculus
gtcagctgtgagaagtgtcgccatg

SEQ ID NO: 724819 - DNA, 25 bp, Mus musculus
gtcagctgtgagtagtgtcgccatg

SEQ ID NO: 724820 - DNA, 25 bp, Mus musculus
gtcagctgtgccaaccgtgctagcc

SEQ ID NO: 724821 - DNA, 25 bp, Mus musculus
gtcagctgtgcctaccgtgctagcc

SEQ ID NO: 724822 - DNA, 25 bp, Mus musculus
gtcagcttctagcaaaaatgctagg

SEQ ID NO: 724823 - DNA, 25 bp, Mus musculus
gtcagcttctaggaaaaatgctagg

SEQ ID NO: 724824 - DNA, 25 bp, Mus musculus
gtcagcttctggactcacagcagac

SEQ ID NO: 724825 - DNA, 25 bp, Mus musculus
gtcagcttctggtctcacagcagac

SEQ ID NO: 724826 - DNA, 25 bp, Mus musculus
gtcaggaaggtccacttcgacaccc

SEQ ID NO: 724827 - DNA, 25 bp, Mus musculus
gtcaggaaggtcgacttcgacaccc

SEQ ID NO: 724828 - DNA, 25 bp, Mus musculus
gtcaggagcacaagctcaaaagatc

SEQ ID NO: 724829 - DNA, 25 bp, Mus musculus
gtcaggagcacatgctcaaaagatc

SEQ ID NO: 724830 - DNA, 25 bp, Mus musculus
gtcaggagccctcgaagaccgtgtc

SEQ ID NO: 724831 - DNA, 25 bp, Mus musculus
gtcaggagccctggaagaccgtgtc

SEQ ID NO: 724832 - DNA, 25 bp, Mus musculus
gtcaggagctcaatccagtgaccca

SEQ ID NO: 724833 - DNA, 25 bp, Mus musculus
gtcaggagctcattccagtgaccca

SEQ ID NO: 724834 - DNA, 25 bp, Mus musculus
gtcaggaggctgcacctttctcagt

SEQ ID NO: 724835 - DNA, 25 bp, Mus musculus
gtcaggaggctggacctttctcagt

SEQ ID NO: 724836 - DNA, 25 bp, Mus musculus
gtcaggatgctaatccaatcctcat

SEQ ID NO: 724837 - DNA, 25 bp, Mus musculus
gtcaggatgctattccaatcctcat

SEQ ID NO: 724838 - DNA, 25 bp, Mus musculus
gtcaggattcatcggaggttatttc

SEQ ID NO: 724839 - DNA, 25 bp, Mus musculus
gtcaggattcatgggaggttatttc

SEQ ID NO: 724840 - DNA, 25 bp, Mus musculus
gtcaggcacaggagaggccaacgga

SEQ ID NO: 724841 - DNA, 25 bp, Mus musculus
gtcaggcacaggtgaggccaacgga

SEQ ID NO: 724842 - DNA, 25 bp, Mus musculus
gtcaggcagctgagatcatgtgcaa

SEQ ID NO: 724843 - DNA, 25 bp, Mus musculus
gtcaggcagctgtgatcatgtgcaa

SEQ ID NO: 724844 - DNA, 25 bp, Mus musculus
gtcaggccaaccaggcgtcagctac

SEQ ID NO: 724845 - DNA, 25 bp, Mus musculus
gtcaggccaacctggcgtcagctac

SEQ ID NO: 724846 - DNA, 25 bp, Mus musculus
gtcaggccgggaaccatccttggaa

SEQ ID NO: 724847 - DNA, 25 bp, Mus musculus
gtcaggccgggatccatccttggaa

SEQ ID NO: 724848 - DNA, 25 bp, Mus musculus
gtcaggcggagcctgcgggattgct

SEQ ID NO: 724849 - DNA, 25 bp, Mus musculus
gtcaggcggagcgtgcgggattgct

SEQ ID NO: 724850 - DNA, 25 bp, Mus musculus
gtcaggctctacaccagcttccatg

SEQ ID NO: 724851 - DNA, 25 bp, Mus musculus
gtcaggctctactccagcttccatg

SEQ ID NO: 724852 - DNA, 25 bp, Mus musculus
gtcaggctgtcaaccaagaacttcg

SEQ ID NO: 724853 - DNA, 25 bp, Mus musculus
gtcaggctgtcatccaagaacttcg

SEQ ID NO: 724854 - DNA, 25 bp, Mus musculus
gtcaggcttctacgatcacgtccaa

SEQ ID NO: 724855 - DNA, 25 bp, Mus musculus
gtcaggcttctaggatcacgtccaa

SEQ ID NO: 724856 - DNA, 25 bp, Mus musculus
gtcagggaagccagggatgccactc

SEQ ID NO: 724857 - DNA, 25 bp, Mus musculus
gtcagggaagcctgggatgccactc

SEQ ID NO: 724858 - DNA, 25 bp, Mus musculus
gtcagggactgacccactaataact

SEQ ID NO: 724859 - DNA, 25 bp, Mus musculus
gtcagggactgagccactaataact

SEQ ID NO: 724860 - DNA, 25 bp, Mus musculus
gtcagggcaacacccactgagagtg

SEQ ID NO: 724861 - DNA, 25 bp, Mus musculus
gtcagggcaacagccactgagagtg

SEQ ID NO: 724862 - DNA, 25 bp, Mus musculus
gtcagggccaaaactggaaccaagg

SEQ ID NO: 724863 - DNA, 25 bp, Mus musculus
gtcagggccaaatctggaaccaagg

SEQ ID NO: 724864 - DNA, 25 bp, Mus musculus
gtcagggccccactgatgaggcaca

SEQ ID NO: 724865 - DNA, 25 bp, Mus musculus
gtcagggccccagtgatgaggcaca

SEQ ID NO: 724866 - DNA, 25 bp, Mus musculus
gtcagggtatgaacaaaaggacttt

SEQ ID NO: 724867 - DNA, 25 bp, Mus musculus
gtcagggtatgatcaaaaggacttt

SEQ ID NO: 724868 - DNA, 25 bp, Mus musculus
gtcagtacgtgtccgcagagctgca

SEQ ID NO: 724869 - DNA, 25 bp, Mus musculus
gtcagtacgtgtgcgcagagctgca

SEQ ID NO: 724870 - DNA, 25 bp, Mus musculus
gtcagtactcgtcaccacaccaaat

SEQ ID NO: 724871 - DNA, 25 bp, Mus musculus
gtcagtactcgtgaccacaccaaat

SEQ ID NO: 724872 - DNA, 25 bp, Mus musculus
gtcagtcaccaaagaataccgcctg

SEQ ID NO: 724873 - DNA, 25 bp, Mus musculus
gtcagtcaccaatgaataccgcctg

SEQ ID NO: 724874 - DNA, 25 bp, Mus musculus
gtcagtcactgtaatgagcctagaa

SEQ ID NO: 724875 - DNA, 25 bp, Mus musculus
gtcagtcactgttatgagcctagaa

SEQ ID NO: 724876 - DNA, 25 bp, Mus musculus
gtcagtcagagtactgcctggtccg

SEQ ID NO: 724877 - DNA, 25 bp, Mus musculus
gtcagtcagagttctgcctggtccg

SEQ ID NO: 724878 - DNA, 25 bp, Mus musculus
gtcagtcagattagcatccaggtca

SEQ ID NO: 724879 - DNA, 25 bp, Mus musculus
gtcagtcagatttgcatccaggtca

SEQ ID NO: 724880 - DNA, 25 bp, Mus musculus
gtcagtcctgggaatctgtccttgg

SEQ ID NO: 724881 - DNA, 25 bp, Mus musculus
gtcagtcctgggtatctgtccttgg

SEQ ID NO: 724882 - DNA, 25 bp, Mus musculus
gtcagtctccggacgcgcagcggct

SEQ ID NO: 724883 - DNA, 25 bp, Mus musculus
gtcagtctccggtcgcgcagcggct

SEQ ID NO: 724884 - DNA, 25 bp, Mus musculus
gtcagtctccttcgtgtctacaaaa

SEQ ID NO: 724885 - DNA, 25 bp, Mus musculus
gtcagtctccttggtgtctacaaaa

SEQ ID NO: 724886 - DNA, 25 bp, Mus musculus
gtcagtctgtcgcagtcagtcttcc

SEQ ID NO: 724887 - DNA, 25 bp, Mus musculus
gtcagtctgtcggagtcagtcttcc

SEQ ID NO: 724888 - DNA, 25 bp, Mus musculus
gtcagtgaatatctgggtgtgacct

SEQ ID NO: 724889 - DNA, 25 bp, Mus musculus
gtcagtgaatatgtgggtgtgacct

SEQ ID NO: 724890 - DNA, 25 bp, Mus musculus
gtcagtgaccccagcaacgtagcca

SEQ ID NO: 724891 - DNA, 25 bp, Mus musculus
gtcagtgacccctgcaacgtagcca

SEQ ID NO: 724892 - DNA, 25 bp, Mus musculus
gtcagtgagaacaggagcaaccaga

SEQ ID NO: 724893 - DNA, 25 bp, Mus musculus
gtcagtgagaactggagcaaccaga

SEQ ID NO: 724894 - DNA, 25 bp, Mus musculus
gtcagtgcttcgcaagatggaaaat

SEQ ID NO: 724895 - DNA, 25 bp, Mus musculus
gtcagtgcttcggaagatggaaaat

SEQ ID NO: 724896 - DNA, 25 bp, Mus musculus
gtcagtggacgaaagcgcacgagct

SEQ ID NO: 724897 - DNA, 25 bp, Mus musculus
gtcagtggacgatagcgcacgagct

SEQ ID NO: 724898 - DNA, 25 bp, Mus musculus
gtcagtggcttcacacagccagatg

SEQ ID NO: 724899 - DNA, 25 bp, Mus musculus
gtcagtggcttctcacagccagatg

SEQ ID NO: 724900 - DNA, 25 bp, Mus musculus
gtcagtgggcagacctcctccctga

SEQ ID NO: 724901 - DNA, 25 bp, Mus musculus
gtcagtgggcagtcctcctccctga

SEQ ID NO: 724902 - DNA, 25 bp, Mus musculus
gtcagtgtcacaaaaccatttatgt

SEQ ID NO: 724903 - DNA, 25 bp, Mus musculus
gtcagtgtcacataaccatttatgt

SEQ ID NO: 724904 - DNA, 25 bp, Mus musculus
gtcagtgtcttcacgcaggcccatt

SEQ ID NO: 724905 - DNA, 25 bp, Mus musculus
gtcagtgtcttcactaatgcagcca

SEQ ID NO: 724906 - DNA, 25 bp, Mus musculus
gtcagtgtcttctcgcaggcccatt

SEQ ID NO: 724907 - DNA, 25 bp, Mus musculus
gtcagtgtcttctctaatgcagcca

SEQ ID NO: 724908 - DNA, 25 bp, Mus musculus
gtcagtgtgtccacccagtctggga

SEQ ID NO: 724909 - DNA, 25 bp, Mus musculus
gtcagtgtgtcctcccagtctggga

SEQ ID NO: 724910 - DNA, 25 bp, Mus musculus
gtcagtgttggaccacgggatccaa

SEQ ID NO: 724911 - DNA, 25 bp, Mus musculus
gtcagtgttggagcacgggatccaa

SEQ ID NO: 724912 - DNA, 25 bp, Mus musculus
gtcagttaccacagcttttcccaga

SEQ ID NO: 724913 - DNA, 25 bp, Mus musculus
gtcagttaccactgcttttcccaga

SEQ ID NO: 724914 - DNA, 25 bp, Mus musculus
gtcagttatgctcacacggagctca

SEQ ID NO: 724915 - DNA, 25 bp, Mus musculus
gtcagttatgctgacacggagctca

SEQ ID NO: 724916 - DNA, 25 bp, Mus musculus
gtcagtttacatcgtggaccccaag

SEQ ID NO: 724917 - DNA, 25 bp, Mus musculus
gtcagtttacatggtggaccccaag

SEQ ID NO: 724918 - DNA, 25 bp, Mus musculus
gtcagtttctccagtccaggccaca

SEQ ID NO: 724919 - DNA, 25 bp, Mus musculus
gtcagtttctcctgtccaggccaca

SEQ ID NO: 724920 - DNA, 25 bp, Mus musculus
gtcagtttgcatccattcatttcag

SEQ ID NO: 724921 - DNA, 25 bp, Mus musculus
gtcagtttgcatgcattcatttcag

SEQ ID NO: 724922 - DNA, 25 bp, Mus musculus
gtcataaagcttccatactacactg

SEQ ID NO: 724923 - DNA, 25 bp, Mus musculus
gtcataaagcttgcatactacactg

SEQ ID NO: 724924 - DNA, 25 bp, Mus musculus
gtcataaatacaaacgtgggcaaga

SEQ ID NO: 724925 - DNA, 25 bp, Mus musculus
gtcataaatacatacgtgggcaaga

SEQ ID NO: 724926 - DNA, 25 bp, Mus musculus
gtcatacacaacctagactacagtg

SEQ ID NO: 724927 - DNA, 25 bp, Mus musculus
gtcatacacaacgtagactacagtg

SEQ ID NO: 724928 - DNA, 25 bp, Mus musculus
gtcatacccactcaggaacatgtag

SEQ ID NO: 724929 - DNA, 25 bp, Mus musculus
gtcatacccactgaggaacatgtag

SEQ ID NO: 724930 - DNA, 25 bp, Mus musculus
gtcataccgtgcactccagggagca

SEQ ID NO: 724931 - DNA, 25 bp, Mus musculus
gtcataccgtgctctccagggagca

SEQ ID NO: 724932 - DNA, 25 bp, Mus musculus
gtcatagagagcctactgttcccca

SEQ ID NO: 724933 - DNA, 25 bp, Mus musculus
gtcatagagagcgtactgttcccca

SEQ ID NO: 724934 - DNA, 25 bp, Mus musculus
gtcataggatcacatcgacaggaga

SEQ ID NO: 724935 - DNA, 25 bp, Mus musculus
gtcataggatcagatcgacaggaga

SEQ ID NO: 724936 - DNA, 25 bp, Mus musculus
gtcatatctcagcaagtgtcagata

SEQ ID NO: 724937 - DNA, 25 bp, Mus musculus
gtcatatctcaggaagtgtcagata

SEQ ID NO: 724938 - DNA, 25 bp, Mus musculus
gtcatcaaactcctggcgcctcttg

SEQ ID NO: 724939 - DNA, 25 bp, Mus musculus
gtcatcaaactcgtggcgcctcttg

SEQ ID NO: 724940 - DNA, 25 bp, Mus musculus
gtcatcaagaaacccctcaatgcgt

SEQ ID NO: 724941 - DNA, 25 bp, Mus musculus
gtcatcaagaaagccctcaatgcgt

SEQ ID NO: 724942 - DNA, 25 bp, Mus musculus
gtcatcaagccaatctgtgtcatct

SEQ ID NO: 724943 - DNA, 25 bp, Mus musculus
gtcatcaagccattctgtgtcatct

SEQ ID NO: 724944 - DNA, 25 bp, Mus musculus
gtcatcaatgagctagtcctgagtt

SEQ ID NO: 724945 - DNA, 25 bp, Mus musculus
gtcatcaatgaggtagtcctgagtt

SEQ ID NO: 724946 - DNA, 25 bp, Mus musculus
gtcatcaggtaaccagtctgtcggg

SEQ ID NO: 724947 - DNA, 25 bp, Mus musculus
gtcatcaggtaagcagtctgtcggg

SEQ ID NO: 724948 - DNA, 25 bp, Mus musculus
gtcatcatagagacaaagttctttg

SEQ ID NO: 724949 - DNA, 25 bp, Mus musculus
gtcatcatagagtcaaagttctttg

SEQ ID NO: 724950 - DNA, 25 bp, Mus musculus
gtcatcataggccagtacacatcag

SEQ ID NO: 724951 - DNA, 25 bp, Mus musculus
gtcatcataggcgagtacacatcag

SEQ ID NO: 724952 - DNA, 25 bp, Mus musculus
gtcatcatcaaccaggccagcggca

SEQ ID NO: 724953 - DNA, 25 bp, Mus musculus
gtcatcatcaacgaggccagcggca

SEQ ID NO: 724954 - DNA, 25 bp, Mus musculus
gtcatcatccccattagacaccggg

SEQ ID NO: 724955 - DNA, 25 bp, Mus musculus
gtcatcatcccctttagacaccggg

SEQ ID NO: 724956 - DNA, 25 bp, Mus musculus
gtcatcatctccatcgtgtccagct

SEQ ID NO: 724957 - DNA, 25 bp, Mus musculus
gtcatcatctccttcgtgtccagct

SEQ ID NO: 724958 - DNA, 25 bp, Mus musculus
gtcatcatgaccatgagacactgct

SEQ ID NO: 724959 - DNA, 25 bp, Mus musculus
gtcatcatgaccttgagacactgct

SEQ ID NO: 724960 - DNA, 25 bp, Mus musculus
gtcatcatggaccagcccactgctg

SEQ ID NO: 724961 - DNA, 25 bp, Mus musculus
gtcatcatggacgagcccactgctg

SEQ ID NO: 724962 - DNA, 25 bp, Mus musculus
gtcatcatggccctgggcatcacca

SEQ ID NO: 724963 - DNA, 25 bp, Mus musculus
gtcatcatggccgtgggcatcacca

SEQ ID NO: 724964 - DNA, 25 bp, Mus musculus
gtcatcatggtcctcttcatgctga

SEQ ID NO: 724965 - DNA, 25 bp, Mus musculus
gtcatcatggtcgtcttcatgctga

SEQ ID NO: 724966 - DNA, 25 bp, Mus musculus
gtcatccactctctagcggaaggcg

SEQ ID NO: 724967 - DNA, 25 bp, Mus musculus
gtcatccactctgtagcggaaggcg

SEQ ID NO: 724968 - DNA, 25 bp, Mus musculus
gtcatccagaagctcatcaacacag

SEQ ID NO: 724969 - DNA, 25 bp, Mus musculus
gtcatccagaaggtcatcaacacag

SEQ ID NO: 724970 - DNA, 25 bp, Mus musculus
gtcatccaggatattcaagcttccg

SEQ ID NO: 724971 - DNA, 25 bp, Mus musculus
gtcatccaggattttcaagcttccg

SEQ ID NO: 724972 - DNA, 25 bp, Mus musculus
gtcatccagtgccataacttttaaa

SEQ ID NO: 724973 - DNA, 25 bp, Mus musculus
gtcatccagtgcgataacttttaaa

SEQ ID NO: 724974 - DNA, 25 bp, Mus musculus
gtcatccattagagcggtaatcaag

SEQ ID NO: 724975 - DNA, 25 bp, Mus musculus
gtcatccattagtgcggtaatcaag

SEQ ID NO: 724976 - DNA, 25 bp, Mus musculus
gtcatcctcatgaacaccttctgca

SEQ ID NO: 724977 - DNA, 25 bp, Mus musculus
gtcatcctcatgagtttctccattg

SEQ ID NO: 724978 - DNA, 25 bp, Mus musculus
gtcatcctcatgtacaccttctgca

SEQ ID NO: 724979 - DNA, 25 bp, Mus musculus
gtcatcctcatgtgtttctccattg

SEQ ID NO: 724980 - DNA, 25 bp, Mus musculus
gtcatcctcccacttcttaaaagtg

SEQ ID NO: 724981 - DNA, 25 bp, Mus musculus
gtcatcctcccagttcttaaaagtg

SEQ ID NO: 724982 - DNA, 25 bp, Mus musculus
gtcatcctcttacgagaacgtcaag

SEQ ID NO: 724983 - DNA, 25 bp, Mus musculus
gtcatcctcttaggagaacgtcaag

SEQ ID NO: 724984 - DNA, 25 bp, Mus musculus
gtcatcgatgacagatgccttctgt

SEQ ID NO: 724985 - DNA, 25 bp, Mus musculus
gtcatcgatgactgatgccttctgt

SEQ ID NO: 724986 - DNA, 25 bp, Mus musculus
gtcatcgattacacaccctacctaa

SEQ ID NO: 724987 - DNA, 25 bp, Mus musculus
gtcatcgattactcaccctacctaa

SEQ ID NO: 724988 - DNA, 25 bp, Mus musculus
gtcatcggaaatccgggaactggca

SEQ ID NO: 724989 - DNA, 25 bp, Mus musculus
gtcatcggaaatgcgggaactggca

SEQ ID NO: 724990 - DNA, 25 bp, Mus musculus
gtcatctactgcaagaggcagttca

SEQ ID NO: 724991 - DNA, 25 bp, Mus musculus
gtcatctactgctagaggcagttca

SEQ ID NO: 724992 - DNA, 25 bp, Mus musculus
gtcatctccaaccaggaatgtaaca

SEQ ID NO: 724993 - DNA, 25 bp, Mus musculus
gtcatctccaacgaggaatgtaaca

SEQ ID NO: 724994 - DNA, 25 bp, Mus musculus
gtcatctcgcgcacaccagactttg

SEQ ID NO: 724995 - DNA, 25 bp, Mus musculus
gtcatctcgcgctcaccagactttg

SEQ ID NO: 724996 - DNA, 25 bp, Mus musculus
gtcatctcggtcactggctgcctgc

SEQ ID NO: 724997 - DNA, 25 bp, Mus musculus
gtcatctcggtctctggctgcctgc

SEQ ID NO: 724998 - DNA, 25 bp, Mus musculus
gtcatcttagccacaccctacaagg

SEQ ID NO: 724999 - DNA, 25 bp, Mus musculus
gtcatcttagcctcaccctacaagg

SEQ ID NO: 725000 - DNA, 25 bp, Mus musculus
gtcatgaaactgaaaccattgaatt

SEQ ID NO: 725001 - DNA, 25 bp, Mus musculus
gtcatgaaactgtaaccattgaatt

SEQ ID NO: 725002 - DNA, 25 bp, Mus musculus
gtcatgaacttcacagctgagaaca

SEQ ID NO: 725003 - DNA, 25 bp, Mus musculus
gtcatgaacttctcagctgagaaca

SEQ ID NO: 725004 - DNA, 25 bp, Mus musculus
gtcatgaatgcaatagataacagag

SEQ ID NO: 725005 - DNA, 25 bp, Mus musculus
gtcatgaatgcattagataacagag

SEQ ID NO: 725006 - DNA, 25 bp, Mus musculus
gtcatgactggtactatttctcaag

SEQ ID NO: 725007 - DNA, 25 bp, Mus musculus
gtcatgactggttctatttctcaag

SEQ ID NO: 725008 - DNA, 25 bp, Mus musculus
gtcatgagctccaaacaccttcttg

SEQ ID NO: 725009 - DNA, 25 bp, Mus musculus
gtcatgagctcctaacaccttcttg

SEQ ID NO: 725010 - DNA, 25 bp, Mus musculus
gtcatgaggccacagctgatcatga

SEQ ID NO: 725011 - DNA, 25 bp, Mus musculus
gtcatgaggccagagctgatcatga

SEQ ID NO: 725012 - DNA, 25 bp, Mus musculus
gtcatgatcttcatcccagcgcttc

SEQ ID NO: 725013 - DNA, 25 bp, Mus musculus
gtcatgatcttcttcccagcgcttc

SEQ ID NO: 725014 - DNA, 25 bp, Mus musculus
gtcatgcacagaatgtccatctcct

SEQ ID NO: 725015 - DNA, 25 bp, Mus musculus
gtcatgcacagattgtccatctcct

SEQ ID NO: 725016 - DNA, 25 bp, Mus musculus
gtcatgcacttcagaagcagagaga

SEQ ID NO: 725017 - DNA, 25 bp, Mus musculus
gtcatgcacttctgaagcagagaga

SEQ ID NO: 725018 - DNA, 25 bp, Mus musculus
gtcatgctaccactttgctttagag

SEQ ID NO: 725019 - DNA, 25 bp, Mus musculus
gtcatgctaccagtttgctttagag

SEQ ID NO: 725020 - DNA, 25 bp, Mus musculus
gtcatgctttgaccagcctcggctc

SEQ ID NO: 725021 - DNA, 25 bp, Mus musculus
gtcatgctttgagcagcctcggctc

SEQ ID NO: 725022 - DNA, 25 bp, Mus musculus
gtcatggaacagcagactctgtcca

SEQ ID NO: 725023 - DNA, 25 bp, Mus musculus
gtcatggaacaggagactctgtcca

SEQ ID NO: 725024 - DNA, 25 bp, Mus musculus
gtcatggaccaacacaagctcagca

SEQ ID NO: 725025 - DNA, 25 bp, Mus musculus
gtcatggaccaagacaagctcagca

SEQ ID NO: 725026 - DNA, 25 bp, Mus musculus
gtcatggagcccctataccaacaaa

SEQ ID NO: 725027 - DNA, 25 bp, Mus musculus
gtcatggagcccgtataccaacaaa

SEQ ID NO: 725028 - DNA, 25 bp, Mus musculus
gtcatggagtaccaccaggccactg

SEQ ID NO: 725029 - DNA, 25 bp, Mus musculus
gtcatggagtacgaccaggccactg

SEQ ID NO: 725030 - DNA, 25 bp, Mus musculus
gtcatggatcaaacatgctgtcctc

SEQ ID NO: 725031 - DNA, 25 bp, Mus musculus
gtcatggatcaaagaaggagagctg

SEQ ID NO: 725032 - DNA, 25 bp, Mus musculus
gtcatggatcaatcatgctgtcctc

SEQ ID NO: 725033 - DNA, 25 bp, Mus musculus
gtcatggatcaatgaaggagagctg

SEQ ID NO: 725034 - DNA, 25 bp, Mus musculus
gtcatggcgctgacctcgcgactgt

SEQ ID NO: 725035 - DNA, 25 bp, Mus musculus
gtcatggcgctgtcctcgcgactgt

SEQ ID NO: 725036 - DNA, 25 bp, Mus musculus
gtcatggctgcaagcattttcttcc

SEQ ID NO: 725037 - DNA, 25 bp, Mus musculus
gtcatggctgcatgcattttcttcc

SEQ ID NO: 725038 - DNA, 25 bp, Mus musculus
gtcatgggccatattctcatatgtt

SEQ ID NO: 725039 - DNA, 25 bp, Mus musculus
gtcatgggccattttctcatatgtt

SEQ ID NO: 725040 - DNA, 25 bp, Mus musculus
gtcatggtgagcctcctgccgctgt

SEQ ID NO: 725041 - DNA, 25 bp, Mus musculus
gtcatggtgagcgtcctgccgctgt

SEQ ID NO: 725042 - DNA, 25 bp, Mus musculus
gtcatggtgccaccctgactgagaa

SEQ ID NO: 725043 - DNA, 25 bp, Mus musculus
gtcatggtgccagcctgactgagaa

SEQ ID NO: 725044 - DNA, 25 bp, Mus musculus
gtcatgtacaacagcagctgcctcg

SEQ ID NO: 725045 - DNA, 25 bp, Mus musculus
gtcatgtacaactgcagctgcctcg

SEQ ID NO: 725046 - DNA, 25 bp, Mus musculus
gtcatgtcgggcatcgacgacccgg

SEQ ID NO: 725047 - DNA, 25 bp, Mus musculus
gtcatgtcgggcttcgacgacccgg

SEQ ID NO: 725048 - DNA, 25 bp, Mus musculus
gtcatgtgcagtattgcaaactcac

SEQ ID NO: 725049 - DNA, 25 bp, Mus musculus
gtcatgtgcagttttgcaaactcac

SEQ ID NO: 725050 - DNA, 25 bp, Mus musculus
gtcatgtgggcgattgtgagtccac

SEQ ID NO: 725051 - DNA, 25 bp, Mus musculus
gtcatgtgggcgtttgtgagtccac

SEQ ID NO: 725052 - DNA, 25 bp, Mus musculus
gtcatgttccctcctaatggcagca

SEQ ID NO: 725053 - DNA, 25 bp, Mus musculus
gtcatgttccctgctaatggcagca

SEQ ID NO: 725054 - DNA, 25 bp, Mus musculus
gtcattaattcgcttagcagaagcc

SEQ ID NO: 725055 - DNA, 25 bp, Mus musculus
gtcattaattcggttagcagaagcc

SEQ ID NO: 725056 - DNA, 25 bp, Mus musculus
gtcattacacggagttccttccaag

SEQ ID NO: 725057 - DNA, 25 bp, Mus musculus
gtcattacacggtgttccttccaag

SEQ ID NO: 725058 - DNA, 25 bp, Mus musculus
gtcattactgccctgtcataaatcc

SEQ ID NO: 725059 - DNA, 25 bp, Mus musculus
gtcattactgccgtgtcataaatcc

SEQ ID NO: 725060 - DNA, 25 bp, Mus musculus
gtcattattgtcatctacctgtctg

SEQ ID NO: 725061 - DNA, 25 bp, Mus musculus
gtcattattgtcttctacctgtctg

SEQ ID NO: 725062 - DNA, 25 bp, Mus musculus
gtcattcactttcgagaccacttta

SEQ ID NO: 725063 - DNA, 25 bp, Mus musculus
gtcattcactttggagaccacttta

SEQ ID NO: 725064 - DNA, 25 bp, Mus musculus
gtcattcagaggctggtcaccgcca

SEQ ID NO: 725065 - DNA, 25 bp, Mus musculus
gtcattcagagggtggtcaccgcca

SEQ ID NO: 725066 - DNA, 25 bp, Mus musculus
gtcattcatcaacatcggtcttctg

SEQ ID NO: 725067 - DNA, 25 bp, Mus musculus
gtcattcatcaagatcggtcttctg

SEQ ID NO: 725068 - DNA, 25 bp, Mus musculus
gtcattccagatcaaaagatgcctg

SEQ ID NO: 725069 - DNA, 25 bp, Mus musculus
gtcattccagatgaaaagatgcctg

SEQ ID NO: 725070 - DNA, 25 bp, Mus musculus
gtcattcccagaccgtgagctcagg

SEQ ID NO: 725071 - DNA, 25 bp, Mus musculus
gtcattcccagagcgtgagctcagg

SEQ ID NO: 725072 - DNA, 25 bp, Mus musculus
gtcattcgaaagattgcaaagaagc

SEQ ID NO: 725073 - DNA, 25 bp, Mus musculus
gtcattcgaaagtttgcaaagaagc

SEQ ID NO: 725074 - DNA, 25 bp, Mus musculus
gtcattctcttcaccaccgacggag

SEQ ID NO: 725075 - DNA, 25 bp, Mus musculus
gtcattctcttctccaccgacggag

SEQ ID NO: 725076 - DNA, 25 bp, Mus musculus
gtcattgaaacgcaaaaaactctct

SEQ ID NO: 725077 - DNA, 25 bp, Mus musculus
gtcattgaaacggaaaaaactctct

SEQ ID NO: 725078 - DNA, 25 bp, Mus musculus
gtcattgaactaactcaggccagca

SEQ ID NO: 725079 - DNA, 25 bp, Mus musculus
gtcattgaactatctcaggccagca

SEQ ID NO: 725080 - DNA, 25 bp, Mus musculus
gtcattgaagcactcagtaccatcg

SEQ ID NO: 725081 - DNA, 25 bp, Mus musculus
gtcattgaagcagtcagtaccatcg

SEQ ID NO: 725082 - DNA, 25 bp, Mus musculus
gtcattgacgccatcactaccactg

SEQ ID NO: 725083 - DNA, 25 bp, Mus musculus
gtcattgacgccttcactaccactg

SEQ ID NO: 725084 - DNA, 25 bp, Mus musculus
gtcattgagaagcagcggccacagc

SEQ ID NO: 725085 - DNA, 25 bp, Mus musculus
gtcattgagaaggagcggccacagc

SEQ ID NO: 725086 - DNA, 25 bp, Mus musculus
gtcattgagcgcaccttccatgtgg

SEQ ID NO: 725087 - DNA, 25 bp, Mus musculus
gtcattgagcgctccttccatgtgg

SEQ ID NO: 725088 - DNA, 25 bp, Mus musculus
gtcattgcacagcaccagaacctgc

SEQ ID NO: 725089 - DNA, 25 bp, Mus musculus
gtcattgcacaggaccagaacctgc

SEQ ID NO: 725090 - DNA, 25 bp, Mus musculus
gtcattgcatgtatttcctgtgggc

SEQ ID NO: 725091 - DNA, 25 bp, Mus musculus
gtcattgcatgtttttcctgtgggc

SEQ ID NO: 725092 - DNA, 25 bp, Mus musculus
gtcattggccatctcttgcaaccct

SEQ ID NO: 725093 - DNA, 25 bp, Mus musculus
gtcattggccatgtcttgcaaccct

SEQ ID NO: 725094 - DNA, 25 bp, Mus musculus
gtcattggcctcctaatcattgtca

SEQ ID NO: 725095 - DNA, 25 bp, Mus musculus
gtcattggcctcgtaatcattgtca

SEQ ID NO: 725096 - DNA, 25 bp, Mus musculus
gtcattggtctcatcagccctgggt

SEQ ID NO: 725097 - DNA, 25 bp, Mus musculus
gtcattggtctcttcagccctgggt

SEQ ID NO: 725098 - DNA, 25 bp, Mus musculus
gtcattggtgataactttgggaaag

SEQ ID NO: 725099 - DNA, 25 bp, Mus musculus
gtcattggtgattactttgggaaag

SEQ ID NO: 725100 - DNA, 25 bp, Mus musculus
gtcattgtcaagactgaacaaaccg

SEQ ID NO: 725101 - DNA, 25 bp, Mus musculus
gtcattgtcaagtctgaacaaaccg

SEQ ID NO: 725102 - DNA, 25 bp, Mus musculus
gtcattgtcatcctcctctgccgga

SEQ ID NO: 725103 - DNA, 25 bp, Mus musculus
gtcattgtcatcgtcctctgccgga

SEQ ID NO: 725104 - DNA, 25 bp, Mus musculus
gtcatttaagttacacttctgtggg

SEQ ID NO: 725105 - DNA, 25 bp, Mus musculus
gtcatttaagtttcacttctgtggg

SEQ ID NO: 725106 - DNA, 25 bp, Mus musculus
gtcatttccctgataccacagccag

SEQ ID NO: 725107 - DNA, 25 bp, Mus musculus
gtcatttccctgttaccacagccag

SEQ ID NO: 725108 - DNA, 25 bp, Mus musculus
gtcatttctacaacgggacgcagcg

SEQ ID NO: 725109 - DNA, 25 bp, Mus musculus
gtcatttctacatcgggacgcagcg

SEQ ID NO: 725110 - DNA, 25 bp, Mus musculus
gtcatttgagaacaggatatgccaa

SEQ ID NO: 725111 - DNA, 25 bp, Mus musculus
gtcatttgagaagaggatatgccaa

SEQ ID NO: 725112 - DNA, 25 bp, Mus musculus
gtcattttgccaaaattagtcacag

SEQ ID NO: 725113 - DNA, 25 bp, Mus musculus
gtcattttgccataattagtcacag

SEQ ID NO: 725114 - DNA, 25 bp, Mus musculus
gtcatttttctacaattcctaccct

SEQ ID NO: 725115 - DNA, 25 bp, Mus musculus
gtcatttttctagaattcctaccct

SEQ ID NO: 725116 - DNA, 25 bp, Mus musculus
gtccaaaacagaccgagacagggag

SEQ ID NO: 725117 - DNA, 25 bp, Mus musculus
gtccaaaacagagcgagacagggag

SEQ ID NO: 725118 - DNA, 25 bp, Mus musculus
gtccaaaattctaaaatgtgctggt

SEQ ID NO: 725119 - DNA, 25 bp, Mus musculus
gtccaaaattcttaaatgtgctggt

SEQ ID NO: 725120 - DNA, 25 bp, Mus musculus
gtccaaactgagcaacacagaaaag

SEQ ID NO: 725121 - DNA, 25 bp, Mus musculus
gtccaaactgaggaacacagaaaag

SEQ ID NO: 725122 - DNA, 25 bp, Mus musculus
gtccaaatcagcacctgggtacaag

SEQ ID NO: 725123 - DNA, 25 bp, Mus musculus
gtccaaatcagctcctgggtacaag

SEQ ID NO: 725124 - DNA, 25 bp, Mus musculus
gtccaaccaatccaatgttgttcca

SEQ ID NO: 725125 - DNA, 25 bp, Mus musculus
gtccaaccaatcgaatgttgttcca

SEQ ID NO: 725126 - DNA, 25 bp, Mus musculus
gtccaaccccggagtacactacgag

SEQ ID NO: 725127 - DNA, 25 bp, Mus musculus
gtccaaccccggtgtacactacgag

SEQ ID NO: 725128 - DNA, 25 bp, Mus musculus
gtccaaccggctaaacattctaggg

SEQ ID NO: 725129 - DNA, 25 bp, Mus musculus
gtccaaccggcttaacattctaggg

SEQ ID NO: 725130 - DNA, 25 bp, Mus musculus
gtccaaccgtgactgtcagattgat

SEQ ID NO: 725131 - DNA, 25 bp, Mus musculus
gtccaaccgtgagtgtcagattgat

SEQ ID NO: 725132 - DNA, 25 bp, Mus musculus
gtccaactggagaacctccaagaac

SEQ ID NO: 725133 - DNA, 25 bp, Mus musculus
gtccaactggagtacctccaagaac

SEQ ID NO: 725134 - DNA, 25 bp, Mus musculus
gtccaacttgcaacgtggcagtcat

SEQ ID NO: 725135 - DNA, 25 bp, Mus musculus
gtccaacttgcatcgtggcagtcat

SEQ ID NO: 725136 - DNA, 25 bp, Mus musculus
gtccaactttaaccatgaacagctt

SEQ ID NO: 725137 - DNA, 25 bp, Mus musculus
gtccaactttaagcatgaacagctt

SEQ ID NO: 725138 - DNA, 25 bp, Mus musculus
gtccaagaagtcctcgcttatggtg

SEQ ID NO: 725139 - DNA, 25 bp, Mus musculus
gtccaagaagtcgtcgcttatggtg

SEQ ID NO: 725140 - DNA, 25 bp, Mus musculus
gtccaagaatttccgatcgtgccct

SEQ ID NO: 725141 - DNA, 25 bp, Mus musculus
gtccaagaatttgcgatcgtgccct

SEQ ID NO: 725142 - DNA, 25 bp, Mus musculus
gtccaagactgcagttcatcttgag

SEQ ID NO: 725143 - DNA, 25 bp, Mus musculus
gtccaagactgctgttcatcttgag

SEQ ID NO: 725144 - DNA, 25 bp, Mus musculus
gtccaagatggaaagtcataaacca

SEQ ID NO: 725145 - DNA, 25 bp, Mus musculus
gtccaagatggatagtcataaacca

SEQ ID NO: 725146 - DNA, 25 bp, Mus musculus
gtccaagattgcaggaaagttgcac

SEQ ID NO: 725147 - DNA, 25 bp, Mus musculus
gtccaagattgctggaaagttgcac

SEQ ID NO: 725148 - DNA, 25 bp, Mus musculus
gtccaagcaggacggcaataaggta

SEQ ID NO: 725149 - DNA, 25 bp, Mus musculus
gtccaagcaggagggcaataaggta

SEQ ID NO: 725150 - DNA, 25 bp, Mus musculus
gtccaaggatcccaaaccactttgc

SEQ ID NO: 725151 - DNA, 25 bp, Mus musculus
gtccaaggatccgaaaccactttgc

SEQ ID NO: 725152 - DNA, 25 bp, Mus musculus
gtccaaggcactcactgcctgactg

SEQ ID NO: 725153 - DNA, 25 bp, Mus musculus
gtccaaggcactgactgcctgactg

SEQ ID NO: 725154 - DNA, 25 bp, Mus musculus
gtccaaggcccacgtaactacagcg

SEQ ID NO: 725155 - DNA, 25 bp, Mus musculus
gtccaaggcccaggtaactacagcg

SEQ ID NO: 725156 - DNA, 25 bp, Mus musculus
gtccaaggtgccagagtcttcctaa

SEQ ID NO: 725157 - DNA, 25 bp, Mus musculus
gtccaaggtgcctgagtcttcctaa

SEQ ID NO: 725158 - DNA, 25 bp, Mus musculus
gtccaagtacatcgagcccctgcga

SEQ ID NO: 725159 - DNA, 25 bp, Mus musculus
gtccaagtacatggagcccctgcga

SEQ ID NO: 725160 - DNA, 25 bp, Mus musculus
gtccacaaggctctccaggtttgcc

SEQ ID NO: 725161 - DNA, 25 bp, Mus musculus
gtccacaaggctgtccaggtttgcc

SEQ ID NO: 725162 - DNA, 25 bp, Mus musculus
gtccacactgcgagtgcgtgcccaa

SEQ ID NO: 725163 - DNA, 25 bp, Mus musculus
gtccacactgcgtgtgcgtgcccaa

SEQ ID NO: 725164 - DNA, 25 bp, Mus musculus
gtccacagcaaaacggccgaaccgg

SEQ ID NO: 725165 - DNA, 25 bp, Mus musculus
gtccacagcaaacgattgaagctag

SEQ ID NO: 725166 - DNA, 25 bp, Mus musculus
gtccacagcaaaggattgaagctag

SEQ ID NO: 725167 - DNA, 25 bp, Mus musculus
gtccacagcaaatcggccgaaccgg

SEQ ID NO: 725168 - DNA, 25 bp, Mus musculus
gtccacagcaagctcttggctgact

SEQ ID NO: 725169 - DNA, 25 bp, Mus musculus
gtccacagcaaggtcttggctgact

SEQ ID NO: 725170 - DNA, 25 bp, Mus musculus
gtccacaggatgattgctgagttca

SEQ ID NO: 725171 - DNA, 25 bp, Mus musculus
gtccacaggatgtttgctgagttca

SEQ ID NO: 725172 - DNA, 25 bp, Mus musculus
gtccacagtcaacacacttgggaag

SEQ ID NO: 725173 - DNA, 25 bp, Mus musculus
gtccacagtcaagacacttgggaag

SEQ ID NO: 725174 - DNA, 25 bp, Mus musculus
gtccacatgcatcgcgtctaatgag

SEQ ID NO: 725175 - DNA, 25 bp, Mus musculus
gtccacatgcatggcgtctaatgag

SEQ ID NO: 725176 - DNA, 25 bp, Mus musculus
gtccaccaatgtaagaaaactcacc

SEQ ID NO: 725177 - DNA, 25 bp, Mus musculus
gtccaccaatgttagaaaactcacc

SEQ ID NO: 725178 - DNA, 25 bp, Mus musculus
gtccaccacattcactactataaga

SEQ ID NO: 725179 - DNA, 25 bp, Mus musculus
gtccaccacattgactactataaga

SEQ ID NO: 725180 - DNA, 25 bp, Mus musculus
gtccaccatgatagacgggagtggt

SEQ ID NO: 725181 - DNA, 25 bp, Mus musculus
gtccaccatgattgacgggagtggt

SEQ ID NO: 725182 - DNA, 25 bp, Mus musculus
gtccacccgaccaggaagagcgtgc

SEQ ID NO: 725183 - DNA, 25 bp, Mus musculus
gtccacccgacctggaagagcgtgc

SEQ ID NO: 725184 - DNA, 25 bp, Mus musculus
gtccacctcaggaagacattctgca

SEQ ID NO: 725185 - DNA, 25 bp, Mus musculus
gtccacctcaggtagacattctgca

SEQ ID NO: 725186 - DNA, 25 bp, Mus musculus
gtccacctgagaaggaaggacttca

SEQ ID NO: 725187 - DNA, 25 bp, Mus musculus
gtccacctgagatggaaggacttca

SEQ ID NO: 725188 - DNA, 25 bp, Mus musculus
gtccacctgattactgaagcctcct

SEQ ID NO: 725189 - DNA, 25 bp, Mus musculus
gtccacctgatttctgaagcctcct

SEQ ID NO: 725190 - DNA, 25 bp, Mus musculus
gtccacgatgcccaacctgtgaagg

SEQ ID NO: 725191 - DNA, 25 bp, Mus musculus
gtccacgatgccgaacctgtgaagg

SEQ ID NO: 725192 - DNA, 25 bp, Mus musculus
gtccacgcttcaagttctaccactg

SEQ ID NO: 725193 - DNA, 25 bp, Mus musculus
gtccacgcttcatgttctaccactg

SEQ ID NO: 725194 - DNA, 25 bp, Mus musculus
gtccacggcatcctggaagggatcc

SEQ ID NO: 725195 - DNA, 25 bp, Mus musculus
gtccacggcatcgtggaagggatcc

SEQ ID NO: 725196 - DNA, 25 bp, Mus musculus
gtccacggccataaaaactgagaag

SEQ ID NO: 725197 - DNA, 25 bp, Mus musculus
gtccacggccattaaaactgagaag

SEQ ID NO: 725198 - DNA, 25 bp, Mus musculus
gtccacggtgtgctgaacgacacaa

SEQ ID NO: 725199 - DNA, 25 bp, Mus musculus
gtccacggtgtggtgaacgacacaa

SEQ ID NO: 725200 - DNA, 25 bp, Mus musculus
gtccacgtgatcacgggtgccctga

SEQ ID NO: 725201 - DNA, 25 bp, Mus musculus
gtccacgtgatctcgggtgccctga

SEQ ID NO: 725202 - DNA, 25 bp, Mus musculus
gtccactaccaacacccttaggccg

SEQ ID NO: 725203 - DNA, 25 bp, Mus musculus
gtccactaccaagacccttaggccg

SEQ ID NO: 725204 - DNA, 25 bp, Mus musculus
gtccactgagcccaatttgatatgt

SEQ ID NO: 725205 - DNA, 25 bp, Mus musculus
gtccactgagccgaatttgatatgt

SEQ ID NO: 725206 - DNA, 25 bp, Mus musculus
gtccagaaattacaacagaagatat

SEQ ID NO: 725207 - DNA, 25 bp, Mus musculus
gtccagaaattagaacagaagatat

SEQ ID NO: 725208 - DNA, 25 bp, Mus musculus
gtccagaacaacacgctaaagggcg

SEQ ID NO: 725209 - DNA, 25 bp, Mus musculus
gtccagaacaactcgctaaagggcg

SEQ ID NO: 725210 - DNA, 25 bp, Mus musculus
gtccagaactggattgagttactta

SEQ ID NO: 725211 - DNA, 25 bp, Mus musculus
gtccagaactggtttgagttactta

SEQ ID NO: 725212 - DNA, 25 bp, Mus musculus
gtccagagcacaactgcaggcctgt

SEQ ID NO: 725213 - DNA, 25 bp, Mus musculus
gtccagagcacatctgcaggcctgt

SEQ ID NO: 725214 - DNA, 25 bp, Mus musculus
gtccagagcaccctgtgagtgaaca

SEQ ID NO: 725215 - DNA, 25 bp, Mus musculus
gtccagagcaccgtgtgagtgaaca

SEQ ID NO: 725216 - DNA, 25 bp, Mus musculus
gtccagagtgccctgtgatatcaga

SEQ ID NO: 725217 - DNA, 25 bp, Mus musculus
gtccagagtgccgtgtgatatcaga

SEQ ID NO: 725218 - DNA, 25 bp, Mus musculus
gtccagatctcccaggagacaaccg

SEQ ID NO: 725219 - DNA, 25 bp, Mus musculus
gtccagatctccgaggagacaaccg

SEQ ID NO: 725220 - DNA, 25 bp, Mus musculus
gtccagcaaacacgccaaagatgtc

SEQ ID NO: 725221 - DNA, 25 bp, Mus musculus
gtccagcaaacaggccaaagatgtc

SEQ ID NO: 725222 - DNA, 25 bp, Mus musculus
gtccagcagacccaggacgtcagga

SEQ ID NO: 725223 - DNA, 25 bp, Mus musculus
gtccagcagaccgaggacgtcagga

SEQ ID NO: 725224 - DNA, 25 bp, Mus musculus
gtccagcagcccaaacaacctgagt

SEQ ID NO: 725225 - DNA, 25 bp, Mus musculus
gtccagcagccctaacaacctgagt

SEQ ID NO: 725226 - DNA, 25 bp, Mus musculus
gtccagcagccgcttctacgttgtg

SEQ ID NO: 725227 - DNA, 25 bp, Mus musculus
gtccagcagccggttctacgttgtg

SEQ ID NO: 725228 - DNA, 25 bp, Mus musculus
gtccagcagtggatccacctcagta

SEQ ID NO: 725229 - DNA, 25 bp, Mus musculus
gtccagcagtggttccacctcagta

SEQ ID NO: 725230 - DNA, 25 bp, Mus musculus
gtccagcatcttacacatcccaaga

SEQ ID NO: 725231 - DNA, 25 bp, Mus musculus
gtccagcatctttcacatcccaaga

SEQ ID NO: 725232 - DNA, 25 bp, Mus musculus
gtccagcatgtcatctccacagtgc

SEQ ID NO: 725233 - DNA, 25 bp, Mus musculus
gtccagcatgtcttctccacagtgc

SEQ ID NO: 725234 - DNA, 25 bp, Mus musculus
gtccagccccggctaagagctgcat

SEQ ID NO: 725235 - DNA, 25 bp, Mus musculus
gtccagccccgggtaagagctgcat

SEQ ID NO: 725236 - DNA, 25 bp, Mus musculus
gtccagccgcttctcatctccattg

SEQ ID NO: 725237 - DNA, 25 bp, Mus musculus
gtccagccgcttgtcatctccattg

SEQ ID NO: 725238 - DNA, 25 bp, Mus musculus
gtccagccggcactctacagagaaa

SEQ ID NO: 725239 - DNA, 25 bp, Mus musculus
gtccagccggcagtctacagagaaa

SEQ ID NO: 725240 - DNA, 25 bp, Mus musculus
gtccagcctgcgagcagatctacaa

SEQ ID NO: 725241 - DNA, 25 bp, Mus musculus
gtccagcctgcgtgcagatctacaa

SEQ ID NO: 725242 - DNA, 25 bp, Mus musculus
gtccagcgggaactacacatttgca

SEQ ID NO: 725243 - DNA, 25 bp, Mus musculus
gtccagcgggaagtacacatttgca

SEQ ID NO: 725244 - DNA, 25 bp, Mus musculus
gtccagctagctcggacaagtttac

SEQ ID NO: 725245 - DNA, 25 bp, Mus musculus
gtccagctagctgggacaagtttac

SEQ ID NO: 725246 - DNA, 25 bp, Mus musculus
gtccagctcgcacaggccatgcaga

SEQ ID NO: 725247 - DNA, 25 bp, Mus musculus
gtccagctcgcagaggccatgcaga

SEQ ID NO: 725248 - DNA, 25 bp, Mus musculus
gtccaggaacacaatggacatgtgt

SEQ ID NO: 725249 - DNA, 25 bp, Mus musculus
gtccaggaacactatggacatgtgt

SEQ ID NO: 725250 - DNA, 25 bp, Mus musculus
gtccaggagacccatgcctgccatg

SEQ ID NO: 725251 - DNA, 25 bp, Mus musculus
gtccaggagaccgatgcctgccatg

SEQ ID NO: 725252 - DNA, 25 bp, Mus musculus
gtccaggatatgagtgagtgcatca

SEQ ID NO: 725253 - DNA, 25 bp, Mus musculus
gtccaggatatgtgtgagtgcatca

SEQ ID NO: 725254 - DNA, 25 bp, Mus musculus
gtccaggcagcacccggaactttgt

SEQ ID NO: 725255 - DNA, 25 bp, Mus musculus
gtccaggcagcagccggaactttgt

SEQ ID NO: 725256 - DNA, 25 bp, Mus musculus
gtccaggcaggcaccaaccctaaga

SEQ ID NO: 725257 - DNA, 25 bp, Mus musculus
gtccaggcaggctccaaccctaaga

SEQ ID NO: 725258 - DNA, 25 bp, Mus musculus
gtccaggtccagaaagaacctaaag

SEQ ID NO: 725259 - DNA, 25 bp, Mus musculus
gtccaggtccagtaagaacctaaag

SEQ ID NO: 725260 - DNA, 25 bp, Mus musculus
gtccaggtcttcactgtgccagtac

SEQ ID NO: 725261 - DNA, 25 bp, Mus musculus
gtccaggtcttctctgtgccagtac

SEQ ID NO: 725262 - DNA, 25 bp, Mus musculus
gtccaggtgaggatagaggaacacc

SEQ ID NO: 725263 - DNA, 25 bp, Mus musculus
gtccaggtgaggttagaggaacacc

SEQ ID NO: 725264 - DNA, 25 bp, Mus musculus
gtccaggtgtcacagaaggagttta

SEQ ID NO: 725265 - DNA, 25 bp, Mus musculus
gtccaggtgtcagagaaggagttta

SEQ ID NO: 725266 - DNA, 25 bp, Mus musculus
gtccaggtgtctctgcctatcatca

SEQ ID NO: 725267 - DNA, 25 bp, Mus musculus
gtccaggtgtctgtgcctatcatca

SEQ ID NO: 725268 - DNA, 25 bp, Mus musculus
gtccagtagttaccttgcaagattg

SEQ ID NO: 725269 - DNA, 25 bp, Mus musculus
gtccagtagttagcttgcaagattg

SEQ ID NO: 725270 - DNA, 25 bp, Mus musculus
gtccagtgctcacatgacccaaggg

SEQ ID NO: 725271 - DNA, 25 bp, Mus musculus
gtccagtgctcagatgacccaaggg

SEQ ID NO: 725272 - DNA, 25 bp, Mus musculus
gtccagtgtctgcatgcctaggcca

SEQ ID NO: 725273 - DNA, 25 bp, Mus musculus
gtccagtgtctggatgcctaggcca

SEQ ID NO: 725274 - DNA, 25 bp, Mus musculus
gtccagtgttacaatggctatagtc

SEQ ID NO: 725275 - DNA, 25 bp, Mus musculus
gtccagtgttactatggctatagtc

SEQ ID NO: 725276 - DNA, 25 bp, Mus musculus
gtccagtttcccatgtgggaatcct

SEQ ID NO: 725277 - DNA, 25 bp, Mus musculus
gtccagtttcccttgtgggaatcct

SEQ ID NO: 725278 - DNA, 25 bp, Mus musculus
gtccatactctgctttctcccggaa

SEQ ID NO: 725279 - DNA, 25 bp, Mus musculus
gtccatactctggtttctcccggaa

SEQ ID NO: 725280 - DNA, 25 bp, Mus musculus
gtccatagaaagaccatttagcatg

SEQ ID NO: 725281 - DNA, 25 bp, Mus musculus
gtccatagaaagtccatttagcatg

SEQ ID NO: 725282 - DNA, 25 bp, Mus musculus
gtccatatagaacggcccatcctgc

SEQ ID NO: 725283 - DNA, 25 bp, Mus musculus
gtccatatagaagggcccatcctgc

SEQ ID NO: 725284 - DNA, 25 bp, Mus musculus
gtccatattgcccaatggaacagag

SEQ ID NO: 725285 - DNA, 25 bp, Mus musculus
gtccatattgccgaatggaacagag

SEQ ID NO: 725286 - DNA, 25 bp, Mus musculus
gtccatcacctaagaattggctatc

SEQ ID NO: 725287 - DNA, 25 bp, Mus musculus
gtccatcacctatgaattggctatc

SEQ ID NO: 725288 - DNA, 25 bp, Mus musculus
gtccatcataagaggatctttcctg

SEQ ID NO: 725289 - DNA, 25 bp, Mus musculus
gtccatcataagtggatctttcctg

SEQ ID NO: 725290 - DNA, 25 bp, Mus musculus
gtccatcctgcaccaaagactttag

SEQ ID NO: 725291 - DNA, 25 bp, Mus musculus
gtccatcctgcagcaaagactttag

SEQ ID NO: 725292 - DNA, 25 bp, Mus musculus
gtccatcttcttctgagtgtcctag

SEQ ID NO: 725293 - DNA, 25 bp, Mus musculus
gtccatcttcttgtgagtgtcctag

SEQ ID NO: 725294 - DNA, 25 bp, Mus musculus
gtccatgagaagaggcagggaaaac

SEQ ID NO: 725295 - DNA, 25 bp, Mus musculus
gtccatgagaagtggcagggaaaac

SEQ ID NO: 725296 - DNA, 25 bp, Mus musculus
gtccatggagctacaggtacaggca

SEQ ID NO: 725297 - DNA, 25 bp, Mus musculus
gtccatggagcttcaggtacaggca

SEQ ID NO: 725298 - DNA, 25 bp, Mus musculus
gtccatggatgaccaggaacttgaa

SEQ ID NO: 725299 - DNA, 25 bp, Mus musculus
gtccatggatgagcaggaacttgaa

SEQ ID NO: 725300 - DNA, 25 bp, Mus musculus
gtccatgggctaccagccgtacaat

SEQ ID NO: 725301 - DNA, 25 bp, Mus musculus
gtccatgggctagcagccgtacaat

SEQ ID NO: 725302 - DNA, 25 bp, Mus musculus
gtccatggtctgacccgcgtaagct

SEQ ID NO: 725303 - DNA, 25 bp, Mus musculus
gtccatggtctgtcccgcgtaagct

SEQ ID NO: 725304 - DNA, 25 bp, Mus musculus
gtccatggtgagacgctgtggctct

SEQ ID NO: 725305 - DNA, 25 bp, Mus musculus
gtccatggtgagtcgctgtggctct

SEQ ID NO: 725306 - DNA, 25 bp, Mus musculus
gtccatggtgcacgcgttctgtcaa

SEQ ID NO: 725307 - DNA, 25 bp, Mus musculus
gtccatggtgcaggcgttctgtcaa

SEQ ID NO: 725308 - DNA, 25 bp, Mus musculus
gtccatgtagcacgcggcatctctg

SEQ ID NO: 725309 - DNA, 25 bp, Mus musculus
gtccatgtagcaggcggcatctctg

SEQ ID NO: 725310 - DNA, 25 bp, Mus musculus
gtccatgtgctgatcctcactgctg

SEQ ID NO: 725311 - DNA, 25 bp, Mus musculus
gtccatgtgctgttcctcactgctg

SEQ ID NO: 725312 - DNA, 25 bp, Mus musculus
gtccattcacacagcctggctgatc

SEQ ID NO: 725313 - DNA, 25 bp, Mus musculus
gtccattcacactgcctggctgatc

SEQ ID NO: 725314 - DNA, 25 bp, Mus musculus
gtccattgagacatccaactgaata

SEQ ID NO: 725315 - DNA, 25 bp, Mus musculus
gtccattgagacttccaactgaata

SEQ ID NO: 725316 - DNA, 25 bp, Mus musculus
gtccattgtacacgccaagatctca

SEQ ID NO: 725317 - DNA, 25 bp, Mus musculus
gtccattgtacaggccaagatctca

SEQ ID NO: 725318 - DNA, 25 bp, Mus musculus
gtccattgtcgcacgttccggtccg

SEQ ID NO: 725319 - DNA, 25 bp, Mus musculus
gtccattgtcgctcgttccggtccg

SEQ ID NO: 725320 - DNA, 25 bp, Mus musculus
gtccatttaggactgccgtgcctcc

SEQ ID NO: 725321 - DNA, 25 bp, Mus musculus
gtccatttaggagtgccgtgcctcc

SEQ ID NO: 725322 - DNA, 25 bp, Mus musculus
gtccatttcaagacatactttccgg

SEQ ID NO: 725323 - DNA, 25 bp, Mus musculus
gtccatttcaagtcatactttccgg

SEQ ID NO: 725324 - DNA, 25 bp, Mus musculus
gtccattttgagaggtctcttccca

SEQ ID NO: 725325 - DNA, 25 bp, Mus musculus
gtccattttgagtggtctcttccca

SEQ ID NO: 725326 - DNA, 25 bp, Mus musculus
gtcccaaaaggcaagctccgcaggt

SEQ ID NO: 725327 - DNA, 25 bp, Mus musculus
gtcccaaaaggctagctccgcaggt

SEQ ID NO: 725328 - DNA, 25 bp, Mus musculus
gtcccaaatttgcaaaagctgactc

SEQ ID NO: 725329 - DNA, 25 bp, Mus musculus
gtcccaaatttggaaaagctgactc

SEQ ID NO: 725330 - DNA, 25 bp, Mus musculus
gtcccaacctggaggctctccatgg

SEQ ID NO: 725331 - DNA, 25 bp, Mus musculus
gtcccaacctggtggctctccatgg

SEQ ID NO: 725332 - DNA, 25 bp, Mus musculus
gtcccaacttccatctaggagtgga

SEQ ID NO: 725333 - DNA, 25 bp, Mus musculus
gtcccaacttccttctaggagtgga

SEQ ID NO: 725334 - DNA, 25 bp, Mus musculus
gtcccaagaaatcttttgaaggtga

SEQ ID NO: 725335 - DNA, 25 bp, Mus musculus
gtcccaagaaatgttttgaaggtga

SEQ ID NO: 725336 - DNA, 25 bp, Mus musculus
gtcccaagaagaaccatgaatttag

SEQ ID NO: 725337 - DNA, 25 bp, Mus musculus
gtcccaagaagatccatgaatttag

SEQ ID NO: 725338 - DNA, 25 bp, Mus musculus
gtcccaagcattctctactacctgg

SEQ ID NO: 725339 - DNA, 25 bp, Mus musculus
gtcccaagcattgtctactacctgg

SEQ ID NO: 725340 - DNA, 25 bp, Mus musculus
gtcccacacagcagcttggtgcaca

SEQ ID NO: 725341 - DNA, 25 bp, Mus musculus
gtcccacacagctgcttggtgcaca

SEQ ID NO: 725342 - DNA, 25 bp, Mus musculus
gtcccacatcagatctgcaatacgg

SEQ ID NO: 725343 - DNA, 25 bp, Mus musculus
gtcccacatcagttctgcaatacgg

SEQ ID NO: 725344 - DNA, 25 bp, Mus musculus
gtcccacatgtgcaagaacctttaa

SEQ ID NO: 725345 - DNA, 25 bp, Mus musculus
gtcccacatgtggaagaacctttaa

SEQ ID NO: 725346 - DNA, 25 bp, Mus musculus
gtcccaccgaagaagcgtctcttca

SEQ ID NO: 725347 - DNA, 25 bp, Mus musculus
gtcccaccgaagtagcgtctcttca

SEQ ID NO: 725348 - DNA, 25 bp, Mus musculus
gtcccacctcttagaaggtcttgct

SEQ ID NO: 725349 - DNA, 25 bp, Mus musculus
gtcccacctctttgaaggtcttgct

SEQ ID NO: 725350 - DNA, 25 bp, Mus musculus
gtcccactacttaccagatctgcag

SEQ ID NO: 725351 - DNA, 25 bp, Mus musculus
gtcccactactttccagatctgcag

SEQ ID NO: 725352 - DNA, 25 bp, Mus musculus
gtcccagaatataaatgagctcaag

SEQ ID NO: 725353 - DNA, 25 bp, Mus musculus
gtcccagaatattaatgagctcaag

SEQ ID NO: 725354 - DNA, 25 bp, Mus musculus
gtcccagaccagatgtgtatcttca

SEQ ID NO: 725355 - DNA, 25 bp, Mus musculus
gtcccagaccagttgtgtatcttca

SEQ ID NO: 725356 - DNA, 25 bp, Mus musculus
gtcccagactaacttctacttggag

SEQ ID NO: 725357 - DNA, 25 bp, Mus musculus
gtcccagactaagttctacttggag

SEQ ID NO: 725358 - DNA, 25 bp, Mus musculus
gtcccagaggaccacacacatttct

SEQ ID NO: 725359 - DNA, 25 bp, Mus musculus
gtcccagaggacgacacacatttct

SEQ ID NO: 725360 - DNA, 25 bp, Mus musculus
gtcccagaggcacaggtcaacgtcc

SEQ ID NO: 725361 - DNA, 25 bp, Mus musculus
gtcccagaggcagaggtcaacgtcc

SEQ ID NO: 725362 - DNA, 25 bp, Mus musculus
gtcccagatgtcctgggtcctcagg

SEQ ID NO: 725363 - DNA, 25 bp, Mus musculus
gtcccagatgtcgtgggtcctcagg

SEQ ID NO: 725364 - DNA, 25 bp, Mus musculus
gtcccagcaacccttgggaactggc

SEQ ID NO: 725365 - DNA, 25 bp, Mus musculus
gtcccagcaaccgttgggaactggc

SEQ ID NO: 725366 - DNA, 25 bp, Mus musculus
gtcccagcatgtccaggtggaagaa

SEQ ID NO: 725367 - DNA, 25 bp, Mus musculus
gtcccagcatgtgcaggtggaagaa

SEQ ID NO: 725368 - DNA, 25 bp, Mus musculus
gtcccagccgttctctctggaggaa

SEQ ID NO: 725369 - DNA, 25 bp, Mus musculus
gtcccagccgttgtctctggaggaa

SEQ ID NO: 725370 - DNA, 25 bp, Mus musculus
gtcccaggcactagtaaccatgagt

SEQ ID NO: 725371 - DNA, 25 bp, Mus musculus
gtcccaggcacttgtaaccatgagt

SEQ ID NO: 725372 - DNA, 25 bp, Mus musculus
gtcccagggcctagtcacgagtttt

SEQ ID NO: 725373 - DNA, 25 bp, Mus musculus
gtcccagggccttgtcacgagtttt

SEQ ID NO: 725374 - DNA, 25 bp, Mus musculus
gtcccaggtgaactgacccagatgc

SEQ ID NO: 725375 - DNA, 25 bp, Mus musculus
gtcccaggtgaagtgacccagatgc

SEQ ID NO: 725376 - DNA, 25 bp, Mus musculus
gtcccaggtgatctggacttacctg

SEQ ID NO: 725377 - DNA, 25 bp, Mus musculus
gtcccaggtgatgtggacttacctg

SEQ ID NO: 725378 - DNA, 25 bp, Mus musculus
gtcccaggtttcagtgaagctggtt

SEQ ID NO: 725379 - DNA, 25 bp, Mus musculus
gtcccaggtttctgtgaagctggtt

SEQ ID NO: 725380 - DNA, 25 bp, Mus musculus
gtcccagtcggcagcagctaagccg

SEQ ID NO: 725381 - DNA, 25 bp, Mus musculus
gtcccagtcggctgcagctaagccg

SEQ ID NO: 725382 - DNA, 25 bp, Mus musculus
gtcccagtgaggagcaccggacaga

SEQ ID NO: 725383 - DNA, 25 bp, Mus musculus
gtcccagtgaggtgcaccggacaga

SEQ ID NO: 725384 - DNA, 25 bp, Mus musculus
gtcccataggcacagaacgatcaca

SEQ ID NO: 725385 - DNA, 25 bp, Mus musculus
gtcccataggcagagaacgatcaca

SEQ ID NO: 725386 - DNA, 25 bp, Mus musculus
gtcccatcaccaaggttgccaaact

SEQ ID NO: 725387 - DNA, 25 bp, Mus musculus
gtcccatcaccatggttgccaaact

SEQ ID NO: 725388 - DNA, 25 bp, Mus musculus
gtcccatctggacactgtgcttggg

SEQ ID NO: 725389 - DNA, 25 bp, Mus musculus
gtcccatctggagactgtgcttggg

SEQ ID NO: 725390 - DNA, 25 bp, Mus musculus
gtcccatgaaaacagtttcttggtg

SEQ ID NO: 725391 - DNA, 25 bp, Mus musculus
gtcccatgaaaagagtttcttggtg

SEQ ID NO: 725392 - DNA, 25 bp, Mus musculus
gtcccatgtgcgagcctgataccta

SEQ ID NO: 725393 - DNA, 25 bp, Mus musculus
gtcccatgtgcgtgcctgataccta

SEQ ID NO: 725394 - DNA, 25 bp, Mus musculus
gtcccatttgagacttcttgcccat

SEQ ID NO: 725395 - DNA, 25 bp, Mus musculus
gtcccatttgagtcttcttgcccat

SEQ ID NO: 725396 - DNA, 25 bp, Mus musculus
gtccccaaagttccataattgagca

SEQ ID NO: 725397 - DNA, 25 bp, Mus musculus
gtccccaaagttgcataattgagca

SEQ ID NO: 725398 - DNA, 25 bp, Mus musculus
gtccccaattcactcagttaaatgt

SEQ ID NO: 725399 - DNA, 25 bp, Mus musculus
gtccccaattcagtcagttaaatgt

SEQ ID NO: 725400 - DNA, 25 bp, Mus musculus
gtccccaccaggagttccagggaga

SEQ ID NO: 725401 - DNA, 25 bp, Mus musculus
gtccccaccaggtgttccagggaga

SEQ ID NO: 725402 - DNA, 25 bp, Mus musculus
gtccccactgcgacgagtgaatcag

SEQ ID NO: 725403 - DNA, 25 bp, Mus musculus
gtccccactgcgtcgagtgaatcag

SEQ ID NO: 725404 - DNA, 25 bp, Mus musculus
gtccccagagagaggctatacactg

SEQ ID NO: 725405 - DNA, 25 bp, Mus musculus
gtccccagagagtggctatacactg

SEQ ID NO: 725406 - DNA, 25 bp, Mus musculus
gtccccagcgataggcctctgcaaa

SEQ ID NO: 725407 - DNA, 25 bp, Mus musculus
gtccccagcgattggcctctgcaaa

SEQ ID NO: 725408 - DNA, 25 bp, Mus musculus
gtccccagctcgaggatggcgtcct

SEQ ID NO: 725409 - DNA, 25 bp, Mus musculus
gtccccagctcgtggatggcgtcct

SEQ ID NO: 725410 - DNA, 25 bp, Mus musculus
gtccccaggcaacaactattctcat

SEQ ID NO: 725411 - DNA, 25 bp, Mus musculus
gtccccaggcaagaactattctcat

SEQ ID NO: 725412 - DNA, 25 bp, Mus musculus
gtccccatcctactgtggcactaag

SEQ ID NO: 725413 - DNA, 25 bp, Mus musculus
gtccccatcctagtgtggcactaag

SEQ ID NO: 725414 - DNA, 25 bp, Mus musculus
gtccccatcgtcaacacaaacgatg

SEQ ID NO: 725415 - DNA, 25 bp, Mus musculus
gtccccatcgtctacacaaacgatg

SEQ ID NO: 725416 - DNA, 25 bp, Mus musculus
gtccccattctgaactaacagacga

SEQ ID NO: 725417 - DNA, 25 bp, Mus musculus
gtccccattctgtactaacagacga

SEQ ID NO: 725418 - DNA, 25 bp, Mus musculus
gtccccgagtctactcagtgtccat

SEQ ID NO: 725419 - DNA, 25 bp, Mus musculus
gtccccgagtcttctcagtgtccat

SEQ ID NO: 725420 - DNA, 25 bp, Mus musculus
gtccccgcagcacgaaggtccaaga

SEQ ID NO: 725421 - DNA, 25 bp, Mus musculus
gtccccgcagcaggaaggtccaaga

SEQ ID NO: 725422 - DNA, 25 bp, Mus musculus
gtccccgcctgccacgaaaagaatt

SEQ ID NO: 725423 - DNA, 25 bp, Mus musculus
gtccccgcctgcgacgaaaagaatt

SEQ ID NO: 725424 - DNA, 25 bp, Mus musculus
gtccccgctattcgcgctgcaattg

SEQ ID NO: 725425 - DNA, 25 bp, Mus musculus
gtccccgctattggcgctgcaattg

SEQ ID NO: 725426 - DNA, 25 bp, Mus musculus
gtccccgctgtccatgaagcagctg

SEQ ID NO: 725427 - DNA, 25 bp, Mus musculus
gtccccgctgtcgatgaagcagctg

SEQ ID NO: 725428 - DNA, 25 bp, Mus musculus
gtccccggagatctaggctcgccag

SEQ ID NO: 725429 - DNA, 25 bp, Mus musculus
gtccccggagatgtaggctcgccag

SEQ ID NO: 725430 - DNA, 25 bp, Mus musculus
gtccccggagccaggtgagtcatct

SEQ ID NO: 725431 - DNA, 25 bp, Mus musculus
gtccccggagcctggtgagtcatct

SEQ ID NO: 725432 - DNA, 25 bp, Mus musculus
gtcccctcccttagtagtccaggat

SEQ ID NO: 725433 - DNA, 25 bp, Mus musculus
gtcccctccctttgtagtccaggat

SEQ ID NO: 725434 - DNA, 25 bp, Mus musculus
gtcccctccgtgcaagtgtacatag

SEQ ID NO: 725435 - DNA, 25 bp, Mus musculus
gtcccctccgtggaagtgtacatag

SEQ ID NO: 725436 - DNA, 25 bp, Mus musculus
gtcccctcgtgtatgaaagctgcca

SEQ ID NO: 725437 - DNA, 25 bp, Mus musculus
gtcccctcgtgtttgaaagctgcca

SEQ ID NO: 725438 - DNA, 25 bp, Mus musculus
gtcccctctagcctaaggtcagtag

SEQ ID NO: 725439 - DNA, 25 bp, Mus musculus
gtcccctctagcgtaaggtcagtag

SEQ ID NO: 725440 - DNA, 25 bp, Mus musculus
gtcccctctgggagctgctacactc

SEQ ID NO: 725441 - DNA, 25 bp, Mus musculus
gtcccctctgggtgctgctacactc

SEQ ID NO: 725442 - DNA, 25 bp, Mus musculus
gtcccctgcagaactgaagcaagcc

SEQ ID NO: 725443 - DNA, 25 bp, Mus musculus
gtcccctgcagatctgaagcaagcc

SEQ ID NO: 725444 - DNA, 25 bp, Mus musculus
gtcccctgccaaagtgcatgtcttc

SEQ ID NO: 725445 - DNA, 25 bp, Mus musculus
gtcccctgccaatgtgcatgtcttc

SEQ ID NO: 725446 - DNA, 25 bp, Mus musculus
gtcccctgtaaacttagatgctgtg

SEQ ID NO: 725447 - DNA, 25 bp, Mus musculus
gtcccctgtaaagttagatgctgtg

SEQ ID NO: 725448 - DNA, 25 bp, Mus musculus
gtccccttactcagttgagccggca

SEQ ID NO: 725449 - DNA, 25 bp, Mus musculus
gtccccttactctgttgagccggca

SEQ ID NO: 725450 - DNA, 25 bp, Mus musculus
gtccccttggatcttcacacagctg

SEQ ID NO: 725451 - DNA, 25 bp, Mus musculus
gtccccttggatgttcacacagctg

SEQ ID NO: 725452 - DNA, 25 bp, Mus musculus
gtcccgacgcggattctgggcgcca

SEQ ID NO: 725453 - DNA, 25 bp, Mus musculus
gtcccgacgcggtttctgggcgcca

SEQ ID NO: 725454 - DNA, 25 bp, Mus musculus
gtcccgactgggacctggcagagat

SEQ ID NO: 725455 - DNA, 25 bp, Mus musculus
gtcccgactgggtcctggcagagat

SEQ ID NO: 725456 - DNA, 25 bp, Mus musculus
gtcccgagatgaaatggtttcctgg

SEQ ID NO: 725457 - DNA, 25 bp, Mus musculus
gtcccgagatgatatggtttcctgg

SEQ ID NO: 725458 - DNA, 25 bp, Mus musculus
gtcccgagggacagaatgccaccct

SEQ ID NO: 725459 - DNA, 25 bp, Mus musculus
gtcccgagggactgaatgccaccct

SEQ ID NO: 725460 - DNA, 25 bp, Mus musculus
gtcccgcagagcatcggctagctgg

SEQ ID NO: 725461 - DNA, 25 bp, Mus musculus
gtcccgcagagcttcggctagctgg

SEQ ID NO: 725462 - DNA, 25 bp, Mus musculus
gtcccgctatgaagccaccgcagag

SEQ ID NO: 725463 - DNA, 25 bp, Mus musculus
gtcccgctatgatgccaccgcagag

SEQ ID NO: 725464 - DNA, 25 bp, Mus musculus
gtcccggcagcgaaggcagaaaaaa

SEQ ID NO: 725465 - DNA, 25 bp, Mus musculus
gtcccggcagcgtaggcagaaaaaa

SEQ ID NO: 725466 - DNA, 25 bp, Mus musculus
gtcccggcagctaccattgcggaca

SEQ ID NO: 725467 - DNA, 25 bp, Mus musculus
gtcccggcagcttccattgcggaca

SEQ ID NO: 725468 - DNA, 25 bp, Mus musculus
gtcccggcgtcccagtacatggaga

SEQ ID NO: 725469 - DNA, 25 bp, Mus musculus
gtcccggcgtccgagtacatggaga

SEQ ID NO: 725470 - DNA, 25 bp, Mus musculus
gtcccgggaggtcatcgacagcatc

SEQ ID NO: 725471 - DNA, 25 bp, Mus musculus
gtcccgggaggtgatcgacagcatc

SEQ ID NO: 725472 - DNA, 25 bp, Mus musculus
gtcccgggatgacttcttatggaag

SEQ ID NO: 725473 - DNA, 25 bp, Mus musculus
gtcccgggatgagttcttatggaag

SEQ ID NO: 725474 - DNA, 25 bp, Mus musculus
gtcccggtcattaacagtgtggcta

SEQ ID NO: 725475 - DNA, 25 bp, Mus musculus
gtcccggtcatttacagtgtggcta

SEQ ID NO: 725476 - DNA, 25 bp, Mus musculus
gtcccggtccgcaggctagcgctgt

SEQ ID NO: 725477 - DNA, 25 bp, Mus musculus
gtcccggtccgctggctagcgctgt

SEQ ID NO: 725478 - DNA, 25 bp, Mus musculus
gtcccggttcatcactgccaatcag

SEQ ID NO: 725479 - DNA, 25 bp, Mus musculus
gtcccggttcatgactgccaatcag

SEQ ID NO: 725480 - DNA, 25 bp, Mus musculus
gtcccgtcagacaaaggcaactaca

SEQ ID NO: 725481 - DNA, 25 bp, Mus musculus
gtcccgtcagactaaggcaactaca

SEQ ID NO: 725482 - DNA, 25 bp, Mus musculus
gtcccgtcagatatcaacaacccag

SEQ ID NO: 725483 - DNA, 25 bp, Mus musculus
gtcccgtcagatttcaacaacccag

SEQ ID NO: 725484 - DNA, 25 bp, Mus musculus
gtcccgtggaacctgggtctagcca

SEQ ID NO: 725485 - DNA, 25 bp, Mus musculus
gtcccgtggaacgtgggtctagcca

SEQ ID NO: 725486 - DNA, 25 bp, Mus musculus
gtcccgttgtggatcatcatcctag

SEQ ID NO: 725487 - DNA, 25 bp, Mus musculus
gtcccgttgtggttcatcatcctag

SEQ ID NO: 725488 - DNA, 25 bp, Mus musculus
gtccctaaaagtcaggcaccacaca

SEQ ID NO: 725489 - DNA, 25 bp, Mus musculus
gtccctaaaagtgaggcaccacaca

SEQ ID NO: 725490 - DNA, 25 bp, Mus musculus
gtccctaaaatcaaccgctctatgc

SEQ ID NO: 725491 - DNA, 25 bp, Mus musculus
gtccctaaaatctaccgctctatgc

SEQ ID NO: 725492 - DNA, 25 bp, Mus musculus
gtccctacagccaggatcctagaga

SEQ ID NO: 725493 - DNA, 25 bp, Mus musculus
gtccctacagcctggatcctagaga

SEQ ID NO: 725494 - DNA, 25 bp, Mus musculus
gtccctagccacacatactccaatg

SEQ ID NO: 725495 - DNA, 25 bp, Mus musculus
gtccctagccactcatactccaatg

SEQ ID NO: 725496 - DNA, 25 bp, Mus musculus
gtccctatagtgcagcaaagaggaa

SEQ ID NO: 725497 - DNA, 25 bp, Mus musculus
gtccctatagtggagcaaagaggaa

SEQ ID NO: 725498 - DNA, 25 bp, Mus musculus
gtccctatgagtcgtataatccaca

SEQ ID NO: 725499 - DNA, 25 bp, Mus musculus
gtccctatgagtggtataatccaca

SEQ ID NO: 725500 - DNA, 25 bp, Mus musculus
gtccctcaactgcatgagagaagaa

SEQ ID NO: 725501 - DNA, 25 bp, Mus musculus
gtccctcaactggatgagagaagaa

SEQ ID NO: 725502 - DNA, 25 bp, Mus musculus
gtccctcaagtgagtgactttacct

SEQ ID NO: 725503 - DNA, 25 bp, Mus musculus
gtccctcaagtgtgtgactttacct

SEQ ID NO: 725504 - DNA, 25 bp, Mus musculus
gtccctcaatcaacctggataagga

SEQ ID NO: 725505 - DNA, 25 bp, Mus musculus
gtccctcaatcatcctggataagga

SEQ ID NO: 725506 - DNA, 25 bp, Mus musculus
gtccctcatcagcatattcaccatg

SEQ ID NO: 725507 - DNA, 25 bp, Mus musculus
gtccctcatcaggatattcaccatg

SEQ ID NO: 725508 - DNA, 25 bp, Mus musculus
gtccctctcggcagacaagttccag

SEQ ID NO: 725509 - DNA, 25 bp, Mus musculus
gtccctctcggctgacaagttccag

SEQ ID NO: 725510 - DNA, 25 bp, Mus musculus
gtccctcttgcacaaaagtactttg

SEQ ID NO: 725511 - DNA, 25 bp, Mus musculus
gtccctcttgcagaaaagtactttg

SEQ ID NO: 725512 - DNA, 25 bp, Mus musculus
gtccctgaaagcaggcctccaacaa

SEQ ID NO: 725513 - DNA, 25 bp, Mus musculus
gtccctgaaagctggcctccaacaa

SEQ ID NO: 725514 - DNA, 25 bp, Mus musculus
gtccctgaacatcgcagatgcaatg

SEQ ID NO: 725515 - DNA, 25 bp, Mus musculus
gtccctgaacatggcagatgcaatg

SEQ ID NO: 725516 - DNA, 25 bp, Mus musculus
gtccctgaaccaatctcttccggag

SEQ ID NO: 725517 - DNA, 25 bp, Mus musculus
gtccctgaaccattctcttccggag

SEQ ID NO: 725518 - DNA, 25 bp, Mus musculus
gtccctgagagtaagaacggcggca

SEQ ID NO: 725519 - DNA, 25 bp, Mus musculus
gtccctgagagttagaacggcggca

SEQ ID NO: 725520 - DNA, 25 bp, Mus musculus
gtccctgagtttcagccctgatacg

SEQ ID NO: 725521 - DNA, 25 bp, Mus musculus
gtccctgagtttgagccctgatacg

SEQ ID NO: 725522 - DNA, 25 bp, Mus musculus
gtccctgatctgcataagaggaagt

SEQ ID NO: 725523 - DNA, 25 bp, Mus musculus
gtccctgatctggataagaggaagt

SEQ ID NO: 725524 - DNA, 25 bp, Mus musculus
gtccctgcactgaggtaaaagtggt

SEQ ID NO: 725525 - DNA, 25 bp, Mus musculus
gtccctgcactgtggtaaaagtggt

SEQ ID NO: 725526 - DNA, 25 bp, Mus musculus
gtccctgcagatcggctacacgcag

SEQ ID NO: 725527 - DNA, 25 bp, Mus musculus
gtccctgcagatgggctacacgcag

SEQ ID NO: 725528 - DNA, 25 bp, Mus musculus
gtccctgcgaatccgaaagcctcgt

SEQ ID NO: 725529 - DNA, 25 bp, Mus musculus
gtccctgcgaatgcgaaagcctcgt

SEQ ID NO: 725530 - DNA, 25 bp, Mus musculus
gtccctggacccaccgaagaaagca

SEQ ID NO: 725531 - DNA, 25 bp, Mus musculus
gtccctggaccctccgaagaaagca

SEQ ID NO: 725532 - DNA, 25 bp, Mus musculus
gtccctggccttagatgagtccctg

SEQ ID NO: 725533 - DNA, 25 bp, Mus musculus
gtccctggcctttgatgagtccctg

SEQ ID NO: 725534 - DNA, 25 bp, Mus musculus
gtccctggctggatcctccacagag

SEQ ID NO: 725535 - DNA, 25 bp, Mus musculus
gtccctggctggttcctccacagag

SEQ ID NO: 725536 - DNA, 25 bp, Mus musculus
gtccctgtgccgatcctgagcaatt

SEQ ID NO: 725537 - DNA, 25 bp, Mus musculus
gtccctgtgccgttcctgagcaatt

SEQ ID NO: 725538 - DNA, 25 bp, Mus musculus
gtccctgtggctcatgaggatgtca

SEQ ID NO: 725539 - DNA, 25 bp, Mus musculus
gtccctgtggctgatgaggatgtca

SEQ ID NO: 725540 - DNA, 25 bp, Mus musculus
gtccctgtgtcaatgggatttgtac

SEQ ID NO: 725541 - DNA, 25 bp, Mus musculus
gtccctgtgtcattgggatttgtac

SEQ ID NO: 725542 - DNA, 25 bp, Mus musculus
gtcccttatctgaagaattcttaca

SEQ ID NO: 725543 - DNA, 25 bp, Mus musculus
gtcccttatctgtagaattcttaca

SEQ ID NO: 725544 - DNA, 25 bp, Mus musculus
gtcccttcacttaaggccagctgaa

SEQ ID NO: 725545 - DNA, 25 bp, Mus musculus
gtcccttcactttaggccagctgaa

SEQ ID NO: 725546 - DNA, 25 bp, Mus musculus
gtcccttgcatcagctggctaccga

SEQ ID NO: 725547 - DNA, 25 bp, Mus musculus
gtcccttgcatctgctggctaccga

SEQ ID NO: 725548 - DNA, 25 bp, Mus musculus
gtccctttcagaccgggctcttttg

SEQ ID NO: 725549 - DNA, 25 bp, Mus musculus
gtccctttcagagcgggctcttttg

SEQ ID NO: 725550 - DNA, 25 bp, Mus musculus
gtccctttcaggatccagacttaag

SEQ ID NO: 725551 - DNA, 25 bp, Mus musculus
gtccctttcaggttccagacttaag

SEQ ID NO: 725552 - DNA, 25 bp, Mus musculus
gtccctttccggcagagcaagctca

SEQ ID NO: 725553 - DNA, 25 bp, Mus musculus
gtccctttccgggagagcaagctca

SEQ ID NO: 725554 - DNA, 25 bp, Mus musculus
gtccctttgtctagatgcctggcaa

SEQ ID NO: 725555 - DNA, 25 bp, Mus musculus
gtccctttgtcttgatgcctggcaa

SEQ ID NO: 725556 - DNA, 25 bp, Mus musculus
gtccgaaatggacactggaccttcc

SEQ ID NO: 725557 - DNA, 25 bp, Mus musculus
gtccgaaatggagactggaccttcc

SEQ ID NO: 725558 - DNA, 25 bp, Mus musculus
gtccgaatcatccatcctaggcggg

SEQ ID NO: 725559 - DNA, 25 bp, Mus musculus
gtccgaatcatcgatcctaggcggg

SEQ ID NO: 725560 - DNA, 25 bp, Mus musculus
gtccgaattgagcaccgtgggaggc

SEQ ID NO: 725561 - DNA, 25 bp, Mus musculus
gtccgaattgaggaccgtgggaggc

SEQ ID NO: 725562 - DNA, 25 bp, Mus musculus
gtccgacccagactgtggcgctcat

SEQ ID NO: 725563 - DNA, 25 bp, Mus musculus
gtccgacccagagtgtggcgctcat

SEQ ID NO: 725564 - DNA, 25 bp, Mus musculus
gtccgacctctacaactgggaggtg

SEQ ID NO: 725565 - DNA, 25 bp, Mus musculus
gtccgacctctagaactgggaggtg

SEQ ID NO: 725566 - DNA, 25 bp, Mus musculus
gtccgagactctacccatcataata

SEQ ID NO: 725567 - DNA, 25 bp, Mus musculus
gtccgagactcttcccatcataata

SEQ ID NO: 725568 - DNA, 25 bp, Mus musculus
gtccgagccgcgagtccctttgcat

SEQ ID NO: 725569 - DNA, 25 bp, Mus musculus
gtccgagccgcgtgtccctttgcat

SEQ ID NO: 725570 - DNA, 25 bp, Mus musculus
gtccgagctgaacattatgagtcat

SEQ ID NO: 725571 - DNA, 25 bp, Mus musculus
gtccgagctgaagattatgagtcat

SEQ ID NO: 725572 - DNA, 25 bp, Mus musculus
gtccgatcagagattactcagccag

SEQ ID NO: 725573 - DNA, 25 bp, Mus musculus
gtccgatcagagtttactcagccag

SEQ ID NO: 725574 - DNA, 25 bp, Mus musculus
gtccgatgaacgacttcagcctctg

SEQ ID NO: 725575 - DNA, 25 bp, Mus musculus
gtccgatgaacgtcttcagcctctg

SEQ ID NO: 725576 - DNA, 25 bp, Mus musculus
gtccgatggctgcagaggacaaccc

SEQ ID NO: 725577 - DNA, 25 bp, Mus musculus
gtccgatggctggagaggacaaccc

SEQ ID NO: 725578 - DNA, 25 bp, Mus musculus
gtccgcacacaaagtcattgtcaag

SEQ ID NO: 725579 - DNA, 25 bp, Mus musculus
gtccgcacacaatgtcattgtcaag

SEQ ID NO: 725580 - DNA, 25 bp, Mus musculus
gtccgcctgacaccagtgcctttga

SEQ ID NO: 725581 - DNA, 25 bp, Mus musculus
gtccgcctgacagcagtgcctttga

SEQ ID NO: 725582 - DNA, 25 bp, Mus musculus
gtccgcctggccaatatcctgaagg

SEQ ID NO: 725583 - DNA, 25 bp, Mus musculus
gtccgcctggcctatatcctgaagg

SEQ ID NO: 725584 - DNA, 25 bp, Mus musculus
gtccgcctggctcggatgaagatct

SEQ ID NO: 725585 - DNA, 25 bp, Mus musculus
gtccgcctggctgggatgaagatct

SEQ ID NO: 725586 - DNA, 25 bp, Mus musculus
gtccgcgaacgcctaaggaacgcag

SEQ ID NO: 725587 - DNA, 25 bp, Mus musculus
gtccgcgaacgcgtaaggaacgcag

SEQ ID NO: 725588 - DNA, 25 bp, Mus musculus
gtccgcgagaagagcgacccacacg

SEQ ID NO: 725589 - DNA, 25 bp, Mus musculus
gtccgcgagaagtgcgacccacacg

SEQ ID NO: 725590 - DNA, 25 bp, Mus musculus
gtccgctagtagcacactccagaaa

SEQ ID NO: 725591 - DNA, 25 bp, Mus musculus
gtccgctagtaggacactccagaaa

SEQ ID NO: 725592 - DNA, 25 bp, Mus musculus
gtccgcttccgccactggttcgtgg

SEQ ID NO: 725593 - DNA, 25 bp, Mus musculus
gtccgcttccgcgactggttcgtgg

SEQ ID NO: 725594 - DNA, 25 bp, Mus musculus
gtccggaaacgtccgctgtcacaaa

SEQ ID NO: 725595 - DNA, 25 bp, Mus musculus
gtccggaaacgtgcgctgtcacaaa

SEQ ID NO: 725596 - DNA, 25 bp, Mus musculus
gtccggaagaccagagccgactgct

SEQ ID NO: 725597 - DNA, 25 bp, Mus musculus
gtccggaagacctgagccgactgct

SEQ ID NO: 725598 - DNA, 25 bp, Mus musculus
gtccggagccgcctgctggcaactt

SEQ ID NO: 725599 - DNA, 25 bp, Mus musculus
gtccggagccgcgtgctggcaactt

SEQ ID NO: 725600 - DNA, 25 bp, Mus musculus
gtccggaggtcccacagctctgcag

SEQ ID NO: 725601 - DNA, 25 bp, Mus musculus
gtccggaggtccgacagctctgcag

SEQ ID NO: 725602 - DNA, 25 bp, Mus musculus
gtccggatatatatccctgctgctg

SEQ ID NO: 725603 - DNA, 25 bp, Mus musculus
gtccggatatatttccctgctgctg

SEQ ID NO: 725604 - DNA, 25 bp, Mus musculus
gtccggcctggcacgtaagtctcag

SEQ ID NO: 725605 - DNA, 25 bp, Mus musculus
gtccggcctggctcgtaagtctcag

SEQ ID NO: 725606 - DNA, 25 bp, Mus musculus
gtccggcggcagaggcgctctccaa

SEQ ID NO: 725607 - DNA, 25 bp, Mus musculus
gtccggcggcagtggcgctctccaa

SEQ ID NO: 725608 - DNA, 25 bp, Mus musculus
gtccgggacaatctttgacaatttc

SEQ ID NO: 725609 - DNA, 25 bp, Mus musculus
gtccgggacaatgtttgacaatttc

SEQ ID NO: 725610 - DNA, 25 bp, Mus musculus
gtccgggacataccattgccagagg

SEQ ID NO: 725611 - DNA, 25 bp, Mus musculus
gtccgggacatagcattgccagagg

SEQ ID NO: 725612 - DNA, 25 bp, Mus musculus
gtccgggtctcaccacaagatgcca

SEQ ID NO: 725613 - DNA, 25 bp, Mus musculus
gtccgggtctcagcacaagatgcca

SEQ ID NO: 725614 - DNA, 25 bp, Mus musculus
gtccggtcgcagactcccttcgagg

SEQ ID NO: 725615 - DNA, 25 bp, Mus musculus
gtccggtcgcagtctcccttcgagg

SEQ ID NO: 725616 - DNA, 25 bp, Mus musculus
gtccgtcagtcacgaactgctaaaa

SEQ ID NO: 725617 - DNA, 25 bp, Mus musculus
gtccgtcagtcaggaactgctaaaa

SEQ ID NO: 725618 - DNA, 25 bp, Mus musculus
gtccgtcatcatctttgctggcttc

SEQ ID NO: 725619 - DNA, 25 bp, Mus musculus
gtccgtcatcatgtttgctggcttc

SEQ ID NO: 725620 - DNA, 25 bp, Mus musculus
gtccgtctgctgaggaagaccttcc

SEQ ID NO: 725621 - DNA, 25 bp, Mus musculus
gtccgtctgctgtggaagaccttcc

SEQ ID NO: 725622 - DNA, 25 bp, Mus musculus
gtccgtgaagtcctgcagctcccag

SEQ ID NO: 725623 - DNA, 25 bp, Mus musculus
gtccgtgaagtcgtgcagctcccag

SEQ ID NO: 725624 - DNA, 25 bp, Mus musculus
gtccgtgtgaatctagttcagaata

SEQ ID NO: 725625 - DNA, 25 bp, Mus musculus
gtccgtgtgaatgtagttcagaata

SEQ ID NO: 725626 - DNA, 25 bp, Mus musculus
gtcctaaacctgcaagggacattag

SEQ ID NO: 725627 - DNA, 25 bp, Mus musculus
gtcctaaacctggaagggacattag

SEQ ID NO: 725628 - DNA, 25 bp, Mus musculus
gtcctacattgtccttctgatccag

SEQ ID NO: 725629 - DNA, 25 bp, Mus musculus
gtcctacattgtgcttctgatccag

SEQ ID NO: 725630 - DNA, 25 bp, Mus musculus
gtcctaccacagagaaactcaaagt

SEQ ID NO: 725631 - DNA, 25 bp, Mus musculus
gtcctaccacagtgaaactcaaagt

SEQ ID NO: 725632 - DNA, 25 bp, Mus musculus
gtcctaccacgccatggaaggttac

SEQ ID NO: 725633 - DNA, 25 bp, Mus musculus
gtcctaccacgcgatggaaggttac

SEQ ID NO: 725634 - DNA, 25 bp, Mus musculus
gtcctacctacaaatggcaccgagg

SEQ ID NO: 725635 - DNA, 25 bp, Mus musculus
gtcctacctacatatggcaccgagg

SEQ ID NO: 725636 - DNA, 25 bp, Mus musculus
gtcctacctggacctctatcgaaag

SEQ ID NO: 725637 - DNA, 25 bp, Mus musculus
gtcctacctggagctctatcgaaag

SEQ ID NO: 725638 - DNA, 25 bp, Mus musculus
gtcctaccttctctatcaaatgctg

SEQ ID NO: 725639 - DNA, 25 bp, Mus musculus
gtcctaccttctgtatcaaatgctg

SEQ ID NO: 725640 - DNA, 25 bp, Mus musculus
gtcctactggccaagcgcaagtcgg

SEQ ID NO: 725641 - DNA, 25 bp, Mus musculus
gtcctactggcctagcgcaagtcgg

SEQ ID NO: 725642 - DNA, 25 bp, Mus musculus
gtcctagagaacactcttcacttca

SEQ ID NO: 725643 - DNA, 25 bp, Mus musculus
gtcctagagaactctcttcacttca

SEQ ID NO: 725644 - DNA, 25 bp, Mus musculus
gtcctagagacacaaggaagatgga

SEQ ID NO: 725645 - DNA, 25 bp, Mus musculus
gtcctagagacagaaggaagatgga

SEQ ID NO: 725646 - DNA, 25 bp, Mus musculus
gtcctagccatgatacaagccaaag

SEQ ID NO: 725647 - DNA, 25 bp, Mus musculus
gtcctagccatgttacaagccaaag

SEQ ID NO: 725648 - DNA, 25 bp, Mus musculus
gtcctatgaaaacccgccgcccatt

SEQ ID NO: 725649 - DNA, 25 bp, Mus musculus
gtcctatgaaaagccgccgcccatt

SEQ ID NO: 725650 - DNA, 25 bp, Mus musculus
gtcctatgtgtacgctgaagagccc

SEQ ID NO: 725651 - DNA, 25 bp, Mus musculus
gtcctatgtgtaggctgaagagccc

SEQ ID NO: 725652 - DNA, 25 bp, Mus musculus
gtcctcaacaaaatcctgaaaggca

SEQ ID NO: 725653 - DNA, 25 bp, Mus musculus
gtcctcaacaaattcctgaaaggca

SEQ ID NO: 725654 - DNA, 25 bp, Mus musculus
gtcctcaactttcacacccttgtgg

SEQ ID NO: 725655 - DNA, 25 bp, Mus musculus
gtcctcaactttgacacccttgtgg

SEQ ID NO: 725656 - DNA, 25 bp, Mus musculus
gtcctcacaaacagtcccttagggt

SEQ ID NO: 725657 - DNA, 25 bp, Mus musculus
gtcctcacaaactgtcccttagggt

SEQ ID NO: 725658 - DNA, 25 bp, Mus musculus
gtcctcacagcgatttgaaagagct

SEQ ID NO: 725659 - DNA, 25 bp, Mus musculus
gtcctcacagcgttttgaaagagct

SEQ ID NO: 725660 - DNA, 25 bp, Mus musculus
gtcctcaccaaactcctacaggaag

SEQ ID NO: 725661 - DNA, 25 bp, Mus musculus
gtcctcaccaaagtcctacaggaag

SEQ ID NO: 725662 - DNA, 25 bp, Mus musculus
gtcctcacgaggcatcctgcagggc

SEQ ID NO: 725663 - DNA, 25 bp, Mus musculus
gtcctcacgagggatcctgcagggc

SEQ ID NO: 725664 - DNA, 25 bp, Mus musculus
gtcctcacgtccatttttcctatag

SEQ ID NO: 725665 - DNA, 25 bp, Mus musculus
gtcctcacgtccttttttcctatag

SEQ ID NO: 725666 - DNA, 25 bp, Mus musculus
gtcctcactcccctgttcaaaataa

SEQ ID NO: 725667 - DNA, 25 bp, Mus musculus
gtcctcactcccgtgttcaaaataa

SEQ ID NO: 725668 - DNA, 25 bp, Mus musculus
gtcctcactctcagcggcggcgaga

SEQ ID NO: 725669 - DNA, 25 bp, Mus musculus
gtcctcactctctgcggcggcgaga

SEQ ID NO: 725670 - DNA, 25 bp, Mus musculus
gtcctcagagcaattggtaccgatg

SEQ ID NO: 725671 - DNA, 25 bp, Mus musculus
gtcctcagagcatttggtaccgatg

SEQ ID NO: 725672 - DNA, 25 bp, Mus musculus
gtcctcagcggcatccggacggctg

SEQ ID NO: 725673 - DNA, 25 bp, Mus musculus
gtcctcagcggcttccggacggctg

SEQ ID NO: 725674 - DNA, 25 bp, Mus musculus
gtcctcagggtacggagccaccttg

SEQ ID NO: 725675 - DNA, 25 bp, Mus musculus
gtcctcagggtagggagccaccttg

SEQ ID NO: 725676 - DNA, 25 bp, Mus musculus
gtcctcagtactatcgggcctgttc

SEQ ID NO: 725677 - DNA, 25 bp, Mus musculus
gtcctcagtactttcgggcctgttc

SEQ ID NO: 725678 - DNA, 25 bp, Mus musculus
gtcctcatgcccatttcctgtaatg

SEQ ID NO: 725679 - DNA, 25 bp, Mus musculus
gtcctcatgcccttttcctgtaatg

SEQ ID NO: 725680 - DNA, 25 bp, Mus musculus
gtcctccaacctccgagatggtgcg

SEQ ID NO: 725681 - DNA, 25 bp, Mus musculus
gtcctccaacctgcgagatggtgcg

SEQ ID NO: 725682 - DNA, 25 bp, Mus musculus
gtcctccagatcctagatgtccagg

SEQ ID NO: 725683 - DNA, 25 bp, Mus musculus
gtcctccagatcgtagatgtccagg

SEQ ID NO: 725684 - DNA, 25 bp, Mus musculus
gtcctccaggaaagcaactccacag

SEQ ID NO: 725685 - DNA, 25 bp, Mus musculus
gtcctccaggaatgcaactccacag

SEQ ID NO: 725686 - DNA, 25 bp, Mus musculus
gtcctccatccacgacggagtatca

SEQ ID NO: 725687 - DNA, 25 bp, Mus musculus
gtcctccatccaggacggagtatca

SEQ ID NO: 725688 - DNA, 25 bp, Mus musculus
gtcctccgccgcaggccagaagaga

SEQ ID NO: 725689 - DNA, 25 bp, Mus musculus
gtcctccgccgctggccagaagaga

SEQ ID NO: 725690 - DNA, 25 bp, Mus musculus
gtcctccggcatcgttgtgcttcta

SEQ ID NO: 725691 - DNA, 25 bp, Mus musculus
gtcctccggcatggttgtgcttcta

SEQ ID NO: 725692 - DNA, 25 bp, Mus musculus
gtcctccggcggcttccttgggctc

SEQ ID NO: 725693 - DNA, 25 bp, Mus musculus
gtcctccggcgggttccttgggctc

SEQ ID NO: 725694 - DNA, 25 bp, Mus musculus
gtcctcctcggaactgatgtctaag

SEQ ID NO: 725695 - DNA, 25 bp, Mus musculus
gtcctcctcggatctgatgtctaag

SEQ ID NO: 725696 - DNA, 25 bp, Mus musculus
gtcctcctgcacactggacagaaga

SEQ ID NO: 725697 - DNA, 25 bp, Mus musculus
gtcctcctgcactctggacagaaga

SEQ ID NO: 725698 - DNA, 25 bp, Mus musculus
gtcctcctggaactacccaggcaaa

SEQ ID NO: 725699 - DNA, 25 bp, Mus musculus
gtcctcctggaagtacccaggcaaa

SEQ ID NO: 725700 - DNA, 25 bp, Mus musculus
gtcctccttttgattggcagctctt

SEQ ID NO: 725701 - DNA, 25 bp, Mus musculus
gtcctccttttgtttggcagctctt

SEQ ID NO: 725702 - DNA, 25 bp, Mus musculus
gtcctcgatgacctgaataaaaata

SEQ ID NO: 725703 - DNA, 25 bp, Mus musculus
gtcctcgatgacgtgaataaaaata

SEQ ID NO: 725704 - DNA, 25 bp, Mus musculus
gtcctcgccttcagtcgattatcag

SEQ ID NO: 725705 - DNA, 25 bp, Mus musculus
gtcctcgccttctgtcgattatcag

SEQ ID NO: 725706 - DNA, 25 bp, Mus musculus
gtcctcgcgtagaacccggttgtca

SEQ ID NO: 725707 - DNA, 25 bp, Mus musculus
gtcctcgcgtagtacccggttgtca

SEQ ID NO: 725708 - DNA, 25 bp, Mus musculus
gtcctcgctcagacgtgggccgctg

SEQ ID NO: 725709 - DNA, 25 bp, Mus musculus
gtcctcgctcagtcgtgggccgctg

SEQ ID NO: 725710 - DNA, 25 bp, Mus musculus
gtcctcggctgcagtttcgcccgga

SEQ ID NO: 725711 - DNA, 25 bp, Mus musculus
gtcctcggctgctgtttcgcccgga

SEQ ID NO: 725712 - DNA, 25 bp, Mus musculus
gtcctctccgggctgacagcaggct

SEQ ID NO: 725713 - DNA, 25 bp, Mus musculus
gtcctctccggggtgacagcaggct

SEQ ID NO: 725714 - DNA, 25 bp, Mus musculus
gtcctctctgggagcgccataattg

SEQ ID NO: 725715 - DNA, 25 bp, Mus musculus
gtcctctctgggtgcgccataattg

SEQ ID NO: 725716 - DNA, 25 bp, Mus musculus
gtcctctgacctccagcaaattgtc

SEQ ID NO: 725717 - DNA, 25 bp, Mus musculus
gtcctctgacctgcagcaaattgtc

SEQ ID NO: 725718 - DNA, 25 bp, Mus musculus
gtcctctgaggaactgctactactg

SEQ ID NO: 725719 - DNA, 25 bp, Mus musculus
gtcctctgaggatctgctactactg

SEQ ID NO: 725720 - DNA, 25 bp, Mus musculus
gtcctctgagtaccgggaatatgct

SEQ ID NO: 725721 - DNA, 25 bp, Mus musculus
gtcctctgagtagcgggaatatgct

SEQ ID NO: 725722 - DNA, 25 bp, Mus musculus
gtcctctgcggcctgtgccactggt

SEQ ID NO: 725723 - DNA, 25 bp, Mus musculus
gtcctctgcggcgtgtgccactggt

SEQ ID NO: 725724 - DNA, 25 bp, Mus musculus
gtcctcttagtccagatcccagcag

SEQ ID NO: 725725 - DNA, 25 bp, Mus musculus
gtcctcttagtcgagatcccagcag

SEQ ID NO: 725726 - DNA, 25 bp, Mus musculus
gtcctcttctacatcaacgctgaca

SEQ ID NO: 725727 - DNA, 25 bp, Mus musculus
gtcctcttctacttcaacgctgaca

SEQ ID NO: 725728 - DNA, 25 bp, Mus musculus
gtcctcttggccatggctgaacagc

SEQ ID NO: 725729 - DNA, 25 bp, Mus musculus
gtcctcttggccttggctgaacagc

SEQ ID NO: 725730 - DNA, 25 bp, Mus musculus
gtcctcttgttgcagctacaactcc

SEQ ID NO: 725731 - DNA, 25 bp, Mus musculus
gtcctcttgttggagctacaactcc

SEQ ID NO: 725732 - DNA, 25 bp, Mus musculus
gtcctgaactccctggataagatca

SEQ ID NO: 725733 - DNA, 25 bp, Mus musculus
gtcctgaactccgtggataagatca

SEQ ID NO: 725734 - DNA, 25 bp, Mus musculus
gtcctgaagccaaggtttgcatcat

SEQ ID NO: 725735 - DNA, 25 bp, Mus musculus
gtcctgaagccatggtttgcatcat

SEQ ID NO: 725736 - DNA, 25 bp, Mus musculus
gtcctgaagtcccactgaatatcat

SEQ ID NO: 725737 - DNA, 25 bp, Mus musculus
gtcctgaagtccgactgaatatcat

SEQ ID NO: 725738 - DNA, 25 bp, Mus musculus
gtcctgaattacaccaacacgggag

SEQ ID NO: 725739 - DNA, 25 bp, Mus musculus
gtcctgaattactccaacacgggag

SEQ ID NO: 725740 - DNA, 25 bp, Mus musculus
gtcctgacagcaacatggagatgga

SEQ ID NO: 725741 - DNA, 25 bp, Mus musculus
gtcctgacagcatcatggagatgga

SEQ ID NO: 725742 - DNA, 25 bp, Mus musculus
gtcctgacatggcaaaactatttga

SEQ ID NO: 725743 - DNA, 25 bp, Mus musculus
gtcctgacatgggaaaactatttga

SEQ ID NO: 725744 - DNA, 25 bp, Mus musculus
gtcctgaccgggatccagggcctcg

SEQ ID NO: 725745 - DNA, 25 bp, Mus musculus
gtcctgaccgggttccagggcctcg

SEQ ID NO: 725746 - DNA, 25 bp, Mus musculus
gtcctgacctttcccctggatgggc

SEQ ID NO: 725747 - DNA, 25 bp, Mus musculus
gtcctgacctttgccctggatgggc

SEQ ID NO: 725748 - DNA, 25 bp, Mus musculus
gtcctgactggaatctgctgtgtgg

SEQ ID NO: 725749 - DNA, 25 bp, Mus musculus
gtcctgactggattctgctgtgtgg

SEQ ID NO: 725750 - DNA, 25 bp, Mus musculus
gtcctgagaaggagcgctcggtgtg

SEQ ID NO: 725751 - DNA, 25 bp, Mus musculus
gtcctgagaaggtgcgctcggtgtg

SEQ ID NO: 725752 - DNA, 25 bp, Mus musculus
gtcctgatgcttactcagcaagcat

SEQ ID NO: 725753 - DNA, 25 bp, Mus musculus
gtcctgatgctttctcagcaagcat

SEQ ID NO: 725754 - DNA, 25 bp, Mus musculus
gtcctgcagctgaaccctgagaact

SEQ ID NO: 725755 - DNA, 25 bp, Mus musculus
gtcctgcagctgtaccctgagaact

SEQ ID NO: 725756 - DNA, 25 bp, Mus musculus
gtcctgccaacaacgagtctataaa

SEQ ID NO: 725757 - DNA, 25 bp, Mus musculus
gtcctgccaacatcgagtctataaa

SEQ ID NO: 725758 - DNA, 25 bp, Mus musculus
gtcctgccagaacgccgcgatgagc

SEQ ID NO: 725759 - DNA, 25 bp, Mus musculus
gtcctgccagaaggccgcgatgagc

SEQ ID NO: 725760 - DNA, 25 bp, Mus musculus
gtcctgccagatcgttgtgtgccca

SEQ ID NO: 725761 - DNA, 25 bp, Mus musculus
gtcctgccagatggttgtgtgccca

SEQ ID NO: 725762 - DNA, 25 bp, Mus musculus
gtcctgccccctctgagggatgtga

SEQ ID NO: 725763 - DNA, 25 bp, Mus musculus
gtcctgccccctgtgagggatgtga

SEQ ID NO: 725764 - DNA, 25 bp, Mus musculus
gtcctgccctctatataatctgcca

SEQ ID NO: 725765 - DNA, 25 bp, Mus musculus
gtcctgccctctttataatctgcca

SEQ ID NO: 725766 - DNA, 25 bp, Mus musculus
gtcctgcctatcagctgagttccag

SEQ ID NO: 725767 - DNA, 25 bp, Mus musculus
gtcctgcctatctgctgagttccag

SEQ ID NO: 725768 - DNA, 25 bp, Mus musculus
gtcctgcgacagaggcttcacaagg

SEQ ID NO: 725769 - DNA, 25 bp, Mus musculus
gtcctgcgacagtggcttcacaagg

SEQ ID NO: 725770 - DNA, 25 bp, Mus musculus
gtcctgcgccggactcggattgcca

SEQ ID NO: 725771 - DNA, 25 bp, Mus musculus
gtcctgcgccggtctcggattgcca

SEQ ID NO: 725772 - DNA, 25 bp, Mus musculus
gtcctgcgcttcagcagcaaggagg

SEQ ID NO: 725773 - DNA, 25 bp, Mus musculus
gtcctgcgcttctgcagcaaggagg

SEQ ID NO: 725774 - DNA, 25 bp, Mus musculus
gtcctgcggacactctaccatctgg

SEQ ID NO: 725775 - DNA, 25 bp, Mus musculus
gtcctgcggacagtctaccatctgg

SEQ ID NO: 725776 - DNA, 25 bp, Mus musculus
gtcctgctacacatggaccccgtgg

SEQ ID NO: 725777 - DNA, 25 bp, Mus musculus
gtcctgctacacttggaccccgtgg

SEQ ID NO: 725778 - DNA, 25 bp, Mus musculus
gtcctgcttagtacagattgcctca

SEQ ID NO: 725779 - DNA, 25 bp, Mus musculus
gtcctgcttagttcagattgcctca

SEQ ID NO: 725780 - DNA, 25 bp, Mus musculus
gtcctgcttatgcatctagctccta

SEQ ID NO: 725781 - DNA, 25 bp, Mus musculus
gtcctgcttatggatctagctccta

SEQ ID NO: 725782 - DNA, 25 bp, Mus musculus
gtcctggacaatactcagcagttga

SEQ ID NO: 725783 - DNA, 25 bp, Mus musculus
gtcctggacaattctcagcagttga

SEQ ID NO: 725784 - DNA, 25 bp, Mus musculus
gtcctggactaacgcagagtgcaga

SEQ ID NO: 725785 - DNA, 25 bp, Mus musculus
gtcctggactaaggcagagtgcaga

SEQ ID NO: 725786 - DNA, 25 bp, Mus musculus
gtcctggagaagacctttgctgcct

SEQ ID NO: 725787 - DNA, 25 bp, Mus musculus
gtcctggagaagtcctttgctgcct

SEQ ID NO: 725788 - DNA, 25 bp, Mus musculus
gtcctggagacaccgtgaagttcga

SEQ ID NO: 725789 - DNA, 25 bp, Mus musculus
gtcctggagacagcgtgaagttcga

SEQ ID NO: 725790 - DNA, 25 bp, Mus musculus
gtcctggagtctctgtatattgaga

SEQ ID NO: 725791 - DNA, 25 bp, Mus musculus
gtcctggagtctgtgtatattgaga

SEQ ID NO: 725792 - DNA, 25 bp, Mus musculus
gtcctggatgacagacccgctggcc

SEQ ID NO: 725793 - DNA, 25 bp, Mus musculus
gtcctggatgacaggcgcaaatggt

SEQ ID NO: 725794 - DNA, 25 bp, Mus musculus
gtcctggatgacctccgccaacatt

SEQ ID NO: 725795 - DNA, 25 bp, Mus musculus
gtcctggatgacgtccgccaacatt

SEQ ID NO: 725796 - DNA, 25 bp, Mus musculus
gtcctggatgactgacccgctggcc

SEQ ID NO: 725797 - DNA, 25 bp, Mus musculus
gtcctggatgactggcgcaaatggt

SEQ ID NO: 725798 - DNA, 25 bp, Mus musculus
gtcctggcataactacatgtgtaac

SEQ ID NO: 725799 - DNA, 25 bp, Mus musculus
gtcctggcataagtacatgtgtaac

SEQ ID NO: 725800 - DNA, 25 bp, Mus musculus
gtcctggccgatcactacagcatcg

SEQ ID NO: 725801 - DNA, 25 bp, Mus musculus
gtcctggccgatgactacagcatcg

SEQ ID NO: 725802 - DNA, 25 bp, Mus musculus
gtcctggcgcaaaggcctggccttc

SEQ ID NO: 725803 - DNA, 25 bp, Mus musculus
gtcctggcgcaatggcctggccttc

SEQ ID NO: 725804 - DNA, 25 bp, Mus musculus
gtcctggcgggaccctaagaaaaag

SEQ ID NO: 725805 - DNA, 25 bp, Mus musculus
gtcctggcgggagcctaagaaaaag

SEQ ID NO: 725806 - DNA, 25 bp, Mus musculus
gtcctggctgtaagcactcactgcc

SEQ ID NO: 725807 - DNA, 25 bp, Mus musculus
gtcctggctgtatgcactcactgcc

SEQ ID NO: 725808 - DNA, 25 bp, Mus musculus
gtcctgggagccatcgagagagcca

SEQ ID NO: 725809 - DNA, 25 bp, Mus musculus
gtcctgggagccttcgagagagcca

SEQ ID NO: 725810 - DNA, 25 bp, Mus musculus
gtcctgggcttgaacagtatgctat

SEQ ID NO: 725811 - DNA, 25 bp, Mus musculus
gtcctgggcttgtacagtatgctat

SEQ ID NO: 725812 - DNA, 25 bp, Mus musculus
gtcctggtgaatcctatcatcaaca

SEQ ID NO: 725813 - DNA, 25 bp, Mus musculus
gtcctggtgaatgctatcatcaaca

SEQ ID NO: 725814 - DNA, 25 bp, Mus musculus
gtcctgtagcccctagcccgggcgc

SEQ ID NO: 725815 - DNA, 25 bp, Mus musculus
gtcctgtagcccgtagcccgggcgc

SEQ ID NO: 725816 - DNA, 25 bp, Mus musculus
gtcctgtctttgcaacctgaattag

SEQ ID NO: 725817 - DNA, 25 bp, Mus musculus
gtcctgtctttggaacctgaattag

SEQ ID NO: 725818 - DNA, 25 bp, Mus musculus
gtcctgtgacctagctcggcgctat

SEQ ID NO: 725819 - DNA, 25 bp, Mus musculus
gtcctgtgaccttgctcggcgctat

SEQ ID NO: 725820 - DNA, 25 bp, Mus musculus
gtcctgtgattacccgagcgccctg

SEQ ID NO: 725821 - DNA, 25 bp, Mus musculus
gtcctgtgattagccgagcgccctg

SEQ ID NO: 725822 - DNA, 25 bp, Mus musculus
gtcctgtgtgcccatactgtcaaac

SEQ ID NO: 725823 - DNA, 25 bp, Mus musculus
gtcctgtgtgccgatactgtcaaac

SEQ ID NO: 725824 - DNA, 25 bp, Mus musculus
gtcctgttcactactaagggccctg

SEQ ID NO: 725825 - DNA, 25 bp, Mus musculus
gtcctgttcacttctaagggccctg

SEQ ID NO: 725826 - DNA, 25 bp, Mus musculus
gtcctgttcagacagcgccaccttg

SEQ ID NO: 725827 - DNA, 25 bp, Mus musculus
gtcctgttcagagagcgccaccttg

SEQ ID NO: 725828 - DNA, 25 bp, Mus musculus
gtcctgttcgcgcaggctgctagct

SEQ ID NO: 725829 - DNA, 25 bp, Mus musculus
gtcctgttcgcggaggctgctagct

SEQ ID NO: 725830 - DNA, 25 bp, Mus musculus
gtcctgttgttgcagagttcccctc

SEQ ID NO: 725831 - DNA, 25 bp, Mus musculus
gtcctgttgttggagagttcccctc

SEQ ID NO: 725832 - DNA, 25 bp, Mus musculus
gtcctgtttattcctgatgaaatac

SEQ ID NO: 725833 - DNA, 25 bp, Mus musculus
gtcctgtttattgctgatgaaatac

SEQ ID NO: 725834 - DNA, 25 bp, Mus musculus
gtccttcacccactttctgacaggt

SEQ ID NO: 725835 - DNA, 25 bp, Mus musculus
gtccttcacccagtttctgacaggt

SEQ ID NO: 725836 - DNA, 25 bp, Mus musculus
gtccttcacggaacaaccagcgact

SEQ ID NO: 725837 - DNA, 25 bp, Mus musculus
gtccttcacggatcaaccagcgact

SEQ ID NO: 725838 - DNA, 25 bp, Mus musculus
gtccttcagcttcgagatccccttt

SEQ ID NO: 725839 - DNA, 25 bp, Mus musculus
gtccttcagcttggagatccccttt

SEQ ID NO: 725840 - DNA, 25 bp, Mus musculus
gtccttccctcgagacacacttggt

SEQ ID NO: 725841 - DNA, 25 bp, Mus musculus
gtccttccctcgtgacacacttggt

SEQ ID NO: 725842 - DNA, 25 bp, Mus musculus
gtccttcggagtaacctggtggaca

SEQ ID NO: 725843 - DNA, 25 bp, Mus musculus
gtccttcggagttacctggtggaca

SEQ ID NO: 725844 - DNA, 25 bp, Mus musculus
gtccttcgtgaaacattccatggag

SEQ ID NO: 725845 - DNA, 25 bp, Mus musculus
gtccttcgtgaatcattccatggag

SEQ ID NO: 725846 - DNA, 25 bp, Mus musculus
gtccttctgactatatcaagccggg

SEQ ID NO: 725847 - DNA, 25 bp, Mus musculus
gtccttctgactttatcaagccggg

SEQ ID NO: 725848 - DNA, 25 bp, Mus musculus
gtccttctggacagtgtggttcctc

SEQ ID NO: 725849 - DNA, 25 bp, Mus musculus
gtccttctggactgtgtggttcctc

SEQ ID NO: 725850 - DNA, 25 bp, Mus musculus
gtccttgaaaatactgtctgcagaa

SEQ ID NO: 725851 - DNA, 25 bp, Mus musculus
gtccttgaaaattctgtctgcagaa

SEQ ID NO: 725852 - DNA, 25 bp, Mus musculus
gtccttgaagagaatgtcaagacgc

SEQ ID NO: 725853 - DNA, 25 bp, Mus musculus
gtccttgaagagtatgtcaagacgc

SEQ ID NO: 725854 - DNA, 25 bp, Mus musculus
gtccttgacagaaatgtggccatta

SEQ ID NO: 725855 - DNA, 25 bp, Mus musculus
gtccttgacagatatgtggccatta

SEQ ID NO: 725856 - DNA, 25 bp, Mus musculus
gtccttgagtggattggtgaaaaag

SEQ ID NO: 725857 - DNA, 25 bp, Mus musculus
gtccttgagtggtttggtgaaaaag

SEQ ID NO: 725858 - DNA, 25 bp, Mus musculus
gtccttgcacagagccggacactgc

SEQ ID NO: 725859 - DNA, 25 bp, Mus musculus
gtccttgcacagtgccggacactgc

SEQ ID NO: 725860 - DNA, 25 bp, Mus musculus
gtccttggagccctctggtcctaca

SEQ ID NO: 725861 - DNA, 25 bp, Mus musculus
gtccttggagccgtctggtcctaca

SEQ ID NO: 725862 - DNA, 25 bp, Mus musculus
gtccttggctggctacgcggacatc

SEQ ID NO: 725863 - DNA, 25 bp, Mus musculus
gtccttggctgggtacgcggacatc

SEQ ID NO: 725864 - DNA, 25 bp, Mus musculus
gtccttgttcaccaactaaaactgc

SEQ ID NO: 725865 - DNA, 25 bp, Mus musculus
gtccttgttcacgaactaaaactgc

SEQ ID NO: 725866 - DNA, 25 bp, Mus musculus
gtcctttctgacagatctgccactg

SEQ ID NO: 725867 - DNA, 25 bp, Mus musculus
gtcctttctgactgatctgccactg

SEQ ID NO: 725868 - DNA, 25 bp, Mus musculus
gtcctttgaaagcagggaccttctc

SEQ ID NO: 725869 - DNA, 25 bp, Mus musculus
gtcctttgaaaggagggaccttctc

SEQ ID NO: 725870 - DNA, 25 bp, Mus musculus
gtcctttgtgcccacctgggatttg

SEQ ID NO: 725871 - DNA, 25 bp, Mus musculus
gtcctttgtgccgacctgggatttg

SEQ ID NO: 725872 - DNA, 25 bp, Mus musculus
gtccttttaggaagcggccttggca

SEQ ID NO: 725873 - DNA, 25 bp, Mus musculus
gtccttttaggatgcggccttggca

SEQ ID NO: 725874 - DNA, 25 bp, Mus musculus
gtccttttctgtcttacagtgccct

SEQ ID NO: 725875 - DNA, 25 bp, Mus musculus
gtccttttctgtgttacagtgccct

SEQ ID NO: 725876 - DNA, 25 bp, Mus musculus
gtcctttttggtccatgtattgaag

SEQ ID NO: 725877 - DNA, 25 bp, Mus musculus
gtcctttttggtgcatgtattgaag

SEQ ID NO: 725878 - DNA, 25 bp, Mus musculus
gtcgaaaatgggacacagagattaa

SEQ ID NO: 725879 - DNA, 25 bp, Mus musculus
gtcgaaaatgggtcacagagattaa

SEQ ID NO: 725880 - DNA, 25 bp, Mus musculus
gtcgaaatggctatggagctaaact

SEQ ID NO: 725881 - DNA, 25 bp, Mus musculus
gtcgaaatggctttggagctaaact

SEQ ID NO: 725882 - DNA, 25 bp, Mus musculus
gtcgaaatggttcctgtactgccca

SEQ ID NO: 725883 - DNA, 25 bp, Mus musculus
gtcgaaatggttgctgtactgccca

SEQ ID NO: 725884 - DNA, 25 bp, Mus musculus
gtcgaacctccacgcgctcatagat

SEQ ID NO: 725885 - DNA, 25 bp, Mus musculus
gtcgaacctccaggcgctcatagat

SEQ ID NO: 725886 - DNA, 25 bp, Mus musculus
gtcgaacgacgtccctccagggtgt

SEQ ID NO: 725887 - DNA, 25 bp, Mus musculus
gtcgaacgacgtgcctccagggtgt

SEQ ID NO: 725888 - DNA, 25 bp, Mus musculus
gtcgaacggtccatgaaagagatgg

SEQ ID NO: 725889 - DNA, 25 bp, Mus musculus
gtcgaacggtccttgaaagagatgg

SEQ ID NO: 725890 - DNA, 25 bp, Mus musculus
gtcgaagaaaatcccacggccatgg

SEQ ID NO: 725891 - DNA, 25 bp, Mus musculus
gtcgaagaaaatgccacggccatgg

SEQ ID NO: 725892 - DNA, 25 bp, Mus musculus
gtcgaagagactcagccggagtctc

SEQ ID NO: 725893 - DNA, 25 bp, Mus musculus
gtcgaagagactgagccggagtctc

SEQ ID NO: 725894 - DNA, 25 bp, Mus musculus
gtcgaagcagcacaacaggtcaaaa

SEQ ID NO: 725895 - DNA, 25 bp, Mus musculus
gtcgaagcagcagaacaggtcaaaa

SEQ ID NO: 725896 - DNA, 25 bp, Mus musculus
gtcgaagtcactcgcccaggcagga

SEQ ID NO: 725897 - DNA, 25 bp, Mus musculus
gtcgaagtcactggcccaggcagga

SEQ ID NO: 725898 - DNA, 25 bp, Mus musculus
gtcgacacgggacgtttcccagccg

SEQ ID NO: 725899 - DNA, 25 bp, Mus musculus
gtcgacacgggaggtttcccagccg

SEQ ID NO: 725900 - DNA, 25 bp, Mus musculus
gtcgacatcgcacctttcaacaaga

SEQ ID NO: 725901 - DNA, 25 bp, Mus musculus
gtcgacatcgcagctttcaacaaga

SEQ ID NO: 725902 - DNA, 25 bp, Mus musculus
gtcgacctggttccccaggacctgt

SEQ ID NO: 725903 - DNA, 25 bp, Mus musculus
gtcgacctggttgcccaggacctgt

SEQ ID NO: 725904 - DNA, 25 bp, Mus musculus
gtcgacgcaagtccaccaaatttgg

SEQ ID NO: 725905 - DNA, 25 bp, Mus musculus
gtcgacgcaagtgcaccaaatttgg

SEQ ID NO: 725906 - DNA, 25 bp, Mus musculus
gtcgactacaacaacactcactcca

SEQ ID NO: 725907 - DNA, 25 bp, Mus musculus
gtcgactacaactacactcactcca

SEQ ID NO: 725908 - DNA, 25 bp, Mus musculus
gtcgacttccagaacggattaccaa

SEQ ID NO: 725909 - DNA, 25 bp, Mus musculus
gtcgacttccagtacggattaccaa

SEQ ID NO: 725910 - DNA, 25 bp, Mus musculus
gtcgacttctgcaggcaatcgcgaa

SEQ ID NO: 725911 - DNA, 25 bp, Mus musculus
gtcgacttctgctggcaatcgcgaa

SEQ ID NO: 725912 - DNA, 25 bp, Mus musculus
gtcgagagcctgaggccagcgcact

SEQ ID NO: 725913 - DNA, 25 bp, Mus musculus
gtcgagagcctgtggccagcgcact

SEQ ID NO: 725914 - DNA, 25 bp, Mus musculus
gtcgagcagaagaagtgagtttgct

SEQ ID NO: 725915 - DNA, 25 bp, Mus musculus
gtcgagcagaagtagtgagtttgct

SEQ ID NO: 725916 - DNA, 25 bp, Mus musculus
gtcgagcatcaacaaaaccgtcctt

SEQ ID NO: 725917 - DNA, 25 bp, Mus musculus
gtcgagcatcaagaaaaccgtcctt

SEQ ID NO: 725918 - DNA, 25 bp, Mus musculus
gtcgagcccagtcttaccaccaaga

SEQ ID NO: 725919 - DNA, 25 bp, Mus musculus
gtcgagcccagtgttaccaccaaga

SEQ ID NO: 725920 - DNA, 25 bp, Mus musculus
gtcgagctagagcagccccttccaa

SEQ ID NO: 725921 - DNA, 25 bp, Mus musculus
gtcgagctagaggagccccttccaa

SEQ ID NO: 725922 - DNA, 25 bp, Mus musculus
gtcgagctctccaggctttgaagaa

SEQ ID NO: 725923 - DNA, 25 bp, Mus musculus
gtcgagctctcctggctttgaagaa

SEQ ID NO: 725924 - DNA, 25 bp, Mus musculus
gtcgaggtgacactgtttgacccca

SEQ ID NO: 725925 - DNA, 25 bp, Mus musculus
gtcgaggtgacagtgtttgacccca

SEQ ID NO: 725926 - DNA, 25 bp, Mus musculus
gtcgagtatgccaacagtgacaaca

SEQ ID NO: 725927 - DNA, 25 bp, Mus musculus
gtcgagtatgcctacagtgacaaca

SEQ ID NO: 725928 - DNA, 25 bp, Mus musculus
gtcgatgcaaatacaaccaacagca

SEQ ID NO: 725929 - DNA, 25 bp, Mus musculus
gtcgatgcaaattcaaccaacagca

SEQ ID NO: 725930 - DNA, 25 bp, Mus musculus
gtcgatgccaatctggacgctgcag

SEQ ID NO: 725931 - DNA, 25 bp, Mus musculus
gtcgatgccaatgtggacgctgcag

SEQ ID NO: 725932 - DNA, 25 bp, Mus musculus
gtcgatgcccctcaacgggctgaag

SEQ ID NO: 725933 - DNA, 25 bp, Mus musculus
gtcgatgcccctgaacgggctgaag

SEQ ID NO: 725934 - DNA, 25 bp, Mus musculus
gtcgattccgagcagctgtgcccag

SEQ ID NO: 725935 - DNA, 25 bp, Mus musculus
gtcgattccgaggagctgtgcccag

SEQ ID NO: 725936 - DNA, 25 bp, Mus musculus
gtcgattgctcacctcattgatgtg

SEQ ID NO: 725937 - DNA, 25 bp, Mus musculus
gtcgattgctcagctcattgatgtg

SEQ ID NO: 725938 - DNA, 25 bp, Mus musculus
gtcgcaaattttccactactggcat

SEQ ID NO: 725939 - DNA, 25 bp, Mus musculus
gtcgcaaattttgcactactggcat

SEQ ID NO: 725940 - DNA, 25 bp, Mus musculus
gtcgcaagcaccaggcctaccttat

SEQ ID NO: 725941 - DNA, 25 bp, Mus musculus
gtcgcaagcacctggcctaccttat

SEQ ID NO: 725942 - DNA, 25 bp, Mus musculus
gtcgcaagtggaccacagcaccata

SEQ ID NO: 725943 - DNA, 25 bp, Mus musculus
gtcgcaagtggagcacagcaccata

SEQ ID NO: 725944 - DNA, 25 bp, Mus musculus
gtcgcacccaccatgatggaagacg

SEQ ID NO: 725945 - DNA, 25 bp, Mus musculus
gtcgcacccaccttgatggaagacg

SEQ ID NO: 725946 - DNA, 25 bp, Mus musculus
gtcgcacctatgacctgcctgcaga

SEQ ID NO: 725947 - DNA, 25 bp, Mus musculus
gtcgcacctatgtcctgcctgcaga

SEQ ID NO: 725948 - DNA, 25 bp, Mus musculus
gtcgcagacatgcagcaaggctacg

SEQ ID NO: 725949 - DNA, 25 bp, Mus musculus
gtcgcagacatggagcaaggctacg

SEQ ID NO: 725950 - DNA, 25 bp, Mus musculus
gtcgcagacgcgcagactgactgac

SEQ ID NO: 725951 - DNA, 25 bp, Mus musculus
gtcgcagacgcggagactgactgac

SEQ ID NO: 725952 - DNA, 25 bp, Mus musculus
gtcgcagactcccttcgaggcgctt

SEQ ID NO: 725953 - DNA, 25 bp, Mus musculus
gtcgcagactccgttcgaggcgctt

SEQ ID NO: 725954 - DNA, 25 bp, Mus musculus
gtcgcagccatcagtgttgcgtttg

SEQ ID NO: 725955 - DNA, 25 bp, Mus musculus
gtcgcagccatctgtgttgcgtttg

SEQ ID NO: 725956 - DNA, 25 bp, Mus musculus
gtcgcagccctgacgcgccatttat

SEQ ID NO: 725957 - DNA, 25 bp, Mus musculus
gtcgcagccctgtcgcgccatttat

SEQ ID NO: 725958 - DNA, 25 bp, Mus musculus
gtcgcagcgctcaggcacctggcgt

SEQ ID NO: 725959 - DNA, 25 bp, Mus musculus
gtcgcagcgctctggcacctggcgt

SEQ ID NO: 725960 - DNA, 25 bp, Mus musculus
gtcgcagtgttactcctgactcccg

SEQ ID NO: 725961 - DNA, 25 bp, Mus musculus
gtcgcagtgttagtcctgactcccg

SEQ ID NO: 725962 - DNA, 25 bp, Mus musculus
gtcgcagttggacccctacaggaga

SEQ ID NO: 725963 - DNA, 25 bp, Mus musculus
gtcgcagttggagccctacaggaga

SEQ ID NO: 725964 - DNA, 25 bp, Mus musculus
gtcgccactgccagactgccgtgga

SEQ ID NO: 725965 - DNA, 25 bp, Mus musculus
gtcgccactgcctgactgccgtgga

SEQ ID NO: 725966 - DNA, 25 bp, Mus musculus
gtcgccagtaagcctgaggagaatc

SEQ ID NO: 725967 - DNA, 25 bp, Mus musculus
gtcgccagtaaggctgaggagaatc

SEQ ID NO: 725968 - DNA, 25 bp, Mus musculus
gtcgccatctggcagaggaacttca

SEQ ID NO: 725969 - DNA, 25 bp, Mus musculus
gtcgccatctgggagaggaacttca

SEQ ID NO: 725970 - DNA, 25 bp, Mus musculus
gtcgccatgatcagtgccattgcca

SEQ ID NO: 725971 - DNA, 25 bp, Mus musculus
gtcgccatgatctgtgccattgcca

SEQ ID NO: 725972 - DNA, 25 bp, Mus musculus
gtcgccctgattctgcccagcagag

SEQ ID NO: 725973 - DNA, 25 bp, Mus musculus
gtcgccctgattgtgcccagcagag

SEQ ID NO: 725974 - DNA, 25 bp, Mus musculus
gtcgccgctcgtagcagtagccgct

SEQ ID NO: 725975 - DNA, 25 bp, Mus musculus
gtcgccgctcgttgcagtagccgct

SEQ ID NO: 725976 - DNA, 25 bp, Mus musculus
gtcgccgctgcgagacctcagctgg

SEQ ID NO: 725977 - DNA, 25 bp, Mus musculus
gtcgccgctgcgtgacctcagctgg

SEQ ID NO: 725978 - DNA, 25 bp, Mus musculus
gtcgccggcatcatcttccacgaag

SEQ ID NO: 725979 - DNA, 25 bp, Mus musculus
gtcgccggcatcttcttccacgaag

SEQ ID NO: 725980 - DNA, 25 bp, Mus musculus
gtcgccgggcttcggctgcgtccgt

SEQ ID NO: 725981 - DNA, 25 bp, Mus musculus
gtcgccgggcttgggctgcgtccgt

SEQ ID NO: 725982 - DNA, 25 bp, Mus musculus
gtcgcctggattcggatgagaacac

SEQ ID NO: 725983 - DNA, 25 bp, Mus musculus
gtcgcctggattgggatgagaacac

SEQ ID NO: 725984 - DNA, 25 bp, Mus musculus
gtcgccttcatgcaacgccttcaaa

SEQ ID NO: 725985 - DNA, 25 bp, Mus musculus
gtcgccttcatggaacgccttcaaa

SEQ ID NO: 725986 - DNA, 25 bp, Mus musculus
gtcgcctttgcacaggaagcagatc

SEQ ID NO: 725987 - DNA, 25 bp, Mus musculus
gtcgcctttgcagaggaagcagatc

SEQ ID NO: 725988 - DNA, 25 bp, Mus musculus
gtcgcgactgaaccggcgcaaagac

SEQ ID NO: 725989 - DNA, 25 bp, Mus musculus
gtcgcgactgaagcggcgcaaagac

SEQ ID NO: 725990 - DNA, 25 bp, Mus musculus
gtcgcgcacagacttgactgactac

SEQ ID NO: 725991 - DNA, 25 bp, Mus musculus
gtcgcgcacagagttgactgactac

SEQ ID NO: 725992 - DNA, 25 bp, Mus musculus
gtcgcgcccgaactgtaacactttc

SEQ ID NO: 725993 - DNA, 25 bp, Mus musculus
gtcgcgcccgaagtgtaacactttc

SEQ ID NO: 725994 - DNA, 25 bp, Mus musculus
gtcgcgccgtcactccgtttggaaa

SEQ ID NO: 725995 - DNA, 25 bp, Mus musculus
gtcgcgccgtcagtccgtttggaaa

SEQ ID NO: 725996 - DNA, 25 bp, Mus musculus
gtcgcgcctgtcctcttaaaaaaca

SEQ ID NO: 725997 - DNA, 25 bp, Mus musculus
gtcgcgcctgtcgtcttaaaaaaca

SEQ ID NO: 725998 - DNA, 25 bp, Mus musculus
gtcgcgctctcacgatggctctgct

SEQ ID NO: 725999 - DNA, 25 bp, Mus musculus
gtcgcgctctcaggatggctctgct

SEQ ID NO: 726000 - DNA, 25 bp, Mus musculus
gtcgcggcttggatttcaaactgga

SEQ ID NO: 726001 - DNA, 25 bp, Mus musculus
gtcgcggcttggttttcaaactgga

SEQ ID NO: 726002 - DNA, 25 bp, Mus musculus
gtcgcgtcatttactccgcagtgcc

SEQ ID NO: 726003 - DNA, 25 bp, Mus musculus
gtcgcgtcattttctccgcagtgcc

SEQ ID NO: 726004 - DNA, 25 bp, Mus musculus
gtcgcgttcatgaccctctggtcct

SEQ ID NO: 726005 - DNA, 25 bp, Mus musculus
gtcgcgttcatgtccctctggtcct

SEQ ID NO: 726006 - DNA, 25 bp, Mus musculus
gtcgctaaccatcgcgtctggagat

SEQ ID NO: 726007 - DNA, 25 bp, Mus musculus
gtcgctaaccatggcgtctggagat

SEQ ID NO: 726008 - DNA, 25 bp, Mus musculus
gtcgctcatccacggcctggtgtac

SEQ ID NO: 726009 - DNA, 25 bp, Mus musculus
gtcgctcatccagggcctggtgtac

SEQ ID NO: 726010 - DNA, 25 bp, Mus musculus
gtcgctccattaaagtcctgctctg

SEQ ID NO: 726011 - DNA, 25 bp, Mus musculus
gtcgctccattatagtcctgctctg

SEQ ID NO: 726012 - DNA, 25 bp, Mus musculus
gtcgctccctggactcggttctact

SEQ ID NO: 726013 - DNA, 25 bp, Mus musculus
gtcgctccctggtctcggttctact

SEQ ID NO: 726014 - DNA, 25 bp, Mus musculus
gtcgctcgcttgcacaacatctttc

SEQ ID NO: 726015 - DNA, 25 bp, Mus musculus
gtcgctcgcttggacaacatctttc

SEQ ID NO: 726016 - DNA, 25 bp, Mus musculus
gtcgctctagttaataaagctgtcc

SEQ ID NO: 726017 - DNA, 25 bp, Mus musculus
gtcgctctagtttataaagctgtcc

SEQ ID NO: 726018 - DNA, 25 bp, Mus musculus
gtcgctgcgcaaccatgtcggaaga

SEQ ID NO: 726019 - DNA, 25 bp, Mus musculus
gtcgctgcgcaagcatgtcggaaga

SEQ ID NO: 726020 - DNA, 25 bp, Mus musculus
gtcgctggatttctgactgttgtca

SEQ ID NO: 726021 - DNA, 25 bp, Mus musculus
gtcgctggatttgtgactgttgtca

SEQ ID NO: 726022 - DNA, 25 bp, Mus musculus
gtcgctgggccaacctaggactagg

SEQ ID NO: 726023 - DNA, 25 bp, Mus musculus
gtcgctgggccatcctaggactagg

SEQ ID NO: 726024 - DNA, 25 bp, Mus musculus
gtcgctgtcgacacagttggaatcc

SEQ ID NO: 726025 - DNA, 25 bp, Mus musculus
gtcgctgtcgactcagttggaatcc

SEQ ID NO: 726026 - DNA, 25 bp, Mus musculus
gtcgcttctgcaagcagcccctggg

SEQ ID NO: 726027 - DNA, 25 bp, Mus musculus
gtcgcttctgcatgcagcccctggg

SEQ ID NO: 726028 - DNA, 25 bp, Mus musculus
gtcgctttcatcaagaaatacaaga

SEQ ID NO: 726029 - DNA, 25 bp, Mus musculus
gtcgctttcatctagaaatacaaga

SEQ ID NO: 726030 - DNA, 25 bp, Mus musculus
gtcggaaagtgtccggaaagaacag

SEQ ID NO: 726031 - DNA, 25 bp, Mus musculus
gtcggaaagtgtgcggaaagaacag

SEQ ID NO: 726032 - DNA, 25 bp, Mus musculus
gtcggaacagctacaagcgctcggc

SEQ ID NO: 726033 - DNA, 25 bp, Mus musculus
gtcggaacagcttcaagcgctcggc

SEQ ID NO: 726034 - DNA, 25 bp, Mus musculus
gtcggaagatccaaattacaacgtg

SEQ ID NO: 726035 - DNA, 25 bp, Mus musculus
gtcggaagatcctaattacaacgtg

SEQ ID NO: 726036 - DNA, 25 bp, Mus musculus
gtcggaatacatcaccacagctctt

SEQ ID NO: 726037 - DNA, 25 bp, Mus musculus
gtcggaatacatgaccacagctctt

SEQ ID NO: 726038 - DNA, 25 bp, Mus musculus
gtcggaatgaagatgtcggtttaat

SEQ ID NO: 726039 - DNA, 25 bp, Mus musculus
gtcggaatgaagttgtcggtttaat

SEQ ID NO: 726040 - DNA, 25 bp, Mus musculus
gtcggaatgctcatcccctcagctg

SEQ ID NO: 726041 - DNA, 25 bp, Mus musculus
gtcggaatgctcttcccctcagctg

SEQ ID NO: 726042 - DNA, 25 bp, Mus musculus
gtcggacaccctagaggacagccat

SEQ ID NO: 726043 - DNA, 25 bp, Mus musculus
gtcggacacccttgaggacagccat

SEQ ID NO: 726044 - DNA, 25 bp, Mus musculus
gtcggacactgaatctctccactca

SEQ ID NO: 726045 - DNA, 25 bp, Mus musculus
gtcggacactgattctctccactca

SEQ ID NO: 726046 - DNA, 25 bp, Mus musculus
gtcggacatcaaataagaatccaat

SEQ ID NO: 726047 - DNA, 25 bp, Mus musculus
gtcggacatcaattaagaatccaat

SEQ ID NO: 726048 - DNA, 25 bp, Mus musculus
gtcggacgcagaagcggagagcagc

SEQ ID NO: 726049 - DNA, 25 bp, Mus musculus
gtcggacgcagatgcggagagcagc

SEQ ID NO: 726050 - DNA, 25 bp, Mus musculus
gtcggagctgttagccaagcgcgcc

SEQ ID NO: 726051 - DNA, 25 bp, Mus musculus
gtcggagctgtttgccaagcgcgcc

SEQ ID NO: 726052 - DNA, 25 bp, Mus musculus
gtcggagcttccaccatgggctggg

SEQ ID NO: 726053 - DNA, 25 bp, Mus musculus
gtcggagcttcctccatgggctggg

SEQ ID NO: 726054 - DNA, 25 bp, Mus musculus
gtcggaggactacgagaacctaccg

SEQ ID NO: 726055 - DNA, 25 bp, Mus musculus
gtcggaggactaggagaacctaccg

SEQ ID NO: 726056 - DNA, 25 bp, Mus musculus
gtcggcagattgatgatgtcctcag

SEQ ID NO: 726057 - DNA, 25 bp, Mus musculus
gtcggcagattgttgatgtcctcag

SEQ ID NO: 726058 - DNA, 25 bp, Mus musculus
gtcggccaccaacatgctgcggcat

SEQ ID NO: 726059 - DNA, 25 bp, Mus musculus
gtcggccaccaagatgctgcggcat

SEQ ID NO: 726060 - DNA, 25 bp, Mus musculus
gtcggcccgtggcatggctctctat

SEQ ID NO: 726061 - DNA, 25 bp, Mus musculus
gtcggcccgtgggatggctctctat

SEQ ID NO: 726062 - DNA, 25 bp, Mus musculus
gtcggcctgggacatcgttttaaga

SEQ ID NO: 726063 - DNA, 25 bp, Mus musculus
gtcggcctgggagatcgttttaaga

SEQ ID NO: 726064 - DNA, 25 bp, Mus musculus
gtcggcgcagaccttcctgtctgag

SEQ ID NO: 726065 - DNA, 25 bp, Mus musculus
gtcggcgcagacgttcctgtctgag

SEQ ID NO: 726066 - DNA, 25 bp, Mus musculus
gtcggcggcagacgaaaccctttca

SEQ ID NO: 726067 - DNA, 25 bp, Mus musculus
gtcggcggcagaggaaaccctttca

SEQ ID NO: 726068 - DNA, 25 bp, Mus musculus
gtcggcttatcccaggtcccggtca

SEQ ID NO: 726069 - DNA, 25 bp, Mus musculus
gtcggcttatccgaggtcccggtca

SEQ ID NO: 726070 - DNA, 25 bp, Mus musculus
gtcgggaaaggacccagaccatgtt

SEQ ID NO: 726071 - DNA, 25 bp, Mus musculus
gtcgggaaaggagccagaccatgtt

SEQ ID NO: 726072 - DNA, 25 bp, Mus musculus
gtcgggaacctgagcagcctatgca

SEQ ID NO: 726073 - DNA, 25 bp, Mus musculus
gtcgggaacctgtgcagcctatgca

SEQ ID NO: 726074 - DNA, 25 bp, Mus musculus
gtcgggaccacaacttctccgtctt

SEQ ID NO: 726075 - DNA, 25 bp, Mus musculus
gtcgggaccacatcttctccgtctt

SEQ ID NO: 726076 - DNA, 25 bp, Mus musculus
gtcgggaccccacccaggtgaagct

SEQ ID NO: 726077 - DNA, 25 bp, Mus musculus
gtcgggaccccagccaggtgaagct

SEQ ID NO: 726078 - DNA, 25 bp, Mus musculus
gtcgggcacagcagccgacgagcct

SEQ ID NO: 726079 - DNA, 25 bp, Mus musculus
gtcgggcacagctgccgacgagcct

SEQ ID NO: 726080 - DNA, 25 bp, Mus musculus
gtcgggctttgtcagtccctgcagc

SEQ ID NO: 726081 - DNA, 25 bp, Mus musculus
gtcgggctttgtgagtccctgcagc

SEQ ID NO: 726082 - DNA, 25 bp, Mus musculus
gtcgggtgctccacccggagcagca

SEQ ID NO: 726083 - DNA, 25 bp, Mus musculus
gtcgggtgctcctcccggagcagca

SEQ ID NO: 726084 - DNA, 25 bp, Mus musculus
gtcggtacccagaccaatggattgt

SEQ ID NO: 726085 - DNA, 25 bp, Mus musculus
gtcggtacccagtccaatggattgt

SEQ ID NO: 726086 - DNA, 25 bp, Mus musculus
gtcggtattctaaggactccaaggg

SEQ ID NO: 726087 - DNA, 25 bp, Mus musculus
gtcggtattctatggactccaaggg

SEQ ID NO: 726088 - DNA, 25 bp, Mus musculus
gtcggtcacgcgcaggccaactttc

SEQ ID NO: 726089 - DNA, 25 bp, Mus musculus
gtcggtcacgcggaggccaactttc

SEQ ID NO: 726090 - DNA, 25 bp, Mus musculus
gtcggtctgccgctctctactgcat

SEQ ID NO: 726091 - DNA, 25 bp, Mus musculus
gtcggtctgccggtctctactgcat

SEQ ID NO: 726092 - DNA, 25 bp, Mus musculus
gtcggtgagcgacatcaatggaacc

SEQ ID NO: 726093 - DNA, 25 bp, Mus musculus
gtcggtgagcgagatcaatggaacc

SEQ ID NO: 726094 - DNA, 25 bp, Mus musculus
gtcggtgcacaacgcgcagagtcct

SEQ ID NO: 726095 - DNA, 25 bp, Mus musculus
gtcggtgcacaaggcgcagagtcct

SEQ ID NO: 726096 - DNA, 25 bp, Mus musculus
gtcggtgcagtaagaccaccccaat

SEQ ID NO: 726097 - DNA, 25 bp, Mus musculus
gtcggtgcagtatgaccaccccaat

SEQ ID NO: 726098 - DNA, 25 bp, Mus musculus
gtcggtgcccaccttcacacaggtt

SEQ ID NO: 726099 - DNA, 25 bp, Mus musculus
gtcggtgcccacgttcacacaggtt

SEQ ID NO: 726100 - DNA, 25 bp, Mus musculus
gtcggtggccacacaatgttgccca

SEQ ID NO: 726101 - DNA, 25 bp, Mus musculus
gtcggtggccactcaatgttgccca

SEQ ID NO: 726102 - DNA, 25 bp, Mus musculus
gtcggtgggaaacaaaagcatgtca

SEQ ID NO: 726103 - DNA, 25 bp, Mus musculus
gtcggtgggaaagaaaagcatgtca

SEQ ID NO: 726104 - DNA, 25 bp, Mus musculus
gtcggtgtcagaagcaaggcagcct

SEQ ID NO: 726105 - DNA, 25 bp, Mus musculus
gtcggtgtcagatgcaaggcagcct

SEQ ID NO: 726106 - DNA, 25 bp, Mus musculus
gtcggtgtgcttcgcctctgttaga

SEQ ID NO: 726107 - DNA, 25 bp, Mus musculus
gtcggtgtgcttggcctctgttaga

SEQ ID NO: 726108 - DNA, 25 bp, Mus musculus
gtcggttccaagagctatgatatct

SEQ ID NO: 726109 - DNA, 25 bp, Mus musculus
gtcggttccaagtgctatgatatct

SEQ ID NO: 726110 - DNA, 25 bp, Mus musculus
gtcggtttatcaaggtaatgggagc

SEQ ID NO: 726111 - DNA, 25 bp, Mus musculus
gtcggtttatcatggtaatgggagc

SEQ ID NO: 726112 - DNA, 25 bp, Mus musculus
gtcgtacaaagacagcacgctaata

SEQ ID NO: 726113 - DNA, 25 bp, Mus musculus
gtcgtacaaagagagcacgctaata

SEQ ID NO: 726114 - DNA, 25 bp, Mus musculus
gtcgtatctaatcgccagacatgga

SEQ ID NO: 726115 - DNA, 25 bp, Mus musculus
gtcgtatctaatggccagacatgga

SEQ ID NO: 726116 - DNA, 25 bp, Mus musculus
gtcgtatctgggagatgagcaagca

SEQ ID NO: 726117 - DNA, 25 bp, Mus musculus
gtcgtatctgggtgatgagcaagca

SEQ ID NO: 726118 - DNA, 25 bp, Mus musculus
gtcgtcagcccgcaacagttcatga

SEQ ID NO: 726119 - DNA, 25 bp, Mus musculus
gtcgtcagcccggaacagttcatga

SEQ ID NO: 726120 - DNA, 25 bp, Mus musculus
gtcgtccaatgaagcgcaacaggtg

SEQ ID NO: 726121 - DNA, 25 bp, Mus musculus
gtcgtccaatgatgcgcaacaggtg

SEQ ID NO: 726122 - DNA, 25 bp, Mus musculus
gtcgtccgcagcacctcatcgtgtt

SEQ ID NO: 726123 - DNA, 25 bp, Mus musculus
gtcgtccgcagctcctcatcgtgtt

SEQ ID NO: 726124 - DNA, 25 bp, Mus musculus
gtcgtctttgatactggctcctcta

SEQ ID NO: 726125 - DNA, 25 bp, Mus musculus
gtcgtctttgattctggctcctcta

SEQ ID NO: 726126 - DNA, 25 bp, Mus musculus
gtcgtgacggtcactgcagactttg

SEQ ID NO: 726127 - DNA, 25 bp, Mus musculus
gtcgtgacggtctctgcagactttg

SEQ ID NO: 726128 - DNA, 25 bp, Mus musculus
gtcgtgatgtcacctccgcgtacaa

SEQ ID NO: 726129 - DNA, 25 bp, Mus musculus
gtcgtgatgtcagctccgcgtacaa

SEQ ID NO: 726130 - DNA, 25 bp, Mus musculus
gtcgtgcacttgacagagaaaatga

SEQ ID NO: 726131 - DNA, 25 bp, Mus musculus
gtcgtgcacttgtcagagaaaatga

SEQ ID NO: 726132 - DNA, 25 bp, Mus musculus
gtcgtgcagactatccgagacctgg

SEQ ID NO: 726133 - DNA, 25 bp, Mus musculus
gtcgtgcagactttccgagacctgg

SEQ ID NO: 726134 - DNA, 25 bp, Mus musculus
gtcgtggattccaccaatacagccc

SEQ ID NO: 726135 - DNA, 25 bp, Mus musculus
gtcgtggattcctccaatacagccc

SEQ ID NO: 726136 - DNA, 25 bp, Mus musculus
gtcgtgggcagtacgagtttcatag

SEQ ID NO: 726137 - DNA, 25 bp, Mus musculus
gtcgtgggcagttcgagtttcatag

SEQ ID NO: 726138 - DNA, 25 bp, Mus musculus
gtcgtgggtgccagtcgctgcctac

SEQ ID NO: 726139 - DNA, 25 bp, Mus musculus
gtcgtgggtgcctgtcgctgcctac

SEQ ID NO: 726140 - DNA, 25 bp, Mus musculus
gtcgtggtccaaagttgtttactac

SEQ ID NO: 726141 - DNA, 25 bp, Mus musculus
gtcgtggtccaatgttgtttactac

SEQ ID NO: 726142 - DNA, 25 bp, Mus musculus
gtcgtgtctgagatcccggtgctga

SEQ ID NO: 726143 - DNA, 25 bp, Mus musculus
gtcgtgtctgagttcccggtgctga

SEQ ID NO: 726144 - DNA, 25 bp, Mus musculus
gtcgtgtctggacaaggaaaccagt

SEQ ID NO: 726145 - DNA, 25 bp, Mus musculus
gtcgtgtctggagaaggaaaccagt

SEQ ID NO: 726146 - DNA, 25 bp, Mus musculus
gtcgtgttatctatggctccttatg

SEQ ID NO: 726147 - DNA, 25 bp, Mus musculus
gtcgtgttatctttggctccttatg

SEQ ID NO: 726148 - DNA, 25 bp, Mus musculus
gtcgttaccatacatgagttcattg

SEQ ID NO: 726149 - DNA, 25 bp, Mus musculus
gtcgttaccatagatgagttcattg

SEQ ID NO: 726150 - DNA, 25 bp, Mus musculus
gtcgttggcggcaacctccttggcc

SEQ ID NO: 726151 - DNA, 25 bp, Mus musculus
gtcgttggcggctacctccttggcc

SEQ ID NO: 726152 - DNA, 25 bp, Mus musculus
gtcgtttggtcactttaaagccgca

SEQ ID NO: 726153 - DNA, 25 bp, Mus musculus
gtcgtttggtcagtttaaagccgca

SEQ ID NO: 726154 - DNA, 25 bp, Mus musculus
gtctaaaccgaaagccagtgagtgg

SEQ ID NO: 726155 - DNA, 25 bp, Mus musculus
gtctaaaccgaatgccagtgagtgg

SEQ ID NO: 726156 - DNA, 25 bp, Mus musculus
gtctaaccctgtctaccctctgaag

SEQ ID NO: 726157 - DNA, 25 bp, Mus musculus
gtctaaccctgtgtaccctctgaag

SEQ ID NO: 726158 - DNA, 25 bp, Mus musculus
gtctaaccgctgatttcccagctgc

SEQ ID NO: 726159 - DNA, 25 bp, Mus musculus
gtctaaccgctgttttcccagctgc

SEQ ID NO: 726160 - DNA, 25 bp, Mus musculus
gtctaactcccgacagcagcagtgt

SEQ ID NO: 726161 - DNA, 25 bp, Mus musculus
gtctaactcccgtcagcagcagtgt

SEQ ID NO: 726162 - DNA, 25 bp, Mus musculus
gtctaactgagcctgctctgcaagg

SEQ ID NO: 726163 - DNA, 25 bp, Mus musculus
gtctaactgagcgtgctctgcaagg

SEQ ID NO: 726164 - DNA, 25 bp, Mus musculus
gtctaagggataaggctttgtctcc

SEQ ID NO: 726165 - DNA, 25 bp, Mus musculus
gtctaagggatatggctttgtctcc

SEQ ID NO: 726166 - DNA, 25 bp, Mus musculus
gtctaaggtacaaattgcaatcctg

SEQ ID NO: 726167 - DNA, 25 bp, Mus musculus
gtctaaggtacatattgcaatcctg

SEQ ID NO: 726168 - DNA, 25 bp, Mus musculus
gtctaagtgagtactccctcgcccg

SEQ ID NO: 726169 - DNA, 25 bp, Mus musculus
gtctaagtgagttctccctcgcccg

SEQ ID NO: 726170 - DNA, 25 bp, Mus musculus
gtctacaatccaacagtgagctggg

SEQ ID NO: 726171 - DNA, 25 bp, Mus musculus
gtctacaatccatcagtgagctggg

SEQ ID NO: 726172 - DNA, 25 bp, Mus musculus
gtctacaccagaaaggaagccttaa

SEQ ID NO: 726173 - DNA, 25 bp, Mus musculus
gtctacaccagataggaagccttaa

SEQ ID NO: 726174 - DNA, 25 bp, Mus musculus
gtctacacccaaatttgcatatgga

SEQ ID NO: 726175 - DNA, 25 bp, Mus musculus
gtctacacccaattttgcatatgga

SEQ ID NO: 726176 - DNA, 25 bp, Mus musculus
gtctacagaacaagccaaaaatgtt

SEQ ID NO: 726177 - DNA, 25 bp, Mus musculus
gtctacagaacatgccaaaaatgtt

SEQ ID NO: 726178 - DNA, 25 bp, Mus musculus
gtctacagccggctcacgtcacgag

SEQ ID NO: 726179 - DNA, 25 bp, Mus musculus
gtctacagccgggtcacgtcacgag

SEQ ID NO: 726180 - DNA, 25 bp, Mus musculus
gtctacagcctacgcccagaagcag

SEQ ID NO: 726181 - DNA, 25 bp, Mus musculus
gtctacagcctaggcccagaagcag

SEQ ID NO: 726182 - DNA, 25 bp, Mus musculus
gtctacagctacctgaataagcttc

SEQ ID NO: 726183 - DNA, 25 bp, Mus musculus
gtctacagctacgtgaataagcttc

SEQ ID NO: 726184 - DNA, 25 bp, Mus musculus
gtctacagttcaaacaaaaaccctg

SEQ ID NO: 726185 - DNA, 25 bp, Mus musculus
gtctacagttcatacaaaaaccctg

SEQ ID NO: 726186 - DNA, 25 bp, Mus musculus
gtctaccagcgacgtttgaccggct

SEQ ID NO: 726187 - DNA, 25 bp, Mus musculus
gtctaccagcgaggtttgaccggct

SEQ ID NO: 726188 - DNA, 25 bp, Mus musculus
gtctaccagctgacgcgcatgtgca

SEQ ID NO: 726189 - DNA, 25 bp, Mus musculus
gtctaccagctgtcgcgcatgtgca

SEQ ID NO: 726190 - DNA, 25 bp, Mus musculus
gtctaccatgaactcgtccagccgt

SEQ ID NO: 726191 - DNA, 25 bp, Mus musculus
gtctaccatgaagtcgtccagccgt

SEQ ID NO: 726192 - DNA, 25 bp, Mus musculus
gtctacccagatctttggcttggga

SEQ ID NO: 726193 - DNA, 25 bp, Mus musculus
gtctacccagatgtttggcttggga

SEQ ID NO: 726194 - DNA, 25 bp, Mus musculus
gtctaccgacatcacaagaggatca

SEQ ID NO: 726195 - DNA, 25 bp, Mus musculus
gtctaccgacatgacaagaggatca

SEQ ID NO: 726196 - DNA, 25 bp, Mus musculus
gtctacctcccgaggtgattccata

SEQ ID NO: 726197 - DNA, 25 bp, Mus musculus
gtctacctcccgtggtgattccata

SEQ ID NO: 726198 - DNA, 25 bp, Mus musculus
gtctacctctttctacagtatatca

SEQ ID NO: 726199 - DNA, 25 bp, Mus musculus
gtctacctctttgtacagtatatca

SEQ ID NO: 726200 - DNA, 25 bp, Mus musculus
gtctacgataccatttcagatcaca

SEQ ID NO: 726201 - DNA, 25 bp, Mus musculus
gtctacgataccttttcagatcaca

SEQ ID NO: 726202 - DNA, 25 bp, Mus musculus
gtctacgcgtcacgctgggcagcta

SEQ ID NO: 726203 - DNA, 25 bp, Mus musculus
gtctacgcgtcaggctgggcagcta

SEQ ID NO: 726204 - DNA, 25 bp, Mus musculus
gtctacgggatgctcagcgatagtt

SEQ ID NO: 726205 - DNA, 25 bp, Mus musculus
gtctacgggatggtcagcgatagtt

SEQ ID NO: 726206 - DNA, 25 bp, Mus musculus
gtctacgtcatgacacagccactgt

SEQ ID NO: 726207 - DNA, 25 bp, Mus musculus
gtctacgtcatgtcacagccactgt

SEQ ID NO: 726208 - DNA, 25 bp, Mus musculus
gtctacgtgtggagccgaaggaacc

SEQ ID NO: 726209 - DNA, 25 bp, Mus musculus
gtctacgtgtggtgccgaaggaacc

SEQ ID NO: 726210 - DNA, 25 bp, Mus musculus
gtctactagctcaccctaaggctgt

SEQ ID NO: 726211 - DNA, 25 bp, Mus musculus
gtctactagctctccctaaggctgt

SEQ ID NO: 726212 - DNA, 25 bp, Mus musculus
gtctactattaaatcccaggtgatg

SEQ ID NO: 726213 - DNA, 25 bp, Mus musculus
gtctactattaattcccaggtgatg

SEQ ID NO: 726214 - DNA, 25 bp, Mus musculus
gtctactcccaaaagtcagcgatgt

SEQ ID NO: 726215 - DNA, 25 bp, Mus musculus
gtctactcccaatagtcagcgatgt

SEQ ID NO: 726216 - DNA, 25 bp, Mus musculus
gtctactctgtcatcggtgctccaa

SEQ ID NO: 726217 - DNA, 25 bp, Mus musculus
gtctactctgtcttcggtgctccaa

SEQ ID NO: 726218 - DNA, 25 bp, Mus musculus
gtctactgtatactctcacctattg

SEQ ID NO: 726219 - DNA, 25 bp, Mus musculus
gtctactgtatagtctcacctattg

SEQ ID NO: 726220 - DNA, 25 bp, Mus musculus
gtctactgtttcatgcaccgccgat

SEQ ID NO: 726221 - DNA, 25 bp, Mus musculus
gtctactgtttcttgcaccgccgat

SEQ ID NO: 726222 - DNA, 25 bp, Mus musculus
gtctacttttgacgagacacttagg

SEQ ID NO: 726223 - DNA, 25 bp, Mus musculus
gtctacttttgaggagacacttagg

SEQ ID NO: 726224 - DNA, 25 bp, Mus musculus
gtctagagacccagacgctcgggat

SEQ ID NO: 726225 - DNA, 25 bp, Mus musculus
gtctagagaccctgacgctcgggat

SEQ ID NO: 726226 - DNA, 25 bp, Mus musculus
gtctagagcccgatctgtgagccat

SEQ ID NO: 726227 - DNA, 25 bp, Mus musculus
gtctagagcccgttctgtgagccat

SEQ ID NO: 726228 - DNA, 25 bp, Mus musculus
gtctagagccttactccgcaccaga

SEQ ID NO: 726229 - DNA, 25 bp, Mus musculus
gtctagagcctttctccgcaccaga

SEQ ID NO: 726230 - DNA, 25 bp, Mus musculus
gtctagataagactcagtttgccag

SEQ ID NO: 726231 - DNA, 25 bp, Mus musculus
gtctagataagagtcagtttgccag

SEQ ID NO: 726232 - DNA, 25 bp, Mus musculus
gtctagatgatgacgcaaccacaga

SEQ ID NO: 726233 - DNA, 25 bp, Mus musculus
gtctagatgatgtcgcaaccacaga

SEQ ID NO: 726234 - DNA, 25 bp, Mus musculus
gtctagccggctaccggcagagcga

SEQ ID NO: 726235 - DNA, 25 bp, Mus musculus
gtctagccggcttccggcagagcga

SEQ ID NO: 726236 - DNA, 25 bp, Mus musculus
gtctagcgagacagagaaaattccc

SEQ ID NO: 726237 - DNA, 25 bp, Mus musculus
gtctagcgagactgagaaaattccc

SEQ ID NO: 726238 - DNA, 25 bp, Mus musculus
gtctagctgtttccgatcctggtcc

SEQ ID NO: 726239 - DNA, 25 bp, Mus musculus
gtctagctgtttgcgatcctggtcc

SEQ ID NO: 726240 - DNA, 25 bp, Mus musculus
gtctaggagcctcgcagcctcacgt

SEQ ID NO: 726241 - DNA, 25 bp, Mus musculus
gtctaggagcctggcagcctcacgt

SEQ ID NO: 726242 - DNA, 25 bp, Mus musculus
gtctaggcccagaggtaacccacgt

SEQ ID NO: 726243 - DNA, 25 bp, Mus musculus
gtctaggcccagtggtaacccacgt

SEQ ID NO: 726244 - DNA, 25 bp, Mus musculus
gtctaggctcctacgctgatgtggg

SEQ ID NO: 726245 - DNA, 25 bp, Mus musculus
gtctaggctccttcgctgatgtggg

SEQ ID NO: 726246 - DNA, 25 bp, Mus musculus
gtctaggtcctgaaatagttcctgg

SEQ ID NO: 726247 - DNA, 25 bp, Mus musculus
gtctaggtcctgtaatagttcctgg

SEQ ID NO: 726248 - DNA, 25 bp, Mus musculus
gtctaggttacaatgctggctccaa

SEQ ID NO: 726249 - DNA, 25 bp, Mus musculus
gtctaggttacattgctggctccaa

SEQ ID NO: 726250 - DNA, 25 bp, Mus musculus
gtctagtcccaacaactgcactgtg

SEQ ID NO: 726251 - DNA, 25 bp, Mus musculus
gtctagtcccaagaactgcactgtg

SEQ ID NO: 726252 - DNA, 25 bp, Mus musculus
gtctagtgatagaattaaaaaacca

SEQ ID NO: 726253 - DNA, 25 bp, Mus musculus
gtctagtgatagtattaaaaaacca

SEQ ID NO: 726254 - DNA, 25 bp, Mus musculus
gtctagttgattctgatggaaaagg

SEQ ID NO: 726255 - DNA, 25 bp, Mus musculus
gtctagttgattgtgatggaaaagg

SEQ ID NO: 726256 - DNA, 25 bp, Mus musculus
gtctagtttagcaaacgtgtcccca

SEQ ID NO: 726257 - DNA, 25 bp, Mus musculus
gtctagtttagctaacgtgtcccca

SEQ ID NO: 726258 - DNA, 25 bp, Mus musculus
gtctataagaacatggtgcctaagc

SEQ ID NO: 726259 - DNA, 25 bp, Mus musculus
gtctataagaacttggtgcctaagc

SEQ ID NO: 726260 - DNA, 25 bp, Mus musculus
gtctatcctgacagtgccctgggtg

SEQ ID NO: 726261 - DNA, 25 bp, Mus musculus
gtctatcctgactgtgccctgggtg

SEQ ID NO: 726262 - DNA, 25 bp, Mus musculus
gtctatcgtgctcttcctcaacaag

SEQ ID NO: 726263 - DNA, 25 bp, Mus musculus
gtctatcgtgctgttcctcaacaag

SEQ ID NO: 726264 - DNA, 25 bp, Mus musculus
gtctatctccatccaatcgtgcgtg

SEQ ID NO: 726265 - DNA, 25 bp, Mus musculus
gtctatctccatgcaatcgtgcgtg

SEQ ID NO: 726266 - DNA, 25 bp, Mus musculus
gtctatgagcgactgacctggacca

SEQ ID NO: 726267 - DNA, 25 bp, Mus musculus
gtctatgagcgagtgacctggacca

SEQ ID NO: 726268 - DNA, 25 bp, Mus musculus
gtctatggacgaccctgctcctggg

SEQ ID NO: 726269 - DNA, 25 bp, Mus musculus
gtctatggacgagcctgctcctggg

SEQ ID NO: 726270 - DNA, 25 bp, Mus musculus
gtctatggagatatgagccccacag

SEQ ID NO: 726271 - DNA, 25 bp, Mus musculus
gtctatggagatttgagccccacag

SEQ ID NO: 726272 - DNA, 25 bp, Mus musculus
gtctatgggagcagcatgttcgtct

SEQ ID NO: 726273 - DNA, 25 bp, Mus musculus
gtctatgggagctgcatgttcgtct

SEQ ID NO: 726274 - DNA, 25 bp, Mus musculus
gtctatggttgcaacgtggtcagcg

SEQ ID NO: 726275 - DNA, 25 bp, Mus musculus
gtctatggttgctacgtggtcagcg

SEQ ID NO: 726276 - DNA, 25 bp, Mus musculus
gtctattacaatcgctaccatggag

SEQ ID NO: 726277 - DNA, 25 bp, Mus musculus
gtctattacaatggctaccatggag

SEQ ID NO: 726278 - DNA, 25 bp, Mus musculus
gtctattatcagcaggtaagggcct

SEQ ID NO: 726279 - DNA, 25 bp, Mus musculus
gtctattatcaggaggtaagggcct

SEQ ID NO: 726280 - DNA, 25 bp, Mus musculus
gtctattgctgcactaggaccccag

SEQ ID NO: 726281 - DNA, 25 bp, Mus musculus
gtctattgctgctctaggaccccag

SEQ ID NO: 726282 - DNA, 25 bp, Mus musculus
gtctatttagctccagcagccagct

SEQ ID NO: 726283 - DNA, 25 bp, Mus musculus
gtctatttagctgcagcagccagct

SEQ ID NO: 726284 - DNA, 25 bp, Mus musculus
gtctattttcagacattgcctcaag

SEQ ID NO: 726285 - DNA, 25 bp, Mus musculus
gtctattttcagtcattgcctcaag

SEQ ID NO: 726286 - DNA, 25 bp, Mus musculus
gtctcaaacattcctagacagttta

SEQ ID NO: 726287 - DNA, 25 bp, Mus musculus
gtctcaaacattgctagacagttta

SEQ ID NO: 726288 - DNA, 25 bp, Mus musculus
gtctcaacaaataccaaatcgatgg

SEQ ID NO: 726289 - DNA, 25 bp, Mus musculus
gtctcaacaaattccaaatcgatgg

SEQ ID NO: 726290 - DNA, 25 bp, Mus musculus
gtctcaagagtgagagaaactcaag

SEQ ID NO: 726291 - DNA, 25 bp, Mus musculus
gtctcaagagtgtgagaaactcaag

SEQ ID NO: 726292 - DNA, 25 bp, Mus musculus
gtctcaagcctgaagctgcctcttg

SEQ ID NO: 726293 - DNA, 25 bp, Mus musculus
gtctcaagcctgtagctgcctcttg

SEQ ID NO: 726294 - DNA, 25 bp, Mus musculus
gtctcaatccatagaagtcttggac

SEQ ID NO: 726295 - DNA, 25 bp, Mus musculus
gtctcaatccattgaagtcttggac

SEQ ID NO: 726296 - DNA, 25 bp, Mus musculus
gtctcacagctcagttgaaaagcag

SEQ ID NO: 726297 - DNA, 25 bp, Mus musculus
gtctcacagctctgttgaaaagcag

SEQ ID NO: 726298 - DNA, 25 bp, Mus musculus
gtctcacaggctacgggatctcgga

SEQ ID NO: 726299 - DNA, 25 bp, Mus musculus
gtctcacaggcttcgggatctcgga

SEQ ID NO: 726300 - DNA, 25 bp, Mus musculus
gtctcactgcatcgagccagaggtg

SEQ ID NO: 726301 - DNA, 25 bp, Mus musculus
gtctcactgcatggagccagaggtg

SEQ ID NO: 726302 - DNA, 25 bp, Mus musculus
gtctcactgcgcatcatggatttga

SEQ ID NO: 726303 - DNA, 25 bp, Mus musculus
gtctcactgcgcttcatggatttga

SEQ ID NO: 726304 - DNA, 25 bp, Mus musculus
gtctcagaatgaacttccttgggaa

SEQ ID NO: 726305 - DNA, 25 bp, Mus musculus
gtctcagaatgatcttccttgggaa

SEQ ID NO: 726306 - DNA, 25 bp, Mus musculus
gtctcagagactccggctggccatt

SEQ ID NO: 726307 - DNA, 25 bp, Mus musculus
gtctcagagactgcggctggccatt

SEQ ID NO: 726308 - DNA, 25 bp, Mus musculus
gtctcagagcaacggacgaacaaat

SEQ ID NO: 726309 - DNA, 25 bp, Mus musculus
gtctcagagcaagggacgaacaaat

SEQ ID NO: 726310 - DNA, 25 bp, Mus musculus
gtctcagagcgtccggcaagccctg

SEQ ID NO: 726311 - DNA, 25 bp, Mus musculus
gtctcagagcgtgcggcaagccctg

SEQ ID NO: 726312 - DNA, 25 bp, Mus musculus
gtctcagaggatagcaaagtttgcg

SEQ ID NO: 726313 - DNA, 25 bp, Mus musculus
gtctcagaggattgcaaagtttgcg

SEQ ID NO: 726314 - DNA, 25 bp, Mus musculus
gtctcagcccatacagattgcacag

SEQ ID NO: 726315 - DNA, 25 bp, Mus musculus
gtctcagcccattcagattgcacag

SEQ ID NO: 726316 - DNA, 25 bp, Mus musculus
gtctcagcccgaagtctcagaggcc

SEQ ID NO: 726317 - DNA, 25 bp, Mus musculus
gtctcagcccgatgtctcagaggcc

SEQ ID NO: 726318 - DNA, 25 bp, Mus musculus
gtctcagtaacaagctgttccagtg

SEQ ID NO: 726319 - DNA, 25 bp, Mus musculus
gtctcagtaacatgctgttccagtg

SEQ ID NO: 726320 - DNA, 25 bp, Mus musculus
gtctcagtccgaccgggctagcttt

SEQ ID NO: 726321 - DNA, 25 bp, Mus musculus
gtctcagtccgagcgggctagcttt

SEQ ID NO: 726322 - DNA, 25 bp, Mus musculus
gtctcatcatctctgaccgggctca

SEQ ID NO: 726323 - DNA, 25 bp, Mus musculus
gtctcatcatctgtgaccgggctca

SEQ ID NO: 726324 - DNA, 25 bp, Mus musculus
gtctcatccaccaggtaacctacat

SEQ ID NO: 726325 - DNA, 25 bp, Mus musculus
gtctcatccacctggtaacctacat

SEQ ID NO: 726326 - DNA, 25 bp, Mus musculus
gtctcattcaggaacgtcacctgat

SEQ ID NO: 726327 - DNA, 25 bp, Mus musculus
gtctcattcaggtacgtcacctgat

SEQ ID NO: 726328 - DNA, 25 bp, Mus musculus
gtctcattcttgaaatcgaacctga

SEQ ID NO: 726329 - DNA, 25 bp, Mus musculus
gtctcattcttgtaatcgaacctga

SEQ ID NO: 726330 - DNA, 25 bp, Mus musculus
gtctccaaaggcaatgtctttcaga

SEQ ID NO: 726331 - DNA, 25 bp, Mus musculus
gtctccaaaggctatgtctttcaga

SEQ ID NO: 726332 - DNA, 25 bp, Mus musculus
gtctccaaccaccagtcttgcatgg

SEQ ID NO: 726333 - DNA, 25 bp, Mus musculus
gtctccaaccacgagtcttgcatgg

SEQ ID NO: 726334 - DNA, 25 bp, Mus musculus
gtctccaacgacagtggcatctacg

SEQ ID NO: 726335 - DNA, 25 bp, Mus musculus
gtctccaacgactgtggcatctacg

SEQ ID NO: 726336 - DNA, 25 bp, Mus musculus
gtctccaaggctactacagggccag

SEQ ID NO: 726337 - DNA, 25 bp, Mus musculus
gtctccaaggcttctacagggccag

SEQ ID NO: 726338 - DNA, 25 bp, Mus musculus
gtctccaagtccaggcataactaca

SEQ ID NO: 726339 - DNA, 25 bp, Mus musculus
gtctccaagtcctggcataactaca

SEQ ID NO: 726340 - DNA, 25 bp, Mus musculus
gtctccagtcttcagtgccatgttt

SEQ ID NO: 726341 - DNA, 25 bp, Mus musculus
gtctccagtcttgagtgccatgttt

SEQ ID NO: 726342 - DNA, 25 bp, Mus musculus
gtctccatgattcccttcaagctgg

SEQ ID NO: 726343 - DNA, 25 bp, Mus musculus
gtctccatgattgccttcaagctgg

SEQ ID NO: 726344 - DNA, 25 bp, Mus musculus
gtctccattttgacagtgccagcag

SEQ ID NO: 726345 - DNA, 25 bp, Mus musculus
gtctccattttgtcagtgccagcag

SEQ ID NO: 726346 - DNA, 25 bp, Mus musculus
gtctcccaaataatctcattccagg

SEQ ID NO: 726347 - DNA, 25 bp, Mus musculus
gtctcccaaatattctcattccagg

SEQ ID NO: 726348 - DNA, 25 bp, Mus musculus
gtctcccagtgaatacatttctgcc

SEQ ID NO: 726349 - DNA, 25 bp, Mus musculus
gtctcccagtgattacatttctgcc

SEQ ID NO: 726350 - DNA, 25 bp, Mus musculus
gtctccccgcagagttatgctagca

SEQ ID NO: 726351 - DNA, 25 bp, Mus musculus
gtctccccgcagtgttatgctagca

SEQ ID NO: 726352 - DNA, 25 bp, Mus musculus
gtctcccgaggaacttcaacagctc

SEQ ID NO: 726353 - DNA, 25 bp, Mus musculus
gtctcccgaggatcttcaacagctc

SEQ ID NO: 726354 - DNA, 25 bp, Mus musculus
gtctcccggcccatcagtgcaatgg

SEQ ID NO: 726355 - DNA, 25 bp, Mus musculus
gtctcccggcccttcagtgcaatgg

SEQ ID NO: 726356 - DNA, 25 bp, Mus musculus
gtctcccggtctcaggccctgaaaa

SEQ ID NO: 726357 - DNA, 25 bp, Mus musculus
gtctcccggtctgaggccctgaaaa

SEQ ID NO: 726358 - DNA, 25 bp, Mus musculus
gtctccctggagattcatgctcttc

SEQ ID NO: 726359 - DNA, 25 bp, Mus musculus
gtctccctggagctgactgtgcaca

SEQ ID NO: 726360 - DNA, 25 bp, Mus musculus
gtctccctggaggtgactgtgcaca

SEQ ID NO: 726361 - DNA, 25 bp, Mus musculus
gtctccctggagtttcatgctcttc

SEQ ID NO: 726362 - DNA, 25 bp, Mus musculus
gtctccgagtctctgctcgataagt

SEQ ID NO: 726363 - DNA, 25 bp, Mus musculus
gtctccgagtctgtgctcgataagt

SEQ ID NO: 726364 - DNA, 25 bp, Mus musculus
gtctccgctcagcacgcagagcgaa

SEQ ID NO: 726365 - DNA, 25 bp, Mus musculus
gtctccgctcaggacgcagagcgaa

SEQ ID NO: 726366 - DNA, 25 bp, Mus musculus
gtctccgctccaccaggatctttgg

SEQ ID NO: 726367 - DNA, 25 bp, Mus musculus
gtctccgctccagcaggatctttgg

SEQ ID NO: 726368 - DNA, 25 bp, Mus musculus
gtctccggccgaagaatgcagctgg

SEQ ID NO: 726369 - DNA, 25 bp, Mus musculus
gtctccggccgatgaatgcagctgg

SEQ ID NO: 726370 - DNA, 25 bp, Mus musculus
gtctccgggctgagaatcccagcgt

SEQ ID NO: 726371 - DNA, 25 bp, Mus musculus
gtctccgggctgtgaatcccagcgt

SEQ ID NO: 726372 - DNA, 25 bp, Mus musculus
gtctccgtcatcaagcatactgacc

SEQ ID NO: 726373 - DNA, 25 bp, Mus musculus
gtctccgtcatctagcatactgacc

SEQ ID NO: 726374 - DNA, 25 bp, Mus musculus
gtctccgtcgtcacggctggaccag

SEQ ID NO: 726375 - DNA, 25 bp, Mus musculus
gtctccgtcgtctcggctggaccag

SEQ ID NO: 726376 - DNA, 25 bp, Mus musculus
gtctcctacgacaccaagccagatt

SEQ ID NO: 726377 - DNA, 25 bp, Mus musculus
gtctcctacgactccaagccagatt

SEQ ID NO: 726378 - DNA, 25 bp, Mus musculus
gtctcctagatcctgttttgcgcaa

SEQ ID NO: 726379 - DNA, 25 bp, Mus musculus
gtctcctagatcgtgttttgcgcaa

SEQ ID NO: 726380 - DNA, 25 bp, Mus musculus
gtctcctcacacaggcttggttcct

SEQ ID NO: 726381 - DNA, 25 bp, Mus musculus
gtctcctcacactggcttggttcct

SEQ ID NO: 726382 - DNA, 25 bp, Mus musculus
gtctcctcactaatgtcgccctgat

SEQ ID NO: 726383 - DNA, 25 bp, Mus musculus
gtctcctcactattgtcgccctgat

SEQ ID NO: 726384 - DNA, 25 bp, Mus musculus
gtctcctcccagctgaccagatggt

SEQ ID NO: 726385 - DNA, 25 bp, Mus musculus
gtctcctcccaggtgaccagatggt

SEQ ID NO: 726386 - DNA, 25 bp, Mus musculus
gtctcctcgaagatagactctcatg

SEQ ID NO: 726387 - DNA, 25 bp, Mus musculus
gtctcctcgaagttagactctcatg

SEQ ID NO: 726388 - DNA, 25 bp, Mus musculus
gtctcctcttacaacgaatgggacc

SEQ ID NO: 726389 - DNA, 25 bp, Mus musculus
gtctcctcttactacgaatgggacc

SEQ ID NO: 726390 - DNA, 25 bp, Mus musculus
gtctcctgaagaaacaccttattga

SEQ ID NO: 726391 - DNA, 25 bp, Mus musculus
gtctcctgaagatacaccttattga

SEQ ID NO: 726392 - DNA, 25 bp, Mus musculus
gtctcctgacttatggccgccgcat

SEQ ID NO: 726393 - DNA, 25 bp, Mus musculus
gtctcctgacttttggccgccgcat

SEQ ID NO: 726394 - DNA, 25 bp, Mus musculus
gtctcctgatttcattccgtcgcag

SEQ ID NO: 726395 - DNA, 25 bp, Mus musculus
gtctcctgatttgattccgtcgcag

SEQ ID NO: 726396 - DNA, 25 bp, Mus musculus
gtctcctgctcacggcaagaagagt

SEQ ID NO: 726397 - DNA, 25 bp, Mus musculus
gtctcctgctcagggcaagaagagt

SEQ ID NO: 726398 - DNA, 25 bp, Mus musculus
gtctcctgtacaagcagtttctctg

SEQ ID NO: 726399 - DNA, 25 bp, Mus musculus
gtctcctgtacatgcagtttctctg

SEQ ID NO: 726400 - DNA, 25 bp, Mus musculus
gtctcctgttggaacactgtcccca

SEQ ID NO: 726401 - DNA, 25 bp, Mus musculus
gtctcctgttggtacactgtcccca

SEQ ID NO: 726402 - DNA, 25 bp, Mus musculus
gtctccttagtgcatgaatcgttcc

SEQ ID NO: 726403 - DNA, 25 bp, Mus musculus
gtctccttagtggatgaatcgttcc

SEQ ID NO: 726404 - DNA, 25 bp, Mus musculus
gtctccttcccactctcggtggagg

SEQ ID NO: 726405 - DNA, 25 bp, Mus musculus
gtctccttcccagtctcggtggagg

SEQ ID NO: 726406 - DNA, 25 bp, Mus musculus
gtctccttctttcccagcaatgtgg

SEQ ID NO: 726407 - DNA, 25 bp, Mus musculus
gtctccttctttgccagcaatgtgg

SEQ ID NO: 726408 - DNA, 25 bp, Mus musculus
gtctccttgcagagactcactacca

SEQ ID NO: 726409 - DNA, 25 bp, Mus musculus
gtctccttgcagtgactcactacca

SEQ ID NO: 726410 - DNA, 25 bp, Mus musculus
gtctccttttggagatgcacaagca

SEQ ID NO: 726411 - DNA, 25 bp, Mus musculus
gtctccttttggtgatgcacaagca

SEQ ID NO: 726412 - DNA, 25 bp, Mus musculus
gtctcgaattgtcggcaaatctggc

SEQ ID NO: 726413 - DNA, 25 bp, Mus musculus
gtctcgaattgtgggcaaatctggc

SEQ ID NO: 726414 - DNA, 25 bp, Mus musculus
gtctcgagatcccattccttcagtg

SEQ ID NO: 726415 - DNA, 25 bp, Mus musculus
gtctcgagatccgattccttcagtg

SEQ ID NO: 726416 - DNA, 25 bp, Mus musculus
gtctcgcaatggcagcaactttgta

SEQ ID NO: 726417 - DNA, 25 bp, Mus musculus
gtctcgcaatgggagcaactttgta

SEQ ID NO: 726418 - DNA, 25 bp, Mus musculus
gtctcgctctcgaagcagacattcc

SEQ ID NO: 726419 - DNA, 25 bp, Mus musculus
gtctcgctctcgtagcagacattcc

SEQ ID NO: 726420 - DNA, 25 bp, Mus musculus
gtctcgctgaagcaaccaggtccga

SEQ ID NO: 726421 - DNA, 25 bp, Mus musculus
gtctcgctgaaggaaccaggtccga

SEQ ID NO: 726422 - DNA, 25 bp, Mus musculus
gtctcgctgcctagaactcggagca

SEQ ID NO: 726423 - DNA, 25 bp, Mus musculus
gtctcgctgccttgaactcggagca

SEQ ID NO: 726424 - DNA, 25 bp, Mus musculus
gtctcggaacatctacggctcacgc

SEQ ID NO: 726425 - DNA, 25 bp, Mus musculus
gtctcggaacatgtacggctcacgc

SEQ ID NO: 726426 - DNA, 25 bp, Mus musculus
gtctcggctgacacaagaatgtgga

SEQ ID NO: 726427 - DNA, 25 bp, Mus musculus
gtctcggctgactcaagaatgtgga

SEQ ID NO: 726428 - DNA, 25 bp, Mus musculus
gtctcgtagacgcaggactgatgaa

SEQ ID NO: 726429 - DNA, 25 bp, Mus musculus
gtctcgtagacggaggactgatgaa

SEQ ID NO: 726430 - DNA, 25 bp, Mus musculus
gtctcgttagcacccagtggagcgt

SEQ ID NO: 726431 - DNA, 25 bp, Mus musculus
gtctcgttagcagccagtggagcgt

SEQ ID NO: 726432 - DNA, 25 bp, Mus musculus
gtctcgttgcatactccagagaggg

SEQ ID NO: 726433 - DNA, 25 bp, Mus musculus
gtctcgttgcattctccagagaggg

SEQ ID NO: 726434 - DNA, 25 bp, Mus musculus
gtctctaaggcaaagtaagttcctg

SEQ ID NO: 726435 - DNA, 25 bp, Mus musculus
gtctctaaggcatagtaagttcctg

SEQ ID NO: 726436 - DNA, 25 bp, Mus musculus
gtctctacctttctggcgctcctgg

SEQ ID NO: 726437 - DNA, 25 bp, Mus musculus
gtctctacctttgtggcgctcctgg

SEQ ID NO: 726438 - DNA, 25 bp, Mus musculus
gtctctacgccaagtattttcaagg

SEQ ID NO: 726439 - DNA, 25 bp, Mus musculus
gtctctacgccatgtattttcaagg

SEQ ID NO: 726440 - DNA, 25 bp, Mus musculus
gtctctacgggtctcccgggcctga

SEQ ID NO: 726441 - DNA, 25 bp, Mus musculus
gtctctacgggtgtcccgggcctga

SEQ ID NO: 726442 - DNA, 25 bp, Mus musculus
gtctctacgtgtccaaaggcttcaa

SEQ ID NO: 726443 - DNA, 25 bp, Mus musculus
gtctctacgtgtgcaaaggcttcaa

SEQ ID NO: 726444 - DNA, 25 bp, Mus musculus
gtctctatctacaagctctgacttg

SEQ ID NO: 726445 - DNA, 25 bp, Mus musculus
gtctctatctactagctctgacttg

SEQ ID NO: 726446 - DNA, 25 bp, Mus musculus
gtctctcaatcacatcttcatccag

SEQ ID NO: 726447 - DNA, 25 bp, Mus musculus
gtctctcaatcagatcttcatccag

SEQ ID NO: 726448 - DNA, 25 bp, Mus musculus
gtctctcagtttcggtgcaggtcgt

SEQ ID NO: 726449 - DNA, 25 bp, Mus musculus
gtctctcagtttgggtgcaggtcgt

SEQ ID NO: 726450 - DNA, 25 bp, Mus musculus
gtctctcatcaaatcctggaaaaaa

SEQ ID NO: 726451 - DNA, 25 bp, Mus musculus
gtctctcatcaattcctggaaaaaa

SEQ ID NO: 726452 - DNA, 25 bp, Mus musculus
gtctctccgagacactgtttcagcg

SEQ ID NO: 726453 - DNA, 25 bp, Mus musculus
gtctctccgagagactgtttcagcg

SEQ ID NO: 726454 - DNA, 25 bp, Mus musculus
gtctctcctttcagccttctggagc

SEQ ID NO: 726455 - DNA, 25 bp, Mus musculus
gtctctcctttctgccttctggagc

SEQ ID NO: 726456 - DNA, 25 bp, Mus musculus
gtctctcggcgtacacccacatgga

SEQ ID NO: 726457 - DNA, 25 bp, Mus musculus
gtctctcggcgttcacccacatgga

SEQ ID NO: 726458 - DNA, 25 bp, Mus musculus
gtctctcttaagcacctggccttga

SEQ ID NO: 726459 - DNA, 25 bp, Mus musculus
gtctctcttaaggacctggccttga

SEQ ID NO: 726460 - DNA, 25 bp, Mus musculus
gtctctctttggcaatcgtcggctg

SEQ ID NO: 726461 - DNA, 25 bp, Mus musculus
gtctctctttgggaatcgtcggctg

SEQ ID NO: 726462 - DNA, 25 bp, Mus musculus
gtctctgacactctggaagccttct

SEQ ID NO: 726463 - DNA, 25 bp, Mus musculus
gtctctgacactgtggaagccttct

SEQ ID NO: 726464 - DNA, 25 bp, Mus musculus
gtctctgactctagcacagcgctgg

SEQ ID NO: 726465 - DNA, 25 bp, Mus musculus
gtctctgactcttgcacagcgctgg

SEQ ID NO: 726466 - DNA, 25 bp, Mus musculus
gtctctgcagagcttgtttgaccaa

SEQ ID NO: 726467 - DNA, 25 bp, Mus musculus
gtctctgcagaggttgtttgaccaa

SEQ ID NO: 726468 - DNA, 25 bp, Mus musculus
gtctctgcaggtcccagctgatgag

SEQ ID NO: 726469 - DNA, 25 bp, Mus musculus
gtctctgcaggtgccagctgatgag

SEQ ID NO: 726470 - DNA, 25 bp, Mus musculus
gtctctgccccgattctgaatgtca

SEQ ID NO: 726471 - DNA, 25 bp, Mus musculus
gtctctgccccgtttctgaatgtca

SEQ ID NO: 726472 - DNA, 25 bp, Mus musculus
gtctctggagacctcaggtcacctg

SEQ ID NO: 726473 - DNA, 25 bp, Mus musculus
gtctctggagacgtcaggtcacctg

SEQ ID NO: 726474 - DNA, 25 bp, Mus musculus
gtctctggcagaacgcgctgcttga

SEQ ID NO: 726475 - DNA, 25 bp, Mus musculus
gtctctggcagatcgcgctgcttga

SEQ ID NO: 726476 - DNA, 25 bp, Mus musculus
gtctctggctcaccacagcttgggt

SEQ ID NO: 726477 - DNA, 25 bp, Mus musculus
gtctctggctcagcacagcttgggt

SEQ ID NO: 726478 - DNA, 25 bp, Mus musculus
gtctctggcttcagtttcttatgct

SEQ ID NO: 726479 - DNA, 25 bp, Mus musculus
gtctctggcttctgtttcttatgct

SEQ ID NO: 726480 - DNA, 25 bp, Mus musculus
gtctctggtgcgctctcgagcccga

SEQ ID NO: 726481 - DNA, 25 bp, Mus musculus
gtctctggtgcggtctcgagcccga

SEQ ID NO: 726482 - DNA, 25 bp, Mus musculus
gtctctgtcacgagccccggacgtt

SEQ ID NO: 726483 - DNA, 25 bp, Mus musculus
gtctctgtcacgtgccccggacgtt

SEQ ID NO: 726484 - DNA, 25 bp, Mus musculus
gtctctgtgtggctcgcagacccat

SEQ ID NO: 726485 - DNA, 25 bp, Mus musculus
gtctctgtgtgggtcgcagacccat

SEQ ID NO: 726486 - DNA, 25 bp, Mus musculus
gtctctgttaatcattgctccacca

SEQ ID NO: 726487 - DNA, 25 bp, Mus musculus
gtctctgttaatgattgctccacca

SEQ ID NO: 726488 - DNA, 25 bp, Mus musculus
gtctcttacccgcatcccagagttg

SEQ ID NO: 726489 - DNA, 25 bp, Mus musculus
gtctcttacccggatcccagagttg

SEQ ID NO: 726490 - DNA, 25 bp, Mus musculus
gtctcttagagcaaaccggccgggc

SEQ ID NO: 726491 - DNA, 25 bp, Mus musculus
gtctcttagagctaaccggccgggc

SEQ ID NO: 726492 - DNA, 25 bp, Mus musculus
gtctcttagcagagcttagctgctg

SEQ ID NO: 726493 - DNA, 25 bp, Mus musculus
gtctcttagcagtgcttagctgctg

SEQ ID NO: 726494 - DNA, 25 bp, Mus musculus
gtctcttcagaactgtccctgatgg

SEQ ID NO: 726495 - DNA, 25 bp, Mus musculus
gtctcttcagaagtgtccctgatgg

SEQ ID NO: 726496 - DNA, 25 bp, Mus musculus
gtctcttccggccacagctggcgat

SEQ ID NO: 726497 - DNA, 25 bp, Mus musculus
gtctcttccggcgacagctggcgat

SEQ ID NO: 726498 - DNA, 25 bp, Mus musculus
gtctcttcgtaaccggcttcagctc

SEQ ID NO: 726499 - DNA, 25 bp, Mus musculus
gtctcttcgtaagcggcttcagctc

SEQ ID NO: 726500 - DNA, 25 bp, Mus musculus
gtctcttgctccagacaccagactg

SEQ ID NO: 726501 - DNA, 25 bp, Mus musculus
gtctcttgctcctgacaccagactg

SEQ ID NO: 726502 - DNA, 25 bp, Mus musculus
gtctcttgtgctctatagctgcctg

SEQ ID NO: 726503 - DNA, 25 bp, Mus musculus
gtctcttgtgctgtatagctgcctg

SEQ ID NO: 726504 - DNA, 25 bp, Mus musculus
gtctctttcctacaaagctacttca

SEQ ID NO: 726505 - DNA, 25 bp, Mus musculus
gtctctttcctagaaagctacttca

SEQ ID NO: 726506 - DNA, 25 bp, Mus musculus
gtctgaaatgggacctcgcgctctg

SEQ ID NO: 726507 - DNA, 25 bp, Mus musculus
gtctgaaatgggtcctcgcgctctg

SEQ ID NO: 726508 - DNA, 25 bp, Mus musculus
gtctgaaccggcaccagctgggccg

SEQ ID NO: 726509 - DNA, 25 bp, Mus musculus
gtctgaaccggctccagctgggccg

SEQ ID NO: 726510 - DNA, 25 bp, Mus musculus
gtctgaagccgaaaaccagtttaag

SEQ ID NO: 726511 - DNA, 25 bp, Mus musculus
gtctgaagccgataaccagtttaag

SEQ ID NO: 726512 - DNA, 25 bp, Mus musculus
gtctgaaggccaacaccaacgaagt

SEQ ID NO: 726513 - DNA, 25 bp, Mus musculus
gtctgaaggccatcaccaacgaagt

SEQ ID NO: 726514 - DNA, 25 bp, Mus musculus
gtctgaagggtaaggagtccaacaa

SEQ ID NO: 726515 - DNA, 25 bp, Mus musculus
gtctgaagggtatggagtccaacaa

SEQ ID NO: 726516 - DNA, 25 bp, Mus musculus
gtctgaatcctaaaacaaacctttg

SEQ ID NO: 726517 - DNA, 25 bp, Mus musculus
gtctgaatcctataacaaacctttg

SEQ ID NO: 726518 - DNA, 25 bp, Mus musculus
gtctgacctactctgatgctgacag

SEQ ID NO: 726519 - DNA, 25 bp, Mus musculus
gtctgacctactgtgatgctgacag

SEQ ID NO: 726520 - DNA, 25 bp, Mus musculus
gtctgactttgtcaccctgccattc

SEQ ID NO: 726521 - DNA, 25 bp, Mus musculus
gtctgactttgtgaccctgccattc

SEQ ID NO: 726522 - DNA, 25 bp, Mus musculus
gtctgagacttcagtaagtcctggg

SEQ ID NO: 726523 - DNA, 25 bp, Mus musculus
gtctgagacttctgtaagtcctggg

SEQ ID NO: 726524 - DNA, 25 bp, Mus musculus
gtctgagagcccagatgaacacaca

SEQ ID NO: 726525 - DNA, 25 bp, Mus musculus
gtctgagagccctgatgaacacaca

SEQ ID NO: 726526 - DNA, 25 bp, Mus musculus
gtctgagcaagcaggcctgagtcca

SEQ ID NO: 726527 - DNA, 25 bp, Mus musculus
gtctgagcaagctggcctgagtcca

SEQ ID NO: 726528 - DNA, 25 bp, Mus musculus
gtctgaggaatgctttaattgaccc

SEQ ID NO: 726529 - DNA, 25 bp, Mus musculus
gtctgaggaatggtttaattgaccc

SEQ ID NO: 726530 - DNA, 25 bp, Mus musculus
gtctgagtcgctcgttcctttggcg

SEQ ID NO: 726531 - DNA, 25 bp, Mus musculus
gtctgagtcgctggttcctttggcg

SEQ ID NO: 726532 - DNA, 25 bp, Mus musculus
gtctgagtgggacgctgtaaaccat

SEQ ID NO: 726533 - DNA, 25 bp, Mus musculus
gtctgagtgggaggctgtaaaccat

SEQ ID NO: 726534 - DNA, 25 bp, Mus musculus
gtctgataaggccaccctgctggcc

SEQ ID NO: 726535 - DNA, 25 bp, Mus musculus
gtctgataaggcgaccctgctggcc

SEQ ID NO: 726536 - DNA, 25 bp, Mus musculus
gtctgatatcagcatgtgaactgcc

SEQ ID NO: 726537 - DNA, 25 bp, Mus musculus
gtctgatatcaggatgtgaactgcc

SEQ ID NO: 726538 - DNA, 25 bp, Mus musculus
gtctgatccaaaatactgctgaaaa

SEQ ID NO: 726539 - DNA, 25 bp, Mus musculus
gtctgatccaaattactgctgaaaa

SEQ ID NO: 726540 - DNA, 25 bp, Mus musculus
gtctgatgattcacagtggagaccc

SEQ ID NO: 726541 - DNA, 25 bp, Mus musculus
gtctgatgattctcagtggagaccc

SEQ ID NO: 726542 - DNA, 25 bp, Mus musculus
gtctgattcagaaggacgtgccaag

SEQ ID NO: 726543 - DNA, 25 bp, Mus musculus
gtctgattcagatggacgtgccaag

SEQ ID NO: 726544 - DNA, 25 bp, Mus musculus
gtctgattgttgcagtgacatcact

SEQ ID NO: 726545 - DNA, 25 bp, Mus musculus
gtctgattgttggagtgacatcact

SEQ ID NO: 726546 - DNA, 25 bp, Mus musculus
gtctgattttcgaggttgacagtaa

SEQ ID NO: 726547 - DNA, 25 bp, Mus musculus
gtctgattttcgtggttgacagtaa

SEQ ID NO: 726548 - DNA, 25 bp, Mus musculus
gtctgattttggaattagaaacggc

SEQ ID NO: 726549 - DNA, 25 bp, Mus musculus
gtctgattttggtattagaaacggc

SEQ ID NO: 726550 - DNA, 25 bp, Mus musculus
gtctgcaacctgcaagatgccagcg

SEQ ID NO: 726551 - DNA, 25 bp, Mus musculus
gtctgcaacctggaagatgccagcg

SEQ ID NO: 726552 - DNA, 25 bp, Mus musculus
gtctgcaaggttaacagcgatgccc

SEQ ID NO: 726553 - DNA, 25 bp, Mus musculus
gtctgcaaggtttacagcgatgccc

SEQ ID NO: 726554 - DNA, 25 bp, Mus musculus
gtctgcaagttgacaaaggccaaga

SEQ ID NO: 726555 - DNA, 25 bp, Mus musculus
gtctgcaagttgtcaaaggccaaga

SEQ ID NO: 726556 - DNA, 25 bp, Mus musculus
gtctgcagaaatccctctttggctt

SEQ ID NO: 726557 - DNA, 25 bp, Mus musculus
gtctgcagaaatgcctctttggctt

SEQ ID NO: 726558 - DNA, 25 bp, Mus musculus
gtctgcagagatacgggatctcgaa

SEQ ID NO: 726559 - DNA, 25 bp, Mus musculus
gtctgcagagattcgggatctcgaa

SEQ ID NO: 726560 - DNA, 25 bp, Mus musculus
gtctgcagggccatcgatgtcccca

SEQ ID NO: 726561 - DNA, 25 bp, Mus musculus
gtctgcagggccttcgatgtcccca

SEQ ID NO: 726562 - DNA, 25 bp, Mus musculus
gtctgcatcctgatcacagatggga

SEQ ID NO: 726563 - DNA, 25 bp, Mus musculus
gtctgcatcctgttcacagatggga

SEQ ID NO: 726564 - DNA, 25 bp, Mus musculus
gtctgccatagcctgtgcttttcat

SEQ ID NO: 726565 - DNA, 25 bp, Mus musculus
gtctgccatagcgtgtgcttttcat

SEQ ID NO: 726566 - DNA, 25 bp, Mus musculus
gtctgcccactgaatagtaatcaca

SEQ ID NO: 726567 - DNA, 25 bp, Mus musculus
gtctgcccactgtatagtaatcaca

SEQ ID NO: 726568 - DNA, 25 bp, Mus musculus
gtctgcccctgcagtctgtattcct

SEQ ID NO: 726569 - DNA, 25 bp, Mus musculus
gtctgcccctgctgtctgtattcct

SEQ ID NO: 726570 - DNA, 25 bp, Mus musculus
gtctgcccggccctgttggacctaa

SEQ ID NO: 726571 - DNA, 25 bp, Mus musculus
gtctgcccggccgtgttggacctaa

SEQ ID NO: 726572 - DNA, 25 bp, Mus musculus
gtctgccctagccttctgcatattc

SEQ ID NO: 726573 - DNA, 25 bp, Mus musculus
gtctgccctagcgttctgcatattc

SEQ ID NO: 726574 - DNA, 25 bp, Mus musculus
gtctgccctgcaccctgagactggt

SEQ ID NO: 726575 - DNA, 25 bp, Mus musculus
gtctgccctgcagcctgagactggt

SEQ ID NO: 726576 - DNA, 25 bp, Mus musculus
gtctgccctgccactaaattccgtt

SEQ ID NO: 726577 - DNA, 25 bp, Mus musculus
gtctgccctgcctctaaattccgtt

SEQ ID NO: 726578 - DNA, 25 bp, Mus musculus
gtctgccggctgacttcgtggctgt

SEQ ID NO: 726579 - DNA, 25 bp, Mus musculus
gtctgccggctgtcttcgtggctgt

SEQ ID NO: 726580 - DNA, 25 bp, Mus musculus
gtctgcctacttctctcactgaagt

SEQ ID NO: 726581 - DNA, 25 bp, Mus musculus
gtctgcctacttgtctcactgaagt

SEQ ID NO: 726582 - DNA, 25 bp, Mus musculus
gtctgcctgaatccatcattgcagc

SEQ ID NO: 726583 - DNA, 25 bp, Mus musculus
gtctgcctgaatgcatcattgcagc

SEQ ID NO: 726584 - DNA, 25 bp, Mus musculus
gtctgcgaccggacgcctctaggtg

SEQ ID NO: 726585 - DNA, 25 bp, Mus musculus
gtctgcgaccggtcgcctctaggtg

SEQ ID NO: 726586 - DNA, 25 bp, Mus musculus
gtctgcgatggccactgcctcggct

SEQ ID NO: 726587 - DNA, 25 bp, Mus musculus
gtctgcgatggcgactgcctcggct

SEQ ID NO: 726588 - DNA, 25 bp, Mus musculus
gtctgcgcagttcgagcacacagtc

SEQ ID NO: 726589 - DNA, 25 bp, Mus musculus
gtctgcgcagttggagcacacagtc

SEQ ID NO: 726590 - DNA, 25 bp, Mus musculus
gtctgcgcgcacagctgctccgggt

SEQ ID NO: 726591 - DNA, 25 bp, Mus musculus
gtctgcgcgcactgctgctccgggt

SEQ ID NO: 726592 - DNA, 25 bp, Mus musculus
gtctgcggtgtcacctgggcttggg

SEQ ID NO: 726593 - DNA, 25 bp, Mus musculus
gtctgcggtgtctcctgggcttggg

SEQ ID NO: 726594 - DNA, 25 bp, Mus musculus
gtctgctacctgctgatcatccgga

SEQ ID NO: 726595 - DNA, 25 bp, Mus musculus
gtctgctacctggtgatcatccgga

SEQ ID NO: 726596 - DNA, 25 bp, Mus musculus
gtctgctacgacacctgcggtgcca

SEQ ID NO: 726597 - DNA, 25 bp, Mus musculus
gtctgctacgactcctgcggtgcca

SEQ ID NO: 726598 - DNA, 25 bp, Mus musculus
gtctgctcaggaagagactcccagg

SEQ ID NO: 726599 - DNA, 25 bp, Mus musculus
gtctgctcaggatgagactcccagg

SEQ ID NO: 726600 - DNA, 25 bp, Mus musculus
gtctgctcatcacaggcaacacggg

SEQ ID NO: 726601 - DNA, 25 bp, Mus musculus
gtctgctcatcagaggcaacacggg

SEQ ID NO: 726602 - DNA, 25 bp, Mus musculus
gtctgctccccaacctgaagaatgt

SEQ ID NO: 726603 - DNA, 25 bp, Mus musculus
gtctgctccccatcctgaagaatgt

SEQ ID NO: 726604 - DNA, 25 bp, Mus musculus
gtctgctccgagacagctacgggcg

SEQ ID NO: 726605 - DNA, 25 bp, Mus musculus
gtctgctccgagtcagctacgggcg

SEQ ID NO: 726606 - DNA, 25 bp, Mus musculus
gtctgctctcccagaacctgtctgt

SEQ ID NO: 726607 - DNA, 25 bp, Mus musculus
gtctgctctccctgaacctgtctgt

SEQ ID NO: 726608 - DNA, 25 bp, Mus musculus
gtctgctctgaaaggtgcccacaca

SEQ ID NO: 726609 - DNA, 25 bp, Mus musculus
gtctgctctgaatggtgcccacaca

SEQ ID NO: 726610 - DNA, 25 bp, Mus musculus
gtctgctctgagatcttccgcgcgc

SEQ ID NO: 726611 - DNA, 25 bp, Mus musculus
gtctgctctgagttcttccgcgcgc

SEQ ID NO: 726612 - DNA, 25 bp, Mus musculus
gtctgctcttttcagaagtctggac

SEQ ID NO: 726613 - DNA, 25 bp, Mus musculus
gtctgctcttttgagaagtctggac

SEQ ID NO: 726614 - DNA, 25 bp, Mus musculus
gtctgctgtacaagaaggagaagcc

SEQ ID NO: 726615 - DNA, 25 bp, Mus musculus
gtctgctgtacatgaaggagaagcc

SEQ ID NO: 726616 - DNA, 25 bp, Mus musculus
gtctgcttaggtcgttggctatccc

SEQ ID NO: 726617 - DNA, 25 bp, Mus musculus
gtctgcttaggtggttggctatccc

SEQ ID NO: 726618 - DNA, 25 bp, Mus musculus
gtctgcttcagactttgaacagcaa

SEQ ID NO: 726619 - DNA, 25 bp, Mus musculus
gtctgcttcagagtttgaacagcaa

SEQ ID NO: 726620 - DNA, 25 bp, Mus musculus
gtctgctttggacacttcccgacag

SEQ ID NO: 726621 - DNA, 25 bp, Mus musculus
gtctgctttggagacttcccgacag

SEQ ID NO: 726622 - DNA, 25 bp, Mus musculus
gtctggaaccgcactgaactgctgg

SEQ ID NO: 726623 - DNA, 25 bp, Mus musculus
gtctggaaccgctctgaactgctgg

SEQ ID NO: 726624 - DNA, 25 bp, Mus musculus
gtctggaagatcaccaaaatcaaca

SEQ ID NO: 726625 - DNA, 25 bp, Mus musculus
gtctggaagatctccaaaatcaaca

SEQ ID NO: 726626 - DNA, 25 bp, Mus musculus
gtctggaaggcacgcagcgcttcaa

SEQ ID NO: 726627 - DNA, 25 bp, Mus musculus
gtctggaaggcaggcagcgcttcaa

SEQ ID NO: 726628 - DNA, 25 bp, Mus musculus
gtctggacgctgatgccaccggtcg

SEQ ID NO: 726629 - DNA, 25 bp, Mus musculus
gtctggacgctgttgccaccggtcg

SEQ ID NO: 726630 - DNA, 25 bp, Mus musculus
gtctggagagcccaattgcctgctc

SEQ ID NO: 726631 - DNA, 25 bp, Mus musculus
gtctggagagccgaattgcctgctc

SEQ ID NO: 726632 - DNA, 25 bp, Mus musculus
gtctggagatccctgccatggacga

SEQ ID NO: 726633 - DNA, 25 bp, Mus musculus
gtctggagatccgtgccatggacga

SEQ ID NO: 726634 - DNA, 25 bp, Mus musculus
gtctggagcaacagaagcagactgt

SEQ ID NO: 726635 - DNA, 25 bp, Mus musculus
gtctggagcaactgaagcagactgt

SEQ ID NO: 726636 - DNA, 25 bp, Mus musculus
gtctggagcactcgaacctggacag

SEQ ID NO: 726637 - DNA, 25 bp, Mus musculus
gtctggagcactggaacctggacag

SEQ ID NO: 726638 - DNA, 25 bp, Mus musculus
gtctggagccaaagtcatcttgtct

SEQ ID NO: 726639 - DNA, 25 bp, Mus musculus
gtctggagccaatgtcatcttgtct

SEQ ID NO: 726640 - DNA, 25 bp, Mus musculus
gtctggataggaatcaagaagttac

SEQ ID NO: 726641 - DNA, 25 bp, Mus musculus
gtctggataggattcaagaagttac

SEQ ID NO: 726642 - DNA, 25 bp, Mus musculus
gtctggatgcctacaacagtctgac

SEQ ID NO: 726643 - DNA, 25 bp, Mus musculus
gtctggatgccttcaacagtctgac

SEQ ID NO: 726644 - DNA, 25 bp, Mus musculus
gtctggcaggaaagctggatgccct

SEQ ID NO: 726645 - DNA, 25 bp, Mus musculus
gtctggcaggaatgctggatgccct

SEQ ID NO: 726646 - DNA, 25 bp, Mus musculus
gtctggcaggttaatacttctcgga

SEQ ID NO: 726647 - DNA, 25 bp, Mus musculus
gtctggcaggtttatacttctcgga

SEQ ID NO: 726648 - DNA, 25 bp, Mus musculus
gtctggcccggaacaaggcccggct

SEQ ID NO: 726649 - DNA, 25 bp, Mus musculus
gtctggcccggatcaaggcccggct

SEQ ID NO: 726650 - DNA, 25 bp, Mus musculus
gtctggccggtcacctgacatgaag

SEQ ID NO: 726651 - DNA, 25 bp, Mus musculus
gtctggccggtctcctgacatgaag

SEQ ID NO: 726652 - DNA, 25 bp, Mus musculus
gtctggcctttaccgcttcatcctt

SEQ ID NO: 726653 - DNA, 25 bp, Mus musculus
gtctggcctttagcgcttcatcctt

SEQ ID NO: 726654 - DNA, 25 bp, Mus musculus
gtctggctccagagccggcagccat

SEQ ID NO: 726655 - DNA, 25 bp, Mus musculus
gtctggctccagtgccggcagccat

SEQ ID NO: 726656 - DNA, 25 bp, Mus musculus
gtctggcttcctctttcaactgcat

SEQ ID NO: 726657 - DNA, 25 bp, Mus musculus
gtctggcttcctgtttcaactgcat

SEQ ID NO: 726658 - DNA, 25 bp, Mus musculus
gtctgggacccacgcaatgtcagaa

SEQ ID NO: 726659 - DNA, 25 bp, Mus musculus
gtctgggacccaggcaatgtcagaa

SEQ ID NO: 726660 - DNA, 25 bp, Mus musculus
gtctgggagttcagttccacctgag

SEQ ID NO: 726661 - DNA, 25 bp, Mus musculus
gtctgggagttctgttccacctgag

SEQ ID NO: 726662 - DNA, 25 bp, Mus musculus
gtctgggcagccctgcaggttccct

SEQ ID NO: 726663 - DNA, 25 bp, Mus musculus
gtctgggcagccgtgcaggttccct

SEQ ID NO: 726664 - DNA, 25 bp, Mus musculus
gtctgggccataactgtggaggaaa

SEQ ID NO: 726665 - DNA, 25 bp, Mus musculus
gtctgggccatatctgtggaggaaa

SEQ ID NO: 726666 - DNA, 25 bp, Mus musculus
gtctgggcttcgctacccgtaccgt

SEQ ID NO: 726667 - DNA, 25 bp, Mus musculus
gtctgggcttcggtacccgtaccgt

SEQ ID NO: 726668 - DNA, 25 bp, Mus musculus
gtctgggttggaaaagactcccagg

SEQ ID NO: 726669 - DNA, 25 bp, Mus musculus
gtctgggttggataagactcccagg

SEQ ID NO: 726670 - DNA, 25 bp, Mus musculus
gtctggtcagcccagccgaaaggcc

SEQ ID NO: 726671 - DNA, 25 bp, Mus musculus
gtctggtcagccgagccgaaaggcc

SEQ ID NO: 726672 - DNA, 25 bp, Mus musculus
gtctggtcagctacccactatgccg

SEQ ID NO: 726673 - DNA, 25 bp, Mus musculus
gtctggtcagcttcccactatgccg

SEQ ID NO: 726674 - DNA, 25 bp, Mus musculus
gtctggtgctgaagactcgtgtcag

SEQ ID NO: 726675 - DNA, 25 bp, Mus musculus
gtctggtgctgatgactcgtgtcag

SEQ ID NO: 726676 - DNA, 25 bp, Mus musculus
gtctggttcaggatcccacgaaggg

SEQ ID NO: 726677 - DNA, 25 bp, Mus musculus
gtctggttcaggttcccacgaaggg

SEQ ID NO: 726678 - DNA, 25 bp, Mus musculus
gtctggttcatcaacagtctcttca

SEQ ID NO: 726679 - DNA, 25 bp, Mus musculus
gtctggttcatctacagtctcttca

SEQ ID NO: 726680 - DNA, 25 bp, Mus musculus
gtctggttctctcaaaggctccttg

SEQ ID NO: 726681 - DNA, 25 bp, Mus musculus
gtctggttctctgaaaggctccttg

SEQ ID NO: 726682 - DNA, 25 bp, Mus musculus
gtctggtttctcaaagctctctggg

SEQ ID NO: 726683 - DNA, 25 bp, Mus musculus
gtctggtttctctaagctctctggg

SEQ ID NO: 726684 - DNA, 25 bp, Mus musculus
gtctgtaaagataccattggcttac

SEQ ID NO: 726685 - DNA, 25 bp, Mus musculus
gtctgtaaagattccattggcttac

SEQ ID NO: 726686 - DNA, 25 bp, Mus musculus
gtctgtacaactcggaagaaaactg

SEQ ID NO: 726687 - DNA, 25 bp, Mus musculus
gtctgtacaactgggaagaaaactg

SEQ ID NO: 726688 - DNA, 25 bp, Mus musculus
gtctgtacctggagagccaggaaga

SEQ ID NO: 726689 - DNA, 25 bp, Mus musculus
gtctgtacctggtgagccaggaaga

SEQ ID NO: 726690 - DNA, 25 bp, Mus musculus
gtctgtagagggacgctccgctagc

SEQ ID NO: 726691 - DNA, 25 bp, Mus musculus
gtctgtagagggtcgctccgctagc

SEQ ID NO: 726692 - DNA, 25 bp, Mus musculus
gtctgtagccatcccggtgactgag

SEQ ID NO: 726693 - DNA, 25 bp, Mus musculus
gtctgtagccatgccggtgactgag

SEQ ID NO: 726694 - DNA, 25 bp, Mus musculus
gtctgtcaacagaatagtcctcaca

SEQ ID NO: 726695 - DNA, 25 bp, Mus musculus
gtctgtcaacagtatagtcctcaca

SEQ ID NO: 726696 - DNA, 25 bp, Mus musculus
gtctgtcaaccacggctttgaggct

SEQ ID NO: 726697 - DNA, 25 bp, Mus musculus
gtctgtcaaccagggctttgaggct

SEQ ID NO: 726698 - DNA, 25 bp, Mus musculus
gtctgtcactgtaggctgcttcgcc

SEQ ID NO: 726699 - DNA, 25 bp, Mus musculus
gtctgtcactgttggctgcttcgcc

SEQ ID NO: 726700 - DNA, 25 bp, Mus musculus
gtctgtcagaaacatggatcttggg

SEQ ID NO: 726701 - DNA, 25 bp, Mus musculus
gtctgtcagaaagatggatcttggg

SEQ ID NO: 726702 - DNA, 25 bp, Mus musculus
gtctgtcatacaatgttacaataaa

SEQ ID NO: 726703 - DNA, 25 bp, Mus musculus
gtctgtcatacattgttacaataaa

SEQ ID NO: 726704 - DNA, 25 bp, Mus musculus
gtctgtcatgatagccaaccctaat

SEQ ID NO: 726705 - DNA, 25 bp, Mus musculus
gtctgtcatgattgccaaccctaat

SEQ ID NO: 726706 - DNA, 25 bp, Mus musculus
gtctgtccaccaaggtctccagtta

SEQ ID NO: 726707 - DNA, 25 bp, Mus musculus
gtctgtccaccatggtctccagtta

SEQ ID NO: 726708 - DNA, 25 bp, Mus musculus
gtctgtccccagagaagctccaaga

SEQ ID NO: 726709 - DNA, 25 bp, Mus musculus
gtctgtccccagtgaagctccaaga

SEQ ID NO: 726710 - DNA, 25 bp, Mus musculus
gtctgtcctagccttggtggcctat

SEQ ID NO: 726711 - DNA, 25 bp, Mus musculus
gtctgtcctagcgttggtggcctat

SEQ ID NO: 726712 - DNA, 25 bp, Mus musculus
gtctgtctaatgcagcagacctcca

SEQ ID NO: 726713 - DNA, 25 bp, Mus musculus
gtctgtctaatggagcagacctcca

SEQ ID NO: 726714 - DNA, 25 bp, Mus musculus
gtctgtctagaacgccactggccac

SEQ ID NO: 726715 - DNA, 25 bp, Mus musculus
gtctgtctagaaggccactggccac

SEQ ID NO: 726716 - DNA, 25 bp, Mus musculus
gtctgtctccagctatctggcacct

SEQ ID NO: 726717 - DNA, 25 bp, Mus musculus
gtctgtctccaggtatctggcacct

SEQ ID NO: 726718 - DNA, 25 bp, Mus musculus
gtctgtctgactaaacattattcaa

SEQ ID NO: 726719 - DNA, 25 bp, Mus musculus
gtctgtctgacttaacattattcaa

SEQ ID NO: 726720 - DNA, 25 bp, Mus musculus
gtctgtctgcatagtccggcgtcat

SEQ ID NO: 726721 - DNA, 25 bp, Mus musculus
gtctgtctgcattgtccggcgtcat

SEQ ID NO: 726722 - DNA, 25 bp, Mus musculus
gtctgtctgcttaaccatgttattg

SEQ ID NO: 726723 - DNA, 25 bp, Mus musculus
gtctgtctgctttaccatgttattg

SEQ ID NO: 726724 - DNA, 25 bp, Mus musculus
gtctgtgacgagaagctactacaga

SEQ ID NO: 726725 - DNA, 25 bp, Mus musculus
gtctgtgacgagtagctactacaga

SEQ ID NO: 726726 - DNA, 25 bp, Mus musculus
gtctgtgatgagaacggctctaagg

SEQ ID NO: 726727 - DNA, 25 bp, Mus musculus
gtctgtgatgagtacggctctaagg

SEQ ID NO: 726728 - DNA, 25 bp, Mus musculus
gtctgtgcagagactggatacccag

SEQ ID NO: 726729 - DNA, 25 bp, Mus musculus
gtctgtgcagagtctggatacccag

SEQ ID NO: 726730 - DNA, 25 bp, Mus musculus
gtctgtgccagacacgattgacgag

SEQ ID NO: 726731 - DNA, 25 bp, Mus musculus
gtctgtgccagagacgattgacgag

SEQ ID NO: 726732 - DNA, 25 bp, Mus musculus
gtctgtgctcctacgtgaaacctga

SEQ ID NO: 726733 - DNA, 25 bp, Mus musculus
gtctgtgctccttcgtgaaacctga

SEQ ID NO: 726734 - DNA, 25 bp, Mus musculus
gtctgtggcaatcgcaaaaagccgg

SEQ ID NO: 726735 - DNA, 25 bp, Mus musculus
gtctgtggcaatggcaaaaagccgg

SEQ ID NO: 726736 - DNA, 25 bp, Mus musculus
gtctgtggcagcacgacagtgacat

SEQ ID NO: 726737 - DNA, 25 bp, Mus musculus
gtctgtggcagctcgacagtgacat

SEQ ID NO: 726738 - DNA, 25 bp, Mus musculus
gtctgtggcattcctgcttcgtgaa

SEQ ID NO: 726739 - DNA, 25 bp, Mus musculus
gtctgtggcattgctgcttcgtgaa

SEQ ID NO: 726740 - DNA, 25 bp, Mus musculus
gtctgtggccttcatcctgttcctc

SEQ ID NO: 726741 - DNA, 25 bp, Mus musculus
gtctgtggccttgatcctgttcctc

SEQ ID NO: 726742 - DNA, 25 bp, Mus musculus
gtctgtgtccccagccatatgccat

SEQ ID NO: 726743 - DNA, 25 bp, Mus musculus
gtctgtgtcccctgccatatgccat

SEQ ID NO: 726744 - DNA, 25 bp, Mus musculus
gtctgtgttcccctccatgcacaag

SEQ ID NO: 726745 - DNA, 25 bp, Mus musculus
gtctgtgttcccgtccatgcacaag

SEQ ID NO: 726746 - DNA, 25 bp, Mus musculus
gtctgttcactacagcgcttccgct

SEQ ID NO: 726747 - DNA, 25 bp, Mus musculus
gtctgttcactagagcgcttccgct

SEQ ID NO: 726748 - DNA, 25 bp, Mus musculus
gtctgttccagacggatcaaagcct

SEQ ID NO: 726749 - DNA, 25 bp, Mus musculus
gtctgttccagagggatcaaagcct

SEQ ID NO: 726750 - DNA, 25 bp, Mus musculus
gtctgttcctgtcggcgcagtggcc

SEQ ID NO: 726751 - DNA, 25 bp, Mus musculus
gtctgttcctgtgggcgcagtggcc

SEQ ID NO: 726752 - DNA, 25 bp, Mus musculus
gtctgttcttgtattgcgggtaatt

SEQ ID NO: 726753 - DNA, 25 bp, Mus musculus
gtctgttcttgttttgcgggtaatt

SEQ ID NO: 726754 - DNA, 25 bp, Mus musculus
gtctgttgcaagacctgtccctcag

SEQ ID NO: 726755 - DNA, 25 bp, Mus musculus
gtctgttgcaagtcctgtccctcag

SEQ ID NO: 726756 - DNA, 25 bp, Mus musculus
gtctgttgcgacacaatctttccag

SEQ ID NO: 726757 - DNA, 25 bp, Mus musculus
gtctgttgcgactcaatctttccag

SEQ ID NO: 726758 - DNA, 25 bp, Mus musculus
gtctgttggactctcagtggctgac

SEQ ID NO: 726759 - DNA, 25 bp, Mus musculus
gtctgttggactgtcagtggctgac

SEQ ID NO: 726760 - DNA, 25 bp, Mus musculus
gtctgttttattactcctggtgcga

SEQ ID NO: 726761 - DNA, 25 bp, Mus musculus
gtctgttttatttctcctggtgcga

SEQ ID NO: 726762 - DNA, 25 bp, Mus musculus
gtctgttttggacaacttctgggca

SEQ ID NO: 726763 - DNA, 25 bp, Mus musculus
gtctgttttggagaacttctgggca

SEQ ID NO: 726764 - DNA, 25 bp, Mus musculus
gtcttaaaaaatcctggaggctggg

SEQ ID NO: 726765 - DNA, 25 bp, Mus musculus
gtcttaaaaaatgctggaggctggg

SEQ ID NO: 726766 - DNA, 25 bp, Mus musculus
gtcttaacctgcatcatgaagcctg

SEQ ID NO: 726767 - DNA, 25 bp, Mus musculus
gtcttaacctgcttcatgaagcctg

SEQ ID NO: 726768 - DNA, 25 bp, Mus musculus
gtcttacaagatatggacaacccag

SEQ ID NO: 726769 - DNA, 25 bp, Mus musculus
gtcttacaagatttggacaacccag

SEQ ID NO: 726770 - DNA, 25 bp, Mus musculus
gtcttacaagggactagtatgttta

SEQ ID NO: 726771 - DNA, 25 bp, Mus musculus
gtcttacaagggtctagtatgttta

SEQ ID NO: 726772 - DNA, 25 bp, Mus musculus
gtcttacagtcaatgcgagcccttg

SEQ ID NO: 726773 - DNA, 25 bp, Mus musculus
gtcttacagtcattgcgagcccttg

SEQ ID NO: 726774 - DNA, 25 bp, Mus musculus
gtcttacatacacctaaaaacatgg

SEQ ID NO: 726775 - DNA, 25 bp, Mus musculus
gtcttacatacagctaaaaacatgg

SEQ ID NO: 726776 - DNA, 25 bp, Mus musculus
gtcttactgatgatgccagcctggg

SEQ ID NO: 726777 - DNA, 25 bp, Mus musculus
gtcttactgatgttgccagcctggg

SEQ ID NO: 726778 - DNA, 25 bp, Mus musculus
gtcttagctggacacgacaaccgag

SEQ ID NO: 726779 - DNA, 25 bp, Mus musculus
gtcttagctggagacgacaaccgag

SEQ ID NO: 726780 - DNA, 25 bp, Mus musculus
gtcttaggacgtcggcattcttccc

SEQ ID NO: 726781 - DNA, 25 bp, Mus musculus
gtcttaggacgtgggcattcttccc

SEQ ID NO: 726782 - DNA, 25 bp, Mus musculus
gtcttatctcctctgggcaaggacc

SEQ ID NO: 726783 - DNA, 25 bp, Mus musculus
gtcttatctcctgtgggcaaggacc

SEQ ID NO: 726784 - DNA, 25 bp, Mus musculus
gtcttcacaagtactgaacaaaaat

SEQ ID NO: 726785 - DNA, 25 bp, Mus musculus
gtcttcacaagttctgaacaaaaat

SEQ ID NO: 726786 - DNA, 25 bp, Mus musculus
gtcttcacacaacgaactagaaaag

SEQ ID NO: 726787 - DNA, 25 bp, Mus musculus
gtcttcacacaaggaactagaaaag

SEQ ID NO: 726788 - DNA, 25 bp, Mus musculus
gtcttcacatgcaccgtatgccagg

SEQ ID NO: 726789 - DNA, 25 bp, Mus musculus
gtcttcacatgctccgtatgccagg

SEQ ID NO: 726790 - DNA, 25 bp, Mus musculus
gtcttcagattacaagtggctaaac

SEQ ID NO: 726791 - DNA, 25 bp, Mus musculus
gtcttcagattagaagtggctaaac

SEQ ID NO: 726792 - DNA, 25 bp, Mus musculus
gtcttcagggtcacaagatctacag

SEQ ID NO: 726793 - DNA, 25 bp, Mus musculus
gtcttcagggtctcaagatctacag

SEQ ID NO: 726794 - DNA, 25 bp, Mus musculus
gtcttcagtgacacagcaaccccag

SEQ ID NO: 726795 - DNA, 25 bp, Mus musculus
gtcttcagtgactcagcaaccccag

SEQ ID NO: 726796 - DNA, 25 bp, Mus musculus
gtcttcagtgccatgtttgaacatg

SEQ ID NO: 726797 - DNA, 25 bp, Mus musculus
gtcttcagtgccttgtttgaacatg

SEQ ID NO: 726798 - DNA, 25 bp, Mus musculus
gtcttcagttcaagccttatcataa

SEQ ID NO: 726799 - DNA, 25 bp, Mus musculus
gtcttcagttcatgccttatcataa

SEQ ID NO: 726800 - DNA, 25 bp, Mus musculus
gtcttcatatggcaacagttcccca

SEQ ID NO: 726801 - DNA, 25 bp, Mus musculus
gtcttcatatgggaacagttcccca

SEQ ID NO: 726802 - DNA, 25 bp, Mus musculus
gtcttcatcggtctgggcgccatca

SEQ ID NO: 726803 - DNA, 25 bp, Mus musculus
gtcttcatcggtgtgggcgccatca

SEQ ID NO: 726804 - DNA, 25 bp, Mus musculus
gtcttcatgggaaaatagggcctct

SEQ ID NO: 726805 - DNA, 25 bp, Mus musculus
gtcttcatgggataatagggcctct

SEQ ID NO: 726806 - DNA, 25 bp, Mus musculus
gtcttcatggtcacagctaggcctc

SEQ ID NO: 726807 - DNA, 25 bp, Mus musculus
gtcttcatggtctcagctaggcctc

SEQ ID NO: 726808 - DNA, 25 bp, Mus musculus
gtcttcattggtacctactacactg

SEQ ID NO: 726809 - DNA, 25 bp, Mus musculus
gtcttcattggttcctactacactg

SEQ ID NO: 726810 - DNA, 25 bp, Mus musculus
gtcttccaacacagtcttgaaaagg

SEQ ID NO: 726811 - DNA, 25 bp, Mus musculus
gtcttccaacactgtcttgaaaagg

SEQ ID NO: 726812 - DNA, 25 bp, Mus musculus
gtcttccacgcgctctccatgattg

SEQ ID NO: 726813 - DNA, 25 bp, Mus musculus
gtcttccacgcggtctccatgattg

SEQ ID NO: 726814 - DNA, 25 bp, Mus musculus
gtcttccaggacaatgtgagtctac

SEQ ID NO: 726815 - DNA, 25 bp, Mus musculus
gtcttccaggactatgtgagtctac

SEQ ID NO: 726816 - DNA, 25 bp, Mus musculus
gtcttccatagcctgctcacagaaa

SEQ ID NO: 726817 - DNA, 25 bp, Mus musculus
gtcttccatagcgtgctcacagaaa

SEQ ID NO: 726818 - DNA, 25 bp, Mus musculus
gtcttccattacaaccaggccatca

SEQ ID NO: 726819 - DNA, 25 bp, Mus musculus
gtcttccattactaccaggccatca

SEQ ID NO: 726820 - DNA, 25 bp, Mus musculus
gtcttccggccgagcttgatgggtc

SEQ ID NO: 726821 - DNA, 25 bp, Mus musculus
gtcttccggccgtgcttgatgggtc

SEQ ID NO: 726822 - DNA, 25 bp, Mus musculus
gtcttccgtgcacgctttcggcagc

SEQ ID NO: 726823 - DNA, 25 bp, Mus musculus
gtcttccgtgcaggctttcggcagc

SEQ ID NO: 726824 - DNA, 25 bp, Mus musculus
gtcttcctcattcggcatagccttg

SEQ ID NO: 726825 - DNA, 25 bp, Mus musculus
gtcttcctcattgggcatagccttg

SEQ ID NO: 726826 - DNA, 25 bp, Mus musculus
gtcttcgccgtcagtcaatgacatg

SEQ ID NO: 726827 - DNA, 25 bp, Mus musculus
gtcttcgccgtctgtcaatgacatg

SEQ ID NO: 726828 - DNA, 25 bp, Mus musculus
gtcttcggtgctccaattttaagag

SEQ ID NO: 726829 - DNA, 25 bp, Mus musculus
gtcttcggtgctgcaattttaagag

SEQ ID NO: 726830 - DNA, 25 bp, Mus musculus
gtcttcgtgcgtcgccctgagcagt

SEQ ID NO: 726831 - DNA, 25 bp, Mus musculus
gtcttcgtgcgtggccctgagcagt

SEQ ID NO: 726832 - DNA, 25 bp, Mus musculus
gtcttcgttggcctgcgactttcca

SEQ ID NO: 726833 - DNA, 25 bp, Mus musculus
gtcttcgttggcgtgcgactttcca

SEQ ID NO: 726834 - DNA, 25 bp, Mus musculus
gtcttctacttacaaaggacaatga

SEQ ID NO: 726835 - DNA, 25 bp, Mus musculus
gtcttctacttagaaaggacaatga

SEQ ID NO: 726836 - DNA, 25 bp, Mus musculus
gtcttctatgcaaacatcagtcagg

SEQ ID NO: 726837 - DNA, 25 bp, Mus musculus
gtcttctatgcatacatcagtcagg

SEQ ID NO: 726838 - DNA, 25 bp, Mus musculus
gtcttctatggcactactacaccat

SEQ ID NO: 726839 - DNA, 25 bp, Mus musculus
gtcttctatggctctactacaccat

SEQ ID NO: 726840 - DNA, 25 bp, Mus musculus
gtcttctatggtatcctcacggcca

SEQ ID NO: 726841 - DNA, 25 bp, Mus musculus
gtcttctatggtttcctcacggcca

SEQ ID NO: 726842 - DNA, 25 bp, Mus musculus
gtcttctgccccaggtggataccac

SEQ ID NO: 726843 - DNA, 25 bp, Mus musculus
gtcttctgcccctggtggataccac

SEQ ID NO: 726844 - DNA, 25 bp, Mus musculus
gtcttctgccttcacattgctcctg

SEQ ID NO: 726845 - DNA, 25 bp, Mus musculus
gtcttctgccttgacattgctcctg

SEQ ID NO: 726846 - DNA, 25 bp, Mus musculus
gtcttctgctccaggatgacacacc

SEQ ID NO: 726847 - DNA, 25 bp, Mus musculus
gtcttctgctcctggatgacacacc

SEQ ID NO: 726848 - DNA, 25 bp, Mus musculus
gtcttctgcttgagacacgctcatc

SEQ ID NO: 726849 - DNA, 25 bp, Mus musculus
gtcttctgcttgtgacacgctcatc

SEQ ID NO: 726850 - DNA, 25 bp, Mus musculus
gtcttcttcagcagctcagttcggg

SEQ ID NO: 726851 - DNA, 25 bp, Mus musculus
gtcttcttcagctgctcagttcggg

SEQ ID NO: 726852 - DNA, 25 bp, Mus musculus
gtcttcttccacactccgatgcatg

SEQ ID NO: 726853 - DNA, 25 bp, Mus musculus
gtcttcttccactctccgatgcatg

SEQ ID NO: 726854 - DNA, 25 bp, Mus musculus
gtcttcttctgcatgattctattca

SEQ ID NO: 726855 - DNA, 25 bp, Mus musculus
gtcttcttctgcttgattctattca

SEQ ID NO: 726856 - DNA, 25 bp, Mus musculus
gtcttgaaatgtctagagttactac

SEQ ID NO: 726857 - DNA, 25 bp, Mus musculus
gtcttgaaatgtgtagagttactac

SEQ ID NO: 726858 - DNA, 25 bp, Mus musculus
gtcttgaacttgatttgaagaccag

SEQ ID NO: 726859 - DNA, 25 bp, Mus musculus
gtcttgaacttgttttgaagaccag

SEQ ID NO: 726860 - DNA, 25 bp, Mus musculus
gtcttgaagaaaccgcggactaatt

SEQ ID NO: 726861 - DNA, 25 bp, Mus musculus
gtcttgaagaaagcgcggactaatt

SEQ ID NO: 726862 - DNA, 25 bp, Mus musculus
gtcttgacctgcacctgagttcttg

SEQ ID NO: 726863 - DNA, 25 bp, Mus musculus
gtcttgacctgctcctgagttcttg

SEQ ID NO: 726864 - DNA, 25 bp, Mus musculus
gtcttgagctgcactttcggaccct

SEQ ID NO: 726865 - DNA, 25 bp, Mus musculus
gtcttgagctgctctttcggaccct

SEQ ID NO: 726866 - DNA, 25 bp, Mus musculus
gtcttgatttggaggaccaacttca

SEQ ID NO: 726867 - DNA, 25 bp, Mus musculus
gtcttgatttggtggaccaacttca

SEQ ID NO: 726868 - DNA, 25 bp, Mus musculus
gtcttgcaaacaacaatctccagac

SEQ ID NO: 726869 - DNA, 25 bp, Mus musculus
gtcttgcaaacatcaatctccagac

SEQ ID NO: 726870 - DNA, 25 bp, Mus musculus
gtcttgcaatggctcttcagtcttt

SEQ ID NO: 726871 - DNA, 25 bp, Mus musculus
gtcttgcaatgggtcttcagtcttt

SEQ ID NO: 726872 - DNA, 25 bp, Mus musculus
gtcttgccacttcttagctgcgcag

SEQ ID NO: 726873 - DNA, 25 bp, Mus musculus
gtcttgccacttgttagctgcgcag

SEQ ID NO: 726874 - DNA, 25 bp, Mus musculus
gtcttgcccctcagaataaaccaga

SEQ ID NO: 726875 - DNA, 25 bp, Mus musculus
gtcttgcccctctgaataaaccaga

SEQ ID NO: 726876 - DNA, 25 bp, Mus musculus
gtcttgccgtgaccccttgtgtgta

SEQ ID NO: 726877 - DNA, 25 bp, Mus musculus
gtcttgccgtgagcccttgtgtgta

SEQ ID NO: 726878 - DNA, 25 bp, Mus musculus
gtcttgctcctgaactgcatctcca

SEQ ID NO: 726879 - DNA, 25 bp, Mus musculus
gtcttgctcctgactatcatagcgg

SEQ ID NO: 726880 - DNA, 25 bp, Mus musculus
gtcttgctcctgtactgcatctcca

SEQ ID NO: 726881 - DNA, 25 bp, Mus musculus
gtcttgctcctgtctatcatagcgg

SEQ ID NO: 726882 - DNA, 25 bp, Mus musculus
gtcttgctggatccgcagtgatgtc

SEQ ID NO: 726883 - DNA, 25 bp, Mus musculus
gtcttgctggatgcgcagtgatgtc

SEQ ID NO: 726884 - DNA, 25 bp, Mus musculus
gtcttgcttccacccactgtttcgg

SEQ ID NO: 726885 - DNA, 25 bp, Mus musculus
gtcttgcttccagccactgtttcgg

SEQ ID NO: 726886 - DNA, 25 bp, Mus musculus
gtcttggaagcacagaatacagggc

SEQ ID NO: 726887 - DNA, 25 bp, Mus musculus
gtcttggaagcagagaatacagggc

SEQ ID NO: 726888 - DNA, 25 bp, Mus musculus
gtcttggagccactaacttgggcaa

SEQ ID NO: 726889 - DNA, 25 bp, Mus musculus
gtcttggagccagtaacttgggcaa

SEQ ID NO: 726890 - DNA, 25 bp, Mus musculus
gtcttggataaacttcttctctatt

SEQ ID NO: 726891 - DNA, 25 bp, Mus musculus
gtcttggataaagttcttctctatt

SEQ ID NO: 726892 - DNA, 25 bp, Mus musculus
gtcttggatgacacagccagccagc

SEQ ID NO: 726893 - DNA, 25 bp, Mus musculus
gtcttggatgactcagccagccagc

SEQ ID NO: 726894 - DNA, 25 bp, Mus musculus
gtcttggcacaaatacatgtgcaac

SEQ ID NO: 726895 - DNA, 25 bp, Mus musculus
gtcttggcacaattacatgtgcaac

SEQ ID NO: 726896 - DNA, 25 bp, Mus musculus
gtcttggcatggacacacctattaa

SEQ ID NO: 726897 - DNA, 25 bp, Mus musculus
gtcttggcatggtcacacctattaa

SEQ ID NO: 726898 - DNA, 25 bp, Mus musculus
gtcttggctacacgattatccacca

SEQ ID NO: 726899 - DNA, 25 bp, Mus musculus
gtcttggctacaggattatccacca

SEQ ID NO: 726900 - DNA, 25 bp, Mus musculus
gtcttggctgcccttctctgacctt

SEQ ID NO: 726901 - DNA, 25 bp, Mus musculus
gtcttggctgccgttctctgacctt

SEQ ID NO: 726902 - DNA, 25 bp, Mus musculus
gtcttgggaccacgcttcagcgacc

SEQ ID NO: 726903 - DNA, 25 bp, Mus musculus
gtcttgggaccaggcttcagcgacc

SEQ ID NO: 726904 - DNA, 25 bp, Mus musculus
gtcttggtgcgcattctattctctg

SEQ ID NO: 726905 - DNA, 25 bp, Mus musculus
gtcttggtgcgctttctattctctg

SEQ ID NO: 726906 - DNA, 25 bp, Mus musculus
gtcttgtgatatccctgtatttgag

SEQ ID NO: 726907 - DNA, 25 bp, Mus musculus
gtcttgtgatatgcctgtatttgag

SEQ ID NO: 726908 - DNA, 25 bp, Mus musculus
gtcttgttcattaccgcttgacgtt

SEQ ID NO: 726909 - DNA, 25 bp, Mus musculus
gtcttgttcatttccgcttgacgtt

SEQ ID NO: 726910 - DNA, 25 bp, Mus musculus
gtctttaaagccaagcaccgtcaga

SEQ ID NO: 726911 - DNA, 25 bp, Mus musculus
gtctttaaagcctagcaccgtcaga

SEQ ID NO: 726912 - DNA, 25 bp, Mus musculus
gtctttaaagcgatcgggacagata

SEQ ID NO: 726913 - DNA, 25 bp, Mus musculus
gtctttaaagcgttcgggacagata

SEQ ID NO: 726914 - DNA, 25 bp, Mus musculus
gtctttaagcatcacgcctggttca

SEQ ID NO: 726915 - DNA, 25 bp, Mus musculus
gtctttaagcatgacgcctggttca

SEQ ID NO: 726916 - DNA, 25 bp, Mus musculus
gtctttaccaaacaggaacagattt

SEQ ID NO: 726917 - DNA, 25 bp, Mus musculus
gtctttaccaaagaggaacagattt

SEQ ID NO: 726918 - DNA, 25 bp, Mus musculus
gtctttaccagtattgacaattgtg

SEQ ID NO: 726919 - DNA, 25 bp, Mus musculus
gtctttaccagttttgacaattgtg

SEQ ID NO: 726920 - DNA, 25 bp, Mus musculus
gtctttagcaagcaagctcatggag

SEQ ID NO: 726921 - DNA, 25 bp, Mus musculus
gtctttagcaaggaagctcatggag

SEQ ID NO: 726922 - DNA, 25 bp, Mus musculus
gtctttatgtcacaagccgggcgcc

SEQ ID NO: 726923 - DNA, 25 bp, Mus musculus
gtctttatgtcagaagccgggcgcc

SEQ ID NO: 726924 - DNA, 25 bp, Mus musculus
gtctttcaccatccagggactgcca

SEQ ID NO: 726925 - DNA, 25 bp, Mus musculus
gtctttcaccatgcagggactgcca

SEQ ID NO: 726926 - DNA, 25 bp, Mus musculus
gtctttcactaaatgaacgtttcag

SEQ ID NO: 726927 - DNA, 25 bp, Mus musculus
gtctttcactaattgaacgtttcag

SEQ ID NO: 726928 - DNA, 25 bp, Mus musculus
gtctttcatgatatccgaaatggct

SEQ ID NO: 726929 - DNA, 25 bp, Mus musculus
gtctttcatgatttccgaaatggct

SEQ ID NO: 726930 - DNA, 25 bp, Mus musculus
gtctttccaagaacactgcaagcgc

SEQ ID NO: 726931 - DNA, 25 bp, Mus musculus
gtctttccaagatcactgcaagcgc

SEQ ID NO: 726932 - DNA, 25 bp, Mus musculus
gtctttcctggaattctaatctgag

SEQ ID NO: 726933 - DNA, 25 bp, Mus musculus
gtctttcctggatttctaatctgag

SEQ ID NO: 726934 - DNA, 25 bp, Mus musculus
gtctttcggagcagctggtgaaaca

SEQ ID NO: 726935 - DNA, 25 bp, Mus musculus
gtctttcggagctgctggtgaaaca

SEQ ID NO: 726936 - DNA, 25 bp, Mus musculus
gtctttcggatactgctgactaggg

SEQ ID NO: 726937 - DNA, 25 bp, Mus musculus
gtctttcggatagtgctgactaggg

SEQ ID NO: 726938 - DNA, 25 bp, Mus musculus
gtctttcgtcccagcaacccttggg

SEQ ID NO: 726939 - DNA, 25 bp, Mus musculus
gtctttcgtccctgcaacccttggg

SEQ ID NO: 726940 - DNA, 25 bp, Mus musculus
gtctttcttgagagcaggtgctgct

SEQ ID NO: 726941 - DNA, 25 bp, Mus musculus
gtctttcttgagtgcaggtgctgct

SEQ ID NO: 726942 - DNA, 25 bp, Mus musculus
gtctttgaaatgcttcttggtggag

SEQ ID NO: 726943 - DNA, 25 bp, Mus musculus
gtctttgaaatggttcttggtggag

SEQ ID NO: 726944 - DNA, 25 bp, Mus musculus
gtctttgaagacagcaaggttcctg

SEQ ID NO: 726945 - DNA, 25 bp, Mus musculus
gtctttgaagactgcaaggttcctg

SEQ ID NO: 726946 - DNA, 25 bp, Mus musculus
gtctttgaattcatccaaaactgaa

SEQ ID NO: 726947 - DNA, 25 bp, Mus musculus
gtctttgaattcttccaaaactgaa

SEQ ID NO: 726948 - DNA, 25 bp, Mus musculus
gtctttgacaacaggcttcagggcc

SEQ ID NO: 726949 - DNA, 25 bp, Mus musculus
gtctttgacaactggcttcagggcc

SEQ ID NO: 726950 - DNA, 25 bp, Mus musculus
gtctttgacatcatccagtttgcaa

SEQ ID NO: 726951 - DNA, 25 bp, Mus musculus
gtctttgacatcttccagtttgcaa

SEQ ID NO: 726952 - DNA, 25 bp, Mus musculus
gtctttgacccactgcgcttttctc

SEQ ID NO: 726953 - DNA, 25 bp, Mus musculus
gtctttgacccagtgcgcttttctc

SEQ ID NO: 726954 - DNA, 25 bp, Mus musculus
gtctttgacctaaagcatgtgccag

SEQ ID NO: 726955 - DNA, 25 bp, Mus musculus
gtctttgacctatagcatgtgccag

SEQ ID NO: 726956 - DNA, 25 bp, Mus musculus
gtctttgatgccaccttggtcccct

SEQ ID NO: 726957 - DNA, 25 bp, Mus musculus
gtctttgatgcctccttggtcccct

SEQ ID NO: 726958 - DNA, 25 bp, Mus musculus
gtctttgcagcactgataaagcagt

SEQ ID NO: 726959 - DNA, 25 bp, Mus musculus
gtctttgcagcagtgataaagcagt

SEQ ID NO: 726960 - DNA, 25 bp, Mus musculus
gtctttgccggtctgaccaccacag

SEQ ID NO: 726961 - DNA, 25 bp, Mus musculus
gtctttgccggtgtgaccaccacag

SEQ ID NO: 726962 - DNA, 25 bp, Mus musculus
gtctttgcggagagcctcagtgaca

SEQ ID NO: 726963 - DNA, 25 bp, Mus musculus
gtctttgcggagtgcctcagtgaca

SEQ ID NO: 726964 - DNA, 25 bp, Mus musculus
gtctttgctgcacgttcttcccaca

SEQ ID NO: 726965 - DNA, 25 bp, Mus musculus
gtctttgctgcaggttcttcccaca

SEQ ID NO: 726966 - DNA, 25 bp, Mus musculus
gtctttggcaaaaaacacagatgtg

SEQ ID NO: 726967 - DNA, 25 bp, Mus musculus
gtctttggcaaataacacagatgtg

SEQ ID NO: 726968 - DNA, 25 bp, Mus musculus
gtctttgggcacaaccagcagcacc

SEQ ID NO: 726969 - DNA, 25 bp, Mus musculus
gtctttgggcactaccagcagcacc

SEQ ID NO: 726970 - DNA, 25 bp, Mus musculus
gtctttgggtgtctattcagcatta

SEQ ID NO: 726971 - DNA, 25 bp, Mus musculus
gtctttgggtgtgtattcagcatta

SEQ ID NO: 726972 - DNA, 25 bp, Mus musculus
gtctttggtgctcttgcctactagg

SEQ ID NO: 726973 - DNA, 25 bp, Mus musculus
gtctttggtgctgttgcctactagg

SEQ ID NO: 726974 - DNA, 25 bp, Mus musculus
gtctttgtactaagcatcgggtctc

SEQ ID NO: 726975 - DNA, 25 bp, Mus musculus
gtctttgtactatgcatcgggtctc

SEQ ID NO: 726976 - DNA, 25 bp, Mus musculus
gtctttgtagacatcgattccatca

SEQ ID NO: 726977 - DNA, 25 bp, Mus musculus
gtctttgtagacttcgattccatca

SEQ ID NO: 726978 - DNA, 25 bp, Mus musculus
gtctttgtctctagggtgatcacca

SEQ ID NO: 726979 - DNA, 25 bp, Mus musculus
gtctttgtctcttgggtgatcacca

SEQ ID NO: 726980 - DNA, 25 bp, Mus musculus
gtcttttcagctatgaagtcttaca

SEQ ID NO: 726981 - DNA, 25 bp, Mus musculus
gtcttttcagctttgaagtcttaca

SEQ ID NO: 726982 - DNA, 25 bp, Mus musculus
gtcttttcgctgctcactggcagac

SEQ ID NO: 726983 - DNA, 25 bp, Mus musculus
gtcttttcgctggtcactggcagac

SEQ ID NO: 726984 - DNA, 25 bp, Mus musculus
gtcttttctcatcgtctcggagcct

SEQ ID NO: 726985 - DNA, 25 bp, Mus musculus
gtcttttctcatggtctcggagcct

SEQ ID NO: 726986 - DNA, 25 bp, Mus musculus
gtcttttgggtccatgtaccccaca

SEQ ID NO: 726987 - DNA, 25 bp, Mus musculus
gtcttttgggtcgatgtaccccaca

SEQ ID NO: 726988 - DNA, 25 bp, Mus musculus
gtgaaaaaggaacgccagcagtctt

SEQ ID NO: 726989 - DNA, 25 bp, Mus musculus
gtgaaaaaggaaggccagcagtctt

SEQ ID NO: 726990 - DNA, 25 bp, Mus musculus
gtgaaaacacagaagtaacgtccgg

SEQ ID NO: 726991 - DNA, 25 bp, Mus musculus
gtgaaaacacagtagtaacgtccgg

SEQ ID NO: 726992 - DNA, 25 bp, Mus musculus
gtgaaaacagctacccttgccactg

SEQ ID NO: 726993 - DNA, 25 bp, Mus musculus
gtgaaaacagcttcccttgccactg

SEQ ID NO: 726994 - DNA, 25 bp, Mus musculus
gtgaaaactcggctacagcggccag

SEQ ID NO: 726995 - DNA, 25 bp, Mus musculus
gtgaaaactcgggtacagcggccag

SEQ ID NO: 726996 - DNA, 25 bp, Mus musculus
gtgaaaagcctcaatcccctgacat

SEQ ID NO: 726997 - DNA, 25 bp, Mus musculus
gtgaaaagcctctatcccctgacat

SEQ ID NO: 726998 - DNA, 25 bp, Mus musculus
gtgaaaaggttcacagggcacgagc

SEQ ID NO: 726999 - DNA, 25 bp, Mus musculus
gtgaaaaggttctcagggcacgagc

SEQ ID NO: 727000 - DNA, 25 bp, Mus musculus
gtgaaaatagtgaagcaaaaaagaa

SEQ ID NO: 727001 - DNA, 25 bp, Mus musculus
gtgaaaatagtgtagcaaaaaagaa

SEQ ID NO: 727002 - DNA, 25 bp, Mus musculus
gtgaaaatgtcaccgccagagggtc

SEQ ID NO: 727003 - DNA, 25 bp, Mus musculus
gtgaaaatgtcagcgccagagggtc

SEQ ID NO: 727004 - DNA, 25 bp, Mus musculus
gtgaaaatgtggagccccgagagcc

SEQ ID NO: 727005 - DNA, 25 bp, Mus musculus
gtgaaaatgtggtgccccgagagcc

SEQ ID NO: 727006 - DNA, 25 bp, Mus musculus
gtgaaaccatctccaacttgctcca

SEQ ID NO: 727007 - DNA, 25 bp, Mus musculus
gtgaaaccatctgcaacttgctcca

SEQ ID NO: 727008 - DNA, 25 bp, Mus musculus
gtgaaaccccgccttgcagtcaaca

SEQ ID NO: 727009 - DNA, 25 bp, Mus musculus
gtgaaaccccgcgttgcagtcaaca

SEQ ID NO: 727010 - DNA, 25 bp, Mus musculus
gtgaaacctacacatagctgcctct

SEQ ID NO: 727011 - DNA, 25 bp, Mus musculus
gtgaaacctacagatagctgcctct

SEQ ID NO: 727012 - DNA, 25 bp, Mus musculus
gtgaaacctttgacccctaccacat

SEQ ID NO: 727013 - DNA, 25 bp, Mus musculus
gtgaaacctttgtcccctaccacat

SEQ ID NO: 727014 - DNA, 25 bp, Mus musculus
gtgaaacgcaaaacgcgccgaagcc

SEQ ID NO: 727015 - DNA, 25 bp, Mus musculus
gtgaaacgcaaatcgcgccgaagcc

SEQ ID NO: 727016 - DNA, 25 bp, Mus musculus
gtgaaacgcttcaacagtgctaatg

SEQ ID NO: 727017 - DNA, 25 bp, Mus musculus
gtgaaacgcttctacagtgctaatg

SEQ ID NO: 727018 - DNA, 25 bp, Mus musculus
gtgaaactcataacctttccacagg

SEQ ID NO: 727019 - DNA, 25 bp, Mus musculus
gtgaaactcatatcctttccacagg

SEQ ID NO: 727020 - DNA, 25 bp, Mus musculus
gtgaaactggttcttgccaagctgt

SEQ ID NO: 727021 - DNA, 25 bp, Mus musculus
gtgaaactggttgttgccaagctgt

SEQ ID NO: 727022 - DNA, 25 bp, Mus musculus
gtgaaactgtcgcagcgatcgccct

SEQ ID NO: 727023 - DNA, 25 bp, Mus musculus
gtgaaactgtcggagcgatcgccct

SEQ ID NO: 727024 - DNA, 25 bp, Mus musculus
gtgaaactgtctctctgaccttggg

SEQ ID NO: 727025 - DNA, 25 bp, Mus musculus
gtgaaactgtctgtctgaccttggg

SEQ ID NO: 727026 - DNA, 25 bp, Mus musculus
gtgaaagacttcatgacaactcccc

SEQ ID NO: 727027 - DNA, 25 bp, Mus musculus
gtgaaagacttcttgacaactcccc

SEQ ID NO: 727028 - DNA, 25 bp, Mus musculus
gtgaaagatgtgagctctgcaagat

SEQ ID NO: 727029 - DNA, 25 bp, Mus musculus
gtgaaagatgtgtgctctgcaagat

SEQ ID NO: 727030 - DNA, 25 bp, Mus musculus
gtgaaagcaagtcaccgcgggcctt

SEQ ID NO: 727031 - DNA, 25 bp, Mus musculus
gtgaaagcaagtgaccgcgggcctt

SEQ ID NO: 727032 - DNA, 25 bp, Mus musculus
gtgaaagcagccattaaacatgccc

SEQ ID NO: 727033 - DNA, 25 bp, Mus musculus
gtgaaagcagcctttaaacatgccc

SEQ ID NO: 727034 - DNA, 25 bp, Mus musculus
gtgaaagcctggaaagaagctcagc

SEQ ID NO: 727035 - DNA, 25 bp, Mus musculus
gtgaaagcctggtaagaagctcagc

SEQ ID NO: 727036 - DNA, 25 bp, Mus musculus
gtgaaagctatgaactccacatcta

SEQ ID NO: 727037 - DNA, 25 bp, Mus musculus
gtgaaagctatgtactccacatcta

SEQ ID NO: 727038 - DNA, 25 bp, Mus musculus
gtgaaagtcaacataatcggagaag

SEQ ID NO: 727039 - DNA, 25 bp, Mus musculus
gtgaaagtcaacttaatcggagaag

SEQ ID NO: 727040 - DNA, 25 bp, Mus musculus
gtgaaagtgaatagggcaacaaccc

SEQ ID NO: 727041 - DNA, 25 bp, Mus musculus
gtgaaagtgaattgggcaacaaccc

SEQ ID NO: 727042 - DNA, 25 bp, Mus musculus
gtgaaatccaaaattggtgaattgg

SEQ ID NO: 727043 - DNA, 25 bp, Mus musculus
gtgaaatccaaatttggtgaattgg

SEQ ID NO: 727044 - DNA, 25 bp, Mus musculus
gtgaaatctttgctgcacacggact

SEQ ID NO: 727045 - DNA, 25 bp, Mus musculus
gtgaaatctttggtgcacacggact

SEQ ID NO: 727046 - DNA, 25 bp, Mus musculus
gtgaaatgactaaagaaattgctga

SEQ ID NO: 727047 - DNA, 25 bp, Mus musculus
gtgaaatgactatagaaattgctga

SEQ ID NO: 727048 - DNA, 25 bp, Mus musculus
gtgaaattagccatagaacatctta

SEQ ID NO: 727049 - DNA, 25 bp, Mus musculus
gtgaaattagccttagaacatctta

SEQ ID NO: 727050 - DNA, 25 bp, Mus musculus
gtgaaattgctgaaggaccagctcc

SEQ ID NO: 727051 - DNA, 25 bp, Mus musculus
gtgaaattgctgtaggaccagctcc

SEQ ID NO: 727052 - DNA, 25 bp, Mus musculus
gtgaacaacacaacttgcagtctta

SEQ ID NO: 727053 - DNA, 25 bp, Mus musculus
gtgaacaacacatcttgcagtctta

SEQ ID NO: 727054 - DNA, 25 bp, Mus musculus
gtgaacaagcctcgcactttcttct

SEQ ID NO: 727055 - DNA, 25 bp, Mus musculus
gtgaacaagcctggcactttcttct

SEQ ID NO: 727056 - DNA, 25 bp, Mus musculus
gtgaacaatgtgcatgctgctgttg

SEQ ID NO: 727057 - DNA, 25 bp, Mus musculus
gtgaacaatgtggatgctgctgttg

SEQ ID NO: 727058 - DNA, 25 bp, Mus musculus
gtgaacacagaacgctccttccatt

SEQ ID NO: 727059 - DNA, 25 bp, Mus musculus
gtgaacacagaaggctccttccatt

SEQ ID NO: 727060 - DNA, 25 bp, Mus musculus
gtgaacacttcgcaactatggaagc

SEQ ID NO: 727061 - DNA, 25 bp, Mus musculus
gtgaacacttcggaactatggaagc

SEQ ID NO: 727062 - DNA, 25 bp, Mus musculus
gtgaacagaaagaattagagaccct

SEQ ID NO: 727063 - DNA, 25 bp, Mus musculus
gtgaacagaaagtattagagaccct

SEQ ID NO: 727064 - DNA, 25 bp, Mus musculus
gtgaacagagtgcaggaccacatcc

SEQ ID NO: 727065 - DNA, 25 bp, Mus musculus
gtgaacagagtggaggaccacatcc

SEQ ID NO: 727066 - DNA, 25 bp, Mus musculus
gtgaacatgatacacccacagccct

SEQ ID NO: 727067 - DNA, 25 bp, Mus musculus
gtgaacatgatagacccacagccct

SEQ ID NO: 727068 - DNA, 25 bp, Mus musculus
gtgaacatgatgcagctgtacagtg

SEQ ID NO: 727069 - DNA, 25 bp, Mus musculus
gtgaacatgatggagctgtacagtg

SEQ ID NO: 727070 - DNA, 25 bp, Mus musculus
gtgaaccagtggcaggttaaccatg

SEQ ID NO: 727071 - DNA, 25 bp, Mus musculus
gtgaaccagtgggaggttaaccatg

SEQ ID NO: 727072 - DNA, 25 bp, Mus musculus
gtgaaccggttcacagaggactccc

SEQ ID NO: 727073 - DNA, 25 bp, Mus musculus
gtgaaccggttctcagaggactccc

SEQ ID NO: 727074 - DNA, 25 bp, Mus musculus
gtgaacctagcccaccatgcagggc

SEQ ID NO: 727075 - DNA, 25 bp, Mus musculus
gtgaacctagccgaccatgcagggc

SEQ ID NO: 727076 - DNA, 25 bp, Mus musculus
gtgaacctcctgaagcgctgcccgg

SEQ ID NO: 727077 - DNA, 25 bp, Mus musculus
gtgaacctcctgtagcgctgcccgg

SEQ ID NO: 727078 - DNA, 25 bp, Mus musculus
gtgaacctggcaagcttacctccca

SEQ ID NO: 727079 - DNA, 25 bp, Mus musculus
gtgaacctggcatgcttacctccca

SEQ ID NO: 727080 - DNA, 25 bp, Mus musculus
gtgaacctgttccaggcattcctta

SEQ ID NO: 727081 - DNA, 25 bp, Mus musculus
gtgaacctgttcgaggcattcctta

SEQ ID NO: 727082 - DNA, 25 bp, Mus musculus
gtgaacctgtttctagtgaacaagc

SEQ ID NO: 727083 - DNA, 25 bp, Mus musculus
gtgaacctgtttgtagtgaacaagc

SEQ ID NO: 727084 - DNA, 25 bp, Mus musculus
gtgaaccttcacagcgtcatcttct

SEQ ID NO: 727085 - DNA, 25 bp, Mus musculus
gtgaaccttcactgcgtcatcttct

SEQ ID NO: 727086 - DNA, 25 bp, Mus musculus
gtgaaccttgtgaagatctcctcca

SEQ ID NO: 727087 - DNA, 25 bp, Mus musculus
gtgaaccttgtgtagatctcctcca

SEQ ID NO: 727088 - DNA, 25 bp, Mus musculus
gtgaacgacgacagtcataccgtgc

SEQ ID NO: 727089 - DNA, 25 bp, Mus musculus
gtgaacgacgactgtcataccgtgc

SEQ ID NO: 727090 - DNA, 25 bp, Mus musculus
gtgaacgagtgccaggcagagccct

SEQ ID NO: 727091 - DNA, 25 bp, Mus musculus
gtgaacgagtgcgaggcagagccct

SEQ ID NO: 727092 - DNA, 25 bp, Mus musculus
gtgaacgatgtcaactttgagaaca

SEQ ID NO: 727093 - DNA, 25 bp, Mus musculus
gtgaacgatgtctactttgagaaca

SEQ ID NO: 727094 - DNA, 25 bp, Mus musculus
gtgaacgcaaggagcctgcctcccg

SEQ ID NO: 727095 - DNA, 25 bp, Mus musculus
gtgaacgcaaggtgcctgcctcccg

SEQ ID NO: 727096 - DNA, 25 bp, Mus musculus
gtgaacggctgtatcctcttatcca

SEQ ID NO: 727097 - DNA, 25 bp, Mus musculus
gtgaacggctgtttcctcttatcca

SEQ ID NO: 727098 - DNA, 25 bp, Mus musculus
gtgaactaccttcggactgtgaatg

SEQ ID NO: 727099 - DNA, 25 bp, Mus musculus
gtgaactaccttgggactgtgaatg

SEQ ID NO: 727100 - DNA, 25 bp, Mus musculus
gtgaactcaatgcatacagtcatga

SEQ ID NO: 727101 - DNA, 25 bp, Mus musculus
gtgaactcaatggatacagtcatga

SEQ ID NO: 727102 - DNA, 25 bp, Mus musculus
gtgaactcctccactcacactggga

SEQ ID NO: 727103 - DNA, 25 bp, Mus musculus
gtgaactcctcctctcacactggga

SEQ ID NO: 727104 - DNA, 25 bp, Mus musculus
gtgaactcgcgcagccctgctgcag

SEQ ID NO: 727105 - DNA, 25 bp, Mus musculus
gtgaactcgcgctgccctgctgcag

SEQ ID NO: 727106 - DNA, 25 bp, Mus musculus
gtgaactctcgtctctgtttcagaa

SEQ ID NO: 727107 - DNA, 25 bp, Mus musculus
gtgaactctcgtgtctgtttcagaa

SEQ ID NO: 727108 - DNA, 25 bp, Mus musculus
gtgaactgaaacaattttggtatgc

SEQ ID NO: 727109 - DNA, 25 bp, Mus musculus
gtgaactgaaactattttggtatgc

SEQ ID NO: 727110 - DNA, 25 bp, Mus musculus
gtgaactgcgaacacataaaatcat

SEQ ID NO: 727111 - DNA, 25 bp, Mus musculus
gtgaactgcgaagacataaaatcat

SEQ ID NO: 727112 - DNA, 25 bp, Mus musculus
gtgaactgcggacctggacctagca

SEQ ID NO: 727113 - DNA, 25 bp, Mus musculus
gtgaactgcggagctggacctagca

SEQ ID NO: 727114 - DNA, 25 bp, Mus musculus
gtgaacttcagcaagaacagaaccg

SEQ ID NO: 727115 - DNA, 25 bp, Mus musculus
gtgaacttcagccacgtgcagggcc

SEQ ID NO: 727116 - DNA, 25 bp, Mus musculus
gtgaacttcagcgacgtgcagggcc

SEQ ID NO: 727117 - DNA, 25 bp, Mus musculus
gtgaacttcagctagaacagaaccg

SEQ ID NO: 727118 - DNA, 25 bp, Mus musculus
gtgaacttgaccagctgcggcagga

SEQ ID NO: 727119 - DNA, 25 bp, Mus musculus
gtgaacttgacctgctgcggcagga

SEQ ID NO: 727120 - DNA, 25 bp, Mus musculus
gtgaacttgtaccacgagctgatga

SEQ ID NO: 727121 - DNA, 25 bp, Mus musculus
gtgaacttgtacgacgagctgatga

SEQ ID NO: 727122 - DNA, 25 bp, Mus musculus
gtgaactttcggctaaggtacatct

SEQ ID NO: 727123 - DNA, 25 bp, Mus musculus
gtgaactttcgggtaaggtacatct

SEQ ID NO: 727124 - DNA, 25 bp, Mus musculus
gtgaagaaccttcgggtgtccaact

SEQ ID NO: 727125 - DNA, 25 bp, Mus musculus
gtgaagaaccttggggtgtccaact

SEQ ID NO: 727126 - DNA, 25 bp, Mus musculus
gtgaagaagaaactccggccccgct

SEQ ID NO: 727127 - DNA, 25 bp, Mus musculus
gtgaagaagaaagtccggccccgct

SEQ ID NO: 727128 - DNA, 25 bp, Mus musculus
gtgaagaagactcagcacaaagtca

SEQ ID NO: 727129 - DNA, 25 bp, Mus musculus
gtgaagaagactgagcacaaagtca

SEQ ID NO: 727130 - DNA, 25 bp, Mus musculus
gtgaagaatggacccatgcagccca

SEQ ID NO: 727131 - DNA, 25 bp, Mus musculus
gtgaagaatggagccatgcagccca

SEQ ID NO: 727132 - DNA, 25 bp, Mus musculus
gtgaagacaccgctgggaccagcct

SEQ ID NO: 727133 - DNA, 25 bp, Mus musculus
gtgaagacaccggtgggaccagcct

SEQ ID NO: 727134 - DNA, 25 bp, Mus musculus
gtgaagacagcacggaatcaaccag

SEQ ID NO: 727135 - DNA, 25 bp, Mus musculus
gtgaagacagcagggaatcaaccag

SEQ ID NO: 727136 - DNA, 25 bp, Mus musculus
gtgaagaccatgagctccatctttg

SEQ ID NO: 727137 - DNA, 25 bp, Mus musculus
gtgaagaccatgtgctccatctttg

SEQ ID NO: 727138 - DNA, 25 bp, Mus musculus
gtgaagacgttccaggtgctcccta

SEQ ID NO: 727139 - DNA, 25 bp, Mus musculus
gtgaagacgttcgaggtgctcccta

SEQ ID NO: 727140 - DNA, 25 bp, Mus musculus
gtgaagagaatacctgaactttctg

SEQ ID NO: 727141 - DNA, 25 bp, Mus musculus
gtgaagagaatagctgaactttctg

SEQ ID NO: 727142 - DNA, 25 bp, Mus musculus
gtgaagagaatcatgaacccttgag

SEQ ID NO: 727143 - DNA, 25 bp, Mus musculus
gtgaagagaatcttgaacccttgag

SEQ ID NO: 727144 - DNA, 25 bp, Mus musculus
gtgaagagccccacatagtgcctga

SEQ ID NO: 727145 - DNA, 25 bp, Mus musculus
gtgaagagcccctcatagtgcctga

SEQ ID NO: 727146 - DNA, 25 bp, Mus musculus
gtgaagagctcaagaggatgctagc

SEQ ID NO: 727147 - DNA, 25 bp, Mus musculus
gtgaagagctcatgaggatgctagc

SEQ ID NO: 727148 - DNA, 25 bp, Mus musculus
gtgaagagtgaaataccagcaagga

SEQ ID NO: 727149 - DNA, 25 bp, Mus musculus
gtgaagagtgaattaccagcaagga

SEQ ID NO: 727150 - DNA, 25 bp, Mus musculus
gtgaagatccagcttatgttaaacc

SEQ ID NO: 727151 - DNA, 25 bp, Mus musculus
gtgaagatccaggttatgttaaacc

SEQ ID NO: 727152 - DNA, 25 bp, Mus musculus
gtgaagatgacaaagagtgacgatg

SEQ ID NO: 727153 - DNA, 25 bp, Mus musculus
gtgaagatgacatagagtgacgatg

SEQ ID NO: 727154 - DNA, 25 bp, Mus musculus
gtgaagcaagatccccttcagggcc

SEQ ID NO: 727155 - DNA, 25 bp, Mus musculus
gtgaagcaagatgcccttcagggcc

SEQ ID NO: 727156 - DNA, 25 bp, Mus musculus
gtgaagcagacaaagacgagagcct

SEQ ID NO: 727157 - DNA, 25 bp, Mus musculus
gtgaagcagacatagacgagagcct

SEQ ID NO: 727158 - DNA, 25 bp, Mus musculus
gtgaagcagtacaagcctgtggtct

SEQ ID NO: 727159 - DNA, 25 bp, Mus musculus
gtgaagcagtactagcctgtggtct

SEQ ID NO: 727160 - DNA, 25 bp, Mus musculus
gtgaagccaccgagatcattgaggg

SEQ ID NO: 727161 - DNA, 25 bp, Mus musculus
gtgaagccaccgtgatcattgaggg

SEQ ID NO: 727162 - DNA, 25 bp, Mus musculus
gtgaagccatcaacacccactttaa

SEQ ID NO: 727163 - DNA, 25 bp, Mus musculus
gtgaagccatcatcacccactttaa

SEQ ID NO: 727164 - DNA, 25 bp, Mus musculus
gtgaagccgggaatgccctacctgg

SEQ ID NO: 727165 - DNA, 25 bp, Mus musculus
gtgaagccgggattgccctacctgg

SEQ ID NO: 727166 - DNA, 25 bp, Mus musculus
gtgaagcgcagcagcccttcttgtg

SEQ ID NO: 727167 - DNA, 25 bp, Mus musculus
gtgaagcgcagctgcccttcttgtg

SEQ ID NO: 727168 - DNA, 25 bp, Mus musculus
gtgaagctgacaataaggaccagcc

SEQ ID NO: 727169 - DNA, 25 bp, Mus musculus
gtgaagctgacattaaggaccagcc

SEQ ID NO: 727170 - DNA, 25 bp, Mus musculus
gtgaagctgccaagactgtcctgag

SEQ ID NO: 727171 - DNA, 25 bp, Mus musculus
gtgaagctgccatgactgtcctgag

SEQ ID NO: 727172 - DNA, 25 bp, Mus musculus
gtgaagctggagacactgcccctgt

SEQ ID NO: 727173 - DNA, 25 bp, Mus musculus
gtgaagctggagtcactgcccctgt

SEQ ID NO: 727174 - DNA, 25 bp, Mus musculus
gtgaagctggccctgactcctagga

SEQ ID NO: 727175 - DNA, 25 bp, Mus musculus
gtgaagctggccgtgactcctagga

SEQ ID NO: 727176 - DNA, 25 bp, Mus musculus
gtgaagctgttacctttaagccttt

SEQ ID NO: 727177 - DNA, 25 bp, Mus musculus
gtgaagctgttagctttaagccttt

SEQ ID NO: 727178 - DNA, 25 bp, Mus musculus
gtgaagcttgaaccccattccacag

SEQ ID NO: 727179 - DNA, 25 bp, Mus musculus
gtgaagcttgaagcccattccacag

SEQ ID NO: 727180 - DNA, 25 bp, Mus musculus
gtgaaggaagtcctgctccaacaga

SEQ ID NO: 727181 - DNA, 25 bp, Mus musculus
gtgaaggaagtcgtgctccaacaga

SEQ ID NO: 727182 - DNA, 25 bp, Mus musculus
gtgaaggacttcaactttagggaag

SEQ ID NO: 727183 - DNA, 25 bp, Mus musculus
gtgaaggacttctactttagggaag

SEQ ID NO: 727184 - DNA, 25 bp, Mus musculus
gtgaaggagttcatgacgccccggc

SEQ ID NO: 727185 - DNA, 25 bp, Mus musculus
gtgaaggagttcttgacgccccggc

SEQ ID NO: 727186 - DNA, 25 bp, Mus musculus
gtgaaggcagaacccgttcacaccg

SEQ ID NO: 727187 - DNA, 25 bp, Mus musculus
gtgaaggcagaagccgttcacaccg

SEQ ID NO: 727188 - DNA, 25 bp, Mus musculus
gtgaaggctgtcaccggccccagag

SEQ ID NO: 727189 - DNA, 25 bp, Mus musculus
gtgaaggctgtctccggccccagag

SEQ ID NO: 727190 - DNA, 25 bp, Mus musculus
gtgaaggtccccaaagcagctgccg

SEQ ID NO: 727191 - DNA, 25 bp, Mus musculus
gtgaaggtcccctaagcagctgccg

SEQ ID NO: 727192 - DNA, 25 bp, Mus musculus
gtgaaggtgaagagttcaaacatcc

SEQ ID NO: 727193 - DNA, 25 bp, Mus musculus
gtgaaggtgaagtgttcaaacatcc

SEQ ID NO: 727194 - DNA, 25 bp, Mus musculus
gtgaaggttcagacattccagatga

SEQ ID NO: 727195 - DNA, 25 bp, Mus musculus
gtgaaggttcagtcattccagatga

SEQ ID NO: 727196 - DNA, 25 bp, Mus musculus
gtgaagtcagagacatttcccgctg

SEQ ID NO: 727197 - DNA, 25 bp, Mus musculus
gtgaagtcagagtcatttcccgctg

SEQ ID NO: 727198 - DNA, 25 bp, Mus musculus
gtgaagtcatccctggtgacacctt

SEQ ID NO: 727199 - DNA, 25 bp, Mus musculus
gtgaagtcatccgtggtgacacctt

SEQ ID NO: 727200 - DNA, 25 bp, Mus musculus
gtgaagtccttccaagagcttcgcc

SEQ ID NO: 727201 - DNA, 25 bp, Mus musculus
gtgaagtccttcgaagagcttcgcc

SEQ ID NO: 727202 - DNA, 25 bp, Mus musculus
gtgaagtcggccagcctgagcaaga

SEQ ID NO: 727203 - DNA, 25 bp, Mus musculus
gtgaagtcggcctgcctgagcaaga

SEQ ID NO: 727204 - DNA, 25 bp, Mus musculus
gtgaagtctgtacgcatgattgcag

SEQ ID NO: 727205 - DNA, 25 bp, Mus musculus
gtgaagtctgtaggcatgattgcag

SEQ ID NO: 727206 - DNA, 25 bp, Mus musculus
gtgaagtctgtgatgaaagcttgtg

SEQ ID NO: 727207 - DNA, 25 bp, Mus musculus
gtgaagtctgtgttgaaagcttgtg

SEQ ID NO: 727208 - DNA, 25 bp, Mus musculus
gtgaagtcttttctggctgtttgcc

SEQ ID NO: 727209 - DNA, 25 bp, Mus musculus
gtgaagtcttttgtggctgtttgcc

SEQ ID NO: 727210 - DNA, 25 bp, Mus musculus
gtgaagtgacctatgacaagacccc

SEQ ID NO: 727211 - DNA, 25 bp, Mus musculus
gtgaagtgacctttgacaagacccc

SEQ ID NO: 727212 - DNA, 25 bp, Mus musculus
gtgaagtgctaaaacagttaacaga

SEQ ID NO: 727213 - DNA, 25 bp, Mus musculus
gtgaagtgctaatacagttaacaga

SEQ ID NO: 727214 - DNA, 25 bp, Mus musculus
gtgaagttaactccctcatgggaga

SEQ ID NO: 727215 - DNA, 25 bp, Mus musculus
gtgaagttaactgcctcatgggaga

SEQ ID NO: 727216 - DNA, 25 bp, Mus musculus
gtgaagttttctccaagtggagagc

SEQ ID NO: 727217 - DNA, 25 bp, Mus musculus
gtgaagttttctgcaagtggagagc

SEQ ID NO: 727218 - DNA, 25 bp, Mus musculus
gtgaataccctgcttggtggacaga

SEQ ID NO: 727219 - DNA, 25 bp, Mus musculus
gtgaataccctggttggtggacaga

SEQ ID NO: 727220 - DNA, 25 bp, Mus musculus
gtgaatagttgtcgcggtcacagtt

SEQ ID NO: 727221 - DNA, 25 bp, Mus musculus
gtgaatagttgtggcggtcacagtt

SEQ ID NO: 727222 - DNA, 25 bp, Mus musculus
gtgaatatcagtccagaagcccatg

SEQ ID NO: 727223 - DNA, 25 bp, Mus musculus
gtgaatatcagtgcagaagcccatg

SEQ ID NO: 727224 - DNA, 25 bp, Mus musculus
gtgaatcaccccaacatggactcca

SEQ ID NO: 727225 - DNA, 25 bp, Mus musculus
gtgaatcacccctacatggactcca

SEQ ID NO: 727226 - DNA, 25 bp, Mus musculus
gtgaatcctcatcgatatgtacatg

SEQ ID NO: 727227 - DNA, 25 bp, Mus musculus
gtgaatcctcatggatatgtacatg

SEQ ID NO: 727228 - DNA, 25 bp, Mus musculus
gtgaatcttctgaatgccaacctca

SEQ ID NO: 727229 - DNA, 25 bp, Mus musculus
gtgaatcttctgtatgccaacctca

SEQ ID NO: 727230 - DNA, 25 bp, Mus musculus
gtgaatgaaactataacccagatct

SEQ ID NO: 727231 - DNA, 25 bp, Mus musculus
gtgaatgaaactttaacccagatct

SEQ ID NO: 727232 - DNA, 25 bp, Mus musculus
gtgaatgacaccaagcgaggagatg

SEQ ID NO: 727233 - DNA, 25 bp, Mus musculus
gtgaatgacacctagcgaggagatg

SEQ ID NO: 727234 - DNA, 25 bp, Mus musculus
gtgaatgacatacacatctttgaga

SEQ ID NO: 727235 - DNA, 25 bp, Mus musculus
gtgaatgacatagacatctttgaga

SEQ ID NO: 727236 - DNA, 25 bp, Mus musculus
gtgaatgagacccagctggaccagc

SEQ ID NO: 727237 - DNA, 25 bp, Mus musculus
gtgaatgagaccgagctggaccagc

SEQ ID NO: 727238 - DNA, 25 bp, Mus musculus
gtgaatgagcgtctcgaacgtgcca

SEQ ID NO: 727239 - DNA, 25 bp, Mus musculus
gtgaatgagcgtgtcgaacgtgcca

SEQ ID NO: 727240 - DNA, 25 bp, Mus musculus
gtgaatgccagcaggatcgctgtcc

SEQ ID NO: 727241 - DNA, 25 bp, Mus musculus
gtgaatgccagctggatcgctgtcc

SEQ ID NO: 727242 - DNA, 25 bp, Mus musculus
gtgaatgcccagagcagcaccaacc

SEQ ID NO: 727243 - DNA, 25 bp, Mus musculus
gtgaatgcccagtgcagcaccaacc

SEQ ID NO: 727244 - DNA, 25 bp, Mus musculus
gtgaatgcccttatcaaggagcgtg

SEQ ID NO: 727245 - DNA, 25 bp, Mus musculus
gtgaatgcccttttcaaggagcgtg

SEQ ID NO: 727246 - DNA, 25 bp, Mus musculus
gtgaatgctctgcttccagatgtgc

SEQ ID NO: 727247 - DNA, 25 bp, Mus musculus
gtgaatgctctggttccagatgtgc

SEQ ID NO: 727248 - DNA, 25 bp, Mus musculus
gtgaatggattcactaacaactact

SEQ ID NO: 727249 - DNA, 25 bp, Mus musculus
gtgaatggattctctaacaactact

SEQ ID NO: 727250 - DNA, 25 bp, Mus musculus
gtgaatgtgccgaaaatacctacaa

SEQ ID NO: 727251 - DNA, 25 bp, Mus musculus
gtgaatgtgccgtaaatacctacaa

SEQ ID NO: 727252 - DNA, 25 bp, Mus musculus
gtgaattcctcaccagcagcattgc

SEQ ID NO: 727253 - DNA, 25 bp, Mus musculus
gtgaattcctcagcagcagcattgc

SEQ ID NO: 727254 - DNA, 25 bp, Mus musculus
gtgaattctgtgagcagcgcttcac

SEQ ID NO: 727255 - DNA, 25 bp, Mus musculus
gtgaattctgtgtgcagcgcttcac

SEQ ID NO: 727256 - DNA, 25 bp, Mus musculus
gtgaatttacagaaccgccgcctct

SEQ ID NO: 727257 - DNA, 25 bp, Mus musculus
gtgaatttacagtaccgccgcctct

SEQ ID NO: 727258 - DNA, 25 bp, Mus musculus
gtgacaaaaaccacacctgaagaaa

SEQ ID NO: 727259 - DNA, 25 bp, Mus musculus
gtgacaaaaacctcacctgaagaaa

SEQ ID NO: 727260 - DNA, 25 bp, Mus musculus
gtgacaaaaggacagtattctacag

SEQ ID NO: 727261 - DNA, 25 bp, Mus musculus
gtgacaaaaggagagtattctacag

SEQ ID NO: 727262 - DNA, 25 bp, Mus musculus
gtgacaaaatatctagaatctgatg

SEQ ID NO: 727263 - DNA, 25 bp, Mus musculus
gtgacaaaatatgtagaatctgatg

SEQ ID NO: 727264 - DNA, 25 bp, Mus musculus
gtgacaaacatcaatggagaagctg

SEQ ID NO: 727265 - DNA, 25 bp, Mus musculus
gtgacaaacatctatggagaagctg

SEQ ID NO: 727266 - DNA, 25 bp, Mus musculus
gtgacaaacggcactggacaccatg

SEQ ID NO: 727267 - DNA, 25 bp, Mus musculus
gtgacaaacggctctggacaccatg

SEQ ID NO: 727268 - DNA, 25 bp, Mus musculus
gtgacaaagaacattagaagagtag

SEQ ID NO: 727269 - DNA, 25 bp, Mus musculus
gtgacaaagaactttagaagagtag

SEQ ID NO: 727270 - DNA, 25 bp, Mus musculus
gtgacaaaggagacataaccctgtg

SEQ ID NO: 727271 - DNA, 25 bp, Mus musculus
gtgacaaaggagtcataaccctgtg

SEQ ID NO: 727272 - DNA, 25 bp, Mus musculus
gtgacaacagcgcagactcctgcct

SEQ ID NO: 727273 - DNA, 25 bp, Mus musculus
gtgacaacagcggagactcctgcct

SEQ ID NO: 727274 - DNA, 25 bp, Mus musculus
gtgacaaccaacacacctgcataca

SEQ ID NO: 727275 - DNA, 25 bp, Mus musculus
gtgacaaccaactcacctgcataca

SEQ ID NO: 727276 - DNA, 25 bp, Mus musculus
gtgacaaccagcacgcctgaggacc

SEQ ID NO: 727277 - DNA, 25 bp, Mus musculus
gtgacaaccagctcgcctgaggacc

SEQ ID NO: 727278 - DNA, 25 bp, Mus musculus
gtgacaagaggaacatcgacacccc

SEQ ID NO: 727279 - DNA, 25 bp, Mus musculus
gtgacaagaggatcatcgacacccc

SEQ ID NO: 727280 - DNA, 25 bp, Mus musculus
gtgacaagctacagtgcgactggcc

SEQ ID NO: 727281 - DNA, 25 bp, Mus musculus
gtgacaagctacctggagcccggct

SEQ ID NO: 727282 - DNA, 25 bp, Mus musculus
gtgacaagctacgtggagcccggct

SEQ ID NO: 727283 - DNA, 25 bp, Mus musculus
gtgacaagctactgtgcgactggcc

SEQ ID NO: 727284 - DNA, 25 bp, Mus musculus
gtgacaaggcctccgtgcccattgt

SEQ ID NO: 727285 - DNA, 25 bp, Mus musculus
gtgacaaggcctgcgtgcccattgt

SEQ ID NO: 727286 - DNA, 25 bp, Mus musculus
gtgacaagtgccctgaacatcatgc

SEQ ID NO: 727287 - DNA, 25 bp, Mus musculus
gtgacaagtgccgtgaacatcatgc

SEQ ID NO: 727288 - DNA, 25 bp, Mus musculus
gtgacaatgccacatacgccagcga

SEQ ID NO: 727289 - DNA, 25 bp, Mus musculus
gtgacaatgccagatacgccagcga

SEQ ID NO: 727290 - DNA, 25 bp, Mus musculus
gtgacacaaggaagaactcaactaa

SEQ ID NO: 727291 - DNA, 25 bp, Mus musculus
gtgacacaaggatgaactcaactaa

SEQ ID NO: 727292 - DNA, 25 bp, Mus musculus
gtgacacagcaaccccagacatcaa

SEQ ID NO: 727293 - DNA, 25 bp, Mus musculus
gtgacacagcaagcccagacatcaa

SEQ ID NO: 727294 - DNA, 25 bp, Mus musculus
gtgacaccttctaactgagttctga

SEQ ID NO: 727295 - DNA, 25 bp, Mus musculus
gtgacaccttcttactgagttctga

SEQ ID NO: 727296 - DNA, 25 bp, Mus musculus
gtgacacgcttgctgctgcctggca

SEQ ID NO: 727297 - DNA, 25 bp, Mus musculus
gtgacacgcttggtgctgcctggca

SEQ ID NO: 727298 - DNA, 25 bp, Mus musculus
gtgacacggaccctggacagagaaa

SEQ ID NO: 727299 - DNA, 25 bp, Mus musculus
gtgacacggaccgtggacagagaaa

SEQ ID NO: 727300 - DNA, 25 bp, Mus musculus
gtgacactgatgcttctgaactgac

SEQ ID NO: 727301 - DNA, 25 bp, Mus musculus
gtgacactgatggttctgaactgac

SEQ ID NO: 727302 - DNA, 25 bp, Mus musculus
gtgacagagactcaagacgacagtg

SEQ ID NO: 727303 - DNA, 25 bp, Mus musculus
gtgacagagactgaagacgacagtg

SEQ ID NO: 727304 - DNA, 25 bp, Mus musculus
gtgacagagtacatgtgtggagatc

SEQ ID NO: 727305 - DNA, 25 bp, Mus musculus
gtgacagagtacttgtgtggagatc

SEQ ID NO: 727306 - DNA, 25 bp, Mus musculus
gtgacagagtgaacagtgactgggc

SEQ ID NO: 727307 - DNA, 25 bp, Mus musculus
gtgacagagtgatcagtgactgggc

SEQ ID NO: 727308 - DNA, 25 bp, Mus musculus
gtgacagccatcacaggtttgtcca

SEQ ID NO: 727309 - DNA, 25 bp, Mus musculus
gtgacagccatctcaggtttgtcca

SEQ ID NO: 727310 - DNA, 25 bp, Mus musculus
gtgacagctcagcaacgccagcgag

SEQ ID NO: 727311 - DNA, 25 bp, Mus musculus
gtgacagctcaggaacgccagcgag

SEQ ID NO: 727312 - DNA, 25 bp, Mus musculus
gtgacaggagacatgtttacaccaa

SEQ ID NO: 727313 - DNA, 25 bp, Mus musculus
gtgacaggagacttgtttacaccaa

SEQ ID NO: 727314 - DNA, 25 bp, Mus musculus
gtgacagtaaggactctcactgcag

SEQ ID NO: 727315 - DNA, 25 bp, Mus musculus
gtgacagtaaggtctctcactgcag

SEQ ID NO: 727316 - DNA, 25 bp, Mus musculus
gtgacagtcactctttccatatctt

SEQ ID NO: 727317 - DNA, 25 bp, Mus musculus
gtgacagtcactgtttccatatctt

SEQ ID NO: 727318 - DNA, 25 bp, Mus musculus
gtgacagtcctaactcacacaactg

SEQ ID NO: 727319 - DNA, 25 bp, Mus musculus
gtgacagtcctatctcacacaactg

SEQ ID NO: 727320 - DNA, 25 bp, Mus musculus
gtgacatagatgaccttccccgtga

SEQ ID NO: 727321 - DNA, 25 bp, Mus musculus
gtgacatagatgtccttccccgtga

SEQ ID NO: 727322 - DNA, 25 bp, Mus musculus
gtgacatcaaacacaccaaagacgg

SEQ ID NO: 727323 - DNA, 25 bp, Mus musculus
gtgacatcaaactcaccaaagacgg

SEQ ID NO: 727324 - DNA, 25 bp, Mus musculus
gtgacatcacacctttcctcagtgt

SEQ ID NO: 727325 - DNA, 25 bp, Mus musculus
gtgacatcacacgtttcctcagtgt

SEQ ID NO: 727326 - DNA, 25 bp, Mus musculus
gtgacatcctcacatgacccttggg

SEQ ID NO: 727327 - DNA, 25 bp, Mus musculus
gtgacatcctcagatgacccttggg

SEQ ID NO: 727328 - DNA, 25 bp, Mus musculus
gtgacatcctggacagcagtgatga

SEQ ID NO: 727329 - DNA, 25 bp, Mus musculus
gtgacatcctggtcagcagtgatga

SEQ ID NO: 727330 - DNA, 25 bp, Mus musculus
gtgacatctgtacctccttgcgcta

SEQ ID NO: 727331 - DNA, 25 bp, Mus musculus
gtgacatctgtagctccttgcgcta

SEQ ID NO: 727332 - DNA, 25 bp, Mus musculus
gtgacatggtttatggccctgccaa

SEQ ID NO: 727333 - DNA, 25 bp, Mus musculus
gtgacatggtttttggccctgccaa

SEQ ID NO: 727334 - DNA, 25 bp, Mus musculus
gtgacatgtgcccttcgacccacgg

SEQ ID NO: 727335 - DNA, 25 bp, Mus musculus
gtgacatgtgccgttcgacccacgg

SEQ ID NO: 727336 - DNA, 25 bp, Mus musculus
gtgacattcgctactgcactcagga

SEQ ID NO: 727337 - DNA, 25 bp, Mus musculus
gtgacattcgcttctgcactcagga

SEQ ID NO: 727338 - DNA, 25 bp, Mus musculus
gtgacattgcttaccacctgaaccc

SEQ ID NO: 727339 - DNA, 25 bp, Mus musculus
gtgacattgctttccacctgaaccc

SEQ ID NO: 727340 - DNA, 25 bp, Mus musculus
gtgaccaagatccaggaggcgaccc

SEQ ID NO: 727341 - DNA, 25 bp, Mus musculus
gtgaccaagatcgaggaggcgaccc

SEQ ID NO: 727342 - DNA, 25 bp, Mus musculus
gtgaccaagcgcagtcctgggtcgc

SEQ ID NO: 727343 - DNA, 25 bp, Mus musculus
gtgaccaagcgctgtcctgggtcgc

SEQ ID NO: 727344 - DNA, 25 bp, Mus musculus
gtgaccaagtccatcatcgaataca

SEQ ID NO: 727345 - DNA, 25 bp, Mus musculus
gtgaccaagtccttcatcgaataca

SEQ ID NO: 727346 - DNA, 25 bp, Mus musculus
gtgaccaccaacctgtgtgcccgtg

SEQ ID NO: 727347 - DNA, 25 bp, Mus musculus
gtgaccaccaacgtgtgtgcccgtg

SEQ ID NO: 727348 - DNA, 25 bp, Mus musculus
gtgaccaccagaagaaccacagcat

SEQ ID NO: 727349 - DNA, 25 bp, Mus musculus
gtgaccaccagatgaaccacagcat

SEQ ID NO: 727350 - DNA, 25 bp, Mus musculus
gtgaccacctgccattcccgaagtg

SEQ ID NO: 727351 - DNA, 25 bp, Mus musculus
gtgaccacctgcgattcccgaagtg

SEQ ID NO: 727352 - DNA, 25 bp, Mus musculus
gtgaccagacatcctagccgcggag

SEQ ID NO: 727353 - DNA, 25 bp, Mus musculus
gtgaccagacatgctagccgcggag

SEQ ID NO: 727354 - DNA, 25 bp, Mus musculus
gtgaccagcactagtgtcaaccgcc

SEQ ID NO: 727355 - DNA, 25 bp, Mus musculus
gtgaccagcacttgtgtcaaccgcc

SEQ ID NO: 727356 - DNA, 25 bp, Mus musculus
gtgaccagctccatctcgggcttct

SEQ ID NO: 727357 - DNA, 25 bp, Mus musculus
gtgaccagctcccacagagactgtg

SEQ ID NO: 727358 - DNA, 25 bp, Mus musculus
gtgaccagctccgacagagactgtg

SEQ ID NO: 727359 - DNA, 25 bp, Mus musculus
gtgaccagctccttctcgggcttct

SEQ ID NO: 727360 - DNA, 25 bp, Mus musculus
gtgaccaggattaaccactcccatg

SEQ ID NO: 727361 - DNA, 25 bp, Mus musculus
gtgaccaggatttaccactcccatg

SEQ ID NO: 727362 - DNA, 25 bp, Mus musculus
gtgaccaggtggcacgcctcctttt

SEQ ID NO: 727363 - DNA, 25 bp, Mus musculus
gtgaccaggtgggacgcctcctttt

SEQ ID NO: 727364 - DNA, 25 bp, Mus musculus
gtgaccagtggacccgtcgccttcg

SEQ ID NO: 727365 - DNA, 25 bp, Mus musculus
gtgaccagtggagccgtcgccttcg

SEQ ID NO: 727366 - DNA, 25 bp, Mus musculus
gtgaccagttgacttcagggaccca

SEQ ID NO: 727367 - DNA, 25 bp, Mus musculus
gtgaccagttgagttcagggaccca

SEQ ID NO: 727368 - DNA, 25 bp, Mus musculus
gtgaccatcaatccccgggccgagg

SEQ ID NO: 727369 - DNA, 25 bp, Mus musculus
gtgaccatcaatgcccgggccgagg

SEQ ID NO: 727370 - DNA, 25 bp, Mus musculus
gtgaccatcatgctggccaataatg

SEQ ID NO: 727371 - DNA, 25 bp, Mus musculus
gtgaccatcatggtggccaataatg

SEQ ID NO: 727372 - DNA, 25 bp, Mus musculus
gtgaccatccacaaccgctgtaaag

SEQ ID NO: 727373 - DNA, 25 bp, Mus musculus
gtgaccatccactaccgctgtaaag

SEQ ID NO: 727374 - DNA, 25 bp, Mus musculus
gtgaccatggcacatcgggcagcgg

SEQ ID NO: 727375 - DNA, 25 bp, Mus musculus
gtgaccatggcagatcgggcagcgg

SEQ ID NO: 727376 - DNA, 25 bp, Mus musculus
gtgaccattaatcgttctgctcgac

SEQ ID NO: 727377 - DNA, 25 bp, Mus musculus
gtgaccattaatggttctgctcgac

SEQ ID NO: 727378 - DNA, 25 bp, Mus musculus
gtgacccacatcagagtcgtagtga

SEQ ID NO: 727379 - DNA, 25 bp, Mus musculus
gtgacccacatctgagtcgtagtga

SEQ ID NO: 727380 - DNA, 25 bp, Mus musculus
gtgacccaccacaagctaatacatg

SEQ ID NO: 727381 - DNA, 25 bp, Mus musculus
gtgacccaccactagctaatacatg

SEQ ID NO: 727382 - DNA, 25 bp, Mus musculus
gtgacccacgtgcttcttatttcgc

SEQ ID NO: 727383 - DNA, 25 bp, Mus musculus
gtgacccacgtggttcttatttcgc

SEQ ID NO: 727384 - DNA, 25 bp, Mus musculus
gtgacccagctgacctacaatgcgg

SEQ ID NO: 727385 - DNA, 25 bp, Mus musculus
gtgacccagctgtcctacaatgcgg

SEQ ID NO: 727386 - DNA, 25 bp, Mus musculus
gtgaccccatagacttttccaatag

SEQ ID NO: 727387 - DNA, 25 bp, Mus musculus
gtgaccccatagtcttttccaatag

SEQ ID NO: 727388 - DNA, 25 bp, Mus musculus
gtgaccccatctctggtgttcgccg

SEQ ID NO: 727389 - DNA, 25 bp, Mus musculus
gtgaccccatctgtggtgttcgccg

SEQ ID NO: 727390 - DNA, 25 bp, Mus musculus
gtgaccccgactctacgtgagacgt

SEQ ID NO: 727391 - DNA, 25 bp, Mus musculus
gtgaccccgactgtacgtgagacgt

SEQ ID NO: 727392 - DNA, 25 bp, Mus musculus
gtgaccccgtgacccgagtcctaga

SEQ ID NO: 727393 - DNA, 25 bp, Mus musculus
gtgaccccgtgagccgagtcctaga

SEQ ID NO: 727394 - DNA, 25 bp, Mus musculus
gtgacccctggcacaacggaagaaa

SEQ ID NO: 727395 - DNA, 25 bp, Mus musculus
gtgacccctggctcaacggaagaaa

SEQ ID NO: 727396 - DNA, 25 bp, Mus musculus
gtgacccgggcaagatcaagcggct

SEQ ID NO: 727397 - DNA, 25 bp, Mus musculus
gtgacccgggcatgatcaagcggct

SEQ ID NO: 727398 - DNA, 25 bp, Mus musculus
gtgaccctctgaagctcatctgcct

SEQ ID NO: 727399 - DNA, 25 bp, Mus musculus
gtgaccctctgatgctcatctgcct

SEQ ID NO: 727400 - DNA, 25 bp, Mus musculus
gtgaccctgacactgtcattcttaa

SEQ ID NO: 727401 - DNA, 25 bp, Mus musculus
gtgaccctgacagtgtcattcttaa

SEQ ID NO: 727402 - DNA, 25 bp, Mus musculus
gtgaccctggacctaaaggagacag

SEQ ID NO: 727403 - DNA, 25 bp, Mus musculus
gtgaccctggacgtaaaggagacag

SEQ ID NO: 727404 - DNA, 25 bp, Mus musculus
gtgaccgacactcgcaagatgcagg

SEQ ID NO: 727405 - DNA, 25 bp, Mus musculus
gtgaccgacactggcaagatgcagg

SEQ ID NO: 727406 - DNA, 25 bp, Mus musculus
gtgaccgaggacagcctggaccacg

SEQ ID NO: 727407 - DNA, 25 bp, Mus musculus
gtgaccgaggactgcctggaccacg

SEQ ID NO: 727408 - DNA, 25 bp, Mus musculus
gtgaccgatctgacatctgcccctg

SEQ ID NO: 727409 - DNA, 25 bp, Mus musculus
gtgaccgatctgtcatctgcccctg

SEQ ID NO: 727410 - DNA, 25 bp, Mus musculus
gtgaccgcaacaagcccggagtcta

SEQ ID NO: 727411 - DNA, 25 bp, Mus musculus
gtgaccgcaacatgcccggagtcta

SEQ ID NO: 727412 - DNA, 25 bp, Mus musculus
gtgaccggaaatcccagtgccgaac

SEQ ID NO: 727413 - DNA, 25 bp, Mus musculus
gtgaccggaaatccgagtgccaaat

SEQ ID NO: 727414 - DNA, 25 bp, Mus musculus
gtgaccggaaatgccagtgccgaac

SEQ ID NO: 727415 - DNA, 25 bp, Mus musculus
gtgaccggaaatgcgagtgccaaat

SEQ ID NO: 727416 - DNA, 25 bp, Mus musculus
gtgaccggatatcccgcctatgaca

SEQ ID NO: 727417 - DNA, 25 bp, Mus musculus
gtgaccggatatgccgcctatgaca

SEQ ID NO: 727418 - DNA, 25 bp, Mus musculus
gtgaccgtgtgcatcaagatgaaac

SEQ ID NO: 727419 - DNA, 25 bp, Mus musculus
gtgaccgtgtgcttcaagatgaaac

SEQ ID NO: 727420 - DNA, 25 bp, Mus musculus
gtgaccgtttggagaaaaccctcag

SEQ ID NO: 727421 - DNA, 25 bp, Mus musculus
gtgaccgtttggtgaaaaccctcag

SEQ ID NO: 727422 - DNA, 25 bp, Mus musculus
gtgacctaatatatctgagcctgtg

SEQ ID NO: 727423 - DNA, 25 bp, Mus musculus
gtgacctaatatttctgagcctgtg

SEQ ID NO: 727424 - DNA, 25 bp, Mus musculus
gtgacctcaaacaccgtcggatgcc

SEQ ID NO: 727425 - DNA, 25 bp, Mus musculus
gtgacctcaaactccgtcggatgcc

SEQ ID NO: 727426 - DNA, 25 bp, Mus musculus
gtgacctccacaaccaagttttgca

SEQ ID NO: 727427 - DNA, 25 bp, Mus musculus
gtgacctccacatccaagttttgca

SEQ ID NO: 727428 - DNA, 25 bp, Mus musculus
gtgacctccctcagaagggcgtctc

SEQ ID NO: 727429 - DNA, 25 bp, Mus musculus
gtgacctccctctgaagggcgtctc

SEQ ID NO: 727430 - DNA, 25 bp, Mus musculus
gtgacctcggccagggccgcttctt

SEQ ID NO: 727431 - DNA, 25 bp, Mus musculus
gtgacctcggcctgggccgcttctt

SEQ ID NO: 727432 - DNA, 25 bp, Mus musculus
gtgacctcgtcaaggcatcttctgc

SEQ ID NO: 727433 - DNA, 25 bp, Mus musculus
gtgacctcgtcatggcatcttctgc

SEQ ID NO: 727434 - DNA, 25 bp, Mus musculus
gtgacctctgacaaatccgctcatt

SEQ ID NO: 727435 - DNA, 25 bp, Mus musculus
gtgacctctgactaatccgctcatt

SEQ ID NO: 727436 - DNA, 25 bp, Mus musculus
gtgacctctggtcctgtggcatcac

SEQ ID NO: 727437 - DNA, 25 bp, Mus musculus
gtgacctctggtgctgtggcatcac

SEQ ID NO: 727438 - DNA, 25 bp, Mus musculus
gtgaccttatgacagcccactccat

SEQ ID NO: 727439 - DNA, 25 bp, Mus musculus
gtgaccttatgagagcccactccat

SEQ ID NO: 727440 - DNA, 25 bp, Mus musculus
gtgaccttatgcacctgtgcagcaa

SEQ ID NO: 727441 - DNA, 25 bp, Mus musculus
gtgaccttatgctcctgtgcagcaa

SEQ ID NO: 727442 - DNA, 25 bp, Mus musculus
gtgaccttcagaaagactcatgtgg

SEQ ID NO: 727443 - DNA, 25 bp, Mus musculus
gtgaccttcagatagactcatgtgg

SEQ ID NO: 727444 - DNA, 25 bp, Mus musculus
gtgaccttgaacagaagtttgaact

SEQ ID NO: 727445 - DNA, 25 bp, Mus musculus
gtgaccttgaactgaagtttgaact

SEQ ID NO: 727446 - DNA, 25 bp, Mus musculus
gtgaccttgccgaggagaagagccc

SEQ ID NO: 727447 - DNA, 25 bp, Mus musculus
gtgaccttgccgtggagaagagccc

SEQ ID NO: 727448 - DNA, 25 bp, Mus musculus
gtgaccttgcgccttgtcatccctg

SEQ ID NO: 727449 - DNA, 25 bp, Mus musculus
gtgaccttgcgcgttgtcatccctg

SEQ ID NO: 727450 - DNA, 25 bp, Mus musculus
gtgaccttggacaagctccctctgt

SEQ ID NO: 727451 - DNA, 25 bp, Mus musculus
gtgaccttggactagctccctctgt

SEQ ID NO: 727452 - DNA, 25 bp, Mus musculus
gtgacgacactcatctacgcctgct

SEQ ID NO: 727453 - DNA, 25 bp, Mus musculus
gtgacgacactcttctacgcctgct

SEQ ID NO: 727454 - DNA, 25 bp, Mus musculus
gtgacgacatctcggactttctatg

SEQ ID NO: 727455 - DNA, 25 bp, Mus musculus
gtgacgacatctgggactttctatg

SEQ ID NO: 727456 - DNA, 25 bp, Mus musculus
gtgacgaggacaagtttggccacaa

SEQ ID NO: 727457 - DNA, 25 bp, Mus musculus
gtgacgaggacatgtttggccacaa

SEQ ID NO: 727458 - DNA, 25 bp, Mus musculus
gtgacgagggccaacggagcctcaa

SEQ ID NO: 727459 - DNA, 25 bp, Mus musculus
gtgacgagggcctacggagcctcaa

SEQ ID NO: 727460 - DNA, 25 bp, Mus musculus
gtgacgatattacccgtgactcaga

SEQ ID NO: 727461 - DNA, 25 bp, Mus musculus
gtgacgatattagccgtgactcaga

SEQ ID NO: 727462 - DNA, 25 bp, Mus musculus
gtgacgatcactctgactgatgtca

SEQ ID NO: 727463 - DNA, 25 bp, Mus musculus
gtgacgatcactgtgactgatgtca

SEQ ID NO: 727464 - DNA, 25 bp, Mus musculus
gtgacgatcctcatgaatgactatc

SEQ ID NO: 727465 - DNA, 25 bp, Mus musculus
gtgacgatcctcttgaatgactatc

SEQ ID NO: 727466 - DNA, 25 bp, Mus musculus
gtgacgatgcccacaaccacgactt

SEQ ID NO: 727467 - DNA, 25 bp, Mus musculus
gtgacgatgccctcaaccacgactt

SEQ ID NO: 727468 - DNA, 25 bp, Mus musculus
gtgacgctcatgcttttgatgatga

SEQ ID NO: 727469 - DNA, 25 bp, Mus musculus
gtgacgctcatggttttgatgatga

SEQ ID NO: 727470 - DNA, 25 bp, Mus musculus
gtgacgctgactcagaccctgaaag

SEQ ID NO: 727471 - DNA, 25 bp, Mus musculus
gtgacgctgactgagaccctgaaag

SEQ ID NO: 727472 - DNA, 25 bp, Mus musculus
gtgacggacatcaaagctgaggatg

SEQ ID NO: 727473 - DNA, 25 bp, Mus musculus
gtgacggacatctaagctgaggatg

SEQ ID NO: 727474 - DNA, 25 bp, Mus musculus
gtgacggcaccaacacaaccaagga

SEQ ID NO: 727475 - DNA, 25 bp, Mus musculus
gtgacggcaccatcacaaccaagga

SEQ ID NO: 727476 - DNA, 25 bp, Mus musculus
gtgacgggctccctaccatctgcgt

SEQ ID NO: 727477 - DNA, 25 bp, Mus musculus
gtgacgggctccgtaccatctgcgt

SEQ ID NO: 727478 - DNA, 25 bp, Mus musculus
gtgacgggctggctccgccatcctt

SEQ ID NO: 727479 - DNA, 25 bp, Mus musculus
gtgacgggctgggtccgccatcctt

SEQ ID NO: 727480 - DNA, 25 bp, Mus musculus
gtgacggtcactcgcctggctgtca

SEQ ID NO: 727481 - DNA, 25 bp, Mus musculus
gtgacggtcactggcctggctgtca

SEQ ID NO: 727482 - DNA, 25 bp, Mus musculus
gtgacgtcactgcaatggagctacc

SEQ ID NO: 727483 - DNA, 25 bp, Mus musculus
gtgacgtcactggaatggagctacc

SEQ ID NO: 727484 - DNA, 25 bp, Mus musculus
gtgacgtccacaagagctccctgag

SEQ ID NO: 727485 - DNA, 25 bp, Mus musculus
gtgacgtccacatgagctccctgag

SEQ ID NO: 727486 - DNA, 25 bp, Mus musculus
gtgacgtctccaagctgtccccagt

SEQ ID NO: 727487 - DNA, 25 bp, Mus musculus
gtgacgtctccatgctgtccccagt

SEQ ID NO: 727488 - DNA, 25 bp, Mus musculus
gtgacgtgcacacaccaagacaccg

SEQ ID NO: 727489 - DNA, 25 bp, Mus musculus
gtgacgtgcacagaccaagacaccg

SEQ ID NO: 727490 - DNA, 25 bp, Mus musculus
gtgacgtgcatcattttcatcgctg

SEQ ID NO: 727491 - DNA, 25 bp, Mus musculus
gtgacgtgcatctttttcatcgctg

SEQ ID NO: 727492 - DNA, 25 bp, Mus musculus
gtgacgtttgaccagagcaaccgcc

SEQ ID NO: 727493 - DNA, 25 bp, Mus musculus
gtgacgtttgacgagagcaaccgcc

SEQ ID NO: 727494 - DNA, 25 bp, Mus musculus
gtgactacccctagcctgatgtggc

SEQ ID NO: 727495 - DNA, 25 bp, Mus musculus
gtgactaccccttgcctgatgtggc

SEQ ID NO: 727496 - DNA, 25 bp, Mus musculus
gtgactaccggcagctgtgcagcca

SEQ ID NO: 727497 - DNA, 25 bp, Mus musculus
gtgactaccggctgctgtgcagcca

SEQ ID NO: 727498 - DNA, 25 bp, Mus musculus
gtgactactactaccataacatgcc

SEQ ID NO: 727499 - DNA, 25 bp, Mus musculus
gtgactactacttccataacatgcc

SEQ ID NO: 727500 - DNA, 25 bp, Mus musculus
gtgactactgccagaatcctgcagc

SEQ ID NO: 727501 - DNA, 25 bp, Mus musculus
gtgactactgcctgaatcctgcagc

SEQ ID NO: 727502 - DNA, 25 bp, Mus musculus
gtgactcaaaagatggaaatctgga

SEQ ID NO: 727503 - DNA, 25 bp, Mus musculus
gtgactcaaaagttggaaatctgga

SEQ ID NO: 727504 - DNA, 25 bp, Mus musculus
gtgactcaaatgattccatctccag

SEQ ID NO: 727505 - DNA, 25 bp, Mus musculus
gtgactcaaatgtttccatctccag

SEQ ID NO: 727506 - DNA, 25 bp, Mus musculus
gtgactcagagcaggctggcatcct

SEQ ID NO: 727507 - DNA, 25 bp, Mus musculus
gtgactcagagctggctggcatcct

SEQ ID NO: 727508 - DNA, 25 bp, Mus musculus
gtgactcagcagctgtccaagtctc

SEQ ID NO: 727509 - DNA, 25 bp, Mus musculus
gtgactcagcaggtgtccaagtctc

SEQ ID NO: 727510 - DNA, 25 bp, Mus musculus
gtgactcagctgagattgagggacc

SEQ ID NO: 727511 - DNA, 25 bp, Mus musculus
gtgactcagctgtgattgagggacc

SEQ ID NO: 727512 - DNA, 25 bp, Mus musculus
gtgactcatattctcaatgttgcat

SEQ ID NO: 727513 - DNA, 25 bp, Mus musculus
gtgactcatattgtcaatgttgcat

SEQ ID NO: 727514 - DNA, 25 bp, Mus musculus
gtgactcatggaaccgaattagctg

SEQ ID NO: 727515 - DNA, 25 bp, Mus musculus
gtgactcatggatccgaattagctg

SEQ ID NO: 727516 - DNA, 25 bp, Mus musculus
gtgactccagctatgagacagccct

SEQ ID NO: 727517 - DNA, 25 bp, Mus musculus
gtgactccagctttgagacagccct

SEQ ID NO: 727518 - DNA, 25 bp, Mus musculus
gtgactcccacaagtcccatggagg

SEQ ID NO: 727519 - DNA, 25 bp, Mus musculus
gtgactcccacatgtcccatggagg

SEQ ID NO: 727520 - DNA, 25 bp, Mus musculus
gtgactccctacagccctgtacaaa

SEQ ID NO: 727521 - DNA, 25 bp, Mus musculus
gtgactccctactgccctgtacaaa

SEQ ID NO: 727522 - DNA, 25 bp, Mus musculus
gtgactccctctacatccactatga

SEQ ID NO: 727523 - DNA, 25 bp, Mus musculus
gtgactccctcttcatccactatga

SEQ ID NO: 727524 - DNA, 25 bp, Mus musculus
gtgactcctacacattgatccagtt

SEQ ID NO: 727525 - DNA, 25 bp, Mus musculus
gtgactcctacagattgatccagtt

SEQ ID NO: 727526 - DNA, 25 bp, Mus musculus
gtgactcggcctcgtgtacctccag

SEQ ID NO: 727527 - DNA, 25 bp, Mus musculus
gtgactcggcctggtgtacctccag

SEQ ID NO: 727528 - DNA, 25 bp, Mus musculus
gtgactctacagctgttaaccatag

SEQ ID NO: 727529 - DNA, 25 bp, Mus musculus
gtgactctacaggtgttaaccatag

SEQ ID NO: 727530 - DNA, 25 bp, Mus musculus
gtgactctccaaacaaggtagccag

SEQ ID NO: 727531 - DNA, 25 bp, Mus musculus
gtgactctccaatcaaggtagccag

SEQ ID NO: 727532 - DNA, 25 bp, Mus musculus
gtgactctcctaatccatctgtttc

SEQ ID NO: 727533 - DNA, 25 bp, Mus musculus
gtgactctcctattccatctgtttc

SEQ ID NO: 727534 - DNA, 25 bp, Mus musculus
gtgactctgaacaatgtggaagtct

SEQ ID NO: 727535 - DNA, 25 bp, Mus musculus
gtgactctgaactatgtggaagtct

SEQ ID NO: 727536 - DNA, 25 bp, Mus musculus
gtgactctggcacctcgggactcag

SEQ ID NO: 727537 - DNA, 25 bp, Mus musculus
gtgactctggcagctcgggactcag

SEQ ID NO: 727538 - DNA, 25 bp, Mus musculus
gtgactcttcaaatctctcagcgag

SEQ ID NO: 727539 - DNA, 25 bp, Mus musculus
gtgactcttcaattctctcagcgag

SEQ ID NO: 727540 - DNA, 25 bp, Mus musculus
gtgactgaacgtccctcatacattg

SEQ ID NO: 727541 - DNA, 25 bp, Mus musculus
gtgactgaacgtgcctcatacattg

SEQ ID NO: 727542 - DNA, 25 bp, Mus musculus
gtgactgaatacatttcaaaagacc

SEQ ID NO: 727543 - DNA, 25 bp, Mus musculus
gtgactgaatacttttcaaaagacc

SEQ ID NO: 727544 - DNA, 25 bp, Mus musculus
gtgactgctcccacaggatgaaggt

SEQ ID NO: 727545 - DNA, 25 bp, Mus musculus
gtgactgctccctcaggatgaaggt

SEQ ID NO: 727546 - DNA, 25 bp, Mus musculus
gtgactggtgtgaatgagctcagcc

SEQ ID NO: 727547 - DNA, 25 bp, Mus musculus
gtgactggtgtgtatgagctcagcc

SEQ ID NO: 727548 - DNA, 25 bp, Mus musculus
gtgactgtaaccacgaacacctggc

SEQ ID NO: 727549 - DNA, 25 bp, Mus musculus
gtgactgtaacctcgaacacctggc

SEQ ID NO: 727550 - DNA, 25 bp, Mus musculus
gtgactgtcatcctgaatttctgcc

SEQ ID NO: 727551 - DNA, 25 bp, Mus musculus
gtgactgtcatcgtgaatttctgcc

SEQ ID NO: 727552 - DNA, 25 bp, Mus musculus
gtgactgtcccaatctgactcacca

SEQ ID NO: 727553 - DNA, 25 bp, Mus musculus
gtgactgtcccattctgactcacca

SEQ ID NO: 727554 - DNA, 25 bp, Mus musculus
gtgactgtggttcccctctatgcca

SEQ ID NO: 727555 - DNA, 25 bp, Mus musculus
gtgactgtggttgccctctatgcca

SEQ ID NO: 727556 - DNA, 25 bp, Mus musculus
gtgactgttatcattctcagtgaga

SEQ ID NO: 727557 - DNA, 25 bp, Mus musculus
gtgactgttatctttctcagtgaga

SEQ ID NO: 727558 - DNA, 25 bp, Mus musculus
gtgactgttccccacacatagccaa

SEQ ID NO: 727559 - DNA, 25 bp, Mus musculus
gtgactgttcccgacacatagccaa

SEQ ID NO: 727560 - DNA, 25 bp, Mus musculus
gtgactgttctacattgaggctttg

SEQ ID NO: 727561 - DNA, 25 bp, Mus musculus
gtgactgttctagattgaggctttg

SEQ ID NO: 727562 - DNA, 25 bp, Mus musculus
gtgacttcgggaacgcccaggaact

SEQ ID NO: 727563 - DNA, 25 bp, Mus musculus
gtgacttcgggatcgcccaggaact

SEQ ID NO: 727564 - DNA, 25 bp, Mus musculus
gtgacttctgccctgacatgaagaa

SEQ ID NO: 727565 - DNA, 25 bp, Mus musculus
gtgacttctgccgtgacatgaagaa

SEQ ID NO: 727566 - DNA, 25 bp, Mus musculus
gtgacttggccacagtcacaagctg

SEQ ID NO: 727567 - DNA, 25 bp, Mus musculus
gtgacttggccagagtcacaagctg

SEQ ID NO: 727568 - DNA, 25 bp, Mus musculus
gtgacttgttgccaccctgcagccg

SEQ ID NO: 727569 - DNA, 25 bp, Mus musculus
gtgacttgttgcgaccctgcagccg

SEQ ID NO: 727570 - DNA, 25 bp, Mus musculus
gtgactttcgcaaccctgataagag

SEQ ID NO: 727571 - DNA, 25 bp, Mus musculus
gtgactttcgcatccctgataagag

SEQ ID NO: 727572 - DNA, 25 bp, Mus musculus
gtgactttgagccaagaaaacacac

SEQ ID NO: 727573 - DNA, 25 bp, Mus musculus
gtgactttgagcgaagaaaacacac

SEQ ID NO: 727574 - DNA, 25 bp, Mus musculus
gtgactttgaggatgaataaccagt

SEQ ID NO: 727575 - DNA, 25 bp, Mus musculus
gtgactttgaggttgaataaccagt

SEQ ID NO: 727576 - DNA, 25 bp, Mus musculus
gtgactttggaaaggcccgtggcct

SEQ ID NO: 727577 - DNA, 25 bp, Mus musculus
gtgactttggaatggcccgtggcct

SEQ ID NO: 727578 - DNA, 25 bp, Mus musculus
gtgacttttgagaatggccggccca

SEQ ID NO: 727579 - DNA, 25 bp, Mus musculus
gtgacttttgagtatggccggccca

SEQ ID NO: 727580 - DNA, 25 bp, Mus musculus
gtgagaaagaagaggacgaatgtct

SEQ ID NO: 727581 - DNA, 25 bp, Mus musculus
gtgagaaagaagtggacgaatgtct

SEQ ID NO: 727582 - DNA, 25 bp, Mus musculus
gtgagaaagagacaatgcacacagc

SEQ ID NO: 727583 - DNA, 25 bp, Mus musculus
gtgagaaagagagaatgcacacagc

SEQ ID NO: 727584 - DNA, 25 bp, Mus musculus
gtgagaacagtcctggttcctaccg

SEQ ID NO: 727585 - DNA, 25 bp, Mus musculus
gtgagaacagtcgtggttcctaccg

SEQ ID NO: 727586 - DNA, 25 bp, Mus musculus
gtgagaacctgcaacatcgcgccat

SEQ ID NO: 727587 - DNA, 25 bp, Mus musculus
gtgagaacctgctacatcgcgccat

SEQ ID NO: 727588 - DNA, 25 bp, Mus musculus
gtgagaactcagataagcctgagca

SEQ ID NO: 727589 - DNA, 25 bp, Mus musculus
gtgagaactcagttaagcctgagca

SEQ ID NO: 727590 - DNA, 25 bp, Mus musculus
gtgagaagccatactcctgctccca

SEQ ID NO: 727591 - DNA, 25 bp, Mus musculus
gtgagaagccattctcctgctccca

SEQ ID NO: 727592 - DNA, 25 bp, Mus musculus
gtgagaagcgcccaggactctgcaa

SEQ ID NO: 727593 - DNA, 25 bp, Mus musculus
gtgagaagcgccgaggactctgcaa

SEQ ID NO: 727594 - DNA, 25 bp, Mus musculus
gtgagaagtcttcccgggcagcctc

SEQ ID NO: 727595 - DNA, 25 bp, Mus musculus
gtgagaagtcttgccgggcagcctc

SEQ ID NO: 727596 - DNA, 25 bp, Mus musculus
gtgagaagtgtcacccaggaacatt

SEQ ID NO: 727597 - DNA, 25 bp, Mus musculus
gtgagaagtgtctcccaggaacatt

SEQ ID NO: 727598 - DNA, 25 bp, Mus musculus
gtgagaatagccaagagttcagccc

SEQ ID NO: 727599 - DNA, 25 bp, Mus musculus
gtgagaatagcctagagttcagccc

SEQ ID NO: 727600 - DNA, 25 bp, Mus musculus
gtgagacaggacatgcacgcatgct

SEQ ID NO: 727601 - DNA, 25 bp, Mus musculus
gtgagacaggacttgcacgcatgct

SEQ ID NO: 727602 - DNA, 25 bp, Mus musculus
gtgagacatacaccagtgtgtgtgc

SEQ ID NO: 727603 - DNA, 25 bp, Mus musculus
gtgagacatacagcagtgtgtgtgc

SEQ ID NO: 727604 - DNA, 25 bp, Mus musculus
gtgagacatgatactgccacagata

SEQ ID NO: 727605 - DNA, 25 bp, Mus musculus
gtgagacatgattctgccacagata

SEQ ID NO: 727606 - DNA, 25 bp, Mus musculus
gtgagacccctgaccacagcttgca

SEQ ID NO: 727607 - DNA, 25 bp, Mus musculus
gtgagacccctgctcctttgccagt

SEQ ID NO: 727608 - DNA, 25 bp, Mus musculus
gtgagacccctggtcctttgccagt

SEQ ID NO: 727609 - DNA, 25 bp, Mus musculus
gtgagacccctgtccacagcttgca

SEQ ID NO: 727610 - DNA, 25 bp, Mus musculus
gtgagaccgggcagcacaattgcgt

SEQ ID NO: 727611 - DNA, 25 bp, Mus musculus
gtgagaccgggctgcacaattgcgt

SEQ ID NO: 727612 - DNA, 25 bp, Mus musculus
gtgagaccggtaacctcatcgcctc

SEQ ID NO: 727613 - DNA, 25 bp, Mus musculus
gtgagaccggtatcctcatcgcctc

SEQ ID NO: 727614 - DNA, 25 bp, Mus musculus
gtgagactcttcacacggcggttgc

SEQ ID NO: 727615 - DNA, 25 bp, Mus musculus
gtgagactcttctcacggcggttgc

SEQ ID NO: 727616 - DNA, 25 bp, Mus musculus
gtgagactgatccaatccaaagtcg

SEQ ID NO: 727617 - DNA, 25 bp, Mus musculus
gtgagactgatcgaatccaaagtcg

SEQ ID NO: 727618 - DNA, 25 bp, Mus musculus
gtgagagcagctcggttactcctgt

SEQ ID NO: 727619 - DNA, 25 bp, Mus musculus
gtgagagcagctgggttactcctgt

SEQ ID NO: 727620 - DNA, 25 bp, Mus musculus
gtgagagcctcacgctgacctgcga

SEQ ID NO: 727621 - DNA, 25 bp, Mus musculus
gtgagagcctcaggctgacctgcga

SEQ ID NO: 727622 - DNA, 25 bp, Mus musculus
gtgagagcgatcaccccaaggcact

SEQ ID NO: 727623 - DNA, 25 bp, Mus musculus
gtgagagcgatctccccaaggcact

SEQ ID NO: 727624 - DNA, 25 bp, Mus musculus
gtgagagctgctataccaagacaca

SEQ ID NO: 727625 - DNA, 25 bp, Mus musculus
gtgagagctgctttaccaagacaca

SEQ ID NO: 727626 - DNA, 25 bp, Mus musculus
gtgagaggctttctacccgcggtct

SEQ ID NO: 727627 - DNA, 25 bp, Mus musculus
gtgagaggctttgtacccgcggtct

SEQ ID NO: 727628 - DNA, 25 bp, Mus musculus
gtgagagtgccaaccaagccttcct

SEQ ID NO: 727629 - DNA, 25 bp, Mus musculus
gtgagagtgccatccaagccttcct

SEQ ID NO: 727630 - DNA, 25 bp, Mus musculus
gtgagatcagagaactgagccacca

SEQ ID NO: 727631 - DNA, 25 bp, Mus musculus
gtgagatcagagtactgagccacca

SEQ ID NO: 727632 - DNA, 25 bp, Mus musculus
gtgagatcatctagaaaccatctaa

SEQ ID NO: 727633 - DNA, 25 bp, Mus musculus
gtgagatcatcttgaaaccatctaa

SEQ ID NO: 727634 - DNA, 25 bp, Mus musculus
gtgagatccccccatcctgttgcaa

SEQ ID NO: 727635 - DNA, 25 bp, Mus musculus
gtgagatcccccgatcctgttgcaa

SEQ ID NO: 727636 - DNA, 25 bp, Mus musculus
gtgagatccgtgcacctccaacctg

SEQ ID NO: 727637 - DNA, 25 bp, Mus musculus
gtgagatccgtggacctccaacctg

SEQ ID NO: 727638 - DNA, 25 bp, Mus musculus
gtgagatcctcgctgttcaatccca

SEQ ID NO: 727639 - DNA, 25 bp, Mus musculus
gtgagatcctcggtgttcaatccca

SEQ ID NO: 727640 - DNA, 25 bp, Mus musculus
gtgagatcctgaagcttttctgtgg

SEQ ID NO: 727641 - DNA, 25 bp, Mus musculus
gtgagatcctgatgcttttctgtgg

SEQ ID NO: 727642 - DNA, 25 bp, Mus musculus
gtgagatcgaccaggccaagatgaa

SEQ ID NO: 727643 - DNA, 25 bp, Mus musculus
gtgagatcgacctggccaagatgaa

SEQ ID NO: 727644 - DNA, 25 bp, Mus musculus
gtgagatgaccgacccttcgcatgc

SEQ ID NO: 727645 - DNA, 25 bp, Mus musculus
gtgagatgaccgtcccttcgcatgc

SEQ ID NO: 727646 - DNA, 25 bp, Mus musculus
gtgagcaaaatcagcctggtggacc

SEQ ID NO: 727647 - DNA, 25 bp, Mus musculus
gtgagcaaaatctgcctggtggacc

SEQ ID NO: 727648 - DNA, 25 bp, Mus musculus
gtgagcaaatacagtgacgggaagc

SEQ ID NO: 727649 - DNA, 25 bp, Mus musculus
gtgagcaaatactgtgacgggaagc

SEQ ID NO: 727650 - DNA, 25 bp, Mus musculus
gtgagcaattgcaggctgagcagaa

SEQ ID NO: 727651 - DNA, 25 bp, Mus musculus
gtgagcaattgctggctgagcagaa

SEQ ID NO: 727652 - DNA, 25 bp, Mus musculus
gtgagcacagatcacctgaagctct

SEQ ID NO: 727653 - DNA, 25 bp, Mus musculus
gtgagcacagatgacctgaagctct

SEQ ID NO: 727654 - DNA, 25 bp, Mus musculus
gtgagcacctcaccgatgcgtttgc

SEQ ID NO: 727655 - DNA, 25 bp, Mus musculus
gtgagcacctcagcgatgcgtttgc

SEQ ID NO: 727656 - DNA, 25 bp, Mus musculus
gtgagcatgccaactcttagcttcc

SEQ ID NO: 727657 - DNA, 25 bp, Mus musculus
gtgagcatgccatctcttagcttcc

SEQ ID NO: 727658 - DNA, 25 bp, Mus musculus
gtgagcattcggaggatttactaaa

SEQ ID NO: 727659 - DNA, 25 bp, Mus musculus
gtgagcattcggtggatttactaaa

SEQ ID NO: 727660 - DNA, 25 bp, Mus musculus
gtgagccaatcaccgttcccagatg

SEQ ID NO: 727661 - DNA, 25 bp, Mus musculus
gtgagccaatcagcgttcccagatg

SEQ ID NO: 727662 - DNA, 25 bp, Mus musculus
gtgagccacttgatacaggtgtcct

SEQ ID NO: 727663 - DNA, 25 bp, Mus musculus
gtgagccacttgttacaggtgtcct

SEQ ID NO: 727664 - DNA, 25 bp, Mus musculus
gtgagccaggttagcctggaaaagc

SEQ ID NO: 727665 - DNA, 25 bp, Mus musculus
gtgagccaggtttgcctggaaaagc

SEQ ID NO: 727666 - DNA, 25 bp, Mus musculus
gtgagcccatagacatgactgtgcc

SEQ ID NO: 727667 - DNA, 25 bp, Mus musculus
gtgagcccatagtcatgactgtgcc

SEQ ID NO: 727668 - DNA, 25 bp, Mus musculus
gtgagcccctacctctcagatcttt

SEQ ID NO: 727669 - DNA, 25 bp, Mus musculus
gtgagcccctacgtctcagatcttt

SEQ ID NO: 727670 - DNA, 25 bp, Mus musculus
gtgagcccgagtaccactacatcgc

SEQ ID NO: 727671 - DNA, 25 bp, Mus musculus
gtgagcccgagttccactacatcgc

SEQ ID NO: 727672 - DNA, 25 bp, Mus musculus
gtgagccgggcacccaacagcatca

SEQ ID NO: 727673 - DNA, 25 bp, Mus musculus
gtgagccgggcagccaacagcatca

SEQ ID NO: 727674 - DNA, 25 bp, Mus musculus
gtgagcctatgaccgaactgtctgg

SEQ ID NO: 727675 - DNA, 25 bp, Mus musculus
gtgagcctatgagcgaactgtctgg

SEQ ID NO: 727676 - DNA, 25 bp, Mus musculus
gtgagcctgactcaacgaattaatc

SEQ ID NO: 727677 - DNA, 25 bp, Mus musculus
gtgagcctgactgaacgaattaatc

SEQ ID NO: 727678 - DNA, 25 bp, Mus musculus
gtgagcctgctgctttaaccaccct

SEQ ID NO: 727679 - DNA, 25 bp, Mus musculus
gtgagcctgctggtttaaccaccct

SEQ ID NO: 727680 - DNA, 25 bp, Mus musculus
gtgagcctggacaactccgtgttgg

SEQ ID NO: 727681 - DNA, 25 bp, Mus musculus
gtgagcctggactactccgtgttgg

SEQ ID NO: 727682 - DNA, 25 bp, Mus musculus
gtgagcctggccctctgcctgtcta

SEQ ID NO: 727683 - DNA, 25 bp, Mus musculus
gtgagcctggccgtctgcctgtcta

SEQ ID NO: 727684 - DNA, 25 bp, Mus musculus
gtgagcgagcctctcagtcattgtg

SEQ ID NO: 727685 - DNA, 25 bp, Mus musculus
gtgagcgagcctgtcagtcattgtg

SEQ ID NO: 727686 - DNA, 25 bp, Mus musculus
gtgagcgagtccctgacctcctgaa

SEQ ID NO: 727687 - DNA, 25 bp, Mus musculus
gtgagcgagtccgtgacctcctgaa

SEQ ID NO: 727688 - DNA, 25 bp, Mus musculus
gtgagcgcagccacagagcgcacgc

SEQ ID NO: 727689 - DNA, 25 bp, Mus musculus
gtgagcgcagcctcagagcgcacgc

SEQ ID NO: 727690 - DNA, 25 bp, Mus musculus
gtgagcgcccagagcgctggcaaat

SEQ ID NO: 727691 - DNA, 25 bp, Mus musculus
gtgagcgcccagtgcgctggcaaat

SEQ ID NO: 727692 - DNA, 25 bp, Mus musculus
gtgagcggcctcctacagtttgtgc

SEQ ID NO: 727693 - DNA, 25 bp, Mus musculus
gtgagcggcctcgtacagtttgtgc

SEQ ID NO: 727694 - DNA, 25 bp, Mus musculus
gtgagcggtcagcatgctaatccaa

SEQ ID NO: 727695 - DNA, 25 bp, Mus musculus
gtgagcggtcaggatgctaatccaa

SEQ ID NO: 727696 - DNA, 25 bp, Mus musculus
gtgagcggtgtcagcattacaaggt

SEQ ID NO: 727697 - DNA, 25 bp, Mus musculus
gtgagcggtgtctgcattacaaggt

SEQ ID NO: 727698 - DNA, 25 bp, Mus musculus
gtgagcgtgcgcacccctacaggat

SEQ ID NO: 727699 - DNA, 25 bp, Mus musculus
gtgagcgtgcgctcccctacaggat

SEQ ID NO: 727700 - DNA, 25 bp, Mus musculus
gtgagctatgtgactctccctggag

SEQ ID NO: 727701 - DNA, 25 bp, Mus musculus
gtgagctatgtgtctctccctggag

SEQ ID NO: 727702 - DNA, 25 bp, Mus musculus
gtgagctccacccagcatgacacgg

SEQ ID NO: 727703 - DNA, 25 bp, Mus musculus
gtgagctccaccgagcatgacacgg

SEQ ID NO: 727704 - DNA, 25 bp, Mus musculus
gtgagctctacccaaccttcagtga

SEQ ID NO: 727705 - DNA, 25 bp, Mus musculus
gtgagctctaccctacagtcctcag

SEQ ID NO: 727706 - DNA, 25 bp, Mus musculus
gtgagctctaccgaaccttcagtga

SEQ ID NO: 727707 - DNA, 25 bp, Mus musculus
gtgagctctaccgtacagtcctcag

SEQ ID NO: 727708 - DNA, 25 bp, Mus musculus
gtgagctgaactccattcccaaggg

SEQ ID NO: 727709 - DNA, 25 bp, Mus musculus
gtgagctgaactgcattcccaaggg

SEQ ID NO: 727710 - DNA, 25 bp, Mus musculus
gtgagctggacgagagcaacacccc

SEQ ID NO: 727711 - DNA, 25 bp, Mus musculus
gtgagctggacgtgagcaacacccc

SEQ ID NO: 727712 - DNA, 25 bp, Mus musculus
gtgagctggccacagtccacaacca

SEQ ID NO: 727713 - DNA, 25 bp, Mus musculus
gtgagctggccagagtccacaacca

SEQ ID NO: 727714 - DNA, 25 bp, Mus musculus
gtgagctgttgcctactgtatcata

SEQ ID NO: 727715 - DNA, 25 bp, Mus musculus
gtgagctgttgcgtactgtatcata

SEQ ID NO: 727716 - DNA, 25 bp, Mus musculus
gtgagcttcttgcaaactgaggaga

SEQ ID NO: 727717 - DNA, 25 bp, Mus musculus
gtgagcttcttggaaactgaggaga

SEQ ID NO: 727718 - DNA, 25 bp, Mus musculus
gtgagcttgattattctcccctgga

SEQ ID NO: 727719 - DNA, 25 bp, Mus musculus
gtgagcttgatttttctcccctgga

SEQ ID NO: 727720 - DNA, 25 bp, Mus musculus
gtgagctttgcaatgaatgatagcc

SEQ ID NO: 727721 - DNA, 25 bp, Mus musculus
gtgagctttgcattgaatgatagcc

SEQ ID NO: 727722 - DNA, 25 bp, Mus musculus
gtgagctttttcacaggctacctga

SEQ ID NO: 727723 - DNA, 25 bp, Mus musculus
gtgagctttttctcaggctacctga

SEQ ID NO: 727724 - DNA, 25 bp, Mus musculus
gtgaggaaacctcgagagactttca

SEQ ID NO: 727725 - DNA, 25 bp, Mus musculus
gtgaggaaacctggagagactttca

SEQ ID NO: 727726 - DNA, 25 bp, Mus musculus
gtgaggaagatcatctgagtcctcc

SEQ ID NO: 727727 - DNA, 25 bp, Mus musculus
gtgaggaagatcttctgagtcctcc

SEQ ID NO: 727728 - DNA, 25 bp, Mus musculus
gtgaggagagtgatgctggcaaaga

SEQ ID NO: 727729 - DNA, 25 bp, Mus musculus
gtgaggagagtgttgctggcaaaga

SEQ ID NO: 727730 - DNA, 25 bp, Mus musculus
gtgaggagccgcagctcactttccc

SEQ ID NO: 727731 - DNA, 25 bp, Mus musculus
gtgaggagccgctgctcactttccc

SEQ ID NO: 727732 - DNA, 25 bp, Mus musculus
gtgaggagcttcagatgacagcagc

SEQ ID NO: 727733 - DNA, 25 bp, Mus musculus
gtgaggagcttctgatgacagcagc

SEQ ID NO: 727734 - DNA, 25 bp, Mus musculus
gtgaggatcccaattaaactctgtg

SEQ ID NO: 727735 - DNA, 25 bp, Mus musculus
gtgaggatcccatttaaactctgtg

SEQ ID NO: 727736 - DNA, 25 bp, Mus musculus
gtgaggcaaaaaagggaccagaagt

SEQ ID NO: 727737 - DNA, 25 bp, Mus musculus
gtgaggcaaaaatgggaccagaagt

SEQ ID NO: 727738 - DNA, 25 bp, Mus musculus
gtgaggcagtttcgacagcaagact

SEQ ID NO: 727739 - DNA, 25 bp, Mus musculus
gtgaggcagtttggacagcaagact

SEQ ID NO: 727740 - DNA, 25 bp, Mus musculus
gtgaggccattacaagacccagtaa

SEQ ID NO: 727741 - DNA, 25 bp, Mus musculus
gtgaggccattagaagacccagtaa

SEQ ID NO: 727742 - DNA, 25 bp, Mus musculus
gtgaggcgcgagcaaataccaacgc

SEQ ID NO: 727743 - DNA, 25 bp, Mus musculus
gtgaggcgcgaggaaataccaacgc

SEQ ID NO: 727744 - DNA, 25 bp, Mus musculus
gtgaggcgcgtgatatcccgcgtct

SEQ ID NO: 727745 - DNA, 25 bp, Mus musculus
gtgaggcgcgtgttatcccgcgtct

SEQ ID NO: 727746 - DNA, 25 bp, Mus musculus
gtgagggaccagaggctcagacccc

SEQ ID NO: 727747 - DNA, 25 bp, Mus musculus
gtgagggaccagtggctcagacccc

SEQ ID NO: 727748 - DNA, 25 bp, Mus musculus
gtgagggcctctcggactcctgtat

SEQ ID NO: 727749 - DNA, 25 bp, Mus musculus
gtgagggcctctgggactcctgtat

SEQ ID NO: 727750 - DNA, 25 bp, Mus musculus
gtgagggtggtaagatcttctccac

SEQ ID NO: 727751 - DNA, 25 bp, Mus musculus
gtgagggtggtatgatcttctccac

SEQ ID NO: 727752 - DNA, 25 bp, Mus musculus
gtgagggttctcacagcaaaggaac

SEQ ID NO: 727753 - DNA, 25 bp, Mus musculus
gtgagggttctctcagcaaaggaac

SEQ ID NO: 727754 - DNA, 25 bp, Mus musculus
gtgaggtccagtaccacgagtccga

SEQ ID NO: 727755 - DNA, 25 bp, Mus musculus
gtgaggtccagttccacgagtccga

SEQ ID NO: 727756 - DNA, 25 bp, Mus musculus
gtgaggtcctgcacacttgatgggt

SEQ ID NO: 727757 - DNA, 25 bp, Mus musculus
gtgaggtcctgctcacttgatgggt

SEQ ID NO: 727758 - DNA, 25 bp, Mus musculus
gtgaggtggccactcctgcaaccgt

SEQ ID NO: 727759 - DNA, 25 bp, Mus musculus
gtgaggtggccagtcctgcaaccgt

SEQ ID NO: 727760 - DNA, 25 bp, Mus musculus
gtgaggttcgcacgccgcgactcaa

SEQ ID NO: 727761 - DNA, 25 bp, Mus musculus
gtgaggttcgcaggccgcgactcaa

SEQ ID NO: 727762 - DNA, 25 bp, Mus musculus
gtgagtaaccacctgtacctggaag

SEQ ID NO: 727763 - DNA, 25 bp, Mus musculus
gtgagtaaccacgtgtacctggaag

SEQ ID NO: 727764 - DNA, 25 bp, Mus musculus
gtgagtaccccgactctgtcttttc

SEQ ID NO: 727765 - DNA, 25 bp, Mus musculus
gtgagtaccccgtctctgtcttttc

SEQ ID NO: 727766 - DNA, 25 bp, Mus musculus
gtgagtaccgctcgcacatcaactt

SEQ ID NO: 727767 - DNA, 25 bp, Mus musculus
gtgagtaccgctggcacatcaactt

SEQ ID NO: 727768 - DNA, 25 bp, Mus musculus
gtgagtagcagtcggtacccagacc

SEQ ID NO: 727769 - DNA, 25 bp, Mus musculus
gtgagtagcagtgggtacccagacc

SEQ ID NO: 727770 - DNA, 25 bp, Mus musculus
gtgagtcagaaaattctaacagaga

SEQ ID NO: 727771 - DNA, 25 bp, Mus musculus
gtgagtcagaaatttctaacagaga

SEQ ID NO: 727772 - DNA, 25 bp, Mus musculus
gtgagtcagcctcaggacccacatc

SEQ ID NO: 727773 - DNA, 25 bp, Mus musculus
gtgagtcagcctgaggacccacatc

SEQ ID NO: 727774 - DNA, 25 bp, Mus musculus
gtgagtccactgagccggccagctg

SEQ ID NO: 727775 - DNA, 25 bp, Mus musculus
gtgagtccactgtgccggccagctg

SEQ ID NO: 727776 - DNA, 25 bp, Mus musculus
gtgagtccctccaggctccgaatag

SEQ ID NO: 727777 - DNA, 25 bp, Mus musculus
gtgagtccctcctggctccgaatag

SEQ ID NO: 727778 - DNA, 25 bp, Mus musculus
gtgagtccggcccagggcaggtagt

SEQ ID NO: 727779 - DNA, 25 bp, Mus musculus
gtgagtccggccgagggcaggtagt

SEQ ID NO: 727780 - DNA, 25 bp, Mus musculus
gtgagtcctgcaacctggcggccta

SEQ ID NO: 727781 - DNA, 25 bp, Mus musculus
gtgagtcctgcatcctggcggccta

SEQ ID NO: 727782 - DNA, 25 bp, Mus musculus
gtgagtctcaccagtgccaacggga

SEQ ID NO: 727783 - DNA, 25 bp, Mus musculus
gtgagtctcacctgtgccaacggga

SEQ ID NO: 727784 - DNA, 25 bp, Mus musculus
gtgagtctctgcagtccggaattct

SEQ ID NO: 727785 - DNA, 25 bp, Mus musculus
gtgagtctctgctgtccggaattct

SEQ ID NO: 727786 - DNA, 25 bp, Mus musculus
gtgagtgagcagattgtcattggca

SEQ ID NO: 727787 - DNA, 25 bp, Mus musculus
gtgagtgagcagtttgtcattggca

SEQ ID NO: 727788 - DNA, 25 bp, Mus musculus
gtgagtgaggagacattgaaagaat

SEQ ID NO: 727789 - DNA, 25 bp, Mus musculus
gtgagtgaggagtcattgaaagaat

SEQ ID NO: 727790 - DNA, 25 bp, Mus musculus
gtgagtgcatcacctcttagtttct

SEQ ID NO: 727791 - DNA, 25 bp, Mus musculus
gtgagtgcatcagctcttagtttct

SEQ ID NO: 727792 - DNA, 25 bp, Mus musculus
gtgagtggcccaaagcctgagacac

SEQ ID NO: 727793 - DNA, 25 bp, Mus musculus
gtgagtggcccatagcctgagacac

SEQ ID NO: 727794 - DNA, 25 bp, Mus musculus
gtgagtggcgttccctgagctccct

SEQ ID NO: 727795 - DNA, 25 bp, Mus musculus
gtgagtggcgttgcctgagctccct

SEQ ID NO: 727796 - DNA, 25 bp, Mus musculus
gtgagttctgcacccatgccttcac

SEQ ID NO: 727797 - DNA, 25 bp, Mus musculus
gtgagttctgcagccatgccttcac

SEQ ID NO: 727798 - DNA, 25 bp, Mus musculus
gtgagtttaaaacgcagcagctgga

SEQ ID NO: 727799 - DNA, 25 bp, Mus musculus
gtgagtttaaaaggcagcagctgga

SEQ ID NO: 727800 - DNA, 25 bp, Mus musculus
gtgataaagaagaggacaactcggg

SEQ ID NO: 727801 - DNA, 25 bp, Mus musculus
gtgataaagaagtggacaactcggg

SEQ ID NO: 727802 - DNA, 25 bp, Mus musculus
gtgatacactaccagccacgctctt

SEQ ID NO: 727803 - DNA, 25 bp, Mus musculus
gtgatacactacgagccacgctctt

SEQ ID NO: 727804 - DNA, 25 bp, Mus musculus
gtgatacagtgcaacgcctccgccg

SEQ ID NO: 727805 - DNA, 25 bp, Mus musculus
gtgatacagtgctacgcctccgccg

SEQ ID NO: 727806 - DNA, 25 bp, Mus musculus
gtgatactttaaacctcctcgaatg

SEQ ID NO: 727807 - DNA, 25 bp, Mus musculus
gtgatactttaatcctcctcgaatg

SEQ ID NO: 727808 - DNA, 25 bp, Mus musculus
gtgataggaaatacaagacctttca

SEQ ID NO: 727809 - DNA, 25 bp, Mus musculus
gtgataggaaattcaagacctttca

SEQ ID NO: 727810 - DNA, 25 bp, Mus musculus
gtgatatgtaaccaagggtgacttt

SEQ ID NO: 727811 - DNA, 25 bp, Mus musculus
gtgatatgtaacgaagggtgacttt

SEQ ID NO: 727812 - DNA, 25 bp, Mus musculus
gtgatatttatcctccggaagaagg

SEQ ID NO: 727813 - DNA, 25 bp, Mus musculus
gtgatatttatcgtccggaagaagg

SEQ ID NO: 727814 - DNA, 25 bp, Mus musculus
gtgatcaaagctctgtactcaggct

SEQ ID NO: 727815 - DNA, 25 bp, Mus musculus
gtgatcaaagctgtgtactcaggct

SEQ ID NO: 727816 - DNA, 25 bp, Mus musculus
gtgatcaacatgaaagaatcctgaa

SEQ ID NO: 727817 - DNA, 25 bp, Mus musculus
gtgatcaacatgtaagaatcctgaa

SEQ ID NO: 727818 - DNA, 25 bp, Mus musculus
gtgatcaccacgcaacactggctgg

SEQ ID NO: 727819 - DNA, 25 bp, Mus musculus
gtgatcaccacggaacactggctgg

SEQ ID NO: 727820 - DNA, 25 bp, Mus musculus
gtgatcacgggtcccctgaagctct

SEQ ID NO: 727821 - DNA, 25 bp, Mus musculus
gtgatcacgggtgccctgaagctct

SEQ ID NO: 727822 - DNA, 25 bp, Mus musculus
gtgatcacttccaccacggcagaac

SEQ ID NO: 727823 - DNA, 25 bp, Mus musculus
gtgatcacttcctccacggcagaac

SEQ ID NO: 727824 - DNA, 25 bp, Mus musculus
gtgatcagagagagaggattacact

SEQ ID NO: 727825 - DNA, 25 bp, Mus musculus
gtgatcagagagtgaggattacact

SEQ ID NO: 727826 - DNA, 25 bp, Mus musculus
gtgatcagcagcacagaggattcgg

SEQ ID NO: 727827 - DNA, 25 bp, Mus musculus
gtgatcagcagctcagaggattcgg

SEQ ID NO: 727828 - DNA, 25 bp, Mus musculus
gtgatcagcattcagcgggcctacc

SEQ ID NO: 727829 - DNA, 25 bp, Mus musculus
gtgatcagcattgagcgggcctacc

SEQ ID NO: 727830 - DNA, 25 bp, Mus musculus
gtgatcatgctaacctttgggaagt

SEQ ID NO: 727831 - DNA, 25 bp, Mus musculus
gtgatcatgctatcctttgggaagt

SEQ ID NO: 727832 - DNA, 25 bp, Mus musculus
gtgatcatggaactcaacttggtct

SEQ ID NO: 727833 - DNA, 25 bp, Mus musculus
gtgatcatggaagtcaacttggtct

SEQ ID NO: 727834 - DNA, 25 bp, Mus musculus
gtgatccagcacaaagaaaaatgca

SEQ ID NO: 727835 - DNA, 25 bp, Mus musculus
gtgatccagcactaagaaaaatgca

SEQ ID NO: 727836 - DNA, 25 bp, Mus musculus
gtgatcccaactcgacggtccacgg

SEQ ID NO: 727837 - DNA, 25 bp, Mus musculus
gtgatcccaactggacggtccacgg

SEQ ID NO: 727838 - DNA, 25 bp, Mus musculus
gtgatccccgccagcacggacgagt

SEQ ID NO: 727839 - DNA, 25 bp, Mus musculus
gtgatccccgcctgcacggacgagt

SEQ ID NO: 727840 - DNA, 25 bp, Mus musculus
gtgatccgagccctcctgaaggacc

SEQ ID NO: 727841 - DNA, 25 bp, Mus musculus
gtgatccgagccgtcctgaaggacc

SEQ ID NO: 727842 - DNA, 25 bp, Mus musculus
gtgatccgcaacatgagctctgagt

SEQ ID NO: 727843 - DNA, 25 bp, Mus musculus
gtgatccgcaacttgagctctgagt

SEQ ID NO: 727844 - DNA, 25 bp, Mus musculus
gtgatccggaaccagatcggcccgc

SEQ ID NO: 727845 - DNA, 25 bp, Mus musculus
gtgatccggaacgagatcggcccgc

SEQ ID NO: 727846 - DNA, 25 bp, Mus musculus
gtgatcctcatgcatgagacgctca

SEQ ID NO: 727847 - DNA, 25 bp, Mus musculus
gtgatcctcatggatgagacgctca

SEQ ID NO: 727848 - DNA, 25 bp, Mus musculus
gtgatcctccctatgaagtgcgtgg

SEQ ID NO: 727849 - DNA, 25 bp, Mus musculus
gtgatcctccctttgaagtgcgtgg

SEQ ID NO: 727850 - DNA, 25 bp, Mus musculus
gtgatcctctttctgcctagtgcga

SEQ ID NO: 727851 - DNA, 25 bp, Mus musculus
gtgatcctctttgtgcctagtgcga

SEQ ID NO: 727852 - DNA, 25 bp, Mus musculus
gtgatcctgccacagccactgacta

SEQ ID NO: 727853 - DNA, 25 bp, Mus musculus
gtgatcctgccagagccactgacta

SEQ ID NO: 727854 - DNA, 25 bp, Mus musculus
gtgatccttactccgcctgggatgg

SEQ ID NO: 727855 - DNA, 25 bp, Mus musculus
gtgatccttactgcgcctgggatgg

SEQ ID NO: 727856 - DNA, 25 bp, Mus musculus
gtgatccttgtcattgtactaagca

SEQ ID NO: 727857 - DNA, 25 bp, Mus musculus
gtgatccttgtctttgtactaagca

SEQ ID NO: 727858 - DNA, 25 bp, Mus musculus
gtgatcgagactcagaagactctct

SEQ ID NO: 727859 - DNA, 25 bp, Mus musculus
gtgatcgagactgagaagactctct

SEQ ID NO: 727860 - DNA, 25 bp, Mus musculus
gtgatctactttacagccttattcc

SEQ ID NO: 727861 - DNA, 25 bp, Mus musculus
gtgatctacttttcagccttattcc

SEQ ID NO: 727862 - DNA, 25 bp, Mus musculus
gtgatctatttgacacactgtagct

SEQ ID NO: 727863 - DNA, 25 bp, Mus musculus
gtgatctatttgtcacactgtagct

SEQ ID NO: 727864 - DNA, 25 bp, Mus musculus
gtgatctctgcacgaagggctttcc

SEQ ID NO: 727865 - DNA, 25 bp, Mus musculus
gtgatctctgcaggaagggctttcc

SEQ ID NO: 727866 - DNA, 25 bp, Mus musculus
gtgatctgctttccctgtttcctct

SEQ ID NO: 727867 - DNA, 25 bp, Mus musculus
gtgatctgctttgcctgtttcctct

SEQ ID NO: 727868 - DNA, 25 bp, Mus musculus
gtgatctggaccctgcggacttgct

SEQ ID NO: 727869 - DNA, 25 bp, Mus musculus
gtgatctggaccgtgcggacttgct

SEQ ID NO: 727870 - DNA, 25 bp, Mus musculus
gtgatctgtaaaacggatgctccaa

SEQ ID NO: 727871 - DNA, 25 bp, Mus musculus
gtgatctgtaaatcggatgctccaa

SEQ ID NO: 727872 - DNA, 25 bp, Mus musculus
gtgatgaaaagcagcttgaccgatt

SEQ ID NO: 727873 - DNA, 25 bp, Mus musculus
gtgatgaaaagctgcttgaccgatt

SEQ ID NO: 727874 - DNA, 25 bp, Mus musculus
gtgatgaagaagcaagatgtcatct

SEQ ID NO: 727875 - DNA, 25 bp, Mus musculus
gtgatgaagaaggaagatgtcatct

SEQ ID NO: 727876 - DNA, 25 bp, Mus musculus
gtgatgacgacaagatccgactgca

SEQ ID NO: 727877 - DNA, 25 bp, Mus musculus
gtgatgacgacatgatccgactgca

SEQ ID NO: 727878 - DNA, 25 bp, Mus musculus
gtgatgagcagacccacacgtgacc

SEQ ID NO: 727879 - DNA, 25 bp, Mus musculus
gtgatgagcagagccacacgtgacc

SEQ ID NO: 727880 - DNA, 25 bp, Mus musculus
gtgatgatgagcaagcagatctgct

SEQ ID NO: 727881 - DNA, 25 bp, Mus musculus
gtgatgatgagctagcagatctgct

SEQ ID NO: 727882 - DNA, 25 bp, Mus musculus
gtgatgatgtttctaggcttcctgg

SEQ ID NO: 727883 - DNA, 25 bp, Mus musculus
gtgatgatgtttgtaggcttcctgg

SEQ ID NO: 727884 - DNA, 25 bp, Mus musculus
gtgatgcaaataagccccttgggca

SEQ ID NO: 727885 - DNA, 25 bp, Mus musculus
gtgatgcaaatatgccccttgggca

SEQ ID NO: 727886 - DNA, 25 bp, Mus musculus
gtgatgcacacccagtgtcattcca

SEQ ID NO: 727887 - DNA, 25 bp, Mus musculus
gtgatgcacaccgagtgtcattcca

SEQ ID NO: 727888 - DNA, 25 bp, Mus musculus
gtgatgcacccgcaaggaggcttca

SEQ ID NO: 727889 - DNA, 25 bp, Mus musculus
gtgatgcacccggaaggaggcttca

SEQ ID NO: 727890 - DNA, 25 bp, Mus musculus
gtgatgcccacacctacgtgcaggc

SEQ ID NO: 727891 - DNA, 25 bp, Mus musculus
gtgatgcccacagctacgtgcaggc

SEQ ID NO: 727892 - DNA, 25 bp, Mus musculus
gtgatgctagacagggacggccaca

SEQ ID NO: 727893 - DNA, 25 bp, Mus musculus
gtgatgctagactgggacggccaca

SEQ ID NO: 727894 - DNA, 25 bp, Mus musculus
gtgatgctaggaacaaaagcccaca

SEQ ID NO: 727895 - DNA, 25 bp, Mus musculus
gtgatgctaggatcaaaagcccaca

SEQ ID NO: 727896 - DNA, 25 bp, Mus musculus
gtgatgctcaagagccagccgagcc

SEQ ID NO: 727897 - DNA, 25 bp, Mus musculus
gtgatgctcaagtgccagccgagcc

SEQ ID NO: 727898 - DNA, 25 bp, Mus musculus
gtgatgctgcccaactcccctgagg

SEQ ID NO: 727899 - DNA, 25 bp, Mus musculus
gtgatgctgccctactcccctgagg

SEQ ID NO: 727900 - DNA, 25 bp, Mus musculus
gtgatggaacttccgccactgggct

SEQ ID NO: 727901 - DNA, 25 bp, Mus musculus
gtgatggaacttgcgccactgggct

SEQ ID NO: 727902 - DNA, 25 bp, Mus musculus
gtgatggaagtcattcagagggcct

SEQ ID NO: 727903 - DNA, 25 bp, Mus musculus
gtgatggaagtctttcagagggcct

SEQ ID NO: 727904 - DNA, 25 bp, Mus musculus
gtgatggacatcattcgcaactaca

SEQ ID NO: 727905 - DNA, 25 bp, Mus musculus
gtgatggacatctttcgcaactaca

SEQ ID NO: 727906 - DNA, 25 bp, Mus musculus
gtgatggactctagctctcctagaa

SEQ ID NO: 727907 - DNA, 25 bp, Mus musculus
gtgatggactcttgctctcctagaa

SEQ ID NO: 727908 - DNA, 25 bp, Mus musculus
gtgatggcatgaatgcttacatggc

SEQ ID NO: 727909 - DNA, 25 bp, Mus musculus
gtgatggcatgattgcttacatggc

SEQ ID NO: 727910 - DNA, 25 bp, Mus musculus
gtgatggctcagatttgtggcgcct

SEQ ID NO: 727911 - DNA, 25 bp, Mus musculus
gtgatggctcagttttgtggcgcct

SEQ ID NO: 727912 - DNA, 25 bp, Mus musculus
gtgatggctcatcctgctacccggt

SEQ ID NO: 727913 - DNA, 25 bp, Mus musculus
gtgatggctcatgctgctacccggt

SEQ ID NO: 727914 - DNA, 25 bp, Mus musculus
gtgatggcttccagctccaacgatg

SEQ ID NO: 727915 - DNA, 25 bp, Mus musculus
gtgatggcttcctgctccaacgatg

SEQ ID NO: 727916 - DNA, 25 bp, Mus musculus
gtgatgggaaagacattacagtgcc

SEQ ID NO: 727917 - DNA, 25 bp, Mus musculus
gtgatgggaaagtcattacagtgcc

SEQ ID NO: 727918 - DNA, 25 bp, Mus musculus
gtgatgtcacacctgaacacagaca

SEQ ID NO: 727919 - DNA, 25 bp, Mus musculus
gtgatgtcacacgtgaacacagaca

SEQ ID NO: 727920 - DNA, 25 bp, Mus musculus
gtgatgtcagctcaatgtaaaagac

SEQ ID NO: 727921 - DNA, 25 bp, Mus musculus
gtgatgtcagctccgcgtacaacaa

SEQ ID NO: 727922 - DNA, 25 bp, Mus musculus
gtgatgtcagctgaatgtaaaagac

SEQ ID NO: 727923 - DNA, 25 bp, Mus musculus
gtgatgtcagctgcgcgtacaacaa

SEQ ID NO: 727924 - DNA, 25 bp, Mus musculus
gtgatgtccatccaagtgcagcctg

SEQ ID NO: 727925 - DNA, 25 bp, Mus musculus
gtgatgtccatcgaagtgcagcctg

SEQ ID NO: 727926 - DNA, 25 bp, Mus musculus
gtgatgtggctcagctcagcctgga

SEQ ID NO: 727927 - DNA, 25 bp, Mus musculus
gtgatgtggctctgctcagcctgga

SEQ ID NO: 727928 - DNA, 25 bp, Mus musculus
gtgatgttcctgagttgaaagaaga

SEQ ID NO: 727929 - DNA, 25 bp, Mus musculus
gtgatgttcctgtgttgaaagaaga

SEQ ID NO: 727930 - DNA, 25 bp, Mus musculus
gtgattacacacaacagaaggccta

SEQ ID NO: 727931 - DNA, 25 bp, Mus musculus
gtgattacacactacagaaggccta

SEQ ID NO: 727932 - DNA, 25 bp, Mus musculus
gtgattacctctatcctgacaccac

SEQ ID NO: 727933 - DNA, 25 bp, Mus musculus
gtgattacctctttcctgacaccac

SEQ ID NO: 727934 - DNA, 25 bp, Mus musculus
gtgattacgtatctgagcctgagac

SEQ ID NO: 727935 - DNA, 25 bp, Mus musculus
gtgattacgtatgtgagcctgagac

SEQ ID NO: 727936 - DNA, 25 bp, Mus musculus
gtgattagccgaccgccctgccaag

SEQ ID NO: 727937 - DNA, 25 bp, Mus musculus
gtgattagccgagcgccctgccaag

SEQ ID NO: 727938 - DNA, 25 bp, Mus musculus
gtgattatggcaactatacaatgcc

SEQ ID NO: 727939 - DNA, 25 bp, Mus musculus
gtgattatggcatctatacaatgcc

SEQ ID NO: 727940 - DNA, 25 bp, Mus musculus
gtgattatgtggcacccctacaccg

SEQ ID NO: 727941 - DNA, 25 bp, Mus musculus
gtgattatgtgggacccctacaccg

SEQ ID NO: 727942 - DNA, 25 bp, Mus musculus
gtgattcacaagatgctgctctcca

SEQ ID NO: 727943 - DNA, 25 bp, Mus musculus
gtgattcacaagttgctgctctcca

SEQ ID NO: 727944 - DNA, 25 bp, Mus musculus
gtgattcagagtactcctccacagg

SEQ ID NO: 727945 - DNA, 25 bp, Mus musculus
gtgattcagagttctcctccacagg

SEQ ID NO: 727946 - DNA, 25 bp, Mus musculus
gtgattcaggataacacaacacctc

SEQ ID NO: 727947 - DNA, 25 bp, Mus musculus
gtgattcaggattacacaacacctc

SEQ ID NO: 727948 - DNA, 25 bp, Mus musculus
gtgattcctggtcgctcatctactc

SEQ ID NO: 727949 - DNA, 25 bp, Mus musculus
gtgattcctggtggctcatctactc

SEQ ID NO: 727950 - DNA, 25 bp, Mus musculus
gtgattcgcaacaccaacctggacg

SEQ ID NO: 727951 - DNA, 25 bp, Mus musculus
gtgattcgcaactccaacctggacg

SEQ ID NO: 727952 - DNA, 25 bp, Mus musculus
gtgattctctgtaccgatgcaagca

SEQ ID NO: 727953 - DNA, 25 bp, Mus musculus
gtgattctctgttccgatgcaagca

SEQ ID NO: 727954 - DNA, 25 bp, Mus musculus
gtgattctggtgaaagagaaggcca

SEQ ID NO: 727955 - DNA, 25 bp, Mus musculus
gtgattctggtgtaagagaaggcca

SEQ ID NO: 727956 - DNA, 25 bp, Mus musculus
gtgattgacaacaccaacccagatg

SEQ ID NO: 727957 - DNA, 25 bp, Mus musculus
gtgattgacaactccaacccagatg

SEQ ID NO: 727958 - DNA, 25 bp, Mus musculus
gtgattgacctgatcatggcaggga

SEQ ID NO: 727959 - DNA, 25 bp, Mus musculus
gtgattgacctgcaacgggcctacc

SEQ ID NO: 727960 - DNA, 25 bp, Mus musculus
gtgattgacctggaacgggcctacc

SEQ ID NO: 727961 - DNA, 25 bp, Mus musculus
gtgattgacctgttcatggcaggga

SEQ ID NO: 727962 - DNA, 25 bp, Mus musculus
gtgattgatgccctccgagtgaaca

SEQ ID NO: 727963 - DNA, 25 bp, Mus musculus
gtgattgatgccgtccgagtgaaca

SEQ ID NO: 727964 - DNA, 25 bp, Mus musculus
gtgattggcagacatcggcagcccc

SEQ ID NO: 727965 - DNA, 25 bp, Mus musculus
gtgattggcagagatcggcagcccc

SEQ ID NO: 727966 - DNA, 25 bp, Mus musculus
gtgattgtagatcccctgcttcgag

SEQ ID NO: 727967 - DNA, 25 bp, Mus musculus
gtgattgtagatgccctgcttcgag

SEQ ID NO: 727968 - DNA, 25 bp, Mus musculus
gtgatttaccgcctgccattgtcaa

SEQ ID NO: 727969 - DNA, 25 bp, Mus musculus
gtgatttaccgcgtgccattgtcaa

SEQ ID NO: 727970 - DNA, 25 bp, Mus musculus
gtgatttccagtatttgccaccaga

SEQ ID NO: 727971 - DNA, 25 bp, Mus musculus
gtgatttccagtttttgccaccaga

SEQ ID NO: 727972 - DNA, 25 bp, Mus musculus
gtgatttctgacatagcaagaacta

SEQ ID NO: 727973 - DNA, 25 bp, Mus musculus
gtgatttctgacttagcaagaacta

SEQ ID NO: 727974 - DNA, 25 bp, Mus musculus
gtgattttcccactcagcgactgga

SEQ ID NO: 727975 - DNA, 25 bp, Mus musculus
gtgattttcccagtcagcgactgga

SEQ ID NO: 727976 - DNA, 25 bp, Mus musculus
gtgcaaaaggcaccggacacagtgt

SEQ ID NO: 727977 - DNA, 25 bp, Mus musculus
gtgcaaaaggcagcggacacagtgt

SEQ ID NO: 727978 - DNA, 25 bp, Mus musculus
gtgcaaaaggtgatgccggtgaaaa

SEQ ID NO: 727979 - DNA, 25 bp, Mus musculus
gtgcaaaaggtgttgccggtgaaaa

SEQ ID NO: 727980 - DNA, 25 bp, Mus musculus
gtgcaaaatgacctgtatggagtaa

SEQ ID NO: 727981 - DNA, 25 bp, Mus musculus
gtgcaaaatgacgtgtatggagtaa

SEQ ID NO: 727982 - DNA, 25 bp, Mus musculus
gtgcaaagagctcctggacactgtg

SEQ ID NO: 727983 - DNA, 25 bp, Mus musculus
gtgcaaagagctgctggacactgtg

SEQ ID NO: 727984 - DNA, 25 bp, Mus musculus
gtgcaaatagtcaacaagccggtgg

SEQ ID NO: 727985 - DNA, 25 bp, Mus musculus
gtgcaaatagtctacaagccggtgg

SEQ ID NO: 727986 - DNA, 25 bp, Mus musculus
gtgcaaatctaacatcatggcctcg

SEQ ID NO: 727987 - DNA, 25 bp, Mus musculus
gtgcaaatctaagatcatggcctcg

SEQ ID NO: 727988 - DNA, 25 bp, Mus musculus
gtgcaacaatacctggatgttgtgg

SEQ ID NO: 727989 - DNA, 25 bp, Mus musculus
gtgcaacaatacgtggatgttgtgg

SEQ ID NO: 727990 - DNA, 25 bp, Mus musculus
gtgcaacaattccaaacccaaaaag

SEQ ID NO: 727991 - DNA, 25 bp, Mus musculus
gtgcaacaattcgaaacccaaaaag

SEQ ID NO: 727992 - DNA, 25 bp, Mus musculus
gtgcaacacaagcatccacactggc

SEQ ID NO: 727993 - DNA, 25 bp, Mus musculus
gtgcaacacaaggatccacactggc

SEQ ID NO: 727994 - DNA, 25 bp, Mus musculus
gtgcaacagagacaaattatgcgaa

SEQ ID NO: 727995 - DNA, 25 bp, Mus musculus
gtgcaacagagagaaattatgcgaa

SEQ ID NO: 727996 - DNA, 25 bp, Mus musculus
gtgcaacctttgcaaataactcatg

SEQ ID NO: 727997 - DNA, 25 bp, Mus musculus
gtgcaacctttggaaataactcatg

SEQ ID NO: 727998 - DNA, 25 bp, Mus musculus
gtgcaagaactcagagccccaggtg

SEQ ID NO: 727999 - DNA, 25 bp, Mus musculus
gtgcaagaactctgagccccaggtg

SEQ ID NO: 728000 - DNA, 25 bp, Mus musculus
gtgcaagagcgccagaaggaaatct

SEQ ID NO: 728001 - DNA, 25 bp, Mus musculus
gtgcaagagcgcgagaaggaaatct

SEQ ID NO: 728002 - DNA, 25 bp, Mus musculus
gtgcaagcagaactactaagaaaac

SEQ ID NO: 728003 - DNA, 25 bp, Mus musculus
gtgcaagcagaagtactaagaaaac

SEQ ID NO: 728004 - DNA, 25 bp, Mus musculus
gtgcaagccataaatgtcctgaagg

SEQ ID NO: 728005 - DNA, 25 bp, Mus musculus
gtgcaagccatatatgtcctgaagg

SEQ ID NO: 728006 - DNA, 25 bp, Mus musculus
gtgcaagcctgcattggccgctcac

SEQ ID NO: 728007 - DNA, 25 bp, Mus musculus
gtgcaagcctgctttggccgctcac

SEQ ID NO: 728008 - DNA, 25 bp, Mus musculus
gtgcaagctctgaggggcctctttt

SEQ ID NO: 728009 - DNA, 25 bp, Mus musculus
gtgcaagctctgtggggcctctttt

SEQ ID NO: 728010 - DNA, 25 bp, Mus musculus
gtgcaatccgttaacatccgacctc

SEQ ID NO: 728011 - DNA, 25 bp, Mus musculus
gtgcaatccgtttacatccgacctc

SEQ ID NO: 728012 - DNA, 25 bp, Mus musculus
gtgcaatggctgcagcaagtcccag

SEQ ID NO: 728013 - DNA, 25 bp, Mus musculus
gtgcaatggctggagcaagtcccag

SEQ ID NO: 728014 - DNA, 25 bp, Mus musculus
gtgcacaaaggaagctcccgcctgc

SEQ ID NO: 728015 - DNA, 25 bp, Mus musculus
gtgcacaaaggatgctcccgcctgc

SEQ ID NO: 728016 - DNA, 25 bp, Mus musculus
gtgcacacaatcatcctggagaata

SEQ ID NO: 728017 - DNA, 25 bp, Mus musculus
gtgcacacaatcttcctggagaata

SEQ ID NO: 728018 - DNA, 25 bp, Mus musculus
gtgcacagtccaaatgtacattcaa

SEQ ID NO: 728019 - DNA, 25 bp, Mus musculus
gtgcacagtccatatgtacattcaa

SEQ ID NO: 728020 - DNA, 25 bp, Mus musculus
gtgcacatctagaccacatccctga

SEQ ID NO: 728021 - DNA, 25 bp, Mus musculus
gtgcacatctagtccacatccctga

SEQ ID NO: 728022 - DNA, 25 bp, Mus musculus
gtgcacatctataagaagaatggga

SEQ ID NO: 728023 - DNA, 25 bp, Mus musculus
gtgcacatctattagaagaatggga

SEQ ID NO: 728024 - DNA, 25 bp, Mus musculus
gtgcaccacactccaggataacggg

SEQ ID NO: 728025 - DNA, 25 bp, Mus musculus
gtgcaccacactgcaggataacggg

SEQ ID NO: 728026 - DNA, 25 bp, Mus musculus
gtgcaccacaggcattcagtgtctg

SEQ ID NO: 728027 - DNA, 25 bp, Mus musculus
gtgcaccacagggattcagtgtctg

SEQ ID NO: 728028 - DNA, 25 bp, Mus musculus
gtgcaccaccatacaatttgacagc

SEQ ID NO: 728029 - DNA, 25 bp, Mus musculus
gtgcaccaccattcaatttgacagc

SEQ ID NO: 728030 - DNA, 25 bp, Mus musculus
gtgcaccagcatatggtaagtgctt

SEQ ID NO: 728031 - DNA, 25 bp, Mus musculus
gtgcaccagcatttggtaagtgctt

SEQ ID NO: 728032 - DNA, 25 bp, Mus musculus
gtgcacccatcgactctcagttaca

SEQ ID NO: 728033 - DNA, 25 bp, Mus musculus
gtgcacccatcgtctctcagttaca

SEQ ID NO: 728034 - DNA, 25 bp, Mus musculus
gtgcaccgtggaagagccatgtcta

SEQ ID NO: 728035 - DNA, 25 bp, Mus musculus
gtgcaccgtggatgagccatgtcta

SEQ ID NO: 728036 - DNA, 25 bp, Mus musculus
gtgcaccttggtacagtcgtctaag

SEQ ID NO: 728037 - DNA, 25 bp, Mus musculus
gtgcaccttggttcagtcgtctaag

SEQ ID NO: 728038 - DNA, 25 bp, Mus musculus
gtgcactatggtcacagctgtctag

SEQ ID NO: 728039 - DNA, 25 bp, Mus musculus
gtgcactatggtgacagctgtctag

SEQ ID NO: 728040 - DNA, 25 bp, Mus musculus
gtgcactcacagatgagaagacaaa

SEQ ID NO: 728041 - DNA, 25 bp, Mus musculus
gtgcactcacagttgagaagacaaa

SEQ ID NO: 728042 - DNA, 25 bp, Mus musculus
gtgcactccggccttgtgacccttg

SEQ ID NO: 728043 - DNA, 25 bp, Mus musculus
gtgcactccggcgttgtgacccttg

SEQ ID NO: 728044 - DNA, 25 bp, Mus musculus
gtgcactgacacagacacaggctgt

SEQ ID NO: 728045 - DNA, 25 bp, Mus musculus
gtgcactgacactgacacaggctgt

SEQ ID NO: 728046 - DNA, 25 bp, Mus musculus
gtgcactgagcgacacggccctgaa

SEQ ID NO: 728047 - DNA, 25 bp, Mus musculus
gtgcactgagcgtcacggccctgaa

SEQ ID NO: 728048 - DNA, 25 bp, Mus musculus
gtgcactgcagcagcaagaacctgg

SEQ ID NO: 728049 - DNA, 25 bp, Mus musculus
gtgcactgcagctgcaagaacctgg

SEQ ID NO: 728050 - DNA, 25 bp, Mus musculus
gtgcagaaaataatagacctaaagc

SEQ ID NO: 728051 - DNA, 25 bp, Mus musculus
gtgcagaaaatattagacctaaagc

SEQ ID NO: 728052 - DNA, 25 bp, Mus musculus
gtgcagaacaaccagaccaactcac

SEQ ID NO: 728053 - DNA, 25 bp, Mus musculus
gtgcagaacaacgagaccaactcac

SEQ ID NO: 728054 - DNA, 25 bp, Mus musculus
gtgcagaacataacatcccggttgt

SEQ ID NO: 728055 - DNA, 25 bp, Mus musculus
gtgcagaacatatcatcccggttgt

SEQ ID NO: 728056 - DNA, 25 bp, Mus musculus
gtgcagaagaccctctatgatatac

SEQ ID NO: 728057 - DNA, 25 bp, Mus musculus
gtgcagaagaccgtctatgatatac

SEQ ID NO: 728058 - DNA, 25 bp, Mus musculus
gtgcagaagagaacagccgaacttc

SEQ ID NO: 728059 - DNA, 25 bp, Mus musculus
gtgcagaagagatcagccgaacttc

SEQ ID NO: 728060 - DNA, 25 bp, Mus musculus
gtgcagacctccaagcctgactgga

SEQ ID NO: 728061 - DNA, 25 bp, Mus musculus
gtgcagacctcctagcctgactgga

SEQ ID NO: 728062 - DNA, 25 bp, Mus musculus
gtgcagaccttaagtacagtccggg

SEQ ID NO: 728063 - DNA, 25 bp, Mus musculus
gtgcagaccttatgtacagtccggg

SEQ ID NO: 728064 - DNA, 25 bp, Mus musculus
gtgcagacgggcatgctcatctcct

SEQ ID NO: 728065 - DNA, 25 bp, Mus musculus
gtgcagacgggcttgctcatctcct

SEQ ID NO: 728066 - DNA, 25 bp, Mus musculus
gtgcagagacatccaatcattccag

SEQ ID NO: 728067 - DNA, 25 bp, Mus musculus
gtgcagagacatgcaatcattccag

SEQ ID NO: 728068 - DNA, 25 bp, Mus musculus
gtgcagagccccacttggatgcagc

SEQ ID NO: 728069 - DNA, 25 bp, Mus musculus
gtgcagagcccctcttggatgcagc

SEQ ID NO: 728070 - DNA, 25 bp, Mus musculus
gtgcagaggaacatgggcagtcccc

SEQ ID NO: 728071 - DNA, 25 bp, Mus musculus
gtgcagaggaacttgggcagtcccc

SEQ ID NO: 728072 - DNA, 25 bp, Mus musculus
gtgcagagggtactccacacgggcg

SEQ ID NO: 728073 - DNA, 25 bp, Mus musculus
gtgcagagggtagtccacacgggcg

SEQ ID NO: 728074 - DNA, 25 bp, Mus musculus
gtgcagaggtgaccacagatcacct

SEQ ID NO: 728075 - DNA, 25 bp, Mus musculus
gtgcagaggtgagcacagatcacct

SEQ ID NO: 728076 - DNA, 25 bp, Mus musculus
gtgcagagtggcacccacccagcag

SEQ ID NO: 728077 - DNA, 25 bp, Mus musculus
gtgcagagtggctcccacccagcag

SEQ ID NO: 728078 - DNA, 25 bp, Mus musculus
gtgcagagtgtccacatcgcagctt

SEQ ID NO: 728079 - DNA, 25 bp, Mus musculus
gtgcagagtgtcgacatcgcagctt

SEQ ID NO: 728080 - DNA, 25 bp, Mus musculus
gtgcagatcgcccaggaagcagccc

SEQ ID NO: 728081 - DNA, 25 bp, Mus musculus
gtgcagatcgccgaggaagcagccc

SEQ ID NO: 728082 - DNA, 25 bp, Mus musculus
gtgcagatgaacagcctcacatcgg

SEQ ID NO: 728083 - DNA, 25 bp, Mus musculus
gtgcagatgaactgcctcacatcgg

SEQ ID NO: 728084 - DNA, 25 bp, Mus musculus
gtgcagatgctgctcatggcctcaa

SEQ ID NO: 728085 - DNA, 25 bp, Mus musculus
gtgcagatgctggtcatggcctcaa

SEQ ID NO: 728086 - DNA, 25 bp, Mus musculus
gtgcagcaatgcatccgcaccgtcg

SEQ ID NO: 728087 - DNA, 25 bp, Mus musculus
gtgcagcaatgcttccgcaccgtcg

SEQ ID NO: 728088 - DNA, 25 bp, Mus musculus
gtgcagcagcacagccccatgtgtc

SEQ ID NO: 728089 - DNA, 25 bp, Mus musculus
gtgcagcagcactgccccatgtgtc

SEQ ID NO: 728090 - DNA, 25 bp, Mus musculus
gtgcagcagcggactttgatgatga

SEQ ID NO: 728091 - DNA, 25 bp, Mus musculus
gtgcagcagcggtctttgatgatga

SEQ ID NO: 728092 - DNA, 25 bp, Mus musculus
gtgcagccaggtagcagaggacact

SEQ ID NO: 728093 - DNA, 25 bp, Mus musculus
gtgcagccaggttgcagaggacact

SEQ ID NO: 728094 - DNA, 25 bp, Mus musculus
gtgcagccagttacccccaataaag

SEQ ID NO: 728095 - DNA, 25 bp, Mus musculus
gtgcagccagtttcccccaataaag

SEQ ID NO: 728096 - DNA, 25 bp, Mus musculus
gtgcagcccactccatcattgtcat

SEQ ID NO: 728097 - DNA, 25 bp, Mus musculus
gtgcagcccactgcatcattgtcat

SEQ ID NO: 728098 - DNA, 25 bp, Mus musculus
gtgcagctagtgataatagacggaa

SEQ ID NO: 728099 - DNA, 25 bp, Mus musculus
gtgcagctagtgttaatagacggaa

SEQ ID NO: 728100 - DNA, 25 bp, Mus musculus
gtgcagctcagtcacctcagcagcg

SEQ ID NO: 728101 - DNA, 25 bp, Mus musculus
gtgcagctcagtgacctcagcagcg

SEQ ID NO: 728102 - DNA, 25 bp, Mus musculus
gtgcagctgacaaggttgcccaagc

SEQ ID NO: 728103 - DNA, 25 bp, Mus musculus
gtgcagctgacatggttgcccaagc

SEQ ID NO: 728104 - DNA, 25 bp, Mus musculus
gtgcagctgagccatgctaggaaca

SEQ ID NO: 728105 - DNA, 25 bp, Mus musculus
gtgcagctgagcgatgctaggaaca

SEQ ID NO: 728106 - DNA, 25 bp, Mus musculus
gtgcagctgaggaacccaccgcgca

SEQ ID NO: 728107 - DNA, 25 bp, Mus musculus
gtgcagctgaggtacccaccgcgca

SEQ ID NO: 728108 - DNA, 25 bp, Mus musculus
gtgcagctgcccaggttcccacgga

SEQ ID NO: 728109 - DNA, 25 bp, Mus musculus
gtgcagctgccctggttcccacgga

SEQ ID NO: 728110 - DNA, 25 bp, Mus musculus
gtgcagctttttcggaaaacctggc

SEQ ID NO: 728111 - DNA, 25 bp, Mus musculus
gtgcagctttttgggaaaacctggc

SEQ ID NO: 728112 - DNA, 25 bp, Mus musculus
gtgcaggaccagacagacatcatct

SEQ ID NO: 728113 - DNA, 25 bp, Mus musculus
gtgcaggaccagtcagacatcatct

SEQ ID NO: 728114 - DNA, 25 bp, Mus musculus
gtgcaggagtttctgagaccagaaa

SEQ ID NO: 728115 - DNA, 25 bp, Mus musculus
gtgcaggagtttgtgagaccagaaa

SEQ ID NO: 728116 - DNA, 25 bp, Mus musculus
gtgcaggcacgcatgcaggccagct

SEQ ID NO: 728117 - DNA, 25 bp, Mus musculus
gtgcaggcacgcttgcaggccagct

SEQ ID NO: 728118 - DNA, 25 bp, Mus musculus
gtgcaggccacacgctctgtaccgt

SEQ ID NO: 728119 - DNA, 25 bp, Mus musculus
gtgcaggccacaggctctgtaccgt

SEQ ID NO: 728120 - DNA, 25 bp, Mus musculus
gtgcagggcttcatggatcgctgtc

SEQ ID NO: 728121 - DNA, 25 bp, Mus musculus
gtgcagggcttcttggatcgctgtc

SEQ ID NO: 728122 - DNA, 25 bp, Mus musculus
gtgcaggtagctccatcgccatcct

SEQ ID NO: 728123 - DNA, 25 bp, Mus musculus
gtgcaggtagctgcatcgccatcct

SEQ ID NO: 728124 - DNA, 25 bp, Mus musculus
gtgcaggtctctaaaaagctgagag

SEQ ID NO: 728125 - DNA, 25 bp, Mus musculus
gtgcaggtctcttaaaagctgagag

SEQ ID NO: 728126 - DNA, 25 bp, Mus musculus
gtgcaggtggcaagtccacgcctct

SEQ ID NO: 728127 - DNA, 25 bp, Mus musculus
gtgcaggtggcatgtccacgcctct

SEQ ID NO: 728128 - DNA, 25 bp, Mus musculus
gtgcaggtttgcaccatcccatacc

SEQ ID NO: 728129 - DNA, 25 bp, Mus musculus
gtgcaggtttgctccatcccatacc

SEQ ID NO: 728130 - DNA, 25 bp, Mus musculus
gtgcagtactgtcaccagaagttca

SEQ ID NO: 728131 - DNA, 25 bp, Mus musculus
gtgcagtactgtgaccagaagttca

SEQ ID NO: 728132 - DNA, 25 bp, Mus musculus
gtgcagtatgaccaccccaatcaca

SEQ ID NO: 728133 - DNA, 25 bp, Mus musculus
gtgcagtatgacgaccccaatcaca

SEQ ID NO: 728134 - DNA, 25 bp, Mus musculus
gtgcagtctggaccgtggagccctg

SEQ ID NO: 728135 - DNA, 25 bp, Mus musculus
gtgcagtctggagcgtggagccctg

SEQ ID NO: 728136 - DNA, 25 bp, Mus musculus
gtgcagtgagacattcccaacagca

SEQ ID NO: 728137 - DNA, 25 bp, Mus musculus
gtgcagtgagactttcccaacagca

SEQ ID NO: 728138 - DNA, 25 bp, Mus musculus
gtgcagttaaaaaccacgggaggtg

SEQ ID NO: 728139 - DNA, 25 bp, Mus musculus
gtgcagttaaaatccacgggaggtg

SEQ ID NO: 728140 - DNA, 25 bp, Mus musculus
gtgcagttttgcaaactcactgtcc

SEQ ID NO: 728141 - DNA, 25 bp, Mus musculus
gtgcagttttgctaactcactgtcc

SEQ ID NO: 728142 - DNA, 25 bp, Mus musculus
gtgcataactcaaaacacatgtgga

SEQ ID NO: 728143 - DNA, 25 bp, Mus musculus
gtgcataactcataacacatgtgga

SEQ ID NO: 728144 - DNA, 25 bp, Mus musculus
gtgcataagtaaagggtaaagtatt

SEQ ID NO: 728145 - DNA, 25 bp, Mus musculus
gtgcataagtaatgggtaaagtatt

SEQ ID NO: 728146 - DNA, 25 bp, Mus musculus
gtgcatatccagatgacttaccctc

SEQ ID NO: 728147 - DNA, 25 bp, Mus musculus
gtgcatatccagttgacttaccctc

SEQ ID NO: 728148 - DNA, 25 bp, Mus musculus
gtgcatcaatgtacctccacccaga

SEQ ID NO: 728149 - DNA, 25 bp, Mus musculus
gtgcatcaatgttcctccacccaga

SEQ ID NO: 728150 - DNA, 25 bp, Mus musculus
gtgcatccaccacgtgaagcgcctt

SEQ ID NO: 728151 - DNA, 25 bp, Mus musculus
gtgcatccaccaggtgaagcgcctt

SEQ ID NO: 728152 - DNA, 25 bp, Mus musculus
gtgcatcctcgtccccaggattggt

SEQ ID NO: 728153 - DNA, 25 bp, Mus musculus
gtgcatcctcgtgcccaggattggt

SEQ ID NO: 728154 - DNA, 25 bp, Mus musculus
gtgcatgacggacaggatctcagta

SEQ ID NO: 728155 - DNA, 25 bp, Mus musculus
gtgcatgacggagaggatctcagta

SEQ ID NO: 728156 - DNA, 25 bp, Mus musculus
gtgcatgagctcattccagcagtaa

SEQ ID NO: 728157 - DNA, 25 bp, Mus musculus
gtgcatgagctctttccagcagtaa

SEQ ID NO: 728158 - DNA, 25 bp, Mus musculus
gtgcatgcacatcagaacctgtcct

SEQ ID NO: 728159 - DNA, 25 bp, Mus musculus
gtgcatgcacatgagaacctgtcct

SEQ ID NO: 728160 - DNA, 25 bp, Mus musculus
gtgcatgctatgacacaagaccttc

SEQ ID NO: 728161 - DNA, 25 bp, Mus musculus
gtgcatgctatgtcacaagaccttc

SEQ ID NO: 728162 - DNA, 25 bp, Mus musculus
gtgcatggacagcaactcgcctctc

SEQ ID NO: 728163 - DNA, 25 bp, Mus musculus
gtgcatggacaggaactcgcctctc

SEQ ID NO: 728164 - DNA, 25 bp, Mus musculus
gtgcatggccgaccctgcaaggttc

SEQ ID NO: 728165 - DNA, 25 bp, Mus musculus
gtgcatggccgagcctgcaaggttc

SEQ ID NO: 728166 - DNA, 25 bp, Mus musculus
gtgcatggtgtcacctaccaggagt

SEQ ID NO: 728167 - DNA, 25 bp, Mus musculus
gtgcatggtgtctcctaccaggagt

SEQ ID NO: 728168 - DNA, 25 bp, Mus musculus
gtgcatgtcttcaacatcgactacg

SEQ ID NO: 728169 - DNA, 25 bp, Mus musculus
gtgcatgtcttctacatcgactacg

SEQ ID NO: 728170 - DNA, 25 bp, Mus musculus
gtgcatgtggtcagtcagtcctatg

SEQ ID NO: 728171 - DNA, 25 bp, Mus musculus
gtgcatgtggtctgtcagtcctatg

SEQ ID NO: 728172 - DNA, 25 bp, Mus musculus
gtgcattatgggagaaatggtttgc

SEQ ID NO: 728173 - DNA, 25 bp, Mus musculus
gtgcattatgggtgaaatggtttgc

SEQ ID NO: 728174 - DNA, 25 bp, Mus musculus
gtgcattctcatctccaaattctgg

SEQ ID NO: 728175 - DNA, 25 bp, Mus musculus
gtgcattctcatgtccaaattctgg

SEQ ID NO: 728176 - DNA, 25 bp, Mus musculus
gtgcattgaccccaaattaaagtgg

SEQ ID NO: 728177 - DNA, 25 bp, Mus musculus
gtgcattgacccgaaattaaagtgg

SEQ ID NO: 728178 - DNA, 25 bp, Mus musculus
gtgcatttatcccaagccagcccga

SEQ ID NO: 728179 - DNA, 25 bp, Mus musculus
gtgcatttatccgaagccagcccga

SEQ ID NO: 728180 - DNA, 25 bp, Mus musculus
gtgcatttcctcagatggatcttca

SEQ ID NO: 728181 - DNA, 25 bp, Mus musculus
gtgcatttcctctgatggatcttca

SEQ ID NO: 728182 - DNA, 25 bp, Mus musculus
gtgcattttactcagtctctcagga

SEQ ID NO: 728183 - DNA, 25 bp, Mus musculus
gtgcattttactgagtctctcagga

SEQ ID NO: 728184 - DNA, 25 bp, Mus musculus
gtgccaacactgctatacctggtca

SEQ ID NO: 728185 - DNA, 25 bp, Mus musculus
gtgccaacactggtatacctggtca

SEQ ID NO: 728186 - DNA, 25 bp, Mus musculus
gtgccaacgaggacttccactacgg

SEQ ID NO: 728187 - DNA, 25 bp, Mus musculus
gtgccaacgaggtcttccactacgg

SEQ ID NO: 728188 - DNA, 25 bp, Mus musculus
gtgccaagctcacgcctcagaaggt

SEQ ID NO: 728189 - DNA, 25 bp, Mus musculus
gtgccaagctcaggcctcagaaggt

SEQ ID NO: 728190 - DNA, 25 bp, Mus musculus
gtgccaatagttctgctgagcaaag

SEQ ID NO: 728191 - DNA, 25 bp, Mus musculus
gtgccaatagttgtgctgagcaaag

SEQ ID NO: 728192 - DNA, 25 bp, Mus musculus
gtgccaatgatcactgaagctgggc

SEQ ID NO: 728193 - DNA, 25 bp, Mus musculus
gtgccaatgatctctgaagctgggc

SEQ ID NO: 728194 - DNA, 25 bp, Mus musculus
gtgccaatgggcaccattccagttg

SEQ ID NO: 728195 - DNA, 25 bp, Mus musculus
gtgccaatgggctccattccagttg

SEQ ID NO: 728196 - DNA, 25 bp, Mus musculus
gtgccaattgagacttcctgcccag

SEQ ID NO: 728197 - DNA, 25 bp, Mus musculus
gtgccaattgagtcttcctgcccag

SEQ ID NO: 728198 - DNA, 25 bp, Mus musculus
gtgccacagcacatggatttcagaa

SEQ ID NO: 728199 - DNA, 25 bp, Mus musculus
gtgccacagcacttggatttcagaa

SEQ ID NO: 728200 - DNA, 25 bp, Mus musculus
gtgccaccaaagaccaaaaacgaag

SEQ ID NO: 728201 - DNA, 25 bp, Mus musculus
gtgccaccaaagtccaaaaacgaag

SEQ ID NO: 728202 - DNA, 25 bp, Mus musculus
gtgccacccgctccagaaaagagta

SEQ ID NO: 728203 - DNA, 25 bp, Mus musculus
gtgccacccgctgcagaaaagagta

SEQ ID NO: 728204 - DNA, 25 bp, Mus musculus
gtgccacgaccgagtaccacacatt

SEQ ID NO: 728205 - DNA, 25 bp, Mus musculus
gtgccacgaccgtgtaccacacatt

SEQ ID NO: 728206 - DNA, 25 bp, Mus musculus
gtgccacgagagacagcccacagtg

SEQ ID NO: 728207 - DNA, 25 bp, Mus musculus
gtgccacgagagtcagcccacagtg

SEQ ID NO: 728208 - DNA, 25 bp, Mus musculus
gtgccactggtgacagcgcaaactg

SEQ ID NO: 728209 - DNA, 25 bp, Mus musculus
gtgccactggtgtcagcgcaaactg

SEQ ID NO: 728210 - DNA, 25 bp, Mus musculus
gtgccactgtctcctccttcattga

SEQ ID NO: 728211 - DNA, 25 bp, Mus musculus
gtgccactgtctgctccttcattga

SEQ ID NO: 728212 - DNA, 25 bp, Mus musculus
gtgccacttctcctaaacggaaaga

SEQ ID NO: 728213 - DNA, 25 bp, Mus musculus
gtgccacttctcgtaaacggaaaga

SEQ ID NO: 728214 - DNA, 25 bp, Mus musculus
gtgccagagtctacatctacactac

SEQ ID NO: 728215 - DNA, 25 bp, Mus musculus
gtgccagagtcttcatctacactac

SEQ ID NO: 728216 - DNA, 25 bp, Mus musculus
gtgccagattcccagagcgtattca

SEQ ID NO: 728217 - DNA, 25 bp, Mus musculus
gtgccagattccgagagcgtattca

SEQ ID NO: 728218 - DNA, 25 bp, Mus musculus
gtgccagcacaaagagagcgggcac

SEQ ID NO: 728219 - DNA, 25 bp, Mus musculus
gtgccagcacaatgagagcgggcac

SEQ ID NO: 728220 - DNA, 25 bp, Mus musculus
gtgccagccaaaatacctgaaattg

SEQ ID NO: 728221 - DNA, 25 bp, Mus musculus
gtgccagccaaattacctgaaattg

SEQ ID NO: 728222 - DNA, 25 bp, Mus musculus
gtgccagcggcactttgaagatttc

SEQ ID NO: 728223 - DNA, 25 bp, Mus musculus
gtgccagcggcagtttgaagatttc

SEQ ID NO: 728224 - DNA, 25 bp, Mus musculus
gtgccagcgggcaggtatcacagtc

SEQ ID NO: 728225 - DNA, 25 bp, Mus musculus
gtgccagcgggctggtatcacagtc

SEQ ID NO: 728226 - DNA, 25 bp, Mus musculus
gtgccagcgtgaacctccgagacat

SEQ ID NO: 728227 - DNA, 25 bp, Mus musculus
gtgccagcgtgatcctccgagacat

SEQ ID NO: 728228 - DNA, 25 bp, Mus musculus
gtgccaggagatcagaaccccagga

SEQ ID NO: 728229 - DNA, 25 bp, Mus musculus
gtgccaggagatgagaaccccagga

SEQ ID NO: 728230 - DNA, 25 bp, Mus musculus
gtgccagggccaatgactcaagaaa

SEQ ID NO: 728231 - DNA, 25 bp, Mus musculus
gtgccagggccattgactcaagaaa

SEQ ID NO: 728232 - DNA, 25 bp, Mus musculus
gtgccagggcctagtgcggctctca

SEQ ID NO: 728233 - DNA, 25 bp, Mus musculus
gtgccagggccttgtgcggctctca

SEQ ID NO: 728234 - DNA, 25 bp, Mus musculus
gtgccagggctgagcacctttctca

SEQ ID NO: 728235 - DNA, 25 bp, Mus musculus
gtgccagggctgtgcacctttctca

SEQ ID NO: 728236 - DNA, 25 bp, Mus musculus
gtgccaggtcagctgatacagaaat

SEQ ID NO: 728237 - DNA, 25 bp, Mus musculus
gtgccaggtcaggtgatacagaaat

SEQ ID NO: 728238 - DNA, 25 bp, Mus musculus
gtgccagtcacaccccaacgtggtg

SEQ ID NO: 728239 - DNA, 25 bp, Mus musculus
gtgccagtcacagcccaacgtggtg

SEQ ID NO: 728240 - DNA, 25 bp, Mus musculus
gtgccagtgccaccccaatggacat

SEQ ID NO: 728241 - DNA, 25 bp, Mus musculus
gtgccagtgccagcccaatggacat

SEQ ID NO: 728242 - DNA, 25 bp, Mus musculus
gtgccagtgcccatgcacggctatc

SEQ ID NO: 728243 - DNA, 25 bp, Mus musculus
gtgccagtgcccttgcacggctatc

SEQ ID NO: 728244 - DNA, 25 bp, Mus musculus
gtgccagtgcttctgcgcggctcca

SEQ ID NO: 728245 - DNA, 25 bp, Mus musculus
gtgccagtgcttgtgcgcggctcca

SEQ ID NO: 728246 - DNA, 25 bp, Mus musculus
gtgccatagccaacctcttcgcggt

SEQ ID NO: 728247 - DNA, 25 bp, Mus musculus
gtgccatagccatcctcttcgcggt

SEQ ID NO: 728248 - DNA, 25 bp, Mus musculus
gtgccataggtgaggaggccccaca

SEQ ID NO: 728249 - DNA, 25 bp, Mus musculus
gtgccataggtgtggaggccccaca

SEQ ID NO: 728250 - DNA, 25 bp, Mus musculus
gtgccatctgcacgaaccacattat

SEQ ID NO: 728251 - DNA, 25 bp, Mus musculus
gtgccatctgcaggaaccacattat

SEQ ID NO: 728252 - DNA, 25 bp, Mus musculus
gtgccatcttaaatcagttccagcc

SEQ ID NO: 728253 - DNA, 25 bp, Mus musculus
gtgccatcttaattcagttccagcc

SEQ ID NO: 728254 - DNA, 25 bp, Mus musculus
gtgccatgcagcagcggatcctgga

SEQ ID NO: 728255 - DNA, 25 bp, Mus musculus
gtgccatgcagctgcggatcctgga

SEQ ID NO: 728256 - DNA, 25 bp, Mus musculus
gtgccatgcgcaacctcatctacga

SEQ ID NO: 728257 - DNA, 25 bp, Mus musculus
gtgccatgcgcatcctcatctacga

SEQ ID NO: 728258 - DNA, 25 bp, Mus musculus
gtgccatggtctccagcaactcagc

SEQ ID NO: 728259 - DNA, 25 bp, Mus musculus
gtgccatggtctgcagcaactcagc

SEQ ID NO: 728260 - DNA, 25 bp, Mus musculus
gtgccattaaccactttgcaggcgg

SEQ ID NO: 728261 - DNA, 25 bp, Mus musculus
gtgccattaacctctttgcaggcgg

SEQ ID NO: 728262 - DNA, 25 bp, Mus musculus
gtgcccaaatgcagtagtcctcttt

SEQ ID NO: 728263 - DNA, 25 bp, Mus musculus
gtgcccaaatgctgtagtcctcttt

SEQ ID NO: 728264 - DNA, 25 bp, Mus musculus
gtgcccagctgtcgagaagcctcac

SEQ ID NO: 728265 - DNA, 25 bp, Mus musculus
gtgcccagctgtggagaagcctcac

SEQ ID NO: 728266 - DNA, 25 bp, Mus musculus
gtgcccaggtaacggtcctttcatc

SEQ ID NO: 728267 - DNA, 25 bp, Mus musculus
gtgcccaggtaagggtcctttcatc

SEQ ID NO: 728268 - DNA, 25 bp, Mus musculus
gtgcccagtaaacaacgggacctga

SEQ ID NO: 728269 - DNA, 25 bp, Mus musculus
gtgcccagtaaagaacgggacctga

SEQ ID NO: 728270 - DNA, 25 bp, Mus musculus
gtgcccagtcctagttgactaccag

SEQ ID NO: 728271 - DNA, 25 bp, Mus musculus
gtgcccagtccttgttgactaccag

SEQ ID NO: 728272 - DNA, 25 bp, Mus musculus
gtgcccagtctacccaggatgaggt

SEQ ID NO: 728273 - DNA, 25 bp, Mus musculus
gtgcccagtctagccaggatgaggt

SEQ ID NO: 728274 - DNA, 25 bp, Mus musculus
gtgcccatgagcaacggcgtcacgg

SEQ ID NO: 728275 - DNA, 25 bp, Mus musculus
gtgcccatgagctacggcgtcacgg

SEQ ID NO: 728276 - DNA, 25 bp, Mus musculus
gtgccccagtacaggccaagctgcg

SEQ ID NO: 728277 - DNA, 25 bp, Mus musculus
gtgccccagtactggccaagctgcg

SEQ ID NO: 728278 - DNA, 25 bp, Mus musculus
gtgccccattatagaccctgcctgg

SEQ ID NO: 728279 - DNA, 25 bp, Mus musculus
gtgccccattattgaccctgcctgg

SEQ ID NO: 728280 - DNA, 25 bp, Mus musculus
gtgccccgggtacgtctagattcgt

SEQ ID NO: 728281 - DNA, 25 bp, Mus musculus
gtgccccgggtaggtctagattcgt

SEQ ID NO: 728282 - DNA, 25 bp, Mus musculus
gtgcccctgcggcaatctgccaagg

SEQ ID NO: 728283 - DNA, 25 bp, Mus musculus
gtgcccctgcgggaatctgccaagg

SEQ ID NO: 728284 - DNA, 25 bp, Mus musculus
gtgccccttccgacacagtgatgca

SEQ ID NO: 728285 - DNA, 25 bp, Mus musculus
gtgccccttccgtcacagtgatgca

SEQ ID NO: 728286 - DNA, 25 bp, Mus musculus
gtgcccgaaaggacatccatgccca

SEQ ID NO: 728287 - DNA, 25 bp, Mus musculus
gtgcccgaaaggtcatccatgccca

SEQ ID NO: 728288 - DNA, 25 bp, Mus musculus
gtgcccgaacgaaaccagaacctgt

SEQ ID NO: 728289 - DNA, 25 bp, Mus musculus
gtgcccgaacgataccagaacctgt

SEQ ID NO: 728290 - DNA, 25 bp, Mus musculus
gtgcccgagggcactacttctgaca

SEQ ID NO: 728291 - DNA, 25 bp, Mus musculus
gtgcccgagggctctacttctgaca

SEQ ID NO: 728292 - DNA, 25 bp, Mus musculus
gtgcccgaggtcagcaagcaaggac

SEQ ID NO: 728293 - DNA, 25 bp, Mus musculus
gtgcccgaggtctgcaagcaaggac

SEQ ID NO: 728294 - DNA, 25 bp, Mus musculus
gtgcccggactaccaactacaacag

SEQ ID NO: 728295 - DNA, 25 bp, Mus musculus
gtgcccggactagcaactacaacag

SEQ ID NO: 728296 - DNA, 25 bp, Mus musculus
gtgcccggcacaccggaagtccttt

SEQ ID NO: 728297 - DNA, 25 bp, Mus musculus
gtgcccggcacagcggaagtccttt

SEQ ID NO: 728298 - DNA, 25 bp, Mus musculus
gtgcccgtgcagatgccaaaggcca

SEQ ID NO: 728299 - DNA, 25 bp, Mus musculus
gtgcccgtgcagttgccaaaggcca

SEQ ID NO: 728300 - DNA, 25 bp, Mus musculus
gtgcccgtggtgctcattgacagct

SEQ ID NO: 728301 - DNA, 25 bp, Mus musculus
gtgcccgtggtggtcattgacagct

SEQ ID NO: 728302 - DNA, 25 bp, Mus musculus
gtgccctatcgtcttccatggcaaa

SEQ ID NO: 728303 - DNA, 25 bp, Mus musculus
gtgccctatcgtgttccatggcaaa

SEQ ID NO: 728304 - DNA, 25 bp, Mus musculus
gtgccctccaggatccacacagtta

SEQ ID NO: 728305 - DNA, 25 bp, Mus musculus
gtgccctccaggctacgtcctgttg

SEQ ID NO: 728306 - DNA, 25 bp, Mus musculus
gtgccctccagggtacgtcctgttg

SEQ ID NO: 728307 - DNA, 25 bp, Mus musculus
gtgccctccaggttccacacagtta

SEQ ID NO: 728308 - DNA, 25 bp, Mus musculus
gtgccctgctagcttggagagaccc

SEQ ID NO: 728309 - DNA, 25 bp, Mus musculus
gtgccctgctaggttggagagaccc

SEQ ID NO: 728310 - DNA, 25 bp, Mus musculus
gtgccctgggcaatatagtccttat

SEQ ID NO: 728311 - DNA, 25 bp, Mus musculus
gtgccctgggcattatagtccttat

SEQ ID NO: 728312 - DNA, 25 bp, Mus musculus
gtgcccttacaactgctgacgcgcg

SEQ ID NO: 728313 - DNA, 25 bp, Mus musculus
gtgcccttacaagtgctgacgcgcg

SEQ ID NO: 728314 - DNA, 25 bp, Mus musculus
gtgcccttcagtcgcgactcctggt

SEQ ID NO: 728315 - DNA, 25 bp, Mus musculus
gtgcccttcagtggcgactcctggt

SEQ ID NO: 728316 - DNA, 25 bp, Mus musculus
gtgcccttggcccagagccatgctg

SEQ ID NO: 728317 - DNA, 25 bp, Mus musculus
gtgcccttggccgagagccatgctg

SEQ ID NO: 728318 - DNA, 25 bp, Mus musculus
gtgccgacttcgcaatggctgctga

SEQ ID NO: 728319 - DNA, 25 bp, Mus musculus
gtgccgacttcggaatggctgctga

SEQ ID NO: 728320 - DNA, 25 bp, Mus musculus
gtgccgactttaagccccgctggca

SEQ ID NO: 728321 - DNA, 25 bp, Mus musculus
gtgccgactttatgccccgctggca

SEQ ID NO: 728322 - DNA, 25 bp, Mus musculus
gtgccgagacccagacgcgtctgcg

SEQ ID NO: 728323 - DNA, 25 bp, Mus musculus
gtgccgagaccctgacgcgtctgcg

SEQ ID NO: 728324 - DNA, 25 bp, Mus musculus
gtgccgctatgccacacagctgcag

SEQ ID NO: 728325 - DNA, 25 bp, Mus musculus
gtgccgctatgcgacacagctgcag

SEQ ID NO: 728326 - DNA, 25 bp, Mus musculus
gtgccggatcatagttcatttcatg

SEQ ID NO: 728327 - DNA, 25 bp, Mus musculus
gtgccggatcattgttcatttcatg

SEQ ID NO: 728328 - DNA, 25 bp, Mus musculus
gtgccggcccaacactgcagatgtg

SEQ ID NO: 728329 - DNA, 25 bp, Mus musculus
gtgccggcccaagactgcagatgtg

SEQ ID NO: 728330 - DNA, 25 bp, Mus musculus
gtgccggcgaataaggacttctatt

SEQ ID NO: 728331 - DNA, 25 bp, Mus musculus
gtgccggcgaattaggacttctatt

SEQ ID NO: 728332 - DNA, 25 bp, Mus musculus
gtgccgggagtacccatggtacccc

SEQ ID NO: 728333 - DNA, 25 bp, Mus musculus
gtgccgggagtagccatggtacccc

SEQ ID NO: 728334 - DNA, 25 bp, Mus musculus
gtgccgggtaccaacgccagcagcg

SEQ ID NO: 728335 - DNA, 25 bp, Mus musculus
gtgccgggtacctacgccagcagcg

SEQ ID NO: 728336 - DNA, 25 bp, Mus musculus
gtgccgggtatcaacaccagagttt

SEQ ID NO: 728337 - DNA, 25 bp, Mus musculus
gtgccgggtatctacaccagagttt

SEQ ID NO: 728338 - DNA, 25 bp, Mus musculus
gtgccgtactttccggatgctgtga

SEQ ID NO: 728339 - DNA, 25 bp, Mus musculus
gtgccgtactttgcggatgctgtga

SEQ ID NO: 728340 - DNA, 25 bp, Mus musculus
gtgccgtaggatatatagaatattt

SEQ ID NO: 728341 - DNA, 25 bp, Mus musculus
gtgccgtaggatttatagaatattt

SEQ ID NO: 728342 - DNA, 25 bp, Mus musculus
gtgccgtcaggaccaaacttgcacc

SEQ ID NO: 728343 - DNA, 25 bp, Mus musculus
gtgccgtcaggagcaaacttgcacc

SEQ ID NO: 728344 - DNA, 25 bp, Mus musculus
gtgccgtgaaggcagaacttcgaca

SEQ ID NO: 728345 - DNA, 25 bp, Mus musculus
gtgccgtgaagggagaacttcgaca

SEQ ID NO: 728346 - DNA, 25 bp, Mus musculus
gtgccgtgctgacccaatccctgga

SEQ ID NO: 728347 - DNA, 25 bp, Mus musculus
gtgccgtgctgagccaatccctgga

SEQ ID NO: 728348 - DNA, 25 bp, Mus musculus
gtgccgtggataatctaaaattcag

SEQ ID NO: 728349 - DNA, 25 bp, Mus musculus
gtgccgtggatattctaaaattcag

SEQ ID NO: 728350 - DNA, 25 bp, Mus musculus
gtgccgtggccactgtcatcgctcg

SEQ ID NO: 728351 - DNA, 25 bp, Mus musculus
gtgccgtggccagtgtcatcgctcg

SEQ ID NO: 728352 - DNA, 25 bp, Mus musculus
gtgccgttcctgagcaatttcggga

SEQ ID NO: 728353 - DNA, 25 bp, Mus musculus
gtgccgttcctgtgcaatttcggga

SEQ ID NO: 728354 - DNA, 25 bp, Mus musculus
gtgccgttctctcagagaaaaagac

SEQ ID NO: 728355 - DNA, 25 bp, Mus musculus
gtgccgttctctgagagaaaaagac

SEQ ID NO: 728356 - DNA, 25 bp, Mus musculus
gtgcctacgccaataacttgaaaag

SEQ ID NO: 728357 - DNA, 25 bp, Mus musculus
gtgcctacgccattaacttgaaaag

SEQ ID NO: 728358 - DNA, 25 bp, Mus musculus
gtgcctagacggacgcccaggagca

SEQ ID NO: 728359 - DNA, 25 bp, Mus musculus
gtgcctagacggtcgcccaggagca

SEQ ID NO: 728360 - DNA, 25 bp, Mus musculus
gtgcctatctaaaatactctctgag

SEQ ID NO: 728361 - DNA, 25 bp, Mus musculus
gtgcctatctaatatactctctgag

SEQ ID NO: 728362 - DNA, 25 bp, Mus musculus
gtgcctatggccctcctggaacctg

SEQ ID NO: 728363 - DNA, 25 bp, Mus musculus
gtgcctatggccgtcctggaacctg

SEQ ID NO: 728364 - DNA, 25 bp, Mus musculus
gtgcctattgaaagagactcactct

SEQ ID NO: 728365 - DNA, 25 bp, Mus musculus
gtgcctattgaatgagactcactct

SEQ ID NO: 728366 - DNA, 25 bp, Mus musculus
gtgcctcagactatcactacgataa

SEQ ID NO: 728367 - DNA, 25 bp, Mus musculus
gtgcctcagactttcactacgataa

SEQ ID NO: 728368 - DNA, 25 bp, Mus musculus
gtgcctcaggccatggagtggctaa

SEQ ID NO: 728369 - DNA, 25 bp, Mus musculus
gtgcctcaggccttggagtggctaa

SEQ ID NO: 728370 - DNA, 25 bp, Mus musculus
gtgcctccaaggaaaatcaacctcc

SEQ ID NO: 728371 - DNA, 25 bp, Mus musculus
gtgcctccaaggtaaatcaacctcc

SEQ ID NO: 728372 - DNA, 25 bp, Mus musculus
gtgcctcgcaccacagagatttaca

SEQ ID NO: 728373 - DNA, 25 bp, Mus musculus
gtgcctcgcacctcagagatttaca

SEQ ID NO: 728374 - DNA, 25 bp, Mus musculus
gtgcctcggctcagcgctgccgctg

SEQ ID NO: 728375 - DNA, 25 bp, Mus musculus
gtgcctcggctctgcgctgccgctg

SEQ ID NO: 728376 - DNA, 25 bp, Mus musculus
gtgcctcgggcactctttgtggacc

SEQ ID NO: 728377 - DNA, 25 bp, Mus musculus
gtgcctcgggcagtctttgtggacc

SEQ ID NO: 728378 - DNA, 25 bp, Mus musculus
gtgcctctgatgctggctttccttt

SEQ ID NO: 728379 - DNA, 25 bp, Mus musculus
gtgcctctgatggtggctttccttt

SEQ ID NO: 728380 - DNA, 25 bp, Mus musculus
gtgcctctgggaacttggcaaagga

SEQ ID NO: 728381 - DNA, 25 bp, Mus musculus
gtgcctctgggatcttggcaaagga

SEQ ID NO: 728382 - DNA, 25 bp, Mus musculus
gtgcctgagaacaggctacctgctg

SEQ ID NO: 728383 - DNA, 25 bp, Mus musculus
gtgcctgagaactggctacctgctg

SEQ ID NO: 728384 - DNA, 25 bp, Mus musculus
gtgcctgagcggagacctggcccca

SEQ ID NO: 728385 - DNA, 25 bp, Mus musculus
gtgcctgagcggtgacctggcccca

SEQ ID NO: 728386 - DNA, 25 bp, Mus musculus
gtgcctgcccacagaaatatgtagg

SEQ ID NO: 728387 - DNA, 25 bp, Mus musculus
gtgcctgcccactgaaatatgtagg

SEQ ID NO: 728388 - DNA, 25 bp, Mus musculus
gtgcctgctggcctcccagatctca

SEQ ID NO: 728389 - DNA, 25 bp, Mus musculus
gtgcctgctggcgtcccagatctca

SEQ ID NO: 728390 - DNA, 25 bp, Mus musculus
gtgcctggagcacaccctgtaccag

SEQ ID NO: 728391 - DNA, 25 bp, Mus musculus
gtgcctggagcagaccctgtaccag

SEQ ID NO: 728392 - DNA, 25 bp, Mus musculus
gtgcctggctaactgaccgcacaca

SEQ ID NO: 728393 - DNA, 25 bp, Mus musculus
gtgcctggctaagtgaccgcacaca

SEQ ID NO: 728394 - DNA, 25 bp, Mus musculus
gtgcctgggcccaggaaagttcaag

SEQ ID NO: 728395 - DNA, 25 bp, Mus musculus
gtgcctgggccctggaaagttcaag

SEQ ID NO: 728396 - DNA, 25 bp, Mus musculus
gtgcctggtcagcacgacagccaca

SEQ ID NO: 728397 - DNA, 25 bp, Mus musculus
gtgcctggtcaggacgacagccaca

SEQ ID NO: 728398 - DNA, 25 bp, Mus musculus
gtgcctggtcctctactctatgagt

SEQ ID NO: 728399 - DNA, 25 bp, Mus musculus
gtgcctggtcctgtactctatgagt

SEQ ID NO: 728400 - DNA, 25 bp, Mus musculus
gtgcctgtggacatatgagatccag

SEQ ID NO: 728401 - DNA, 25 bp, Mus musculus
gtgcctgtggaccaggcccgaggca

SEQ ID NO: 728402 - DNA, 25 bp, Mus musculus
gtgcctgtggacgaggcccgaggca

SEQ ID NO: 728403 - DNA, 25 bp, Mus musculus
gtgcctgtggacttatgagatccag

SEQ ID NO: 728404 - DNA, 25 bp, Mus musculus
gtgcctgttggcaatggcatccgga

SEQ ID NO: 728405 - DNA, 25 bp, Mus musculus
gtgcctgttggctatggcatccgga

SEQ ID NO: 728406 - DNA, 25 bp, Mus musculus
gtgccttacaacagtggcagtttct

SEQ ID NO: 728407 - DNA, 25 bp, Mus musculus
gtgccttacaactgtggcagtttct

SEQ ID NO: 728408 - DNA, 25 bp, Mus musculus
gtgccttactcactctcagtccggg

SEQ ID NO: 728409 - DNA, 25 bp, Mus musculus
gtgccttactcagtctcagtccggg

SEQ ID NO: 728410 - DNA, 25 bp, Mus musculus
gtgccttatacaccatgatgaagga

SEQ ID NO: 728411 - DNA, 25 bp, Mus musculus
gtgccttatacagcatgatgaagga

SEQ ID NO: 728412 - DNA, 25 bp, Mus musculus
gtgccttcaagcaccagggctggga

SEQ ID NO: 728413 - DNA, 25 bp, Mus musculus
gtgccttcaagctccagggctggga

SEQ ID NO: 728414 - DNA, 25 bp, Mus musculus
gtgccttctcgtatccgccctagag

SEQ ID NO: 728415 - DNA, 25 bp, Mus musculus
gtgccttctcgtttccgccctagag

SEQ ID NO: 728416 - DNA, 25 bp, Mus musculus
gtgccttcttcacaaaggtgctgga

SEQ ID NO: 728417 - DNA, 25 bp, Mus musculus
gtgccttcttcagaaaggtgctgga

SEQ ID NO: 728418 - DNA, 25 bp, Mus musculus
gtgccttcttccagtgtttctgctg

SEQ ID NO: 728419 - DNA, 25 bp, Mus musculus
gtgccttcttcctgtgtttctgctg

SEQ ID NO: 728420 - DNA, 25 bp, Mus musculus
gtgccttgagcacaacatgaccatc

SEQ ID NO: 728421 - DNA, 25 bp, Mus musculus
gtgccttgagcagaacatgaccatc

SEQ ID NO: 728422 - DNA, 25 bp, Mus musculus
gtgccttgtaacctcattgcttgtt

SEQ ID NO: 728423 - DNA, 25 bp, Mus musculus
gtgccttgtaacgtcattgcttgtt

SEQ ID NO: 728424 - DNA, 25 bp, Mus musculus
gtgcctttgcgccagtgaccttgag

SEQ ID NO: 728425 - DNA, 25 bp, Mus musculus
gtgcctttgcgcgagtgaccttgag

SEQ ID NO: 728426 - DNA, 25 bp, Mus musculus
gtgcctttgtcaacgccagacagga

SEQ ID NO: 728427 - DNA, 25 bp, Mus musculus
gtgcctttgtcatcgccagacagga

SEQ ID NO: 728428 - DNA, 25 bp, Mus musculus
gtgcgaaccgccaagtcccttgtca

SEQ ID NO: 728429 - DNA, 25 bp, Mus musculus
gtgcgaaccgcctagtcccttgtca

SEQ ID NO: 728430 - DNA, 25 bp, Mus musculus
gtgcgacaggatatggcccagctca

SEQ ID NO: 728431 - DNA, 25 bp, Mus musculus
gtgcgacaggatttggcccagctca

SEQ ID NO: 728432 - DNA, 25 bp, Mus musculus
gtgcgaccagacctgcagacacgct

SEQ ID NO: 728433 - DNA, 25 bp, Mus musculus
gtgcgaccagacgtgcagacacgct

SEQ ID NO: 728434 - DNA, 25 bp, Mus musculus
gtgcgaccgcaccttcacgctgaag

SEQ ID NO: 728435 - DNA, 25 bp, Mus musculus
gtgcgaccgcacgttcacgctgaag

SEQ ID NO: 728436 - DNA, 25 bp, Mus musculus
gtgcgacctcatagaaccgcagccg

SEQ ID NO: 728437 - DNA, 25 bp, Mus musculus
gtgcgacctcattgaaccgcagccg

SEQ ID NO: 728438 - DNA, 25 bp, Mus musculus
gtgcgactggccatcctctgattca

SEQ ID NO: 728439 - DNA, 25 bp, Mus musculus
gtgcgactggccttcctctgattca

SEQ ID NO: 728440 - DNA, 25 bp, Mus musculus
gtgcgagactaaactggatcttaca

SEQ ID NO: 728441 - DNA, 25 bp, Mus musculus
gtgcgagactaatctggatcttaca

SEQ ID NO: 728442 - DNA, 25 bp, Mus musculus
gtgcgagactctcgtctgccctgct

SEQ ID NO: 728443 - DNA, 25 bp, Mus musculus
gtgcgagactctggtctgccctgct

SEQ ID NO: 728444 - DNA, 25 bp, Mus musculus
gtgcgagattccagctattccttgg

SEQ ID NO: 728445 - DNA, 25 bp, Mus musculus
gtgcgagattcctgctattccttgg

SEQ ID NO: 728446 - DNA, 25 bp, Mus musculus
gtgcgagcgtcgatatcgtcctgcg

SEQ ID NO: 728447 - DNA, 25 bp, Mus musculus
gtgcgagcgtcgttatcgtcctgcg

SEQ ID NO: 728448 - DNA, 25 bp, Mus musculus
gtgcgatccaaacggctgcaccctg

SEQ ID NO: 728449 - DNA, 25 bp, Mus musculus
gtgcgatccaaagggctgcaccctg

SEQ ID NO: 728450 - DNA, 25 bp, Mus musculus
gtgcgattgcaaatatgggacacag

SEQ ID NO: 728451 - DNA, 25 bp, Mus musculus
gtgcgattgcaattatgggacacag

SEQ ID NO: 728452 - DNA, 25 bp, Mus musculus
gtgcgattggacagaaacttggcaa

SEQ ID NO: 728453 - DNA, 25 bp, Mus musculus
gtgcgattggactgaaacttggcaa

SEQ ID NO: 728454 - DNA, 25 bp, Mus musculus
gtgcgattggccagctctgcgcagc

SEQ ID NO: 728455 - DNA, 25 bp, Mus musculus
gtgcgattggcctgctctgcgcagc

SEQ ID NO: 728456 - DNA, 25 bp, Mus musculus
gtgcgcaagcatatcttcaataagc

SEQ ID NO: 728457 - DNA, 25 bp, Mus musculus
gtgcgcaagcatttcttcaataagc

SEQ ID NO: 728458 - DNA, 25 bp, Mus musculus
gtgcgcaccactccttcgtcgaggt

SEQ ID NO: 728459 - DNA, 25 bp, Mus musculus
gtgcgcaccactgcttcgtcgaggt

SEQ ID NO: 728460 - DNA, 25 bp, Mus musculus
gtgcgcatccgacgctctggctaca

SEQ ID NO: 728461 - DNA, 25 bp, Mus musculus
gtgcgcatccgaggctctggctaca

SEQ ID NO: 728462 - DNA, 25 bp, Mus musculus
gtgcgcatgcacagtttcgggaccc

SEQ ID NO: 728463 - DNA, 25 bp, Mus musculus
gtgcgcatgcactgtttcgggaccc

SEQ ID NO: 728464 - DNA, 25 bp, Mus musculus
gtgcgccatgtgctcctcagacagg

SEQ ID NO: 728465 - DNA, 25 bp, Mus musculus
gtgcgccatgtggtcctcagacagg

SEQ ID NO: 728466 - DNA, 25 bp, Mus musculus
gtgcgcccaagcactggaacctcat

SEQ ID NO: 728467 - DNA, 25 bp, Mus musculus
gtgcgcccaagctctggaacctcat

SEQ ID NO: 728468 - DNA, 25 bp, Mus musculus
gtgcgcccgggccttgtatgactac

SEQ ID NO: 728469 - DNA, 25 bp, Mus musculus
gtgcgcccgggcgttgtatgactac

SEQ ID NO: 728470 - DNA, 25 bp, Mus musculus
gtgcgccctgagaccctccaagggt

SEQ ID NO: 728471 - DNA, 25 bp, Mus musculus
gtgcgccctgagtccctccaagggt

SEQ ID NO: 728472 - DNA, 25 bp, Mus musculus
gtgcgcctcgagcttacagaggatc

SEQ ID NO: 728473 - DNA, 25 bp, Mus musculus
gtgcgcctcgaggttacagaggatc

SEQ ID NO: 728474 - DNA, 25 bp, Mus musculus
gtgcgcctgctcatcagctgctggg

SEQ ID NO: 728475 - DNA, 25 bp, Mus musculus
gtgcgcctgctcttcagctgctggg

SEQ ID NO: 728476 - DNA, 25 bp, Mus musculus
gtgcgccttacccatacttcagtag

SEQ ID NO: 728477 - DNA, 25 bp, Mus musculus
gtgcgccttaccgatacttcagtag

SEQ ID NO: 728478 - DNA, 25 bp, Mus musculus
gtgcgccttcggcacactgcatgtg

SEQ ID NO: 728479 - DNA, 25 bp, Mus musculus
gtgcgccttcgggacactgcatgtg

SEQ ID NO: 728480 - DNA, 25 bp, Mus musculus
gtgcgcgcctgcacgtgaatcctct

SEQ ID NO: 728481 - DNA, 25 bp, Mus musculus
gtgcgcgcctgctcgtgaatcctct

SEQ ID NO: 728482 - DNA, 25 bp, Mus musculus
gtgcgcggcaccagcgaagatgctt

SEQ ID NO: 728483 - DNA, 25 bp, Mus musculus
gtgcgcggcacctgcgaagatgctt

SEQ ID NO: 728484 - DNA, 25 bp, Mus musculus
gtgcgcgtagtcaccgagaaatccc

SEQ ID NO: 728485 - DNA, 25 bp, Mus musculus
gtgcgcgtagtctccgagaaatccc

SEQ ID NO: 728486 - DNA, 25 bp, Mus musculus
gtgcgctacaacacacaactatgac

SEQ ID NO: 728487 - DNA, 25 bp, Mus musculus
gtgcgctacaactcacaactatgac

SEQ ID NO: 728488 - DNA, 25 bp, Mus musculus
gtgcgctaccgacacacagaacgtc

SEQ ID NO: 728489 - DNA, 25 bp, Mus musculus
gtgcgctaccgagacacagaacgtc

SEQ ID NO: 728490 - DNA, 25 bp, Mus musculus
gtgcgctacctcagccaaacagctt

SEQ ID NO: 728491 - DNA, 25 bp, Mus musculus
gtgcgctacctctgccaaacagctt

SEQ ID NO: 728492 - DNA, 25 bp, Mus musculus
gtgcgctacgcccagatccagctgg

SEQ ID NO: 728493 - DNA, 25 bp, Mus musculus
gtgcgctacgccgagatccagctgg

SEQ ID NO: 728494 - DNA, 25 bp, Mus musculus
gtgcgctctcaacgtggtttatatg

SEQ ID NO: 728495 - DNA, 25 bp, Mus musculus
gtgcgctctcaaggtggtttatatg

SEQ ID NO: 728496 - DNA, 25 bp, Mus musculus
gtgcgctgccgacccatgaacaagc

SEQ ID NO: 728497 - DNA, 25 bp, Mus musculus
gtgcgctgccgagccatgaacaagc

SEQ ID NO: 728498 - DNA, 25 bp, Mus musculus
gtgcgctgctgacttggcctctctc

SEQ ID NO: 728499 - DNA, 25 bp, Mus musculus
gtgcgctgctgagttggcctctctc

SEQ ID NO: 728500 - DNA, 25 bp, Mus musculus
gtgcgctttcccagaccttcgtgcg

SEQ ID NO: 728501 - DNA, 25 bp, Mus musculus
gtgcgctttccctgaccttcgtgcg

SEQ ID NO: 728502 - DNA, 25 bp, Mus musculus
gtgcggaaaggaccatgtgccaacc

SEQ ID NO: 728503 - DNA, 25 bp, Mus musculus
gtgcggaaaggagcatgtgccaacc

SEQ ID NO: 728504 - DNA, 25 bp, Mus musculus
gtgcggaaccagcaagcctccggca

SEQ ID NO: 728505 - DNA, 25 bp, Mus musculus
gtgcggaaccaggaagcctccggca

SEQ ID NO: 728506 - DNA, 25 bp, Mus musculus
gtgcggaatgataggcttgatctcc

SEQ ID NO: 728507 - DNA, 25 bp, Mus musculus
gtgcggaatgattggcttgatctcc

SEQ ID NO: 728508 - DNA, 25 bp, Mus musculus
gtgcggacattcaacacaaaggtgt

SEQ ID NO: 728509 - DNA, 25 bp, Mus musculus
gtgcggacattctacacaaaggtgt

SEQ ID NO: 728510 - DNA, 25 bp, Mus musculus
gtgcggacttgcacgtccctcagct

SEQ ID NO: 728511 - DNA, 25 bp, Mus musculus
gtgcggacttgctcgtccctcagct

SEQ ID NO: 728512 - DNA, 25 bp, Mus musculus
gtgcggagtcctactggctgtgccc

SEQ ID NO: 728513 - DNA, 25 bp, Mus musculus
gtgcggagtccttctggctgtgccc

SEQ ID NO: 728514 - DNA, 25 bp, Mus musculus
gtgcggcaagcgatacaaaaccaag

SEQ ID NO: 728515 - DNA, 25 bp, Mus musculus
gtgcggcaagcgttacaaaaccaag

SEQ ID NO: 728516 - DNA, 25 bp, Mus musculus
gtgcggcctcacactgcaccagaat

SEQ ID NO: 728517 - DNA, 25 bp, Mus musculus
gtgcggcctcactctgcaccagaat

SEQ ID NO: 728518 - DNA, 25 bp, Mus musculus
gtgcggctgtccaaaaccctgatta

SEQ ID NO: 728519 - DNA, 25 bp, Mus musculus
gtgcggctgtcctaaaccctgatta

SEQ ID NO: 728520 - DNA, 25 bp, Mus musculus
gtgcgggccatgacccatgtcatca

SEQ ID NO: 728521 - DNA, 25 bp, Mus musculus
gtgcgggccatgtcccatgtcatca

SEQ ID NO: 728522 - DNA, 25 bp, Mus musculus
gtgcgggccctcattgactttaatg

SEQ ID NO: 728523 - DNA, 25 bp, Mus musculus
gtgcgggccctctttgactttaatg

SEQ ID NO: 728524 - DNA, 25 bp, Mus musculus
gtgcggtacaccaacctcacactga

SEQ ID NO: 728525 - DNA, 25 bp, Mus musculus
gtgcggtacacctacctcacactga

SEQ ID NO: 728526 - DNA, 25 bp, Mus musculus
gtgcggtcccagcataccacacatg

SEQ ID NO: 728527 - DNA, 25 bp, Mus musculus
gtgcggtcccaggataccacacatg

SEQ ID NO: 728528 - DNA, 25 bp, Mus musculus
gtgcggtcgcggaccctatcccgga

SEQ ID NO: 728529 - DNA, 25 bp, Mus musculus
gtgcggtcgcggtccctatcccgga

SEQ ID NO: 728530 - DNA, 25 bp, Mus musculus
gtgcggtctccaccagcggccatag

SEQ ID NO: 728531 - DNA, 25 bp, Mus musculus
gtgcggtctccagcagcggccatag

SEQ ID NO: 728532 - DNA, 25 bp, Mus musculus
gtgcggtgtgccatccacctgcaca

SEQ ID NO: 728533 - DNA, 25 bp, Mus musculus
gtgcggtgtgccttccacctgcaca

SEQ ID NO: 728534 - DNA, 25 bp, Mus musculus
gtgcgtaagctgcaatctaccctca

SEQ ID NO: 728535 - DNA, 25 bp, Mus musculus
gtgcgtaagctggaatctaccctca

SEQ ID NO: 728536 - DNA, 25 bp, Mus musculus
gtgcgtacccacctgaacagttctg

SEQ ID NO: 728537 - DNA, 25 bp, Mus musculus
gtgcgtacccacgtgaacagttctg

SEQ ID NO: 728538 - DNA, 25 bp, Mus musculus
gtgcgtcatcctaagaaacatcgat

SEQ ID NO: 728539 - DNA, 25 bp, Mus musculus
gtgcgtcatccttagaaacatcgat

SEQ ID NO: 728540 - DNA, 25 bp, Mus musculus
gtgcgtcatcgcaggccacgagagc

SEQ ID NO: 728541 - DNA, 25 bp, Mus musculus
gtgcgtcatcgctggccacgagagc

SEQ ID NO: 728542 - DNA, 25 bp, Mus musculus
gtgcgtcccctgatgacatcaagaa

SEQ ID NO: 728543 - DNA, 25 bp, Mus musculus
gtgcgtcccctgttgacatcaagaa

SEQ ID NO: 728544 - DNA, 25 bp, Mus musculus
gtgcgtcgccggagctgctagcgca

SEQ ID NO: 728545 - DNA, 25 bp, Mus musculus
gtgcgtcgccggtgctgctagcgca

SEQ ID NO: 728546 - DNA, 25 bp, Mus musculus
gtgcgtcgcggtccttgctcagaaa

SEQ ID NO: 728547 - DNA, 25 bp, Mus musculus
gtgcgtcgcggtgcttgctcagaaa

SEQ ID NO: 728548 - DNA, 25 bp, Mus musculus
gtgcgtgcgagcctcgatatcgtcc

SEQ ID NO: 728549 - DNA, 25 bp, Mus musculus
gtgcgtgcgagcgtcgatatcgtcc

SEQ ID NO: 728550 - DNA, 25 bp, Mus musculus
gtgcgtggcccaagggccagtccca

SEQ ID NO: 728551 - DNA, 25 bp, Mus musculus
gtgcgtggcccatgggccagtccca

SEQ ID NO: 728552 - DNA, 25 bp, Mus musculus
gtgcgttatatcaatgagaacctga

SEQ ID NO: 728553 - DNA, 25 bp, Mus musculus
gtgcgttatatctatgagaacctga

SEQ ID NO: 728554 - DNA, 25 bp, Mus musculus
gtgcgttcctcaaaccgtattttat

SEQ ID NO: 728555 - DNA, 25 bp, Mus musculus
gtgcgttcctcataccgtattttat

SEQ ID NO: 728556 - DNA, 25 bp, Mus musculus
gtgctaaaatgtcggcacaagtttc

SEQ ID NO: 728557 - DNA, 25 bp, Mus musculus
gtgctaaaatgtgggcacaagtttc

SEQ ID NO: 728558 - DNA, 25 bp, Mus musculus
gtgctaaagtcaacgcccaggctct

SEQ ID NO: 728559 - DNA, 25 bp, Mus musculus
gtgctaaagtcatcgcccaggctct

SEQ ID NO: 728560 - DNA, 25 bp, Mus musculus
gtgctaacagcaccataggacattt

SEQ ID NO: 728561 - DNA, 25 bp, Mus musculus
gtgctaacagcagcataggacattt

SEQ ID NO: 728562 - DNA, 25 bp, Mus musculus
gtgctaagtcacaccagggatcccc

SEQ ID NO: 728563 - DNA, 25 bp, Mus musculus
gtgctaagtcactccagggatcccc

SEQ ID NO: 728564 - DNA, 25 bp, Mus musculus
gtgctacaccacagacccgaatgtt

SEQ ID NO: 728565 - DNA, 25 bp, Mus musculus
gtgctacaccactgacccgaatgtt

SEQ ID NO: 728566 - DNA, 25 bp, Mus musculus
gtgctacctgatcgccgggtcatcc

SEQ ID NO: 728567 - DNA, 25 bp, Mus musculus
gtgctacctgatggccgggtcatcc

SEQ ID NO: 728568 - DNA, 25 bp, Mus musculus
gtgctaccttttaatagggtgcgga

SEQ ID NO: 728569 - DNA, 25 bp, Mus musculus
gtgctacctttttatagggtgcgga

SEQ ID NO: 728570 - DNA, 25 bp, Mus musculus
gtgctacttccccaactgatcggga

SEQ ID NO: 728571 - DNA, 25 bp, Mus musculus
gtgctacttcccgaactgatcggga

SEQ ID NO: 728572 - DNA, 25 bp, Mus musculus
gtgctagacataaaggaaatcctgg

SEQ ID NO: 728573 - DNA, 25 bp, Mus musculus
gtgctagacatataggaaatcctgg

SEQ ID NO: 728574 - DNA, 25 bp, Mus musculus
gtgctagatgccaggagccagagtt

SEQ ID NO: 728575 - DNA, 25 bp, Mus musculus
gtgctagatgcctggagccagagtt

SEQ ID NO: 728576 - DNA, 25 bp, Mus musculus
gtgctaggcatgagccccagaacca

SEQ ID NO: 728577 - DNA, 25 bp, Mus musculus
gtgctaggcatgtgccccagaacca

SEQ ID NO: 728578 - DNA, 25 bp, Mus musculus
gtgctagtgttgctcttcgtctcca

SEQ ID NO: 728579 - DNA, 25 bp, Mus musculus
gtgctagtgttggtcttcgtctcca

SEQ ID NO: 728580 - DNA, 25 bp, Mus musculus
gtgctatgcctgaaacaagagcatc

SEQ ID NO: 728581 - DNA, 25 bp, Mus musculus
gtgctatgcctgtaacaagagcatc

SEQ ID NO: 728582 - DNA, 25 bp, Mus musculus
gtgctcaacttacgctgaacaacag

SEQ ID NO: 728583 - DNA, 25 bp, Mus musculus
gtgctcaacttaggctgaacaacag

SEQ ID NO: 728584 - DNA, 25 bp, Mus musculus
gtgctcaagcgcatgggcatggcat

SEQ ID NO: 728585 - DNA, 25 bp, Mus musculus
gtgctcaagcgcttgggcatggcat

SEQ ID NO: 728586 - DNA, 25 bp, Mus musculus
gtgctcaatgagacactccggctca

SEQ ID NO: 728587 - DNA, 25 bp, Mus musculus
gtgctcaatgagtcactccggctca

SEQ ID NO: 728588 - DNA, 25 bp, Mus musculus
gtgctcacagctcaatatctattgg

SEQ ID NO: 728589 - DNA, 25 bp, Mus musculus
gtgctcacagctgaatatctattgg

SEQ ID NO: 728590 - DNA, 25 bp, Mus musculus
gtgctcacagttctgcactacaggc

SEQ ID NO: 728591 - DNA, 25 bp, Mus musculus
gtgctcacagttgtgcactacaggc

SEQ ID NO: 728592 - DNA, 25 bp, Mus musculus
gtgctcagctacacagacctcgtgg

SEQ ID NO: 728593 - DNA, 25 bp, Mus musculus
gtgctcagctactcagacctcgtgg

SEQ ID NO: 728594 - DNA, 25 bp, Mus musculus
gtgctcaggagcctctggccacagc

SEQ ID NO: 728595 - DNA, 25 bp, Mus musculus
gtgctcaggagcgtctggccacagc

SEQ ID NO: 728596 - DNA, 25 bp, Mus musculus
gtgctcataaggaccgccgattaga

SEQ ID NO: 728597 - DNA, 25 bp, Mus musculus
gtgctcataaggtccgccgattaga

SEQ ID NO: 728598 - DNA, 25 bp, Mus musculus
gtgctcatagttccctacatccagg

SEQ ID NO: 728599 - DNA, 25 bp, Mus musculus
gtgctcatagttgcctacatccagg

SEQ ID NO: 728600 - DNA, 25 bp, Mus musculus
gtgctcatcccgaagtgacctgcca

SEQ ID NO: 728601 - DNA, 25 bp, Mus musculus
gtgctcatcccgtagtgacctgcca

SEQ ID NO: 728602 - DNA, 25 bp, Mus musculus
gtgctcatctgtaccaagctttggg

SEQ ID NO: 728603 - DNA, 25 bp, Mus musculus
gtgctcatctgttccaagctttggg

SEQ ID NO: 728604 - DNA, 25 bp, Mus musculus
gtgctccaagaactgcctgtgcgcg

SEQ ID NO: 728605 - DNA, 25 bp, Mus musculus
gtgctccaagaagtgcctgtgcgcg

SEQ ID NO: 728606 - DNA, 25 bp, Mus musculus
gtgctccaagtgaccaaagcagtgg

SEQ ID NO: 728607 - DNA, 25 bp, Mus musculus
gtgctccaagtgtccaaagcagtgg

SEQ ID NO: 728608 - DNA, 25 bp, Mus musculus
gtgctccagtttcgccgtgtggccc

SEQ ID NO: 728609 - DNA, 25 bp, Mus musculus
gtgctccagtttggccgtgtggccc

SEQ ID NO: 728610 - DNA, 25 bp, Mus musculus
gtgctccatcttcactatgcctgtg

SEQ ID NO: 728611 - DNA, 25 bp, Mus musculus
gtgctccatcttgactatgcctgtg

SEQ ID NO: 728612 - DNA, 25 bp, Mus musculus
gtgctcccggaacccagaaactttc

SEQ ID NO: 728613 - DNA, 25 bp, Mus musculus
gtgctcccggaagccagaaactttc

SEQ ID NO: 728614 - DNA, 25 bp, Mus musculus
gtgctccgccagcatcacaggcaag

SEQ ID NO: 728615 - DNA, 25 bp, Mus musculus
gtgctccgccaggatcacaggcaag

SEQ ID NO: 728616 - DNA, 25 bp, Mus musculus
gtgctcctaggcagtggcaccatct

SEQ ID NO: 728617 - DNA, 25 bp, Mus musculus
gtgctcctaggctgtggcaccatct

SEQ ID NO: 728618 - DNA, 25 bp, Mus musculus
gtgctcctccgtcagccaagatgct

SEQ ID NO: 728619 - DNA, 25 bp, Mus musculus
gtgctcctccgtgagccaagatgct

SEQ ID NO: 728620 - DNA, 25 bp, Mus musculus
gtgctcctgaatcccacaatgtcac

SEQ ID NO: 728621 - DNA, 25 bp, Mus musculus
gtgctcctgaatgccacaatgtcac

SEQ ID NO: 728622 - DNA, 25 bp, Mus musculus
gtgctcctgagcagccaaggctgcg

SEQ ID NO: 728623 - DNA, 25 bp, Mus musculus
gtgctcctgagctgccaaggctgcg

SEQ ID NO: 728624 - DNA, 25 bp, Mus musculus
gtgctcctggaaccaaagactcagg

SEQ ID NO: 728625 - DNA, 25 bp, Mus musculus
gtgctcctggaagcaaagactcagg

SEQ ID NO: 728626 - DNA, 25 bp, Mus musculus
gtgctcctggtcacgtctgcagatg

SEQ ID NO: 728627 - DNA, 25 bp, Mus musculus
gtgctcctggtctcgtctgcagatg

SEQ ID NO: 728628 - DNA, 25 bp, Mus musculus
gtgctcggccctagcctgcatggac

SEQ ID NO: 728629 - DNA, 25 bp, Mus musculus
gtgctcggcccttgcctgcatggac

SEQ ID NO: 728630 - DNA, 25 bp, Mus musculus
gtgctcgtcctcaggaaccatggca

SEQ ID NO: 728631 - DNA, 25 bp, Mus musculus
gtgctcgtcctctggaaccatggca

SEQ ID NO: 728632 - DNA, 25 bp, Mus musculus
gtgctcgtcgtaacctctggcctga

SEQ ID NO: 728633 - DNA, 25 bp, Mus musculus
gtgctcgtcgtatcctctggcctga

SEQ ID NO: 728634 - DNA, 25 bp, Mus musculus
gtgctctcagcccagccctaatgag

SEQ ID NO: 728635 - DNA, 25 bp, Mus musculus
gtgctctcagccgagccctaatgag

SEQ ID NO: 728636 - DNA, 25 bp, Mus musculus
gtgctctgcgagctggccggctggg

SEQ ID NO: 728637 - DNA, 25 bp, Mus musculus
gtgctctgcgaggtggccggctggg

SEQ ID NO: 728638 - DNA, 25 bp, Mus musculus
gtgctctgtcctcactggaatctgc

SEQ ID NO: 728639 - DNA, 25 bp, Mus musculus
gtgctctgtcctgactggaatctgc

SEQ ID NO: 728640 - DNA, 25 bp, Mus musculus
gtgctcttaggaaggagtatagaaa

SEQ ID NO: 728641 - DNA, 25 bp, Mus musculus
gtgctcttaggatggagtatagaaa

SEQ ID NO: 728642 - DNA, 25 bp, Mus musculus
gtgctcttctgaccggcgttgtaaa

SEQ ID NO: 728643 - DNA, 25 bp, Mus musculus
gtgctcttctgagcggcgttgtaaa

SEQ ID NO: 728644 - DNA, 25 bp, Mus musculus
gtgctcttgcaaccctggctaccaa

SEQ ID NO: 728645 - DNA, 25 bp, Mus musculus
gtgctcttgcaagcctggctaccaa

SEQ ID NO: 728646 - DNA, 25 bp, Mus musculus
gtgctcttttacctcgttaggatcg

SEQ ID NO: 728647 - DNA, 25 bp, Mus musculus
gtgctcttttacgtcgttaggatcg

SEQ ID NO: 728648 - DNA, 25 bp, Mus musculus
gtgctgaagaacatgtcgcagcgca

SEQ ID NO: 728649 - DNA, 25 bp, Mus musculus
gtgctgaagaacttgtcgcagcgca

SEQ ID NO: 728650 - DNA, 25 bp, Mus musculus
gtgctgaaggctacccggtccctac

SEQ ID NO: 728651 - DNA, 25 bp, Mus musculus
gtgctgaaggcttcccggtccctac

SEQ ID NO: 728652 - DNA, 25 bp, Mus musculus
gtgctgaatagcagctgcctgcggc

SEQ ID NO: 728653 - DNA, 25 bp, Mus musculus
gtgctgaatagctgctgcctgcggc

SEQ ID NO: 728654 - DNA, 25 bp, Mus musculus
gtgctgacattcctatgatgttaaa

SEQ ID NO: 728655 - DNA, 25 bp, Mus musculus
gtgctgacattcgtatgatgttaaa

SEQ ID NO: 728656 - DNA, 25 bp, Mus musculus
gtgctgacatttccaatccttgtcg

SEQ ID NO: 728657 - DNA, 25 bp, Mus musculus
gtgctgacatttgcaatccttgtcg

SEQ ID NO: 728658 - DNA, 25 bp, Mus musculus
gtgctgacctagctcccagatctca

SEQ ID NO: 728659 - DNA, 25 bp, Mus musculus
gtgctgacctaggtcccagatctca

SEQ ID NO: 728660 - DNA, 25 bp, Mus musculus
gtgctgaccttcagcctgctgtccg

SEQ ID NO: 728661 - DNA, 25 bp, Mus musculus
gtgctgaccttctgcctgctgtccg

SEQ ID NO: 728662 - DNA, 25 bp, Mus musculus
gtgctgacgtctagccttctcctcg

SEQ ID NO: 728663 - DNA, 25 bp, Mus musculus
gtgctgacgtcttgccttctcctcg

SEQ ID NO: 728664 - DNA, 25 bp, Mus musculus
gtgctgactgacaacccatctcctg

SEQ ID NO: 728665 - DNA, 25 bp, Mus musculus
gtgctgactgactacccatctcctg

SEQ ID NO: 728666 - DNA, 25 bp, Mus musculus
gtgctgagcaggaacttcgtgcagt

SEQ ID NO: 728667 - DNA, 25 bp, Mus musculus
gtgctgagcaggtacttcgtgcagt

SEQ ID NO: 728668 - DNA, 25 bp, Mus musculus
gtgctgagcatgaacccgagcggct

SEQ ID NO: 728669 - DNA, 25 bp, Mus musculus
gtgctgagcatgtacccgagcggct

SEQ ID NO: 728670 - DNA, 25 bp, Mus musculus
gtgctgagctatcctgacttgtgca

SEQ ID NO: 728671 - DNA, 25 bp, Mus musculus
gtgctgagctatgctgacttgtgca

SEQ ID NO: 728672 - DNA, 25 bp, Mus musculus
gtgctgaggactaaccagttctccg

SEQ ID NO: 728673 - DNA, 25 bp, Mus musculus
gtgctgaggacttaccagttctccg

SEQ ID NO: 728674 - DNA, 25 bp, Mus musculus
gtgctgaggctcaactttgatgatg

SEQ ID NO: 728675 - DNA, 25 bp, Mus musculus
gtgctgaggctctactttgatgatg

SEQ ID NO: 728676 - DNA, 25 bp, Mus musculus
gtgctgatgtatcggccgcctggaa

SEQ ID NO: 728677 - DNA, 25 bp, Mus musculus
gtgctgatgtatgggccgcctggaa

SEQ ID NO: 728678 - DNA, 25 bp, Mus musculus
gtgctgcacactccatggatggagt

SEQ ID NO: 728679 - DNA, 25 bp, Mus musculus
gtgctgcacactgcatggatggagt

SEQ ID NO: 728680 - DNA, 25 bp, Mus musculus
gtgctgcactgtaacgcggacaccc

SEQ ID NO: 728681 - DNA, 25 bp, Mus musculus
gtgctgcactgttacgcggacaccc

SEQ ID NO: 728682 - DNA, 25 bp, Mus musculus
gtgctgcagctgagccaacagctct

SEQ ID NO: 728683 - DNA, 25 bp, Mus musculus
gtgctgcagctgtgccaacagctct

SEQ ID NO: 728684 - DNA, 25 bp, Mus musculus
gtgctgcagttcaccaccgggaggt

SEQ ID NO: 728685 - DNA, 25 bp, Mus musculus
gtgctgcagttctccaccgggaggt

SEQ ID NO: 728686 - DNA, 25 bp, Mus musculus
gtgctgccaacgctgccagggaaac

SEQ ID NO: 728687 - DNA, 25 bp, Mus musculus
gtgctgccaacggtgccagggaaac

SEQ ID NO: 728688 - DNA, 25 bp, Mus musculus
gtgctgcccaccacggctgcgggat

SEQ ID NO: 728689 - DNA, 25 bp, Mus musculus
gtgctgcccacctcggctgcgggat

SEQ ID NO: 728690 - DNA, 25 bp, Mus musculus
gtgctgcccaggatggacaacatca

SEQ ID NO: 728691 - DNA, 25 bp, Mus musculus
gtgctgcccaggttggacaacatca

SEQ ID NO: 728692 - DNA, 25 bp, Mus musculus
gtgctgcctacccagatccttcaaa

SEQ ID NO: 728693 - DNA, 25 bp, Mus musculus
gtgctgcctaccgagatccttcaaa

SEQ ID NO: 728694 - DNA, 25 bp, Mus musculus
gtgctgcctgccagcgaggcacctg

SEQ ID NO: 728695 - DNA, 25 bp, Mus musculus
gtgctgcctgcctgcgaggcacctg

SEQ ID NO: 728696 - DNA, 25 bp, Mus musculus
gtgctgccttcacacttcggacaca

SEQ ID NO: 728697 - DNA, 25 bp, Mus musculus
gtgctgccttcagacttcggacaca

SEQ ID NO: 728698 - DNA, 25 bp, Mus musculus
gtgctgctacatcaacttcacaggg

SEQ ID NO: 728699 - DNA, 25 bp, Mus musculus
gtgctgctacatgaacttcacaggg

SEQ ID NO: 728700 - DNA, 25 bp, Mus musculus
gtgctgctccacaagcgagactcga

SEQ ID NO: 728701 - DNA, 25 bp, Mus musculus
gtgctgctccactagcgagactcga

SEQ ID NO: 728702 - DNA, 25 bp, Mus musculus
gtgctgctcctgacagtcgccgcat

SEQ ID NO: 728703 - DNA, 25 bp, Mus musculus
gtgctgctcctgtcagtcgccgcat

SEQ ID NO: 728704 - DNA, 25 bp, Mus musculus
gtgctgctccttctcactggagcag

SEQ ID NO: 728705 - DNA, 25 bp, Mus musculus
gtgctgctccttgtcactggagcag

SEQ ID NO: 728706 - DNA, 25 bp, Mus musculus
gtgctgctcgcaagccgatgtcagt

SEQ ID NO: 728707 - DNA, 25 bp, Mus musculus
gtgctgctcgcatgccgatgtcagt

SEQ ID NO: 728708 - DNA, 25 bp, Mus musculus
gtgctgctgcatcgtggttcatcgc

SEQ ID NO: 728709 - DNA, 25 bp, Mus musculus
gtgctgctgcatggtggttcatcgc

SEQ ID NO: 728710 - DNA, 25 bp, Mus musculus
gtgctgctgctcctcattgtacttc

SEQ ID NO: 728711 - DNA, 25 bp, Mus musculus
gtgctgctgctcgtcattgtacttc

SEQ ID NO: 728712 - DNA, 25 bp, Mus musculus
gtgctgctgtggctccccgcttttc

SEQ ID NO: 728713 - DNA, 25 bp, Mus musculus
gtgctgctgtgggtccccgcttttc

SEQ ID NO: 728714 - DNA, 25 bp, Mus musculus
gtgctggacacgactgcgcctacag

SEQ ID NO: 728715 - DNA, 25 bp, Mus musculus
gtgctggacacgtctgcgcctacag

SEQ ID NO: 728716 - DNA, 25 bp, Mus musculus
gtgctggacccgctctggcaaactc

SEQ ID NO: 728717 - DNA, 25 bp, Mus musculus
gtgctggacccggtctggcaaactc

SEQ ID NO: 728718 - DNA, 25 bp, Mus musculus
gtgctggaccttacccaccaatcag

SEQ ID NO: 728719 - DNA, 25 bp, Mus musculus
gtgctggacctttcccaccaatcag

SEQ ID NO: 728720 - DNA, 25 bp, Mus musculus
gtgctggaggacaacgactacggcc

SEQ ID NO: 728721 - DNA, 25 bp, Mus musculus
gtgctggaggactacgactacggcc

SEQ ID NO: 728722 - DNA, 25 bp, Mus musculus
gtgctggcagaccaacacgcagtac

SEQ ID NO: 728723 - DNA, 25 bp, Mus musculus
gtgctggcagacgaacacgcagtac

SEQ ID NO: 728724 - DNA, 25 bp, Mus musculus
gtgctggcagctcggatctacctaa

SEQ ID NO: 728725 - DNA, 25 bp, Mus musculus
gtgctggcagctgggatctacctaa

SEQ ID NO: 728726 - DNA, 25 bp, Mus musculus
gtgctggccatcaacgggcatgacc

SEQ ID NO: 728727 - DNA, 25 bp, Mus musculus
gtgctggccatctacgggcatgacc

SEQ ID NO: 728728 - DNA, 25 bp, Mus musculus
gtgctggctgctcgcaccagtgttc

SEQ ID NO: 728729 - DNA, 25 bp, Mus musculus
gtgctggctgctggcaccagtgttc

SEQ ID NO: 728730 - DNA, 25 bp, Mus musculus
gtgctggcttgcaaatggccttcta

SEQ ID NO: 728731 - DNA, 25 bp, Mus musculus
gtgctggcttgctaatggccttcta

SEQ ID NO: 728732 - DNA, 25 bp, Mus musculus
gtgctgggaatcaggagatgacccc

SEQ ID NO: 728733 - DNA, 25 bp, Mus musculus
gtgctgggaatctggagatgacccc

SEQ ID NO: 728734 - DNA, 25 bp, Mus musculus
gtgctgggactacaaggcgctctcc

SEQ ID NO: 728735 - DNA, 25 bp, Mus musculus
gtgctgggactagaaggcgctctcc

SEQ ID NO: 728736 - DNA, 25 bp, Mus musculus
gtgctgggccagcacccagtcctga

SEQ ID NO: 728737 - DNA, 25 bp, Mus musculus
gtgctgggccaggacccagtcctga

SEQ ID NO: 728738 - DNA, 25 bp, Mus musculus
gtgctgggtccccagtgagccatac

SEQ ID NO: 728739 - DNA, 25 bp, Mus musculus
gtgctgggtcccgagtgagccatac

SEQ ID NO: 728740 - DNA, 25 bp, Mus musculus
gtgctggtatttagagcgcagcgcc

SEQ ID NO: 728741 - DNA, 25 bp, Mus musculus
gtgctggtattttgagcgcagcgcc

SEQ ID NO: 728742 - DNA, 25 bp, Mus musculus
gtgctggtggtacccaagaagtccc

SEQ ID NO: 728743 - DNA, 25 bp, Mus musculus
gtgctggtggtagccaagaagtccc

SEQ ID NO: 728744 - DNA, 25 bp, Mus musculus
gtgctggtgtgcagaacgacaccct

SEQ ID NO: 728745 - DNA, 25 bp, Mus musculus
gtgctggtgtgctgaacgacaccct

SEQ ID NO: 728746 - DNA, 25 bp, Mus musculus
gtgctgtcccagagcctgtttaccc

SEQ ID NO: 728747 - DNA, 25 bp, Mus musculus
gtgctgtcccagtgcctgtttaccc

SEQ ID NO: 728748 - DNA, 25 bp, Mus musculus
gtgctgtcctcccttaaacatggcc

SEQ ID NO: 728749 - DNA, 25 bp, Mus musculus
gtgctgtcctccgttaaacatggcc

SEQ ID NO: 728750 - DNA, 25 bp, Mus musculus
gtgctgtgaagacgcccgcagctct

SEQ ID NO: 728751 - DNA, 25 bp, Mus musculus
gtgctgtgaagaggcccgcagctct

SEQ ID NO: 728752 - DNA, 25 bp, Mus musculus
gtgctgtgcggaactgcccatggac

SEQ ID NO: 728753 - DNA, 25 bp, Mus musculus
gtgctgtgcggatctgcccatggac

SEQ ID NO: 728754 - DNA, 25 bp, Mus musculus
gtgctgtgctataattctcgactcc

SEQ ID NO: 728755 - DNA, 25 bp, Mus musculus
gtgctgtgctattattctcgactcc

SEQ ID NO: 728756 - DNA, 25 bp, Mus musculus
gtgctgtgctgaatcctggtaaata

SEQ ID NO: 728757 - DNA, 25 bp, Mus musculus
gtgctgtgctgattcctggtaaata

SEQ ID NO: 728758 - DNA, 25 bp, Mus musculus
gtgctgttcatcacgggaattatca

SEQ ID NO: 728759 - DNA, 25 bp, Mus musculus
gtgctgttcatctcgggaattatca

SEQ ID NO: 728760 - DNA, 25 bp, Mus musculus
gtgctgttcatgagtctccaaatgc

SEQ ID NO: 728761 - DNA, 25 bp, Mus musculus
gtgctgttcatgtgtctccaaatgc

SEQ ID NO: 728762 - DNA, 25 bp, Mus musculus
gtgctgttggcaccccttctgggca

SEQ ID NO: 728763 - DNA, 25 bp, Mus musculus
gtgctgttggcagcccttctgggca

SEQ ID NO: 728764 - DNA, 25 bp, Mus musculus
gtgctgtttgacaagcccaccaggg

SEQ ID NO: 728765 - DNA, 25 bp, Mus musculus
gtgctgtttgactagcccaccaggg

SEQ ID NO: 728766 - DNA, 25 bp, Mus musculus
gtgctgttttccagggacgcttcca

SEQ ID NO: 728767 - DNA, 25 bp, Mus musculus
gtgctgttttcctgggacgcttcca

SEQ ID NO: 728768 - DNA, 25 bp, Mus musculus
gtgcttacagacacataatgtcaat

SEQ ID NO: 728769 - DNA, 25 bp, Mus musculus
gtgcttacagactcataatgtcaat

SEQ ID NO: 728770 - DNA, 25 bp, Mus musculus
gtgcttagctacaaggctctgctgg

SEQ ID NO: 728771 - DNA, 25 bp, Mus musculus
gtgcttagctactaggctctgctgg

SEQ ID NO: 728772 - DNA, 25 bp, Mus musculus
gtgcttcaaccgcactgacttcctg

SEQ ID NO: 728773 - DNA, 25 bp, Mus musculus
gtgcttcaaccggactgacttcctg

SEQ ID NO: 728774 - DNA, 25 bp, Mus musculus
gtgcttcagaggatcctcgctgtcc

SEQ ID NO: 728775 - DNA, 25 bp, Mus musculus
gtgcttcagaggttcctcgctgtcc

SEQ ID NO: 728776 - DNA, 25 bp, Mus musculus
gtgcttcccggaaagctgtgcccaa

SEQ ID NO: 728777 - DNA, 25 bp, Mus musculus
gtgcttcccggacaacagtatgtgt

SEQ ID NO: 728778 - DNA, 25 bp, Mus musculus
gtgcttcccggagaacagtatgtgt

SEQ ID NO: 728779 - DNA, 25 bp, Mus musculus
gtgcttcccggatagctgtgcccaa

SEQ ID NO: 728780 - DNA, 25 bp, Mus musculus
gtgcttccgggccttcacgagcagc

SEQ ID NO: 728781 - DNA, 25 bp, Mus musculus
gtgcttccgggcgttcacgagcagc

SEQ ID NO: 728782 - DNA, 25 bp, Mus musculus
gtgcttcggctgcacatctgcgcag

SEQ ID NO: 728783 - DNA, 25 bp, Mus musculus
gtgcttcggctggacatctgcgcag

SEQ ID NO: 728784 - DNA, 25 bp, Mus musculus
gtgcttcgggagatcgtgtcccaga

SEQ ID NO: 728785 - DNA, 25 bp, Mus musculus
gtgcttcgggagttcgtgtcccaga

SEQ ID NO: 728786 - DNA, 25 bp, Mus musculus
gtgcttctcaggcaacatcatcagc

SEQ ID NO: 728787 - DNA, 25 bp, Mus musculus
gtgcttctcagggaacatcatcagc

SEQ ID NO: 728788 - DNA, 25 bp, Mus musculus
gtgcttcttattacgcctgccttgg

SEQ ID NO: 728789 - DNA, 25 bp, Mus musculus
gtgcttcttatttcgcctgccttgg

SEQ ID NO: 728790 - DNA, 25 bp, Mus musculus
gtgcttcttgttaatcgtgtcatgc

SEQ ID NO: 728791 - DNA, 25 bp, Mus musculus
gtgcttcttgtttatcgtgtcatgc

SEQ ID NO: 728792 - DNA, 25 bp, Mus musculus
gtgcttgaagctcaaggtgactgtc

SEQ ID NO: 728793 - DNA, 25 bp, Mus musculus
gtgcttgaagctgaaggtgactgtc

SEQ ID NO: 728794 - DNA, 25 bp, Mus musculus
gtgcttgaccataggacatagtctg

SEQ ID NO: 728795 - DNA, 25 bp, Mus musculus
gtgcttgaccattggacatagtctg

SEQ ID NO: 728796 - DNA, 25 bp, Mus musculus
gtgctttaaaccaagagcccttcgg

SEQ ID NO: 728797 - DNA, 25 bp, Mus musculus
gtgctttaaacctagagcccttcgg

SEQ ID NO: 728798 - DNA, 25 bp, Mus musculus
gtgctttccgctccgtttctacgtc

SEQ ID NO: 728799 - DNA, 25 bp, Mus musculus
gtgctttccgctgcgtttctacgtc

SEQ ID NO: 728800 - DNA, 25 bp, Mus musculus
gtgctttcgagaagcctcccagcct

SEQ ID NO: 728801 - DNA, 25 bp, Mus musculus
gtgctttcgagatgcctcccagcct

SEQ ID NO: 728802 - DNA, 25 bp, Mus musculus
gtgctttgaattctccaggattggg

SEQ ID NO: 728803 - DNA, 25 bp, Mus musculus
gtgctttgaattgtccaggattggg

SEQ ID NO: 728804 - DNA, 25 bp, Mus musculus
gtgctttgagtgatatgggcaaaaa

SEQ ID NO: 728805 - DNA, 25 bp, Mus musculus
gtgctttgagtgttatgggcaaaaa

SEQ ID NO: 728806 - DNA, 25 bp, Mus musculus
gtgctttgccctctcattctgcatc

SEQ ID NO: 728807 - DNA, 25 bp, Mus musculus
gtgctttgccctgtcattctgcatc

SEQ ID NO: 728808 - DNA, 25 bp, Mus musculus
gtgctttgtctacaggaagttcaag

SEQ ID NO: 728809 - DNA, 25 bp, Mus musculus
gtgctttgtctagaggaagttcaag

SEQ ID NO: 728810 - DNA, 25 bp, Mus musculus
gtgcttttctccagccccgtgagga

SEQ ID NO: 728811 - DNA, 25 bp, Mus musculus
gtgcttttctcctgccccgtgagga

SEQ ID NO: 728812 - DNA, 25 bp, Mus musculus
gtggaaaaagtcactactcactcag

SEQ ID NO: 728813 - DNA, 25 bp, Mus musculus
gtggaaaaagtctctactcactcag

SEQ ID NO: 728814 - DNA, 25 bp, Mus musculus
gtggaaaaccaaaagcctgttggat

SEQ ID NO: 728815 - DNA, 25 bp, Mus musculus
gtggaaaaccaatagcctgttggat

SEQ ID NO: 728816 - DNA, 25 bp, Mus musculus
gtggaaaaccagatcctcacccgag

SEQ ID NO: 728817 - DNA, 25 bp, Mus musculus
gtggaaaaccagttcctcacccgag

SEQ ID NO: 728818 - DNA, 25 bp, Mus musculus
gtggaaaacttcagactttggcttc

SEQ ID NO: 728819 - DNA, 25 bp, Mus musculus
gtggaaaacttctgactttggcttc

SEQ ID NO: 728820 - DNA, 25 bp, Mus musculus
gtggaaaagcacacggagcagagcc

SEQ ID NO: 728821 - DNA, 25 bp, Mus musculus
gtggaaaagcactcggagcagagcc

SEQ ID NO: 728822 - DNA, 25 bp, Mus musculus
gtggaaaccacgacaaattgacaac

SEQ ID NO: 728823 - DNA, 25 bp, Mus musculus
gtggaaaccacgtcaaattgacaac

SEQ ID NO: 728824 - DNA, 25 bp, Mus musculus
gtggaaactctgaagccgaccagtt

SEQ ID NO: 728825 - DNA, 25 bp, Mus musculus
gtggaaactctgtagccgaccagtt

SEQ ID NO: 728826 - DNA, 25 bp, Mus musculus
gtggaaacttcactcatctgatctg

SEQ ID NO: 728827 - DNA, 25 bp, Mus musculus
gtggaaacttcagtcatctgatctg

SEQ ID NO: 728828 - DNA, 25 bp, Mus musculus
gtggaaagaaataacctgatgaggt

SEQ ID NO: 728829 - DNA, 25 bp, Mus musculus
gtggaaagaaattacctgatgaggt

SEQ ID NO: 728830 - DNA, 25 bp, Mus musculus
gtggaaagggacagtcgagctctcc

SEQ ID NO: 728831 - DNA, 25 bp, Mus musculus
gtggaaagggactgtcgagctctcc

SEQ ID NO: 728832 - DNA, 25 bp, Mus musculus
gtggaacaagtacgtttgaagtcag

SEQ ID NO: 728833 - DNA, 25 bp, Mus musculus
gtggaacaagtaggtttgaagtcag

SEQ ID NO: 728834 - DNA, 25 bp, Mus musculus
gtggaacacatcaacaagactctag

SEQ ID NO: 728835 - DNA, 25 bp, Mus musculus
gtggaacacatctacaagactctag

SEQ ID NO: 728836 - DNA, 25 bp, Mus musculus
gtggaacacgacaccatccggctgc

SEQ ID NO: 728837 - DNA, 25 bp, Mus musculus
gtggaacacgactccatccggctgc

SEQ ID NO: 728838 - DNA, 25 bp, Mus musculus
gtggaacagaacatcccagccattg

SEQ ID NO: 728839 - DNA, 25 bp, Mus musculus
gtggaacagaacttcccagccattg

SEQ ID NO: 728840 - DNA, 25 bp, Mus musculus
gtggaacatccacacaaattcctca

SEQ ID NO: 728841 - DNA, 25 bp, Mus musculus
gtggaacatccagacaaattcctca

SEQ ID NO: 728842 - DNA, 25 bp, Mus musculus
gtggaaccatggcaacatcacccgc

SEQ ID NO: 728843 - DNA, 25 bp, Mus musculus
gtggaaccatgggaacatcacccgc

SEQ ID NO: 728844 - DNA, 25 bp, Mus musculus
gtggaaccccacagtacggagctgc

SEQ ID NO: 728845 - DNA, 25 bp, Mus musculus
gtggaaccccactgtacggagctgc

SEQ ID NO: 728846 - DNA, 25 bp, Mus musculus
gtggaaccttcacgccctcgatgaa

SEQ ID NO: 728847 - DNA, 25 bp, Mus musculus
gtggaaccttcaggccctcgatgaa

SEQ ID NO: 728848 - DNA, 25 bp, Mus musculus
gtggaactgttcatgctcaccctcg

SEQ ID NO: 728849 - DNA, 25 bp, Mus musculus
gtggaactgttcttgctcaccctcg

SEQ ID NO: 728850 - DNA, 25 bp, Mus musculus
gtggaagaagtacctcacacaggct

SEQ ID NO: 728851 - DNA, 25 bp, Mus musculus
gtggaagaagtagctcacacaggct

SEQ ID NO: 728852 - DNA, 25 bp, Mus musculus
gtggaagaggataccacctgctata

SEQ ID NO: 728853 - DNA, 25 bp, Mus musculus
gtggaagaggattccacctgctata

SEQ ID NO: 728854 - DNA, 25 bp, Mus musculus
gtggaagattacagaaatagaaact

SEQ ID NO: 728855 - DNA, 25 bp, Mus musculus
gtggaagattactgaaatagaaact

SEQ ID NO: 728856 - DNA, 25 bp, Mus musculus
gtggaagccaagcttgaagaattaa

SEQ ID NO: 728857 - DNA, 25 bp, Mus musculus
gtggaagccaaggttgaagaattaa

SEQ ID NO: 728858 - DNA, 25 bp, Mus musculus
gtggaagcccacactggtcatcctc

SEQ ID NO: 728859 - DNA, 25 bp, Mus musculus
gtggaagcccactctggtcatcctc

SEQ ID NO: 728860 - DNA, 25 bp, Mus musculus
gtggaaggaatcagacgaacctttt

SEQ ID NO: 728861 - DNA, 25 bp, Mus musculus
gtggaaggaatctgacgaacctttt

SEQ ID NO: 728862 - DNA, 25 bp, Mus musculus
gtggaaggcaagatcccactccact

SEQ ID NO: 728863 - DNA, 25 bp, Mus musculus
gtggaaggcaagttcccactccact

SEQ ID NO: 728864 - DNA, 25 bp, Mus musculus
gtggaaggcatcactggcaatctct

SEQ ID NO: 728865 - DNA, 25 bp, Mus musculus
gtggaaggcatctctggcaatctct

SEQ ID NO: 728866 - DNA, 25 bp, Mus musculus
gtggaaggccctctgaagaaactcc

SEQ ID NO: 728867 - DNA, 25 bp, Mus musculus
gtggaaggccctgtgaagaaactcc

SEQ ID NO: 728868 - DNA, 25 bp, Mus musculus
gtggaagttcacacagagccgatgg

SEQ ID NO: 728869 - DNA, 25 bp, Mus musculus
gtggaagttcactcagagccgatgg

SEQ ID NO: 728870 - DNA, 25 bp, Mus musculus
gtggaagttcccctgattctaataa

SEQ ID NO: 728871 - DNA, 25 bp, Mus musculus
gtggaagttcccgtgattctaataa

SEQ ID NO: 728872 - DNA, 25 bp, Mus musculus
gtggaagttgcgatagcagaagctc

SEQ ID NO: 728873 - DNA, 25 bp, Mus musculus
gtggaagttgcgttagcagaagctc

SEQ ID NO: 728874 - DNA, 25 bp, Mus musculus
gtggaatccagcatcgcaggcacaa

SEQ ID NO: 728875 - DNA, 25 bp, Mus musculus
gtggaatccagcttcgcaggcacaa

SEQ ID NO: 728876 - DNA, 25 bp, Mus musculus
gtggaatgagaaagtgacgcagtct

SEQ ID NO: 728877 - DNA, 25 bp, Mus musculus
gtggaatgagaatgtgacgcagtct

SEQ ID NO: 728878 - DNA, 25 bp, Mus musculus
gtggaatgagccagcagcatgccga

SEQ ID NO: 728879 - DNA, 25 bp, Mus musculus
gtggaatgagcctgcagcatgccga

SEQ ID NO: 728880 - DNA, 25 bp, Mus musculus
gtggaatgagctcaactacatgggt

SEQ ID NO: 728881 - DNA, 25 bp, Mus musculus
gtggaatgagctgaactacatgggt

SEQ ID NO: 728882 - DNA, 25 bp, Mus musculus
gtggaatggcgtcaagaatgcaact

SEQ ID NO: 728883 - DNA, 25 bp, Mus musculus
gtggaatggcgtgaagaatgcaact

SEQ ID NO: 728884 - DNA, 25 bp, Mus musculus
gtggaatgtaacacaaagctggacc

SEQ ID NO: 728885 - DNA, 25 bp, Mus musculus
gtggaatgtaactcaaagctggacc

SEQ ID NO: 728886 - DNA, 25 bp, Mus musculus
gtggaattttccatagccatgaagc

SEQ ID NO: 728887 - DNA, 25 bp, Mus musculus
gtggaattttccttagccatgaagc

SEQ ID NO: 728888 - DNA, 25 bp, Mus musculus
gtggacaagagtcgaatttcaggcc

SEQ ID NO: 728889 - DNA, 25 bp, Mus musculus
gtggacaagagtggaatttcaggcc

SEQ ID NO: 728890 - DNA, 25 bp, Mus musculus
gtggacaatgccaagttcacgatgg

SEQ ID NO: 728891 - DNA, 25 bp, Mus musculus
gtggacaatgcctagttcacgatgg

SEQ ID NO: 728892 - DNA, 25 bp, Mus musculus
gtggacacactacagtattgcttcc

SEQ ID NO: 728893 - DNA, 25 bp, Mus musculus
gtggacacactagagtattgcttcc

SEQ ID NO: 728894 - DNA, 25 bp, Mus musculus
gtggacaccttcctggtcaacaaga

SEQ ID NO: 728895 - DNA, 25 bp, Mus musculus
gtggacaccttcgtggtcaacaaga

SEQ ID NO: 728896 - DNA, 25 bp, Mus musculus
gtggacacgcatccctactgagcac

SEQ ID NO: 728897 - DNA, 25 bp, Mus musculus
gtggacacgcatgcctactgagcac

SEQ ID NO: 728898 - DNA, 25 bp, Mus musculus
gtggacacgtcacctacccctgtgt

SEQ ID NO: 728899 - DNA, 25 bp, Mus musculus
gtggacacgtcagctacccctgtgt

SEQ ID NO: 728900 - DNA, 25 bp, Mus musculus
gtggacagacccactatgaacaagt

SEQ ID NO: 728901 - DNA, 25 bp, Mus musculus
gtggacagaccctctatgaacaagt

SEQ ID NO: 728902 - DNA, 25 bp, Mus musculus
gtggacagacttccccaaccaatgc

SEQ ID NO: 728903 - DNA, 25 bp, Mus musculus
gtggacagacttgcccaaccaatgc

SEQ ID NO: 728904 - DNA, 25 bp, Mus musculus
gtggacagagtaccccgcctccatt

SEQ ID NO: 728905 - DNA, 25 bp, Mus musculus
gtggacagagtagcccgcctccatt

SEQ ID NO: 728906 - DNA, 25 bp, Mus musculus
gtggacaggtggacttttctgagac

SEQ ID NO: 728907 - DNA, 25 bp, Mus musculus
gtggacaggtggtcttttctgagac

SEQ ID NO: 728908 - DNA, 25 bp, Mus musculus
gtggacatcaatcgcaatcaagtgg

SEQ ID NO: 728909 - DNA, 25 bp, Mus musculus
gtggacatcaatggcaatcaagtgg

SEQ ID NO: 728910 - DNA, 25 bp, Mus musculus
gtggaccactgtcggcgacttggaa

SEQ ID NO: 728911 - DNA, 25 bp, Mus musculus
gtggaccactgtgggcgacttggaa

SEQ ID NO: 728912 - DNA, 25 bp, Mus musculus
gtggaccatcggctaagtgcccttg

SEQ ID NO: 728913 - DNA, 25 bp, Mus musculus
gtggaccatcgggtaagtgcccttg

SEQ ID NO: 728914 - DNA, 25 bp, Mus musculus
gtggacccaacactactctgatcat

SEQ ID NO: 728915 - DNA, 25 bp, Mus musculus
gtggacccaacagtactctgatcat

SEQ ID NO: 728916 - DNA, 25 bp, Mus musculus
gtggacccaagtcgtaacaacctcg

SEQ ID NO: 728917 - DNA, 25 bp, Mus musculus
gtggacccaagtggtaacaacctcg

SEQ ID NO: 728918 - DNA, 25 bp, Mus musculus
gtggaccgaggcagcagcagtcacc

SEQ ID NO: 728919 - DNA, 25 bp, Mus musculus
gtggaccgaggctgcagcagtcacc

SEQ ID NO: 728920 - DNA, 25 bp, Mus musculus
gtggaccgagtgacagagttcctcc

SEQ ID NO: 728921 - DNA, 25 bp, Mus musculus
gtggaccgagtgtcagagttcctcc

SEQ ID NO: 728922 - DNA, 25 bp, Mus musculus
gtggaccgtggtatctacagtgttg

SEQ ID NO: 728923 - DNA, 25 bp, Mus musculus
gtggaccgtggtttctacagtgttg

SEQ ID NO: 728924 - DNA, 25 bp, Mus musculus
gtggacctcatgaccattggcactc

SEQ ID NO: 728925 - DNA, 25 bp, Mus musculus
gtggacctcatgtccattggcactc

SEQ ID NO: 728926 - DNA, 25 bp, Mus musculus
gtggacctcgttactgcctgtgaca

SEQ ID NO: 728927 - DNA, 25 bp, Mus musculus
gtggacctcgtttctgcctgtgaca

SEQ ID NO: 728928 - DNA, 25 bp, Mus musculus
gtggacctggaacctacttctggca

SEQ ID NO: 728929 - DNA, 25 bp, Mus musculus
gtggacctggaagctacttctggca

SEQ ID NO: 728930 - DNA, 25 bp, Mus musculus
gtggaccttcttaaaggcaccgagg

SEQ ID NO: 728931 - DNA, 25 bp, Mus musculus
gtggaccttctttaaggcaccgagg

SEQ ID NO: 728932 - DNA, 25 bp, Mus musculus
gtggacgacgcgcacttgctcctac

SEQ ID NO: 728933 - DNA, 25 bp, Mus musculus
gtggacgacgcggacttgctcctac

SEQ ID NO: 728934 - DNA, 25 bp, Mus musculus
gtggacgagttgcagtcatccttcg

SEQ ID NO: 728935 - DNA, 25 bp, Mus musculus
gtggacgagttggagtcatccttcg

SEQ ID NO: 728936 - DNA, 25 bp, Mus musculus
gtggacgatgccattccatcacctc

SEQ ID NO: 728937 - DNA, 25 bp, Mus musculus
gtggacgatgcctttccatcacctc

SEQ ID NO: 728938 - DNA, 25 bp, Mus musculus
gtggacgccaacattgacgaggcct

SEQ ID NO: 728939 - DNA, 25 bp, Mus musculus
gtggacgccaactttgacgaggcct

SEQ ID NO: 728940 - DNA, 25 bp, Mus musculus
gtggacgccgcgatcagccgccatg

SEQ ID NO: 728941 - DNA, 25 bp, Mus musculus
gtggacgccgcgttcagccgccatg

SEQ ID NO: 728942 - DNA, 25 bp, Mus musculus
gtggacgcggcccaggcgtgtacag

SEQ ID NO: 728943 - DNA, 25 bp, Mus musculus
gtggacgcggccgaggcgtgtacag

SEQ ID NO: 728944 - DNA, 25 bp, Mus musculus
gtggacgctcctcgccaacaagaag

SEQ ID NO: 728945 - DNA, 25 bp, Mus musculus
gtggacgctcctggccaacaagaag

SEQ ID NO: 728946 - DNA, 25 bp, Mus musculus
gtggacggacgcatttctgcagccc

SEQ ID NO: 728947 - DNA, 25 bp, Mus musculus
gtggacggacgcttttctgcagccc

SEQ ID NO: 728948 - DNA, 25 bp, Mus musculus
gtggacggcaagcagtatgactttc

SEQ ID NO: 728949 - DNA, 25 bp, Mus musculus
gtggacggcaaggagtatgactttc

SEQ ID NO: 728950 - DNA, 25 bp, Mus musculus
gtggacggccacatcagccctgctt

SEQ ID NO: 728951 - DNA, 25 bp, Mus musculus
gtggacggccacttcagccctgctt

SEQ ID NO: 728952 - DNA, 25 bp, Mus musculus
gtggacggcgtgaatacctacaatt

SEQ ID NO: 728953 - DNA, 25 bp, Mus musculus
gtggacggcgtgtatacctacaatt

SEQ ID NO: 728954 - DNA, 25 bp, Mus musculus
gtggactagtgaaggcagcgccatt

SEQ ID NO: 728955 - DNA, 25 bp, Mus musculus
gtggactagtgatggcagcgccatt

SEQ ID NO: 728956 - DNA, 25 bp, Mus musculus
gtggactcccctaaccatagtggac

SEQ ID NO: 728957 - DNA, 25 bp, Mus musculus
gtggactccccttaccatagtggac

SEQ ID NO: 728958 - DNA, 25 bp, Mus musculus
gtggactcgcatcgctaggcctcct

SEQ ID NO: 728959 - DNA, 25 bp, Mus musculus
gtggactcgcatggctaggcctcct

SEQ ID NO: 728960 - DNA, 25 bp, Mus musculus
gtggactgacccagccaggtgctgg

SEQ ID NO: 728961 - DNA, 25 bp, Mus musculus
gtggactgaccctgccaggtgctgg

SEQ ID NO: 728962 - DNA, 25 bp, Mus musculus
gtggactgccaactcacacagaact

SEQ ID NO: 728963 - DNA, 25 bp, Mus musculus
gtggactgccaagtcacacagaact

SEQ ID NO: 728964 - DNA, 25 bp, Mus musculus
gtggactgcgatcgcttttccacct

SEQ ID NO: 728965 - DNA, 25 bp, Mus musculus
gtggactgcgatggcttttccacct

SEQ ID NO: 728966 - DNA, 25 bp, Mus musculus
gtggactggctgaacacacacgtgg

SEQ ID NO: 728967 - DNA, 25 bp, Mus musculus
gtggactggctgtacacacacgtgg

SEQ ID NO: 728968 - DNA, 25 bp, Mus musculus
gtggacttcaccaacacgcaggagg

SEQ ID NO: 728969 - DNA, 25 bp, Mus musculus
gtggacttcacctacacgcaggagg

SEQ ID NO: 728970 - DNA, 25 bp, Mus musculus
gtggacttctaccagccgacgtgca

SEQ ID NO: 728971 - DNA, 25 bp, Mus musculus
gtggacttctacgagccgacgtgca

SEQ ID NO: 728972 - DNA, 25 bp, Mus musculus
gtggacttgattcccaaatacatcg

SEQ ID NO: 728973 - DNA, 25 bp, Mus musculus
gtggacttgattgccaaatacatcg

SEQ ID NO: 728974 - DNA, 25 bp, Mus musculus
gtggactttgaccacagctgctcag

SEQ ID NO: 728975 - DNA, 25 bp, Mus musculus
gtggactttgacgacagctgctcag

SEQ ID NO: 728976 - DNA, 25 bp, Mus musculus
gtggagaaaccgcttagcttttcac

SEQ ID NO: 728977 - DNA, 25 bp, Mus musculus
gtggagaaaccggttagcttttcac

SEQ ID NO: 728978 - DNA, 25 bp, Mus musculus
gtggagaaggtgcacatcatcatca

SEQ ID NO: 728979 - DNA, 25 bp, Mus musculus
gtggagaaggtggacatcatcatca

SEQ ID NO: 728980 - DNA, 25 bp, Mus musculus
gtggagaataaaccaccctgtgtac

SEQ ID NO: 728981 - DNA, 25 bp, Mus musculus
gtggagaataaagcaccctgtgtac

SEQ ID NO: 728982 - DNA, 25 bp, Mus musculus
gtggagacatctccaaagacccgcg

SEQ ID NO: 728983 - DNA, 25 bp, Mus musculus
gtggagacatctgcaaagacccgcg

SEQ ID NO: 728984 - DNA, 25 bp, Mus musculus
gtggagacgctaaccctgtcaggga

SEQ ID NO: 728985 - DNA, 25 bp, Mus musculus
gtggagacgctatccctgtcaggga

SEQ ID NO: 728986 - DNA, 25 bp, Mus musculus
gtggagactccacgacatctgtctt

SEQ ID NO: 728987 - DNA, 25 bp, Mus musculus
gtggagactccaggacatctgtctt

SEQ ID NO: 728988 - DNA, 25 bp, Mus musculus
gtggagactcttcctgagcccagct

SEQ ID NO: 728989 - DNA, 25 bp, Mus musculus
gtggagactcttgctgagcccagct

SEQ ID NO: 728990 - DNA, 25 bp, Mus musculus
gtggagactgtcacctcaaattctc

SEQ ID NO: 728991 - DNA, 25 bp, Mus musculus
gtggagactgtctcctcaaattctc

SEQ ID NO: 728992 - DNA, 25 bp, Mus musculus
gtggagactgttcaatacaagaata

SEQ ID NO: 728993 - DNA, 25 bp, Mus musculus
gtggagactgttgaatacaagaata

SEQ ID NO: 728994 - DNA, 25 bp, Mus musculus
gtggagagatttctgctcaacctct

SEQ ID NO: 728995 - DNA, 25 bp, Mus musculus
gtggagagatttgtgctcaacctct

SEQ ID NO: 728996 - DNA, 25 bp, Mus musculus
gtggagaggaggattttctctgcaa

SEQ ID NO: 728997 - DNA, 25 bp, Mus musculus
gtggagaggaggtttttctctgcaa

SEQ ID NO: 728998 - DNA, 25 bp, Mus musculus
gtggagagttgtagtctctgcgcta

SEQ ID NO: 728999 - DNA, 25 bp, Mus musculus
gtggagagttgttgtctctgcgcta

SEQ ID NO: 729000 - DNA, 25 bp, Mus musculus
gtggagatcccacccacagtcactg

SEQ ID NO: 729001 - DNA, 25 bp, Mus musculus
gtggagatcccagccacagtcactg

SEQ ID NO: 729002 - DNA, 25 bp, Mus musculus
gtggagatccctcgccagaagtaca

SEQ ID NO: 729003 - DNA, 25 bp, Mus musculus
gtggagatccctggccagaagtaca

SEQ ID NO: 729004 - DNA, 25 bp, Mus musculus
gtggagatgatcactcaactttaac

SEQ ID NO: 729005 - DNA, 25 bp, Mus musculus
gtggagatgatctctcaactttaac

SEQ ID NO: 729006 - DNA, 25 bp, Mus musculus
gtggagatgctcatcaaagaacaga

SEQ ID NO: 729007 - DNA, 25 bp, Mus musculus
gtggagatgctcttcaaagaacaga

SEQ ID NO: 729008 - DNA, 25 bp, Mus musculus
gtggagatggatcgaactctgcaca

SEQ ID NO: 729009 - DNA, 25 bp, Mus musculus
gtggagatggatggaactctgcaca

SEQ ID NO: 729010 - DNA, 25 bp, Mus musculus
gtggagcaaggaaatcatgatgagc

SEQ ID NO: 729011 - DNA, 25 bp, Mus musculus
gtggagcaaggatatcatgatgagc

SEQ ID NO: 729012 - DNA, 25 bp, Mus musculus
gtggagcacaatctggcttcagaga

SEQ ID NO: 729013 - DNA, 25 bp, Mus musculus
gtggagcacaatgtggcttcagaga

SEQ ID NO: 729014 - DNA, 25 bp, Mus musculus
gtggagcaccctccggtcactggaa

SEQ ID NO: 729015 - DNA, 25 bp, Mus musculus
gtggagcaccctgcggtcactggaa

SEQ ID NO: 729016 - DNA, 25 bp, Mus musculus
gtggagcacctgagcgccagctgcc

SEQ ID NO: 729017 - DNA, 25 bp, Mus musculus
gtggagcacctgtgcgccagctgcc

SEQ ID NO: 729018 - DNA, 25 bp, Mus musculus
gtggagcagatacacaataaggtgc

SEQ ID NO: 729019 - DNA, 25 bp, Mus musculus
gtggagcagatagacaataaggtgc

SEQ ID NO: 729020 - DNA, 25 bp, Mus musculus
gtggagcagctgaagtcaatgcatt

SEQ ID NO: 729021 - DNA, 25 bp, Mus musculus
gtggagcagctgtagtcaatgcatt

SEQ ID NO: 729022 - DNA, 25 bp, Mus musculus
gtggagcaggcccactttgccctgt

SEQ ID NO: 729023 - DNA, 25 bp, Mus musculus
gtggagcaggccgactttgccctgt

SEQ ID NO: 729024 - DNA, 25 bp, Mus musculus
gtggagcagtccatcttcaatgact

SEQ ID NO: 729025 - DNA, 25 bp, Mus musculus
gtggagcagtccttcttcaatgact

SEQ ID NO: 729026 - DNA, 25 bp, Mus musculus
gtggagccagccatacaagagctgt

SEQ ID NO: 729027 - DNA, 25 bp, Mus musculus
gtggagccagccttacaagagctgt

SEQ ID NO: 729028 - DNA, 25 bp, Mus musculus
gtggagcccggcacaagtcctttca

SEQ ID NO: 729029 - DNA, 25 bp, Mus musculus
gtggagcccggctcaagtcctttca

SEQ ID NO: 729030 - DNA, 25 bp, Mus musculus
gtggagcctggtactacttgtgccg

SEQ ID NO: 729031 - DNA, 25 bp, Mus musculus
gtggagcctggttctacttgtgccg

SEQ ID NO: 729032 - DNA, 25 bp, Mus musculus
gtggagcgccacacaggttcaccac

SEQ ID NO: 729033 - DNA, 25 bp, Mus musculus
gtggagcgccactcaggttcaccac

SEQ ID NO: 729034 - DNA, 25 bp, Mus musculus
gtggagcggcaacagcgctggctgc

SEQ ID NO: 729035 - DNA, 25 bp, Mus musculus
gtggagcggcaagagcgctggctgc

SEQ ID NO: 729036 - DNA, 25 bp, Mus musculus
gtggagcggctcactcaaggtcgat

SEQ ID NO: 729037 - DNA, 25 bp, Mus musculus
gtggagcggctctctcaaggtcgat

SEQ ID NO: 729038 - DNA, 25 bp, Mus musculus
gtggagcgtcgcatcgtgtctcagt

SEQ ID NO: 729039 - DNA, 25 bp, Mus musculus
gtggagcgtcgcttcgtgtctcagt

SEQ ID NO: 729040 - DNA, 25 bp, Mus musculus
gtggaggaaatcactctgacctcgg

SEQ ID NO: 729041 - DNA, 25 bp, Mus musculus
gtggaggaaatctctctgacctcgg

SEQ ID NO: 729042 - DNA, 25 bp, Mus musculus
gtggaggaacttaggaaaaccaatg

SEQ ID NO: 729043 - DNA, 25 bp, Mus musculus
gtggaggaactttggaaaaccaatg

SEQ ID NO: 729044 - DNA, 25 bp, Mus musculus
gtggaggccacacctcacggtctga

SEQ ID NO: 729045 - DNA, 25 bp, Mus musculus
gtggaggccacagctcacggtctga

SEQ ID NO: 729046 - DNA, 25 bp, Mus musculus
gtggaggcgggcagctcaccaaaca

SEQ ID NO: 729047 - DNA, 25 bp, Mus musculus
gtggaggcgggctgctcaccaaaca

SEQ ID NO: 729048 - DNA, 25 bp, Mus musculus
gtggagggcatgctggaggacctca

SEQ ID NO: 729049 - DNA, 25 bp, Mus musculus
gtggagggcatggtggaggacctca

SEQ ID NO: 729050 - DNA, 25 bp, Mus musculus
gtggagggctctaccatcaagaagc

SEQ ID NO: 729051 - DNA, 25 bp, Mus musculus
gtggagggctcttccatcaagaagc

SEQ ID NO: 729052 - DNA, 25 bp, Mus musculus
gtggagggtgccattcctgtgacca

SEQ ID NO: 729053 - DNA, 25 bp, Mus musculus
gtggagggtgcctttcctgtgacca

SEQ ID NO: 729054 - DNA, 25 bp, Mus musculus
gtggaggtgactctgcccactgagc

SEQ ID NO: 729055 - DNA, 25 bp, Mus musculus
gtggaggtgactgtgcccactgagc

SEQ ID NO: 729056 - DNA, 25 bp, Mus musculus
gtggagtcaccccttcctgctggga

SEQ ID NO: 729057 - DNA, 25 bp, Mus musculus
gtggagtcacccgttcctgctggga

SEQ ID NO: 729058 - DNA, 25 bp, Mus musculus
gtggagtcaccgccaatgatgtcat

SEQ ID NO: 729059 - DNA, 25 bp, Mus musculus
gtggagtcaccggcaatgatgtcat

SEQ ID NO: 729060 - DNA, 25 bp, Mus musculus
gtggagtcccagcaccaccttcttt

SEQ ID NO: 729061 - DNA, 25 bp, Mus musculus
gtggagtcccaggaccaccttcttt

SEQ ID NO: 729062 - DNA, 25 bp, Mus musculus
gtggagtcccctcccaaagtgcatg

SEQ ID NO: 729063 - DNA, 25 bp, Mus musculus
gtggagtcccctgccaaagtgcatg

SEQ ID NO: 729064 - DNA, 25 bp, Mus musculus
gtggagttggccctctgatgtcccc

SEQ ID NO: 729065 - DNA, 25 bp, Mus musculus
gtggagttggccgtctgatgtcccc

SEQ ID NO: 729066 - DNA, 25 bp, Mus musculus
gtggagttgggaccccagtccatca

SEQ ID NO: 729067 - DNA, 25 bp, Mus musculus
gtggagttgggagcccagtccatca

SEQ ID NO: 729068 - DNA, 25 bp, Mus musculus
gtggagtttctccagcgcctacttc

SEQ ID NO: 729069 - DNA, 25 bp, Mus musculus
gtggagtttctcgagcgcctacttc

SEQ ID NO: 729070 - DNA, 25 bp, Mus musculus
gtggataacatcactgtggatcctg

SEQ ID NO: 729071 - DNA, 25 bp, Mus musculus
gtggataacatctctgtggatcctg

SEQ ID NO: 729072 - DNA, 25 bp, Mus musculus
gtggatacaaaactgtttccgaaat

SEQ ID NO: 729073 - DNA, 25 bp, Mus musculus
gtggatacaaaagtgtttccgaaat

SEQ ID NO: 729074 - DNA, 25 bp, Mus musculus
gtggatacccagcacagcctagctt

SEQ ID NO: 729075 - DNA, 25 bp, Mus musculus
gtggatacccaggacagcctagctt

SEQ ID NO: 729076 - DNA, 25 bp, Mus musculus
gtggataccccacagagaaggaaca

SEQ ID NO: 729077 - DNA, 25 bp, Mus musculus
gtggataccccagagagaaggaaca

SEQ ID NO: 729078 - DNA, 25 bp, Mus musculus
gtggatagacacctagatcttctag

SEQ ID NO: 729079 - DNA, 25 bp, Mus musculus
gtggatagacacgtagatcttctag

SEQ ID NO: 729080 - DNA, 25 bp, Mus musculus
gtggatatcttcactaaagtgcgca

SEQ ID NO: 729081 - DNA, 25 bp, Mus musculus
gtggatatcttctctaaagtgcgca

SEQ ID NO: 729082 - DNA, 25 bp, Mus musculus
gtggatatttggcaccagatgaaag

SEQ ID NO: 729083 - DNA, 25 bp, Mus musculus
gtggatatttgggaccagatgaaag

SEQ ID NO: 729084 - DNA, 25 bp, Mus musculus
gtggatcaaccacgacaactgccag

SEQ ID NO: 729085 - DNA, 25 bp, Mus musculus
gtggatcaaccaggacaactgccag

SEQ ID NO: 729086 - DNA, 25 bp, Mus musculus
gtggatcagatcctaactgtgctgc

SEQ ID NO: 729087 - DNA, 25 bp, Mus musculus
gtggatcagatcgtaactgtgctgc

SEQ ID NO: 729088 - DNA, 25 bp, Mus musculus
gtggatcagcctcgccccaaggctt

SEQ ID NO: 729089 - DNA, 25 bp, Mus musculus
gtggatcagcctggccccaaggctt

SEQ ID NO: 729090 - DNA, 25 bp, Mus musculus
gtggatcagcggcaagcgcccaact

SEQ ID NO: 729091 - DNA, 25 bp, Mus musculus
gtggatcagcgggaagcgcccaact

SEQ ID NO: 729092 - DNA, 25 bp, Mus musculus
gtggatcagtgtcgccatcgcctgc

SEQ ID NO: 729093 - DNA, 25 bp, Mus musculus
gtggatcagtgtggccatcgcctgc

SEQ ID NO: 729094 - DNA, 25 bp, Mus musculus
gtggatccagcgaagcaggctatgc

SEQ ID NO: 729095 - DNA, 25 bp, Mus musculus
gtggatccagcgtagcaggctatgc

SEQ ID NO: 729096 - DNA, 25 bp, Mus musculus
gtggatccaggacactgagccctca

SEQ ID NO: 729097 - DNA, 25 bp, Mus musculus
gtggatccaggagactgagccctca

SEQ ID NO: 729098 - DNA, 25 bp, Mus musculus
gtggatccatgccttagaagaaact

SEQ ID NO: 729099 - DNA, 25 bp, Mus musculus
gtggatccatgcgttagaagaaact

SEQ ID NO: 729100 - DNA, 25 bp, Mus musculus
gtggatcccagaaacaccgcgtgga

SEQ ID NO: 729101 - DNA, 25 bp, Mus musculus
gtggatcccagatacaccgcgtgga

SEQ ID NO: 729102 - DNA, 25 bp, Mus musculus
gtggatccccagagcgtcattcgcg

SEQ ID NO: 729103 - DNA, 25 bp, Mus musculus
gtggatccccagtgcgtcattcgcg

SEQ ID NO: 729104 - DNA, 25 bp, Mus musculus
gtggatcctcggaaggacgcccact

SEQ ID NO: 729105 - DNA, 25 bp, Mus musculus
gtggatcctcggtaggacgcccact

SEQ ID NO: 729106 - DNA, 25 bp, Mus musculus
gtggatcctgatagcctcctccctg

SEQ ID NO: 729107 - DNA, 25 bp, Mus musculus
gtggatcctgattgcctcctccctg

SEQ ID NO: 729108 - DNA, 25 bp, Mus musculus
gtggatcgatacagcacccctgcca

SEQ ID NO: 729109 - DNA, 25 bp, Mus musculus
gtggatcgatactgcacccctgcca

SEQ ID NO: 729110 - DNA, 25 bp, Mus musculus
gtggatcgcactcggacctggctct

SEQ ID NO: 729111 - DNA, 25 bp, Mus musculus
gtggatcgcactgggacctggctct

SEQ ID NO: 729112 - DNA, 25 bp, Mus musculus
gtggatgacttgcacactcaggaga

SEQ ID NO: 729113 - DNA, 25 bp, Mus musculus
gtggatgacttggacactcaggaga

SEQ ID NO: 729114 - DNA, 25 bp, Mus musculus
gtggatgagtacatgggtatgacca

SEQ ID NO: 729115 - DNA, 25 bp, Mus musculus
gtggatgagtacttgggtatgacca

SEQ ID NO: 729116 - DNA, 25 bp, Mus musculus
gtggatgatgacatcacagcccaag

SEQ ID NO: 729117 - DNA, 25 bp, Mus musculus
gtggatgatgacttcacagcccaag

SEQ ID NO: 729118 - DNA, 25 bp, Mus musculus
gtggatgcagaaaagctgaagccag

SEQ ID NO: 729119 - DNA, 25 bp, Mus musculus
gtggatgcagaatagctgaagccag

SEQ ID NO: 729120 - DNA, 25 bp, Mus musculus
gtggatgcagcccacaacgcctgta

SEQ ID NO: 729121 - DNA, 25 bp, Mus musculus
gtggatgcagccgacaacgcctgta

SEQ ID NO: 729122 - DNA, 25 bp, Mus musculus
gtggatgcgagcagtcaagaagcat

SEQ ID NO: 729123 - DNA, 25 bp, Mus musculus
gtggatgcgagctgtcaagaagcat

SEQ ID NO: 729124 - DNA, 25 bp, Mus musculus
gtggatgctgatacattgtgacccc

SEQ ID NO: 729125 - DNA, 25 bp, Mus musculus
gtggatgctgattcattgtgacccc

SEQ ID NO: 729126 - DNA, 25 bp, Mus musculus
gtggatgctgtgcacaagaccctga

SEQ ID NO: 729127 - DNA, 25 bp, Mus musculus
gtggatgctgtggacaagaccctga

SEQ ID NO: 729128 - DNA, 25 bp, Mus musculus
gtggatggcaatccaaagatgaccc

SEQ ID NO: 729129 - DNA, 25 bp, Mus musculus
gtggatggcaatgcaaagatgaccc

SEQ ID NO: 729130 - DNA, 25 bp, Mus musculus
gtggatgggccaacaaagaaggact

SEQ ID NO: 729131 - DNA, 25 bp, Mus musculus
gtggatgggccatcaaagaaggact

SEQ ID NO: 729132 - DNA, 25 bp, Mus musculus
gtggatggtccaacacacactcact

SEQ ID NO: 729133 - DNA, 25 bp, Mus musculus
gtggatggtccatcacacactcact

SEQ ID NO: 729134 - DNA, 25 bp, Mus musculus
gtggatgtcttcacttttgggatcg

SEQ ID NO: 729135 - DNA, 25 bp, Mus musculus
gtggatgtcttctcttttgggatcg

SEQ ID NO: 729136 - DNA, 25 bp, Mus musculus
gtggattcaggcacagtctatgaca

SEQ ID NO: 729137 - DNA, 25 bp, Mus musculus
gtggattcaggctcagtctatgaca

SEQ ID NO: 729138 - DNA, 25 bp, Mus musculus
gtggattgacgcaggcagtcgctat

SEQ ID NO: 729139 - DNA, 25 bp, Mus musculus
gtggattgacgctggcagtcgctat

SEQ ID NO: 729140 - DNA, 25 bp, Mus musculus
gtggattgagcccagatacttcaga

SEQ ID NO: 729141 - DNA, 25 bp, Mus musculus
gtggattgagccgagatacttcaga

SEQ ID NO: 729142 - DNA, 25 bp, Mus musculus
gtggattgcttgatacctgagtacc

SEQ ID NO: 729143 - DNA, 25 bp, Mus musculus
gtggattgcttgttacctgagtacc

SEQ ID NO: 729144 - DNA, 25 bp, Mus musculus
gtggcaaacccaatacgccgggagt

SEQ ID NO: 729145 - DNA, 25 bp, Mus musculus
gtggcaaacccattacgccgggagt

SEQ ID NO: 729146 - DNA, 25 bp, Mus musculus
gtggcaaacgagacgggaccttcct

SEQ ID NO: 729147 - DNA, 25 bp, Mus musculus
gtggcaaacgagtcgggaccttcct

SEQ ID NO: 729148 - DNA, 25 bp, Mus musculus
gtggcaaaggctaccgccaggccag

SEQ ID NO: 729149 - DNA, 25 bp, Mus musculus
gtggcaaaggcttccgccaggccag

SEQ ID NO: 729150 - DNA, 25 bp, Mus musculus
gtggcaaagggtatcaagtgcccta

SEQ ID NO: 729151 - DNA, 25 bp, Mus musculus
gtggcaaagggtttcaagtgcccta

SEQ ID NO: 729152 - DNA, 25 bp, Mus musculus
gtggcaaatgcaaatgcaagttcag

SEQ ID NO: 729153 - DNA, 25 bp, Mus musculus
gtggcaaatgcatatgcaagttcag

SEQ ID NO: 729154 - DNA, 25 bp, Mus musculus
gtggcaacacatccaggtctaaacc

SEQ ID NO: 729155 - DNA, 25 bp, Mus musculus
gtggcaacacatgcaggtctaaacc

SEQ ID NO: 729156 - DNA, 25 bp, Mus musculus
gtggcaacagctccaagaaccaggg

SEQ ID NO: 729157 - DNA, 25 bp, Mus musculus
gtggcaacagctgcaagaaccaggg

SEQ ID NO: 729158 - DNA, 25 bp, Mus musculus
gtggcaaccactccaagccttgtga

SEQ ID NO: 729159 - DNA, 25 bp, Mus musculus
gtggcaaccactgcaagccttgtga

SEQ ID NO: 729160 - DNA, 25 bp, Mus musculus
gtggcaagggctccaaagcacatgt

SEQ ID NO: 729161 - DNA, 25 bp, Mus musculus
gtggcaagggctgcaaagcacatgt

SEQ ID NO: 729162 - DNA, 25 bp, Mus musculus
gtggcaagtcctacatctattctgg

SEQ ID NO: 729163 - DNA, 25 bp, Mus musculus
gtggcaagtccttcatctattctgg

SEQ ID NO: 729164 - DNA, 25 bp, Mus musculus
gtggcaatgacacccgtaaagcacg

SEQ ID NO: 729165 - DNA, 25 bp, Mus musculus
gtggcaatgacagccgtaaagcacg

SEQ ID NO: 729166 - DNA, 25 bp, Mus musculus
gtggcaatgaccagtcacagtacaa

SEQ ID NO: 729167 - DNA, 25 bp, Mus musculus
gtggcaatgacctgtcacagtacaa

SEQ ID NO: 729168 - DNA, 25 bp, Mus musculus
gtggcacaagcgagtagccctccat

SEQ ID NO: 729169 - DNA, 25 bp, Mus musculus
gtggcacaagcgtgtagccctccat

SEQ ID NO: 729170 - DNA, 25 bp, Mus musculus
gtggcaccagtgcaagtccacacac

SEQ ID NO: 729171 - DNA, 25 bp, Mus musculus
gtggcaccagtggaagtccacacac

SEQ ID NO: 729172 - DNA, 25 bp, Mus musculus
gtggcaccatggagaacctcagccg

SEQ ID NO: 729173 - DNA, 25 bp, Mus musculus
gtggcaccatggtgaacctcagccg

SEQ ID NO: 729174 - DNA, 25 bp, Mus musculus
gtggcacccctcagcaagtggagtc

SEQ ID NO: 729175 - DNA, 25 bp, Mus musculus
gtggcacccctctgcaagtggagtc

SEQ ID NO: 729176 - DNA, 25 bp, Mus musculus
gtggcaccctgaaccacccgagatt

SEQ ID NO: 729177 - DNA, 25 bp, Mus musculus
gtggcaccctgatccacccgagatt

SEQ ID NO: 729178 - DNA, 25 bp, Mus musculus
gtggcacgacatctgcaaagagctg

SEQ ID NO: 729179 - DNA, 25 bp, Mus musculus
gtggcacgacatgtgcaaagagctg

SEQ ID NO: 729180 - DNA, 25 bp, Mus musculus
gtggcactgatgcaattggaaaagc

SEQ ID NO: 729181 - DNA, 25 bp, Mus musculus
gtggcactgatggaattggaaaagc

SEQ ID NO: 729182 - DNA, 25 bp, Mus musculus
gtggcagaaatgacctcttatcacc

SEQ ID NO: 729183 - DNA, 25 bp, Mus musculus
gtggcagaaatgtcctcttatcacc

SEQ ID NO: 729184 - DNA, 25 bp, Mus musculus
gtggcagcaaccctttgcctggcct

SEQ ID NO: 729185 - DNA, 25 bp, Mus musculus
gtggcagcaaccgtttgcctggcct

SEQ ID NO: 729186 - DNA, 25 bp, Mus musculus
gtggcagcagagcagttttcaattt

SEQ ID NO: 729187 - DNA, 25 bp, Mus musculus
gtggcagcagaggagttttcaattt

SEQ ID NO: 729188 - DNA, 25 bp, Mus musculus
gtggcagcagatctacgctcatcag

SEQ ID NO: 729189 - DNA, 25 bp, Mus musculus
gtggcagcagatgtacgctcatcag

SEQ ID NO: 729190 - DNA, 25 bp, Mus musculus
gtggcagcagcccaagaccatgtca

SEQ ID NO: 729191 - DNA, 25 bp, Mus musculus
gtggcagcagccgaagaccatgtca

SEQ ID NO: 729192 - DNA, 25 bp, Mus musculus
gtggcagcgaatcgtagcgcctccc

SEQ ID NO: 729193 - DNA, 25 bp, Mus musculus
gtggcagcgaatggtagcgcctccc

SEQ ID NO: 729194 - DNA, 25 bp, Mus musculus
gtggcagctcttcagggtccagcaa

SEQ ID NO: 729195 - DNA, 25 bp, Mus musculus
gtggcagctcttgagggtccagcaa

SEQ ID NO: 729196 - DNA, 25 bp, Mus musculus
gtggcaggtgctcgcagaccaacac

SEQ ID NO: 729197 - DNA, 25 bp, Mus musculus
gtggcaggtgctggcagaccaacac

SEQ ID NO: 729198 - DNA, 25 bp, Mus musculus
gtggcaggtggccacagaacctata

SEQ ID NO: 729199 - DNA, 25 bp, Mus musculus
gtggcaggtggcgacagaacctata

SEQ ID NO: 729200 - DNA, 25 bp, Mus musculus
gtggcagtgagtcccaccagacccg

SEQ ID NO: 729201 - DNA, 25 bp, Mus musculus
gtggcagtgagtgccaccagacccg

SEQ ID NO: 729202 - DNA, 25 bp, Mus musculus
gtggcatactttatactcattctct

SEQ ID NO: 729203 - DNA, 25 bp, Mus musculus
gtggcatactttttactcattctct

SEQ ID NO: 729204 - DNA, 25 bp, Mus musculus
gtggcatccggtcccccattgatga

SEQ ID NO: 729205 - DNA, 25 bp, Mus musculus
gtggcatccggtgccccattgatga

SEQ ID NO: 729206 - DNA, 25 bp, Mus musculus
gtggcatgaattacctgcacctgca

SEQ ID NO: 729207 - DNA, 25 bp, Mus musculus
gtggcatgaatttcctgcacctgca

SEQ ID NO: 729208 - DNA, 25 bp, Mus musculus
gtggcatggaccaatcagcggcctc

SEQ ID NO: 729209 - DNA, 25 bp, Mus musculus
gtggcatggacctatcagcggcctc

SEQ ID NO: 729210 - DNA, 25 bp, Mus musculus
gtggcatggatgacatgaagctgct

SEQ ID NO: 729211 - DNA, 25 bp, Mus musculus
gtggcatggatgtcatgaagctgct

SEQ ID NO: 729212 - DNA, 25 bp, Mus musculus
gtggcattcaccatgggccttctaa

SEQ ID NO: 729213 - DNA, 25 bp, Mus musculus
gtggcattcaccttgggccttctaa

SEQ ID NO: 729214 - DNA, 25 bp, Mus musculus
gtggcattccatcagcgcagagctg

SEQ ID NO: 729215 - DNA, 25 bp, Mus musculus
gtggcattccatgagcgcagagctg

SEQ ID NO: 729216 - DNA, 25 bp, Mus musculus
gtggcattcgccctagtctagagcc

SEQ ID NO: 729217 - DNA, 25 bp, Mus musculus
gtggcattcgccgtagtctagagcc

SEQ ID NO: 729218 - DNA, 25 bp, Mus musculus
gtggcattgtctactgcaggactag

SEQ ID NO: 729219 - DNA, 25 bp, Mus musculus
gtggcattgtcttctgcaggactag

SEQ ID NO: 729220 - DNA, 25 bp, Mus musculus
gtggccaacaaacagaccatggaag

SEQ ID NO: 729221 - DNA, 25 bp, Mus musculus
gtggccaacaaagagaccatggaag

SEQ ID NO: 729222 - DNA, 25 bp, Mus musculus
gtggccaacggcctcgaagacaaag

SEQ ID NO: 729223 - DNA, 25 bp, Mus musculus
gtggccaacggcgtcgaagacaaag

SEQ ID NO: 729224 - DNA, 25 bp, Mus musculus
gtggccaagacgaagcagcagatcg

SEQ ID NO: 729225 - DNA, 25 bp, Mus musculus
gtggccaagacgtagcagcagatcg

SEQ ID NO: 729226 - DNA, 25 bp, Mus musculus
gtggccaatatgatctacattgtag

SEQ ID NO: 729227 - DNA, 25 bp, Mus musculus
gtggccaatatgttctacattgtag

SEQ ID NO: 729228 - DNA, 25 bp, Mus musculus
gtggccaccctgacggctgcctgtg

SEQ ID NO: 729229 - DNA, 25 bp, Mus musculus
gtggccaccctgtcggctgcctgtg

SEQ ID NO: 729230 - DNA, 25 bp, Mus musculus
gtggccacctatctgagtgggatac

SEQ ID NO: 729231 - DNA, 25 bp, Mus musculus
gtggccacctatgtgagtgggatac

SEQ ID NO: 729232 - DNA, 25 bp, Mus musculus
gtggccagaagcagcgcctagccat

SEQ ID NO: 729233 - DNA, 25 bp, Mus musculus
gtggccagaagctgcgcctagccat

SEQ ID NO: 729234 - DNA, 25 bp, Mus musculus
gtggccagacgccagacgcagtcat

SEQ ID NO: 729235 - DNA, 25 bp, Mus musculus
gtggccagacgcgagacgcagtcat

SEQ ID NO: 729236 - DNA, 25 bp, Mus musculus
gtggccagcaccaagacgaccctaa

SEQ ID NO: 729237 - DNA, 25 bp, Mus musculus
gtggccagcacctagacgaccctaa

SEQ ID NO: 729238 - DNA, 25 bp, Mus musculus
gtggccagcggaccttggtcaacaa

SEQ ID NO: 729239 - DNA, 25 bp, Mus musculus
gtggccagcggagcttggtcaacaa

SEQ ID NO: 729240 - DNA, 25 bp, Mus musculus
gtggccagctttaggaaagaccccg

SEQ ID NO: 729241 - DNA, 25 bp, Mus musculus
gtggccagcttttggaaagaccccg

SEQ ID NO: 729242 - DNA, 25 bp, Mus musculus
gtggccaggacaagattcggcccct

SEQ ID NO: 729243 - DNA, 25 bp, Mus musculus
gtggccaggacatgattcggcccct

SEQ ID NO: 729244 - DNA, 25 bp, Mus musculus
gtggccaggaccacaacaagctcag

SEQ ID NO: 729245 - DNA, 25 bp, Mus musculus
gtggccaggacctcaacaagctcag

SEQ ID NO: 729246 - DNA, 25 bp, Mus musculus
gtggccaggataccaaagccttaag

SEQ ID NO: 729247 - DNA, 25 bp, Mus musculus
gtggccaggatagcaaagccttaag

SEQ ID NO: 729248 - DNA, 25 bp, Mus musculus
gtggccagggaaacaggcgcttaaa

SEQ ID NO: 729249 - DNA, 25 bp, Mus musculus
gtggccagggaatcaggcgcttaaa

SEQ ID NO: 729250 - DNA, 25 bp, Mus musculus
gtggccagtcccctgtctccgggta

SEQ ID NO: 729251 - DNA, 25 bp, Mus musculus
gtggccagtcccgtgtctccgggta

SEQ ID NO: 729252 - DNA, 25 bp, Mus musculus
gtggccatcaagaagttgtaccggc

SEQ ID NO: 729253 - DNA, 25 bp, Mus musculus
gtggccatcaagtagttgtaccggc

SEQ ID NO: 729254 - DNA, 25 bp, Mus musculus
gtggccatcatcctcatagtctccg

SEQ ID NO: 729255 - DNA, 25 bp, Mus musculus
gtggccatcatcgtcatagtctccg

SEQ ID NO: 729256 - DNA, 25 bp, Mus musculus
gtggccatcggtcacagtgcctgtg

SEQ ID NO: 729257 - DNA, 25 bp, Mus musculus
gtggccatcggtgacagtgcctgtg

SEQ ID NO: 729258 - DNA, 25 bp, Mus musculus
gtggccatctttatgctggacacag

SEQ ID NO: 729259 - DNA, 25 bp, Mus musculus
gtggccatctttttgctggacacag

SEQ ID NO: 729260 - DNA, 25 bp, Mus musculus
gtggccatggccaagcagtacgact

SEQ ID NO: 729261 - DNA, 25 bp, Mus musculus
gtggccatggcctagcagtacgact

SEQ ID NO: 729262 - DNA, 25 bp, Mus musculus
gtggccattaagaagctcagcagac

SEQ ID NO: 729263 - DNA, 25 bp, Mus musculus
gtggccattaagtagctcagcagac

SEQ ID NO: 729264 - DNA, 25 bp, Mus musculus
gtggccattctcattttaccaccag

SEQ ID NO: 729265 - DNA, 25 bp, Mus musculus
gtggccattctctttttaccaccag

SEQ ID NO: 729266 - DNA, 25 bp, Mus musculus
gtggccattgaacagccaggccctg

SEQ ID NO: 729267 - DNA, 25 bp, Mus musculus
gtggccattgaagagccaggccctg

SEQ ID NO: 729268 - DNA, 25 bp, Mus musculus
gtggccattggcactctctgcgcac

SEQ ID NO: 729269 - DNA, 25 bp, Mus musculus
gtggccattggctctctctgcgcac

SEQ ID NO: 729270 - DNA, 25 bp, Mus musculus
gtggcccacagcacttccctggatg

SEQ ID NO: 729271 - DNA, 25 bp, Mus musculus
gtggcccacagctcttccctggatg

SEQ ID NO: 729272 - DNA, 25 bp, Mus musculus
gtggcccacagtaaatctagcaagg

SEQ ID NO: 729273 - DNA, 25 bp, Mus musculus
gtggcccacagttaatctagcaagg

SEQ ID NO: 729274 - DNA, 25 bp, Mus musculus
gtggcccagagtcgtgagatccccc

SEQ ID NO: 729275 - DNA, 25 bp, Mus musculus
gtggcccagagtggtgagatccccc

SEQ ID NO: 729276 - DNA, 25 bp, Mus musculus
gtggcccaggcaaatagtttcttca

SEQ ID NO: 729277 - DNA, 25 bp, Mus musculus
gtggcccaggcatatagtttcttca

SEQ ID NO: 729278 - DNA, 25 bp, Mus musculus
gtggcccagtctaaccgttcagtgg

SEQ ID NO: 729279 - DNA, 25 bp, Mus musculus
gtggcccagtctctgcagctcttca

SEQ ID NO: 729280 - DNA, 25 bp, Mus musculus
gtggcccagtctgtgcagctcttca

SEQ ID NO: 729281 - DNA, 25 bp, Mus musculus
gtggcccagtcttaccgttcagtgg

SEQ ID NO: 729282 - DNA, 25 bp, Mus musculus
gtggcccagttaaaatctgagagtg

SEQ ID NO: 729283 - DNA, 25 bp, Mus musculus
gtggcccagttataatctgagagtg

SEQ ID NO: 729284 - DNA, 25 bp, Mus musculus
gtggcccatggcaggatgaaagaaa

SEQ ID NO: 729285 - DNA, 25 bp, Mus musculus
gtggcccatggctggatgaaagaaa

SEQ ID NO: 729286 - DNA, 25 bp, Mus musculus
gtggccccaaacatattcacgatgg

SEQ ID NO: 729287 - DNA, 25 bp, Mus musculus
gtggccccaaacttattcacgatgg

SEQ ID NO: 729288 - DNA, 25 bp, Mus musculus
gtggcccgcaccatgcgtgaggcca

SEQ ID NO: 729289 - DNA, 25 bp, Mus musculus
gtggcccgcaccttgcgtgaggcca

SEQ ID NO: 729290 - DNA, 25 bp, Mus musculus
gtggcccggactattcggttgcaga

SEQ ID NO: 729291 - DNA, 25 bp, Mus musculus
gtggcccggacttttcggttgcaga

SEQ ID NO: 729292 - DNA, 25 bp, Mus musculus
gtggcccgggagacagatgcccacc

SEQ ID NO: 729293 - DNA, 25 bp, Mus musculus
gtggcccgggagtcagatgcccacc

SEQ ID NO: 729294 - DNA, 25 bp, Mus musculus
gtggcccgtgagaattccctgaggt

SEQ ID NO: 729295 - DNA, 25 bp, Mus musculus
gtggcccgtgagtattccctgaggt

SEQ ID NO: 729296 - DNA, 25 bp, Mus musculus
gtggccctagacaacaagattgagc

SEQ ID NO: 729297 - DNA, 25 bp, Mus musculus
gtggccctagactacaagattgagc

SEQ ID NO: 729298 - DNA, 25 bp, Mus musculus
gtggccctatgaaacaccggatact

SEQ ID NO: 729299 - DNA, 25 bp, Mus musculus
gtggccctatgatacaccggatact

SEQ ID NO: 729300 - DNA, 25 bp, Mus musculus
gtggccctcaccatcaagggaggtc

SEQ ID NO: 729301 - DNA, 25 bp, Mus musculus
gtggccctcaccttcaagggaggtc

SEQ ID NO: 729302 - DNA, 25 bp, Mus musculus
gtggccctcagcagtcggcgtcttt

SEQ ID NO: 729303 - DNA, 25 bp, Mus musculus
gtggccctcagctgtcggcgtcttt

SEQ ID NO: 729304 - DNA, 25 bp, Mus musculus
gtggccctgattagcctgcctcctg

SEQ ID NO: 729305 - DNA, 25 bp, Mus musculus
gtggccctgatttgcctgcctcctg

SEQ ID NO: 729306 - DNA, 25 bp, Mus musculus
gtggccctggccacttagtcctggt

SEQ ID NO: 729307 - DNA, 25 bp, Mus musculus
gtggccctggcctcttagtcctggt

SEQ ID NO: 729308 - DNA, 25 bp, Mus musculus
gtggccgagatccacaaagcctcca

SEQ ID NO: 729309 - DNA, 25 bp, Mus musculus
gtggccgagatcgacaaagcctcca

SEQ ID NO: 729310 - DNA, 25 bp, Mus musculus
gtggccgaggcgcataccccgtctt

SEQ ID NO: 729311 - DNA, 25 bp, Mus musculus
gtggccgaggcggataccccgtctt

SEQ ID NO: 729312 - DNA, 25 bp, Mus musculus
gtggccgccaccactccaggttggg

SEQ ID NO: 729313 - DNA, 25 bp, Mus musculus
gtggccgccacctctccaggttggg

SEQ ID NO: 729314 - DNA, 25 bp, Mus musculus
gtggccgcccagaagactcggagcc

SEQ ID NO: 729315 - DNA, 25 bp, Mus musculus
gtggccgcccagtagactcggagcc

SEQ ID NO: 729316 - DNA, 25 bp, Mus musculus
gtggccgctactattgtctcaatgt

SEQ ID NO: 729317 - DNA, 25 bp, Mus musculus
gtggccgctacttttgtctcaatgt

SEQ ID NO: 729318 - DNA, 25 bp, Mus musculus
gtggccggtgaaccagtatttattg

SEQ ID NO: 729319 - DNA, 25 bp, Mus musculus
gtggccggtgaagcagtatttattg

SEQ ID NO: 729320 - DNA, 25 bp, Mus musculus
gtggccgtgatgctgcatttctgct

SEQ ID NO: 729321 - DNA, 25 bp, Mus musculus
gtggccgtgatggtgcatttctgct

SEQ ID NO: 729322 - DNA, 25 bp, Mus musculus
gtggcctatggactcatctcccgcg

SEQ ID NO: 729323 - DNA, 25 bp, Mus musculus
gtggcctatggagtcatctcccgcg

SEQ ID NO: 729324 - DNA, 25 bp, Mus musculus
gtggcctcaaggataggcgctcccc

SEQ ID NO: 729325 - DNA, 25 bp, Mus musculus
gtggcctcaaggttaggcgctcccc

SEQ ID NO: 729326 - DNA, 25 bp, Mus musculus
gtggcctcagccctgggtgtcacac

SEQ ID NO: 729327 - DNA, 25 bp, Mus musculus
gtggcctcagccgtgggtgtcacac

SEQ ID NO: 729328 - DNA, 25 bp, Mus musculus
gtggcctcaggacaagccctttctt

SEQ ID NO: 729329 - DNA, 25 bp, Mus musculus
gtggcctcaggagaagccctttctt

SEQ ID NO: 729330 - DNA, 25 bp, Mus musculus
gtggcctgaataagacagaaagtca

SEQ ID NO: 729331 - DNA, 25 bp, Mus musculus
gtggcctgaatatgacagaaagtca

SEQ ID NO: 729332 - DNA, 25 bp, Mus musculus
gtggcctgcctcacggtgagtccta

SEQ ID NO: 729333 - DNA, 25 bp, Mus musculus
gtggcctgcctctcggtgagtccta

SEQ ID NO: 729334 - DNA, 25 bp, Mus musculus
gtggcctggcctatctgaatggttc

SEQ ID NO: 729335 - DNA, 25 bp, Mus musculus
gtggcctggcctttctgaatggttc

SEQ ID NO: 729336 - DNA, 25 bp, Mus musculus
gtggcctgtggtcgcctggataaca

SEQ ID NO: 729337 - DNA, 25 bp, Mus musculus
gtggcctgtggtggcctggataaca

SEQ ID NO: 729338 - DNA, 25 bp, Mus musculus
gtggccttagagctccaaccggcag

SEQ ID NO: 729339 - DNA, 25 bp, Mus musculus
gtggccttagaggtccaaccggcag

SEQ ID NO: 729340 - DNA, 25 bp, Mus musculus
gtggccttatggagcaaggacacca

SEQ ID NO: 729341 - DNA, 25 bp, Mus musculus
gtggccttatggtgcaaggacacca

SEQ ID NO: 729342 - DNA, 25 bp, Mus musculus
gtggccttcagtccggtcacagaac

SEQ ID NO: 729343 - DNA, 25 bp, Mus musculus
gtggccttcagtgcggtcacagaac

SEQ ID NO: 729344 - DNA, 25 bp, Mus musculus
gtggccttccaacctacgtagcaga

SEQ ID NO: 729345 - DNA, 25 bp, Mus musculus
gtggccttccaagctacgtagcaga

SEQ ID NO: 729346 - DNA, 25 bp, Mus musculus
gtggccttctcaagctcctgctttt

SEQ ID NO: 729347 - DNA, 25 bp, Mus musculus
gtggccttctcatgctcctgctttt

SEQ ID NO: 729348 - DNA, 25 bp, Mus musculus
gtggccttctggagattctacaacc

SEQ ID NO: 729349 - DNA, 25 bp, Mus musculus
gtggccttctggtgattctacaacc

SEQ ID NO: 729350 - DNA, 25 bp, Mus musculus
gtggccttgccacaacagatatagt

SEQ ID NO: 729351 - DNA, 25 bp, Mus musculus
gtggccttgccagaacagatatagt

SEQ ID NO: 729352 - DNA, 25 bp, Mus musculus
gtggcgaagactcagatctcaagca

SEQ ID NO: 729353 - DNA, 25 bp, Mus musculus
gtggcgaagactgagatctcaagca

SEQ ID NO: 729354 - DNA, 25 bp, Mus musculus
gtggcgaagcaacatcctcctgggc

SEQ ID NO: 729355 - DNA, 25 bp, Mus musculus
gtggcgaagcaagatcctcctgggc

SEQ ID NO: 729356 - DNA, 25 bp, Mus musculus
gtggcgaaggcactgtgaaaatcct

SEQ ID NO: 729357 - DNA, 25 bp, Mus musculus
gtggcgaaggcagtgtgaaaatcct

SEQ ID NO: 729358 - DNA, 25 bp, Mus musculus
gtggcgacgtccagcccggagaacc

SEQ ID NO: 729359 - DNA, 25 bp, Mus musculus
gtggcgacgtcctgcccggagaacc

SEQ ID NO: 729360 - DNA, 25 bp, Mus musculus
gtggcgagcccaagtagtggcttcc

SEQ ID NO: 729361 - DNA, 25 bp, Mus musculus
gtggcgagcccatgtagtggcttcc

SEQ ID NO: 729362 - DNA, 25 bp, Mus musculus
gtggcgaggcgcaggagcttctgga

SEQ ID NO: 729363 - DNA, 25 bp, Mus musculus
gtggcgaggcgctggagcttctgga

SEQ ID NO: 729364 - DNA, 25 bp, Mus musculus
gtggcgatagctacagaggaactgt

SEQ ID NO: 729365 - DNA, 25 bp, Mus musculus
gtggcgatagcttcagaggaactgt

SEQ ID NO: 729366 - DNA, 25 bp, Mus musculus
gtggcgatgtccctgagaccaacta

SEQ ID NO: 729367 - DNA, 25 bp, Mus musculus
gtggcgatgtccgtgagaccaacta

SEQ ID NO: 729368 - DNA, 25 bp, Mus musculus
gtggcgccacatcctctttttccag

SEQ ID NO: 729369 - DNA, 25 bp, Mus musculus
gtggcgccacatgctctttttccag

SEQ ID NO: 729370 - DNA, 25 bp, Mus musculus
gtggcgcgatcaagctccgggtccc

SEQ ID NO: 729371 - DNA, 25 bp, Mus musculus
gtggcgcgatcatgctccgggtccc

SEQ ID NO: 729372 - DNA, 25 bp, Mus musculus
gtggcgcgctgtccttagtcaccgt

SEQ ID NO: 729373 - DNA, 25 bp, Mus musculus
gtggcgcgctgtgcttagtcaccgt

SEQ ID NO: 729374 - DNA, 25 bp, Mus musculus
gtggcgcggaaacaaactttgccga

SEQ ID NO: 729375 - DNA, 25 bp, Mus musculus
gtggcgcggaaagaaactttgccga

SEQ ID NO: 729376 - DNA, 25 bp, Mus musculus
gtggcgctacttccgagactacttt

SEQ ID NO: 729377 - DNA, 25 bp, Mus musculus
gtggcgctacttgcgagactacttt

SEQ ID NO: 729378 - DNA, 25 bp, Mus musculus
gtggcgctgctacctgtttctatgc

SEQ ID NO: 729379 - DNA, 25 bp, Mus musculus
gtggcgctgctagctgtttctatgc

SEQ ID NO: 729380 - DNA, 25 bp, Mus musculus
gtggcgctggatcaacaactctgtg

SEQ ID NO: 729381 - DNA, 25 bp, Mus musculus
gtggcgctggatgaacaactctgtg

SEQ ID NO: 729382 - DNA, 25 bp, Mus musculus
gtggcgctggtgctccacatagccc

SEQ ID NO: 729383 - DNA, 25 bp, Mus musculus
gtggcgctggtggtccacatagccc

SEQ ID NO: 729384 - DNA, 25 bp, Mus musculus
gtggcgcttgtcaacgaactcctgg

SEQ ID NO: 729385 - DNA, 25 bp, Mus musculus
gtggcgcttgtctacgaactcctgg

SEQ ID NO: 729386 - DNA, 25 bp, Mus musculus
gtggcgtcggcaaaccggcgcttct

SEQ ID NO: 729387 - DNA, 25 bp, Mus musculus
gtggcgtcggcataccggcgcttct

SEQ ID NO: 729388 - DNA, 25 bp, Mus musculus
gtggctaaagacagaagtcctgggc

SEQ ID NO: 729389 - DNA, 25 bp, Mus musculus
gtggctaaagactgaagtcctgggc

SEQ ID NO: 729390 - DNA, 25 bp, Mus musculus
gtggctacgaggagaaccaccaggc

SEQ ID NO: 729391 - DNA, 25 bp, Mus musculus
gtggctacgaggtgaaccaccaggc

SEQ ID NO: 729392 - DNA, 25 bp, Mus musculus
gtggctacgcacacacattagtatt

SEQ ID NO: 729393 - DNA, 25 bp, Mus musculus
gtggctacgcactcacattagtatt

SEQ ID NO: 729394 - DNA, 25 bp, Mus musculus
gtggctacgtccagcctgttggtcc

SEQ ID NO: 729395 - DNA, 25 bp, Mus musculus
gtggctacgtcctgcctgttggtcc

SEQ ID NO: 729396 - DNA, 25 bp, Mus musculus
gtggctatcttgctctacctggcac

SEQ ID NO: 729397 - DNA, 25 bp, Mus musculus
gtggctatcttggtctacctggcac

SEQ ID NO: 729398 - DNA, 25 bp, Mus musculus
gtggctattttgagcctgcagttcc

SEQ ID NO: 729399 - DNA, 25 bp, Mus musculus
gtggctattttgtgcctgcagttcc

SEQ ID NO: 729400 - DNA, 25 bp, Mus musculus
gtggctcaagaaccctgccagctct

SEQ ID NO: 729401 - DNA, 25 bp, Mus musculus
gtggctcaagaagcctgccagctct

SEQ ID NO: 729402 - DNA, 25 bp, Mus musculus
gtggctcagagaagcccaacacctc

SEQ ID NO: 729403 - DNA, 25 bp, Mus musculus
gtggctcagagatgcccaacacctc

SEQ ID NO: 729404 - DNA, 25 bp, Mus musculus
gtggctcaggcaagcgctgctaccc

SEQ ID NO: 729405 - DNA, 25 bp, Mus musculus
gtggctcaggcatgcgctgctaccc

SEQ ID NO: 729406 - DNA, 25 bp, Mus musculus
gtggctccacccagatccaacgata

SEQ ID NO: 729407 - DNA, 25 bp, Mus musculus
gtggctccaccctgatccaacgata

SEQ ID NO: 729408 - DNA, 25 bp, Mus musculus
gtggctccagttcactccatccagg

SEQ ID NO: 729409 - DNA, 25 bp, Mus musculus
gtggctccagttgactccatccagg

SEQ ID NO: 729410 - DNA, 25 bp, Mus musculus
gtggctccggacacccagcatggat

SEQ ID NO: 729411 - DNA, 25 bp, Mus musculus
gtggctccggactcccagcatggat

SEQ ID NO: 729412 - DNA, 25 bp, Mus musculus
gtggctcctacccattcattgactt

SEQ ID NO: 729413 - DNA, 25 bp, Mus musculus
gtggctcctaccgattcattgactt

SEQ ID NO: 729414 - DNA, 25 bp, Mus musculus
gtggctcctggtactagggtcatca

SEQ ID NO: 729415 - DNA, 25 bp, Mus musculus
gtggctcctggttctagggtcatca

SEQ ID NO: 729416 - DNA, 25 bp, Mus musculus
gtggctcgcagacccatgaagaaga

SEQ ID NO: 729417 - DNA, 25 bp, Mus musculus
gtggctcgcagagccatgaagaaga

SEQ ID NO: 729418 - DNA, 25 bp, Mus musculus
gtggctcgctggctcagctcataaa

SEQ ID NO: 729419 - DNA, 25 bp, Mus musculus
gtggctcgctgggtcagctcataaa

SEQ ID NO: 729420 - DNA, 25 bp, Mus musculus
gtggctcgtccccaaagcgcttaat

SEQ ID NO: 729421 - DNA, 25 bp, Mus musculus
gtggctcgtcccgaaagcgcttaat

SEQ ID NO: 729422 - DNA, 25 bp, Mus musculus
gtggctcttcatcatttcccagcag

SEQ ID NO: 729423 - DNA, 25 bp, Mus musculus
gtggctcttcatgatttcccagcag

SEQ ID NO: 729424 - DNA, 25 bp, Mus musculus
gtggctcttgttcgtaccggtagca

SEQ ID NO: 729425 - DNA, 25 bp, Mus musculus
gtggctcttgttggtaccggtagca

SEQ ID NO: 729426 - DNA, 25 bp, Mus musculus
gtggctgaacgacgctcgcacagtc

SEQ ID NO: 729427 - DNA, 25 bp, Mus musculus
gtggctgaacgaggctcgcacagtc

SEQ ID NO: 729428 - DNA, 25 bp, Mus musculus
gtggctgacaacctcgtcctcggga

SEQ ID NO: 729429 - DNA, 25 bp, Mus musculus
gtggctgacaacgtcgtcctcggga

SEQ ID NO: 729430 - DNA, 25 bp, Mus musculus
gtggctgagatcactccggagaccg

SEQ ID NO: 729431 - DNA, 25 bp, Mus musculus
gtggctgagatctctccggagaccg

SEQ ID NO: 729432 - DNA, 25 bp, Mus musculus
gtggctgatcccagacagtgcggac

SEQ ID NO: 729433 - DNA, 25 bp, Mus musculus
gtggctgatccctgacagtgcggac

SEQ ID NO: 729434 - DNA, 25 bp, Mus musculus
gtggctgcaggacatagatcgctac

SEQ ID NO: 729435 - DNA, 25 bp, Mus musculus
gtggctgcaggagatagatcgctac

SEQ ID NO: 729436 - DNA, 25 bp, Mus musculus
gtggctgcataacgaagtgaagaac

SEQ ID NO: 729437 - DNA, 25 bp, Mus musculus
gtggctgcataaggaagtgaagaac

SEQ ID NO: 729438 - DNA, 25 bp, Mus musculus
gtggctgccactcataccaatggag

SEQ ID NO: 729439 - DNA, 25 bp, Mus musculus
gtggctgccactgataccaatggag

SEQ ID NO: 729440 - DNA, 25 bp, Mus musculus
gtggctgctataatttgctgtggag

SEQ ID NO: 729441 - DNA, 25 bp, Mus musculus
gtggctgctatattttgctgtggag

SEQ ID NO: 729442 - DNA, 25 bp, Mus musculus
gtggctgctcttcgcctgtgccagt

SEQ ID NO: 729443 - DNA, 25 bp, Mus musculus
gtggctgctcttggcctgtgccagt

SEQ ID NO: 729444 - DNA, 25 bp, Mus musculus
gtggctggacacagcagagaaatcc

SEQ ID NO: 729445 - DNA, 25 bp, Mus musculus
gtggctggacactgcagagaaatcc

SEQ ID NO: 729446 - DNA, 25 bp, Mus musculus
gtggctgggacaacctccttgctgt

SEQ ID NO: 729447 - DNA, 25 bp, Mus musculus
gtggctgggacatcctccttgctgt

SEQ ID NO: 729448 - DNA, 25 bp, Mus musculus
gtggctggtgccattgacctgttcc

SEQ ID NO: 729449 - DNA, 25 bp, Mus musculus
gtggctggtgcctttgacctgttcc

SEQ ID NO: 729450 - DNA, 25 bp, Mus musculus
gtggctgtaaagaagttactcaaaa

SEQ ID NO: 729451 - DNA, 25 bp, Mus musculus
gtggctgtaaagtagttactcaaaa

SEQ ID NO: 729452 - DNA, 25 bp, Mus musculus
gtggctgtaaatcttcctcctgaag

SEQ ID NO: 729453 - DNA, 25 bp, Mus musculus
gtggctgtaaatgttcctcctgaag

SEQ ID NO: 729454 - DNA, 25 bp, Mus musculus
gtggctgtgctcatcctagcctatt

SEQ ID NO: 729455 - DNA, 25 bp, Mus musculus
gtggctgtgctcttcctagcctatt

SEQ ID NO: 729456 - DNA, 25 bp, Mus musculus
gtggctgtggatacctactgttggc

SEQ ID NO: 729457 - DNA, 25 bp, Mus musculus
gtggctgtggattcctactgttggc

SEQ ID NO: 729458 - DNA, 25 bp, Mus musculus
gtggctgttcagataaatccacatg

SEQ ID NO: 729459 - DNA, 25 bp, Mus musculus
gtggctgttcagttaaatccacatg

SEQ ID NO: 729460 - DNA, 25 bp, Mus musculus
gtggctgttgtgaagagctcgtact

SEQ ID NO: 729461 - DNA, 25 bp, Mus musculus
gtggctgttgtgtagagctcgtact

SEQ ID NO: 729462 - DNA, 25 bp, Mus musculus
gtggcttaaagcacagactacatgc

SEQ ID NO: 729463 - DNA, 25 bp, Mus musculus
gtggcttaaagctcagactacatgc

SEQ ID NO: 729464 - DNA, 25 bp, Mus musculus
gtggcttacttcaacatcgagttca

SEQ ID NO: 729465 - DNA, 25 bp, Mus musculus
gtggcttacttctacatcgagttca

SEQ ID NO: 729466 - DNA, 25 bp, Mus musculus
gtggcttaggccatgaagcgattca

SEQ ID NO: 729467 - DNA, 25 bp, Mus musculus
gtggcttaggccttgaagcgattca

SEQ ID NO: 729468 - DNA, 25 bp, Mus musculus
gtggcttcatggcaatggacatacc

SEQ ID NO: 729469 - DNA, 25 bp, Mus musculus
gtggcttcatgggaatggacatacc

SEQ ID NO: 729470 - DNA, 25 bp, Mus musculus
gtggcttcccacaatgaagaatccg

SEQ ID NO: 729471 - DNA, 25 bp, Mus musculus
gtggcttcccactatgaagaatccg

SEQ ID NO: 729472 - DNA, 25 bp, Mus musculus
gtggcttcgcggagcatggcacact

SEQ ID NO: 729473 - DNA, 25 bp, Mus musculus
gtggcttcgcggtgcatggcacact

SEQ ID NO: 729474 - DNA, 25 bp, Mus musculus
gtggcttctcggacttcaccacctt

SEQ ID NO: 729475 - DNA, 25 bp, Mus musculus
gtggcttctcggtcttcaccacctt

SEQ ID NO: 729476 - DNA, 25 bp, Mus musculus
gtggcttgcacaacatcatctttga

SEQ ID NO: 729477 - DNA, 25 bp, Mus musculus
gtggcttgcacatcatcatctttga

SEQ ID NO: 729478 - DNA, 25 bp, Mus musculus
gtggcttgcaggagtgaccccacaa

SEQ ID NO: 729479 - DNA, 25 bp, Mus musculus
gtggcttgcaggtgtgaccccacaa

SEQ ID NO: 729480 - DNA, 25 bp, Mus musculus
gtggcttgccctactcacgaaccat

SEQ ID NO: 729481 - DNA, 25 bp, Mus musculus
gtggcttgcccttctcacgaaccat

SEQ ID NO: 729482 - DNA, 25 bp, Mus musculus
gtggcttggtggaagacaaatcaga

SEQ ID NO: 729483 - DNA, 25 bp, Mus musculus
gtggcttggtggtagacaaatcaga

SEQ ID NO: 729484 - DNA, 25 bp, Mus musculus
gtggctttgcagctaattaggttaa

SEQ ID NO: 729485 - DNA, 25 bp, Mus musculus
gtggctttgcaggtaattaggttaa

SEQ ID NO: 729486 - DNA, 25 bp, Mus musculus
gtgggaaagaggcaaccaccagcct

SEQ ID NO: 729487 - DNA, 25 bp, Mus musculus
gtgggaaagagggaaccaccagcct

SEQ ID NO: 729488 - DNA, 25 bp, Mus musculus
gtgggaacgaccagctgagcaaaaa

SEQ ID NO: 729489 - DNA, 25 bp, Mus musculus
gtgggaacgacctgctgagcaaaaa

SEQ ID NO: 729490 - DNA, 25 bp, Mus musculus
gtgggaactcaccacctagcagcag

SEQ ID NO: 729491 - DNA, 25 bp, Mus musculus
gtgggaactcacgacctagcagcag

SEQ ID NO: 729492 - DNA, 25 bp, Mus musculus
gtgggaagacctatgtaacacaaac

SEQ ID NO: 729493 - DNA, 25 bp, Mus musculus
gtgggaagacctttgtaacacaaac

SEQ ID NO: 729494 - DNA, 25 bp, Mus musculus
gtgggaagcccgctccttgacaacc

SEQ ID NO: 729495 - DNA, 25 bp, Mus musculus
gtgggaagcccggtccttgacaacc

SEQ ID NO: 729496 - DNA, 25 bp, Mus musculus
gtgggaatcgataaagacaaaccca

SEQ ID NO: 729497 - DNA, 25 bp, Mus musculus
gtgggaatcgattaagacaaaccca

SEQ ID NO: 729498 - DNA, 25 bp, Mus musculus
gtgggaatctctctcacccttctgg

SEQ ID NO: 729499 - DNA, 25 bp, Mus musculus
gtgggaatctctgtcacccttctgg

SEQ ID NO: 729500 - DNA, 25 bp, Mus musculus
gtgggaccaattatgcctattggaa

SEQ ID NO: 729501 - DNA, 25 bp, Mus musculus
gtgggaccaattttgcctattggaa

SEQ ID NO: 729502 - DNA, 25 bp, Mus musculus
gtgggaccctcactcacaccaatga

SEQ ID NO: 729503 - DNA, 25 bp, Mus musculus
gtgggaccctcagtcacaccaatga

SEQ ID NO: 729504 - DNA, 25 bp, Mus musculus
gtgggaccgaacacttggccgagct

SEQ ID NO: 729505 - DNA, 25 bp, Mus musculus
gtgggaccgaactcttggccgagct

SEQ ID NO: 729506 - DNA, 25 bp, Mus musculus
gtgggaccggctacacagaacaact

SEQ ID NO: 729507 - DNA, 25 bp, Mus musculus
gtgggaccggcttcacagaacaact

SEQ ID NO: 729508 - DNA, 25 bp, Mus musculus
gtgggacctcgcacggcagacagca

SEQ ID NO: 729509 - DNA, 25 bp, Mus musculus
gtgggacctcgctcggcagacagca

SEQ ID NO: 729510 - DNA, 25 bp, Mus musculus
gtgggactagagcttggacctcaca

SEQ ID NO: 729511 - DNA, 25 bp, Mus musculus
gtgggactagaggttggacctcaca

SEQ ID NO: 729512 - DNA, 25 bp, Mus musculus
gtgggactttatacatatgattcag

SEQ ID NO: 729513 - DNA, 25 bp, Mus musculus
gtgggactttattcatatgattcag

SEQ ID NO: 729514 - DNA, 25 bp, Mus musculus
gtgggagacattcccaccggcatca

SEQ ID NO: 729515 - DNA, 25 bp, Mus musculus
gtgggagacattgccaccggcatca

SEQ ID NO: 729516 - DNA, 25 bp, Mus musculus
gtgggagaccccatgcggttcaagc

SEQ ID NO: 729517 - DNA, 25 bp, Mus musculus
gtgggagaccccttgcggttcaagc

SEQ ID NO: 729518 - DNA, 25 bp, Mus musculus
gtgggagccatgcacgccttcatcc

SEQ ID NO: 729519 - DNA, 25 bp, Mus musculus
gtgggagccatggacgccttcatcc

SEQ ID NO: 729520 - DNA, 25 bp, Mus musculus
gtgggagcccagagtcgtcgctaca

SEQ ID NO: 729521 - DNA, 25 bp, Mus musculus
gtgggagcccagtgtcgtcgctaca

SEQ ID NO: 729522 - DNA, 25 bp, Mus musculus
gtgggagcggacacagagccaccat

SEQ ID NO: 729523 - DNA, 25 bp, Mus musculus
gtgggagcggactcagagccaccat

SEQ ID NO: 729524 - DNA, 25 bp, Mus musculus
gtgggaggctccctgtactacacca

SEQ ID NO: 729525 - DNA, 25 bp, Mus musculus
gtgggaggctccgtgtactacacca

SEQ ID NO: 729526 - DNA, 25 bp, Mus musculus
gtgggagtcacaattcttatttgga

SEQ ID NO: 729527 - DNA, 25 bp, Mus musculus
gtgggagtcacatttcttatttgga

SEQ ID NO: 729528 - DNA, 25 bp, Mus musculus
gtgggataacctcggctctctgaca

SEQ ID NO: 729529 - DNA, 25 bp, Mus musculus
gtgggataacctgggctctctgaca

SEQ ID NO: 729530 - DNA, 25 bp, Mus musculus
gtgggataggccacctcagagattg

SEQ ID NO: 729531 - DNA, 25 bp, Mus musculus
gtgggataggcctcctcagagattg

SEQ ID NO: 729532 - DNA, 25 bp, Mus musculus
gtgggatcgaggaacaaatcacctg

SEQ ID NO: 729533 - DNA, 25 bp, Mus musculus
gtgggatcgaggtacaaatcacctg

SEQ ID NO: 729534 - DNA, 25 bp, Mus musculus
gtgggatctaccagtggcctggcct

SEQ ID NO: 729535 - DNA, 25 bp, Mus musculus
gtgggatctacctgtggcctggcct

SEQ ID NO: 729536 - DNA, 25 bp, Mus musculus
gtgggatgacagactggttaacaga

SEQ ID NO: 729537 - DNA, 25 bp, Mus musculus
gtgggatgacagtctggttaacaga

SEQ ID NO: 729538 - DNA, 25 bp, Mus musculus
gtgggatgtccgacataagctcttc

SEQ ID NO: 729539 - DNA, 25 bp, Mus musculus
gtgggatgtccgtcataagctcttc

SEQ ID NO: 729540 - DNA, 25 bp, Mus musculus
gtgggattccttcacagagacatca

SEQ ID NO: 729541 - DNA, 25 bp, Mus musculus
gtgggattccttgacagagacatca

SEQ ID NO: 729542 - DNA, 25 bp, Mus musculus
gtgggcacctacaacaccaggaagt

SEQ ID NO: 729543 - DNA, 25 bp, Mus musculus
gtgggcacctactacaccaggaagt

SEQ ID NO: 729544 - DNA, 25 bp, Mus musculus
gtgggcactgaaatccaacgtcctc

SEQ ID NO: 729545 - DNA, 25 bp, Mus musculus
gtgggcactgaattccaacgtcctc

SEQ ID NO: 729546 - DNA, 25 bp, Mus musculus
gtgggcagcacaccccttctcaagt

SEQ ID NO: 729547 - DNA, 25 bp, Mus musculus
gtgggcagcacagcccttctcaagt

SEQ ID NO: 729548 - DNA, 25 bp, Mus musculus
gtgggcagcactcccttcagcacct

SEQ ID NO: 729549 - DNA, 25 bp, Mus musculus
gtgggcagcactgccttcagcacct

SEQ ID NO: 729550 - DNA, 25 bp, Mus musculus
gtgggcagcgccctttcagaccctt

SEQ ID NO: 729551 - DNA, 25 bp, Mus musculus
gtgggcagcgccgtttcagaccctt

SEQ ID NO: 729552 - DNA, 25 bp, Mus musculus
gtgggcagcgtgcaagccctccttc

SEQ ID NO: 729553 - DNA, 25 bp, Mus musculus
gtgggcagcgtggaagccctccttc

SEQ ID NO: 729554 - DNA, 25 bp, Mus musculus
gtgggcaggaatatagccaacccca

SEQ ID NO: 729555 - DNA, 25 bp, Mus musculus
gtgggcaggaatttagccaacccca

SEQ ID NO: 729556 - DNA, 25 bp, Mus musculus
gtgggcagtatcaaaccgagaaatg

SEQ ID NO: 729557 - DNA, 25 bp, Mus musculus
gtgggcagtatctaaccgagaaatg

SEQ ID NO: 729558 - DNA, 25 bp, Mus musculus
gtgggcatgatacccagcttttaca

SEQ ID NO: 729559 - DNA, 25 bp, Mus musculus
gtgggcatgatagccagcttttaca

SEQ ID NO: 729560 - DNA, 25 bp, Mus musculus
gtgggcattatcacctggcacccca

SEQ ID NO: 729561 - DNA, 25 bp, Mus musculus
gtgggcattatctcctggcacccca

SEQ ID NO: 729562 - DNA, 25 bp, Mus musculus
gtgggcccaccacgtactgccagtt

SEQ ID NO: 729563 - DNA, 25 bp, Mus musculus
gtgggcccaccaggtactgccagtt

SEQ ID NO: 729564 - DNA, 25 bp, Mus musculus
gtgggccggttcactgctttcctgc

SEQ ID NO: 729565 - DNA, 25 bp, Mus musculus
gtgggccggttctctgctttcctgc

SEQ ID NO: 729566 - DNA, 25 bp, Mus musculus
gtgggccgtgttccataagttcaaa

SEQ ID NO: 729567 - DNA, 25 bp, Mus musculus
gtgggccgtgttgcataagttcaaa

SEQ ID NO: 729568 - DNA, 25 bp, Mus musculus
gtgggcctcaataccacccggcttt

SEQ ID NO: 729569 - DNA, 25 bp, Mus musculus
gtgggcctcaattccacccggcttt

SEQ ID NO: 729570 - DNA, 25 bp, Mus musculus
gtgggcctgcccagcccgagagcat

SEQ ID NO: 729571 - DNA, 25 bp, Mus musculus
gtgggcctgccctgcccgagagcat

SEQ ID NO: 729572 - DNA, 25 bp, Mus musculus
gtgggcctgcgcaactccttccaga

SEQ ID NO: 729573 - DNA, 25 bp, Mus musculus
gtgggcctgcgctactccttccaga

SEQ ID NO: 729574 - DNA, 25 bp, Mus musculus
gtgggccttggtcctattccttcag

SEQ ID NO: 729575 - DNA, 25 bp, Mus musculus
gtgggccttggtgctattccttcag

SEQ ID NO: 729576 - DNA, 25 bp, Mus musculus
gtgggcgccatcaccatagtgatgg

SEQ ID NO: 729577 - DNA, 25 bp, Mus musculus
gtgggcgccatctccatagtgatgg

SEQ ID NO: 729578 - DNA, 25 bp, Mus musculus
gtgggcgccgctagccaagaaaaca

SEQ ID NO: 729579 - DNA, 25 bp, Mus musculus
gtgggcgccgcttgccaagaaaaca

SEQ ID NO: 729580 - DNA, 25 bp, Mus musculus
gtgggcgcctccagttagccggcta

SEQ ID NO: 729581 - DNA, 25 bp, Mus musculus
gtgggcgcctcctgttagccggcta

SEQ ID NO: 729582 - DNA, 25 bp, Mus musculus
gtgggcgctcagaggaagtttccct

SEQ ID NO: 729583 - DNA, 25 bp, Mus musculus
gtgggcgctcagtggaagtttccct

SEQ ID NO: 729584 - DNA, 25 bp, Mus musculus
gtgggcgtcagcctgctcaccatgc

SEQ ID NO: 729585 - DNA, 25 bp, Mus musculus
gtgggcgtcagcgtgctcaccatgc

SEQ ID NO: 729586 - DNA, 25 bp, Mus musculus
gtgggctaatctagccaaaacttac

SEQ ID NO: 729587 - DNA, 25 bp, Mus musculus
gtgggctaatcttgccaaaacttac

SEQ ID NO: 729588 - DNA, 25 bp, Mus musculus
gtgggctcagccacccattggccat

SEQ ID NO: 729589 - DNA, 25 bp, Mus musculus
gtgggctcagcctcccattggccat

SEQ ID NO: 729590 - DNA, 25 bp, Mus musculus
gtgggctccactctctacaccaagg

SEQ ID NO: 729591 - DNA, 25 bp, Mus musculus
gtgggctccactgtctacaccaagg

SEQ ID NO: 729592 - DNA, 25 bp, Mus musculus
gtgggctcgagacaaggccacctcc

SEQ ID NO: 729593 - DNA, 25 bp, Mus musculus
gtgggctcgagagaaggccacctcc

SEQ ID NO: 729594 - DNA, 25 bp, Mus musculus
gtgggctctcttcgcaccatggctt

SEQ ID NO: 729595 - DNA, 25 bp, Mus musculus
gtgggctctcttggcaccatggctt

SEQ ID NO: 729596 - DNA, 25 bp, Mus musculus
gtgggctcttcacccacacaatttt

SEQ ID NO: 729597 - DNA, 25 bp, Mus musculus
gtgggctcttcagccacacaatttt

SEQ ID NO: 729598 - DNA, 25 bp, Mus musculus
gtgggctgattgaaccacccttccc

SEQ ID NO: 729599 - DNA, 25 bp, Mus musculus
gtgggctgattgtaccacccttccc

SEQ ID NO: 729600 - DNA, 25 bp, Mus musculus
gtgggctgctttactcacttatcca

SEQ ID NO: 729601 - DNA, 25 bp, Mus musculus
gtgggctgcttttctcacttatcca

SEQ ID NO: 729602 - DNA, 25 bp, Mus musculus
gtgggctggctactcgcccctgtca

SEQ ID NO: 729603 - DNA, 25 bp, Mus musculus
gtgggctggctagtcgcccctgtca

SEQ ID NO: 729604 - DNA, 25 bp, Mus musculus
gtgggctgtgccataacttgagaca

SEQ ID NO: 729605 - DNA, 25 bp, Mus musculus
gtgggctgtgccttaacttgagaca

SEQ ID NO: 729606 - DNA, 25 bp, Mus musculus
gtgggcttcggtcccctgatgactc

SEQ ID NO: 729607 - DNA, 25 bp, Mus musculus
gtgggcttcggtgccctgatgactc

SEQ ID NO: 729608 - DNA, 25 bp, Mus musculus
gtgggtaaagcacgaaactgagatt

SEQ ID NO: 729609 - DNA, 25 bp, Mus musculus
gtgggtaaagcaggaaactgagatt

SEQ ID NO: 729610 - DNA, 25 bp, Mus musculus
gtgggtactgacagcccggcaatgc

SEQ ID NO: 729611 - DNA, 25 bp, Mus musculus
gtgggtactgactgcccggcaatgc

SEQ ID NO: 729612 - DNA, 25 bp, Mus musculus
gtgggtcacaagcaaactctcccca

SEQ ID NO: 729613 - DNA, 25 bp, Mus musculus
gtgggtcacaaggaaactctcccca

SEQ ID NO: 729614 - DNA, 25 bp, Mus musculus
gtgggtcagctacaaacaactttgc

SEQ ID NO: 729615 - DNA, 25 bp, Mus musculus
gtgggtcagctagaaacaactttgc

SEQ ID NO: 729616 - DNA, 25 bp, Mus musculus
gtgggtcagcttaatctacgctgga

SEQ ID NO: 729617 - DNA, 25 bp, Mus musculus
gtgggtcagctttatctacgctgga

SEQ ID NO: 729618 - DNA, 25 bp, Mus musculus
gtgggtctggagactcacttcccct

SEQ ID NO: 729619 - DNA, 25 bp, Mus musculus
gtgggtctggagtctcacttcccct

SEQ ID NO: 729620 - DNA, 25 bp, Mus musculus
gtgggtgcccgtccaaaagccatcg

SEQ ID NO: 729621 - DNA, 25 bp, Mus musculus
gtgggtgcccgtgcaaaagccatcg

SEQ ID NO: 729622 - DNA, 25 bp, Mus musculus
gtgggtgtcccactttgtcaaatac

SEQ ID NO: 729623 - DNA, 25 bp, Mus musculus
gtgggtgtcccagtttgtcaaatac

SEQ ID NO: 729624 - DNA, 25 bp, Mus musculus
gtgggttcaactatcaccgtgttct

SEQ ID NO: 729625 - DNA, 25 bp, Mus musculus
gtgggttcaactttcaccgtgttct

SEQ ID NO: 729626 - DNA, 25 bp, Mus musculus
gtgggttccgccatgactgagaaaa

SEQ ID NO: 729627 - DNA, 25 bp, Mus musculus
gtgggttccgccttgactgagaaaa

SEQ ID NO: 729628 - DNA, 25 bp, Mus musculus
gtggtaagattgctcccaagaagcc

SEQ ID NO: 729629 - DNA, 25 bp, Mus musculus
gtggtaagattggtcccaagaagcc

SEQ ID NO: 729630 - DNA, 25 bp, Mus musculus
gtggtaagcgggaccatgcctccaa

SEQ ID NO: 729631 - DNA, 25 bp, Mus musculus
gtggtaagcgggtccatgcctccaa

SEQ ID NO: 729632 - DNA, 25 bp, Mus musculus
gtggtaataaatccatactttggtc

SEQ ID NO: 729633 - DNA, 25 bp, Mus musculus
gtggtaataaatgcatactttggtc

SEQ ID NO: 729634 - DNA, 25 bp, Mus musculus
gtggtacaaactcaacagggcccct

SEQ ID NO: 729635 - DNA, 25 bp, Mus musculus
gtggtacaaactgaacagggcccct

SEQ ID NO: 729636 - DNA, 25 bp, Mus musculus
gtggtacagttcaagatcaagaggc

SEQ ID NO: 729637 - DNA, 25 bp, Mus musculus
gtggtacagttctagatcaagaggc

SEQ ID NO: 729638 - DNA, 25 bp, Mus musculus
gtggtaccctagaaaaaactgcact

SEQ ID NO: 729639 - DNA, 25 bp, Mus musculus
gtggtaccctagtaaaaactgcact

SEQ ID NO: 729640 - DNA, 25 bp, Mus musculus
gtggtaccctcgcaccgtggcacat

SEQ ID NO: 729641 - DNA, 25 bp, Mus musculus
gtggtaccctcggaccgtggcacat

SEQ ID NO: 729642 - DNA, 25 bp, Mus musculus
gtggtacggtttcgagagactcttc

SEQ ID NO: 729643 - DNA, 25 bp, Mus musculus
gtggtacggtttggagagactcttc

SEQ ID NO: 729644 - DNA, 25 bp, Mus musculus
gtggtactgcgcaagaagttctccg

SEQ ID NO: 729645 - DNA, 25 bp, Mus musculus
gtggtactgcgctagaagttctccg

SEQ ID NO: 729646 - DNA, 25 bp, Mus musculus
gtggtagaggacattgaatacctta

SEQ ID NO: 729647 - DNA, 25 bp, Mus musculus
gtggtagaggactttgaatacctta

SEQ ID NO: 729648 - DNA, 25 bp, Mus musculus
gtggtagtccacagcacaggctaca

SEQ ID NO: 729649 - DNA, 25 bp, Mus musculus
gtggtagtccactgcacaggctaca

SEQ ID NO: 729650 - DNA, 25 bp, Mus musculus
gtggtatcaaccctctcagctatct

SEQ ID NO: 729651 - DNA, 25 bp, Mus musculus
gtggtatcaaccgtctcagctatct

SEQ ID NO: 729652 - DNA, 25 bp, Mus musculus
gtggtatctcttctagccgtccacc

SEQ ID NO: 729653 - DNA, 25 bp, Mus musculus
gtggtatctcttgtagccgtccacc

SEQ ID NO: 729654 - DNA, 25 bp, Mus musculus
gtggtattgtgaacctgggctctgt

SEQ ID NO: 729655 - DNA, 25 bp, Mus musculus
gtggtattgtgatcctgggctctgt

SEQ ID NO: 729656 - DNA, 25 bp, Mus musculus
gtggtcaagaggaggttctacagaa

SEQ ID NO: 729657 - DNA, 25 bp, Mus musculus
gtggtcaagaggtggttctacagaa

SEQ ID NO: 729658 - DNA, 25 bp, Mus musculus
gtggtcaagcacactacgttgatgg

SEQ ID NO: 729659 - DNA, 25 bp, Mus musculus
gtggtcaagcactctacgttgatgg

SEQ ID NO: 729660 - DNA, 25 bp, Mus musculus
gtggtcacagacacggtttccggcg

SEQ ID NO: 729661 - DNA, 25 bp, Mus musculus
gtggtcacagacatggacaccattg

SEQ ID NO: 729662 - DNA, 25 bp, Mus musculus
gtggtcacagactcggtttccggcg

SEQ ID NO: 729663 - DNA, 25 bp, Mus musculus
gtggtcacagacttggacaccattg

SEQ ID NO: 729664 - DNA, 25 bp, Mus musculus
gtggtcacatctccaaggaggcccc

SEQ ID NO: 729665 - DNA, 25 bp, Mus musculus
gtggtcacatctgcaaggaggcccc

SEQ ID NO: 729666 - DNA, 25 bp, Mus musculus
gtggtcaccatgcagcactctgcga

SEQ ID NO: 729667 - DNA, 25 bp, Mus musculus
gtggtcaccatggagcactctgcga

SEQ ID NO: 729668 - DNA, 25 bp, Mus musculus
gtggtcacgtcactggcaaatatgc

SEQ ID NO: 729669 - DNA, 25 bp, Mus musculus
gtggtcacgtcagtggcaaatatgc

SEQ ID NO: 729670 - DNA, 25 bp, Mus musculus
gtggtcagcctcaccgggaaccagt

SEQ ID NO: 729671 - DNA, 25 bp, Mus musculus
gtggtcagcctctccgggaaccagt

SEQ ID NO: 729672 - DNA, 25 bp, Mus musculus
gtggtcataaatacaaacgtgggca

SEQ ID NO: 729673 - DNA, 25 bp, Mus musculus
gtggtcataaattcaaacgtgggca

SEQ ID NO: 729674 - DNA, 25 bp, Mus musculus
gtggtcatgagcacagccgccttgc

SEQ ID NO: 729675 - DNA, 25 bp, Mus musculus
gtggtcatgagctcagccgccttgc

SEQ ID NO: 729676 - DNA, 25 bp, Mus musculus
gtggtccaccttactttttatcctg

SEQ ID NO: 729677 - DNA, 25 bp, Mus musculus
gtggtccacctttctttttatcctg

SEQ ID NO: 729678 - DNA, 25 bp, Mus musculus
gtggtcccaggaaacggtcatgcag

SEQ ID NO: 729679 - DNA, 25 bp, Mus musculus
gtggtcccaggatacggtcatgcag

SEQ ID NO: 729680 - DNA, 25 bp, Mus musculus
gtggtccgcaaccagaagcccagcg

SEQ ID NO: 729681 - DNA, 25 bp, Mus musculus
gtggtccgcaacgagaagcccagcg

SEQ ID NO: 729682 - DNA, 25 bp, Mus musculus
gtggtccgcttcctacagctatcct

SEQ ID NO: 729683 - DNA, 25 bp, Mus musculus
gtggtccgcttcgtacagctatcct

SEQ ID NO: 729684 - DNA, 25 bp, Mus musculus
gtggtccggaacatcctgcgtcccg

SEQ ID NO: 729685 - DNA, 25 bp, Mus musculus
gtggtccggaacttcctgcgtcccg

SEQ ID NO: 729686 - DNA, 25 bp, Mus musculus
gtggtcctgaagagcaaggatgacc

SEQ ID NO: 729687 - DNA, 25 bp, Mus musculus
gtggtcctgaagtgcaaggatgacc

SEQ ID NO: 729688 - DNA, 25 bp, Mus musculus
gtggtcctgtgaatagccgagcgcc

SEQ ID NO: 729689 - DNA, 25 bp, Mus musculus
gtggtcctgtgattagccgagcgcc

SEQ ID NO: 729690 - DNA, 25 bp, Mus musculus
gtggtcgcgcacaccggcttcttca

SEQ ID NO: 729691 - DNA, 25 bp, Mus musculus
gtggtcgcgcactccggcttcttca

SEQ ID NO: 729692 - DNA, 25 bp, Mus musculus
gtggtcgtccgaactggatggaaaa

SEQ ID NO: 729693 - DNA, 25 bp, Mus musculus
gtggtcgtccgatctggatggaaaa

SEQ ID NO: 729694 - DNA, 25 bp, Mus musculus
gtggtctacgaaatgtttctcatct

SEQ ID NO: 729695 - DNA, 25 bp, Mus musculus
gtggtctacgaattgtttctcatct

SEQ ID NO: 729696 - DNA, 25 bp, Mus musculus
gtggtctactagctctccctaaggc

SEQ ID NO: 729697 - DNA, 25 bp, Mus musculus
gtggtctactaggtctccctaaggc

SEQ ID NO: 729698 - DNA, 25 bp, Mus musculus
gtggtctacttcaccgcatcgatgc

SEQ ID NO: 729699 - DNA, 25 bp, Mus musculus
gtggtctacttctccgcatcgatgc

SEQ ID NO: 729700 - DNA, 25 bp, Mus musculus
gtggtctatcacaccactcatgtac

SEQ ID NO: 729701 - DNA, 25 bp, Mus musculus
gtggtctatcactccactcatgtac

SEQ ID NO: 729702 - DNA, 25 bp, Mus musculus
gtggtctcttcccacccagtagtgg

SEQ ID NO: 729703 - DNA, 25 bp, Mus musculus
gtggtctcttccgacccagtagtgg

SEQ ID NO: 729704 - DNA, 25 bp, Mus musculus
gtggtctgtgatcagaacggctcta

SEQ ID NO: 729705 - DNA, 25 bp, Mus musculus
gtggtctgtgatgagaacggctcta

SEQ ID NO: 729706 - DNA, 25 bp, Mus musculus
gtggtctgtgctcggtctttacgtt

SEQ ID NO: 729707 - DNA, 25 bp, Mus musculus
gtggtctgtgctgggtctttacgtt

SEQ ID NO: 729708 - DNA, 25 bp, Mus musculus
gtggtcttagccagccctgtcgcca

SEQ ID NO: 729709 - DNA, 25 bp, Mus musculus
gtggtcttagcctgccctgtcgcca

SEQ ID NO: 729710 - DNA, 25 bp, Mus musculus
gtggtgaacctgcaccccgctaacg

SEQ ID NO: 729711 - DNA, 25 bp, Mus musculus
gtggtgaacctggaccccgctaacg

SEQ ID NO: 729712 - DNA, 25 bp, Mus musculus
gtggtgaactttcgctccctgccac

SEQ ID NO: 729713 - DNA, 25 bp, Mus musculus
gtggtgaactttggctccctgccac

SEQ ID NO: 729714 - DNA, 25 bp, Mus musculus
gtggtgaagacaatatctgtgtgcc

SEQ ID NO: 729715 - DNA, 25 bp, Mus musculus
gtggtgaagacattatctgtgtgcc

SEQ ID NO: 729716 - DNA, 25 bp, Mus musculus
gtggtgaagctaaagcagatcgagc

SEQ ID NO: 729717 - DNA, 25 bp, Mus musculus
gtggtgaagctatagcagatcgagc

SEQ ID NO: 729718 - DNA, 25 bp, Mus musculus
gtggtgaagctcatggcctctacaa

SEQ ID NO: 729719 - DNA, 25 bp, Mus musculus
gtggtgaagctcttggcctctacaa

SEQ ID NO: 729720 - DNA, 25 bp, Mus musculus
gtggtgaaggagcacagcatagagg

SEQ ID NO: 729721 - DNA, 25 bp, Mus musculus
gtggtgaaggaggacagcatagagg

SEQ ID NO: 729722 - DNA, 25 bp, Mus musculus
gtggtgaatgccatcagccgagcct

SEQ ID NO: 729723 - DNA, 25 bp, Mus musculus
gtggtgaatgccttcagccgagcct

SEQ ID NO: 729724 - DNA, 25 bp, Mus musculus
gtggtgactctcaggccgcacgccg

SEQ ID NO: 729725 - DNA, 25 bp, Mus musculus
gtggtgactctctggccgcacgccg

SEQ ID NO: 729726 - DNA, 25 bp, Mus musculus
gtggtgatttgtctaacttaatggc

SEQ ID NO: 729727 - DNA, 25 bp, Mus musculus
gtggtgatttgtgtaacttaatggc

SEQ ID NO: 729728 - DNA, 25 bp, Mus musculus
gtggtgcaccaacggcccgtccgat

SEQ ID NO: 729729 - DNA, 25 bp, Mus musculus
gtggtgcaccaagggcccgtccgat

SEQ ID NO: 729730 - DNA, 25 bp, Mus musculus
gtggtgcagacacccagtctcacgc

SEQ ID NO: 729731 - DNA, 25 bp, Mus musculus
gtggtgcagacagccagtctcacgc

SEQ ID NO: 729732 - DNA, 25 bp, Mus musculus
gtggtgcagacgctgtaccccttca

SEQ ID NO: 729733 - DNA, 25 bp, Mus musculus
gtggtgcagacggtgtaccccttca

SEQ ID NO: 729734 - DNA, 25 bp, Mus musculus
gtggtgcatgcccaactgagcctca

SEQ ID NO: 729735 - DNA, 25 bp, Mus musculus
gtggtgcatgccgaactgagcctca

SEQ ID NO: 729736 - DNA, 25 bp, Mus musculus
gtggtgcattgtcggaaactcctga

SEQ ID NO: 729737 - DNA, 25 bp, Mus musculus
gtggtgcattgtgggaaactcctga

SEQ ID NO: 729738 - DNA, 25 bp, Mus musculus
gtggtgccaaccagtggatcaagtt

SEQ ID NO: 729739 - DNA, 25 bp, Mus musculus
gtggtgccaacctgtggatcaagtt

SEQ ID NO: 729740 - DNA, 25 bp, Mus musculus
gtggtgccaagtaccatttggaatt

SEQ ID NO: 729741 - DNA, 25 bp, Mus musculus
gtggtgccaagttccatttggaatt

SEQ ID NO: 729742 - DNA, 25 bp, Mus musculus
gtggtgccacaccaatccctgcagt

SEQ ID NO: 729743 - DNA, 25 bp, Mus musculus
gtggtgccacacgaatccctgcagt

SEQ ID NO: 729744 - DNA, 25 bp, Mus musculus
gtggtgcccacactgtacatgaagg

SEQ ID NO: 729745 - DNA, 25 bp, Mus musculus
gtggtgcccacagtgtacatgaagg

SEQ ID NO: 729746 - DNA, 25 bp, Mus musculus
gtggtgccgcccaatcgctcgcaga

SEQ ID NO: 729747 - DNA, 25 bp, Mus musculus
gtggtgccgccctatcgctcgcaga

SEQ ID NO: 729748 - DNA, 25 bp, Mus musculus
gtggtgctggcccacctctggaact

SEQ ID NO: 729749 - DNA, 25 bp, Mus musculus
gtggtgctggcccagtacatattca

SEQ ID NO: 729750 - DNA, 25 bp, Mus musculus
gtggtgctggccgacctctggaact

SEQ ID NO: 729751 - DNA, 25 bp, Mus musculus
gtggtgctggccgagtacatattca

SEQ ID NO: 729752 - DNA, 25 bp, Mus musculus
gtggtgcttcaaaccatgtgagatc

SEQ ID NO: 729753 - DNA, 25 bp, Mus musculus
gtggtgcttcaatccatgtgagatc

SEQ ID NO: 729754 - DNA, 25 bp, Mus musculus
gtggtggccaagacatccctaggac

SEQ ID NO: 729755 - DNA, 25 bp, Mus musculus
gtggtggccaagtcatccctaggac

SEQ ID NO: 729756 - DNA, 25 bp, Mus musculus
gtggtggccattcaatatcgcctga

SEQ ID NO: 729757 - DNA, 25 bp, Mus musculus
gtggtggccattgaatatcgcctga

SEQ ID NO: 729758 - DNA, 25 bp, Mus musculus
gtggtggcccacacagcctttgctg

SEQ ID NO: 729759 - DNA, 25 bp, Mus musculus
gtggtggcccactcagcctttgctg

SEQ ID NO: 729760 - DNA, 25 bp, Mus musculus
gtggtggcccagaaaataccagggc

SEQ ID NO: 729761 - DNA, 25 bp, Mus musculus
gtggtggcccagtaaataccagggc

SEQ ID NO: 729762 - DNA, 25 bp, Mus musculus
gtggtggccctacacaacaagattg

SEQ ID NO: 729763 - DNA, 25 bp, Mus musculus
gtggtggccctagacaacaagattg

SEQ ID NO: 729764 - DNA, 25 bp, Mus musculus
gtggtggccgcaagccctggcaaca

SEQ ID NO: 729765 - DNA, 25 bp, Mus musculus
gtggtggccgcatgccctggcaaca

SEQ ID NO: 729766 - DNA, 25 bp, Mus musculus
gtggtggctattcacctttgcctct

SEQ ID NO: 729767 - DNA, 25 bp, Mus musculus
gtggtggctattgacctttgcctct

SEQ ID NO: 729768 - DNA, 25 bp, Mus musculus
gtggtggtgtcgctggtcatggtgg

SEQ ID NO: 729769 - DNA, 25 bp, Mus musculus
gtggtggtgtcggtggtcatggtgg

SEQ ID NO: 729770 - DNA, 25 bp, Mus musculus
gtggtgtcgcataccctcagagagg

SEQ ID NO: 729771 - DNA, 25 bp, Mus musculus
gtggtgtcgcattccctcagagagg

SEQ ID NO: 729772 - DNA, 25 bp, Mus musculus
gtggtgtctaccatgttcctccttc

SEQ ID NO: 729773 - DNA, 25 bp, Mus musculus
gtggtgtctaccttgttcctccttc

SEQ ID NO: 729774 - DNA, 25 bp, Mus musculus
gtggtgtgaactcccacaagcaatg

SEQ ID NO: 729775 - DNA, 25 bp, Mus musculus
gtggtgtgaactgccacaagcaatg

SEQ ID NO: 729776 - DNA, 25 bp, Mus musculus
gtggtgtgtcatagatgaaaatgcc

SEQ ID NO: 729777 - DNA, 25 bp, Mus musculus
gtggtgtgtcattgatgaaaatgcc

SEQ ID NO: 729778 - DNA, 25 bp, Mus musculus
gtggtgtgttttcaactggatacct

SEQ ID NO: 729779 - DNA, 25 bp, Mus musculus
gtggtgtgttttgaactggatacct

SEQ ID NO: 729780 - DNA, 25 bp, Mus musculus
gtggttacacacattaggtcttcct

SEQ ID NO: 729781 - DNA, 25 bp, Mus musculus
gtggttacacactttaggtcttcct

SEQ ID NO: 729782 - DNA, 25 bp, Mus musculus
gtggttaccatcacaatcatgccta

SEQ ID NO: 729783 - DNA, 25 bp, Mus musculus
gtggttaccatctcaatcatgccta

SEQ ID NO: 729784 - DNA, 25 bp, Mus musculus
gtggttaccggtatgcagaaagtag

SEQ ID NO: 729785 - DNA, 25 bp, Mus musculus
gtggttaccggtttgcagaaagtag

SEQ ID NO: 729786 - DNA, 25 bp, Mus musculus
gtggttaccttcaccctgcgcactg

SEQ ID NO: 729787 - DNA, 25 bp, Mus musculus
gtggttaccttctccctgcgcactg

SEQ ID NO: 729788 - DNA, 25 bp, Mus musculus
gtggttatcatccttcgggcgccgc

SEQ ID NO: 729789 - DNA, 25 bp, Mus musculus
gtggttatcatcgttcgggcgccgc

SEQ ID NO: 729790 - DNA, 25 bp, Mus musculus
gtggttatcctcacctgctccctgt

SEQ ID NO: 729791 - DNA, 25 bp, Mus musculus
gtggttatcctctcctgctccctgt

SEQ ID NO: 729792 - DNA, 25 bp, Mus musculus
gtggttatctccacaggcgcctcag

SEQ ID NO: 729793 - DNA, 25 bp, Mus musculus
gtggttatctcctcaggcgcctcag

SEQ ID NO: 729794 - DNA, 25 bp, Mus musculus
gtggttccatcaccttccaaaatgt

SEQ ID NO: 729795 - DNA, 25 bp, Mus musculus
gtggttccatcagcttccaaaatgt

SEQ ID NO: 729796 - DNA, 25 bp, Mus musculus
gtggttccatggacacttgtctgga

SEQ ID NO: 729797 - DNA, 25 bp, Mus musculus
gtggttccatggtcacttgtctgga

SEQ ID NO: 729798 - DNA, 25 bp, Mus musculus
gtggttcctcccagctcaggctgac

SEQ ID NO: 729799 - DNA, 25 bp, Mus musculus
gtggttcctccctgctcaggctgac

SEQ ID NO: 729800 - DNA, 25 bp, Mus musculus
gtggttccttgccttctgtctgtaa

SEQ ID NO: 729801 - DNA, 25 bp, Mus musculus
gtggttccttgcgttctgtctgtaa

SEQ ID NO: 729802 - DNA, 25 bp, Mus musculus
gtggttcgccaaactgatgggcaaa

SEQ ID NO: 729803 - DNA, 25 bp, Mus musculus
gtggttcgccaatctgatgggcaaa

SEQ ID NO: 729804 - DNA, 25 bp, Mus musculus
gtggttctgagtcagcacctgtcct

SEQ ID NO: 729805 - DNA, 25 bp, Mus musculus
gtggttctgagtgagcacctgtcct

SEQ ID NO: 729806 - DNA, 25 bp, Mus musculus
gtggttctgtgtatcacgttcaagc

SEQ ID NO: 729807 - DNA, 25 bp, Mus musculus
gtggttctgtgtttcacgttcaagc

SEQ ID NO: 729808 - DNA, 25 bp, Mus musculus
gtggttgaagtcaccaccctagagc

SEQ ID NO: 729809 - DNA, 25 bp, Mus musculus
gtggttgaagtctccaccctagagc

SEQ ID NO: 729810 - DNA, 25 bp, Mus musculus
gtggttgccctcaatgccaacagca

SEQ ID NO: 729811 - DNA, 25 bp, Mus musculus
gtggttgccctctatgccaacagca

SEQ ID NO: 729812 - DNA, 25 bp, Mus musculus
gtggttggagaccaagcacctcatg

SEQ ID NO: 729813 - DNA, 25 bp, Mus musculus
gtggttggagacgaagcacctcatg

SEQ ID NO: 729814 - DNA, 25 bp, Mus musculus
gtggttgtaagccttgcatatgtac

SEQ ID NO: 729815 - DNA, 25 bp, Mus musculus
gtggttgtaagcgttgcatatgtac

SEQ ID NO: 729816 - DNA, 25 bp, Mus musculus
gtggttgtgaacagtctgaggtctc

SEQ ID NO: 729817 - DNA, 25 bp, Mus musculus
gtggttgtgaactgtctgaggtctc

SEQ ID NO: 729818 - DNA, 25 bp, Mus musculus
gtggttgtgcttattctctgtagta

SEQ ID NO: 729819 - DNA, 25 bp, Mus musculus
gtggttgtgctttttctctgtagta

SEQ ID NO: 729820 - DNA, 25 bp, Mus musculus
gtggttgtgtccaaccaccagagtt

SEQ ID NO: 729821 - DNA, 25 bp, Mus musculus
gtggttgtgtcctaccaccagagtt

SEQ ID NO: 729822 - DNA, 25 bp, Mus musculus
gtggtttcacctccctgccgctgtg

SEQ ID NO: 729823 - DNA, 25 bp, Mus musculus
gtggtttcacctgcctgccgctgtg

SEQ ID NO: 729824 - DNA, 25 bp, Mus musculus
gtgtaaaaacgtcctgccattgggc

SEQ ID NO: 729825 - DNA, 25 bp, Mus musculus
gtgtaaaaacgtgctgccattgggc

SEQ ID NO: 729826 - DNA, 25 bp, Mus musculus
gtgtaaaaggatcctatgctcatgt

SEQ ID NO: 729827 - DNA, 25 bp, Mus musculus
gtgtaaaaggatgctatgctcatgt

SEQ ID NO: 729828 - DNA, 25 bp, Mus musculus
gtgtaaagcacacttggaagacaag

SEQ ID NO: 729829 - DNA, 25 bp, Mus musculus
gtgtaaagcacagttggaagacaag

SEQ ID NO: 729830 - DNA, 25 bp, Mus musculus
gtgtaaatctgaacatcaacatagg

SEQ ID NO: 729831 - DNA, 25 bp, Mus musculus
gtgtaaatctgatcatcaacatagg

SEQ ID NO: 729832 - DNA, 25 bp, Mus musculus
gtgtaacatgccctttgagatccgt

SEQ ID NO: 729833 - DNA, 25 bp, Mus musculus
gtgtaacatgccgtttgagatccgt

SEQ ID NO: 729834 - DNA, 25 bp, Mus musculus
gtgtaacatttgaggctgagcaagt

SEQ ID NO: 729835 - DNA, 25 bp, Mus musculus
gtgtaacatttgtggctgagcaagt

SEQ ID NO: 729836 - DNA, 25 bp, Mus musculus
gtgtaaccagacagatcaccacagg

SEQ ID NO: 729837 - DNA, 25 bp, Mus musculus
gtgtaaccagactgatcaccacagg

SEQ ID NO: 729838 - DNA, 25 bp, Mus musculus
gtgtaacggcctacattgccttggc

SEQ ID NO: 729839 - DNA, 25 bp, Mus musculus
gtgtaacggccttcattgccttggc

SEQ ID NO: 729840 - DNA, 25 bp, Mus musculus
gtgtaacttctgagtgacagccatg

SEQ ID NO: 729841 - DNA, 25 bp, Mus musculus
gtgtaacttctgtgtgacagccatg

SEQ ID NO: 729842 - DNA, 25 bp, Mus musculus
gtgtaagtagagatgccaggaccaa

SEQ ID NO: 729843 - DNA, 25 bp, Mus musculus
gtgtaagtagagttgccaggaccaa

SEQ ID NO: 729844 - DNA, 25 bp, Mus musculus
gtgtaataatcacgcatgtggctgg

SEQ ID NO: 729845 - DNA, 25 bp, Mus musculus
gtgtaataatcaggcatgtggctgg

SEQ ID NO: 729846 - DNA, 25 bp, Mus musculus
gtgtaatcgccaatattgctgggag

SEQ ID NO: 729847 - DNA, 25 bp, Mus musculus
gtgtaatcgccattattgctgggag

SEQ ID NO: 729848 - DNA, 25 bp, Mus musculus
gtgtaatgaatcacaacccagccaa

SEQ ID NO: 729849 - DNA, 25 bp, Mus musculus
gtgtaatgaatctcaacccagccaa

SEQ ID NO: 729850 - DNA, 25 bp, Mus musculus
gtgtacaagtatcaccgcgcctgcc

SEQ ID NO: 729851 - DNA, 25 bp, Mus musculus
gtgtacaagtatgaccgcgcctgcc

SEQ ID NO: 729852 - DNA, 25 bp, Mus musculus
gtgtacacatctcggaaaggtagca

SEQ ID NO: 729853 - DNA, 25 bp, Mus musculus
gtgtacacatctgggaaaggtagca

SEQ ID NO: 729854 - DNA, 25 bp, Mus musculus
gtgtacacgtacatccaggagttct

SEQ ID NO: 729855 - DNA, 25 bp, Mus musculus
gtgtacacgtacttccaggagttct

SEQ ID NO: 729856 - DNA, 25 bp, Mus musculus
gtgtacactgtgagatcaatgttga

SEQ ID NO: 729857 - DNA, 25 bp, Mus musculus
gtgtacactgtgtgatcaatgttga

SEQ ID NO: 729858 - DNA, 25 bp, Mus musculus
gtgtacagtcatcccttagctgtgg

SEQ ID NO: 729859 - DNA, 25 bp, Mus musculus
gtgtacagtcatgccttagctgtgg

SEQ ID NO: 729860 - DNA, 25 bp, Mus musculus
gtgtacatttgcacagcaaaaaggc

SEQ ID NO: 729861 - DNA, 25 bp, Mus musculus
gtgtacatttgctcagcaaaaaggc

SEQ ID NO: 729862 - DNA, 25 bp, Mus musculus
gtgtaccaatgcaaatagtatctcg

SEQ ID NO: 729863 - DNA, 25 bp, Mus musculus
gtgtaccaatgctaatagtatctcg

SEQ ID NO: 729864 - DNA, 25 bp, Mus musculus
gtgtaccactctagcctgccagcat

SEQ ID NO: 729865 - DNA, 25 bp, Mus musculus
gtgtaccactcttgcctgccagcat

SEQ ID NO: 729866 - DNA, 25 bp, Mus musculus
gtgtaccatgctcctgacttgccca

SEQ ID NO: 729867 - DNA, 25 bp, Mus musculus
gtgtaccatgctgctgacttgccca

SEQ ID NO: 729868 - DNA, 25 bp, Mus musculus
gtgtaccccactatacctgtctggg

SEQ ID NO: 729869 - DNA, 25 bp, Mus musculus
gtgtaccccactttacctgtctggg

SEQ ID NO: 729870 - DNA, 25 bp, Mus musculus
gtgtaccccgagacctccaagtggg

SEQ ID NO: 729871 - DNA, 25 bp, Mus musculus
gtgtaccccgagtcctccaagtggg

SEQ ID NO: 729872 - DNA, 25 bp, Mus musculus
gtgtacctccagacattgtcctgga

SEQ ID NO: 729873 - DNA, 25 bp, Mus musculus
gtgtacctccagtcattgtcctgga

SEQ ID NO: 729874 - DNA, 25 bp, Mus musculus
gtgtacctgggtctcgtggatttcc

SEQ ID NO: 729875 - DNA, 25 bp, Mus musculus
gtgtacctgggtgtcgtggatttcc

SEQ ID NO: 729876 - DNA, 25 bp, Mus musculus
gtgtacgactgcacggccagcatct

SEQ ID NO: 729877 - DNA, 25 bp, Mus musculus
gtgtacgactgctcggccagcatct

SEQ ID NO: 729878 - DNA, 25 bp, Mus musculus
gtgtacgccttgacttaattcaaga

SEQ ID NO: 729879 - DNA, 25 bp, Mus musculus
gtgtacgccttgtcttaattcaaga

SEQ ID NO: 729880 - DNA, 25 bp, Mus musculus
gtgtactatcggaagccactgctag

SEQ ID NO: 729881 - DNA, 25 bp, Mus musculus
gtgtactatcggtagccactgctag

SEQ ID NO: 729882 - DNA, 25 bp, Mus musculus
gtgtactcccgcctggtgctctgta

SEQ ID NO: 729883 - DNA, 25 bp, Mus musculus
gtgtactcccgcgtggtgctctgta

SEQ ID NO: 729884 - DNA, 25 bp, Mus musculus
gtgtactgaggtcgcccagctccac

SEQ ID NO: 729885 - DNA, 25 bp, Mus musculus
gtgtactgaggtggcccagctccac

SEQ ID NO: 729886 - DNA, 25 bp, Mus musculus
gtgtacttaaacagaagttggcttg

SEQ ID NO: 729887 - DNA, 25 bp, Mus musculus
gtgtacttaaactgaagttggcttg

SEQ ID NO: 729888 - DNA, 25 bp, Mus musculus
gtgtacttcggtcccctgacctgct

SEQ ID NO: 729889 - DNA, 25 bp, Mus musculus
gtgtacttcggtgccctgacctgct

SEQ ID NO: 729890 - DNA, 25 bp, Mus musculus
gtgtacttggctaaaagtctggcag

SEQ ID NO: 729891 - DNA, 25 bp, Mus musculus
gtgtacttggcttaaagtctggcag

SEQ ID NO: 729892 - DNA, 25 bp, Mus musculus
gtgtagaaccgtccgtgaggccacc

SEQ ID NO: 729893 - DNA, 25 bp, Mus musculus
gtgtagaaccgtgcgtgaggccacc

SEQ ID NO: 729894 - DNA, 25 bp, Mus musculus
gtgtagacaatgacaacctccattg

SEQ ID NO: 729895 - DNA, 25 bp, Mus musculus
gtgtagacaatgtcaacctccattg

SEQ ID NO: 729896 - DNA, 25 bp, Mus musculus
gtgtagagattcacaagaaatgtgg

SEQ ID NO: 729897 - DNA, 25 bp, Mus musculus
gtgtagagattctcaagaaatgtgg

SEQ ID NO: 729898 - DNA, 25 bp, Mus musculus
gtgtagatggcccagatggaatacc

SEQ ID NO: 729899 - DNA, 25 bp, Mus musculus
gtgtagatggccgagatggaatacc

SEQ ID NO: 729900 - DNA, 25 bp, Mus musculus
gtgtagcagccaatgaagattcata

SEQ ID NO: 729901 - DNA, 25 bp, Mus musculus
gtgtagcagccattgaagattcata

SEQ ID NO: 729902 - DNA, 25 bp, Mus musculus
gtgtagccgaggagccctaccgagt

SEQ ID NO: 729903 - DNA, 25 bp, Mus musculus
gtgtagccgaggtgccctaccgagt

SEQ ID NO: 729904 - DNA, 25 bp, Mus musculus
gtgtagccgtccacggagcaaggaa

SEQ ID NO: 729905 - DNA, 25 bp, Mus musculus
gtgtagccgtcctcggagcaaggaa

SEQ ID NO: 729906 - DNA, 25 bp, Mus musculus
gtgtagcctgcacccgacagctcat

SEQ ID NO: 729907 - DNA, 25 bp, Mus musculus
gtgtagcctgcagccgacagctcat

SEQ ID NO: 729908 - DNA, 25 bp, Mus musculus
gtgtagcgccctagggtacttggaa

SEQ ID NO: 729909 - DNA, 25 bp, Mus musculus
gtgtagcgcccttgggtacttggaa

SEQ ID NO: 729910 - DNA, 25 bp, Mus musculus
gtgtagctgtttaacctcatcaggg

SEQ ID NO: 729911 - DNA, 25 bp, Mus musculus
gtgtagctgttttacctcatcaggg

SEQ ID NO: 729912 - DNA, 25 bp, Mus musculus
gtgtataaagtgaccctcccaagct

SEQ ID NO: 729913 - DNA, 25 bp, Mus musculus
gtgtataaagtgtccctcccaagct

SEQ ID NO: 729914 - DNA, 25 bp, Mus musculus
gtgtatacagcacaagcccctgtac

SEQ ID NO: 729915 - DNA, 25 bp, Mus musculus
gtgtatacagcagaagcccctgtac

SEQ ID NO: 729916 - DNA, 25 bp, Mus musculus
gtgtatatgagccagccagccccag

SEQ ID NO: 729917 - DNA, 25 bp, Mus musculus
gtgtatatgagcgagccagccccag

SEQ ID NO: 729918 - DNA, 25 bp, Mus musculus
gtgtatcacctcatttccgtcatga

SEQ ID NO: 729919 - DNA, 25 bp, Mus musculus
gtgtatcacctcttttccgtcatga

SEQ ID NO: 729920 - DNA, 25 bp, Mus musculus
gtgtatcagcataagaaaaccaccc

SEQ ID NO: 729921 - DNA, 25 bp, Mus musculus
gtgtatcagcattagaaaaccaccc

SEQ ID NO: 729922 - DNA, 25 bp, Mus musculus
gtgtatcccctgatggccagcagtg

SEQ ID NO: 729923 - DNA, 25 bp, Mus musculus
gtgtatcccctgttggccagcagtg

SEQ ID NO: 729924 - DNA, 25 bp, Mus musculus
gtgtatccctccaatgcaaactgtg

SEQ ID NO: 729925 - DNA, 25 bp, Mus musculus
gtgtatccctcctatgcaaactgtg

SEQ ID NO: 729926 - DNA, 25 bp, Mus musculus
gtgtatcgtcccagctggtcccctt

SEQ ID NO: 729927 - DNA, 25 bp, Mus musculus
gtgtatcgtccctgctggtcccctt

SEQ ID NO: 729928 - DNA, 25 bp, Mus musculus
gtgtatcgtgatctctttgggaccc

SEQ ID NO: 729929 - DNA, 25 bp, Mus musculus
gtgtatcgtgatgtctttgggaccc

SEQ ID NO: 729930 - DNA, 25 bp, Mus musculus
gtgtatctggcaaacttggcctggg

SEQ ID NO: 729931 - DNA, 25 bp, Mus musculus
gtgtatctggcatacttggcctggg

SEQ ID NO: 729932 - DNA, 25 bp, Mus musculus
gtgtatgagggtcctcagagtccct

SEQ ID NO: 729933 - DNA, 25 bp, Mus musculus
gtgtatgagggtgctcagagtccct

SEQ ID NO: 729934 - DNA, 25 bp, Mus musculus
gtgtatgatgttcctccttctgtga

SEQ ID NO: 729935 - DNA, 25 bp, Mus musculus
gtgtatgatgttgctccttctgtga

SEQ ID NO: 729936 - DNA, 25 bp, Mus musculus
gtgtatgcccagctgtgcccagcac

SEQ ID NO: 729937 - DNA, 25 bp, Mus musculus
gtgtatgcccaggtgtgcccagcac

SEQ ID NO: 729938 - DNA, 25 bp, Mus musculus
gtgtatgcccgccacaaaacactgg

SEQ ID NO: 729939 - DNA, 25 bp, Mus musculus
gtgtatgcccgcgacaaaacactgg

SEQ ID NO: 729940 - DNA, 25 bp, Mus musculus
gtgtattcagccagcagctttactt

SEQ ID NO: 729941 - DNA, 25 bp, Mus musculus
gtgtattcagcctgcagctttactt

SEQ ID NO: 729942 - DNA, 25 bp, Mus musculus
gtgtattcctacaagcaagtgggag

SEQ ID NO: 729943 - DNA, 25 bp, Mus musculus
gtgtattcctactagcaagtgggag

SEQ ID NO: 729944 - DNA, 25 bp, Mus musculus
gtgtcaaaatagaagctcccagagg

SEQ ID NO: 729945 - DNA, 25 bp, Mus musculus
gtgtcaaaatagtagctcccagagg

SEQ ID NO: 729946 - DNA, 25 bp, Mus musculus
gtgtcaaacgctaccgccagagcat

SEQ ID NO: 729947 - DNA, 25 bp, Mus musculus
gtgtcaaacgcttccgccagagcat

SEQ ID NO: 729948 - DNA, 25 bp, Mus musculus
gtgtcaaagtcgcagatctgttgtt

SEQ ID NO: 729949 - DNA, 25 bp, Mus musculus
gtgtcaaagtcggagatctgttgtt

SEQ ID NO: 729950 - DNA, 25 bp, Mus musculus
gtgtcaaatcagacacttttatcag

SEQ ID NO: 729951 - DNA, 25 bp, Mus musculus
gtgtcaaatcagtcacttttatcag

SEQ ID NO: 729952 - DNA, 25 bp, Mus musculus
gtgtcaacagttactacccaacgcc

SEQ ID NO: 729953 - DNA, 25 bp, Mus musculus
gtgtcaacagtttctacccaacgcc

SEQ ID NO: 729954 - DNA, 25 bp, Mus musculus
gtgtcaacccggcagcctcaatgga

SEQ ID NO: 729955 - DNA, 25 bp, Mus musculus
gtgtcaacccgggagcctcaatgga

SEQ ID NO: 729956 - DNA, 25 bp, Mus musculus
gtgtcaacgccccaggaacattcta

SEQ ID NO: 729957 - DNA, 25 bp, Mus musculus
gtgtcaacgcccgaggaacattcta

SEQ ID NO: 729958 - DNA, 25 bp, Mus musculus
gtgtcaacgtgcctgggagctacca

SEQ ID NO: 729959 - DNA, 25 bp, Mus musculus
gtgtcaacgtgcgtgggagctacca

SEQ ID NO: 729960 - DNA, 25 bp, Mus musculus
gtgtcaagaccactgctttaaagag

SEQ ID NO: 729961 - DNA, 25 bp, Mus musculus
gtgtcaagaccagtgctttaaagag

SEQ ID NO: 729962 - DNA, 25 bp, Mus musculus
gtgtcaagctgaccttttctacaag

SEQ ID NO: 729963 - DNA, 25 bp, Mus musculus
gtgtcaagctgagcttttctacaag

SEQ ID NO: 729964 - DNA, 25 bp, Mus musculus
gtgtcaagtaaaagaccatgaagac

SEQ ID NO: 729965 - DNA, 25 bp, Mus musculus
gtgtcaagtaaatgaccatgaagac

SEQ ID NO: 729966 - DNA, 25 bp, Mus musculus
gtgtcaagtactcgcctgatgagta

SEQ ID NO: 729967 - DNA, 25 bp, Mus musculus
gtgtcaagtactggcctgatgagta

SEQ ID NO: 729968 - DNA, 25 bp, Mus musculus
gtgtcaagtaggagctgcgtgtctt

SEQ ID NO: 729969 - DNA, 25 bp, Mus musculus
gtgtcaagtaggtgctgcgtgtctt

SEQ ID NO: 729970 - DNA, 25 bp, Mus musculus
gtgtcacaaccgatgacctgaaaag

SEQ ID NO: 729971 - DNA, 25 bp, Mus musculus
gtgtcacaaccgttgacctgaaaag

SEQ ID NO: 729972 - DNA, 25 bp, Mus musculus
gtgtcacaagcacaagcccttcctg

SEQ ID NO: 729973 - DNA, 25 bp, Mus musculus
gtgtcacaagcagaagcccttcctg

SEQ ID NO: 729974 - DNA, 25 bp, Mus musculus
gtgtcaccgcccagcagtgcacgga

SEQ ID NO: 729975 - DNA, 25 bp, Mus musculus
gtgtcaccgccctgcagtgcacgga

SEQ ID NO: 729976 - DNA, 25 bp, Mus musculus
gtgtcacctcttcaactcccatggg

SEQ ID NO: 729977 - DNA, 25 bp, Mus musculus
gtgtcacctcttgaactcccatggg

SEQ ID NO: 729978 - DNA, 25 bp, Mus musculus
gtgtcacctggcaactccattcaca

SEQ ID NO: 729979 - DNA, 25 bp, Mus musculus
gtgtcacctggctactccattcaca

SEQ ID NO: 729980 - DNA, 25 bp, Mus musculus
gtgtcactcacgacactaccttcag

SEQ ID NO: 729981 - DNA, 25 bp, Mus musculus
gtgtcactcacgtcactaccttcag

SEQ ID NO: 729982 - DNA, 25 bp, Mus musculus
gtgtcactctgtcttataaagaaag

SEQ ID NO: 729983 - DNA, 25 bp, Mus musculus
gtgtcactctgtgttataaagaaag

SEQ ID NO: 729984 - DNA, 25 bp, Mus musculus
gtgtcacttgtacccacgacgttct

SEQ ID NO: 729985 - DNA, 25 bp, Mus musculus
gtgtcacttgtagccacgacgttct

SEQ ID NO: 729986 - DNA, 25 bp, Mus musculus
gtgtcagaacttcgcccaatagtcc

SEQ ID NO: 729987 - DNA, 25 bp, Mus musculus
gtgtcagaacttggcccaatagtcc

SEQ ID NO: 729988 - DNA, 25 bp, Mus musculus
gtgtcagaattaagccaaggaggtg

SEQ ID NO: 729989 - DNA, 25 bp, Mus musculus
gtgtcagaattatgccaaggaggtg

SEQ ID NO: 729990 - DNA, 25 bp, Mus musculus
gtgtcagacgtgctgaactcagtga

SEQ ID NO: 729991 - DNA, 25 bp, Mus musculus
gtgtcagacgtggtgaactcagtga

SEQ ID NO: 729992 - DNA, 25 bp, Mus musculus
gtgtcagatgtcactgtcactcatc

SEQ ID NO: 729993 - DNA, 25 bp, Mus musculus
gtgtcagatgtctctgtcactcatc

SEQ ID NO: 729994 - DNA, 25 bp, Mus musculus
gtgtcagcaccaataccgccaatgt

SEQ ID NO: 729995 - DNA, 25 bp, Mus musculus
gtgtcagcaccattaccgccaatgt

SEQ ID NO: 729996 - DNA, 25 bp, Mus musculus
gtgtcagcaggaacctagcccactg

SEQ ID NO: 729997 - DNA, 25 bp, Mus musculus
gtgtcagcaggatcctagcccactg

SEQ ID NO: 729998 - DNA, 25 bp, Mus musculus
gtgtcagcctggagggctctgcacc

SEQ ID NO: 729999 - DNA, 25 bp, Mus musculus
gtgtcagcctggtgggctctgcacc

SEQ ID NO: 730000 - DNA, 25 bp, Mus musculus
gtgtcagcgtgcagtccataaagtg

SEQ ID NO: 730001 - DNA, 25 bp, Mus musculus
gtgtcagcgtgctgtccataaagtg

SEQ ID NO: 730002 - DNA, 25 bp, Mus musculus
gtgtcagctgacaccagtgcatcca

SEQ ID NO: 730003 - DNA, 25 bp, Mus musculus
gtgtcagctgactccagtgcatcca

SEQ ID NO: 730004 - DNA, 25 bp, Mus musculus
gtgtcagctggcaacgtccatgtga

SEQ ID NO: 730005 - DNA, 25 bp, Mus musculus
gtgtcagctggctacgtccatgtga

SEQ ID NO: 730006 - DNA, 25 bp, Mus musculus
gtgtcagggacaaggacgccaaccc

SEQ ID NO: 730007 - DNA, 25 bp, Mus musculus
gtgtcagggacatggacgccaaccc

SEQ ID NO: 730008 - DNA, 25 bp, Mus musculus
gtgtcaggtgttcagtgaactcacc

SEQ ID NO: 730009 - DNA, 25 bp, Mus musculus
gtgtcaggtgttgagtgaactcacc

SEQ ID NO: 730010 - DNA, 25 bp, Mus musculus
gtgtcagtactgacggctcaagaag

SEQ ID NO: 730011 - DNA, 25 bp, Mus musculus
gtgtcagtactgtcggctcaagaag

SEQ ID NO: 730012 - DNA, 25 bp, Mus musculus
gtgtcagtggagcttgccttgcccc

SEQ ID NO: 730013 - DNA, 25 bp, Mus musculus
gtgtcagtggaggttgccttgcccc

SEQ ID NO: 730014 - DNA, 25 bp, Mus musculus
gtgtcataagcccaataagtatttt

SEQ ID NO: 730015 - DNA, 25 bp, Mus musculus
gtgtcataagccgaataagtatttt

SEQ ID NO: 730016 - DNA, 25 bp, Mus musculus
gtgtcatatcatctgcctgccaagg

SEQ ID NO: 730017 - DNA, 25 bp, Mus musculus
gtgtcatatcatgtgcctgccaagg

SEQ ID NO: 730018 - DNA, 25 bp, Mus musculus
gtgtcatccgcaagctgaagaaata

SEQ ID NO: 730019 - DNA, 25 bp, Mus musculus
gtgtcatccgcatgctgaagaaata

SEQ ID NO: 730020 - DNA, 25 bp, Mus musculus
gtgtcatcgacaaggatgcactggg

SEQ ID NO: 730021 - DNA, 25 bp, Mus musculus
gtgtcatcgacatggatgcactggg

SEQ ID NO: 730022 - DNA, 25 bp, Mus musculus
gtgtcatgatgcaacaacttttgga

SEQ ID NO: 730023 - DNA, 25 bp, Mus musculus
gtgtcatgatgctacaacttttgga

SEQ ID NO: 730024 - DNA, 25 bp, Mus musculus
gtgtcatggtccatagacatgaggg

SEQ ID NO: 730025 - DNA, 25 bp, Mus musculus
gtgtcatggtccttagacatgaggg

SEQ ID NO: 730026 - DNA, 25 bp, Mus musculus
gtgtcatttgtcacagagaacagcg

SEQ ID NO: 730027 - DNA, 25 bp, Mus musculus
gtgtcatttgtctcagagaacagcg

SEQ ID NO: 730028 - DNA, 25 bp, Mus musculus
gtgtccaaatccaaccaggcctcag

SEQ ID NO: 730029 - DNA, 25 bp, Mus musculus
gtgtccaaatcctaccaggcctcag

SEQ ID NO: 730030 - DNA, 25 bp, Mus musculus
gtgtccaacttgcatcgtggcagtc

SEQ ID NO: 730031 - DNA, 25 bp, Mus musculus
gtgtccaacttggatcgtggcagtc

SEQ ID NO: 730032 - DNA, 25 bp, Mus musculus
gtgtccaataacaaccaaattggtt

SEQ ID NO: 730033 - DNA, 25 bp, Mus musculus
gtgtccaataactaccaaattggtt

SEQ ID NO: 730034 - DNA, 25 bp, Mus musculus
gtgtccacaaagagcaaaagagggc

SEQ ID NO: 730035 - DNA, 25 bp, Mus musculus
gtgtccacaaagtgcaaaagagggc

SEQ ID NO: 730036 - DNA, 25 bp, Mus musculus
gtgtccactcccctagcctatagtt

SEQ ID NO: 730037 - DNA, 25 bp, Mus musculus
gtgtccactcccgtagcctatagtt

SEQ ID NO: 730038 - DNA, 25 bp, Mus musculus
gtgtccagccctaaagaaccaccag

SEQ ID NO: 730039 - DNA, 25 bp, Mus musculus
gtgtccagcccttaagaaccaccag

SEQ ID NO: 730040 - DNA, 25 bp, Mus musculus
gtgtccagctacaacgccctgagag

SEQ ID NO: 730041 - DNA, 25 bp, Mus musculus
gtgtccagctactacgccctgagag

SEQ ID NO: 730042 - DNA, 25 bp, Mus musculus
gtgtccaggcacaaagaaacaaaac

SEQ ID NO: 730043 - DNA, 25 bp, Mus musculus
gtgtccaggcactaagaaacaaaac

SEQ ID NO: 730044 - DNA, 25 bp, Mus musculus
gtgtccatccagacgggctacctca

SEQ ID NO: 730045 - DNA, 25 bp, Mus musculus
gtgtccatccagtcgggctacctca

SEQ ID NO: 730046 - DNA, 25 bp, Mus musculus
gtgtccatgaaacagctcaacaaga

SEQ ID NO: 730047 - DNA, 25 bp, Mus musculus
gtgtccatgaaagagctcaacaaga

SEQ ID NO: 730048 - DNA, 25 bp, Mus musculus
gtgtccattttgcaccggcgcagcc

SEQ ID NO: 730049 - DNA, 25 bp, Mus musculus
gtgtccattttggaccggcgcagcc

SEQ ID NO: 730050 - DNA, 25 bp, Mus musculus
gtgtcccaatgtcgctctgacccaa

SEQ ID NO: 730051 - DNA, 25 bp, Mus musculus
gtgtcccaatgtggctctgacccaa

SEQ ID NO: 730052 - DNA, 25 bp, Mus musculus
gtgtcccagctcactcattcagtgc

SEQ ID NO: 730053 - DNA, 25 bp, Mus musculus
gtgtcccagctctctcattcagtgc

SEQ ID NO: 730054 - DNA, 25 bp, Mus musculus
gtgtccccacctcgtgctcttagga

SEQ ID NO: 730055 - DNA, 25 bp, Mus musculus
gtgtccccacctggtgctcttagga

SEQ ID NO: 730056 - DNA, 25 bp, Mus musculus
gtgtccctcatgaacagcacgcagc

SEQ ID NO: 730057 - DNA, 25 bp, Mus musculus
gtgtccctcatgtacagcacgcagc

SEQ ID NO: 730058 - DNA, 25 bp, Mus musculus
gtgtccctgaataggatcttcactg

SEQ ID NO: 730059 - DNA, 25 bp, Mus musculus
gtgtccctgaattggatcttcactg

SEQ ID NO: 730060 - DNA, 25 bp, Mus musculus
gtgtccctgtctatgccaacatgag

SEQ ID NO: 730061 - DNA, 25 bp, Mus musculus
gtgtccctgtctttgccaacatgag

SEQ ID NO: 730062 - DNA, 25 bp, Mus musculus
gtgtccgaacagaggagagtcacag

SEQ ID NO: 730063 - DNA, 25 bp, Mus musculus
gtgtccgaacagtggagagtcacag

SEQ ID NO: 730064 - DNA, 25 bp, Mus musculus
gtgtccgatatgatgagccgttagg

SEQ ID NO: 730065 - DNA, 25 bp, Mus musculus
gtgtccgatatgttgagccgttagg

SEQ ID NO: 730066 - DNA, 25 bp, Mus musculus
gtgtccgcctacagtttccagcagg

SEQ ID NO: 730067 - DNA, 25 bp, Mus musculus
gtgtccgcctactgtttccagcagg

SEQ ID NO: 730068 - DNA, 25 bp, Mus musculus
gtgtccgcctgaacctggtgcggaa

SEQ ID NO: 730069 - DNA, 25 bp, Mus musculus
gtgtccgcctgatcctggtgcggaa

SEQ ID NO: 730070 - DNA, 25 bp, Mus musculus
gtgtccgggcctcatccaaagccgg

SEQ ID NO: 730071 - DNA, 25 bp, Mus musculus
gtgtccgggcctgatccaaagccgg

SEQ ID NO: 730072 - DNA, 25 bp, Mus musculus
gtgtcctacaagaacctctccgagg

SEQ ID NO: 730073 - DNA, 25 bp, Mus musculus
gtgtcctacaagtacctctccgagg

SEQ ID NO: 730074 - DNA, 25 bp, Mus musculus
gtgtcctccgctcccgagagaaagt

SEQ ID NO: 730075 - DNA, 25 bp, Mus musculus
gtgtcctccgctgccgagagaaagt

SEQ ID NO: 730076 - DNA, 25 bp, Mus musculus
gtgtcctctcctaccggcgatttcg

SEQ ID NO: 730077 - DNA, 25 bp, Mus musculus
gtgtcctctccttccggcgatttcg

SEQ ID NO: 730078 - DNA, 25 bp, Mus musculus
gtgtcctgagtgcacggccatcgac

SEQ ID NO: 730079 - DNA, 25 bp, Mus musculus
gtgtcctgagtggacggccatcgac

SEQ ID NO: 730080 - DNA, 25 bp, Mus musculus
gtgtcctgcctgcacatgcctgtct

SEQ ID NO: 730081 - DNA, 25 bp, Mus musculus
gtgtcctgcctggacatgcctgtct

SEQ ID NO: 730082 - DNA, 25 bp, Mus musculus
gtgtcctggagtctctgtatattga

SEQ ID NO: 730083 - DNA, 25 bp, Mus musculus
gtgtcctggagtgtctgtatattga

SEQ ID NO: 730084 - DNA, 25 bp, Mus musculus
gtgtcctggctgaatgcactcactg

SEQ ID NO: 730085 - DNA, 25 bp, Mus musculus
gtgtcctggctgtatgcactcactg

SEQ ID NO: 730086 - DNA, 25 bp, Mus musculus
gtgtcctgggctagaacagtatgct

SEQ ID NO: 730087 - DNA, 25 bp, Mus musculus
gtgtcctgggcttgaacagtatgct

SEQ ID NO: 730088 - DNA, 25 bp, Mus musculus
gtgtcctgtccaaggcgaacgcagg

SEQ ID NO: 730089 - DNA, 25 bp, Mus musculus
gtgtcctgtccatggcgaacgcagg

SEQ ID NO: 730090 - DNA, 25 bp, Mus musculus
gtgtcctgtctcatgttaactaatg

SEQ ID NO: 730091 - DNA, 25 bp, Mus musculus
gtgtcctgtctcttgttaactaatg

SEQ ID NO: 730092 - DNA, 25 bp, Mus musculus
gtgtccttcaccatcaagcccaagg

SEQ ID NO: 730093 - DNA, 25 bp, Mus musculus
gtgtccttcaccttcaagcccaagg

SEQ ID NO: 730094 - DNA, 25 bp, Mus musculus
gtgtccttcacgcaacaaccagcga

SEQ ID NO: 730095 - DNA, 25 bp, Mus musculus
gtgtccttcacggaacaaccagcga

SEQ ID NO: 730096 - DNA, 25 bp, Mus musculus
gtgtccttccagcagtcaagcactg

SEQ ID NO: 730097 - DNA, 25 bp, Mus musculus
gtgtccttccaggagtcaagcactg

SEQ ID NO: 730098 - DNA, 25 bp, Mus musculus
gtgtccttgctgctcatgacaaccg

SEQ ID NO: 730099 - DNA, 25 bp, Mus musculus
gtgtccttgctggtcatgacaaccg

SEQ ID NO: 730100 - DNA, 25 bp, Mus musculus
gtgtccttggaaactaactcctcta

SEQ ID NO: 730101 - DNA, 25 bp, Mus musculus
gtgtccttggaatctaactcctcta

SEQ ID NO: 730102 - DNA, 25 bp, Mus musculus
gtgtccttggccctcactgttcccc

SEQ ID NO: 730103 - DNA, 25 bp, Mus musculus
gtgtccttggccgtcactgttcccc

SEQ ID NO: 730104 - DNA, 25 bp, Mus musculus
gtgtcctttagcatccttgtttcca

SEQ ID NO: 730105 - DNA, 25 bp, Mus musculus
gtgtcctttagcttccttgtttcca

SEQ ID NO: 730106 - DNA, 25 bp, Mus musculus
gtgtcctttcagatagctccttggg

SEQ ID NO: 730107 - DNA, 25 bp, Mus musculus
gtgtcctttcagttagctccttggg

SEQ ID NO: 730108 - DNA, 25 bp, Mus musculus
gtgtcgacatcgcagctttcaacaa

SEQ ID NO: 730109 - DNA, 25 bp, Mus musculus
gtgtcgacatcggagctttcaacaa

SEQ ID NO: 730110 - DNA, 25 bp, Mus musculus
gtgtcgaggtccagcatcagtacga

SEQ ID NO: 730111 - DNA, 25 bp, Mus musculus
gtgtcgaggtcctgcatcagtacga

SEQ ID NO: 730112 - DNA, 25 bp, Mus musculus
gtgtcgcactcaccggctatgacca

SEQ ID NO: 730113 - DNA, 25 bp, Mus musculus
gtgtcgcactcagcggctatgacca

SEQ ID NO: 730114 - DNA, 25 bp, Mus musculus
gtgtcgcagatcctgagcaccatgg

SEQ ID NO: 730115 - DNA, 25 bp, Mus musculus
gtgtcgcagatcgtgagcaccatgg

SEQ ID NO: 730116 - DNA, 25 bp, Mus musculus
gtgtcgccgccacaggtacctagct

SEQ ID NO: 730117 - DNA, 25 bp, Mus musculus
gtgtcgccgccagaggtacctagct

SEQ ID NO: 730118 - DNA, 25 bp, Mus musculus
gtgtcgccttgaccgcttatgactt

SEQ ID NO: 730119 - DNA, 25 bp, Mus musculus
gtgtcgccttgagcgcttatgactt

SEQ ID NO: 730120 - DNA, 25 bp, Mus musculus
gtgtcgcggaacaggctgctccgca

SEQ ID NO: 730121 - DNA, 25 bp, Mus musculus
gtgtcgcggaactggctgctccgca

SEQ ID NO: 730122 - DNA, 25 bp, Mus musculus
gtgtcgcgggccagatccctgcgca

SEQ ID NO: 730123 - DNA, 25 bp, Mus musculus
gtgtcgcgggcctgatccctgcgca

SEQ ID NO: 730124 - DNA, 25 bp, Mus musculus
gtgtcgctaggcatgaactccggat

SEQ ID NO: 730125 - DNA, 25 bp, Mus musculus
gtgtcgctaggcttgaactccggat

SEQ ID NO: 730126 - DNA, 25 bp, Mus musculus
gtgtcgctggcaccctcagaagtca

SEQ ID NO: 730127 - DNA, 25 bp, Mus musculus
gtgtcgctggcagcctcagaagtca

SEQ ID NO: 730128 - DNA, 25 bp, Mus musculus
gtgtcggatgtcaatcaactcaagg

SEQ ID NO: 730129 - DNA, 25 bp, Mus musculus
gtgtcggatgtctatcaactcaagg

SEQ ID NO: 730130 - DNA, 25 bp, Mus musculus
gtgtcggcggcacaggaaacccttt

SEQ ID NO: 730131 - DNA, 25 bp, Mus musculus
gtgtcggcggcagaggaaacccttt

SEQ ID NO: 730132 - DNA, 25 bp, Mus musculus
gtgtcggtggagatagagaagcccc

SEQ ID NO: 730133 - DNA, 25 bp, Mus musculus
gtgtcggtggagttagagaagcccc

SEQ ID NO: 730134 - DNA, 25 bp, Mus musculus
gtgtcgtgtctgcagaaggaaacca

SEQ ID NO: 730135 - DNA, 25 bp, Mus musculus
gtgtcgtgtctggagaaggaaacca

SEQ ID NO: 730136 - DNA, 25 bp, Mus musculus
gtgtctaaatcacaccacacagaag

SEQ ID NO: 730137 - DNA, 25 bp, Mus musculus
gtgtctaaatcagaccacacagaag

SEQ ID NO: 730138 - DNA, 25 bp, Mus musculus
gtgtctaactaaccgcctcgcttct

SEQ ID NO: 730139 - DNA, 25 bp, Mus musculus
gtgtctaactaagcgcctcgcttct

SEQ ID NO: 730140 - DNA, 25 bp, Mus musculus
gtgtctaagcacaggatccgggccc

SEQ ID NO: 730141 - DNA, 25 bp, Mus musculus
gtgtctaagcactggatccgggccc

SEQ ID NO: 730142 - DNA, 25 bp, Mus musculus
gtgtctaccagcagccttaacctca

SEQ ID NO: 730143 - DNA, 25 bp, Mus musculus
gtgtctaccagctgccttaacctca

SEQ ID NO: 730144 - DNA, 25 bp, Mus musculus
gtgtctactattaatcctggctaag

SEQ ID NO: 730145 - DNA, 25 bp, Mus musculus
gtgtctactatttatcctggctaag

SEQ ID NO: 730146 - DNA, 25 bp, Mus musculus
gtgtctaggctcctacgctgatgtg

SEQ ID NO: 730147 - DNA, 25 bp, Mus musculus
gtgtctaggctcgtacgctgatgtg

SEQ ID NO: 730148 - DNA, 25 bp, Mus musculus
gtgtctatgtccaagccggtgccgt

SEQ ID NO: 730149 - DNA, 25 bp, Mus musculus
gtgtctatgtcctagccggtgccgt

SEQ ID NO: 730150 - DNA, 25 bp, Mus musculus
gtgtctcaagcaaaaccatgaggag

SEQ ID NO: 730151 - DNA, 25 bp, Mus musculus
gtgtctcaagcataaccatgaggag

SEQ ID NO: 730152 - DNA, 25 bp, Mus musculus
gtgtctcatcttagcacctctctca

SEQ ID NO: 730153 - DNA, 25 bp, Mus musculus
gtgtctcatctttgcacctctctca

SEQ ID NO: 730154 - DNA, 25 bp, Mus musculus
gtgtctcatgcgcattattcttcca

SEQ ID NO: 730155 - DNA, 25 bp, Mus musculus
gtgtctcatgcggattattcttcca

SEQ ID NO: 730156 - DNA, 25 bp, Mus musculus
gtgtctccaagaattgcttccaaag

SEQ ID NO: 730157 - DNA, 25 bp, Mus musculus
gtgtctccaagatttgcttccaaag

SEQ ID NO: 730158 - DNA, 25 bp, Mus musculus
gtgtctccaaggatgcccagttggc

SEQ ID NO: 730159 - DNA, 25 bp, Mus musculus
gtgtctccaaggttgcccagttggc

SEQ ID NO: 730160 - DNA, 25 bp, Mus musculus
gtgtctccagctcctctcaaaagga

SEQ ID NO: 730161 - DNA, 25 bp, Mus musculus
gtgtctccagctgctctcaaaagga

SEQ ID NO: 730162 - DNA, 25 bp, Mus musculus
gtgtctccccaccagactgtgagct

SEQ ID NO: 730163 - DNA, 25 bp, Mus musculus
gtgtctccccacgagactgtgagct

SEQ ID NO: 730164 - DNA, 25 bp, Mus musculus
gtgtctcctagaaccaggccttcaa

SEQ ID NO: 730165 - DNA, 25 bp, Mus musculus
gtgtctcctagatccaggccttcaa

SEQ ID NO: 730166 - DNA, 25 bp, Mus musculus
gtgtctcctcacaattgtcgccctg

SEQ ID NO: 730167 - DNA, 25 bp, Mus musculus
gtgtctcctcactattgtcgccctg

SEQ ID NO: 730168 - DNA, 25 bp, Mus musculus
gtgtctcctgacagagctgaccctg

SEQ ID NO: 730169 - DNA, 25 bp, Mus musculus
gtgtctcctgactgagctgaccctg

SEQ ID NO: 730170 - DNA, 25 bp, Mus musculus
gtgtctcggacaaacaaccccttgc

SEQ ID NO: 730171 - DNA, 25 bp, Mus musculus
gtgtctcggacatacaaccccttgc

SEQ ID NO: 730172 - DNA, 25 bp, Mus musculus
gtgtctctaactacctgaaggactt

SEQ ID NO: 730173 - DNA, 25 bp, Mus musculus
gtgtctctaacttcctgaaggactt

SEQ ID NO: 730174 - DNA, 25 bp, Mus musculus
gtgtctctaagcacatctggtttag

SEQ ID NO: 730175 - DNA, 25 bp, Mus musculus
gtgtctctaagctcatctggtttag

SEQ ID NO: 730176 - DNA, 25 bp, Mus musculus
gtgtctctatcaagggcagcgaccc

SEQ ID NO: 730177 - DNA, 25 bp, Mus musculus
gtgtctctatcatgggcagcgaccc

SEQ ID NO: 730178 - DNA, 25 bp, Mus musculus
gtgtctctcgtactgcaggcttcga

SEQ ID NO: 730179 - DNA, 25 bp, Mus musculus
gtgtctctcgtagtgcaggcttcga

SEQ ID NO: 730180 - DNA, 25 bp, Mus musculus
gtgtctctctttcggaatcgtcggc

SEQ ID NO: 730181 - DNA, 25 bp, Mus musculus
gtgtctctctttgggaatcgtcggc

SEQ ID NO: 730182 - DNA, 25 bp, Mus musculus
gtgtctcttcgtaggcctcatctcc

SEQ ID NO: 730183 - DNA, 25 bp, Mus musculus
gtgtctcttcgttggcctcatctcc

SEQ ID NO: 730184 - DNA, 25 bp, Mus musculus
gtgtctgagtgcagctgaagaaaag

SEQ ID NO: 730185 - DNA, 25 bp, Mus musculus
gtgtctgagtgctgctgaagaaaag

SEQ ID NO: 730186 - DNA, 25 bp, Mus musculus
gtgtctgagttccacgcccaggtgc

SEQ ID NO: 730187 - DNA, 25 bp, Mus musculus
gtgtctgagttcgacgcccaggtgc

SEQ ID NO: 730188 - DNA, 25 bp, Mus musculus
gtgtctgcgagacctgctgctcctc

SEQ ID NO: 730189 - DNA, 25 bp, Mus musculus
gtgtctgcgagagctgctgctcctc

SEQ ID NO: 730190 - DNA, 25 bp, Mus musculus
gtgtctgctcagacgcctccaactt

SEQ ID NO: 730191 - DNA, 25 bp, Mus musculus
gtgtctgctcagtcgcctccaactt

SEQ ID NO: 730192 - DNA, 25 bp, Mus musculus
gtgtctgctctgaatggtgcccaca

SEQ ID NO: 730193 - DNA, 25 bp, Mus musculus
gtgtctgctctgtatggtgcccaca

SEQ ID NO: 730194 - DNA, 25 bp, Mus musculus
gtgtctggcctgaaacatctctgga

SEQ ID NO: 730195 - DNA, 25 bp, Mus musculus
gtgtctggcctgtaacatctctgga

SEQ ID NO: 730196 - DNA, 25 bp, Mus musculus
gtgtctggtgctctcctccaggacc

SEQ ID NO: 730197 - DNA, 25 bp, Mus musculus
gtgtctggtgctgtcctccaggacc

SEQ ID NO: 730198 - DNA, 25 bp, Mus musculus
gtgtctgtggctaccctgggactaa

SEQ ID NO: 730199 - DNA, 25 bp, Mus musculus
gtgtctgtggcttccctgggactaa

SEQ ID NO: 730200 - DNA, 25 bp, Mus musculus
gtgtctgttacacccagcttgaggg

SEQ ID NO: 730201 - DNA, 25 bp, Mus musculus
gtgtctgttacagccagcttgaggg

SEQ ID NO: 730202 - DNA, 25 bp, Mus musculus
gtgtcttagctgcacacgacaaccg

SEQ ID NO: 730203 - DNA, 25 bp, Mus musculus
gtgtcttagctggacacgacaaccg

SEQ ID NO: 730204 - DNA, 25 bp, Mus musculus
gtgtcttcagcacttaccctcatga

SEQ ID NO: 730205 - DNA, 25 bp, Mus musculus
gtgtcttcagcagttaccctcatga

SEQ ID NO: 730206 - DNA, 25 bp, Mus musculus
gtgtcttcatgaagtgcatcccacc

SEQ ID NO: 730207 - DNA, 25 bp, Mus musculus
gtgtcttcatgatgtgcatcccacc

SEQ ID NO: 730208 - DNA, 25 bp, Mus musculus
gtgtcttccacaaaccaatgcactg

SEQ ID NO: 730209 - DNA, 25 bp, Mus musculus
gtgtcttccacataccaatgcactg

SEQ ID NO: 730210 - DNA, 25 bp, Mus musculus
gtgtcttctacaatgccacgagcag

SEQ ID NO: 730211 - DNA, 25 bp, Mus musculus
gtgtcttctacattgccacgagcag

SEQ ID NO: 730212 - DNA, 25 bp, Mus musculus
gtgtcttgagctcctctttcggacc

SEQ ID NO: 730213 - DNA, 25 bp, Mus musculus
gtgtcttgagctgctctttcggacc

SEQ ID NO: 730214 - DNA, 25 bp, Mus musculus
gtgtcttgccttcctcactgtgaag

SEQ ID NO: 730215 - DNA, 25 bp, Mus musculus
gtgtcttgccttgctcactgtgaag

SEQ ID NO: 730216 - DNA, 25 bp, Mus musculus
gtgtctttcaaaatgaccccaactg

SEQ ID NO: 730217 - DNA, 25 bp, Mus musculus
gtgtctttcaaattgaccccaactg

SEQ ID NO: 730218 - DNA, 25 bp, Mus musculus
gtgtctttcccgcacttcagatact

SEQ ID NO: 730219 - DNA, 25 bp, Mus musculus
gtgtctttcccggacttcagatact

SEQ ID NO: 730220 - DNA, 25 bp, Mus musculus
gtgtgaaaataaaggtaccaaattc

SEQ ID NO: 730221 - DNA, 25 bp, Mus musculus
gtgtgaaaataatggtaccaaattc

SEQ ID NO: 730222 - DNA, 25 bp, Mus musculus
gtgtgaaactgcctggtccggatca

SEQ ID NO: 730223 - DNA, 25 bp, Mus musculus
gtgtgaaactgcgtggtccggatca

SEQ ID NO: 730224 - DNA, 25 bp, Mus musculus
gtgtgaacacaacaccacgggcccc

SEQ ID NO: 730225 - DNA, 25 bp, Mus musculus
gtgtgaacacaagaccacgggcccc

SEQ ID NO: 730226 - DNA, 25 bp, Mus musculus
gtgtgaacacagaaggctccttcca

SEQ ID NO: 730227 - DNA, 25 bp, Mus musculus
gtgtgaacacagtaggctccttcca

SEQ ID NO: 730228 - DNA, 25 bp, Mus musculus
gtgtgaacatggctacgcctcatcg

SEQ ID NO: 730229 - DNA, 25 bp, Mus musculus
gtgtgaacatgggtacgcctcatcg

SEQ ID NO: 730230 - DNA, 25 bp, Mus musculus
gtgtgaacccatagtgcctccacca

SEQ ID NO: 730231 - DNA, 25 bp, Mus musculus
gtgtgaacccattgtgcctccacca

SEQ ID NO: 730232 - DNA, 25 bp, Mus musculus
gtgtgaaccccaagaatgtgtcttt

SEQ ID NO: 730233 - DNA, 25 bp, Mus musculus
gtgtgaaccccatgaatgtgtcttt

SEQ ID NO: 730234 - DNA, 25 bp, Mus musculus
gtgtgaaccccgacgacagtaatga

SEQ ID NO: 730235 - DNA, 25 bp, Mus musculus
gtgtgaaccccgtcgacagtaatga

SEQ ID NO: 730236 - DNA, 25 bp, Mus musculus
gtgtgaacgacaacctcgcccaggg

SEQ ID NO: 730237 - DNA, 25 bp, Mus musculus
gtgtgaacgacatcctcgcccaggg

SEQ ID NO: 730238 - DNA, 25 bp, Mus musculus
gtgtgaactcttctgcacctgctcc

SEQ ID NO: 730239 - DNA, 25 bp, Mus musculus
gtgtgaactcttgtgcacctgctcc

SEQ ID NO: 730240 - DNA, 25 bp, Mus musculus
gtgtgaagatggcacttacagtcca

SEQ ID NO: 730241 - DNA, 25 bp, Mus musculus
gtgtgaagatgggacttacagtcca

SEQ ID NO: 730242 - DNA, 25 bp, Mus musculus
gtgtgaagcacaagtttactgacca

SEQ ID NO: 730243 - DNA, 25 bp, Mus musculus
gtgtgaagcacatgtttactgacca

SEQ ID NO: 730244 - DNA, 25 bp, Mus musculus
gtgtgaagccatcatcacccacttt

SEQ ID NO: 730245 - DNA, 25 bp, Mus musculus
gtgtgaagccatgatcacccacttt

SEQ ID NO: 730246 - DNA, 25 bp, Mus musculus
gtgtgacaacggcttttcaccacct

SEQ ID NO: 730247 - DNA, 25 bp, Mus musculus
gtgtgacaacgggttttcaccacct

SEQ ID NO: 730248 - DNA, 25 bp, Mus musculus
gtgtgacagccgagccaactgcatc

SEQ ID NO: 730249 - DNA, 25 bp, Mus musculus
gtgtgacagccgtgccaactgcatc

SEQ ID NO: 730250 - DNA, 25 bp, Mus musculus
gtgtgaccaaatcatccaagctgga

SEQ ID NO: 730251 - DNA, 25 bp, Mus musculus
gtgtgaccaaatgatccaagctgga

SEQ ID NO: 730252 - DNA, 25 bp, Mus musculus
gtgtgaccagtaccgcaccatcctg

SEQ ID NO: 730253 - DNA, 25 bp, Mus musculus
gtgtgaccagtagcgcaccatcctg

SEQ ID NO: 730254 - DNA, 25 bp, Mus musculus
gtgtgacccatgcttattaccgaga

SEQ ID NO: 730255 - DNA, 25 bp, Mus musculus
gtgtgacccatggttattaccgaga

SEQ ID NO: 730256 - DNA, 25 bp, Mus musculus
gtgtgacggtgcaggcgcgggtcat

SEQ ID NO: 730257 - DNA, 25 bp, Mus musculus
gtgtgacggtgctggcgcgggtcat

SEQ ID NO: 730258 - DNA, 25 bp, Mus musculus
gtgtgactctccatatcaacttatt

SEQ ID NO: 730259 - DNA, 25 bp, Mus musculus
gtgtgactctccttatcaacttatt

SEQ ID NO: 730260 - DNA, 25 bp, Mus musculus
gtgtgactgagcaagtaagagtgtc

SEQ ID NO: 730261 - DNA, 25 bp, Mus musculus
gtgtgactgagctagtaagagtgtc

SEQ ID NO: 730262 - DNA, 25 bp, Mus musculus
gtgtgactttgacgttgaataacca

SEQ ID NO: 730263 - DNA, 25 bp, Mus musculus
gtgtgactttgaggttgaataacca

SEQ ID NO: 730264 - DNA, 25 bp, Mus musculus
gtgtgagaaagtacgagtgcaccga

SEQ ID NO: 730265 - DNA, 25 bp, Mus musculus
gtgtgagaaagttcgagtgcaccga

SEQ ID NO: 730266 - DNA, 25 bp, Mus musculus
gtgtgagaacatagccggccacctg

SEQ ID NO: 730267 - DNA, 25 bp, Mus musculus
gtgtgagaacattgccggccacctg

SEQ ID NO: 730268 - DNA, 25 bp, Mus musculus
gtgtgagaacccacgtagctggtgt

SEQ ID NO: 730269 - DNA, 25 bp, Mus musculus
gtgtgagaaccctcgtagctggtgt

SEQ ID NO: 730270 - DNA, 25 bp, Mus musculus
gtgtgagaagctcgccgagatcatc

SEQ ID NO: 730271 - DNA, 25 bp, Mus musculus
gtgtgagaagctggccgagatcatc

SEQ ID NO: 730272 - DNA, 25 bp, Mus musculus
gtgtgagaatgactactacaacggg

SEQ ID NO: 730273 - DNA, 25 bp, Mus musculus
gtgtgagaatgagtactacaacggg

SEQ ID NO: 730274 - DNA, 25 bp, Mus musculus
gtgtgagcccatagtcatgactgtg

SEQ ID NO: 730275 - DNA, 25 bp, Mus musculus
gtgtgagcccattgtcatgactgtg

SEQ ID NO: 730276 - DNA, 25 bp, Mus musculus
gtgtgagctccgcatcccagtgcac

SEQ ID NO: 730277 - DNA, 25 bp, Mus musculus
gtgtgagctccggatcccagtgcac

SEQ ID NO: 730278 - DNA, 25 bp, Mus musculus
gtgtgagtaactcaataaaatacca

SEQ ID NO: 730279 - DNA, 25 bp, Mus musculus
gtgtgagtaactgaataaaatacca

SEQ ID NO: 730280 - DNA, 25 bp, Mus musculus
gtgtgagtcgccacaaggcccacct

SEQ ID NO: 730281 - DNA, 25 bp, Mus musculus
gtgtgagtcgcctcaaggcccacct

SEQ ID NO: 730282 - DNA, 25 bp, Mus musculus
gtgtgagtgcatcagctcttagttt

SEQ ID NO: 730283 - DNA, 25 bp, Mus musculus
gtgtgagtgcatgagctcttagttt

SEQ ID NO: 730284 - DNA, 25 bp, Mus musculus
gtgtgatcaatgctatgtttgccaa

SEQ ID NO: 730285 - DNA, 25 bp, Mus musculus
gtgtgatcaatggtatgtttgccaa

SEQ ID NO: 730286 - DNA, 25 bp, Mus musculus
gtgtgatcagcaatgagcgggccta

SEQ ID NO: 730287 - DNA, 25 bp, Mus musculus
gtgtgatcagcattgagcgggccta

SEQ ID NO: 730288 - DNA, 25 bp, Mus musculus
gtgtgatcatccagggtcttgcctt

SEQ ID NO: 730289 - DNA, 25 bp, Mus musculus
gtgtgatcatcctgggtcttgcctt

SEQ ID NO: 730290 - DNA, 25 bp, Mus musculus
gtgtgatccagcacaaagaaaaatg

SEQ ID NO: 730291 - DNA, 25 bp, Mus musculus
gtgtgatccagctcaaagaaaaatg

SEQ ID NO: 730292 - DNA, 25 bp, Mus musculus
gtgtgatgcgttacaccactgctgg

SEQ ID NO: 730293 - DNA, 25 bp, Mus musculus
gtgtgatgcgtttcaccactgctgg

SEQ ID NO: 730294 - DNA, 25 bp, Mus musculus
gtgtgattgtacacgcacgggctac

SEQ ID NO: 730295 - DNA, 25 bp, Mus musculus
gtgtgattgtactcgcacgggctac

SEQ ID NO: 730296 - DNA, 25 bp, Mus musculus
gtgtgatttctgacatagcaagaac

SEQ ID NO: 730297 - DNA, 25 bp, Mus musculus
gtgtgatttctgtcatagcaagaac

SEQ ID NO: 730298 - DNA, 25 bp, Mus musculus
gtgtgcaaggcacgtatagctgtct

SEQ ID NO: 730299 - DNA, 25 bp, Mus musculus
gtgtgcaaggcaggtatagctgtct

SEQ ID NO: 730300 - DNA, 25 bp, Mus musculus
gtgtgcaatccactgcgtccaccaa

SEQ ID NO: 730301 - DNA, 25 bp, Mus musculus
gtgtgcaatccagtgcgtccaccaa

SEQ ID NO: 730302 - DNA, 25 bp, Mus musculus
gtgtgcaccagtccccagatggcac

SEQ ID NO: 730303 - DNA, 25 bp, Mus musculus
gtgtgcaccagtgcccagatggcac

SEQ ID NO: 730304 - DNA, 25 bp, Mus musculus
gtgtgcaccgttactcagatgttca

SEQ ID NO: 730305 - DNA, 25 bp, Mus musculus
gtgtgcaccgtttctcagatgttca

SEQ ID NO: 730306 - DNA, 25 bp, Mus musculus
gtgtgcaggccacatacaatactca

SEQ ID NO: 730307 - DNA, 25 bp, Mus musculus
gtgtgcaggccagatacaatactca

SEQ ID NO: 730308 - DNA, 25 bp, Mus musculus
gtgtgcagtacgaggagacatctgc

SEQ ID NO: 730309 - DNA, 25 bp, Mus musculus
gtgtgcagtacgtggagacatctgc

SEQ ID NO: 730310 - DNA, 25 bp, Mus musculus
gtgtgcatagtgctgttcatcttcc

SEQ ID NO: 730311 - DNA, 25 bp, Mus musculus
gtgtgcatagtggtgttcatcttcc

SEQ ID NO: 730312 - DNA, 25 bp, Mus musculus
gtgtgcattttactgagtctctcag

SEQ ID NO: 730313 - DNA, 25 bp, Mus musculus
gtgtgcattttagtgagtctctcag

SEQ ID NO: 730314 - DNA, 25 bp, Mus musculus
gtgtgccaccgtcagtgacagccgc

SEQ ID NO: 730315 - DNA, 25 bp, Mus musculus
gtgtgccaccgtgagtgacagccgc

SEQ ID NO: 730316 - DNA, 25 bp, Mus musculus
gtgtgccaggcacttctcagcttca

SEQ ID NO: 730317 - DNA, 25 bp, Mus musculus
gtgtgccaggcagttctcagcttca

SEQ ID NO: 730318 - DNA, 25 bp, Mus musculus
gtgtgccccttcctcgtgctctgga

SEQ ID NO: 730319 - DNA, 25 bp, Mus musculus
gtgtgccccttcgtcgtgctctgga

SEQ ID NO: 730320 - DNA, 25 bp, Mus musculus
gtgtgccgatgccactctttctcag

SEQ ID NO: 730321 - DNA, 25 bp, Mus musculus
gtgtgccgatgcgactctttctcag

SEQ ID NO: 730322 - DNA, 25 bp, Mus musculus
gtgtgccgtgctatgctgtctgtca

SEQ ID NO: 730323 - DNA, 25 bp, Mus musculus
gtgtgccgtgctttgctgtctgtca

SEQ ID NO: 730324 - DNA, 25 bp, Mus musculus
gtgtgcctacgtcgtgactcggaca

SEQ ID NO: 730325 - DNA, 25 bp, Mus musculus
gtgtgcctacgtggtgactcggaca

SEQ ID NO: 730326 - DNA, 25 bp, Mus musculus
gtgtgcgaggtgacggcagccttcg

SEQ ID NO: 730327 - DNA, 25 bp, Mus musculus
gtgtgcgaggtgtcggcagccttcg

SEQ ID NO: 730328 - DNA, 25 bp, Mus musculus
gtgtgcgctgctcagttggcctctc

SEQ ID NO: 730329 - DNA, 25 bp, Mus musculus
gtgtgcgctgctgagttggcctctc

SEQ ID NO: 730330 - DNA, 25 bp, Mus musculus
gtgtgcggctctactacatcggagg

SEQ ID NO: 730331 - DNA, 25 bp, Mus musculus
gtgtgcggctcttctacatcggagg

SEQ ID NO: 730332 - DNA, 25 bp, Mus musculus
gtgtgcgtcgccagcgtcctgctag

SEQ ID NO: 730333 - DNA, 25 bp, Mus musculus
gtgtgcgtcgcctgcgtcctgctag

SEQ ID NO: 730334 - DNA, 25 bp, Mus musculus
gtgtgctcccttatgtccatcttca

SEQ ID NO: 730335 - DNA, 25 bp, Mus musculus
gtgtgctcccttttgtccatcttca

SEQ ID NO: 730336 - DNA, 25 bp, Mus musculus
gtgtgctcctgtcgcggatagcccc

SEQ ID NO: 730337 - DNA, 25 bp, Mus musculus
gtgtgctcctgtggcggatagcccc

SEQ ID NO: 730338 - DNA, 25 bp, Mus musculus
gtgtgctgtccgctctacactggca

SEQ ID NO: 730339 - DNA, 25 bp, Mus musculus
gtgtgctgtccggtctacactggca

SEQ ID NO: 730340 - DNA, 25 bp, Mus musculus
gtgtgcttaacaatgagcgagagag

SEQ ID NO: 730341 - DNA, 25 bp, Mus musculus
gtgtgcttaacattgagcgagagag

SEQ ID NO: 730342 - DNA, 25 bp, Mus musculus
gtgtgcttagctacaaggctctgct

SEQ ID NO: 730343 - DNA, 25 bp, Mus musculus
gtgtgcttagcttcaaggctctgct

SEQ ID NO: 730344 - DNA, 25 bp, Mus musculus
gtgtgcttcagacgatcctcgctgt

SEQ ID NO: 730345 - DNA, 25 bp, Mus musculus
gtgtgcttcagaggatcctcgctgt

SEQ ID NO: 730346 - DNA, 25 bp, Mus musculus
gtgtgcttcgcacccaatatgatgt

SEQ ID NO: 730347 - DNA, 25 bp, Mus musculus
gtgtgcttcgcagccaatatgatgt

SEQ ID NO: 730348 - DNA, 25 bp, Mus musculus
gtgtggaacacaagtacctgtgaat

SEQ ID NO: 730349 - DNA, 25 bp, Mus musculus
gtgtggaacacatgtacctgtgaat

SEQ ID NO: 730350 - DNA, 25 bp, Mus musculus
gtgtggaagcacattcagagactgc

SEQ ID NO: 730351 - DNA, 25 bp, Mus musculus
gtgtggaagcactttcagagactgc

SEQ ID NO: 730352 - DNA, 25 bp, Mus musculus
gtgtggaagccactcactcgcctgt

SEQ ID NO: 730353 - DNA, 25 bp, Mus musculus
gtgtggaagccagtcactcgcctgt

SEQ ID NO: 730354 - DNA, 25 bp, Mus musculus
gtgtggacacgtcacctacccctgt

SEQ ID NO: 730355 - DNA, 25 bp, Mus musculus
gtgtggacacgtgacctacccctgt

SEQ ID NO: 730356 - DNA, 25 bp, Mus musculus
gtgtggaccaccaagtgctgaccgt

SEQ ID NO: 730357 - DNA, 25 bp, Mus musculus
gtgtggaccacctagtgctgaccgt

SEQ ID NO: 730358 - DNA, 25 bp, Mus musculus
gtgtggacctcgattctgcctgtga

SEQ ID NO: 730359 - DNA, 25 bp, Mus musculus
gtgtggacctcgtttctgcctgtga

SEQ ID NO: 730360 - DNA, 25 bp, Mus musculus
gtgtggacggcaagacatcccctgt

SEQ ID NO: 730361 - DNA, 25 bp, Mus musculus
gtgtggacggcatgacatcccctgt

SEQ ID NO: 730362 - DNA, 25 bp, Mus musculus
gtgtggacggcgagaatacctacaa

SEQ ID NO: 730363 - DNA, 25 bp, Mus musculus
gtgtggacggcgtgaatacctacaa

SEQ ID NO: 730364 - DNA, 25 bp, Mus musculus
gtgtggactaacacagcaggatagg

SEQ ID NO: 730365 - DNA, 25 bp, Mus musculus
gtgtggactaactcagcaggatagg

SEQ ID NO: 730366 - DNA, 25 bp, Mus musculus
gtgtggactgcgatggcttttccac

SEQ ID NO: 730367 - DNA, 25 bp, Mus musculus
gtgtggactgcgttggcttttccac

SEQ ID NO: 730368 - DNA, 25 bp, Mus musculus
gtgtggactgtgacatcgacgttcc

SEQ ID NO: 730369 - DNA, 25 bp, Mus musculus
gtgtggactgtgtcatcgacgttcc

SEQ ID NO: 730370 - DNA, 25 bp, Mus musculus
gtgtggagcagcaggcctaccatca

SEQ ID NO: 730371 - DNA, 25 bp, Mus musculus
gtgtggagcagctggcctaccatca

SEQ ID NO: 730372 - DNA, 25 bp, Mus musculus
gtgtggaggactactctgtgagcca

SEQ ID NO: 730373 - DNA, 25 bp, Mus musculus
gtgtggaggacttctctgtgagcca

SEQ ID NO: 730374 - DNA, 25 bp, Mus musculus
gtgtggaggtacaactggctcctcg

SEQ ID NO: 730375 - DNA, 25 bp, Mus musculus
gtgtggaggtactactggctcctcg

SEQ ID NO: 730376 - DNA, 25 bp, Mus musculus
gtgtggatcacgaaacagccagtgt

SEQ ID NO: 730377 - DNA, 25 bp, Mus musculus
gtgtggatcacgtaacagccagtgt

SEQ ID NO: 730378 - DNA, 25 bp, Mus musculus
gtgtggatgctgagcacaagaccct

SEQ ID NO: 730379 - DNA, 25 bp, Mus musculus
gtgtggatgctgtgcacaagaccct

SEQ ID NO: 730380 - DNA, 25 bp, Mus musculus
gtgtggattatcactctggaccgcg

SEQ ID NO: 730381 - DNA, 25 bp, Mus musculus
gtgtggattatctctctggaccgcg

SEQ ID NO: 730382 - DNA, 25 bp, Mus musculus
gtgtggcaaaacatgttggtgatgc

SEQ ID NO: 730383 - DNA, 25 bp, Mus musculus
gtgtggcaaaacttgttggtgatgc

SEQ ID NO: 730384 - DNA, 25 bp, Mus musculus
gtgtggcaccttaaatcgtcttcga

SEQ ID NO: 730385 - DNA, 25 bp, Mus musculus
gtgtggcacctttaatcgtcttcga

SEQ ID NO: 730386 - DNA, 25 bp, Mus musculus
gtgtggcacgacctctcagacttcc

SEQ ID NO: 730387 - DNA, 25 bp, Mus musculus
gtgtggcacgacgtctcagacttcc

SEQ ID NO: 730388 - DNA, 25 bp, Mus musculus
gtgtggcagttgatgattatcaaac

SEQ ID NO: 730389 - DNA, 25 bp, Mus musculus
gtgtggcagttgttgattatcaaac

SEQ ID NO: 730390 - DNA, 25 bp, Mus musculus
gtgtggccaaacctagacaagtatg

SEQ ID NO: 730391 - DNA, 25 bp, Mus musculus
gtgtggccaaacgtagacaagtatg

SEQ ID NO: 730392 - DNA, 25 bp, Mus musculus
gtgtggccacctatacctgcctgtg

SEQ ID NO: 730393 - DNA, 25 bp, Mus musculus
gtgtggccacctttacctgcctgtg

SEQ ID NO: 730394 - DNA, 25 bp, Mus musculus
gtgtggccagcacctagacgaccct

SEQ ID NO: 730395 - DNA, 25 bp, Mus musculus
gtgtggccagcagctagacgaccct

SEQ ID NO: 730396 - DNA, 25 bp, Mus musculus
gtgtggccattgcagcacctccgtc

SEQ ID NO: 730397 - DNA, 25 bp, Mus musculus
gtgtggccattggagcacctccgtc

SEQ ID NO: 730398 - DNA, 25 bp, Mus musculus
gtgtggcccatacagctttcgacaa

SEQ ID NO: 730399 - DNA, 25 bp, Mus musculus
gtgtggcccatagagctttcgacaa

SEQ ID NO: 730400 - DNA, 25 bp, Mus musculus
gtgtggccccctccgtgctttttga

SEQ ID NO: 730401 - DNA, 25 bp, Mus musculus
gtgtggccccctgcgtgctttttga

SEQ ID NO: 730402 - DNA, 25 bp, Mus musculus
gtgtggcccctgcaagatcctagga

SEQ ID NO: 730403 - DNA, 25 bp, Mus musculus
gtgtggcccctggaagatcctagga

SEQ ID NO: 730404 - DNA, 25 bp, Mus musculus
gtgtggccggttccgcgttcgccgg

SEQ ID NO: 730405 - DNA, 25 bp, Mus musculus
gtgtggccggttgcgcgttcgccgg

SEQ ID NO: 730406 - DNA, 25 bp, Mus musculus
gtgtggccgtcaatggcatcgatga

SEQ ID NO: 730407 - DNA, 25 bp, Mus musculus
gtgtggccgtcattggcatcgatga

SEQ ID NO: 730408 - DNA, 25 bp, Mus musculus
gtgtggcctctgagcgcccagctgt

SEQ ID NO: 730409 - DNA, 25 bp, Mus musculus
gtgtggcctctgtgcgcccagctgt

SEQ ID NO: 730410 - DNA, 25 bp, Mus musculus
gtgtggccttagcttggcagaaccc

SEQ ID NO: 730411 - DNA, 25 bp, Mus musculus
gtgtggccttaggttggcagaaccc

SEQ ID NO: 730412 - DNA, 25 bp, Mus musculus
gtgtggccttcaatcctggaatgtt

SEQ ID NO: 730413 - DNA, 25 bp, Mus musculus
gtgtggccttcattcctggaatgtt

SEQ ID NO: 730414 - DNA, 25 bp, Mus musculus
gtgtggcctttgaccaagtatgagt

SEQ ID NO: 730415 - DNA, 25 bp, Mus musculus
gtgtggcctttgtccaagtatgagt

SEQ ID NO: 730416 - DNA, 25 bp, Mus musculus
gtgtggcgctacatccgagactact

SEQ ID NO: 730417 - DNA, 25 bp, Mus musculus
gtgtggcgctacttccgagactact

SEQ ID NO: 730418 - DNA, 25 bp, Mus musculus
gtgtggctacaacgaccccgaggat

SEQ ID NO: 730419 - DNA, 25 bp, Mus musculus
gtgtggctacaacttcacgcggcag

SEQ ID NO: 730420 - DNA, 25 bp, Mus musculus
gtgtggctacaaggaccccgaggat

SEQ ID NO: 730421 - DNA, 25 bp, Mus musculus
gtgtggctacaagttcacgcggcag

SEQ ID NO: 730422 - DNA, 25 bp, Mus musculus
gtgtggctcgcacacccatgaagaa

SEQ ID NO: 730423 - DNA, 25 bp, Mus musculus
gtgtggctcgcagacccatgaagaa

SEQ ID NO: 730424 - DNA, 25 bp, Mus musculus
gtgtggctgcccaattttacctcag

SEQ ID NO: 730425 - DNA, 25 bp, Mus musculus
gtgtggctgccctattttacctcag

SEQ ID NO: 730426 - DNA, 25 bp, Mus musculus
gtgtggctgttgacagccacgccca

SEQ ID NO: 730427 - DNA, 25 bp, Mus musculus
gtgtggctgttgtcagccacgccca

SEQ ID NO: 730428 - DNA, 25 bp, Mus musculus
gtgtgggaaccaccgccaccagact

SEQ ID NO: 730429 - DNA, 25 bp, Mus musculus
gtgtgggaaccagcgccaccagact

SEQ ID NO: 730430 - DNA, 25 bp, Mus musculus
gtgtgggaatagatggctgctggca

SEQ ID NO: 730431 - DNA, 25 bp, Mus musculus
gtgtgggaatagttggctgctggca

SEQ ID NO: 730432 - DNA, 25 bp, Mus musculus
gtgtgggagcatcatgccactcaaa

SEQ ID NO: 730433 - DNA, 25 bp, Mus musculus
gtgtgggagcatgatgccactcaaa

SEQ ID NO: 730434 - DNA, 25 bp, Mus musculus
gtgtgggatgacagactggttaaca

SEQ ID NO: 730435 - DNA, 25 bp, Mus musculus
gtgtgggatgactgactggttaaca

SEQ ID NO: 730436 - DNA, 25 bp, Mus musculus
gtgtgggcatctcccagcttccagg

SEQ ID NO: 730437 - DNA, 25 bp, Mus musculus
gtgtgggcatctgccagcttccagg

SEQ ID NO: 730438 - DNA, 25 bp, Mus musculus
gtgtgggctcctactcctgcctctg

SEQ ID NO: 730439 - DNA, 25 bp, Mus musculus
gtgtgggctccttctcctgcctctg

SEQ ID NO: 730440 - DNA, 25 bp, Mus musculus
gtgtgggcttccctcacctctaaga

SEQ ID NO: 730441 - DNA, 25 bp, Mus musculus
gtgtgggcttccgtcacctctaaga

SEQ ID NO: 730442 - DNA, 25 bp, Mus musculus
gtgtgggtcccgcagctctaccaag

SEQ ID NO: 730443 - DNA, 25 bp, Mus musculus
gtgtgggtcccggagctctaccaag

SEQ ID NO: 730444 - DNA, 25 bp, Mus musculus
gtgtgggtgcctccgttgcgcgcat

SEQ ID NO: 730445 - DNA, 25 bp, Mus musculus
gtgtgggtgcctgcgttgcgcgcat

SEQ ID NO: 730446 - DNA, 25 bp, Mus musculus
gtgtgggttcgcagccctctcaacc

SEQ ID NO: 730447 - DNA, 25 bp, Mus musculus
gtgtgggttcgctgccctctcaacc

SEQ ID NO: 730448 - DNA, 25 bp, Mus musculus
gtgtggtaaaagacatggctaccgg

SEQ ID NO: 730449 - DNA, 25 bp, Mus musculus
gtgtggtaaaagtcatggctaccgg

SEQ ID NO: 730450 - DNA, 25 bp, Mus musculus
gtgtggtaccctccgatcgtggcaa

SEQ ID NO: 730451 - DNA, 25 bp, Mus musculus
gtgtggtaccctgcgatcgtggcaa

SEQ ID NO: 730452 - DNA, 25 bp, Mus musculus
gtgtggtatctcatgtagccgtcca

SEQ ID NO: 730453 - DNA, 25 bp, Mus musculus
gtgtggtatctcttgtagccgtcca

SEQ ID NO: 730454 - DNA, 25 bp, Mus musculus
gtgtggtcacccatgcaggacgcag

SEQ ID NO: 730455 - DNA, 25 bp, Mus musculus
gtgtggtcacccttgcaggacgcag

SEQ ID NO: 730456 - DNA, 25 bp, Mus musculus
gtgtggtccggcatcatgctttgca

SEQ ID NO: 730457 - DNA, 25 bp, Mus musculus
gtgtggtccggcttcatgctttgca

SEQ ID NO: 730458 - DNA, 25 bp, Mus musculus
gtgtggtctgagcaggcttcatctc

SEQ ID NO: 730459 - DNA, 25 bp, Mus musculus
gtgtggtctgaggaggcttcatctc

SEQ ID NO: 730460 - DNA, 25 bp, Mus musculus
gtgtggtggcctcattgcttttgcc

SEQ ID NO: 730461 - DNA, 25 bp, Mus musculus
gtgtggtggcctgattgcttttgcc

SEQ ID NO: 730462 - DNA, 25 bp, Mus musculus
gtgtggttgaacagcccacttccct

SEQ ID NO: 730463 - DNA, 25 bp, Mus musculus
gtgtggttgaactgcccacttccct

SEQ ID NO: 730464 - DNA, 25 bp, Mus musculus
gtgtggtttcatcttaaacctcaaa

SEQ ID NO: 730465 - DNA, 25 bp, Mus musculus
gtgtggtttcatgttaaacctcaaa

SEQ ID NO: 730466 - DNA, 25 bp, Mus musculus
gtgtgtaacagtccgcccggctctg

SEQ ID NO: 730467 - DNA, 25 bp, Mus musculus
gtgtgtaacagtgcgcccggctctg

SEQ ID NO: 730468 - DNA, 25 bp, Mus musculus
gtgtgtacaacacccggcacgtgtg

SEQ ID NO: 730469 - DNA, 25 bp, Mus musculus
gtgtgtacaacagccggcacgtgtg

SEQ ID NO: 730470 - DNA, 25 bp, Mus musculus
gtgtgtatacaccttagcatgaaag

SEQ ID NO: 730471 - DNA, 25 bp, Mus musculus
gtgtgtatacacgttagcatgaaag

SEQ ID NO: 730472 - DNA, 25 bp, Mus musculus
gtgtgtcacatgagcgactgttttt

SEQ ID NO: 730473 - DNA, 25 bp, Mus musculus
gtgtgtcacatgtgcgactgttttt

SEQ ID NO: 730474 - DNA, 25 bp, Mus musculus
gtgtgtcagtgcaaacatttctgtc

SEQ ID NO: 730475 - DNA, 25 bp, Mus musculus
gtgtgtcagtgctaacatttctgtc

SEQ ID NO: 730476 - DNA, 25 bp, Mus musculus
gtgtgtcatgtaccacctccttcct

SEQ ID NO: 730477 - DNA, 25 bp, Mus musculus
gtgtgtcatgtagcacctccttcct

SEQ ID NO: 730478 - DNA, 25 bp, Mus musculus
gtgtgtccagtccaagcaccttcca

SEQ ID NO: 730479 - DNA, 25 bp, Mus musculus
gtgtgtccagtcgaagcaccttcca

SEQ ID NO: 730480 - DNA, 25 bp, Mus musculus
gtgtgtccccatccctggaggagca

SEQ ID NO: 730481 - DNA, 25 bp, Mus musculus
gtgtgtccccatgcctggaggagca

SEQ ID NO: 730482 - DNA, 25 bp, Mus musculus
gtgtgtccccttcgcgaattaaggg

SEQ ID NO: 730483 - DNA, 25 bp, Mus musculus
gtgtgtccccttggcgaattaaggg

SEQ ID NO: 730484 - DNA, 25 bp, Mus musculus
gtgtgtcctacacggcgccctgagc

SEQ ID NO: 730485 - DNA, 25 bp, Mus musculus
gtgtgtcctacagggcgccctgagc

SEQ ID NO: 730486 - DNA, 25 bp, Mus musculus
gtgtgtcctcacagcgatttgaaag

SEQ ID NO: 730487 - DNA, 25 bp, Mus musculus
gtgtgtcctcactgcgatttgaaag

SEQ ID NO: 730488 - DNA, 25 bp, Mus musculus
gtgtgtccttgaccctcgaggtctc

SEQ ID NO: 730489 - DNA, 25 bp, Mus musculus
gtgtgtccttgagcctcgaggtctc

SEQ ID NO: 730490 - DNA, 25 bp, Mus musculus
gtgtgtcgaaacagcaaatccttaa

SEQ ID NO: 730491 - DNA, 25 bp, Mus musculus
gtgtgtcgaaactgcaaatccttaa

SEQ ID NO: 730492 - DNA, 25 bp, Mus musculus
gtgtgtcgttttctccaggatcact

SEQ ID NO: 730493 - DNA, 25 bp, Mus musculus
gtgtgtcgttttgtccaggatcact

SEQ ID NO: 730494 - DNA, 25 bp, Mus musculus
gtgtgtctagtgaaccccaagaaga

SEQ ID NO: 730495 - DNA, 25 bp, Mus musculus
gtgtgtctagtgtaccccaagaaga

SEQ ID NO: 730496 - DNA, 25 bp, Mus musculus
gtgtgtctttgcaatcgccactaag

SEQ ID NO: 730497 - DNA, 25 bp, Mus musculus
gtgtgtctttgctatcgccactaag

SEQ ID NO: 730498 - DNA, 25 bp, Mus musculus
gtgtgtgacactcatgaagggccca

SEQ ID NO: 730499 - DNA, 25 bp, Mus musculus
gtgtgtgacactgatgaagggccca

SEQ ID NO: 730500 - DNA, 25 bp, Mus musculus
gtgtgtgagtccagccctcctcaca

SEQ ID NO: 730501 - DNA, 25 bp, Mus musculus
gtgtgtgagtcctgccctcctcaca

SEQ ID NO: 730502 - DNA, 25 bp, Mus musculus
gtgtgtgatcaaagctatgtttgcc

SEQ ID NO: 730503 - DNA, 25 bp, Mus musculus
gtgtgtgatcaatgctatgtttgcc

SEQ ID NO: 730504 - DNA, 25 bp, Mus musculus
gtgtgtgcccgcctgcagcagttcc

SEQ ID NO: 730505 - DNA, 25 bp, Mus musculus
gtgtgtgcccgcgtgcagcagttcc

SEQ ID NO: 730506 - DNA, 25 bp, Mus musculus
gtgtgtgcgcgcaccaagagtgtat

SEQ ID NO: 730507 - DNA, 25 bp, Mus musculus
gtgtgtgcgcgctccaagagtgtat

SEQ ID NO: 730508 - DNA, 25 bp, Mus musculus
gtgtgtgctacaccgctgctgtcac

SEQ ID NO: 730509 - DNA, 25 bp, Mus musculus
gtgtgtgctacagcgctgctgtcac

SEQ ID NO: 730510 - DNA, 25 bp, Mus musculus
gtgtgtggacgtaaaacttctgcct

SEQ ID NO: 730511 - DNA, 25 bp, Mus musculus
gtgtgtggacgttaaacttctgcct

SEQ ID NO: 730512 - DNA, 25 bp, Mus musculus
gtgtgtggccaacgaacggaaccca

SEQ ID NO: 730513 - DNA, 25 bp, Mus musculus
gtgtgtggccaaggaacggaaccca

SEQ ID NO: 730514 - DNA, 25 bp, Mus musculus
gtgtgtgtcacccttctggaccgtc

SEQ ID NO: 730515 - DNA, 25 bp, Mus musculus
gtgtgtgtcaccgttctggaccgtc

SEQ ID NO: 730516 - DNA, 25 bp, Mus musculus
gtgtgtgtggccaacgcaacctacc

SEQ ID NO: 730517 - DNA, 25 bp, Mus musculus
gtgtgtgtggcctacgcaacctacc

SEQ ID NO: 730518 - DNA, 25 bp, Mus musculus
gtgtgttattgaagcacaactgggt

SEQ ID NO: 730519 - DNA, 25 bp, Mus musculus
gtgtgttattgatgcacaactgggt

SEQ ID NO: 730520 - DNA, 25 bp, Mus musculus
gtgtgttcactcactcatgtctttc

SEQ ID NO: 730521 - DNA, 25 bp, Mus musculus
gtgtgttcactctctcatgtctttc

SEQ ID NO: 730522 - DNA, 25 bp, Mus musculus
gtgtgttcattgaagagaccatggg

SEQ ID NO: 730523 - DNA, 25 bp, Mus musculus
gtgtgttcattgtagagaccatggg

SEQ ID NO: 730524 - DNA, 25 bp, Mus musculus
gtgtgttcctaacagatggcagtgt

SEQ ID NO: 730525 - DNA, 25 bp, Mus musculus
gtgtgttcctaagagatggcagtgt

SEQ ID NO: 730526 - DNA, 25 bp, Mus musculus
gtgtgttgcttacgaagctcctgct

SEQ ID NO: 730527 - DNA, 25 bp, Mus musculus
gtgtgttgcttaggaagctcctgct

SEQ ID NO: 730528 - DNA, 25 bp, Mus musculus
gtgtgtttctagaactactttgaga

SEQ ID NO: 730529 - DNA, 25 bp, Mus musculus
gtgtgtttctagtactactttgaga

SEQ ID NO: 730530 - DNA, 25 bp, Mus musculus
gtgtgtttgaaaagccgaatgaaaa

SEQ ID NO: 730531 - DNA, 25 bp, Mus musculus
gtgtgtttgaaaccgaggccaaaga

SEQ ID NO: 730532 - DNA, 25 bp, Mus musculus
gtgtgtttgaaagcgaggccaaaga

SEQ ID NO: 730533 - DNA, 25 bp, Mus musculus
gtgtgtttgaaatgccgaatgaaaa

SEQ ID NO: 730534 - DNA, 25 bp, Mus musculus
gtgttacaccaaatggaagacccat

SEQ ID NO: 730535 - DNA, 25 bp, Mus musculus
gtgttacaccaattggaagacccat

SEQ ID NO: 730536 - DNA, 25 bp, Mus musculus
gtgttacagccaatgatcaatcttt

SEQ ID NO: 730537 - DNA, 25 bp, Mus musculus
gtgttacagccattgatcaatcttt

SEQ ID NO: 730538 - DNA, 25 bp, Mus musculus
gtgttaccagtgctatggagtccca

SEQ ID NO: 730539 - DNA, 25 bp, Mus musculus
gtgttaccagtggtatggagtccca

SEQ ID NO: 730540 - DNA, 25 bp, Mus musculus
gtgttacgggcacacaggagccggc

SEQ ID NO: 730541 - DNA, 25 bp, Mus musculus
gtgttacgggcagacaggagccggc

SEQ ID NO: 730542 - DNA, 25 bp, Mus musculus
gtgttactacctctctcctccggaa

SEQ ID NO: 730543 - DNA, 25 bp, Mus musculus
gtgttactacctgtctcctccggaa

SEQ ID NO: 730544 - DNA, 25 bp, Mus musculus
gtgttactgaaaaaggcgcctcctc

SEQ ID NO: 730545 - DNA, 25 bp, Mus musculus
gtgttactgaaataggcgcctcctc

SEQ ID NO: 730546 - DNA, 25 bp, Mus musculus
gtgttactggccacacctgtaaccg

SEQ ID NO: 730547 - DNA, 25 bp, Mus musculus
gtgttactggcctcacctgtaaccg

SEQ ID NO: 730548 - DNA, 25 bp, Mus musculus
gtgttagaacatcaagaagagaaga

SEQ ID NO: 730549 - DNA, 25 bp, Mus musculus
gtgttagaacatgaagaagagaaga

SEQ ID NO: 730550 - DNA, 25 bp, Mus musculus
gtgttagaagccatgacttcagctg

SEQ ID NO: 730551 - DNA, 25 bp, Mus musculus
gtgttagaagccttgacttcagctg

SEQ ID NO: 730552 - DNA, 25 bp, Mus musculus
gtgttatattgcatgcaagctggta

SEQ ID NO: 730553 - DNA, 25 bp, Mus musculus
gtgttatattgcttgcaagctggta

SEQ ID NO: 730554 - DNA, 25 bp, Mus musculus
gtgttattgaagcacaactgggttt

SEQ ID NO: 730555 - DNA, 25 bp, Mus musculus
gtgttattgaaggacaactgggttt

SEQ ID NO: 730556 - DNA, 25 bp, Mus musculus
gtgttcaatgctcactataacctca

SEQ ID NO: 730557 - DNA, 25 bp, Mus musculus
gtgttcaatgctgactataacctca

SEQ ID NO: 730558 - DNA, 25 bp, Mus musculus
gtgttcaccacacgtttcagccgca

SEQ ID NO: 730559 - DNA, 25 bp, Mus musculus
gtgttcaccacaggtttcagccgca

SEQ ID NO: 730560 - DNA, 25 bp, Mus musculus
gtgttcactaccatctactccatgt

SEQ ID NO: 730561 - DNA, 25 bp, Mus musculus
gtgttcactaccttctactccatgt

SEQ ID NO: 730562 - DNA, 25 bp, Mus musculus
gtgttcacttcacacgatacattcc

SEQ ID NO: 730563 - DNA, 25 bp, Mus musculus
gtgttcacttcagacgatacattcc

SEQ ID NO: 730564 - DNA, 25 bp, Mus musculus
gtgttcaggttccaaatgtccctcc

SEQ ID NO: 730565 - DNA, 25 bp, Mus musculus
gtgttcaggttcgaaatgtccctcc

SEQ ID NO: 730566 - DNA, 25 bp, Mus musculus
gtgttccactgacccaattagctcg

SEQ ID NO: 730567 - DNA, 25 bp, Mus musculus
gtgttccactgagccaattagctcg

SEQ ID NO: 730568 - DNA, 25 bp, Mus musculus
gtgttccagttactaacggatctca

SEQ ID NO: 730569 - DNA, 25 bp, Mus musculus
gtgttccagttagtaacggatctca

SEQ ID NO: 730570 - DNA, 25 bp, Mus musculus
gtgttcccagctattgctcaggaga

SEQ ID NO: 730571 - DNA, 25 bp, Mus musculus
gtgttcccagcttttgctcaggaga

SEQ ID NO: 730572 - DNA, 25 bp, Mus musculus
gtgttcccttctctaggcacttcgg

SEQ ID NO: 730573 - DNA, 25 bp, Mus musculus
gtgttcccttctgtaggcacttcgg

SEQ ID NO: 730574 - DNA, 25 bp, Mus musculus
gtgttcctagacacaggagtgagaa

SEQ ID NO: 730575 - DNA, 25 bp, Mus musculus
gtgttcctagactcaggagtgagaa

SEQ ID NO: 730576 - DNA, 25 bp, Mus musculus
gtgttcctatatatctccaaagacc

SEQ ID NO: 730577 - DNA, 25 bp, Mus musculus
gtgttcctatatttctccaaagacc

SEQ ID NO: 730578 - DNA, 25 bp, Mus musculus
gtgttcctcttgcatgccactcgag

SEQ ID NO: 730579 - DNA, 25 bp, Mus musculus
gtgttcctcttggatgccactcgag

SEQ ID NO: 730580 - DNA, 25 bp, Mus musculus
gtgttcctgggcctgaatcgctcag

SEQ ID NO: 730581 - DNA, 25 bp, Mus musculus
gtgttcctgggcgtgaatcgctcag

SEQ ID NO: 730582 - DNA, 25 bp, Mus musculus
gtgttcgactaccacaagaagaagg

SEQ ID NO: 730583 - DNA, 25 bp, Mus musculus
gtgttcgactacgacaagaagaagg

SEQ ID NO: 730584 - DNA, 25 bp, Mus musculus
gtgttcgttttcaccattgggatcc

SEQ ID NO: 730585 - DNA, 25 bp, Mus musculus
gtgttcgttttctccattgggatcc

SEQ ID NO: 730586 - DNA, 25 bp, Mus musculus
gtgttctcccggagcgtgctccgag

SEQ ID NO: 730587 - DNA, 25 bp, Mus musculus
gtgttctcccggtgcgtgctccgag

SEQ ID NO: 730588 - DNA, 25 bp, Mus musculus
gtgttctggacaattatggctttga

SEQ ID NO: 730589 - DNA, 25 bp, Mus musculus
gtgttctggacatttatggctttga

SEQ ID NO: 730590 - DNA, 25 bp, Mus musculus
gtgttcttctgtatggacctccagg

SEQ ID NO: 730591 - DNA, 25 bp, Mus musculus
gtgttcttctgtttggacctccagg

SEQ ID NO: 730592 - DNA, 25 bp, Mus musculus
gtgttctttggcatttcccactggt

SEQ ID NO: 730593 - DNA, 25 bp, Mus musculus
gtgttctttggcttttcccactggt

SEQ ID NO: 730594 - DNA, 25 bp, Mus musculus
gtgttgaactctagaagaaaactcc

SEQ ID NO: 730595 - DNA, 25 bp, Mus musculus
gtgttgaactcttgaagaaaactcc

SEQ ID NO: 730596 - DNA, 25 bp, Mus musculus
gtgttgaaggcacaccctgaagacc

SEQ ID NO: 730597 - DNA, 25 bp, Mus musculus
gtgttgaaggcagaccctgaagacc

SEQ ID NO: 730598 - DNA, 25 bp, Mus musculus
gtgttgacccttagcccctgatcag

SEQ ID NO: 730599 - DNA, 25 bp, Mus musculus
gtgttgaccctttgcccctgatcag

SEQ ID NO: 730600 - DNA, 25 bp, Mus musculus
gtgttgaccgcgcttctccaggacg

SEQ ID NO: 730601 - DNA, 25 bp, Mus musculus
gtgttgaccgcggttctccaggacg

SEQ ID NO: 730602 - DNA, 25 bp, Mus musculus
gtgttgagtgaactcaccttgttca

SEQ ID NO: 730603 - DNA, 25 bp, Mus musculus
gtgttgagtgaagtcaccttgttca

SEQ ID NO: 730604 - DNA, 25 bp, Mus musculus
gtgttgatctaacggaacgctttgc

SEQ ID NO: 730605 - DNA, 25 bp, Mus musculus
gtgttgatctaagggaacgctttgc

SEQ ID NO: 730606 - DNA, 25 bp, Mus musculus
gtgttgccacagagcctcggctcag

SEQ ID NO: 730607 - DNA, 25 bp, Mus musculus
gtgttgccacagtgcctcggctcag

SEQ ID NO: 730608 - DNA, 25 bp, Mus musculus
gtgttgccatttccagccgccatga

SEQ ID NO: 730609 - DNA, 25 bp, Mus musculus
gtgttgccatttgcagccgccatga

SEQ ID NO: 730610 - DNA, 25 bp, Mus musculus
gtgttgcccaatccctacatgatcc

SEQ ID NO: 730611 - DNA, 25 bp, Mus musculus
gtgttgcccaatgcctacatgatcc

SEQ ID NO: 730612 - DNA, 25 bp, Mus musculus
gtgttgcccaccaaccccgaggaga

SEQ ID NO: 730613 - DNA, 25 bp, Mus musculus
gtgttgcccacctaccccgaggaga

SEQ ID NO: 730614 - DNA, 25 bp, Mus musculus
gtgttgcctgccctctttgtgggcc

SEQ ID NO: 730615 - DNA, 25 bp, Mus musculus
gtgttgcctgccgtctttgtgggcc

SEQ ID NO: 730616 - DNA, 25 bp, Mus musculus
gtgttgctgcagctttacctggaat

SEQ ID NO: 730617 - DNA, 25 bp, Mus musculus
gtgttgctgcaggtttacctggaat

SEQ ID NO: 730618 - DNA, 25 bp, Mus musculus
gtgttgcttaggaagctcctgctgt

SEQ ID NO: 730619 - DNA, 25 bp, Mus musculus
gtgttgcttaggtagctcctgctgt

SEQ ID NO: 730620 - DNA, 25 bp, Mus musculus
gtgttgcttcaccacatcatccaca

SEQ ID NO: 730621 - DNA, 25 bp, Mus musculus
gtgttgcttcacgacatcatccaca

SEQ ID NO: 730622 - DNA, 25 bp, Mus musculus
gtgttgctttctcacaaagccccgg

SEQ ID NO: 730623 - DNA, 25 bp, Mus musculus
gtgttgctttctgacaaagccccgg

SEQ ID NO: 730624 - DNA, 25 bp, Mus musculus
gtgttggtcattccccaccggctta

SEQ ID NO: 730625 - DNA, 25 bp, Mus musculus
gtgttggtcattgcccaccggctta

SEQ ID NO: 730626 - DNA, 25 bp, Mus musculus
gtgttggtgcagacgactctgccca

SEQ ID NO: 730627 - DNA, 25 bp, Mus musculus
gtgttggtgcagtcgactctgccca

SEQ ID NO: 730628 - DNA, 25 bp, Mus musculus
gtgttggtgccacgccacaccgaga

SEQ ID NO: 730629 - DNA, 25 bp, Mus musculus
gtgttggtgccaggccacaccgaga

SEQ ID NO: 730630 - DNA, 25 bp, Mus musculus
gtgttgtggtgtatgcctttactcc

SEQ ID NO: 730631 - DNA, 25 bp, Mus musculus
gtgttgtggtgtttgcctttactcc

SEQ ID NO: 730632 - DNA, 25 bp, Mus musculus
gtgttgttcagccagttcagatact

SEQ ID NO: 730633 - DNA, 25 bp, Mus musculus
gtgttgttcagcgagttcagatact

SEQ ID NO: 730634 - DNA, 25 bp, Mus musculus
gtgttgtttccccagcatggcggac

SEQ ID NO: 730635 - DNA, 25 bp, Mus musculus
gtgttgtttcccgagcatggcggac

SEQ ID NO: 730636 - DNA, 25 bp, Mus musculus
gtgtttaaatacaaccgattcttga

SEQ ID NO: 730637 - DNA, 25 bp, Mus musculus
gtgtttaaatactaccgattcttga

SEQ ID NO: 730638 - DNA, 25 bp, Mus musculus
gtgtttaaggacctgctgctcctag

SEQ ID NO: 730639 - DNA, 25 bp, Mus musculus
gtgtttaaggacgtgctgctcctag

SEQ ID NO: 730640 - DNA, 25 bp, Mus musculus
gtgtttacccagcaggagaggtaca

SEQ ID NO: 730641 - DNA, 25 bp, Mus musculus
gtgtttacccaggaggagaggtaca

SEQ ID NO: 730642 - DNA, 25 bp, Mus musculus
gtgtttagccctcgccctgggcact

SEQ ID NO: 730643 - DNA, 25 bp, Mus musculus
gtgtttagccctggccctgggcact

SEQ ID NO: 730644 - DNA, 25 bp, Mus musculus
gtgtttattcctctacttcagtcag

SEQ ID NO: 730645 - DNA, 25 bp, Mus musculus
gtgtttattcctgtacttcagtcag

SEQ ID NO: 730646 - DNA, 25 bp, Mus musculus
gtgtttccacagctcaatgtcatca

SEQ ID NO: 730647 - DNA, 25 bp, Mus musculus
gtgtttccacaggtcaatgtcatca

SEQ ID NO: 730648 - DNA, 25 bp, Mus musculus
gtgtttccactaccaacattgctgg

SEQ ID NO: 730649 - DNA, 25 bp, Mus musculus
gtgtttccactagcaacattgctgg

SEQ ID NO: 730650 - DNA, 25 bp, Mus musculus
gtgtttcccagaacttctgtggcct

SEQ ID NO: 730651 - DNA, 25 bp, Mus musculus
gtgtttcccagatcttctgtggcct

SEQ ID NO: 730652 - DNA, 25 bp, Mus musculus
gtgtttccgcctagtgagcaccgaa

SEQ ID NO: 730653 - DNA, 25 bp, Mus musculus
gtgtttccgccttgtgagcaccgaa

SEQ ID NO: 730654 - DNA, 25 bp, Mus musculus
gtgtttcctcaaagtctgctttgca

SEQ ID NO: 730655 - DNA, 25 bp, Mus musculus
gtgtttcctcaatgtctgctttgca

SEQ ID NO: 730656 - DNA, 25 bp, Mus musculus
gtgtttccttatattttggctgatg

SEQ ID NO: 730657 - DNA, 25 bp, Mus musculus
gtgtttccttattttttggctgatg

SEQ ID NO: 730658 - DNA, 25 bp, Mus musculus
gtgtttctaaatcgttacagcacaa

SEQ ID NO: 730659 - DNA, 25 bp, Mus musculus
gtgtttctaaatggttacagcacaa

SEQ ID NO: 730660 - DNA, 25 bp, Mus musculus
gtgtttctgttaacctactaaacga

SEQ ID NO: 730661 - DNA, 25 bp, Mus musculus
gtgtttctgttatcctactaaacga

SEQ ID NO: 730662 - DNA, 25 bp, Mus musculus
gtgtttcttaaaccgccagcctccg

SEQ ID NO: 730663 - DNA, 25 bp, Mus musculus
gtgtttcttaaagcgccagcctccg

SEQ ID NO: 730664 - DNA, 25 bp, Mus musculus
gtgtttcttccgcaatcattttcgc

SEQ ID NO: 730665 - DNA, 25 bp, Mus musculus
gtgtttcttccggaatcattttcgc

SEQ ID NO: 730666 - DNA, 25 bp, Mus musculus
gtgtttgacagacatcaagaacctg

SEQ ID NO: 730667 - DNA, 25 bp, Mus musculus
gtgtttgacagagatcaagaacctg

SEQ ID NO: 730668 - DNA, 25 bp, Mus musculus
gtgtttgagcgcatccagtctgtca

SEQ ID NO: 730669 - DNA, 25 bp, Mus musculus
gtgtttgagcgcttccagtctgtca

SEQ ID NO: 730670 - DNA, 25 bp, Mus musculus
gtgtttgctttacagatgggctttg

SEQ ID NO: 730671 - DNA, 25 bp, Mus musculus
gtgtttgctttagagatgggctttg

SEQ ID NO: 730672 - DNA, 25 bp, Mus musculus
gtgtttgctttgatgttcctacaag

SEQ ID NO: 730673 - DNA, 25 bp, Mus musculus
gtgtttgctttgttgttcctacaag

SEQ ID NO: 730674 - DNA, 25 bp, Mus musculus
gtgtttgtcctaccctgcattcagc

SEQ ID NO: 730675 - DNA, 25 bp, Mus musculus
gtgtttgtcctagcctgcattcagc

SEQ ID NO: 730676 - DNA, 25 bp, Mus musculus
gtgtttgtgtcccacctgcacgccg

SEQ ID NO: 730677 - DNA, 25 bp, Mus musculus
gtgtttgtgtccgacctgcacgccg

SEQ ID NO: 730678 - DNA, 25 bp, Mus musculus
gtgttttcatcgataaccttgatac

SEQ ID NO: 730679 - DNA, 25 bp, Mus musculus
gtgttttcatcgttaaccttgatac

SEQ ID NO: 730680 - DNA, 25 bp, Mus musculus
gtgttttccatcctgttagaatctg

SEQ ID NO: 730681 - DNA, 25 bp, Mus musculus
gtgttttccatcgtgttagaatctg

SEQ ID NO: 730682 - DNA, 25 bp, Mus musculus
gtgttttcccctatgtaggtgaata

SEQ ID NO: 730683 - DNA, 25 bp, Mus musculus
gtgttttcccctttgtaggtgaata

SEQ ID NO: 730684 - DNA, 25 bp, Mus musculus
gtgttttctagccatttaccaatct

SEQ ID NO: 730685 - DNA, 25 bp, Mus musculus
gtgttttctagcgatttaccaatct

SEQ ID NO: 730686 - DNA, 25 bp, Mus musculus
gtgttttctctgacaagtactgcag

SEQ ID NO: 730687 - DNA, 25 bp, Mus musculus
gtgttttctctgtcaagtactgcag

SEQ ID NO: 730688 - DNA, 25 bp, Mus musculus
gtgttttgaactcgataccttgtgg

SEQ ID NO: 730689 - DNA, 25 bp, Mus musculus
gtgttttgaactggataccttgtgg

SEQ ID NO: 730690 - DNA, 25 bp, Mus musculus
gtgtttttcaggcacgaattcatac

SEQ ID NO: 730691 - DNA, 25 bp, Mus musculus
gtgtttttcagggacgaattcatac

SEQ ID NO: 730692 - DNA, 25 bp, Mus musculus
gtgtttttggcaaagcatgataggg

SEQ ID NO: 730693 - DNA, 25 bp, Mus musculus
gtgtttttggcatagcatgataggg

SEQ ID NO: 730694 - DNA, 25 bp, Mus musculus
gttaaaacaagtccagcagaacagt

SEQ ID NO: 730695 - DNA, 25 bp, Mus musculus
gttaaaacaagtgcagcagaacagt

SEQ ID NO: 730696 - DNA, 25 bp, Mus musculus
gttaaaaccccacgatgtccagatg

SEQ ID NO: 730697 - DNA, 25 bp, Mus musculus
gttaaaaccccaggatgtccagatg

SEQ ID NO: 730698 - DNA, 25 bp, Mus musculus
gttaaaagactcctgaataaactgc

SEQ ID NO: 730699 - DNA, 25 bp, Mus musculus
gttaaaagactcgtgaataaactgc

SEQ ID NO: 730700 - DNA, 25 bp, Mus musculus
gttaaaagagcacaggtcctggctc

SEQ ID NO: 730701 - DNA, 25 bp, Mus musculus
gttaaaagagcagaggtcctggctc

SEQ ID NO: 730702 - DNA, 25 bp, Mus musculus
gttaaaagcaccctctgttcttcca

SEQ ID NO: 730703 - DNA, 25 bp, Mus musculus
gttaaaagcaccgtctgttcttcca

SEQ ID NO: 730704 - DNA, 25 bp, Mus musculus
gttaaacactctcttctgaatctag

SEQ ID NO: 730705 - DNA, 25 bp, Mus musculus
gttaaacactctgttctgaatctag

SEQ ID NO: 730706 - DNA, 25 bp, Mus musculus
gttaaacatcttatcctggtggatc

SEQ ID NO: 730707 - DNA, 25 bp, Mus musculus
gttaaacatcttttcctggtggatc

SEQ ID NO: 730708 - DNA, 25 bp, Mus musculus
gttaaacatgtgaaagactctgcct

SEQ ID NO: 730709 - DNA, 25 bp, Mus musculus
gttaaacatgtgtaagactctgcct

SEQ ID NO: 730710 - DNA, 25 bp, Mus musculus
gttaaacgatggataaatgaagccc

SEQ ID NO: 730711 - DNA, 25 bp, Mus musculus
gttaaacgatggttaaatgaagccc

SEQ ID NO: 730712 - DNA, 25 bp, Mus musculus
gttaaactggaccacctcctggcct

SEQ ID NO: 730713 - DNA, 25 bp, Mus musculus
gttaaactggacgacctcctggcct

SEQ ID NO: 730714 - DNA, 25 bp, Mus musculus
gttaaagaacttactgaacgtctct

SEQ ID NO: 730715 - DNA, 25 bp, Mus musculus
gttaaagaactttctgaacgtctct

SEQ ID NO: 730716 - DNA, 25 bp, Mus musculus
gttaaagcaacaaatggaccaagat

SEQ ID NO: 730717 - DNA, 25 bp, Mus musculus
gttaaagcaacatatggaccaagat

SEQ ID NO: 730718 - DNA, 25 bp, Mus musculus
gttaaaggaaaaccttacagctcag

SEQ ID NO: 730719 - DNA, 25 bp, Mus musculus
gttaaaggaaaagcttacagctcag

SEQ ID NO: 730720 - DNA, 25 bp, Mus musculus
gttaaaggtggtcggaatcacacag

SEQ ID NO: 730721 - DNA, 25 bp, Mus musculus
gttaaaggtggtgggaatcacacag

SEQ ID NO: 730722 - DNA, 25 bp, Mus musculus
gttaaagtcatgatgcagacttcag

SEQ ID NO: 730723 - DNA, 25 bp, Mus musculus
gttaaagtcatgttgcagacttcag

SEQ ID NO: 730724 - DNA, 25 bp, Mus musculus
gttaaatccctgatgtattggctgg

SEQ ID NO: 730725 - DNA, 25 bp, Mus musculus
gttaaatccctgttgtattggctgg

SEQ ID NO: 730726 - DNA, 25 bp, Mus musculus
gttaaatctaaaagcatggatgcca

SEQ ID NO: 730727 - DNA, 25 bp, Mus musculus
gttaaatctaaatgcatggatgcca

SEQ ID NO: 730728 - DNA, 25 bp, Mus musculus
gttaacaaaatgaaccatggcatcc

SEQ ID NO: 730729 - DNA, 25 bp, Mus musculus
gttaacaaaatgtaccatggcatcc

SEQ ID NO: 730730 - DNA, 25 bp, Mus musculus
gttaacaccacgcacaaagagattg

SEQ ID NO: 730731 - DNA, 25 bp, Mus musculus
gttaacaccacggacaaagagattg

SEQ ID NO: 730732 - DNA, 25 bp, Mus musculus
gttaacatcccgacattttctgtca

SEQ ID NO: 730733 - DNA, 25 bp, Mus musculus
gttaacatcccgtcattttctgtca

SEQ ID NO: 730734 - DNA, 25 bp, Mus musculus
gttaacatgcctaacgtcatgatcc

SEQ ID NO: 730735 - DNA, 25 bp, Mus musculus
gttaacatgccttacgtcatgatcc

SEQ ID NO: 730736 - DNA, 25 bp, Mus musculus
gttaaccacgtcacgtctacgacct

SEQ ID NO: 730737 - DNA, 25 bp, Mus musculus
gttaaccacgtctcgtctacgacct

SEQ ID NO: 730738 - DNA, 25 bp, Mus musculus
gttaacccagcgcacttacatgtct

SEQ ID NO: 730739 - DNA, 25 bp, Mus musculus
gttaacccagcggacttacatgtct

SEQ ID NO: 730740 - DNA, 25 bp, Mus musculus
gttaacccgcgcctcaatcacttgt

SEQ ID NO: 730741 - DNA, 25 bp, Mus musculus
gttaacccgcgcgtcaatcacttgt

SEQ ID NO: 730742 - DNA, 25 bp, Mus musculus
gttaaccctcatccaggcggagtcg

SEQ ID NO: 730743 - DNA, 25 bp, Mus musculus
gttaaccctcatgcaggcggagtcg

SEQ ID NO: 730744 - DNA, 25 bp, Mus musculus
gttaacctctccacagccattgtcg

SEQ ID NO: 730745 - DNA, 25 bp, Mus musculus
gttaacctctcctcagccattgtcg

SEQ ID NO: 730746 - DNA, 25 bp, Mus musculus
gttaacgagagtcagaatacatgtc

SEQ ID NO: 730747 - DNA, 25 bp, Mus musculus
gttaacgagagtgagaatacatgtc

SEQ ID NO: 730748 - DNA, 25 bp, Mus musculus
gttaacgatgaaagtgacaccaggg

SEQ ID NO: 730749 - DNA, 25 bp, Mus musculus
gttaacgatgaatgtgacaccaggg

SEQ ID NO: 730750 - DNA, 25 bp, Mus musculus
gttaactaccacagcagtgaagttg

SEQ ID NO: 730751 - DNA, 25 bp, Mus musculus
gttaactaccactgcagtgaagttg

SEQ ID NO: 730752 - DNA, 25 bp, Mus musculus
gttaactactatctcgacacagctg

SEQ ID NO: 730753 - DNA, 25 bp, Mus musculus
gttaactactatgtcgacacagctg

SEQ ID NO: 730754 - DNA, 25 bp, Mus musculus
gttaactagctgagctgcggcccgg

SEQ ID NO: 730755 - DNA, 25 bp, Mus musculus
gttaactagctgtgctgcggcccgg

SEQ ID NO: 730756 - DNA, 25 bp, Mus musculus
gttaagaattccataaaccacttgg

SEQ ID NO: 730757 - DNA, 25 bp, Mus musculus
gttaagaattccttaaaccacttgg

SEQ ID NO: 730758 - DNA, 25 bp, Mus musculus
gttaagagacgcaggcatgctgcgt

SEQ ID NO: 730759 - DNA, 25 bp, Mus musculus
gttaagagacgctggcatgctgcgt

SEQ ID NO: 730760 - DNA, 25 bp, Mus musculus
gttaagaggcggctgcggcggaccg

SEQ ID NO: 730761 - DNA, 25 bp, Mus musculus
gttaagaggcgggtgcggcggaccg

SEQ ID NO: 730762 - DNA, 25 bp, Mus musculus
gttaagaggctgaggaaaatgtccg

SEQ ID NO: 730763 - DNA, 25 bp, Mus musculus
gttaagaggctgtggaaaatgtccg

SEQ ID NO: 730764 - DNA, 25 bp, Mus musculus
gttaagcaaaaaaccctcccaggtg

SEQ ID NO: 730765 - DNA, 25 bp, Mus musculus
gttaagcaaaaatccctcccaggtg

SEQ ID NO: 730766 - DNA, 25 bp, Mus musculus
gttaagcagtacagccccaaaatgg

SEQ ID NO: 730767 - DNA, 25 bp, Mus musculus
gttaagcagtactgccccaaaatgg

SEQ ID NO: 730768 - DNA, 25 bp, Mus musculus
gttaagcattaacgccttggcacgc

SEQ ID NO: 730769 - DNA, 25 bp, Mus musculus
gttaagcattaaggccttggcacgc

SEQ ID NO: 730770 - DNA, 25 bp, Mus musculus
gttaaggaagaacgcaggtgctccc

SEQ ID NO: 730771 - DNA, 25 bp, Mus musculus
gttaaggaagaaggcaggtgctccc

SEQ ID NO: 730772 - DNA, 25 bp, Mus musculus
gttaaggtcaatagaagaactggat

SEQ ID NO: 730773 - DNA, 25 bp, Mus musculus
gttaaggtcaattgaagaactggat

SEQ ID NO: 730774 - DNA, 25 bp, Mus musculus
gttaaggtcttcattatcggcagtg

SEQ ID NO: 730775 - DNA, 25 bp, Mus musculus
gttaaggtcttctttatcggcagtg

SEQ ID NO: 730776 - DNA, 25 bp, Mus musculus
gttaagtgtttgatcaccctgtcca

SEQ ID NO: 730777 - DNA, 25 bp, Mus musculus
gttaagtgtttgttcaccctgtcca

SEQ ID NO: 730778 - DNA, 25 bp, Mus musculus
gttaagttctttaccccatacactg

SEQ ID NO: 730779 - DNA, 25 bp, Mus musculus
gttaagttcttttccccatacactg

SEQ ID NO: 730780 - DNA, 25 bp, Mus musculus
gttaagttggtaatctgcagtgcac

SEQ ID NO: 730781 - DNA, 25 bp, Mus musculus
gttaagttggtattctgcagtgcac

SEQ ID NO: 730782 - DNA, 25 bp, Mus musculus
gttaatatacagatcatggctcaag

SEQ ID NO: 730783 - DNA, 25 bp, Mus musculus
gttaatatacagttcatggctcaag

SEQ ID NO: 730784 - DNA, 25 bp, Mus musculus
gttaatcttccactgtgagcttgcc

SEQ ID NO: 730785 - DNA, 25 bp, Mus musculus
gttaatcttccagtgtgagcttgcc

SEQ ID NO: 730786 - DNA, 25 bp, Mus musculus
gttaatgataagaacccacacgtgg

SEQ ID NO: 730787 - DNA, 25 bp, Mus musculus
gttaatgataagtacccacacgtgg

SEQ ID NO: 730788 - DNA, 25 bp, Mus musculus
gttaatgccttaccaggtactgtct

SEQ ID NO: 730789 - DNA, 25 bp, Mus musculus
gttaatgccttagcaggtactgtct

SEQ ID NO: 730790 - DNA, 25 bp, Mus musculus
gttaatggagccagctacccatact

SEQ ID NO: 730791 - DNA, 25 bp, Mus musculus
gttaatggagcctgctacccatact

SEQ ID NO: 730792 - DNA, 25 bp, Mus musculus
gttaatgttgatcgctccttaccag

SEQ ID NO: 730793 - DNA, 25 bp, Mus musculus
gttaatgttgatggctccttaccag

SEQ ID NO: 730794 - DNA, 25 bp, Mus musculus
gttaattttcctcatggttagcccg

SEQ ID NO: 730795 - DNA, 25 bp, Mus musculus
gttaattttcctgatggttagcccg

SEQ ID NO: 730796 - DNA, 25 bp, Mus musculus
gttacaaaacaaaagcaatgaggcc

SEQ ID NO: 730797 - DNA, 25 bp, Mus musculus
gttacaaaacaatagcaatgaggcc

SEQ ID NO: 730798 - DNA, 25 bp, Mus musculus
gttacaaaccctaaatggcagccag

SEQ ID NO: 730799 - DNA, 25 bp, Mus musculus
gttacaaacccttaatggcagccag

SEQ ID NO: 730800 - DNA, 25 bp, Mus musculus
gttacaaatgtgagtgaccaaagcc

SEQ ID NO: 730801 - DNA, 25 bp, Mus musculus
gttacaaatgtgtgtgaccaaagcc

SEQ ID NO: 730802 - DNA, 25 bp, Mus musculus
gttacaacacagcaggttgacaggc

SEQ ID NO: 730803 - DNA, 25 bp, Mus musculus
gttacaacacaggaggttgacaggc

SEQ ID NO: 730804 - DNA, 25 bp, Mus musculus
gttacaacagttaaccaggagccca

SEQ ID NO: 730805 - DNA, 25 bp, Mus musculus
gttacaacagtttaccaggagccca

SEQ ID NO: 730806 - DNA, 25 bp, Mus musculus
gttacaagaaccacacactgaaatt

SEQ ID NO: 730807 - DNA, 25 bp, Mus musculus
gttacaagaacctcacactgaaatt

SEQ ID NO: 730808 - DNA, 25 bp, Mus musculus
gttacaatacttatcctcactggtg

SEQ ID NO: 730809 - DNA, 25 bp, Mus musculus
gttacaatacttttcctcactggtg

SEQ ID NO: 730810 - DNA, 25 bp, Mus musculus
gttacacacagcagacatcagtcat

SEQ ID NO: 730811 - DNA, 25 bp, Mus musculus
gttacacacagctgacatcagtcat

SEQ ID NO: 730812 - DNA, 25 bp, Mus musculus
gttacacagcctacaacggcgtgga

SEQ ID NO: 730813 - DNA, 25 bp, Mus musculus
gttacacagccttcaacggcgtgga

SEQ ID NO: 730814 - DNA, 25 bp, Mus musculus
gttacacagggacccactgcgaagt

SEQ ID NO: 730815 - DNA, 25 bp, Mus musculus
gttacacagggagccactgcgaagt

SEQ ID NO: 730816 - DNA, 25 bp, Mus musculus
gttacacccagacgacacgcttcaa

SEQ ID NO: 730817 - DNA, 25 bp, Mus musculus
gttacacccagaggacacgcttcaa

SEQ ID NO: 730818 - DNA, 25 bp, Mus musculus
gttacaccggctctaactgcagcca

SEQ ID NO: 730819 - DNA, 25 bp, Mus musculus
gttacaccggctgtaactgcagcca

SEQ ID NO: 730820 - DNA, 25 bp, Mus musculus
gttacacgagctcttgggccatggc

SEQ ID NO: 730821 - DNA, 25 bp, Mus musculus
gttacacgagctgttgggccatggc

SEQ ID NO: 730822 - DNA, 25 bp, Mus musculus
gttacacggcttcatctatctccag

SEQ ID NO: 730823 - DNA, 25 bp, Mus musculus
gttacacggcttgatctatctccag

SEQ ID NO: 730824 - DNA, 25 bp, Mus musculus
gttacagaaggcacaatcattcgat

SEQ ID NO: 730825 - DNA, 25 bp, Mus musculus
gttacagaaggctcaatcattcgat

SEQ ID NO: 730826 - DNA, 25 bp, Mus musculus
gttacagacctgattctctagccct

SEQ ID NO: 730827 - DNA, 25 bp, Mus musculus
gttacagacctgtttctctagccct

SEQ ID NO: 730828 - DNA, 25 bp, Mus musculus
gttacagactcacccggagctggac

SEQ ID NO: 730829 - DNA, 25 bp, Mus musculus
gttacagactcagccggagctggac

SEQ ID NO: 730830 - DNA, 25 bp, Mus musculus
gttacagaggaaatagtgaatgtcc

SEQ ID NO: 730831 - DNA, 25 bp, Mus musculus
gttacagaggaattagtgaatgtcc

SEQ ID NO: 730832 - DNA, 25 bp, Mus musculus
gttacagatgctcaccctggttgcc

SEQ ID NO: 730833 - DNA, 25 bp, Mus musculus
gttacagatgctgaccctggttgcc

SEQ ID NO: 730834 - DNA, 25 bp, Mus musculus
gttacaggccctacgacgagggtct

SEQ ID NO: 730835 - DNA, 25 bp, Mus musculus
gttacaggcccttcgacgagggtct

SEQ ID NO: 730836 - DNA, 25 bp, Mus musculus
gttacagggataccagtgtcttgca

SEQ ID NO: 730837 - DNA, 25 bp, Mus musculus
gttacagggatagcagtgtcttgca

SEQ ID NO: 730838 - DNA, 25 bp, Mus musculus
gttacagtcctgctcttagattggg

SEQ ID NO: 730839 - DNA, 25 bp, Mus musculus
gttacagtcctggtcttagattggg

SEQ ID NO: 730840 - DNA, 25 bp, Mus musculus
gttacagtctctagcttcgccatgt

SEQ ID NO: 730841 - DNA, 25 bp, Mus musculus
gttacagtctcttgcttcgccatgt

SEQ ID NO: 730842 - DNA, 25 bp, Mus musculus
gttacatagactcagacagctcctg

SEQ ID NO: 730843 - DNA, 25 bp, Mus musculus
gttacatagactgagacagctcctg

SEQ ID NO: 730844 - DNA, 25 bp, Mus musculus
gttacatatatgaggatcgcctctc

SEQ ID NO: 730845 - DNA, 25 bp, Mus musculus
gttacatatatgcaagaagagagga

SEQ ID NO: 730846 - DNA, 25 bp, Mus musculus
gttacatatatggaagaagagagga

SEQ ID NO: 730847 - DNA, 25 bp, Mus musculus
gttacatatatgtggatcgcctctc

SEQ ID NO: 730848 - DNA, 25 bp, Mus musculus
gttacatcaactcccgggacctggg

SEQ ID NO: 730849 - DNA, 25 bp, Mus musculus
gttacatcaactgccgggacctggg

SEQ ID NO: 730850 - DNA, 25 bp, Mus musculus
gttacatccaccacatttgaatgaa

SEQ ID NO: 730851 - DNA, 25 bp, Mus musculus
gttacatccacctcatttgaatgaa

SEQ ID NO: 730852 - DNA, 25 bp, Mus musculus
gttacatcgaagacaactccaatca

SEQ ID NO: 730853 - DNA, 25 bp, Mus musculus
gttacatcgaagtcaactccaatca

SEQ ID NO: 730854 - DNA, 25 bp, Mus musculus
gttacatctccacgatcaaccagga

SEQ ID NO: 730855 - DNA, 25 bp, Mus musculus
gttacatctccaggatcaaccagga

SEQ ID NO: 730856 - DNA, 25 bp, Mus musculus
gttacatggctcctcaattctggaa

SEQ ID NO: 730857 - DNA, 25 bp, Mus musculus
gttacatggctcgtcaattctggaa

SEQ ID NO: 730858 - DNA, 25 bp, Mus musculus
gttacatgggtcacccaattccaga

SEQ ID NO: 730859 - DNA, 25 bp, Mus musculus
gttacatgggtctcccaattccaga

SEQ ID NO: 730860 - DNA, 25 bp, Mus musculus
gttacattgcccctgctttgtgcga

SEQ ID NO: 730861 - DNA, 25 bp, Mus musculus
gttacattgcccgtgctttgtgcga

SEQ ID NO: 730862 - DNA, 25 bp, Mus musculus
gttaccaaaggcaaaatccaaccag

SEQ ID NO: 730863 - DNA, 25 bp, Mus musculus
gttaccaaaggctaaatccaaccag

SEQ ID NO: 730864 - DNA, 25 bp, Mus musculus
gttaccaacaaactagaaagtagtg

SEQ ID NO: 730865 - DNA, 25 bp, Mus musculus
gttaccaacaaagtagaaagtagtg

SEQ ID NO: 730866 - DNA, 25 bp, Mus musculus
gttaccaacataaccgcatgtatga

SEQ ID NO: 730867 - DNA, 25 bp, Mus musculus
gttaccaacatatccgcatgtatga

SEQ ID NO: 730868 - DNA, 25 bp, Mus musculus
gttaccaacatcagtcaagcagcag

SEQ ID NO: 730869 - DNA, 25 bp, Mus musculus
gttaccaacatctgtcaagcagcag

SEQ ID NO: 730870 - DNA, 25 bp, Mus musculus
gttaccaaggagataagatcatgca

SEQ ID NO: 730871 - DNA, 25 bp, Mus musculus
gttaccaaggagttaagatcatgca

SEQ ID NO: 730872 - DNA, 25 bp, Mus musculus
gttaccacataaaccaggcgtggcc

SEQ ID NO: 730873 - DNA, 25 bp, Mus musculus
gttaccacataatccaggcgtggcc

SEQ ID NO: 730874 - DNA, 25 bp, Mus musculus
gttaccacggaaaccagcagagcta

SEQ ID NO: 730875 - DNA, 25 bp, Mus musculus
gttaccacggaatccagcagagcta

SEQ ID NO: 730876 - DNA, 25 bp, Mus musculus
gttaccagctcgctctcattggcgg

SEQ ID NO: 730877 - DNA, 25 bp, Mus musculus
gttaccagctcggtctcattggcgg

SEQ ID NO: 730878 - DNA, 25 bp, Mus musculus
gttaccagtgctatggagtcccatt

SEQ ID NO: 730879 - DNA, 25 bp, Mus musculus
gttaccagtgctttggagtcccatt

SEQ ID NO: 730880 - DNA, 25 bp, Mus musculus
gttaccatcacaatcatgcctactt

SEQ ID NO: 730881 - DNA, 25 bp, Mus musculus
gttaccatcacattcatgcctactt

SEQ ID NO: 730882 - DNA, 25 bp, Mus musculus
gttaccatgcagctggaaagggact

SEQ ID NO: 730883 - DNA, 25 bp, Mus musculus
gttaccatgcaggtggaaagggact

SEQ ID NO: 730884 - DNA, 25 bp, Mus musculus
gttaccccgacacaaggagctcttg

SEQ ID NO: 730885 - DNA, 25 bp, Mus musculus
gttaccccgacagaaggagctcttg

SEQ ID NO: 730886 - DNA, 25 bp, Mus musculus
gttaccctctggcactggtccgtac

SEQ ID NO: 730887 - DNA, 25 bp, Mus musculus
gttaccctctgggactggtccgtac

SEQ ID NO: 730888 - DNA, 25 bp, Mus musculus
gttaccgaatcaccctgaagaagtt

SEQ ID NO: 730889 - DNA, 25 bp, Mus musculus
gttaccgaatcagcctgaagaagtt

SEQ ID NO: 730890 - DNA, 25 bp, Mus musculus
gttacctcttcgaccagaaattggg

SEQ ID NO: 730891 - DNA, 25 bp, Mus musculus
gttacctcttcgtccagaaattggg

SEQ ID NO: 730892 - DNA, 25 bp, Mus musculus
gttacctctttccttagcggcagag

SEQ ID NO: 730893 - DNA, 25 bp, Mus musculus
gttacctctttcgttagcggcagag

SEQ ID NO: 730894 - DNA, 25 bp, Mus musculus
gttacctgaaccagacttagaaatt

SEQ ID NO: 730895 - DNA, 25 bp, Mus musculus
gttacctgaacctgacttagaaatt

SEQ ID NO: 730896 - DNA, 25 bp, Mus musculus
gttacctggtcaaccattcctaagg

SEQ ID NO: 730897 - DNA, 25 bp, Mus musculus
gttacctggtcatccattcctaagg

SEQ ID NO: 730898 - DNA, 25 bp, Mus musculus
gttacctgtcatagcaatcccggga

SEQ ID NO: 730899 - DNA, 25 bp, Mus musculus
gttacctgtcattgcaatcccggga

SEQ ID NO: 730900 - DNA, 25 bp, Mus musculus
gttacctgtgaaattgtgtgtcatt

SEQ ID NO: 730901 - DNA, 25 bp, Mus musculus
gttacctgtgaatttgtgtgtcatt

SEQ ID NO: 730902 - DNA, 25 bp, Mus musculus
gttacctgttcaatgacagagcctt

SEQ ID NO: 730903 - DNA, 25 bp, Mus musculus
gttacctgttcattgacagagcctt

SEQ ID NO: 730904 - DNA, 25 bp, Mus musculus
gttaccttcctaatgcacacttgga

SEQ ID NO: 730905 - DNA, 25 bp, Mus musculus
gttaccttcctattgcacacttgga

SEQ ID NO: 730906 - DNA, 25 bp, Mus musculus
gttaccttgcgcagtgtggcccgtg

SEQ ID NO: 730907 - DNA, 25 bp, Mus musculus
gttaccttgcgctgtgtggcccgtg

SEQ ID NO: 730908 - DNA, 25 bp, Mus musculus
gttacctttggcctgctgccgatct

SEQ ID NO: 730909 - DNA, 25 bp, Mus musculus
gttacctttggcgtgctgccgatct

SEQ ID NO: 730910 - DNA, 25 bp, Mus musculus
gttacgaatgtgatggtgagccacc

SEQ ID NO: 730911 - DNA, 25 bp, Mus musculus
gttacgaatgtgttggtgagccacc

SEQ ID NO: 730912 - DNA, 25 bp, Mus musculus
gttacgagatagaccatcaaacaga

SEQ ID NO: 730913 - DNA, 25 bp, Mus musculus
gttacgagatagtccatcaaacaga

SEQ ID NO: 730914 - DNA, 25 bp, Mus musculus
gttacgcaggccatcacaccaactg

SEQ ID NO: 730915 - DNA, 25 bp, Mus musculus
gttacgcaggccttcacaccaactg

SEQ ID NO: 730916 - DNA, 25 bp, Mus musculus
gttacgcctacgaatgttagtgcgt

SEQ ID NO: 730917 - DNA, 25 bp, Mus musculus
gttacgcctacgtatgttagtgcgt

SEQ ID NO: 730918 - DNA, 25 bp, Mus musculus
gttacgtccgcaaccactacttcga

SEQ ID NO: 730919 - DNA, 25 bp, Mus musculus
gttacgtccgcatccactacttcga

SEQ ID NO: 730920 - DNA, 25 bp, Mus musculus
gttacgtctggaccggactcagcct

SEQ ID NO: 730921 - DNA, 25 bp, Mus musculus
gttacgtctggagcggactcagcct

SEQ ID NO: 730922 - DNA, 25 bp, Mus musculus
gttacgtgtctactatttatcctgg

SEQ ID NO: 730923 - DNA, 25 bp, Mus musculus
gttacgtgtctagtatttatcctgg

SEQ ID NO: 730924 - DNA, 25 bp, Mus musculus
gttactaaggaaactgtcatctcca

SEQ ID NO: 730925 - DNA, 25 bp, Mus musculus
gttactaaggaatctgtcatctcca

SEQ ID NO: 730926 - DNA, 25 bp, Mus musculus
gttactacttcacaaacgtaaagag

SEQ ID NO: 730927 - DNA, 25 bp, Mus musculus
gttactacttcagaaacgtaaagag

SEQ ID NO: 730928 - DNA, 25 bp, Mus musculus
gttactatccgtcccagaaccaggg

SEQ ID NO: 730929 - DNA, 25 bp, Mus musculus
gttactatccgtgccagaaccaggg

SEQ ID NO: 730930 - DNA, 25 bp, Mus musculus
gttactcaagacagctttccagccg

SEQ ID NO: 730931 - DNA, 25 bp, Mus musculus
gttactcaagactgctttccagccg

SEQ ID NO: 730932 - DNA, 25 bp, Mus musculus
gttactctagtgacacaatctgtgg

SEQ ID NO: 730933 - DNA, 25 bp, Mus musculus
gttactctagtgtcacaatctgtgg

SEQ ID NO: 730934 - DNA, 25 bp, Mus musculus
gttactctgatcaacttctggccag

SEQ ID NO: 730935 - DNA, 25 bp, Mus musculus
gttactctgatctacttctggccag

SEQ ID NO: 730936 - DNA, 25 bp, Mus musculus
gttactcttacaatatccggcatag

SEQ ID NO: 730937 - DNA, 25 bp, Mus musculus
gttactcttacattatccggcatag

SEQ ID NO: 730938 - DNA, 25 bp, Mus musculus
gttactgaaaaacgcgcctcctcag

SEQ ID NO: 730939 - DNA, 25 bp, Mus musculus
gttactgaaaaaggcgcctcctcag

SEQ ID NO: 730940 - DNA, 25 bp, Mus musculus
gttactgactgcagtgcccctggtc

SEQ ID NO: 730941 - DNA, 25 bp, Mus musculus
gttactgactgctgtgcccctggtc

SEQ ID NO: 730942 - DNA, 25 bp, Mus musculus
gttactgatgtcaaggagaaactga

SEQ ID NO: 730943 - DNA, 25 bp, Mus musculus
gttactgatgtctaggagaaactga

SEQ ID NO: 730944 - DNA, 25 bp, Mus musculus
gttactgccatgagaccatgactgg

SEQ ID NO: 730945 - DNA, 25 bp, Mus musculus
gttactgccatgtgaccatgactgg

SEQ ID NO: 730946 - DNA, 25 bp, Mus musculus
gttactgctggcagtaagaccacca

SEQ ID NO: 730947 - DNA, 25 bp, Mus musculus
gttactgctggctgtaagaccacca

SEQ ID NO: 730948 - DNA, 25 bp, Mus musculus
gttactggtattatagaaaatcagg

SEQ ID NO: 730949 - DNA, 25 bp, Mus musculus
gttactggtattttagaaaatcagg

SEQ ID NO: 730950 - DNA, 25 bp, Mus musculus
gttactgtgacaaccgtcccaactt

SEQ ID NO: 730951 - DNA, 25 bp, Mus musculus
gttactgtgacatccgtcccaactt

SEQ ID NO: 730952 - DNA, 25 bp, Mus musculus
gttactgtggccctcctccttgtga

SEQ ID NO: 730953 - DNA, 25 bp, Mus musculus
gttactgtggccgtcctccttgtga

SEQ ID NO: 730954 - DNA, 25 bp, Mus musculus
gttactgttaagcagtgcgtctccc

SEQ ID NO: 730955 - DNA, 25 bp, Mus musculus
gttactgttaaggagtgcgtctccc

SEQ ID NO: 730956 - DNA, 25 bp, Mus musculus
gttacttcatggcagctatcccaca

SEQ ID NO: 730957 - DNA, 25 bp, Mus musculus
gttacttcatgggagctatcccaca

SEQ ID NO: 730958 - DNA, 25 bp, Mus musculus
gttacttctgataggcgattctggg

SEQ ID NO: 730959 - DNA, 25 bp, Mus musculus
gttacttctgattggcgattctggg

SEQ ID NO: 730960 - DNA, 25 bp, Mus musculus
gttacttgacgacgttgaggccagc

SEQ ID NO: 730961 - DNA, 25 bp, Mus musculus
gttacttgacgaggttgaggccagc

SEQ ID NO: 730962 - DNA, 25 bp, Mus musculus
gttacttggagtcatatagcaggtt

SEQ ID NO: 730963 - DNA, 25 bp, Mus musculus
gttacttggagtgatatagcaggtt

SEQ ID NO: 730964 - DNA, 25 bp, Mus musculus
gttactttcaatcccagtgctctgg

SEQ ID NO: 730965 - DNA, 25 bp, Mus musculus
gttactttcaatgccagtgctctgg

SEQ ID NO: 730966 - DNA, 25 bp, Mus musculus
gttagaacatggagtcctttcctgg

SEQ ID NO: 730967 - DNA, 25 bp, Mus musculus
gttagaacatggtgtcctttcctgg

SEQ ID NO: 730968 - DNA, 25 bp, Mus musculus
gttagaacgattcagtaggacttag

SEQ ID NO: 730969 - DNA, 25 bp, Mus musculus
gttagaacgattgagtaggacttag

SEQ ID NO: 730970 - DNA, 25 bp, Mus musculus
gttagaagaagtcatggagcaactc

SEQ ID NO: 730971 - DNA, 25 bp, Mus musculus
gttagaagaagtgatggagcaactc

SEQ ID NO: 730972 - DNA, 25 bp, Mus musculus
gttagaagacatactgggaccagat

SEQ ID NO: 730973 - DNA, 25 bp, Mus musculus
gttagaagacattctgggaccagat

SEQ ID NO: 730974 - DNA, 25 bp, Mus musculus
gttagaaggtccagcccctgctcct

SEQ ID NO: 730975 - DNA, 25 bp, Mus musculus
gttagaaggtcctgcccctgctcct

SEQ ID NO: 730976 - DNA, 25 bp, Mus musculus
gttagactgcagactcacacttcca

SEQ ID NO: 730977 - DNA, 25 bp, Mus musculus
gttagactgcagtctcacacttcca

SEQ ID NO: 730978 - DNA, 25 bp, Mus musculus
gttagagactaacccctgggtctgg

SEQ ID NO: 730979 - DNA, 25 bp, Mus musculus
gttagagactaagccctgggtctgg

SEQ ID NO: 730980 - DNA, 25 bp, Mus musculus
gttagagatgcacttcagccccaaa

SEQ ID NO: 730981 - DNA, 25 bp, Mus musculus
gttagagatgcagttcagccccaaa

SEQ ID NO: 730982 - DNA, 25 bp, Mus musculus
gttagagcctatatggaaacccaga

SEQ ID NO: 730983 - DNA, 25 bp, Mus musculus
gttagagcctatttggaaacccaga

SEQ ID NO: 730984 - DNA, 25 bp, Mus musculus
gttagagctggaccgcataggccct

SEQ ID NO: 730985 - DNA, 25 bp, Mus musculus
gttagagctggagcgcataggccct

SEQ ID NO: 730986 - DNA, 25 bp, Mus musculus
gttagaggctctccacgcagtggac

SEQ ID NO: 730987 - DNA, 25 bp, Mus musculus
gttagaggctctgcacgcagtggac

SEQ ID NO: 730988 - DNA, 25 bp, Mus musculus
gttagagtcaccatgtaacggacgg

SEQ ID NO: 730989 - DNA, 25 bp, Mus musculus
gttagagtcaccttgtaacggacgg

SEQ ID NO: 730990 - DNA, 25 bp, Mus musculus
gttagcaatgtactcatcccacctc

SEQ ID NO: 730991 - DNA, 25 bp, Mus musculus
gttagcaatgtagtcatcccacctc

SEQ ID NO: 730992 - DNA, 25 bp, Mus musculus
gttagcacagatcaggcctaatcca

SEQ ID NO: 730993 - DNA, 25 bp, Mus musculus
gttagcacagatgaggcctaatcca

SEQ ID NO: 730994 - DNA, 25 bp, Mus musculus
gttagcactgaaacccgatgcagtt

SEQ ID NO: 730995 - DNA, 25 bp, Mus musculus
gttagcactgaatcccgatgcagtt

SEQ ID NO: 730996 - DNA, 25 bp, Mus musculus
gttagcatagccaggaccagcctgc

SEQ ID NO: 730997 - DNA, 25 bp, Mus musculus
gttagcatagcctggaccagcctgc

SEQ ID NO: 730998 - DNA, 25 bp, Mus musculus
gttagcgatgataccatttgtgtcc

SEQ ID NO: 730999 - DNA, 25 bp, Mus musculus
gttagcgatgattccatttgtgtcc

SEQ ID NO: 731000 - DNA, 25 bp, Mus musculus
gttagcgatgcaactaagttaaggc

SEQ ID NO: 731001 - DNA, 25 bp, Mus musculus
gttagcgatgcatctaagttaaggc

SEQ ID NO: 731002 - DNA, 25 bp, Mus musculus
gttagcggagtgcagctgtctcact

SEQ ID NO: 731003 - DNA, 25 bp, Mus musculus
gttagcggagtggagctgtctcact

SEQ ID NO: 731004 - DNA, 25 bp, Mus musculus
gttagctacgagcaccccagattca

SEQ ID NO: 731005 - DNA, 25 bp, Mus musculus
gttagctacgaggaccccagattca

SEQ ID NO: 731006 - DNA, 25 bp, Mus musculus
gttagctcgcctatctcagtacctg

SEQ ID NO: 731007 - DNA, 25 bp, Mus musculus
gttagctcgcctttctcagtacctg

SEQ ID NO: 731008 - DNA, 25 bp, Mus musculus
gttagctcgcgacctggcgtctcag

SEQ ID NO: 731009 - DNA, 25 bp, Mus musculus
gttagctcgcgagctggcgtctcag

SEQ ID NO: 731010 - DNA, 25 bp, Mus musculus
gttagctctactccccatgagctca

SEQ ID NO: 731011 - DNA, 25 bp, Mus musculus
gttagctctactgcccatgagctca

SEQ ID NO: 731012 - DNA, 25 bp, Mus musculus
gttagcttcttactctaagttgccc

SEQ ID NO: 731013 - DNA, 25 bp, Mus musculus
gttagcttcttagtctaagttgccc

SEQ ID NO: 731014 - DNA, 25 bp, Mus musculus
gttaggaaaattccagccctgtgga

SEQ ID NO: 731015 - DNA, 25 bp, Mus musculus
gttaggaaaattgcagccctgtgga

SEQ ID NO: 731016 - DNA, 25 bp, Mus musculus
gttaggacagcaaatcctggctgac

SEQ ID NO: 731017 - DNA, 25 bp, Mus musculus
gttaggacagcatatcctggctgac

SEQ ID NO: 731018 - DNA, 25 bp, Mus musculus
gttaggcatcatattcttgttttca

SEQ ID NO: 731019 - DNA, 25 bp, Mus musculus
gttaggcatcattttcttgttttca

SEQ ID NO: 731020 - DNA, 25 bp, Mus musculus
gttaggcccaatacacaagaaccag

SEQ ID NO: 731021 - DNA, 25 bp, Mus musculus
gttaggcccaattcacaagaaccag

SEQ ID NO: 731022 - DNA, 25 bp, Mus musculus
gttaggcctggaccctcatgtcact

SEQ ID NO: 731023 - DNA, 25 bp, Mus musculus
gttaggcctggagcctcatgtcact

SEQ ID NO: 731024 - DNA, 25 bp, Mus musculus
gttaggcgcgatcctttccactgct

SEQ ID NO: 731025 - DNA, 25 bp, Mus musculus
gttaggcgcgatgctttccactgct

SEQ ID NO: 731026 - DNA, 25 bp, Mus musculus
gttagtagtcaaccaaacgctgtgc

SEQ ID NO: 731027 - DNA, 25 bp, Mus musculus
gttagtagtcaagcaaacgctgtgc

SEQ ID NO: 731028 - DNA, 25 bp, Mus musculus
gttagtctgcagcttcgggtcgttc

SEQ ID NO: 731029 - DNA, 25 bp, Mus musculus
gttagtctgcaggttcgggtcgttc

SEQ ID NO: 731030 - DNA, 25 bp, Mus musculus
gttataaaattgaaaccccatcaag

SEQ ID NO: 731031 - DNA, 25 bp, Mus musculus
gttataaaattgtaaccccatcaag

SEQ ID NO: 731032 - DNA, 25 bp, Mus musculus
gttataagccagacaagtgcttttg

SEQ ID NO: 731033 - DNA, 25 bp, Mus musculus
gttataagccagtcaagtgcttttg

SEQ ID NO: 731034 - DNA, 25 bp, Mus musculus
gttataagtacaaggccttggcctt

SEQ ID NO: 731035 - DNA, 25 bp, Mus musculus
gttataagtacatggccttggcctt

SEQ ID NO: 731036 - DNA, 25 bp, Mus musculus
gttatacacagaaaaggacacagga

SEQ ID NO: 731037 - DNA, 25 bp, Mus musculus
gttatacacagataaggacacagga

SEQ ID NO: 731038 - DNA, 25 bp, Mus musculus
gttatacagtgtagtcccaagcaca

SEQ ID NO: 731039 - DNA, 25 bp, Mus musculus
gttatacagtgttgtcccaagcaca

SEQ ID NO: 731040 - DNA, 25 bp, Mus musculus
gttataccaaccattgacatggctg

SEQ ID NO: 731041 - DNA, 25 bp, Mus musculus
gttataccaacctttgacatggctg

SEQ ID NO: 731042 - DNA, 25 bp, Mus musculus
gttatacctgttacttcaaccacaa

SEQ ID NO: 731043 - DNA, 25 bp, Mus musculus
gttatacctgtttcttcaaccacaa

SEQ ID NO: 731044 - DNA, 25 bp, Mus musculus
gttatagagctgaaaaaccgcacgg

SEQ ID NO: 731045 - DNA, 25 bp, Mus musculus
gttatagagctgtaaaaccgcacgg

SEQ ID NO: 731046 - DNA, 25 bp, Mus musculus
gttatagtgcctcgcggagagaaaa

SEQ ID NO: 731047 - DNA, 25 bp, Mus musculus
gttatagtgcctggcggagagaaaa

SEQ ID NO: 731048 - DNA, 25 bp, Mus musculus
gttatatatgcacgtggatttgggc

SEQ ID NO: 731049 - DNA, 25 bp, Mus musculus
gttatatatgcaggtggatttgggc

SEQ ID NO: 731050 - DNA, 25 bp, Mus musculus
gttatcaacaagaaactgtggaggg

SEQ ID NO: 731051 - DNA, 25 bp, Mus musculus
gttatcaacaagtaactgtggaggg

SEQ ID NO: 731052 - DNA, 25 bp, Mus musculus
gttatcaatgtcacaggcatttcag

SEQ ID NO: 731053 - DNA, 25 bp, Mus musculus
gttatcaatgtctcaggcatttcag

SEQ ID NO: 731054 - DNA, 25 bp, Mus musculus
gttatcagacccaagcacattctcc

SEQ ID NO: 731055 - DNA, 25 bp, Mus musculus
gttatcagaccctagcacattctcc

SEQ ID NO: 731056 - DNA, 25 bp, Mus musculus
gttatcagccacctaaaccagggac

SEQ ID NO: 731057 - DNA, 25 bp, Mus musculus
gttatcagccacgtaaaccagggac

SEQ ID NO: 731058 - DNA, 25 bp, Mus musculus
gttatcagtactaagaaatcaagag

SEQ ID NO: 731059 - DNA, 25 bp, Mus musculus
gttatcagtacttagaaatcaagag

SEQ ID NO: 731060 - DNA, 25 bp, Mus musculus
gttatccaacttcagcctcccagaa

SEQ ID NO: 731061 - DNA, 25 bp, Mus musculus
gttatccaacttgagcctcccagaa

SEQ ID NO: 731062 - DNA, 25 bp, Mus musculus
gttatccacctcatgaatcactggc

SEQ ID NO: 731063 - DNA, 25 bp, Mus musculus
gttatccacctcttgaatcactggc

SEQ ID NO: 731064 - DNA, 25 bp, Mus musculus
gttatccagtctaggcacctgctgc

SEQ ID NO: 731065 - DNA, 25 bp, Mus musculus
gttatccagtcttggcacctgctgc

SEQ ID NO: 731066 - DNA, 25 bp, Mus musculus
gttatccatagcaaccctgctggaa

SEQ ID NO: 731067 - DNA, 25 bp, Mus musculus
gttatccatagctaccctgctggaa

SEQ ID NO: 731068 - DNA, 25 bp, Mus musculus
gttatcctgggaaacctcggaacag

SEQ ID NO: 731069 - DNA, 25 bp, Mus musculus
gttatcctgggatacctcggaacag

SEQ ID NO: 731070 - DNA, 25 bp, Mus musculus
gttatcgctgccaatttcctgctgg

SEQ ID NO: 731071 - DNA, 25 bp, Mus musculus
gttatcgctgcctatttcctgctgg

SEQ ID NO: 731072 - DNA, 25 bp, Mus musculus
gttatctatgccatggctgaagatg

SEQ ID NO: 731073 - DNA, 25 bp, Mus musculus
gttatctatgccttggctgaagatg

SEQ ID NO: 731074 - DNA, 25 bp, Mus musculus
gttatctcaggcattgacagtgtga

SEQ ID NO: 731075 - DNA, 25 bp, Mus musculus
gttatctcaggctttgacagtgtga

SEQ ID NO: 731076 - DNA, 25 bp, Mus musculus
gttatctctgatcgcaactcctatg

SEQ ID NO: 731077 - DNA, 25 bp, Mus musculus
gttatctctgatggcaactcctatg

SEQ ID NO: 731078 - DNA, 25 bp, Mus musculus
gttatctgggacagaacaactagaa

SEQ ID NO: 731079 - DNA, 25 bp, Mus musculus
gttatctgggactgaacaactagaa

SEQ ID NO: 731080 - DNA, 25 bp, Mus musculus
gttatcttatccaccatccttacag

SEQ ID NO: 731081 - DNA, 25 bp, Mus musculus
gttatcttatcctccatccttacag

SEQ ID NO: 731082 - DNA, 25 bp, Mus musculus
gttatcttgctacgtctttgccttc

SEQ ID NO: 731083 - DNA, 25 bp, Mus musculus
gttatcttgctaggtctttgccttc

SEQ ID NO: 731084 - DNA, 25 bp, Mus musculus
gttatctttcgtccggtagtcttcg

SEQ ID NO: 731085 - DNA, 25 bp, Mus musculus
gttatctttcgtgcggtagtcttcg

SEQ ID NO: 731086 - DNA, 25 bp, Mus musculus
gttatgaactacctgcccaccatgg

SEQ ID NO: 731087 - DNA, 25 bp, Mus musculus
gttatgaactacgtgcccaccatgg

SEQ ID NO: 731088 - DNA, 25 bp, Mus musculus
gttatgacacctatgcggcagacat

SEQ ID NO: 731089 - DNA, 25 bp, Mus musculus
gttatgacacctttgcggcagacat

SEQ ID NO: 731090 - DNA, 25 bp, Mus musculus
gttatgacacttagccccattgaga

SEQ ID NO: 731091 - DNA, 25 bp, Mus musculus
gttatgacactttgccccattgaga

SEQ ID NO: 731092 - DNA, 25 bp, Mus musculus
gttatgacctataccaaagtaggag

SEQ ID NO: 731093 - DNA, 25 bp, Mus musculus
gttatgacctattccaaagtaggag

SEQ ID NO: 731094 - DNA, 25 bp, Mus musculus
gttatgacctgcaggaaacactgat

SEQ ID NO: 731095 - DNA, 25 bp, Mus musculus
gttatgacctgctggaaacactgat

SEQ ID NO: 731096 - DNA, 25 bp, Mus musculus
gttatgacttctcttctgagaagca

SEQ ID NO: 731097 - DNA, 25 bp, Mus musculus
gttatgacttctgttctgagaagca

SEQ ID NO: 731098 - DNA, 25 bp, Mus musculus
gttatgagacctcgaagaagtgacc

SEQ ID NO: 731099 - DNA, 25 bp, Mus musculus
gttatgagacctggaagaagtgacc

SEQ ID NO: 731100 - DNA, 25 bp, Mus musculus
gttatgatacatatccacgcttggg

SEQ ID NO: 731101 - DNA, 25 bp, Mus musculus
gttatgatacatttccacgcttggg

SEQ ID NO: 731102 - DNA, 25 bp, Mus musculus
gttatgatgatgcttctcccgttat

SEQ ID NO: 731103 - DNA, 25 bp, Mus musculus
gttatgatgatggttctcccgttat

SEQ ID NO: 731104 - DNA, 25 bp, Mus musculus
gttatgattttgagatcaaggttcc

SEQ ID NO: 731105 - DNA, 25 bp, Mus musculus
gttatgattttgtgatcaaggttcc

SEQ ID NO: 731106 - DNA, 25 bp, Mus musculus
gttatgcaaagcctacacgttagag

SEQ ID NO: 731107 - DNA, 25 bp, Mus musculus
gttatgcaaagcgtacacgttagag

SEQ ID NO: 731108 - DNA, 25 bp, Mus musculus
gttatgcagatgctagaagacactc

SEQ ID NO: 731109 - DNA, 25 bp, Mus musculus
gttatgcagatggtagaagacactc

SEQ ID NO: 731110 - DNA, 25 bp, Mus musculus
gttatgcatgaccttggagggccca

SEQ ID NO: 731111 - DNA, 25 bp, Mus musculus
gttatgcatgacgttggagggccca

SEQ ID NO: 731112 - DNA, 25 bp, Mus musculus
gttatgcccctcatttgacagccag

SEQ ID NO: 731113 - DNA, 25 bp, Mus musculus
gttatgcccctcttttgacagccag

SEQ ID NO: 731114 - DNA, 25 bp, Mus musculus
gttatgcccgggaggcaccacctgg

SEQ ID NO: 731115 - DNA, 25 bp, Mus musculus
gttatgcccgggtggcaccacctgg

SEQ ID NO: 731116 - DNA, 25 bp, Mus musculus
gttatgccctcactgtactgaagct

SEQ ID NO: 731117 - DNA, 25 bp, Mus musculus
gttatgccctcagtgtactgaagct

SEQ ID NO: 731118 - DNA, 25 bp, Mus musculus
gttatggaacagcaccagtaaatct

SEQ ID NO: 731119 - DNA, 25 bp, Mus musculus
gttatggaacaggaccagtaaatct

SEQ ID NO: 731120 - DNA, 25 bp, Mus musculus
gttatggaatacactgggtgtctgc

SEQ ID NO: 731121 - DNA, 25 bp, Mus musculus
gttatggaatactctgggtgtctgc

SEQ ID NO: 731122 - DNA, 25 bp, Mus musculus
gttatggagatcacaacagccaaag

SEQ ID NO: 731123 - DNA, 25 bp, Mus musculus
gttatggagatctcaacagccaaag

SEQ ID NO: 731124 - DNA, 25 bp, Mus musculus
gttatggatcgcacggtaatggacc

SEQ ID NO: 731125 - DNA, 25 bp, Mus musculus
gttatggatcgctcggtaatggacc

SEQ ID NO: 731126 - DNA, 25 bp, Mus musculus
gttatggctatgaaaaatcccttcg

SEQ ID NO: 731127 - DNA, 25 bp, Mus musculus
gttatggctatgtaaaatcccttcg

SEQ ID NO: 731128 - DNA, 25 bp, Mus musculus
gttatggcttaaaacagatgtggca

SEQ ID NO: 731129 - DNA, 25 bp, Mus musculus
gttatggcttaatacagatgtggca

SEQ ID NO: 731130 - DNA, 25 bp, Mus musculus
gttatggcttgccaatttctcgtct

SEQ ID NO: 731131 - DNA, 25 bp, Mus musculus
gttatggcttgcgaatttctcgtct

SEQ ID NO: 731132 - DNA, 25 bp, Mus musculus
gttatgtaccgcacagatgggccca

SEQ ID NO: 731133 - DNA, 25 bp, Mus musculus
gttatgtaccgctcagatgggccca

SEQ ID NO: 731134 - DNA, 25 bp, Mus musculus
gttatgtattctccgctctgtctca

SEQ ID NO: 731135 - DNA, 25 bp, Mus musculus
gttatgtattctgcgctctgtctca

SEQ ID NO: 731136 - DNA, 25 bp, Mus musculus
gttatgtcgtcaacgctatccccat

SEQ ID NO: 731137 - DNA, 25 bp, Mus musculus
gttatgtcgtcatcgctatccccat

SEQ ID NO: 731138 - DNA, 25 bp, Mus musculus
gttatgtggactatgagtctgctga

SEQ ID NO: 731139 - DNA, 25 bp, Mus musculus
gttatgtggactttgagtctgctga

SEQ ID NO: 731140 - DNA, 25 bp, Mus musculus
gttatgttagtgacagtgccaccaa

SEQ ID NO: 731141 - DNA, 25 bp, Mus musculus
gttatgttagtgtcagtgccaccaa

SEQ ID NO: 731142 - DNA, 25 bp, Mus musculus
gttattaagtgcaaagcggctgtcc

SEQ ID NO: 731143 - DNA, 25 bp, Mus musculus
gttattaagtgctaagcggctgtcc

SEQ ID NO: 731144 - DNA, 25 bp, Mus musculus
gttattacaatgagactcagctgcc

SEQ ID NO: 731145 - DNA, 25 bp, Mus musculus
gttattacaatgtgactcagctgcc

SEQ ID NO: 731146 - DNA, 25 bp, Mus musculus
gttattatatgccttgttttctgtc

SEQ ID NO: 731147 - DNA, 25 bp, Mus musculus
gttattatatgcgttgttttctgtc

SEQ ID NO: 731148 - DNA, 25 bp, Mus musculus
gttattatcaagatcacaccaacag

SEQ ID NO: 731149 - DNA, 25 bp, Mus musculus
gttattatcaagttcacaccaacag

SEQ ID NO: 731150 - DNA, 25 bp, Mus musculus
gttattatcaggagatgcccacagc

SEQ ID NO: 731151 - DNA, 25 bp, Mus musculus
gttattatcaggtgatgcccacagc

SEQ ID NO: 731152 - DNA, 25 bp, Mus musculus
gttattcatgaacacgcacccacca

SEQ ID NO: 731153 - DNA, 25 bp, Mus musculus
gttattcatgaagacgcacccacca

SEQ ID NO: 731154 - DNA, 25 bp, Mus musculus
gttattcattagaccaagtgtccat

SEQ ID NO: 731155 - DNA, 25 bp, Mus musculus
gttattcattagtccaagtgtccat

SEQ ID NO: 731156 - DNA, 25 bp, Mus musculus
gttattgataaaaaagcgtgttcct

SEQ ID NO: 731157 - DNA, 25 bp, Mus musculus
gttattgataaataagcgtgttcct

SEQ ID NO: 731158 - DNA, 25 bp, Mus musculus
gttatttacgtccaactcctttgat

SEQ ID NO: 731159 - DNA, 25 bp, Mus musculus
gttatttacgtcgaactcctttgat

SEQ ID NO: 731160 - DNA, 25 bp, Mus musculus
gttatttctgtacatggaggcatgc

SEQ ID NO: 731161 - DNA, 25 bp, Mus musculus
gttatttctgtagatggaggcatgc

SEQ ID NO: 731162 - DNA, 25 bp, Mus musculus
gttatttgggcaatacataccttgc

SEQ ID NO: 731163 - DNA, 25 bp, Mus musculus
gttatttgggcattacataccttgc

SEQ ID NO: 731164 - DNA, 25 bp, Mus musculus
gttcaaacatccaggtgggagacct

SEQ ID NO: 731165 - DNA, 25 bp, Mus musculus
gttcaaacatcctggtgggagacct

SEQ ID NO: 731166 - DNA, 25 bp, Mus musculus
gttcaaagccacatgcaccaacgtg

SEQ ID NO: 731167 - DNA, 25 bp, Mus musculus
gttcaaagccacttgcaccaacgtg

SEQ ID NO: 731168 - DNA, 25 bp, Mus musculus
gttcaaagtcagacaagttatcatg

SEQ ID NO: 731169 - DNA, 25 bp, Mus musculus
gttcaaagtcagtcaagttatcatg

SEQ ID NO: 731170 - DNA, 25 bp, Mus musculus
gttcaaagttgtagagacagatccc

SEQ ID NO: 731171 - DNA, 25 bp, Mus musculus
gttcaaagttgttgagacagatccc

SEQ ID NO: 731172 - DNA, 25 bp, Mus musculus
gttcaaataagtaccccaatgggct

SEQ ID NO: 731173 - DNA, 25 bp, Mus musculus
gttcaaataagttccccaatgggct

SEQ ID NO: 731174 - DNA, 25 bp, Mus musculus
gttcaaatatgactccacacatggt

SEQ ID NO: 731175 - DNA, 25 bp, Mus musculus
gttcaaatatgagtccacacatggt

SEQ ID NO: 731176 - DNA, 25 bp, Mus musculus
gttcaaatgcatacaccagtggaga

SEQ ID NO: 731177 - DNA, 25 bp, Mus musculus
gttcaaatgcattcaccagtggaga

SEQ ID NO: 731178 - DNA, 25 bp, Mus musculus
gttcaacaaccacgccttctcagtg

SEQ ID NO: 731179 - DNA, 25 bp, Mus musculus
gttcaacaaccaggccttctcagtg

SEQ ID NO: 731180 - DNA, 25 bp, Mus musculus
gttcaacaagctcaaagttggctgc

SEQ ID NO: 731181 - DNA, 25 bp, Mus musculus
gttcaacaagctgaaagttggctgc

SEQ ID NO: 731182 - DNA, 25 bp, Mus musculus
gttcaacaccgcatccaggtgccgg

SEQ ID NO: 731183 - DNA, 25 bp, Mus musculus
gttcaacaccgcttccaggtgccgg

SEQ ID NO: 731184 - DNA, 25 bp, Mus musculus
gttcaacactcaattgaggtcccag

SEQ ID NO: 731185 - DNA, 25 bp, Mus musculus
gttcaacactcatttgaggtcccag

SEQ ID NO: 731186 - DNA, 25 bp, Mus musculus
gttcaacagatgctcgagacagtag

SEQ ID NO: 731187 - DNA, 25 bp, Mus musculus
gttcaacagatggtcgagacagtag

SEQ ID NO: 731188 - DNA, 25 bp, Mus musculus
gttcaacagcaacttaaaccgggag

SEQ ID NO: 731189 - DNA, 25 bp, Mus musculus
gttcaacagcaagttaaaccgggag

SEQ ID NO: 731190 - DNA, 25 bp, Mus musculus
gttcaaccagacagtccagagctct

SEQ ID NO: 731191 - DNA, 25 bp, Mus musculus
gttcaaccagactgtccagagctct

SEQ ID NO: 731192 - DNA, 25 bp, Mus musculus
gttcaaccagatctggactgcctag

SEQ ID NO: 731193 - DNA, 25 bp, Mus musculus
gttcaaccagatgtggactgcctag

SEQ ID NO: 731194 - DNA, 25 bp, Mus musculus
gttcaacccaacactcgccttgaag

SEQ ID NO: 731195 - DNA, 25 bp, Mus musculus
gttcaacccaactctcgccttgaag

SEQ ID NO: 731196 - DNA, 25 bp, Mus musculus
gttcaaccctcgatctttctctcag

SEQ ID NO: 731197 - DNA, 25 bp, Mus musculus
gttcaaccctcgttctttctctcag

SEQ ID NO: 731198 - DNA, 25 bp, Mus musculus
gttcaacgaactccggatcagagga

SEQ ID NO: 731199 - DNA, 25 bp, Mus musculus
gttcaacgaactgcggatcagagga

SEQ ID NO: 731200 - DNA, 25 bp, Mus musculus
gttcaacgggcacatttagagaatg

SEQ ID NO: 731201 - DNA, 25 bp, Mus musculus
gttcaacgggcagatttagagaatg

SEQ ID NO: 731202 - DNA, 25 bp, Mus musculus
gttcaactcagactttgcacatata

SEQ ID NO: 731203 - DNA, 25 bp, Mus musculus
gttcaactcagagtttgcacatata

SEQ ID NO: 731204 - DNA, 25 bp, Mus musculus
gttcaactggagagcggatatgcct

SEQ ID NO: 731205 - DNA, 25 bp, Mus musculus
gttcaactggagtgcggatatgcct

SEQ ID NO: 731206 - DNA, 25 bp, Mus musculus
gttcaacttgatctacgatggcacc

SEQ ID NO: 731207 - DNA, 25 bp, Mus musculus
gttcaacttgatgtacgatggcacc

SEQ ID NO: 731208 - DNA, 25 bp, Mus musculus
gttcaagaacaacgtcctaatctgg

SEQ ID NO: 731209 - DNA, 25 bp, Mus musculus
gttcaagaacaaggtcctaatctgg

SEQ ID NO: 731210 - DNA, 25 bp, Mus musculus
gttcaagaatgtccccatccaagca

SEQ ID NO: 731211 - DNA, 25 bp, Mus musculus
gttcaagaatgtgcccatccaagca

SEQ ID NO: 731212 - DNA, 25 bp, Mus musculus
gttcaagaccgcctatggcatgaag

SEQ ID NO: 731213 - DNA, 25 bp, Mus musculus
gttcaagaccgcgtatggcatgaag

SEQ ID NO: 731214 - DNA, 25 bp, Mus musculus
gttcaagatctgcatgcagcctgtg

SEQ ID NO: 731215 - DNA, 25 bp, Mus musculus
gttcaagatctggatgcagcctgtg

SEQ ID NO: 731216 - DNA, 25 bp, Mus musculus
gttcaagattggctcccaagaatca

SEQ ID NO: 731217 - DNA, 25 bp, Mus musculus
gttcaagattgggtcccaagaatca

SEQ ID NO: 731218 - DNA, 25 bp, Mus musculus
gttcaagcacatccagattcgagtg

SEQ ID NO: 731219 - DNA, 25 bp, Mus musculus
gttcaagcacatgcagattcgagtg

SEQ ID NO: 731220 - DNA, 25 bp, Mus musculus
gttcaagcacgacttaactgcccgg

SEQ ID NO: 731221 - DNA, 25 bp, Mus musculus
gttcaagcacgagttaactgcccgg

SEQ ID NO: 731222 - DNA, 25 bp, Mus musculus
gttcaagcccagacttctcccgggt

SEQ ID NO: 731223 - DNA, 25 bp, Mus musculus
gttcaagcccagtcttctcccgggt

SEQ ID NO: 731224 - DNA, 25 bp, Mus musculus
gttcaagggcaccaacagctcgatt

SEQ ID NO: 731225 - DNA, 25 bp, Mus musculus
gttcaagggcacgaacagctcgatt

SEQ ID NO: 731226 - DNA, 25 bp, Mus musculus
gttcaagggcagacggagttttcga

SEQ ID NO: 731227 - DNA, 25 bp, Mus musculus
gttcaagggcagtcggagttttcga

SEQ ID NO: 731228 - DNA, 25 bp, Mus musculus
gttcaagtacttccaaagaatgacc

SEQ ID NO: 731229 - DNA, 25 bp, Mus musculus
gttcaagtacttgcaaagaatgacc

SEQ ID NO: 731230 - DNA, 25 bp, Mus musculus
gttcaagtgaacagaaggtctggga

SEQ ID NO: 731231 - DNA, 25 bp, Mus musculus
gttcaagtgaactgaaggtctggga

SEQ ID NO: 731232 - DNA, 25 bp, Mus musculus
gttcaataaatgaaaaggtgccgca

SEQ ID NO: 731233 - DNA, 25 bp, Mus musculus
gttcaataaatgtaaaggtgccgca

SEQ ID NO: 731234 - DNA, 25 bp, Mus musculus
gttcaatatgttccctggagctccc

SEQ ID NO: 731235 - DNA, 25 bp, Mus musculus
gttcaatatgttgcctggagctccc

SEQ ID NO: 731236 - DNA, 25 bp, Mus musculus
gttcaatcaagacgagctggcgctc

SEQ ID NO: 731237 - DNA, 25 bp, Mus musculus
gttcaatcaagaggagctggcgctc

SEQ ID NO: 731238 - DNA, 25 bp, Mus musculus
gttcaatgacatcgtattactgaag

SEQ ID NO: 731239 - DNA, 25 bp, Mus musculus
gttcaatgacatggtattactgaag

SEQ ID NO: 731240 - DNA, 25 bp, Mus musculus
gttcaatgcgctacctgtacccaat

SEQ ID NO: 731241 - DNA, 25 bp, Mus musculus
gttcaatgcgcttcctgtacccaat

SEQ ID NO: 731242 - DNA, 25 bp, Mus musculus
gttcaatgctcactataacctcacc

SEQ ID NO: 731243 - DNA, 25 bp, Mus musculus
gttcaatgctcagtataacctcacc

SEQ ID NO: 731244 - DNA, 25 bp, Mus musculus
gttcaatgtcggcagaagacctgga

SEQ ID NO: 731245 - DNA, 25 bp, Mus musculus
gttcaatgtcgggagaagacctgga

SEQ ID NO: 731246 - DNA, 25 bp, Mus musculus
gttcaattatacaccagggcatctg

SEQ ID NO: 731247 - DNA, 25 bp, Mus musculus
gttcaattatactccagggcatctg

SEQ ID NO: 731248 - DNA, 25 bp, Mus musculus
gttcaatttcaacatggctgaggtg

SEQ ID NO: 731249 - DNA, 25 bp, Mus musculus
gttcaatttcaagatggctgaggtg

SEQ ID NO: 731250 - DNA, 25 bp, Mus musculus
gttcacaacaaacagcaacttgaaa

SEQ ID NO: 731251 - DNA, 25 bp, Mus musculus
gttcacaacaaagagcaacttgaaa

SEQ ID NO: 731252 - DNA, 25 bp, Mus musculus
gttcacaagtgtacatccacctggg

SEQ ID NO: 731253 - DNA, 25 bp, Mus musculus
gttcacaagtgttcatccacctggg

SEQ ID NO: 731254 - DNA, 25 bp, Mus musculus
gttcacacccgcaaggtcactggag

SEQ ID NO: 731255 - DNA, 25 bp, Mus musculus
gttcacacccgctaggtcactggag

SEQ ID NO: 731256 - DNA, 25 bp, Mus musculus
gttcacaccgctccctctgtggtgg

SEQ ID NO: 731257 - DNA, 25 bp, Mus musculus
gttcacaccgctgcctctgtggtgg

SEQ ID NO: 731258 - DNA, 25 bp, Mus musculus
gttcacactaggaaaatgaatttag

SEQ ID NO: 731259 - DNA, 25 bp, Mus musculus
gttcacactaggtaaatgaatttag

SEQ ID NO: 731260 - DNA, 25 bp, Mus musculus
gttcacactcgcataggtatttcta

SEQ ID NO: 731261 - DNA, 25 bp, Mus musculus
gttcacactcgcttaggtatttcta

SEQ ID NO: 731262 - DNA, 25 bp, Mus musculus
gttcacagctcacatgatcaccatc

SEQ ID NO: 731263 - DNA, 25 bp, Mus musculus
gttcacagctcagatgatcaccatc

SEQ ID NO: 731264 - DNA, 25 bp, Mus musculus
gttcacagtcagagtggaccatcgg

SEQ ID NO: 731265 - DNA, 25 bp, Mus musculus
gttcacagtcagtgtggaccatcgg

SEQ ID NO: 731266 - DNA, 25 bp, Mus musculus
gttcacagtcgcctctgccagtggg

SEQ ID NO: 731267 - DNA, 25 bp, Mus musculus
gttcacagtcgcgtctgccagtggg

SEQ ID NO: 731268 - DNA, 25 bp, Mus musculus
gttcacatcgctataccataaagag

SEQ ID NO: 731269 - DNA, 25 bp, Mus musculus
gttcacatcgctttaccataaagag

SEQ ID NO: 731270 - DNA, 25 bp, Mus musculus
gttcaccagcacattccaggaaatg

SEQ ID NO: 731271 - DNA, 25 bp, Mus musculus
gttcaccagcactttccaggaaatg

SEQ ID NO: 731272 - DNA, 25 bp, Mus musculus
gttcacccgcagctacaacaagact

SEQ ID NO: 731273 - DNA, 25 bp, Mus musculus
gttcacccgcaggtacaacaagact

SEQ ID NO: 731274 - DNA, 25 bp, Mus musculus
gttcaccctaaacgctgggcaggtg

SEQ ID NO: 731275 - DNA, 25 bp, Mus musculus
gttcaccctaaaggctgggcaggtg

SEQ ID NO: 731276 - DNA, 25 bp, Mus musculus
gttcaccctgcaacctggaacggtg

SEQ ID NO: 731277 - DNA, 25 bp, Mus musculus
gttcaccctgcatcctggaacggtg

SEQ ID NO: 731278 - DNA, 25 bp, Mus musculus
gttcaccgtcagcatcaccgagggt

SEQ ID NO: 731279 - DNA, 25 bp, Mus musculus
gttcaccgtcaggatcaccgagggt

SEQ ID NO: 731280 - DNA, 25 bp, Mus musculus
gttcacctggttcgtttcattacag

SEQ ID NO: 731281 - DNA, 25 bp, Mus musculus
gttcacctggttggtttcattacag

SEQ ID NO: 731282 - DNA, 25 bp, Mus musculus
gttcaccttgcaaggccgggctatc

SEQ ID NO: 731283 - DNA, 25 bp, Mus musculus
gttcaccttgcatggccgggctatc

SEQ ID NO: 731284 - DNA, 25 bp, Mus musculus
gttcacctttagacaatatatggag

SEQ ID NO: 731285 - DNA, 25 bp, Mus musculus
gttcacctttagtcaatatatggag

SEQ ID NO: 731286 - DNA, 25 bp, Mus musculus
gttcacgagggcagcaggctcagct

SEQ ID NO: 731287 - DNA, 25 bp, Mus musculus
gttcacgagggctgcaggctcagct

SEQ ID NO: 731288 - DNA, 25 bp, Mus musculus
gttcacgcagcgcttcggtgtgcca

SEQ ID NO: 731289 - DNA, 25 bp, Mus musculus
gttcacgcagcggttcggtgtgcca

SEQ ID NO: 731290 - DNA, 25 bp, Mus musculus
gttcacgcccggaataaactgcagg

SEQ ID NO: 731291 - DNA, 25 bp, Mus musculus
gttcacgcccggtataaactgcagg

SEQ ID NO: 731292 - DNA, 25 bp, Mus musculus
gttcacgcgagcactggagtacctg

SEQ ID NO: 731293 - DNA, 25 bp, Mus musculus
gttcacgcgagctctggagtacctg

SEQ ID NO: 731294 - DNA, 25 bp, Mus musculus
gttcacggcagcaggattccttcac

SEQ ID NO: 731295 - DNA, 25 bp, Mus musculus
gttcacggcagctggattccttcac

SEQ ID NO: 731296 - DNA, 25 bp, Mus musculus
gttcactatgccagaggatgattat

SEQ ID NO: 731297 - DNA, 25 bp, Mus musculus
gttcactatgcctgaggatgattat

SEQ ID NO: 731298 - DNA, 25 bp, Mus musculus
gttcactctggtaccgagggcggaa

SEQ ID NO: 731299 - DNA, 25 bp, Mus musculus
gttcactctggttccgagggcggaa

SEQ ID NO: 731300 - DNA, 25 bp, Mus musculus
gttcactgcctacttcggagcctgt

SEQ ID NO: 731301 - DNA, 25 bp, Mus musculus
gttcactgcctagttcggagcctgt

SEQ ID NO: 731302 - DNA, 25 bp, Mus musculus
gttcacttaaaacctgtcctgcttc

SEQ ID NO: 731303 - DNA, 25 bp, Mus musculus
gttcacttaaaagctgtcctgcttc

SEQ ID NO: 731304 - DNA, 25 bp, Mus musculus
gttcactttgagactcttccactgg

SEQ ID NO: 731305 - DNA, 25 bp, Mus musculus
gttcactttgagtctcttccactgg

SEQ ID NO: 731306 - DNA, 25 bp, Mus musculus
gttcagaaaactccaagatgccagc

SEQ ID NO: 731307 - DNA, 25 bp, Mus musculus
gttcagaaaactgcaagatgccagc

SEQ ID NO: 731308 - DNA, 25 bp, Mus musculus
gttcagaacaggcatgcgaggctca

SEQ ID NO: 731309 - DNA, 25 bp, Mus musculus
gttcagaacagggatgcgaggctca

SEQ ID NO: 731310 - DNA, 25 bp, Mus musculus
gttcagacattaatgctcagataga

SEQ ID NO: 731311 - DNA, 25 bp, Mus musculus
gttcagacattattgctcagataga

SEQ ID NO: 731312 - DNA, 25 bp, Mus musculus
gttcagatgccaccctcacatgtac

SEQ ID NO: 731313 - DNA, 25 bp, Mus musculus
gttcagatgccagcctcacatgtac

SEQ ID NO: 731314 - DNA, 25 bp, Mus musculus
gttcagcaaactacctgaagcagag

SEQ ID NO: 731315 - DNA, 25 bp, Mus musculus
gttcagcaaacttcctgaagcagag

SEQ ID NO: 731316 - DNA, 25 bp, Mus musculus
gttcagcaagtcagaccccttcatg

SEQ ID NO: 731317 - DNA, 25 bp, Mus musculus
gttcagcaagtctgaccccttcatg

SEQ ID NO: 731318 - DNA, 25 bp, Mus musculus
gttcagcaccgaaaaggagatcctg

SEQ ID NO: 731319 - DNA, 25 bp, Mus musculus
gttcagcaccgataaggagatcctg

SEQ ID NO: 731320 - DNA, 25 bp, Mus musculus
gttcagcagtcaagccgcaggtgca

SEQ ID NO: 731321 - DNA, 25 bp, Mus musculus
gttcagcagtcatgccgcaggtgca

SEQ ID NO: 731322 - DNA, 25 bp, Mus musculus
gttcagccaaagctgaggacagagc

SEQ ID NO: 731323 - DNA, 25 bp, Mus musculus
gttcagccaaaggtgaggacagagc

SEQ ID NO: 731324 - DNA, 25 bp, Mus musculus
gttcagcctctaaacgtctccttct

SEQ ID NO: 731325 - DNA, 25 bp, Mus musculus
gttcagcctctatacgtctccttct

SEQ ID NO: 731326 - DNA, 25 bp, Mus musculus
gttcagcgcagcaaggacatggtgt

SEQ ID NO: 731327 - DNA, 25 bp, Mus musculus
gttcagcgcagctaggacatggtgt

SEQ ID NO: 731328 - DNA, 25 bp, Mus musculus
gttcagcgggcacctcaatttccag

SEQ ID NO: 731329 - DNA, 25 bp, Mus musculus
gttcagcgggcagctcaatttccag

SEQ ID NO: 731330 - DNA, 25 bp, Mus musculus
gttcaggaaatgcagggacagcaaa

SEQ ID NO: 731331 - DNA, 25 bp, Mus musculus
gttcaggaaatggagggacagcaaa

SEQ ID NO: 731332 - DNA, 25 bp, Mus musculus
gttcaggagagtcgctgtgacccat

SEQ ID NO: 731333 - DNA, 25 bp, Mus musculus
gttcaggagagtggctgtgacccat

SEQ ID NO: 731334 - DNA, 25 bp, Mus musculus
gttcaggcaagcagtccatattgtc

SEQ ID NO: 731335 - DNA, 25 bp, Mus musculus
gttcaggcaagctgtccatattgtc

SEQ ID NO: 731336 - DNA, 25 bp, Mus musculus
gttcaggcccacagacatagacctt

SEQ ID NO: 731337 - DNA, 25 bp, Mus musculus
gttcaggcccactgacatagacctt

SEQ ID NO: 731338 - DNA, 25 bp, Mus musculus
gttcagggtgggacaagtacttcct

SEQ ID NO: 731339 - DNA, 25 bp, Mus musculus
gttcagggtgggtcaagtacttcct

SEQ ID NO: 731340 - DNA, 25 bp, Mus musculus
gttcagtaagagagaattttcagtc

SEQ ID NO: 731341 - DNA, 25 bp, Mus musculus
gttcagtaagagtgaattttcagtc

SEQ ID NO: 731342 - DNA, 25 bp, Mus musculus
gttcagtatagtcacccatatgcag

SEQ ID NO: 731343 - DNA, 25 bp, Mus musculus
gttcagtatagtgacccatatgcag

SEQ ID NO: 731344 - DNA, 25 bp, Mus musculus
gttcagtcagcaaaagatgaaactt

SEQ ID NO: 731345 - DNA, 25 bp, Mus musculus
gttcagtcagcataagatgaaactt

SEQ ID NO: 731346 - DNA, 25 bp, Mus musculus
gttcagtcggcacaagcaggacttc

SEQ ID NO: 731347 - DNA, 25 bp, Mus musculus
gttcagtcggcagaagcaggacttc

SEQ ID NO: 731348 - DNA, 25 bp, Mus musculus
gttcagtctccgagaagcgtttgca

SEQ ID NO: 731349 - DNA, 25 bp, Mus musculus
gttcagtctccgtgaagcgtttgca

SEQ ID NO: 731350 - DNA, 25 bp, Mus musculus
gttcagtgatagctgtgggttacat

SEQ ID NO: 731351 - DNA, 25 bp, Mus musculus
gttcagtgataggtgtgggttacat

SEQ ID NO: 731352 - DNA, 25 bp, Mus musculus
gttcagtgccatccgggaacaatac

SEQ ID NO: 731353 - DNA, 25 bp, Mus musculus
gttcagtgccatgcgggaacaatac

SEQ ID NO: 731354 - DNA, 25 bp, Mus musculus
gttcagtggccgaggcgcatacccc

SEQ ID NO: 731355 - DNA, 25 bp, Mus musculus
gttcagtggccgtggcgcatacccc

SEQ ID NO: 731356 - DNA, 25 bp, Mus musculus
gttcagttggagaaccagatggtgt

SEQ ID NO: 731357 - DNA, 25 bp, Mus musculus
gttcagttggagtaccagatggtgt

SEQ ID NO: 731358 - DNA, 25 bp, Mus musculus
gttcataccccgcaaaccagcgtgt

SEQ ID NO: 731359 - DNA, 25 bp, Mus musculus
gttcataccccggaaaccagcgtgt

SEQ ID NO: 731360 - DNA, 25 bp, Mus musculus
gttcatacttgcctgggaacttcag

SEQ ID NO: 731361 - DNA, 25 bp, Mus musculus
gttcatacttgcgtgggaacttcag

SEQ ID NO: 731362 - DNA, 25 bp, Mus musculus
gttcatagagatcagtgttgagcag

SEQ ID NO: 731363 - DNA, 25 bp, Mus musculus
gttcatagagatgagtgttgagcag

SEQ ID NO: 731364 - DNA, 25 bp, Mus musculus
gttcatatgattcaacatgcacaga

SEQ ID NO: 731365 - DNA, 25 bp, Mus musculus
gttcatatgattgaacatgcacaga

SEQ ID NO: 731366 - DNA, 25 bp, Mus musculus
gttcatcaaggcctggactaaggac

SEQ ID NO: 731367 - DNA, 25 bp, Mus musculus
gttcatcaaggcgtggactaaggac

SEQ ID NO: 731368 - DNA, 25 bp, Mus musculus
gttcatcacaatcctctccataagt

SEQ ID NO: 731369 - DNA, 25 bp, Mus musculus
gttcatcacaatgctctccataagt

SEQ ID NO: 731370 - DNA, 25 bp, Mus musculus
gttcatcactgccaatcagtatgag

SEQ ID NO: 731371 - DNA, 25 bp, Mus musculus
gttcatcactgcgaatcagtatgag

SEQ ID NO: 731372 - DNA, 25 bp, Mus musculus
gttcatcagccaccgattcccagaa

SEQ ID NO: 731373 - DNA, 25 bp, Mus musculus
gttcatcagccagcgattcccagaa

SEQ ID NO: 731374 - DNA, 25 bp, Mus musculus
gttcatccaacacgccactgagctg

SEQ ID NO: 731375 - DNA, 25 bp, Mus musculus
gttcatccaacaggccactgagctg

SEQ ID NO: 731376 - DNA, 25 bp, Mus musculus
gttcatccaagtcaactacctagaa

SEQ ID NO: 731377 - DNA, 25 bp, Mus musculus
gttcatccaagtgaactacctagaa

SEQ ID NO: 731378 - DNA, 25 bp, Mus musculus
gttcatccacaaacggagctttgta

SEQ ID NO: 731379 - DNA, 25 bp, Mus musculus
gttcatccacaatcggagctttgta

SEQ ID NO: 731380 - DNA, 25 bp, Mus musculus
gttcatccagttccagtgcagactc

SEQ ID NO: 731381 - DNA, 25 bp, Mus musculus
gttcatccagttgcagtgcagactc

SEQ ID NO: 731382 - DNA, 25 bp, Mus musculus
gttcatccgtccacgccaaatgggt

SEQ ID NO: 731383 - DNA, 25 bp, Mus musculus
gttcatccgtcctcgccaaatgggt

SEQ ID NO: 731384 - DNA, 25 bp, Mus musculus
gttcatcgaggcatcaaaggcatag

SEQ ID NO: 731385 - DNA, 25 bp, Mus musculus
gttcatcgaggcttcaaaggcatag

SEQ ID NO: 731386 - DNA, 25 bp, Mus musculus
gttcatcgtgcaagagatctgtgga

SEQ ID NO: 731387 - DNA, 25 bp, Mus musculus
gttcatcgtgcatgagatctgtgga

SEQ ID NO: 731388 - DNA, 25 bp, Mus musculus
gttcatcgtggtctgtggaaacatc

SEQ ID NO: 731389 - DNA, 25 bp, Mus musculus
gttcatcgtggtgtgtggaaacatc

SEQ ID NO: 731390 - DNA, 25 bp, Mus musculus
gttcatctacttcaggaaccagaaa

SEQ ID NO: 731391 - DNA, 25 bp, Mus musculus
gttcatctacttgaggaaccagaaa

SEQ ID NO: 731392 - DNA, 25 bp, Mus musculus
gttcatcttagcaacgagagggctg

SEQ ID NO: 731393 - DNA, 25 bp, Mus musculus
gttcatcttagctacgagagggctg

SEQ ID NO: 731394 - DNA, 25 bp, Mus musculus
gttcatcttcgcacctcgactggac

SEQ ID NO: 731395 - DNA, 25 bp, Mus musculus
gttcatcttcgctcctcgactggac

SEQ ID NO: 731396 - DNA, 25 bp, Mus musculus
gttcatcttctgattcttgccagag

SEQ ID NO: 731397 - DNA, 25 bp, Mus musculus
gttcatcttctgtttcttgccagag

SEQ ID NO: 731398 - DNA, 25 bp, Mus musculus
gttcatgaacaactggctgccctgt

SEQ ID NO: 731399 - DNA, 25 bp, Mus musculus
gttcatgaacaagtggctgccctgt

SEQ ID NO: 731400 - DNA, 25 bp, Mus musculus
gttcatgacagcctccgagcggagt

SEQ ID NO: 731401 - DNA, 25 bp, Mus musculus
gttcatgacagcgtccgagcggagt

SEQ ID NO: 731402 - DNA, 25 bp, Mus musculus
gttcatgattgacctggacgggacc

SEQ ID NO: 731403 - DNA, 25 bp, Mus musculus
gttcatgattgagctggacgggacc

SEQ ID NO: 731404 - DNA, 25 bp, Mus musculus
gttcatgcaaaacacgttaacaaga

SEQ ID NO: 731405 - DNA, 25 bp, Mus musculus
gttcatgcaaaagacgttaacaaga

SEQ ID NO: 731406 - DNA, 25 bp, Mus musculus
gttcatgcatcaccggcctttccag

SEQ ID NO: 731407 - DNA, 25 bp, Mus musculus
gttcatgcatcagcggcctttccag

SEQ ID NO: 731408 - DNA, 25 bp, Mus musculus
gttcatgcggccagggaagttgtct

SEQ ID NO: 731409 - DNA, 25 bp, Mus musculus
gttcatgcggcctgggaagttgtct

SEQ ID NO: 731410 - DNA, 25 bp, Mus musculus
gttcatgctgaactggccgacatac

SEQ ID NO: 731411 - DNA, 25 bp, Mus musculus
gttcatgctgaagtggccgacatac

SEQ ID NO: 731412 - DNA, 25 bp, Mus musculus
gttcatggcagacaccaagatcgct

SEQ ID NO: 731413 - DNA, 25 bp, Mus musculus
gttcatggcagagaccaagatcgct

SEQ ID NO: 731414 - DNA, 25 bp, Mus musculus
gttcatggctctcatctgtgaggcc

SEQ ID NO: 731415 - DNA, 25 bp, Mus musculus
gttcatggctctgatctgtgaggcc

SEQ ID NO: 731416 - DNA, 25 bp, Mus musculus
gttcatgttgtgcagacagagccca

SEQ ID NO: 731417 - DNA, 25 bp, Mus musculus
gttcatgttgtggagacagagccca

SEQ ID NO: 731418 - DNA, 25 bp, Mus musculus
gttcattgccccagaaccacaggtt

SEQ ID NO: 731419 - DNA, 25 bp, Mus musculus
gttcattgcccctgaaccacaggtt

SEQ ID NO: 731420 - DNA, 25 bp, Mus musculus
gttcattgctgcacctggtgtgcca

SEQ ID NO: 731421 - DNA, 25 bp, Mus musculus
gttcattgctgctcctggtgtgcca

SEQ ID NO: 731422 - DNA, 25 bp, Mus musculus
gttcattggtgcaagtatccttaca

SEQ ID NO: 731423 - DNA, 25 bp, Mus musculus
gttcattggtgctagtatccttaca

SEQ ID NO: 731424 - DNA, 25 bp, Mus musculus
gttcattgttcaaagagatctaaag

SEQ ID NO: 731425 - DNA, 25 bp, Mus musculus
gttcattgttcatagagatctaaag

SEQ ID NO: 731426 - DNA, 25 bp, Mus musculus
gttcatttcttccagggcctgctcc

SEQ ID NO: 731427 - DNA, 25 bp, Mus musculus
gttcatttcttcgagggcctgctcc

SEQ ID NO: 731428 - DNA, 25 bp, Mus musculus
gttcattttcgccacatacccaaaa

SEQ ID NO: 731429 - DNA, 25 bp, Mus musculus
gttcattttcgcgacatacccaaaa

SEQ ID NO: 731430 - DNA, 25 bp, Mus musculus
gttccaaatgacctttactgctgct

SEQ ID NO: 731431 - DNA, 25 bp, Mus musculus
gttccaaatgacgtttactgctgct

SEQ ID NO: 731432 - DNA, 25 bp, Mus musculus
gttccaaattgacaaggctgcatct

SEQ ID NO: 731433 - DNA, 25 bp, Mus musculus
gttccaaattgagaaggctgcatct

SEQ ID NO: 731434 - DNA, 25 bp, Mus musculus
gttccaactgtcaaagtgagttctc

SEQ ID NO: 731435 - DNA, 25 bp, Mus musculus
gttccaactgtctaagtgagttctc

SEQ ID NO: 731436 - DNA, 25 bp, Mus musculus
gttccaagactgcttctcctacgtc

SEQ ID NO: 731437 - DNA, 25 bp, Mus musculus
gttccaagactggttctcctacgtc

SEQ ID NO: 731438 - DNA, 25 bp, Mus musculus
gttccaagcagtagtgcagcagcag

SEQ ID NO: 731439 - DNA, 25 bp, Mus musculus
gttccaagcagttgtgcagcagcag

SEQ ID NO: 731440 - DNA, 25 bp, Mus musculus
gttccaagctggattctcgccgtcg

SEQ ID NO: 731441 - DNA, 25 bp, Mus musculus
gttccaagctggtttctcgccgtcg

SEQ ID NO: 731442 - DNA, 25 bp, Mus musculus
gttccacaacagagaagtcgcagtg

SEQ ID NO: 731443 - DNA, 25 bp, Mus musculus
gttccacaacagtgaagtcgcagtg

SEQ ID NO: 731444 - DNA, 25 bp, Mus musculus
gttccacaaggaacacttcaaatat

SEQ ID NO: 731445 - DNA, 25 bp, Mus musculus
gttccacaaggatcacttcaaatat

SEQ ID NO: 731446 - DNA, 25 bp, Mus musculus
gttccacaatgcctaagaaagccgg

SEQ ID NO: 731447 - DNA, 25 bp, Mus musculus
gttccacaatgcgtaagaaagccgg

SEQ ID NO: 731448 - DNA, 25 bp, Mus musculus
gttccacagggtcctgtacagaccc

SEQ ID NO: 731449 - DNA, 25 bp, Mus musculus
gttccacagggtgctgtacagaccc

SEQ ID NO: 731450 - DNA, 25 bp, Mus musculus
gttccacatgttcggctgagccagg

SEQ ID NO: 731451 - DNA, 25 bp, Mus musculus
gttccacatgttgggctgagccagg

SEQ ID NO: 731452 - DNA, 25 bp, Mus musculus
gttccaccaggtcaccttagtctag

SEQ ID NO: 731453 - DNA, 25 bp, Mus musculus
gttccaccaggtgaccttagtctag

SEQ ID NO: 731454 - DNA, 25 bp, Mus musculus
gttccacctggtcggacttttgcac

SEQ ID NO: 731455 - DNA, 25 bp, Mus musculus
gttccacctggtgggacttttgcac

SEQ ID NO: 731456 - DNA, 25 bp, Mus musculus
gttccacgtgaaacctgggaaagcg

SEQ ID NO: 731457 - DNA, 25 bp, Mus musculus
gttccacgtgaatcctgggaaagcg

SEQ ID NO: 731458 - DNA, 25 bp, Mus musculus
gttccactccagaaatgccccagtt

SEQ ID NO: 731459 - DNA, 25 bp, Mus musculus
gttccactccagtaatgccccagtt

SEQ ID NO: 731460 - DNA, 25 bp, Mus musculus
gttccactcccgaattctggacatc

SEQ ID NO: 731461 - DNA, 25 bp, Mus musculus
gttccactcccgtattctggacatc

SEQ ID NO: 731462 - DNA, 25 bp, Mus musculus
gttccactcgcaagctctacgaaaa

SEQ ID NO: 731463 - DNA, 25 bp, Mus musculus
gttccactcgcatgctctacgaaaa

SEQ ID NO: 731464 - DNA, 25 bp, Mus musculus
gttccacttaccatagctctgcctt

SEQ ID NO: 731465 - DNA, 25 bp, Mus musculus
gttccacttaccttagctctgcctt

SEQ ID NO: 731466 - DNA, 25 bp, Mus musculus
gttccactttacagcgacaccatca

SEQ ID NO: 731467 - DNA, 25 bp, Mus musculus
gttccactttactgcgacaccatca

SEQ ID NO: 731468 - DNA, 25 bp, Mus musculus
gttccagaacttacggaagcaccca

SEQ ID NO: 731469 - DNA, 25 bp, Mus musculus
gttccagaactttcggaagcaccca

SEQ ID NO: 731470 - DNA, 25 bp, Mus musculus
gttccagaagccaagtggagtgtcg

SEQ ID NO: 731471 - DNA, 25 bp, Mus musculus
gttccagaagcctagtggagtgtcg

SEQ ID NO: 731472 - DNA, 25 bp, Mus musculus
gttccagaagtgctaagagtataac

SEQ ID NO: 731473 - DNA, 25 bp, Mus musculus
gttccagaagtggtaagagtataac

SEQ ID NO: 731474 - DNA, 25 bp, Mus musculus
gttccagacagtccccggatcagag

SEQ ID NO: 731475 - DNA, 25 bp, Mus musculus
gttccagacagtgcccggatcagag

SEQ ID NO: 731476 - DNA, 25 bp, Mus musculus
gttccagaccttcgtggccacacaa

SEQ ID NO: 731477 - DNA, 25 bp, Mus musculus
gttccagaccttggtggccacacaa

SEQ ID NO: 731478 - DNA, 25 bp, Mus musculus
gttccagaggaaaagatgtcagatg

SEQ ID NO: 731479 - DNA, 25 bp, Mus musculus
gttccagaggaatagatgtcagatg

SEQ ID NO: 731480 - DNA, 25 bp, Mus musculus
gttccagagtcacattctccactgt

SEQ ID NO: 731481 - DNA, 25 bp, Mus musculus
gttccagagtcagattctccactgt

SEQ ID NO: 731482 - DNA, 25 bp, Mus musculus
gttccagagtccacttgtcattggg

SEQ ID NO: 731483 - DNA, 25 bp, Mus musculus
gttccagagtcctcttgtcattggg

SEQ ID NO: 731484 - DNA, 25 bp, Mus musculus
gttccagatgccagaagtttcccca

SEQ ID NO: 731485 - DNA, 25 bp, Mus musculus
gttccagatgcctgaagtttcccca

SEQ ID NO: 731486 - DNA, 25 bp, Mus musculus
gttccagcacagctgtatcaatgac

SEQ ID NO: 731487 - DNA, 25 bp, Mus musculus
gttccagcacaggtgtatcaatgac

SEQ ID NO: 731488 - DNA, 25 bp, Mus musculus
gttccagcagaacacgtggtccaga

SEQ ID NO: 731489 - DNA, 25 bp, Mus musculus
gttccagcagaagacgtggtccaga

SEQ ID NO: 731490 - DNA, 25 bp, Mus musculus
gttccagcgacccttggccacttag

SEQ ID NO: 731491 - DNA, 25 bp, Mus musculus
gttccagcgaccgttggccacttag

SEQ ID NO: 731492 - DNA, 25 bp, Mus musculus
gttccagcggttcttttacactaag

SEQ ID NO: 731493 - DNA, 25 bp, Mus musculus
gttccagcggttgttttacactaag

SEQ ID NO: 731494 - DNA, 25 bp, Mus musculus
gttccagctcgaccaagggctccgt

SEQ ID NO: 731495 - DNA, 25 bp, Mus musculus
gttccagctcgagcaagggctccgt

SEQ ID NO: 731496 - DNA, 25 bp, Mus musculus
gttccagctgccactattcttcttc

SEQ ID NO: 731497 - DNA, 25 bp, Mus musculus
gttccagctgcctctattcttcttc

SEQ ID NO: 731498 - DNA, 25 bp, Mus musculus
gttccaggacacaagtcagtacgtg

SEQ ID NO: 731499 - DNA, 25 bp, Mus musculus
gttccaggacactagtcagtacgtg

SEQ ID NO: 731500 - DNA, 25 bp, Mus musculus
gttccaggagaactctcgagtcatt

SEQ ID NO: 731501 - DNA, 25 bp, Mus musculus
gttccaggagaagtctcgagtcatt

SEQ ID NO: 731502 - DNA, 25 bp, Mus musculus
gttccaggatggagtcaatgtcttc

SEQ ID NO: 731503 - DNA, 25 bp, Mus musculus
gttccaggatggtgtcaatgtcttc

SEQ ID NO: 731504 - DNA, 25 bp, Mus musculus
gttccaggcacaacagaatgccatg

SEQ ID NO: 731505 - DNA, 25 bp, Mus musculus
gttccaggcacacctgttcgactct

SEQ ID NO: 731506 - DNA, 25 bp, Mus musculus
gttccaggcacagctgttcgactct

SEQ ID NO: 731507 - DNA, 25 bp, Mus musculus
gttccaggcacatcagaatgccatg

SEQ ID NO: 731508 - DNA, 25 bp, Mus musculus
gttccagtaatcagaatggctccag

SEQ ID NO: 731509 - DNA, 25 bp, Mus musculus
gttccagtaatctgaatggctccag

SEQ ID NO: 731510 - DNA, 25 bp, Mus musculus
gttccagtagccaaggtaagactct

SEQ ID NO: 731511 - DNA, 25 bp, Mus musculus
gttccagtagcctaggtaagactct

SEQ ID NO: 731512 - DNA, 25 bp, Mus musculus
gttccatcacatctcgggtgactga

SEQ ID NO: 731513 - DNA, 25 bp, Mus musculus
gttccatcacatgtcgggtgactga

SEQ ID NO: 731514 - DNA, 25 bp, Mus musculus
gttccatcttctcaggccagcaaag

SEQ ID NO: 731515 - DNA, 25 bp, Mus musculus
gttccatcttctgaggccagcaaag

SEQ ID NO: 731516 - DNA, 25 bp, Mus musculus
gttcccaaggacaacggatgatgca

SEQ ID NO: 731517 - DNA, 25 bp, Mus musculus
gttcccaaggactacggatgatgca

SEQ ID NO: 731518 - DNA, 25 bp, Mus musculus
gttcccacaatcaggcagtacaccg

SEQ ID NO: 731519 - DNA, 25 bp, Mus musculus
gttcccacaatctggcagtacaccg

SEQ ID NO: 731520 - DNA, 25 bp, Mus musculus
gttcccacagccaggatgcgggtgt

SEQ ID NO: 731521 - DNA, 25 bp, Mus musculus
gttcccacagcctggatgcgggtgt

SEQ ID NO: 731522 - DNA, 25 bp, Mus musculus
gttcccaccctgctacgtgcagaga

SEQ ID NO: 731523 - DNA, 25 bp, Mus musculus
gttcccaccctggtacgtgcagaga

SEQ ID NO: 731524 - DNA, 25 bp, Mus musculus
gttcccagaagaagatcacagtctt

SEQ ID NO: 731525 - DNA, 25 bp, Mus musculus
gttcccagaagatgatcacagtctt

SEQ ID NO: 731526 - DNA, 25 bp, Mus musculus
gttcccagcatcatgagggcctgga

SEQ ID NO: 731527 - DNA, 25 bp, Mus musculus
gttcccagcatcttgagggcctgga

SEQ ID NO: 731528 - DNA, 25 bp, Mus musculus
gttcccagccagcagtcgggtgtcc

SEQ ID NO: 731529 - DNA, 25 bp, Mus musculus
gttcccagccaggagtcgggtgtcc

SEQ ID NO: 731530 - DNA, 25 bp, Mus musculus
gttcccaggcctcttgcaatgcgga

SEQ ID NO: 731531 - DNA, 25 bp, Mus musculus
gttcccaggcctgttgcaatgcgga

SEQ ID NO: 731532 - DNA, 25 bp, Mus musculus
gttcccagtaggagcagatgttcca

SEQ ID NO: 731533 - DNA, 25 bp, Mus musculus
gttcccagtaggtgcagatgttcca

SEQ ID NO: 731534 - DNA, 25 bp, Mus musculus
gttcccagtccaacataagaggatc

SEQ ID NO: 731535 - DNA, 25 bp, Mus musculus
gttcccagtccatcataagaggatc

SEQ ID NO: 731536 - DNA, 25 bp, Mus musculus
gttcccagtggaaaaagccgtacct

SEQ ID NO: 731537 - DNA, 25 bp, Mus musculus
gttcccagtggataaagccgtacct

SEQ ID NO: 731538 - DNA, 25 bp, Mus musculus
gttcccatttggcaagtctcacaag

SEQ ID NO: 731539 - DNA, 25 bp, Mus musculus
gttcccatttgggaagtctcacaag

SEQ ID NO: 731540 - DNA, 25 bp, Mus musculus
gttccccagtataaatatgctgcgg

SEQ ID NO: 731541 - DNA, 25 bp, Mus musculus
gttccccagtattaatatgctgcgg

SEQ ID NO: 731542 - DNA, 25 bp, Mus musculus
gttcccctgactactccggaggtgt

SEQ ID NO: 731543 - DNA, 25 bp, Mus musculus
gttcccctgacttctccggaggtgt

SEQ ID NO: 731544 - DNA, 25 bp, Mus musculus
gttcccctgatgcaggacttaaggg

SEQ ID NO: 731545 - DNA, 25 bp, Mus musculus
gttcccctgatggaggacttaaggg

SEQ ID NO: 731546 - DNA, 25 bp, Mus musculus
gttcccctgcccatggagagaaatg

SEQ ID NO: 731547 - DNA, 25 bp, Mus musculus
gttcccctgcccttggagagaaatg

SEQ ID NO: 731548 - DNA, 25 bp, Mus musculus
gttcccggaagcataagaggcccag

SEQ ID NO: 731549 - DNA, 25 bp, Mus musculus
gttcccggaagcttaagaggcccag

SEQ ID NO: 731550 - DNA, 25 bp, Mus musculus
gttcccggcgacagcgaagagagtt

SEQ ID NO: 731551 - DNA, 25 bp, Mus musculus
gttcccggcgactgcgaagagagtt

SEQ ID NO: 731552 - DNA, 25 bp, Mus musculus
gttcccgggtttacagcccatctgt

SEQ ID NO: 731553 - DNA, 25 bp, Mus musculus
gttcccgggttttcagcccatctgt

SEQ ID NO: 731554 - DNA, 25 bp, Mus musculus
gttcccggtgcactccgagtctctg

SEQ ID NO: 731555 - DNA, 25 bp, Mus musculus
gttcccggtgcagtccgagtctctg

SEQ ID NO: 731556 - DNA, 25 bp, Mus musculus
gttcccgtcaatattgctgagttct

SEQ ID NO: 731557 - DNA, 25 bp, Mus musculus
gttcccgtcaattttgctgagttct

SEQ ID NO: 731558 - DNA, 25 bp, Mus musculus
gttcccgtgagaacgacctctcgtt

SEQ ID NO: 731559 - DNA, 25 bp, Mus musculus
gttcccgtgagatcgacctctcgtt

SEQ ID NO: 731560 - DNA, 25 bp, Mus musculus
gttccctccctaccgcgggatgatg

SEQ ID NO: 731561 - DNA, 25 bp, Mus musculus
gttccctccctagcgcgggatgatg

SEQ ID NO: 731562 - DNA, 25 bp, Mus musculus
gttccctcggtcactggcatgctgt

SEQ ID NO: 731563 - DNA, 25 bp, Mus musculus
gttccctcggtctctggcatgctgt

SEQ ID NO: 731564 - DNA, 25 bp, Mus musculus
gttccctcttcacgtagcagcgggc

SEQ ID NO: 731565 - DNA, 25 bp, Mus musculus
gttccctcttcaggtagcagcgggc

SEQ ID NO: 731566 - DNA, 25 bp, Mus musculus
gttccctgaacaaaagatgccatgg

SEQ ID NO: 731567 - DNA, 25 bp, Mus musculus
gttccctgaacataagatgccatgg

SEQ ID NO: 731568 - DNA, 25 bp, Mus musculus
gttccctgaggaacccagcacctgg

SEQ ID NO: 731569 - DNA, 25 bp, Mus musculus
gttccctgaggatcccagcacctgg

SEQ ID NO: 731570 - DNA, 25 bp, Mus musculus
gttccctgagggattcaaagtgtca

SEQ ID NO: 731571 - DNA, 25 bp, Mus musculus
gttccctgagggtttcaaagtgtca

SEQ ID NO: 731572 - DNA, 25 bp, Mus musculus
gttccctgcagtatgattgcttcta

SEQ ID NO: 731573 - DNA, 25 bp, Mus musculus
gttccctgcagtttgattgcttcta

SEQ ID NO: 731574 - DNA, 25 bp, Mus musculus
gttccctgctgaagactgtaatatg

SEQ ID NO: 731575 - DNA, 25 bp, Mus musculus
gttccctgctgatgactgtaatatg

SEQ ID NO: 731576 - DNA, 25 bp, Mus musculus
gttccctggcgtactctgagccctg

SEQ ID NO: 731577 - DNA, 25 bp, Mus musculus
gttccctggcgttctctgagccctg

SEQ ID NO: 731578 - DNA, 25 bp, Mus musculus
gttccctggtcacacaggacctcga

SEQ ID NO: 731579 - DNA, 25 bp, Mus musculus
gttccctggtcagacaggacctcga

SEQ ID NO: 731580 - DNA, 25 bp, Mus musculus
gttccctgtatgcaaacaaaatcac

SEQ ID NO: 731581 - DNA, 25 bp, Mus musculus
gttccctgtatggaaacaaaatcac

SEQ ID NO: 731582 - DNA, 25 bp, Mus musculus
gttccctgtgagaacctgtcgctcc

SEQ ID NO: 731583 - DNA, 25 bp, Mus musculus
gttccctgtgagtacctgtcgctcc

SEQ ID NO: 731584 - DNA, 25 bp, Mus musculus
gttcccttctctaggcacttcggag

SEQ ID NO: 731585 - DNA, 25 bp, Mus musculus
gttcccttctcttggcacttcggag

SEQ ID NO: 731586 - DNA, 25 bp, Mus musculus
gttccctttgcaacacccagtgtgg

SEQ ID NO: 731587 - DNA, 25 bp, Mus musculus
gttccctttgcatcacccagtgtgg

SEQ ID NO: 731588 - DNA, 25 bp, Mus musculus
gttccgagaagtcgcaggatccctg

SEQ ID NO: 731589 - DNA, 25 bp, Mus musculus
gttccgagaagtggcaggatccctg

SEQ ID NO: 731590 - DNA, 25 bp, Mus musculus
gttccgagggtcagcaagatgtcga

SEQ ID NO: 731591 - DNA, 25 bp, Mus musculus
gttccgagggtctgcaagatgtcga

SEQ ID NO: 731592 - DNA, 25 bp, Mus musculus
gttccgatctaactaccaccctgat

SEQ ID NO: 731593 - DNA, 25 bp, Mus musculus
gttccgatctaagtaccaccctgat

SEQ ID NO: 731594 - DNA, 25 bp, Mus musculus
gttccgcaaatgaactgcaaatcat

SEQ ID NO: 731595 - DNA, 25 bp, Mus musculus
gttccgcaaatgtactgcaaatcat

SEQ ID NO: 731596 - DNA, 25 bp, Mus musculus
gttccgccaggtacggctgaaacac

SEQ ID NO: 731597 - DNA, 25 bp, Mus musculus
gttccgccaggttcggctgaaacac

SEQ ID NO: 731598 - DNA, 25 bp, Mus musculus
gttccgctacacacgtgaaccttag

SEQ ID NO: 731599 - DNA, 25 bp, Mus musculus
gttccgctacactcgtgaaccttag

SEQ ID NO: 731600 - DNA, 25 bp, Mus musculus
gttccgctgggcagtactacgagca

SEQ ID NO: 731601 - DNA, 25 bp, Mus musculus
gttccgctgggctgtactacgagca

SEQ ID NO: 731602 - DNA, 25 bp, Mus musculus
gttccgctgtctcggaagctctcag

SEQ ID NO: 731603 - DNA, 25 bp, Mus musculus
gttccgctgtctgggaagctctcag

SEQ ID NO: 731604 - DNA, 25 bp, Mus musculus
gttccggaacttaggaggcatgaaa

SEQ ID NO: 731605 - DNA, 25 bp, Mus musculus
gttccggaactttggaggcatgaaa

SEQ ID NO: 731606 - DNA, 25 bp, Mus musculus
gttccggaagacaacatctggagag

SEQ ID NO: 731607 - DNA, 25 bp, Mus musculus
gttccggaagactacatctggagag

SEQ ID NO: 731608 - DNA, 25 bp, Mus musculus
gttccggagcacagatgtggctgaa

SEQ ID NO: 731609 - DNA, 25 bp, Mus musculus
gttccggagcactgatgtggctgaa

SEQ ID NO: 731610 - DNA, 25 bp, Mus musculus
gttccggcggctctatgacatggta

SEQ ID NO: 731611 - DNA, 25 bp, Mus musculus
gttccggcggctgtatgacatggta

SEQ ID NO: 731612 - DNA, 25 bp, Mus musculus
gttccgtaatccaaaggccaaatga

SEQ ID NO: 731613 - DNA, 25 bp, Mus musculus
gttccgtaatcctaaggccaaatga

SEQ ID NO: 731614 - DNA, 25 bp, Mus musculus
gttccgtcggaactatgggactaga

SEQ ID NO: 731615 - DNA, 25 bp, Mus musculus
gttccgtcggaagtatgggactaga

SEQ ID NO: 731616 - DNA, 25 bp, Mus musculus
gttccgtggcacaccataaatcttg

SEQ ID NO: 731617 - DNA, 25 bp, Mus musculus
gttccgtggcactccataaatcttg

SEQ ID NO: 731618 - DNA, 25 bp, Mus musculus
gttccgtgggctaattattactaca

SEQ ID NO: 731619 - DNA, 25 bp, Mus musculus
gttccgtgggcttattattactaca

SEQ ID NO: 731620 - DNA, 25 bp, Mus musculus
gttccgtggtggatgcagccatcgc

SEQ ID NO: 731621 - DNA, 25 bp, Mus musculus
gttccgtggtggttgcagccatcgc

SEQ ID NO: 731622 - DNA, 25 bp, Mus musculus
gttcctaaccagcattttacagaac

SEQ ID NO: 731623 - DNA, 25 bp, Mus musculus
gttcctaaccaggattttacagaac

SEQ ID NO: 731624 - DNA, 25 bp, Mus musculus
gttcctaaccatcgtctgtatggag

SEQ ID NO: 731625 - DNA, 25 bp, Mus musculus
gttcctaaccatggtctgtatggag

SEQ ID NO: 731626 - DNA, 25 bp, Mus musculus
gttcctacaagtcagtcagaaagat

SEQ ID NO: 731627 - DNA, 25 bp, Mus musculus
gttcctacaagtgagtcagaaagat

SEQ ID NO: 731628 - DNA, 25 bp, Mus musculus
gttcctacacgaaaggattacggat

SEQ ID NO: 731629 - DNA, 25 bp, Mus musculus
gttcctacacgataggattacggat

SEQ ID NO: 731630 - DNA, 25 bp, Mus musculus
gttcctacagaaatctcgggtccgg

SEQ ID NO: 731631 - DNA, 25 bp, Mus musculus
gttcctacagaattctcgggtccgg

SEQ ID NO: 731632 - DNA, 25 bp, Mus musculus
gttcctacctttcttggcacaccgt

SEQ ID NO: 731633 - DNA, 25 bp, Mus musculus
gttcctacctttgttggcacaccgt

SEQ ID NO: 731634 - DNA, 25 bp, Mus musculus
gttcctagacaaagatctgaaagac

SEQ ID NO: 731635 - DNA, 25 bp, Mus musculus
gttcctagacaatgatctgaaagac

SEQ ID NO: 731636 - DNA, 25 bp, Mus musculus
gttcctagaggcataaccataataa

SEQ ID NO: 731637 - DNA, 25 bp, Mus musculus
gttcctagaggcttaaccataataa

SEQ ID NO: 731638 - DNA, 25 bp, Mus musculus
gttcctagatagagcagaagaactg

SEQ ID NO: 731639 - DNA, 25 bp, Mus musculus
gttcctagatagtgcagaagaactg

SEQ ID NO: 731640 - DNA, 25 bp, Mus musculus
gttcctagccctccgggaccaggtt

SEQ ID NO: 731641 - DNA, 25 bp, Mus musculus
gttcctagccctgcgggaccaggtt

SEQ ID NO: 731642 - DNA, 25 bp, Mus musculus
gttcctagtttcaacactgatgcag

SEQ ID NO: 731643 - DNA, 25 bp, Mus musculus
gttcctagtttctacactgatgcag

SEQ ID NO: 731644 - DNA, 25 bp, Mus musculus
gttcctatccgtcggtcttcagaga

SEQ ID NO: 731645 - DNA, 25 bp, Mus musculus
gttcctatccgtgggtcttcagaga

SEQ ID NO: 731646 - DNA, 25 bp, Mus musculus
gttcctatttctacactatggtgga

SEQ ID NO: 731647 - DNA, 25 bp, Mus musculus
gttcctatttcttcactatggtgga

SEQ ID NO: 731648 - DNA, 25 bp, Mus musculus
gttcctcaacctcctgggacaattg

SEQ ID NO: 731649 - DNA, 25 bp, Mus musculus
gttcctcaacctgctgggacaattg

SEQ ID NO: 731650 - DNA, 25 bp, Mus musculus
gttcctcacaggaggtcaggcgcag

SEQ ID NO: 731651 - DNA, 25 bp, Mus musculus
gttcctcacaggtggtcaggcgcag

SEQ ID NO: 731652 - DNA, 25 bp, Mus musculus
gttcctcagtagacgaatgttatga

SEQ ID NO: 731653 - DNA, 25 bp, Mus musculus
gttcctcagtagtcgaatgttatga

SEQ ID NO: 731654 - DNA, 25 bp, Mus musculus
gttcctcatgtaaggccacgctata

SEQ ID NO: 731655 - DNA, 25 bp, Mus musculus
gttcctcatgtatggccacgctata

SEQ ID NO: 731656 - DNA, 25 bp, Mus musculus
gttcctccaagacttttattacgag

SEQ ID NO: 731657 - DNA, 25 bp, Mus musculus
gttcctccaagagttttattacgag

SEQ ID NO: 731658 - DNA, 25 bp, Mus musculus
gttcctccagggattctggcccgca

SEQ ID NO: 731659 - DNA, 25 bp, Mus musculus
gttcctccagggtttctggcccgca

SEQ ID NO: 731660 - DNA, 25 bp, Mus musculus
gttcctcgaacacgcaagcaggtca

SEQ ID NO: 731661 - DNA, 25 bp, Mus musculus
gttcctcgaacaggcaagcaggtca

SEQ ID NO: 731662 - DNA, 25 bp, Mus musculus
gttcctcgctcactggtgttcctag

SEQ ID NO: 731663 - DNA, 25 bp, Mus musculus
gttcctcgctcagtggtgttcctag

SEQ ID NO: 731664 - DNA, 25 bp, Mus musculus
gttcctctcctgctgataaattgga

SEQ ID NO: 731665 - DNA, 25 bp, Mus musculus
gttcctctcctggtgataaattgga

SEQ ID NO: 731666 - DNA, 25 bp, Mus musculus
gttcctctctaccaaggcttcctga

SEQ ID NO: 731667 - DNA, 25 bp, Mus musculus
gttcctctctacgaaggcttcctga

SEQ ID NO: 731668 - DNA, 25 bp, Mus musculus
gttcctctgtctcggacctcgtcaa

SEQ ID NO: 731669 - DNA, 25 bp, Mus musculus
gttcctctgtctgggacctcgtcaa

SEQ ID NO: 731670 - DNA, 25 bp, Mus musculus
gttcctctgtgtcttacatgataag

SEQ ID NO: 731671 - DNA, 25 bp, Mus musculus
gttcctctgtgtgttacatgataag

SEQ ID NO: 731672 - DNA, 25 bp, Mus musculus
gttcctcttgaaagtgatcctccat

SEQ ID NO: 731673 - DNA, 25 bp, Mus musculus
gttcctcttgaatgtgatcctccat

SEQ ID NO: 731674 - DNA, 25 bp, Mus musculus
gttcctctttacataacggcgtggg

SEQ ID NO: 731675 - DNA, 25 bp, Mus musculus
gttcctctttacttaacggcgtggg

SEQ ID NO: 731676 - DNA, 25 bp, Mus musculus
gttcctgaaacacatcaacagctcg

SEQ ID NO: 731677 - DNA, 25 bp, Mus musculus
gttcctgaaacagatcaacagctcg

SEQ ID NO: 731678 - DNA, 25 bp, Mus musculus
gttcctgaagcaacctgactgggca

SEQ ID NO: 731679 - DNA, 25 bp, Mus musculus
gttcctgaagcatcctgactgggca

SEQ ID NO: 731680 - DNA, 25 bp, Mus musculus
gttcctgaccacatgagaaccaagc

SEQ ID NO: 731681 - DNA, 25 bp, Mus musculus
gttcctgaccacttgagaaccaagc

SEQ ID NO: 731682 - DNA, 25 bp, Mus musculus
gttcctgagggcatcaggctcactc

SEQ ID NO: 731683 - DNA, 25 bp, Mus musculus
gttcctgagggcttcaggctcactc

SEQ ID NO: 731684 - DNA, 25 bp, Mus musculus
gttcctgagtacctatgtcatgatg

SEQ ID NO: 731685 - DNA, 25 bp, Mus musculus
gttcctgagtacgtatgtcatgatg

SEQ ID NO: 731686 - DNA, 25 bp, Mus musculus
gttcctgatgatctccagcctatcg

SEQ ID NO: 731687 - DNA, 25 bp, Mus musculus
gttcctgatgatgtccagcctatcg

SEQ ID NO: 731688 - DNA, 25 bp, Mus musculus
gttcctgattcccaagaacaaccca

SEQ ID NO: 731689 - DNA, 25 bp, Mus musculus
gttcctgattccgaagaacaaccca

SEQ ID NO: 731690 - DNA, 25 bp, Mus musculus
gttcctgcctcaagaccagttgggt

SEQ ID NO: 731691 - DNA, 25 bp, Mus musculus
gttcctgcctcatgaccagttgggt

SEQ ID NO: 731692 - DNA, 25 bp, Mus musculus
gttcctgctgcgctcccgggttgtt

SEQ ID NO: 731693 - DNA, 25 bp, Mus musculus
gttcctgctgcggtcccgggttgtt

SEQ ID NO: 731694 - DNA, 25 bp, Mus musculus
gttcctgctttgaggccgtctctcg

SEQ ID NO: 731695 - DNA, 25 bp, Mus musculus
gttcctgctttgtggccgtctctcg

SEQ ID NO: 731696 - DNA, 25 bp, Mus musculus
gttcctggaagaagttaggcatgca

SEQ ID NO: 731697 - DNA, 25 bp, Mus musculus
gttcctggaagatgttaggcatgca

SEQ ID NO: 731698 - DNA, 25 bp, Mus musculus
gttcctggaatgataattgtaccaa

SEQ ID NO: 731699 - DNA, 25 bp, Mus musculus
gttcctggaatgttaattgtaccaa

SEQ ID NO: 731700 - DNA, 25 bp, Mus musculus
gttcctggacatccccagtagaagg

SEQ ID NO: 731701 - DNA, 25 bp, Mus musculus
gttcctggacatgcccagtagaagg

SEQ ID NO: 731702 - DNA, 25 bp, Mus musculus
gttcctggctaacatgactaatggc

SEQ ID NO: 731703 - DNA, 25 bp, Mus musculus
gttcctggctaagatgactaatggc

SEQ ID NO: 731704 - DNA, 25 bp, Mus musculus
gttcctgggccacgcaggtagctcc

SEQ ID NO: 731705 - DNA, 25 bp, Mus musculus
gttcctgggccaggcaggtagctcc

SEQ ID NO: 731706 - DNA, 25 bp, Mus musculus
gttcctggtgaacttggacccttct

SEQ ID NO: 731707 - DNA, 25 bp, Mus musculus
gttcctggtgaagttggacccttct

SEQ ID NO: 731708 - DNA, 25 bp, Mus musculus
gttcctggttcaaccttgagactca

SEQ ID NO: 731709 - DNA, 25 bp, Mus musculus
gttcctggttcatccttgagactca

SEQ ID NO: 731710 - DNA, 25 bp, Mus musculus
gttcctgtccgtcatcagccagcag

SEQ ID NO: 731711 - DNA, 25 bp, Mus musculus
gttcctgtccgtgatcagccagcag

SEQ ID NO: 731712 - DNA, 25 bp, Mus musculus
gttcctgtgagtcctgaggccgcca

SEQ ID NO: 731713 - DNA, 25 bp, Mus musculus
gttcctgtgagtgctgaggccgcca

SEQ ID NO: 731714 - DNA, 25 bp, Mus musculus
gttccttaagggatcaactgtccac

SEQ ID NO: 731715 - DNA, 25 bp, Mus musculus
gttccttaagggttcaactgtccac

SEQ ID NO: 731716 - DNA, 25 bp, Mus musculus
gttccttcagctcgtggttccttca

SEQ ID NO: 731717 - DNA, 25 bp, Mus musculus
gttccttcagctggtggttccttca

SEQ ID NO: 731718 - DNA, 25 bp, Mus musculus
gttccttcattgagcacctcccagg

SEQ ID NO: 731719 - DNA, 25 bp, Mus musculus
gttccttcattgtgcacctcccagg

SEQ ID NO: 731720 - DNA, 25 bp, Mus musculus
gttccttccctaagctggtgcccag

SEQ ID NO: 731721 - DNA, 25 bp, Mus musculus
gttccttccctatgctggtgcccag

SEQ ID NO: 731722 - DNA, 25 bp, Mus musculus
gttccttcctggacgaggcctctgt

SEQ ID NO: 731723 - DNA, 25 bp, Mus musculus
gttccttcctggtcgaggcctctgt

SEQ ID NO: 731724 - DNA, 25 bp, Mus musculus
gttccttcggctcggtttctcctgc

SEQ ID NO: 731725 - DNA, 25 bp, Mus musculus
gttccttcggctgggtttctcctgc

SEQ ID NO: 731726 - DNA, 25 bp, Mus musculus
gttccttcgggtacaagagaggcaa

SEQ ID NO: 731727 - DNA, 25 bp, Mus musculus
gttccttcgggttcaagagaggcaa

SEQ ID NO: 731728 - DNA, 25 bp, Mus musculus
gttccttctgcgacgtctccgagcg

SEQ ID NO: 731729 - DNA, 25 bp, Mus musculus
gttccttctgcgtcgtctccgagcg

SEQ ID NO: 731730 - DNA, 25 bp, Mus musculus
gttccttgccttcactccttggaga

SEQ ID NO: 731731 - DNA, 25 bp, Mus musculus
gttccttgccttgactccttggaga

SEQ ID NO: 731732 - DNA, 25 bp, Mus musculus
gttccttggattcatctggacctct

SEQ ID NO: 731733 - DNA, 25 bp, Mus musculus
gttccttggattgatctggacctct

SEQ ID NO: 731734 - DNA, 25 bp, Mus musculus
gttccttgtcatacaagtctcggga

SEQ ID NO: 731735 - DNA, 25 bp, Mus musculus
gttccttgtcattcaagtctcggga

SEQ ID NO: 731736 - DNA, 25 bp, Mus musculus
gttcgaacctcacatatgggtggtt

SEQ ID NO: 731737 - DNA, 25 bp, Mus musculus
gttcgaacctcagatatgggtggtt

SEQ ID NO: 731738 - DNA, 25 bp, Mus musculus
gttcgaacttatacatggcaaattc

SEQ ID NO: 731739 - DNA, 25 bp, Mus musculus
gttcgaacttattcatggcaaattc

SEQ ID NO: 731740 - DNA, 25 bp, Mus musculus
gttcgaataccgcttagtgccggcg

SEQ ID NO: 731741 - DNA, 25 bp, Mus musculus
gttcgaataccggttagtgccggcg

SEQ ID NO: 731742 - DNA, 25 bp, Mus musculus
gttcgaccccaaaaagctggcacct

SEQ ID NO: 731743 - DNA, 25 bp, Mus musculus
gttcgaccccaataagctggcacct

SEQ ID NO: 731744 - DNA, 25 bp, Mus musculus
gttcgactgaaccagctcttacagg

SEQ ID NO: 731745 - DNA, 25 bp, Mus musculus
gttcgactgaacgagctcttacagg

SEQ ID NO: 731746 - DNA, 25 bp, Mus musculus
gttcgagaaggtactccagccaact

SEQ ID NO: 731747 - DNA, 25 bp, Mus musculus
gttcgagaaggttctccagccaact

SEQ ID NO: 731748 - DNA, 25 bp, Mus musculus
gttcgagctggtcagtcactgatga

SEQ ID NO: 731749 - DNA, 25 bp, Mus musculus
gttcgagctggtgagtcactgatga

SEQ ID NO: 731750 - DNA, 25 bp, Mus musculus
gttcgaggaactagacagcaacaag

SEQ ID NO: 731751 - DNA, 25 bp, Mus musculus
gttcgaggaacttgacagcaacaag

SEQ ID NO: 731752 - DNA, 25 bp, Mus musculus
gttcgaggatctcaagcgagttgca

SEQ ID NO: 731753 - DNA, 25 bp, Mus musculus
gttcgaggatctgaagcgagttgca

SEQ ID NO: 731754 - DNA, 25 bp, Mus musculus
gttcgaggccttccacgtgttcaag

SEQ ID NO: 731755 - DNA, 25 bp, Mus musculus
gttcgaggccttgcacgtgttcaag

SEQ ID NO: 731756 - DNA, 25 bp, Mus musculus
gttcgaggctaaagagtaggtccca

SEQ ID NO: 731757 - DNA, 25 bp, Mus musculus
gttcgaggctaatgagtaggtccca

SEQ ID NO: 731758 - DNA, 25 bp, Mus musculus
gttcgagtttgacgcctaagttctg

SEQ ID NO: 731759 - DNA, 25 bp, Mus musculus
gttcgagtttgaggcctaagttctg

SEQ ID NO: 731760 - DNA, 25 bp, Mus musculus
gttcgatgcctaccctaagactctg

SEQ ID NO: 731761 - DNA, 25 bp, Mus musculus
gttcgatgcctagcctaagactctg

SEQ ID NO: 731762 - DNA, 25 bp, Mus musculus
gttcgcaccacacagacccaagtgt

SEQ ID NO: 731763 - DNA, 25 bp, Mus musculus
gttcgcaccacagagacccaagtgt

SEQ ID NO: 731764 - DNA, 25 bp, Mus musculus
gttcgccaacaccagatacgttcct

SEQ ID NO: 731765 - DNA, 25 bp, Mus musculus
gttcgccaacacgagatacgttcct

SEQ ID NO: 731766 - DNA, 25 bp, Mus musculus
gttcgcccggccagggctagcacgt

SEQ ID NO: 731767 - DNA, 25 bp, Mus musculus
gttcgcccggcctgggctagcacgt

SEQ ID NO: 731768 - DNA, 25 bp, Mus musculus
gttcgccctgtcctgtgctgcagag

SEQ ID NO: 731769 - DNA, 25 bp, Mus musculus
gttcgccctgtcgtgtgctgcagag

SEQ ID NO: 731770 - DNA, 25 bp, Mus musculus
gttcgccgaggcaactgtgcccaaa

SEQ ID NO: 731771 - DNA, 25 bp, Mus musculus
gttcgccgaggctactgtgcccaaa

SEQ ID NO: 731772 - DNA, 25 bp, Mus musculus
gttcgccgggtcatggtgccagcct

SEQ ID NO: 731773 - DNA, 25 bp, Mus musculus
gttcgccgggtcttggtgccagcct

SEQ ID NO: 731774 - DNA, 25 bp, Mus musculus
gttcgcgacccaaacagctcgactg

SEQ ID NO: 731775 - DNA, 25 bp, Mus musculus
gttcgcgacccatacagctcgactg

SEQ ID NO: 731776 - DNA, 25 bp, Mus musculus
gttcgcgacgtgcagcagcgacacc

SEQ ID NO: 731777 - DNA, 25 bp, Mus musculus
gttcgcgacgtggagcagcgacacc

SEQ ID NO: 731778 - DNA, 25 bp, Mus musculus
gttcgcgtcgacagaccagagtccg

SEQ ID NO: 731779 - DNA, 25 bp, Mus musculus
gttcgcgtcgactgaccagagtccg

SEQ ID NO: 731780 - DNA, 25 bp, Mus musculus
gttcgctatcctcacagaatcactt

SEQ ID NO: 731781 - DNA, 25 bp, Mus musculus
gttcgctatcctgacagaatcactt

SEQ ID NO: 731782 - DNA, 25 bp, Mus musculus
gttcgctatgccacctggagcatca

SEQ ID NO: 731783 - DNA, 25 bp, Mus musculus
gttcgctatgcctcctggagcatca

SEQ ID NO: 731784 - DNA, 25 bp, Mus musculus
gttcggacatccagtaaagcccagg

SEQ ID NO: 731785 - DNA, 25 bp, Mus musculus
gttcggacatcctgtaaagcccagg

SEQ ID NO: 731786 - DNA, 25 bp, Mus musculus
gttcggaggaccaggacactgtcat

SEQ ID NO: 731787 - DNA, 25 bp, Mus musculus
gttcggaggacctggacactgtcat

SEQ ID NO: 731788 - DNA, 25 bp, Mus musculus
gttcggagttgtcaaggtgacagcc

SEQ ID NO: 731789 - DNA, 25 bp, Mus musculus
gttcggagttgtgaaggtgacagcc

SEQ ID NO: 731790 - DNA, 25 bp, Mus musculus
gttcggcaagctaggtgtcctgctg

SEQ ID NO: 731791 - DNA, 25 bp, Mus musculus
gttcggcaagcttggtgtcctgctg

SEQ ID NO: 731792 - DNA, 25 bp, Mus musculus
gttcggcacggcaatgaggatacca

SEQ ID NO: 731793 - DNA, 25 bp, Mus musculus
gttcggcacggctatgaggatacca

SEQ ID NO: 731794 - DNA, 25 bp, Mus musculus
gttcggcatcaactgtgcccagtgc

SEQ ID NO: 731795 - DNA, 25 bp, Mus musculus
gttcggcatcaagtgtgcccagtgc

SEQ ID NO: 731796 - DNA, 25 bp, Mus musculus
gttcggcatccgagctgagagaccc

SEQ ID NO: 731797 - DNA, 25 bp, Mus musculus
gttcggcatccgtgctgagagaccc

SEQ ID NO: 731798 - DNA, 25 bp, Mus musculus
gttcggcgcgtccactgtccagagt

SEQ ID NO: 731799 - DNA, 25 bp, Mus musculus
gttcggcgcgtcgactgtccagagt

SEQ ID NO: 731800 - DNA, 25 bp, Mus musculus
gttcggctttccagtgatcctctag

SEQ ID NO: 731801 - DNA, 25 bp, Mus musculus
gttcggctttcctgtgatcctctag

SEQ ID NO: 731802 - DNA, 25 bp, Mus musculus
gttcgggcctgacacacagcacctg

SEQ ID NO: 731803 - DNA, 25 bp, Mus musculus
gttcgggcctgagacacagcacctg

SEQ ID NO: 731804 - DNA, 25 bp, Mus musculus
gttcggtgcgtaacagcccaggaga

SEQ ID NO: 731805 - DNA, 25 bp, Mus musculus
gttcggtgcgtatcagcccaggaga

SEQ ID NO: 731806 - DNA, 25 bp, Mus musculus
gttcggtgctctcgccaggagccct

SEQ ID NO: 731807 - DNA, 25 bp, Mus musculus
gttcggtgctctggccaggagccct

SEQ ID NO: 731808 - DNA, 25 bp, Mus musculus
gttcggtgtccactccacacagcgg

SEQ ID NO: 731809 - DNA, 25 bp, Mus musculus
gttcggtgtccagtccacacagcgg

SEQ ID NO: 731810 - DNA, 25 bp, Mus musculus
gttcgtaagttgagcccacggtgcc

SEQ ID NO: 731811 - DNA, 25 bp, Mus musculus
gttcgtaagttgtgcccacggtgcc

SEQ ID NO: 731812 - DNA, 25 bp, Mus musculus
gttcgtcatcctaccaagcaccatg

SEQ ID NO: 731813 - DNA, 25 bp, Mus musculus
gttcgtcatccttccaagcaccatg

SEQ ID NO: 731814 - DNA, 25 bp, Mus musculus
gttcgtccagggagcaacgctgccc

SEQ ID NO: 731815 - DNA, 25 bp, Mus musculus
gttcgtccagggtgcaacgctgccc

SEQ ID NO: 731816 - DNA, 25 bp, Mus musculus
gttcgtcccttcactttaggccagc

SEQ ID NO: 731817 - DNA, 25 bp, Mus musculus
gttcgtcccttctctttaggccagc

SEQ ID NO: 731818 - DNA, 25 bp, Mus musculus
gttcgtcctcagcagaagggactca

SEQ ID NO: 731819 - DNA, 25 bp, Mus musculus
gttcgtcctcaggagaagggactca

SEQ ID NO: 731820 - DNA, 25 bp, Mus musculus
gttcgtcgcgctctcacgatggctc

SEQ ID NO: 731821 - DNA, 25 bp, Mus musculus
gttcgtcgcgctgtcacgatggctc

SEQ ID NO: 731822 - DNA, 25 bp, Mus musculus
gttcgtctccaacaagtacctggtg

SEQ ID NO: 731823 - DNA, 25 bp, Mus musculus
gttcgtctccaagaagtacctggtg

SEQ ID NO: 731824 - DNA, 25 bp, Mus musculus
gttcgtctgaacagttgctgggcca

SEQ ID NO: 731825 - DNA, 25 bp, Mus musculus
gttcgtctgaactgttgctgggcca

SEQ ID NO: 731826 - DNA, 25 bp, Mus musculus
gttcgtgaaatcatccaaaatggcc

SEQ ID NO: 731827 - DNA, 25 bp, Mus musculus
gttcgtgaaatcttccaaaatggcc

SEQ ID NO: 731828 - DNA, 25 bp, Mus musculus
gttcgtgacaagagtgcttgatgga

SEQ ID NO: 731829 - DNA, 25 bp, Mus musculus
gttcgtgacaagtgtgcttgatgga

SEQ ID NO: 731830 - DNA, 25 bp, Mus musculus
gttcgtgtgtggaatctgcctgccg

SEQ ID NO: 731831 - DNA, 25 bp, Mus musculus
gttcgtgtgtggtatctgcctgccg

SEQ ID NO: 731832 - DNA, 25 bp, Mus musculus
gttcgttatgcaacaatcaatgctc

SEQ ID NO: 731833 - DNA, 25 bp, Mus musculus
gttcgttatgcatcaatcaatgctc

SEQ ID NO: 731834 - DNA, 25 bp, Mus musculus
gttcgttgacttcctgtattaccac

SEQ ID NO: 731835 - DNA, 25 bp, Mus musculus
gttcgttgacttgctgtattaccac

SEQ ID NO: 731836 - DNA, 25 bp, Mus musculus
gttctaaaatacctgcgcagcaaga

SEQ ID NO: 731837 - DNA, 25 bp, Mus musculus
gttctaaaatacgtgcgcagcaaga

SEQ ID NO: 731838 - DNA, 25 bp, Mus musculus
gttctaacaggcattctggagcagg

SEQ ID NO: 731839 - DNA, 25 bp, Mus musculus
gttctaacaggctttctggagcagg

SEQ ID NO: 731840 - DNA, 25 bp, Mus musculus
gttctaagagcacggcctttgagac

SEQ ID NO: 731841 - DNA, 25 bp, Mus musculus
gttctaagagcagggcctttgagac

SEQ ID NO: 731842 - DNA, 25 bp, Mus musculus
gttctacaatgacccgggaagctgc

SEQ ID NO: 731843 - DNA, 25 bp, Mus musculus
gttctacaatgagccgggaagctgc

SEQ ID NO: 731844 - DNA, 25 bp, Mus musculus
gttctaccagctacggagtccccaa

SEQ ID NO: 731845 - DNA, 25 bp, Mus musculus
gttctaccagcttcggagtccccaa

SEQ ID NO: 731846 - DNA, 25 bp, Mus musculus
gttctacctctgactgttttctggg

SEQ ID NO: 731847 - DNA, 25 bp, Mus musculus
gttctacctctgtctgttttctggg

SEQ ID NO: 731848 - DNA, 25 bp, Mus musculus
gttctacgttctcggtgaggatgca

SEQ ID NO: 731849 - DNA, 25 bp, Mus musculus
gttctacgttctgggtgaggatgca

SEQ ID NO: 731850 - DNA, 25 bp, Mus musculus
gttctagaagcccatggactgaaac

SEQ ID NO: 731851 - DNA, 25 bp, Mus musculus
gttctagaagccgatggactgaaac

SEQ ID NO: 731852 - DNA, 25 bp, Mus musculus
gttctagatgaccagcgccgtctga

SEQ ID NO: 731853 - DNA, 25 bp, Mus musculus
gttctagatgacgagcgccgtctga

SEQ ID NO: 731854 - DNA, 25 bp, Mus musculus
gttctagatgagaacaagctgctga

SEQ ID NO: 731855 - DNA, 25 bp, Mus musculus
gttctagatgagtacaagctgctga

SEQ ID NO: 731856 - DNA, 25 bp, Mus musculus
gttctaggccctaacacaagtgtct

SEQ ID NO: 731857 - DNA, 25 bp, Mus musculus
gttctaggcccttacacaagtgtct

SEQ ID NO: 731858 - DNA, 25 bp, Mus musculus
gttctaggtcatatgtccctttccc

SEQ ID NO: 731859 - DNA, 25 bp, Mus musculus
gttctaggtcatttgtccctttccc

SEQ ID NO: 731860 - DNA, 25 bp, Mus musculus
gttctaggtcttatagtggaagagg

SEQ ID NO: 731861 - DNA, 25 bp, Mus musculus
gttctaggtcttttagtggaagagg

SEQ ID NO: 731862 - DNA, 25 bp, Mus musculus
gttctatagtccaccaatgtaagaa

SEQ ID NO: 731863 - DNA, 25 bp, Mus musculus
gttctatagtcctccaatgtaagaa

SEQ ID NO: 731864 - DNA, 25 bp, Mus musculus
gttctatcacacaccaggttctgtt

SEQ ID NO: 731865 - DNA, 25 bp, Mus musculus
gttctatcacactccaggttctgtt

SEQ ID NO: 731866 - DNA, 25 bp, Mus musculus
gttctatgccacaagagaccattac

SEQ ID NO: 731867 - DNA, 25 bp, Mus musculus
gttctatgccactagagaccattac

SEQ ID NO: 731868 - DNA, 25 bp, Mus musculus
gttctatggaagcatatcagcccag

SEQ ID NO: 731869 - DNA, 25 bp, Mus musculus
gttctatggaaggatatcagcccag

SEQ ID NO: 731870 - DNA, 25 bp, Mus musculus
gttctatttccactgtgaaggacat

SEQ ID NO: 731871 - DNA, 25 bp, Mus musculus
gttctatttccagtgtgaaggacat

SEQ ID NO: 731872 - DNA, 25 bp, Mus musculus
gttctcaacaagacccaggatgccc

SEQ ID NO: 731873 - DNA, 25 bp, Mus musculus
gttctcaacaagtcccaggatgccc

SEQ ID NO: 731874 - DNA, 25 bp, Mus musculus
gttctcaagccaatccagatgcctg

SEQ ID NO: 731875 - DNA, 25 bp, Mus musculus
gttctcaagccattccagatgcctg

SEQ ID NO: 731876 - DNA, 25 bp, Mus musculus
gttctcaagtcacaagcatgttctc

SEQ ID NO: 731877 - DNA, 25 bp, Mus musculus
gttctcaagtcagaagcatgttctc

SEQ ID NO: 731878 - DNA, 25 bp, Mus musculus
gttctcacaaggctcagtatttgca

SEQ ID NO: 731879 - DNA, 25 bp, Mus musculus
gttctcacaagggtcagtatttgca

SEQ ID NO: 731880 - DNA, 25 bp, Mus musculus
gttctcagaagcaccggatccaggc

SEQ ID NO: 731881 - DNA, 25 bp, Mus musculus
gttctcagaagctccggatccaggc

SEQ ID NO: 731882 - DNA, 25 bp, Mus musculus
gttctcagaccactataaacacgtg

SEQ ID NO: 731883 - DNA, 25 bp, Mus musculus
gttctcagaccagtataaacacgtg

SEQ ID NO: 731884 - DNA, 25 bp, Mus musculus
gttctcagcaccacaaatgattctg

SEQ ID NO: 731885 - DNA, 25 bp, Mus musculus
gttctcagcacctcaaatgattctg

SEQ ID NO: 731886 - DNA, 25 bp, Mus musculus
gttctcagccaaatattttacatgg

SEQ ID NO: 731887 - DNA, 25 bp, Mus musculus
gttctcagccaattattttacatgg

SEQ ID NO: 731888 - DNA, 25 bp, Mus musculus
gttctcagtgaacgaccgtgcggcc

SEQ ID NO: 731889 - DNA, 25 bp, Mus musculus
gttctcagtgaaggaccgtgcggcc

SEQ ID NO: 731890 - DNA, 25 bp, Mus musculus
gttctcataactccccttaacctat

SEQ ID NO: 731891 - DNA, 25 bp, Mus musculus
gttctcataactgcccttaacctat

SEQ ID NO: 731892 - DNA, 25 bp, Mus musculus
gttctcatcaacattgatcccaatg

SEQ ID NO: 731893 - DNA, 25 bp, Mus musculus
gttctcatcaactttgatcccaatg

SEQ ID NO: 731894 - DNA, 25 bp, Mus musculus
gttctcatcgtgcactgggatgtgc

SEQ ID NO: 731895 - DNA, 25 bp, Mus musculus
gttctcatcgtggactgggatgtgc

SEQ ID NO: 731896 - DNA, 25 bp, Mus musculus
gttctccacaaactcatggttgtca

SEQ ID NO: 731897 - DNA, 25 bp, Mus musculus
gttctccacaaagtcatggttgtca

SEQ ID NO: 731898 - DNA, 25 bp, Mus musculus
gttctccacatgatggaaaaacaac

SEQ ID NO: 731899 - DNA, 25 bp, Mus musculus
gttctccacatgttggaaaaacaac

SEQ ID NO: 731900 - DNA, 25 bp, Mus musculus
gttctccacgtgcagctaaaccggc

SEQ ID NO: 731901 - DNA, 25 bp, Mus musculus
gttctccacgtggagctaaaccggc

SEQ ID NO: 731902 - DNA, 25 bp, Mus musculus
gttctccatggtcatagacaacggc

SEQ ID NO: 731903 - DNA, 25 bp, Mus musculus
gttctccatggtgatagacaacggc

SEQ ID NO: 731904 - DNA, 25 bp, Mus musculus
gttctcccaactctacagacatgag

SEQ ID NO: 731905 - DNA, 25 bp, Mus musculus
gttctcccaactgtacagacatgag

SEQ ID NO: 731906 - DNA, 25 bp, Mus musculus
gttctcccaagacaaacctgtgggc

SEQ ID NO: 731907 - DNA, 25 bp, Mus musculus
gttctcccaagagaaacctgtgggc

SEQ ID NO: 731908 - DNA, 25 bp, Mus musculus
gttctcccacctacggcggattgga

SEQ ID NO: 731909 - DNA, 25 bp, Mus musculus
gttctcccaccttcggcggattgga

SEQ ID NO: 731910 - DNA, 25 bp, Mus musculus
gttctcccatggccaggtggtatct

SEQ ID NO: 731911 - DNA, 25 bp, Mus musculus
gttctcccatgggcaggtggtatct

SEQ ID NO: 731912 - DNA, 25 bp, Mus musculus
gttctccccactcaagcagctttag

SEQ ID NO: 731913 - DNA, 25 bp, Mus musculus
gttctccccactgaagcagctttag

SEQ ID NO: 731914 - DNA, 25 bp, Mus musculus
gttctcccgctcagtggctctgttc

SEQ ID NO: 731915 - DNA, 25 bp, Mus musculus
gttctcccgctctgtggctctgttc

SEQ ID NO: 731916 - DNA, 25 bp, Mus musculus
gttctccggaagagccaggctagcc

SEQ ID NO: 731917 - DNA, 25 bp, Mus musculus
gttctccggaagtgccaggctagcc

SEQ ID NO: 731918 - DNA, 25 bp, Mus musculus
gttctcctggcaccccgttcttatg

SEQ ID NO: 731919 - DNA, 25 bp, Mus musculus
gttctcctggcagcccgttcttatg

SEQ ID NO: 731920 - DNA, 25 bp, Mus musculus
gttctcgagtaacatttagctcccg

SEQ ID NO: 731921 - DNA, 25 bp, Mus musculus
gttctcgagtaagatttagctcccg

SEQ ID NO: 731922 - DNA, 25 bp, Mus musculus
gttctcgctggaagtccatgaccaa

SEQ ID NO: 731923 - DNA, 25 bp, Mus musculus
gttctcgctggatgtccatgaccaa

SEQ ID NO: 731924 - DNA, 25 bp, Mus musculus
gttctcggaatacctgtgcaaacag

SEQ ID NO: 731925 - DNA, 25 bp, Mus musculus
gttctcggaatagctgtgcaaacag

SEQ ID NO: 731926 - DNA, 25 bp, Mus musculus
gttctcggcggcacttctggtgctg

SEQ ID NO: 731927 - DNA, 25 bp, Mus musculus
gttctcggcggctcttctggtgctg

SEQ ID NO: 731928 - DNA, 25 bp, Mus musculus
gttctcggtaaaacctgcaagccaa

SEQ ID NO: 731929 - DNA, 25 bp, Mus musculus
gttctcggtaaatcctgcaagccaa

SEQ ID NO: 731930 - DNA, 25 bp, Mus musculus
gttctctagtgcaggtagtcaggca

SEQ ID NO: 731931 - DNA, 25 bp, Mus musculus
gttctctagtgctggtagtcaggca

SEQ ID NO: 731932 - DNA, 25 bp, Mus musculus
gttctctccactatggcccggcgta

SEQ ID NO: 731933 - DNA, 25 bp, Mus musculus
gttctctccactttggcccggcgta

SEQ ID NO: 731934 - DNA, 25 bp, Mus musculus
gttctctctgcaaataccggacctt

SEQ ID NO: 731935 - DNA, 25 bp, Mus musculus
gttctctctgcatataccggacctt

SEQ ID NO: 731936 - DNA, 25 bp, Mus musculus
gttctctgccccacggagcttgtga

SEQ ID NO: 731937 - DNA, 25 bp, Mus musculus
gttctctgcccctcggagcttgtga

SEQ ID NO: 731938 - DNA, 25 bp, Mus musculus
gttctctgggagatgctaacaaggg

SEQ ID NO: 731939 - DNA, 25 bp, Mus musculus
gttctctgggagttgctaacaaggg

SEQ ID NO: 731940 - DNA, 25 bp, Mus musculus
gttctctggtgtcccctggaactca

SEQ ID NO: 731941 - DNA, 25 bp, Mus musculus
gttctctggtgtgccctggaactca

SEQ ID NO: 731942 - DNA, 25 bp, Mus musculus
gttctcttaaagagcagacaacgct

SEQ ID NO: 731943 - DNA, 25 bp, Mus musculus
gttctcttaaagtgcagacaacgct

SEQ ID NO: 731944 - DNA, 25 bp, Mus musculus
gttctcttaaatcacagcccaggga

SEQ ID NO: 731945 - DNA, 25 bp, Mus musculus
gttctcttaaatgacagcccaggga

SEQ ID NO: 731946 - DNA, 25 bp, Mus musculus
gttctcttctgcagatcatttccca

SEQ ID NO: 731947 - DNA, 25 bp, Mus musculus
gttctcttctgctgatcatttccca

SEQ ID NO: 731948 - DNA, 25 bp, Mus musculus
gttctcttgggcattgagcagcagg

SEQ ID NO: 731949 - DNA, 25 bp, Mus musculus
gttctcttgggctttgagcagcagg

SEQ ID NO: 731950 - DNA, 25 bp, Mus musculus
gttctgaactctcgcctggccctgg

SEQ ID NO: 731951 - DNA, 25 bp, Mus musculus
gttctgaactctggcctggccctgg

SEQ ID NO: 731952 - DNA, 25 bp, Mus musculus
gttctgaatttcagttatatgcttg

SEQ ID NO: 731953 - DNA, 25 bp, Mus musculus
gttctgaatttctgttatatgcttg

SEQ ID NO: 731954 - DNA, 25 bp, Mus musculus
gttctgacaccacggatggaccacc

SEQ ID NO: 731955 - DNA, 25 bp, Mus musculus
gttctgacaccagggatggaccacc

SEQ ID NO: 731956 - DNA, 25 bp, Mus musculus
gttctgacagctcttgggatttccc

SEQ ID NO: 731957 - DNA, 25 bp, Mus musculus
gttctgacagctgttgggatttccc

SEQ ID NO: 731958 - DNA, 25 bp, Mus musculus
gttctgactacaaacagtatgtgtt

SEQ ID NO: 731959 - DNA, 25 bp, Mus musculus
gttctgactacatacagtatgtgtt

SEQ ID NO: 731960 - DNA, 25 bp, Mus musculus
gttctgagccaccaggaccttactg

SEQ ID NO: 731961 - DNA, 25 bp, Mus musculus
gttctgagccacgaggaccttactg

SEQ ID NO: 731962 - DNA, 25 bp, Mus musculus
gttctgagccgacaccaccagatgg

SEQ ID NO: 731963 - DNA, 25 bp, Mus musculus
gttctgagccgagaccaccagatgg

SEQ ID NO: 731964 - DNA, 25 bp, Mus musculus
gttctgagctcaagcccaaagcact

SEQ ID NO: 731965 - DNA, 25 bp, Mus musculus
gttctgagctcatgcccaaagcact

SEQ ID NO: 731966 - DNA, 25 bp, Mus musculus
gttctgaggagtcatttgcaacgca

SEQ ID NO: 731967 - DNA, 25 bp, Mus musculus
gttctgaggagtgatttgcaacgca

SEQ ID NO: 731968 - DNA, 25 bp, Mus musculus
gttctgaggctcactgcaagccggt

SEQ ID NO: 731969 - DNA, 25 bp, Mus musculus
gttctgaggctctctgcaagccggt

SEQ ID NO: 731970 - DNA, 25 bp, Mus musculus
gttctgagtgccagactgcctcgcc

SEQ ID NO: 731971 - DNA, 25 bp, Mus musculus
gttctgagtgcctgactgcctcgcc

SEQ ID NO: 731972 - DNA, 25 bp, Mus musculus
gttctgagttccagcgcttcaaatg

SEQ ID NO: 731973 - DNA, 25 bp, Mus musculus
gttctgagttcctgcgcttcaaatg

SEQ ID NO: 731974 - DNA, 25 bp, Mus musculus
gttctgatcactaccacgcagttgg

SEQ ID NO: 731975 - DNA, 25 bp, Mus musculus
gttctgatcacttccacgcagttgg

SEQ ID NO: 731976 - DNA, 25 bp, Mus musculus
gttctgatctggagaaggtcacaag

SEQ ID NO: 731977 - DNA, 25 bp, Mus musculus
gttctgatctggtgaaggtcacaag

SEQ ID NO: 731978 - DNA, 25 bp, Mus musculus
gttctgatcttaacgaacaaccttc

SEQ ID NO: 731979 - DNA, 25 bp, Mus musculus
gttctgatcttatcgaacaaccttc

SEQ ID NO: 731980 - DNA, 25 bp, Mus musculus
gttctgattcagagaggctacgact

SEQ ID NO: 731981 - DNA, 25 bp, Mus musculus
gttctgattcagtgaggctacgact

SEQ ID NO: 731982 - DNA, 25 bp, Mus musculus
gttctgcaacagctggaggacaagt

SEQ ID NO: 731983 - DNA, 25 bp, Mus musculus
gttctgcaacaggtggaggacaagt

SEQ ID NO: 731984 - DNA, 25 bp, Mus musculus
gttctgcacgcacaggaggagccaa

SEQ ID NO: 731985 - DNA, 25 bp, Mus musculus
gttctgcacgcagaggaggagccaa

SEQ ID NO: 731986 - DNA, 25 bp, Mus musculus
gttctgcagtacagccacatactgg

SEQ ID NO: 731987 - DNA, 25 bp, Mus musculus
gttctgcagtactgccacatactgg

SEQ ID NO: 731988 - DNA, 25 bp, Mus musculus
gttctgccactcagatctacttgcc

SEQ ID NO: 731989 - DNA, 25 bp, Mus musculus
gttctgccactcagtccatggctta

SEQ ID NO: 731990 - DNA, 25 bp, Mus musculus
gttctgccactctgatctacttgcc

SEQ ID NO: 731991 - DNA, 25 bp, Mus musculus
gttctgccactctgtccatggctta

SEQ ID NO: 731992 - DNA, 25 bp, Mus musculus
gttctgcgatcgagttcaggacgcg

SEQ ID NO: 731993 - DNA, 25 bp, Mus musculus
gttctgcgatcgtgttcaggacgcg

SEQ ID NO: 731994 - DNA, 25 bp, Mus musculus
gttctgctgatcctaattctggcca

SEQ ID NO: 731995 - DNA, 25 bp, Mus musculus
gttctgctgatcgtaattctggcca

SEQ ID NO: 731996 - DNA, 25 bp, Mus musculus
gttctggaagaacaccgcagtggtt

SEQ ID NO: 731997 - DNA, 25 bp, Mus musculus
gttctggaagaagaccgcagtggtt

SEQ ID NO: 731998 - DNA, 25 bp, Mus musculus
gttctggacagtcctgcgatccagt

SEQ ID NO: 731999 - DNA, 25 bp, Mus musculus
gttctggacagtgctgcgatccagt

SEQ ID NO: 732000 - DNA, 25 bp, Mus musculus
gttctggagaggaggacatctttct

SEQ ID NO: 732001 - DNA, 25 bp, Mus musculus
gttctggagaggtggacatctttct

SEQ ID NO: 732002 - DNA, 25 bp, Mus musculus
gttctggcaaccagactctgactct

SEQ ID NO: 732003 - DNA, 25 bp, Mus musculus
gttctggcaacctgactctgactct

SEQ ID NO: 732004 - DNA, 25 bp, Mus musculus
gttctggctatgaccagtcgctcat

SEQ ID NO: 732005 - DNA, 25 bp, Mus musculus
gttctggctatgtccagtcgctcat

SEQ ID NO: 732006 - DNA, 25 bp, Mus musculus
gttctgggtcagatggaagtgctcc

SEQ ID NO: 732007 - DNA, 25 bp, Mus musculus
gttctgggtcagttggaagtgctcc

SEQ ID NO: 732008 - DNA, 25 bp, Mus musculus
gttctggtcactcagactacgctgg

SEQ ID NO: 732009 - DNA, 25 bp, Mus musculus
gttctggtcactgagactacgctgg

SEQ ID NO: 732010 - DNA, 25 bp, Mus musculus
gttctggtcctactgcccctggagg

SEQ ID NO: 732011 - DNA, 25 bp, Mus musculus
gttctggtcctagtgcccctggagg

SEQ ID NO: 732012 - DNA, 25 bp, Mus musculus
gttctggtggatccttctgctgctc

SEQ ID NO: 732013 - DNA, 25 bp, Mus musculus
gttctggtggatgcttctgctgctc

SEQ ID NO: 732014 - DNA, 25 bp, Mus musculus
gttctgtacttcaccaatggccacc

SEQ ID NO: 732015 - DNA, 25 bp, Mus musculus
gttctgtacttctccaatggccacc

SEQ ID NO: 732016 - DNA, 25 bp, Mus musculus
gttctgtgaggcagctgactgagca

SEQ ID NO: 732017 - DNA, 25 bp, Mus musculus
gttctgtgaggctgctgactgagca

SEQ ID NO: 732018 - DNA, 25 bp, Mus musculus
gttctgtgataactgcttcagccgg

SEQ ID NO: 732019 - DNA, 25 bp, Mus musculus
gttctgtgataagtgcttcagccgg

SEQ ID NO: 732020 - DNA, 25 bp, Mus musculus
gttctgtgtttcacgttcaagcctg

SEQ ID NO: 732021 - DNA, 25 bp, Mus musculus
gttctgtgtttctcgttcaagcctg

SEQ ID NO: 732022 - DNA, 25 bp, Mus musculus
gttcttaagaacacatctatttcca

SEQ ID NO: 732023 - DNA, 25 bp, Mus musculus
gttcttaagaactcatctatttcca

SEQ ID NO: 732024 - DNA, 25 bp, Mus musculus
gttcttaatgcaaggccagaggatg

SEQ ID NO: 732025 - DNA, 25 bp, Mus musculus
gttcttaatgcatggccagaggatg

SEQ ID NO: 732026 - DNA, 25 bp, Mus musculus
gttcttacagagaagcccaccttgg

SEQ ID NO: 732027 - DNA, 25 bp, Mus musculus
gttcttacagagtagcccaccttgg

SEQ ID NO: 732028 - DNA, 25 bp, Mus musculus
gttcttactgccatacgacctggag

SEQ ID NO: 732029 - DNA, 25 bp, Mus musculus
gttcttactgccttacgacctggag

SEQ ID NO: 732030 - DNA, 25 bp, Mus musculus
gttcttcaagaactggcgggaccca

SEQ ID NO: 732031 - DNA, 25 bp, Mus musculus
gttcttcaagaagtggcgggaccca

SEQ ID NO: 732032 - DNA, 25 bp, Mus musculus
gttcttcacgaacctggaccagctc

SEQ ID NO: 732033 - DNA, 25 bp, Mus musculus
gttcttcacgaagctggaccagctc

SEQ ID NO: 732034 - DNA, 25 bp, Mus musculus
gttcttcacggtcacattccacaag

SEQ ID NO: 732035 - DNA, 25 bp, Mus musculus
gttcttcacggtgacattccacaag

SEQ ID NO: 732036 - DNA, 25 bp, Mus musculus
gttcttcaggtgacagactccacct

SEQ ID NO: 732037 - DNA, 25 bp, Mus musculus
gttcttcaggtgtcagactccacct

SEQ ID NO: 732038 - DNA, 25 bp, Mus musculus
gttcttcattgactcagcccgctgg

SEQ ID NO: 732039 - DNA, 25 bp, Mus musculus
gttcttcattgagtcagcccgctgg

SEQ ID NO: 732040 - DNA, 25 bp, Mus musculus
gttcttcgctgaccagttcctgcag

SEQ ID NO: 732041 - DNA, 25 bp, Mus musculus
gttcttcgctgagcagttcctgcag

SEQ ID NO: 732042 - DNA, 25 bp, Mus musculus
gttcttctccagaaacagctgcagg

SEQ ID NO: 732043 - DNA, 25 bp, Mus musculus
gttcttctccagtaacagctgcagg

SEQ ID NO: 732044 - DNA, 25 bp, Mus musculus
gttcttgaacatcatcccattgaga

SEQ ID NO: 732045 - DNA, 25 bp, Mus musculus
gttcttgaacatgatcccattgaga

SEQ ID NO: 732046 - DNA, 25 bp, Mus musculus
gttcttgaccatcatggccagaaag

SEQ ID NO: 732047 - DNA, 25 bp, Mus musculus
gttcttgaccatgatggccagaaag

SEQ ID NO: 732048 - DNA, 25 bp, Mus musculus
gttcttgactatcatggctagaaaa

SEQ ID NO: 732049 - DNA, 25 bp, Mus musculus
gttcttgactatgatggctagaaaa

SEQ ID NO: 732050 - DNA, 25 bp, Mus musculus
gttcttgagaccacgcatcatcggg

SEQ ID NO: 732051 - DNA, 25 bp, Mus musculus
gttcttgagacctcgcatcatcggg

SEQ ID NO: 732052 - DNA, 25 bp, Mus musculus
gttcttgagcaaccaagatgggcag

SEQ ID NO: 732053 - DNA, 25 bp, Mus musculus
gttcttgagcaagcaagatgggcag

SEQ ID NO: 732054 - DNA, 25 bp, Mus musculus
gttcttgcagaaccagagcctgggt

SEQ ID NO: 732055 - DNA, 25 bp, Mus musculus
gttcttgcagaagcagagcctgggt

SEQ ID NO: 732056 - DNA, 25 bp, Mus musculus
gttcttgcatgtcagcagggcttgc

SEQ ID NO: 732057 - DNA, 25 bp, Mus musculus
gttcttgcatgtgagcagggcttgc

SEQ ID NO: 732058 - DNA, 25 bp, Mus musculus
gttcttgccaggcaaatggattctt

SEQ ID NO: 732059 - DNA, 25 bp, Mus musculus
gttcttgccagggaaatggattctt

SEQ ID NO: 732060 - DNA, 25 bp, Mus musculus
gttcttgcctaaagaggccactcat

SEQ ID NO: 732061 - DNA, 25 bp, Mus musculus
gttcttgcctaatgaggccactcat

SEQ ID NO: 732062 - DNA, 25 bp, Mus musculus
gttcttggaacaccgaatgaggaca

SEQ ID NO: 732063 - DNA, 25 bp, Mus musculus
gttcttggaacagcgaatgaggaca

SEQ ID NO: 732064 - DNA, 25 bp, Mus musculus
gttcttggctcaatggcaaaaaagt

SEQ ID NO: 732065 - DNA, 25 bp, Mus musculus
gttcttggctcattggcaaaaaagt

SEQ ID NO: 732066 - DNA, 25 bp, Mus musculus
gttcttgtggaaataaaaagtacag

SEQ ID NO: 732067 - DNA, 25 bp, Mus musculus
gttcttgtggaattaaaaagtacag

SEQ ID NO: 732068 - DNA, 25 bp, Mus musculus
gttcttgtgtatagtgtgaataacc

SEQ ID NO: 732069 - DNA, 25 bp, Mus musculus
gttcttgtgtattgtgtgaataacc

SEQ ID NO: 732070 - DNA, 25 bp, Mus musculus
gttctttcaagccaagtcgctggga

SEQ ID NO: 732071 - DNA, 25 bp, Mus musculus
gttctttcaagcgaagtcgctggga

SEQ ID NO: 732072 - DNA, 25 bp, Mus musculus
gttctttcagcaagactatgtgatt

SEQ ID NO: 732073 - DNA, 25 bp, Mus musculus
gttctttcagcatgactatgtgatt

SEQ ID NO: 732074 - DNA, 25 bp, Mus musculus
gttctttcagctcggttgcaggcct

SEQ ID NO: 732075 - DNA, 25 bp, Mus musculus
gttctttcagctgggttgcaggcct

SEQ ID NO: 732076 - DNA, 25 bp, Mus musculus
gttctttcaggtcacctcttctata

SEQ ID NO: 732077 - DNA, 25 bp, Mus musculus
gttctttcaggtgacctcttctata

SEQ ID NO: 732078 - DNA, 25 bp, Mus musculus
gttctttggcttatcccactggtca

SEQ ID NO: 732079 - DNA, 25 bp, Mus musculus
gttctttggcttttcccactggtca

SEQ ID NO: 732080 - DNA, 25 bp, Mus musculus
gttcttttacacaaagtccttcgtg

SEQ ID NO: 732081 - DNA, 25 bp, Mus musculus
gttcttttacactaagtccttcgtg

SEQ ID NO: 732082 - DNA, 25 bp, Mus musculus
gttcttttgaatccagatgccatct

SEQ ID NO: 732083 - DNA, 25 bp, Mus musculus
gttcttttgaatgcagatgccatct

SEQ ID NO: 732084 - DNA, 25 bp, Mus musculus
gttcttttgcgactccagttaaaca

SEQ ID NO: 732085 - DNA, 25 bp, Mus musculus
gttcttttgcgagtccagttaaaca

SEQ ID NO: 732086 - DNA, 25 bp, Mus musculus
gttgaaaagtacatcttgcctccaa

SEQ ID NO: 732087 - DNA, 25 bp, Mus musculus
gttgaaaagtacttcttgcctccaa

SEQ ID NO: 732088 - DNA, 25 bp, Mus musculus
gttgaaaatgaacttgtagaactgc

SEQ ID NO: 732089 - DNA, 25 bp, Mus musculus
gttgaaaatgaagttgtagaactgc

SEQ ID NO: 732090 - DNA, 25 bp, Mus musculus
gttgaaacacaaattaacatggtac

SEQ ID NO: 732091 - DNA, 25 bp, Mus musculus
gttgaaacacaatttaacatggtac

SEQ ID NO: 732092 - DNA, 25 bp, Mus musculus
gttgaaacatccagcaagacaggca

SEQ ID NO: 732093 - DNA, 25 bp, Mus musculus
gttgaaacatcctgcaagacaggca

SEQ ID NO: 732094 - DNA, 25 bp, Mus musculus
gttgaaactcagagacctgcagtca

SEQ ID NO: 732095 - DNA, 25 bp, Mus musculus
gttgaaactcagtgacctgcagtca

SEQ ID NO: 732096 - DNA, 25 bp, Mus musculus
gttgaaagacgccattaacaagcca

SEQ ID NO: 732097 - DNA, 25 bp, Mus musculus
gttgaaagacgcgattaacaagcca

SEQ ID NO: 732098 - DNA, 25 bp, Mus musculus
gttgaaagcgctcgtttctccttcg

SEQ ID NO: 732099 - DNA, 25 bp, Mus musculus
gttgaaagcgctggtttctccttcg

SEQ ID NO: 732100 - DNA, 25 bp, Mus musculus
gttgaacaattcaaggcactggaag

SEQ ID NO: 732101 - DNA, 25 bp, Mus musculus
gttgaacaattctaggcactggaag

SEQ ID NO: 732102 - DNA, 25 bp, Mus musculus
gttgaacacccgctggaattccctg

SEQ ID NO: 732103 - DNA, 25 bp, Mus musculus
gttgaacacccggtggaattccctg

SEQ ID NO: 732104 - DNA, 25 bp, Mus musculus
gttgaacatggaccatattgaagtg

SEQ ID NO: 732105 - DNA, 25 bp, Mus musculus
gttgaacatggagcatattgaagtg

SEQ ID NO: 732106 - DNA, 25 bp, Mus musculus
gttgaaccagaactagacatctcag

SEQ ID NO: 732107 - DNA, 25 bp, Mus musculus
gttgaaccagaagtagacatctcag

SEQ ID NO: 732108 - DNA, 25 bp, Mus musculus
gttgaacgacatctggacaattggc

SEQ ID NO: 732109 - DNA, 25 bp, Mus musculus
gttgaacgacatgtggacaattggc

SEQ ID NO: 732110 - DNA, 25 bp, Mus musculus
gttgaacggaccagaagtgagctcc

SEQ ID NO: 732111 - DNA, 25 bp, Mus musculus
gttgaacggacctgaagtgagctcc

SEQ ID NO: 732112 - DNA, 25 bp, Mus musculus
gttgaactgcccacttccctttcta

SEQ ID NO: 732113 - DNA, 25 bp, Mus musculus
gttgaactgccctcttccctttcta

SEQ ID NO: 732114 - DNA, 25 bp, Mus musculus
gttgaacttgccacccacttcaggg

SEQ ID NO: 732115 - DNA, 25 bp, Mus musculus
gttgaacttgcctcccacttcaggg

SEQ ID NO: 732116 - DNA, 25 bp, Mus musculus
gttgaacttggacctacgcccaggg

SEQ ID NO: 732117 - DNA, 25 bp, Mus musculus
gttgaacttggagctacgcccaggg

SEQ ID NO: 732118 - DNA, 25 bp, Mus musculus
gttgaagaccctccatcagtatatg

SEQ ID NO: 732119 - DNA, 25 bp, Mus musculus
gttgaagaccctgcatcagtatatg

SEQ ID NO: 732120 - DNA, 25 bp, Mus musculus
gttgaagaggacaaccaaaatctca

SEQ ID NO: 732121 - DNA, 25 bp, Mus musculus
gttgaagaggactaccaaaatctca

SEQ ID NO: 732122 - DNA, 25 bp, Mus musculus
gttgaagatctgaaactccgtcttc

SEQ ID NO: 732123 - DNA, 25 bp, Mus musculus
gttgaagatctgtaactccgtcttc

SEQ ID NO: 732124 - DNA, 25 bp, Mus musculus
gttgaagcaccacgccagcatcaat

SEQ ID NO: 732125 - DNA, 25 bp, Mus musculus
gttgaagcaccaggccagcatcaat

SEQ ID NO: 732126 - DNA, 25 bp, Mus musculus
gttgaagctcatattaagactcgtt

SEQ ID NO: 732127 - DNA, 25 bp, Mus musculus
gttgaagctcattttaagactcgtt

SEQ ID NO: 732128 - DNA, 25 bp, Mus musculus
gttgaagctgtgctctgcgttccaa

SEQ ID NO: 732129 - DNA, 25 bp, Mus musculus
gttgaagctgtggtctgcgttccaa

SEQ ID NO: 732130 - DNA, 25 bp, Mus musculus
gttgaagcttgcagattgtatacca

SEQ ID NO: 732131 - DNA, 25 bp, Mus musculus
gttgaagcttgctgattgtatacca

SEQ ID NO: 732132 - DNA, 25 bp, Mus musculus
gttgaaggactaaaacgcttaatga

SEQ ID NO: 732133 - DNA, 25 bp, Mus musculus
gttgaaggactataacgcttaatga

SEQ ID NO: 732134 - DNA, 25 bp, Mus musculus
gttgaaggcacaccctgaagaccct

SEQ ID NO: 732135 - DNA, 25 bp, Mus musculus
gttgaaggcacagcctgaagaccct

SEQ ID NO: 732136 - DNA, 25 bp, Mus musculus
gttgaaggctcgattccacgatgag

SEQ ID NO: 732137 - DNA, 25 bp, Mus musculus
gttgaaggctcgtttccacgatgag

SEQ ID NO: 732138 - DNA, 25 bp, Mus musculus
gttgaagtccagaatctgctccgtg

SEQ ID NO: 732139 - DNA, 25 bp, Mus musculus
gttgaagtccagtatctgctccgtg

SEQ ID NO: 732140 - DNA, 25 bp, Mus musculus
gttgaatcagccacaggcctgtggg

SEQ ID NO: 732141 - DNA, 25 bp, Mus musculus
gttgaatcagcctcaggcctgtggg

SEQ ID NO: 732142 - DNA, 25 bp, Mus musculus
gttgaatccaacaagtctacaaaag

SEQ ID NO: 732143 - DNA, 25 bp, Mus musculus
gttgaatccaactagtctacaaaag

SEQ ID NO: 732144 - DNA, 25 bp, Mus musculus
gttgaatgactacaaatggtttgcg

SEQ ID NO: 732145 - DNA, 25 bp, Mus musculus
gttgaatgactagaaatggtttgcg

SEQ ID NO: 732146 - DNA, 25 bp, Mus musculus
gttgaatgccgacttagtttgcccg

SEQ ID NO: 732147 - DNA, 25 bp, Mus musculus
gttgaatgccgagttagtttgcccg

SEQ ID NO: 732148 - DNA, 25 bp, Mus musculus
gttgaatgtaatactcgcctcgacc

SEQ ID NO: 732149 - DNA, 25 bp, Mus musculus
gttgaatgtaattctcgcctcgacc

SEQ ID NO: 732150 - DNA, 25 bp, Mus musculus
gttgaatgttgccttctgtcctgat

SEQ ID NO: 732151 - DNA, 25 bp, Mus musculus
gttgaatgttgcgttctgtcctgat

SEQ ID NO: 732152 - DNA, 25 bp, Mus musculus
gttgaatttactccacagtaactgc

SEQ ID NO: 732153 - DNA, 25 bp, Mus musculus
gttgaatttactgcacagtaactgc

SEQ ID NO: 732154 - DNA, 25 bp, Mus musculus
gttgacaaagtcaagccagtttctt

SEQ ID NO: 732155 - DNA, 25 bp, Mus musculus
gttgacaaagtctagccagtttctt

SEQ ID NO: 732156 - DNA, 25 bp, Mus musculus
gttgacaaccttaaccaccacaatc

SEQ ID NO: 732157 - DNA, 25 bp, Mus musculus
gttgacaacctttaccaccacaatc

SEQ ID NO: 732158 - DNA, 25 bp, Mus musculus
gttgacaagttcatgattgagctgg

SEQ ID NO: 732159 - DNA, 25 bp, Mus musculus
gttgacaagttcttgattgagctgg

SEQ ID NO: 732160 - DNA, 25 bp, Mus musculus
gttgacaatctactctgcaaccaag

SEQ ID NO: 732161 - DNA, 25 bp, Mus musculus
gttgacaatctagtctgcaaccaag

SEQ ID NO: 732162 - DNA, 25 bp, Mus musculus
gttgacatggatccgctcagagccc

SEQ ID NO: 732163 - DNA, 25 bp, Mus musculus
gttgacatggatgcgctcagagccc

SEQ ID NO: 732164 - DNA, 25 bp, Mus musculus
gttgaccagcccctgaaaattgcca

SEQ ID NO: 732165 - DNA, 25 bp, Mus musculus
gttgaccagcccgtgaaaattgcca

SEQ ID NO: 732166 - DNA, 25 bp, Mus musculus
gttgaccaggttcacttgagagaca

SEQ ID NO: 732167 - DNA, 25 bp, Mus musculus
gttgaccaggttgacttgagagaca

SEQ ID NO: 732168 - DNA, 25 bp, Mus musculus
gttgaccatgtcaacgaccatcatg

SEQ ID NO: 732169 - DNA, 25 bp, Mus musculus
gttgaccatgtctacgaccatcatg

SEQ ID NO: 732170 - DNA, 25 bp, Mus musculus
gttgaccccttcaatcgagacatgc

SEQ ID NO: 732171 - DNA, 25 bp, Mus musculus
gttgaccccttctatcgagacatgc

SEQ ID NO: 732172 - DNA, 25 bp, Mus musculus
gttgaccgcagtagtccagaagcgc

SEQ ID NO: 732173 - DNA, 25 bp, Mus musculus
gttgaccgcagttgtccagaagcgc

SEQ ID NO: 732174 - DNA, 25 bp, Mus musculus
gttgacctgggtagaatctagattc

SEQ ID NO: 732175 - DNA, 25 bp, Mus musculus
gttgacctgggttgaatctagattc

SEQ ID NO: 732176 - DNA, 25 bp, Mus musculus
gttgacctgtctacctggtgttatg

SEQ ID NO: 732177 - DNA, 25 bp, Mus musculus
gttgacctgtcttcctggtgttatg

SEQ ID NO: 732178 - DNA, 25 bp, Mus musculus
gttgaccttgcacgcggtcaagccg

SEQ ID NO: 732179 - DNA, 25 bp, Mus musculus
gttgaccttgcaggcggtcaagccg

SEQ ID NO: 732180 - DNA, 25 bp, Mus musculus
gttgaccttgttcgaaaaatgactc

SEQ ID NO: 732181 - DNA, 25 bp, Mus musculus
gttgaccttgttggaaaaatgactc

SEQ ID NO: 732182 - DNA, 25 bp, Mus musculus
gttgactataaacaggtcctgctga

SEQ ID NO: 732183 - DNA, 25 bp, Mus musculus
gttgactataaagaggtcctgctga

SEQ ID NO: 732184 - DNA, 25 bp, Mus musculus
gttgactctcataactctgctccct

SEQ ID NO: 732185 - DNA, 25 bp, Mus musculus
gttgactctcattactctgctccct

SEQ ID NO: 732186 - DNA, 25 bp, Mus musculus
gttgactttccccaagaccagctgg

SEQ ID NO: 732187 - DNA, 25 bp, Mus musculus
gttgactttcccgaagaccagctgg

SEQ ID NO: 732188 - DNA, 25 bp, Mus musculus
gttgagaaaataaatgtcccagctc

SEQ ID NO: 732189 - DNA, 25 bp, Mus musculus
gttgagaaaatatatgtcccagctc

SEQ ID NO: 732190 - DNA, 25 bp, Mus musculus
gttgagaaccatcaagtatggaaca

SEQ ID NO: 732191 - DNA, 25 bp, Mus musculus
gttgagaaccatgaagtatggaaca

SEQ ID NO: 732192 - DNA, 25 bp, Mus musculus
gttgagaagcggagtgagaccttca

SEQ ID NO: 732193 - DNA, 25 bp, Mus musculus
gttgagaagcggtgtgagaccttca

SEQ ID NO: 732194 - DNA, 25 bp, Mus musculus
gttgagaatcctccggtccggtgtt

SEQ ID NO: 732195 - DNA, 25 bp, Mus musculus
gttgagaatcctgcggtccggtgtt

SEQ ID NO: 732196 - DNA, 25 bp, Mus musculus
gttgagaatgagaacgggtcctact

SEQ ID NO: 732197 - DNA, 25 bp, Mus musculus
gttgagaatgagtacgggtcctact

SEQ ID NO: 732198 - DNA, 25 bp, Mus musculus
gttgagaattccagttctgtatggg

SEQ ID NO: 732199 - DNA, 25 bp, Mus musculus
gttgagaattcctgttctgtatggg

SEQ ID NO: 732200 - DNA, 25 bp, Mus musculus
gttgagacaactcttgcaagcctca

SEQ ID NO: 732201 - DNA, 25 bp, Mus musculus
gttgagacaactgttgcaagcctca

SEQ ID NO: 732202 - DNA, 25 bp, Mus musculus
gttgagcacggtagcaggaagggca

SEQ ID NO: 732203 - DNA, 25 bp, Mus musculus
gttgagcacggttgcaggaagggca

SEQ ID NO: 732204 - DNA, 25 bp, Mus musculus
gttgagcaggacaagctgtatgcta

SEQ ID NO: 732205 - DNA, 25 bp, Mus musculus
gttgagcaggactagctgtatgcta

SEQ ID NO: 732206 - DNA, 25 bp, Mus musculus
gttgagccaaagaacaaaccgcttg

SEQ ID NO: 732207 - DNA, 25 bp, Mus musculus
gttgagccaaagtacaaaccgcttg

SEQ ID NO: 732208 - DNA, 25 bp, Mus musculus
gttgagccaacccatgaaaatagcc

SEQ ID NO: 732209 - DNA, 25 bp, Mus musculus
gttgagccaaccgatgaaaatagcc

SEQ ID NO: 732210 - DNA, 25 bp, Mus musculus
gttgagccggcacagaccacacagg

SEQ ID NO: 732211 - DNA, 25 bp, Mus musculus
gttgagccggcagagaccacacagg

SEQ ID NO: 732212 - DNA, 25 bp, Mus musculus
gttgagccgggcacagaaacacagc

SEQ ID NO: 732213 - DNA, 25 bp, Mus musculus
gttgagccgggctcagaaacacagc

SEQ ID NO: 732214 - DNA, 25 bp, Mus musculus
gttgagctgccgaggtctccgccgc

SEQ ID NO: 732215 - DNA, 25 bp, Mus musculus
gttgagctgccgtggtctccgccgc

SEQ ID NO: 732216 - DNA, 25 bp, Mus musculus
gttgaggaggaaaaccgtgctctgc

SEQ ID NO: 732217 - DNA, 25 bp, Mus musculus
gttgaggaggaataccgtgctctgc

SEQ ID NO: 732218 - DNA, 25 bp, Mus musculus
gttgaggatccaccacccacggttg

SEQ ID NO: 732219 - DNA, 25 bp, Mus musculus
gttgaggatccagcacccacggttg

SEQ ID NO: 732220 - DNA, 25 bp, Mus musculus
gttgagtacctccttattcatggaa

SEQ ID NO: 732221 - DNA, 25 bp, Mus musculus
gttgagtacctcgttattcatggaa

SEQ ID NO: 732222 - DNA, 25 bp, Mus musculus
gttgagtacgtgcatgacaacaagc

SEQ ID NO: 732223 - DNA, 25 bp, Mus musculus
gttgagtacgtggatgacaacaagc

SEQ ID NO: 732224 - DNA, 25 bp, Mus musculus
gttgagtgtgacaccacggtcccgg

SEQ ID NO: 732225 - DNA, 25 bp, Mus musculus
gttgagtgtgactccacggtcccgg

SEQ ID NO: 732226 - DNA, 25 bp, Mus musculus
gttgagttctccacccgcactgtaa

SEQ ID NO: 732227 - DNA, 25 bp, Mus musculus
gttgagttctcctcccgcactgtaa

SEQ ID NO: 732228 - DNA, 25 bp, Mus musculus
gttgagtttcagcatccgagcttcg

SEQ ID NO: 732229 - DNA, 25 bp, Mus musculus
gttgagtttcaggatccgagcttcg

SEQ ID NO: 732230 - DNA, 25 bp, Mus musculus
gttgagtttccaagaagagcaggag

SEQ ID NO: 732231 - DNA, 25 bp, Mus musculus
gttgagtttccatgaagagcaggag

SEQ ID NO: 732232 - DNA, 25 bp, Mus musculus
gttgataaatctcagcccttctctt

SEQ ID NO: 732233 - DNA, 25 bp, Mus musculus
gttgataaatctgagcccttctctt

SEQ ID NO: 732234 - DNA, 25 bp, Mus musculus
gttgatattccacaaggaagaagtg

SEQ ID NO: 732235 - DNA, 25 bp, Mus musculus
gttgatattccagaaggaagaagtg

SEQ ID NO: 732236 - DNA, 25 bp, Mus musculus
gttgatcagtgtatccagaagtttt

SEQ ID NO: 732237 - DNA, 25 bp, Mus musculus
gttgatcagtgtttccagaagtttt

SEQ ID NO: 732238 - DNA, 25 bp, Mus musculus
gttgatcatcttctaaatactcctg

SEQ ID NO: 732239 - DNA, 25 bp, Mus musculus
gttgatcatcttgtaaatactcctg

SEQ ID NO: 732240 - DNA, 25 bp, Mus musculus
gttgatcccaaccatagtggcctcg

SEQ ID NO: 732241 - DNA, 25 bp, Mus musculus
gttgatcccaacgatagtggcctcg

SEQ ID NO: 732242 - DNA, 25 bp, Mus musculus
gttgatcccaggactcaataatttg

SEQ ID NO: 732243 - DNA, 25 bp, Mus musculus
gttgatcccaggtctcaataatttg

SEQ ID NO: 732244 - DNA, 25 bp, Mus musculus
gttgatccgctgagatgaggaaacc

SEQ ID NO: 732245 - DNA, 25 bp, Mus musculus
gttgatccgctgtgatgaggaaacc

SEQ ID NO: 732246 - DNA, 25 bp, Mus musculus
gttgatcctgttctcaccgtggaag

SEQ ID NO: 732247 - DNA, 25 bp, Mus musculus
gttgatcctgttgtcaccgtggaag

SEQ ID NO: 732248 - DNA, 25 bp, Mus musculus
gttgatctaaggcaacgctttgctt

SEQ ID NO: 732249 - DNA, 25 bp, Mus musculus
gttgatctaagggaacgctttgctt

SEQ ID NO: 732250 - DNA, 25 bp, Mus musculus
gttgatgaatttagagagcgccaca

SEQ ID NO: 732251 - DNA, 25 bp, Mus musculus
gttgatgaattttgagagcgccaca

SEQ ID NO: 732252 - DNA, 25 bp, Mus musculus
gttgatgaccgccaacagcccagaa

SEQ ID NO: 732253 - DNA, 25 bp, Mus musculus
gttgatgaccgcgaacagcccagaa

SEQ ID NO: 732254 - DNA, 25 bp, Mus musculus
gttgatgagatcattaaaatctgcc

SEQ ID NO: 732255 - DNA, 25 bp, Mus musculus
gttgatgagatctttaaaatctgcc

SEQ ID NO: 732256 - DNA, 25 bp, Mus musculus
gttgatgcagcgatcgcccttcctg

SEQ ID NO: 732257 - DNA, 25 bp, Mus musculus
gttgatgcagcgttcgcccttcctg

SEQ ID NO: 732258 - DNA, 25 bp, Mus musculus
gttgatgccattaagagtggaaagc

SEQ ID NO: 732259 - DNA, 25 bp, Mus musculus
gttgatgccatttagagtggaaagc

SEQ ID NO: 732260 - DNA, 25 bp, Mus musculus
gttgatgccctcacatcttgccata

SEQ ID NO: 732261 - DNA, 25 bp, Mus musculus
gttgatgccctctcatcttgccata

SEQ ID NO: 732262 - DNA, 25 bp, Mus musculus
gttgatgcgctacccaccaggtgtc

SEQ ID NO: 732263 - DNA, 25 bp, Mus musculus
gttgatgcgctagccaccaggtgtc

SEQ ID NO: 732264 - DNA, 25 bp, Mus musculus
gttgatgctttaatagcagtacccc

SEQ ID NO: 732265 - DNA, 25 bp, Mus musculus
gttgatgctttattagcagtacccc

SEQ ID NO: 732266 - DNA, 25 bp, Mus musculus
gttgatgggcgcaccgtgaacctaa

SEQ ID NO: 732267 - DNA, 25 bp, Mus musculus
gttgatgggcgctccgtgaacctaa

SEQ ID NO: 732268 - DNA, 25 bp, Mus musculus
gttgatgtgccaatctacgtgaggg

SEQ ID NO: 732269 - DNA, 25 bp, Mus musculus
gttgatgtgccattctacgtgaggg

SEQ ID NO: 732270 - DNA, 25 bp, Mus musculus
gttgatgttcttaaagcgacagcgc

SEQ ID NO: 732271 - DNA, 25 bp, Mus musculus
gttgatgttctttaagcgacagcgc

SEQ ID NO: 732272 - DNA, 25 bp, Mus musculus
gttgattacagcatcgggcgggaca

SEQ ID NO: 732273 - DNA, 25 bp, Mus musculus
gttgattacagcttcgggcgggaca

SEQ ID NO: 732274 - DNA, 25 bp, Mus musculus
gttgattcggtgcatgaaagcaagt

SEQ ID NO: 732275 - DNA, 25 bp, Mus musculus
gttgattcggtggatgaaagcaagt

SEQ ID NO: 732276 - DNA, 25 bp, Mus musculus
gttgattgtgatcgaaaaggagcca

SEQ ID NO: 732277 - DNA, 25 bp, Mus musculus
gttgattgtgatggaaaaggagcca

SEQ ID NO: 732278 - DNA, 25 bp, Mus musculus
gttgattttcctactcctgcgtttg

SEQ ID NO: 732279 - DNA, 25 bp, Mus musculus
gttgattttccttctcctgcgtttg

SEQ ID NO: 732280 - DNA, 25 bp, Mus musculus
gttgcaaaacctctagcttgggaac

SEQ ID NO: 732281 - DNA, 25 bp, Mus musculus
gttgcaaaacctgtagcttgggaac

SEQ ID NO: 732282 - DNA, 25 bp, Mus musculus
gttgcaaaatctactccctgaaggc

SEQ ID NO: 732283 - DNA, 25 bp, Mus musculus
gttgcaaaatcttctccctgaaggc

SEQ ID NO: 732284 - DNA, 25 bp, Mus musculus
gttgcaaacatgataaaggcatcct

SEQ ID NO: 732285 - DNA, 25 bp, Mus musculus
gttgcaaacatgttaaaggcatcct

SEQ ID NO: 732286 - DNA, 25 bp, Mus musculus
gttgcaaaggcactgttaacgtctg

SEQ ID NO: 732287 - DNA, 25 bp, Mus musculus
gttgcaaaggcagtgttaacgtctg

SEQ ID NO: 732288 - DNA, 25 bp, Mus musculus
gttgcaagaactagacaagcagata

SEQ ID NO: 732289 - DNA, 25 bp, Mus musculus
gttgcaagaacttgacaagcagata

SEQ ID NO: 732290 - DNA, 25 bp, Mus musculus
gttgcaaggatccaattcgagaagt

SEQ ID NO: 732291 - DNA, 25 bp, Mus musculus
gttgcaaggatcgaattcgagaagt

SEQ ID NO: 732292 - DNA, 25 bp, Mus musculus
gttgcaataccaaaagaactggctg

SEQ ID NO: 732293 - DNA, 25 bp, Mus musculus
gttgcaataccataagaactggctg

SEQ ID NO: 732294 - DNA, 25 bp, Mus musculus
gttgcacagcgaccaaatcattggc

SEQ ID NO: 732295 - DNA, 25 bp, Mus musculus
gttgcacagcgagcaaatcattggc

SEQ ID NO: 732296 - DNA, 25 bp, Mus musculus
gttgcacctgcaacttctgagccaa

SEQ ID NO: 732297 - DNA, 25 bp, Mus musculus
gttgcacctgcatcttctgagccaa

SEQ ID NO: 732298 - DNA, 25 bp, Mus musculus
gttgcactgaaaaagaacatggagg

SEQ ID NO: 732299 - DNA, 25 bp, Mus musculus
gttgcactgaaatagaacatggagg

SEQ ID NO: 732300 - DNA, 25 bp, Mus musculus
gttgcactttctctttggacctctg

SEQ ID NO: 732301 - DNA, 25 bp, Mus musculus
gttgcactttctgtttggacctctg

SEQ ID NO: 732302 - DNA, 25 bp, Mus musculus
gttgcagaagagctggaaccccact

SEQ ID NO: 732303 - DNA, 25 bp, Mus musculus
gttgcagaagaggtggaaccccact

SEQ ID NO: 732304 - DNA, 25 bp, Mus musculus
gttgcagaaggcaggcctggcacca

SEQ ID NO: 732305 - DNA, 25 bp, Mus musculus
gttgcagaaggctggcctggcacca

SEQ ID NO: 732306 - DNA, 25 bp, Mus musculus
gttgcagatgaacctcccacactca

SEQ ID NO: 732307 - DNA, 25 bp, Mus musculus
gttgcagatgaagctcccacactca

SEQ ID NO: 732308 - DNA, 25 bp, Mus musculus
gttgcagcattacgacttttagagg

SEQ ID NO: 732309 - DNA, 25 bp, Mus musculus
gttgcagcattaggacttttagagg

SEQ ID NO: 732310 - DNA, 25 bp, Mus musculus
gttgcagccagcacccttaggaatg

SEQ ID NO: 732311 - DNA, 25 bp, Mus musculus
gttgcagccagctcccttaggaatg

SEQ ID NO: 732312 - DNA, 25 bp, Mus musculus
gttgcagccagtcttagtcactgtt

SEQ ID NO: 732313 - DNA, 25 bp, Mus musculus
gttgcagccagtgttagtcactgtt

SEQ ID NO: 732314 - DNA, 25 bp, Mus musculus
gttgcagcctgtcctccccgtggag

SEQ ID NO: 732315 - DNA, 25 bp, Mus musculus
gttgcagcctgtgctccccgtggag

SEQ ID NO: 732316 - DNA, 25 bp, Mus musculus
gttgcagcggaaaggaaatgtgtca

SEQ ID NO: 732317 - DNA, 25 bp, Mus musculus
gttgcagcggaatggaaatgtgtca

SEQ ID NO: 732318 - DNA, 25 bp, Mus musculus
gttgcagctcccaaaggaggtagct

SEQ ID NO: 732319 - DNA, 25 bp, Mus musculus
gttgcagctccctaaggaggtagct

SEQ ID NO: 732320 - DNA, 25 bp, Mus musculus
gttgcaggaacccaagaaggacctg

SEQ ID NO: 732321 - DNA, 25 bp, Mus musculus
gttgcaggaaccgaagaaggacctg

SEQ ID NO: 732322 - DNA, 25 bp, Mus musculus
gttgcaggcagcctatcaccagctc

SEQ ID NO: 732323 - DNA, 25 bp, Mus musculus
gttgcaggcagcgtatcaccagctc

SEQ ID NO: 732324 - DNA, 25 bp, Mus musculus
gttgcagtattaactcactacggag

SEQ ID NO: 732325 - DNA, 25 bp, Mus musculus
gttgcagtattatctcactacggag

SEQ ID NO: 732326 - DNA, 25 bp, Mus musculus
gttgcagtgtgaagcaagcatggca

SEQ ID NO: 732327 - DNA, 25 bp, Mus musculus
gttgcagtgtgatgcaagcatggca

SEQ ID NO: 732328 - DNA, 25 bp, Mus musculus
gttgcatatcatcgcgcaggtgccg

SEQ ID NO: 732329 - DNA, 25 bp, Mus musculus
gttgcatatcatggcgcaggtgccg

SEQ ID NO: 732330 - DNA, 25 bp, Mus musculus
gttgcatcaaccaccctggcacatt

SEQ ID NO: 732331 - DNA, 25 bp, Mus musculus
gttgcatcaacctccctggcacatt

SEQ ID NO: 732332 - DNA, 25 bp, Mus musculus
gttgcatccagcagggcggttgttc

SEQ ID NO: 732333 - DNA, 25 bp, Mus musculus
gttgcatccagctgggcggttgttc

SEQ ID NO: 732334 - DNA, 25 bp, Mus musculus
gttgcatccggacaaaataaacaaa

SEQ ID NO: 732335 - DNA, 25 bp, Mus musculus
gttgcatccggagaaaataaacaaa

SEQ ID NO: 732336 - DNA, 25 bp, Mus musculus
gttgcatctcctctgaaatggacac

SEQ ID NO: 732337 - DNA, 25 bp, Mus musculus
gttgcatctcctgtgaaatggacac

SEQ ID NO: 732338 - DNA, 25 bp, Mus musculus
gttgcatctcttcttttgaagccat

SEQ ID NO: 732339 - DNA, 25 bp, Mus musculus
gttgcatctcttgttttgaagccat

SEQ ID NO: 732340 - DNA, 25 bp, Mus musculus
gttgcatgtagtacgaggatcccgg

SEQ ID NO: 732341 - DNA, 25 bp, Mus musculus
gttgcatgtagttcgaggatcccgg

SEQ ID NO: 732342 - DNA, 25 bp, Mus musculus
gttgccaagtgactacccgggtaca

SEQ ID NO: 732343 - DNA, 25 bp, Mus musculus
gttgccaagtgagtacccgggtaca

SEQ ID NO: 732344 - DNA, 25 bp, Mus musculus
gttgccacctgacatgccgccagtt

SEQ ID NO: 732345 - DNA, 25 bp, Mus musculus
gttgccacctgagatgccgccagtt

SEQ ID NO: 732346 - DNA, 25 bp, Mus musculus
gttgccagctgcagccgtggaccca

SEQ ID NO: 732347 - DNA, 25 bp, Mus musculus
gttgccagctgctgccgtggaccca

SEQ ID NO: 732348 - DNA, 25 bp, Mus musculus
gttgccagtgttctggtctccttct

SEQ ID NO: 732349 - DNA, 25 bp, Mus musculus
gttgccagtgttgtggtctccttct

SEQ ID NO: 732350 - DNA, 25 bp, Mus musculus
gttgccagttcaagaccgcctatgg

SEQ ID NO: 732351 - DNA, 25 bp, Mus musculus
gttgccagttcatgaccgcctatgg

SEQ ID NO: 732352 - DNA, 25 bp, Mus musculus
gttgccatggcaacctactacgaga

SEQ ID NO: 732353 - DNA, 25 bp, Mus musculus
gttgccatggcatcctactacgaga

SEQ ID NO: 732354 - DNA, 25 bp, Mus musculus
gttgcccacctcatggtctggaaac

SEQ ID NO: 732355 - DNA, 25 bp, Mus musculus
gttgcccacctcttggtctggaaac

SEQ ID NO: 732356 - DNA, 25 bp, Mus musculus
gttgcccacggacctcagtacatct

SEQ ID NO: 732357 - DNA, 25 bp, Mus musculus
gttgcccacggagctcagtacatct

SEQ ID NO: 732358 - DNA, 25 bp, Mus musculus
gttgccccacgtagcaggaccgaat

SEQ ID NO: 732359 - DNA, 25 bp, Mus musculus
gttgccccacgttgcaggaccgaat

SEQ ID NO: 732360 - DNA, 25 bp, Mus musculus
gttgccccattcaatgatgtaattg

SEQ ID NO: 732361 - DNA, 25 bp, Mus musculus
gttgccccattctatgatgtaattg

SEQ ID NO: 732362 - DNA, 25 bp, Mus musculus
gttgccctatgcaagctactttgga

SEQ ID NO: 732363 - DNA, 25 bp, Mus musculus
gttgccctatgctagctactttgga

SEQ ID NO: 732364 - DNA, 25 bp, Mus musculus
gttgccgctgctcagtacagaagag

SEQ ID NO: 732365 - DNA, 25 bp, Mus musculus
gttgccgctgctgagtacagaagag

SEQ ID NO: 732366 - DNA, 25 bp, Mus musculus
gttgccggtggcacatgctttgctg

SEQ ID NO: 732367 - DNA, 25 bp, Mus musculus
gttgccggtggctcatgctttgctg

SEQ ID NO: 732368 - DNA, 25 bp, Mus musculus
gttgccggttccaggatgacaatca

SEQ ID NO: 732369 - DNA, 25 bp, Mus musculus
gttgccggttcctggatgacaatca

SEQ ID NO: 732370 - DNA, 25 bp, Mus musculus
gttgcctatgttcccaaagaccctg

SEQ ID NO: 732371 - DNA, 25 bp, Mus musculus
gttgcctatgttgccaaagaccctg

SEQ ID NO: 732372 - DNA, 25 bp, Mus musculus
gttgcctccggcctctcagggttgc

SEQ ID NO: 732373 - DNA, 25 bp, Mus musculus
gttgcctccggcgtctcagggttgc

SEQ ID NO: 732374 - DNA, 25 bp, Mus musculus
gttgcctcctcgattgcccatgaat

SEQ ID NO: 732375 - DNA, 25 bp, Mus musculus
gttgcctcctcgtttgcccatgaat

SEQ ID NO: 732376 - DNA, 25 bp, Mus musculus
gttgcctctgcacacctggctattg

SEQ ID NO: 732377 - DNA, 25 bp, Mus musculus
gttgcctctgcagacctggctattg

SEQ ID NO: 732378 - DNA, 25 bp, Mus musculus
gttgcctgaagcatccactggccag

SEQ ID NO: 732379 - DNA, 25 bp, Mus musculus
gttgcctgaagcttccactggccag

SEQ ID NO: 732380 - DNA, 25 bp, Mus musculus
gttgcctgccttacaagccacagag

SEQ ID NO: 732381 - DNA, 25 bp, Mus musculus
gttgcctgcctttcaagccacagag

SEQ ID NO: 732382 - DNA, 25 bp, Mus musculus
gttgccttccgacctcctgctggat

SEQ ID NO: 732383 - DNA, 25 bp, Mus musculus
gttgccttccgagctcctgctggat

SEQ ID NO: 732384 - DNA, 25 bp, Mus musculus
gttgccttcgagaccatcgcagtca

SEQ ID NO: 732385 - DNA, 25 bp, Mus musculus
gttgccttcgagtccatcgcagtca

SEQ ID NO: 732386 - DNA, 25 bp, Mus musculus
gttgccttgaccattcgaatcttag

SEQ ID NO: 732387 - DNA, 25 bp, Mus musculus
gttgccttgacctttcgaatcttag

SEQ ID NO: 732388 - DNA, 25 bp, Mus musculus
gttgccttgaggaatttacatttca

SEQ ID NO: 732389 - DNA, 25 bp, Mus musculus
gttgccttgaggtatttacatttca

SEQ ID NO: 732390 - DNA, 25 bp, Mus musculus
gttgccttgggaatgaccacctctg

SEQ ID NO: 732391 - DNA, 25 bp, Mus musculus
gttgccttgggattgaccacctctg

SEQ ID NO: 732392 - DNA, 25 bp, Mus musculus
gttgcctttgctatggctcttctgg

SEQ ID NO: 732393 - DNA, 25 bp, Mus musculus
gttgcctttgctttggctcttctgg

SEQ ID NO: 732394 - DNA, 25 bp, Mus musculus
gttgcgacagtcaaaacagtttgga

SEQ ID NO: 732395 - DNA, 25 bp, Mus musculus
gttgcgacagtctaaacagtttgga

SEQ ID NO: 732396 - DNA, 25 bp, Mus musculus
gttgcgaccatcagttttgggatgg

SEQ ID NO: 732397 - DNA, 25 bp, Mus musculus
gttgcgaccatctgttttgggatgg

SEQ ID NO: 732398 - DNA, 25 bp, Mus musculus
gttgcgacgactcatcttcctttaa

SEQ ID NO: 732399 - DNA, 25 bp, Mus musculus
gttgcgacgactgatcttcctttaa

SEQ ID NO: 732400 - DNA, 25 bp, Mus musculus
gttgcgagctctccgtaagaacaag

SEQ ID NO: 732401 - DNA, 25 bp, Mus musculus
gttgcgagctctgcgtaagaacaag

SEQ ID NO: 732402 - DNA, 25 bp, Mus musculus
gttgcgagtggcactgcccagtgtc

SEQ ID NO: 732403 - DNA, 25 bp, Mus musculus
gttgcgagtggctctgcccagtgtc

SEQ ID NO: 732404 - DNA, 25 bp, Mus musculus
gttgcggacactacgagagcaggat

SEQ ID NO: 732405 - DNA, 25 bp, Mus musculus
gttgcggacacttcgagagcaggat

SEQ ID NO: 732406 - DNA, 25 bp, Mus musculus
gttgcggacagcatcagactccccg

SEQ ID NO: 732407 - DNA, 25 bp, Mus musculus
gttgcggacagcttcagactccccg

SEQ ID NO: 732408 - DNA, 25 bp, Mus musculus
gttgcggcaccaacaagacagtgga

SEQ ID NO: 732409 - DNA, 25 bp, Mus musculus
gttgcggcaccatcaagacagtgga

SEQ ID NO: 732410 - DNA, 25 bp, Mus musculus
gttgcgggccatcctggccattgaa

SEQ ID NO: 732411 - DNA, 25 bp, Mus musculus
gttgcgggccatgctggccattgaa

SEQ ID NO: 732412 - DNA, 25 bp, Mus musculus
gttgcggtgaagaccaagactcccg

SEQ ID NO: 732413 - DNA, 25 bp, Mus musculus
gttgcggtgaagtccaagactcccg

SEQ ID NO: 732414 - DNA, 25 bp, Mus musculus
gttgctaacactcggtatgggaagc

SEQ ID NO: 732415 - DNA, 25 bp, Mus musculus
gttgctaacactgggtatgggaagc

SEQ ID NO: 732416 - DNA, 25 bp, Mus musculus
gttgctaagacactctggctcgctc

SEQ ID NO: 732417 - DNA, 25 bp, Mus musculus
gttgctaagacagtctggctcgctc

SEQ ID NO: 732418 - DNA, 25 bp, Mus musculus
gttgctaatgaaattgaaagcctgg

SEQ ID NO: 732419 - DNA, 25 bp, Mus musculus
gttgctaatgaatttgaaagcctgg

SEQ ID NO: 732420 - DNA, 25 bp, Mus musculus
gttgctaggcacagaacacctggct

SEQ ID NO: 732421 - DNA, 25 bp, Mus musculus
gttgctaggcactgaacacctggct

SEQ ID NO: 732422 - DNA, 25 bp, Mus musculus
gttgctagttcaagctctctatccc

SEQ ID NO: 732423 - DNA, 25 bp, Mus musculus
gttgctagttcatgctctctatccc

SEQ ID NO: 732424 - DNA, 25 bp, Mus musculus
gttgctcaccatcgagaggacagaa

SEQ ID NO: 732425 - DNA, 25 bp, Mus musculus
gttgctcaccatggagaggacagaa

SEQ ID NO: 732426 - DNA, 25 bp, Mus musculus
gttgctcagcggaacagcatccatt

SEQ ID NO: 732427 - DNA, 25 bp, Mus musculus
gttgctcagcggtacagcatccatt

SEQ ID NO: 732428 - DNA, 25 bp, Mus musculus
gttgctcatgagcagccaccaggag

SEQ ID NO: 732429 - DNA, 25 bp, Mus musculus
gttgctcatgaggagccaccaggag

SEQ ID NO: 732430 - DNA, 25 bp, Mus musculus
gttgctccaccccagacaactgttg

SEQ ID NO: 732431 - DNA, 25 bp, Mus musculus
gttgctccacccgagacaactgttg

SEQ ID NO: 732432 - DNA, 25 bp, Mus musculus
gttgctccgcccatgacaaaggtta

SEQ ID NO: 732433 - DNA, 25 bp, Mus musculus
gttgctccgcccttgacaaaggtta

SEQ ID NO: 732434 - DNA, 25 bp, Mus musculus
gttgctctcaaaatgctgaagtcct

SEQ ID NO: 732435 - DNA, 25 bp, Mus musculus
gttgctctcaaattgctgaagtcct

SEQ ID NO: 732436 - DNA, 25 bp, Mus musculus
gttgctctcagcacgggattcacgc

SEQ ID NO: 732437 - DNA, 25 bp, Mus musculus
gttgctctcagctcgggattcacgc

SEQ ID NO: 732438 - DNA, 25 bp, Mus musculus
gttgctcttctacctgattcggtac

SEQ ID NO: 732439 - DNA, 25 bp, Mus musculus
gttgctcttctagctgattcggtac

SEQ ID NO: 732440 - DNA, 25 bp, Mus musculus
gttgctcttctgctggctgctgagt

SEQ ID NO: 732441 - DNA, 25 bp, Mus musculus
gttgctcttctggtggctgctgagt

SEQ ID NO: 732442 - DNA, 25 bp, Mus musculus
gttgctgaaatcagagcaggagcag

SEQ ID NO: 732443 - DNA, 25 bp, Mus musculus
gttgctgaaatctgagcaggagcag

SEQ ID NO: 732444 - DNA, 25 bp, Mus musculus
gttgctgaccaaagcaatcgggagc

SEQ ID NO: 732445 - DNA, 25 bp, Mus musculus
gttgctgaccaatgcaatcgggagc

SEQ ID NO: 732446 - DNA, 25 bp, Mus musculus
gttgctgagggcagaggtccatcat

SEQ ID NO: 732447 - DNA, 25 bp, Mus musculus
gttgctgagggctgaggtccatcat

SEQ ID NO: 732448 - DNA, 25 bp, Mus musculus
gttgctgcagctatacctggaatgg

SEQ ID NO: 732449 - DNA, 25 bp, Mus musculus
gttgctgcagctcgtccctcaactg

SEQ ID NO: 732450 - DNA, 25 bp, Mus musculus
gttgctgcagctggtccctcaactg

SEQ ID NO: 732451 - DNA, 25 bp, Mus musculus
gttgctgcagctttacctggaatgg

SEQ ID NO: 732452 - DNA, 25 bp, Mus musculus
gttgctgcaggaatggcttacatcg

SEQ ID NO: 732453 - DNA, 25 bp, Mus musculus
gttgctgcaggattggcttacatcg

SEQ ID NO: 732454 - DNA, 25 bp, Mus musculus
gttgctgcatgaacgaaactgactg

SEQ ID NO: 732455 - DNA, 25 bp, Mus musculus
gttgctgcatgatcgaaactgactg

SEQ ID NO: 732456 - DNA, 25 bp, Mus musculus
gttgctgccaccaacaagctcatgg

SEQ ID NO: 732457 - DNA, 25 bp, Mus musculus
gttgctgccacctacaagctcatgg

SEQ ID NO: 732458 - DNA, 25 bp, Mus musculus
gttgctgcccagagcttgacaggac

SEQ ID NO: 732459 - DNA, 25 bp, Mus musculus
gttgctgcccagtgcttgacaggac

SEQ ID NO: 732460 - DNA, 25 bp, Mus musculus
gttgctgcctgaccttgcccggaga

SEQ ID NO: 732461 - DNA, 25 bp, Mus musculus
gttgctgcctgagcttgcccggaga

SEQ ID NO: 732462 - DNA, 25 bp, Mus musculus
gttgctgccttgatctcctactttg

SEQ ID NO: 732463 - DNA, 25 bp, Mus musculus
gttgctgccttgttctcctactttg

SEQ ID NO: 732464 - DNA, 25 bp, Mus musculus
gttgctgcggctacgaaaactacgg

SEQ ID NO: 732465 - DNA, 25 bp, Mus musculus
gttgctgcggcttcgaaaactacgg

SEQ ID NO: 732466 - DNA, 25 bp, Mus musculus
gttgctgctctgatgaagagactga

SEQ ID NO: 732467 - DNA, 25 bp, Mus musculus
gttgctgctctgttgaagagactga

SEQ ID NO: 732468 - DNA, 25 bp, Mus musculus
gttgctgctgatcacagatgtgctc

SEQ ID NO: 732469 - DNA, 25 bp, Mus musculus
gttgctgctgatgacagatgtgctc

SEQ ID NO: 732470 - DNA, 25 bp, Mus musculus
gttgctggaggcaacagcacaaaaa

SEQ ID NO: 732471 - DNA, 25 bp, Mus musculus
gttgctggaggctacagcacaaaaa

SEQ ID NO: 732472 - DNA, 25 bp, Mus musculus
gttgctggtcctcagttccataaga

SEQ ID NO: 732473 - DNA, 25 bp, Mus musculus
gttgctggtcctgagttccataaga

SEQ ID NO: 732474 - DNA, 25 bp, Mus musculus
gttgctgtcattcaggtctgtccct

SEQ ID NO: 732475 - DNA, 25 bp, Mus musculus
gttgctgtcattgaggtctgtccct

SEQ ID NO: 732476 - DNA, 25 bp, Mus musculus
gttgctgtggtgaacttccgagatg

SEQ ID NO: 732477 - DNA, 25 bp, Mus musculus
gttgctgtggtgtacttccgagatg

SEQ ID NO: 732478 - DNA, 25 bp, Mus musculus
gttgcttaaagtcctgaccagggtg

SEQ ID NO: 732479 - DNA, 25 bp, Mus musculus
gttgcttaaagtgctgaccagggtg

SEQ ID NO: 732480 - DNA, 25 bp, Mus musculus
gttgcttacagtcctctgggaagcc

SEQ ID NO: 732481 - DNA, 25 bp, Mus musculus
gttgcttacagtgctctgggaagcc

SEQ ID NO: 732482 - DNA, 25 bp, Mus musculus
gttgcttccataagacagcatctgg

SEQ ID NO: 732483 - DNA, 25 bp, Mus musculus
gttgcttccatatgacagcatctgg

SEQ ID NO: 732484 - DNA, 25 bp, Mus musculus
gttgcttctgcaactgtaagaagtg

SEQ ID NO: 732485 - DNA, 25 bp, Mus musculus
gttgcttctgcatctgtaagaagtg

SEQ ID NO: 732486 - DNA, 25 bp, Mus musculus
gttgcttgtatgcagctcataaatg

SEQ ID NO: 732487 - DNA, 25 bp, Mus musculus
gttgcttgtatggagctcataaatg

SEQ ID NO: 732488 - DNA, 25 bp, Mus musculus
gttgctttagaaagactttactaca

SEQ ID NO: 732489 - DNA, 25 bp, Mus musculus
gttgctttagaatgactttactaca

SEQ ID NO: 732490 - DNA, 25 bp, Mus musculus
gttgctttcactaccagaatctatc

SEQ ID NO: 732491 - DNA, 25 bp, Mus musculus
gttgctttcacttccagaatctatc

SEQ ID NO: 732492 - DNA, 25 bp, Mus musculus
gttgctttccggcagcgaacgctga

SEQ ID NO: 732493 - DNA, 25 bp, Mus musculus
gttgctttccggctgattcgtcgag

SEQ ID NO: 732494 - DNA, 25 bp, Mus musculus
gttgctttccgggagcgaacgctga

SEQ ID NO: 732495 - DNA, 25 bp, Mus musculus
gttgctttccgggtgattcgtcgag

SEQ ID NO: 732496 - DNA, 25 bp, Mus musculus
gttgctttggagaacagcttcaagt

SEQ ID NO: 732497 - DNA, 25 bp, Mus musculus
gttgctttggagtacagcttcaagt

SEQ ID NO: 732498 - DNA, 25 bp, Mus musculus
gttggaaaatgtcagcgtgttttcc

SEQ ID NO: 732499 - DNA, 25 bp, Mus musculus
gttggaaaatgtgagcgtgttttcc

SEQ ID NO: 732500 - DNA, 25 bp, Mus musculus
gttggaaacagtcaagttgcatttg

SEQ ID NO: 732501 - DNA, 25 bp, Mus musculus
gttggaaacagtgaagttgcatttg

SEQ ID NO: 732502 - DNA, 25 bp, Mus musculus
gttggaaacatgagacttagaagaa

SEQ ID NO: 732503 - DNA, 25 bp, Mus musculus
gttggaaacatgtgacttagaagaa

SEQ ID NO: 732504 - DNA, 25 bp, Mus musculus
gttggaaatcacagcttgttcagca

SEQ ID NO: 732505 - DNA, 25 bp, Mus musculus
gttggaaatcactgcttgttcagca

SEQ ID NO: 732506 - DNA, 25 bp, Mus musculus
gttggaaccttcagacgagccggac

SEQ ID NO: 732507 - DNA, 25 bp, Mus musculus
gttggaaccttctgacgagccggac

SEQ ID NO: 732508 - DNA, 25 bp, Mus musculus
gttggaagccaacttctgggtccct

SEQ ID NO: 732509 - DNA, 25 bp, Mus musculus
gttggaagccaagttctgggtccct

SEQ ID NO: 732510 - DNA, 25 bp, Mus musculus
gttggaagcctgctcaaataggtga

SEQ ID NO: 732511 - DNA, 25 bp, Mus musculus
gttggaagcctggtcaaataggtga

SEQ ID NO: 732512 - DNA, 25 bp, Mus musculus
gttggaatcctgctcaaagaaagat

SEQ ID NO: 732513 - DNA, 25 bp, Mus musculus
gttggaatcctggtcaaagaaagat

SEQ ID NO: 732514 - DNA, 25 bp, Mus musculus
gttggaatggaaactgggacacctg

SEQ ID NO: 732515 - DNA, 25 bp, Mus musculus
gttggaatggaatctgggacacctg

SEQ ID NO: 732516 - DNA, 25 bp, Mus musculus
gttggaatgtaaaggcggcccctgt

SEQ ID NO: 732517 - DNA, 25 bp, Mus musculus
gttggaatgtaatggcggcccctgt

SEQ ID NO: 732518 - DNA, 25 bp, Mus musculus
gttggaattcaaagacggcgcctac

SEQ ID NO: 732519 - DNA, 25 bp, Mus musculus
gttggaattcaatgacggcgcctac

SEQ ID NO: 732520 - DNA, 25 bp, Mus musculus
gttggaattgatcacaccttttcag

SEQ ID NO: 732521 - DNA, 25 bp, Mus musculus
gttggaattgatgacaccttttcag

SEQ ID NO: 732522 - DNA, 25 bp, Mus musculus
gttggacagccaatggtgtcctctt

SEQ ID NO: 732523 - DNA, 25 bp, Mus musculus
gttggacagccattggtgtcctctt

SEQ ID NO: 732524 - DNA, 25 bp, Mus musculus
gttggacagcgcagatgtatgcctc

SEQ ID NO: 732525 - DNA, 25 bp, Mus musculus
gttggacagcgctgatgtatgcctc

SEQ ID NO: 732526 - DNA, 25 bp, Mus musculus
gttggacaggtacgtgataaagttt

SEQ ID NO: 732527 - DNA, 25 bp, Mus musculus
gttggacaggtaggtgataaagttt

SEQ ID NO: 732528 - DNA, 25 bp, Mus musculus
gttggacagtaaaacaacaccggga

SEQ ID NO: 732529 - DNA, 25 bp, Mus musculus
gttggacagtaatacaacaccggga

SEQ ID NO: 732530 - DNA, 25 bp, Mus musculus
gttggacctccgagaatagtgtctg

SEQ ID NO: 732531 - DNA, 25 bp, Mus musculus
gttggacctccgtgaatagtgtctg

SEQ ID NO: 732532 - DNA, 25 bp, Mus musculus
gttggagacacgatccccgtgggct

SEQ ID NO: 732533 - DNA, 25 bp, Mus musculus
gttggagacacgttccccgtgggct

SEQ ID NO: 732534 - DNA, 25 bp, Mus musculus
gttggagacccgcttgcatgtcact

SEQ ID NO: 732535 - DNA, 25 bp, Mus musculus
gttggagacccggttgcatgtcact

SEQ ID NO: 732536 - DNA, 25 bp, Mus musculus
gttggagagagaccgtccaatgtcc

SEQ ID NO: 732537 - DNA, 25 bp, Mus musculus
gttggagagagagcgtccaatgtcc

SEQ ID NO: 732538 - DNA, 25 bp, Mus musculus
gttggagattccatcatcatggaag

SEQ ID NO: 732539 - DNA, 25 bp, Mus musculus
gttggagattccttcatcatggaag

SEQ ID NO: 732540 - DNA, 25 bp, Mus musculus
gttggagccaatcagtaatcctgtt

SEQ ID NO: 732541 - DNA, 25 bp, Mus musculus
gttggagccaatgagtaatcctgtt

SEQ ID NO: 732542 - DNA, 25 bp, Mus musculus
gttggagccatccttctcatcccag

SEQ ID NO: 732543 - DNA, 25 bp, Mus musculus
gttggagccatcgttctcatcccag

SEQ ID NO: 732544 - DNA, 25 bp, Mus musculus
gttggagccattaaacttacctaca

SEQ ID NO: 732545 - DNA, 25 bp, Mus musculus
gttggagccatttaacttacctaca

SEQ ID NO: 732546 - DNA, 25 bp, Mus musculus
gttggagcctctctgttcgccagca

SEQ ID NO: 732547 - DNA, 25 bp, Mus musculus
gttggagcctctgtgttcgccagca

SEQ ID NO: 732548 - DNA, 25 bp, Mus musculus
gttggagcggacacagcgcagaata

SEQ ID NO: 732549 - DNA, 25 bp, Mus musculus
gttggagcggactcagcgcagaata

SEQ ID NO: 732550 - DNA, 25 bp, Mus musculus
gttggagcgggcaacagagccccac

SEQ ID NO: 732551 - DNA, 25 bp, Mus musculus
gttggagcgggctacagagccccac

SEQ ID NO: 732552 - DNA, 25 bp, Mus musculus
gttggagctggacgagccgcccctc

SEQ ID NO: 732553 - DNA, 25 bp, Mus musculus
gttggagctggaggagccgcccctc

SEQ ID NO: 732554 - DNA, 25 bp, Mus musculus
gttggaggacttagaagatctaacc

SEQ ID NO: 732555 - DNA, 25 bp, Mus musculus
gttggaggactttgaagatctaacc

SEQ ID NO: 732556 - DNA, 25 bp, Mus musculus
gttggaggctatcaaagactttctg

SEQ ID NO: 732557 - DNA, 25 bp, Mus musculus
gttggaggctatgaaagactttctg

SEQ ID NO: 732558 - DNA, 25 bp, Mus musculus
gttggatgacgaactcaagagtgtg

SEQ ID NO: 732559 - DNA, 25 bp, Mus musculus
gttggatgacgatctcaagagtgtg

SEQ ID NO: 732560 - DNA, 25 bp, Mus musculus
gttggatgataaccgaagctgccag

SEQ ID NO: 732561 - DNA, 25 bp, Mus musculus
gttggatgataagcgaagctgccag

SEQ ID NO: 732562 - DNA, 25 bp, Mus musculus
gttggatggaagcacacatcccaaa

SEQ ID NO: 732563 - DNA, 25 bp, Mus musculus
gttggatggaaggacacatcccaaa

SEQ ID NO: 732564 - DNA, 25 bp, Mus musculus
gttggatggagtactgctcgtgact

SEQ ID NO: 732565 - DNA, 25 bp, Mus musculus
gttggatggagttctgctcgtgact

SEQ ID NO: 732566 - DNA, 25 bp, Mus musculus
gttggattactccttcagaagctgt

SEQ ID NO: 732567 - DNA, 25 bp, Mus musculus
gttggattactcgttcagaagctgt

SEQ ID NO: 732568 - DNA, 25 bp, Mus musculus
gttggattatccaaataatgttctg

SEQ ID NO: 732569 - DNA, 25 bp, Mus musculus
gttggattatcctaataatgttctg

SEQ ID NO: 732570 - DNA, 25 bp, Mus musculus
gttggcaagaatatggctcccgtat

SEQ ID NO: 732571 - DNA, 25 bp, Mus musculus
gttggcaagaatttggctcccgtat

SEQ ID NO: 732572 - DNA, 25 bp, Mus musculus
gttggcaccagtctttggctacctg

SEQ ID NO: 732573 - DNA, 25 bp, Mus musculus
gttggcaccagtgtttggctacctg

SEQ ID NO: 732574 - DNA, 25 bp, Mus musculus
gttggcaccctcaaacatgaaaggc

SEQ ID NO: 732575 - DNA, 25 bp, Mus musculus
gttggcaccctctaacatgaaaggc

SEQ ID NO: 732576 - DNA, 25 bp, Mus musculus
gttggcacgtttccagcctcagggt

SEQ ID NO: 732577 - DNA, 25 bp, Mus musculus
gttggcacgtttgcagcctcagggt

SEQ ID NO: 732578 - DNA, 25 bp, Mus musculus
gttggcactcaccagggagcgcttc

SEQ ID NO: 732579 - DNA, 25 bp, Mus musculus
gttggcactcacgagggagcgcttc

SEQ ID NO: 732580 - DNA, 25 bp, Mus musculus
gttggcactgaaatcacaacagtcc

SEQ ID NO: 732581 - DNA, 25 bp, Mus musculus
gttggcactgaattcacaacagtcc

SEQ ID NO: 732582 - DNA, 25 bp, Mus musculus
gttggcagcgatctggagctactct

SEQ ID NO: 732583 - DNA, 25 bp, Mus musculus
gttggcagcgatgtggagctactct

SEQ ID NO: 732584 - DNA, 25 bp, Mus musculus
gttggcatctacatcccgtctgtaa

SEQ ID NO: 732585 - DNA, 25 bp, Mus musculus
gttggcatctacttcccgtctgtaa

SEQ ID NO: 732586 - DNA, 25 bp, Mus musculus
gttggcatggccagcaggcttcgcc

SEQ ID NO: 732587 - DNA, 25 bp, Mus musculus
gttggcatggcctgcaggcttcgcc

SEQ ID NO: 732588 - DNA, 25 bp, Mus musculus
gttggcattgcacatccatccactc

SEQ ID NO: 732589 - DNA, 25 bp, Mus musculus
gttggcattgcagatccatccactc

SEQ ID NO: 732590 - DNA, 25 bp, Mus musculus
gttggccaagctcgcctgcttgtag

SEQ ID NO: 732591 - DNA, 25 bp, Mus musculus
gttggccaagctggcctgcttgtag

SEQ ID NO: 732592 - DNA, 25 bp, Mus musculus
gttggccacagaatctgataaagaa

SEQ ID NO: 732593 - DNA, 25 bp, Mus musculus
gttggccacagattctgataaagaa

SEQ ID NO: 732594 - DNA, 25 bp, Mus musculus
gttggccaccacatagtagtacccc

SEQ ID NO: 732595 - DNA, 25 bp, Mus musculus
gttggccaccacttagtagtacccc

SEQ ID NO: 732596 - DNA, 25 bp, Mus musculus
gttggcccagggaatctgcctggaa

SEQ ID NO: 732597 - DNA, 25 bp, Mus musculus
gttggcccagggtatctgcctggaa

SEQ ID NO: 732598 - DNA, 25 bp, Mus musculus
gttggccccggaccaagaactggcc

SEQ ID NO: 732599 - DNA, 25 bp, Mus musculus
gttggccccggagcaagaactggcc

SEQ ID NO: 732600 - DNA, 25 bp, Mus musculus
gttggccctctgatgtcccctggtc

SEQ ID NO: 732601 - DNA, 25 bp, Mus musculus
gttggccctctgttgtcccctggtc

SEQ ID NO: 732602 - DNA, 25 bp, Mus musculus
gttggccgccttcagaatgcaatcg

SEQ ID NO: 732603 - DNA, 25 bp, Mus musculus
gttggccgccttgagaatgcaatcg

SEQ ID NO: 732604 - DNA, 25 bp, Mus musculus
gttggcctcattcgagtcgttgcgt

SEQ ID NO: 732605 - DNA, 25 bp, Mus musculus
gttggcctcattggagtcgttgcgt

SEQ ID NO: 732606 - DNA, 25 bp, Mus musculus
gttggcgcagcaaagcatccctggg

SEQ ID NO: 732607 - DNA, 25 bp, Mus musculus
gttggcgcagcatagcatccctggg

SEQ ID NO: 732608 - DNA, 25 bp, Mus musculus
gttggcgcaggcctaaccttcttgc

SEQ ID NO: 732609 - DNA, 25 bp, Mus musculus
gttggcgcaggcgtaaccttcttgc

SEQ ID NO: 732610 - DNA, 25 bp, Mus musculus
gttggcggctacctccttggccctg

SEQ ID NO: 732611 - DNA, 25 bp, Mus musculus
gttggcggctacgtccttggccctg

SEQ ID NO: 732612 - DNA, 25 bp, Mus musculus
gttggcgtcctacatctgctaatgg

SEQ ID NO: 732613 - DNA, 25 bp, Mus musculus
gttggcgtcctagatctgctaatgg

SEQ ID NO: 732614 - DNA, 25 bp, Mus musculus
gttggctacaccctgatgaataagg

SEQ ID NO: 732615 - DNA, 25 bp, Mus musculus
gttggctacaccgtgatgaataagg

SEQ ID NO: 732616 - DNA, 25 bp, Mus musculus
gttggctagtttcgaagtaacctgt

SEQ ID NO: 732617 - DNA, 25 bp, Mus musculus
gttggctagtttggaagtaacctgt

SEQ ID NO: 732618 - DNA, 25 bp, Mus musculus
gttggctcatccactagttcttgtg

SEQ ID NO: 732619 - DNA, 25 bp, Mus musculus
gttggctcatcctctagttcttgtg

SEQ ID NO: 732620 - DNA, 25 bp, Mus musculus
gttggctgagtacctacacctggcg

SEQ ID NO: 732621 - DNA, 25 bp, Mus musculus
gttggctgagtagctacacctggcg

SEQ ID NO: 732622 - DNA, 25 bp, Mus musculus
gttggctgtatcattgcagagatgt

SEQ ID NO: 732623 - DNA, 25 bp, Mus musculus
gttggctgtatctttgcagagatgt

SEQ ID NO: 732624 - DNA, 25 bp, Mus musculus
gttggctgtcagatccggtgcatca

SEQ ID NO: 732625 - DNA, 25 bp, Mus musculus
gttggctgtcagttccggtgcatca

SEQ ID NO: 732626 - DNA, 25 bp, Mus musculus
gttggcttcaaaaatatgcagaatg

SEQ ID NO: 732627 - DNA, 25 bp, Mus musculus
gttggcttcaaatatatgcagaatg

SEQ ID NO: 732628 - DNA, 25 bp, Mus musculus
gttggcttccagagcgctgagcctg

SEQ ID NO: 732629 - DNA, 25 bp, Mus musculus
gttggcttccagtgcgctgagcctg

SEQ ID NO: 732630 - DNA, 25 bp, Mus musculus
gttggcttccccagccagtttccag

SEQ ID NO: 732631 - DNA, 25 bp, Mus musculus
gttggcttcccctgccagtttccag

SEQ ID NO: 732632 - DNA, 25 bp, Mus musculus
gttggcttcctgaagatcctgcaca

SEQ ID NO: 732633 - DNA, 25 bp, Mus musculus
gttggcttcctgtagatcctgcaca

SEQ ID NO: 732634 - DNA, 25 bp, Mus musculus
gttgggaaatccagcattgtgtgtc

SEQ ID NO: 732635 - DNA, 25 bp, Mus musculus
gttgggaaatcctgcattgtgtgtc

SEQ ID NO: 732636 - DNA, 25 bp, Mus musculus
gttgggaacagacaagaaccaatgt

SEQ ID NO: 732637 - DNA, 25 bp, Mus musculus
gttgggaacagagaagaaccaatgt

SEQ ID NO: 732638 - DNA, 25 bp, Mus musculus
gttgggaccaaacttaactcttgag

SEQ ID NO: 732639 - DNA, 25 bp, Mus musculus
gttgggaccaaagttaactcttgag

SEQ ID NO: 732640 - DNA, 25 bp, Mus musculus
gttgggactgtcatttaagttacac

SEQ ID NO: 732641 - DNA, 25 bp, Mus musculus
gttgggactgtcttttaagttacac

SEQ ID NO: 732642 - DNA, 25 bp, Mus musculus
gttgggagccaacagcagaactcgc

SEQ ID NO: 732643 - DNA, 25 bp, Mus musculus
gttgggagccaagagcagaactcgc

SEQ ID NO: 732644 - DNA, 25 bp, Mus musculus
gttgggagccccaagccctccagtt

SEQ ID NO: 732645 - DNA, 25 bp, Mus musculus
gttgggagcccctagccctccagtt

SEQ ID NO: 732646 - DNA, 25 bp, Mus musculus
gttgggatatctaaagaggaagcct

SEQ ID NO: 732647 - DNA, 25 bp, Mus musculus
gttgggatatcttaagaggaagcct

SEQ ID NO: 732648 - DNA, 25 bp, Mus musculus
gttgggcacaaacgctccaccatgg

SEQ ID NO: 732649 - DNA, 25 bp, Mus musculus
gttgggcacaaaggctccaccatgg

SEQ ID NO: 732650 - DNA, 25 bp, Mus musculus
gttgggccaatcaccagtggtggtt

SEQ ID NO: 732651 - DNA, 25 bp, Mus musculus
gttgggccaatctccagtggtggtt

SEQ ID NO: 732652 - DNA, 25 bp, Mus musculus
gttgggccatacaaataattacatg

SEQ ID NO: 732653 - DNA, 25 bp, Mus musculus
gttgggccatactaataattacatg

SEQ ID NO: 732654 - DNA, 25 bp, Mus musculus
gttgggcctcacagatctggtagtc

SEQ ID NO: 732655 - DNA, 25 bp, Mus musculus
gttgggcctcactgatctggtagtc

SEQ ID NO: 732656 - DNA, 25 bp, Mus musculus
gttgggctctgcatatattaaataa

SEQ ID NO: 732657 - DNA, 25 bp, Mus musculus
gttgggctctgcttatattaaataa

SEQ ID NO: 732658 - DNA, 25 bp, Mus musculus
gttgggctctgtcatcatctataag

SEQ ID NO: 732659 - DNA, 25 bp, Mus musculus
gttgggctctgtgatcatctataag

SEQ ID NO: 732660 - DNA, 25 bp, Mus musculus
gttgggctgctcatcatgcctggac

SEQ ID NO: 732661 - DNA, 25 bp, Mus musculus
gttgggctgctcttcatgcctggac

SEQ ID NO: 732662 - DNA, 25 bp, Mus musculus
gttgggctggtcacagccatgcgat

SEQ ID NO: 732663 - DNA, 25 bp, Mus musculus
gttgggctggtctcagccatgcgat

SEQ ID NO: 732664 - DNA, 25 bp, Mus musculus
gttgggtttcttagcctgtctgtgg

SEQ ID NO: 732665 - DNA, 25 bp, Mus musculus
gttgggtttctttgcctgtctgtgg

SEQ ID NO: 732666 - DNA, 25 bp, Mus musculus
gttggtaagcacagtgccaatgagg

SEQ ID NO: 732667 - DNA, 25 bp, Mus musculus
gttggtaagcactgtgccaatgagg

SEQ ID NO: 732668 - DNA, 25 bp, Mus musculus
gttggtagagaaagccagagtttac

SEQ ID NO: 732669 - DNA, 25 bp, Mus musculus
gttggtagagaatgccagagtttac

SEQ ID NO: 732670 - DNA, 25 bp, Mus musculus
gttggtatcatacccaccctggtta

SEQ ID NO: 732671 - DNA, 25 bp, Mus musculus
gttggtatcatagccaccctggtta

SEQ ID NO: 732672 - DNA, 25 bp, Mus musculus
gttggtcaatggagaccccaacacc

SEQ ID NO: 732673 - DNA, 25 bp, Mus musculus
gttggtcaatggtgaccccaacacc

SEQ ID NO: 732674 - DNA, 25 bp, Mus musculus
gttggtcacctaatccaggtggccg

SEQ ID NO: 732675 - DNA, 25 bp, Mus musculus
gttggtcacctattccaggtggccg

SEQ ID NO: 732676 - DNA, 25 bp, Mus musculus
gttggtcactgtcattaaacaagct

SEQ ID NO: 732677 - DNA, 25 bp, Mus musculus
gttggtcactgtgattaaacaagct

SEQ ID NO: 732678 - DNA, 25 bp, Mus musculus
gttggtccctggcattggatttgcc

SEQ ID NO: 732679 - DNA, 25 bp, Mus musculus
gttggtccctgggattggatttgcc

SEQ ID NO: 732680 - DNA, 25 bp, Mus musculus
gttggtgaaaagacggaagcttcct

SEQ ID NO: 732681 - DNA, 25 bp, Mus musculus
gttggtgaaaagtcggaagcttcct

SEQ ID NO: 732682 - DNA, 25 bp, Mus musculus
gttggtgaccacaagctgaatgcca

SEQ ID NO: 732683 - DNA, 25 bp, Mus musculus
gttggtgaccactagctgaatgcca

SEQ ID NO: 732684 - DNA, 25 bp, Mus musculus
gttggtgaccagatcgttgaaatca

SEQ ID NO: 732685 - DNA, 25 bp, Mus musculus
gttggtgaccagttcgttgaaatca

SEQ ID NO: 732686 - DNA, 25 bp, Mus musculus
gttggtgacctcagtccagaaatca

SEQ ID NO: 732687 - DNA, 25 bp, Mus musculus
gttggtgacctctgtccagaaatca

SEQ ID NO: 732688 - DNA, 25 bp, Mus musculus
gttggtgatgctcaacctggactcg

SEQ ID NO: 732689 - DNA, 25 bp, Mus musculus
gttggtgatgctgaacctggactcg

SEQ ID NO: 732690 - DNA, 25 bp, Mus musculus
gttggtgatggcaccacctcagtga

SEQ ID NO: 732691 - DNA, 25 bp, Mus musculus
gttggtgatggctccacctcagtga

SEQ ID NO: 732692 - DNA, 25 bp, Mus musculus
gttggtgcatttcaatctgattctg

SEQ ID NO: 732693 - DNA, 25 bp, Mus musculus
gttggtgcatttgaatctgattctg

SEQ ID NO: 732694 - DNA, 25 bp, Mus musculus
gttggtgccgctcccgcttctgctg

SEQ ID NO: 732695 - DNA, 25 bp, Mus musculus
gttggtgccgctgccgcttctgctg

SEQ ID NO: 732696 - DNA, 25 bp, Mus musculus
gttggtgctcctccgtcagccaaga

SEQ ID NO: 732697 - DNA, 25 bp, Mus musculus
gttggtgctcctgcgtcagccaaga

SEQ ID NO: 732698 - DNA, 25 bp, Mus musculus
gttggtgctctcattgtgctgccgt

SEQ ID NO: 732699 - DNA, 25 bp, Mus musculus
gttggtgctctctttgtgctgccgt

SEQ ID NO: 732700 - DNA, 25 bp, Mus musculus
gttggtggctgtcttcgactaccac

SEQ ID NO: 732701 - DNA, 25 bp, Mus musculus
gttggtggctgtgttcgactaccac

SEQ ID NO: 732702 - DNA, 25 bp, Mus musculus
gttggtggtgcacatagataatgcc

SEQ ID NO: 732703 - DNA, 25 bp, Mus musculus
gttggtggtgcagatagataatgcc

SEQ ID NO: 732704 - DNA, 25 bp, Mus musculus
gttggtgtacgaatcctgggaagct

SEQ ID NO: 732705 - DNA, 25 bp, Mus musculus
gttggtgtacgattcctgggaagct

SEQ ID NO: 732706 - DNA, 25 bp, Mus musculus
gttggtgtattcaggcagactgctt

SEQ ID NO: 732707 - DNA, 25 bp, Mus musculus
gttggtgtattctggcagactgctt

SEQ ID NO: 732708 - DNA, 25 bp, Mus musculus
gttggtgtccgaaatgatgagccgt

SEQ ID NO: 732709 - DNA, 25 bp, Mus musculus
gttggtgtccgatatgatgagccgt

SEQ ID NO: 732710 - DNA, 25 bp, Mus musculus
gttggtgtgcagcaactacacccca

SEQ ID NO: 732711 - DNA, 25 bp, Mus musculus
gttggtgtgcaggaactacacccca

SEQ ID NO: 732712 - DNA, 25 bp, Mus musculus
gttggtgtggccattgcagcacctc

SEQ ID NO: 732713 - DNA, 25 bp, Mus musculus
gttggtgtggcctttgcagcacctc

SEQ ID NO: 732714 - DNA, 25 bp, Mus musculus
gttggtgtttgcagccggcctctgc

SEQ ID NO: 732715 - DNA, 25 bp, Mus musculus
gttggtgtttgctgccggcctctgc

SEQ ID NO: 732716 - DNA, 25 bp, Mus musculus
gttggttcaaacaatccctctcaga

SEQ ID NO: 732717 - DNA, 25 bp, Mus musculus
gttggttcaaactatccctctcaga

SEQ ID NO: 732718 - DNA, 25 bp, Mus musculus
gttggtttcggcatcggcgtctctg

SEQ ID NO: 732719 - DNA, 25 bp, Mus musculus
gttggtttcggcttcggcgtctctg

SEQ ID NO: 732720 - DNA, 25 bp, Mus musculus
gttggttttctcaccagaagttgat

SEQ ID NO: 732721 - DNA, 25 bp, Mus musculus
gttggttttctctccagaagttgat

SEQ ID NO: 732722 - DNA, 25 bp, Mus musculus
gttgtacaaccgactgctgcagcgc

SEQ ID NO: 732723 - DNA, 25 bp, Mus musculus
gttgtacaaccgtctgctgcagcgc

SEQ ID NO: 732724 - DNA, 25 bp, Mus musculus
gttgtaccaggtctcacggcagtga

SEQ ID NO: 732725 - DNA, 25 bp, Mus musculus
gttgtaccaggtgtcacggcagtga

SEQ ID NO: 732726 - DNA, 25 bp, Mus musculus
gttgtaccgattcgcggatctcatt

SEQ ID NO: 732727 - DNA, 25 bp, Mus musculus
gttgtaccgattggcggatctcatt

SEQ ID NO: 732728 - DNA, 25 bp, Mus musculus
gttgtactgcacaaggaaatctctc

SEQ ID NO: 732729 - DNA, 25 bp, Mus musculus
gttgtactgcactaggaaatctctc

SEQ ID NO: 732730 - DNA, 25 bp, Mus musculus
gttgtagaaagcactgcaggttttc

SEQ ID NO: 732731 - DNA, 25 bp, Mus musculus
gttgtagaaagctctgcaggttttc

SEQ ID NO: 732732 - DNA, 25 bp, Mus musculus
gttgtagtcactccaattttggtca

SEQ ID NO: 732733 - DNA, 25 bp, Mus musculus
gttgtagtcactgcaattttggtca

SEQ ID NO: 732734 - DNA, 25 bp, Mus musculus
gttgtatacattccgatccaccctg

SEQ ID NO: 732735 - DNA, 25 bp, Mus musculus
gttgtatacattgcgatccaccctg

SEQ ID NO: 732736 - DNA, 25 bp, Mus musculus
gttgtatctccaacaccgcgtcgta

SEQ ID NO: 732737 - DNA, 25 bp, Mus musculus
gttgtatctccatcaccgcgtcgta

SEQ ID NO: 732738 - DNA, 25 bp, Mus musculus
gttgtatctttacaagtctctctca

SEQ ID NO: 732739 - DNA, 25 bp, Mus musculus
gttgtatctttagaagtctctctca

SEQ ID NO: 732740 - DNA, 25 bp, Mus musculus
gttgtcaatagtaatcagtacctgg

SEQ ID NO: 732741 - DNA, 25 bp, Mus musculus
gttgtcaatagttatcagtacctgg

SEQ ID NO: 732742 - DNA, 25 bp, Mus musculus
gttgtcacagaacaattaaagccct

SEQ ID NO: 732743 - DNA, 25 bp, Mus musculus
gttgtcacagaagaattaaagccct

SEQ ID NO: 732744 - DNA, 25 bp, Mus musculus
gttgtcaccagaccttcaccgatgg

SEQ ID NO: 732745 - DNA, 25 bp, Mus musculus
gttgtcaccagagcttcaccgatgg

SEQ ID NO: 732746 - DNA, 25 bp, Mus musculus
gttgtcaccctgctgaaatctgtcc

SEQ ID NO: 732747 - DNA, 25 bp, Mus musculus
gttgtcaccctggtgaaatctgtcc

SEQ ID NO: 732748 - DNA, 25 bp, Mus musculus
gttgtcagcaagcaaattatataac

SEQ ID NO: 732749 - DNA, 25 bp, Mus musculus
gttgtcagcaaggaaattatataac

SEQ ID NO: 732750 - DNA, 25 bp, Mus musculus
gttgtcagcacacagcgttcacaag

SEQ ID NO: 732751 - DNA, 25 bp, Mus musculus
gttgtcagcacagagcgttcacaag

SEQ ID NO: 732752 - DNA, 25 bp, Mus musculus
gttgtcatccctcagaaaaaaggca

SEQ ID NO: 732753 - DNA, 25 bp, Mus musculus
gttgtcatccctgagaaaaaaggca

SEQ ID NO: 732754 - DNA, 25 bp, Mus musculus
gttgtcatggtaactactgtggttg

SEQ ID NO: 732755 - DNA, 25 bp, Mus musculus
gttgtcatggtatctactgtggttg

SEQ ID NO: 732756 - DNA, 25 bp, Mus musculus
gttgtcatttcaaaaccgttcatgg

SEQ ID NO: 732757 - DNA, 25 bp, Mus musculus
gttgtcatttcataaccgttcatgg

SEQ ID NO: 732758 - DNA, 25 bp, Mus musculus
gttgtccatgaactgggccattgtg

SEQ ID NO: 732759 - DNA, 25 bp, Mus musculus
gttgtccatgaagtgggccattgtg

SEQ ID NO: 732760 - DNA, 25 bp, Mus musculus
gttgtcccaggaaagatctataccc

SEQ ID NO: 732761 - DNA, 25 bp, Mus musculus
gttgtcccaggatagatctataccc

SEQ ID NO: 732762 - DNA, 25 bp, Mus musculus
gttgtcccaggccaaagactgtcca

SEQ ID NO: 732763 - DNA, 25 bp, Mus musculus
gttgtcccaggcgaaagactgtcca

SEQ ID NO: 732764 - DNA, 25 bp, Mus musculus
gttgtcctaccgagagattataaag

SEQ ID NO: 732765 - DNA, 25 bp, Mus musculus
gttgtcctaccgtgagattataaag

SEQ ID NO: 732766 - DNA, 25 bp, Mus musculus
gttgtcctccaaaagagtatggaac

SEQ ID NO: 732767 - DNA, 25 bp, Mus musculus
gttgtcctccaatagagtatggaac

SEQ ID NO: 732768 - DNA, 25 bp, Mus musculus
gttgtcctggctaaaggaataccag

SEQ ID NO: 732769 - DNA, 25 bp, Mus musculus
gttgtcctggcttaaggaataccag

SEQ ID NO: 732770 - DNA, 25 bp, Mus musculus
gttgtcgctggcagccgctatctcc

SEQ ID NO: 732771 - DNA, 25 bp, Mus musculus
gttgtcgctggctgccgctatctcc

SEQ ID NO: 732772 - DNA, 25 bp, Mus musculus
gttgtcgtgaaaagccacagaacct

SEQ ID NO: 732773 - DNA, 25 bp, Mus musculus
gttgtcgtgaaatgccacagaacct

SEQ ID NO: 732774 - DNA, 25 bp, Mus musculus
gttgtctacttcaccgctactttcc

SEQ ID NO: 732775 - DNA, 25 bp, Mus musculus
gttgtctacttctccgctactttcc

SEQ ID NO: 732776 - DNA, 25 bp, Mus musculus
gttgtctactttaggaaatgcagga

SEQ ID NO: 732777 - DNA, 25 bp, Mus musculus
gttgtctacttttggaaatgcagga

SEQ ID NO: 732778 - DNA, 25 bp, Mus musculus
gttgtctcaattatgcctgaatcgc

SEQ ID NO: 732779 - DNA, 25 bp, Mus musculus
gttgtctcaattttgcctgaatcgc

SEQ ID NO: 732780 - DNA, 25 bp, Mus musculus
gttgtctcatgtctccctagctggt

SEQ ID NO: 732781 - DNA, 25 bp, Mus musculus
gttgtctcatgtgtccctagctggt

SEQ ID NO: 732782 - DNA, 25 bp, Mus musculus
gttgtcttcagaacggtctttctct

SEQ ID NO: 732783 - DNA, 25 bp, Mus musculus
gttgtcttcagatcggtctttctct

SEQ ID NO: 732784 - DNA, 25 bp, Mus musculus
gttgtcttgacaccctacaaaccgg

SEQ ID NO: 732785 - DNA, 25 bp, Mus musculus
gttgtcttgacagcctacaaaccgg

SEQ ID NO: 732786 - DNA, 25 bp, Mus musculus
gttgtctttccccaaacgagcaccg

SEQ ID NO: 732787 - DNA, 25 bp, Mus musculus
gttgtctttcccgaaacgagcaccg

SEQ ID NO: 732788 - DNA, 25 bp, Mus musculus
gttgtctttctactcgggacactct

SEQ ID NO: 732789 - DNA, 25 bp, Mus musculus
gttgtctttctagtcgggacactct

SEQ ID NO: 732790 - DNA, 25 bp, Mus musculus
gttgtgacacctaaagagctctttt

SEQ ID NO: 732791 - DNA, 25 bp, Mus musculus
gttgtgacaccttaagagctctttt

SEQ ID NO: 732792 - DNA, 25 bp, Mus musculus
gttgtgactctcataccagctggtc

SEQ ID NO: 732793 - DNA, 25 bp, Mus musculus
gttgtgactctcttaccagctggtc

SEQ ID NO: 732794 - DNA, 25 bp, Mus musculus
gttgtgactgaaaattcaatgtggc

SEQ ID NO: 732795 - DNA, 25 bp, Mus musculus
gttgtgactgaatattcaatgtggc

SEQ ID NO: 732796 - DNA, 25 bp, Mus musculus
gttgtgactgttatcacagttttgc

SEQ ID NO: 732797 - DNA, 25 bp, Mus musculus
gttgtgactgttttcacagttttgc

SEQ ID NO: 732798 - DNA, 25 bp, Mus musculus
gttgtgatacttaaatcctcctcga

SEQ ID NO: 732799 - DNA, 25 bp, Mus musculus
gttgtgatactttaatcctcctcga

SEQ ID NO: 732800 - DNA, 25 bp, Mus musculus
gttgtgattcatccctggcctcgga

SEQ ID NO: 732801 - DNA, 25 bp, Mus musculus
gttgtgattcatgcctggcctcgga

SEQ ID NO: 732802 - DNA, 25 bp, Mus musculus
gttgtgcacacaatttgaactagca

SEQ ID NO: 732803 - DNA, 25 bp, Mus musculus
gttgtgcacacattttgaactagca

SEQ ID NO: 732804 - DNA, 25 bp, Mus musculus
gttgtgccatgaactccctgccaga

SEQ ID NO: 732805 - DNA, 25 bp, Mus musculus
gttgtgccatgatctccctgccaga

SEQ ID NO: 732806 - DNA, 25 bp, Mus musculus
gttgtgctcgatatcccaaaggaag

SEQ ID NO: 732807 - DNA, 25 bp, Mus musculus
gttgtgctcgatttcccaaaggaag

SEQ ID NO: 732808 - DNA, 25 bp, Mus musculus
gttgtgctttaaaccaagagccctt

SEQ ID NO: 732809 - DNA, 25 bp, Mus musculus
gttgtgctttaatccaagagccctt

SEQ ID NO: 732810 - DNA, 25 bp, Mus musculus
gttgtggagtgtccctccaaggcct

SEQ ID NO: 732811 - DNA, 25 bp, Mus musculus
gttgtggagtgtgcctccaaggcct

SEQ ID NO: 732812 - DNA, 25 bp, Mus musculus
gttgtggatcctaggtgagtatgtc

SEQ ID NO: 732813 - DNA, 25 bp, Mus musculus
gttgtggatccttggtgagtatgtc

SEQ ID NO: 732814 - DNA, 25 bp, Mus musculus
gttgtggattgaaagagatattgcc

SEQ ID NO: 732815 - DNA, 25 bp, Mus musculus
gttgtggattgatagagatattgcc

SEQ ID NO: 732816 - DNA, 25 bp, Mus musculus
gttgtggcccatcatctgatccgga

SEQ ID NO: 732817 - DNA, 25 bp, Mus musculus
gttgtggcccatgatctgatccgga

SEQ ID NO: 732818 - DNA, 25 bp, Mus musculus
gttgtggctggtcgcacagtggttc

SEQ ID NO: 732819 - DNA, 25 bp, Mus musculus
gttgtggctggtggcacagtggttc

SEQ ID NO: 732820 - DNA, 25 bp, Mus musculus
gttgtgggatacaggccatcggcaa

SEQ ID NO: 732821 - DNA, 25 bp, Mus musculus
gttgtgggatactggccatcggcaa

SEQ ID NO: 732822 - DNA, 25 bp, Mus musculus
gttgtgggtccactacactgtggca

SEQ ID NO: 732823 - DNA, 25 bp, Mus musculus
gttgtgggtccagtacactgtggca

SEQ ID NO: 732824 - DNA, 25 bp, Mus musculus
gttgtggtgcccagcaagtgaagat

SEQ ID NO: 732825 - DNA, 25 bp, Mus musculus
gttgtggtgccctgcaagtgaagat

SEQ ID NO: 732826 - DNA, 25 bp, Mus musculus
gttgtggtgcctcgtctgtccacca

SEQ ID NO: 732827 - DNA, 25 bp, Mus musculus
gttgtggtgcctggtctgtccacca

SEQ ID NO: 732828 - DNA, 25 bp, Mus musculus
gttgtggttcccatggtacacaatg

SEQ ID NO: 732829 - DNA, 25 bp, Mus musculus
gttgtggttcccttggtacacaatg

SEQ ID NO: 732830 - DNA, 25 bp, Mus musculus
gttgtgtggcgcagcctgcgctaat

SEQ ID NO: 732831 - DNA, 25 bp, Mus musculus
gttgtgtggcgctgcctgcgctaat

SEQ ID NO: 732832 - DNA, 25 bp, Mus musculus
gttgtgtgggccacagaccgccagt

SEQ ID NO: 732833 - DNA, 25 bp, Mus musculus
gttgtgtgggcctcagaccgccagt

SEQ ID NO: 732834 - DNA, 25 bp, Mus musculus
gttgtgttagtcattgctctcagca

SEQ ID NO: 732835 - DNA, 25 bp, Mus musculus
gttgtgttagtctttgctctcagca

SEQ ID NO: 732836 - DNA, 25 bp, Mus musculus
gttgtgttggtcactggaccctacc

SEQ ID NO: 732837 - DNA, 25 bp, Mus musculus
gttgtgttggtctctggaccctacc

SEQ ID NO: 732838 - DNA, 25 bp, Mus musculus
gttgtgtttttcagggacgaattca

SEQ ID NO: 732839 - DNA, 25 bp, Mus musculus
gttgtgtttttctgggacgaattca

SEQ ID NO: 732840 - DNA, 25 bp, Mus musculus
gttgttacactgacgggactggcat

SEQ ID NO: 732841 - DNA, 25 bp, Mus musculus
gttgttacactgtcgggactggcat

SEQ ID NO: 732842 - DNA, 25 bp, Mus musculus
gttgttactgtaccagcttacttca

SEQ ID NO: 732843 - DNA, 25 bp, Mus musculus
gttgttactgtagcagcttacttca

SEQ ID NO: 732844 - DNA, 25 bp, Mus musculus
gttgttagtcctctgactgtctggg

SEQ ID NO: 732845 - DNA, 25 bp, Mus musculus
gttgttagtcctgtgactgtctggg

SEQ ID NO: 732846 - DNA, 25 bp, Mus musculus
gttgttatctccactgatggtcagt

SEQ ID NO: 732847 - DNA, 25 bp, Mus musculus
gttgttatctcctctgatggtcagt

SEQ ID NO: 732848 - DNA, 25 bp, Mus musculus
gttgttcaacgtattggatgtccag

SEQ ID NO: 732849 - DNA, 25 bp, Mus musculus
gttgttcaacgttttggatgtccag

SEQ ID NO: 732850 - DNA, 25 bp, Mus musculus
gttgttcctcaaagtcattcaagct

SEQ ID NO: 732851 - DNA, 25 bp, Mus musculus
gttgttcctcaatgtcattcaagct

SEQ ID NO: 732852 - DNA, 25 bp, Mus musculus
gttgttcctgctagattgcttcagc

SEQ ID NO: 732853 - DNA, 25 bp, Mus musculus
gttgttcctgcttgattgcttcagc

SEQ ID NO: 732854 - DNA, 25 bp, Mus musculus
gttgttcctgggagcaccttttcca

SEQ ID NO: 732855 - DNA, 25 bp, Mus musculus
gttgttcctgggtgcaccttttcca

SEQ ID NO: 732856 - DNA, 25 bp, Mus musculus
gttgttcgtcatccgttgtttccag

SEQ ID NO: 732857 - DNA, 25 bp, Mus musculus
gttgttcgtcatgcgttgtttccag

SEQ ID NO: 732858 - DNA, 25 bp, Mus musculus
gttgttctaagtcctctgcaggaag

SEQ ID NO: 732859 - DNA, 25 bp, Mus musculus
gttgttctaagtgctctgcaggaag

SEQ ID NO: 732860 - DNA, 25 bp, Mus musculus
gttgttctacgtcaaccacgcctga

SEQ ID NO: 732861 - DNA, 25 bp, Mus musculus
gttgttctacgtgaaccacgcctga

SEQ ID NO: 732862 - DNA, 25 bp, Mus musculus
gttgttctagaactccacgtgatgt

SEQ ID NO: 732863 - DNA, 25 bp, Mus musculus
gttgttctagaagtccacgtgatgt

SEQ ID NO: 732864 - DNA, 25 bp, Mus musculus
gttgttctccgcaggccctcggacg

SEQ ID NO: 732865 - DNA, 25 bp, Mus musculus
gttgttctccgctggccctcggacg

SEQ ID NO: 732866 - DNA, 25 bp, Mus musculus
gttgttctgccaaaaaccttcgaga

SEQ ID NO: 732867 - DNA, 25 bp, Mus musculus
gttgttctgccataaaccttcgaga

SEQ ID NO: 732868 - DNA, 25 bp, Mus musculus
gttgttcttggactctagaaatctc

SEQ ID NO: 732869 - DNA, 25 bp, Mus musculus
gttgttcttggagtctagaaatctc

SEQ ID NO: 732870 - DNA, 25 bp, Mus musculus
gttgttgcccatcctcctgcagtgc

SEQ ID NO: 732871 - DNA, 25 bp, Mus musculus
gttgttgcccatgctcctgcagtgc

SEQ ID NO: 732872 - DNA, 25 bp, Mus musculus
gttgttggaaacagtcaagttgcat

SEQ ID NO: 732873 - DNA, 25 bp, Mus musculus
gttgttggaaactgtcaagttgcat

SEQ ID NO: 732874 - DNA, 25 bp, Mus musculus
gttgttgtcatgctgactggagtcc

SEQ ID NO: 732875 - DNA, 25 bp, Mus musculus
gttgttgtcatggtgactggagtcc

SEQ ID NO: 732876 - DNA, 25 bp, Mus musculus
gttgttgtggaacccttagctgctc

SEQ ID NO: 732877 - DNA, 25 bp, Mus musculus
gttgttgtggaagccttagctgctc

SEQ ID NO: 732878 - DNA, 25 bp, Mus musculus
gttgtttcctgaagcccacctaggg

SEQ ID NO: 732879 - DNA, 25 bp, Mus musculus
gttgtttcctgatgcccacctaggg

SEQ ID NO: 732880 - DNA, 25 bp, Mus musculus
gttgtttctaccatgctttccctag

SEQ ID NO: 732881 - DNA, 25 bp, Mus musculus
gttgtttctaccttgctttccctag

SEQ ID NO: 732882 - DNA, 25 bp, Mus musculus
gttgtttctggtcccggtctcatcc

SEQ ID NO: 732883 - DNA, 25 bp, Mus musculus
gttgtttctggtgccggtctcatcc

SEQ ID NO: 732884 - DNA, 25 bp, Mus musculus
gttgtttgaagtcatcgagactgag

SEQ ID NO: 732885 - DNA, 25 bp, Mus musculus
gttgtttgaagtgatcgagactgag

SEQ ID NO: 732886 - DNA, 25 bp, Mus musculus
gttgtttgaccgcatctacacacac

SEQ ID NO: 732887 - DNA, 25 bp, Mus musculus
gttgtttgaccggatctacacacac

SEQ ID NO: 732888 - DNA, 25 bp, Mus musculus
gttgtttgcatcctaccccaagtga

SEQ ID NO: 732889 - DNA, 25 bp, Mus musculus
gttgtttgcatcgtaccccaagtga

SEQ ID NO: 732890 - DNA, 25 bp, Mus musculus
gttgtttgtaaacaacaagcccttg

SEQ ID NO: 732891 - DNA, 25 bp, Mus musculus
gttgtttgtaaagaacaagcccttg

SEQ ID NO: 732892 - DNA, 25 bp, Mus musculus
gttgtttgtgatcaaggccatattc

SEQ ID NO: 732893 - DNA, 25 bp, Mus musculus
gttgtttgtgatgaaggccatattc

SEQ ID NO: 732894 - DNA, 25 bp, Mus musculus
gttgttttcatacaggaacggccaa

SEQ ID NO: 732895 - DNA, 25 bp, Mus musculus
gttgttttcatagaggaacggccaa

SEQ ID NO: 732896 - DNA, 25 bp, Mus musculus
gttgtttttaccacagcctcccttg

SEQ ID NO: 732897 - DNA, 25 bp, Mus musculus
gttgtttttacctcagcctcccttg

SEQ ID NO: 732898 - DNA, 25 bp, Mus musculus
gtttaaaaagttccctagcatctgt

SEQ ID NO: 732899 - DNA, 25 bp, Mus musculus
gtttaaaaagttgcctagcatctgt

SEQ ID NO: 732900 - DNA, 25 bp, Mus musculus
gtttaaaaccaaccagacccacctg

SEQ ID NO: 732901 - DNA, 25 bp, Mus musculus
gtttaaaaccaagcagacccacctg

SEQ ID NO: 732902 - DNA, 25 bp, Mus musculus
gtttaaacataacaaccctccatgg

SEQ ID NO: 732903 - DNA, 25 bp, Mus musculus
gtttaaacataagaaccctccatgg

SEQ ID NO: 732904 - DNA, 25 bp, Mus musculus
gtttaaacatggcaccaaaccaaag

SEQ ID NO: 732905 - DNA, 25 bp, Mus musculus
gtttaaacatgggaccaaaccaaag

SEQ ID NO: 732906 - DNA, 25 bp, Mus musculus
gtttaaaccttgctcaggctcggca

SEQ ID NO: 732907 - DNA, 25 bp, Mus musculus
gtttaaaccttggtcaggctcggca

SEQ ID NO: 732908 - DNA, 25 bp, Mus musculus
gtttaaactaatagaacctgaagag

SEQ ID NO: 732909 - DNA, 25 bp, Mus musculus
gtttaaactaattgaacctgaagag

SEQ ID NO: 732910 - DNA, 25 bp, Mus musculus
gtttaaactggaccaaggctctcag

SEQ ID NO: 732911 - DNA, 25 bp, Mus musculus
gtttaaactggagcaaggctctcag

SEQ ID NO: 732912 - DNA, 25 bp, Mus musculus
gtttaaagagaccatcgagaagtgt

SEQ ID NO: 732913 - DNA, 25 bp, Mus musculus
gtttaaagagacgatcgagaagtgt

SEQ ID NO: 732914 - DNA, 25 bp, Mus musculus
gtttaaagcaaaacatgagtttggg

SEQ ID NO: 732915 - DNA, 25 bp, Mus musculus
gtttaaagcaaatcatgagtttggg

SEQ ID NO: 732916 - DNA, 25 bp, Mus musculus
gtttaacagcatagcgcagtgatga

SEQ ID NO: 732917 - DNA, 25 bp, Mus musculus
gtttaacagcattgcgcagtgatga

SEQ ID NO: 732918 - DNA, 25 bp, Mus musculus
gtttaaccaagcagcccgaggaagt

SEQ ID NO: 732919 - DNA, 25 bp, Mus musculus
gtttaaccaagctgcccgaggaagt

SEQ ID NO: 732920 - DNA, 25 bp, Mus musculus
gtttaaccacccagagcaggcccgt

SEQ ID NO: 732921 - DNA, 25 bp, Mus musculus
gtttaaccaccctgagcaggcccgt

SEQ ID NO: 732922 - DNA, 25 bp, Mus musculus
gtttaacgggccaagccgagctctg

SEQ ID NO: 732923 - DNA, 25 bp, Mus musculus
gtttaacgggcctagccgagctctg

SEQ ID NO: 732924 - DNA, 25 bp, Mus musculus
gtttaagagtgcagaggtagtgtct

SEQ ID NO: 732925 - DNA, 25 bp, Mus musculus
gtttaagagtgctgaggtagtgtct

SEQ ID NO: 732926 - DNA, 25 bp, Mus musculus
gtttaaggaactcaacctcaccaat

SEQ ID NO: 732927 - DNA, 25 bp, Mus musculus
gtttaaggaactgaacctcaccaat

SEQ ID NO: 732928 - DNA, 25 bp, Mus musculus
gtttaagtacaaccaacttctccag

SEQ ID NO: 732929 - DNA, 25 bp, Mus musculus
gtttaagtacaagcaacttctccag

SEQ ID NO: 732930 - DNA, 25 bp, Mus musculus
gtttaagtaccacccagagtgcttt

SEQ ID NO: 732931 - DNA, 25 bp, Mus musculus
gtttaagtaccagccagagtgcttt

SEQ ID NO: 732932 - DNA, 25 bp, Mus musculus
gtttaataagttcactacatgtcag

SEQ ID NO: 732933 - DNA, 25 bp, Mus musculus
gtttaataagttgactacatgtcag

SEQ ID NO: 732934 - DNA, 25 bp, Mus musculus
gtttaatgagctagagattcctgtg

SEQ ID NO: 732935 - DNA, 25 bp, Mus musculus
gtttaatgagcttgagattcctgtg

SEQ ID NO: 732936 - DNA, 25 bp, Mus musculus
gtttaatgtgcacccgctctgcatg

SEQ ID NO: 732937 - DNA, 25 bp, Mus musculus
gtttaatgtgcagccgctctgcatg

SEQ ID NO: 732938 - DNA, 25 bp, Mus musculus
gtttaattagcaataagatgggcat

SEQ ID NO: 732939 - DNA, 25 bp, Mus musculus
gtttaattagcattaagatgggcat

SEQ ID NO: 732940 - DNA, 25 bp, Mus musculus
gtttaattgccgctttggtgatccg

SEQ ID NO: 732941 - DNA, 25 bp, Mus musculus
gtttaattgccggtttggtgatccg

SEQ ID NO: 732942 - DNA, 25 bp, Mus musculus
gtttacaacatcattggaggacttg

SEQ ID NO: 732943 - DNA, 25 bp, Mus musculus
gtttacaacatctttggaggacttg

SEQ ID NO: 732944 - DNA, 25 bp, Mus musculus
gtttacaagagaacacacgtgccat

SEQ ID NO: 732945 - DNA, 25 bp, Mus musculus
gtttacaagagatcacacgtgccat

SEQ ID NO: 732946 - DNA, 25 bp, Mus musculus
gtttacaatcaacaatgagactggg

SEQ ID NO: 732947 - DNA, 25 bp, Mus musculus
gtttacaatcaagaatgagactggg

SEQ ID NO: 732948 - DNA, 25 bp, Mus musculus
gtttacaccctcagatcatcatccg

SEQ ID NO: 732949 - DNA, 25 bp, Mus musculus
gtttacaccctctgatcatcatccg

SEQ ID NO: 732950 - DNA, 25 bp, Mus musculus
gtttacagagttactatcatggccc

SEQ ID NO: 732951 - DNA, 25 bp, Mus musculus
gtttacagagtttctatcatggccc

SEQ ID NO: 732952 - DNA, 25 bp, Mus musculus
gtttacagatgacccggataatgcc

SEQ ID NO: 732953 - DNA, 25 bp, Mus musculus
gtttacagatgagccggataatgcc

SEQ ID NO: 732954 - DNA, 25 bp, Mus musculus
gtttacagcacacagctggctgagc

SEQ ID NO: 732955 - DNA, 25 bp, Mus musculus
gtttacagcacagagctggctgagc

SEQ ID NO: 732956 - DNA, 25 bp, Mus musculus
gtttacagcatgatatgggacacag

SEQ ID NO: 732957 - DNA, 25 bp, Mus musculus
gtttacagcatgttatgggacacag

SEQ ID NO: 732958 - DNA, 25 bp, Mus musculus
gtttacagctaccactacctcctgg

SEQ ID NO: 732959 - DNA, 25 bp, Mus musculus
gtttacagctacgactacctcctgg

SEQ ID NO: 732960 - DNA, 25 bp, Mus musculus
gtttacaggaacagacggaccaagt

SEQ ID NO: 732961 - DNA, 25 bp, Mus musculus
gtttacaggaactgacggaccaagt

SEQ ID NO: 732962 - DNA, 25 bp, Mus musculus
gtttacatgaggaaccacaaagccc

SEQ ID NO: 732963 - DNA, 25 bp, Mus musculus
gtttacatgaggtaccacaaagccc

SEQ ID NO: 732964 - DNA, 25 bp, Mus musculus
gtttacattgaacaccggctgatga

SEQ ID NO: 732965 - DNA, 25 bp, Mus musculus
gtttacattgaagaccggctgatga

SEQ ID NO: 732966 - DNA, 25 bp, Mus musculus
gtttaccagatcattgcggacgagg

SEQ ID NO: 732967 - DNA, 25 bp, Mus musculus
gtttaccagatctttgcggacgagg

SEQ ID NO: 732968 - DNA, 25 bp, Mus musculus
gtttaccagccacatctggttttag

SEQ ID NO: 732969 - DNA, 25 bp, Mus musculus
gtttaccagccagatctggttttag

SEQ ID NO: 732970 - DNA, 25 bp, Mus musculus
gtttaccatgtgaacatcaatcata

SEQ ID NO: 732971 - DNA, 25 bp, Mus musculus
gtttaccatgtgtacatcaatcata

SEQ ID NO: 732972 - DNA, 25 bp, Mus musculus
gtttaccgccaaacggctatttgat

SEQ ID NO: 732973 - DNA, 25 bp, Mus musculus
gtttaccgccaatcggctatttgat

SEQ ID NO: 732974 - DNA, 25 bp, Mus musculus
gtttacctatgacaatgctgcggtg

SEQ ID NO: 732975 - DNA, 25 bp, Mus musculus
gtttacctatgagaatgctgcggtg

SEQ ID NO: 732976 - DNA, 25 bp, Mus musculus
gtttacctcatgaatcccggcactg

SEQ ID NO: 732977 - DNA, 25 bp, Mus musculus
gtttacctcatgtatcccggcactg

SEQ ID NO: 732978 - DNA, 25 bp, Mus musculus
gtttacgatgatctggatgcctcag

SEQ ID NO: 732979 - DNA, 25 bp, Mus musculus
gtttacgatgatgtggatgcctcag

SEQ ID NO: 732980 - DNA, 25 bp, Mus musculus
gtttactcctgtccaggctactgtg

SEQ ID NO: 732981 - DNA, 25 bp, Mus musculus
gtttactcctgtgcaggctactgtg

SEQ ID NO: 732982 - DNA, 25 bp, Mus musculus
gtttactggcacaaagcactggcac

SEQ ID NO: 732983 - DNA, 25 bp, Mus musculus
gtttactggcactaagcactggcac

SEQ ID NO: 732984 - DNA, 25 bp, Mus musculus
gtttacttcaaacgacaatgcctag

SEQ ID NO: 732985 - DNA, 25 bp, Mus musculus
gtttacttcaaaggacaatgcctag

SEQ ID NO: 732986 - DNA, 25 bp, Mus musculus
gtttagaagtacacatgcatgtcac

SEQ ID NO: 732987 - DNA, 25 bp, Mus musculus
gtttagaagtactcatgcatgtcac

SEQ ID NO: 732988 - DNA, 25 bp, Mus musculus
gtttagcaaacgagtccccacctgg

SEQ ID NO: 732989 - DNA, 25 bp, Mus musculus
gtttagcaaacgtgtccccacctgg

SEQ ID NO: 732990 - DNA, 25 bp, Mus musculus
gtttagcagtgaaccttcacagcgt

SEQ ID NO: 732991 - DNA, 25 bp, Mus musculus
gtttagcagtgatccttcacagcgt

SEQ ID NO: 732992 - DNA, 25 bp, Mus musculus
gtttagcatgagctttaacagacac

SEQ ID NO: 732993 - DNA, 25 bp, Mus musculus
gtttagcatgaggtttaacagacac

SEQ ID NO: 732994 - DNA, 25 bp, Mus musculus
gtttagccgacaatgtgtggtagac

SEQ ID NO: 732995 - DNA, 25 bp, Mus musculus
gtttagccgacattgtgtggtagac

SEQ ID NO: 732996 - DNA, 25 bp, Mus musculus
gtttagctcaggacccaccgatccg

SEQ ID NO: 732997 - DNA, 25 bp, Mus musculus
gtttagctcaggtcccaccgatccg

SEQ ID NO: 732998 - DNA, 25 bp, Mus musculus
gtttagctcccgctgcgtttgtccc

SEQ ID NO: 732999 - DNA, 25 bp, Mus musculus
gtttagctcccggtgcgtttgtccc

SEQ ID NO: 733000 - DNA, 25 bp, Mus musculus
gtttaggaagatatgggtactctcc

SEQ ID NO: 733001 - DNA, 25 bp, Mus musculus
gtttaggaagatttgggtactctcc

SEQ ID NO: 733002 - DNA, 25 bp, Mus musculus
gtttaggaatccatacaactatggc

SEQ ID NO: 733003 - DNA, 25 bp, Mus musculus
gtttaggaatccttacaactatggc

SEQ ID NO: 733004 - DNA, 25 bp, Mus musculus
gtttaggcttataattacgaggcag

SEQ ID NO: 733005 - DNA, 25 bp, Mus musculus
gtttaggcttattattacgaggcag

SEQ ID NO: 733006 - DNA, 25 bp, Mus musculus
gtttagggacagaaaccagcctttg

SEQ ID NO: 733007 - DNA, 25 bp, Mus musculus
gtttagggacagtaaccagcctttg

SEQ ID NO: 733008 - DNA, 25 bp, Mus musculus
gtttagtaacgtcaactccatagag

SEQ ID NO: 733009 - DNA, 25 bp, Mus musculus
gtttagtaacgtgaactccatagag

SEQ ID NO: 733010 - DNA, 25 bp, Mus musculus
gtttagtatcttctgccaacctcca

SEQ ID NO: 733011 - DNA, 25 bp, Mus musculus
gtttagtatcttgtgccaacctcca

SEQ ID NO: 733012 - DNA, 25 bp, Mus musculus
gtttagtccctaagagtggtataat

SEQ ID NO: 733013 - DNA, 25 bp, Mus musculus
gtttagtccctatgagtggtataat

SEQ ID NO: 733014 - DNA, 25 bp, Mus musculus
gtttagttcctacagctatgacagc

SEQ ID NO: 733015 - DNA, 25 bp, Mus musculus
gtttagttcctagagctatgacagc

SEQ ID NO: 733016 - DNA, 25 bp, Mus musculus
gtttataactacatgagccccacct

SEQ ID NO: 733017 - DNA, 25 bp, Mus musculus
gtttataactacttgagccccacct

SEQ ID NO: 733018 - DNA, 25 bp, Mus musculus
gtttataggaacaagatgacccctc

SEQ ID NO: 733019 - DNA, 25 bp, Mus musculus
gtttataggaactagatgacccctc

SEQ ID NO: 733020 - DNA, 25 bp, Mus musculus
gtttatatcctgagagtgttggcca

SEQ ID NO: 733021 - DNA, 25 bp, Mus musculus
gtttatatcctgtgagtgttggcca

SEQ ID NO: 733022 - DNA, 25 bp, Mus musculus
gtttatcactcccaaaggaaggaga

SEQ ID NO: 733023 - DNA, 25 bp, Mus musculus
gtttatcactccgaaaggaaggaga

SEQ ID NO: 733024 - DNA, 25 bp, Mus musculus
gtttatcatggtaatgggagccatg

SEQ ID NO: 733025 - DNA, 25 bp, Mus musculus
gtttatcatggttatgggagccatg

SEQ ID NO: 733026 - DNA, 25 bp, Mus musculus
gtttatcgccaccttcttcgggcag

SEQ ID NO: 733027 - DNA, 25 bp, Mus musculus
gtttatcgccacgttcttcgggcag

SEQ ID NO: 733028 - DNA, 25 bp, Mus musculus
gtttatctggaccacctcacggaca

SEQ ID NO: 733029 - DNA, 25 bp, Mus musculus
gtttatctggacgacctcacggaca

SEQ ID NO: 733030 - DNA, 25 bp, Mus musculus
gtttatgaagctcattttaaagctg

SEQ ID NO: 733031 - DNA, 25 bp, Mus musculus
gtttatgaagctgattttaaagctg

SEQ ID NO: 733032 - DNA, 25 bp, Mus musculus
gtttatgatccaactctgtgagaag

SEQ ID NO: 733033 - DNA, 25 bp, Mus musculus
gtttatgatccatctctgtgagaag

SEQ ID NO: 733034 - DNA, 25 bp, Mus musculus
gtttatgatgatctcctcttcttcc

SEQ ID NO: 733035 - DNA, 25 bp, Mus musculus
gtttatgatgatgtcctcttcttcc

SEQ ID NO: 733036 - DNA, 25 bp, Mus musculus
gtttatgcagagaatggtaccgtcc

SEQ ID NO: 733037 - DNA, 25 bp, Mus musculus
gtttatgcagagtatggtaccgtcc

SEQ ID NO: 733038 - DNA, 25 bp, Mus musculus
gtttatgtcgggacgcggtgtctcc

SEQ ID NO: 733039 - DNA, 25 bp, Mus musculus
gtttatgtcgggtcgcggtgtctcc

SEQ ID NO: 733040 - DNA, 25 bp, Mus musculus
gtttatgtgagcaggactagcttgc

SEQ ID NO: 733041 - DNA, 25 bp, Mus musculus
gtttatgtgagctggactagcttgc

SEQ ID NO: 733042 - DNA, 25 bp, Mus musculus
gtttattaaacaccatctatcagag

SEQ ID NO: 733043 - DNA, 25 bp, Mus musculus
gtttattaaacagcatctatcagag

SEQ ID NO: 733044 - DNA, 25 bp, Mus musculus
gtttattcccctcctgatgctctgc

SEQ ID NO: 733045 - DNA, 25 bp, Mus musculus
gtttattcccctgctgatgctctgc

SEQ ID NO: 733046 - DNA, 25 bp, Mus musculus
gtttattgccaaacaccaaggattc

SEQ ID NO: 733047 - DNA, 25 bp, Mus musculus
gtttattgccaatcaccaaggattc

SEQ ID NO: 733048 - DNA, 25 bp, Mus musculus
gtttattgccatctacacatacgag

SEQ ID NO: 733049 - DNA, 25 bp, Mus musculus
gtttattgccatgtacacatacgag

SEQ ID NO: 733050 - DNA, 25 bp, Mus musculus
gtttattgtattctattcccagcca

SEQ ID NO: 733051 - DNA, 25 bp, Mus musculus
gtttattgtattgtattcccagcca

SEQ ID NO: 733052 - DNA, 25 bp, Mus musculus
gtttattttggacgaagtcactgcg

SEQ ID NO: 733053 - DNA, 25 bp, Mus musculus
gtttattttggaggaagtcactgcg

SEQ ID NO: 733054 - DNA, 25 bp, Mus musculus
gtttcaaaggaacacactgatcagg

SEQ ID NO: 733055 - DNA, 25 bp, Mus musculus
gtttcaaaggaagacactgatcagg

SEQ ID NO: 733056 - DNA, 25 bp, Mus musculus
gtttcaataagtcagaactgttcac

SEQ ID NO: 733057 - DNA, 25 bp, Mus musculus
gtttcaataagtgagaactgttcac

SEQ ID NO: 733058 - DNA, 25 bp, Mus musculus
gtttcacaaagtagccccagctggc

SEQ ID NO: 733059 - DNA, 25 bp, Mus musculus
gtttcacaaagttgccccagctggc

SEQ ID NO: 733060 - DNA, 25 bp, Mus musculus
gtttcacaagaactattgtagctgt

SEQ ID NO: 733061 - DNA, 25 bp, Mus musculus
gtttcacaagaagtattgtagctgt

SEQ ID NO: 733062 - DNA, 25 bp, Mus musculus
gtttcacacaagcacctaacaagta

SEQ ID NO: 733063 - DNA, 25 bp, Mus musculus
gtttcacacaaggacctaacaagta

SEQ ID NO: 733064 - DNA, 25 bp, Mus musculus
gtttcacattaacaagccaagaaga

SEQ ID NO: 733065 - DNA, 25 bp, Mus musculus
gtttcacattaagaagccaagaaga

SEQ ID NO: 733066 - DNA, 25 bp, Mus musculus
gtttcaccggcaagactgatcttag

SEQ ID NO: 733067 - DNA, 25 bp, Mus musculus
gtttcaccggcatgactgatcttag

SEQ ID NO: 733068 - DNA, 25 bp, Mus musculus
gtttcacggtgcagggctctctagg

SEQ ID NO: 733069 - DNA, 25 bp, Mus musculus
gtttcacggtgctgggctctctagg

SEQ ID NO: 733070 - DNA, 25 bp, Mus musculus
gtttcactgcagaaaatgagggaac

SEQ ID NO: 733071 - DNA, 25 bp, Mus musculus
gtttcactgcagtaaatgagggaac

SEQ ID NO: 733072 - DNA, 25 bp, Mus musculus
gtttcactggtgcagagcaatgccc

SEQ ID NO: 733073 - DNA, 25 bp, Mus musculus
gtttcactggtggagagcaatgccc

SEQ ID NO: 733074 - DNA, 25 bp, Mus musculus
gtttcactgtttagctgtgtatgca

SEQ ID NO: 733075 - DNA, 25 bp, Mus musculus
gtttcactgttttgctgtgtatgca

SEQ ID NO: 733076 - DNA, 25 bp, Mus musculus
gtttcacttggccagtgcagactgg

SEQ ID NO: 733077 - DNA, 25 bp, Mus musculus
gtttcacttggcgagtgcagactgg

SEQ ID NO: 733078 - DNA, 25 bp, Mus musculus
gtttcaggagacatccgtaaagcgc

SEQ ID NO: 733079 - DNA, 25 bp, Mus musculus
gtttcaggagacttccgtaaagcgc

SEQ ID NO: 733080 - DNA, 25 bp, Mus musculus
gtttcagtaacacgatatgatggaa

SEQ ID NO: 733081 - DNA, 25 bp, Mus musculus
gtttcagtaacaggatatgatggaa

SEQ ID NO: 733082 - DNA, 25 bp, Mus musculus
gtttcagtgcgactccagcccgtgg

SEQ ID NO: 733083 - DNA, 25 bp, Mus musculus
gtttcagtgcgagtccagcccgtgg

SEQ ID NO: 733084 - DNA, 25 bp, Mus musculus
gtttcataagctcagtgttctgtgg

SEQ ID NO: 733085 - DNA, 25 bp, Mus musculus
gtttcataagctgagtgttctgtgg

SEQ ID NO: 733086 - DNA, 25 bp, Mus musculus
gtttcatactccattcagccaactc

SEQ ID NO: 733087 - DNA, 25 bp, Mus musculus
gtttcatactcctttcagccaactc

SEQ ID NO: 733088 - DNA, 25 bp, Mus musculus
gtttcatactggcaaatggttcccc

SEQ ID NO: 733089 - DNA, 25 bp, Mus musculus
gtttcatactgggaaatggttcccc

SEQ ID NO: 733090 - DNA, 25 bp, Mus musculus
gtttcatgcaatcaaacacagtctc

SEQ ID NO: 733091 - DNA, 25 bp, Mus musculus
gtttcatgcaatgaaacacagtctc

SEQ ID NO: 733092 - DNA, 25 bp, Mus musculus
gtttcatgccataaagacacttcgg

SEQ ID NO: 733093 - DNA, 25 bp, Mus musculus
gtttcatgccattaagacacttcgg

SEQ ID NO: 733094 - DNA, 25 bp, Mus musculus
gtttcattatgaagccgggaagggc

SEQ ID NO: 733095 - DNA, 25 bp, Mus musculus
gtttcattatgatgccgggaagggc

SEQ ID NO: 733096 - DNA, 25 bp, Mus musculus
gtttcattgggacaattactgggca

SEQ ID NO: 733097 - DNA, 25 bp, Mus musculus
gtttcattgggagaattactgggca

SEQ ID NO: 733098 - DNA, 25 bp, Mus musculus
gtttcatttcaacactgcttacagg

SEQ ID NO: 733099 - DNA, 25 bp, Mus musculus
gtttcatttcaagactgcttacagg

SEQ ID NO: 733100 - DNA, 25 bp, Mus musculus
gtttccaaagataatgggcccaaca

SEQ ID NO: 733101 - DNA, 25 bp, Mus musculus
gtttccaaagattatgggcccaaca

SEQ ID NO: 733102 - DNA, 25 bp, Mus musculus
gtttccaaaggaaagtgtcacacat

SEQ ID NO: 733103 - DNA, 25 bp, Mus musculus
gtttccaaaggatagtgtcacacat

SEQ ID NO: 733104 - DNA, 25 bp, Mus musculus
gtttccacaggcaccagatggaaat

SEQ ID NO: 733105 - DNA, 25 bp, Mus musculus
gtttccacaggctccagatggaaat

SEQ ID NO: 733106 - DNA, 25 bp, Mus musculus
gtttccacaggtcaatgtcatcaag

SEQ ID NO: 733107 - DNA, 25 bp, Mus musculus
gtttccacaggtgaatgtcatcaag

SEQ ID NO: 733108 - DNA, 25 bp, Mus musculus
gtttccagacctacaacatctccta

SEQ ID NO: 733109 - DNA, 25 bp, Mus musculus
gtttccagaccttcaacatctccta

SEQ ID NO: 733110 - DNA, 25 bp, Mus musculus
gtttccagattcaggactcccagtc

SEQ ID NO: 733111 - DNA, 25 bp, Mus musculus
gtttccagattctggactcccagtc

SEQ ID NO: 733112 - DNA, 25 bp, Mus musculus
gtttccagccaactttgtggaggtc

SEQ ID NO: 733113 - DNA, 25 bp, Mus musculus
gtttccagccaagtttgtggaggtc

SEQ ID NO: 733114 - DNA, 25 bp, Mus musculus
gtttccaggactattcgagttctgc

SEQ ID NO: 733115 - DNA, 25 bp, Mus musculus
gtttccaggacttttcgagttctgc

SEQ ID NO: 733116 - DNA, 25 bp, Mus musculus
gtttccaggagcaccacctccagga

SEQ ID NO: 733117 - DNA, 25 bp, Mus musculus
gtttccaggagctccacctccagga

SEQ ID NO: 733118 - DNA, 25 bp, Mus musculus
gtttccagggcgctgacgcatgctt

SEQ ID NO: 733119 - DNA, 25 bp, Mus musculus
gtttccagggcggtgacgcatgctt

SEQ ID NO: 733120 - DNA, 25 bp, Mus musculus
gtttccaggtgacagacacgattca

SEQ ID NO: 733121 - DNA, 25 bp, Mus musculus
gtttccaggtgagagacacgattca

SEQ ID NO: 733122 - DNA, 25 bp, Mus musculus
gtttccagtgatagtgggacatgaa

SEQ ID NO: 733123 - DNA, 25 bp, Mus musculus
gtttccagtgattgtgggacatgaa

SEQ ID NO: 733124 - DNA, 25 bp, Mus musculus
gtttccagttcaccttctgtctcag

SEQ ID NO: 733125 - DNA, 25 bp, Mus musculus
gtttccagttcagcttctgtctcag

SEQ ID NO: 733126 - DNA, 25 bp, Mus musculus
gtttccatcttacatacctacatag

SEQ ID NO: 733127 - DNA, 25 bp, Mus musculus
gtttccatcttagatacctacatag

SEQ ID NO: 733128 - DNA, 25 bp, Mus musculus
gtttccatggagatgtgagggtact

SEQ ID NO: 733129 - DNA, 25 bp, Mus musculus
gtttccatggagttgtgagggtact

SEQ ID NO: 733130 - DNA, 25 bp, Mus musculus
gtttccatgtgaacagtgaggtcaa

SEQ ID NO: 733131 - DNA, 25 bp, Mus musculus
gtttccatgtgatcagtgaggtcaa

SEQ ID NO: 733132 - DNA, 25 bp, Mus musculus
gtttcccaatcactcaaaggcagca

SEQ ID NO: 733133 - DNA, 25 bp, Mus musculus
gtttcccaatcagtcaaaggcagca

SEQ ID NO: 733134 - DNA, 25 bp, Mus musculus
gtttcccacaaaacagcatatccag

SEQ ID NO: 733135 - DNA, 25 bp, Mus musculus
gtttcccacaaatcagcatatccag

SEQ ID NO: 733136 - DNA, 25 bp, Mus musculus
gtttcccacttgactaccccttgag

SEQ ID NO: 733137 - DNA, 25 bp, Mus musculus
gtttcccacttgtctaccccttgag

SEQ ID NO: 733138 - DNA, 25 bp, Mus musculus
gtttcccagccaatcatggtgcaga

SEQ ID NO: 733139 - DNA, 25 bp, Mus musculus
gtttcccagccattcatggtgcaga

SEQ ID NO: 733140 - DNA, 25 bp, Mus musculus
gtttccccaagcaggtccttccaca

SEQ ID NO: 733141 - DNA, 25 bp, Mus musculus
gtttccccaagctggtccttccaca

SEQ ID NO: 733142 - DNA, 25 bp, Mus musculus
gtttccccagcaaggcggacaagga

SEQ ID NO: 733143 - DNA, 25 bp, Mus musculus
gtttccccagcatggcggacaagga

SEQ ID NO: 733144 - DNA, 25 bp, Mus musculus
gtttccccttagcatttcatcactg

SEQ ID NO: 733145 - DNA, 25 bp, Mus musculus
gtttccccttaggatttcatcactg

SEQ ID NO: 733146 - DNA, 25 bp, Mus musculus
gtttcccggcagcttctcggcggct

SEQ ID NO: 733147 - DNA, 25 bp, Mus musculus
gtttcccggcaggttctcggcggct

SEQ ID NO: 733148 - DNA, 25 bp, Mus musculus
gtttcccgggatacctgcaactcaa

SEQ ID NO: 733149 - DNA, 25 bp, Mus musculus
gtttcccgggattcctgcaactcaa

SEQ ID NO: 733150 - DNA, 25 bp, Mus musculus
gtttcccgggcaacaaaacaacaga

SEQ ID NO: 733151 - DNA, 25 bp, Mus musculus
gtttcccgggcatcaaaacaacaga

SEQ ID NO: 733152 - DNA, 25 bp, Mus musculus
gtttcccggtggctcatggcatcct

SEQ ID NO: 733153 - DNA, 25 bp, Mus musculus
gtttcccggtgggtcatggcatcct

SEQ ID NO: 733154 - DNA, 25 bp, Mus musculus
gtttccctcaccctgatagaaagga

SEQ ID NO: 733155 - DNA, 25 bp, Mus musculus
gtttccctcaccgtgatagaaagga

SEQ ID NO: 733156 - DNA, 25 bp, Mus musculus
gtttccctcttcatagagcctgtgc

SEQ ID NO: 733157 - DNA, 25 bp, Mus musculus
gtttccctcttcttagagcctgtgc

SEQ ID NO: 733158 - DNA, 25 bp, Mus musculus
gtttcccttgaacgcagcagcggag

SEQ ID NO: 733159 - DNA, 25 bp, Mus musculus
gtttcccttgaaggcagcagcggag

SEQ ID NO: 733160 - DNA, 25 bp, Mus musculus
gtttccgactctcgcatcgttgctg

SEQ ID NO: 733161 - DNA, 25 bp, Mus musculus
gtttccgactctggcatcgttgctg

SEQ ID NO: 733162 - DNA, 25 bp, Mus musculus
gtttccgccactctgttggttccag

SEQ ID NO: 733163 - DNA, 25 bp, Mus musculus
gtttccgccactgtgttggttccag

SEQ ID NO: 733164 - DNA, 25 bp, Mus musculus
gtttccgccctacagaggtgtttca

SEQ ID NO: 733165 - DNA, 25 bp, Mus musculus
gtttccgccctagagaggtgtttca

SEQ ID NO: 733166 - DNA, 25 bp, Mus musculus
gtttccgccttgagagcaccgaaca

SEQ ID NO: 733167 - DNA, 25 bp, Mus musculus
gtttccgccttgtgagcaccgaaca

SEQ ID NO: 733168 - DNA, 25 bp, Mus musculus
gtttcctagacccttataattattg

SEQ ID NO: 733169 - DNA, 25 bp, Mus musculus
gtttcctagaccgttataattattg

SEQ ID NO: 733170 - DNA, 25 bp, Mus musculus
gtttcctctctgagcatcggaccct

SEQ ID NO: 733171 - DNA, 25 bp, Mus musculus
gtttcctctctgtgcatcggaccct

SEQ ID NO: 733172 - DNA, 25 bp, Mus musculus
gtttcctctggacggagagaagaca

SEQ ID NO: 733173 - DNA, 25 bp, Mus musculus
gtttcctctggagggagagaagaca

SEQ ID NO: 733174 - DNA, 25 bp, Mus musculus
gtttcctctttgaccctaggactca

SEQ ID NO: 733175 - DNA, 25 bp, Mus musculus
gtttcctctttgtccctaggactca

SEQ ID NO: 733176 - DNA, 25 bp, Mus musculus
gtttcctgaactaggccctgccctt

SEQ ID NO: 733177 - DNA, 25 bp, Mus musculus
gtttcctgaacttggccctgccctt

SEQ ID NO: 733178 - DNA, 25 bp, Mus musculus
gtttcctgacccctgcagggatacc

SEQ ID NO: 733179 - DNA, 25 bp, Mus musculus
gtttcctgacccgtgcagggatacc

SEQ ID NO: 733180 - DNA, 25 bp, Mus musculus
gtttcctgcctgagcgccgagaggc

SEQ ID NO: 733181 - DNA, 25 bp, Mus musculus
gtttcctgcctgtgcgccgagaggc

SEQ ID NO: 733182 - DNA, 25 bp, Mus musculus
gtttcctgtaccactgctccgattc

SEQ ID NO: 733183 - DNA, 25 bp, Mus musculus
gtttcctgtacctctgctccgattc

SEQ ID NO: 733184 - DNA, 25 bp, Mus musculus
gtttcctgtgcacgtgttcttccag

SEQ ID NO: 733185 - DNA, 25 bp, Mus musculus
gtttcctgtgcaggtgttcttccag

SEQ ID NO: 733186 - DNA, 25 bp, Mus musculus
gtttcctgtggccaagcagaaagta

SEQ ID NO: 733187 - DNA, 25 bp, Mus musculus
gtttcctgtggcgaagcagaaagta

SEQ ID NO: 733188 - DNA, 25 bp, Mus musculus
gtttccttcaacaaagatctgctgg

SEQ ID NO: 733189 - DNA, 25 bp, Mus musculus
gtttccttcaactaagatctgctgg

SEQ ID NO: 733190 - DNA, 25 bp, Mus musculus
gtttccttctctaattgctctggct

SEQ ID NO: 733191 - DNA, 25 bp, Mus musculus
gtttccttctcttattgctctggct

SEQ ID NO: 733192 - DNA, 25 bp, Mus musculus
gtttcctttctgagtcactggcata

SEQ ID NO: 733193 - DNA, 25 bp, Mus musculus
gtttcctttctgtgtcactggcata

SEQ ID NO: 733194 - DNA, 25 bp, Mus musculus
gtttcgaggactccccgggcacaca

SEQ ID NO: 733195 - DNA, 25 bp, Mus musculus
gtttcgaggactgcccgggcacaca

SEQ ID NO: 733196 - DNA, 25 bp, Mus musculus
gtttcgatgtgaaggattgctcctg

SEQ ID NO: 733197 - DNA, 25 bp, Mus musculus
gtttcgatgtgatggattgctcctg

SEQ ID NO: 733198 - DNA, 25 bp, Mus musculus
gtttcgcattgtctacgcacagaag

SEQ ID NO: 733199 - DNA, 25 bp, Mus musculus
gtttcgcattgtgtacgcacagaag

SEQ ID NO: 733200 - DNA, 25 bp, Mus musculus
gtttcggaggccctctgcagtacca

SEQ ID NO: 733201 - DNA, 25 bp, Mus musculus
gtttcggaggccgtctgcagtacca

SEQ ID NO: 733202 - DNA, 25 bp, Mus musculus
gtttcggccaataggcactcagcca

SEQ ID NO: 733203 - DNA, 25 bp, Mus musculus
gtttcggccaattggcactcagcca

SEQ ID NO: 733204 - DNA, 25 bp, Mus musculus
gtttcggttacaactgggaagcaca

SEQ ID NO: 733205 - DNA, 25 bp, Mus musculus
gtttcggttacatctgggaagcaca

SEQ ID NO: 733206 - DNA, 25 bp, Mus musculus
gtttcgtcaatcctgacacaccaat

SEQ ID NO: 733207 - DNA, 25 bp, Mus musculus
gtttcgtcaatcgtgacacaccaat

SEQ ID NO: 733208 - DNA, 25 bp, Mus musculus
gtttcgtgaacaagcaacaggccca

SEQ ID NO: 733209 - DNA, 25 bp, Mus musculus
gtttcgtgaacatgcaacaggccca

SEQ ID NO: 733210 - DNA, 25 bp, Mus musculus
gtttctaaactaccccaatggatgc

SEQ ID NO: 733211 - DNA, 25 bp, Mus musculus
gtttctaaactagcccaatggatgc

SEQ ID NO: 733212 - DNA, 25 bp, Mus musculus
gtttctaaatggatacagcacaaat

SEQ ID NO: 733213 - DNA, 25 bp, Mus musculus
gtttctaaatggttacagcacaaat

SEQ ID NO: 733214 - DNA, 25 bp, Mus musculus
gtttctacacagcaaaggcattatt

SEQ ID NO: 733215 - DNA, 25 bp, Mus musculus
gtttctacacaggaaaggcattatt

SEQ ID NO: 733216 - DNA, 25 bp, Mus musculus
gtttctacagagcagttcacttact

SEQ ID NO: 733217 - DNA, 25 bp, Mus musculus
gtttctacagaggagttcacttact

SEQ ID NO: 733218 - DNA, 25 bp, Mus musculus
gtttctacgtgtatgcaggcatcct

SEQ ID NO: 733219 - DNA, 25 bp, Mus musculus
gtttctacgtgtttgcaggcatcct

SEQ ID NO: 733220 - DNA, 25 bp, Mus musculus
gtttctagacagaccctcacctggg

SEQ ID NO: 733221 - DNA, 25 bp, Mus musculus
gtttctagacagtccctcacctggg

SEQ ID NO: 733222 - DNA, 25 bp, Mus musculus
gtttctatcattccacccctgttca

SEQ ID NO: 733223 - DNA, 25 bp, Mus musculus
gtttctatcattgcacccctgttca

SEQ ID NO: 733224 - DNA, 25 bp, Mus musculus
gtttctatctgtcaacagaagctgc

SEQ ID NO: 733225 - DNA, 25 bp, Mus musculus
gtttctatctgtgaacagaagctgc

SEQ ID NO: 733226 - DNA, 25 bp, Mus musculus
gtttctattcgcagtctgtgagaca

SEQ ID NO: 733227 - DNA, 25 bp, Mus musculus
gtttctattcgctgtctgtgagaca

SEQ ID NO: 733228 - DNA, 25 bp, Mus musculus
gtttctcaagcccttgatgggtaca

SEQ ID NO: 733229 - DNA, 25 bp, Mus musculus
gtttctcaagccgttgatgggtaca

SEQ ID NO: 733230 - DNA, 25 bp, Mus musculus
gtttctcacatgaagtccttgaggg

SEQ ID NO: 733231 - DNA, 25 bp, Mus musculus
gtttctcacatgtagtccttgaggg

SEQ ID NO: 733232 - DNA, 25 bp, Mus musculus
gtttctcactgaatcaactgctcac

SEQ ID NO: 733233 - DNA, 25 bp, Mus musculus
gtttctcactgattcaactgctcac

SEQ ID NO: 733234 - DNA, 25 bp, Mus musculus
gtttctcacttccaaaagctatttg

SEQ ID NO: 733235 - DNA, 25 bp, Mus musculus
gtttctcacttcgaaaagctatttg

SEQ ID NO: 733236 - DNA, 25 bp, Mus musculus
gtttctccacgaagacgagaagggc

SEQ ID NO: 733237 - DNA, 25 bp, Mus musculus
gtttctccacgatgacgagaagggc

SEQ ID NO: 733238 - DNA, 25 bp, Mus musculus
gtttctccagagcaagtgacagtca

SEQ ID NO: 733239 - DNA, 25 bp, Mus musculus
gtttctccagaggaagtgacagtca

SEQ ID NO: 733240 - DNA, 25 bp, Mus musculus
gtttctccatatagctgttgcccaa

SEQ ID NO: 733241 - DNA, 25 bp, Mus musculus
gtttctccatattgctgttgcccaa

SEQ ID NO: 733242 - DNA, 25 bp, Mus musculus
gtttctcccaccacaaatggcactg

SEQ ID NO: 733243 - DNA, 25 bp, Mus musculus
gtttctcccacctcaaatggcactg

SEQ ID NO: 733244 - DNA, 25 bp, Mus musculus
gtttctcgatgccttcttttccctg

SEQ ID NO: 733245 - DNA, 25 bp, Mus musculus
gtttctcgatgcgttcttttccctg

SEQ ID NO: 733246 - DNA, 25 bp, Mus musculus
gtttctcggcttctcatcgcagtca

SEQ ID NO: 733247 - DNA, 25 bp, Mus musculus
gtttctcggcttgtcatcgcagtca

SEQ ID NO: 733248 - DNA, 25 bp, Mus musculus
gtttctctattgatcggcacgtgcc

SEQ ID NO: 733249 - DNA, 25 bp, Mus musculus
gtttctctattgttcggcacgtgcc

SEQ ID NO: 733250 - DNA, 25 bp, Mus musculus
gtttctctcaaaagccctctaggca

SEQ ID NO: 733251 - DNA, 25 bp, Mus musculus
gtttctctcaaatgccctctaggca

SEQ ID NO: 733252 - DNA, 25 bp, Mus musculus
gtttctctgccactgggaaccgcct

SEQ ID NO: 733253 - DNA, 25 bp, Mus musculus
gtttctctgccagtgggaaccgcct

SEQ ID NO: 733254 - DNA, 25 bp, Mus musculus
gtttctcttcatagacagacagcat

SEQ ID NO: 733255 - DNA, 25 bp, Mus musculus
gtttctcttcattgacagacagcat

SEQ ID NO: 733256 - DNA, 25 bp, Mus musculus
gtttctcttcgtccctcctgaaaag

SEQ ID NO: 733257 - DNA, 25 bp, Mus musculus
gtttctcttcgtgcctcctgaaaag

SEQ ID NO: 733258 - DNA, 25 bp, Mus musculus
gtttctcttgcaaccgtgaccagtc

SEQ ID NO: 733259 - DNA, 25 bp, Mus musculus
gtttctcttgcatccgtgaccagtc

SEQ ID NO: 733260 - DNA, 25 bp, Mus musculus
gtttctcttggaagtgccactgggt

SEQ ID NO: 733261 - DNA, 25 bp, Mus musculus
gtttctcttggatgtgccactgggt

SEQ ID NO: 733262 - DNA, 25 bp, Mus musculus
gtttctgaaaaacagcaacctgcgg

SEQ ID NO: 733263 - DNA, 25 bp, Mus musculus
gtttctgaaaaagagcaacctgcgg

SEQ ID NO: 733264 - DNA, 25 bp, Mus musculus
gtttctgatcaactaaacaccagca

SEQ ID NO: 733265 - DNA, 25 bp, Mus musculus
gtttctgatcaagtaaacaccagca

SEQ ID NO: 733266 - DNA, 25 bp, Mus musculus
gtttctgatcctcaacgacttcccg

SEQ ID NO: 733267 - DNA, 25 bp, Mus musculus
gtttctgatcctgaacgacttcccg

SEQ ID NO: 733268 - DNA, 25 bp, Mus musculus
gtttctgctcacagtaacagcccct

SEQ ID NO: 733269 - DNA, 25 bp, Mus musculus
gtttctgctcactgtaacagcccct

SEQ ID NO: 733270 - DNA, 25 bp, Mus musculus
gtttctggcttacgtcagtagatca

SEQ ID NO: 733271 - DNA, 25 bp, Mus musculus
gtttctggcttaggtcagtagatca

SEQ ID NO: 733272 - DNA, 25 bp, Mus musculus
gtttctgggacgcatcaatgagatc

SEQ ID NO: 733273 - DNA, 25 bp, Mus musculus
gtttctgggacggatcaatgagatc

SEQ ID NO: 733274 - DNA, 25 bp, Mus musculus
gtttctggttcaccttcaagagaaa

SEQ ID NO: 733275 - DNA, 25 bp, Mus musculus
gtttctggttcagcttcaagagaaa

SEQ ID NO: 733276 - DNA, 25 bp, Mus musculus
gtttctggttctatggaaggatatc

SEQ ID NO: 733277 - DNA, 25 bp, Mus musculus
gtttctggttctttggaaggatatc

SEQ ID NO: 733278 - DNA, 25 bp, Mus musculus
gtttctgtccccagcagatgacctg

SEQ ID NO: 733279 - DNA, 25 bp, Mus musculus
gtttctgtcccctgcagatgacctg

SEQ ID NO: 733280 - DNA, 25 bp, Mus musculus
gtttctgttgatcccatttagagtg

SEQ ID NO: 733281 - DNA, 25 bp, Mus musculus
gtttctgttgatgccatttagagtg

SEQ ID NO: 733282 - DNA, 25 bp, Mus musculus
gtttcttagcatcgccaacgtggag

SEQ ID NO: 733283 - DNA, 25 bp, Mus musculus
gtttcttagcatggccaacgtggag

SEQ ID NO: 733284 - DNA, 25 bp, Mus musculus
gtttcttccaaaaaatcaagccaag

SEQ ID NO: 733285 - DNA, 25 bp, Mus musculus
gtttcttccaaataatcaagccaag

SEQ ID NO: 733286 - DNA, 25 bp, Mus musculus
gtttcttccgaacaagcattaccaa

SEQ ID NO: 733287 - DNA, 25 bp, Mus musculus
gtttcttccgaagaagcattaccaa

SEQ ID NO: 733288 - DNA, 25 bp, Mus musculus
gtttcttccggaatcattttcgctg

SEQ ID NO: 733289 - DNA, 25 bp, Mus musculus
gtttcttccggattcattttcgctg

SEQ ID NO: 733290 - DNA, 25 bp, Mus musculus
gtttcttcgaaaataccttcttcag

SEQ ID NO: 733291 - DNA, 25 bp, Mus musculus
gtttcttcgaaattaccttcttcag

SEQ ID NO: 733292 - DNA, 25 bp, Mus musculus
gtttcttcgattaaagagaacaagg

SEQ ID NO: 733293 - DNA, 25 bp, Mus musculus
gtttcttcgatttaagagaacaagg

SEQ ID NO: 733294 - DNA, 25 bp, Mus musculus
gtttcttcgctcagaggccgtggcc

SEQ ID NO: 733295 - DNA, 25 bp, Mus musculus
gtttcttcgctctgaggccgtggcc

SEQ ID NO: 733296 - DNA, 25 bp, Mus musculus
gtttcttcgggaacatcttcacctc

SEQ ID NO: 733297 - DNA, 25 bp, Mus musculus
gtttcttcgggatcatcttcacctc

SEQ ID NO: 733298 - DNA, 25 bp, Mus musculus
gtttcttctagaacaagtcactgct

SEQ ID NO: 733299 - DNA, 25 bp, Mus musculus
gtttcttctagatcaagtcactgct

SEQ ID NO: 733300 - DNA, 25 bp, Mus musculus
gtttcttgaagcactccacaaccct

SEQ ID NO: 733301 - DNA, 25 bp, Mus musculus
gtttcttgaagctctccacaaccct

SEQ ID NO: 733302 - DNA, 25 bp, Mus musculus
gtttcttgccatcaatggattccct

SEQ ID NO: 733303 - DNA, 25 bp, Mus musculus
gtttcttgccatgaatggattccct

SEQ ID NO: 733304 - DNA, 25 bp, Mus musculus
gtttcttggccgctgcgctcggcac

SEQ ID NO: 733305 - DNA, 25 bp, Mus musculus
gtttcttggccggtgcgctcggcac

SEQ ID NO: 733306 - DNA, 25 bp, Mus musculus
gtttcttggtataacccaggctgag

SEQ ID NO: 733307 - DNA, 25 bp, Mus musculus
gtttcttggtattacccaggctgag

SEQ ID NO: 733308 - DNA, 25 bp, Mus musculus
gtttcttgttgtcacaggccaaagc

SEQ ID NO: 733309 - DNA, 25 bp, Mus musculus
gtttcttgttgtgacaggccaaagc

SEQ ID NO: 733310 - DNA, 25 bp, Mus musculus
gtttctttgccacatatggctcagt

SEQ ID NO: 733311 - DNA, 25 bp, Mus musculus
gtttctttgccagatatggctcagt

SEQ ID NO: 733312 - DNA, 25 bp, Mus musculus
gtttctttgcttcactcctcccaag

SEQ ID NO: 733313 - DNA, 25 bp, Mus musculus
gtttctttgcttgactcctcccaag

SEQ ID NO: 733314 - DNA, 25 bp, Mus musculus
gtttcttttagcacatggacctggg

SEQ ID NO: 733315 - DNA, 25 bp, Mus musculus
gtttcttttagctcatggacctggg

SEQ ID NO: 733316 - DNA, 25 bp, Mus musculus
gtttgaaaagcgaatttatatccca

SEQ ID NO: 733317 - DNA, 25 bp, Mus musculus
gtttgaaaagcgtatttatatccca

SEQ ID NO: 733318 - DNA, 25 bp, Mus musculus
gtttgaaagggcaaaagcggcagta

SEQ ID NO: 733319 - DNA, 25 bp, Mus musculus
gtttgaaagggctaaagcggcagta

SEQ ID NO: 733320 - DNA, 25 bp, Mus musculus
gtttgaaatgcccaatgaaaatgat

SEQ ID NO: 733321 - DNA, 25 bp, Mus musculus
gtttgaaatgccgaatgaaaatgat

SEQ ID NO: 733322 - DNA, 25 bp, Mus musculus
gtttgaaccatgaatcttttactcc

SEQ ID NO: 733323 - DNA, 25 bp, Mus musculus
gtttgaaccatgtatcttttactcc

SEQ ID NO: 733324 - DNA, 25 bp, Mus musculus
gtttgaacgcttccgaacaggccag

SEQ ID NO: 733325 - DNA, 25 bp, Mus musculus
gtttgaacgcttgcgaacaggccag

SEQ ID NO: 733326 - DNA, 25 bp, Mus musculus
gtttgaacttcaccaactgcagccg

SEQ ID NO: 733327 - DNA, 25 bp, Mus musculus
gtttgaacttcagcaactgcagccg

SEQ ID NO: 733328 - DNA, 25 bp, Mus musculus
gtttgaagaacaacaacgctctctc

SEQ ID NO: 733329 - DNA, 25 bp, Mus musculus
gtttgaagaacatcaacgctctctc

SEQ ID NO: 733330 - DNA, 25 bp, Mus musculus
gtttgaagagcaaattaaggccatt

SEQ ID NO: 733331 - DNA, 25 bp, Mus musculus
gtttgaagagcatattaaggccatt

SEQ ID NO: 733332 - DNA, 25 bp, Mus musculus
gtttgaagatcaaggtcaggacttt

SEQ ID NO: 733333 - DNA, 25 bp, Mus musculus
gtttgaagatcatggtcaggacttt

SEQ ID NO: 733334 - DNA, 25 bp, Mus musculus
gtttgaagcaggagtcacatctcaa

SEQ ID NO: 733335 - DNA, 25 bp, Mus musculus
gtttgaagcaggtgtcacatctcaa

SEQ ID NO: 733336 - DNA, 25 bp, Mus musculus
gtttgaagctggctccacaagggac

SEQ ID NO: 733337 - DNA, 25 bp, Mus musculus
gtttgaagctgggtccacaagggac

SEQ ID NO: 733338 - DNA, 25 bp, Mus musculus
gtttgaatggtgaggacatccactc

SEQ ID NO: 733339 - DNA, 25 bp, Mus musculus
gtttgaatggtgtggacatccactc

SEQ ID NO: 733340 - DNA, 25 bp, Mus musculus
gtttgacaccaaacatgatgtatac

SEQ ID NO: 733341 - DNA, 25 bp, Mus musculus
gtttgacaccaatcatgatgtatac

SEQ ID NO: 733342 - DNA, 25 bp, Mus musculus
gtttgacacccgctacagcatccgg

SEQ ID NO: 733343 - DNA, 25 bp, Mus musculus
gtttgacacccggtacagcatccgg

SEQ ID NO: 733344 - DNA, 25 bp, Mus musculus
gtttgacactgaatgagctctggga

SEQ ID NO: 733345 - DNA, 25 bp, Mus musculus
gtttgacactgattgagctctggga

SEQ ID NO: 733346 - DNA, 25 bp, Mus musculus
gtttgacagacaacaagaacctgtt

SEQ ID NO: 733347 - DNA, 25 bp, Mus musculus
gtttgacagacatcaagaacctgtt

SEQ ID NO: 733348 - DNA, 25 bp, Mus musculus
gtttgacattatacggcgatggtgc

SEQ ID NO: 733349 - DNA, 25 bp, Mus musculus
gtttgacattattcggcgatggtgc

SEQ ID NO: 733350 - DNA, 25 bp, Mus musculus
gtttgaccacaacgctggccaatcc

SEQ ID NO: 733351 - DNA, 25 bp, Mus musculus
gtttgaccacaaggctggccaatcc

SEQ ID NO: 733352 - DNA, 25 bp, Mus musculus
gtttgaccgactccaaaataacaga

SEQ ID NO: 733353 - DNA, 25 bp, Mus musculus
gtttgaccgactgcaaaataacaga

SEQ ID NO: 733354 - DNA, 25 bp, Mus musculus
gtttgaccgagaaaacaaggctggt

SEQ ID NO: 733355 - DNA, 25 bp, Mus musculus
gtttgaccgagataacaaggctggt

SEQ ID NO: 733356 - DNA, 25 bp, Mus musculus
gtttgaccggatctacacacaccag

SEQ ID NO: 733357 - DNA, 25 bp, Mus musculus
gtttgaccggatgtacacacaccag

SEQ ID NO: 733358 - DNA, 25 bp, Mus musculus
gtttgaccggctacctgggccaggt

SEQ ID NO: 733359 - DNA, 25 bp, Mus musculus
gtttgaccggcttcctgggccaggt

SEQ ID NO: 733360 - DNA, 25 bp, Mus musculus
gtttgactctgcagagctagcaatg

SEQ ID NO: 733361 - DNA, 25 bp, Mus musculus
gtttgactctgctgagctagcaatg

SEQ ID NO: 733362 - DNA, 25 bp, Mus musculus
gtttgacttactcgctgagcttgaa

SEQ ID NO: 733363 - DNA, 25 bp, Mus musculus
gtttgacttactggctgagcttgaa

SEQ ID NO: 733364 - DNA, 25 bp, Mus musculus
gtttgagaaagaagcataccaggcc

SEQ ID NO: 733365 - DNA, 25 bp, Mus musculus
gtttgagaaagatgcataccaggcc

SEQ ID NO: 733366 - DNA, 25 bp, Mus musculus
gtttgagaacttcggtatccagccc

SEQ ID NO: 733367 - DNA, 25 bp, Mus musculus
gtttgagaacttgggtatccagccc

SEQ ID NO: 733368 - DNA, 25 bp, Mus musculus
gtttgagaagcgcaccatgtcggcc

SEQ ID NO: 733369 - DNA, 25 bp, Mus musculus
gtttgagaagcggaccatgtcggcc

SEQ ID NO: 733370 - DNA, 25 bp, Mus musculus
gtttgagagaatatgtgtgcacttc

SEQ ID NO: 733371 - DNA, 25 bp, Mus musculus
gtttgagagaatttgtgtgcacttc

SEQ ID NO: 733372 - DNA, 25 bp, Mus musculus
gtttgagagcaccatcggcttcaag

SEQ ID NO: 733373 - DNA, 25 bp, Mus musculus
gtttgagagcacgatcggcttcaag

SEQ ID NO: 733374 - DNA, 25 bp, Mus musculus
gtttgagatttcaaagagctctgcg

SEQ ID NO: 733375 - DNA, 25 bp, Mus musculus
gtttgagatttctaagagctctgcg

SEQ ID NO: 733376 - DNA, 25 bp, Mus musculus
gtttgagcttggcctgggctccttc

SEQ ID NO: 733377 - DNA, 25 bp, Mus musculus
gtttgagcttgggctgggctccttc

SEQ ID NO: 733378 - DNA, 25 bp, Mus musculus
gtttgaggaagacagtcagtcagaa

SEQ ID NO: 733379 - DNA, 25 bp, Mus musculus
gtttgaggaagagagtcagtcagaa

SEQ ID NO: 733380 - DNA, 25 bp, Mus musculus
gtttgaggacgtcccaattgcacac

SEQ ID NO: 733381 - DNA, 25 bp, Mus musculus
gtttgaggacgtgccaattgcacac

SEQ ID NO: 733382 - DNA, 25 bp, Mus musculus
gtttgaggagctccgcctgatcaca

SEQ ID NO: 733383 - DNA, 25 bp, Mus musculus
gtttgaggagctgcgcctgatcaca

SEQ ID NO: 733384 - DNA, 25 bp, Mus musculus
gtttgaggctgtcgcccagatgttc

SEQ ID NO: 733385 - DNA, 25 bp, Mus musculus
gtttgaggctgtggcccagatgttc

SEQ ID NO: 733386 - DNA, 25 bp, Mus musculus
gtttgagtacctcaagctactgggc

SEQ ID NO: 733387 - DNA, 25 bp, Mus musculus
gtttgagtacctgaagctactgggc

SEQ ID NO: 733388 - DNA, 25 bp, Mus musculus
gtttgagtcttcagacttctacaga

SEQ ID NO: 733389 - DNA, 25 bp, Mus musculus
gtttgagtcttctgacttctacaga

SEQ ID NO: 733390 - DNA, 25 bp, Mus musculus
gtttgagtgatcaaggaagaacacc

SEQ ID NO: 733391 - DNA, 25 bp, Mus musculus
gtttgagtgatctaggaagaacacc

SEQ ID NO: 733392 - DNA, 25 bp, Mus musculus
gtttgagttcgtccagcagccggtc

SEQ ID NO: 733393 - DNA, 25 bp, Mus musculus
gtttgagttcgtgcagcagccggtc

SEQ ID NO: 733394 - DNA, 25 bp, Mus musculus
gtttgataaaacaccgtggcagtgc

SEQ ID NO: 733395 - DNA, 25 bp, Mus musculus
gtttgataaaactccgtggcagtgc

SEQ ID NO: 733396 - DNA, 25 bp, Mus musculus
gtttgatcaccaatacaaccaacag

SEQ ID NO: 733397 - DNA, 25 bp, Mus musculus
gtttgatcaccattacaaccaacag

SEQ ID NO: 733398 - DNA, 25 bp, Mus musculus
gtttgatcacccagtccactgcctt

SEQ ID NO: 733399 - DNA, 25 bp, Mus musculus
gtttgatcaccccaccagaacttct

SEQ ID NO: 733400 - DNA, 25 bp, Mus musculus
gtttgatcacccgaccagaacttct

SEQ ID NO: 733401 - DNA, 25 bp, Mus musculus
gtttgatcaccctgtccactgcctt

SEQ ID NO: 733402 - DNA, 25 bp, Mus musculus
gtttgatccagtccctgtcaagcag

SEQ ID NO: 733403 - DNA, 25 bp, Mus musculus
gtttgatccagtgcctgtcaagcag

SEQ ID NO: 733404 - DNA, 25 bp, Mus musculus
gtttgatcccaacggccatcacgtg

SEQ ID NO: 733405 - DNA, 25 bp, Mus musculus
gtttgatcccaagggccatcacgtg

SEQ ID NO: 733406 - DNA, 25 bp, Mus musculus
gtttgatcccctagccgagagacat

SEQ ID NO: 733407 - DNA, 25 bp, Mus musculus
gtttgatccccttgccgagagacat

SEQ ID NO: 733408 - DNA, 25 bp, Mus musculus
gtttgatcctcaagggctttaagcc

SEQ ID NO: 733409 - DNA, 25 bp, Mus musculus
gtttgatcctcatgggctttaagcc

SEQ ID NO: 733410 - DNA, 25 bp, Mus musculus
gtttgatctagccttcgtcgtccgc

SEQ ID NO: 733411 - DNA, 25 bp, Mus musculus
gtttgatctagcgttcgtcgtccgc

SEQ ID NO: 733412 - DNA, 25 bp, Mus musculus
gtttgatctgtgcatgaaatgaatc

SEQ ID NO: 733413 - DNA, 25 bp, Mus musculus
gtttgatctgtggatgaaatgaatc

SEQ ID NO: 733414 - DNA, 25 bp, Mus musculus
gtttgatcttttcggagaggaagat

SEQ ID NO: 733415 - DNA, 25 bp, Mus musculus
gtttgatcttttgggagaggaagat

SEQ ID NO: 733416 - DNA, 25 bp, Mus musculus
gtttgatgtggtcgttatcctcacc

SEQ ID NO: 733417 - DNA, 25 bp, Mus musculus
gtttgatgtggtggttatcctcacc

SEQ ID NO: 733418 - DNA, 25 bp, Mus musculus
gtttgattacctagtggcccatggc

SEQ ID NO: 733419 - DNA, 25 bp, Mus musculus
gtttgattaccttgtggcccatggc

SEQ ID NO: 733420 - DNA, 25 bp, Mus musculus
gtttgattctcaaaaaggcttctgg

SEQ ID NO: 733421 - DNA, 25 bp, Mus musculus
gtttgattctcataaaggcttctgg

SEQ ID NO: 733422 - DNA, 25 bp, Mus musculus
gtttgcaactaacccggatccgagg

SEQ ID NO: 733423 - DNA, 25 bp, Mus musculus
gtttgcaactaagccggatccgagg

SEQ ID NO: 733424 - DNA, 25 bp, Mus musculus
gtttgcaagtgaaggaatctacaac

SEQ ID NO: 733425 - DNA, 25 bp, Mus musculus
gtttgcaagtgatggaatctacaac

SEQ ID NO: 733426 - DNA, 25 bp, Mus musculus
gtttgcacacccataccagtatgaa

SEQ ID NO: 733427 - DNA, 25 bp, Mus musculus
gtttgcacacccttaccagtatgaa

SEQ ID NO: 733428 - DNA, 25 bp, Mus musculus
gtttgcacatccctccgctgactgg

SEQ ID NO: 733429 - DNA, 25 bp, Mus musculus
gtttgcacatccgtccgctgactgg

SEQ ID NO: 733430 - DNA, 25 bp, Mus musculus
gtttgcacccacctcatcatgaagg

SEQ ID NO: 733431 - DNA, 25 bp, Mus musculus
gtttgcacccacgtcatcatgaagg

SEQ ID NO: 733432 - DNA, 25 bp, Mus musculus
gtttgcactgaactttctagaccag

SEQ ID NO: 733433 - DNA, 25 bp, Mus musculus
gtttgcactgaagtttctagaccag

SEQ ID NO: 733434 - DNA, 25 bp, Mus musculus
gtttgcactgggagtctaccgtaca

SEQ ID NO: 733435 - DNA, 25 bp, Mus musculus
gtttgcactgggtgtctaccgtaca

SEQ ID NO: 733436 - DNA, 25 bp, Mus musculus
gtttgcagaccccaaccactggata

SEQ ID NO: 733437 - DNA, 25 bp, Mus musculus
gtttgcagacccgaaccactggata

SEQ ID NO: 733438 - DNA, 25 bp, Mus musculus
gtttgcagcctgcaagcccaagtcg

SEQ ID NO: 733439 - DNA, 25 bp, Mus musculus
gtttgcagcctggaagcccaagtcg

SEQ ID NO: 733440 - DNA, 25 bp, Mus musculus
gtttgcaggtccaaagatggaagaa

SEQ ID NO: 733441 - DNA, 25 bp, Mus musculus
gtttgcaggtcctaagatggaagaa

SEQ ID NO: 733442 - DNA, 25 bp, Mus musculus
gtttgcagtcccaaaaaattacaag

SEQ ID NO: 733443 - DNA, 25 bp, Mus musculus
gtttgcagtccctaaaaattacaag

SEQ ID NO: 733444 - DNA, 25 bp, Mus musculus
gtttgcatatatagagttctcggac

SEQ ID NO: 733445 - DNA, 25 bp, Mus musculus
gtttgcatatattgagttctcggac

SEQ ID NO: 733446 - DNA, 25 bp, Mus musculus
gtttgcatctaaagggctgtgtttt

SEQ ID NO: 733447 - DNA, 25 bp, Mus musculus
gtttgcatctaatgggctgtgtttt

SEQ ID NO: 733448 - DNA, 25 bp, Mus musculus
gtttgccaaaggcatctcctctgga

SEQ ID NO: 733449 - DNA, 25 bp, Mus musculus
gtttgccaaagggatctcctctgga

SEQ ID NO: 733450 - DNA, 25 bp, Mus musculus
gtttgccaacagcagttcctccatg

SEQ ID NO: 733451 - DNA, 25 bp, Mus musculus
gtttgccaacaggagttcctccatg

SEQ ID NO: 733452 - DNA, 25 bp, Mus musculus
gtttgccaacgtagtccacgtgaag

SEQ ID NO: 733453 - DNA, 25 bp, Mus musculus
gtttgccaacgttgtccacgtgaag

SEQ ID NO: 733454 - DNA, 25 bp, Mus musculus
gtttgccaggccattaacctactct

SEQ ID NO: 733455 - DNA, 25 bp, Mus musculus
gtttgccaggcctttaacctactct

SEQ ID NO: 733456 - DNA, 25 bp, Mus musculus
gtttgccaggttctcatgtcttgag

SEQ ID NO: 733457 - DNA, 25 bp, Mus musculus
gtttgccaggttgtcatgtcttgag

SEQ ID NO: 733458 - DNA, 25 bp, Mus musculus
gtttgcccctaaagtactgtcccca

SEQ ID NO: 733459 - DNA, 25 bp, Mus musculus
gtttgcccctaatgtactgtcccca

SEQ ID NO: 733460 - DNA, 25 bp, Mus musculus
gtttgccgccaccttgtttgccttg

SEQ ID NO: 733461 - DNA, 25 bp, Mus musculus
gtttgccgccacgttgtttgccttg

SEQ ID NO: 733462 - DNA, 25 bp, Mus musculus
gtttgcctcaaaaactatgagtacg

SEQ ID NO: 733463 - DNA, 25 bp, Mus musculus
gtttgcctcaaatactatgagtacg

SEQ ID NO: 733464 - DNA, 25 bp, Mus musculus
gtttgcctcctgctccaaggactgc

SEQ ID NO: 733465 - DNA, 25 bp, Mus musculus
gtttgcctcctggtccaaggactgc

SEQ ID NO: 733466 - DNA, 25 bp, Mus musculus
gtttgccttccacgcgagccaggac

SEQ ID NO: 733467 - DNA, 25 bp, Mus musculus
gtttgccttccaggcgagccaggac

SEQ ID NO: 733468 - DNA, 25 bp, Mus musculus
gtttgccttcttagcacaacacttc

SEQ ID NO: 733469 - DNA, 25 bp, Mus musculus
gtttgccttctttgcacaacacttc

SEQ ID NO: 733470 - DNA, 25 bp, Mus musculus
gtttgcgaacggagcagctgcagca

SEQ ID NO: 733471 - DNA, 25 bp, Mus musculus
gtttgcgaacggtgcagctgcagca

SEQ ID NO: 733472 - DNA, 25 bp, Mus musculus
gtttgcgcaccccagacctttctct

SEQ ID NO: 733473 - DNA, 25 bp, Mus musculus
gtttgcgcacccgagacctttctct

SEQ ID NO: 733474 - DNA, 25 bp, Mus musculus
gtttgcgcagttattcctgtgcccc

SEQ ID NO: 733475 - DNA, 25 bp, Mus musculus
gtttgcgcagtttttcctgtgcccc

SEQ ID NO: 733476 - DNA, 25 bp, Mus musculus
gtttgcggtggaaccccaggcgccc

SEQ ID NO: 733477 - DNA, 25 bp, Mus musculus
gtttgcggtggatccccaggcgccc

SEQ ID NO: 733478 - DNA, 25 bp, Mus musculus
gtttgctactctagccctggccctg

SEQ ID NO: 733479 - DNA, 25 bp, Mus musculus
gtttgctactcttgccctggccctg

SEQ ID NO: 733480 - DNA, 25 bp, Mus musculus
gtttgctagagcatggtcggattgc

SEQ ID NO: 733481 - DNA, 25 bp, Mus musculus
gtttgctagagcttggtcggattgc

SEQ ID NO: 733482 - DNA, 25 bp, Mus musculus
gtttgctattttctcatggtaccca

SEQ ID NO: 733483 - DNA, 25 bp, Mus musculus
gtttgctattttgtcatggtaccca

SEQ ID NO: 733484 - DNA, 25 bp, Mus musculus
gtttgctcaggtctgcgacgagccc

SEQ ID NO: 733485 - DNA, 25 bp, Mus musculus
gtttgctcaggtgtgcgacgagccc

SEQ ID NO: 733486 - DNA, 25 bp, Mus musculus
gtttgctcttcccttgccctgtggc

SEQ ID NO: 733487 - DNA, 25 bp, Mus musculus
gtttgctcttccgttgccctgtggc

SEQ ID NO: 733488 - DNA, 25 bp, Mus musculus
gtttgctgagctcccggagtttaga

SEQ ID NO: 733489 - DNA, 25 bp, Mus musculus
gtttgctgagctgccggagtttaga

SEQ ID NO: 733490 - DNA, 25 bp, Mus musculus
gtttgctgagtaccttgccagtgag

SEQ ID NO: 733491 - DNA, 25 bp, Mus musculus
gtttgctgagtagcttgccagtgag

SEQ ID NO: 733492 - DNA, 25 bp, Mus musculus
gtttgctgcatgctgcatgacaccc

SEQ ID NO: 733493 - DNA, 25 bp, Mus musculus
gtttgctgcatggtgcatgacaccc

SEQ ID NO: 733494 - DNA, 25 bp, Mus musculus
gtttgctgccttccctattggcatc

SEQ ID NO: 733495 - DNA, 25 bp, Mus musculus
gtttgctgccttgcctattggcatc

SEQ ID NO: 733496 - DNA, 25 bp, Mus musculus
gtttgctgcgctatgaattctctcc

SEQ ID NO: 733497 - DNA, 25 bp, Mus musculus
gtttgctgcgctttgaattctctcc

SEQ ID NO: 733498 - DNA, 25 bp, Mus musculus
gtttgctgctaacctgggagtgatc

SEQ ID NO: 733499 - DNA, 25 bp, Mus musculus
gtttgctgctaagctgggagtgatc

SEQ ID NO: 733500 - DNA, 25 bp, Mus musculus
gtttgctgctacacagcatgctctg

SEQ ID NO: 733501 - DNA, 25 bp, Mus musculus
gtttgctgctactcagcatgctctg

SEQ ID NO: 733502 - DNA, 25 bp, Mus musculus
gtttgctggaaactgctggcatcaa

SEQ ID NO: 733503 - DNA, 25 bp, Mus musculus
gtttgctggaaagtgctggcatcaa

SEQ ID NO: 733504 - DNA, 25 bp, Mus musculus
gtttgcttacgtcactgatggtgct

SEQ ID NO: 733505 - DNA, 25 bp, Mus musculus
gtttgcttacgtgactgatggtgct

SEQ ID NO: 733506 - DNA, 25 bp, Mus musculus
gtttgcttcagccatcgggatgcca

SEQ ID NO: 733507 - DNA, 25 bp, Mus musculus
gtttgcttcagcgatcgggatgcca

SEQ ID NO: 733508 - DNA, 25 bp, Mus musculus
gtttgctttacacatgggctttgct

SEQ ID NO: 733509 - DNA, 25 bp, Mus musculus
gtttgctttacagatgggctttgct

SEQ ID NO: 733510 - DNA, 25 bp, Mus musculus
gtttgctttagactcaccacccata

SEQ ID NO: 733511 - DNA, 25 bp, Mus musculus
gtttgctttagagtcaccacccata

SEQ ID NO: 733512 - DNA, 25 bp, Mus musculus
gtttggaaataaccaggacagtgcc

SEQ ID NO: 733513 - DNA, 25 bp, Mus musculus
gtttggaaataagcaggacagtgcc

SEQ ID NO: 733514 - DNA, 25 bp, Mus musculus
gtttggaaattacgtcattcagaag

SEQ ID NO: 733515 - DNA, 25 bp, Mus musculus
gtttggaaattaggtcattcagaag

SEQ ID NO: 733516 - DNA, 25 bp, Mus musculus
gtttggaaggtacatcccaccagcc

SEQ ID NO: 733517 - DNA, 25 bp, Mus musculus
gtttggaaggtagatcccaccagcc

SEQ ID NO: 733518 - DNA, 25 bp, Mus musculus
gtttggaatgggatgacatctcgga

SEQ ID NO: 733519 - DNA, 25 bp, Mus musculus
gtttggaatgggttgacatctcgga

SEQ ID NO: 733520 - DNA, 25 bp, Mus musculus
gtttggacaatcaatctcaggacaa

SEQ ID NO: 733521 - DNA, 25 bp, Mus musculus
gtttggacaatctatctcaggacaa

SEQ ID NO: 733522 - DNA, 25 bp, Mus musculus
gtttggacagcaagactggaagttc

SEQ ID NO: 733523 - DNA, 25 bp, Mus musculus
gtttggacagcatgactggaagttc

SEQ ID NO: 733524 - DNA, 25 bp, Mus musculus
gtttggaccatgattctcccgggca

SEQ ID NO: 733525 - DNA, 25 bp, Mus musculus
gtttggaccatgtttctcccgggca

SEQ ID NO: 733526 - DNA, 25 bp, Mus musculus
gtttggactcctaccactgagcatg

SEQ ID NO: 733527 - DNA, 25 bp, Mus musculus
gtttggactccttccactgagcatg

SEQ ID NO: 733528 - DNA, 25 bp, Mus musculus
gtttggactcggcacagcccatgat

SEQ ID NO: 733529 - DNA, 25 bp, Mus musculus
gtttggactcgggacagcccatgat

SEQ ID NO: 733530 - DNA, 25 bp, Mus musculus
gtttggagacagcatgttctaccgg

SEQ ID NO: 733531 - DNA, 25 bp, Mus musculus
gtttggagacaggatgttctaccgg

SEQ ID NO: 733532 - DNA, 25 bp, Mus musculus
gtttggagaggtagttgactgtaca

SEQ ID NO: 733533 - DNA, 25 bp, Mus musculus
gtttggagaggttgttgactgtaca

SEQ ID NO: 733534 - DNA, 25 bp, Mus musculus
gtttggagcaagagctgggactact

SEQ ID NO: 733535 - DNA, 25 bp, Mus musculus
gtttggagcaagtgctgggactact

SEQ ID NO: 733536 - DNA, 25 bp, Mus musculus
gtttggagccaacgcccagcttgag

SEQ ID NO: 733537 - DNA, 25 bp, Mus musculus
gtttggagccaaggcccagcttgag

SEQ ID NO: 733538 - DNA, 25 bp, Mus musculus
gtttggagtcgacattcaggaataa

SEQ ID NO: 733539 - DNA, 25 bp, Mus musculus
gtttggagtcgagattcaggaataa

SEQ ID NO: 733540 - DNA, 25 bp, Mus musculus
gtttggagttccctatgtctatacc

SEQ ID NO: 733541 - DNA, 25 bp, Mus musculus
gtttggagttccgtatgtctatacc

SEQ ID NO: 733542 - DNA, 25 bp, Mus musculus
gtttggatggtgcaacggattttaa

SEQ ID NO: 733543 - DNA, 25 bp, Mus musculus
gtttggatggtggaacggattttaa

SEQ ID NO: 733544 - DNA, 25 bp, Mus musculus
gtttggattccactaccgaagccta

SEQ ID NO: 733545 - DNA, 25 bp, Mus musculus
gtttggattccagtaccgaagccta

SEQ ID NO: 733546 - DNA, 25 bp, Mus musculus
gtttggcaaatcaatcgatgtcatt

SEQ ID NO: 733547 - DNA, 25 bp, Mus musculus
gtttggcaaatctatcgatgtcatt

SEQ ID NO: 733548 - DNA, 25 bp, Mus musculus
gtttggcacagaacatatctatggg

SEQ ID NO: 733549 - DNA, 25 bp, Mus musculus
gtttggcacagatcatatctatggg

SEQ ID NO: 733550 - DNA, 25 bp, Mus musculus
gtttggcacagccatgacccggcaa

SEQ ID NO: 733551 - DNA, 25 bp, Mus musculus
gtttggcacagcgatgacccggcaa

SEQ ID NO: 733552 - DNA, 25 bp, Mus musculus
gtttggcagagtcttttcattcctt

SEQ ID NO: 733553 - DNA, 25 bp, Mus musculus
gtttggcagagtgttttcattcctt

SEQ ID NO: 733554 - DNA, 25 bp, Mus musculus
gtttggcagcatccggcagacatac

SEQ ID NO: 733555 - DNA, 25 bp, Mus musculus
gtttggcagcatgcggcagacatac

SEQ ID NO: 733556 - DNA, 25 bp, Mus musculus
gtttggcagcggagcagggacatct

SEQ ID NO: 733557 - DNA, 25 bp, Mus musculus
gtttggcagcggtgcagggacatct

SEQ ID NO: 733558 - DNA, 25 bp, Mus musculus
gtttggcattgaccccaatgctgag

SEQ ID NO: 733559 - DNA, 25 bp, Mus musculus
gtttggcattgagcccaatgctgag

SEQ ID NO: 733560 - DNA, 25 bp, Mus musculus
gtttggccgattccgtcttcccagc

SEQ ID NO: 733561 - DNA, 25 bp, Mus musculus
gtttggccgattgcgtcttcccagc

SEQ ID NO: 733562 - DNA, 25 bp, Mus musculus
gtttggccgcaaccccatcctgacc

SEQ ID NO: 733563 - DNA, 25 bp, Mus musculus
gtttggccgcaagcccatcctgacc

SEQ ID NO: 733564 - DNA, 25 bp, Mus musculus
gtttggcctcacaaggactaccctc

SEQ ID NO: 733565 - DNA, 25 bp, Mus musculus
gtttggcctcactaggactaccctc

SEQ ID NO: 733566 - DNA, 25 bp, Mus musculus
gtttggctctcactaacctgttttc

SEQ ID NO: 733567 - DNA, 25 bp, Mus musculus
gtttggctctcagtaacctgttttc

SEQ ID NO: 733568 - DNA, 25 bp, Mus musculus
gtttggctctccctgcctgcagtga

SEQ ID NO: 733569 - DNA, 25 bp, Mus musculus
gtttggctctccgtgcctgcagtga

SEQ ID NO: 733570 - DNA, 25 bp, Mus musculus
gtttggctgccccagtgagactgat

SEQ ID NO: 733571 - DNA, 25 bp, Mus musculus
gtttggctgcccgagtgagactgat

SEQ ID NO: 733572 - DNA, 25 bp, Mus musculus
gtttggctgtgactttagtctgaac

SEQ ID NO: 733573 - DNA, 25 bp, Mus musculus
gtttggctgtgagtttagtctgaac

SEQ ID NO: 733574 - DNA, 25 bp, Mus musculus
gtttgggatcatcagaagactccta

SEQ ID NO: 733575 - DNA, 25 bp, Mus musculus
gtttgggatcatgagaagactccta

SEQ ID NO: 733576 - DNA, 25 bp, Mus musculus
gtttgggatgttcgaacaaggacct

SEQ ID NO: 733577 - DNA, 25 bp, Mus musculus
gtttgggatgttggaacaaggacct

SEQ ID NO: 733578 - DNA, 25 bp, Mus musculus
gtttgggcaccaactgcctatctgc

SEQ ID NO: 733579 - DNA, 25 bp, Mus musculus
gtttgggcaccatctgcctatctgc

SEQ ID NO: 733580 - DNA, 25 bp, Mus musculus
gtttgggtttgacatcacccacgag

SEQ ID NO: 733581 - DNA, 25 bp, Mus musculus
gtttgggtttgagatcacccacgag

SEQ ID NO: 733582 - DNA, 25 bp, Mus musculus
gtttggtcacatcaagattgtagcc

SEQ ID NO: 733583 - DNA, 25 bp, Mus musculus
gtttggtcacatgaagattgtagcc

SEQ ID NO: 733584 - DNA, 25 bp, Mus musculus
gtttggtcacttaaaagccgcataa

SEQ ID NO: 733585 - DNA, 25 bp, Mus musculus
gtttggtcactttaaagccgcataa

SEQ ID NO: 733586 - DNA, 25 bp, Mus musculus
gtttggtctcgacatcaaaggcaga

SEQ ID NO: 733587 - DNA, 25 bp, Mus musculus
gtttggtctcgagatcaaaggcaga

SEQ ID NO: 733588 - DNA, 25 bp, Mus musculus
gtttggtctgaaaggcccctcctga

SEQ ID NO: 733589 - DNA, 25 bp, Mus musculus
gtttggtctgaatggcccctcctga

SEQ ID NO: 733590 - DNA, 25 bp, Mus musculus
gtttggtgtactattcatcgtccag

SEQ ID NO: 733591 - DNA, 25 bp, Mus musculus
gtttggtgtacttttcatcgtccag

SEQ ID NO: 733592 - DNA, 25 bp, Mus musculus
gtttggttccctcctcagctgcgcg

SEQ ID NO: 733593 - DNA, 25 bp, Mus musculus
gtttggttccctgctcagctgcgcg

SEQ ID NO: 733594 - DNA, 25 bp, Mus musculus
gtttgtaaatccatagacgcttgag

SEQ ID NO: 733595 - DNA, 25 bp, Mus musculus
gtttgtaaatccttagacgcttgag

SEQ ID NO: 733596 - DNA, 25 bp, Mus musculus
gtttgtaaggaacgcgataactgtc

SEQ ID NO: 733597 - DNA, 25 bp, Mus musculus
gtttgtaaggaaggcgataactgtc

SEQ ID NO: 733598 - DNA, 25 bp, Mus musculus
gtttgtacaactaaggccacaccag

SEQ ID NO: 733599 - DNA, 25 bp, Mus musculus
gtttgtacaacttaggccacaccag

SEQ ID NO: 733600 - DNA, 25 bp, Mus musculus
gtttgtacaccgaaggaatcctgat

SEQ ID NO: 733601 - DNA, 25 bp, Mus musculus
gtttgtacaccgtaggaatcctgat

SEQ ID NO: 733602 - DNA, 25 bp, Mus musculus
gtttgtacacggacccctgtgggat

SEQ ID NO: 733603 - DNA, 25 bp, Mus musculus
gtttgtacacggtcccctgtgggat

SEQ ID NO: 733604 - DNA, 25 bp, Mus musculus
gtttgtacagcgcaatgcctcgaga

SEQ ID NO: 733605 - DNA, 25 bp, Mus musculus
gtttgtacagcggaatgcctcgaga

SEQ ID NO: 733606 - DNA, 25 bp, Mus musculus
gtttgtacattcacttttaccccag

SEQ ID NO: 733607 - DNA, 25 bp, Mus musculus
gtttgtacattctcttttaccccag

SEQ ID NO: 733608 - DNA, 25 bp, Mus musculus
gtttgtactgagacccctgctgtgg

SEQ ID NO: 733609 - DNA, 25 bp, Mus musculus
gtttgtactgagtcccctgctgtgg

SEQ ID NO: 733610 - DNA, 25 bp, Mus musculus
gtttgtatggagagactctaccaga

SEQ ID NO: 733611 - DNA, 25 bp, Mus musculus
gtttgtatggagtgactctaccaga

SEQ ID NO: 733612 - DNA, 25 bp, Mus musculus
gtttgtcaaaggactgtctgaggat

SEQ ID NO: 733613 - DNA, 25 bp, Mus musculus
gtttgtcaaaggtctgtctgaggat

SEQ ID NO: 733614 - DNA, 25 bp, Mus musculus
gtttgtcactcgaccctccggaatc

SEQ ID NO: 733615 - DNA, 25 bp, Mus musculus
gtttgtcactcgtccctccggaatc

SEQ ID NO: 733616 - DNA, 25 bp, Mus musculus
gtttgtccacggagaaagcttgcag

SEQ ID NO: 733617 - DNA, 25 bp, Mus musculus
gtttgtccacggtgaaagcttgcag

SEQ ID NO: 733618 - DNA, 25 bp, Mus musculus
gtttgtcctaccctgcattcagcaa

SEQ ID NO: 733619 - DNA, 25 bp, Mus musculus
gtttgtcctaccgtgcattcagcaa

SEQ ID NO: 733620 - DNA, 25 bp, Mus musculus
gtttgtctgataaccatccgaggtc

SEQ ID NO: 733621 - DNA, 25 bp, Mus musculus
gtttgtctgatatccatccgaggtc

SEQ ID NO: 733622 - DNA, 25 bp, Mus musculus
gtttgtgaattcagactacgaactc

SEQ ID NO: 733623 - DNA, 25 bp, Mus musculus
gtttgtgaattctgactacgaactc

SEQ ID NO: 733624 - DNA, 25 bp, Mus musculus
gtttgtgacaccacatcctcgaagg

SEQ ID NO: 733625 - DNA, 25 bp, Mus musculus
gtttgtgacacctcatcctcgaagg

SEQ ID NO: 733626 - DNA, 25 bp, Mus musculus
gtttgtgacatactaggtgacaccc

SEQ ID NO: 733627 - DNA, 25 bp, Mus musculus
gtttgtgacatagtaggtgacaccc

SEQ ID NO: 733628 - DNA, 25 bp, Mus musculus
gtttgtgacgtcatccttcgagcgg

SEQ ID NO: 733629 - DNA, 25 bp, Mus musculus
gtttgtgacgtcttccttcgagcgg

SEQ ID NO: 733630 - DNA, 25 bp, Mus musculus
gtttgtgagatgatccagaagtctg

SEQ ID NO: 733631 - DNA, 25 bp, Mus musculus
gtttgtgagatgttccagaagtctg

SEQ ID NO: 733632 - DNA, 25 bp, Mus musculus
gtttgtgatcctcagagatgagaag

SEQ ID NO: 733633 - DNA, 25 bp, Mus musculus
gtttgtgatcctgagagatgagaag

SEQ ID NO: 733634 - DNA, 25 bp, Mus musculus
gtttgtgcaccacaggcattcagtg

SEQ ID NO: 733635 - DNA, 25 bp, Mus musculus
gtttgtgcaccagaggcattcagtg

SEQ ID NO: 733636 - DNA, 25 bp, Mus musculus
gtttgtgccagactctacatctaca

SEQ ID NO: 733637 - DNA, 25 bp, Mus musculus
gtttgtgccagagtctacatctaca

SEQ ID NO: 733638 - DNA, 25 bp, Mus musculus
gtttgtgccggtacattcattctga

SEQ ID NO: 733639 - DNA, 25 bp, Mus musculus
gtttgtgccggttcattcattctga

SEQ ID NO: 733640 - DNA, 25 bp, Mus musculus
gtttgtgctcgaagaggactcctac

SEQ ID NO: 733641 - DNA, 25 bp, Mus musculus
gtttgtgctcgatgaggactcctac

SEQ ID NO: 733642 - DNA, 25 bp, Mus musculus
gtttgtggacatcctacctgtggag

SEQ ID NO: 733643 - DNA, 25 bp, Mus musculus
gtttgtggacatgctacctgtggag

SEQ ID NO: 733644 - DNA, 25 bp, Mus musculus
gtttgtggagaactgctctcccatt

SEQ ID NO: 733645 - DNA, 25 bp, Mus musculus
gtttgtggagaagtgctctcccatt

SEQ ID NO: 733646 - DNA, 25 bp, Mus musculus
gtttgtggcttacaaagcgtttctg

SEQ ID NO: 733647 - DNA, 25 bp, Mus musculus
gtttgtggcttagaaagcgtttctg

SEQ ID NO: 733648 - DNA, 25 bp, Mus musculus
gtttgtggtgaactttcagaacagc

SEQ ID NO: 733649 - DNA, 25 bp, Mus musculus
gtttgtggtgaagtttcagaacagc

SEQ ID NO: 733650 - DNA, 25 bp, Mus musculus
gtttgtgtctctcacattgtcaaca

SEQ ID NO: 733651 - DNA, 25 bp, Mus musculus
gtttgtgtctctgacattgtcaaca

SEQ ID NO: 733652 - DNA, 25 bp, Mus musculus
gtttgttcagaacctacagagtgca

SEQ ID NO: 733653 - DNA, 25 bp, Mus musculus
gtttgttcagaagctacagagtgca

SEQ ID NO: 733654 - DNA, 25 bp, Mus musculus
gtttgttcagctcaacatctgccag

SEQ ID NO: 733655 - DNA, 25 bp, Mus musculus
gtttgttcagctgaacatctgccag

SEQ ID NO: 733656 - DNA, 25 bp, Mus musculus
gtttgttcctgaacagaaggaagag

SEQ ID NO: 733657 - DNA, 25 bp, Mus musculus
gtttgttcctgatcagaaggaagag

SEQ ID NO: 733658 - DNA, 25 bp, Mus musculus
gtttgttgccatcctacccaaggag

SEQ ID NO: 733659 - DNA, 25 bp, Mus musculus
gtttgttgccatgctacccaaggag

SEQ ID NO: 733660 - DNA, 25 bp, Mus musculus
gtttgttgctcaatggaatattgcc

SEQ ID NO: 733661 - DNA, 25 bp, Mus musculus
gtttgttgctcattggaatattgcc

SEQ ID NO: 733662 - DNA, 25 bp, Mus musculus
gtttgttggctaaggtctcatgtag

SEQ ID NO: 733663 - DNA, 25 bp, Mus musculus
gtttgttggctatggtctcatgtag

SEQ ID NO: 733664 - DNA, 25 bp, Mus musculus
gtttgttgtctcatgtgtccctagc

SEQ ID NO: 733665 - DNA, 25 bp, Mus musculus
gtttgttgtctcttgtgtccctagc

SEQ ID NO: 733666 - DNA, 25 bp, Mus musculus
gtttgttttcctctccattccctcg

SEQ ID NO: 733667 - DNA, 25 bp, Mus musculus
gtttgttttcctgtccattccctcg

SEQ ID NO: 733668 - DNA, 25 bp, Mus musculus
gtttgttttctaccacccagataga

SEQ ID NO: 733669 - DNA, 25 bp, Mus musculus
gtttgttttctagcacccagataga

SEQ ID NO: 733670 - DNA, 25 bp, Mus musculus
gttttaaaattcaacttcgccagtg

SEQ ID NO: 733671 - DNA, 25 bp, Mus musculus
gttttaaaattctacttcgccagtg

SEQ ID NO: 733672 - DNA, 25 bp, Mus musculus
gttttaactaatccctgactttgcc

SEQ ID NO: 733673 - DNA, 25 bp, Mus musculus
gttttaactaatgcctgactttgcc

SEQ ID NO: 733674 - DNA, 25 bp, Mus musculus
gttttaccaaacagcctcattcatg

SEQ ID NO: 733675 - DNA, 25 bp, Mus musculus
gttttaccaaactgcctcattcatg

SEQ ID NO: 733676 - DNA, 25 bp, Mus musculus
gttttaccaggcacactaccagctg

SEQ ID NO: 733677 - DNA, 25 bp, Mus musculus
gttttaccaggctcactaccagctg

SEQ ID NO: 733678 - DNA, 25 bp, Mus musculus
gttttaccccacagatcctggcggc

SEQ ID NO: 733679 - DNA, 25 bp, Mus musculus
gttttaccccactgatcctggcggc

SEQ ID NO: 733680 - DNA, 25 bp, Mus musculus
gttttaccctgaactgaagctagct

SEQ ID NO: 733681 - DNA, 25 bp, Mus musculus
gttttaccctgatctgaagctagct

SEQ ID NO: 733682 - DNA, 25 bp, Mus musculus
gttttactaagcatcgtctttcagc

SEQ ID NO: 733683 - DNA, 25 bp, Mus musculus
gttttactaagcttcgtctttcagc

SEQ ID NO: 733684 - DNA, 25 bp, Mus musculus
gttttactatgactggagaacccca

SEQ ID NO: 733685 - DNA, 25 bp, Mus musculus
gttttactatgagtggagaacccca

SEQ ID NO: 733686 - DNA, 25 bp, Mus musculus
gttttactgaaaactcagaagggag

SEQ ID NO: 733687 - DNA, 25 bp, Mus musculus
gttttactgaaatctcagaagggag

SEQ ID NO: 733688 - DNA, 25 bp, Mus musculus
gttttactgcaaagacgagagcatc

SEQ ID NO: 733689 - DNA, 25 bp, Mus musculus
gttttactgcaatgacgagagcatc

SEQ ID NO: 733690 - DNA, 25 bp, Mus musculus
gttttactggaaagccctgctggcc

SEQ ID NO: 733691 - DNA, 25 bp, Mus musculus
gttttactggaatgccctgctggcc

SEQ ID NO: 733692 - DNA, 25 bp, Mus musculus
gttttagaagagcagaatcttgctg

SEQ ID NO: 733693 - DNA, 25 bp, Mus musculus
gttttagaagaggagaatcttgctg

SEQ ID NO: 733694 - DNA, 25 bp, Mus musculus
gttttagcccaacgaatcagtgacc

SEQ ID NO: 733695 - DNA, 25 bp, Mus musculus
gttttagcccaaggaatcagtgacc

SEQ ID NO: 733696 - DNA, 25 bp, Mus musculus
gttttaggcattagtgatcggcaca

SEQ ID NO: 733697 - DNA, 25 bp, Mus musculus
gttttaggcatttgtgatcggcaca

SEQ ID NO: 733698 - DNA, 25 bp, Mus musculus
gttttataaagcaatgggaaatcca

SEQ ID NO: 733699 - DNA, 25 bp, Mus musculus
gttttataaagctatgggaaatcca

SEQ ID NO: 733700 - DNA, 25 bp, Mus musculus
gttttatacccactaacaagtgaat

SEQ ID NO: 733701 - DNA, 25 bp, Mus musculus
gttttatacccagtaacaagtgaat

SEQ ID NO: 733702 - DNA, 25 bp, Mus musculus
gttttatcagctagtaagtaccgag

SEQ ID NO: 733703 - DNA, 25 bp, Mus musculus
gttttatcagcttgtaagtaccgag

SEQ ID NO: 733704 - DNA, 25 bp, Mus musculus
gttttatctgtacacagccgtgctg

SEQ ID NO: 733705 - DNA, 25 bp, Mus musculus
gttttatctgtagacagccgtgctg

SEQ ID NO: 733706 - DNA, 25 bp, Mus musculus
gttttatggaagaccttgggttatg

SEQ ID NO: 733707 - DNA, 25 bp, Mus musculus
gttttatggaagtccttgggttatg

SEQ ID NO: 733708 - DNA, 25 bp, Mus musculus
gttttattacctcacccatgatggg

SEQ ID NO: 733709 - DNA, 25 bp, Mus musculus
gttttattacctgacccatgatggg

SEQ ID NO: 733710 - DNA, 25 bp, Mus musculus
gttttattacgacaatgagcttgga

SEQ ID NO: 733711 - DNA, 25 bp, Mus musculus
gttttattacgagaatgagcttgga

SEQ ID NO: 733712 - DNA, 25 bp, Mus musculus
gttttatttaagagacgcgtctttg

SEQ ID NO: 733713 - DNA, 25 bp, Mus musculus
gttttatttaagtgacgcgtctttg

SEQ ID NO: 733714 - DNA, 25 bp, Mus musculus
gttttatttcataccagtggctacg

SEQ ID NO: 733715 - DNA, 25 bp, Mus musculus
gttttatttcattccagtggctacg

SEQ ID NO: 733716 - DNA, 25 bp, Mus musculus
gttttcacaccacagaaatccctag

SEQ ID NO: 733717 - DNA, 25 bp, Mus musculus
gttttcacaccagagaaatccctag

SEQ ID NO: 733718 - DNA, 25 bp, Mus musculus
gttttcacgaagaacctgaattttg

SEQ ID NO: 733719 - DNA, 25 bp, Mus musculus
gttttcacgaagtacctgaattttg

SEQ ID NO: 733720 - DNA, 25 bp, Mus musculus
gttttcactggaagagttacaagtg

SEQ ID NO: 733721 - DNA, 25 bp, Mus musculus
gttttcactggatgagttacaagtg

SEQ ID NO: 733722 - DNA, 25 bp, Mus musculus
gttttcagagcacagctatcacggc

SEQ ID NO: 733723 - DNA, 25 bp, Mus musculus
gttttcagagcagagctatcacggc

SEQ ID NO: 733724 - DNA, 25 bp, Mus musculus
gttttcagatagaagctttgcccag

SEQ ID NO: 733725 - DNA, 25 bp, Mus musculus
gttttcagatagtagctttgcccag

SEQ ID NO: 733726 - DNA, 25 bp, Mus musculus
gttttcaggacaccgaaactctgga

SEQ ID NO: 733727 - DNA, 25 bp, Mus musculus
gttttcaggacagcgaaactctgga

SEQ ID NO: 733728 - DNA, 25 bp, Mus musculus
gttttcatggttcgtaaatcgtatc

SEQ ID NO: 733729 - DNA, 25 bp, Mus musculus
gttttcatggttggtaaatcgtatc

SEQ ID NO: 733730 - DNA, 25 bp, Mus musculus
gttttcattgacatctccctagccc

SEQ ID NO: 733731 - DNA, 25 bp, Mus musculus
gttttcattgacttctccctagccc

SEQ ID NO: 733732 - DNA, 25 bp, Mus musculus
gttttccaaggcagtggccctccga

SEQ ID NO: 733733 - DNA, 25 bp, Mus musculus
gttttccaaggctgtggccctccga

SEQ ID NO: 733734 - DNA, 25 bp, Mus musculus
gttttccatcctcttagaatctggc

SEQ ID NO: 733735 - DNA, 25 bp, Mus musculus
gttttccatcctgttagaatctggc

SEQ ID NO: 733736 - DNA, 25 bp, Mus musculus
gttttccatctcctccagagaaact

SEQ ID NO: 733737 - DNA, 25 bp, Mus musculus
gttttccatctcgtccagagaaact

SEQ ID NO: 733738 - DNA, 25 bp, Mus musculus
gttttcccctatctaggtgaatatg

SEQ ID NO: 733739 - DNA, 25 bp, Mus musculus
gttttcccctatgtaggtgaatatg

SEQ ID NO: 733740 - DNA, 25 bp, Mus musculus
gttttccgagctccaggacaccagt

SEQ ID NO: 733741 - DNA, 25 bp, Mus musculus
gttttccgagctgcaggacaccagt

SEQ ID NO: 733742 - DNA, 25 bp, Mus musculus
gttttccgcatgctcaagcagggag

SEQ ID NO: 733743 - DNA, 25 bp, Mus musculus
gttttccgcatggtcaagcagggag

SEQ ID NO: 733744 - DNA, 25 bp, Mus musculus
gttttccgctgtctccccatctttg

SEQ ID NO: 733745 - DNA, 25 bp, Mus musculus
gttttccgctgtgtccccatctttg

SEQ ID NO: 733746 - DNA, 25 bp, Mus musculus
gttttcctgaacatctatgagcctg

SEQ ID NO: 733747 - DNA, 25 bp, Mus musculus
gttttcctgaacttctatgagcctg

SEQ ID NO: 733748 - DNA, 25 bp, Mus musculus
gttttcggaggaccaggttttacag

SEQ ID NO: 733749 - DNA, 25 bp, Mus musculus
gttttcggaggagcaggttttacag

SEQ ID NO: 733750 - DNA, 25 bp, Mus musculus
gttttctcaaaacctggcagcttgt

SEQ ID NO: 733751 - DNA, 25 bp, Mus musculus
gttttctcaaaagctggcagcttgt

SEQ ID NO: 733752 - DNA, 25 bp, Mus musculus
gttttctcagccctctcagatcagc

SEQ ID NO: 733753 - DNA, 25 bp, Mus musculus
gttttctcagccgtctcagatcagc

SEQ ID NO: 733754 - DNA, 25 bp, Mus musculus
gttttctccacccaggtgcctggaa

SEQ ID NO: 733755 - DNA, 25 bp, Mus musculus
gttttctccaccgaggtgcctggaa

SEQ ID NO: 733756 - DNA, 25 bp, Mus musculus
gttttctccctcacgtgggccaggg

SEQ ID NO: 733757 - DNA, 25 bp, Mus musculus
gttttctccctctcgtgggccaggg

SEQ ID NO: 733758 - DNA, 25 bp, Mus musculus
gttttctctgaaatccatcctctca

SEQ ID NO: 733759 - DNA, 25 bp, Mus musculus
gttttctctgaattccatcctctca

SEQ ID NO: 733760 - DNA, 25 bp, Mus musculus
gttttctctgtcaagtactgcagtc

SEQ ID NO: 733761 - DNA, 25 bp, Mus musculus
gttttctctgtctagtactgcagtc

SEQ ID NO: 733762 - DNA, 25 bp, Mus musculus
gttttctgaaatcaacccaaacatg

SEQ ID NO: 733763 - DNA, 25 bp, Mus musculus
gttttctgaaatgaacccaaacatg

SEQ ID NO: 733764 - DNA, 25 bp, Mus musculus
gttttctgcttgctcgccgcagccg

SEQ ID NO: 733765 - DNA, 25 bp, Mus musculus
gttttctgcttggtcgccgcagccg

SEQ ID NO: 733766 - DNA, 25 bp, Mus musculus
gttttcttccgccagacttggactg

SEQ ID NO: 733767 - DNA, 25 bp, Mus musculus
gttttcttccgcgagacttggactg

SEQ ID NO: 733768 - DNA, 25 bp, Mus musculus
gttttcttgcataaaagtcaaactt

SEQ ID NO: 733769 - DNA, 25 bp, Mus musculus
gttttcttgcattaaagtcaaactt

SEQ ID NO: 733770 - DNA, 25 bp, Mus musculus
gttttcttggaacggctccatcatc

SEQ ID NO: 733771 - DNA, 25 bp, Mus musculus
gttttcttggaagggctccatcatc

SEQ ID NO: 733772 - DNA, 25 bp, Mus musculus
gttttgagacaccacataggctctg

SEQ ID NO: 733773 - DNA, 25 bp, Mus musculus
gttttgagacacgacataggctctg

SEQ ID NO: 733774 - DNA, 25 bp, Mus musculus
gttttgagtactaacaagaagccag

SEQ ID NO: 733775 - DNA, 25 bp, Mus musculus
gttttgagtacttacaagaagccag

SEQ ID NO: 733776 - DNA, 25 bp, Mus musculus
gttttgagtcacaacgtagccctga

SEQ ID NO: 733777 - DNA, 25 bp, Mus musculus
gttttgagtcactacgtagccctga

SEQ ID NO: 733778 - DNA, 25 bp, Mus musculus
gttttgatgatgaaatcaccattca

SEQ ID NO: 733779 - DNA, 25 bp, Mus musculus
gttttgatgatgtaatcaccattca

SEQ ID NO: 733780 - DNA, 25 bp, Mus musculus
gttttgattgcgcacgttctgagcg

SEQ ID NO: 733781 - DNA, 25 bp, Mus musculus
gttttgattgcggacgttctgagcg

SEQ ID NO: 733782 - DNA, 25 bp, Mus musculus
gttttgcagtctccccgcaacagtg

SEQ ID NO: 733783 - DNA, 25 bp, Mus musculus
gttttgcagtctgcccgcaacagtg

SEQ ID NO: 733784 - DNA, 25 bp, Mus musculus
gttttgcccagaacatcagtccagc

SEQ ID NO: 733785 - DNA, 25 bp, Mus musculus
gttttgcccagatcatcagtccagc

SEQ ID NO: 733786 - DNA, 25 bp, Mus musculus
gttttgccgaatagacaagcccctg

SEQ ID NO: 733787 - DNA, 25 bp, Mus musculus
gttttgccgaattgacaagcccctg

SEQ ID NO: 733788 - DNA, 25 bp, Mus musculus
gttttgcctgatatgaaaagccttg

SEQ ID NO: 733789 - DNA, 25 bp, Mus musculus
gttttgcctgatttgaaaagccttg

SEQ ID NO: 733790 - DNA, 25 bp, Mus musculus
gttttgctagcacaggatccttggg

SEQ ID NO: 733791 - DNA, 25 bp, Mus musculus
gttttgctagcagaggatccttggg

SEQ ID NO: 733792 - DNA, 25 bp, Mus musculus
gttttgctcactagccagactgcaa

SEQ ID NO: 733793 - DNA, 25 bp, Mus musculus
gttttgctcacttgccagactgcaa

SEQ ID NO: 733794 - DNA, 25 bp, Mus musculus
gttttgctccggaatcgctgccggg

SEQ ID NO: 733795 - DNA, 25 bp, Mus musculus
gttttgctccggtatcgctgccggg

SEQ ID NO: 733796 - DNA, 25 bp, Mus musculus
gttttgctggacagaactgtgaaga

SEQ ID NO: 733797 - DNA, 25 bp, Mus musculus
gttttgctggactgaactgtgaaga

SEQ ID NO: 733798 - DNA, 25 bp, Mus musculus
gttttgctgtcaatggatcgtcgtc

SEQ ID NO: 733799 - DNA, 25 bp, Mus musculus
gttttgctgtcattggatcgtcgtc

SEQ ID NO: 733800 - DNA, 25 bp, Mus musculus
gttttggacaacatctgggcatgtg

SEQ ID NO: 733801 - DNA, 25 bp, Mus musculus
gttttggacaacttctgggcatgtg

SEQ ID NO: 733802 - DNA, 25 bp, Mus musculus
gttttggcagccagatcgcttttgc

SEQ ID NO: 733803 - DNA, 25 bp, Mus musculus
gttttggcagcctgatcgcttttgc

SEQ ID NO: 733804 - DNA, 25 bp, Mus musculus
gttttggccactagaccaggcagct

SEQ ID NO: 733805 - DNA, 25 bp, Mus musculus
gttttggccacttgaccaggcagct

SEQ ID NO: 733806 - DNA, 25 bp, Mus musculus
gttttggccagccaagagcaacaga

SEQ ID NO: 733807 - DNA, 25 bp, Mus musculus
gttttggccagcgaagagcaacaga

SEQ ID NO: 733808 - DNA, 25 bp, Mus musculus
gttttgggacccaggtccgtcagca

SEQ ID NO: 733809 - DNA, 25 bp, Mus musculus
gttttgggaccctggtccgtcagca

SEQ ID NO: 733810 - DNA, 25 bp, Mus musculus
gttttgtaaaacaatgccatgaaca

SEQ ID NO: 733811 - DNA, 25 bp, Mus musculus
gttttgtaaaactatgccatgaaca

SEQ ID NO: 733812 - DNA, 25 bp, Mus musculus
gttttgtcaagactcaggaaggaga

SEQ ID NO: 733813 - DNA, 25 bp, Mus musculus
gttttgtcaagagtcaggaaggaga

SEQ ID NO: 733814 - DNA, 25 bp, Mus musculus
gttttgtcaggtcctccagcgcgtc

SEQ ID NO: 733815 - DNA, 25 bp, Mus musculus
gttttgtcaggtgctccagcgcgtc

SEQ ID NO: 733816 - DNA, 25 bp, Mus musculus
gttttgtcattaacagtacacccag

SEQ ID NO: 733817 - DNA, 25 bp, Mus musculus
gttttgtcattatcagtacacccag

SEQ ID NO: 733818 - DNA, 25 bp, Mus musculus
gttttgtcccacagcactggagcca

SEQ ID NO: 733819 - DNA, 25 bp, Mus musculus
gttttgtcccactgcactggagcca

SEQ ID NO: 733820 - DNA, 25 bp, Mus musculus
gttttgtgcctaagaaaattgctct

SEQ ID NO: 733821 - DNA, 25 bp, Mus musculus
gttttgtgcctatgaaaattgctct

SEQ ID NO: 733822 - DNA, 25 bp, Mus musculus
gttttgtggcgccttctgaaggtcc

SEQ ID NO: 733823 - DNA, 25 bp, Mus musculus
gttttgtggcgcgttctgaaggtcc

SEQ ID NO: 733824 - DNA, 25 bp, Mus musculus
gttttgttcaaaagctcagacttcg

SEQ ID NO: 733825 - DNA, 25 bp, Mus musculus
gttttgttcaaatgctcagacttcg

SEQ ID NO: 733826 - DNA, 25 bp, Mus musculus
gttttgttgtttcagctatccttaa

SEQ ID NO: 733827 - DNA, 25 bp, Mus musculus
gttttgttgtttgagctatccttaa

SEQ ID NO: 733828 - DNA, 25 bp, Mus musculus
gtttttaaccaaagagcagaagcct

SEQ ID NO: 733829 - DNA, 25 bp, Mus musculus
gtttttaaccaatgagcagaagcct

SEQ ID NO: 733830 - DNA, 25 bp, Mus musculus
gtttttacaaaaagacctcaggatt

SEQ ID NO: 733831 - DNA, 25 bp, Mus musculus
gtttttacaaaatgacctcaggatt

SEQ ID NO: 733832 - DNA, 25 bp, Mus musculus
gtttttacaggcaagaaactacatt

SEQ ID NO: 733833 - DNA, 25 bp, Mus musculus
gtttttacaggctagaaactacatt

SEQ ID NO: 733834 - DNA, 25 bp, Mus musculus
gtttttacggtgctgatcgagacgc

SEQ ID NO: 733835 - DNA, 25 bp, Mus musculus
gtttttacggtggtgatcgagacgc

SEQ ID NO: 733836 - DNA, 25 bp, Mus musculus
gtttttatatggatgcgtttatgcc

SEQ ID NO: 733837 - DNA, 25 bp, Mus musculus
gtttttatatggttgcgtttatgcc

SEQ ID NO: 733838 - DNA, 25 bp, Mus musculus
gtttttattcaacaggcccagcctg

SEQ ID NO: 733839 - DNA, 25 bp, Mus musculus
gtttttattcaagaggcccagcctg

SEQ ID NO: 733840 - DNA, 25 bp, Mus musculus
gtttttattcagactttggatgacc

SEQ ID NO: 733841 - DNA, 25 bp, Mus musculus
gtttttattcagtctttggatgacc

SEQ ID NO: 733842 - DNA, 25 bp, Mus musculus
gtttttatttcacggcagtaatgga

SEQ ID NO: 733843 - DNA, 25 bp, Mus musculus
gtttttatttcagggcagtaatgga

SEQ ID NO: 733844 - DNA, 25 bp, Mus musculus
gtttttcacattcgatcagaggatc

SEQ ID NO: 733845 - DNA, 25 bp, Mus musculus
gtttttcacattggatcagaggatc

SEQ ID NO: 733846 - DNA, 25 bp, Mus musculus
gtttttcatcttcgccgcctttgcc

SEQ ID NO: 733847 - DNA, 25 bp, Mus musculus
gtttttcatcttggccgcctttgcc

SEQ ID NO: 733848 - DNA, 25 bp, Mus musculus
gtttttcattggagcggctgtccta

SEQ ID NO: 733849 - DNA, 25 bp, Mus musculus
gtttttcattggtgcggctgtccta

SEQ ID NO: 733850 - DNA, 25 bp, Mus musculus
gtttttcattttctccctggcaggg

SEQ ID NO: 733851 - DNA, 25 bp, Mus musculus
gtttttcattttgtccctggcaggg

SEQ ID NO: 733852 - DNA, 25 bp, Mus musculus
gtttttccatcccaagccggtgccg

SEQ ID NO: 733853 - DNA, 25 bp, Mus musculus
gtttttccatccgaagccggtgccg

SEQ ID NO: 733854 - DNA, 25 bp, Mus musculus
gtttttcgctccagggtcatcgccg

SEQ ID NO: 733855 - DNA, 25 bp, Mus musculus
gtttttcgctcctgggtcatcgccg

SEQ ID NO: 733856 - DNA, 25 bp, Mus musculus
gtttttctcagcacagatgaagatg

SEQ ID NO: 733857 - DNA, 25 bp, Mus musculus
gtttttctcagcctgccgcctatgg

SEQ ID NO: 733858 - DNA, 25 bp, Mus musculus
gtttttctcagcgtgccgcctatgg

SEQ ID NO: 733859 - DNA, 25 bp, Mus musculus
gtttttctcagctcagatgaagatg

SEQ ID NO: 733860 - DNA, 25 bp, Mus musculus
gtttttctcttgagccttttggaag

SEQ ID NO: 733861 - DNA, 25 bp, Mus musculus
gtttttctcttgtgccttttggaag

SEQ ID NO: 733862 - DNA, 25 bp, Mus musculus
gtttttctggagagttagagctgag

SEQ ID NO: 733863 - DNA, 25 bp, Mus musculus
gtttttctggagtgttagagctgag

SEQ ID NO: 733864 - DNA, 25 bp, Mus musculus
gtttttcttacacgtgaagcaagat

SEQ ID NO: 733865 - DNA, 25 bp, Mus musculus
gtttttcttacaggtgaagcaagat

SEQ ID NO: 733866 - DNA, 25 bp, Mus musculus
gtttttgacattcgatcgtacacag

SEQ ID NO: 733867 - DNA, 25 bp, Mus musculus
gtttttgacattggatcgtacacag

SEQ ID NO: 733868 - DNA, 25 bp, Mus musculus
gtttttgagcttctatcagaggccc

SEQ ID NO: 733869 - DNA, 25 bp, Mus musculus
gtttttgagcttgtatcagaggccc

SEQ ID NO: 733870 - DNA, 25 bp, Mus musculus
gtttttgcagcaaccttcagtgaag

SEQ ID NO: 733871 - DNA, 25 bp, Mus musculus
gtttttgcagcatccttcagtgaag

SEQ ID NO: 733872 - DNA, 25 bp, Mus musculus
gtttttggttttcacttgaagccag

SEQ ID NO: 733873 - DNA, 25 bp, Mus musculus
gtttttggttttgacttgaagccag

SEQ ID NO: 733874 - DNA, 25 bp, Mus musculus
gttttttcaagacatgatgaccatg

SEQ ID NO: 733875 - DNA, 25 bp, Mus musculus
gttttttcaagagatgatgaccatg

SEQ ID NO: 733876 - DNA, 25 bp, Mus musculus
gttttttcgccgaggctgggtgact

SEQ ID NO: 733877 - DNA, 25 bp, Mus musculus
gttttttcgccgtggctgggtgact

SEQ ID NO: 733878 - DNA, 25 bp, Mus musculus
gttttttggtaaagaactcagcaca

SEQ ID NO: 733879 - DNA, 25 bp, Mus musculus
gttttttggtaatgaactcagcaca

SEQ ID NO: 733880 - DNA, 25 bp, Mus musculus
taaaaaacaagtagatgatcgaaag

SEQ ID NO: 733881 - DNA, 25 bp, Mus musculus
taaaaaacaagttgatgatcgaaag

SEQ ID NO: 733882 - DNA, 25 bp, Mus musculus
taaaaaacacgactgtaactcccag

SEQ ID NO: 733883 - DNA, 25 bp, Mus musculus
taaaaaacacgagtgtaactcccag

SEQ ID NO: 733884 - DNA, 25 bp, Mus musculus
taaaaaacctgacgacgctgcacct

SEQ ID NO: 733885 - DNA, 25 bp, Mus musculus
taaaaaacctgaggacgctgcacct

SEQ ID NO: 733886 - DNA, 25 bp, Mus musculus
taaaaaagactgctgtagactccac

SEQ ID NO: 733887 - DNA, 25 bp, Mus musculus
taaaaaagactggtgtagactccac

SEQ ID NO: 733888 - DNA, 25 bp, Mus musculus
taaaaaagcaatcgaagttccccat

SEQ ID NO: 733889 - DNA, 25 bp, Mus musculus
taaaaaagcaatggaagttccccat

SEQ ID NO: 733890 - DNA, 25 bp, Mus musculus
taaaaaagcactcaagacccaggga

SEQ ID NO: 733891 - DNA, 25 bp, Mus musculus
taaaaaagcactgaagacccaggga

SEQ ID NO: 733892 - DNA, 25 bp, Mus musculus
taaaaaagcataaactccagaaggg

SEQ ID NO: 733893 - DNA, 25 bp, Mus musculus
taaaaaagcatatactccagaaggg

SEQ ID NO: 733894 - DNA, 25 bp, Mus musculus
taaaaaagcccgaaatgcttatctc

SEQ ID NO: 733895 - DNA, 25 bp, Mus musculus
taaaaaagcccgtaatgcttatctc

SEQ ID NO: 733896 - DNA, 25 bp, Mus musculus
taaaaaaggcacacctcagcatctg

SEQ ID NO: 733897 - DNA, 25 bp, Mus musculus
taaaaaaggcactcctcagcatctg

SEQ ID NO: 733898 - DNA, 25 bp, Mus musculus
taaaaaagtatgaggatgatgccgg

SEQ ID NO: 733899 - DNA, 25 bp, Mus musculus
taaaaaagtatgtggatgatgccgg

SEQ ID NO: 733900 - DNA, 25 bp, Mus musculus
taaaaaagtgaacaatgagcaaact

SEQ ID NO: 733901 - DNA, 25 bp, Mus musculus
taaaaaagtgaagaatgagcaaact

SEQ ID NO: 733902 - DNA, 25 bp, Mus musculus
taaaaaatatgacctcgtggaggcg

SEQ ID NO: 733903 - DNA, 25 bp, Mus musculus
taaaaaatatgagctcgtggaggcg

SEQ ID NO: 733904 - DNA, 25 bp, Mus musculus
taaaaaattagaagccttgcttcag

SEQ ID NO: 733905 - DNA, 25 bp, Mus musculus
taaaaaattagatgccttgcttcag

SEQ ID NO: 733906 - DNA, 25 bp, Mus musculus
taaaaacaaggaagtggaggaccca

SEQ ID NO: 733907 - DNA, 25 bp, Mus musculus
taaaaacaaggatgtggaggaccca

SEQ ID NO: 733908 - DNA, 25 bp, Mus musculus
taaaaacaaggcaggacattaactc

SEQ ID NO: 733909 - DNA, 25 bp, Mus musculus
taaaaacaaggctggacattaactc

SEQ ID NO: 733910 - DNA, 25 bp, Mus musculus
taaaaacaatctactgacaaacaag

SEQ ID NO: 733911 - DNA, 25 bp, Mus musculus
taaaaacaatcttctgacaaacaag

SEQ ID NO: 733912 - DNA, 25 bp, Mus musculus
taaaaacaatgtaagtctggagggc

SEQ ID NO: 733913 - DNA, 25 bp, Mus musculus
taaaaacaatgttagtctggagggc

SEQ ID NO: 733914 - DNA, 25 bp, Mus musculus
taaaaacagaacacacaagcgcgag

SEQ ID NO: 733915 - DNA, 25 bp, Mus musculus
taaaaacagaactcacaagcgcgag

SEQ ID NO: 733916 - DNA, 25 bp, Mus musculus
taaaaacagccccaggctgtgcaag

SEQ ID NO: 733917 - DNA, 25 bp, Mus musculus
taaaaacagcccgaggctgtgcaag

SEQ ID NO: 733918 - DNA, 25 bp, Mus musculus
taaaaacagcctatctagtagatgg

SEQ ID NO: 733919 - DNA, 25 bp, Mus musculus
taaaaacagcctttctagtagatgg

SEQ ID NO: 733920 - DNA, 25 bp, Mus musculus
taaaaaccaactatttcattgtgtc

SEQ ID NO: 733921 - DNA, 25 bp, Mus musculus
taaaaaccaactttttcattgtgtc

SEQ ID NO: 733922 - DNA, 25 bp, Mus musculus
taaaaaccatatcaggacacctgcc

SEQ ID NO: 733923 - DNA, 25 bp, Mus musculus
taaaaaccatatgaggacacctgcc

SEQ ID NO: 733924 - DNA, 25 bp, Mus musculus
taaaaaccctgtaaaaatatcactg

SEQ ID NO: 733925 - DNA, 25 bp, Mus musculus
taaaaaccctgttaaaatatcactg

SEQ ID NO: 733926 - DNA, 25 bp, Mus musculus
taaaaacctgaaaggactgcatctc

SEQ ID NO: 733927 - DNA, 25 bp, Mus musculus
taaaaacctgaatggactgcatctc

SEQ ID NO: 733928 - DNA, 25 bp, Mus musculus
taaaaacctggaacaataagaagaa

SEQ ID NO: 733929 - DNA, 25 bp, Mus musculus
taaaaacctggatcaataagaagaa

SEQ ID NO: 733930 - DNA, 25 bp, Mus musculus
taaaaacgacaacgagcaccaacca

SEQ ID NO: 733931 - DNA, 25 bp, Mus musculus
taaaaacgacaaggagcaccaacca

SEQ ID NO: 733932 - DNA, 25 bp, Mus musculus
taaaaacgcttcactcctcaagtcc

SEQ ID NO: 733933 - DNA, 25 bp, Mus musculus
taaaaacgcttctctcctcaagtcc

SEQ ID NO: 733934 - DNA, 25 bp, Mus musculus
taaaaacggtttactgtgttcacag

SEQ ID NO: 733935 - DNA, 25 bp, Mus musculus
taaaaacggttttctgtgttcacag

SEQ ID NO: 733936 - DNA, 25 bp, Mus musculus
taaaaacgtcctcccattgggcaca

SEQ ID NO: 733937 - DNA, 25 bp, Mus musculus
taaaaacgtcctgccattgggcaca

SEQ ID NO: 733938 - DNA, 25 bp, Mus musculus
taaaaactctcaatcccaatgccag

SEQ ID NO: 733939 - DNA, 25 bp, Mus musculus
taaaaactctcattcccaatgccag

SEQ ID NO: 733940 - DNA, 25 bp, Mus musculus
taaaaactctggcactctgactagc

SEQ ID NO: 733941 - DNA, 25 bp, Mus musculus
taaaaactctgggactctgactagc

SEQ ID NO: 733942 - DNA, 25 bp, Mus musculus
taaaaactgttacggagagaatcac

SEQ ID NO: 733943 - DNA, 25 bp, Mus musculus
taaaaactgttagggagagaatcac

SEQ ID NO: 733944 - DNA, 25 bp, Mus musculus
taaaaactgttgctgtccgcatcgc

SEQ ID NO: 733945 - DNA, 25 bp, Mus musculus
taaaaactgttggtgtccgcatcgc

SEQ ID NO: 733946 - DNA, 25 bp, Mus musculus
taaaaagacttgctaaatttgcatg

SEQ ID NO: 733947 - DNA, 25 bp, Mus musculus
taaaaagacttggtaaatttgcatg

SEQ ID NO: 733948 - DNA, 25 bp, Mus musculus
taaaaagagagccacgggactgttc

SEQ ID NO: 733949 - DNA, 25 bp, Mus musculus
taaaaagagagcgacgggactgttc

SEQ ID NO: 733950 - DNA, 25 bp, Mus musculus
taaaaagagcctcaggtcatgcggt

SEQ ID NO: 733951 - DNA, 25 bp, Mus musculus
taaaaagagcctgaggtcatgcggt

SEQ ID NO: 733952 - DNA, 25 bp, Mus musculus
taaaaagcaagtctgaagagctgag

SEQ ID NO: 733953 - DNA, 25 bp, Mus musculus
taaaaagcaagtgtgaagagctgag

SEQ ID NO: 733954 - DNA, 25 bp, Mus musculus
taaaaagcagcgatcaataagctgt

SEQ ID NO: 733955 - DNA, 25 bp, Mus musculus
taaaaagcagcgttcaataagctgt

SEQ ID NO: 733956 - DNA, 25 bp, Mus musculus
taaaaagcatgaaatcccttgggaa

SEQ ID NO: 733957 - DNA, 25 bp, Mus musculus
taaaaagcatgatatcccttgggaa

SEQ ID NO: 733958 - DNA, 25 bp, Mus musculus
taaaaagccgccaagctgcaatatc

SEQ ID NO: 733959 - DNA, 25 bp, Mus musculus
taaaaagccgcctagctgcaatatc

SEQ ID NO: 733960 - DNA, 25 bp, Mus musculus
taaaaagcctttcactggcagcaaa

SEQ ID NO: 733961 - DNA, 25 bp, Mus musculus
taaaaagcctttgactggcagcaaa

SEQ ID NO: 733962 - DNA, 25 bp, Mus musculus
taaaaaggaaacactgacccctgct

SEQ ID NO: 733963 - DNA, 25 bp, Mus musculus
taaaaaggaaactctgacccctgct

SEQ ID NO: 733964 - DNA, 25 bp, Mus musculus
taaaaaggaagtcgagcggtctcga

SEQ ID NO: 733965 - DNA, 25 bp, Mus musculus
taaaaaggaagtggagcggtctcga

SEQ ID NO: 733966 - DNA, 25 bp, Mus musculus
taaaaaggaggaaatcgaatatggc

SEQ ID NO: 733967 - DNA, 25 bp, Mus musculus
taaaaaggaggatatcgaatatggc

SEQ ID NO: 733968 - DNA, 25 bp, Mus musculus
taaaaagggtcacagaattctcagc

SEQ ID NO: 733969 - DNA, 25 bp, Mus musculus
taaaaagggtcagagaattctcagc

SEQ ID NO: 733970 - DNA, 25 bp, Mus musculus
taaaaagggtgcatgaccactggcc

SEQ ID NO: 733971 - DNA, 25 bp, Mus musculus
taaaaagggtgcttgaccactggcc

SEQ ID NO: 733972 - DNA, 25 bp, Mus musculus
taaaaaggttatcaataccagtgaa

SEQ ID NO: 733973 - DNA, 25 bp, Mus musculus
taaaaaggttatgaataccagtgaa

SEQ ID NO: 733974 - DNA, 25 bp, Mus musculus
taaaaagtggttccacaggcccctt

SEQ ID NO: 733975 - DNA, 25 bp, Mus musculus
taaaaagtggttgcacaggcccctt

SEQ ID NO: 733976 - DNA, 25 bp, Mus musculus
taaaaagttagtcgaggttgccagg

SEQ ID NO: 733977 - DNA, 25 bp, Mus musculus
taaaaagttagtggaggttgccagg

SEQ ID NO: 733978 - DNA, 25 bp, Mus musculus
taaaaataacgactagtagtgacta

SEQ ID NO: 733979 - DNA, 25 bp, Mus musculus
taaaaataacgagtagtagtgacta

SEQ ID NO: 733980 - DNA, 25 bp, Mus musculus
taaaaataaggcagacaagaaggat

SEQ ID NO: 733981 - DNA, 25 bp, Mus musculus
taaaaataaggctgacaagaaggat

SEQ ID NO: 733982 - DNA, 25 bp, Mus musculus
taaaaataatagagggattgaaggc

SEQ ID NO: 733983 - DNA, 25 bp, Mus musculus
taaaaataatagtgggattgaaggc

SEQ ID NO: 733984 - DNA, 25 bp, Mus musculus
taaaaatactctcagcatcattcgc

SEQ ID NO: 733985 - DNA, 25 bp, Mus musculus
taaaaatactctgagcatcattcgc

SEQ ID NO: 733986 - DNA, 25 bp, Mus musculus
taaaaatagtggcatatgcttagca

SEQ ID NO: 733987 - DNA, 25 bp, Mus musculus
taaaaatagtgggatatgcttagca

SEQ ID NO: 733988 - DNA, 25 bp, Mus musculus
taaaaatagtttagctgtggcccct

SEQ ID NO: 733989 - DNA, 25 bp, Mus musculus
taaaaatagttttgctgtggcccct

SEQ ID NO: 733990 - DNA, 25 bp, Mus musculus
taaaaatatgctacaactcattggg

SEQ ID NO: 733991 - DNA, 25 bp, Mus musculus
taaaaatatgcttcaactcattggg

SEQ ID NO: 733992 - DNA, 25 bp, Mus musculus
taaaaatcagagctaactattgtgc

SEQ ID NO: 733993 - DNA, 25 bp, Mus musculus
taaaaatcagaggtaactattgtgc

SEQ ID NO: 733994 - DNA, 25 bp, Mus musculus
taaaaatcctagatgagaacttgcc

SEQ ID NO: 733995 - DNA, 25 bp, Mus musculus
taaaaatcctagttgagaacttgcc

SEQ ID NO: 733996 - DNA, 25 bp, Mus musculus
taaaaatcctgccacaagagtaagc

SEQ ID NO: 733997 - DNA, 25 bp, Mus musculus
taaaaatcctgcgacaagagtaagc

SEQ ID NO: 733998 - DNA, 25 bp, Mus musculus
taaaaatcgttcagcgaggagtgac

SEQ ID NO: 733999 - DNA, 25 bp, Mus musculus
taaaaatcgttctgcgaggagtgac

SEQ ID NO: 734000 - DNA, 25 bp, Mus musculus
taaaaatctcgcctcagctgctcct

SEQ ID NO: 734001 - DNA, 25 bp, Mus musculus
taaaaatctcgcgtcagctgctcct

SEQ ID NO: 734002 - DNA, 25 bp, Mus musculus
taaaaatctttgcagacctgatagt

SEQ ID NO: 734003 - DNA, 25 bp, Mus musculus
taaaaatctttggagacctgatagt

SEQ ID NO: 734004 - DNA, 25 bp, Mus musculus
taaaaatgaccgagtagctgggtgt

SEQ ID NO: 734005 - DNA, 25 bp, Mus musculus
taaaaatgaccgtgtagctgggtgt

SEQ ID NO: 734006 - DNA, 25 bp, Mus musculus
taaaaatgagagactggcagctatt

SEQ ID NO: 734007 - DNA, 25 bp, Mus musculus
taaaaatgagagtctggcagctatt

SEQ ID NO: 734008 - DNA, 25 bp, Mus musculus
taaaaatgcactaacttctcacatg

SEQ ID NO: 734009 - DNA, 25 bp, Mus musculus
taaaaatgcacttacttctcacatg

SEQ ID NO: 734010 - DNA, 25 bp, Mus musculus
taaaaatgccagcacggataactca

SEQ ID NO: 734011 - DNA, 25 bp, Mus musculus
taaaaatgccagcactgataacact

SEQ ID NO: 734012 - DNA, 25 bp, Mus musculus
taaaaatgccaggacggataactca

SEQ ID NO: 734013 - DNA, 25 bp, Mus musculus
taaaaatgccaggactgataacact

SEQ ID NO: 734014 - DNA, 25 bp, Mus musculus
taaaaatggaacagttaccttcagt

SEQ ID NO: 734015 - DNA, 25 bp, Mus musculus
taaaaatggaactgttaccttcagt

SEQ ID NO: 734016 - DNA, 25 bp, Mus musculus
taaaaatggtgcatcggtcttcagc

SEQ ID NO: 734017 - DNA, 25 bp, Mus musculus
taaaaatggtgcttcggtcttcagc

SEQ ID NO: 734018 - DNA, 25 bp, Mus musculus
taaaaatgtgagatgccgctagagt

SEQ ID NO: 734019 - DNA, 25 bp, Mus musculus
taaaaatgtgagttgccgctagagt

SEQ ID NO: 734020 - DNA, 25 bp, Mus musculus
taaaaatgtgtcaaatgtcctcagt

SEQ ID NO: 734021 - DNA, 25 bp, Mus musculus
taaaaatgtgtctaatgtcctcagt

SEQ ID NO: 734022 - DNA, 25 bp, Mus musculus
taaaaattcacgcaggccccaagtt

SEQ ID NO: 734023 - DNA, 25 bp, Mus musculus
taaaaattcacggaggccccaagtt

SEQ ID NO: 734024 - DNA, 25 bp, Mus musculus
taaaaattcagactctacaactgaa

SEQ ID NO: 734025 - DNA, 25 bp, Mus musculus
taaaaattcagagtctacaactgaa

SEQ ID NO: 734026 - DNA, 25 bp, Mus musculus
taaaaattcctgcatggctgcagat

SEQ ID NO: 734027 - DNA, 25 bp, Mus musculus
taaaaattcctggatggctgcagat

SEQ ID NO: 734028 - DNA, 25 bp, Mus musculus
taaaaatttcaacataacgtgtcca

SEQ ID NO: 734029 - DNA, 25 bp, Mus musculus
taaaaatttcaagataacgtgtcca

SEQ ID NO: 734030 - DNA, 25 bp, Mus musculus
taaaaatttggacaaatccatcgac

SEQ ID NO: 734031 - DNA, 25 bp, Mus musculus
taaaaatttggagaaatccatcgac

SEQ ID NO: 734032 - DNA, 25 bp, Mus musculus
taaaacaagaaaacgataatgccag

SEQ ID NO: 734033 - DNA, 25 bp, Mus musculus
taaaacaagaaatcgataatgccag

SEQ ID NO: 734034 - DNA, 25 bp, Mus musculus
taaaacaagaggagtcggaaagtgt

SEQ ID NO: 734035 - DNA, 25 bp, Mus musculus
taaaacaagaggtgtcggaaagtgt

SEQ ID NO: 734036 - DNA, 25 bp, Mus musculus
taaaacacagagcatttgagtccct

SEQ ID NO: 734037 - DNA, 25 bp, Mus musculus
taaaacacagaggatttgagtccct

SEQ ID NO: 734038 - DNA, 25 bp, Mus musculus
taaaacacccgcacaacacagggta

SEQ ID NO: 734039 - DNA, 25 bp, Mus musculus
taaaacacccgctcaacacagggta

SEQ ID NO: 734040 - DNA, 25 bp, Mus musculus
taaaacacctttacaagagagtgcg

SEQ ID NO: 734041 - DNA, 25 bp, Mus musculus
taaaacaccttttcaagagagtgcg

SEQ ID NO: 734042 - DNA, 25 bp, Mus musculus
taaaacactggcaacctccctctat

SEQ ID NO: 734043 - DNA, 25 bp, Mus musculus
taaaacactggctacctccctctat

SEQ ID NO: 734044 - DNA, 25 bp, Mus musculus
taaaacagatgtacacagtcctgga

SEQ ID NO: 734045 - DNA, 25 bp, Mus musculus
taaaacagatgttcacagtcctgga

SEQ ID NO: 734046 - DNA, 25 bp, Mus musculus
taaaacagtaggattgcagacccga

SEQ ID NO: 734047 - DNA, 25 bp, Mus musculus
taaaacagtaggtttgcagacccga

SEQ ID NO: 734048 - DNA, 25 bp, Mus musculus
taaaacagtcttcctcctggaactt

SEQ ID NO: 734049 - DNA, 25 bp, Mus musculus
taaaacagtcttgctcctggaactt

SEQ ID NO: 734050 - DNA, 25 bp, Mus musculus
taaaacagttgacgctcgatccccg

SEQ ID NO: 734051 - DNA, 25 bp, Mus musculus
taaaacagttgaggctcgatccccg

SEQ ID NO: 734052 - DNA, 25 bp, Mus musculus
taaaacattcacactttggagaagt

SEQ ID NO: 734053 - DNA, 25 bp, Mus musculus
taaaacattcactctttggagaagt

SEQ ID NO: 734054 - DNA, 25 bp, Mus musculus
taaaaccaaagacagccgcttacgt

SEQ ID NO: 734055 - DNA, 25 bp, Mus musculus
taaaaccaaagagagccgcttacgt

SEQ ID NO: 734056 - DNA, 25 bp, Mus musculus
taaaaccaaatccaaagaagccaca

SEQ ID NO: 734057 - DNA, 25 bp, Mus musculus
taaaaccaaatcgaaagaagccaca

SEQ ID NO: 734058 - DNA, 25 bp, Mus musculus
taaaaccaacaacttcacgcacggc

SEQ ID NO: 734059 - DNA, 25 bp, Mus musculus
taaaaccaacaagttcacgcacggc

SEQ ID NO: 734060 - DNA, 25 bp, Mus musculus
taaaaccaaggcagaaatgtcccat

SEQ ID NO: 734061 - DNA, 25 bp, Mus musculus
taaaaccaaggctgaaatgtcccat

SEQ ID NO: 734062 - DNA, 25 bp, Mus musculus
taaaaccaccctagcagaggatcca

SEQ ID NO: 734063 - DNA, 25 bp, Mus musculus
taaaaccacccttgcagaggatcca

SEQ ID NO: 734064 - DNA, 25 bp, Mus musculus
taaaaccagagacgcggagctgata

SEQ ID NO: 734065 - DNA, 25 bp, Mus musculus
taaaaccagagaggcggagctgata

SEQ ID NO: 734066 - DNA, 25 bp, Mus musculus
taaaaccatagtaattttgtgtgcc

SEQ ID NO: 734067 - DNA, 25 bp, Mus musculus
taaaaccatagttattttgtgtgcc

SEQ ID NO: 734068 - DNA, 25 bp, Mus musculus
taaaacccacctatgtctgaggtgc

SEQ ID NO: 734069 - DNA, 25 bp, Mus musculus
taaaacccacctttgtctgaggtgc

SEQ ID NO: 734070 - DNA, 25 bp, Mus musculus
taaaacccctgtcccgagatgaaca

SEQ ID NO: 734071 - DNA, 25 bp, Mus musculus
taaaacccctgtgccgagatgaaca

SEQ ID NO: 734072 - DNA, 25 bp, Mus musculus
taaaaccgactcagaagaaaaagag

SEQ ID NO: 734073 - DNA, 25 bp, Mus musculus
taaaaccgactctgaagaaaaagag

SEQ ID NO: 734074 - DNA, 25 bp, Mus musculus
taaaaccggacgacaaattgtacag

SEQ ID NO: 734075 - DNA, 25 bp, Mus musculus
taaaaccggacgtcaaattgtacag

SEQ ID NO: 734076 - DNA, 25 bp, Mus musculus
taaaaccggtaacatcaagtgccta

SEQ ID NO: 734077 - DNA, 25 bp, Mus musculus
taaaaccggtaagatcaagtgccta

SEQ ID NO: 734078 - DNA, 25 bp, Mus musculus
taaaacctactgcagggagcccaag

SEQ ID NO: 734079 - DNA, 25 bp, Mus musculus
taaaacctactggagggagcccaag

SEQ ID NO: 734080 - DNA, 25 bp, Mus musculus
taaaacctatctagctgttgggagc

SEQ ID NO: 734081 - DNA, 25 bp, Mus musculus
taaaacctatcttgctgttgggagc

SEQ ID NO: 734082 - DNA, 25 bp, Mus musculus
taaaacctgagacatagctgcagcc

SEQ ID NO: 734083 - DNA, 25 bp, Mus musculus
taaaacctgagagatagctgcagcc

SEQ ID NO: 734084 - DNA, 25 bp, Mus musculus
taaaacctggcccagcatagcagtt

SEQ ID NO: 734085 - DNA, 25 bp, Mus musculus
taaaacctggccgagcatagcagtt

SEQ ID NO: 734086 - DNA, 25 bp, Mus musculus
taaaacctgtccagcttcaaacaga

SEQ ID NO: 734087 - DNA, 25 bp, Mus musculus
taaaacctgtcctgcttcaaacaga

SEQ ID NO: 734088 - DNA, 25 bp, Mus musculus
taaaacgagaccagaagcatgttgc

SEQ ID NO: 734089 - DNA, 25 bp, Mus musculus
taaaacgagacctgaagcatgttgc

SEQ ID NO: 734090 - DNA, 25 bp, Mus musculus
taaaacgattagatttgttggtctc

SEQ ID NO: 734091 - DNA, 25 bp, Mus musculus
taaaacgattagttttgttggtctc

SEQ ID NO: 734092 - DNA, 25 bp, Mus musculus
taaaacgattctctggttcagtggg

SEQ ID NO: 734093 - DNA, 25 bp, Mus musculus
taaaacgattctgtggttcagtggg

SEQ ID NO: 734094 - DNA, 25 bp, Mus musculus
taaaacgccaccagctcggtaagga

SEQ ID NO: 734095 - DNA, 25 bp, Mus musculus
taaaacgccacctgctcggtaagga

SEQ ID NO: 734096 - DNA, 25 bp, Mus musculus
taaaacgccagccaatctgaaagga

SEQ ID NO: 734097 - DNA, 25 bp, Mus musculus
taaaacgccagcgaatctgaaagga

SEQ ID NO: 734098 - DNA, 25 bp, Mus musculus
taaaacgcccagataccacagagtc

SEQ ID NO: 734099 - DNA, 25 bp, Mus musculus
taaaacgcccagttaccacagagtc

SEQ ID NO: 734100 - DNA, 25 bp, Mus musculus
taaaacgccctccagagtgtcagga

SEQ ID NO: 734101 - DNA, 25 bp, Mus musculus
taaaacgccctcgagagtgtcagga

SEQ ID NO: 734102 - DNA, 25 bp, Mus musculus
taaaacgctgcgcttactagccact

SEQ ID NO: 734103 - DNA, 25 bp, Mus musculus
taaaacgctgcggttactagccact

SEQ ID NO: 734104 - DNA, 25 bp, Mus musculus
taaaacgggactcatggacgtgtcc

SEQ ID NO: 734105 - DNA, 25 bp, Mus musculus
taaaacgggactgatggacgtgtcc

SEQ ID NO: 734106 - DNA, 25 bp, Mus musculus
taaaacgtgcaacgaagaccttcct

SEQ ID NO: 734107 - DNA, 25 bp, Mus musculus
taaaacgtgcaaggaagaccttcct

SEQ ID NO: 734108 - DNA, 25 bp, Mus musculus
taaaacgtgtaaatgtctgatcggt

SEQ ID NO: 734109 - DNA, 25 bp, Mus musculus
taaaacgtgtaattgtctgatcggt

SEQ ID NO: 734110 - DNA, 25 bp, Mus musculus
taaaactacgaaacctctagatagg

SEQ ID NO: 734111 - DNA, 25 bp, Mus musculus
taaaactacgaatcctctagatagg

SEQ ID NO: 734112 - DNA, 25 bp, Mus musculus
taaaactaggaacccaacattcaat

SEQ ID NO: 734113 - DNA, 25 bp, Mus musculus
taaaactaggaacccctgatgcagt

SEQ ID NO: 734114 - DNA, 25 bp, Mus musculus
taaaactaggaagccaacattcaat

SEQ ID NO: 734115 - DNA, 25 bp, Mus musculus
taaaactaggaagccctgatgcagt

SEQ ID NO: 734116 - DNA, 25 bp, Mus musculus
taaaactaggcgagacaacacatgc

SEQ ID NO: 734117 - DNA, 25 bp, Mus musculus
taaaactaggcgtgacaacacatgc

SEQ ID NO: 734118 - DNA, 25 bp, Mus musculus
taaaactagtctcttgtgtgaatag

SEQ ID NO: 734119 - DNA, 25 bp, Mus musculus
taaaactagtctgttgtgtgaatag

SEQ ID NO: 734120 - DNA, 25 bp, Mus musculus
taaaactattgtagatgttcactgg

SEQ ID NO: 734121 - DNA, 25 bp, Mus musculus
taaaactattgttgatgttcactgg

SEQ ID NO: 734122 - DNA, 25 bp, Mus musculus
taaaactcaaatatgcacgaggcat

SEQ ID NO: 734123 - DNA, 25 bp, Mus musculus
taaaactcaaatttgcacgaggcat

SEQ ID NO: 734124 - DNA, 25 bp, Mus musculus
taaaactccctccaaaggatctaag

SEQ ID NO: 734125 - DNA, 25 bp, Mus musculus
taaaactccctcgaaaggatctaag

SEQ ID NO: 734126 - DNA, 25 bp, Mus musculus
taaaactccgccacatctggaacct

SEQ ID NO: 734127 - DNA, 25 bp, Mus musculus
taaaactccgcctcatctggaacct

SEQ ID NO: 734128 - DNA, 25 bp, Mus musculus
taaaactgaccaaacccttattgag

SEQ ID NO: 734129 - DNA, 25 bp, Mus musculus
taaaactgaccatacccttattgag

SEQ ID NO: 734130 - DNA, 25 bp, Mus musculus
taaaactgcaaacagaaaccaggtg

SEQ ID NO: 734131 - DNA, 25 bp, Mus musculus
taaaactgcaaagagaaaccaggtg

SEQ ID NO: 734132 - DNA, 25 bp, Mus musculus
taaaactggccaagaacaaatctat

SEQ ID NO: 734133 - DNA, 25 bp, Mus musculus
taaaactggccatgaacaaatctat

SEQ ID NO: 734134 - DNA, 25 bp, Mus musculus
taaaactggcctagagttggaccta

SEQ ID NO: 734135 - DNA, 25 bp, Mus musculus
taaaactggccttgagttggaccta

SEQ ID NO: 734136 - DNA, 25 bp, Mus musculus
taaaactggctcagaatgtaacagg

SEQ ID NO: 734137 - DNA, 25 bp, Mus musculus
taaaactggctctgaatgtaacagg

SEQ ID NO: 734138 - DNA, 25 bp, Mus musculus
taaaactggtcaccccttggagaga

SEQ ID NO: 734139 - DNA, 25 bp, Mus musculus
taaaactggtcagcccttggagaga

SEQ ID NO: 734140 - DNA, 25 bp, Mus musculus
taaaactgtgacaaccaggtatggc

SEQ ID NO: 734141 - DNA, 25 bp, Mus musculus
taaaactgtgactaccaggtatggc

SEQ ID NO: 734142 - DNA, 25 bp, Mus musculus
taaaacttacgcagctggttgcaga

SEQ ID NO: 734143 - DNA, 25 bp, Mus musculus
taaaacttacgctgctggttgcaga

SEQ ID NO: 734144 - DNA, 25 bp, Mus musculus
taaaacttgaacaagctgaagtaga

SEQ ID NO: 734145 - DNA, 25 bp, Mus musculus
taaaacttgaactagctgaagtaga

SEQ ID NO: 734146 - DNA, 25 bp, Mus musculus
taaaactttgccaatctaggagctg

SEQ ID NO: 734147 - DNA, 25 bp, Mus musculus
taaaactttgcctatctaggagctg

SEQ ID NO: 734148 - DNA, 25 bp, Mus musculus
taaaagaaaccaagccaaagaagcc

SEQ ID NO: 734149 - DNA, 25 bp, Mus musculus
taaaagaaaccatgccaaagaagcc

SEQ ID NO: 734150 - DNA, 25 bp, Mus musculus
taaaagaaacctcaaaagactgcac

SEQ ID NO: 734151 - DNA, 25 bp, Mus musculus
taaaagaaacctgaaaagactgcac

SEQ ID NO: 734152 - DNA, 25 bp, Mus musculus
taaaagaaatctccagcagccaaag

SEQ ID NO: 734153 - DNA, 25 bp, Mus musculus
taaaagaaatctgcagcagccaaag

SEQ ID NO: 734154 - DNA, 25 bp, Mus musculus
taaaagaaatgaattctgccaaaga

SEQ ID NO: 734155 - DNA, 25 bp, Mus musculus
taaaagaaatgatttctgccaaaga

SEQ ID NO: 734156 - DNA, 25 bp, Mus musculus
taaaagaaatgtctcgggatgccgc

SEQ ID NO: 734157 - DNA, 25 bp, Mus musculus
taaaagaaatgtgtcgggatgccgc

SEQ ID NO: 734158 - DNA, 25 bp, Mus musculus
taaaagaaatttccgagttgaccag

SEQ ID NO: 734159 - DNA, 25 bp, Mus musculus
taaaagaaatttgcgagttgaccag

SEQ ID NO: 734160 - DNA, 25 bp, Mus musculus
taaaagaactagatgactggttaac

SEQ ID NO: 734161 - DNA, 25 bp, Mus musculus
taaaagaactagttgactggttaac

SEQ ID NO: 734162 - DNA, 25 bp, Mus musculus
taaaagaactcgattggacaataag

SEQ ID NO: 734163 - DNA, 25 bp, Mus musculus
taaaagaactcgtttggacaataag

SEQ ID NO: 734164 - DNA, 25 bp, Mus musculus
taaaagaacttaccaagcagtatga

SEQ ID NO: 734165 - DNA, 25 bp, Mus musculus
taaaagaacttagcaagcagtatga

SEQ ID NO: 734166 - DNA, 25 bp, Mus musculus
taaaagaagacgatcggcgcagtgc

SEQ ID NO: 734167 - DNA, 25 bp, Mus musculus
taaaagaagacgttcggcgcagtgc

SEQ ID NO: 734168 - DNA, 25 bp, Mus musculus
taaaagaagccaagcaaatcagaag

SEQ ID NO: 734169 - DNA, 25 bp, Mus musculus
taaaagaagccacaggtggaaaccg

SEQ ID NO: 734170 - DNA, 25 bp, Mus musculus
taaaagaagccagaggtggaaaccg

SEQ ID NO: 734171 - DNA, 25 bp, Mus musculus
taaaagaagccatgcaaatcagaag

SEQ ID NO: 734172 - DNA, 25 bp, Mus musculus
taaaagaagtggctttgtgtccgag

SEQ ID NO: 734173 - DNA, 25 bp, Mus musculus
taaaagaagtgggtttgtgtccgag

SEQ ID NO: 734174 - DNA, 25 bp, Mus musculus
taaaagaagttgagattcatccctg

SEQ ID NO: 734175 - DNA, 25 bp, Mus musculus
taaaagaagttgtgattcatccctg

SEQ ID NO: 734176 - DNA, 25 bp, Mus musculus
taaaagaatatccagctaaacacgc

SEQ ID NO: 734177 - DNA, 25 bp, Mus musculus
taaaagaatatcgagctaaacacgc

SEQ ID NO: 734178 - DNA, 25 bp, Mus musculus
taaaagaatcatatgagggctctgt

SEQ ID NO: 734179 - DNA, 25 bp, Mus musculus
taaaagaatcatttgagggctctgt

SEQ ID NO: 734180 - DNA, 25 bp, Mus musculus
taaaagaatgcccttagacgcacgc

SEQ ID NO: 734181 - DNA, 25 bp, Mus musculus
taaaagaatgccgttagacgcacgc

SEQ ID NO: 734182 - DNA, 25 bp, Mus musculus
taaaagaatggcaagacgataaagg

SEQ ID NO: 734183 - DNA, 25 bp, Mus musculus
taaaagaatggctagacgataaagg

SEQ ID NO: 734184 - DNA, 25 bp, Mus musculus
taaaagacaggtctcctcacaccgg

SEQ ID NO: 734185 - DNA, 25 bp, Mus musculus
taaaagacaggtgtcctcacaccgg

SEQ ID NO: 734186 - DNA, 25 bp, Mus musculus
taaaagacatggctaccgggaagtc

SEQ ID NO: 734187 - DNA, 25 bp, Mus musculus
taaaagacatgggtaccgggaagtc

SEQ ID NO: 734188 - DNA, 25 bp, Mus musculus
taaaagactcacatgtcagctccct

SEQ ID NO: 734189 - DNA, 25 bp, Mus musculus
taaaagactcacttgtcagctccct

SEQ ID NO: 734190 - DNA, 25 bp, Mus musculus
taaaagagcaagaaaggacaagtaa

SEQ ID NO: 734191 - DNA, 25 bp, Mus musculus
taaaagagcaagtaaggacaagtaa

SEQ ID NO: 734192 - DNA, 25 bp, Mus musculus
taaaagaggttcatgtgctcctgtg

SEQ ID NO: 734193 - DNA, 25 bp, Mus musculus
taaaagaggttcttgtgctcctgtg

SEQ ID NO: 734194 - DNA, 25 bp, Mus musculus
taaaagagtcgtcgatgtgttcacc

SEQ ID NO: 734195 - DNA, 25 bp, Mus musculus
taaaagagtcgtggatgtgttcacc

SEQ ID NO: 734196 - DNA, 25 bp, Mus musculus
taaaagagtgtgacggcatagtccc

SEQ ID NO: 734197 - DNA, 25 bp, Mus musculus
taaaagagtgtgtcggcatagtccc

SEQ ID NO: 734198 - DNA, 25 bp, Mus musculus
taaaagagttttacaggagggacag

SEQ ID NO: 734199 - DNA, 25 bp, Mus musculus
taaaagagtttttcaggagggacag

SEQ ID NO: 734200 - DNA, 25 bp, Mus musculus
taaaagatattcctaatggtgcaac

SEQ ID NO: 734201 - DNA, 25 bp, Mus musculus
taaaagatattcgtaatggtgcaac

SEQ ID NO: 734202 - DNA, 25 bp, Mus musculus
taaaagatctcactacagtagaagc

SEQ ID NO: 734203 - DNA, 25 bp, Mus musculus
taaaagatctcagtacagtagaagc

SEQ ID NO: 734204 - DNA, 25 bp, Mus musculus
taaaagatggccctgatagacctga

SEQ ID NO: 734205 - DNA, 25 bp, Mus musculus
taaaagatggccgtgatagacctga

SEQ ID NO: 734206 - DNA, 25 bp, Mus musculus
taaaagcaatcacggtcgctggctg

SEQ ID NO: 734207 - DNA, 25 bp, Mus musculus
taaaagcaatcagggtcgctggctg

SEQ ID NO: 734208 - DNA, 25 bp, Mus musculus
taaaagcaatggaatccttacgggc

SEQ ID NO: 734209 - DNA, 25 bp, Mus musculus
taaaagcaatggtatccttacgggc

SEQ ID NO: 734210 - DNA, 25 bp, Mus musculus
taaaagcacactcgaatgcaagcgg

SEQ ID NO: 734211 - DNA, 25 bp, Mus musculus
taaaagcacactggaatgcaagcgg

SEQ ID NO: 734212 - DNA, 25 bp, Mus musculus
taaaagcagccaatcgaagagccgg

SEQ ID NO: 734213 - DNA, 25 bp, Mus musculus
taaaagcagccattcgaagagccgg

SEQ ID NO: 734214 - DNA, 25 bp, Mus musculus
taaaagcagcctatctcaggtgcgg

SEQ ID NO: 734215 - DNA, 25 bp, Mus musculus
taaaagcagcctttctcaggtgcgg

SEQ ID NO: 734216 - DNA, 25 bp, Mus musculus
taaaagcagtcaaaacaccgatgta

SEQ ID NO: 734217 - DNA, 25 bp, Mus musculus
taaaagcagtcataacaccgatgta

SEQ ID NO: 734218 - DNA, 25 bp, Mus musculus
taaaagccaaaaaggctgccccaag

SEQ ID NO: 734219 - DNA, 25 bp, Mus musculus
taaaagccaaaatggctgccccaag

SEQ ID NO: 734220 - DNA, 25 bp, Mus musculus
taaaagccaaggcttatccagcaca

SEQ ID NO: 734221 - DNA, 25 bp, Mus musculus
taaaagccaagggttatccagcaca

SEQ ID NO: 734222 - DNA, 25 bp, Mus musculus
taaaagcccggaatcaggatcccca

SEQ ID NO: 734223 - DNA, 25 bp, Mus musculus
taaaagcccggattcaggatcccca

SEQ ID NO: 734224 - DNA, 25 bp, Mus musculus
taaaagcctgagagaagtcaagtct

SEQ ID NO: 734225 - DNA, 25 bp, Mus musculus
taaaagcctgagtgaagtcaagtct

SEQ ID NO: 734226 - DNA, 25 bp, Mus musculus
taaaagccttgacgactctcagtgc

SEQ ID NO: 734227 - DNA, 25 bp, Mus musculus
taaaagccttgaggactctcagtgc

SEQ ID NO: 734228 - DNA, 25 bp, Mus musculus
taaaagctagtgcactctacctggt

SEQ ID NO: 734229 - DNA, 25 bp, Mus musculus
taaaagctagtggactctacctggt

SEQ ID NO: 734230 - DNA, 25 bp, Mus musculus
taaaagctcaccaccacaataaaga

SEQ ID NO: 734231 - DNA, 25 bp, Mus musculus
taaaagctcacctccacaataaaga

SEQ ID NO: 734232 - DNA, 25 bp, Mus musculus
taaaagctcagaagcacttacagtc

SEQ ID NO: 734233 - DNA, 25 bp, Mus musculus
taaaagctcagatgcacttacagtc

SEQ ID NO: 734234 - DNA, 25 bp, Mus musculus
taaaagctgctcacaaggtagagga

SEQ ID NO: 734235 - DNA, 25 bp, Mus musculus
taaaagctgctctcaaggtagagga

SEQ ID NO: 734236 - DNA, 25 bp, Mus musculus
taaaagctggagactctctgatggt

SEQ ID NO: 734237 - DNA, 25 bp, Mus musculus
taaaagctggagtctctctgatggt

SEQ ID NO: 734238 - DNA, 25 bp, Mus musculus
taaaagctgtggatccggcattcgg

SEQ ID NO: 734239 - DNA, 25 bp, Mus musculus
taaaagctgtggttccggcattcgg

SEQ ID NO: 734240 - DNA, 25 bp, Mus musculus
taaaaggaatcacctgagtgtggtg

SEQ ID NO: 734241 - DNA, 25 bp, Mus musculus
taaaaggaatcagctgagtgtggtg

SEQ ID NO: 734242 - DNA, 25 bp, Mus musculus
taaaaggagcacatgaaaaagagtc

SEQ ID NO: 734243 - DNA, 25 bp, Mus musculus
taaaaggagcacttgaaaaagagtc

SEQ ID NO: 734244 - DNA, 25 bp, Mus musculus
taaaaggagccccatctgtgagcat

SEQ ID NO: 734245 - DNA, 25 bp, Mus musculus
taaaaggagcccgatctgtgagcat

SEQ ID NO: 734246 - DNA, 25 bp, Mus musculus
taaaaggaggaacctgcttgctgcc

SEQ ID NO: 734247 - DNA, 25 bp, Mus musculus
taaaaggaggaagctgcttgctgcc

SEQ ID NO: 734248 - DNA, 25 bp, Mus musculus
taaaaggagtaacgctgcccagctt

SEQ ID NO: 734249 - DNA, 25 bp, Mus musculus
taaaaggagtaaggctgcccagctt

SEQ ID NO: 734250 - DNA, 25 bp, Mus musculus
taaaaggagtgaagccagcaaaagc

SEQ ID NO: 734251 - DNA, 25 bp, Mus musculus
taaaaggagtgatgccagcaaaagc

SEQ ID NO: 734252 - DNA, 25 bp, Mus musculus
taaaaggagttacgcctacgaatgt

SEQ ID NO: 734253 - DNA, 25 bp, Mus musculus
taaaaggagttaggcctacgaatgt

SEQ ID NO: 734254 - DNA, 25 bp, Mus musculus
taaaaggatgctatgctcatgttct

SEQ ID NO: 734255 - DNA, 25 bp, Mus musculus
taaaaggatgctttgctcatgttct

SEQ ID NO: 734256 - DNA, 25 bp, Mus musculus
taaaaggcaccgacttgccacttct

SEQ ID NO: 734257 - DNA, 25 bp, Mus musculus
taaaaggcaccgtcttgccacttct

SEQ ID NO: 734258 - DNA, 25 bp, Mus musculus
taaaaggcatcacgagtttgtgcac

SEQ ID NO: 734259 - DNA, 25 bp, Mus musculus
taaaaggcatcaggagtttgtgcac

SEQ ID NO: 734260 - DNA, 25 bp, Mus musculus
taaaaggccaacatgagaaagaagc

SEQ ID NO: 734261 - DNA, 25 bp, Mus musculus
taaaaggccaacttgagaaagaagc

SEQ ID NO: 734262 - DNA, 25 bp, Mus musculus
taaaaggccaccatgtgcctaggct

SEQ ID NO: 734263 - DNA, 25 bp, Mus musculus
taaaaggccaccttgtgcctaggct

SEQ ID NO: 734264 - DNA, 25 bp, Mus musculus
taaaagggatccagagacagatggc

SEQ ID NO: 734265 - DNA, 25 bp, Mus musculus
taaaagggatcctgagacagatggc

SEQ ID NO: 734266 - DNA, 25 bp, Mus musculus
taaaagggatgtcgcaagcgttgac

SEQ ID NO: 734267 - DNA, 25 bp, Mus musculus
taaaagggatgtggcaagcgttgac

SEQ ID NO: 734268 - DNA, 25 bp, Mus musculus
taaaagggcacacacttccccagct

SEQ ID NO: 734269 - DNA, 25 bp, Mus musculus
taaaagggcacagacttccccagct

SEQ ID NO: 734270 - DNA, 25 bp, Mus musculus
taaaaggtcaggagctgtccgtcat

SEQ ID NO: 734271 - DNA, 25 bp, Mus musculus
taaaaggtcaggtgctgtccgtcat

SEQ ID NO: 734272 - DNA, 25 bp, Mus musculus
taaaaggtctaacgccgcttcctgc

SEQ ID NO: 734273 - DNA, 25 bp, Mus musculus
taaaaggtctaaggccgcttcctgc

SEQ ID NO: 734274 - DNA, 25 bp, Mus musculus
taaaaggtgctgacaaaggagtgta

SEQ ID NO: 734275 - DNA, 25 bp, Mus musculus
taaaaggtgctgtcaaaggagtgta

SEQ ID NO: 734276 - DNA, 25 bp, Mus musculus
taaaaggtgtagaatggaagccact

SEQ ID NO: 734277 - DNA, 25 bp, Mus musculus
taaaaggtgtagtatggaagccact

SEQ ID NO: 734278 - DNA, 25 bp, Mus musculus
taaaagtaaatccacaagtgtggct

SEQ ID NO: 734279 - DNA, 25 bp, Mus musculus
taaaagtaaatcgacaagtgtggct

SEQ ID NO: 734280 - DNA, 25 bp, Mus musculus
taaaagtaacaaaacaaccaggcag

SEQ ID NO: 734281 - DNA, 25 bp, Mus musculus
taaaagtaacaatacaaccaggcag

SEQ ID NO: 734282 - DNA, 25 bp, Mus musculus
taaaagtaagtcaagttgagtagct

SEQ ID NO: 734283 - DNA, 25 bp, Mus musculus
taaaagtaagtctagttgagtagct

SEQ ID NO: 734284 - DNA, 25 bp, Mus musculus
taaaagtagtgacttccccgagtcg

SEQ ID NO: 734285 - DNA, 25 bp, Mus musculus
taaaagtagtgagttccccgagtcg

SEQ ID NO: 734286 - DNA, 25 bp, Mus musculus
taaaagtcaaacattaagtagctgc

SEQ ID NO: 734287 - DNA, 25 bp, Mus musculus
taaaagtcaaactttaagtagctgc

SEQ ID NO: 734288 - DNA, 25 bp, Mus musculus
taaaagtcacaccatctggacctgc

SEQ ID NO: 734289 - DNA, 25 bp, Mus musculus
taaaagtcacacgatctggacctgc

SEQ ID NO: 734290 - DNA, 25 bp, Mus musculus
taaaagtccaggatatggatggcca

SEQ ID NO: 734291 - DNA, 25 bp, Mus musculus
taaaagtccaggttatggatggcca

SEQ ID NO: 734292 - DNA, 25 bp, Mus musculus
taaaagtgaattctatttggctctc

SEQ ID NO: 734293 - DNA, 25 bp, Mus musculus
taaaagtgaattgtatttggctctc

SEQ ID NO: 734294 - DNA, 25 bp, Mus musculus
taaaagtgatcaagtcgagtcttcc

SEQ ID NO: 734295 - DNA, 25 bp, Mus musculus
taaaagtgatcatgtcgagtcttcc

SEQ ID NO: 734296 - DNA, 25 bp, Mus musculus
taaaagttaagaagctagacacctc

SEQ ID NO: 734297 - DNA, 25 bp, Mus musculus
taaaagttaagatgctagacacctc

SEQ ID NO: 734298 - DNA, 25 bp, Mus musculus
taaaagttccttactagtatcatgt

SEQ ID NO: 734299 - DNA, 25 bp, Mus musculus
taaaagttcctttctagtatcatgt

SEQ ID NO: 734300 - DNA, 25 bp, Mus musculus
taaaagtttatcctcacgagctagc

SEQ ID NO: 734301 - DNA, 25 bp, Mus musculus
taaaagtttatcgtcacgagctagc

SEQ ID NO: 734302 - DNA, 25 bp, Mus musculus
taaaataacccgctgaagcagccga

SEQ ID NO: 734303 - DNA, 25 bp, Mus musculus
taaaataacccggtgaagcagccga

SEQ ID NO: 734304 - DNA, 25 bp, Mus musculus
taaaataagaacctccctgagtgga

SEQ ID NO: 734305 - DNA, 25 bp, Mus musculus
taaaataagaacgtccctgagtgga

SEQ ID NO: 734306 - DNA, 25 bp, Mus musculus
taaaatacagtgcttacaacacagg

SEQ ID NO: 734307 - DNA, 25 bp, Mus musculus
taaaatacagtggttacaacacagg

SEQ ID NO: 734308 - DNA, 25 bp, Mus musculus
taaaatacctccctgactggacagg

SEQ ID NO: 734309 - DNA, 25 bp, Mus musculus
taaaatacctccgtgactggacagg

SEQ ID NO: 734310 - DNA, 25 bp, Mus musculus
taaaatacgattataaccttggccg

SEQ ID NO: 734311 - DNA, 25 bp, Mus musculus
taaaatacgattttaaccttggccg

SEQ ID NO: 734312 - DNA, 25 bp, Mus musculus
taaaatacttagctttatgggactg

SEQ ID NO: 734313 - DNA, 25 bp, Mus musculus
taaaatacttaggtttatgggactg

SEQ ID NO: 734314 - DNA, 25 bp, Mus musculus
taaaatagaagaatttggcgtgcac

SEQ ID NO: 734315 - DNA, 25 bp, Mus musculus
taaaatagaagattttggcgtgcac

SEQ ID NO: 734316 - DNA, 25 bp, Mus musculus
taaaatagagcgagcaaacgcctgc

SEQ ID NO: 734317 - DNA, 25 bp, Mus musculus
taaaatagagcgtgcaaacgcctgc

SEQ ID NO: 734318 - DNA, 25 bp, Mus musculus
taaaatagcagcaagggacctaggc

SEQ ID NO: 734319 - DNA, 25 bp, Mus musculus
taaaatagcagctagggacctaggc

SEQ ID NO: 734320 - DNA, 25 bp, Mus musculus
taaaatagctgcagcgggatgctgg

SEQ ID NO: 734321 - DNA, 25 bp, Mus musculus
taaaatagctgctgcgggatgctgg

SEQ ID NO: 734322 - DNA, 25 bp, Mus musculus
taaaatagtgcaaaaacgtagctgg

SEQ ID NO: 734323 - DNA, 25 bp, Mus musculus
taaaatagtgcataaacgtagctgg

SEQ ID NO: 734324 - DNA, 25 bp, Mus musculus
taaaatatagttcattcatccaatc

SEQ ID NO: 734325 - DNA, 25 bp, Mus musculus
taaaatatagttgattcatccaatc

SEQ ID NO: 734326 - DNA, 25 bp, Mus musculus
taaaatatatcaaggagaggaacta

SEQ ID NO: 734327 - DNA, 25 bp, Mus musculus
taaaatatatcatggagaggaacta

SEQ ID NO: 734328 - DNA, 25 bp, Mus musculus
taaaatatgtcgacggaaccgggct

SEQ ID NO: 734329 - DNA, 25 bp, Mus musculus
taaaatatgtcgtcggaaccgggct

SEQ ID NO: 734330 - DNA, 25 bp, Mus musculus
taaaatattgggaccatggcggagc

SEQ ID NO: 734331 - DNA, 25 bp, Mus musculus
taaaatattgggtccatggcggagc

SEQ ID NO: 734332 - DNA, 25 bp, Mus musculus
taaaatcaaaatcttcgcccagcag

SEQ ID NO: 734333 - DNA, 25 bp, Mus musculus
taaaatcaaaatgttcgcccagcag

SEQ ID NO: 734334 - DNA, 25 bp, Mus musculus
taaaatcaacctcgtagatctggca

SEQ ID NO: 734335 - DNA, 25 bp, Mus musculus
taaaatcaacctggtagatctggca

SEQ ID NO: 734336 - DNA, 25 bp, Mus musculus
taaaatcactgtcgttggaagtgga

SEQ ID NO: 734337 - DNA, 25 bp, Mus musculus
taaaatcactgtggttggaagtgga

SEQ ID NO: 734338 - DNA, 25 bp, Mus musculus
taaaatcagcctcctagggttcctg

SEQ ID NO: 734339 - DNA, 25 bp, Mus musculus
taaaatcagcctgctagggttcctg

SEQ ID NO: 734340 - DNA, 25 bp, Mus musculus
taaaatccagctatcgacaattaat

SEQ ID NO: 734341 - DNA, 25 bp, Mus musculus
taaaatccagctttcgacaattaat

SEQ ID NO: 734342 - DNA, 25 bp, Mus musculus
taaaatcctatgactgcaaacatgt

SEQ ID NO: 734343 - DNA, 25 bp, Mus musculus
taaaatcctatgtctgcaaacatgt

SEQ ID NO: 734344 - DNA, 25 bp, Mus musculus
taaaatcctgtaaccggcgagccat

SEQ ID NO: 734345 - DNA, 25 bp, Mus musculus
taaaatcctgtatccggcgagccat

SEQ ID NO: 734346 - DNA, 25 bp, Mus musculus
taaaatcgaagaagttcttcaagca

SEQ ID NO: 734347 - DNA, 25 bp, Mus musculus
taaaatcgaagatgttcttcaagca

SEQ ID NO: 734348 - DNA, 25 bp, Mus musculus
taaaatcgatccatcggcccctttg

SEQ ID NO: 734349 - DNA, 25 bp, Mus musculus
taaaatcgatccttcggcccctttg

SEQ ID NO: 734350 - DNA, 25 bp, Mus musculus
taaaatcgccggctcgtttctgccc

SEQ ID NO: 734351 - DNA, 25 bp, Mus musculus
taaaatcgccgggtcgtttctgccc

SEQ ID NO: 734352 - DNA, 25 bp, Mus musculus
taaaatctgagactgaagacttaca

SEQ ID NO: 734353 - DNA, 25 bp, Mus musculus
taaaatctgagagtgaagacttaca

SEQ ID NO: 734354 - DNA, 25 bp, Mus musculus
taaaatctgatccaaacttgtcaac

SEQ ID NO: 734355 - DNA, 25 bp, Mus musculus
taaaatctgatcgaaacttgtcaac

SEQ ID NO: 734356 - DNA, 25 bp, Mus musculus
taaaatctggccataattgaggctc

SEQ ID NO: 734357 - DNA, 25 bp, Mus musculus
taaaatctggccttaattgaggctc

SEQ ID NO: 734358 - DNA, 25 bp, Mus musculus
taaaatctgtaaatagcacatgacc

SEQ ID NO: 734359 - DNA, 25 bp, Mus musculus
taaaatctgtaattagcacatgacc

SEQ ID NO: 734360 - DNA, 25 bp, Mus musculus
taaaatctgtggatctggacttaat

SEQ ID NO: 734361 - DNA, 25 bp, Mus musculus
taaaatctgtggttctggacttaat

SEQ ID NO: 734362 - DNA, 25 bp, Mus musculus
taaaatctgttcatgagcaaagtct

SEQ ID NO: 734363 - DNA, 25 bp, Mus musculus
taaaatctgttcttgagcaaagtct

SEQ ID NO: 734364 - DNA, 25 bp, Mus musculus
taaaatcttacacatcctacaagtc

SEQ ID NO: 734365 - DNA, 25 bp, Mus musculus
taaaatcttacagatcctacaagtc

SEQ ID NO: 734366 - DNA, 25 bp, Mus musculus
taaaatcttgcacctttatacacgg

SEQ ID NO: 734367 - DNA, 25 bp, Mus musculus
taaaatcttgcagctttatacacgg

SEQ ID NO: 734368 - DNA, 25 bp, Mus musculus
taaaatgaaaatatcccggcccaag

SEQ ID NO: 734369 - DNA, 25 bp, Mus musculus
taaaatgaaaatttcccggcccaag

SEQ ID NO: 734370 - DNA, 25 bp, Mus musculus
taaaatgagcatccgcataacttcc

SEQ ID NO: 734371 - DNA, 25 bp, Mus musculus
taaaatgagcatgcgcataacttcc

SEQ ID NO: 734372 - DNA, 25 bp, Mus musculus
taaaatgagcttaatagtacacaca

SEQ ID NO: 734373 - DNA, 25 bp, Mus musculus
taaaatgagctttatagtacacaca

SEQ ID NO: 734374 - DNA, 25 bp, Mus musculus
taaaatgagttacctcatgccgctg

SEQ ID NO: 734375 - DNA, 25 bp, Mus musculus
taaaatgagttagctcatgccgctg

SEQ ID NO: 734376 - DNA, 25 bp, Mus musculus
taaaatgatcgacaagaacctgcgg

SEQ ID NO: 734377 - DNA, 25 bp, Mus musculus
taaaatgatcgagaagaacctgcgg

SEQ ID NO: 734378 - DNA, 25 bp, Mus musculus
taaaatgatcgtagagggctggtga

SEQ ID NO: 734379 - DNA, 25 bp, Mus musculus
taaaatgatcgttgagggctggtga

SEQ ID NO: 734380 - DNA, 25 bp, Mus musculus
taaaatgatctacatggaaggaccg

SEQ ID NO: 734381 - DNA, 25 bp, Mus musculus
taaaatgatctagatggaaggaccg

SEQ ID NO: 734382 - DNA, 25 bp, Mus musculus
taaaatgcaactcaagaataggctg

SEQ ID NO: 734383 - DNA, 25 bp, Mus musculus
taaaatgcaactgaagaataggctg

SEQ ID NO: 734384 - DNA, 25 bp, Mus musculus
taaaatgcactaccccatggtagag

SEQ ID NO: 734385 - DNA, 25 bp, Mus musculus
taaaatgcactagcccatggtagag

SEQ ID NO: 734386 - DNA, 25 bp, Mus musculus
taaaatgcaggtaggaggctatgag

SEQ ID NO: 734387 - DNA, 25 bp, Mus musculus
taaaatgcaggttggaggctatgag

SEQ ID NO: 734388 - DNA, 25 bp, Mus musculus
taaaatgcccgtcaagtcactgttg

SEQ ID NO: 734389 - DNA, 25 bp, Mus musculus
taaaatgcccgtgaagtcactgttg

SEQ ID NO: 734390 - DNA, 25 bp, Mus musculus
taaaatgctacacaccaaagatggc

SEQ ID NO: 734391 - DNA, 25 bp, Mus musculus
taaaatgctacagaccaaagatggc

SEQ ID NO: 734392 - DNA, 25 bp, Mus musculus
taaaatgctccaactgactgctcgc

SEQ ID NO: 734393 - DNA, 25 bp, Mus musculus
taaaatgctccatctgactgctcgc

SEQ ID NO: 734394 - DNA, 25 bp, Mus musculus
taaaatggaagtcgagcggactcct

SEQ ID NO: 734395 - DNA, 25 bp, Mus musculus
taaaatggaagtggagcggactcct

SEQ ID NO: 734396 - DNA, 25 bp, Mus musculus
taaaatggcagtccgcctagctggt

SEQ ID NO: 734397 - DNA, 25 bp, Mus musculus
taaaatggcagtgcgcctagctggt

SEQ ID NO: 734398 - DNA, 25 bp, Mus musculus
taaaatggctgtactccagctcgac

SEQ ID NO: 734399 - DNA, 25 bp, Mus musculus
taaaatggctgttctccagctcgac

SEQ ID NO: 734400 - DNA, 25 bp, Mus musculus
taaaatggtcatcaatcgcctggag

SEQ ID NO: 734401 - DNA, 25 bp, Mus musculus
taaaatggtcatgaatcgcctggag

SEQ ID NO: 734402 - DNA, 25 bp, Mus musculus
taaaatgtagggagatgcttgctgc

SEQ ID NO: 734403 - DNA, 25 bp, Mus musculus
taaaatgtagggtgatgcttgctgc

SEQ ID NO: 734404 - DNA, 25 bp, Mus musculus
taaaatgtccatattgcccaatgga

SEQ ID NO: 734405 - DNA, 25 bp, Mus musculus
taaaatgtccattttgcccaatgga

SEQ ID NO: 734406 - DNA, 25 bp, Mus musculus
taaaatgtccggctgtctgcagtct

SEQ ID NO: 734407 - DNA, 25 bp, Mus musculus
taaaatgtccgggtgtctgcagtct

SEQ ID NO: 734408 - DNA, 25 bp, Mus musculus
taaaatgtcggcaccaggaccttac

SEQ ID NO: 734409 - DNA, 25 bp, Mus musculus
taaaatgtcggctccaggaccttac

SEQ ID NO: 734410 - DNA, 25 bp, Mus musculus
taaaatgtgaagatacttgccccag

SEQ ID NO: 734411 - DNA, 25 bp, Mus musculus
taaaatgtgaagttacttgccccag

SEQ ID NO: 734412 - DNA, 25 bp, Mus musculus
taaaattaatcaagcagggacacag

SEQ ID NO: 734413 - DNA, 25 bp, Mus musculus
taaaattaatcatgcagggacacag

SEQ ID NO: 734414 - DNA, 25 bp, Mus musculus
taaaattcaacaagctaaaaacgag

SEQ ID NO: 734415 - DNA, 25 bp, Mus musculus
taaaattcaacatgctaaaaacgag

SEQ ID NO: 734416 - DNA, 25 bp, Mus musculus
taaaattcccagaaatccagcattg

SEQ ID NO: 734417 - DNA, 25 bp, Mus musculus
taaaattcccagtaatccagcattg

SEQ ID NO: 734418 - DNA, 25 bp, Mus musculus
taaaattcttctctttcgccacgac

SEQ ID NO: 734419 - DNA, 25 bp, Mus musculus
taaaattcttctgtttcgccacgac

SEQ ID NO: 734420 - DNA, 25 bp, Mus musculus
taaaattgaataccttgaccttagc

SEQ ID NO: 734421 - DNA, 25 bp, Mus musculus
taaaattgaatagcttgaccttagc

SEQ ID NO: 734422 - DNA, 25 bp, Mus musculus
taaaattgcggtaactaaatgtggc

SEQ ID NO: 734423 - DNA, 25 bp, Mus musculus
taaaattgcggttactaaatgtggc

SEQ ID NO: 734424 - DNA, 25 bp, Mus musculus
taaaattgctgcactttgctgcggg

SEQ ID NO: 734425 - DNA, 25 bp, Mus musculus
taaaattgctgctctttgctgcggg

SEQ ID NO: 734426 - DNA, 25 bp, Mus musculus
taaaattggtggctaccagtggccc

SEQ ID NO: 734427 - DNA, 25 bp, Mus musculus
taaaattggtgggtaccagtggccc

SEQ ID NO: 734428 - DNA, 25 bp, Mus musculus
taaaattgtcctcagacgcttggct

SEQ ID NO: 734429 - DNA, 25 bp, Mus musculus
taaaattgtcctgagacgcttggct

SEQ ID NO: 734430 - DNA, 25 bp, Mus musculus
taaaatttaaatcaactacaggtca

SEQ ID NO: 734431 - DNA, 25 bp, Mus musculus
taaaatttaaatgaactacaggtca

SEQ ID NO: 734432 - DNA, 25 bp, Mus musculus
taaaatttagataagcctctgatag

SEQ ID NO: 734433 - DNA, 25 bp, Mus musculus
taaaatttagattagcctctgatag

SEQ ID NO: 734434 - DNA, 25 bp, Mus musculus
taaaatttctgacgagtgcatcgca

SEQ ID NO: 734435 - DNA, 25 bp, Mus musculus
taaaatttctgaggagtgcatcgca

SEQ ID NO: 734436 - DNA, 25 bp, Mus musculus
taaaatttgggacactaccaataag

SEQ ID NO: 734437 - DNA, 25 bp, Mus musculus
taaaatttgggagactaccaataag

SEQ ID NO: 734438 - DNA, 25 bp, Mus musculus
taaaattttgcaacacattgaagtg

SEQ ID NO: 734439 - DNA, 25 bp, Mus musculus
taaaattttgcatcacattgaagtg

SEQ ID NO: 734440 - DNA, 25 bp, Mus musculus
taaacaaagacaacgaggaattcct

SEQ ID NO: 734441 - DNA, 25 bp, Mus musculus
taaacaaagacatcgaggaattcct

SEQ ID NO: 734442 - DNA, 25 bp, Mus musculus
taaacaaaggccaggcctccgccat

SEQ ID NO: 734443 - DNA, 25 bp, Mus musculus
taaacaaaggcctggcctccgccat

SEQ ID NO: 734444 - DNA, 25 bp, Mus musculus
taaacaaagttcctgtactcaaaga

SEQ ID NO: 734445 - DNA, 25 bp, Mus musculus
taaacaaagttcgtgtactcaaaga

SEQ ID NO: 734446 - DNA, 25 bp, Mus musculus
taaacaaataggagaacaccttctc

SEQ ID NO: 734447 - DNA, 25 bp, Mus musculus
taaacaaataggtgaacaccttctc

SEQ ID NO: 734448 - DNA, 25 bp, Mus musculus
taaacaaatcctctgggaactagat

SEQ ID NO: 734449 - DNA, 25 bp, Mus musculus
taaacaaatcctgtgggaactagat

SEQ ID NO: 734450 - DNA, 25 bp, Mus musculus
taaacaaatgatcctcctccgcatc

SEQ ID NO: 734451 - DNA, 25 bp, Mus musculus
taaacaaatgatgctcctccgcatc

SEQ ID NO: 734452 - DNA, 25 bp, Mus musculus
taaacaaatggaagtcaaaaggagg

SEQ ID NO: 734453 - DNA, 25 bp, Mus musculus
taaacaaatggatgtcaaaaggagg

SEQ ID NO: 734454 - DNA, 25 bp, Mus musculus
taaacaacagcaatgagaaatctgg

SEQ ID NO: 734455 - DNA, 25 bp, Mus musculus
taaacaacagcattgagaaatctgg

SEQ ID NO: 734456 - DNA, 25 bp, Mus musculus
taaacaacaggacctggacatgatg

SEQ ID NO: 734457 - DNA, 25 bp, Mus musculus
taaacaacaggagctggacatgatg

SEQ ID NO: 734458 - DNA, 25 bp, Mus musculus
taaacaacatcaataaaaccaagcg

SEQ ID NO: 734459 - DNA, 25 bp, Mus musculus
taaacaacatcattaaaaccaagcg

SEQ ID NO: 734460 - DNA, 25 bp, Mus musculus
taaacaaccaaactatctcaaccta

SEQ ID NO: 734461 - DNA, 25 bp, Mus musculus
taaacaaccaaagtatctcaaccta

SEQ ID NO: 734462 - DNA, 25 bp, Mus musculus
taaacaacgtgacacgggaagcagg

SEQ ID NO: 734463 - DNA, 25 bp, Mus musculus
taaacaacgtgagacgggaagcagg

SEQ ID NO: 734464 - DNA, 25 bp, Mus musculus
taaacaagcacacaccagatgatcc

SEQ ID NO: 734465 - DNA, 25 bp, Mus musculus
taaacaagcacagaccagatgatcc

SEQ ID NO: 734466 - DNA, 25 bp, Mus musculus
taaacaagccgcacttggccaggac

SEQ ID NO: 734467 - DNA, 25 bp, Mus musculus
taaacaagccgctcttggccaggac

SEQ ID NO: 734468 - DNA, 25 bp, Mus musculus
taaacaagcggaagtggaaaggctt

SEQ ID NO: 734469 - DNA, 25 bp, Mus musculus
taaacaagcggatgtggaaaggctt

SEQ ID NO: 734470 - DNA, 25 bp, Mus musculus
taaacaaggacaacactggctggag

SEQ ID NO: 734471 - DNA, 25 bp, Mus musculus
taaacaaggacatcactggctggag

SEQ ID NO: 734472 - DNA, 25 bp, Mus musculus
taaacaaggaccagtgaaagatgct

SEQ ID NO: 734473 - DNA, 25 bp, Mus musculus
taaacaaggacctgtgaaagatgct

SEQ ID NO: 734474 - DNA, 25 bp, Mus musculus
taaacaagggccactggaggtagtc

SEQ ID NO: 734475 - DNA, 25 bp, Mus musculus
taaacaagggcctctggaggtagtc

SEQ ID NO: 734476 - DNA, 25 bp, Mus musculus
taaacaagtgataagtactaaaggg

SEQ ID NO: 734477 - DNA, 25 bp, Mus musculus
taaacaagtgattagtactaaaggg

SEQ ID NO: 734478 - DNA, 25 bp, Mus musculus
taaacaataaacagactcgtgacct

SEQ ID NO: 734479 - DNA, 25 bp, Mus musculus
taaacaataaactgactcgtgacct

SEQ ID NO: 734480 - DNA, 25 bp, Mus musculus
taaacaatcgctacacctccaaaga

SEQ ID NO: 734481 - DNA, 25 bp, Mus musculus
taaacaatcgcttcacctccaaaga

SEQ ID NO: 734482 - DNA, 25 bp, Mus musculus
taaacaatgacaccacagagctgca

SEQ ID NO: 734483 - DNA, 25 bp, Mus musculus
taaacaatgacagcacagagctgca

SEQ ID NO: 734484 - DNA, 25 bp, Mus musculus
taaacacagatacggaggggcctcc

SEQ ID NO: 734485 - DNA, 25 bp, Mus musculus
taaacacagatagggaggggcctcc

SEQ ID NO: 734486 - DNA, 25 bp, Mus musculus
taaacacagcccagccacactagtt

SEQ ID NO: 734487 - DNA, 25 bp, Mus musculus
taaacacagcccagtatgagccgcc

SEQ ID NO: 734488 - DNA, 25 bp, Mus musculus
taaacacagccctgccacactagtt

SEQ ID NO: 734489 - DNA, 25 bp, Mus musculus
taaacacagccctgtatgagccgcc

SEQ ID NO: 734490 - DNA, 25 bp, Mus musculus
taaacacagtttagagtctccctgt

SEQ ID NO: 734491 - DNA, 25 bp, Mus musculus
taaacacagttttgagtctccctgt

SEQ ID NO: 734492 - DNA, 25 bp, Mus musculus
taaacacatccaatcctgcagggag

SEQ ID NO: 734493 - DNA, 25 bp, Mus musculus
taaacacatccattcctgcagggag

SEQ ID NO: 734494 - DNA, 25 bp, Mus musculus
taaacacattctaccttcacagaaa

SEQ ID NO: 734495 - DNA, 25 bp, Mus musculus
taaacacattcttccttcacagaaa

SEQ ID NO: 734496 - DNA, 25 bp, Mus musculus
taaacaccagcacttgtcattcagt

SEQ ID NO: 734497 - DNA, 25 bp, Mus musculus
taaacaccagcagttgtcattcagt

SEQ ID NO: 734498 - DNA, 25 bp, Mus musculus
taaacaccagttaaaaggcattgga

SEQ ID NO: 734499 - DNA, 25 bp, Mus musculus
taaacaccagtttaaaggcattgga

SEQ ID NO: 734500 - DNA, 25 bp, Mus musculus
taaacaccatatagtgcaatgtggg

SEQ ID NO: 734501 - DNA, 25 bp, Mus musculus
taaacaccatattgtgcaatgtggg

SEQ ID NO: 734502 - DNA, 25 bp, Mus musculus
taaacacccgatagctcatcagttc

SEQ ID NO: 734503 - DNA, 25 bp, Mus musculus
taaacacccgattgctcatcagttc

SEQ ID NO: 734504 - DNA, 25 bp, Mus musculus
taaacaccgaggaggagagtctctt

SEQ ID NO: 734505 - DNA, 25 bp, Mus musculus
taaacaccgaggtggagagtctctt

SEQ ID NO: 734506 - DNA, 25 bp, Mus musculus
taaacaccttgccagactggtatcc

SEQ ID NO: 734507 - DNA, 25 bp, Mus musculus
taaacaccttgcgagactggtatcc

SEQ ID NO: 734508 - DNA, 25 bp, Mus musculus
taaacacgagttcacaatcttggtg

SEQ ID NO: 734509 - DNA, 25 bp, Mus musculus
taaacacgagttgacaatcttggtg

SEQ ID NO: 734510 - DNA, 25 bp, Mus musculus
taaacacggtacacagcatgcagcg

SEQ ID NO: 734511 - DNA, 25 bp, Mus musculus
taaacacggtactcagcatgcagcg

SEQ ID NO: 734512 - DNA, 25 bp, Mus musculus
taaacactatggaagagagtgtaca

SEQ ID NO: 734513 - DNA, 25 bp, Mus musculus
taaacactatggtagagagtgtaca

SEQ ID NO: 734514 - DNA, 25 bp, Mus musculus
taaacactctgtactgaatctagag

SEQ ID NO: 734515 - DNA, 25 bp, Mus musculus
taaacactctgttctgaatctagag

SEQ ID NO: 734516 - DNA, 25 bp, Mus musculus
taaacactgcatagtgttgctacag

SEQ ID NO: 734517 - DNA, 25 bp, Mus musculus
taaacactgcattgtgttgctacag

SEQ ID NO: 734518 - DNA, 25 bp, Mus musculus
taaacactggttcggagggagcctt

SEQ ID NO: 734519 - DNA, 25 bp, Mus musculus
taaacactggttgggagggagcctt

SEQ ID NO: 734520 - DNA, 25 bp, Mus musculus
taaacacttgtgactcccagttgtg

SEQ ID NO: 734521 - DNA, 25 bp, Mus musculus
taaacacttgtgtctcccagttgtg

SEQ ID NO: 734522 - DNA, 25 bp, Mus musculus
taaacagaagtcagtttgtcagatg

SEQ ID NO: 734523 - DNA, 25 bp, Mus musculus
taaacagaagtctgtttgtcagatg

SEQ ID NO: 734524 - DNA, 25 bp, Mus musculus
taaacagaatctcgtgattatgggt

SEQ ID NO: 734525 - DNA, 25 bp, Mus musculus
taaacagaatctggtgattatgggt

SEQ ID NO: 734526 - DNA, 25 bp, Mus musculus
taaacagacaatagaaatacatggt

SEQ ID NO: 734527 - DNA, 25 bp, Mus musculus
taaacagacaattgaaatacatggt

SEQ ID NO: 734528 - DNA, 25 bp, Mus musculus
taaacagacatgaagtcatcctggc

SEQ ID NO: 734529 - DNA, 25 bp, Mus musculus
taaacagacatgtagtcatcctggc

SEQ ID NO: 734530 - DNA, 25 bp, Mus musculus
taaacagaccccagagggtcaggga

SEQ ID NO: 734531 - DNA, 25 bp, Mus musculus
taaacagacccctgagggtcaggga

SEQ ID NO: 734532 - DNA, 25 bp, Mus musculus
taaacagagccaccaaaggaggact

SEQ ID NO: 734533 - DNA, 25 bp, Mus musculus
taaacagagccagcaaaggaggact

SEQ ID NO: 734534 - DNA, 25 bp, Mus musculus
taaacagagccgaacctcggtcttc

SEQ ID NO: 734535 - DNA, 25 bp, Mus musculus
taaacagagccgtacctcggtcttc

SEQ ID NO: 734536 - DNA, 25 bp, Mus musculus
taaacagaggctacagtcggcttct

SEQ ID NO: 734537 - DNA, 25 bp, Mus musculus
taaacagaggcttcagtcggcttct

SEQ ID NO: 734538 - DNA, 25 bp, Mus musculus
taaacagagttcatcgcaacctggc

SEQ ID NO: 734539 - DNA, 25 bp, Mus musculus
taaacagagttcttcgcaacctggc

SEQ ID NO: 734540 - DNA, 25 bp, Mus musculus
taaacagcagaaccgagtgtgtgct

SEQ ID NO: 734541 - DNA, 25 bp, Mus musculus
taaacagcagaagcgagtgtgtgct

SEQ ID NO: 734542 - DNA, 25 bp, Mus musculus
taaacagcagggattgagcacaatc

SEQ ID NO: 734543 - DNA, 25 bp, Mus musculus
taaacagcagggtttgagcacaatc

SEQ ID NO: 734544 - DNA, 25 bp, Mus musculus
taaacagccaggagaccgtcaaagt

SEQ ID NO: 734545 - DNA, 25 bp, Mus musculus
taaacagccaggtgaccgtcaaagt

SEQ ID NO: 734546 - DNA, 25 bp, Mus musculus
taaacagcctccaaaccacagactg

SEQ ID NO: 734547 - DNA, 25 bp, Mus musculus
taaacagcctcctaaccacagactg

SEQ ID NO: 734548 - DNA, 25 bp, Mus musculus
taaacagcgattcggccggcaggat

SEQ ID NO: 734549 - DNA, 25 bp, Mus musculus
taaacagcgattgggccggcaggat

SEQ ID NO: 734550 - DNA, 25 bp, Mus musculus
taaacagctggactctcagttacat

SEQ ID NO: 734551 - DNA, 25 bp, Mus musculus
taaacagctggagtctcagttacat

SEQ ID NO: 734552 - DNA, 25 bp, Mus musculus
taaacaggatggaggctggagtcac

SEQ ID NO: 734553 - DNA, 25 bp, Mus musculus
taaacaggatggtggctggagtcac

SEQ ID NO: 734554 - DNA, 25 bp, Mus musculus
taaacaggtagaaaaatgacttgcc

SEQ ID NO: 734555 - DNA, 25 bp, Mus musculus
taaacaggtagataaatgacttgcc

SEQ ID NO: 734556 - DNA, 25 bp, Mus musculus
taaacagtcactatttgacatgagt

SEQ ID NO: 734557 - DNA, 25 bp, Mus musculus
taaacagtcactttttgacatgagt

SEQ ID NO: 734558 - DNA, 25 bp, Mus musculus
taaacagtcagacgtgggtgcccgt

SEQ ID NO: 734559 - DNA, 25 bp, Mus musculus
taaacagtcagaggtgggtgcccgt

SEQ ID NO: 734560 - DNA, 25 bp, Mus musculus
taaacagtcagccagtgggaccaag

SEQ ID NO: 734561 - DNA, 25 bp, Mus musculus
taaacagtcagcgagtgggaccaag

SEQ ID NO: 734562 - DNA, 25 bp, Mus musculus
taaacagtgtgcagaagcagttgac

SEQ ID NO: 734563 - DNA, 25 bp, Mus musculus
taaacagtgtgctgaagcagttgac

SEQ ID NO: 734564 - DNA, 25 bp, Mus musculus
taaacataagtgctgactggctcca

SEQ ID NO: 734565 - DNA, 25 bp, Mus musculus
taaacataagtggtgactggctcca

SEQ ID NO: 734566 - DNA, 25 bp, Mus musculus
taaacataagttcatggtacagaca

SEQ ID NO: 734567 - DNA, 25 bp, Mus musculus
taaacataagttgatggtacagaca

SEQ ID NO: 734568 - DNA, 25 bp, Mus musculus
taaacatatttcctagaccaacggt

SEQ ID NO: 734569 - DNA, 25 bp, Mus musculus
taaacatatttcgtagaccaacggt

SEQ ID NO: 734570 - DNA, 25 bp, Mus musculus
taaacatccggtctgctcgacttca

SEQ ID NO: 734571 - DNA, 25 bp, Mus musculus
taaacatccggtgtgctcgacttca

SEQ ID NO: 734572 - DNA, 25 bp, Mus musculus
taaacatcctgtagttgagcacggc

SEQ ID NO: 734573 - DNA, 25 bp, Mus musculus
taaacatcctgttgttgagcacggc

SEQ ID NO: 734574 - DNA, 25 bp, Mus musculus
taaacatcgggccaagatggacgat

SEQ ID NO: 734575 - DNA, 25 bp, Mus musculus
taaacatcgggcgaagatggacgat

SEQ ID NO: 734576 - DNA, 25 bp, Mus musculus
taaacatgacccctgactgtgcctc

SEQ ID NO: 734577 - DNA, 25 bp, Mus musculus
taaacatgacccgtgactgtgcctc

SEQ ID NO: 734578 - DNA, 25 bp, Mus musculus
taaacatgagttctgagttcctgcg

SEQ ID NO: 734579 - DNA, 25 bp, Mus musculus
taaacatgagttgtgagttcctgcg

SEQ ID NO: 734580 - DNA, 25 bp, Mus musculus
taaacatgctgtccctaataaagct

SEQ ID NO: 734581 - DNA, 25 bp, Mus musculus
taaacatgctgtgcctaataaagct

SEQ ID NO: 734582 - DNA, 25 bp, Mus musculus
taaacatggcctctttagtgggcag

SEQ ID NO: 734583 - DNA, 25 bp, Mus musculus
taaacatggcctgtttagtgggcag

SEQ ID NO: 734584 - DNA, 25 bp, Mus musculus
taaacatggtgaagatctgcgccaa

SEQ ID NO: 734585 - DNA, 25 bp, Mus musculus
taaacatggtgatgatctgcgccaa

SEQ ID NO: 734586 - DNA, 25 bp, Mus musculus
taaacattatacattaaccatcacg

SEQ ID NO: 734587 - DNA, 25 bp, Mus musculus
taaacattatactttaaccatcacg

SEQ ID NO: 734588 - DNA, 25 bp, Mus musculus
taaacattgtgcatggtgacctcaa

SEQ ID NO: 734589 - DNA, 25 bp, Mus musculus
taaacattgtgcttggtgacctcaa

SEQ ID NO: 734590 - DNA, 25 bp, Mus musculus
taaaccaactacaaatgcaagtcag

SEQ ID NO: 734591 - DNA, 25 bp, Mus musculus
taaaccaactactaatgcaagtcag

SEQ ID NO: 734592 - DNA, 25 bp, Mus musculus
taaaccaagaggagatggcgcctgg

SEQ ID NO: 734593 - DNA, 25 bp, Mus musculus
taaaccaagaggtgatggcgcctgg

SEQ ID NO: 734594 - DNA, 25 bp, Mus musculus
taaaccacgtgtcgaaactccacca

SEQ ID NO: 734595 - DNA, 25 bp, Mus musculus
taaaccacgtgtggaaactccacca

SEQ ID NO: 734596 - DNA, 25 bp, Mus musculus
taaaccacttggataagacgtctca

SEQ ID NO: 734597 - DNA, 25 bp, Mus musculus
taaaccacttggttaagacgtctca

SEQ ID NO: 734598 - DNA, 25 bp, Mus musculus
taaaccagaagaccgaaatgaccca

SEQ ID NO: 734599 - DNA, 25 bp, Mus musculus
taaaccagaagagcgaaatgaccca

SEQ ID NO: 734600 - DNA, 25 bp, Mus musculus
taaaccagaataagcttatggctcg

SEQ ID NO: 734601 - DNA, 25 bp, Mus musculus
taaaccagaatatgcttatggctcg

SEQ ID NO: 734602 - DNA, 25 bp, Mus musculus
taaaccagatgtcggcagataacct

SEQ ID NO: 734603 - DNA, 25 bp, Mus musculus
taaaccagatgtgggcagataacct

SEQ ID NO: 734604 - DNA, 25 bp, Mus musculus
taaaccagccttcagatatgcagct

SEQ ID NO: 734605 - DNA, 25 bp, Mus musculus
taaaccagccttgagatatgcagct

SEQ ID NO: 734606 - DNA, 25 bp, Mus musculus
taaaccaggagtcctgcggcaagcg

SEQ ID NO: 734607 - DNA, 25 bp, Mus musculus
taaaccaggagtgctgcggcaagcg

SEQ ID NO: 734608 - DNA, 25 bp, Mus musculus
taaaccaggcgtcgccaacctgggc

SEQ ID NO: 734609 - DNA, 25 bp, Mus musculus
taaaccaggcgtggccaacctgggc

SEQ ID NO: 734610 - DNA, 25 bp, Mus musculus
taaaccagtagcagggtacaagcct

SEQ ID NO: 734611 - DNA, 25 bp, Mus musculus
taaaccagtagctgggtacaagcct

SEQ ID NO: 734612 - DNA, 25 bp, Mus musculus
taaaccagtccaacattttctgcaa

SEQ ID NO: 734613 - DNA, 25 bp, Mus musculus
taaaccagtccatcattttctgcaa

SEQ ID NO: 734614 - DNA, 25 bp, Mus musculus
taaaccagttctatcggtcctggcg

SEQ ID NO: 734615 - DNA, 25 bp, Mus musculus
taaaccagttctttcggtcctggcg

SEQ ID NO: 734616 - DNA, 25 bp, Mus musculus
taaaccatccttcctacagcctaga

SEQ ID NO: 734617 - DNA, 25 bp, Mus musculus
taaaccatccttgctacagcctaga

SEQ ID NO: 734618 - DNA, 25 bp, Mus musculus
taaaccatttacatcgggagctgag

SEQ ID NO: 734619 - DNA, 25 bp, Mus musculus
taaaccatttacttcgggagctgag

SEQ ID NO: 734620 - DNA, 25 bp, Mus musculus
taaaccccacgcagtaagtgccagt

SEQ ID NO: 734621 - DNA, 25 bp, Mus musculus
taaaccccacgctgtaagtgccagt

SEQ ID NO: 734622 - DNA, 25 bp, Mus musculus
taaacccctggtagataatagccat

SEQ ID NO: 734623 - DNA, 25 bp, Mus musculus
taaacccctggttgataatagccat

SEQ ID NO: 734624 - DNA, 25 bp, Mus musculus
taaacccgcactcgaatgagacctt

SEQ ID NO: 734625 - DNA, 25 bp, Mus musculus
taaacccgcactggaatgagacctt

SEQ ID NO: 734626 - DNA, 25 bp, Mus musculus
taaaccctgattaccggcaggaaat

SEQ ID NO: 734627 - DNA, 25 bp, Mus musculus
taaaccctgatttccggcaggaaat

SEQ ID NO: 734628 - DNA, 25 bp, Mus musculus
taaaccctgcgtatgctgctgaatt

SEQ ID NO: 734629 - DNA, 25 bp, Mus musculus
taaaccctgcgtttgctgctgaatt

SEQ ID NO: 734630 - DNA, 25 bp, Mus musculus
taaacccttcatcctaccgggatgc

SEQ ID NO: 734631 - DNA, 25 bp, Mus musculus
taaacccttcatgctaccgggatgc

SEQ ID NO: 734632 - DNA, 25 bp, Mus musculus
taaacccttggaaacctttcttctg

SEQ ID NO: 734633 - DNA, 25 bp, Mus musculus
taaacccttggatacctttcttctg

SEQ ID NO: 734634 - DNA, 25 bp, Mus musculus
taaaccgaaagccagtgagtggcat

SEQ ID NO: 734635 - DNA, 25 bp, Mus musculus
taaaccgaaagcgagtgagtggcat

SEQ ID NO: 734636 - DNA, 25 bp, Mus musculus
taaaccgaacaccactgatgagact

SEQ ID NO: 734637 - DNA, 25 bp, Mus musculus
taaaccgaacacgactgatgagact

SEQ ID NO: 734638 - DNA, 25 bp, Mus musculus
taaaccgaatagagcgagccactgg

SEQ ID NO: 734639 - DNA, 25 bp, Mus musculus
taaaccgaatagtgcgagccactgg

SEQ ID NO: 734640 - DNA, 25 bp, Mus musculus
taaaccgactcccatgtgaatgagg

SEQ ID NO: 734641 - DNA, 25 bp, Mus musculus
taaaccgactccgatgtgaatgagg

SEQ ID NO: 734642 - DNA, 25 bp, Mus musculus
taaaccgcaagtccatatccagatg

SEQ ID NO: 734643 - DNA, 25 bp, Mus musculus
taaaccgcaagtgcatatccagatg

SEQ ID NO: 734644 - DNA, 25 bp, Mus musculus
taaaccgcgatgaatgagcagaagc

SEQ ID NO: 734645 - DNA, 25 bp, Mus musculus
taaaccgcgatgtatgagcagaagc

SEQ ID NO: 734646 - DNA, 25 bp, Mus musculus
taaaccgcgggcagccgcatcgtgc

SEQ ID NO: 734647 - DNA, 25 bp, Mus musculus
taaaccgcgggctgccgcatcgtgc

SEQ ID NO: 734648 - DNA, 25 bp, Mus musculus
taaaccggccagagaagaggaatgc

SEQ ID NO: 734649 - DNA, 25 bp, Mus musculus
taaaccggccagtgaagaggaatgc

SEQ ID NO: 734650 - DNA, 25 bp, Mus musculus
taaaccggcgtaagggccctgctgt

SEQ ID NO: 734651 - DNA, 25 bp, Mus musculus
taaaccggcgtatgggccctgctgt

SEQ ID NO: 734652 - DNA, 25 bp, Mus musculus
taaacctagaatagagctgtctgcc

SEQ ID NO: 734653 - DNA, 25 bp, Mus musculus
taaacctagaattgagctgtctgcc

SEQ ID NO: 734654 - DNA, 25 bp, Mus musculus
taaacctagtccagatttatcagag

SEQ ID NO: 734655 - DNA, 25 bp, Mus musculus
taaacctagtcctgatttatcagag

SEQ ID NO: 734656 - DNA, 25 bp, Mus musculus
taaacctatcatcatggaaggagcc

SEQ ID NO: 734657 - DNA, 25 bp, Mus musculus
taaacctatcatgatggaaggagcc

SEQ ID NO: 734658 - DNA, 25 bp, Mus musculus
taaacctgaagaactatcacctaag

SEQ ID NO: 734659 - DNA, 25 bp, Mus musculus
taaacctgaagatctatcacctaag

SEQ ID NO: 734660 - DNA, 25 bp, Mus musculus
taaacctgaggtccaaggatacctg

SEQ ID NO: 734661 - DNA, 25 bp, Mus musculus
taaacctgaggtgcaaggatacctg

SEQ ID NO: 734662 - DNA, 25 bp, Mus musculus
taaacctgagtaccaaatgtaggca

SEQ ID NO: 734663 - DNA, 25 bp, Mus musculus
taaacctgagtagcaaatgtaggca

SEQ ID NO: 734664 - DNA, 25 bp, Mus musculus
taaacctgatgtaagaggagcttcg

SEQ ID NO: 734665 - DNA, 25 bp, Mus musculus
taaacctgatgttagaggagcttcg

SEQ ID NO: 734666 - DNA, 25 bp, Mus musculus
taaacctggaagactggcaacaaaa

SEQ ID NO: 734667 - DNA, 25 bp, Mus musculus
taaacctggaagtctggcaacaaaa

SEQ ID NO: 734668 - DNA, 25 bp, Mus musculus
taaacctggtctctggcctcgtgtg

SEQ ID NO: 734669 - DNA, 25 bp, Mus musculus
taaacctggtctgtggcctcgtgtg

SEQ ID NO: 734670 - DNA, 25 bp, Mus musculus
taaacctgtgaacagcatcatggct

SEQ ID NO: 734671 - DNA, 25 bp, Mus musculus
taaacctgtgaagagcatcatggct

SEQ ID NO: 734672 - DNA, 25 bp, Mus musculus
taaaccttacctcttgcctggagac

SEQ ID NO: 734673 - DNA, 25 bp, Mus musculus
taaaccttacctgttgcctggagac

SEQ ID NO: 734674 - DNA, 25 bp, Mus musculus
taaacgaagccaatttcagtgccaa

SEQ ID NO: 734675 - DNA, 25 bp, Mus musculus
taaacgaagccattttcagtgccaa

SEQ ID NO: 734676 - DNA, 25 bp, Mus musculus
taaacgaagtcgcaagaagccacgc

SEQ ID NO: 734677 - DNA, 25 bp, Mus musculus
taaacgaagtcggaagaagccacgc

SEQ ID NO: 734678 - DNA, 25 bp, Mus musculus
taaacgaatactcgaaaatccacag

SEQ ID NO: 734679 - DNA, 25 bp, Mus musculus
taaacgaatactggaaaatccacag

SEQ ID NO: 734680 - DNA, 25 bp, Mus musculus
taaacgacaaaaaggcagagtacac

SEQ ID NO: 734681 - DNA, 25 bp, Mus musculus
taaacgacaaaatggcagagtacac

SEQ ID NO: 734682 - DNA, 25 bp, Mus musculus
taaacgacacaaaagagcttcggga

SEQ ID NO: 734683 - DNA, 25 bp, Mus musculus
taaacgacacaatagagcttcggga

SEQ ID NO: 734684 - DNA, 25 bp, Mus musculus
taaacgaccgcaataaggagctagg

SEQ ID NO: 734685 - DNA, 25 bp, Mus musculus
taaacgaccgcattaaggagctagg

SEQ ID NO: 734686 - DNA, 25 bp, Mus musculus
taaacgacctctacagccgcaagtt

SEQ ID NO: 734687 - DNA, 25 bp, Mus musculus
taaacgacctcttcagccgcaagtt

SEQ ID NO: 734688 - DNA, 25 bp, Mus musculus
taaacgagtcccagcgggaccagct

SEQ ID NO: 734689 - DNA, 25 bp, Mus musculus
taaacgagtccctgcgggaccagct

SEQ ID NO: 734690 - DNA, 25 bp, Mus musculus
taaacgatggataaatgaagcccaa

SEQ ID NO: 734691 - DNA, 25 bp, Mus musculus
taaacgatggattaatgaagcccaa

SEQ ID NO: 734692 - DNA, 25 bp, Mus musculus
taaacgatgtagagtattttgcccc

SEQ ID NO: 734693 - DNA, 25 bp, Mus musculus
taaacgatgtagtgtattttgcccc

SEQ ID NO: 734694 - DNA, 25 bp, Mus musculus
taaacgcagggaaccagactctgtc

SEQ ID NO: 734695 - DNA, 25 bp, Mus musculus
taaacgcagggatccagactctgtc

SEQ ID NO: 734696 - DNA, 25 bp, Mus musculus
taaacgcattcccatctacgagaag

SEQ ID NO: 734697 - DNA, 25 bp, Mus musculus
taaacgcattccgatctacgagaag

SEQ ID NO: 734698 - DNA, 25 bp, Mus musculus
taaacgcctcgcacctgggaggtgt

SEQ ID NO: 734699 - DNA, 25 bp, Mus musculus
taaacgcctcgctcctgggaggtgt

SEQ ID NO: 734700 - DNA, 25 bp, Mus musculus
taaacgctgtgcatccaaagtacca

SEQ ID NO: 734701 - DNA, 25 bp, Mus musculus
taaacgctgtgcttccaaagtacca

SEQ ID NO: 734702 - DNA, 25 bp, Mus musculus
taaacggcaggaagatgcaactcca

SEQ ID NO: 734703 - DNA, 25 bp, Mus musculus
taaacggcaggatgatgcaactcca

SEQ ID NO: 734704 - DNA, 25 bp, Mus musculus
taaacggcctgtcgactgtgggcat

SEQ ID NO: 734705 - DNA, 25 bp, Mus musculus
taaacggcctgtggactgtgggcat

SEQ ID NO: 734706 - DNA, 25 bp, Mus musculus
taaacggctaagcaaaaatgtgaag

SEQ ID NO: 734707 - DNA, 25 bp, Mus musculus
taaacggctaaggaaaaatgtgaag

SEQ ID NO: 734708 - DNA, 25 bp, Mus musculus
taaacgggaggcaagggcaaaccag

SEQ ID NO: 734709 - DNA, 25 bp, Mus musculus
taaacgggaggctagggcaaaccag

SEQ ID NO: 734710 - DNA, 25 bp, Mus musculus
taaacggtctcacagcggagctatc

SEQ ID NO: 734711 - DNA, 25 bp, Mus musculus
taaacggtctcagagcggagctatc

SEQ ID NO: 734712 - DNA, 25 bp, Mus musculus
taaacgtaagggaggcagtagcatt

SEQ ID NO: 734713 - DNA, 25 bp, Mus musculus
taaacgtaagggtggcagtagcatt

SEQ ID NO: 734714 - DNA, 25 bp, Mus musculus
taaacgtcatcacggaaacacagtg

SEQ ID NO: 734715 - DNA, 25 bp, Mus musculus
taaacgtcatcagggaaacacagtg

SEQ ID NO: 734716 - DNA, 25 bp, Mus musculus
taaacgtctggaaagtgctcttctg

SEQ ID NO: 734717 - DNA, 25 bp, Mus musculus
taaacgtctggatagtgctcttctg

SEQ ID NO: 734718 - DNA, 25 bp, Mus musculus
taaacgtgcgctactggagactgag

SEQ ID NO: 734719 - DNA, 25 bp, Mus musculus
taaacgtgcgcttctggagactgag

SEQ ID NO: 734720 - DNA, 25 bp, Mus musculus
taaacgtgtaggagttccgtctaca

SEQ ID NO: 734721 - DNA, 25 bp, Mus musculus
taaacgtgtaggtgttccgtctaca

SEQ ID NO: 734722 - DNA, 25 bp, Mus musculus
taaacgtgtcctagttcaacgctgg

SEQ ID NO: 734723 - DNA, 25 bp, Mus musculus
taaacgtgtccttgttcaacgctgg

SEQ ID NO: 734724 - DNA, 25 bp, Mus musculus
taaacgtgtgccacttaatggcggt

SEQ ID NO: 734725 - DNA, 25 bp, Mus musculus
taaacgtgtgcctcttaatggcggt

SEQ ID NO: 734726 - DNA, 25 bp, Mus musculus
taaactaaagacactgccttccgtg

SEQ ID NO: 734727 - DNA, 25 bp, Mus musculus
taaactaaagactctgccttccgtg

SEQ ID NO: 734728 - DNA, 25 bp, Mus musculus
taaactacataaatcagggccttcc

SEQ ID NO: 734729 - DNA, 25 bp, Mus musculus
taaactacataattcagggccttcc

SEQ ID NO: 734730 - DNA, 25 bp, Mus musculus
taaactaccactaaatccaactgct

SEQ ID NO: 734731 - DNA, 25 bp, Mus musculus
taaactaccacttaatccaactgct

SEQ ID NO: 734732 - DNA, 25 bp, Mus musculus
taaactaccccaatggatgcagaca

SEQ ID NO: 734733 - DNA, 25 bp, Mus musculus
taaactaccccattggatgcagaca

SEQ ID NO: 734734 - DNA, 25 bp, Mus musculus
taaactaccgtaacccgtgctggct

SEQ ID NO: 734735 - DNA, 25 bp, Mus musculus
taaactaccgtatcccgtgctggct

SEQ ID NO: 734736 - DNA, 25 bp, Mus musculus
taaactactcaacgaaccctctgga

SEQ ID NO: 734737 - DNA, 25 bp, Mus musculus
taaactactcaaggaaccctctgga

SEQ ID NO: 734738 - DNA, 25 bp, Mus musculus
taaactactgctagattttgctgct

SEQ ID NO: 734739 - DNA, 25 bp, Mus musculus
taaactactgcttgattttgctgct

SEQ ID NO: 734740 - DNA, 25 bp, Mus musculus
taaactacttgaaggttatgaggaa

SEQ ID NO: 734741 - DNA, 25 bp, Mus musculus
taaactacttgatggttatgaggaa

SEQ ID NO: 734742 - DNA, 25 bp, Mus musculus
taaactagactacaggagtgtccgg

SEQ ID NO: 734743 - DNA, 25 bp, Mus musculus
taaactagactagaggagtgtccgg

SEQ ID NO: 734744 - DNA, 25 bp, Mus musculus
taaactagactcagagcgacacaga

SEQ ID NO: 734745 - DNA, 25 bp, Mus musculus
taaactagactctgagcgacacaga

SEQ ID NO: 734746 - DNA, 25 bp, Mus musculus
taaactagctccaaggaactgcagc

SEQ ID NO: 734747 - DNA, 25 bp, Mus musculus
taaactagctcctaggaactgcagc

SEQ ID NO: 734748 - DNA, 25 bp, Mus musculus
taaactagtcatacatgtacccaca

SEQ ID NO: 734749 - DNA, 25 bp, Mus musculus
taaactagtcattcatgtacccaca

SEQ ID NO: 734750 - DNA, 25 bp, Mus musculus
taaactatcatgaactggccaggag

SEQ ID NO: 734751 - DNA, 25 bp, Mus musculus
taaactatcatgtactggccaggag

SEQ ID NO: 734752 - DNA, 25 bp, Mus musculus
taaactcagagcagcagcggcacta

SEQ ID NO: 734753 - DNA, 25 bp, Mus musculus
taaactcagagctgcagcggcacta

SEQ ID NO: 734754 - DNA, 25 bp, Mus musculus
taaactcagccaacagtaacgtcat

SEQ ID NO: 734755 - DNA, 25 bp, Mus musculus
taaactcagccatcagtaacgtcat

SEQ ID NO: 734756 - DNA, 25 bp, Mus musculus
taaactcaggctctacttggagcag

SEQ ID NO: 734757 - DNA, 25 bp, Mus musculus
taaactcaggctgtacttggagcag

SEQ ID NO: 734758 - DNA, 25 bp, Mus musculus
taaactcatcttccacaagatacag

SEQ ID NO: 734759 - DNA, 25 bp, Mus musculus
taaactcatcttgcacaagatacag

SEQ ID NO: 734760 - DNA, 25 bp, Mus musculus
taaactccaagactttgcttacgtc

SEQ ID NO: 734761 - DNA, 25 bp, Mus musculus
taaactccaagagtttgcttacgtc

SEQ ID NO: 734762 - DNA, 25 bp, Mus musculus
taaactccagatactagaacttaga

SEQ ID NO: 734763 - DNA, 25 bp, Mus musculus
taaactccagattctagaacttaga

SEQ ID NO: 734764 - DNA, 25 bp, Mus musculus
taaactccttcgacaggacaagaaa

SEQ ID NO: 734765 - DNA, 25 bp, Mus musculus
taaactccttcgtcaggacaagaaa

SEQ ID NO: 734766 - DNA, 25 bp, Mus musculus
taaactctaggcagcaacttcaaga

SEQ ID NO: 734767 - DNA, 25 bp, Mus musculus
taaactctaggctgcaacttcaaga

SEQ ID NO: 734768 - DNA, 25 bp, Mus musculus
taaactctgcccaaaagaccagcag

SEQ ID NO: 734769 - DNA, 25 bp, Mus musculus
taaactctgccctaaagaccagcag

SEQ ID NO: 734770 - DNA, 25 bp, Mus musculus
taaactctggaaccaagaactgtgg

SEQ ID NO: 734771 - DNA, 25 bp, Mus musculus
taaactctggaagcaagaactgtgg

SEQ ID NO: 734772 - DNA, 25 bp, Mus musculus
taaactctggcaatttgacttgaat

SEQ ID NO: 734773 - DNA, 25 bp, Mus musculus
taaactctggcattttgacttgaat

SEQ ID NO: 734774 - DNA, 25 bp, Mus musculus
taaactctgtaccagctacagccac

SEQ ID NO: 734775 - DNA, 25 bp, Mus musculus
taaactctgtacgagctacagccac

SEQ ID NO: 734776 - DNA, 25 bp, Mus musculus
taaactcttggcacttgcggtggct

SEQ ID NO: 734777 - DNA, 25 bp, Mus musculus
taaactcttggcatcactggtgaaa

SEQ ID NO: 734778 - DNA, 25 bp, Mus musculus
taaactcttggctcttgcggtggct

SEQ ID NO: 734779 - DNA, 25 bp, Mus musculus
taaactcttggcttcactggtgaaa

SEQ ID NO: 734780 - DNA, 25 bp, Mus musculus
taaactgaaaagaaaggcgcctcac

SEQ ID NO: 734781 - DNA, 25 bp, Mus musculus
taaactgaaaagtaaggcgcctcac

SEQ ID NO: 734782 - DNA, 25 bp, Mus musculus
taaactgaatcacgtttccaacaac

SEQ ID NO: 734783 - DNA, 25 bp, Mus musculus
taaactgaatcaggtttccaacaac

SEQ ID NO: 734784 - DNA, 25 bp, Mus musculus
taaactgaggcacttggtaactgca

SEQ ID NO: 734785 - DNA, 25 bp, Mus musculus
taaactgaggcagttggtaactgca

SEQ ID NO: 734786 - DNA, 25 bp, Mus musculus
taaactgagtttacaaggagatacc

SEQ ID NO: 734787 - DNA, 25 bp, Mus musculus
taaactgagttttcaaggagatacc

SEQ ID NO: 734788 - DNA, 25 bp, Mus musculus
taaactgatctaccggcaatatgca

SEQ ID NO: 734789 - DNA, 25 bp, Mus musculus
taaactgatctagcggcaatatgca

SEQ ID NO: 734790 - DNA, 25 bp, Mus musculus
taaactgatgagaggtgttgaccgt

SEQ ID NO: 734791 - DNA, 25 bp, Mus musculus
taaactgatgagtggtgttgaccgt

SEQ ID NO: 734792 - DNA, 25 bp, Mus musculus
taaactgcacttcggcagaccaaca

SEQ ID NO: 734793 - DNA, 25 bp, Mus musculus
taaactgcacttgggcagaccaaca

SEQ ID NO: 734794 - DNA, 25 bp, Mus musculus
taaactgcagccacgagctctggaa

SEQ ID NO: 734795 - DNA, 25 bp, Mus musculus
taaactgcagcctcgagctctggaa

SEQ ID NO: 734796 - DNA, 25 bp, Mus musculus
taaactggaaaaagagaggctatgt

SEQ ID NO: 734797 - DNA, 25 bp, Mus musculus
taaactggaaaatgagaggctatgt

SEQ ID NO: 734798 - DNA, 25 bp, Mus musculus
taaactggatgacaccaaattccgc

SEQ ID NO: 734799 - DNA, 25 bp, Mus musculus
taaactggatgagaccaaattccgc

SEQ ID NO: 734800 - DNA, 25 bp, Mus musculus
taaactggccacaaatgctgcagtc

SEQ ID NO: 734801 - DNA, 25 bp, Mus musculus
taaactggccactaatgctgcagtc

SEQ ID NO: 734802 - DNA, 25 bp, Mus musculus
taaactgggatgatctgtaccacaa

SEQ ID NO: 734803 - DNA, 25 bp, Mus musculus
taaactgggatgttctgtaccacaa

SEQ ID NO: 734804 - DNA, 25 bp, Mus musculus
taaactgggcaacaacaccaagtag

SEQ ID NO: 734805 - DNA, 25 bp, Mus musculus
taaactgggcaagaacaccaagtag

SEQ ID NO: 734806 - DNA, 25 bp, Mus musculus
taaactgggcagagggcccttcagt

SEQ ID NO: 734807 - DNA, 25 bp, Mus musculus
taaactgggcagtgggcccttcagt

SEQ ID NO: 734808 - DNA, 25 bp, Mus musculus
taaactgggtacctatgaagtgtct

SEQ ID NO: 734809 - DNA, 25 bp, Mus musculus
taaactgggtacgtatgaagtgtct

SEQ ID NO: 734810 - DNA, 25 bp, Mus musculus
taaactggtggcctcggaacagttg

SEQ ID NO: 734811 - DNA, 25 bp, Mus musculus
taaactggtggcgtcggaacagttg

SEQ ID NO: 734812 - DNA, 25 bp, Mus musculus
taaactgtatccagagctctctcaa

SEQ ID NO: 734813 - DNA, 25 bp, Mus musculus
taaactgtatcctgagctctctcaa

SEQ ID NO: 734814 - DNA, 25 bp, Mus musculus
taaactgtcagtctccttaacaagc

SEQ ID NO: 734815 - DNA, 25 bp, Mus musculus
taaactgtcagtgtccttaacaagc

SEQ ID NO: 734816 - DNA, 25 bp, Mus musculus
taaactgtctggcaaacagttggcc

SEQ ID NO: 734817 - DNA, 25 bp, Mus musculus
taaactgtctgggaaacagttggcc

SEQ ID NO: 734818 - DNA, 25 bp, Mus musculus
taaactgtgctcaaaatgggagaac

SEQ ID NO: 734819 - DNA, 25 bp, Mus musculus
taaactgtgctctaaatgggagaac

SEQ ID NO: 734820 - DNA, 25 bp, Mus musculus
taaactgtgtaacatattcagcacc

SEQ ID NO: 734821 - DNA, 25 bp, Mus musculus
taaactgtgtaagatattcagcacc

SEQ ID NO: 734822 - DNA, 25 bp, Mus musculus
taaacttaacatcttggaccaactg

SEQ ID NO: 734823 - DNA, 25 bp, Mus musculus
taaacttaacatgttggaccaactg

SEQ ID NO: 734824 - DNA, 25 bp, Mus musculus
taaacttaagatcgaagactctcag

SEQ ID NO: 734825 - DNA, 25 bp, Mus musculus
taaacttaagatggaagactctcag

SEQ ID NO: 734826 - DNA, 25 bp, Mus musculus
taaacttactgcatgaattcctgca

SEQ ID NO: 734827 - DNA, 25 bp, Mus musculus
taaacttactgcttgaattcctgca

SEQ ID NO: 734828 - DNA, 25 bp, Mus musculus
taaacttagtgacaccacgttggcc

SEQ ID NO: 734829 - DNA, 25 bp, Mus musculus
taaacttagtgagaccacgttggcc

SEQ ID NO: 734830 - DNA, 25 bp, Mus musculus
taaacttatagcctgggaacgtact

SEQ ID NO: 734831 - DNA, 25 bp, Mus musculus
taaacttatagcgtgggaacgtact

SEQ ID NO: 734832 - DNA, 25 bp, Mus musculus
taaacttcaacaccacggtatccct

SEQ ID NO: 734833 - DNA, 25 bp, Mus musculus
taaacttcaacagcacggtatccct

SEQ ID NO: 734834 - DNA, 25 bp, Mus musculus
taaacttcagaacactctgatccag

SEQ ID NO: 734835 - DNA, 25 bp, Mus musculus
taaacttcagaagactctgatccag

SEQ ID NO: 734836 - DNA, 25 bp, Mus musculus
taaacttcccaaagagtacagctgg

SEQ ID NO: 734837 - DNA, 25 bp, Mus musculus
taaacttcccaatgagtacagctgg

SEQ ID NO: 734838 - DNA, 25 bp, Mus musculus
taaacttcctgcatccaaatcatca

SEQ ID NO: 734839 - DNA, 25 bp, Mus musculus
taaacttcctgcttccaaatcatca

SEQ ID NO: 734840 - DNA, 25 bp, Mus musculus
taaacttcgcagatttccagctgca

SEQ ID NO: 734841 - DNA, 25 bp, Mus musculus
taaacttcgcagttttccagctgca

SEQ ID NO: 734842 - DNA, 25 bp, Mus musculus
taaacttcgtgcaccccaatgtcag

SEQ ID NO: 734843 - DNA, 25 bp, Mus musculus
taaacttcgtgctccccaatgtcag

SEQ ID NO: 734844 - DNA, 25 bp, Mus musculus
taaacttcgtgtcgtgggaggccat

SEQ ID NO: 734845 - DNA, 25 bp, Mus musculus
taaacttcgtgtggtgggaggccat

SEQ ID NO: 734846 - DNA, 25 bp, Mus musculus
taaacttctctacctttggacttca

SEQ ID NO: 734847 - DNA, 25 bp, Mus musculus
taaacttctctactataagtcagcc

SEQ ID NO: 734848 - DNA, 25 bp, Mus musculus
taaacttctctagctttggacttca

SEQ ID NO: 734849 - DNA, 25 bp, Mus musculus
taaacttctctagtataagtcagcc

SEQ ID NO: 734850 - DNA, 25 bp, Mus musculus
taaacttgaacgaccactaaaggag

SEQ ID NO: 734851 - DNA, 25 bp, Mus musculus
taaacttgaacgtccactaaaggag

SEQ ID NO: 734852 - DNA, 25 bp, Mus musculus
taaacttgaactagtggtggtgttc

SEQ ID NO: 734853 - DNA, 25 bp, Mus musculus
taaacttgaacttgtggtggtgttc

SEQ ID NO: 734854 - DNA, 25 bp, Mus musculus
taaacttgactccaccagtgggcag

SEQ ID NO: 734855 - DNA, 25 bp, Mus musculus
taaacttgactcgaccagtgggcag

SEQ ID NO: 734856 - DNA, 25 bp, Mus musculus
taaacttggaaaagctgcctcctga

SEQ ID NO: 734857 - DNA, 25 bp, Mus musculus
taaacttggaaatgctgcctcctga

SEQ ID NO: 734858 - DNA, 25 bp, Mus musculus
taaacttggtgaccaaatggccatg

SEQ ID NO: 734859 - DNA, 25 bp, Mus musculus
taaacttggtgaccagacagtcgaa

SEQ ID NO: 734860 - DNA, 25 bp, Mus musculus
taaacttggtgagcaaatggccatg

SEQ ID NO: 734861 - DNA, 25 bp, Mus musculus
taaacttggtgagcagacagtcgaa

SEQ ID NO: 734862 - DNA, 25 bp, Mus musculus
taaacttggtggcacagggcccagc

SEQ ID NO: 734863 - DNA, 25 bp, Mus musculus
taaacttggtgggacagggcccagc

SEQ ID NO: 734864 - DNA, 25 bp, Mus musculus
taaacttgtccgaagcgccaccctt

SEQ ID NO: 734865 - DNA, 25 bp, Mus musculus
taaacttgtccgtagcgccaccctt

SEQ ID NO: 734866 - DNA, 25 bp, Mus musculus
taaactttccacagagagctagagg

SEQ ID NO: 734867 - DNA, 25 bp, Mus musculus
taaactttccactgagagctagagg

SEQ ID NO: 734868 - DNA, 25 bp, Mus musculus
taaactttccttcgcactgagctgg

SEQ ID NO: 734869 - DNA, 25 bp, Mus musculus
taaactttccttggcactgagctgg

SEQ ID NO: 734870 - DNA, 25 bp, Mus musculus
taaactttctctactgctctagcgc

SEQ ID NO: 734871 - DNA, 25 bp, Mus musculus
taaactttctcttctgctctagcgc

SEQ ID NO: 734872 - DNA, 25 bp, Mus musculus
taaactttgacaccagtctgccaac

SEQ ID NO: 734873 - DNA, 25 bp, Mus musculus
taaactttgacagcagtctgccaac

SEQ ID NO: 734874 - DNA, 25 bp, Mus musculus
taaactttgcaacgttttgtgccta

SEQ ID NO: 734875 - DNA, 25 bp, Mus musculus
taaactttgcaaggttttgtgccta

SEQ ID NO: 734876 - DNA, 25 bp, Mus musculus
taaactttggcgctatttcagctta

SEQ ID NO: 734877 - DNA, 25 bp, Mus musculus
taaactttggcggtatttcagctta

SEQ ID NO: 734878 - DNA, 25 bp, Mus musculus
taaacttttcataggccaacaccag

SEQ ID NO: 734879 - DNA, 25 bp, Mus musculus
taaacttttcattggccaacaccag

SEQ ID NO: 734880 - DNA, 25 bp, Mus musculus
taaagaaaaaatcccagaacatcca

SEQ ID NO: 734881 - DNA, 25 bp, Mus musculus
taaagaaaaaatgccagaacatcca

SEQ ID NO: 734882 - DNA, 25 bp, Mus musculus
taaagaaaattgacattccgtctgt

SEQ ID NO: 734883 - DNA, 25 bp, Mus musculus
taaagaaaattgtcattccgtctgt

SEQ ID NO: 734884 - DNA, 25 bp, Mus musculus
taaagaaacctgaacccttcagtga

SEQ ID NO: 734885 - DNA, 25 bp, Mus musculus
taaagaaacctgtacccttcagtga

SEQ ID NO: 734886 - DNA, 25 bp, Mus musculus
taaagaaagagcaaacgtggatggg

SEQ ID NO: 734887 - DNA, 25 bp, Mus musculus
taaagaaagagctaacgtggatggg

SEQ ID NO: 734888 - DNA, 25 bp, Mus musculus
taaagaaaggaactaacggagctgc

SEQ ID NO: 734889 - DNA, 25 bp, Mus musculus
taaagaaaggaagtaacggagctgc

SEQ ID NO: 734890 - DNA, 25 bp, Mus musculus
taaagaaaggataggctatcctgat

SEQ ID NO: 734891 - DNA, 25 bp, Mus musculus
taaagaaaggattggctatcctgat

SEQ ID NO: 734892 - DNA, 25 bp, Mus musculus
taaagaaagtccagtaaagtgctgg

SEQ ID NO: 734893 - DNA, 25 bp, Mus musculus
taaagaaagtcctgtaaagtgctgg

SEQ ID NO: 734894 - DNA, 25 bp, Mus musculus
taaagaaatagccaaaaaggcgcag

SEQ ID NO: 734895 - DNA, 25 bp, Mus musculus
taaagaaatagcgaaaaaggcgcag

SEQ ID NO: 734896 - DNA, 25 bp, Mus musculus
taaagaaatcataaatggatggaga

SEQ ID NO: 734897 - DNA, 25 bp, Mus musculus
taaagaaatcattaatggatggaga

SEQ ID NO: 734898 - DNA, 25 bp, Mus musculus
taaagaaattgactaaagccagaca

SEQ ID NO: 734899 - DNA, 25 bp, Mus musculus
taaagaaattgagtaaagccagaca

SEQ ID NO: 734900 - DNA, 25 bp, Mus musculus
taaagaaattgtatctgggcacggc

SEQ ID NO: 734901 - DNA, 25 bp, Mus musculus
taaagaaattgtttctgggcacggc

SEQ ID NO: 734902 - DNA, 25 bp, Mus musculus
taaagaacagctccaacgatgagac

SEQ ID NO: 734903 - DNA, 25 bp, Mus musculus
taaagaacagctgcaacgatgagac

SEQ ID NO: 734904 - DNA, 25 bp, Mus musculus
taaagaacaggtactagaacccatg

SEQ ID NO: 734905 - DNA, 25 bp, Mus musculus
taaagaacaggttctagaacccatg

SEQ ID NO: 734906 - DNA, 25 bp, Mus musculus
taaagaacagttctgggatccttgg

SEQ ID NO: 734907 - DNA, 25 bp, Mus musculus
taaagaacagttgtgggatccttgg

SEQ ID NO: 734908 - DNA, 25 bp, Mus musculus
taaagaacatctccctgtcactaag

SEQ ID NO: 734909 - DNA, 25 bp, Mus musculus
taaagaacatctgcctgtcactaag

SEQ ID NO: 734910 - DNA, 25 bp, Mus musculus
taaagaacattgcaagcatggtgcg

SEQ ID NO: 734911 - DNA, 25 bp, Mus musculus
taaagaacattggaagcatggtgcg

SEQ ID NO: 734912 - DNA, 25 bp, Mus musculus
taaagaaccagtaacctgcgagact

SEQ ID NO: 734913 - DNA, 25 bp, Mus musculus
taaagaaccagttacctgcgagact

SEQ ID NO: 734914 - DNA, 25 bp, Mus musculus
taaagaacgagcagggagatgcaac

SEQ ID NO: 734915 - DNA, 25 bp, Mus musculus
taaagaacgagctgggagatgcaac

SEQ ID NO: 734916 - DNA, 25 bp, Mus musculus
taaagaacgcttctctgtggaggtg

SEQ ID NO: 734917 - DNA, 25 bp, Mus musculus
taaagaacgcttgtctgtggaggtg

SEQ ID NO: 734918 - DNA, 25 bp, Mus musculus
taaagaactgccaacactaaaggat

SEQ ID NO: 734919 - DNA, 25 bp, Mus musculus
taaagaactgcctacactaaaggat

SEQ ID NO: 734920 - DNA, 25 bp, Mus musculus
taaagaacttgtctatcctccaggt

SEQ ID NO: 734921 - DNA, 25 bp, Mus musculus
taaagaacttgtgtatcctccaggt

SEQ ID NO: 734922 - DNA, 25 bp, Mus musculus
taaagaagaaccagagcggagagcc

SEQ ID NO: 734923 - DNA, 25 bp, Mus musculus
taaagaagaacctgagcggagagcc

SEQ ID NO: 734924 - DNA, 25 bp, Mus musculus
taaagaagaaggcagagcgctgtgc

SEQ ID NO: 734925 - DNA, 25 bp, Mus musculus
taaagaagaagggagagcgctgtgc

SEQ ID NO: 734926 - DNA, 25 bp, Mus musculus
taaagaagactcagaacatctgatt

SEQ ID NO: 734927 - DNA, 25 bp, Mus musculus
taaagaagactctgaacatctgatt

SEQ ID NO: 734928 - DNA, 25 bp, Mus musculus
taaagaagaggaaggcactgctagt

SEQ ID NO: 734929 - DNA, 25 bp, Mus musculus
taaagaagaggatggcactgctagt

SEQ ID NO: 734930 - DNA, 25 bp, Mus musculus
taaagaagagggacttagttcctct

SEQ ID NO: 734931 - DNA, 25 bp, Mus musculus
taaagaagagggtcttagttcctct

SEQ ID NO: 734932 - DNA, 25 bp, Mus musculus
taaagaagagttattcataggctca

SEQ ID NO: 734933 - DNA, 25 bp, Mus musculus
taaagaagagtttttcataggctca

SEQ ID NO: 734934 - DNA, 25 bp, Mus musculus
taaagaagccagactacgtgacgac

SEQ ID NO: 734935 - DNA, 25 bp, Mus musculus
taaagaagccagtctacgtgacgac

SEQ ID NO: 734936 - DNA, 25 bp, Mus musculus
taaagaagcccacgacgacctggtg

SEQ ID NO: 734937 - DNA, 25 bp, Mus musculus
taaagaagcccaggacgacctggtg

SEQ ID NO: 734938 - DNA, 25 bp, Mus musculus
taaagaagcccgatcttgtgggcga

SEQ ID NO: 734939 - DNA, 25 bp, Mus musculus
taaagaagcccgttcttgtgggcga

SEQ ID NO: 734940 - DNA, 25 bp, Mus musculus
taaagaagctcccagaaaaagtgga

SEQ ID NO: 734941 - DNA, 25 bp, Mus musculus
taaagaagctccgagaaaaagtgga

SEQ ID NO: 734942 - DNA, 25 bp, Mus musculus
taaagaaggcccagtgatgatactt

SEQ ID NO: 734943 - DNA, 25 bp, Mus musculus
taaagaaggccctgtgatgatactt

SEQ ID NO: 734944 - DNA, 25 bp, Mus musculus
taaagaagtaaacattttggacagc

SEQ ID NO: 734945 - DNA, 25 bp, Mus musculus
taaagaagtaaagattttggacagc

SEQ ID NO: 734946 - DNA, 25 bp, Mus musculus
taaagaagtacgcagtgggtacctg

SEQ ID NO: 734947 - DNA, 25 bp, Mus musculus
taaagaagtacggagtgggtacctg

SEQ ID NO: 734948 - DNA, 25 bp, Mus musculus
taaagaataaacattgggttctggt

SEQ ID NO: 734949 - DNA, 25 bp, Mus musculus
taaagaataaactttgggttctggt

SEQ ID NO: 734950 - DNA, 25 bp, Mus musculus
taaagaatatttaggagcctttgga

SEQ ID NO: 734951 - DNA, 25 bp, Mus musculus
taaagaatattttggagcctttgga

SEQ ID NO: 734952 - DNA, 25 bp, Mus musculus
taaagaatgaacacaaccgaggaga

SEQ ID NO: 734953 - DNA, 25 bp, Mus musculus
taaagaatgaactcaaccgaggaga

SEQ ID NO: 734954 - DNA, 25 bp, Mus musculus
taaagaatgccactccatgttggac

SEQ ID NO: 734955 - DNA, 25 bp, Mus musculus
taaagaatgccagtccatgttggac

SEQ ID NO: 734956 - DNA, 25 bp, Mus musculus
taaagaatgcttcctgcttatacaa

SEQ ID NO: 734957 - DNA, 25 bp, Mus musculus
taaagaatgcttgctgcttatacaa

SEQ ID NO: 734958 - DNA, 25 bp, Mus musculus
taaagaattctgatgaagtcgccct

SEQ ID NO: 734959 - DNA, 25 bp, Mus musculus
taaagaattctgttgaagtcgccct

SEQ ID NO: 734960 - DNA, 25 bp, Mus musculus
taaagacaatcacattaacccgaag

SEQ ID NO: 734961 - DNA, 25 bp, Mus musculus
taaagacaatcagattaacccgaag

SEQ ID NO: 734962 - DNA, 25 bp, Mus musculus
taaagacacatcatccaatcgatct

SEQ ID NO: 734963 - DNA, 25 bp, Mus musculus
taaagacacatcttccaatcgatct

SEQ ID NO: 734964 - DNA, 25 bp, Mus musculus
taaagacaccctctcctggttggcc

SEQ ID NO: 734965 - DNA, 25 bp, Mus musculus
taaagacaccctgtcctggttggcc

SEQ ID NO: 734966 - DNA, 25 bp, Mus musculus
taaagacacttaataccatgaggtg

SEQ ID NO: 734967 - DNA, 25 bp, Mus musculus
taaagacacttaccaaggacgatat

SEQ ID NO: 734968 - DNA, 25 bp, Mus musculus
taaagacacttagcaaggacgatat

SEQ ID NO: 734969 - DNA, 25 bp, Mus musculus
taaagacacttattaccatgaggtg

SEQ ID NO: 734970 - DNA, 25 bp, Mus musculus
taaagacagaagacctgggcagcgg

SEQ ID NO: 734971 - DNA, 25 bp, Mus musculus
taaagacagaagtcctgggcagcgg

SEQ ID NO: 734972 - DNA, 25 bp, Mus musculus
taaagacaggagaggagtgatttca

SEQ ID NO: 734973 - DNA, 25 bp, Mus musculus
taaagacaggagtggagtgatttca

SEQ ID NO: 734974 - DNA, 25 bp, Mus musculus
taaagacagtagagtagttcctgcc

SEQ ID NO: 734975 - DNA, 25 bp, Mus musculus
taaagacagtagtgtagttcctgcc

SEQ ID NO: 734976 - DNA, 25 bp, Mus musculus
taaagacatcctcttcactgaaggt

SEQ ID NO: 734977 - DNA, 25 bp, Mus musculus
taaagacatcctgttcactgaaggt

SEQ ID NO: 734978 - DNA, 25 bp, Mus musculus
taaagaccaaatatgagcagcacac

SEQ ID NO: 734979 - DNA, 25 bp, Mus musculus
taaagaccaaatcatgctgggcagt

SEQ ID NO: 734980 - DNA, 25 bp, Mus musculus
taaagaccaaatgatgctgggcagt

SEQ ID NO: 734981 - DNA, 25 bp, Mus musculus
taaagaccaaatttgagcagcacac

SEQ ID NO: 734982 - DNA, 25 bp, Mus musculus
taaagaccaagaagtgggtggatga

SEQ ID NO: 734983 - DNA, 25 bp, Mus musculus
taaagaccaagatgtgggtggatga

SEQ ID NO: 734984 - DNA, 25 bp, Mus musculus
taaagaccaagcagacagatgcaca

SEQ ID NO: 734985 - DNA, 25 bp, Mus musculus
taaagaccaagctgacagatgcaca

SEQ ID NO: 734986 - DNA, 25 bp, Mus musculus
taaagaccaggtcattaaggcctgt

SEQ ID NO: 734987 - DNA, 25 bp, Mus musculus
taaagaccaggtgattaaggcctgt

SEQ ID NO: 734988 - DNA, 25 bp, Mus musculus
taaagaccattgcacttcgtgcaag

SEQ ID NO: 734989 - DNA, 25 bp, Mus musculus
taaagaccattggacttcgtgcaag

SEQ ID NO: 734990 - DNA, 25 bp, Mus musculus
taaagacccttaagccaggcaccat

SEQ ID NO: 734991 - DNA, 25 bp, Mus musculus
taaagacccttatgccaggcaccat

SEQ ID NO: 734992 - DNA, 25 bp, Mus musculus
taaagaccgacacttcgggagcaaa

SEQ ID NO: 734993 - DNA, 25 bp, Mus musculus
taaagaccgacagttcgggagcaaa

SEQ ID NO: 734994 - DNA, 25 bp, Mus musculus
taaagacgacatagacggcatccag

SEQ ID NO: 734995 - DNA, 25 bp, Mus musculus
taaagacgacattgacggcatccag

SEQ ID NO: 734996 - DNA, 25 bp, Mus musculus
taaagacgctaaatgtgaataagat

SEQ ID NO: 734997 - DNA, 25 bp, Mus musculus
taaagacgctaattgtgaataagat

SEQ ID NO: 734998 - DNA, 25 bp, Mus musculus
taaagacgtctcacatgtctgcagg

SEQ ID NO: 734999 - DNA, 25 bp, Mus musculus
taaagacgtctctcatgtctgcagg

SEQ ID NO: 735000 - DNA, 25 bp, Mus musculus
taaagacgtctgatgcaagaactgt

SEQ ID NO: 735001 - DNA, 25 bp, Mus musculus
taaagacgtctgttgcaagaactgt

SEQ ID NO: 735002 - DNA, 25 bp, Mus musculus
taaagacgtgacagtgattgaagga

SEQ ID NO: 735003 - DNA, 25 bp, Mus musculus
taaagacgtgactgtgattgaagga

SEQ ID NO: 735004 - DNA, 25 bp, Mus musculus
taaagactaccccttaagagccagt

SEQ ID NO: 735005 - DNA, 25 bp, Mus musculus
taaagactacccgttaagagccagt

SEQ ID NO: 735006 - DNA, 25 bp, Mus musculus
taaagactcggcagactctacgcag

SEQ ID NO: 735007 - DNA, 25 bp, Mus musculus
taaagactcggctgactctacgcag

SEQ ID NO: 735008 - DNA, 25 bp, Mus musculus
taaagactgcccctgaaaactatgg

SEQ ID NO: 735009 - DNA, 25 bp, Mus musculus
taaagactgcccgtgaaaactatgg

SEQ ID NO: 735010 - DNA, 25 bp, Mus musculus
taaagactgcctctcaagaggccgg

SEQ ID NO: 735011 - DNA, 25 bp, Mus musculus
taaagactgcctgtcaagaggccgg

SEQ ID NO: 735012 - DNA, 25 bp, Mus musculus
taaagactgctgaaaactaaggcct

SEQ ID NO: 735013 - DNA, 25 bp, Mus musculus
taaagactgctgtaaactaaggcct

SEQ ID NO: 735014 - DNA, 25 bp, Mus musculus
taaagactgtgccacagtgtttgct

SEQ ID NO: 735015 - DNA, 25 bp, Mus musculus
taaagactgtgcgacagtgtttgct

SEQ ID NO: 735016 - DNA, 25 bp, Mus musculus
taaagacttcttccgcctctttccg

SEQ ID NO: 735017 - DNA, 25 bp, Mus musculus
taaagacttcttgcgcctctttccg

SEQ ID NO: 735018 - DNA, 25 bp, Mus musculus
taaagactttgaccttgatgtcctg

SEQ ID NO: 735019 - DNA, 25 bp, Mus musculus
taaagactttgagcttgatgtcctg

SEQ ID NO: 735020 - DNA, 25 bp, Mus musculus
taaagagaaaacctgcgatcgttta

SEQ ID NO: 735021 - DNA, 25 bp, Mus musculus
taaagagaaaacgtgcgatcgttta

SEQ ID NO: 735022 - DNA, 25 bp, Mus musculus
taaagagaatggaggactcccagtg

SEQ ID NO: 735023 - DNA, 25 bp, Mus musculus
taaagagaatggtggactcccagtg

SEQ ID NO: 735024 - DNA, 25 bp, Mus musculus
taaagagaccatcgagaagtgtgac

SEQ ID NO: 735025 - DNA, 25 bp, Mus musculus
taaagagaccatggagaagtgtgac

SEQ ID NO: 735026 - DNA, 25 bp, Mus musculus
taaagagacgttaggagcagctatc

SEQ ID NO: 735027 - DNA, 25 bp, Mus musculus
taaagagacgtttggagcagctatc

SEQ ID NO: 735028 - DNA, 25 bp, Mus musculus
taaagagactagagatggagctgtg

SEQ ID NO: 735029 - DNA, 25 bp, Mus musculus
taaagagactagtgatggagctgtg

SEQ ID NO: 735030 - DNA, 25 bp, Mus musculus
taaagagactttccagatgatgaga

SEQ ID NO: 735031 - DNA, 25 bp, Mus musculus
taaagagactttgcagatgatgaga

SEQ ID NO: 735032 - DNA, 25 bp, Mus musculus
taaagagagaccacgaggctatacg

SEQ ID NO: 735033 - DNA, 25 bp, Mus musculus
taaagagagacctcgaggctatacg

SEQ ID NO: 735034 - DNA, 25 bp, Mus musculus
taaagagattgtcgctgactctgac

SEQ ID NO: 735035 - DNA, 25 bp, Mus musculus
taaagagattgtggctgactctgac

SEQ ID NO: 735036 - DNA, 25 bp, Mus musculus
taaagagcaagtctatggaacggtt

SEQ ID NO: 735037 - DNA, 25 bp, Mus musculus
taaagagcaagtgtatggaacggtt

SEQ ID NO: 735038 - DNA, 25 bp, Mus musculus
taaagagcacatagtgggctatcat

SEQ ID NO: 735039 - DNA, 25 bp, Mus musculus
taaagagcacattgtgggctatcat

SEQ ID NO: 735040 - DNA, 25 bp, Mus musculus
taaagagcactacaggtcaggacca

SEQ ID NO: 735041 - DNA, 25 bp, Mus musculus
taaagagcactagaggtcaggacca

SEQ ID NO: 735042 - DNA, 25 bp, Mus musculus
taaagagcagctaactccaagtcag

SEQ ID NO: 735043 - DNA, 25 bp, Mus musculus
taaagagcagcttactccaagtcag

SEQ ID NO: 735044 - DNA, 25 bp, Mus musculus
taaagagcctcaatagaaagcaacc

SEQ ID NO: 735045 - DNA, 25 bp, Mus musculus
taaagagcctcattagaaagcaacc

SEQ ID NO: 735046 - DNA, 25 bp, Mus musculus
taaagagcctgcatgtgtttgtcct

SEQ ID NO: 735047 - DNA, 25 bp, Mus musculus
taaagagcctgcttgtgtttgtcct

SEQ ID NO: 735048 - DNA, 25 bp, Mus musculus
taaagagccttacgatcgagcagtg

SEQ ID NO: 735049 - DNA, 25 bp, Mus musculus
taaagagccttacgtagcttccagt

SEQ ID NO: 735050 - DNA, 25 bp, Mus musculus
taaagagccttaggatcgagcagtg

SEQ ID NO: 735051 - DNA, 25 bp, Mus musculus
taaagagccttaggtagcttccagt

SEQ ID NO: 735052 - DNA, 25 bp, Mus musculus
taaagagcggctcatgaagctcttg

SEQ ID NO: 735053 - DNA, 25 bp, Mus musculus
taaagagcggctgatgaagctcttg

SEQ ID NO: 735054 - DNA, 25 bp, Mus musculus
taaagagcgtttcctggatgtgccc

SEQ ID NO: 735055 - DNA, 25 bp, Mus musculus
taaagagcgtttgctggatgtgccc

SEQ ID NO: 735056 - DNA, 25 bp, Mus musculus
taaagagctaaacagaacaggttgt

SEQ ID NO: 735057 - DNA, 25 bp, Mus musculus
taaagagctaaagagaacaggttgt

SEQ ID NO: 735058 - DNA, 25 bp, Mus musculus
taaagagcttgacgcctcgcaaggt

SEQ ID NO: 735059 - DNA, 25 bp, Mus musculus
taaagagcttgaggcctcgcaaggt

SEQ ID NO: 735060 - DNA, 25 bp, Mus musculus
taaagagctttcaggcatccagcag

SEQ ID NO: 735061 - DNA, 25 bp, Mus musculus
taaagagctttctggcatccagcag

SEQ ID NO: 735062 - DNA, 25 bp, Mus musculus
taaagaggaagccatttcagccagc

SEQ ID NO: 735063 - DNA, 25 bp, Mus musculus
taaagaggaagcgatttcagccagc

SEQ ID NO: 735064 - DNA, 25 bp, Mus musculus
taaagaggaccactgctcagaacct

SEQ ID NO: 735065 - DNA, 25 bp, Mus musculus
taaagaggaccagtgctcagaacct

SEQ ID NO: 735066 - DNA, 25 bp, Mus musculus
taaagaggcaaactactatcagctg

SEQ ID NO: 735067 - DNA, 25 bp, Mus musculus
taaagaggcaaagtactatcagctg

SEQ ID NO: 735068 - DNA, 25 bp, Mus musculus
taaagaggcttaagagttcaaggaa

SEQ ID NO: 735069 - DNA, 25 bp, Mus musculus
taaagaggcttatgagttcaaggaa

SEQ ID NO: 735070 - DNA, 25 bp, Mus musculus
taaagagtaactaccaactgggaga

SEQ ID NO: 735071 - DNA, 25 bp, Mus musculus
taaagagtaacttccaactgggaga

SEQ ID NO: 735072 - DNA, 25 bp, Mus musculus
taaagagtaatgagcctcggctaaa

SEQ ID NO: 735073 - DNA, 25 bp, Mus musculus
taaagagtaatgtgcctcggctaaa

SEQ ID NO: 735074 - DNA, 25 bp, Mus musculus
taaagagtcacaccaccgtgatcca

SEQ ID NO: 735075 - DNA, 25 bp, Mus musculus
taaagagtcacagcaccgtgatcca

SEQ ID NO: 735076 - DNA, 25 bp, Mus musculus
taaagagtcatcagtcccaggccac

SEQ ID NO: 735077 - DNA, 25 bp, Mus musculus
taaagagtcatctgtcccaggccac

SEQ ID NO: 735078 - DNA, 25 bp, Mus musculus
taaagagtgagacttttcccatctc

SEQ ID NO: 735079 - DNA, 25 bp, Mus musculus
taaagagtgagagttttcccatctc

SEQ ID NO: 735080 - DNA, 25 bp, Mus musculus
taaagagtgtcacctagcactctga

SEQ ID NO: 735081 - DNA, 25 bp, Mus musculus
taaagagtgtcagctagcactctga

SEQ ID NO: 735082 - DNA, 25 bp, Mus musculus
taaagagttagaccccaagttggct

SEQ ID NO: 735083 - DNA, 25 bp, Mus musculus
taaagagttagagcccaagttggct

SEQ ID NO: 735084 - DNA, 25 bp, Mus musculus
taaagagtttgaccaactggaccag

SEQ ID NO: 735085 - DNA, 25 bp, Mus musculus
taaagagtttgagcaactggaccag

SEQ ID NO: 735086 - DNA, 25 bp, Mus musculus
taaagataagagaggagctccacct

SEQ ID NO: 735087 - DNA, 25 bp, Mus musculus
taaagataagagtggagctccacct

SEQ ID NO: 735088 - DNA, 25 bp, Mus musculus
taaagatcacagcaagagaccaaag

SEQ ID NO: 735089 - DNA, 25 bp, Mus musculus
taaagatcacaggaagagaccaaag

SEQ ID NO: 735090 - DNA, 25 bp, Mus musculus
taaagatcctgtctaccgggcgaga

SEQ ID NO: 735091 - DNA, 25 bp, Mus musculus
taaagatcctgtgtaccgggcgaga

SEQ ID NO: 735092 - DNA, 25 bp, Mus musculus
taaagatctcagacttcggcatggc

SEQ ID NO: 735093 - DNA, 25 bp, Mus musculus
taaagatctcagtcttcggcatggc

SEQ ID NO: 735094 - DNA, 25 bp, Mus musculus
taaagatgaccgagaagcctggcct

SEQ ID NO: 735095 - DNA, 25 bp, Mus musculus
taaagatgaccgtgaagcctggcct

SEQ ID NO: 735096 - DNA, 25 bp, Mus musculus
taaagatgataaactaagaacagaa

SEQ ID NO: 735097 - DNA, 25 bp, Mus musculus
taaagatgataatctaagaacagaa

SEQ ID NO: 735098 - DNA, 25 bp, Mus musculus
taaagatgcaggctccatatcgtgc

SEQ ID NO: 735099 - DNA, 25 bp, Mus musculus
taaagatgcagggtccatatcgtgc

SEQ ID NO: 735100 - DNA, 25 bp, Mus musculus
taaagatgcccgctataccaacggc

SEQ ID NO: 735101 - DNA, 25 bp, Mus musculus
taaagatgcccggtataccaacggc

SEQ ID NO: 735102 - DNA, 25 bp, Mus musculus
taaagatgccctctgagacggttgg

SEQ ID NO: 735103 - DNA, 25 bp, Mus musculus
taaagatgccctgtgagacggttgg

SEQ ID NO: 735104 - DNA, 25 bp, Mus musculus
taaagatgctacatcaattcacctt

SEQ ID NO: 735105 - DNA, 25 bp, Mus musculus
taaagatgctacttcaattcacctt

SEQ ID NO: 735106 - DNA, 25 bp, Mus musculus
taaagatgcttcatcagctgatggc

SEQ ID NO: 735107 - DNA, 25 bp, Mus musculus
taaagatgcttcttcagctgatggc

SEQ ID NO: 735108 - DNA, 25 bp, Mus musculus
taaagatggagcaggattgccgagc

SEQ ID NO: 735109 - DNA, 25 bp, Mus musculus
taaagatggagctggattgccgagc

SEQ ID NO: 735110 - DNA, 25 bp, Mus musculus
taaagatggcaaaggagatgcctgt

SEQ ID NO: 735111 - DNA, 25 bp, Mus musculus
taaagatggcaatggagatgcctgt

SEQ ID NO: 735112 - DNA, 25 bp, Mus musculus
taaagatggcgcattgacactggat

SEQ ID NO: 735113 - DNA, 25 bp, Mus musculus
taaagatggcgctttgacactggat

SEQ ID NO: 735114 - DNA, 25 bp, Mus musculus
taaagatggtgtcgttaccatagat

SEQ ID NO: 735115 - DNA, 25 bp, Mus musculus
taaagatggtgtggttaccatagat

SEQ ID NO: 735116 - DNA, 25 bp, Mus musculus
taaagatgtgaacaaccactcgtgg

SEQ ID NO: 735117 - DNA, 25 bp, Mus musculus
taaagatgtgaacgtgtctgaggcc

SEQ ID NO: 735118 - DNA, 25 bp, Mus musculus
taaagatgtgaagaaccactcgtgg

SEQ ID NO: 735119 - DNA, 25 bp, Mus musculus
taaagatgtgaaggtgtctgaggcc

SEQ ID NO: 735120 - DNA, 25 bp, Mus musculus
taaagattatggataagatctggct

SEQ ID NO: 735121 - DNA, 25 bp, Mus musculus
taaagattatggttaagatctggct

SEQ ID NO: 735122 - DNA, 25 bp, Mus musculus
taaagattatgtccgtcttatgaaa

SEQ ID NO: 735123 - DNA, 25 bp, Mus musculus
taaagattatgtgcgtcttatgaaa

SEQ ID NO: 735124 - DNA, 25 bp, Mus musculus
taaagattcaggataaggagtcttc

SEQ ID NO: 735125 - DNA, 25 bp, Mus musculus
taaagattcaggttaaggagtcttc

SEQ ID NO: 735126 - DNA, 25 bp, Mus musculus
taaagattcattcacgtggcctctg

SEQ ID NO: 735127 - DNA, 25 bp, Mus musculus
taaagattcattgacgtggcctctg

SEQ ID NO: 735128 - DNA, 25 bp, Mus musculus
taaagatttcttaccagtgtaaagg

SEQ ID NO: 735129 - DNA, 25 bp, Mus musculus
taaagatttctttccagtgtaaagg

SEQ ID NO: 735130 - DNA, 25 bp, Mus musculus
taaagatttgcgacactacctgagt

SEQ ID NO: 735131 - DNA, 25 bp, Mus musculus
taaagatttgcgtcactacctgagt

SEQ ID NO: 735132 - DNA, 25 bp, Mus musculus
taaagattttctacaggcagtctcc

SEQ ID NO: 735133 - DNA, 25 bp, Mus musculus
taaagattttcttcaggcagtctcc

SEQ ID NO: 735134 - DNA, 25 bp, Mus musculus
taaagattttttcagctacatctgc

SEQ ID NO: 735135 - DNA, 25 bp, Mus musculus
taaagattttttgagctacatctgc

SEQ ID NO: 735136 - DNA, 25 bp, Mus musculus
taaagcaaatgccaccattgaagtg

SEQ ID NO: 735137 - DNA, 25 bp, Mus musculus
taaagcaaatgcgaccattgaagtg

SEQ ID NO: 735138 - DNA, 25 bp, Mus musculus
taaagcaactgaatgtccagtggct

SEQ ID NO: 735139 - DNA, 25 bp, Mus musculus
taaagcaactgattgtccagtggct

SEQ ID NO: 735140 - DNA, 25 bp, Mus musculus
taaagcaagaatattcctggaggag

SEQ ID NO: 735141 - DNA, 25 bp, Mus musculus
taaagcaagaattttcctggaggag

SEQ ID NO: 735142 - DNA, 25 bp, Mus musculus
taaagcaaggcactcagtaacctgc

SEQ ID NO: 735143 - DNA, 25 bp, Mus musculus
taaagcaaggcagtcagtaacctgc

SEQ ID NO: 735144 - DNA, 25 bp, Mus musculus
taaagcaagtacaagttctcgcatg

SEQ ID NO: 735145 - DNA, 25 bp, Mus musculus
taaagcaagtactagttctcgcatg

SEQ ID NO: 735146 - DNA, 25 bp, Mus musculus
taaagcaagttgaggcactgaagat

SEQ ID NO: 735147 - DNA, 25 bp, Mus musculus
taaagcaagttgtggcactgaagat

SEQ ID NO: 735148 - DNA, 25 bp, Mus musculus
taaagcaatcttcaaagcacgtgga

SEQ ID NO: 735149 - DNA, 25 bp, Mus musculus
taaagcaatcttgaaagcacgtgga

SEQ ID NO: 735150 - DNA, 25 bp, Mus musculus
taaagcacaccacctatcagcggtc

SEQ ID NO: 735151 - DNA, 25 bp, Mus musculus
taaagcacaccagctatcagcggtc

SEQ ID NO: 735152 - DNA, 25 bp, Mus musculus
taaagcacacttcgaagacaagtac

SEQ ID NO: 735153 - DNA, 25 bp, Mus musculus
taaagcacacttggaagacaagtac

SEQ ID NO: 735154 - DNA, 25 bp, Mus musculus
taaagcacataacacccaaggaaga

SEQ ID NO: 735155 - DNA, 25 bp, Mus musculus
taaagcacataagacccaaggaaga

SEQ ID NO: 735156 - DNA, 25 bp, Mus musculus
taaagcaccaggcacaacagctctt

SEQ ID NO: 735157 - DNA, 25 bp, Mus musculus
taaagcaccagggacaacagctctt

SEQ ID NO: 735158 - DNA, 25 bp, Mus musculus
taaagcaccattcattgcagagaga

SEQ ID NO: 735159 - DNA, 25 bp, Mus musculus
taaagcaccattgattgcagagaga

SEQ ID NO: 735160 - DNA, 25 bp, Mus musculus
taaagcaccgaaacagaaatacagt

SEQ ID NO: 735161 - DNA, 25 bp, Mus musculus
taaagcaccgaatcagaaatacagt

SEQ ID NO: 735162 - DNA, 25 bp, Mus musculus
taaagcaccgagacaaaagcatggt

SEQ ID NO: 735163 - DNA, 25 bp, Mus musculus
taaagcaccgagtcaaaagcatggt

SEQ ID NO: 735164 - DNA, 25 bp, Mus musculus
taaagcactgcaacggcatcctgaa

SEQ ID NO: 735165 - DNA, 25 bp, Mus musculus
taaagcactgcatcggcatcctgaa

SEQ ID NO: 735166 - DNA, 25 bp, Mus musculus
taaagcacttggattgtgatgccaa

SEQ ID NO: 735167 - DNA, 25 bp, Mus musculus
taaagcacttggtttgtgatgccaa

SEQ ID NO: 735168 - DNA, 25 bp, Mus musculus
taaagcagaaagactgtgctgagtc

SEQ ID NO: 735169 - DNA, 25 bp, Mus musculus
taaagcagaaagtctgtgctgagtc

SEQ ID NO: 735170 - DNA, 25 bp, Mus musculus
taaagcagacggaacactggactct

SEQ ID NO: 735171 - DNA, 25 bp, Mus musculus
taaagcagacggtacactggactct

SEQ ID NO: 735172 - DNA, 25 bp, Mus musculus
taaagcagatcgagcacactctgaa

SEQ ID NO: 735173 - DNA, 25 bp, Mus musculus
taaagcagatcgtgcacactctgaa

SEQ ID NO: 735174 - DNA, 25 bp, Mus musculus
taaagcagccagagcgcgtgtggaa

SEQ ID NO: 735175 - DNA, 25 bp, Mus musculus
taaagcagccagtgcgcgtgtggaa

SEQ ID NO: 735176 - DNA, 25 bp, Mus musculus
taaagcagcgctcttgggtccagct

SEQ ID NO: 735177 - DNA, 25 bp, Mus musculus
taaagcagcgctgttgggtccagct

SEQ ID NO: 735178 - DNA, 25 bp, Mus musculus
taaagcagcggcataagcaagagca

SEQ ID NO: 735179 - DNA, 25 bp, Mus musculus
taaagcagcggcttaagcaagagca

SEQ ID NO: 735180 - DNA, 25 bp, Mus musculus
taaagcagcggtcccaattacgaga

SEQ ID NO: 735181 - DNA, 25 bp, Mus musculus
taaagcagcggtgccaattacgaga

SEQ ID NO: 735182 - DNA, 25 bp, Mus musculus
taaagcagctggagcctccaggatc

SEQ ID NO: 735183 - DNA, 25 bp, Mus musculus
taaagcagctggtgcctccaggatc

SEQ ID NO: 735184 - DNA, 25 bp, Mus musculus
taaagcagcttaaggctacgagtat

SEQ ID NO: 735185 - DNA, 25 bp, Mus musculus
taaagcagcttatggctacgagtat

SEQ ID NO: 735186 - DNA, 25 bp, Mus musculus
taaagcaggaccatccattgtgatc

SEQ ID NO: 735187 - DNA, 25 bp, Mus musculus
taaagcaggaccttccattgtgatc

SEQ ID NO: 735188 - DNA, 25 bp, Mus musculus
taaagcaggataacatggcgagagc

SEQ ID NO: 735189 - DNA, 25 bp, Mus musculus
taaagcaggatatcatggcgagagc

SEQ ID NO: 735190 - DNA, 25 bp, Mus musculus
taaagcagggcaagtactctgaggc

SEQ ID NO: 735191 - DNA, 25 bp, Mus musculus
taaagcagggcaagtctgggcccct

SEQ ID NO: 735192 - DNA, 25 bp, Mus musculus
taaagcagggcatgtactctgaggc

SEQ ID NO: 735193 - DNA, 25 bp, Mus musculus
taaagcagggcatgtctgggcccct

SEQ ID NO: 735194 - DNA, 25 bp, Mus musculus
taaagcagtcatacgtgcaggtggc

SEQ ID NO: 735195 - DNA, 25 bp, Mus musculus
taaagcagtcattcgtgcaggtggc

SEQ ID NO: 735196 - DNA, 25 bp, Mus musculus
taaagcagtgtccttccggaggaag

SEQ ID NO: 735197 - DNA, 25 bp, Mus musculus
taaagcagtgtcgttccggaggaag

SEQ ID NO: 735198 - DNA, 25 bp, Mus musculus
taaagcagttacagagatgaatggt

SEQ ID NO: 735199 - DNA, 25 bp, Mus musculus
taaagcagttactgagatgaatggt

SEQ ID NO: 735200 - DNA, 25 bp, Mus musculus
taaagcatgctactgattcaagttc

SEQ ID NO: 735201 - DNA, 25 bp, Mus musculus
taaagcatgctagtgattcaagttc

SEQ ID NO: 735202 - DNA, 25 bp, Mus musculus
taaagcatggcaataataccacagc

SEQ ID NO: 735203 - DNA, 25 bp, Mus musculus
taaagcatggcattaataccacagc

SEQ ID NO: 735204 - DNA, 25 bp, Mus musculus
taaagcatggtgatagttggactcc

SEQ ID NO: 735205 - DNA, 25 bp, Mus musculus
taaagcatggtgttagttggactcc

SEQ ID NO: 735206 - DNA, 25 bp, Mus musculus
taaagcatgtataccaaaaacacag

SEQ ID NO: 735207 - DNA, 25 bp, Mus musculus
taaagcatgtattccaaaaacacag

SEQ ID NO: 735208 - DNA, 25 bp, Mus musculus
taaagcatgttaaggagactcagcc

SEQ ID NO: 735209 - DNA, 25 bp, Mus musculus
taaagcatgttatggagactcagcc

SEQ ID NO: 735210 - DNA, 25 bp, Mus musculus
taaagcatttagaaggaaatgaact

SEQ ID NO: 735211 - DNA, 25 bp, Mus musculus
taaagcatttagtaggaaatgaact

SEQ ID NO: 735212 - DNA, 25 bp, Mus musculus
taaagcatttcacatgcaacttgtg

SEQ ID NO: 735213 - DNA, 25 bp, Mus musculus
taaagcatttcagatgcaacttgtg

SEQ ID NO: 735214 - DNA, 25 bp, Mus musculus
taaagcatttggaaattctactgaa

SEQ ID NO: 735215 - DNA, 25 bp, Mus musculus
taaagcatttggtaattctactgaa

SEQ ID NO: 735216 - DNA, 25 bp, Mus musculus
taaagccaacctaagtgctcctggc

SEQ ID NO: 735217 - DNA, 25 bp, Mus musculus
taaagccaaccttagtgctcctggc

SEQ ID NO: 735218 - DNA, 25 bp, Mus musculus
taaagccaagcaccgtcagacgggc

SEQ ID NO: 735219 - DNA, 25 bp, Mus musculus
taaagccaagcagcgtcagacgggc

SEQ ID NO: 735220 - DNA, 25 bp, Mus musculus
taaagccaagggattgaaagccacg

SEQ ID NO: 735221 - DNA, 25 bp, Mus musculus
taaagccaagggtttgaaagccacg

SEQ ID NO: 735222 - DNA, 25 bp, Mus musculus
taaagccacactcgatgaaatccag

SEQ ID NO: 735223 - DNA, 25 bp, Mus musculus
taaagccacactggatgaaatccag

SEQ ID NO: 735224 - DNA, 25 bp, Mus musculus
taaagccacaggcttggtcctaaca

SEQ ID NO: 735225 - DNA, 25 bp, Mus musculus
taaagccacagggttggtcctaaca

SEQ ID NO: 735226 - DNA, 25 bp, Mus musculus
taaagccacttcatataggacttaa

SEQ ID NO: 735227 - DNA, 25 bp, Mus musculus
taaagccacttcttataggacttaa

SEQ ID NO: 735228 - DNA, 25 bp, Mus musculus
taaagccagagaacatcctatgtga

SEQ ID NO: 735229 - DNA, 25 bp, Mus musculus
taaagccagagatcatcctatgtga

SEQ ID NO: 735230 - DNA, 25 bp, Mus musculus
taaagccagctccaagatcaaggtc

SEQ ID NO: 735231 - DNA, 25 bp, Mus musculus
taaagccagctcgaagatcaaggtc

SEQ ID NO: 735232 - DNA, 25 bp, Mus musculus
taaagccatatgcattgctggtaaa

SEQ ID NO: 735233 - DNA, 25 bp, Mus musculus
taaagccatatggattgctggtaaa

SEQ ID NO: 735234 - DNA, 25 bp, Mus musculus
taaagcccacctagtccgctgagca

SEQ ID NO: 735235 - DNA, 25 bp, Mus musculus
taaagcccaccttgtccgctgagca

SEQ ID NO: 735236 - DNA, 25 bp, Mus musculus
taaagcccagcaacctagctgtgaa

SEQ ID NO: 735237 - DNA, 25 bp, Mus musculus
taaagcccagcatcctagctgtgaa

SEQ ID NO: 735238 - DNA, 25 bp, Mus musculus
taaagcccattaactctgaccccga

SEQ ID NO: 735239 - DNA, 25 bp, Mus musculus
taaagcccattatctctgaccccga

SEQ ID NO: 735240 - DNA, 25 bp, Mus musculus
taaagccccatgagtagtatagagc

SEQ ID NO: 735241 - DNA, 25 bp, Mus musculus
taaagccccatgtgtagtatagagc

SEQ ID NO: 735242 - DNA, 25 bp, Mus musculus
taaagcccctttaagagaagtggct

SEQ ID NO: 735243 - DNA, 25 bp, Mus musculus
taaagccccttttagagaagtggct

SEQ ID NO: 735244 - DNA, 25 bp, Mus musculus
taaagcccgaaaatgtgctgcttgc

SEQ ID NO: 735245 - DNA, 25 bp, Mus musculus
taaagcccgaaattgtgctgcttgc

SEQ ID NO: 735246 - DNA, 25 bp, Mus musculus
taaagccctggaaaatttgccacca

SEQ ID NO: 735247 - DNA, 25 bp, Mus musculus
taaagccctggataatttgccacca

SEQ ID NO: 735248 - DNA, 25 bp, Mus musculus
taaagccctgtaagattttcttggg

SEQ ID NO: 735249 - DNA, 25 bp, Mus musculus
taaagccctgtatgattttcttggg

SEQ ID NO: 735250 - DNA, 25 bp, Mus musculus
taaagccctttcataaggagatcgg

SEQ ID NO: 735251 - DNA, 25 bp, Mus musculus
taaagccctttcttaaggagatcgg

SEQ ID NO: 735252 - DNA, 25 bp, Mus musculus
taaagccgagatctgggttccattc

SEQ ID NO: 735253 - DNA, 25 bp, Mus musculus
taaagccgagatgtgggttccattc

SEQ ID NO: 735254 - DNA, 25 bp, Mus musculus
taaagccgtaccaggtgtttggaca

SEQ ID NO: 735255 - DNA, 25 bp, Mus musculus
taaagccgtacctggtgtttggaca

SEQ ID NO: 735256 - DNA, 25 bp, Mus musculus
taaagcctccctcatgagaaaactg

SEQ ID NO: 735257 - DNA, 25 bp, Mus musculus
taaagcctccctgatgagaaaactg

SEQ ID NO: 735258 - DNA, 25 bp, Mus musculus
taaagcctgggcaacttcctgctgg

SEQ ID NO: 735259 - DNA, 25 bp, Mus musculus
taaagcctgggctacttcctgctgg

SEQ ID NO: 735260 - DNA, 25 bp, Mus musculus
taaagcctggttctatgtctaaatg

SEQ ID NO: 735261 - DNA, 25 bp, Mus musculus
taaagcctggttgtatgtctaaatg

SEQ ID NO: 735262 - DNA, 25 bp, Mus musculus
taaagccttaaaagtcccctccagt

SEQ ID NO: 735263 - DNA, 25 bp, Mus musculus
taaagccttaaatgtcccctccagt

SEQ ID NO: 735264 - DNA, 25 bp, Mus musculus
taaagccttcatagtaccccattcc

SEQ ID NO: 735265 - DNA, 25 bp, Mus musculus
taaagccttcattgtaccccattcc

SEQ ID NO: 735266 - DNA, 25 bp, Mus musculus
taaagcgagcagataaccttccaag

SEQ ID NO: 735267 - DNA, 25 bp, Mus musculus
taaagcgagcagttaaccttccaag

SEQ ID NO: 735268 - DNA, 25 bp, Mus musculus
taaagcgcacagagggcgaatcccc

SEQ ID NO: 735269 - DNA, 25 bp, Mus musculus
taaagcgcacagtgggcgaatcccc

SEQ ID NO: 735270 - DNA, 25 bp, Mus musculus
taaagcgcatgtccccaaagtcagc

SEQ ID NO: 735271 - DNA, 25 bp, Mus musculus
taaagcgcatgtgcccaaagtcagc

SEQ ID NO: 735272 - DNA, 25 bp, Mus musculus
taaagcgctcatccatccggaaagg

SEQ ID NO: 735273 - DNA, 25 bp, Mus musculus
taaagcgctcatgcatccggaaagg

SEQ ID NO: 735274 - DNA, 25 bp, Mus musculus
taaagcgcttgcagcaaacgtctgg

SEQ ID NO: 735275 - DNA, 25 bp, Mus musculus
taaagcgcttgctgcaaacgtctgg

SEQ ID NO: 735276 - DNA, 25 bp, Mus musculus
taaagcgggctgagagatcgcgtca

SEQ ID NO: 735277 - DNA, 25 bp, Mus musculus
taaagcgggctgtgagatcgcgtca

SEQ ID NO: 735278 - DNA, 25 bp, Mus musculus
taaagcggttggacaatatcacgca

SEQ ID NO: 735279 - DNA, 25 bp, Mus musculus
taaagcggttggtcaatatcacgca

SEQ ID NO: 735280 - DNA, 25 bp, Mus musculus
taaagctaactaatagcctctatct

SEQ ID NO: 735281 - DNA, 25 bp, Mus musculus
taaagctaactattagcctctatct

SEQ ID NO: 735282 - DNA, 25 bp, Mus musculus
taaagctaatggctactgttttggg

SEQ ID NO: 735283 - DNA, 25 bp, Mus musculus
taaagctaatgggtactgttttggg

SEQ ID NO: 735284 - DNA, 25 bp, Mus musculus
taaagctactttcattgtgggaaat

SEQ ID NO: 735285 - DNA, 25 bp, Mus musculus
taaagctactttgattgtgggaaat

SEQ ID NO: 735286 - DNA, 25 bp, Mus musculus
taaagctatcctcgacgacttgttg

SEQ ID NO: 735287 - DNA, 25 bp, Mus musculus
taaagctatcctggacgacttgttg

SEQ ID NO: 735288 - DNA, 25 bp, Mus musculus
taaagctcaaggagttatggatgac

SEQ ID NO: 735289 - DNA, 25 bp, Mus musculus
taaagctcaaggtgttatggatgac

SEQ ID NO: 735290 - DNA, 25 bp, Mus musculus
taaagctccccaagaatacatccct

SEQ ID NO: 735291 - DNA, 25 bp, Mus musculus
taaagctccccatgaatacatccct

SEQ ID NO: 735292 - DNA, 25 bp, Mus musculus
taaagctcggatatatcgcccaagg

SEQ ID NO: 735293 - DNA, 25 bp, Mus musculus
taaagctcggatttatcgcccaagg

SEQ ID NO: 735294 - DNA, 25 bp, Mus musculus
taaagctcggtactgccatctagga

SEQ ID NO: 735295 - DNA, 25 bp, Mus musculus
taaagctcggtagtgccatctagga

SEQ ID NO: 735296 - DNA, 25 bp, Mus musculus
taaagctctacaagaatgctcggga

SEQ ID NO: 735297 - DNA, 25 bp, Mus musculus
taaagctctacatgaatgctcggga

SEQ ID NO: 735298 - DNA, 25 bp, Mus musculus
taaagctgaccacagacatggaccc

SEQ ID NO: 735299 - DNA, 25 bp, Mus musculus
taaagctgaccagagacatggaccc

SEQ ID NO: 735300 - DNA, 25 bp, Mus musculus
taaagctgagcaacaccaagctccg

SEQ ID NO: 735301 - DNA, 25 bp, Mus musculus
taaagctgagcatcaccaagctccg

SEQ ID NO: 735302 - DNA, 25 bp, Mus musculus
taaagctgagcccatggatactgat

SEQ ID NO: 735303 - DNA, 25 bp, Mus musculus
taaagctgagccgatggatactgat

SEQ ID NO: 735304 - DNA, 25 bp, Mus musculus
taaagctgcagcaagccactgggct

SEQ ID NO: 735305 - DNA, 25 bp, Mus musculus
taaagctgcagctagccactgggct

SEQ ID NO: 735306 - DNA, 25 bp, Mus musculus
taaagctgcggtcagtctagcgaga

SEQ ID NO: 735307 - DNA, 25 bp, Mus musculus
taaagctgcggtgagtctagcgaga

SEQ ID NO: 735308 - DNA, 25 bp, Mus musculus
taaagctgctgtaatggtccatcag

SEQ ID NO: 735309 - DNA, 25 bp, Mus musculus
taaagctgctgttatggtccatcag

SEQ ID NO: 735310 - DNA, 25 bp, Mus musculus
taaagctggatgacaaacgcacgcc

SEQ ID NO: 735311 - DNA, 25 bp, Mus musculus
taaagctggatgtcaaacgcacgcc

SEQ ID NO: 735312 - DNA, 25 bp, Mus musculus
taaagctggcagacgcgaatgtttc

SEQ ID NO: 735313 - DNA, 25 bp, Mus musculus
taaagctggcagtcgcgaatgtttc

SEQ ID NO: 735314 - DNA, 25 bp, Mus musculus
taaagctggcttaaactgagtggct

SEQ ID NO: 735315 - DNA, 25 bp, Mus musculus
taaagctggctttaactgagtggct

SEQ ID NO: 735316 - DNA, 25 bp, Mus musculus
taaagctgggctcttctccgaccaa

SEQ ID NO: 735317 - DNA, 25 bp, Mus musculus
taaagctgggctgttctccgaccaa

SEQ ID NO: 735318 - DNA, 25 bp, Mus musculus
taaagctgtgaaaatgaccctgaag

SEQ ID NO: 735319 - DNA, 25 bp, Mus musculus
taaagctgtgaatatgaccctgaag

SEQ ID NO: 735320 - DNA, 25 bp, Mus musculus
taaagctgtgagcaacgtgatcgcc

SEQ ID NO: 735321 - DNA, 25 bp, Mus musculus
taaagctgtgaggaacgtgatcgcc

SEQ ID NO: 735322 - DNA, 25 bp, Mus musculus
taaagctgttgacggaaggagggtc

SEQ ID NO: 735323 - DNA, 25 bp, Mus musculus
taaagctgttgagggaaggagggtc

SEQ ID NO: 735324 - DNA, 25 bp, Mus musculus
taaagcttccatactacactgcttg

SEQ ID NO: 735325 - DNA, 25 bp, Mus musculus
taaagcttccattctacactgcttg

SEQ ID NO: 735326 - DNA, 25 bp, Mus musculus
taaagcttgaacacggctgaactgg

SEQ ID NO: 735327 - DNA, 25 bp, Mus musculus
taaagcttgaactcggctgaactgg

SEQ ID NO: 735328 - DNA, 25 bp, Mus musculus
taaagcttgctgaccagcaggacct

SEQ ID NO: 735329 - DNA, 25 bp, Mus musculus
taaagcttgctgtccagcaggacct

SEQ ID NO: 735330 - DNA, 25 bp, Mus musculus
taaagcttttaaaatgcctaacggg

SEQ ID NO: 735331 - DNA, 25 bp, Mus musculus
taaagcttttaatatgcctaacggg

SEQ ID NO: 735332 - DNA, 25 bp, Mus musculus
taaagcttttagattaagtgcctgg

SEQ ID NO: 735333 - DNA, 25 bp, Mus musculus
taaagcttttagtttaagtgcctgg

SEQ ID NO: 735334 - DNA, 25 bp, Mus musculus
taaaggaaacgcctaagagttgccg

SEQ ID NO: 735335 - DNA, 25 bp, Mus musculus
taaaggaaacgcgtaagagttgccg

SEQ ID NO: 735336 - DNA, 25 bp, Mus musculus
taaaggaaatccaggccagtgacgc

SEQ ID NO: 735337 - DNA, 25 bp, Mus musculus
taaaggaaatccagggacagaacct

SEQ ID NO: 735338 - DNA, 25 bp, Mus musculus
taaaggaaatcctggccagtgacgc

SEQ ID NO: 735339 - DNA, 25 bp, Mus musculus
taaaggaaatcctgggacagaacct

SEQ ID NO: 735340 - DNA, 25 bp, Mus musculus
taaaggaaatcgatgtgtggcccat

SEQ ID NO: 735341 - DNA, 25 bp, Mus musculus
taaaggaaatcgttgtgtggcccat

SEQ ID NO: 735342 - DNA, 25 bp, Mus musculus
taaaggaaccgtcagagggtgccct

SEQ ID NO: 735343 - DNA, 25 bp, Mus musculus
taaaggaaccgtgagagggtgccct

SEQ ID NO: 735344 - DNA, 25 bp, Mus musculus
taaaggaagaaacgtggcagatctc

SEQ ID NO: 735345 - DNA, 25 bp, Mus musculus
taaaggaagaaaggtggcagatctc

SEQ ID NO: 735346 - DNA, 25 bp, Mus musculus
taaaggaagactcactccctccaca

SEQ ID NO: 735347 - DNA, 25 bp, Mus musculus
taaaggaagactgactccctccaca

SEQ ID NO: 735348 - DNA, 25 bp, Mus musculus
taaaggaagtgacaggcaacaacag

SEQ ID NO: 735349 - DNA, 25 bp, Mus musculus
taaaggaagtgagaggcaacaacag

SEQ ID NO: 735350 - DNA, 25 bp, Mus musculus
taaaggaatattactacaccaggaa

SEQ ID NO: 735351 - DNA, 25 bp, Mus musculus
taaaggaatatttctacaccaggaa

SEQ ID NO: 735352 - DNA, 25 bp, Mus musculus
taaaggaatgtaactcaataggctc

SEQ ID NO: 735353 - DNA, 25 bp, Mus musculus
taaaggaatgtatctcaataggctc

SEQ ID NO: 735354 - DNA, 25 bp, Mus musculus
taaaggaattgcaaatagtgctaag

SEQ ID NO: 735355 - DNA, 25 bp, Mus musculus
taaaggaattgctaatagtgctaag

SEQ ID NO: 735356 - DNA, 25 bp, Mus musculus
taaaggacactgaccagaagttggc

SEQ ID NO: 735357 - DNA, 25 bp, Mus musculus
taaaggacactgtccagaagttggc

SEQ ID NO: 735358 - DNA, 25 bp, Mus musculus
taaaggacagacatacggctcagag

SEQ ID NO: 735359 - DNA, 25 bp, Mus musculus
taaaggacagacttacggctcagag

SEQ ID NO: 735360 - DNA, 25 bp, Mus musculus
taaaggaccagtctcactgcatgga

SEQ ID NO: 735361 - DNA, 25 bp, Mus musculus
taaaggaccagtgtcactgcatgga

SEQ ID NO: 735362 - DNA, 25 bp, Mus musculus
taaaggaccttgaggaagaccagaa

SEQ ID NO: 735363 - DNA, 25 bp, Mus musculus
taaaggaccttgtggaagaccagaa

SEQ ID NO: 735364 - DNA, 25 bp, Mus musculus
taaaggacctttctttgagtcccag

SEQ ID NO: 735365 - DNA, 25 bp, Mus musculus
taaaggacctttgtttgagtcccag

SEQ ID NO: 735366 - DNA, 25 bp, Mus musculus
taaaggactgcacagaagccctcaa

SEQ ID NO: 735367 - DNA, 25 bp, Mus musculus
taaaggactgcagagaagccctcaa

SEQ ID NO: 735368 - DNA, 25 bp, Mus musculus
taaaggactggcattagaagtccac

SEQ ID NO: 735369 - DNA, 25 bp, Mus musculus
taaaggactggctttagaagtccac

SEQ ID NO: 735370 - DNA, 25 bp, Mus musculus
taaaggacttcactggtgaggacag

SEQ ID NO: 735371 - DNA, 25 bp, Mus musculus
taaaggacttcagtggtgaggacag

SEQ ID NO: 735372 - DNA, 25 bp, Mus musculus
taaaggacttgaccaactcagagcc

SEQ ID NO: 735373 - DNA, 25 bp, Mus musculus
taaaggacttgagcaactcagagcc

SEQ ID NO: 735374 - DNA, 25 bp, Mus musculus
taaaggagaagaccattaaccagac

SEQ ID NO: 735375 - DNA, 25 bp, Mus musculus
taaaggagaagagcattaaccagac

SEQ ID NO: 735376 - DNA, 25 bp, Mus musculus
taaaggagaaggaagctaaacacct

SEQ ID NO: 735377 - DNA, 25 bp, Mus musculus
taaaggagaaggtagctaaacacct

SEQ ID NO: 735378 - DNA, 25 bp, Mus musculus
taaaggagacatagtttgactggcc

SEQ ID NO: 735379 - DNA, 25 bp, Mus musculus
taaaggagacattgtttgactggcc

SEQ ID NO: 735380 - DNA, 25 bp, Mus musculus
taaaggagacgacggacgcctcgct

SEQ ID NO: 735381 - DNA, 25 bp, Mus musculus
taaaggagacgagggacgcctcgct

SEQ ID NO: 735382 - DNA, 25 bp, Mus musculus
taaaggagagtgcttcacagacaag

SEQ ID NO: 735383 - DNA, 25 bp, Mus musculus
taaaggagagtggttcacagacaag

SEQ ID NO: 735384 - DNA, 25 bp, Mus musculus
taaaggagctctactgtgcaaagga

SEQ ID NO: 735385 - DNA, 25 bp, Mus musculus
taaaggagctcttctgtgcaaagga

SEQ ID NO: 735386 - DNA, 25 bp, Mus musculus
taaaggaggagaacccacactgtgt

SEQ ID NO: 735387 - DNA, 25 bp, Mus musculus
taaaggaggagatcccacactgtgt

SEQ ID NO: 735388 - DNA, 25 bp, Mus musculus
taaaggaggcgcagccaaacttcag

SEQ ID NO: 735389 - DNA, 25 bp, Mus musculus
taaaggaggcgctgccaaacttcag

SEQ ID NO: 735390 - DNA, 25 bp, Mus musculus
taaaggaggctgcagtcatgacact

SEQ ID NO: 735391 - DNA, 25 bp, Mus musculus
taaaggaggctggagtcatgacact

SEQ ID NO: 735392 - DNA, 25 bp, Mus musculus
taaaggaggtatacatcaccacagc

SEQ ID NO: 735393 - DNA, 25 bp, Mus musculus
taaaggaggtattcatcaccacagc

SEQ ID NO: 735394 - DNA, 25 bp, Mus musculus
taaaggagtttaagaccctggaaga

SEQ ID NO: 735395 - DNA, 25 bp, Mus musculus
taaaggagtttatgaccctggaaga

SEQ ID NO: 735396 - DNA, 25 bp, Mus musculus
taaaggataaaactcctgttgccat

SEQ ID NO: 735397 - DNA, 25 bp, Mus musculus
taaaggataaaagtcctgttgccat

SEQ ID NO: 735398 - DNA, 25 bp, Mus musculus
taaaggatagcgattccaagaaaat

SEQ ID NO: 735399 - DNA, 25 bp, Mus musculus
taaaggatagcgtttccaagaaaat

SEQ ID NO: 735400 - DNA, 25 bp, Mus musculus
taaaggatattccagccaccctgaa

SEQ ID NO: 735401 - DNA, 25 bp, Mus musculus
taaaggatattcgagccaccctgaa

SEQ ID NO: 735402 - DNA, 25 bp, Mus musculus
taaaggatttccaacctggctgaaa

SEQ ID NO: 735403 - DNA, 25 bp, Mus musculus
taaaggatttcctacctggctgaaa

SEQ ID NO: 735404 - DNA, 25 bp, Mus musculus
taaaggattttaaggccctgccaca

SEQ ID NO: 735405 - DNA, 25 bp, Mus musculus
taaaggattttatggccctgccaca

SEQ ID NO: 735406 - DNA, 25 bp, Mus musculus
taaaggcagatgacgtgccaaagac

SEQ ID NO: 735407 - DNA, 25 bp, Mus musculus
taaaggcagatgtcgtgccaaagac

SEQ ID NO: 735408 - DNA, 25 bp, Mus musculus
taaaggcagcttcagatgtcggtcc

SEQ ID NO: 735409 - DNA, 25 bp, Mus musculus
taaaggcagcttgagatgtcggtcc

SEQ ID NO: 735410 - DNA, 25 bp, Mus musculus
taaaggcaggttctcttagagccat

SEQ ID NO: 735411 - DNA, 25 bp, Mus musculus
taaaggcaggttgtcttagagccat

SEQ ID NO: 735412 - DNA, 25 bp, Mus musculus
taaaggcatcctcttatacggaccc

SEQ ID NO: 735413 - DNA, 25 bp, Mus musculus
taaaggcatcctgttatacggaccc

SEQ ID NO: 735414 - DNA, 25 bp, Mus musculus
taaaggccaaccctgtggcagactc

SEQ ID NO: 735415 - DNA, 25 bp, Mus musculus
taaaggccaaccgtgtggcagactc

SEQ ID NO: 735416 - DNA, 25 bp, Mus musculus
taaaggccgtaacacataagagttc

SEQ ID NO: 735417 - DNA, 25 bp, Mus musculus
taaaggccgtaagacataagagttc

SEQ ID NO: 735418 - DNA, 25 bp, Mus musculus
taaaggccgtcccacatttgctgag

SEQ ID NO: 735419 - DNA, 25 bp, Mus musculus
taaaggccgtccgacatttgctgag

SEQ ID NO: 735420 - DNA, 25 bp, Mus musculus
taaaggcctcttagtcctgccaact

SEQ ID NO: 735421 - DNA, 25 bp, Mus musculus
taaaggcctctttgtcctgccaact

SEQ ID NO: 735422 - DNA, 25 bp, Mus musculus
taaaggcctgctcgttcatttcagg

SEQ ID NO: 735423 - DNA, 25 bp, Mus musculus
taaaggcctgctggttcatttcagg

SEQ ID NO: 735424 - DNA, 25 bp, Mus musculus
taaaggcctgtcaccactgccatct

SEQ ID NO: 735425 - DNA, 25 bp, Mus musculus
taaaggcctgtctccactgccatct

SEQ ID NO: 735426 - DNA, 25 bp, Mus musculus
taaaggcgcaaaagcctccaaccct

SEQ ID NO: 735427 - DNA, 25 bp, Mus musculus
taaaggcgcaaacctcatcctgatc

SEQ ID NO: 735428 - DNA, 25 bp, Mus musculus
taaaggcgcaaagctcatcctgatc

SEQ ID NO: 735429 - DNA, 25 bp, Mus musculus
taaaggcgcaaatgcctccaaccct

SEQ ID NO: 735430 - DNA, 25 bp, Mus musculus
taaaggcggcccctgtgaagaccag

SEQ ID NO: 735431 - DNA, 25 bp, Mus musculus
taaaggcggcccgtgtgaagaccag

SEQ ID NO: 735432 - DNA, 25 bp, Mus musculus
taaaggcgtatgaatagcaacagct

SEQ ID NO: 735433 - DNA, 25 bp, Mus musculus
taaaggcgtatgtatagcaacagct

SEQ ID NO: 735434 - DNA, 25 bp, Mus musculus
taaaggcgttttacagacgggctca

SEQ ID NO: 735435 - DNA, 25 bp, Mus musculus
taaaggcgtttttcagacgggctca

SEQ ID NO: 735436 - DNA, 25 bp, Mus musculus
taaaggctactaatccagtaagagc

SEQ ID NO: 735437 - DNA, 25 bp, Mus musculus
taaaggctactattccagtaagagc

SEQ ID NO: 735438 - DNA, 25 bp, Mus musculus
taaaggctatccacgcccagcagat

SEQ ID NO: 735439 - DNA, 25 bp, Mus musculus
taaaggctatcctcgcccagcagat

SEQ ID NO: 735440 - DNA, 25 bp, Mus musculus
taaaggctggctacgttggaatgcc

SEQ ID NO: 735441 - DNA, 25 bp, Mus musculus
taaaggctggcttcgttggaatgcc

SEQ ID NO: 735442 - DNA, 25 bp, Mus musculus
taaaggctgttccaggttaaagcga

SEQ ID NO: 735443 - DNA, 25 bp, Mus musculus
taaaggctgttcgaggttaaagcga

SEQ ID NO: 735444 - DNA, 25 bp, Mus musculus
taaaggcttacaaaaaggagctgga

SEQ ID NO: 735445 - DNA, 25 bp, Mus musculus
taaaggcttacataaaggagctgga

SEQ ID NO: 735446 - DNA, 25 bp, Mus musculus
taaaggcttatgacctgatcctcag

SEQ ID NO: 735447 - DNA, 25 bp, Mus musculus
taaaggcttatgtcctgatcctcag

SEQ ID NO: 735448 - DNA, 25 bp, Mus musculus
taaaggcttctcctgactatgaaag

SEQ ID NO: 735449 - DNA, 25 bp, Mus musculus
taaaggcttctcgtgactatgaaag

SEQ ID NO: 735450 - DNA, 25 bp, Mus musculus
taaaggcttgacagctattttagag

SEQ ID NO: 735451 - DNA, 25 bp, Mus musculus
taaaggcttgactgctattttagag

SEQ ID NO: 735452 - DNA, 25 bp, Mus musculus
taaaggcttgtcagtgcatctcacc

SEQ ID NO: 735453 - DNA, 25 bp, Mus musculus
taaaggcttgtctgtgcatctcacc

SEQ ID NO: 735454 - DNA, 25 bp, Mus musculus
taaagggaccggagaatcagagaca

SEQ ID NO: 735455 - DNA, 25 bp, Mus musculus
taaagggaccggtgaatcagagaca

SEQ ID NO: 735456 - DNA, 25 bp, Mus musculus
taaagggcacaactacggaacatct

SEQ ID NO: 735457 - DNA, 25 bp, Mus musculus
taaagggcacaagtacggaacatct

SEQ ID NO: 735458 - DNA, 25 bp, Mus musculus
taaagggcatgtcagcctttgattc

SEQ ID NO: 735459 - DNA, 25 bp, Mus musculus
taaagggcatgtgagcctttgattc

SEQ ID NO: 735460 - DNA, 25 bp, Mus musculus
taaagggccaaacagttacagattc

SEQ ID NO: 735461 - DNA, 25 bp, Mus musculus
taaagggccaaagagttacagattc

SEQ ID NO: 735462 - DNA, 25 bp, Mus musculus
taaagggccagaccaaaaactccac

SEQ ID NO: 735463 - DNA, 25 bp, Mus musculus
taaagggccagagcaaaaactccac

SEQ ID NO: 735464 - DNA, 25 bp, Mus musculus
taaagggccccaattcaagcaagtt

SEQ ID NO: 735465 - DNA, 25 bp, Mus musculus
taaagggccccatttcaagcaagtt

SEQ ID NO: 735466 - DNA, 25 bp, Mus musculus
taaagggctcaaagttggcgcagtc

SEQ ID NO: 735467 - DNA, 25 bp, Mus musculus
taaagggctcaatgttggcgcagtc

SEQ ID NO: 735468 - DNA, 25 bp, Mus musculus
taaagggggtatagtctaatgatgc

SEQ ID NO: 735469 - DNA, 25 bp, Mus musculus
taaagggggtattgtctaatgatgc

SEQ ID NO: 735470 - DNA, 25 bp, Mus musculus
taaagggtaccaccaacaagacagc

SEQ ID NO: 735471 - DNA, 25 bp, Mus musculus
taaagggtaccagcaacaagacagc

SEQ ID NO: 735472 - DNA, 25 bp, Mus musculus
taaagggtctggcaagcaaaccggc

SEQ ID NO: 735473 - DNA, 25 bp, Mus musculus
taaagggtctgggaagcaaaccggc

SEQ ID NO: 735474 - DNA, 25 bp, Mus musculus
taaaggtactgacaaaagagagtca

SEQ ID NO: 735475 - DNA, 25 bp, Mus musculus
taaaggtactgagaaaagagagtca

SEQ ID NO: 735476 - DNA, 25 bp, Mus musculus
taaaggtagagacactggcatggac

SEQ ID NO: 735477 - DNA, 25 bp, Mus musculus
taaaggtagagagactggcatggac

SEQ ID NO: 735478 - DNA, 25 bp, Mus musculus
taaaggtatcagcaagataacagaa

SEQ ID NO: 735479 - DNA, 25 bp, Mus musculus
taaaggtatcaggaagataacagaa

SEQ ID NO: 735480 - DNA, 25 bp, Mus musculus
taaaggtcacaaagctgccatcacc

SEQ ID NO: 735481 - DNA, 25 bp, Mus musculus
taaaggtcacaatgctgccatcacc

SEQ ID NO: 735482 - DNA, 25 bp, Mus musculus
taaaggtcacctaccactccgacta

SEQ ID NO: 735483 - DNA, 25 bp, Mus musculus
taaaggtcaccttccactccgacta

SEQ ID NO: 735484 - DNA, 25 bp, Mus musculus
taaaggtcggctcaccattaaggcg

SEQ ID NO: 735485 - DNA, 25 bp, Mus musculus
taaaggtcggctgaccattaaggcg

SEQ ID NO: 735486 - DNA, 25 bp, Mus musculus
taaaggtcgtccaccaagagtgcca

SEQ ID NO: 735487 - DNA, 25 bp, Mus musculus
taaaggtcgtcctccaagagtgcca

SEQ ID NO: 735488 - DNA, 25 bp, Mus musculus
taaaggtctgatcctgagacaaggc

SEQ ID NO: 735489 - DNA, 25 bp, Mus musculus
taaaggtctgatgctgagacaaggc

SEQ ID NO: 735490 - DNA, 25 bp, Mus musculus
taaaggtgaaataagtacattctca

SEQ ID NO: 735491 - DNA, 25 bp, Mus musculus
taaaggtgaaattagtacattctca

SEQ ID NO: 735492 - DNA, 25 bp, Mus musculus
taaaggtgcactatcggcttaccgc

SEQ ID NO: 735493 - DNA, 25 bp, Mus musculus
taaaggtgcactttcggcttaccgc

SEQ ID NO: 735494 - DNA, 25 bp, Mus musculus
taaaggtggttgacccaactccaga

SEQ ID NO: 735495 - DNA, 25 bp, Mus musculus
taaaggtggttgtcccaactccaga

SEQ ID NO: 735496 - DNA, 25 bp, Mus musculus
taaaggtgtcctcaaagtcaagggc

SEQ ID NO: 735497 - DNA, 25 bp, Mus musculus
taaaggtgtcctgaaagtcaagggc

SEQ ID NO: 735498 - DNA, 25 bp, Mus musculus
taaaggttactcatacaatatccgg

SEQ ID NO: 735499 - DNA, 25 bp, Mus musculus
taaaggttactcttacaatatccgg

SEQ ID NO: 735500 - DNA, 25 bp, Mus musculus
taaaggttcctgaatgccggttggc

SEQ ID NO: 735501 - DNA, 25 bp, Mus musculus
taaaggttcctgtatgccggttggc

SEQ ID NO: 735502 - DNA, 25 bp, Mus musculus
taaaggttcgcaacgctgtgagcaa

SEQ ID NO: 735503 - DNA, 25 bp, Mus musculus
taaaggttcgcatcgctgtgagcaa

SEQ ID NO: 735504 - DNA, 25 bp, Mus musculus
taaaggttgcggctcctcagtcaat

SEQ ID NO: 735505 - DNA, 25 bp, Mus musculus
taaaggttgcgggtcctcagtcaat

SEQ ID NO: 735506 - DNA, 25 bp, Mus musculus
taaaggttgcttctttcttcgggtg

SEQ ID NO: 735507 - DNA, 25 bp, Mus musculus
taaaggttgcttgtttcttcgggtg

SEQ ID NO: 735508 - DNA, 25 bp, Mus musculus
taaaggttgtgaactccaccaccgg

SEQ ID NO: 735509 - DNA, 25 bp, Mus musculus
taaaggttgtgatctccaccaccgg

SEQ ID NO: 735510 - DNA, 25 bp, Mus musculus
taaagtaaaaatctcgcctcagctg

SEQ ID NO: 735511 - DNA, 25 bp, Mus musculus
taaagtaaaaatgtcgcctcagctg

SEQ ID NO: 735512 - DNA, 25 bp, Mus musculus
taaagtaaacctctttcccatggag

SEQ ID NO: 735513 - DNA, 25 bp, Mus musculus
taaagtaaacctgtttcccatggag

SEQ ID NO: 735514 - DNA, 25 bp, Mus musculus
taaagtaagaataagtcacaattcc

SEQ ID NO: 735515 - DNA, 25 bp, Mus musculus
taaagtaagaattagtcacaattcc

SEQ ID NO: 735516 - DNA, 25 bp, Mus musculus
taaagtaagagccaccagacttgtt

SEQ ID NO: 735517 - DNA, 25 bp, Mus musculus
taaagtaagagcgaccagacttgtt

SEQ ID NO: 735518 - DNA, 25 bp, Mus musculus
taaagtaagtataaagccccgtgat

SEQ ID NO: 735519 - DNA, 25 bp, Mus musculus
taaagtaagtattaagccccgtgat

SEQ ID NO: 735520 - DNA, 25 bp, Mus musculus
taaagtacaaaacgagatgaaaaga

SEQ ID NO: 735521 - DNA, 25 bp, Mus musculus
taaagtacaaaaggagatgaaaaga

SEQ ID NO: 735522 - DNA, 25 bp, Mus musculus
taaagtaccctgactttggcttcag

SEQ ID NO: 735523 - DNA, 25 bp, Mus musculus
taaagtaccctgtctttggcttcag

SEQ ID NO: 735524 - DNA, 25 bp, Mus musculus
taaagtacctcaatctagggaacac

SEQ ID NO: 735525 - DNA, 25 bp, Mus musculus
taaagtacctcattctagggaacac

SEQ ID NO: 735526 - DNA, 25 bp, Mus musculus
taaagtacgatgcatttgactgtgt

SEQ ID NO: 735527 - DNA, 25 bp, Mus musculus
taaagtacgatggatttgactgtgt

SEQ ID NO: 735528 - DNA, 25 bp, Mus musculus
taaagtactgaactcacaagcgtat

SEQ ID NO: 735529 - DNA, 25 bp, Mus musculus
taaagtactgaagtcacaagcgtat

SEQ ID NO: 735530 - DNA, 25 bp, Mus musculus
taaagtactgggaggcattcctacc

SEQ ID NO: 735531 - DNA, 25 bp, Mus musculus
taaagtactgggtggcattcctacc

SEQ ID NO: 735532 - DNA, 25 bp, Mus musculus
taaagtagacatcgtttggatagtc

SEQ ID NO: 735533 - DNA, 25 bp, Mus musculus
taaagtagacatggtttggatagtc

SEQ ID NO: 735534 - DNA, 25 bp, Mus musculus
taaagtaggaaaagccatcccactc

SEQ ID NO: 735535 - DNA, 25 bp, Mus musculus
taaagtaggaaatgccatcccactc

SEQ ID NO: 735536 - DNA, 25 bp, Mus musculus
taaagtagtccgctcagtgtcttca

SEQ ID NO: 735537 - DNA, 25 bp, Mus musculus
taaagtagtccggtcagtgtcttca

SEQ ID NO: 735538 - DNA, 25 bp, Mus musculus
taaagtagttatcaacatagcatgt

SEQ ID NO: 735539 - DNA, 25 bp, Mus musculus
taaagtagttatgaacatagcatgt

SEQ ID NO: 735540 - DNA, 25 bp, Mus musculus
taaagtatcccaaaggcattgccct

SEQ ID NO: 735541 - DNA, 25 bp, Mus musculus
taaagtatcccataggcattgccct

SEQ ID NO: 735542 - DNA, 25 bp, Mus musculus
taaagtatctctcaccactgttgct

SEQ ID NO: 735543 - DNA, 25 bp, Mus musculus
taaagtatctctgaccactgttgct

SEQ ID NO: 735544 - DNA, 25 bp, Mus musculus
taaagtatgagtaccagcctttcgc

SEQ ID NO: 735545 - DNA, 25 bp, Mus musculus
taaagtatgagttccagcctttcgc

SEQ ID NO: 735546 - DNA, 25 bp, Mus musculus
taaagtatggcaaacgtatccacgt

SEQ ID NO: 735547 - DNA, 25 bp, Mus musculus
taaagtatggcatacgtatccacgt

SEQ ID NO: 735548 - DNA, 25 bp, Mus musculus
taaagtcaattccaggaagaggagg

SEQ ID NO: 735549 - DNA, 25 bp, Mus musculus
taaagtcaattcgaggaagaggagg

SEQ ID NO: 735550 - DNA, 25 bp, Mus musculus
taaagtcacaagaatagagatctgg

SEQ ID NO: 735551 - DNA, 25 bp, Mus musculus
taaagtcacaagtatagagatctgg

SEQ ID NO: 735552 - DNA, 25 bp, Mus musculus
taaagtcagaagatgagttacggcc

SEQ ID NO: 735553 - DNA, 25 bp, Mus musculus
taaagtcagaagttgagttacggcc

SEQ ID NO: 735554 - DNA, 25 bp, Mus musculus
taaagtcagacacaaaccaggtggg

SEQ ID NO: 735555 - DNA, 25 bp, Mus musculus
taaagtcagacagaaaccaggtggg

SEQ ID NO: 735556 - DNA, 25 bp, Mus musculus
taaagtcagaggaccaaacctgtgg

SEQ ID NO: 735557 - DNA, 25 bp, Mus musculus
taaagtcagaggtccaaacctgtgg

SEQ ID NO: 735558 - DNA, 25 bp, Mus musculus
taaagtcagcctatgcccaggtggg

SEQ ID NO: 735559 - DNA, 25 bp, Mus musculus
taaagtcagcctttgcccaggtggg

SEQ ID NO: 735560 - DNA, 25 bp, Mus musculus
taaagtcagtagagggacaccgatc

SEQ ID NO: 735561 - DNA, 25 bp, Mus musculus
taaagtcagtagtgggacaccgatc

SEQ ID NO: 735562 - DNA, 25 bp, Mus musculus
taaagtccaagacggatgctcggtc

SEQ ID NO: 735563 - DNA, 25 bp, Mus musculus
taaagtccaagagggatgctcggtc

SEQ ID NO: 735564 - DNA, 25 bp, Mus musculus
taaagtccggtgatgccagcttcag

SEQ ID NO: 735565 - DNA, 25 bp, Mus musculus
taaagtccggtgttgccagcttcag

SEQ ID NO: 735566 - DNA, 25 bp, Mus musculus
taaagtccggttacaccttgccaga

SEQ ID NO: 735567 - DNA, 25 bp, Mus musculus
taaagtccggtttcaccttgccaga

SEQ ID NO: 735568 - DNA, 25 bp, Mus musculus
taaagtcctgggaaaccgctgggct

SEQ ID NO: 735569 - DNA, 25 bp, Mus musculus
taaagtcctgggtaaccgctgggct

SEQ ID NO: 735570 - DNA, 25 bp, Mus musculus
taaagtccttgacgacgcatggacc

SEQ ID NO: 735571 - DNA, 25 bp, Mus musculus
taaagtccttgaggacgcatggacc

SEQ ID NO: 735572 - DNA, 25 bp, Mus musculus
taaagtcgaattacaagcccttaag

SEQ ID NO: 735573 - DNA, 25 bp, Mus musculus
taaagtcgaatttcaagcccttaag

SEQ ID NO: 735574 - DNA, 25 bp, Mus musculus
taaagtcgagggagttggatgccat

SEQ ID NO: 735575 - DNA, 25 bp, Mus musculus
taaagtcgagggtgttggatgccat

SEQ ID NO: 735576 - DNA, 25 bp, Mus musculus
taaagtcgggctctctacgtttcag

SEQ ID NO: 735577 - DNA, 25 bp, Mus musculus
taaagtcgggctgtctacgtttcag

SEQ ID NO: 735578 - DNA, 25 bp, Mus musculus
taaagtcggttcacgttcatagcaa

SEQ ID NO: 735579 - DNA, 25 bp, Mus musculus
taaagtcggttctcgttcatagcaa

SEQ ID NO: 735580 - DNA, 25 bp, Mus musculus
taaagtctattacctctcacctgtg

SEQ ID NO: 735581 - DNA, 25 bp, Mus musculus
taaagtctattagctctcacctgtg

SEQ ID NO: 735582 - DNA, 25 bp, Mus musculus
taaagtctcctgagttgcaaccaca

SEQ ID NO: 735583 - DNA, 25 bp, Mus musculus
taaagtctcctgtgttgcaaccaca

SEQ ID NO: 735584 - DNA, 25 bp, Mus musculus
taaagtctgaggatgaaagcgagcg

SEQ ID NO: 735585 - DNA, 25 bp, Mus musculus
taaagtctgaggttgaaagcgagcg

SEQ ID NO: 735586 - DNA, 25 bp, Mus musculus
taaagtctgcttcatttgcatacag

SEQ ID NO: 735587 - DNA, 25 bp, Mus musculus
taaagtctgcttgatttgcatacag

SEQ ID NO: 735588 - DNA, 25 bp, Mus musculus
taaagtctgtgaccactacattggc

SEQ ID NO: 735589 - DNA, 25 bp, Mus musculus
taaagtctgtgagcactacattggc

SEQ ID NO: 735590 - DNA, 25 bp, Mus musculus
taaagtctgtgcaccgactgtgaga

SEQ ID NO: 735591 - DNA, 25 bp, Mus musculus
taaagtctgtgctccgactgtgaga

SEQ ID NO: 735592 - DNA, 25 bp, Mus musculus
taaagtctgtggatggctcgtacac

SEQ ID NO: 735593 - DNA, 25 bp, Mus musculus
taaagtctgtggttggctcgtacac

SEQ ID NO: 735594 - DNA, 25 bp, Mus musculus
taaagtcttgcacgaggctgaaggc

SEQ ID NO: 735595 - DNA, 25 bp, Mus musculus
taaagtcttgcaggaggctgaaggc

SEQ ID NO: 735596 - DNA, 25 bp, Mus musculus
taaagtgaaacccaagtagactgcg

SEQ ID NO: 735597 - DNA, 25 bp, Mus musculus
taaagtgaaaccgaagtagactgcg

SEQ ID NO: 735598 - DNA, 25 bp, Mus musculus
taaagtgaaactccttactgagact

SEQ ID NO: 735599 - DNA, 25 bp, Mus musculus
taaagtgaaactgcttactgagact

SEQ ID NO: 735600 - DNA, 25 bp, Mus musculus
taaagtgaacatactgggagaggtg

SEQ ID NO: 735601 - DNA, 25 bp, Mus musculus
taaagtgaacattctgggagaggtg

SEQ ID NO: 735602 - DNA, 25 bp, Mus musculus
taaagtgaccccagcgcttagtgct

SEQ ID NO: 735603 - DNA, 25 bp, Mus musculus
taaagtgacccctgcgcttagtgct

SEQ ID NO: 735604 - DNA, 25 bp, Mus musculus
taaagtgcaaatcggctaataggcc

SEQ ID NO: 735605 - DNA, 25 bp, Mus musculus
taaagtgcaaatgggctaataggcc

SEQ ID NO: 735606 - DNA, 25 bp, Mus musculus
taaagtgcataaagctgacgccgcc

SEQ ID NO: 735607 - DNA, 25 bp, Mus musculus
taaagtgcataatgctgacgccgcc

SEQ ID NO: 735608 - DNA, 25 bp, Mus musculus
taaagtgcctgaccggatccagagg

SEQ ID NO: 735609 - DNA, 25 bp, Mus musculus
taaagtgcctgagcggatccagagg

SEQ ID NO: 735610 - DNA, 25 bp, Mus musculus
taaagtgccttccaatgacaacagc

SEQ ID NO: 735611 - DNA, 25 bp, Mus musculus
taaagtgccttcgaatgacaacagc

SEQ ID NO: 735612 - DNA, 25 bp, Mus musculus
taaagtgcgcatcttcggcctcaag

SEQ ID NO: 735613 - DNA, 25 bp, Mus musculus
taaagtgcgcatgttcggcctcaag

SEQ ID NO: 735614 - DNA, 25 bp, Mus musculus
taaagtggatagaccaggagtgagc

SEQ ID NO: 735615 - DNA, 25 bp, Mus musculus
taaagtggatagtccaggagtgagc

SEQ ID NO: 735616 - DNA, 25 bp, Mus musculus
taaagtggcactacttcaaagggcc

SEQ ID NO: 735617 - DNA, 25 bp, Mus musculus
taaagtggcacttcttcaaagggcc

SEQ ID NO: 735618 - DNA, 25 bp, Mus musculus
taaagtggccccaagcagcgcagcc

SEQ ID NO: 735619 - DNA, 25 bp, Mus musculus
taaagtggcccctagcagcgcagcc

SEQ ID NO: 735620 - DNA, 25 bp, Mus musculus
taaagtggccgaacatcaacaacaa

SEQ ID NO: 735621 - DNA, 25 bp, Mus musculus
taaagtggccgatcatcaacaacaa

SEQ ID NO: 735622 - DNA, 25 bp, Mus musculus
taaagtggcgctcatcaactctctc

SEQ ID NO: 735623 - DNA, 25 bp, Mus musculus
taaagtggcgctgatcaactctctc

SEQ ID NO: 735624 - DNA, 25 bp, Mus musculus
taaagtggttggattggatcagcag

SEQ ID NO: 735625 - DNA, 25 bp, Mus musculus
taaagtggttggtttggatcagcag

SEQ ID NO: 735626 - DNA, 25 bp, Mus musculus
taaagtgtccctaatggatgtcaca

SEQ ID NO: 735627 - DNA, 25 bp, Mus musculus
taaagtgtcccttatggatgtcaca

SEQ ID NO: 735628 - DNA, 25 bp, Mus musculus
taaagtgtgatgagacccagagcca

SEQ ID NO: 735629 - DNA, 25 bp, Mus musculus
taaagtgtgatgtgacccagagcca

SEQ ID NO: 735630 - DNA, 25 bp, Mus musculus
taaagtgtgggaacttatggctgct

SEQ ID NO: 735631 - DNA, 25 bp, Mus musculus
taaagtgtgggatcttatggctgct

SEQ ID NO: 735632 - DNA, 25 bp, Mus musculus
taaagttaccatcttcagtcttact

SEQ ID NO: 735633 - DNA, 25 bp, Mus musculus
taaagttaccatgttcagtcttact

SEQ ID NO: 735634 - DNA, 25 bp, Mus musculus
taaagttcaacaagtcatccattac

SEQ ID NO: 735635 - DNA, 25 bp, Mus musculus
taaagttcaacaccttgaagaggac

SEQ ID NO: 735636 - DNA, 25 bp, Mus musculus
taaagttcaacagcttgaagaggac

SEQ ID NO: 735637 - DNA, 25 bp, Mus musculus
taaagttcaacatgtcatccattac

SEQ ID NO: 735638 - DNA, 25 bp, Mus musculus
taaagttcaagaatgtgcccatcca

SEQ ID NO: 735639 - DNA, 25 bp, Mus musculus
taaagttcaagattgtgcccatcca

SEQ ID NO: 735640 - DNA, 25 bp, Mus musculus
taaagttcggatcatgaaaggcgag

SEQ ID NO: 735641 - DNA, 25 bp, Mus musculus
taaagttcggatgatgaaaggcgag

SEQ ID NO: 735642 - DNA, 25 bp, Mus musculus
taaagttctaggcactttcccaaag

SEQ ID NO: 735643 - DNA, 25 bp, Mus musculus
taaagttctagggactttcccaaag

SEQ ID NO: 735644 - DNA, 25 bp, Mus musculus
taaagttctgctccctcctggtagt

SEQ ID NO: 735645 - DNA, 25 bp, Mus musculus
taaagttctgctgcctcctggtagt

SEQ ID NO: 735646 - DNA, 25 bp, Mus musculus
taaagttcttttcggatgagatcta

SEQ ID NO: 735647 - DNA, 25 bp, Mus musculus
taaagttcttttgggatgagatcta

SEQ ID NO: 735648 - DNA, 25 bp, Mus musculus
taaagttgaaccacacttacctagt

SEQ ID NO: 735649 - DNA, 25 bp, Mus musculus
taaagttgaacctcacttacctagt

SEQ ID NO: 735650 - DNA, 25 bp, Mus musculus
taaagttgcgtcctccttaacctct

SEQ ID NO: 735651 - DNA, 25 bp, Mus musculus
taaagttgcgtcgtccttaacctct

SEQ ID NO: 735652 - DNA, 25 bp, Mus musculus
taaagtttaaaacggcaggagagct

SEQ ID NO: 735653 - DNA, 25 bp, Mus musculus
taaagtttaaaagggcaggagagct

SEQ ID NO: 735654 - DNA, 25 bp, Mus musculus
taaagtttgaaactatgttgccatt

SEQ ID NO: 735655 - DNA, 25 bp, Mus musculus
taaagtttgaaagtatgttgccatt

SEQ ID NO: 735656 - DNA, 25 bp, Mus musculus
taaagtttgcctcagaaagtctagg

SEQ ID NO: 735657 - DNA, 25 bp, Mus musculus
taaagtttgcctgagaaagtctagg

SEQ ID NO: 735658 - DNA, 25 bp, Mus musculus
taaagtttgcgtacccctcagagag

SEQ ID NO: 735659 - DNA, 25 bp, Mus musculus
taaagtttgcgttcccctcagagag

SEQ ID NO: 735660 - DNA, 25 bp, Mus musculus
taaagttttcctcagaatggcaccc

SEQ ID NO: 735661 - DNA, 25 bp, Mus musculus
taaagttttcctgagaatggcaccc

SEQ ID NO: 735662 - DNA, 25 bp, Mus musculus
taaataaagattagcgacactacct

SEQ ID NO: 735663 - DNA, 25 bp, Mus musculus
taaataaagatttgcgacactacct

SEQ ID NO: 735664 - DNA, 25 bp, Mus musculus
taaataacctccatcctccaaggca

SEQ ID NO: 735665 - DNA, 25 bp, Mus musculus
taaataacctccttcctccaaggca

SEQ ID NO: 735666 - DNA, 25 bp, Mus musculus
taaataacctggatgtcctgcggct

SEQ ID NO: 735667 - DNA, 25 bp, Mus musculus
taaataacctggttgtcctgcggct

SEQ ID NO: 735668 - DNA, 25 bp, Mus musculus
taaataagcgcaaagacaccaagga

SEQ ID NO: 735669 - DNA, 25 bp, Mus musculus
taaataagcgcatagacaccaagga

SEQ ID NO: 735670 - DNA, 25 bp, Mus musculus
taaataaggctccagaggaaatggc

SEQ ID NO: 735671 - DNA, 25 bp, Mus musculus
taaataaggctcgagaggaaatggc

SEQ ID NO: 735672 - DNA, 25 bp, Mus musculus
taaataatagatctatgcccataac

SEQ ID NO: 735673 - DNA, 25 bp, Mus musculus
taaataatagatgtatgcccataac

SEQ ID NO: 735674 - DNA, 25 bp, Mus musculus
taaataattccacggaacaccagtg

SEQ ID NO: 735675 - DNA, 25 bp, Mus musculus
taaataattccagggaacaccagtg

SEQ ID NO: 735676 - DNA, 25 bp, Mus musculus
taaatacaaacgagggcaagaagaa

SEQ ID NO: 735677 - DNA, 25 bp, Mus musculus
taaatacaaacgtgggcaagaagaa

SEQ ID NO: 735678 - DNA, 25 bp, Mus musculus
taaatacaaagacagttcattctgg

SEQ ID NO: 735679 - DNA, 25 bp, Mus musculus
taaatacaaagagagttcattctgg

SEQ ID NO: 735680 - DNA, 25 bp, Mus musculus
taaatacaagtaatcactcaggagt

SEQ ID NO: 735681 - DNA, 25 bp, Mus musculus
taaatacaagtattcactcaggagt

SEQ ID NO: 735682 - DNA, 25 bp, Mus musculus
taaatacagagaatacccaagtctc

SEQ ID NO: 735683 - DNA, 25 bp, Mus musculus
taaatacagagattacccaagtctc

SEQ ID NO: 735684 - DNA, 25 bp, Mus musculus
taaatacatggcagatatggatgag

SEQ ID NO: 735685 - DNA, 25 bp, Mus musculus
taaatacatggctgatatggatgag

SEQ ID NO: 735686 - DNA, 25 bp, Mus musculus
taaatacccacacgagagcgagctg

SEQ ID NO: 735687 - DNA, 25 bp, Mus musculus
taaatacccacaggagagcgagctg

SEQ ID NO: 735688 - DNA, 25 bp, Mus musculus
taaatacgggccagatgggctgccc

SEQ ID NO: 735689 - DNA, 25 bp, Mus musculus
taaatacgggcctgatgggctgccc

SEQ ID NO: 735690 - DNA, 25 bp, Mus musculus
taaatacgtttgcatgctctctaag

SEQ ID NO: 735691 - DNA, 25 bp, Mus musculus
taaatacgtttggatgctctctaag

SEQ ID NO: 735692 - DNA, 25 bp, Mus musculus
taaatactcgataacttgcttatag

SEQ ID NO: 735693 - DNA, 25 bp, Mus musculus
taaatactcgattacttgcttatag

SEQ ID NO: 735694 - DNA, 25 bp, Mus musculus
taaatactctgtatctgacgccgtg

SEQ ID NO: 735695 - DNA, 25 bp, Mus musculus
taaatactctgtcgcgggtaaaaag

SEQ ID NO: 735696 - DNA, 25 bp, Mus musculus
taaatactctgtggcgggtaaaaag

SEQ ID NO: 735697 - DNA, 25 bp, Mus musculus
taaatactctgtttctgacgccgtg

SEQ ID NO: 735698 - DNA, 25 bp, Mus musculus
taaatacttgaaatcacgacactca

SEQ ID NO: 735699 - DNA, 25 bp, Mus musculus
taaatacttgaattcacgacactca

SEQ ID NO: 735700 - DNA, 25 bp, Mus musculus
taaatacttggccaagcccggcggc

SEQ ID NO: 735701 - DNA, 25 bp, Mus musculus
taaatacttggcgaagcccggcggc

SEQ ID NO: 735702 - DNA, 25 bp, Mus musculus
taaatagagagcattctcagaaaac

SEQ ID NO: 735703 - DNA, 25 bp, Mus musculus
taaatagagagctttctcagaaaac

SEQ ID NO: 735704 - DNA, 25 bp, Mus musculus
taaatagccaagaaaagcatcaagg

SEQ ID NO: 735705 - DNA, 25 bp, Mus musculus
taaatagccaagtaaagcatcaagg

SEQ ID NO: 735706 - DNA, 25 bp, Mus musculus
taaatagccctgcatttcatttgtt

SEQ ID NO: 735707 - DNA, 25 bp, Mus musculus
taaatagccctggatttcatttgtt

SEQ ID NO: 735708 - DNA, 25 bp, Mus musculus
taaatagcgataaggtatactggca

SEQ ID NO: 735709 - DNA, 25 bp, Mus musculus
taaatagcgatatggtatactggca

SEQ ID NO: 735710 - DNA, 25 bp, Mus musculus
taaatagctccaatgcagaagtgct

SEQ ID NO: 735711 - DNA, 25 bp, Mus musculus
taaatagctccattgcagaagtgct

SEQ ID NO: 735712 - DNA, 25 bp, Mus musculus
taaatagtcgccattgcaggcggct

SEQ ID NO: 735713 - DNA, 25 bp, Mus musculus
taaatagtcgcctttgcaggcggct

SEQ ID NO: 735714 - DNA, 25 bp, Mus musculus
taaatagtgtaaaagctcacgctcc

SEQ ID NO: 735715 - DNA, 25 bp, Mus musculus
taaatagtgtaatagctcacgctcc

SEQ ID NO: 735716 - DNA, 25 bp, Mus musculus
taaatagtgttaatgaaggtgggca

SEQ ID NO: 735717 - DNA, 25 bp, Mus musculus
taaatagtgttattgaaggtgggca

SEQ ID NO: 735718 - DNA, 25 bp, Mus musculus
taaatagttaatccacggaaggtac

SEQ ID NO: 735719 - DNA, 25 bp, Mus musculus
taaatagttaatgcacggaaggtac

SEQ ID NO: 735720 - DNA, 25 bp, Mus musculus
taaatatagactctctcagctcatc

SEQ ID NO: 735721 - DNA, 25 bp, Mus musculus
taaatatagactgtctcagctcatc

SEQ ID NO: 735722 - DNA, 25 bp, Mus musculus
taaatatatatccatctagctgcat

SEQ ID NO: 735723 - DNA, 25 bp, Mus musculus
taaatatatatcgatctagctgcat

SEQ ID NO: 735724 - DNA, 25 bp, Mus musculus
taaatatatcaacactgatgcaaag

SEQ ID NO: 735725 - DNA, 25 bp, Mus musculus
taaatatatcaagactgatgcaaag

SEQ ID NO: 735726 - DNA, 25 bp, Mus musculus
taaatatattccacctggacaaaga

SEQ ID NO: 735727 - DNA, 25 bp, Mus musculus
taaatatattcctcctggacaaaga

SEQ ID NO: 735728 - DNA, 25 bp, Mus musculus
taaatatctgaacacccacgtggga

SEQ ID NO: 735729 - DNA, 25 bp, Mus musculus
taaatatctgaagacccacgtggga

SEQ ID NO: 735730 - DNA, 25 bp, Mus musculus
taaatatgaataaggctatgccttc

SEQ ID NO: 735731 - DNA, 25 bp, Mus musculus
taaatatgaatatggctatgccttc

SEQ ID NO: 735732 - DNA, 25 bp, Mus musculus
taaatattagaacactgacagatga

SEQ ID NO: 735733 - DNA, 25 bp, Mus musculus
taaatattagaagactgacagatga

SEQ ID NO: 735734 - DNA, 25 bp, Mus musculus
taaatattatttccccgagagagtt

SEQ ID NO: 735735 - DNA, 25 bp, Mus musculus
taaatattatttgcccgagagagtt

SEQ ID NO: 735736 - DNA, 25 bp, Mus musculus
taaatattcggaaacacagctggcc

SEQ ID NO: 735737 - DNA, 25 bp, Mus musculus
taaatattcggatacacagctggcc

SEQ ID NO: 735738 - DNA, 25 bp, Mus musculus
taaatcaagcagcttctagagagag

SEQ ID NO: 735739 - DNA, 25 bp, Mus musculus
taaatcaagcaggttctagagagag

SEQ ID NO: 735740 - DNA, 25 bp, Mus musculus
taaatcaatcaaataaaggtcttca

SEQ ID NO: 735741 - DNA, 25 bp, Mus musculus
taaatcaatcaattaaaggtcttca

SEQ ID NO: 735742 - DNA, 25 bp, Mus musculus
taaatcaatgaacagtagggcttct

SEQ ID NO: 735743 - DNA, 25 bp, Mus musculus
taaatcaatgaagagtagggcttct

SEQ ID NO: 735744 - DNA, 25 bp, Mus musculus
taaatcaatgctctactttgcaact

SEQ ID NO: 735745 - DNA, 25 bp, Mus musculus
taaatcaatgctgtactttgcaact

SEQ ID NO: 735746 - DNA, 25 bp, Mus musculus
taaatcacaccactgcgtgagcgcg

SEQ ID NO: 735747 - DNA, 25 bp, Mus musculus
taaatcacaccagtgcgtgagcgcg

SEQ ID NO: 735748 - DNA, 25 bp, Mus musculus
taaatcaccctgagcagacgcttcg

SEQ ID NO: 735749 - DNA, 25 bp, Mus musculus
taaatcaccctgtgcagacgcttcg

SEQ ID NO: 735750 - DNA, 25 bp, Mus musculus
taaatcaccgtgctagcttcaaagg

SEQ ID NO: 735751 - DNA, 25 bp, Mus musculus
taaatcaccgtggtagcttcaaagg

SEQ ID NO: 735752 - DNA, 25 bp, Mus musculus
taaatcagagaccaaggacgcatag

SEQ ID NO: 735753 - DNA, 25 bp, Mus musculus
taaatcagagacgaaggacgcatag

SEQ ID NO: 735754 - DNA, 25 bp, Mus musculus
taaatcagagcactggaagttcccc

SEQ ID NO: 735755 - DNA, 25 bp, Mus musculus
taaatcagagcagtggaagttcccc

SEQ ID NO: 735756 - DNA, 25 bp, Mus musculus
taaatcagataaccttacccgggct

SEQ ID NO: 735757 - DNA, 25 bp, Mus musculus
taaatcagataagcttacccgggct

SEQ ID NO: 735758 - DNA, 25 bp, Mus musculus
taaatcagggcacttactaggcgtg

SEQ ID NO: 735759 - DNA, 25 bp, Mus musculus
taaatcagggcagttactaggcgtg

SEQ ID NO: 735760 - DNA, 25 bp, Mus musculus
taaatcaggtaactgtttccagatc

SEQ ID NO: 735761 - DNA, 25 bp, Mus musculus
taaatcaggtaagtgtttccagatc

SEQ ID NO: 735762 - DNA, 25 bp, Mus musculus
taaatcagtgacaatagccccgcct

SEQ ID NO: 735763 - DNA, 25 bp, Mus musculus
taaatcagtgactatagccccgcct

SEQ ID NO: 735764 - DNA, 25 bp, Mus musculus
taaatcagtttaagaccattcagcc

SEQ ID NO: 735765 - DNA, 25 bp, Mus musculus
taaatcagtttatgaccattcagcc

SEQ ID NO: 735766 - DNA, 25 bp, Mus musculus
taaatcatgtggatcggaaatacag

SEQ ID NO: 735767 - DNA, 25 bp, Mus musculus
taaatcatgtggttcggaaatacag

SEQ ID NO: 735768 - DNA, 25 bp, Mus musculus
taaatccagccaaacgaataagaga

SEQ ID NO: 735769 - DNA, 25 bp, Mus musculus
taaatccagccatacgaataagaga

SEQ ID NO: 735770 - DNA, 25 bp, Mus musculus
taaatccagtgtatcttcagagtca

SEQ ID NO: 735771 - DNA, 25 bp, Mus musculus
taaatccagtgtttcttcagagtca

SEQ ID NO: 735772 - DNA, 25 bp, Mus musculus
taaatccatctgattcagaacctct

SEQ ID NO: 735773 - DNA, 25 bp, Mus musculus
taaatccatctgtttcagaacctct

SEQ ID NO: 735774 - DNA, 25 bp, Mus musculus
taaatccatggcctatatgcgtggt

SEQ ID NO: 735775 - DNA, 25 bp, Mus musculus
taaatccatggcgtatatgcgtggt

SEQ ID NO: 735776 - DNA, 25 bp, Mus musculus
taaatccattctcatgagacccggg

SEQ ID NO: 735777 - DNA, 25 bp, Mus musculus
taaatccattctgatgagacccggg

SEQ ID NO: 735778 - DNA, 25 bp, Mus musculus
taaatcccgaatccaagcaagaagt

SEQ ID NO: 735779 - DNA, 25 bp, Mus musculus
taaatcccgaatgcaagcaagaagt

SEQ ID NO: 735780 - DNA, 25 bp, Mus musculus
taaatcctctgacagtgacgagtcc

SEQ ID NO: 735781 - DNA, 25 bp, Mus musculus
taaatcctctgagagtgacgagtcc

SEQ ID NO: 735782 - DNA, 25 bp, Mus musculus
taaatcctgaccacacaagttcttc

SEQ ID NO: 735783 - DNA, 25 bp, Mus musculus
taaatcctgacctcacaagttcttc

SEQ ID NO: 735784 - DNA, 25 bp, Mus musculus
taaatccttggaagatcttcccggc

SEQ ID NO: 735785 - DNA, 25 bp, Mus musculus
taaatccttggatgatcttcccggc

SEQ ID NO: 735786 - DNA, 25 bp, Mus musculus
taaatcgagtttcgaagcagccagc

SEQ ID NO: 735787 - DNA, 25 bp, Mus musculus
taaatcgagtttggaagcagccagc

SEQ ID NO: 735788 - DNA, 25 bp, Mus musculus
taaatcggatccacagactgacttc

SEQ ID NO: 735789 - DNA, 25 bp, Mus musculus
taaatcggatcctcagactgacttc

SEQ ID NO: 735790 - DNA, 25 bp, Mus musculus
taaatcgtcctaatcagctgcaaca

SEQ ID NO: 735791 - DNA, 25 bp, Mus musculus
taaatcgtcctattcagctgcaaca

SEQ ID NO: 735792 - DNA, 25 bp, Mus musculus
taaatctaaaagcatggatgccatc

SEQ ID NO: 735793 - DNA, 25 bp, Mus musculus
taaatctaaaaggatggatgccatc

SEQ ID NO: 735794 - DNA, 25 bp, Mus musculus
taaatctaaatcaaagtgaatggcc

SEQ ID NO: 735795 - DNA, 25 bp, Mus musculus
taaatctaaatctaagtgaatggcc

SEQ ID NO: 735796 - DNA, 25 bp, Mus musculus
taaatctaaggtctgatggatgcca

SEQ ID NO: 735797 - DNA, 25 bp, Mus musculus
taaatctaaggtgtgatggatgcca

SEQ ID NO: 735798 - DNA, 25 bp, Mus musculus
taaatctaattcatggagctttgtg

SEQ ID NO: 735799 - DNA, 25 bp, Mus musculus
taaatctaattcttggagctttgtg

SEQ ID NO: 735800 - DNA, 25 bp, Mus musculus
taaatctcatgcagatcgccatcca

SEQ ID NO: 735801 - DNA, 25 bp, Mus musculus
taaatctcatgctgatcgccatcca

SEQ ID NO: 735802 - DNA, 25 bp, Mus musculus
taaatctccagacctctttgtggga

SEQ ID NO: 735803 - DNA, 25 bp, Mus musculus
taaatctccagagctctttgtggga

SEQ ID NO: 735804 - DNA, 25 bp, Mus musculus
taaatctcgggaaaaggtggtgaag

SEQ ID NO: 735805 - DNA, 25 bp, Mus musculus
taaatctcgggataaggtggtgaag

SEQ ID NO: 735806 - DNA, 25 bp, Mus musculus
taaatctgaaacctgattctgctgg

SEQ ID NO: 735807 - DNA, 25 bp, Mus musculus
taaatctgaaacgtgattctgctgg

SEQ ID NO: 735808 - DNA, 25 bp, Mus musculus
taaatctggaaaaactcctctagac

SEQ ID NO: 735809 - DNA, 25 bp, Mus musculus
taaatctggaaatactcctctagac

SEQ ID NO: 735810 - DNA, 25 bp, Mus musculus
taaatctggatacttaccaaactgc

SEQ ID NO: 735811 - DNA, 25 bp, Mus musculus
taaatctggatagttaccaaactgc

SEQ ID NO: 735812 - DNA, 25 bp, Mus musculus
taaatctggtgtcgttcgagtaaga

SEQ ID NO: 735813 - DNA, 25 bp, Mus musculus
taaatctggtgtggttcgagtaaga

SEQ ID NO: 735814 - DNA, 25 bp, Mus musculus
taaatcttgattaaccaccctacaa

SEQ ID NO: 735815 - DNA, 25 bp, Mus musculus
taaatcttgatttaccaccctacaa

SEQ ID NO: 735816 - DNA, 25 bp, Mus musculus
taaatcttttccagtatacgtaata

SEQ ID NO: 735817 - DNA, 25 bp, Mus musculus
taaatcttttcctgtatacgtaata

SEQ ID NO: 735818 - DNA, 25 bp, Mus musculus
taaatgaaaaggagccgcagcggga

SEQ ID NO: 735819 - DNA, 25 bp, Mus musculus
taaatgaaaaggtgccgcagcggga

SEQ ID NO: 735820 - DNA, 25 bp, Mus musculus
taaatgaaaggtccgctatcccttt

SEQ ID NO: 735821 - DNA, 25 bp, Mus musculus
taaatgaaaggtgcgctatcccttt

SEQ ID NO: 735822 - DNA, 25 bp, Mus musculus
taaatgaaatcacctgtggcgcccg

SEQ ID NO: 735823 - DNA, 25 bp, Mus musculus
taaatgaaatcagctgtggcgcccg

SEQ ID NO: 735824 - DNA, 25 bp, Mus musculus
taaatgaatatccaccccaccaagc

SEQ ID NO: 735825 - DNA, 25 bp, Mus musculus
taaatgaatatcgaccccaccaagc

SEQ ID NO: 735826 - DNA, 25 bp, Mus musculus
taaatgaatttcagataggttggct

SEQ ID NO: 735827 - DNA, 25 bp, Mus musculus
taaatgaatttctgataggttggct

SEQ ID NO: 735828 - DNA, 25 bp, Mus musculus
taaatgacaagcaacagtgaagctg

SEQ ID NO: 735829 - DNA, 25 bp, Mus musculus
taaatgacaagctacagtgaagctg

SEQ ID NO: 735830 - DNA, 25 bp, Mus musculus
taaatgacacctacgagcttggaga

SEQ ID NO: 735831 - DNA, 25 bp, Mus musculus
taaatgacaccttcgagcttggaga

SEQ ID NO: 735832 - DNA, 25 bp, Mus musculus
taaatgacacgaaggagcttcgaga

SEQ ID NO: 735833 - DNA, 25 bp, Mus musculus
taaatgacacgatggagcttcgaga

SEQ ID NO: 735834 - DNA, 25 bp, Mus musculus
taaatgacgaaaatcaagatggtgt

SEQ ID NO: 735835 - DNA, 25 bp, Mus musculus
taaatgacgaaattcaagatggtgt

SEQ ID NO: 735836 - DNA, 25 bp, Mus musculus
taaatgacggccactggtaggaacc

SEQ ID NO: 735837 - DNA, 25 bp, Mus musculus
taaatgacggcctctggtaggaacc

SEQ ID NO: 735838 - DNA, 25 bp, Mus musculus
taaatgacgtttacagccaccaagg

SEQ ID NO: 735839 - DNA, 25 bp, Mus musculus
taaatgacgttttcagccaccaagg

SEQ ID NO: 735840 - DNA, 25 bp, Mus musculus
taaatgactggtagggatagagacc

SEQ ID NO: 735841 - DNA, 25 bp, Mus musculus
taaatgactggttgggatagagacc

SEQ ID NO: 735842 - DNA, 25 bp, Mus musculus
taaatgactgtgcactagtgagcat

SEQ ID NO: 735843 - DNA, 25 bp, Mus musculus
taaatgactgtggactagtgagcat

SEQ ID NO: 735844 - DNA, 25 bp, Mus musculus
taaatgacttgtacaaggccgcctg

SEQ ID NO: 735845 - DNA, 25 bp, Mus musculus
taaatgacttgttcaaggccgcctg

SEQ ID NO: 735846 - DNA, 25 bp, Mus musculus
taaatgagaccaagcgatcaggagt

SEQ ID NO: 735847 - DNA, 25 bp, Mus musculus
taaatgagaccatgcgatcaggagt

SEQ ID NO: 735848 - DNA, 25 bp, Mus musculus
taaatgagaccgaaccccatcacct

SEQ ID NO: 735849 - DNA, 25 bp, Mus musculus
taaatgagaccgtaccccatcacct

SEQ ID NO: 735850 - DNA, 25 bp, Mus musculus
taaatgagagaactgacctggcacc

SEQ ID NO: 735851 - DNA, 25 bp, Mus musculus
taaatgagagaagtgacctggcacc

SEQ ID NO: 735852 - DNA, 25 bp, Mus musculus
taaatgagcattactgggacgggac

SEQ ID NO: 735853 - DNA, 25 bp, Mus musculus
taaatgagcatttctgggacgggac

SEQ ID NO: 735854 - DNA, 25 bp, Mus musculus
taaatgagctataatgaactgcctg

SEQ ID NO: 735855 - DNA, 25 bp, Mus musculus
taaatgagctattatgaactgcctg

SEQ ID NO: 735856 - DNA, 25 bp, Mus musculus
taaatgaggatccagttagatgccc

SEQ ID NO: 735857 - DNA, 25 bp, Mus musculus
taaatgaggatcgagttagatgccc

SEQ ID NO: 735858 - DNA, 25 bp, Mus musculus
taaatgatcgagatccgtgggctaa

SEQ ID NO: 735859 - DNA, 25 bp, Mus musculus
taaatgatcgagttccgtgggctaa

SEQ ID NO: 735860 - DNA, 25 bp, Mus musculus
taaatgatgaatcctccagaaactg

SEQ ID NO: 735861 - DNA, 25 bp, Mus musculus
taaatgatgaatgctccagaaactg

SEQ ID NO: 735862 - DNA, 25 bp, Mus musculus
taaatgcacagacagcaggatacaa

SEQ ID NO: 735863 - DNA, 25 bp, Mus musculus
taaatgcacagagagcaggatacaa

SEQ ID NO: 735864 - DNA, 25 bp, Mus musculus
taaatgcacttgataggcagcctca

SEQ ID NO: 735865 - DNA, 25 bp, Mus musculus
taaatgcacttgttaggcagcctca

SEQ ID NO: 735866 - DNA, 25 bp, Mus musculus
taaatgcagaatagacttaccagtc

SEQ ID NO: 735867 - DNA, 25 bp, Mus musculus
taaatgcagaattgacttaccagtc

SEQ ID NO: 735868 - DNA, 25 bp, Mus musculus
taaatgcagctccagcgagcctggc

SEQ ID NO: 735869 - DNA, 25 bp, Mus musculus
taaatgcagctcgagcgagcctggc

SEQ ID NO: 735870 - DNA, 25 bp, Mus musculus
taaatgcaggctaacagtgaatcca

SEQ ID NO: 735871 - DNA, 25 bp, Mus musculus
taaatgcaggctaggcccactgtgg

SEQ ID NO: 735872 - DNA, 25 bp, Mus musculus
taaatgcaggcttacagtgaatcca

SEQ ID NO: 735873 - DNA, 25 bp, Mus musculus
taaatgcaggcttggcccactgtgg

SEQ ID NO: 735874 - DNA, 25 bp, Mus musculus
taaatgcaggtgagatgctaaacac

SEQ ID NO: 735875 - DNA, 25 bp, Mus musculus
taaatgcaggtgtgatgctaaacac

SEQ ID NO: 735876 - DNA, 25 bp, Mus musculus
taaatgcagtatcacgttctgggcc

SEQ ID NO: 735877 - DNA, 25 bp, Mus musculus
taaatgcagtatgacgttctgggcc

SEQ ID NO: 735878 - DNA, 25 bp, Mus musculus
taaatgcagtgccagctcgcaggtg

SEQ ID NO: 735879 - DNA, 25 bp, Mus musculus
taaatgcagtgcgagctcgcaggtg

SEQ ID NO: 735880 - DNA, 25 bp, Mus musculus
taaatgcattggagattactccgga

SEQ ID NO: 735881 - DNA, 25 bp, Mus musculus
taaatgcattggtgattactccgga

SEQ ID NO: 735882 - DNA, 25 bp, Mus musculus
taaatgccaattacccagtggaccc

SEQ ID NO: 735883 - DNA, 25 bp, Mus musculus
taaatgccaatttcccagtggaccc

SEQ ID NO: 735884 - DNA, 25 bp, Mus musculus
taaatgccattgacatcagagaaac

SEQ ID NO: 735885 - DNA, 25 bp, Mus musculus
taaatgccattgtcatcagagaaac

SEQ ID NO: 735886 - DNA, 25 bp, Mus musculus
taaatgcccgctcttttgctcgagt

SEQ ID NO: 735887 - DNA, 25 bp, Mus musculus
taaatgcccgctgttttgctcgagt

SEQ ID NO: 735888 - DNA, 25 bp, Mus musculus
taaatgcccttacctctcccaagag

SEQ ID NO: 735889 - DNA, 25 bp, Mus musculus
taaatgcccttagctctcccaagag

SEQ ID NO: 735890 - DNA, 25 bp, Mus musculus
taaatgcctaggatgcacaaaatcc

SEQ ID NO: 735891 - DNA, 25 bp, Mus musculus
taaatgcctaggttgcacaaaatcc

SEQ ID NO: 735892 - DNA, 25 bp, Mus musculus
taaatgcctcccacgaagatgcagg

SEQ ID NO: 735893 - DNA, 25 bp, Mus musculus
taaatgcctccctcgaagatgcagg

SEQ ID NO: 735894 - DNA, 25 bp, Mus musculus
taaatgcctctacagttgtgactat

SEQ ID NO: 735895 - DNA, 25 bp, Mus musculus
taaatgcctctagagttgtgactat

SEQ ID NO: 735896 - DNA, 25 bp, Mus musculus
taaatgcgagctactcctctggagt

SEQ ID NO: 735897 - DNA, 25 bp, Mus musculus
taaatgcgagcttctcctctggagt

SEQ ID NO: 735898 - DNA, 25 bp, Mus musculus
taaatgcgctgtaagaactgtgccc

SEQ ID NO: 735899 - DNA, 25 bp, Mus musculus
taaatgcgctgttagaactgtgccc

SEQ ID NO: 735900 - DNA, 25 bp, Mus musculus
taaatgcggagccactggagagact

SEQ ID NO: 735901 - DNA, 25 bp, Mus musculus
taaatgcggagcctgccattcagag

SEQ ID NO: 735902 - DNA, 25 bp, Mus musculus
taaatgcggagcgactggagagact

SEQ ID NO: 735903 - DNA, 25 bp, Mus musculus
taaatgcggagcgtgccattcagag

SEQ ID NO: 735904 - DNA, 25 bp, Mus musculus
taaatgctaccaaaactccttagag

SEQ ID NO: 735905 - DNA, 25 bp, Mus musculus
taaatgctaccataactccttagag

SEQ ID NO: 735906 - DNA, 25 bp, Mus musculus
taaatgctacgccatgtccaaggat

SEQ ID NO: 735907 - DNA, 25 bp, Mus musculus
taaatgctacgcgatgtccaaggat

SEQ ID NO: 735908 - DNA, 25 bp, Mus musculus
taaatgctcacaaagcaagaggctc

SEQ ID NO: 735909 - DNA, 25 bp, Mus musculus
taaatgctcacatagcaagaggctc

SEQ ID NO: 735910 - DNA, 25 bp, Mus musculus
taaatgctgggcagagctcctagct

SEQ ID NO: 735911 - DNA, 25 bp, Mus musculus
taaatgctgggctgagctcctagct

SEQ ID NO: 735912 - DNA, 25 bp, Mus musculus
taaatgctgtatcccttattcccaa

SEQ ID NO: 735913 - DNA, 25 bp, Mus musculus
taaatgctgtatgccttattcccaa

SEQ ID NO: 735914 - DNA, 25 bp, Mus musculus
taaatgctttccctgaagtaacgcc

SEQ ID NO: 735915 - DNA, 25 bp, Mus musculus
taaatgctttccgtgaagtaacgcc

SEQ ID NO: 735916 - DNA, 25 bp, Mus musculus
taaatggaaacacctcacagaagaa

SEQ ID NO: 735917 - DNA, 25 bp, Mus musculus
taaatggaaacagctcacagaagaa

SEQ ID NO: 735918 - DNA, 25 bp, Mus musculus
taaatggaagcacagagagtactgg

SEQ ID NO: 735919 - DNA, 25 bp, Mus musculus
taaatggaagcagagagagtactgg

SEQ ID NO: 735920 - DNA, 25 bp, Mus musculus
taaatggaatccacccttgggagct

SEQ ID NO: 735921 - DNA, 25 bp, Mus musculus
taaatggaatcctcccttgggagct

SEQ ID NO: 735922 - DNA, 25 bp, Mus musculus
taaatggaatgtactacactgcggg

SEQ ID NO: 735923 - DNA, 25 bp, Mus musculus
taaatggaatgttctacactgcggg

SEQ ID NO: 735924 - DNA, 25 bp, Mus musculus
taaatggacaacaaatgccctctga

SEQ ID NO: 735925 - DNA, 25 bp, Mus musculus
taaatggacaactaatgccctctga

SEQ ID NO: 735926 - DNA, 25 bp, Mus musculus
taaatggacagcaccggaagctctt

SEQ ID NO: 735927 - DNA, 25 bp, Mus musculus
taaatggacagctccggaagctctt

SEQ ID NO: 735928 - DNA, 25 bp, Mus musculus
taaatggacattaaatcggacagcg

SEQ ID NO: 735929 - DNA, 25 bp, Mus musculus
taaatggacatttaatcggacagcg

SEQ ID NO: 735930 - DNA, 25 bp, Mus musculus
taaatggaccggagtgatagcgctt

SEQ ID NO: 735931 - DNA, 25 bp, Mus musculus
taaatggaccggtgtgatagcgctt

SEQ ID NO: 735932 - DNA, 25 bp, Mus musculus
taaatggacttgctgtcaaacttca

SEQ ID NO: 735933 - DNA, 25 bp, Mus musculus
taaatggacttggtgtcaaacttca

SEQ ID NO: 735934 - DNA, 25 bp, Mus musculus
taaatggagaatcatcagccctacg

SEQ ID NO: 735935 - DNA, 25 bp, Mus musculus
taaatggagaatgatcagccctacg

SEQ ID NO: 735936 - DNA, 25 bp, Mus musculus
taaatggagccacgattccagccag

SEQ ID NO: 735937 - DNA, 25 bp, Mus musculus
taaatggagccaggattccagccag

SEQ ID NO: 735938 - DNA, 25 bp, Mus musculus
taaatggatgacatgacctgtgacc

SEQ ID NO: 735939 - DNA, 25 bp, Mus musculus
taaatggatgacttgacctgtgacc

SEQ ID NO: 735940 - DNA, 25 bp, Mus musculus
taaatggatgttccctggaaatgct

SEQ ID NO: 735941 - DNA, 25 bp, Mus musculus
taaatggatgttcgaagaagatacg

SEQ ID NO: 735942 - DNA, 25 bp, Mus musculus
taaatggatgttgcctggaaatgct

SEQ ID NO: 735943 - DNA, 25 bp, Mus musculus
taaatggatgttggaagaagatacg

SEQ ID NO: 735944 - DNA, 25 bp, Mus musculus
taaatggcacagcagttcctcagca

SEQ ID NO: 735945 - DNA, 25 bp, Mus musculus
taaatggcacaggagttcctcagca

SEQ ID NO: 735946 - DNA, 25 bp, Mus musculus
taaatggccaagcaagagggtagat

SEQ ID NO: 735947 - DNA, 25 bp, Mus musculus
taaatggccaaggaagagggtagat

SEQ ID NO: 735948 - DNA, 25 bp, Mus musculus
taaatggcccctaaacacaatatgt

SEQ ID NO: 735949 - DNA, 25 bp, Mus musculus
taaatggccccttaacacaatatgt

SEQ ID NO: 735950 - DNA, 25 bp, Mus musculus
taaatggctcatcccagacagtgcg

SEQ ID NO: 735951 - DNA, 25 bp, Mus musculus
taaatggctcatgccagacagtgcg

SEQ ID NO: 735952 - DNA, 25 bp, Mus musculus
taaatggcttctatggcagcatgga

SEQ ID NO: 735953 - DNA, 25 bp, Mus musculus
taaatggcttctttggcagcatgga

SEQ ID NO: 735954 - DNA, 25 bp, Mus musculus
taaatgggacgactatggcgagatc

SEQ ID NO: 735955 - DNA, 25 bp, Mus musculus
taaatgggacgagtatggcgagatc

SEQ ID NO: 735956 - DNA, 25 bp, Mus musculus
taaatgggagagaagccatcaggtc

SEQ ID NO: 735957 - DNA, 25 bp, Mus musculus
taaatgggagagtagccatcaggtc

SEQ ID NO: 735958 - DNA, 25 bp, Mus musculus
taaatgggtcctaactcaggtggcc

SEQ ID NO: 735959 - DNA, 25 bp, Mus musculus
taaatgggtccttactcaggtggcc

SEQ ID NO: 735960 - DNA, 25 bp, Mus musculus
taaatggtagcaagccacttctgtg

SEQ ID NO: 735961 - DNA, 25 bp, Mus musculus
taaatggtagcatgccacttctgtg

SEQ ID NO: 735962 - DNA, 25 bp, Mus musculus
taaatggtccaactagcgcttctgg

SEQ ID NO: 735963 - DNA, 25 bp, Mus musculus
taaatggtccaagtagcgcttctgg

SEQ ID NO: 735964 - DNA, 25 bp, Mus musculus
taaatggtctaaactgcctgtttgg

SEQ ID NO: 735965 - DNA, 25 bp, Mus musculus
taaatggtctaatctgcctgtttgg

SEQ ID NO: 735966 - DNA, 25 bp, Mus musculus
taaatggtctggcttcatatttgga

SEQ ID NO: 735967 - DNA, 25 bp, Mus musculus
taaatggtctgggttcatatttgga

SEQ ID NO: 735968 - DNA, 25 bp, Mus musculus
taaatggtgtcactgcagcactggc

SEQ ID NO: 735969 - DNA, 25 bp, Mus musculus
taaatggtgtcagtgcagcactggc

SEQ ID NO: 735970 - DNA, 25 bp, Mus musculus
taaatgtagtacatgcgaaaaagcc

SEQ ID NO: 735971 - DNA, 25 bp, Mus musculus
taaatgtagtacttgcgaaaaagcc

SEQ ID NO: 735972 - DNA, 25 bp, Mus musculus
taaatgtcctctcacgagccacctg

SEQ ID NO: 735973 - DNA, 25 bp, Mus musculus
taaatgtcctctgacgagccacctg

SEQ ID NO: 735974 - DNA, 25 bp, Mus musculus
taaatgtcggtgctaaatatgtaaa

SEQ ID NO: 735975 - DNA, 25 bp, Mus musculus
taaatgtcggtggtaaatatgtaaa

SEQ ID NO: 735976 - DNA, 25 bp, Mus musculus
taaatgtctttgctgcgtgaccacg

SEQ ID NO: 735977 - DNA, 25 bp, Mus musculus
taaatgtctttggtgcgtgaccacg

SEQ ID NO: 735978 - DNA, 25 bp, Mus musculus
taaatgtgaactccgaacacataaa

SEQ ID NO: 735979 - DNA, 25 bp, Mus musculus
taaatgtgaactgcgaacacataaa

SEQ ID NO: 735980 - DNA, 25 bp, Mus musculus
taaatgtgaataagatcatcgccct

SEQ ID NO: 735981 - DNA, 25 bp, Mus musculus
taaatgtgaatatgatcatcgccct

SEQ ID NO: 735982 - DNA, 25 bp, Mus musculus
taaatgtgagatcttggaatgtgtc

SEQ ID NO: 735983 - DNA, 25 bp, Mus musculus
taaatgtgagatgttggaatgtgtc

SEQ ID NO: 735984 - DNA, 25 bp, Mus musculus
taaatgtgatatctaaccaagggtg

SEQ ID NO: 735985 - DNA, 25 bp, Mus musculus
taaatgtgatatgtaaccaagggtg

SEQ ID NO: 735986 - DNA, 25 bp, Mus musculus
taaatgtgcagtctcctagtgccca

SEQ ID NO: 735987 - DNA, 25 bp, Mus musculus
taaatgtgcagtgtcctagtgccca

SEQ ID NO: 735988 - DNA, 25 bp, Mus musculus
taaatgtgcctaaagctgttgaggg

SEQ ID NO: 735989 - DNA, 25 bp, Mus musculus
taaatgtgcctatagctgttgaggg

SEQ ID NO: 735990 - DNA, 25 bp, Mus musculus
taaatgtgcttaagtagacttgtct

SEQ ID NO: 735991 - DNA, 25 bp, Mus musculus
taaatgtgcttatgtagacttgtct

SEQ ID NO: 735992 - DNA, 25 bp, Mus musculus
taaatgtggagtcgaatatctgcca

SEQ ID NO: 735993 - DNA, 25 bp, Mus musculus
taaatgtggagtggaatatctgcca

SEQ ID NO: 735994 - DNA, 25 bp, Mus musculus
taaatgttcatacctagatggccag

SEQ ID NO: 735995 - DNA, 25 bp, Mus musculus
taaatgttcatagctagatggccag

SEQ ID NO: 735996 - DNA, 25 bp, Mus musculus
taaatgttcatgactgaccaatggc

SEQ ID NO: 735997 - DNA, 25 bp, Mus musculus
taaatgttcatgtctgaccaatggc

SEQ ID NO: 735998 - DNA, 25 bp, Mus musculus
taaatgttcgcacaaccagtccggg

SEQ ID NO: 735999 - DNA, 25 bp, Mus musculus
taaatgttcgcagaaccagtccggg

SEQ ID NO: 736000 - DNA, 25 bp, Mus musculus
taaatgtttctacgatgcagtacac

SEQ ID NO: 736001 - DNA, 25 bp, Mus musculus
taaatgtttctaggatgcagtacac

SEQ ID NO: 736002 - DNA, 25 bp, Mus musculus
taaattaagttccaccagtgcctcc

SEQ ID NO: 736003 - DNA, 25 bp, Mus musculus
taaattaagttcgaccagtgcctcc

SEQ ID NO: 736004 - DNA, 25 bp, Mus musculus
taaattaatgctacgcgcttgaggg

SEQ ID NO: 736005 - DNA, 25 bp, Mus musculus
taaattaatgcttcgcgcttgaggg

SEQ ID NO: 736006 - DNA, 25 bp, Mus musculus
taaattaattcacttgaccgcgggt

SEQ ID NO: 736007 - DNA, 25 bp, Mus musculus
taaattaattcagttgaccgcgggt

SEQ ID NO: 736008 - DNA, 25 bp, Mus musculus
taaattacttagaccttctttgagg

SEQ ID NO: 736009 - DNA, 25 bp, Mus musculus
taaattacttagtccttctttgagg

SEQ ID NO: 736010 - DNA, 25 bp, Mus musculus
taaattatcagtcgacggaggacag

SEQ ID NO: 736011 - DNA, 25 bp, Mus musculus
taaattatcagtggacggaggacag

SEQ ID NO: 736012 - DNA, 25 bp, Mus musculus
taaattatgactagtaagccacgga

SEQ ID NO: 736013 - DNA, 25 bp, Mus musculus
taaattatgacttgtaagccacgga

SEQ ID NO: 736014 - DNA, 25 bp, Mus musculus
taaattattatcacgaacagtggca

SEQ ID NO: 736015 - DNA, 25 bp, Mus musculus
taaattattatctcgaacagtggca

SEQ ID NO: 736016 - DNA, 25 bp, Mus musculus
taaattattggaacagtttgggctg

SEQ ID NO: 736017 - DNA, 25 bp, Mus musculus
taaattattggatcagtttgggctg

SEQ ID NO: 736018 - DNA, 25 bp, Mus musculus
taaattcactggctcagagctggcc

SEQ ID NO: 736019 - DNA, 25 bp, Mus musculus
taaattcactgggtcagagctggcc

SEQ ID NO: 736020 - DNA, 25 bp, Mus musculus
taaattccaagacttcttcatcccc

SEQ ID NO: 736021 - DNA, 25 bp, Mus musculus
taaattccaagagttcttcatcccc

SEQ ID NO: 736022 - DNA, 25 bp, Mus musculus
taaattccctgaagaacacacagct

SEQ ID NO: 736023 - DNA, 25 bp, Mus musculus
taaattccctgatgaacacacagct

SEQ ID NO: 736024 - DNA, 25 bp, Mus musculus
taaattccgaccctactgagctgtt

SEQ ID NO: 736025 - DNA, 25 bp, Mus musculus
taaattccgaccgtactgagctgtt

SEQ ID NO: 736026 - DNA, 25 bp, Mus musculus
taaattcctacacagacgacccact

SEQ ID NO: 736027 - DNA, 25 bp, Mus musculus
taaattcctacagagacgacccact

SEQ ID NO: 736028 - DNA, 25 bp, Mus musculus
taaattcctggtccttgtgccgaag

SEQ ID NO: 736029 - DNA, 25 bp, Mus musculus
taaattcctggtgcttgtgccgaag

SEQ ID NO: 736030 - DNA, 25 bp, Mus musculus
taaattcggttactggcacgagcgc

SEQ ID NO: 736031 - DNA, 25 bp, Mus musculus
taaattcggttagtggcacgagcgc

SEQ ID NO: 736032 - DNA, 25 bp, Mus musculus
taaattctatgcagaagatccatgt

SEQ ID NO: 736033 - DNA, 25 bp, Mus musculus
taaattctatgctgaagatccatgt

SEQ ID NO: 736034 - DNA, 25 bp, Mus musculus
taaattctgcttccgaatgctccag

SEQ ID NO: 736035 - DNA, 25 bp, Mus musculus
taaattctgcttgcgaatgctccag

SEQ ID NO: 736036 - DNA, 25 bp, Mus musculus
taaattcttggtcatcggaaatgcg

SEQ ID NO: 736037 - DNA, 25 bp, Mus musculus
taaattcttggtgatcggaaatgcg

SEQ ID NO: 736038 - DNA, 25 bp, Mus musculus
taaattgaaacacttggctcgacag

SEQ ID NO: 736039 - DNA, 25 bp, Mus musculus
taaattgaaacagttggctcgacag

SEQ ID NO: 736040 - DNA, 25 bp, Mus musculus
taaattgacaaacggccagccacat

SEQ ID NO: 736041 - DNA, 25 bp, Mus musculus
taaattgacaaagggccagccacat

SEQ ID NO: 736042 - DNA, 25 bp, Mus musculus
taaattgcagttcgtagttccttgc

SEQ ID NO: 736043 - DNA, 25 bp, Mus musculus
taaattgcagttggtagttccttgc

SEQ ID NO: 736044 - DNA, 25 bp, Mus musculus
taaattgctcagataggaacccaga

SEQ ID NO: 736045 - DNA, 25 bp, Mus musculus
taaattgctcagttaggaacccaga

SEQ ID NO: 736046 - DNA, 25 bp, Mus musculus
taaattggaacacggagcaagaaaa

SEQ ID NO: 736047 - DNA, 25 bp, Mus musculus
taaattggaacagggagcaagaaaa

SEQ ID NO: 736048 - DNA, 25 bp, Mus musculus
taaattggataaaatacacgggtga

SEQ ID NO: 736049 - DNA, 25 bp, Mus musculus
taaattggataatatacacgggtga

SEQ ID NO: 736050 - DNA, 25 bp, Mus musculus
taaattgtggctaccccggtgtcac

SEQ ID NO: 736051 - DNA, 25 bp, Mus musculus
taaattgtggcttccccggtgtcac

SEQ ID NO: 736052 - DNA, 25 bp, Mus musculus
taaatttcaacacctggataagaga

SEQ ID NO: 736053 - DNA, 25 bp, Mus musculus
taaatttcaacagctggataagaga

SEQ ID NO: 736054 - DNA, 25 bp, Mus musculus
taaatttccatgctaaaaagctgaa

SEQ ID NO: 736055 - DNA, 25 bp, Mus musculus
taaatttccatggtaaaaagctgaa

SEQ ID NO: 736056 - DNA, 25 bp, Mus musculus
taaatttcctagaatggctgtggtt

SEQ ID NO: 736057 - DNA, 25 bp, Mus musculus
taaatttcctagtatggctgtggtt

SEQ ID NO: 736058 - DNA, 25 bp, Mus musculus
taaatttctcagagtcacaagtgcc

SEQ ID NO: 736059 - DNA, 25 bp, Mus musculus
taaatttctcagtgtcacaagtgcc

SEQ ID NO: 736060 - DNA, 25 bp, Mus musculus
taaatttgacacagccagccttgct

SEQ ID NO: 736061 - DNA, 25 bp, Mus musculus
taaatttgacactgccagccttgct

SEQ ID NO: 736062 - DNA, 25 bp, Mus musculus
taaatttgataccatctccgagaag

SEQ ID NO: 736063 - DNA, 25 bp, Mus musculus
taaatttgatacgatctccgagaag

SEQ ID NO: 736064 - DNA, 25 bp, Mus musculus
taaatttgcaagcacatctcctgtc

SEQ ID NO: 736065 - DNA, 25 bp, Mus musculus
taaatttgcaaggacatctcctgtc

SEQ ID NO: 736066 - DNA, 25 bp, Mus musculus
taaatttgccagaatcttgggactg

SEQ ID NO: 736067 - DNA, 25 bp, Mus musculus
taaatttgccagtatcttgggactg

SEQ ID NO: 736068 - DNA, 25 bp, Mus musculus
taaatttggaaccagaagtgctggg

SEQ ID NO: 736069 - DNA, 25 bp, Mus musculus
taaatttggaacgagaagtgctggg

SEQ ID NO: 736070 - DNA, 25 bp, Mus musculus
taaatttggaggatataaagccttg

SEQ ID NO: 736071 - DNA, 25 bp, Mus musculus
taaatttggaggttataaagccttg

SEQ ID NO: 736072 - DNA, 25 bp, Mus musculus
taaatttggcacatgttcctggaga

SEQ ID NO: 736073 - DNA, 25 bp, Mus musculus
taaatttggcacttgttcctggaga

SEQ ID NO: 736074 - DNA, 25 bp, Mus musculus
taaatttgggcaccgagcatttgtg

SEQ ID NO: 736075 - DNA, 25 bp, Mus musculus
taaatttgggcagcgagcatttgtg

SEQ ID NO: 736076 - DNA, 25 bp, Mus musculus
taaatttgttcaacaaccagctgct

SEQ ID NO: 736077 - DNA, 25 bp, Mus musculus
taaatttgttcatcaaccagctgct

SEQ ID NO: 736078 - DNA, 25 bp, Mus musculus
taaattttgttcattgcccctgaac

SEQ ID NO: 736079 - DNA, 25 bp, Mus musculus
taaattttgttctttgcccctgaac

SEQ ID NO: 736080 - DNA, 25 bp, Mus musculus
taacaaaaagagactgacccacgcc

SEQ ID NO: 736081 - DNA, 25 bp, Mus musculus
taacaaaaagagtctgacccacgcc

SEQ ID NO: 736082 - DNA, 25 bp, Mus musculus
taacaaaagccgagacttccagctg

SEQ ID NO: 736083 - DNA, 25 bp, Mus musculus
taacaaaagccgtgacttccagctg

SEQ ID NO: 736084 - DNA, 25 bp, Mus musculus
taacaaaaggatagtgagcggagcc

SEQ ID NO: 736085 - DNA, 25 bp, Mus musculus
taacaaaaggattgtgagcggagcc

SEQ ID NO: 736086 - DNA, 25 bp, Mus musculus
taacaaaaggtcacccagagacgag

SEQ ID NO: 736087 - DNA, 25 bp, Mus musculus
taacaaaaggtctcccagagacgag

SEQ ID NO: 736088 - DNA, 25 bp, Mus musculus
taacaaaagtagattctgcctggga

SEQ ID NO: 736089 - DNA, 25 bp, Mus musculus
taacaaaagtagtttctgcctggga

SEQ ID NO: 736090 - DNA, 25 bp, Mus musculus
taacaaacataaccaggcaacaggg

SEQ ID NO: 736091 - DNA, 25 bp, Mus musculus
taacaaacataagcaggcaacaggg

SEQ ID NO: 736092 - DNA, 25 bp, Mus musculus
taacaaacggctacagaactggaca

SEQ ID NO: 736093 - DNA, 25 bp, Mus musculus
taacaaacggcttcagaactggaca

SEQ ID NO: 736094 - DNA, 25 bp, Mus musculus
taacaaactacgctatgatatacgg

SEQ ID NO: 736095 - DNA, 25 bp, Mus musculus
taacaaactacggtatgatatacgg

SEQ ID NO: 736096 - DNA, 25 bp, Mus musculus
taacaaaggagcaccttccgtggct

SEQ ID NO: 736097 - DNA, 25 bp, Mus musculus
taacaaaggagctccttccgtggct

SEQ ID NO: 736098 - DNA, 25 bp, Mus musculus
taacaaatgcacatgtggaaagaaa

SEQ ID NO: 736099 - DNA, 25 bp, Mus musculus
taacaaatgcacttgtggaaagaaa

SEQ ID NO: 736100 - DNA, 25 bp, Mus musculus
taacaaatttataacagtacaggga

SEQ ID NO: 736101 - DNA, 25 bp, Mus musculus
taacaaatttattacagtacaggga

SEQ ID NO: 736102 - DNA, 25 bp, Mus musculus
taacaacaaggcatactccgttgga

SEQ ID NO: 736103 - DNA, 25 bp, Mus musculus
taacaacaaggcttactccgttgga

SEQ ID NO: 736104 - DNA, 25 bp, Mus musculus
taacaacacagactcaagaggatgt

SEQ ID NO: 736105 - DNA, 25 bp, Mus musculus
taacaacacagagtcaagaggatgt

SEQ ID NO: 736106 - DNA, 25 bp, Mus musculus
taacaacacctgcaatgacctagag

SEQ ID NO: 736107 - DNA, 25 bp, Mus musculus
taacaacacctggaatgacctagag

SEQ ID NO: 736108 - DNA, 25 bp, Mus musculus
taacaacagccgcttctggaacggt

SEQ ID NO: 736109 - DNA, 25 bp, Mus musculus
taacaacagccggttctggaacggt

SEQ ID NO: 736110 - DNA, 25 bp, Mus musculus
taacaacaggatctgcaaccacagg

SEQ ID NO: 736111 - DNA, 25 bp, Mus musculus
taacaacaggatgtgcaaccacagg

SEQ ID NO: 736112 - DNA, 25 bp, Mus musculus
taacaacagtccattccacgtctct

SEQ ID NO: 736113 - DNA, 25 bp, Mus musculus
taacaacagtcctttccacgtctct

SEQ ID NO: 736114 - DNA, 25 bp, Mus musculus
taacaaccacagctgctactggagg

SEQ ID NO: 736115 - DNA, 25 bp, Mus musculus
taacaaccacaggtgctactggagg

SEQ ID NO: 736116 - DNA, 25 bp, Mus musculus
taacaaccccagctatgttcggagt

SEQ ID NO: 736117 - DNA, 25 bp, Mus musculus
taacaaccccaggtatgttcggagt

SEQ ID NO: 736118 - DNA, 25 bp, Mus musculus
taacaaccgctgctatcaaatgggt

SEQ ID NO: 736119 - DNA, 25 bp, Mus musculus
taacaaccgctggtatcaaatgggt

SEQ ID NO: 736120 - DNA, 25 bp, Mus musculus
taacaaccggagatccagacacaga

SEQ ID NO: 736121 - DNA, 25 bp, Mus musculus
taacaaccggagttccagacacaga

SEQ ID NO: 736122 - DNA, 25 bp, Mus musculus
taacaaccttctacctccagcagat

SEQ ID NO: 736123 - DNA, 25 bp, Mus musculus
taacaaccttcttcctccagcagat

SEQ ID NO: 736124 - DNA, 25 bp, Mus musculus
taacaacgcagaaaataagcggcct

SEQ ID NO: 736125 - DNA, 25 bp, Mus musculus
taacaacgcagataataagcggcct

SEQ ID NO: 736126 - DNA, 25 bp, Mus musculus
taacaacgccctcggtgacaaagga

SEQ ID NO: 736127 - DNA, 25 bp, Mus musculus
taacaacgccctgggtgacaaagga

SEQ ID NO: 736128 - DNA, 25 bp, Mus musculus
taacaacggcaacaagctcatgact

SEQ ID NO: 736129 - DNA, 25 bp, Mus musculus
taacaacggcaagaagctcatgact

SEQ ID NO: 736130 - DNA, 25 bp, Mus musculus
taacaacgtctacccttctgcgatt

SEQ ID NO: 736131 - DNA, 25 bp, Mus musculus
taacaacgtctagccttctgcgatt

SEQ ID NO: 736132 - DNA, 25 bp, Mus musculus
taacaactctggacttaacagcctc

SEQ ID NO: 736133 - DNA, 25 bp, Mus musculus
taacaactctggtcttaacagcctc

SEQ ID NO: 736134 - DNA, 25 bp, Mus musculus
taacaactttccatcctaggaggat

SEQ ID NO: 736135 - DNA, 25 bp, Mus musculus
taacaactttccttcctaggaggat

SEQ ID NO: 736136 - DNA, 25 bp, Mus musculus
taacaactttctcctggatttgcag

SEQ ID NO: 736137 - DNA, 25 bp, Mus musculus
taacaactttctgctggatttgcag

SEQ ID NO: 736138 - DNA, 25 bp, Mus musculus
taacaagacatacaacctgctctcc

SEQ ID NO: 736139 - DNA, 25 bp, Mus musculus
taacaagacatagaacctgctctcc

SEQ ID NO: 736140 - DNA, 25 bp, Mus musculus
taacaagagccacccagcctcaaga

SEQ ID NO: 736141 - DNA, 25 bp, Mus musculus
taacaagagccagccagcctcaaga

SEQ ID NO: 736142 - DNA, 25 bp, Mus musculus
taacaagagctgatgctgtacactc

SEQ ID NO: 736143 - DNA, 25 bp, Mus musculus
taacaagagctgttgctgtacactc

SEQ ID NO: 736144 - DNA, 25 bp, Mus musculus
taacaagatcttcggtgtgacaacc

SEQ ID NO: 736145 - DNA, 25 bp, Mus musculus
taacaagatcttgggtgtgacaacc

SEQ ID NO: 736146 - DNA, 25 bp, Mus musculus
taacaagcccgactgtgtacgcgct

SEQ ID NO: 736147 - DNA, 25 bp, Mus musculus
taacaagcccgagtgtgtacgcgct

SEQ ID NO: 736148 - DNA, 25 bp, Mus musculus
taacaagctgttcgaggcactgggc

SEQ ID NO: 736149 - DNA, 25 bp, Mus musculus
taacaagctgttggaggcactgggc

SEQ ID NO: 736150 - DNA, 25 bp, Mus musculus
taacaaggagccatagcaagcacca

SEQ ID NO: 736151 - DNA, 25 bp, Mus musculus
taacaaggagccttagcaagcacca

SEQ ID NO: 736152 - DNA, 25 bp, Mus musculus
taacaaggctggcatcgtgcaggct

SEQ ID NO: 736153 - DNA, 25 bp, Mus musculus
taacaaggctgggatcgtgcaggct

SEQ ID NO: 736154 - DNA, 25 bp, Mus musculus
taacaaggtcctagattgtcacagt

SEQ ID NO: 736155 - DNA, 25 bp, Mus musculus
taacaaggtccttgattgtcacagt

SEQ ID NO: 736156 - DNA, 25 bp, Mus musculus
taacaagtacatcaagaacaggcct

SEQ ID NO: 736157 - DNA, 25 bp, Mus musculus
taacaagtacatgaagaacaggcct

SEQ ID NO: 736158 - DNA, 25 bp, Mus musculus
taacaagtacgacacaacataccct

SEQ ID NO: 736159 - DNA, 25 bp, Mus musculus
taacaagtacgagacaacataccct

SEQ ID NO: 736160 - DNA, 25 bp, Mus musculus
taacaagtgacaaagtaggccaggc

SEQ ID NO: 736161 - DNA, 25 bp, Mus musculus
taacaagtgacatagtaggccaggc

SEQ ID NO: 736162 - DNA, 25 bp, Mus musculus
taacaagtgcacaaaggaagctccc

SEQ ID NO: 736163 - DNA, 25 bp, Mus musculus
taacaagtgcactaaggaagctccc

SEQ ID NO: 736164 - DNA, 25 bp, Mus musculus
taacaagtgctgatgtcagggccaa

SEQ ID NO: 736165 - DNA, 25 bp, Mus musculus
taacaagtgctgttgtcagggccaa

SEQ ID NO: 736166 - DNA, 25 bp, Mus musculus
taacaagtgggccaggatgccgtac

SEQ ID NO: 736167 - DNA, 25 bp, Mus musculus
taacaagtgggcgaggatgccgtac

SEQ ID NO: 736168 - DNA, 25 bp, Mus musculus
taacaagttgacacatacggacctc

SEQ ID NO: 736169 - DNA, 25 bp, Mus musculus
taacaagttgactcatacggacctc

SEQ ID NO: 736170 - DNA, 25 bp, Mus musculus
taacaatcaagaaggtacatgctga

SEQ ID NO: 736171 - DNA, 25 bp, Mus musculus
taacaatcaagatggtacatgctga

SEQ ID NO: 736172 - DNA, 25 bp, Mus musculus
taacaatgaaagcacagtgcagcag

SEQ ID NO: 736173 - DNA, 25 bp, Mus musculus
taacaatgaaaggacagtgcagcag

SEQ ID NO: 736174 - DNA, 25 bp, Mus musculus
taacaatgacgtataggacctctcc

SEQ ID NO: 736175 - DNA, 25 bp, Mus musculus
taacaatgacgtttaggacctctcc

SEQ ID NO: 736176 - DNA, 25 bp, Mus musculus
taacaatggcagcttttacacgtct

SEQ ID NO: 736177 - DNA, 25 bp, Mus musculus
taacaatggcaggttttacacgtct

SEQ ID NO: 736178 - DNA, 25 bp, Mus musculus
taacaattgaaactacaacccacag

SEQ ID NO: 736179 - DNA, 25 bp, Mus musculus
taacaattgaaagtacaacccacag

SEQ ID NO: 736180 - DNA, 25 bp, Mus musculus
taacaattgggtcatgcacatgtgg

SEQ ID NO: 736181 - DNA, 25 bp, Mus musculus
taacaattgggtgatgcacatgtgg

SEQ ID NO: 736182 - DNA, 25 bp, Mus musculus
taacaatttttgatagttctgacct

SEQ ID NO: 736183 - DNA, 25 bp, Mus musculus
taacaatttttgttagttctgacct

SEQ ID NO: 736184 - DNA, 25 bp, Mus musculus
taacacaacttaagaggaggaccca

SEQ ID NO: 736185 - DNA, 25 bp, Mus musculus
taacacaacttatgaggaggaccca

SEQ ID NO: 736186 - DNA, 25 bp, Mus musculus
taacacaagcagaggtagtgagtca

SEQ ID NO: 736187 - DNA, 25 bp, Mus musculus
taacacaagcagtggtagtgagtca

SEQ ID NO: 736188 - DNA, 25 bp, Mus musculus
taacacagacgaacttggaagagac

SEQ ID NO: 736189 - DNA, 25 bp, Mus musculus
taacacagacgatcttggaagagac

SEQ ID NO: 736190 - DNA, 25 bp, Mus musculus
taacacagcaggagcatgggagtcg

SEQ ID NO: 736191 - DNA, 25 bp, Mus musculus
taacacagcaggtgcatgggagtcg

SEQ ID NO: 736192 - DNA, 25 bp, Mus musculus
taacacagtccaagtgcaccaggaa

SEQ ID NO: 736193 - DNA, 25 bp, Mus musculus
taacacagtccatgtgcaccaggaa

SEQ ID NO: 736194 - DNA, 25 bp, Mus musculus
taacacagtcctacatgtggcctcg

SEQ ID NO: 736195 - DNA, 25 bp, Mus musculus
taacacagtccttcatgtggcctcg

SEQ ID NO: 736196 - DNA, 25 bp, Mus musculus
taacacatacacacaaggatttgga

SEQ ID NO: 736197 - DNA, 25 bp, Mus musculus
taacacatacactcaaggatttgga

SEQ ID NO: 736198 - DNA, 25 bp, Mus musculus
taacaccaaccaagtggaagtcctg

SEQ ID NO: 736199 - DNA, 25 bp, Mus musculus
taacaccaaccatgtggaagtcctg

SEQ ID NO: 736200 - DNA, 25 bp, Mus musculus
taacaccaacgaagaggtggatgaa

SEQ ID NO: 736201 - DNA, 25 bp, Mus musculus
taacaccaacgatgaggtggatgaa

SEQ ID NO: 736202 - DNA, 25 bp, Mus musculus
taacaccacggacaaagagattgag

SEQ ID NO: 736203 - DNA, 25 bp, Mus musculus
taacaccacggagaaagagattgag

SEQ ID NO: 736204 - DNA, 25 bp, Mus musculus
taacaccctctacgaaggcggctac

SEQ ID NO: 736205 - DNA, 25 bp, Mus musculus
taacaccctctaggaaggcggctac

SEQ ID NO: 736206 - DNA, 25 bp, Mus musculus
taacaccctgcactgggtggatgca

SEQ ID NO: 736207 - DNA, 25 bp, Mus musculus
taacaccctgcagtgggtggatgca

SEQ ID NO: 736208 - DNA, 25 bp, Mus musculus
taacacctaggcatagaaaccagtc

SEQ ID NO: 736209 - DNA, 25 bp, Mus musculus
taacacctaggcttagaaaccagtc

SEQ ID NO: 736210 - DNA, 25 bp, Mus musculus
taacacctctagagacgaaccctgg

SEQ ID NO: 736211 - DNA, 25 bp, Mus musculus
taacacctctagtgacgaaccctgg

SEQ ID NO: 736212 - DNA, 25 bp, Mus musculus
taacacctgccaaaaagctctaggg

SEQ ID NO: 736213 - DNA, 25 bp, Mus musculus
taacacctgccataaagctctaggg

SEQ ID NO: 736214 - DNA, 25 bp, Mus musculus
taacacctggctatcttatggatct

SEQ ID NO: 736215 - DNA, 25 bp, Mus musculus
taacacctggctttcttatggatct

SEQ ID NO: 736216 - DNA, 25 bp, Mus musculus
taacacctgtgacatcacgtgtgcg

SEQ ID NO: 736217 - DNA, 25 bp, Mus musculus
taacacctgtgagatcacgtgtgcg

SEQ ID NO: 736218 - DNA, 25 bp, Mus musculus
taacacgcgcatatgcggatctcgg

SEQ ID NO: 736219 - DNA, 25 bp, Mus musculus
taacacgcgcatttgcggatctcgg

SEQ ID NO: 736220 - DNA, 25 bp, Mus musculus
taacacgtacggaaggatcaccaag

SEQ ID NO: 736221 - DNA, 25 bp, Mus musculus
taacacgtacggtaggatcaccaag

SEQ ID NO: 736222 - DNA, 25 bp, Mus musculus
taacacgtgtgcagcgtgaacctgg

SEQ ID NO: 736223 - DNA, 25 bp, Mus musculus
taacacgtgtgctgcgtgaacctgg

SEQ ID NO: 736224 - DNA, 25 bp, Mus musculus
taacactaaacaaaggccagcaagt

SEQ ID NO: 736225 - DNA, 25 bp, Mus musculus
taacactaaacataggccagcaagt

SEQ ID NO: 736226 - DNA, 25 bp, Mus musculus
taacactagccacccaggtgtactg

SEQ ID NO: 736227 - DNA, 25 bp, Mus musculus
taacactagccagccaggtgtactg

SEQ ID NO: 736228 - DNA, 25 bp, Mus musculus
taacactatcataacaagatatggc

SEQ ID NO: 736229 - DNA, 25 bp, Mus musculus
taacactatcattacaagatatggc

SEQ ID NO: 736230 - DNA, 25 bp, Mus musculus
taacactatgctagtagcccagaca

SEQ ID NO: 736231 - DNA, 25 bp, Mus musculus
taacactatgcttgtagcccagaca

SEQ ID NO: 736232 - DNA, 25 bp, Mus musculus
taacactgcaggagtatatgcccga

SEQ ID NO: 736233 - DNA, 25 bp, Mus musculus
taacactgcaggtgtatatgcccga

SEQ ID NO: 736234 - DNA, 25 bp, Mus musculus
taacactggcataggactccaagcc

SEQ ID NO: 736235 - DNA, 25 bp, Mus musculus
taacactggcattggactccaagcc

SEQ ID NO: 736236 - DNA, 25 bp, Mus musculus
taacactggcctctgcaggtggtca

SEQ ID NO: 736237 - DNA, 25 bp, Mus musculus
taacactggcctgtgcaggtggtca

SEQ ID NO: 736238 - DNA, 25 bp, Mus musculus
taacactgtcatcgctgttttcaca

SEQ ID NO: 736239 - DNA, 25 bp, Mus musculus
taacactgtcatggctgttttcaca

SEQ ID NO: 736240 - DNA, 25 bp, Mus musculus
taacactgtgtgcagttcatctgtt

SEQ ID NO: 736241 - DNA, 25 bp, Mus musculus
taacactgtgtggagttcatctgtt

SEQ ID NO: 736242 - DNA, 25 bp, Mus musculus
taacacttacgacgatgccggcaac

SEQ ID NO: 736243 - DNA, 25 bp, Mus musculus
taacacttacgaggatgccggcaac

SEQ ID NO: 736244 - DNA, 25 bp, Mus musculus
taacacttcaggaaactgaggcatg

SEQ ID NO: 736245 - DNA, 25 bp, Mus musculus
taacacttcaggtaactgaggcatg

SEQ ID NO: 736246 - DNA, 25 bp, Mus musculus
taacacttgtgtagaacattcctta

SEQ ID NO: 736247 - DNA, 25 bp, Mus musculus
taacacttgtgtccggcaaccggaa

SEQ ID NO: 736248 - DNA, 25 bp, Mus musculus
taacacttgtgtgcggcaaccggaa

SEQ ID NO: 736249 - DNA, 25 bp, Mus musculus
taacacttgtgttgaacattcctta

SEQ ID NO: 736250 - DNA, 25 bp, Mus musculus
taacacttgttacatatttaggtcc

SEQ ID NO: 736251 - DNA, 25 bp, Mus musculus
taacacttgttagatatttaggtcc

SEQ ID NO: 736252 - DNA, 25 bp, Mus musculus
taacagaaatggcaaccagtcatgt

SEQ ID NO: 736253 - DNA, 25 bp, Mus musculus
taacagaaatgggaaccagtcatgt

SEQ ID NO: 736254 - DNA, 25 bp, Mus musculus
taacagaacggaacacaaacctgga

SEQ ID NO: 736255 - DNA, 25 bp, Mus musculus
taacagaacggatcacaaacctgga

SEQ ID NO: 736256 - DNA, 25 bp, Mus musculus
taacagaagacaccgaggtggactt

SEQ ID NO: 736257 - DNA, 25 bp, Mus musculus
taacagaagacagcgaggtggactt

SEQ ID NO: 736258 - DNA, 25 bp, Mus musculus
taacagaagctgagtctgcaagccc

SEQ ID NO: 736259 - DNA, 25 bp, Mus musculus
taacagaagctgtgtctgcaagccc

SEQ ID NO: 736260 - DNA, 25 bp, Mus musculus
taacagaaggtgcaatgtcctttgg

SEQ ID NO: 736261 - DNA, 25 bp, Mus musculus
taacagaaggtggaatgtcctttgg

SEQ ID NO: 736262 - DNA, 25 bp, Mus musculus
taacagaagtcaaaacagacatcta

SEQ ID NO: 736263 - DNA, 25 bp, Mus musculus
taacagaagtcataacagacatcta

SEQ ID NO: 736264 - DNA, 25 bp, Mus musculus
taacagacaaagacaaggacggcat

SEQ ID NO: 736265 - DNA, 25 bp, Mus musculus
taacagacaaagtcaaggacggcat

SEQ ID NO: 736266 - DNA, 25 bp, Mus musculus
taacagacctcgagcgaggaaccct

SEQ ID NO: 736267 - DNA, 25 bp, Mus musculus
taacagacctcgtgcgaggaaccct

SEQ ID NO: 736268 - DNA, 25 bp, Mus musculus
taacagacgactataaaggtgtgga

SEQ ID NO: 736269 - DNA, 25 bp, Mus musculus
taacagacgactttaaaggtgtgga

SEQ ID NO: 736270 - DNA, 25 bp, Mus musculus
taacagacgcccaggaaaatatcag

SEQ ID NO: 736271 - DNA, 25 bp, Mus musculus
taacagacgccctggaaaatatcag

SEQ ID NO: 736272 - DNA, 25 bp, Mus musculus
taacagactatacggaataccatac

SEQ ID NO: 736273 - DNA, 25 bp, Mus musculus
taacagactatagggaataccatac

SEQ ID NO: 736274 - DNA, 25 bp, Mus musculus
taacagactttgacatgactctaag

SEQ ID NO: 736275 - DNA, 25 bp, Mus musculus
taacagactttgtcatgactctaag

SEQ ID NO: 736276 - DNA, 25 bp, Mus musculus
taacagagaccaccggaaaagagaa

SEQ ID NO: 736277 - DNA, 25 bp, Mus musculus
taacagagaccacgcctgggttgac

SEQ ID NO: 736278 - DNA, 25 bp, Mus musculus
taacagagaccagcggaaaagagaa

SEQ ID NO: 736279 - DNA, 25 bp, Mus musculus
taacagagaccaggcctgggttgac

SEQ ID NO: 736280 - DNA, 25 bp, Mus musculus
taacagagacgaaaattgtggagtt

SEQ ID NO: 736281 - DNA, 25 bp, Mus musculus
taacagagacgataattgtggagtt

SEQ ID NO: 736282 - DNA, 25 bp, Mus musculus
taacagagactcatacatggttcct

SEQ ID NO: 736283 - DNA, 25 bp, Mus musculus
taacagagactcttacatggttcct

SEQ ID NO: 736284 - DNA, 25 bp, Mus musculus
taacagagagaaagcaacagttgga

SEQ ID NO: 736285 - DNA, 25 bp, Mus musculus
taacagagagaatgcaacagttgga

SEQ ID NO: 736286 - DNA, 25 bp, Mus musculus
taacagagccagaattcttgcccct

SEQ ID NO: 736287 - DNA, 25 bp, Mus musculus
taacagagccagactggtttcctat

SEQ ID NO: 736288 - DNA, 25 bp, Mus musculus
taacagagccagtattcttgcccct

SEQ ID NO: 736289 - DNA, 25 bp, Mus musculus
taacagagccagtctggtttcctat

SEQ ID NO: 736290 - DNA, 25 bp, Mus musculus
taacagagctcgagtttctgcacca

SEQ ID NO: 736291 - DNA, 25 bp, Mus musculus
taacagagctcgtgtttctgcacca

SEQ ID NO: 736292 - DNA, 25 bp, Mus musculus
taacagagctggagtctaagatgcg

SEQ ID NO: 736293 - DNA, 25 bp, Mus musculus
taacagagctggtgtctaagatgcg

SEQ ID NO: 736294 - DNA, 25 bp, Mus musculus
taacagaggagaacatctgccagct

SEQ ID NO: 736295 - DNA, 25 bp, Mus musculus
taacagaggagatcatctgccagct

SEQ ID NO: 736296 - DNA, 25 bp, Mus musculus
taacagagtcctattcacagaaggg

SEQ ID NO: 736297 - DNA, 25 bp, Mus musculus
taacagagtccttttcacagaaggg

SEQ ID NO: 736298 - DNA, 25 bp, Mus musculus
taacagagttgcagggacttcgaca

SEQ ID NO: 736299 - DNA, 25 bp, Mus musculus
taacagagttgctgggacttcgaca

SEQ ID NO: 736300 - DNA, 25 bp, Mus musculus
taacagataatgacaagtatgaaga

SEQ ID NO: 736301 - DNA, 25 bp, Mus musculus
taacagataatgtcaagtatgaaga

SEQ ID NO: 736302 - DNA, 25 bp, Mus musculus
taacagatatgcaaagctgaaggct

SEQ ID NO: 736303 - DNA, 25 bp, Mus musculus
taacagatatgctaagctgaaggct

SEQ ID NO: 736304 - DNA, 25 bp, Mus musculus
taacagatgcatcgatagacttcag

SEQ ID NO: 736305 - DNA, 25 bp, Mus musculus
taacagatgcatggatagacttcag

SEQ ID NO: 736306 - DNA, 25 bp, Mus musculus
taacagcaacagcagtgaagagatg

SEQ ID NO: 736307 - DNA, 25 bp, Mus musculus
taacagcaacaggagtgaagagatg

SEQ ID NO: 736308 - DNA, 25 bp, Mus musculus
taacagcacccactggatgaacgac

SEQ ID NO: 736309 - DNA, 25 bp, Mus musculus
taacagcacccagtggatgaacgac

SEQ ID NO: 736310 - DNA, 25 bp, Mus musculus
taacagcactcaacatcctcaaggt

SEQ ID NO: 736311 - DNA, 25 bp, Mus musculus
taacagcactcatcatcctcaaggt

SEQ ID NO: 736312 - DNA, 25 bp, Mus musculus
taacagcagaaacctatggaatatt

SEQ ID NO: 736313 - DNA, 25 bp, Mus musculus
taacagcagaaagctatggaatatt

SEQ ID NO: 736314 - DNA, 25 bp, Mus musculus
taacagcagcgtatgaggctgtggc

SEQ ID NO: 736315 - DNA, 25 bp, Mus musculus
taacagcagcgtttgaggctgtggc

SEQ ID NO: 736316 - DNA, 25 bp, Mus musculus
taacagccacctagctgagagcact

SEQ ID NO: 736317 - DNA, 25 bp, Mus musculus
taacagccaccttgctgagagcact

SEQ ID NO: 736318 - DNA, 25 bp, Mus musculus
taacagccctcaatacttgactaag

SEQ ID NO: 736319 - DNA, 25 bp, Mus musculus
taacagccctcattacttgactaag

SEQ ID NO: 736320 - DNA, 25 bp, Mus musculus
taacagcgttgacccggagaacatc

SEQ ID NO: 736321 - DNA, 25 bp, Mus musculus
taacagcgttgagccggagaacatc

SEQ ID NO: 736322 - DNA, 25 bp, Mus musculus
taacagctatctagcagtcacgtct

SEQ ID NO: 736323 - DNA, 25 bp, Mus musculus
taacagctatcttgcagtcacgtct

SEQ ID NO: 736324 - DNA, 25 bp, Mus musculus
taacagctcactcggagatgggccg

SEQ ID NO: 736325 - DNA, 25 bp, Mus musculus
taacagctcactgggagatgggccg

SEQ ID NO: 736326 - DNA, 25 bp, Mus musculus
taacagctctgactgtgggcagcag

SEQ ID NO: 736327 - DNA, 25 bp, Mus musculus
taacagctctgagtgtgggcagcag

SEQ ID NO: 736328 - DNA, 25 bp, Mus musculus
taacagctgcgaagtgaagggcact

SEQ ID NO: 736329 - DNA, 25 bp, Mus musculus
taacagctgcgatgtgaagggcact

SEQ ID NO: 736330 - DNA, 25 bp, Mus musculus
taacagcttcaaagaacaggaggca

SEQ ID NO: 736331 - DNA, 25 bp, Mus musculus
taacagcttcaatgaacaggaggca

SEQ ID NO: 736332 - DNA, 25 bp, Mus musculus
taacaggaaacaacaggattcaccc

SEQ ID NO: 736333 - DNA, 25 bp, Mus musculus
taacaggaaacatcaggattcaccc

SEQ ID NO: 736334 - DNA, 25 bp, Mus musculus
taacaggaagacacagtaaatcaca

SEQ ID NO: 736335 - DNA, 25 bp, Mus musculus
taacaggaagactcagtaaatcaca

SEQ ID NO: 736336 - DNA, 25 bp, Mus musculus
taacaggacctgatggatcccctgg

SEQ ID NO: 736337 - DNA, 25 bp, Mus musculus
taacaggacctgttggatcccctgg

SEQ ID NO: 736338 - DNA, 25 bp, Mus musculus
taacaggagagaaggtagaagagtt

SEQ ID NO: 736339 - DNA, 25 bp, Mus musculus
taacaggagagatggtagaagagtt

SEQ ID NO: 736340 - DNA, 25 bp, Mus musculus
taacaggataggatcagcccatggg

SEQ ID NO: 736341 - DNA, 25 bp, Mus musculus
taacaggataggttcagcccatggg

SEQ ID NO: 736342 - DNA, 25 bp, Mus musculus
taacaggcattcaggagcaggttgt

SEQ ID NO: 736343 - DNA, 25 bp, Mus musculus
taacaggcattctggagcaggttgt

SEQ ID NO: 736344 - DNA, 25 bp, Mus musculus
taacaggccactcattagcctcaca

SEQ ID NO: 736345 - DNA, 25 bp, Mus musculus
taacaggccactgattagcctcaca

SEQ ID NO: 736346 - DNA, 25 bp, Mus musculus
taacaggcggttacagcagacccag

SEQ ID NO: 736347 - DNA, 25 bp, Mus musculus
taacaggcggtttcagcagacccag

SEQ ID NO: 736348 - DNA, 25 bp, Mus musculus
taacaggctacaagaatgcatgtct

SEQ ID NO: 736349 - DNA, 25 bp, Mus musculus
taacaggctacatgaatgcatgtct

SEQ ID NO: 736350 - DNA, 25 bp, Mus musculus
taacaggctgatatctactctggag

SEQ ID NO: 736351 - DNA, 25 bp, Mus musculus
taacaggctgatttctactctggag

SEQ ID NO: 736352 - DNA, 25 bp, Mus musculus
taacagggacagacaagaggaagct

SEQ ID NO: 736353 - DNA, 25 bp, Mus musculus
taacagggacagtcaagaggaagct

SEQ ID NO: 736354 - DNA, 25 bp, Mus musculus
taacagggactaaagcagcgtctct

SEQ ID NO: 736355 - DNA, 25 bp, Mus musculus
taacagggactatagcagcgtctct

SEQ ID NO: 736356 - DNA, 25 bp, Mus musculus
taacagggtctgcatagcagctgca

SEQ ID NO: 736357 - DNA, 25 bp, Mus musculus
taacagggtctggatagcagctgca

SEQ ID NO: 736358 - DNA, 25 bp, Mus musculus
taacaggtgagacctgtgttttcgg

SEQ ID NO: 736359 - DNA, 25 bp, Mus musculus
taacaggtgagagctgtgttttcgg

SEQ ID NO: 736360 - DNA, 25 bp, Mus musculus
taacaggtggaaaggtagttcttga

SEQ ID NO: 736361 - DNA, 25 bp, Mus musculus
taacaggtggaatggtagttcttga

SEQ ID NO: 736362 - DNA, 25 bp, Mus musculus
taacaggtgtctcaaagctaaaggg

SEQ ID NO: 736363 - DNA, 25 bp, Mus musculus
taacaggtgtctgaaagctaaaggg

SEQ ID NO: 736364 - DNA, 25 bp, Mus musculus
taacagtagcagctaacgctggcca

SEQ ID NO: 736365 - DNA, 25 bp, Mus musculus
taacagtagcaggtaacgctggcca

SEQ ID NO: 736366 - DNA, 25 bp, Mus musculus
taacagtagcatcttctcaagggca

SEQ ID NO: 736367 - DNA, 25 bp, Mus musculus
taacagtagcatgttctcaagggca

SEQ ID NO: 736368 - DNA, 25 bp, Mus musculus
taacagtagtaaaggccagtagacc

SEQ ID NO: 736369 - DNA, 25 bp, Mus musculus
taacagtagtaatggccagtagacc

SEQ ID NO: 736370 - DNA, 25 bp, Mus musculus
taacagtcacagattctaagtggca

SEQ ID NO: 736371 - DNA, 25 bp, Mus musculus
taacagtcacagtttctaagtggca

SEQ ID NO: 736372 - DNA, 25 bp, Mus musculus
taacagtcatctcctggttgaatct

SEQ ID NO: 736373 - DNA, 25 bp, Mus musculus
taacagtcatctgctggttgaatct

SEQ ID NO: 736374 - DNA, 25 bp, Mus musculus
taacagtccagaatgtgtgctcact

SEQ ID NO: 736375 - DNA, 25 bp, Mus musculus
taacagtccagattgtgtgctcact

SEQ ID NO: 736376 - DNA, 25 bp, Mus musculus
taacagtccccgaggaaaccaggct

SEQ ID NO: 736377 - DNA, 25 bp, Mus musculus
taacagtccccgtggaaaccaggct

SEQ ID NO: 736378 - DNA, 25 bp, Mus musculus
taacagtccctgcattctcacatgg

SEQ ID NO: 736379 - DNA, 25 bp, Mus musculus
taacagtccctggattctcacatgg

SEQ ID NO: 736380 - DNA, 25 bp, Mus musculus
taacagtcctgtacccatcagcagt

SEQ ID NO: 736381 - DNA, 25 bp, Mus musculus
taacagtcctgttcccatcagcagt

SEQ ID NO: 736382 - DNA, 25 bp, Mus musculus
taacagtcgtctccggccaagctgt

SEQ ID NO: 736383 - DNA, 25 bp, Mus musculus
taacagtcgtctgcggccaagctgt

SEQ ID NO: 736384 - DNA, 25 bp, Mus musculus
taacagtgaaaaccgctggctagct

SEQ ID NO: 736385 - DNA, 25 bp, Mus musculus
taacagtgaaaagcgctggctagct

SEQ ID NO: 736386 - DNA, 25 bp, Mus musculus
taacagtgagccagttgtccaagac

SEQ ID NO: 736387 - DNA, 25 bp, Mus musculus
taacagtgagcctgttgtccaagac

SEQ ID NO: 736388 - DNA, 25 bp, Mus musculus
taacagtgagtaaccacgtgtacct

SEQ ID NO: 736389 - DNA, 25 bp, Mus musculus
taacagtgagtatccacgtgtacct

SEQ ID NO: 736390 - DNA, 25 bp, Mus musculus
taacagtgagtcaagaattcagcac

SEQ ID NO: 736391 - DNA, 25 bp, Mus musculus
taacagtgagtctagaattcagcac

SEQ ID NO: 736392 - DNA, 25 bp, Mus musculus
taacagtgatctacctcggcgacaa

SEQ ID NO: 736393 - DNA, 25 bp, Mus musculus
taacagtgatcttcctcggcgacaa

SEQ ID NO: 736394 - DNA, 25 bp, Mus musculus
taacagtgcaccatgtgtaaacgtg

SEQ ID NO: 736395 - DNA, 25 bp, Mus musculus
taacagtgcaccttgtgtaaacgtg

SEQ ID NO: 736396 - DNA, 25 bp, Mus musculus
taacagtggagtccagtacatgcct

SEQ ID NO: 736397 - DNA, 25 bp, Mus musculus
taacagtggagtgcagtacatgcct

SEQ ID NO: 736398 - DNA, 25 bp, Mus musculus
taacagtggtaactagagatgtctc

SEQ ID NO: 736399 - DNA, 25 bp, Mus musculus
taacagtggtaagtagagatgtctc

SEQ ID NO: 736400 - DNA, 25 bp, Mus musculus
taacagtggtacatatgcagaaggg

SEQ ID NO: 736401 - DNA, 25 bp, Mus musculus
taacagtggtacttatgcagaaggg

SEQ ID NO: 736402 - DNA, 25 bp, Mus musculus
taacagtgtagaacctacttttgac

SEQ ID NO: 736403 - DNA, 25 bp, Mus musculus
taacagtgtagatcctacttttgac

SEQ ID NO: 736404 - DNA, 25 bp, Mus musculus
taacagttaattccctgcctggctt

SEQ ID NO: 736405 - DNA, 25 bp, Mus musculus
taacagttaattgcctgcctggctt

SEQ ID NO: 736406 - DNA, 25 bp, Mus musculus
taacagttacttataaacacggcct

SEQ ID NO: 736407 - DNA, 25 bp, Mus musculus
taacagttacttttaaacacggcct

SEQ ID NO: 736408 - DNA, 25 bp, Mus musculus
taacagttcacgctaaacaagcgga

SEQ ID NO: 736409 - DNA, 25 bp, Mus musculus
taacagttcacggtaaacaagcgga

SEQ ID NO: 736410 - DNA, 25 bp, Mus musculus
taacagttgctcatctcagagcggc

SEQ ID NO: 736411 - DNA, 25 bp, Mus musculus
taacagttgctcttctcagagcggc

SEQ ID NO: 736412 - DNA, 25 bp, Mus musculus
taacagttgttgatgttccccattc

SEQ ID NO: 736413 - DNA, 25 bp, Mus musculus
taacagttgttgttgttccccattc

SEQ ID NO: 736414 - DNA, 25 bp, Mus musculus
taacagtttgcaacgaccacgcagc

SEQ ID NO: 736415 - DNA, 25 bp, Mus musculus
taacagtttgcatcgaccacgcagc

SEQ ID NO: 736416 - DNA, 25 bp, Mus musculus
taacagtttgtgagagcctgagcag

SEQ ID NO: 736417 - DNA, 25 bp, Mus musculus
taacagtttgtgtgagcctgagcag

SEQ ID NO: 736418 - DNA, 25 bp, Mus musculus
taacataaacgaccgcattaaggag

SEQ ID NO: 736419 - DNA, 25 bp, Mus musculus
taacataaacgagcgcattaaggag

SEQ ID NO: 736420 - DNA, 25 bp, Mus musculus
taacataatgatctgtaacctggcc

SEQ ID NO: 736421 - DNA, 25 bp, Mus musculus
taacataatgatgtgtaacctggcc

SEQ ID NO: 736422 - DNA, 25 bp, Mus musculus
taacatagatgtcgtcgttgcacct

SEQ ID NO: 736423 - DNA, 25 bp, Mus musculus
taacatagatgtggtcgttgcacct

SEQ ID NO: 736424 - DNA, 25 bp, Mus musculus
taacataggcttctcagattctgga

SEQ ID NO: 736425 - DNA, 25 bp, Mus musculus
taacataggcttgtcagattctgga

SEQ ID NO: 736426 - DNA, 25 bp, Mus musculus
taacatagtgaacagatctacctgc

SEQ ID NO: 736427 - DNA, 25 bp, Mus musculus
taacatagtgaagagatctacctgc

SEQ ID NO: 736428 - DNA, 25 bp, Mus musculus
taacatatgtataccagacctctgg

SEQ ID NO: 736429 - DNA, 25 bp, Mus musculus
taacatatgtattccagacctctgg

SEQ ID NO: 736430 - DNA, 25 bp, Mus musculus
taacatcaaccaatggactgcaagc

SEQ ID NO: 736431 - DNA, 25 bp, Mus musculus
taacatcaaccattggactgcaagc

SEQ ID NO: 736432 - DNA, 25 bp, Mus musculus
taacatcagagtatgtaagattctg

SEQ ID NO: 736433 - DNA, 25 bp, Mus musculus
taacatcagagtttgtaagattctg

SEQ ID NO: 736434 - DNA, 25 bp, Mus musculus
taacatcagggcaggtgcccatgta

SEQ ID NO: 736435 - DNA, 25 bp, Mus musculus
taacatcagggctggtgcccatgta

SEQ ID NO: 736436 - DNA, 25 bp, Mus musculus
taacatcatgaaagcttcagctgat

SEQ ID NO: 736437 - DNA, 25 bp, Mus musculus
taacatcatgaatgcttcagctgat

SEQ ID NO: 736438 - DNA, 25 bp, Mus musculus
taacatcatgatctactggacgaca

SEQ ID NO: 736439 - DNA, 25 bp, Mus musculus
taacatcatgatgtactggacgaca

SEQ ID NO: 736440 - DNA, 25 bp, Mus musculus
taacatcccacaacagtaaccttga

SEQ ID NO: 736441 - DNA, 25 bp, Mus musculus
taacatcccacatcagtaaccttga

SEQ ID NO: 736442 - DNA, 25 bp, Mus musculus
taacatcccggtagtcatttccaaa

SEQ ID NO: 736443 - DNA, 25 bp, Mus musculus
taacatcccggttgtcatttccaaa

SEQ ID NO: 736444 - DNA, 25 bp, Mus musculus
taacatcgacatctccaaaatggga

SEQ ID NO: 736445 - DNA, 25 bp, Mus musculus
taacatcgacatgtccaaaatggga

SEQ ID NO: 736446 - DNA, 25 bp, Mus musculus
taacatcgactgactctgtgccatg

SEQ ID NO: 736447 - DNA, 25 bp, Mus musculus
taacatcgactgtctctgtgccatg

SEQ ID NO: 736448 - DNA, 25 bp, Mus musculus
taacatcgatggacaaggcaaccac

SEQ ID NO: 736449 - DNA, 25 bp, Mus musculus
taacatcgatggtcaaggcaaccac

SEQ ID NO: 736450 - DNA, 25 bp, Mus musculus
taacatcgccagaattaaacctcac

SEQ ID NO: 736451 - DNA, 25 bp, Mus musculus
taacatcgccagtattaaacctcac

SEQ ID NO: 736452 - DNA, 25 bp, Mus musculus
taacatcggcccacccatgaataat

SEQ ID NO: 736453 - DNA, 25 bp, Mus musculus
taacatcggccctcccatgaataat

SEQ ID NO: 736454 - DNA, 25 bp, Mus musculus
taacatcgtagcacttcgcagggca

SEQ ID NO: 736455 - DNA, 25 bp, Mus musculus
taacatcgtagctcttcgcagggca

SEQ ID NO: 736456 - DNA, 25 bp, Mus musculus
taacatctcaagaagatgctcaggg

SEQ ID NO: 736457 - DNA, 25 bp, Mus musculus
taacatctcaagtagatgctcaggg

SEQ ID NO: 736458 - DNA, 25 bp, Mus musculus
taacatctgagtacttgaatacagt

SEQ ID NO: 736459 - DNA, 25 bp, Mus musculus
taacatctgagttcttgaatacagt

SEQ ID NO: 736460 - DNA, 25 bp, Mus musculus
taacatctgatcagtggaaccgctg

SEQ ID NO: 736461 - DNA, 25 bp, Mus musculus
taacatctgatctgtggaaccgctg

SEQ ID NO: 736462 - DNA, 25 bp, Mus musculus
taacatctgtgacaccattgtgtgg

SEQ ID NO: 736463 - DNA, 25 bp, Mus musculus
taacatctgtgagaccattgtgtgg

SEQ ID NO: 736464 - DNA, 25 bp, Mus musculus
taacatcttcagagaacgaggagca

SEQ ID NO: 736465 - DNA, 25 bp, Mus musculus
taacatcttcagtgaacgaggagca

SEQ ID NO: 736466 - DNA, 25 bp, Mus musculus
taacatctttgcctgcatcgagggc

SEQ ID NO: 736467 - DNA, 25 bp, Mus musculus
taacatctttgcgtgcatcgagggc

SEQ ID NO: 736468 - DNA, 25 bp, Mus musculus
taacatgaccaaaaagcgtgaggct

SEQ ID NO: 736469 - DNA, 25 bp, Mus musculus
taacatgaccaataagcgtgaggct

SEQ ID NO: 736470 - DNA, 25 bp, Mus musculus
taacatgagttacgaagagtaccaa

SEQ ID NO: 736471 - DNA, 25 bp, Mus musculus
taacatgagttaggaagagtaccaa

SEQ ID NO: 736472 - DNA, 25 bp, Mus musculus
taacatgatgtgagcagagagcaac

SEQ ID NO: 736473 - DNA, 25 bp, Mus musculus
taacatgatgtgtgcagagagcaac

SEQ ID NO: 736474 - DNA, 25 bp, Mus musculus
taacatgattgtctctggcagtgcc

SEQ ID NO: 736475 - DNA, 25 bp, Mus musculus
taacatgattgtgtctggcagtgcc

SEQ ID NO: 736476 - DNA, 25 bp, Mus musculus
taacatgcaaagaagcagggttcat

SEQ ID NO: 736477 - DNA, 25 bp, Mus musculus
taacatgcaaagtagcagggttcat

SEQ ID NO: 736478 - DNA, 25 bp, Mus musculus
taacatgcagaaagcccgagagctc

SEQ ID NO: 736479 - DNA, 25 bp, Mus musculus
taacatgcagaatgcccgagagctc

SEQ ID NO: 736480 - DNA, 25 bp, Mus musculus
taacatgcgacgagatgtgaaggag

SEQ ID NO: 736481 - DNA, 25 bp, Mus musculus
taacatgcgacgtgatgtgaaggag

SEQ ID NO: 736482 - DNA, 25 bp, Mus musculus
taacatgcgagtcgaagactacgag

SEQ ID NO: 736483 - DNA, 25 bp, Mus musculus
taacatgcgagtggaagactacgag

SEQ ID NO: 736484 - DNA, 25 bp, Mus musculus
taacatggagaaagcactcgcttct

SEQ ID NO: 736485 - DNA, 25 bp, Mus musculus
taacatggagaatgcactcgcttct

SEQ ID NO: 736486 - DNA, 25 bp, Mus musculus
taacatggagatcgtcaaagccctc

SEQ ID NO: 736487 - DNA, 25 bp, Mus musculus
taacatggagatggtcaaagccctc

SEQ ID NO: 736488 - DNA, 25 bp, Mus musculus
taacatggccacaaggagggtttgg

SEQ ID NO: 736489 - DNA, 25 bp, Mus musculus
taacatggccactaggagggtttgg

SEQ ID NO: 736490 - DNA, 25 bp, Mus musculus
taacatggctgccactagttgttcc

SEQ ID NO: 736491 - DNA, 25 bp, Mus musculus
taacatggctgcgactagttgttcc

SEQ ID NO: 736492 - DNA, 25 bp, Mus musculus
taacatgggtgacctctttggaccc

SEQ ID NO: 736493 - DNA, 25 bp, Mus musculus
taacatgggtgagctctttggaccc

SEQ ID NO: 736494 - DNA, 25 bp, Mus musculus
taacatggtaccaagcctgtcgcag

SEQ ID NO: 736495 - DNA, 25 bp, Mus musculus
taacatggtacctagcctgtcgcag

SEQ ID NO: 736496 - DNA, 25 bp, Mus musculus
taacatggtcctcaggagtgccagc

SEQ ID NO: 736497 - DNA, 25 bp, Mus musculus
taacatggtcctgaggagtgccagc

SEQ ID NO: 736498 - DNA, 25 bp, Mus musculus
taacatggtgtacatgctgcggcct

SEQ ID NO: 736499 - DNA, 25 bp, Mus musculus
taacatggtgtagatgctgcggcct

SEQ ID NO: 736500 - DNA, 25 bp, Mus musculus
taacatgtctcacgaggatcctgga

SEQ ID NO: 736501 - DNA, 25 bp, Mus musculus
taacatgtctcaggaggatcctgga

SEQ ID NO: 736502 - DNA, 25 bp, Mus musculus
taacatgttctacatcgatcccgag

SEQ ID NO: 736503 - DNA, 25 bp, Mus musculus
taacatgttctagatcgatcccgag

SEQ ID NO: 736504 - DNA, 25 bp, Mus musculus
taacattaggagataccttaacccg

SEQ ID NO: 736505 - DNA, 25 bp, Mus musculus
taacattaggagttaccttaacccg

SEQ ID NO: 736506 - DNA, 25 bp, Mus musculus
taacattccacgctgaaggagacca

SEQ ID NO: 736507 - DNA, 25 bp, Mus musculus
taacattccacggtgaaggagacca

SEQ ID NO: 736508 - DNA, 25 bp, Mus musculus
taacattcccctcgtgtcctacaag

SEQ ID NO: 736509 - DNA, 25 bp, Mus musculus
taacattcccctggtgtcctacaag

SEQ ID NO: 736510 - DNA, 25 bp, Mus musculus
taacattcctccaccaattggctta

SEQ ID NO: 736511 - DNA, 25 bp, Mus musculus
taacattcctcctccaattggctta

SEQ ID NO: 736512 - DNA, 25 bp, Mus musculus
taacattgacccctgtgctaagggc

SEQ ID NO: 736513 - DNA, 25 bp, Mus musculus
taacattgacccgtgtgctaagggc

SEQ ID NO: 736514 - DNA, 25 bp, Mus musculus
taacattgagcaagaggttcctcag

SEQ ID NO: 736515 - DNA, 25 bp, Mus musculus
taacattgagcatgaggttcctcag

SEQ ID NO: 736516 - DNA, 25 bp, Mus musculus
taacattgagtaagtccgagacatc

SEQ ID NO: 736517 - DNA, 25 bp, Mus musculus
taacattgagtatgtccgagacatc

SEQ ID NO: 736518 - DNA, 25 bp, Mus musculus
taacattgtcaacaccttgcatgag

SEQ ID NO: 736519 - DNA, 25 bp, Mus musculus
taacattgtcaagaccttgcatgag

SEQ ID NO: 736520 - DNA, 25 bp, Mus musculus
taacattgtccacatctccaacctg

SEQ ID NO: 736521 - DNA, 25 bp, Mus musculus
taacattgtccagatctccaacctg

SEQ ID NO: 736522 - DNA, 25 bp, Mus musculus
taacattgttatcatgcttgtgggc

SEQ ID NO: 736523 - DNA, 25 bp, Mus musculus
taacattgttatgatgcttgtgggc

SEQ ID NO: 736524 - DNA, 25 bp, Mus musculus
taacattgttgtatctctccccaaa

SEQ ID NO: 736525 - DNA, 25 bp, Mus musculus
taacattgttgtttctctccccaaa

SEQ ID NO: 736526 - DNA, 25 bp, Mus musculus
taacatttcagcagcaaggcttggg

SEQ ID NO: 736527 - DNA, 25 bp, Mus musculus
taacatttcagctgcaaggcttggg

SEQ ID NO: 736528 - DNA, 25 bp, Mus musculus
taacatttgggtagaaacactgcat

SEQ ID NO: 736529 - DNA, 25 bp, Mus musculus
taacatttgggttgaaacactgcat

SEQ ID NO: 736530 - DNA, 25 bp, Mus musculus
taacattttttccaagttcaccttg

SEQ ID NO: 736531 - DNA, 25 bp, Mus musculus
taacattttttcgaagttcaccttg

SEQ ID NO: 736532 - DNA, 25 bp, Mus musculus
taaccaaaagagaaactgagatcct

SEQ ID NO: 736533 - DNA, 25 bp, Mus musculus
taaccaaaagagtaactgagatcct

SEQ ID NO: 736534 - DNA, 25 bp, Mus musculus
taaccaaattctcgagaggcagacg

SEQ ID NO: 736535 - DNA, 25 bp, Mus musculus
taaccaaattctggagaggcagacg

SEQ ID NO: 736536 - DNA, 25 bp, Mus musculus
taaccaacaccccttcagtctctca

SEQ ID NO: 736537 - DNA, 25 bp, Mus musculus
taaccaacacccgttcagtctctca

SEQ ID NO: 736538 - DNA, 25 bp, Mus musculus
taaccaaccttgacttgcagcacaa

SEQ ID NO: 736539 - DNA, 25 bp, Mus musculus
taaccaaccttgtcttgcagcacaa

SEQ ID NO: 736540 - DNA, 25 bp, Mus musculus
taaccaacgccgctcctggatgaaa

SEQ ID NO: 736541 - DNA, 25 bp, Mus musculus
taaccaacgccggtcctggatgaaa

SEQ ID NO: 736542 - DNA, 25 bp, Mus musculus
taaccaacttgtaatcaaaggaaga

SEQ ID NO: 736543 - DNA, 25 bp, Mus musculus
taaccaacttgttatcaaaggaaga

SEQ ID NO: 736544 - DNA, 25 bp, Mus musculus
taaccaagagaaaaacagttacagt

SEQ ID NO: 736545 - DNA, 25 bp, Mus musculus
taaccaagagaataacagttacagt

SEQ ID NO: 736546 - DNA, 25 bp, Mus musculus
taaccaagagttcactgagggtcac

SEQ ID NO: 736547 - DNA, 25 bp, Mus musculus
taaccaagagttgactgagggtcac

SEQ ID NO: 736548 - DNA, 25 bp, Mus musculus
taaccaagataaagagcaccccttg

SEQ ID NO: 736549 - DNA, 25 bp, Mus musculus
taaccaagataatgagcaccccttg

SEQ ID NO: 736550 - DNA, 25 bp, Mus musculus
taaccaagccacagatggacacaag

SEQ ID NO: 736551 - DNA, 25 bp, Mus musculus
taaccaagccactgatggacacaag

SEQ ID NO: 736552 - DNA, 25 bp, Mus musculus
taaccaaggaaaacacagatacaag

SEQ ID NO: 736553 - DNA, 25 bp, Mus musculus
taaccaaggaaatcacagatacaag

SEQ ID NO: 736554 - DNA, 25 bp, Mus musculus
taaccaagggacagggcagttggca

SEQ ID NO: 736555 - DNA, 25 bp, Mus musculus
taaccaagggactgggcagttggca

SEQ ID NO: 736556 - DNA, 25 bp, Mus musculus
taaccaagggatcctaggaagccaa

SEQ ID NO: 736557 - DNA, 25 bp, Mus musculus
taaccaagggatgctaggaagccaa

SEQ ID NO: 736558 - DNA, 25 bp, Mus musculus
taaccaaggtcaacgtgtccatcac

SEQ ID NO: 736559 - DNA, 25 bp, Mus musculus
taaccaaggtcatcgtgtccatcac

SEQ ID NO: 736560 - DNA, 25 bp, Mus musculus
taaccaagtagtagactgtaagcct

SEQ ID NO: 736561 - DNA, 25 bp, Mus musculus
taaccaagtagttgactgtaagcct

SEQ ID NO: 736562 - DNA, 25 bp, Mus musculus
taaccaagtgatacattatgatcct

SEQ ID NO: 736563 - DNA, 25 bp, Mus musculus
taaccaagtgattcattatgatcct

SEQ ID NO: 736564 - DNA, 25 bp, Mus musculus
taaccaatatgtagcaggctgcagc

SEQ ID NO: 736565 - DNA, 25 bp, Mus musculus
taaccaatatgttgcaggctgcagc

SEQ ID NO: 736566 - DNA, 25 bp, Mus musculus
taaccaatcaggaagaggatctccg

SEQ ID NO: 736567 - DNA, 25 bp, Mus musculus
taaccaatcaggtagaggatctccg

SEQ ID NO: 736568 - DNA, 25 bp, Mus musculus
taaccaatctgtccgtgatcggcgg

SEQ ID NO: 736569 - DNA, 25 bp, Mus musculus
taaccaatctgtgcgtgatcggcgg

SEQ ID NO: 736570 - DNA, 25 bp, Mus musculus
taaccaatggagcataaaattagat

SEQ ID NO: 736571 - DNA, 25 bp, Mus musculus
taaccaatggaggataaaattagat

SEQ ID NO: 736572 - DNA, 25 bp, Mus musculus
taaccacacacccttggtgggagcg

SEQ ID NO: 736573 - DNA, 25 bp, Mus musculus
taaccacacaccgttggtgggagcg

SEQ ID NO: 736574 - DNA, 25 bp, Mus musculus
taaccacagtggaagaccatgtgaa

SEQ ID NO: 736575 - DNA, 25 bp, Mus musculus
taaccacagtggagatgtgctgttg

SEQ ID NO: 736576 - DNA, 25 bp, Mus musculus
taaccacagtggtagaccatgtgaa

SEQ ID NO: 736577 - DNA, 25 bp, Mus musculus
taaccacagtggtgatgtgctgttg

SEQ ID NO: 736578 - DNA, 25 bp, Mus musculus
taaccaccacggctgtagagcgagt

SEQ ID NO: 736579 - DNA, 25 bp, Mus musculus
taaccaccacgggtgtagagcgagt

SEQ ID NO: 736580 - DNA, 25 bp, Mus musculus
taaccaccatctagccaacctgtat

SEQ ID NO: 736581 - DNA, 25 bp, Mus musculus
taaccaccatcttgccaacctgtat

SEQ ID NO: 736582 - DNA, 25 bp, Mus musculus
taaccaccgctcagccaagcggttg

SEQ ID NO: 736583 - DNA, 25 bp, Mus musculus
taaccaccgctctgccaagcggttg

SEQ ID NO: 736584 - DNA, 25 bp, Mus musculus
taaccacctcatatgggatgagctt

SEQ ID NO: 736585 - DNA, 25 bp, Mus musculus
taaccacctcatttgggatgagctt

SEQ ID NO: 736586 - DNA, 25 bp, Mus musculus
taaccacctcttccaagagtgcagc

SEQ ID NO: 736587 - DNA, 25 bp, Mus musculus
taaccacctcttgcaagagtgcagc

SEQ ID NO: 736588 - DNA, 25 bp, Mus musculus
taaccacctgggacttggagctaca

SEQ ID NO: 736589 - DNA, 25 bp, Mus musculus
taaccacctgggtcttggagctaca

SEQ ID NO: 736590 - DNA, 25 bp, Mus musculus
taaccacgaaatcactaatcaggag

SEQ ID NO: 736591 - DNA, 25 bp, Mus musculus
taaccacgaaatgactaatcaggag

SEQ ID NO: 736592 - DNA, 25 bp, Mus musculus
taaccacgagtcaacacccaatgct

SEQ ID NO: 736593 - DNA, 25 bp, Mus musculus
taaccacgagtctacacccaatgct

SEQ ID NO: 736594 - DNA, 25 bp, Mus musculus
taaccacgggttacagtcgcatgag

SEQ ID NO: 736595 - DNA, 25 bp, Mus musculus
taaccacgggtttcagtcgcatgag

SEQ ID NO: 736596 - DNA, 25 bp, Mus musculus
taaccacgtcgtagacttcagaaat

SEQ ID NO: 736597 - DNA, 25 bp, Mus musculus
taaccacgtcgttgacttcagaaat

SEQ ID NO: 736598 - DNA, 25 bp, Mus musculus
taaccactgggtataggaagacatc

SEQ ID NO: 736599 - DNA, 25 bp, Mus musculus
taaccactgggtttaggaagacatc

SEQ ID NO: 736600 - DNA, 25 bp, Mus musculus
taaccagaacccacagcctggagag

SEQ ID NO: 736601 - DNA, 25 bp, Mus musculus
taaccagaaccctcagcctggagag

SEQ ID NO: 736602 - DNA, 25 bp, Mus musculus
taaccagaagctacggctctctcct

SEQ ID NO: 736603 - DNA, 25 bp, Mus musculus
taaccagaagcttcggctctctcct

SEQ ID NO: 736604 - DNA, 25 bp, Mus musculus
taaccagacgatatgtttgcggttg

SEQ ID NO: 736605 - DNA, 25 bp, Mus musculus
taaccagacgatttgtttgcggttg

SEQ ID NO: 736606 - DNA, 25 bp, Mus musculus
taaccagagctaagagggcagcagc

SEQ ID NO: 736607 - DNA, 25 bp, Mus musculus
taaccagagctatgagggcagcagc

SEQ ID NO: 736608 - DNA, 25 bp, Mus musculus
taaccagatatgaacctccaagaaa

SEQ ID NO: 736609 - DNA, 25 bp, Mus musculus
taaccagatatgtacctccaagaaa

SEQ ID NO: 736610 - DNA, 25 bp, Mus musculus
taaccagcacctctgggaaacagct

SEQ ID NO: 736611 - DNA, 25 bp, Mus musculus
taaccagcacctgtgggaaacagct

SEQ ID NO: 736612 - DNA, 25 bp, Mus musculus
taaccagccacgacagccaggtgga

SEQ ID NO: 736613 - DNA, 25 bp, Mus musculus
taaccagccacgtcagccaggtgga

SEQ ID NO: 736614 - DNA, 25 bp, Mus musculus
taaccagcgcgactagcgatgagga

SEQ ID NO: 736615 - DNA, 25 bp, Mus musculus
taaccagcgcgagtagcgatgagga

SEQ ID NO: 736616 - DNA, 25 bp, Mus musculus
taaccagcggtaataccagcaacac

SEQ ID NO: 736617 - DNA, 25 bp, Mus musculus
taaccagcggtattaccagcaacac

SEQ ID NO: 736618 - DNA, 25 bp, Mus musculus
taaccagcttcactttcatgctgtg

SEQ ID NO: 736619 - DNA, 25 bp, Mus musculus
taaccagcttcagtttcatgctgtg

SEQ ID NO: 736620 - DNA, 25 bp, Mus musculus
taaccaggaataataccagcagtgg

SEQ ID NO: 736621 - DNA, 25 bp, Mus musculus
taaccaggaatattaccagcagtgg

SEQ ID NO: 736622 - DNA, 25 bp, Mus musculus
taaccaggagggatcccacccacag

SEQ ID NO: 736623 - DNA, 25 bp, Mus musculus
taaccaggagggttcccacccacag

SEQ ID NO: 736624 - DNA, 25 bp, Mus musculus
taaccaggcaacagggactgctaac

SEQ ID NO: 736625 - DNA, 25 bp, Mus musculus
taaccaggcaactgggactgctaac

SEQ ID NO: 736626 - DNA, 25 bp, Mus musculus
taaccaggccataatggtggtgcct

SEQ ID NO: 736627 - DNA, 25 bp, Mus musculus
taaccaggccattatggtggtgcct

SEQ ID NO: 736628 - DNA, 25 bp, Mus musculus
taaccagtcagacgcagtacatgct

SEQ ID NO: 736629 - DNA, 25 bp, Mus musculus
taaccagtcagaggcagtacatgct

SEQ ID NO: 736630 - DNA, 25 bp, Mus musculus
taaccagtggaactggccaatatga

SEQ ID NO: 736631 - DNA, 25 bp, Mus musculus
taaccagtggaagtggccaatatga

SEQ ID NO: 736632 - DNA, 25 bp, Mus musculus
taaccataggttcccgtctgttgcc

SEQ ID NO: 736633 - DNA, 25 bp, Mus musculus
taaccataggttgccgtctgttgcc

SEQ ID NO: 736634 - DNA, 25 bp, Mus musculus
taaccatagtggacagaccctctat

SEQ ID NO: 736635 - DNA, 25 bp, Mus musculus
taaccatagtggtcagaccctctat

SEQ ID NO: 736636 - DNA, 25 bp, Mus musculus
taaccatcagcccagtggaaggaag

SEQ ID NO: 736637 - DNA, 25 bp, Mus musculus
taaccatcagccgagtggaaggaag

SEQ ID NO: 736638 - DNA, 25 bp, Mus musculus
taaccatcagggatgtgtcattgtc

SEQ ID NO: 736639 - DNA, 25 bp, Mus musculus
taaccatcagggttgtgtcattgtc

SEQ ID NO: 736640 - DNA, 25 bp, Mus musculus
taaccatcgctacttcttctctttc

SEQ ID NO: 736641 - DNA, 25 bp, Mus musculus
taaccatcgctagttcttctctttc

SEQ ID NO: 736642 - DNA, 25 bp, Mus musculus
taaccatcgtctctatggaggagat

SEQ ID NO: 736643 - DNA, 25 bp, Mus musculus
taaccatcgtctgtatggaggagat

SEQ ID NO: 736644 - DNA, 25 bp, Mus musculus
taaccatcttgactctcccagaaga

SEQ ID NO: 736645 - DNA, 25 bp, Mus musculus
taaccatcttgagtctcccagaaga

SEQ ID NO: 736646 - DNA, 25 bp, Mus musculus
taaccatgaccaccttaagcatcag

SEQ ID NO: 736647 - DNA, 25 bp, Mus musculus
taaccatgaccagcttaagcatcag

SEQ ID NO: 736648 - DNA, 25 bp, Mus musculus
taaccatgcctcactcctataggtg

SEQ ID NO: 736649 - DNA, 25 bp, Mus musculus
taaccatgcctctctcctataggtg

SEQ ID NO: 736650 - DNA, 25 bp, Mus musculus
taaccatggaatctcctatacctgt

SEQ ID NO: 736651 - DNA, 25 bp, Mus musculus
taaccatggaatgtcctatacctgt

SEQ ID NO: 736652 - DNA, 25 bp, Mus musculus
taaccatggagaaaccctcagagac

SEQ ID NO: 736653 - DNA, 25 bp, Mus musculus
taaccatggagataccctcagagac

SEQ ID NO: 736654 - DNA, 25 bp, Mus musculus
taaccatggcgtctggagatgacag

SEQ ID NO: 736655 - DNA, 25 bp, Mus musculus
taaccatggcgtgtggagatgacag

SEQ ID NO: 736656 - DNA, 25 bp, Mus musculus
taaccatggctacctaccagcattg

SEQ ID NO: 736657 - DNA, 25 bp, Mus musculus
taaccatggctagctaccagcattg

SEQ ID NO: 736658 - DNA, 25 bp, Mus musculus
taaccatgggttcaccctggccagt

SEQ ID NO: 736659 - DNA, 25 bp, Mus musculus
taaccatgggttgaccctggccagt

SEQ ID NO: 736660 - DNA, 25 bp, Mus musculus
taaccatggttaaatgactcttgca

SEQ ID NO: 736661 - DNA, 25 bp, Mus musculus
taaccatggttatatgactcttgca

SEQ ID NO: 736662 - DNA, 25 bp, Mus musculus
taaccatggtttccgagtctgagat

SEQ ID NO: 736663 - DNA, 25 bp, Mus musculus
taaccatggtttgcgagtctgagat

SEQ ID NO: 736664 - DNA, 25 bp, Mus musculus
taaccattactaacgatggtgccac

SEQ ID NO: 736665 - DNA, 25 bp, Mus musculus
taaccattactatcgatggtgccac

SEQ ID NO: 736666 - DNA, 25 bp, Mus musculus
taaccattgagacgcgaaatcagca

SEQ ID NO: 736667 - DNA, 25 bp, Mus musculus
taaccattgagaggcgaaatcagca

SEQ ID NO: 736668 - DNA, 25 bp, Mus musculus
taaccattgcagaacctgacaaggc

SEQ ID NO: 736669 - DNA, 25 bp, Mus musculus
taaccattgcagtacctgacaaggc

SEQ ID NO: 736670 - DNA, 25 bp, Mus musculus
taaccattgtaactagtttgtgtaa

SEQ ID NO: 736671 - DNA, 25 bp, Mus musculus
taaccattgtaagtagtttgtgtaa

SEQ ID NO: 736672 - DNA, 25 bp, Mus musculus
taaccattttgaaaagtgcttgttc

SEQ ID NO: 736673 - DNA, 25 bp, Mus musculus
taaccattttgataagtgcttgttc

SEQ ID NO: 736674 - DNA, 25 bp, Mus musculus
taacccaattggagactgtagacac

SEQ ID NO: 736675 - DNA, 25 bp, Mus musculus
taacccaattggtgactgtagacac

SEQ ID NO: 736676 - DNA, 25 bp, Mus musculus
taacccacgcctatacgaagaatag

SEQ ID NO: 736677 - DNA, 25 bp, Mus musculus
taacccacgcctttacgaagaatag

SEQ ID NO: 736678 - DNA, 25 bp, Mus musculus
taacccagaacaatgaagacgtttc

SEQ ID NO: 736679 - DNA, 25 bp, Mus musculus
taacccagaacattgaagacgtttc

SEQ ID NO: 736680 - DNA, 25 bp, Mus musculus
taacccagccagagagcagtcaggg

SEQ ID NO: 736681 - DNA, 25 bp, Mus musculus
taacccagccagtgagcagtcaggg

SEQ ID NO: 736682 - DNA, 25 bp, Mus musculus
taacccagccctaagcatgaagatg

SEQ ID NO: 736683 - DNA, 25 bp, Mus musculus
taacccagcccttagcatgaagatg

SEQ ID NO: 736684 - DNA, 25 bp, Mus musculus
taacccagcgagaactgataagagg

SEQ ID NO: 736685 - DNA, 25 bp, Mus musculus
taacccagcgagtactgataagagg

SEQ ID NO: 736686 - DNA, 25 bp, Mus musculus
taacccaggaagattggcgggccca

SEQ ID NO: 736687 - DNA, 25 bp, Mus musculus
taacccaggaagtttggcgggccca

SEQ ID NO: 736688 - DNA, 25 bp, Mus musculus
taacccaggcatactcgtgctccta

SEQ ID NO: 736689 - DNA, 25 bp, Mus musculus
taacccaggcattctcgtgctccta

SEQ ID NO: 736690 - DNA, 25 bp, Mus musculus
taacccagttatatctgaatgatgc

SEQ ID NO: 736691 - DNA, 25 bp, Mus musculus
taacccagttatttctgaatgatgc

SEQ ID NO: 736692 - DNA, 25 bp, Mus musculus
taacccatacatctaagttagagga

SEQ ID NO: 736693 - DNA, 25 bp, Mus musculus
taacccatacatgtaagttagagga

SEQ ID NO: 736694 - DNA, 25 bp, Mus musculus
taacccatcttgcatgcaataccag

SEQ ID NO: 736695 - DNA, 25 bp, Mus musculus
taacccatcttggatgcaataccag

SEQ ID NO: 736696 - DNA, 25 bp, Mus musculus
taacccatttctatatcgtcaaagg

SEQ ID NO: 736697 - DNA, 25 bp, Mus musculus
taacccatttctttatcgtcaaagg

SEQ ID NO: 736698 - DNA, 25 bp, Mus musculus
taaccccaaggaagtatcaacgttg

SEQ ID NO: 736699 - DNA, 25 bp, Mus musculus
taaccccaaggacagtgcagttctc

SEQ ID NO: 736700 - DNA, 25 bp, Mus musculus
taaccccaaggagagtgcagttctc

SEQ ID NO: 736701 - DNA, 25 bp, Mus musculus
taaccccaaggatgtatcaacgttg

SEQ ID NO: 736702 - DNA, 25 bp, Mus musculus
taaccccagagtcaaaactcggttg

SEQ ID NO: 736703 - DNA, 25 bp, Mus musculus
taaccccagagtgaaaactcggttg

SEQ ID NO: 736704 - DNA, 25 bp, Mus musculus
taaccccagcttagctcaggaccag

SEQ ID NO: 736705 - DNA, 25 bp, Mus musculus
taaccccagctttgctcaggaccag

SEQ ID NO: 736706 - DNA, 25 bp, Mus musculus
taaccccagtccctggatctctgga

SEQ ID NO: 736707 - DNA, 25 bp, Mus musculus
taaccccagtccgtggatctctgga

SEQ ID NO: 736708 - DNA, 25 bp, Mus musculus
taaccccagtgtatgagggcctgag

SEQ ID NO: 736709 - DNA, 25 bp, Mus musculus
taaccccagtgtttgagggcctgag

SEQ ID NO: 736710 - DNA, 25 bp, Mus musculus
taaccccggcgcagcggagcttcgg

SEQ ID NO: 736711 - DNA, 25 bp, Mus musculus
taaccccggcgctgcggagcttcgg

SEQ ID NO: 736712 - DNA, 25 bp, Mus musculus
taaccccgggctcgcaggctgatga

SEQ ID NO: 736713 - DNA, 25 bp, Mus musculus
taaccccgggctggcaggctgatga

SEQ ID NO: 736714 - DNA, 25 bp, Mus musculus
taaccccggtgaccagaatagccta

SEQ ID NO: 736715 - DNA, 25 bp, Mus musculus
taaccccggtgagcagaatagccta

SEQ ID NO: 736716 - DNA, 25 bp, Mus musculus
taacccctacagaggagcacaggac

SEQ ID NO: 736717 - DNA, 25 bp, Mus musculus
taacccctacagtggagcacaggac

SEQ ID NO: 736718 - DNA, 25 bp, Mus musculus
taacccctactacaatgagtccttc

SEQ ID NO: 736719 - DNA, 25 bp, Mus musculus
taacccctactagaatgagtccttc

SEQ ID NO: 736720 - DNA, 25 bp, Mus musculus
taacccctccgaaacagaatctgag

SEQ ID NO: 736721 - DNA, 25 bp, Mus musculus
taacccctccgatacagaatctgag

SEQ ID NO: 736722 - DNA, 25 bp, Mus musculus
taaccccttgacagagtgcaaacac

SEQ ID NO: 736723 - DNA, 25 bp, Mus musculus
taaccccttgactgagtgcaaacac

SEQ ID NO: 736724 - DNA, 25 bp, Mus musculus
taacccctttaaagagtactccaag

SEQ ID NO: 736725 - DNA, 25 bp, Mus musculus
taacccctttaatgagtactccaag

SEQ ID NO: 736726 - DNA, 25 bp, Mus musculus
taacccgaagagataaggctacacg

SEQ ID NO: 736727 - DNA, 25 bp, Mus musculus
taacccgaagagttaaggctacacg

SEQ ID NO: 736728 - DNA, 25 bp, Mus musculus
taacccgagaggagatgacaacttt

SEQ ID NO: 736729 - DNA, 25 bp, Mus musculus
taacccgagaggtgatgacaacttt

SEQ ID NO: 736730 - DNA, 25 bp, Mus musculus
taacccgctcatcagacgcaatagt

SEQ ID NO: 736731 - DNA, 25 bp, Mus musculus
taacccgctcatgagacgcaatagt

SEQ ID NO: 736732 - DNA, 25 bp, Mus musculus
taacccggatcccaggtacgagagg

SEQ ID NO: 736733 - DNA, 25 bp, Mus musculus
taacccggatccgaggtacgagagg

SEQ ID NO: 736734 - DNA, 25 bp, Mus musculus
taacccggcttcacaaatgttggcc

SEQ ID NO: 736735 - DNA, 25 bp, Mus musculus
taacccggcttctcaaatgttggcc

SEQ ID NO: 736736 - DNA, 25 bp, Mus musculus
taacccggtggtatcgggcaccaga

SEQ ID NO: 736737 - DNA, 25 bp, Mus musculus
taacccggtggtttcgggcaccaga

SEQ ID NO: 736738 - DNA, 25 bp, Mus musculus
taacccgtacatccagttaggaatc

SEQ ID NO: 736739 - DNA, 25 bp, Mus musculus
taacccgtacatgcagttaggaatc

SEQ ID NO: 736740 - DNA, 25 bp, Mus musculus
taacccgtatggcaagatatctaca

SEQ ID NO: 736741 - DNA, 25 bp, Mus musculus
taacccgtatgggaagatatctaca

SEQ ID NO: 736742 - DNA, 25 bp, Mus musculus
taacccgtggatctagcctcaaaga

SEQ ID NO: 736743 - DNA, 25 bp, Mus musculus
taacccgtggatgtagcctcaaaga

SEQ ID NO: 736744 - DNA, 25 bp, Mus musculus
taaccctcatatacaggctgatagg

SEQ ID NO: 736745 - DNA, 25 bp, Mus musculus
taaccctcatattcaggctgatagg

SEQ ID NO: 736746 - DNA, 25 bp, Mus musculus
taaccctcatggcattagtacattc

SEQ ID NO: 736747 - DNA, 25 bp, Mus musculus
taaccctcatgggattagtacattc

SEQ ID NO: 736748 - DNA, 25 bp, Mus musculus
taaccctcctttacctatcagcaat

SEQ ID NO: 736749 - DNA, 25 bp, Mus musculus
taaccctccttttcctatcagcaat

SEQ ID NO: 736750 - DNA, 25 bp, Mus musculus
taaccctgaatcctccagaaggaat

SEQ ID NO: 736751 - DNA, 25 bp, Mus musculus
taaccctgaatcgtccagaaggaat

SEQ ID NO: 736752 - DNA, 25 bp, Mus musculus
taaccctgagaactataataaccca

SEQ ID NO: 736753 - DNA, 25 bp, Mus musculus
taaccctgagaagtataataaccca

SEQ ID NO: 736754 - DNA, 25 bp, Mus musculus
taaccctgatgaaaaatctggtcca

SEQ ID NO: 736755 - DNA, 25 bp, Mus musculus
taaccctgatgataaatctggtcca

SEQ ID NO: 736756 - DNA, 25 bp, Mus musculus
taaccctgatggagcatctcatggg

SEQ ID NO: 736757 - DNA, 25 bp, Mus musculus
taaccctgatggtgcatctcatggg

SEQ ID NO: 736758 - DNA, 25 bp, Mus musculus
taaccctgattaaggaccaggctgg

SEQ ID NO: 736759 - DNA, 25 bp, Mus musculus
taaccctgattatggaccaggctgg

SEQ ID NO: 736760 - DNA, 25 bp, Mus musculus
taaccctgctgaaaactaccatctg

SEQ ID NO: 736761 - DNA, 25 bp, Mus musculus
taaccctgctgataactaccatctg

SEQ ID NO: 736762 - DNA, 25 bp, Mus musculus
taaccctgctgcaaagctagacacc

SEQ ID NO: 736763 - DNA, 25 bp, Mus musculus
taaccctgctgctaagctagacacc

SEQ ID NO: 736764 - DNA, 25 bp, Mus musculus
taaccctggacaagctatcctgaag

SEQ ID NO: 736765 - DNA, 25 bp, Mus musculus
taaccctggacatgctatcctgaag

SEQ ID NO: 736766 - DNA, 25 bp, Mus musculus
taaccctggcgcagaagtgacccgg

SEQ ID NO: 736767 - DNA, 25 bp, Mus musculus
taaccctggcgctgaagtgacccgg

SEQ ID NO: 736768 - DNA, 25 bp, Mus musculus
taaccctgtgacaggtctccaggaa

SEQ ID NO: 736769 - DNA, 25 bp, Mus musculus
taaccctgtgactggtctccaggaa

SEQ ID NO: 736770 - DNA, 25 bp, Mus musculus
taaccctgtgtaccttgagcagtcc

SEQ ID NO: 736771 - DNA, 25 bp, Mus musculus
taaccctgtgtagcttgagcagtcc

SEQ ID NO: 736772 - DNA, 25 bp, Mus musculus
taacccttgggtacaacaaagcatg

SEQ ID NO: 736773 - DNA, 25 bp, Mus musculus
taacccttgggttcaacaaagcatg

SEQ ID NO: 736774 - DNA, 25 bp, Mus musculus
taaccctttcaacgagcgaatctgc

SEQ ID NO: 736775 - DNA, 25 bp, Mus musculus
taaccctttcaaggagcgaatctgc

SEQ ID NO: 736776 - DNA, 25 bp, Mus musculus
taaccgaaggtgatcaaaattcctg

SEQ ID NO: 736777 - DNA, 25 bp, Mus musculus
taaccgaaggtgttcaaaattcctg

SEQ ID NO: 736778 - DNA, 25 bp, Mus musculus
taaccgacattcagaggaacatttg

SEQ ID NO: 736779 - DNA, 25 bp, Mus musculus
taaccgacattctgaggaacatttg

SEQ ID NO: 736780 - DNA, 25 bp, Mus musculus
taaccgaggaggctgcaactttaag

SEQ ID NO: 736781 - DNA, 25 bp, Mus musculus
taaccgaggagggtgcaactttaag

SEQ ID NO: 736782 - DNA, 25 bp, Mus musculus
taaccgaggcgaagtcttcctgctg

SEQ ID NO: 736783 - DNA, 25 bp, Mus musculus
taaccgaggcgatgtcttcctgctg

SEQ ID NO: 736784 - DNA, 25 bp, Mus musculus
taaccgagggcaaaggtgccaacgc

SEQ ID NO: 736785 - DNA, 25 bp, Mus musculus
taaccgagggcataggtgccaacgc

SEQ ID NO: 736786 - DNA, 25 bp, Mus musculus
taaccgattcttcagagggtgagca

SEQ ID NO: 736787 - DNA, 25 bp, Mus musculus
taaccgattcttgagagggtgagca

SEQ ID NO: 736788 - DNA, 25 bp, Mus musculus
taaccgcagagcaacttggctacaa

SEQ ID NO: 736789 - DNA, 25 bp, Mus musculus
taaccgcagagctacttggctacaa

SEQ ID NO: 736790 - DNA, 25 bp, Mus musculus
taaccgccgccacaaggagaaaaga

SEQ ID NO: 736791 - DNA, 25 bp, Mus musculus
taaccgccgccagaaggagaaaaga

SEQ ID NO: 736792 - DNA, 25 bp, Mus musculus
taaccgcgatggctcatatgatatg

SEQ ID NO: 736793 - DNA, 25 bp, Mus musculus
taaccgcgatgggtcatatgatatg

SEQ ID NO: 736794 - DNA, 25 bp, Mus musculus
taaccgcgcttcaggttcctcataa

SEQ ID NO: 736795 - DNA, 25 bp, Mus musculus
taaccgcgcttctggttcctcataa

SEQ ID NO: 736796 - DNA, 25 bp, Mus musculus
taaccgctgccccaatccttaaggg

SEQ ID NO: 736797 - DNA, 25 bp, Mus musculus
taaccgctgcccgaatccttaaggg

SEQ ID NO: 736798 - DNA, 25 bp, Mus musculus
taaccggaacaactcatatgggaca

SEQ ID NO: 736799 - DNA, 25 bp, Mus musculus
taaccggaacaagtcatatgggaca

SEQ ID NO: 736800 - DNA, 25 bp, Mus musculus
taaccggaactaaggcttcggctgt

SEQ ID NO: 736801 - DNA, 25 bp, Mus musculus
taaccggaactatggcttcggctgt

SEQ ID NO: 736802 - DNA, 25 bp, Mus musculus
taaccggagtggcaaatatctagcc

SEQ ID NO: 736803 - DNA, 25 bp, Mus musculus
taaccggagtgggaaatatctagcc

SEQ ID NO: 736804 - DNA, 25 bp, Mus musculus
taaccggctgggatgtatcagatgc

SEQ ID NO: 736805 - DNA, 25 bp, Mus musculus
taaccggctgggttgtatcagatgc

SEQ ID NO: 736806 - DNA, 25 bp, Mus musculus
taaccgggagtcactgattgtgttc

SEQ ID NO: 736807 - DNA, 25 bp, Mus musculus
taaccgggagtctctgattgtgttc

SEQ ID NO: 736808 - DNA, 25 bp, Mus musculus
taaccgggtatgaataattttggtg

SEQ ID NO: 736809 - DNA, 25 bp, Mus musculus
taaccgggtatgtataattttggtg

SEQ ID NO: 736810 - DNA, 25 bp, Mus musculus
taaccgggttgtcatcagtaacagt

SEQ ID NO: 736811 - DNA, 25 bp, Mus musculus
taaccgggttgtgatcagtaacagt

SEQ ID NO: 736812 - DNA, 25 bp, Mus musculus
taaccgtgtgaaattagccttagaa

SEQ ID NO: 736813 - DNA, 25 bp, Mus musculus
taaccgtgtgaatttagccttagaa

SEQ ID NO: 736814 - DNA, 25 bp, Mus musculus
taacctacacaaaccacaaggcgat

SEQ ID NO: 736815 - DNA, 25 bp, Mus musculus
taacctacacaatccacaaggcgat

SEQ ID NO: 736816 - DNA, 25 bp, Mus musculus
taacctacaggtccttgaagacaag

SEQ ID NO: 736817 - DNA, 25 bp, Mus musculus
taacctacaggtgcttgaagacaag

SEQ ID NO: 736818 - DNA, 25 bp, Mus musculus
taacctagccagctggagagtccaa

SEQ ID NO: 736819 - DNA, 25 bp, Mus musculus
taacctagccaggtggagagtccaa

SEQ ID NO: 736820 - DNA, 25 bp, Mus musculus
taacctatgcttctgaaaatggaca

SEQ ID NO: 736821 - DNA, 25 bp, Mus musculus
taacctatgcttgtgaaaatggaca

SEQ ID NO: 736822 - DNA, 25 bp, Mus musculus
taacctatgggcaaaacaggacaat

SEQ ID NO: 736823 - DNA, 25 bp, Mus musculus
taacctatgggctaaacaggacaat

SEQ ID NO: 736824 - DNA, 25 bp, Mus musculus
taacctcaagtgaaatgctgatgca

SEQ ID NO: 736825 - DNA, 25 bp, Mus musculus
taacctcaagtgtaatgctgatgca

SEQ ID NO: 736826 - DNA, 25 bp, Mus musculus
taacctcagaaaaactacagctcgt

SEQ ID NO: 736827 - DNA, 25 bp, Mus musculus
taacctcagaaatactacagctcgt

SEQ ID NO: 736828 - DNA, 25 bp, Mus musculus
taacctcagtgtaaaggataactgg

SEQ ID NO: 736829 - DNA, 25 bp, Mus musculus
taacctcagtgttaaggataactgg

SEQ ID NO: 736830 - DNA, 25 bp, Mus musculus
taacctccatcactaatgatgaaga

SEQ ID NO: 736831 - DNA, 25 bp, Mus musculus
taacctccatcagtaatgatgaaga

SEQ ID NO: 736832 - DNA, 25 bp, Mus musculus
taacctcctgtcacgatttactcga

SEQ ID NO: 736833 - DNA, 25 bp, Mus musculus
taacctcctgtctcgatttactcga

SEQ ID NO: 736834 - DNA, 25 bp, Mus musculus
taacctctaaaaagtggggagcgag

SEQ ID NO: 736835 - DNA, 25 bp, Mus musculus
taacctctaaaatgtggggagcgag

SEQ ID NO: 736836 - DNA, 25 bp, Mus musculus
taacctctcaggaaagctctgatgg

SEQ ID NO: 736837 - DNA, 25 bp, Mus musculus
taacctctcaggtaagctctgatgg

SEQ ID NO: 736838 - DNA, 25 bp, Mus musculus
taacctgaagttagctggaatgcca

SEQ ID NO: 736839 - DNA, 25 bp, Mus musculus
taacctgaagtttgctggaatgcca

SEQ ID NO: 736840 - DNA, 25 bp, Mus musculus
taacctgagaagaggcgccaccttt

SEQ ID NO: 736841 - DNA, 25 bp, Mus musculus
taacctgagaagtggcgccaccttt

SEQ ID NO: 736842 - DNA, 25 bp, Mus musculus
taacctgatgagcttgtcacagagt

SEQ ID NO: 736843 - DNA, 25 bp, Mus musculus
taacctgatgaggttgtcacagagt

SEQ ID NO: 736844 - DNA, 25 bp, Mus musculus
taacctgcatcaagaagcctgagga

SEQ ID NO: 736845 - DNA, 25 bp, Mus musculus
taacctgcatcatgaagcctgagga

SEQ ID NO: 736846 - DNA, 25 bp, Mus musculus
taacctgcccaactttataaactgg

SEQ ID NO: 736847 - DNA, 25 bp, Mus musculus
taacctgcccaagtttataaactgg

SEQ ID NO: 736848 - DNA, 25 bp, Mus musculus
taacctgcccatcgaataacccgtt

SEQ ID NO: 736849 - DNA, 25 bp, Mus musculus
taacctgcccatggaataacccgtt

SEQ ID NO: 736850 - DNA, 25 bp, Mus musculus
taacctgcgcaaagttaacaaacac

SEQ ID NO: 736851 - DNA, 25 bp, Mus musculus
taacctgcgcaatgttaacaaacac

SEQ ID NO: 736852 - DNA, 25 bp, Mus musculus
taacctgctgcacgcttgtgggctg

SEQ ID NO: 736853 - DNA, 25 bp, Mus musculus
taacctgctgcaggcttgtgggctg

SEQ ID NO: 736854 - DNA, 25 bp, Mus musculus
taacctgctggccactaaacactgg

SEQ ID NO: 736855 - DNA, 25 bp, Mus musculus
taacctgctggcgactaaacactgg

SEQ ID NO: 736856 - DNA, 25 bp, Mus musculus
taacctggaaatcctctggctgtgg

SEQ ID NO: 736857 - DNA, 25 bp, Mus musculus
taacctggaaatgctctggctgtgg

SEQ ID NO: 736858 - DNA, 25 bp, Mus musculus
taacctggacatcggcagggcaagc

SEQ ID NO: 736859 - DNA, 25 bp, Mus musculus
taacctggacatgggcagggcaagc

SEQ ID NO: 736860 - DNA, 25 bp, Mus musculus
taacctgggaagatattggaggcct

SEQ ID NO: 736861 - DNA, 25 bp, Mus musculus
taacctgggaagttattggaggcct

SEQ ID NO: 736862 - DNA, 25 bp, Mus musculus
taacctgggctcactgacacacagt

SEQ ID NO: 736863 - DNA, 25 bp, Mus musculus
taacctgggctctctgacacacagt

SEQ ID NO: 736864 - DNA, 25 bp, Mus musculus
taacctggtaacacttggactgtct

SEQ ID NO: 736865 - DNA, 25 bp, Mus musculus
taacctggtaactcttggactgtct

SEQ ID NO: 736866 - DNA, 25 bp, Mus musculus
taacctggtgtgctggctattgacc

SEQ ID NO: 736867 - DNA, 25 bp, Mus musculus
taacctggtgtggtggctattgacc

SEQ ID NO: 736868 - DNA, 25 bp, Mus musculus
taacctggttgtcctgcggcttgtg

SEQ ID NO: 736869 - DNA, 25 bp, Mus musculus
taacctggttgtgctgcggcttgtg

SEQ ID NO: 736870 - DNA, 25 bp, Mus musculus
taacctgtggagcacatattcagac

SEQ ID NO: 736871 - DNA, 25 bp, Mus musculus
taacctgtggaggacatattcagac

SEQ ID NO: 736872 - DNA, 25 bp, Mus musculus
taacctgtggtaagagtttgatgac

SEQ ID NO: 736873 - DNA, 25 bp, Mus musculus
taacctgtggtatgagtttgatgac

SEQ ID NO: 736874 - DNA, 25 bp, Mus musculus
taaccttaggccctgctcagtcaga

SEQ ID NO: 736875 - DNA, 25 bp, Mus musculus
taaccttaggccgtgctcagtcaga

SEQ ID NO: 736876 - DNA, 25 bp, Mus musculus
taaccttcaaacaggcgatgtcaag

SEQ ID NO: 736877 - DNA, 25 bp, Mus musculus
taaccttcaaactggcgatgtcaag

SEQ ID NO: 736878 - DNA, 25 bp, Mus musculus
taaccttcattaactgtgcctatgt

SEQ ID NO: 736879 - DNA, 25 bp, Mus musculus
taaccttcattatctgtgcctatgt

SEQ ID NO: 736880 - DNA, 25 bp, Mus musculus
taaccttgagatatgccctttaact

SEQ ID NO: 736881 - DNA, 25 bp, Mus musculus
taaccttgagatttgccctttaact

SEQ ID NO: 736882 - DNA, 25 bp, Mus musculus
taaccttgcaagcatgcacgctgat

SEQ ID NO: 736883 - DNA, 25 bp, Mus musculus
taaccttgcaaggatgcacgctgat

SEQ ID NO: 736884 - DNA, 25 bp, Mus musculus
taaccttgcttaaattgggtgccag

SEQ ID NO: 736885 - DNA, 25 bp, Mus musculus
taaccttgcttatattgggtgccag

SEQ ID NO: 736886 - DNA, 25 bp, Mus musculus
taacctttgagaatgcagaaatgag

SEQ ID NO: 736887 - DNA, 25 bp, Mus musculus
taacctttgagattgcagaaatgag

SEQ ID NO: 736888 - DNA, 25 bp, Mus musculus
taacctttgtggatggccgctctct

SEQ ID NO: 736889 - DNA, 25 bp, Mus musculus
taacctttgtggttggccgctctct

SEQ ID NO: 736890 - DNA, 25 bp, Mus musculus
taaccttttgtcctgaaggaacagc

SEQ ID NO: 736891 - DNA, 25 bp, Mus musculus
taaccttttgtcgtgaaggaacagc

SEQ ID NO: 736892 - DNA, 25 bp, Mus musculus
taacgaaagaggacttgatacagaa

SEQ ID NO: 736893 - DNA, 25 bp, Mus musculus
taacgaaagaggtcttgatacagaa

SEQ ID NO: 736894 - DNA, 25 bp, Mus musculus
taacgaacatagaattactcctgag

SEQ ID NO: 736895 - DNA, 25 bp, Mus musculus
taacgaacatagtattactcctgag

SEQ ID NO: 736896 - DNA, 25 bp, Mus musculus
taacgaagcgttaggcagaaaagaa

SEQ ID NO: 736897 - DNA, 25 bp, Mus musculus
taacgaagcgtttggcagaaaagaa

SEQ ID NO: 736898 - DNA, 25 bp, Mus musculus
taacgacaaggaatcaacaccgcag

SEQ ID NO: 736899 - DNA, 25 bp, Mus musculus
taacgacaaggattcaacaccgcag

SEQ ID NO: 736900 - DNA, 25 bp, Mus musculus
taacgacactaaagagaaaggcaga

SEQ ID NO: 736901 - DNA, 25 bp, Mus musculus
taacgacactaatgagaaaggcaga

SEQ ID NO: 736902 - DNA, 25 bp, Mus musculus
taacgacattgaatcttctacctgg

SEQ ID NO: 736903 - DNA, 25 bp, Mus musculus
taacgacattgattcttctacctgg

SEQ ID NO: 736904 - DNA, 25 bp, Mus musculus
taacgacgttcactttctgggacag

SEQ ID NO: 736905 - DNA, 25 bp, Mus musculus
taacgacgttcagtttctgggacag

SEQ ID NO: 736906 - DNA, 25 bp, Mus musculus
taacgactctatatgcataacggag

SEQ ID NO: 736907 - DNA, 25 bp, Mus musculus
taacgactctatttgcataacggag

SEQ ID NO: 736908 - DNA, 25 bp, Mus musculus
taacgagagcttcgccgagatgaac

SEQ ID NO: 736909 - DNA, 25 bp, Mus musculus
taacgagagcttggccgagatgaac

SEQ ID NO: 736910 - DNA, 25 bp, Mus musculus
taacgagatcataccgatgctgccc

SEQ ID NO: 736911 - DNA, 25 bp, Mus musculus
taacgagatcattccgatgctgccc

SEQ ID NO: 736912 - DNA, 25 bp, Mus musculus
taacgaggacaaaggagctcaagtc

SEQ ID NO: 736913 - DNA, 25 bp, Mus musculus
taacgaggacaatggagctcaagtc

SEQ ID NO: 736914 - DNA, 25 bp, Mus musculus
taacgagtgtccagtgggagcctcc

SEQ ID NO: 736915 - DNA, 25 bp, Mus musculus
taacgagtgtcctgtgggagcctcc

SEQ ID NO: 736916 - DNA, 25 bp, Mus musculus
taacgatacctcaaaggtatgaggt

SEQ ID NO: 736917 - DNA, 25 bp, Mus musculus
taacgatacctctaaggtatgaggt

SEQ ID NO: 736918 - DNA, 25 bp, Mus musculus
taacgatgaataccccatccccggt

SEQ ID NO: 736919 - DNA, 25 bp, Mus musculus
taacgatgaatagcccatccccggt

SEQ ID NO: 736920 - DNA, 25 bp, Mus musculus
taacgatgattccaagtttggccag

SEQ ID NO: 736921 - DNA, 25 bp, Mus musculus
taacgatgattcgaagtttggccag

SEQ ID NO: 736922 - DNA, 25 bp, Mus musculus
taacgatgctgacttgtcaaatgcc

SEQ ID NO: 736923 - DNA, 25 bp, Mus musculus
taacgatgctgagttgtcaaatgcc

SEQ ID NO: 736924 - DNA, 25 bp, Mus musculus
taacgatggaagcatggatcaagtg

SEQ ID NO: 736925 - DNA, 25 bp, Mus musculus
taacgatggaaggatggatcaagtg

SEQ ID NO: 736926 - DNA, 25 bp, Mus musculus
taacgatggcctcaatcacttggac

SEQ ID NO: 736927 - DNA, 25 bp, Mus musculus
taacgatggcctgaatcacttggac

SEQ ID NO: 736928 - DNA, 25 bp, Mus musculus
taacgatgggaaacattggccgtca

SEQ ID NO: 736929 - DNA, 25 bp, Mus musculus
taacgatgggaatcattggccgtca

SEQ ID NO: 736930 - DNA, 25 bp, Mus musculus
taacgcaactacctcagcaaagcca

SEQ ID NO: 736931 - DNA, 25 bp, Mus musculus
taacgcaactacgtcagcaaagcca

SEQ ID NO: 736932 - DNA, 25 bp, Mus musculus
taacgcaatggtacattctcactgg

SEQ ID NO: 736933 - DNA, 25 bp, Mus musculus
taacgcaatggttcattctcactgg

SEQ ID NO: 736934 - DNA, 25 bp, Mus musculus
taacgcagctgtacagccaggcccg

SEQ ID NO: 736935 - DNA, 25 bp, Mus musculus
taacgcagctgttcagccaggcccg

SEQ ID NO: 736936 - DNA, 25 bp, Mus musculus
taacgccacaaaaacatgctgctga

SEQ ID NO: 736937 - DNA, 25 bp, Mus musculus
taacgccacaaatacatgctgctga

SEQ ID NO: 736938 - DNA, 25 bp, Mus musculus
taacgccatgaaatccaatccagcc

SEQ ID NO: 736939 - DNA, 25 bp, Mus musculus
taacgccatgaattccaatccagcc

SEQ ID NO: 736940 - DNA, 25 bp, Mus musculus
taacgcccaggtaccaaggctggtt

SEQ ID NO: 736941 - DNA, 25 bp, Mus musculus
taacgcccaggttccaaggctggtt

SEQ ID NO: 736942 - DNA, 25 bp, Mus musculus
taacgcggctgacgcaactccggag

SEQ ID NO: 736943 - DNA, 25 bp, Mus musculus
taacgcggctgaggcaactccggag

SEQ ID NO: 736944 - DNA, 25 bp, Mus musculus
taacgctcaggaaacatcaggtggg

SEQ ID NO: 736945 - DNA, 25 bp, Mus musculus
taacgctcaggatacatcaggtggg

SEQ ID NO: 736946 - DNA, 25 bp, Mus musculus
taacgctgacagagagactatcaac

SEQ ID NO: 736947 - DNA, 25 bp, Mus musculus
taacgctgacagtgagactatcaac

SEQ ID NO: 736948 - DNA, 25 bp, Mus musculus
taacgctgcatgcagtgggtactcc

SEQ ID NO: 736949 - DNA, 25 bp, Mus musculus
taacgctgcatggagtgggtactcc

SEQ ID NO: 736950 - DNA, 25 bp, Mus musculus
taacgcttcctgagctgaacgcagc

SEQ ID NO: 736951 - DNA, 25 bp, Mus musculus
taacgcttcctgtgctgaacgcagc

SEQ ID NO: 736952 - DNA, 25 bp, Mus musculus
taacgcttctccaagggcttcagag

SEQ ID NO: 736953 - DNA, 25 bp, Mus musculus
taacgcttctcctagggcttcagag

SEQ ID NO: 736954 - DNA, 25 bp, Mus musculus
taacggaatgcacaagaatacagct

SEQ ID NO: 736955 - DNA, 25 bp, Mus musculus
taacggaatgcagaagaatacagct

SEQ ID NO: 736956 - DNA, 25 bp, Mus musculus
taacggacggatctgactccaagcg

SEQ ID NO: 736957 - DNA, 25 bp, Mus musculus
taacggacggatgtgactccaagcg

SEQ ID NO: 736958 - DNA, 25 bp, Mus musculus
taacggacgtgcaaggatctggatc

SEQ ID NO: 736959 - DNA, 25 bp, Mus musculus
taacggacgtgctaggatctggatc

SEQ ID NO: 736960 - DNA, 25 bp, Mus musculus
taacggagaagactcggatgaagct

SEQ ID NO: 736961 - DNA, 25 bp, Mus musculus
taacggagaagagtcggatgaagct

SEQ ID NO: 736962 - DNA, 25 bp, Mus musculus
taacggagatccagagagtggaccc

SEQ ID NO: 736963 - DNA, 25 bp, Mus musculus
taacggagatcctgagagtggaccc

SEQ ID NO: 736964 - DNA, 25 bp, Mus musculus
taacggagcgccaaaaagtgcactg

SEQ ID NO: 736965 - DNA, 25 bp, Mus musculus
taacggagcgcctaaaagtgcactg

SEQ ID NO: 736966 - DNA, 25 bp, Mus musculus
taacggaggcctcatggattttgct

SEQ ID NO: 736967 - DNA, 25 bp, Mus musculus
taacggaggcctgatggattttgct

SEQ ID NO: 736968 - DNA, 25 bp, Mus musculus
taacggatctcaaagagcagcggaa

SEQ ID NO: 736969 - DNA, 25 bp, Mus musculus
taacggatctcatagagcagcggaa

SEQ ID NO: 736970 - DNA, 25 bp, Mus musculus
taacggatgcaaattttgaagatga

SEQ ID NO: 736971 - DNA, 25 bp, Mus musculus
taacggatgcaatttttgaagatga

SEQ ID NO: 736972 - DNA, 25 bp, Mus musculus
taacggattctaacggaagacactg

SEQ ID NO: 736973 - DNA, 25 bp, Mus musculus
taacggattctatcggaagacactg

SEQ ID NO: 736974 - DNA, 25 bp, Mus musculus
taacggcagtgtcagtcattaacag

SEQ ID NO: 736975 - DNA, 25 bp, Mus musculus
taacggcagtgtgagtcattaacag

SEQ ID NO: 736976 - DNA, 25 bp, Mus musculus
taacggccacgtctctgtctttgag

SEQ ID NO: 736977 - DNA, 25 bp, Mus musculus
taacggccacgtgtctgtctttgag

SEQ ID NO: 736978 - DNA, 25 bp, Mus musculus
taacggcgctaaccatccttctttg

SEQ ID NO: 736979 - DNA, 25 bp, Mus musculus
taacggcgctaagcatccttctttg

SEQ ID NO: 736980 - DNA, 25 bp, Mus musculus
taacggcgtcgtatgtgcgggcaca

SEQ ID NO: 736981 - DNA, 25 bp, Mus musculus
taacggcgtcgtttgtgcgggcaca

SEQ ID NO: 736982 - DNA, 25 bp, Mus musculus
taacggctagcacaggaactgtgtc

SEQ ID NO: 736983 - DNA, 25 bp, Mus musculus
taacggctagcagaggaactgtgtc

SEQ ID NO: 736984 - DNA, 25 bp, Mus musculus
taacggctccagacgctgtaacacg

SEQ ID NO: 736985 - DNA, 25 bp, Mus musculus
taacggctccagtcgctgtaacacg

SEQ ID NO: 736986 - DNA, 25 bp, Mus musculus
taacgggtaaccacaaagtctgagc

SEQ ID NO: 736987 - DNA, 25 bp, Mus musculus
taacgggtaacctcaaagtctgagc

SEQ ID NO: 736988 - DNA, 25 bp, Mus musculus
taacggtaagtaagtcgcagcagaa

SEQ ID NO: 736989 - DNA, 25 bp, Mus musculus
taacggtaagtatgtcgcagcagaa

SEQ ID NO: 736990 - DNA, 25 bp, Mus musculus
taacggtcagcacttcattttggag

SEQ ID NO: 736991 - DNA, 25 bp, Mus musculus
taacggtcagcagttcattttggag

SEQ ID NO: 736992 - DNA, 25 bp, Mus musculus
taacggtcattcacatgaagaggat

SEQ ID NO: 736993 - DNA, 25 bp, Mus musculus
taacggtcattctcatgaagaggat

SEQ ID NO: 736994 - DNA, 25 bp, Mus musculus
taacggtctgcgagataaagcttca

SEQ ID NO: 736995 - DNA, 25 bp, Mus musculus
taacggtctgcgtgataaagcttca

SEQ ID NO: 736996 - DNA, 25 bp, Mus musculus
taacggtctggacttctctgccaag

SEQ ID NO: 736997 - DNA, 25 bp, Mus musculus
taacggtctggagttctctgccaag

SEQ ID NO: 736998 - DNA, 25 bp, Mus musculus
taacggtgactgctttctgttccaa

SEQ ID NO: 736999 - DNA, 25 bp, Mus musculus
taacggtgactggtttctgttccaa

SEQ ID NO: 737000 - DNA, 25 bp, Mus musculus
taacggtgatatattcctaatttga

SEQ ID NO: 737001 - DNA, 25 bp, Mus musculus
taacggtgatattttcctaatttga

SEQ ID NO: 737002 - DNA, 25 bp, Mus musculus
taacggtgcccgaggattacatcac

SEQ ID NO: 737003 - DNA, 25 bp, Mus musculus
taacggtgcccgtggattacatcac

SEQ ID NO: 737004 - DNA, 25 bp, Mus musculus
taacggttaaaccagcctcgctttg

SEQ ID NO: 737005 - DNA, 25 bp, Mus musculus
taacggttaaacgagcctcgctttg

SEQ ID NO: 737006 - DNA, 25 bp, Mus musculus
taacggttggcaagtacctgcctat

SEQ ID NO: 737007 - DNA, 25 bp, Mus musculus
taacggttggcatgtacctgcctat

SEQ ID NO: 737008 - DNA, 25 bp, Mus musculus
taacggtttactcttagtgaaggtg

SEQ ID NO: 737009 - DNA, 25 bp, Mus musculus
taacggtttactgttagtgaaggtg

SEQ ID NO: 737010 - DNA, 25 bp, Mus musculus
taacgtaaaggacctcctgcgatcc

SEQ ID NO: 737011 - DNA, 25 bp, Mus musculus
taacgtaaaggagctcctgcgatcc

SEQ ID NO: 737012 - DNA, 25 bp, Mus musculus
taacgtaatgaacatcgcagacttt

SEQ ID NO: 737013 - DNA, 25 bp, Mus musculus
taacgtaatgaagatcgcagacttt

SEQ ID NO: 737014 - DNA, 25 bp, Mus musculus
taacgtacaacaacttcagctggca

SEQ ID NO: 737015 - DNA, 25 bp, Mus musculus
taacgtacaacatcttcagctggca

SEQ ID NO: 737016 - DNA, 25 bp, Mus musculus
taacgtaccgacagctggcaagaga

SEQ ID NO: 737017 - DNA, 25 bp, Mus musculus
taacgtaccgactgctggcaagaga

SEQ ID NO: 737018 - DNA, 25 bp, Mus musculus
taacgtcatcaaccaggacacgagt

SEQ ID NO: 737019 - DNA, 25 bp, Mus musculus
taacgtcatcaagcaggacacgagt

SEQ ID NO: 737020 - DNA, 25 bp, Mus musculus
taacgtcattgcatgttcacaggat

SEQ ID NO: 737021 - DNA, 25 bp, Mus musculus
taacgtcattgcttgttcacaggat

SEQ ID NO: 737022 - DNA, 25 bp, Mus musculus
taacgtccgagcatactgtcccgtg

SEQ ID NO: 737023 - DNA, 25 bp, Mus musculus
taacgtccgagcttactgtcccgtg

SEQ ID NO: 737024 - DNA, 25 bp, Mus musculus
taacgtccggtgaatttccagcagc

SEQ ID NO: 737025 - DNA, 25 bp, Mus musculus
taacgtccggtgtatttccagcagc

SEQ ID NO: 737026 - DNA, 25 bp, Mus musculus
taacgtctcgccagaagcttctggg

SEQ ID NO: 737027 - DNA, 25 bp, Mus musculus
taacgtctcgcctgaagcttctggg

SEQ ID NO: 737028 - DNA, 25 bp, Mus musculus
taacgtctctggatgcaactgggaa

SEQ ID NO: 737029 - DNA, 25 bp, Mus musculus
taacgtctctggttgcaactgggaa

SEQ ID NO: 737030 - DNA, 25 bp, Mus musculus
taacgtctgaacaactgaaatccca

SEQ ID NO: 737031 - DNA, 25 bp, Mus musculus
taacgtctgaactactgaaatccca

SEQ ID NO: 737032 - DNA, 25 bp, Mus musculus
taacgtctgcgaccactgcctagta

SEQ ID NO: 737033 - DNA, 25 bp, Mus musculus
taacgtctgcgagcactgcctagta

SEQ ID NO: 737034 - DNA, 25 bp, Mus musculus
taacgtcttcttaggtgactgtccc

SEQ ID NO: 737035 - DNA, 25 bp, Mus musculus
taacgtcttctttggtgactgtccc

SEQ ID NO: 737036 - DNA, 25 bp, Mus musculus
taacgtgacagaccggatcagaggc

SEQ ID NO: 737037 - DNA, 25 bp, Mus musculus
taacgtgacagagcggatcagaggc

SEQ ID NO: 737038 - DNA, 25 bp, Mus musculus
taacgtgcacggagacgccattctc

SEQ ID NO: 737039 - DNA, 25 bp, Mus musculus
taacgtgcacggtgacgccattctc

SEQ ID NO: 737040 - DNA, 25 bp, Mus musculus
taacgtggccctactcagatcacct

SEQ ID NO: 737041 - DNA, 25 bp, Mus musculus
taacgtggcccttctcagatcacct

SEQ ID NO: 737042 - DNA, 25 bp, Mus musculus
taacgtgggaacagccatcagcaag

SEQ ID NO: 737043 - DNA, 25 bp, Mus musculus
taacgtgggaactgccatcagcaag

SEQ ID NO: 737044 - DNA, 25 bp, Mus musculus
taacgtggtgatccccacaggcctg

SEQ ID NO: 737045 - DNA, 25 bp, Mus musculus
taacgtggtgatgcccacaggcctg

SEQ ID NO: 737046 - DNA, 25 bp, Mus musculus
taacgtggtggtcctttcgccggaa

SEQ ID NO: 737047 - DNA, 25 bp, Mus musculus
taacgtggtggtgctttcgccggaa

SEQ ID NO: 737048 - DNA, 25 bp, Mus musculus
taacgtgtaagcatgaatcagaacg

SEQ ID NO: 737049 - DNA, 25 bp, Mus musculus
taacgtgtaagcttgaatcagaacg

SEQ ID NO: 737050 - DNA, 25 bp, Mus musculus
taacgttagattctcataggaccag

SEQ ID NO: 737051 - DNA, 25 bp, Mus musculus
taacgttagattgtcataggaccag

SEQ ID NO: 737052 - DNA, 25 bp, Mus musculus
taacgttcatgtctacagcaatggc

SEQ ID NO: 737053 - DNA, 25 bp, Mus musculus
taacgttcatgtgtacagcaatggc

SEQ ID NO: 737054 - DNA, 25 bp, Mus musculus
taacgttgagttagatgactctcag

SEQ ID NO: 737055 - DNA, 25 bp, Mus musculus
taacgttgagtttgatgactctcag

SEQ ID NO: 737056 - DNA, 25 bp, Mus musculus
taacgttgggccaccgtgtcagtgg

SEQ ID NO: 737057 - DNA, 25 bp, Mus musculus
taacgttgggcctccgtgtcagtgg

SEQ ID NO: 737058 - DNA, 25 bp, Mus musculus
taacgtttacacctgtctttccaag

SEQ ID NO: 737059 - DNA, 25 bp, Mus musculus
taacgtttacacgtgtctttccaag

SEQ ID NO: 737060 - DNA, 25 bp, Mus musculus
taacgtttgccaacggacagctgac

SEQ ID NO: 737061 - DNA, 25 bp, Mus musculus
taacgtttgccatcggacagctgac

SEQ ID NO: 737062 - DNA, 25 bp, Mus musculus
taacgtttttctcgcaaaccattca

SEQ ID NO: 737063 - DNA, 25 bp, Mus musculus
taacgtttttctggcaaaccattca

SEQ ID NO: 737064 - DNA, 25 bp, Mus musculus
taactaaactccagattctagaact

SEQ ID NO: 737065 - DNA, 25 bp, Mus musculus
taactaaactcctgattctagaact

SEQ ID NO: 737066 - DNA, 25 bp, Mus musculus
taactaacagggataggcagagcac

SEQ ID NO: 737067 - DNA, 25 bp, Mus musculus
taactaacagggttaggcagagcac

SEQ ID NO: 737068 - DNA, 25 bp, Mus musculus
taactaacctatctccgaataacgg

SEQ ID NO: 737069 - DNA, 25 bp, Mus musculus
taactaacctatgtccgaataacgg

SEQ ID NO: 737070 - DNA, 25 bp, Mus musculus
taactaacgagcaaaagctggccct

SEQ ID NO: 737071 - DNA, 25 bp, Mus musculus
taactaacgagctaaagctggccct

SEQ ID NO: 737072 - DNA, 25 bp, Mus musculus
taactaagagttccgagcctgtccc

SEQ ID NO: 737073 - DNA, 25 bp, Mus musculus
taactaagagttgcgagcctgtccc

SEQ ID NO: 737074 - DNA, 25 bp, Mus musculus
taactaatcagaagacaacaaagat

SEQ ID NO: 737075 - DNA, 25 bp, Mus musculus
taactaatcagatgacaacaaagat

SEQ ID NO: 737076 - DNA, 25 bp, Mus musculus
taactaatgcctcactttgccttct

SEQ ID NO: 737077 - DNA, 25 bp, Mus musculus
taactaatgcctgactttgccttct

SEQ ID NO: 737078 - DNA, 25 bp, Mus musculus
taactaatgttgaatgaccgcactg

SEQ ID NO: 737079 - DNA, 25 bp, Mus musculus
taactaatgttgtatgaccgcactg

SEQ ID NO: 737080 - DNA, 25 bp, Mus musculus
taactacaagcaccgtgtgcaggga

SEQ ID NO: 737081 - DNA, 25 bp, Mus musculus
taactacaagcagcgtgtgcaggga

SEQ ID NO: 737082 - DNA, 25 bp, Mus musculus
taactacaagctacggttcacagtg

SEQ ID NO: 737083 - DNA, 25 bp, Mus musculus
taactacaagcttcggttcacagtg

SEQ ID NO: 737084 - DNA, 25 bp, Mus musculus
taactacaatacataccggtcacgg

SEQ ID NO: 737085 - DNA, 25 bp, Mus musculus
taactacaatacttaccggtcacgg

SEQ ID NO: 737086 - DNA, 25 bp, Mus musculus
taactacatgcacaactcccaggtc

SEQ ID NO: 737087 - DNA, 25 bp, Mus musculus
taactacatgcagaactcccaggtc

SEQ ID NO: 737088 - DNA, 25 bp, Mus musculus
taactacatggaaaagacttctgac

SEQ ID NO: 737089 - DNA, 25 bp, Mus musculus
taactacatggataagacttctgac

SEQ ID NO: 737090 - DNA, 25 bp, Mus musculus
taactaccacctagaaaacgcaggc

SEQ ID NO: 737091 - DNA, 25 bp, Mus musculus
taactaccaccttgaaaacgcaggc

SEQ ID NO: 737092 - DNA, 25 bp, Mus musculus
taactaccataactagtcaagtttg

SEQ ID NO: 737093 - DNA, 25 bp, Mus musculus
taactaccataagtagtcaagtttg

SEQ ID NO: 737094 - DNA, 25 bp, Mus musculus
taactacctcccaaacgagcaggac

SEQ ID NO: 737095 - DNA, 25 bp, Mus musculus
taactacctccctaacgagcaggac

SEQ ID NO: 737096 - DNA, 25 bp, Mus musculus
taactactatagcttcagctactgg

SEQ ID NO: 737097 - DNA, 25 bp, Mus musculus
taactactataggttcagctactgg

SEQ ID NO: 737098 - DNA, 25 bp, Mus musculus
taactactatgtcgacacagctgtg

SEQ ID NO: 737099 - DNA, 25 bp, Mus musculus
taactactatgtggacacagctgtg

SEQ ID NO: 737100 - DNA, 25 bp, Mus musculus
taactactgctgctcaccgttgaga

SEQ ID NO: 737101 - DNA, 25 bp, Mus musculus
taactactgctggtcaccgttgaga

SEQ ID NO: 737102 - DNA, 25 bp, Mus musculus
taactagcccaaagtacagattctg

SEQ ID NO: 737103 - DNA, 25 bp, Mus musculus
taactagcccaatgtacagattctg

SEQ ID NO: 737104 - DNA, 25 bp, Mus musculus
taactagcctacagaagccaacgag

SEQ ID NO: 737105 - DNA, 25 bp, Mus musculus
taactagcctactgaagccaacgag

SEQ ID NO: 737106 - DNA, 25 bp, Mus musculus
taactagcgaggagcgaactcggtg

SEQ ID NO: 737107 - DNA, 25 bp, Mus musculus
taactagcgaggtgcgaactcggtg

SEQ ID NO: 737108 - DNA, 25 bp, Mus musculus
taactaggaaagatgtagctccttc

SEQ ID NO: 737109 - DNA, 25 bp, Mus musculus
taactaggaaagttgtagctccttc

SEQ ID NO: 737110 - DNA, 25 bp, Mus musculus
taactagggacccttcagctgccca

SEQ ID NO: 737111 - DNA, 25 bp, Mus musculus
taactagggaccgttcagctgccca

SEQ ID NO: 737112 - DNA, 25 bp, Mus musculus
taactaggtcggcagacttcagatg

SEQ ID NO: 737113 - DNA, 25 bp, Mus musculus
taactaggtcgggagacttcagatg

SEQ ID NO: 737114 - DNA, 25 bp, Mus musculus
taactaggttccattgggagcctgg

SEQ ID NO: 737115 - DNA, 25 bp, Mus musculus
taactaggttcctttgggagcctgg

SEQ ID NO: 737116 - DNA, 25 bp, Mus musculus
taactagtctctacctagggtgcca

SEQ ID NO: 737117 - DNA, 25 bp, Mus musculus
taactagtctcttcctagggtgcca

SEQ ID NO: 737118 - DNA, 25 bp, Mus musculus
taactagtctgaaggttcctaggca

SEQ ID NO: 737119 - DNA, 25 bp, Mus musculus
taactagtctgatggttcctaggca

SEQ ID NO: 737120 - DNA, 25 bp, Mus musculus
taactagtgtgacttaattcaatgc

SEQ ID NO: 737121 - DNA, 25 bp, Mus musculus
taactagtgtgagttaattcaatgc

SEQ ID NO: 737122 - DNA, 25 bp, Mus musculus
taactatgacgacgatgagaagaaa

SEQ ID NO: 737123 - DNA, 25 bp, Mus musculus
taactatgacgaggatgagaagaaa

SEQ ID NO: 737124 - DNA, 25 bp, Mus musculus
taactatgagtgcatctggaaagct

SEQ ID NO: 737125 - DNA, 25 bp, Mus musculus
taactatgagtggatctggaaagct

SEQ ID NO: 737126 - DNA, 25 bp, Mus musculus
taactatgccaccaccgttcaagtg

SEQ ID NO: 737127 - DNA, 25 bp, Mus musculus
taactatgccacgaccgttcaagtg

SEQ ID NO: 737128 - DNA, 25 bp, Mus musculus
taactatggaaacgaccgactggga

SEQ ID NO: 737129 - DNA, 25 bp, Mus musculus
taactatggaaaggaccgactggga

SEQ ID NO: 737130 - DNA, 25 bp, Mus musculus
taactattatcaccgacgtaatgag

SEQ ID NO: 737131 - DNA, 25 bp, Mus musculus
taactattatcagcgacgtaatgag

SEQ ID NO: 737132 - DNA, 25 bp, Mus musculus
taactattatgaacaaggatatgga

SEQ ID NO: 737133 - DNA, 25 bp, Mus musculus
taactattatgatcaaggatatgga

SEQ ID NO: 737134 - DNA, 25 bp, Mus musculus
taactattcagactgggaaaataca

SEQ ID NO: 737135 - DNA, 25 bp, Mus musculus
taactattcagagtgggaaaataca

SEQ ID NO: 737136 - DNA, 25 bp, Mus musculus
taactcaaatgaagggacccatcca

SEQ ID NO: 737137 - DNA, 25 bp, Mus musculus
taactcaaatgatgggacccatcca

SEQ ID NO: 737138 - DNA, 25 bp, Mus musculus
taactcaaattgaggaaaaggagtc

SEQ ID NO: 737139 - DNA, 25 bp, Mus musculus
taactcaaattgtggaaaaggagtc

SEQ ID NO: 737140 - DNA, 25 bp, Mus musculus
taactcaagatacagctggaccaac

SEQ ID NO: 737141 - DNA, 25 bp, Mus musculus
taactcaagatagagctggaccaac

SEQ ID NO: 737142 - DNA, 25 bp, Mus musculus
taactcaagggcagtgtctgcccat

SEQ ID NO: 737143 - DNA, 25 bp, Mus musculus
taactcaagggctgtgtctgcccat

SEQ ID NO: 737144 - DNA, 25 bp, Mus musculus
taactcaagtgaacagacagaaaat

SEQ ID NO: 737145 - DNA, 25 bp, Mus musculus
taactcaagtgatcagacagaaaat

SEQ ID NO: 737146 - DNA, 25 bp, Mus musculus
taactcaatgtaccaggaattacag

SEQ ID NO: 737147 - DNA, 25 bp, Mus musculus
taactcaatgtagcaggaattacag

SEQ ID NO: 737148 - DNA, 25 bp, Mus musculus
taactcaattgtcaagtactttccc

SEQ ID NO: 737149 - DNA, 25 bp, Mus musculus
taactcaattgtgaagtactttccc

SEQ ID NO: 737150 - DNA, 25 bp, Mus musculus
taactcactatcagaggtgtaagga

SEQ ID NO: 737151 - DNA, 25 bp, Mus musculus
taactcactatctgaggtgtaagga

SEQ ID NO: 737152 - DNA, 25 bp, Mus musculus
taactcaggccgaaacttggcggcg

SEQ ID NO: 737153 - DNA, 25 bp, Mus musculus
taactcaggccgtaacttggcggcg

SEQ ID NO: 737154 - DNA, 25 bp, Mus musculus
taactcaggcgacgatggcaagcct

SEQ ID NO: 737155 - DNA, 25 bp, Mus musculus
taactcaggcgaggatggcaagcct

SEQ ID NO: 737156 - DNA, 25 bp, Mus musculus
taactcagggcaagtaggatctgga

SEQ ID NO: 737157 - DNA, 25 bp, Mus musculus
taactcagggcatgtaggatctgga

SEQ ID NO: 737158 - DNA, 25 bp, Mus musculus
taactcagtactcaccggatttttt

SEQ ID NO: 737159 - DNA, 25 bp, Mus musculus
taactcagtactgaccggatttttt

SEQ ID NO: 737160 - DNA, 25 bp, Mus musculus
taactccaaggtcatgcaagaagaa

SEQ ID NO: 737161 - DNA, 25 bp, Mus musculus
taactccaaggtgatgcaagaagaa

SEQ ID NO: 737162 - DNA, 25 bp, Mus musculus
taactccagaatctaccaaaacggg

SEQ ID NO: 737163 - DNA, 25 bp, Mus musculus
taactccagaatgtaccaaaacggg

SEQ ID NO: 737164 - DNA, 25 bp, Mus musculus
taactccagcaaagccactagcagc

SEQ ID NO: 737165 - DNA, 25 bp, Mus musculus
taactccagcaatgccactagcagc

SEQ ID NO: 737166 - DNA, 25 bp, Mus musculus
taactccagtgtagtggctctctaa

SEQ ID NO: 737167 - DNA, 25 bp, Mus musculus
taactccagtgttgtggctctctaa

SEQ ID NO: 737168 - DNA, 25 bp, Mus musculus
taactccagttcagaagggtcagcc

SEQ ID NO: 737169 - DNA, 25 bp, Mus musculus
taactccagttctgaagggtcagcc

SEQ ID NO: 737170 - DNA, 25 bp, Mus musculus
taactccatcaacctggtgaatctg

SEQ ID NO: 737171 - DNA, 25 bp, Mus musculus
taactccatcaagctggtgaatctg

SEQ ID NO: 737172 - DNA, 25 bp, Mus musculus
taactccgcagacggtagcgacaga

SEQ ID NO: 737173 - DNA, 25 bp, Mus musculus
taactccgcagagggtagcgacaga

SEQ ID NO: 737174 - DNA, 25 bp, Mus musculus
taactcctccaactccgtgttcagt

SEQ ID NO: 737175 - DNA, 25 bp, Mus musculus
taactcctccaagtccgtgttcagt

SEQ ID NO: 737176 - DNA, 25 bp, Mus musculus
taactcctggtgctttgtactactg

SEQ ID NO: 737177 - DNA, 25 bp, Mus musculus
taactcctggtggtttgtactactg

SEQ ID NO: 737178 - DNA, 25 bp, Mus musculus
taactccttaggctgcagagataca

SEQ ID NO: 737179 - DNA, 25 bp, Mus musculus
taactccttagggtgcagagataca

SEQ ID NO: 737180 - DNA, 25 bp, Mus musculus
taactcggaacacgtctaagggcat

SEQ ID NO: 737181 - DNA, 25 bp, Mus musculus
taactcggaacaggtctaagggcat

SEQ ID NO: 737182 - DNA, 25 bp, Mus musculus
taactcggagacaccagcaggagcg

SEQ ID NO: 737183 - DNA, 25 bp, Mus musculus
taactcggagactccagcaggagcg

SEQ ID NO: 737184 - DNA, 25 bp, Mus musculus
taactcggcaggaaaaggtacttgc

SEQ ID NO: 737185 - DNA, 25 bp, Mus musculus
taactcggcaggtaaaggtacttgc

SEQ ID NO: 737186 - DNA, 25 bp, Mus musculus
taactcggcctactcaatgagaacg

SEQ ID NO: 737187 - DNA, 25 bp, Mus musculus
taactcggcctagtcaatgagaacg

SEQ ID NO: 737188 - DNA, 25 bp, Mus musculus
taactcggctgcagcaggtcatgaa

SEQ ID NO: 737189 - DNA, 25 bp, Mus musculus
taactcggctgctgcaggtcatgaa

SEQ ID NO: 737190 - DNA, 25 bp, Mus musculus
taactcgtatgacgtgaagctgtcc

SEQ ID NO: 737191 - DNA, 25 bp, Mus musculus
taactcgtatgaggtgaagctgtcc

SEQ ID NO: 737192 - DNA, 25 bp, Mus musculus
taactctacatcagagaagtcgccc

SEQ ID NO: 737193 - DNA, 25 bp, Mus musculus
taactctacatctgagaagtcgccc

SEQ ID NO: 737194 - DNA, 25 bp, Mus musculus
taactctcgcctatgggttgctatg

SEQ ID NO: 737195 - DNA, 25 bp, Mus musculus
taactctcgcctttgggttgctatg

SEQ ID NO: 737196 - DNA, 25 bp, Mus musculus
taactctctgctattgttccaggga

SEQ ID NO: 737197 - DNA, 25 bp, Mus musculus
taactctctgcttttgttccaggga

SEQ ID NO: 737198 - DNA, 25 bp, Mus musculus
taactctcttcactattcctaggag

SEQ ID NO: 737199 - DNA, 25 bp, Mus musculus
taactctcttcagtattcctaggag

SEQ ID NO: 737200 - DNA, 25 bp, Mus musculus
taactctgaccaaaaatgctgaggc

SEQ ID NO: 737201 - DNA, 25 bp, Mus musculus
taactctgaccataaatgctgaggc

SEQ ID NO: 737202 - DNA, 25 bp, Mus musculus
taactctgctgtatgctgcatgctg

SEQ ID NO: 737203 - DNA, 25 bp, Mus musculus
taactctgctgtttgctgcatgctg

SEQ ID NO: 737204 - DNA, 25 bp, Mus musculus
taactctgggcccaaactagctgtg

SEQ ID NO: 737205 - DNA, 25 bp, Mus musculus
taactctgggccgaaactagctgtg

SEQ ID NO: 737206 - DNA, 25 bp, Mus musculus
taactctggttacatatgaatgtga

SEQ ID NO: 737207 - DNA, 25 bp, Mus musculus
taactctggttagatatgaatgtga

SEQ ID NO: 737208 - DNA, 25 bp, Mus musculus
taactcttacacagatgtgatgtgc

SEQ ID NO: 737209 - DNA, 25 bp, Mus musculus
taactcttacactgatgtgatgtgc

SEQ ID NO: 737210 - DNA, 25 bp, Mus musculus
taactgaatacaataacggtgctaa

SEQ ID NO: 737211 - DNA, 25 bp, Mus musculus
taactgaatacattaacggtgctaa

SEQ ID NO: 737212 - DNA, 25 bp, Mus musculus
taactgaccagtagtcccagtgtcg

SEQ ID NO: 737213 - DNA, 25 bp, Mus musculus
taactgaccagttgtcccagtgtcg

SEQ ID NO: 737214 - DNA, 25 bp, Mus musculus
taactgactaaccatgccaccgatg

SEQ ID NO: 737215 - DNA, 25 bp, Mus musculus
taactgactaacgatgccaccgatg

SEQ ID NO: 737216 - DNA, 25 bp, Mus musculus
taactgagcgtgctctgcaaggctg

SEQ ID NO: 737217 - DNA, 25 bp, Mus musculus
taactgagcgtggtctgcaaggctg

SEQ ID NO: 737218 - DNA, 25 bp, Mus musculus
taactgaggcggaagcatagcttgt

SEQ ID NO: 737219 - DNA, 25 bp, Mus musculus
taactgaggcggtagcatagcttgt

SEQ ID NO: 737220 - DNA, 25 bp, Mus musculus
taactgatactacgtcccacggaag

SEQ ID NO: 737221 - DNA, 25 bp, Mus musculus
taactgatactaggtcccacggaag

SEQ ID NO: 737222 - DNA, 25 bp, Mus musculus
taactgcaaatacgacgggcatcgc

SEQ ID NO: 737223 - DNA, 25 bp, Mus musculus
taactgcaaataggacgggcatcgc

SEQ ID NO: 737224 - DNA, 25 bp, Mus musculus
taactgcaagctaaagaccaaccac

SEQ ID NO: 737225 - DNA, 25 bp, Mus musculus
taactgcaagcttaagaccaaccac

SEQ ID NO: 737226 - DNA, 25 bp, Mus musculus
taactgcacagtagcccttagctgc

SEQ ID NO: 737227 - DNA, 25 bp, Mus musculus
taactgcacagttgcccttagctgc

SEQ ID NO: 737228 - DNA, 25 bp, Mus musculus
taactgcacccgcacgtttgtcact

SEQ ID NO: 737229 - DNA, 25 bp, Mus musculus
taactgcacccggacgtttgtcact

SEQ ID NO: 737230 - DNA, 25 bp, Mus musculus
taactgcacgagactccatggccaa

SEQ ID NO: 737231 - DNA, 25 bp, Mus musculus
taactgcacgagtctccatggccaa

SEQ ID NO: 737232 - DNA, 25 bp, Mus musculus
taactgcagagcacaaatgaagcag

SEQ ID NO: 737233 - DNA, 25 bp, Mus musculus
taactgcagagctcaaatgaagcag

SEQ ID NO: 737234 - DNA, 25 bp, Mus musculus
taactgcaggagagtccagcatctg

SEQ ID NO: 737235 - DNA, 25 bp, Mus musculus
taactgcaggagtgtccagcatctg

SEQ ID NO: 737236 - DNA, 25 bp, Mus musculus
taactgcagtcaccaacaatgcagg

SEQ ID NO: 737237 - DNA, 25 bp, Mus musculus
taactgcagtcagcaacaatgcagg

SEQ ID NO: 737238 - DNA, 25 bp, Mus musculus
taactgcattctagtagtcccttgg

SEQ ID NO: 737239 - DNA, 25 bp, Mus musculus
taactgcattcttgtagtcccttgg

SEQ ID NO: 737240 - DNA, 25 bp, Mus musculus
taactgccaagcagctctccagaca

SEQ ID NO: 737241 - DNA, 25 bp, Mus musculus
taactgccaagctgctctccagaca

SEQ ID NO: 737242 - DNA, 25 bp, Mus musculus
taactgccagcgagatatctctgtc

SEQ ID NO: 737243 - DNA, 25 bp, Mus musculus
taactgccagcgtgatatctctgtc

SEQ ID NO: 737244 - DNA, 25 bp, Mus musculus
taactgccatagaaatggctgaagg

SEQ ID NO: 737245 - DNA, 25 bp, Mus musculus
taactgccatagtaatggctgaagg

SEQ ID NO: 737246 - DNA, 25 bp, Mus musculus
taactgcccttcaaatggcatgagg

SEQ ID NO: 737247 - DNA, 25 bp, Mus musculus
taactgcccttctaatggcatgagg

SEQ ID NO: 737248 - DNA, 25 bp, Mus musculus
taactgcctattcagctgtaccatg

SEQ ID NO: 737249 - DNA, 25 bp, Mus musculus
taactgcctattgagctgtaccatg

SEQ ID NO: 737250 - DNA, 25 bp, Mus musculus
taactgccttggcaagagctccacc

SEQ ID NO: 737251 - DNA, 25 bp, Mus musculus
taactgccttgggaagagctccacc

SEQ ID NO: 737252 - DNA, 25 bp, Mus musculus
taactgcggcagaaaagtccttcgg

SEQ ID NO: 737253 - DNA, 25 bp, Mus musculus
taactgcggcagcatttactgctgg

SEQ ID NO: 737254 - DNA, 25 bp, Mus musculus
taactgcggcaggatttactgctgg

SEQ ID NO: 737255 - DNA, 25 bp, Mus musculus
taactgcggcagtaaagtccttcgg

SEQ ID NO: 737256 - DNA, 25 bp, Mus musculus
taactgcggcatcgagatctactac

SEQ ID NO: 737257 - DNA, 25 bp, Mus musculus
taactgcggcatggagatctactac

SEQ ID NO: 737258 - DNA, 25 bp, Mus musculus
taactgcgggtcattcctgaatcac

SEQ ID NO: 737259 - DNA, 25 bp, Mus musculus
taactgcgggtctttcctgaatcac

SEQ ID NO: 737260 - DNA, 25 bp, Mus musculus
taactgctccgacgagatcaacgag

SEQ ID NO: 737261 - DNA, 25 bp, Mus musculus
taactgctccgaggagatcaacgag

SEQ ID NO: 737262 - DNA, 25 bp, Mus musculus
taactgctgggcctatgagactggc

SEQ ID NO: 737263 - DNA, 25 bp, Mus musculus
taactgctgggcgtatgagactggc

SEQ ID NO: 737264 - DNA, 25 bp, Mus musculus
taactgctgttgacaccaggaagcc

SEQ ID NO: 737265 - DNA, 25 bp, Mus musculus
taactgctgttgtcaccaggaagcc

SEQ ID NO: 737266 - DNA, 25 bp, Mus musculus
taactggacagaagcccacagagga

SEQ ID NO: 737267 - DNA, 25 bp, Mus musculus
taactggacagatgcccacagagga

SEQ ID NO: 737268 - DNA, 25 bp, Mus musculus
taactggaccacatcgttctgggac

SEQ ID NO: 737269 - DNA, 25 bp, Mus musculus
taactggaccacttcgttctgggac

SEQ ID NO: 737270 - DNA, 25 bp, Mus musculus
taactggatccacatatgcaccaat

SEQ ID NO: 737271 - DNA, 25 bp, Mus musculus
taactggatccagatatgcaccaat

SEQ ID NO: 737272 - DNA, 25 bp, Mus musculus
taactggatggacggactggaacct

SEQ ID NO: 737273 - DNA, 25 bp, Mus musculus
taactggatggagggactggaacct

SEQ ID NO: 737274 - DNA, 25 bp, Mus musculus
taactggccggcctgacatgcaaaa

SEQ ID NO: 737275 - DNA, 25 bp, Mus musculus
taactggccggcgtgacatgcaaaa

SEQ ID NO: 737276 - DNA, 25 bp, Mus musculus
taactggctaagagagttccagcta

SEQ ID NO: 737277 - DNA, 25 bp, Mus musculus
taactggctaagtgagttccagcta

SEQ ID NO: 737278 - DNA, 25 bp, Mus musculus
taactggctagactatcaaaccaac

SEQ ID NO: 737279 - DNA, 25 bp, Mus musculus
taactggctagagtatcaaaccaac

SEQ ID NO: 737280 - DNA, 25 bp, Mus musculus
taactggctgggatcagtagcacgc

SEQ ID NO: 737281 - DNA, 25 bp, Mus musculus
taactggctgggttcagtagcacgc

SEQ ID NO: 737282 - DNA, 25 bp, Mus musculus
taactgggctttacccgcatcaccg

SEQ ID NO: 737283 - DNA, 25 bp, Mus musculus
taactgggcttttcccgcatcaccg

SEQ ID NO: 737284 - DNA, 25 bp, Mus musculus
taactggggctaagactctgatggg

SEQ ID NO: 737285 - DNA, 25 bp, Mus musculus
taactggggctatgactctgatggg

SEQ ID NO: 737286 - DNA, 25 bp, Mus musculus
taactgggtcacagaagacttgctg

SEQ ID NO: 737287 - DNA, 25 bp, Mus musculus
taactgggtcactgaagacttgctg

SEQ ID NO: 737288 - DNA, 25 bp, Mus musculus
taactggtcagaaacgctgtcacgg

SEQ ID NO: 737289 - DNA, 25 bp, Mus musculus
taactggtcagatacgctgtcacgg

SEQ ID NO: 737290 - DNA, 25 bp, Mus musculus
taactggtccacaataggttttggc

SEQ ID NO: 737291 - DNA, 25 bp, Mus musculus
taactggtccactataggttttggc

SEQ ID NO: 737292 - DNA, 25 bp, Mus musculus
taactggtgcacaaattacatcagg

SEQ ID NO: 737293 - DNA, 25 bp, Mus musculus
taactggtgcactaattacatcagg

SEQ ID NO: 737294 - DNA, 25 bp, Mus musculus
taactggtgtgacagaaaaggacct

SEQ ID NO: 737295 - DNA, 25 bp, Mus musculus
taactggtgtgagagaaaaggacct

SEQ ID NO: 737296 - DNA, 25 bp, Mus musculus
taactgtagaagcacagcagaaggt

SEQ ID NO: 737297 - DNA, 25 bp, Mus musculus
taactgtagaaggacagcagaaggt

SEQ ID NO: 737298 - DNA, 25 bp, Mus musculus
taactgtcaggacgaagatcttcta

SEQ ID NO: 737299 - DNA, 25 bp, Mus musculus
taactgtcaggaggaagatcttcta

SEQ ID NO: 737300 - DNA, 25 bp, Mus musculus
taactgtcaggtacaggagaatgtc

SEQ ID NO: 737301 - DNA, 25 bp, Mus musculus
taactgtcaggttcaggagaatgtc

SEQ ID NO: 737302 - DNA, 25 bp, Mus musculus
taactgtccaagactacagaacaag

SEQ ID NO: 737303 - DNA, 25 bp, Mus musculus
taactgtccaagtctacagaacaag

SEQ ID NO: 737304 - DNA, 25 bp, Mus musculus
taactgtctgatcagagcaattgag

SEQ ID NO: 737305 - DNA, 25 bp, Mus musculus
taactgtctgatgagagcaattgag

SEQ ID NO: 737306 - DNA, 25 bp, Mus musculus
taactgtgatacaactgaggtgccc

SEQ ID NO: 737307 - DNA, 25 bp, Mus musculus
taactgtgatactactgaggtgccc

SEQ ID NO: 737308 - DNA, 25 bp, Mus musculus
taactgtgccatcatgtcagcttct

SEQ ID NO: 737309 - DNA, 25 bp, Mus musculus
taactgtgccatgatgtcagcttct

SEQ ID NO: 737310 - DNA, 25 bp, Mus musculus
taactgtgctgccttcttcgagggc

SEQ ID NO: 737311 - DNA, 25 bp, Mus musculus
taactgtgctgcgttcttcgagggc

SEQ ID NO: 737312 - DNA, 25 bp, Mus musculus
taactgtggattctgaactcaggaa

SEQ ID NO: 737313 - DNA, 25 bp, Mus musculus
taactgtggattgtgaactcaggaa

SEQ ID NO: 737314 - DNA, 25 bp, Mus musculus
taactgtggtgaagcccagcctcac

SEQ ID NO: 737315 - DNA, 25 bp, Mus musculus
taactgtggtgatgcccagcctcac

SEQ ID NO: 737316 - DNA, 25 bp, Mus musculus
taactgtggttacccctgtcctgaa

SEQ ID NO: 737317 - DNA, 25 bp, Mus musculus
taactgtggttagccctgtcctgaa

SEQ ID NO: 737318 - DNA, 25 bp, Mus musculus
taactgtgtgcaccttcttaagcag

SEQ ID NO: 737319 - DNA, 25 bp, Mus musculus
taactgtgtgcagcttcttaagcag

SEQ ID NO: 737320 - DNA, 25 bp, Mus musculus
taactgtgtggtctccaggcctggc

SEQ ID NO: 737321 - DNA, 25 bp, Mus musculus
taactgtgtggtgtccaggcctggc

SEQ ID NO: 737322 - DNA, 25 bp, Mus musculus
taactgttagcgacctcttggcaca

SEQ ID NO: 737323 - DNA, 25 bp, Mus musculus
taactgttagcgtcctcttggcaca

SEQ ID NO: 737324 - DNA, 25 bp, Mus musculus
taactgttagggacttgggagatgc

SEQ ID NO: 737325 - DNA, 25 bp, Mus musculus
taactgttagggtcttgggagatgc

SEQ ID NO: 737326 - DNA, 25 bp, Mus musculus
taactgttgagccaaaattgcatcg

SEQ ID NO: 737327 - DNA, 25 bp, Mus musculus
taactgttgagcgaaaattgcatcg

SEQ ID NO: 737328 - DNA, 25 bp, Mus musculus
taactgttggttcaggccattgagc

SEQ ID NO: 737329 - DNA, 25 bp, Mus musculus
taactgttggttgaggccattgagc

SEQ ID NO: 737330 - DNA, 25 bp, Mus musculus
taactgtttacaagacagcggacag

SEQ ID NO: 737331 - DNA, 25 bp, Mus musculus
taactgtttacatgacagcggacag

SEQ ID NO: 737332 - DNA, 25 bp, Mus musculus
taactgtttgcacaggcttagtcaa

SEQ ID NO: 737333 - DNA, 25 bp, Mus musculus
taactgtttgcagaggcttagtcaa

SEQ ID NO: 737334 - DNA, 25 bp, Mus musculus
taacttaagctcatgcaaacaggag

SEQ ID NO: 737335 - DNA, 25 bp, Mus musculus
taacttaagctcttgcaaacaggag

SEQ ID NO: 737336 - DNA, 25 bp, Mus musculus
taacttaagtggctgcagaaccagc

SEQ ID NO: 737337 - DNA, 25 bp, Mus musculus
taacttaagtgggtgcagaaccagc

SEQ ID NO: 737338 - DNA, 25 bp, Mus musculus
taacttagcactagtaaagcctgaa

SEQ ID NO: 737339 - DNA, 25 bp, Mus musculus
taacttagcacttgtaaagcctgaa

SEQ ID NO: 737340 - DNA, 25 bp, Mus musculus
taacttagcttcatccatgtccgca

SEQ ID NO: 737341 - DNA, 25 bp, Mus musculus
taacttagcttcttccatgtccgca

SEQ ID NO: 737342 - DNA, 25 bp, Mus musculus
taacttatatgacggtattgaggac

SEQ ID NO: 737343 - DNA, 25 bp, Mus musculus
taacttatatgagggtattgaggac

SEQ ID NO: 737344 - DNA, 25 bp, Mus musculus
taacttcaaaagagagtgggaggtc

SEQ ID NO: 737345 - DNA, 25 bp, Mus musculus
taacttcaaaagtgagtgggaggtc

SEQ ID NO: 737346 - DNA, 25 bp, Mus musculus
taacttcaaacacgaggtaccatgg

SEQ ID NO: 737347 - DNA, 25 bp, Mus musculus
taacttcaaacaggaggtaccatgg

SEQ ID NO: 737348 - DNA, 25 bp, Mus musculus
taacttcaacatcttcgagggcatg

SEQ ID NO: 737349 - DNA, 25 bp, Mus musculus
taacttcaacatgttcgagggcatg

SEQ ID NO: 737350 - DNA, 25 bp, Mus musculus
taacttcagtaaacaggctacggaa

SEQ ID NO: 737351 - DNA, 25 bp, Mus musculus
taacttcagtaatcaggctacggaa

SEQ ID NO: 737352 - DNA, 25 bp, Mus musculus
taacttcatagcagcctgcacagag

SEQ ID NO: 737353 - DNA, 25 bp, Mus musculus
taacttcatagctgcctgcacagag

SEQ ID NO: 737354 - DNA, 25 bp, Mus musculus
taacttccaggtattgaaagggtga

SEQ ID NO: 737355 - DNA, 25 bp, Mus musculus
taacttccaggttttgaaagggtga

SEQ ID NO: 737356 - DNA, 25 bp, Mus musculus
taacttccagtcactcactctttgg

SEQ ID NO: 737357 - DNA, 25 bp, Mus musculus
taacttccagtctctcactctttgg

SEQ ID NO: 737358 - DNA, 25 bp, Mus musculus
taacttccctgcaggcattgagccc

SEQ ID NO: 737359 - DNA, 25 bp, Mus musculus
taacttccctgctggcattgagccc

SEQ ID NO: 737360 - DNA, 25 bp, Mus musculus
taacttccggatccctgtgcttcgc

SEQ ID NO: 737361 - DNA, 25 bp, Mus musculus
taacttccggatgcctgtgcttcgc

SEQ ID NO: 737362 - DNA, 25 bp, Mus musculus
taacttccgggaatcggtgggcctg

SEQ ID NO: 737363 - DNA, 25 bp, Mus musculus
taacttccgggattcggtgggcctg

SEQ ID NO: 737364 - DNA, 25 bp, Mus musculus
taacttccgggcagagcagcctcac

SEQ ID NO: 737365 - DNA, 25 bp, Mus musculus
taacttccgggctgagcagcctcac

SEQ ID NO: 737366 - DNA, 25 bp, Mus musculus
taacttcgatccatgctcccttctt

SEQ ID NO: 737367 - DNA, 25 bp, Mus musculus
taacttcgatccttgctcccttctt

SEQ ID NO: 737368 - DNA, 25 bp, Mus musculus
taacttcgcaatcaaaggaaagcgc

SEQ ID NO: 737369 - DNA, 25 bp, Mus musculus
taacttcgcaatgaaaggaaagcgc

SEQ ID NO: 737370 - DNA, 25 bp, Mus musculus
taacttcgcggaatagtgacagtca

SEQ ID NO: 737371 - DNA, 25 bp, Mus musculus
taacttcgcggattagtgacagtca

SEQ ID NO: 737372 - DNA, 25 bp, Mus musculus
taacttctagttccgctcgctttgg

SEQ ID NO: 737373 - DNA, 25 bp, Mus musculus
taacttctagttgcgctcgctttgg

SEQ ID NO: 737374 - DNA, 25 bp, Mus musculus
taacttctcacaagcatatacaatg

SEQ ID NO: 737375 - DNA, 25 bp, Mus musculus
taacttctcacatgcatatacaatg

SEQ ID NO: 737376 - DNA, 25 bp, Mus musculus
taacttctccacactgagggacagg

SEQ ID NO: 737377 - DNA, 25 bp, Mus musculus
taacttctccactctgagggacagg

SEQ ID NO: 737378 - DNA, 25 bp, Mus musculus
taacttgaacgacaggtgtaaacaa

SEQ ID NO: 737379 - DNA, 25 bp, Mus musculus
taacttgaacgagaggtgtaaacaa

SEQ ID NO: 737380 - DNA, 25 bp, Mus musculus
taacttgaccgtagatccagccacg

SEQ ID NO: 737381 - DNA, 25 bp, Mus musculus
taacttgaccgttgatccagccacg

SEQ ID NO: 737382 - DNA, 25 bp, Mus musculus
taacttgctttcctccttcccaggg

SEQ ID NO: 737383 - DNA, 25 bp, Mus musculus
taacttgctttcgtccttcccaggg

SEQ ID NO: 737384 - DNA, 25 bp, Mus musculus
taacttggatagctgtcagcgtgca

SEQ ID NO: 737385 - DNA, 25 bp, Mus musculus
taacttggataggtgtcagcgtgca

SEQ ID NO: 737386 - DNA, 25 bp, Mus musculus
taacttggcagtagtaacaccctcc

SEQ ID NO: 737387 - DNA, 25 bp, Mus musculus
taacttggcagttgtaacaccctcc

SEQ ID NO: 737388 - DNA, 25 bp, Mus musculus
taacttggccatcatgaaccccagc

SEQ ID NO: 737389 - DNA, 25 bp, Mus musculus
taacttggccatgatgaaccccagc

SEQ ID NO: 737390 - DNA, 25 bp, Mus musculus
taacttgggcaacactgtttacaaa

SEQ ID NO: 737391 - DNA, 25 bp, Mus musculus
taacttgggcaagactgtttacaaa

SEQ ID NO: 737392 - DNA, 25 bp, Mus musculus
taacttgggttccagtgtgccgagc

SEQ ID NO: 737393 - DNA, 25 bp, Mus musculus
taacttgggttcgagtgtgccgagc

SEQ ID NO: 737394 - DNA, 25 bp, Mus musculus
taacttggtaccagaatgggtggtg

SEQ ID NO: 737395 - DNA, 25 bp, Mus musculus
taacttggtacctgaatgggtggtg

SEQ ID NO: 737396 - DNA, 25 bp, Mus musculus
taacttggtccacaaagctaacaag

SEQ ID NO: 737397 - DNA, 25 bp, Mus musculus
taacttggtccagaaagctaacaag

SEQ ID NO: 737398 - DNA, 25 bp, Mus musculus
taacttgtagataccaggactttcc

SEQ ID NO: 737399 - DNA, 25 bp, Mus musculus
taacttgtagattccaggactttcc

SEQ ID NO: 737400 - DNA, 25 bp, Mus musculus
taacttgtcgtactgaactagcgga

SEQ ID NO: 737401 - DNA, 25 bp, Mus musculus
taacttgtcgtagtgaactagcgga

SEQ ID NO: 737402 - DNA, 25 bp, Mus musculus
taacttgtggccagcagtgctgacg

SEQ ID NO: 737403 - DNA, 25 bp, Mus musculus
taacttgtggcctgcagtgctgacg

SEQ ID NO: 737404 - DNA, 25 bp, Mus musculus
taacttgttctgcagcgggaatccc

SEQ ID NO: 737405 - DNA, 25 bp, Mus musculus
taacttgttctggagcgggaatccc

SEQ ID NO: 737406 - DNA, 25 bp, Mus musculus
taactttatgagcatgtatgatgcc

SEQ ID NO: 737407 - DNA, 25 bp, Mus musculus
taactttatgaggatgtatgatgcc

SEQ ID NO: 737408 - DNA, 25 bp, Mus musculus
taactttcattaccagtaaccctga

SEQ ID NO: 737409 - DNA, 25 bp, Mus musculus
taactttcattagcagtaaccctga

SEQ ID NO: 737410 - DNA, 25 bp, Mus musculus
taactttcatttcgctggatacatc

SEQ ID NO: 737411 - DNA, 25 bp, Mus musculus
taactttcatttggctggatacatc

SEQ ID NO: 737412 - DNA, 25 bp, Mus musculus
taactttctaaacaagcatgagaag

SEQ ID NO: 737413 - DNA, 25 bp, Mus musculus
taactttctaaagaagcatgagaag

SEQ ID NO: 737414 - DNA, 25 bp, Mus musculus
taactttgacagaagctaggagtcc

SEQ ID NO: 737415 - DNA, 25 bp, Mus musculus
taactttgacagtagctaggagtcc

SEQ ID NO: 737416 - DNA, 25 bp, Mus musculus
taactttgacgactatgaggaggaa

SEQ ID NO: 737417 - DNA, 25 bp, Mus musculus
taactttgacgagtatgaggaggaa

SEQ ID NO: 737418 - DNA, 25 bp, Mus musculus
taactttgagtgacccctgtctatg

SEQ ID NO: 737419 - DNA, 25 bp, Mus musculus
taactttgagtgtcccctgtctatg

SEQ ID NO: 737420 - DNA, 25 bp, Mus musculus
taactttgcggcagagccacagtca

SEQ ID NO: 737421 - DNA, 25 bp, Mus musculus
taactttgcggctgagccacagtca

SEQ ID NO: 737422 - DNA, 25 bp, Mus musculus
taactttgtgtcagcgtgcagtcca

SEQ ID NO: 737423 - DNA, 25 bp, Mus musculus
taactttgtgtctgcgtgcagtcca

SEQ ID NO: 737424 - DNA, 25 bp, Mus musculus
taactttgttctccgtgacccacgg

SEQ ID NO: 737425 - DNA, 25 bp, Mus musculus
taactttgttctgcgtgacccacgg

SEQ ID NO: 737426 - DNA, 25 bp, Mus musculus
taacttttgcatcgcccgttttgtc

SEQ ID NO: 737427 - DNA, 25 bp, Mus musculus
taacttttgcatggcccgttttgtc

SEQ ID NO: 737428 - DNA, 25 bp, Mus musculus
taagaaaacctgcttgacagaagtg

SEQ ID NO: 737429 - DNA, 25 bp, Mus musculus
taagaaaacctggttgacagaagtg

SEQ ID NO: 737430 - DNA, 25 bp, Mus musculus
taagaaaagactcaggcactgtgca

SEQ ID NO: 737431 - DNA, 25 bp, Mus musculus
taagaaaagactgaggcactgtgca

SEQ ID NO: 737432 - DNA, 25 bp, Mus musculus
taagaaaagcaaatagaaactgtca

SEQ ID NO: 737433 - DNA, 25 bp, Mus musculus
taagaaaagcaattagaaactgtca

SEQ ID NO: 737434 - DNA, 25 bp, Mus musculus
taagaaaattgacaaacggcgtcag

SEQ ID NO: 737435 - DNA, 25 bp, Mus musculus
taagaaaattgagaaacggcgtcag

SEQ ID NO: 737436 - DNA, 25 bp, Mus musculus
taagaaacagctacgtgaatgggat

SEQ ID NO: 737437 - DNA, 25 bp, Mus musculus
taagaaacagcttcgtgaatgggat

SEQ ID NO: 737438 - DNA, 25 bp, Mus musculus
taagaaacatcacggagataaattc

SEQ ID NO: 737439 - DNA, 25 bp, Mus musculus
taagaaacatcagggagataaattc

SEQ ID NO: 737440 - DNA, 25 bp, Mus musculus
taagaaaccagcaatttgtaaaagt

SEQ ID NO: 737441 - DNA, 25 bp, Mus musculus
taagaaaccagctatttgtaaaagt

SEQ ID NO: 737442 - DNA, 25 bp, Mus musculus
taagaaacgcagagttgtagacaca

SEQ ID NO: 737443 - DNA, 25 bp, Mus musculus
taagaaacgcagtgttgtagacaca

SEQ ID NO: 737444 - DNA, 25 bp, Mus musculus
taagaaacggaaaatcaatagcctc

SEQ ID NO: 737445 - DNA, 25 bp, Mus musculus
taagaaacggaatatcaatagcctc

SEQ ID NO: 737446 - DNA, 25 bp, Mus musculus
taagaaacggagcacatctgtgtgc

SEQ ID NO: 737447 - DNA, 25 bp, Mus musculus
taagaaacggaggacatctgtgtgc

SEQ ID NO: 737448 - DNA, 25 bp, Mus musculus
taagaaacgtttcctcagaagcggc

SEQ ID NO: 737449 - DNA, 25 bp, Mus musculus
taagaaacgtttgctcagaagcggc

SEQ ID NO: 737450 - DNA, 25 bp, Mus musculus
taagaaagccggagcgacaagcaag

SEQ ID NO: 737451 - DNA, 25 bp, Mus musculus
taagaaagccggtgcgacaagcaag

SEQ ID NO: 737452 - DNA, 25 bp, Mus musculus
taagaaaggcgtcactctgccagag

SEQ ID NO: 737453 - DNA, 25 bp, Mus musculus
taagaaaggcgtgactctgccagag

SEQ ID NO: 737454 - DNA, 25 bp, Mus musculus
taagaaaggctacctgaccctgtcg

SEQ ID NO: 737455 - DNA, 25 bp, Mus musculus
taagaaaggctagctgaccctgtcg

SEQ ID NO: 737456 - DNA, 25 bp, Mus musculus
taagaaaggtatcgtggtcagcaga

SEQ ID NO: 737457 - DNA, 25 bp, Mus musculus
taagaaaggtatggtggtcagcaga

SEQ ID NO: 737458 - DNA, 25 bp, Mus musculus
taagaaatatatcacagcaacccag

SEQ ID NO: 737459 - DNA, 25 bp, Mus musculus
taagaaatatatgacagcaacccag

SEQ ID NO: 737460 - DNA, 25 bp, Mus musculus
taagaaatctgaactaggcagctgc

SEQ ID NO: 737461 - DNA, 25 bp, Mus musculus
taagaaatctgatctaggcagctgc

SEQ ID NO: 737462 - DNA, 25 bp, Mus musculus
taagaaatgcctctgaagaatgttt

SEQ ID NO: 737463 - DNA, 25 bp, Mus musculus
taagaaatgcctgtgaagaatgttt

SEQ ID NO: 737464 - DNA, 25 bp, Mus musculus
taagaaatggacagtggaggccagt

SEQ ID NO: 737465 - DNA, 25 bp, Mus musculus
taagaaatggactgtggaggccagt

SEQ ID NO: 737466 - DNA, 25 bp, Mus musculus
taagaaatgggtactcaatcatgaa

SEQ ID NO: 737467 - DNA, 25 bp, Mus musculus
taagaaatgggttctcaatcatgaa

SEQ ID NO: 737468 - DNA, 25 bp, Mus musculus
taagaaattagtagagaagttcggg

SEQ ID NO: 737469 - DNA, 25 bp, Mus musculus
taagaaattagttgagaagttcggg

SEQ ID NO: 737470 - DNA, 25 bp, Mus musculus
taagaacaataaaccctggacttgg

SEQ ID NO: 737471 - DNA, 25 bp, Mus musculus
taagaacaataatccctggacttgg

SEQ ID NO: 737472 - DNA, 25 bp, Mus musculus
taagaacaattccatctgctgcacc

SEQ ID NO: 737473 - DNA, 25 bp, Mus musculus
taagaacaattcgatctgctgcacc

SEQ ID NO: 737474 - DNA, 25 bp, Mus musculus
taagaacactatacttcagagagca

SEQ ID NO: 737475 - DNA, 25 bp, Mus musculus
taagaacactattcttcagagagca

SEQ ID NO: 737476 - DNA, 25 bp, Mus musculus
taagaacagaaacacagaatgccct

SEQ ID NO: 737477 - DNA, 25 bp, Mus musculus
taagaacagaaagacagaatgccct

SEQ ID NO: 737478 - DNA, 25 bp, Mus musculus
taagaacagtgtaacatttgtggct

SEQ ID NO: 737479 - DNA, 25 bp, Mus musculus
taagaacagtgttacatttgtggct

SEQ ID NO: 737480 - DNA, 25 bp, Mus musculus
taagaacatgtgcaagttaaagccc

SEQ ID NO: 737481 - DNA, 25 bp, Mus musculus
taagaacatgtggaagttaaagccc

SEQ ID NO: 737482 - DNA, 25 bp, Mus musculus
taagaaccactcagagagctgggtg

SEQ ID NO: 737483 - DNA, 25 bp, Mus musculus
taagaaccactctgagagctgggtg

SEQ ID NO: 737484 - DNA, 25 bp, Mus musculus
taagaacccacacgtggctttgtat

SEQ ID NO: 737485 - DNA, 25 bp, Mus musculus
taagaacccacaggtggctttgtat

SEQ ID NO: 737486 - DNA, 25 bp, Mus musculus
taagaaccgggaccacagatgtcca

SEQ ID NO: 737487 - DNA, 25 bp, Mus musculus
taagaaccgggagcacagatgtcca

SEQ ID NO: 737488 - DNA, 25 bp, Mus musculus
taagaacctgcgcatagtggtgatt

SEQ ID NO: 737489 - DNA, 25 bp, Mus musculus
taagaacctgcggatagtggtgatt

SEQ ID NO: 737490 - DNA, 25 bp, Mus musculus
taagaacctggtcactggtcatgat

SEQ ID NO: 737491 - DNA, 25 bp, Mus musculus
taagaacctggtgactggtcatgat

SEQ ID NO: 737492 - DNA, 25 bp, Mus musculus
taagaacgagtgactggcatcaagt

SEQ ID NO: 737493 - DNA, 25 bp, Mus musculus
taagaacgagtgtctggcatcaagt

SEQ ID NO: 737494 - DNA, 25 bp, Mus musculus
taagaacgattgaacagaaaatgcc

SEQ ID NO: 737495 - DNA, 25 bp, Mus musculus
taagaacgattgtacagaaaatgcc

SEQ ID NO: 737496 - DNA, 25 bp, Mus musculus
taagaacggtaacaatgccaagaag

SEQ ID NO: 737497 - DNA, 25 bp, Mus musculus
taagaacggtaagaatgccaagaag

SEQ ID NO: 737498 - DNA, 25 bp, Mus musculus
taagaacgtcgtcctgcagaccctg

SEQ ID NO: 737499 - DNA, 25 bp, Mus musculus
taagaacgtcgtgctgcagaccctg

SEQ ID NO: 737500 - DNA, 25 bp, Mus musculus
taagaacgtgccaacaaatgtacgc

SEQ ID NO: 737501 - DNA, 25 bp, Mus musculus
taagaacgtgcctacaaatgtacgc

SEQ ID NO: 737502 - DNA, 25 bp, Mus musculus
taagaactacccctgcgacagtgat

SEQ ID NO: 737503 - DNA, 25 bp, Mus musculus
taagaactacccgtgcgacagtgat

SEQ ID NO: 737504 - DNA, 25 bp, Mus musculus
taagaactatggcttctacggctgc

SEQ ID NO: 737505 - DNA, 25 bp, Mus musculus
taagaactatgggttctacggctgc

SEQ ID NO: 737506 - DNA, 25 bp, Mus musculus
taagaactcaacatgtggatctggg

SEQ ID NO: 737507 - DNA, 25 bp, Mus musculus
taagaactcaacttgtggatctggg

SEQ ID NO: 737508 - DNA, 25 bp, Mus musculus
taagaacttggtccctaagcctgca

SEQ ID NO: 737509 - DNA, 25 bp, Mus musculus
taagaacttggtgcctaagcctgca

SEQ ID NO: 737510 - DNA, 25 bp, Mus musculus
taagaagaacatacagaggctgaca

SEQ ID NO: 737511 - DNA, 25 bp, Mus musculus
taagaagaacattcagaggctgaca

SEQ ID NO: 737512 - DNA, 25 bp, Mus musculus
taagaagaagtcaggagatccatcc

SEQ ID NO: 737513 - DNA, 25 bp, Mus musculus
taagaagaagtctggagatccatcc

SEQ ID NO: 737514 - DNA, 25 bp, Mus musculus
taagaagaatcaaagaagcgtcccc

SEQ ID NO: 737515 - DNA, 25 bp, Mus musculus
taagaagaatcatagaagcgtcccc

SEQ ID NO: 737516 - DNA, 25 bp, Mus musculus
taagaagactccctcccctgttcgg

SEQ ID NO: 737517 - DNA, 25 bp, Mus musculus
taagaagactccgtcccctgttcgg

SEQ ID NO: 737518 - DNA, 25 bp, Mus musculus
taagaagactgtagcgatgcatgaa

SEQ ID NO: 737519 - DNA, 25 bp, Mus musculus
taagaagactgttgcgatgcatgaa

SEQ ID NO: 737520 - DNA, 25 bp, Mus musculus
taagaagagagcagttgagatcacc

SEQ ID NO: 737521 - DNA, 25 bp, Mus musculus
taagaagagagctgttgagatcacc

SEQ ID NO: 737522 - DNA, 25 bp, Mus musculus
taagaagaggttcggcgcaggtccc

SEQ ID NO: 737523 - DNA, 25 bp, Mus musculus
taagaagaggttgggcgcaggtccc

SEQ ID NO: 737524 - DNA, 25 bp, Mus musculus
taagaagagtagacattccagtatc

SEQ ID NO: 737525 - DNA, 25 bp, Mus musculus
taagaagagtagtcattccagtatc

SEQ ID NO: 737526 - DNA, 25 bp, Mus musculus
taagaagagttccagaagcaaggac

SEQ ID NO: 737527 - DNA, 25 bp, Mus musculus
taagaagagttcgagaagcaaggac

SEQ ID NO: 737528 - DNA, 25 bp, Mus musculus
taagaagcacatcccatatcgcgag

SEQ ID NO: 737529 - DNA, 25 bp, Mus musculus
taagaagcacatgccatatcgcgag

SEQ ID NO: 737530 - DNA, 25 bp, Mus musculus
taagaagcacctccagcaatatcgg

SEQ ID NO: 737531 - DNA, 25 bp, Mus musculus
taagaagcacctgcagcaatatcgg

SEQ ID NO: 737532 - DNA, 25 bp, Mus musculus
taagaagcatcacttccaggatcgg

SEQ ID NO: 737533 - DNA, 25 bp, Mus musculus
taagaagcatcagttccaggatcgg

SEQ ID NO: 737534 - DNA, 25 bp, Mus musculus
taagaagccaagatacagacatagg

SEQ ID NO: 737535 - DNA, 25 bp, Mus musculus
taagaagccaagttacagacatagg

SEQ ID NO: 737536 - DNA, 25 bp, Mus musculus
taagaagccgatccgctccacagtc

SEQ ID NO: 737537 - DNA, 25 bp, Mus musculus
taagaagccgatgcgctccacagtc

SEQ ID NO: 737538 - DNA, 25 bp, Mus musculus
taagaagcgatacccatggttgacc

SEQ ID NO: 737539 - DNA, 25 bp, Mus musculus
taagaagcgatagccatggttgacc

SEQ ID NO: 737540 - DNA, 25 bp, Mus musculus
taagaagcgcttcatgcagtgttcg

SEQ ID NO: 737541 - DNA, 25 bp, Mus musculus
taagaagcgcttgatgcagtgttcg

SEQ ID NO: 737542 - DNA, 25 bp, Mus musculus
taagaagctcagcagacccttccag

SEQ ID NO: 737543 - DNA, 25 bp, Mus musculus
taagaagctcaggagacccttccag

SEQ ID NO: 737544 - DNA, 25 bp, Mus musculus
taagaagctgctaaatgccaggcga

SEQ ID NO: 737545 - DNA, 25 bp, Mus musculus
taagaagctgcttaatgccaggcga

SEQ ID NO: 737546 - DNA, 25 bp, Mus musculus
taagaagctgggaaaagtgcatcag

SEQ ID NO: 737547 - DNA, 25 bp, Mus musculus
taagaagctgggtaaagtgcatcag

SEQ ID NO: 737548 - DNA, 25 bp, Mus musculus
taagaagctggtagtacgatgggcc

SEQ ID NO: 737549 - DNA, 25 bp, Mus musculus
taagaagctggttgtacgatgggcc

SEQ ID NO: 737550 - DNA, 25 bp, Mus musculus
taagaaggacctagtgttagaacag

SEQ ID NO: 737551 - DNA, 25 bp, Mus musculus
taagaaggaccttgtgttagaacag

SEQ ID NO: 737552 - DNA, 25 bp, Mus musculus
taagaaggagaaaaccccgctgctc

SEQ ID NO: 737553 - DNA, 25 bp, Mus musculus
taagaaggagaataccccgctgctc

SEQ ID NO: 737554 - DNA, 25 bp, Mus musculus
taagaaggatccacccagaggttcc

SEQ ID NO: 737555 - DNA, 25 bp, Mus musculus
taagaaggatcctcccagaggttcc

SEQ ID NO: 737556 - DNA, 25 bp, Mus musculus
taagaaggcccaaatagagaaagat

SEQ ID NO: 737557 - DNA, 25 bp, Mus musculus
taagaaggcccatatagagaaagat

SEQ ID NO: 737558 - DNA, 25 bp, Mus musculus
taagaaggccggcaagctgaacatt

SEQ ID NO: 737559 - DNA, 25 bp, Mus musculus
taagaaggccgggaagctgaacatt

SEQ ID NO: 737560 - DNA, 25 bp, Mus musculus
taagaaggtgatagagcccatggcc

SEQ ID NO: 737561 - DNA, 25 bp, Mus musculus
taagaaggtgattgagcccatggcc

SEQ ID NO: 737562 - DNA, 25 bp, Mus musculus
taagaagtactcagagcggctggag

SEQ ID NO: 737563 - DNA, 25 bp, Mus musculus
taagaagtactctgagcggctggag

SEQ ID NO: 737564 - DNA, 25 bp, Mus musculus
taagaagtatggagaaacggctaat

SEQ ID NO: 737565 - DNA, 25 bp, Mus musculus
taagaagtatggtgaaacggctaat

SEQ ID NO: 737566 - DNA, 25 bp, Mus musculus
taagaagtcacccttgaccatctgc

SEQ ID NO: 737567 - DNA, 25 bp, Mus musculus
taagaagtcaccgttgaccatctgc

SEQ ID NO: 737568 - DNA, 25 bp, Mus musculus
taagaagtcagtcccaaactcgctg

SEQ ID NO: 737569 - DNA, 25 bp, Mus musculus
taagaagtcagtgccaaactcgctg

SEQ ID NO: 737570 - DNA, 25 bp, Mus musculus
taagaagtccagaagttgtccagtt

SEQ ID NO: 737571 - DNA, 25 bp, Mus musculus
taagaagtccagtagttgtccagtt

SEQ ID NO: 737572 - DNA, 25 bp, Mus musculus
taagaagtccttcccaggtggaagt

SEQ ID NO: 737573 - DNA, 25 bp, Mus musculus
taagaagtccttgccaggtggaagt

SEQ ID NO: 737574 - DNA, 25 bp, Mus musculus
taagaagtgaagacggatccagagc

SEQ ID NO: 737575 - DNA, 25 bp, Mus musculus
taagaagtgaagtcggatccagagc

SEQ ID NO: 737576 - DNA, 25 bp, Mus musculus
taagaagtgcaaacgctacgacctc

SEQ ID NO: 737577 - DNA, 25 bp, Mus musculus
taagaagtgcaatcgctacgacctc

SEQ ID NO: 737578 - DNA, 25 bp, Mus musculus
taagaagttagacttgtcagattgg

SEQ ID NO: 737579 - DNA, 25 bp, Mus musculus
taagaagttagagttgtcagattgg

SEQ ID NO: 737580 - DNA, 25 bp, Mus musculus
taagaagttcctccaagagttttat

SEQ ID NO: 737581 - DNA, 25 bp, Mus musculus
taagaagttcctgcaagagttttat

SEQ ID NO: 737582 - DNA, 25 bp, Mus musculus
taagaagttggaaactgcctacgac

SEQ ID NO: 737583 - DNA, 25 bp, Mus musculus
taagaagttggatactgcctacgac

SEQ ID NO: 737584 - DNA, 25 bp, Mus musculus
taagaatagcctccgataggtatag

SEQ ID NO: 737585 - DNA, 25 bp, Mus musculus
taagaatagcctgcgataggtatag

SEQ ID NO: 737586 - DNA, 25 bp, Mus musculus
taagaatattcccatgaccctagaa

SEQ ID NO: 737587 - DNA, 25 bp, Mus musculus
taagaatattccgatgaccctagaa

SEQ ID NO: 737588 - DNA, 25 bp, Mus musculus
taagaatcctcgaatccctaaatca

SEQ ID NO: 737589 - DNA, 25 bp, Mus musculus
taagaatcctcgtatccctaaatca

SEQ ID NO: 737590 - DNA, 25 bp, Mus musculus
taagaatcgctacgatgcctatcct

SEQ ID NO: 737591 - DNA, 25 bp, Mus musculus
taagaatcgctaggatgcctatcct

SEQ ID NO: 737592 - DNA, 25 bp, Mus musculus
taagaatcgttcaattggagcagca

SEQ ID NO: 737593 - DNA, 25 bp, Mus musculus
taagaatcgttctattggagcagca

SEQ ID NO: 737594 - DNA, 25 bp, Mus musculus
taagaatctggtatctgatgatgac

SEQ ID NO: 737595 - DNA, 25 bp, Mus musculus
taagaatctggtttctgatgatgac

SEQ ID NO: 737596 - DNA, 25 bp, Mus musculus
taagaatgaaacaaccgtgtctgtg

SEQ ID NO: 737597 - DNA, 25 bp, Mus musculus
taagaatgaaactaccgtgtctgtg

SEQ ID NO: 737598 - DNA, 25 bp, Mus musculus
taagaatgaacgaggtagtgagatc

SEQ ID NO: 737599 - DNA, 25 bp, Mus musculus
taagaatgaacgtggtagtgagatc

SEQ ID NO: 737600 - DNA, 25 bp, Mus musculus
taagaatgagatcgcctccgtcgct

SEQ ID NO: 737601 - DNA, 25 bp, Mus musculus
taagaatgagatggcctccgtcgct

SEQ ID NO: 737602 - DNA, 25 bp, Mus musculus
taagaatgccccattctgggaaagg

SEQ ID NO: 737603 - DNA, 25 bp, Mus musculus
taagaatgcccctttctgggaaagg

SEQ ID NO: 737604 - DNA, 25 bp, Mus musculus
taagaatggttcacgactcagtgac

SEQ ID NO: 737605 - DNA, 25 bp, Mus musculus
taagaatggttctcgactcagtgac

SEQ ID NO: 737606 - DNA, 25 bp, Mus musculus
taagaattcagaacggatgacacac

SEQ ID NO: 737607 - DNA, 25 bp, Mus musculus
taagaattcagatcggatgacacac

SEQ ID NO: 737608 - DNA, 25 bp, Mus musculus
taagaatttactcacaaggaagatc

SEQ ID NO: 737609 - DNA, 25 bp, Mus musculus
taagaatttactgacaaggaagatc

SEQ ID NO: 737610 - DNA, 25 bp, Mus musculus
taagaatttcagaggcgctgagctg

SEQ ID NO: 737611 - DNA, 25 bp, Mus musculus
taagaatttcagtggcgctgagctg

SEQ ID NO: 737612 - DNA, 25 bp, Mus musculus
taagacaaccaaaaagctgcatgag

SEQ ID NO: 737613 - DNA, 25 bp, Mus musculus
taagacaaccaataagctgcatgag

SEQ ID NO: 737614 - DNA, 25 bp, Mus musculus
taagacaacgagagcctcgggtctg

SEQ ID NO: 737615 - DNA, 25 bp, Mus musculus
taagacaacgagtgcctcgggtctg

SEQ ID NO: 737616 - DNA, 25 bp, Mus musculus
taagacaagtgtatagggacagggt

SEQ ID NO: 737617 - DNA, 25 bp, Mus musculus
taagacaagtgtttagggacagggt

SEQ ID NO: 737618 - DNA, 25 bp, Mus musculus
taagacaatgagcagatagaaggga

SEQ ID NO: 737619 - DNA, 25 bp, Mus musculus
taagacaatgaggagatagaaggga

SEQ ID NO: 737620 - DNA, 25 bp, Mus musculus
taagacacccctccaccagaagtat

SEQ ID NO: 737621 - DNA, 25 bp, Mus musculus
taagacacccctgcaccagaagtat

SEQ ID NO: 737622 - DNA, 25 bp, Mus musculus
taagacaccttcagaccatgaagaa

SEQ ID NO: 737623 - DNA, 25 bp, Mus musculus
taagacaccttctgaccatgaagaa

SEQ ID NO: 737624 - DNA, 25 bp, Mus musculus
taagacactggaccatatcaatgcc

SEQ ID NO: 737625 - DNA, 25 bp, Mus musculus
taagacactggagcatatcaatgcc

SEQ ID NO: 737626 - DNA, 25 bp, Mus musculus
taagacagagacaaaggtcacaccc

SEQ ID NO: 737627 - DNA, 25 bp, Mus musculus
taagacagagactaaggtcacaccc

SEQ ID NO: 737628 - DNA, 25 bp, Mus musculus
taagacagagtgaggaattctcttg

SEQ ID NO: 737629 - DNA, 25 bp, Mus musculus
taagacagagtgtggaattctcttg

SEQ ID NO: 737630 - DNA, 25 bp, Mus musculus
taagacagccctaacctaactggaa

SEQ ID NO: 737631 - DNA, 25 bp, Mus musculus
taagacagcccttacctaactggaa

SEQ ID NO: 737632 - DNA, 25 bp, Mus musculus
taagacaggaacagggcccaaagtc

SEQ ID NO: 737633 - DNA, 25 bp, Mus musculus
taagacaggaactgggcccaaagtc

SEQ ID NO: 737634 - DNA, 25 bp, Mus musculus
taagacaggagaagaagcgagccat

SEQ ID NO: 737635 - DNA, 25 bp, Mus musculus
taagacaggagatgaagcgagccat

SEQ ID NO: 737636 - DNA, 25 bp, Mus musculus
taagacagtagcaattccagccctg

SEQ ID NO: 737637 - DNA, 25 bp, Mus musculus
taagacagtagctattccagccctg

SEQ ID NO: 737638 - DNA, 25 bp, Mus musculus
taagacagtcctacagggtccctac

SEQ ID NO: 737639 - DNA, 25 bp, Mus musculus
taagacagtccttcagggtccctac

SEQ ID NO: 737640 - DNA, 25 bp, Mus musculus
taagacataatcctcctagcctggg

SEQ ID NO: 737641 - DNA, 25 bp, Mus musculus
taagacataatcgtcctagcctggg

SEQ ID NO: 737642 - DNA, 25 bp, Mus musculus
taagacatacaacatacccattcgc

SEQ ID NO: 737643 - DNA, 25 bp, Mus musculus
taagacatacaagatacccattcgc

SEQ ID NO: 737644 - DNA, 25 bp, Mus musculus
taagacatggctagcagagggagtc

SEQ ID NO: 737645 - DNA, 25 bp, Mus musculus
taagacatggcttgcagagggagtc

SEQ ID NO: 737646 - DNA, 25 bp, Mus musculus
taagacatgtttcaagcacagtagt

SEQ ID NO: 737647 - DNA, 25 bp, Mus musculus
taagacatgtttgaagcacagtagt

SEQ ID NO: 737648 - DNA, 25 bp, Mus musculus
taagaccaagaaaaacgacattgct

SEQ ID NO: 737649 - DNA, 25 bp, Mus musculus
taagaccaagaacacaccgaaggac

SEQ ID NO: 737650 - DNA, 25 bp, Mus musculus
taagaccaagaagacaccgaaggac

SEQ ID NO: 737651 - DNA, 25 bp, Mus musculus
taagaccaagaataacgacattgct

SEQ ID NO: 737652 - DNA, 25 bp, Mus musculus
taagaccacaaacaactctaatccg

SEQ ID NO: 737653 - DNA, 25 bp, Mus musculus
taagaccacaaagaactctaatccg

SEQ ID NO: 737654 - DNA, 25 bp, Mus musculus
taagaccacactacctgtgagaggg

SEQ ID NO: 737655 - DNA, 25 bp, Mus musculus
taagaccacacttcctgtgagaggg

SEQ ID NO: 737656 - DNA, 25 bp, Mus musculus
taagaccaccttcttcaggaatctt

SEQ ID NO: 737657 - DNA, 25 bp, Mus musculus
taagaccaccttgttcaggaatctt

SEQ ID NO: 737658 - DNA, 25 bp, Mus musculus
taagaccatcagctgggctactggc

SEQ ID NO: 737659 - DNA, 25 bp, Mus musculus
taagaccatcaggtgggctactggc

SEQ ID NO: 737660 - DNA, 25 bp, Mus musculus
taagaccatcccctaatgcagatat

SEQ ID NO: 737661 - DNA, 25 bp, Mus musculus
taagaccatcccgtaatgcagatat

SEQ ID NO: 737662 - DNA, 25 bp, Mus musculus
taagaccatcggaagacacagctgt

SEQ ID NO: 737663 - DNA, 25 bp, Mus musculus
taagaccatcggtagacacagctgt

SEQ ID NO: 737664 - DNA, 25 bp, Mus musculus
taagaccatgcaaggagtgccggtg

SEQ ID NO: 737665 - DNA, 25 bp, Mus musculus
taagaccatgcatggagtgccggtg

SEQ ID NO: 737666 - DNA, 25 bp, Mus musculus
taagacccagatactctatgtgatg

SEQ ID NO: 737667 - DNA, 25 bp, Mus musculus
taagacccagattctctatgtgatg

SEQ ID NO: 737668 - DNA, 25 bp, Mus musculus
taagacccaggactctggtcagggc

SEQ ID NO: 737669 - DNA, 25 bp, Mus musculus
taagacccaggagtctggtcagggc

SEQ ID NO: 737670 - DNA, 25 bp, Mus musculus
taagacccctttcccatagatgaga

SEQ ID NO: 737671 - DNA, 25 bp, Mus musculus
taagacccctttgccatagatgaga

SEQ ID NO: 737672 - DNA, 25 bp, Mus musculus
taagacccgcttatctggtgttgca

SEQ ID NO: 737673 - DNA, 25 bp, Mus musculus
taagacccgcttttctggtgttgca

SEQ ID NO: 737674 - DNA, 25 bp, Mus musculus
taagaccggcaaactgatctcactg

SEQ ID NO: 737675 - DNA, 25 bp, Mus musculus
taagaccggcaatctgatctcactg

SEQ ID NO: 737676 - DNA, 25 bp, Mus musculus
taagacctaatgcagctgcgttgtg

SEQ ID NO: 737677 - DNA, 25 bp, Mus musculus
taagacctaatggagctgcgttgtg

SEQ ID NO: 737678 - DNA, 25 bp, Mus musculus
taagacctatagcagccacagggtg

SEQ ID NO: 737679 - DNA, 25 bp, Mus musculus
taagacctataggagccacagggtg

SEQ ID NO: 737680 - DNA, 25 bp, Mus musculus
taagacctcctcactctcatggttc

SEQ ID NO: 737681 - DNA, 25 bp, Mus musculus
taagacctcctctctctcatggttc

SEQ ID NO: 737682 - DNA, 25 bp, Mus musculus
taagacctggccctaacagggaagg

SEQ ID NO: 737683 - DNA, 25 bp, Mus musculus
taagacctggccctctagatcagct

SEQ ID NO: 737684 - DNA, 25 bp, Mus musculus
taagacctggccgtaacagggaagg

SEQ ID NO: 737685 - DNA, 25 bp, Mus musculus
taagacctggccgtctagatcagct

SEQ ID NO: 737686 - DNA, 25 bp, Mus musculus
taagacctttagagcatcaacagct

SEQ ID NO: 737687 - DNA, 25 bp, Mus musculus
taagacctttagtgcatcaacagct

SEQ ID NO: 737688 - DNA, 25 bp, Mus musculus
taagacctttttctactccgaagct

SEQ ID NO: 737689 - DNA, 25 bp, Mus musculus
taagacctttttgtactccgaagct

SEQ ID NO: 737690 - DNA, 25 bp, Mus musculus
taagacggaaaccagcttggacacg

SEQ ID NO: 737691 - DNA, 25 bp, Mus musculus
taagacggaaacgagcttggacacg

SEQ ID NO: 737692 - DNA, 25 bp, Mus musculus
taagacgggcagcatcactacaaaa

SEQ ID NO: 737693 - DNA, 25 bp, Mus musculus
taagacgggcaggatcactacaaaa

SEQ ID NO: 737694 - DNA, 25 bp, Mus musculus
taagacggtggaagtggagacccct

SEQ ID NO: 737695 - DNA, 25 bp, Mus musculus
taagacggtggatgtggagacccct

SEQ ID NO: 737696 - DNA, 25 bp, Mus musculus
taagacggttctctttgttacacac

SEQ ID NO: 737697 - DNA, 25 bp, Mus musculus
taagacggttctgtttgttacacac

SEQ ID NO: 737698 - DNA, 25 bp, Mus musculus
taagacgtgagacctgcggagggaa

SEQ ID NO: 737699 - DNA, 25 bp, Mus musculus
taagacgtgagagctgcggagggaa

SEQ ID NO: 737700 - DNA, 25 bp, Mus musculus
taagactaaaaaagggcaggctggc

SEQ ID NO: 737701 - DNA, 25 bp, Mus musculus
taagactaaaaatgggcaggctggc

SEQ ID NO: 737702 - DNA, 25 bp, Mus musculus
taagactaaggcagctccctgcatc

SEQ ID NO: 737703 - DNA, 25 bp, Mus musculus
taagactaaggctgctccctgcatc

SEQ ID NO: 737704 - DNA, 25 bp, Mus musculus
taagactatagacaaaccagcctgg

SEQ ID NO: 737705 - DNA, 25 bp, Mus musculus
taagactatagagaaaccagcctgg

SEQ ID NO: 737706 - DNA, 25 bp, Mus musculus
taagactcaaatacagcagggaggc

SEQ ID NO: 737707 - DNA, 25 bp, Mus musculus
taagactcaaattcagcagggaggc

SEQ ID NO: 737708 - DNA, 25 bp, Mus musculus
taagactcgcctactatccagagcc

SEQ ID NO: 737709 - DNA, 25 bp, Mus musculus
taagactcgccttctatccagagcc

SEQ ID NO: 737710 - DNA, 25 bp, Mus musculus
taagactgaactacacagtgggagc

SEQ ID NO: 737711 - DNA, 25 bp, Mus musculus
taagactgaacttcacagtgggagc

SEQ ID NO: 737712 - DNA, 25 bp, Mus musculus
taagactgaatgcaagcgagcagcc

SEQ ID NO: 737713 - DNA, 25 bp, Mus musculus
taagactgaatggaagcgagcagcc

SEQ ID NO: 737714 - DNA, 25 bp, Mus musculus
taagactggatacttgaatgtcacc

SEQ ID NO: 737715 - DNA, 25 bp, Mus musculus
taagactggatagttgaatgtcacc

SEQ ID NO: 737716 - DNA, 25 bp, Mus musculus
taagactggccgcttccttgttacg

SEQ ID NO: 737717 - DNA, 25 bp, Mus musculus
taagactggccggttccttgttacg

SEQ ID NO: 737718 - DNA, 25 bp, Mus musculus
taagactgtaccaagtgctgctgag

SEQ ID NO: 737719 - DNA, 25 bp, Mus musculus
taagactgtacctagtgctgctgag

SEQ ID NO: 737720 - DNA, 25 bp, Mus musculus
taagactgtgctccagatcgataac

SEQ ID NO: 737721 - DNA, 25 bp, Mus musculus
taagactgtgctgcagatcgataac

SEQ ID NO: 737722 - DNA, 25 bp, Mus musculus
taagactgtggaagccacgtcagcc

SEQ ID NO: 737723 - DNA, 25 bp, Mus musculus
taagactgtggatgccacgtcagcc

SEQ ID NO: 737724 - DNA, 25 bp, Mus musculus
taagactgttcaccaaagacgtttt

SEQ ID NO: 737725 - DNA, 25 bp, Mus musculus
taagactgttcagcaaagacgtttt

SEQ ID NO: 737726 - DNA, 25 bp, Mus musculus
taagacttgagaactaggttgggac

SEQ ID NO: 737727 - DNA, 25 bp, Mus musculus
taagacttgagatctaggttgggac

SEQ ID NO: 737728 - DNA, 25 bp, Mus musculus
taagacttggtacgcccttgcagcg

SEQ ID NO: 737729 - DNA, 25 bp, Mus musculus
taagacttggtaggcccttgcagcg

SEQ ID NO: 737730 - DNA, 25 bp, Mus musculus
taagacttggttacaggccaccttg

SEQ ID NO: 737731 - DNA, 25 bp, Mus musculus
taagacttggtttcaggccaccttg

SEQ ID NO: 737732 - DNA, 25 bp, Mus musculus
taagacttgtctccctgggttccca

SEQ ID NO: 737733 - DNA, 25 bp, Mus musculus
taagacttgtctgcctgggttccca

SEQ ID NO: 737734 - DNA, 25 bp, Mus musculus
taagagaacataacctgtccatgca

SEQ ID NO: 737735 - DNA, 25 bp, Mus musculus
taagagaacatatcctgtccatgca

SEQ ID NO: 737736 - DNA, 25 bp, Mus musculus
taagagaaggaaacaccagcatggc

SEQ ID NO: 737737 - DNA, 25 bp, Mus musculus
taagagaaggaatcaccagcatggc

SEQ ID NO: 737738 - DNA, 25 bp, Mus musculus
taagagaaggcaaaacctcctaagc

SEQ ID NO: 737739 - DNA, 25 bp, Mus musculus
taagagaaggcataacctcctaagc

SEQ ID NO: 737740 - DNA, 25 bp, Mus musculus
taagagaatccaattgaacagccgg

SEQ ID NO: 737741 - DNA, 25 bp, Mus musculus
taagagaatccatttgaacagccgg

SEQ ID NO: 737742 - DNA, 25 bp, Mus musculus
taagagaattggctccaccccaaga

SEQ ID NO: 737743 - DNA, 25 bp, Mus musculus
taagagaattgggtccaccccaaga

SEQ ID NO: 737744 - DNA, 25 bp, Mus musculus
taagagacctgacaatggccggaga

SEQ ID NO: 737745 - DNA, 25 bp, Mus musculus
taagagacctgagaatggccggaga

SEQ ID NO: 737746 - DNA, 25 bp, Mus musculus
taagagacctggactgcattcctct

SEQ ID NO: 737747 - DNA, 25 bp, Mus musculus
taagagacctggtctgcattcctct

SEQ ID NO: 737748 - DNA, 25 bp, Mus musculus
taagagactgcaccaacgtgggaac

SEQ ID NO: 737749 - DNA, 25 bp, Mus musculus
taagagactgcagcaacgtgggaac

SEQ ID NO: 737750 - DNA, 25 bp, Mus musculus
taagagagactgaggagagaagaca

SEQ ID NO: 737751 - DNA, 25 bp, Mus musculus
taagagagactgtggagagaagaca

SEQ ID NO: 737752 - DNA, 25 bp, Mus musculus
taagagagacttctgttctcgactc

SEQ ID NO: 737753 - DNA, 25 bp, Mus musculus
taagagagacttgtgttctcgactc

SEQ ID NO: 737754 - DNA, 25 bp, Mus musculus
taagagagcaggaaacgagccccgc

SEQ ID NO: 737755 - DNA, 25 bp, Mus musculus
taagagagcaggtaacgagccccgc

SEQ ID NO: 737756 - DNA, 25 bp, Mus musculus
taagagagctagacaatcttcagaa

SEQ ID NO: 737757 - DNA, 25 bp, Mus musculus
taagagagctagtcaatcttcagaa

SEQ ID NO: 737758 - DNA, 25 bp, Mus musculus
taagagagtacaaatcaaagcgaca

SEQ ID NO: 737759 - DNA, 25 bp, Mus musculus
taagagagtacatatcaaagcgaca

SEQ ID NO: 737760 - DNA, 25 bp, Mus musculus
taagagatagagatcatcctttgcg

SEQ ID NO: 737761 - DNA, 25 bp, Mus musculus
taagagatagagttcatcctttgcg

SEQ ID NO: 737762 - DNA, 25 bp, Mus musculus
taagagatgcccctgtctgtgctgg

SEQ ID NO: 737763 - DNA, 25 bp, Mus musculus
taagagatgcccgtgtctgtgctgg

SEQ ID NO: 737764 - DNA, 25 bp, Mus musculus
taagagatgctcagatacagaaatc

SEQ ID NO: 737765 - DNA, 25 bp, Mus musculus
taagagatgctctgatacagaaatc

SEQ ID NO: 737766 - DNA, 25 bp, Mus musculus
taagagatggacaccgtgcggtcaa

SEQ ID NO: 737767 - DNA, 25 bp, Mus musculus
taagagatggactccgtgcggtcaa

SEQ ID NO: 737768 - DNA, 25 bp, Mus musculus
taagagcaagttcatgccagcggca

SEQ ID NO: 737769 - DNA, 25 bp, Mus musculus
taagagcaagttgatgccagcggca

SEQ ID NO: 737770 - DNA, 25 bp, Mus musculus
taagagcagggcctttgagaccacg

SEQ ID NO: 737771 - DNA, 25 bp, Mus musculus
taagagcagggcgtttgagaccacg

SEQ ID NO: 737772 - DNA, 25 bp, Mus musculus
taagagcagtgcaccaaagctccca

SEQ ID NO: 737773 - DNA, 25 bp, Mus musculus
taagagcagtgctccaaagctccca

SEQ ID NO: 737774 - DNA, 25 bp, Mus musculus
taagagcatcggctttgggccctga

SEQ ID NO: 737775 - DNA, 25 bp, Mus musculus
taagagcatcgggtttgggccctga

SEQ ID NO: 737776 - DNA, 25 bp, Mus musculus
taagagccacctcatctggaagcag

SEQ ID NO: 737777 - DNA, 25 bp, Mus musculus
taagagccacctgatctggaagcag

SEQ ID NO: 737778 - DNA, 25 bp, Mus musculus
taagagcccgagagcgcaagagctc

SEQ ID NO: 737779 - DNA, 25 bp, Mus musculus
taagagcccgagtgcgcaagagctc

SEQ ID NO: 737780 - DNA, 25 bp, Mus musculus
taagagccctctaggtggatttcaa

SEQ ID NO: 737781 - DNA, 25 bp, Mus musculus
taagagccctcttggtggatttcaa

SEQ ID NO: 737782 - DNA, 25 bp, Mus musculus
taagagccgctgacaagggtactgg

SEQ ID NO: 737783 - DNA, 25 bp, Mus musculus
taagagccgctgtcaagggtactgg

SEQ ID NO: 737784 - DNA, 25 bp, Mus musculus
taagagcgaccgaattgtcacttgt

SEQ ID NO: 737785 - DNA, 25 bp, Mus musculus
taagagcgaccgtattgtcacttgt

SEQ ID NO: 737786 - DNA, 25 bp, Mus musculus
taagagcggcgcaaaagatgcaaga

SEQ ID NO: 737787 - DNA, 25 bp, Mus musculus
taagagcggcgctaaagatgcaaga

SEQ ID NO: 737788 - DNA, 25 bp, Mus musculus
taagagctctacatgccagatgtgt

SEQ ID NO: 737789 - DNA, 25 bp, Mus musculus
taagagctctacttgccagatgtgt

SEQ ID NO: 737790 - DNA, 25 bp, Mus musculus
taagagctgcagatgaatttactcc

SEQ ID NO: 737791 - DNA, 25 bp, Mus musculus
taagagctgcagttgaatttactcc

SEQ ID NO: 737792 - DNA, 25 bp, Mus musculus
taagagctggagaccggcacgccgt

SEQ ID NO: 737793 - DNA, 25 bp, Mus musculus
taagagctggagtccggcacgccgt

SEQ ID NO: 737794 - DNA, 25 bp, Mus musculus
taagagctgtcaattgcactgatgg

SEQ ID NO: 737795 - DNA, 25 bp, Mus musculus
taagagctgtcatttgcactgatgg

SEQ ID NO: 737796 - DNA, 25 bp, Mus musculus
taagagcttagcaaacaatagactg

SEQ ID NO: 737797 - DNA, 25 bp, Mus musculus
taagagcttagctaacaatagactg

SEQ ID NO: 737798 - DNA, 25 bp, Mus musculus
taagaggaaaccaagcagtgcgcct

SEQ ID NO: 737799 - DNA, 25 bp, Mus musculus
taagaggaaacctagcagtgcgcct

SEQ ID NO: 737800 - DNA, 25 bp, Mus musculus
taagaggaaccactgtcgttactgc

SEQ ID NO: 737801 - DNA, 25 bp, Mus musculus
taagaggaaccagtgtcgttactgc

SEQ ID NO: 737802 - DNA, 25 bp, Mus musculus
taagaggaagtaccttgtgccctcc

SEQ ID NO: 737803 - DNA, 25 bp, Mus musculus
taagaggaagtagcttgtgccctcc

SEQ ID NO: 737804 - DNA, 25 bp, Mus musculus
taagaggacaagcaaaccagacgat

SEQ ID NO: 737805 - DNA, 25 bp, Mus musculus
taagaggacaaggaaaccagacgat

SEQ ID NO: 737806 - DNA, 25 bp, Mus musculus
taagaggacatccagcagcttggcc

SEQ ID NO: 737807 - DNA, 25 bp, Mus musculus
taagaggacatcgagcagcttggcc

SEQ ID NO: 737808 - DNA, 25 bp, Mus musculus
taagaggacccactcagagcttgag

SEQ ID NO: 737809 - DNA, 25 bp, Mus musculus
taagaggacccagtcagagcttgag

SEQ ID NO: 737810 - DNA, 25 bp, Mus musculus
taagaggagaaaaagcaggacctcc

SEQ ID NO: 737811 - DNA, 25 bp, Mus musculus
taagaggagaaatagcaggacctcc

SEQ ID NO: 737812 - DNA, 25 bp, Mus musculus
taagaggagctgcttggccccacct

SEQ ID NO: 737813 - DNA, 25 bp, Mus musculus
taagaggagctggttggccccacct

SEQ ID NO: 737814 - DNA, 25 bp, Mus musculus
taagaggattatcgaacactatccc

SEQ ID NO: 737815 - DNA, 25 bp, Mus musculus
taagaggattatggaacactatccc

SEQ ID NO: 737816 - DNA, 25 bp, Mus musculus
taagaggcactcctccctaagggaa

SEQ ID NO: 737817 - DNA, 25 bp, Mus musculus
taagaggcactcgtccctaagggaa

SEQ ID NO: 737818 - DNA, 25 bp, Mus musculus
taagaggcctctaggtctgtagcag

SEQ ID NO: 737819 - DNA, 25 bp, Mus musculus
taagaggcctcttggtctgtagcag

SEQ ID NO: 737820 - DNA, 25 bp, Mus musculus
taagaggctcttagccctattgctt

SEQ ID NO: 737821 - DNA, 25 bp, Mus musculus
taagaggctctttgccctattgctt

SEQ ID NO: 737822 - DNA, 25 bp, Mus musculus
taagaggctgccagactccagggtg

SEQ ID NO: 737823 - DNA, 25 bp, Mus musculus
taagaggctgcctgactccagggtg

SEQ ID NO: 737824 - DNA, 25 bp, Mus musculus
taagaggcttaccaaaaggaaacag

SEQ ID NO: 737825 - DNA, 25 bp, Mus musculus
taagaggcttacgaaaaggaaacag

SEQ ID NO: 737826 - DNA, 25 bp, Mus musculus
taagaggcttctcgaagcgcccgct

SEQ ID NO: 737827 - DNA, 25 bp, Mus musculus
taagaggcttctggaagcgcccgct

SEQ ID NO: 737828 - DNA, 25 bp, Mus musculus
taagagggaggcactgtttctaaac

SEQ ID NO: 737829 - DNA, 25 bp, Mus musculus
taagagggaggctctgtttctaaac

SEQ ID NO: 737830 - DNA, 25 bp, Mus musculus
taagagggctttaccactagactga

SEQ ID NO: 737831 - DNA, 25 bp, Mus musculus
taagagggcttttccactagactga

SEQ ID NO: 737832 - DNA, 25 bp, Mus musculus
taagaggtcaccaaaaggaaggcta

SEQ ID NO: 737833 - DNA, 25 bp, Mus musculus
taagaggtcacctaaaggaaggcta

SEQ ID NO: 737834 - DNA, 25 bp, Mus musculus
taagaggtggctataaagccctggc

SEQ ID NO: 737835 - DNA, 25 bp, Mus musculus
taagaggtggctttaaagccctggc

SEQ ID NO: 737836 - DNA, 25 bp, Mus musculus
taagaggttcctccgaaagaaatcc

SEQ ID NO: 737837 - DNA, 25 bp, Mus musculus
taagaggttcctgcgaaagaaatcc

SEQ ID NO: 737838 - DNA, 25 bp, Mus musculus
taagagtaacccaggagacttcact

SEQ ID NO: 737839 - DNA, 25 bp, Mus musculus
taagagtaaccctggagacttcact

SEQ ID NO: 737840 - DNA, 25 bp, Mus musculus
taagagtaaggcatttttctggtgt

SEQ ID NO: 737841 - DNA, 25 bp, Mus musculus
taagagtaaggcttttttctggtgt

SEQ ID NO: 737842 - DNA, 25 bp, Mus musculus
taagagtataacacaaaaggcccat

SEQ ID NO: 737843 - DNA, 25 bp, Mus musculus
taagagtataactcaaaaggcccat

SEQ ID NO: 737844 - DNA, 25 bp, Mus musculus
taagagtccatgctgaccctgcagt

SEQ ID NO: 737845 - DNA, 25 bp, Mus musculus
taagagtccatggtgaccctgcagt

SEQ ID NO: 737846 - DNA, 25 bp, Mus musculus
taagagtcgcgcagtaagaagcaac

SEQ ID NO: 737847 - DNA, 25 bp, Mus musculus
taagagtcgcgctgtaagaagcaac

SEQ ID NO: 737848 - DNA, 25 bp, Mus musculus
taagagtcggcacaacaagaccaat

SEQ ID NO: 737849 - DNA, 25 bp, Mus musculus
taagagtcggcagaacaagaccaat

SEQ ID NO: 737850 - DNA, 25 bp, Mus musculus
taagagtgacctaggccggaagatc

SEQ ID NO: 737851 - DNA, 25 bp, Mus musculus
taagagtgaccttggccggaagatc

SEQ ID NO: 737852 - DNA, 25 bp, Mus musculus
taagagtgacgaagaagctgcctgt

SEQ ID NO: 737853 - DNA, 25 bp, Mus musculus
taagagtgacgactcagtgatccag

SEQ ID NO: 737854 - DNA, 25 bp, Mus musculus
taagagtgacgagtcagtgatccag

SEQ ID NO: 737855 - DNA, 25 bp, Mus musculus
taagagtgacgatgaagctgcctgt

SEQ ID NO: 737856 - DNA, 25 bp, Mus musculus
taagagtgccaaaggagtgtcaata

SEQ ID NO: 737857 - DNA, 25 bp, Mus musculus
taagagtgccaatggagtgtcaata

SEQ ID NO: 737858 - DNA, 25 bp, Mus musculus
taagagtggaaacctagccaaactt

SEQ ID NO: 737859 - DNA, 25 bp, Mus musculus
taagagtggaaagctagccaaactt

SEQ ID NO: 737860 - DNA, 25 bp, Mus musculus
taagagtgtaatcgccaacaagctg

SEQ ID NO: 737861 - DNA, 25 bp, Mus musculus
taagagtgtaatggccaacaagctg

SEQ ID NO: 737862 - DNA, 25 bp, Mus musculus
taagagtgtctcactttagcccagg

SEQ ID NO: 737863 - DNA, 25 bp, Mus musculus
taagagtgtctctctttagcccagg

SEQ ID NO: 737864 - DNA, 25 bp, Mus musculus
taagagtgtcttcgccactggctcc

SEQ ID NO: 737865 - DNA, 25 bp, Mus musculus
taagagtgtcttggccactggctcc

SEQ ID NO: 737866 - DNA, 25 bp, Mus musculus
taagagttggcaactcgcacagcgg

SEQ ID NO: 737867 - DNA, 25 bp, Mus musculus
taagagttggcatctcgcacagcgg

SEQ ID NO: 737868 - DNA, 25 bp, Mus musculus
taagagttgtacatccaccaaaggc

SEQ ID NO: 737869 - DNA, 25 bp, Mus musculus
taagagttgtacttccaccaaaggc

SEQ ID NO: 737870 - DNA, 25 bp, Mus musculus
taagagtttacgaccatcacactgg

SEQ ID NO: 737871 - DNA, 25 bp, Mus musculus
taagagtttacgtccatcacactgg

SEQ ID NO: 737872 - DNA, 25 bp, Mus musculus
taagataattcccatagtgaacggg

SEQ ID NO: 737873 - DNA, 25 bp, Mus musculus
taagataattccgatagtgaacggg

SEQ ID NO: 737874 - DNA, 25 bp, Mus musculus
taagatacaaatatcacgcagtgac

SEQ ID NO: 737875 - DNA, 25 bp, Mus musculus
taagatacaaatttcacgcagtgac

SEQ ID NO: 737876 - DNA, 25 bp, Mus musculus
taagataccctgacacagtgtgtgg

SEQ ID NO: 737877 - DNA, 25 bp, Mus musculus
taagataccctgtcacagtgtgtgg

SEQ ID NO: 737878 - DNA, 25 bp, Mus musculus
taagatactgttcttcttgggctgg

SEQ ID NO: 737879 - DNA, 25 bp, Mus musculus
taagatactgttgttcttgggctgg

SEQ ID NO: 737880 - DNA, 25 bp, Mus musculus
taagatactttcaccaagagcttcc

SEQ ID NO: 737881 - DNA, 25 bp, Mus musculus
taagatactttctccaagagcttcc

SEQ ID NO: 737882 - DNA, 25 bp, Mus musculus
taagatagaggaacccatccatgcc

SEQ ID NO: 737883 - DNA, 25 bp, Mus musculus
taagatagaggatcccatccatgcc

SEQ ID NO: 737884 - DNA, 25 bp, Mus musculus
taagatagcttcagcctcaggactc

SEQ ID NO: 737885 - DNA, 25 bp, Mus musculus
taagatagcttctgcctcaggactc

SEQ ID NO: 737886 - DNA, 25 bp, Mus musculus
taagataggattattccaaggagat

SEQ ID NO: 737887 - DNA, 25 bp, Mus musculus
taagataggatttttccaaggagat

SEQ ID NO: 737888 - DNA, 25 bp, Mus musculus
taagatcaacccaaacgtgcaggat

SEQ ID NO: 737889 - DNA, 25 bp, Mus musculus
taagatcaaccctaacgtgcaggat

SEQ ID NO: 737890 - DNA, 25 bp, Mus musculus
taagatcacagccaccatatactga

SEQ ID NO: 737891 - DNA, 25 bp, Mus musculus
taagatcacagcgaccatatactga

SEQ ID NO: 737892 - DNA, 25 bp, Mus musculus
taagatcaccatagccaatgctgtc

SEQ ID NO: 737893 - DNA, 25 bp, Mus musculus
taagatcaccattgccaatgctgtc

SEQ ID NO: 737894 - DNA, 25 bp, Mus musculus
taagatcactttagagacagatgaa

SEQ ID NO: 737895 - DNA, 25 bp, Mus musculus
taagatcacttttgagacagatgaa

SEQ ID NO: 737896 - DNA, 25 bp, Mus musculus
taagatcagatcagattggcccacc

SEQ ID NO: 737897 - DNA, 25 bp, Mus musculus
taagatcagatctgattggcccacc

SEQ ID NO: 737898 - DNA, 25 bp, Mus musculus
taagatccaagaaggtactttagga

SEQ ID NO: 737899 - DNA, 25 bp, Mus musculus
taagatccaagatggtactttagga

SEQ ID NO: 737900 - DNA, 25 bp, Mus musculus
taagatccacttcatgatgccacca

SEQ ID NO: 737901 - DNA, 25 bp, Mus musculus
taagatccacttgatgatgccacca

SEQ ID NO: 737902 - DNA, 25 bp, Mus musculus
taagatccagaacctcaatgccagc

SEQ ID NO: 737903 - DNA, 25 bp, Mus musculus
taagatccagaagctcaatgccagc

SEQ ID NO: 737904 - DNA, 25 bp, Mus musculus
taagatccggatccgcattgatgat

SEQ ID NO: 737905 - DNA, 25 bp, Mus musculus
taagatccggatgcgcattgatgat

SEQ ID NO: 737906 - DNA, 25 bp, Mus musculus
taagatcctcggaggagaccccaag

SEQ ID NO: 737907 - DNA, 25 bp, Mus musculus
taagatcctcggtggagaccccaag

SEQ ID NO: 737908 - DNA, 25 bp, Mus musculus
taagatcgggccagacaacttgccg

SEQ ID NO: 737909 - DNA, 25 bp, Mus musculus
taagatcgggcctgacaacttgccg

SEQ ID NO: 737910 - DNA, 25 bp, Mus musculus
taagatcgtctccaatctactaggg

SEQ ID NO: 737911 - DNA, 25 bp, Mus musculus
taagatcgtctcgaatctactaggg

SEQ ID NO: 737912 - DNA, 25 bp, Mus musculus
taagatgaaactccagccctttgcc

SEQ ID NO: 737913 - DNA, 25 bp, Mus musculus
taagatgaaactgcagccctttgcc

SEQ ID NO: 737914 - DNA, 25 bp, Mus musculus
taagatgaagaacagtaccaagccc

SEQ ID NO: 737915 - DNA, 25 bp, Mus musculus
taagatgaagaagagtaccaagccc

SEQ ID NO: 737916 - DNA, 25 bp, Mus musculus
taagatgaccagctgcagctacgtg

SEQ ID NO: 737917 - DNA, 25 bp, Mus musculus
taagatgaccaggtgcagctacgtg

SEQ ID NO: 737918 - DNA, 25 bp, Mus musculus
taagatgagaaacgaaatgaatgtc

SEQ ID NO: 737919 - DNA, 25 bp, Mus musculus
taagatgagaaaggaaatgaatgtc

SEQ ID NO: 737920 - DNA, 25 bp, Mus musculus
taagatgataacattttcccacagg

SEQ ID NO: 737921 - DNA, 25 bp, Mus musculus
taagatgataactttttcccacagg

SEQ ID NO: 737922 - DNA, 25 bp, Mus musculus
taagatgattggcttctccgagaca

SEQ ID NO: 737923 - DNA, 25 bp, Mus musculus
taagatgattgggttctccgagaca

SEQ ID NO: 737924 - DNA, 25 bp, Mus musculus
taagatgcgtgacatgcagatggac

SEQ ID NO: 737925 - DNA, 25 bp, Mus musculus
taagatgcgtgagatgcagatggac

SEQ ID NO: 737926 - DNA, 25 bp, Mus musculus
taagatgctctaattccaacatccg

SEQ ID NO: 737927 - DNA, 25 bp, Mus musculus
taagatgctctatttccaacatccg

SEQ ID NO: 737928 - DNA, 25 bp, Mus musculus
taagatgctgcaatctcaactgaca

SEQ ID NO: 737929 - DNA, 25 bp, Mus musculus
taagatgctgcattctcaactgaca

SEQ ID NO: 737930 - DNA, 25 bp, Mus musculus
taagatggaaaccatttgagattcc

SEQ ID NO: 737931 - DNA, 25 bp, Mus musculus
taagatggaaacgatttgagattcc

SEQ ID NO: 737932 - DNA, 25 bp, Mus musculus
taagatggagctactgaccgcactg

SEQ ID NO: 737933 - DNA, 25 bp, Mus musculus
taagatggagcttctgaccgcactg

SEQ ID NO: 737934 - DNA, 25 bp, Mus musculus
taagatggccaacattgtatgcaca

SEQ ID NO: 737935 - DNA, 25 bp, Mus musculus
taagatggccaagattgtatgcaca

SEQ ID NO: 737936 - DNA, 25 bp, Mus musculus
taagatggccttctacaacggctgg

SEQ ID NO: 737937 - DNA, 25 bp, Mus musculus
taagatggccttgtacaacggctgg

SEQ ID NO: 737938 - DNA, 25 bp, Mus musculus
taagatggcgtcctcctgttcgcgg

SEQ ID NO: 737939 - DNA, 25 bp, Mus musculus
taagatggcgtcgtcctgttcgcgg

SEQ ID NO: 737940 - DNA, 25 bp, Mus musculus
taagatggctgacgtctcagcagaa

SEQ ID NO: 737941 - DNA, 25 bp, Mus musculus
taagatggctgaggtctcagcagaa

SEQ ID NO: 737942 - DNA, 25 bp, Mus musculus
taagatgggagtcatgctggcacct

SEQ ID NO: 737943 - DNA, 25 bp, Mus musculus
taagatgggagtgatgctggcacct

SEQ ID NO: 737944 - DNA, 25 bp, Mus musculus
taagatggtacacacaccctatggc

SEQ ID NO: 737945 - DNA, 25 bp, Mus musculus
taagatggtacagacaccctatggc

SEQ ID NO: 737946 - DNA, 25 bp, Mus musculus
taagatgtaccccattgattttgag

SEQ ID NO: 737947 - DNA, 25 bp, Mus musculus
taagatgtacccgattgattttgag

SEQ ID NO: 737948 - DNA, 25 bp, Mus musculus
taagatgtccacaaggacccctttg

SEQ ID NO: 737949 - DNA, 25 bp, Mus musculus
taagatgtccactaggacccctttg

SEQ ID NO: 737950 - DNA, 25 bp, Mus musculus
taagatgtccttctgagtccaaacc

SEQ ID NO: 737951 - DNA, 25 bp, Mus musculus
taagatgtccttgtgagtccaaacc

SEQ ID NO: 737952 - DNA, 25 bp, Mus musculus
taagatgttaatagagcacgactcg

SEQ ID NO: 737953 - DNA, 25 bp, Mus musculus
taagatgttaattgagcacgactcg

SEQ ID NO: 737954 - DNA, 25 bp, Mus musculus
taagatgttagtcattgacccagcg

SEQ ID NO: 737955 - DNA, 25 bp, Mus musculus
taagatgttagtgattgacccagcg

SEQ ID NO: 737956 - DNA, 25 bp, Mus musculus
taagatgttcagctgacttgctcca

SEQ ID NO: 737957 - DNA, 25 bp, Mus musculus
taagatgttcaggtgacttgctcca

SEQ ID NO: 737958 - DNA, 25 bp, Mus musculus
taagatgttcgtcttctcaggacag

SEQ ID NO: 737959 - DNA, 25 bp, Mus musculus
taagatgttcgtgttctcaggacag

SEQ ID NO: 737960 - DNA, 25 bp, Mus musculus
taagattaagaaccagcctgagagg

SEQ ID NO: 737961 - DNA, 25 bp, Mus musculus
taagattaagaagcagcctgagagg

SEQ ID NO: 737962 - DNA, 25 bp, Mus musculus
taagattacaaaagacttgttccac

SEQ ID NO: 737963 - DNA, 25 bp, Mus musculus
taagattacaaatgacttgttccac

SEQ ID NO: 737964 - DNA, 25 bp, Mus musculus
taagattcagcaacctgcagggcgt

SEQ ID NO: 737965 - DNA, 25 bp, Mus musculus
taagattcagcatcctgcagggcgt

SEQ ID NO: 737966 - DNA, 25 bp, Mus musculus
taagattcatctcgcagtcaggaga

SEQ ID NO: 737967 - DNA, 25 bp, Mus musculus
taagattcatctggcagtcaggaga

SEQ ID NO: 737968 - DNA, 25 bp, Mus musculus
taagattcggtccatggagctgagc

SEQ ID NO: 737969 - DNA, 25 bp, Mus musculus
taagattcggtcgatggagctgagc

SEQ ID NO: 737970 - DNA, 25 bp, Mus musculus
taagattcttcaaaatgatccagag

SEQ ID NO: 737971 - DNA, 25 bp, Mus musculus
taagattcttcataatgatccagag

SEQ ID NO: 737972 - DNA, 25 bp, Mus musculus
taagattgcaaaagcctatgttatc

SEQ ID NO: 737973 - DNA, 25 bp, Mus musculus
taagattgcaaatgcctatgttatc

SEQ ID NO: 737974 - DNA, 25 bp, Mus musculus
taagattgtcctctgatgtcttcta

SEQ ID NO: 737975 - DNA, 25 bp, Mus musculus
taagattgtcctgtgatgtcttcta

SEQ ID NO: 737976 - DNA, 25 bp, Mus musculus
taagatttgtgaccccagtgaactg

SEQ ID NO: 737977 - DNA, 25 bp, Mus musculus
taagatttgtgagcccagtgaactg

SEQ ID NO: 737978 - DNA, 25 bp, Mus musculus
taagattttaacctcaccctgagtg

SEQ ID NO: 737979 - DNA, 25 bp, Mus musculus
taagattttaacgtcaccctgagtg

SEQ ID NO: 737980 - DNA, 25 bp, Mus musculus
taagcaaaacgtccccatcatccgt

SEQ ID NO: 737981 - DNA, 25 bp, Mus musculus
taagcaaaacgtgcccatcatccgt

SEQ ID NO: 737982 - DNA, 25 bp, Mus musculus
taagcaaaactcacgtagactgtgt

SEQ ID NO: 737983 - DNA, 25 bp, Mus musculus
taagcaaaactctcgtagactgtgt

SEQ ID NO: 737984 - DNA, 25 bp, Mus musculus
taagcaaaagctagaaagccttcag

SEQ ID NO: 737985 - DNA, 25 bp, Mus musculus
taagcaaaagcttgaaagccttcag

SEQ ID NO: 737986 - DNA, 25 bp, Mus musculus
taagcaaagaatagctctgcagaga

SEQ ID NO: 737987 - DNA, 25 bp, Mus musculus
taagcaaagaattgctctgcagaga

SEQ ID NO: 737988 - DNA, 25 bp, Mus musculus
taagcaaagtgcacttgttacaggt

SEQ ID NO: 737989 - DNA, 25 bp, Mus musculus
taagcaaagtgctcttgttacaggt

SEQ ID NO: 737990 - DNA, 25 bp, Mus musculus
taagcaactgcgagaacaagtaaac

SEQ ID NO: 737991 - DNA, 25 bp, Mus musculus
taagcaactgcgtgaacaagtaaac

SEQ ID NO: 737992 - DNA, 25 bp, Mus musculus
taagcaagaactccagctttcacgc

SEQ ID NO: 737993 - DNA, 25 bp, Mus musculus
taagcaagaactgcagctttcacgc

SEQ ID NO: 737994 - DNA, 25 bp, Mus musculus
taagcaagccatagacaagatgcag

SEQ ID NO: 737995 - DNA, 25 bp, Mus musculus
taagcaagccattgacaagatgcag

SEQ ID NO: 737996 - DNA, 25 bp, Mus musculus
taagcaaggctgatcattcaatctt

SEQ ID NO: 737997 - DNA, 25 bp, Mus musculus
taagcaaggctgttcattcaatctt

SEQ ID NO: 737998 - DNA, 25 bp, Mus musculus
taagcaagggatccgtgaagttatt

SEQ ID NO: 737999 - DNA, 25 bp, Mus musculus
taagcaagggatgcgtgaagttatt

SEQ ID NO: 738000 - DNA, 25 bp, Mus musculus
taagcaatccgtctgggagaagccc

SEQ ID NO: 738001 - DNA, 25 bp, Mus musculus
taagcaatccgtgtgggagaagccc

SEQ ID NO: 738002 - DNA, 25 bp, Mus musculus
taagcaatttccagagcccaagaat

SEQ ID NO: 738003 - DNA, 25 bp, Mus musculus
taagcaatttcctgagcccaagaat

SEQ ID NO: 738004 - DNA, 25 bp, Mus musculus
taagcacagtgcctccttagaaggg

SEQ ID NO: 738005 - DNA, 25 bp, Mus musculus
taagcacagtgcgtccttagaaggg

SEQ ID NO: 738006 - DNA, 25 bp, Mus musculus
taagcacatgatcgctttcattgaa

SEQ ID NO: 738007 - DNA, 25 bp, Mus musculus
taagcacatgatggctttcattgaa

SEQ ID NO: 738008 - DNA, 25 bp, Mus musculus
taagcacattgaatgaaagacagat

SEQ ID NO: 738009 - DNA, 25 bp, Mus musculus
taagcacattgattgaaagacagat

SEQ ID NO: 738010 - DNA, 25 bp, Mus musculus
taagcaccacaactataaggaaatg

SEQ ID NO: 738011 - DNA, 25 bp, Mus musculus
taagcaccacaagtataaggaaatg

SEQ ID NO: 738012 - DNA, 25 bp, Mus musculus
taagcaccatggaggatagcactct

SEQ ID NO: 738013 - DNA, 25 bp, Mus musculus
taagcaccatggtggatagcactct

SEQ ID NO: 738014 - DNA, 25 bp, Mus musculus
taagcaccgtggattctggaacgag

SEQ ID NO: 738015 - DNA, 25 bp, Mus musculus
taagcaccgtggtttctggaacgag

SEQ ID NO: 738016 - DNA, 25 bp, Mus musculus
taagcaccttagcagaagggacctt

SEQ ID NO: 738017 - DNA, 25 bp, Mus musculus
taagcaccttaggagaagggacctt

SEQ ID NO: 738018 - DNA, 25 bp, Mus musculus
taagcaccttctcagctatgacgga

SEQ ID NO: 738019 - DNA, 25 bp, Mus musculus
taagcaccttctgagctatgacgga

SEQ ID NO: 738020 - DNA, 25 bp, Mus musculus
taagcaccttgcacagcctgacact

SEQ ID NO: 738021 - DNA, 25 bp, Mus musculus
taagcaccttgctcagcctgacact

SEQ ID NO: 738022 - DNA, 25 bp, Mus musculus
taagcacgctatagcagttatttgg

SEQ ID NO: 738023 - DNA, 25 bp, Mus musculus
taagcacgctattgcagttatttgg

SEQ ID NO: 738024 - DNA, 25 bp, Mus musculus
taagcacgtgcactccatacagtgg

SEQ ID NO: 738025 - DNA, 25 bp, Mus musculus
taagcacgtgcagtccatacagtgg

SEQ ID NO: 738026 - DNA, 25 bp, Mus musculus
taagcactacagcatccatcagtgg

SEQ ID NO: 738027 - DNA, 25 bp, Mus musculus
taagcactacaggatccatcagtgg

SEQ ID NO: 738028 - DNA, 25 bp, Mus musculus
taagcactagagatatttgcgctat

SEQ ID NO: 738029 - DNA, 25 bp, Mus musculus
taagcactagagttatttgcgctat

SEQ ID NO: 738030 - DNA, 25 bp, Mus musculus
taagcacttttcacagccttctggg

SEQ ID NO: 738031 - DNA, 25 bp, Mus musculus
taagcacttttctcagccttctggg

SEQ ID NO: 738032 - DNA, 25 bp, Mus musculus
taagcagaacctccttccacgtttc

SEQ ID NO: 738033 - DNA, 25 bp, Mus musculus
taagcagaacctgcttccacgtttc

SEQ ID NO: 738034 - DNA, 25 bp, Mus musculus
taagcagaagatacacgtccggaag

SEQ ID NO: 738035 - DNA, 25 bp, Mus musculus
taagcagaagattcacgtccggaag

SEQ ID NO: 738036 - DNA, 25 bp, Mus musculus
taagcagacggcattactggatgca

SEQ ID NO: 738037 - DNA, 25 bp, Mus musculus
taagcagacggctttactggatgca

SEQ ID NO: 738038 - DNA, 25 bp, Mus musculus
taagcagatgcacctgtgactgact

SEQ ID NO: 738039 - DNA, 25 bp, Mus musculus
taagcagatgcagctgtgactgact

SEQ ID NO: 738040 - DNA, 25 bp, Mus musculus
taagcagcaagcagtgcgagaggat

SEQ ID NO: 738041 - DNA, 25 bp, Mus musculus
taagcagcaagctgtgcgagaggat

SEQ ID NO: 738042 - DNA, 25 bp, Mus musculus
taagcagcagacagtgcgtctaagt

SEQ ID NO: 738043 - DNA, 25 bp, Mus musculus
taagcagcagactgtgcgtctaagt

SEQ ID NO: 738044 - DNA, 25 bp, Mus musculus
taagcagcagcgatcgaggtaagcg

SEQ ID NO: 738045 - DNA, 25 bp, Mus musculus
taagcagcagcgttcgaggtaagcg

SEQ ID NO: 738046 - DNA, 25 bp, Mus musculus
taagcagcatctagccaggcagttc

SEQ ID NO: 738047 - DNA, 25 bp, Mus musculus
taagcagcatcttgccaggcagttc

SEQ ID NO: 738048 - DNA, 25 bp, Mus musculus
taagcagccatgactacaagcacct

SEQ ID NO: 738049 - DNA, 25 bp, Mus musculus
taagcagccatgtctacaagcacct

SEQ ID NO: 738050 - DNA, 25 bp, Mus musculus
taagcagccccgagaagtgtgtctc

SEQ ID NO: 738051 - DNA, 25 bp, Mus musculus
taagcagccccgtgaagtgtgtctc

SEQ ID NO: 738052 - DNA, 25 bp, Mus musculus
taagcagcgaaacggtgatccgttc

SEQ ID NO: 738053 - DNA, 25 bp, Mus musculus
taagcagcgaaagggtgatccgttc

SEQ ID NO: 738054 - DNA, 25 bp, Mus musculus
taagcagctacacggaagtattgaa

SEQ ID NO: 738055 - DNA, 25 bp, Mus musculus
taagcagctacagggaagtattgaa

SEQ ID NO: 738056 - DNA, 25 bp, Mus musculus
taagcaggacagagccttttctaac

SEQ ID NO: 738057 - DNA, 25 bp, Mus musculus
taagcaggacagtgccttttctaac

SEQ ID NO: 738058 - DNA, 25 bp, Mus musculus
taagcaggagcaacgcattggaggc

SEQ ID NO: 738059 - DNA, 25 bp, Mus musculus
taagcaggagcatcgcattggaggc

SEQ ID NO: 738060 - DNA, 25 bp, Mus musculus
taagcaggcagtcattatgcgtctc

SEQ ID NO: 738061 - DNA, 25 bp, Mus musculus
taagcaggcagtgattatgcgtctc

SEQ ID NO: 738062 - DNA, 25 bp, Mus musculus
taagcaggccacaacctacggcatg

SEQ ID NO: 738063 - DNA, 25 bp, Mus musculus
taagcaggccactacctacggcatg

SEQ ID NO: 738064 - DNA, 25 bp, Mus musculus
taagcagggcgaatggtacatggca

SEQ ID NO: 738065 - DNA, 25 bp, Mus musculus
taagcagggcgattggtacatggca

SEQ ID NO: 738066 - DNA, 25 bp, Mus musculus
taagcaggtaagatgctccagcacc

SEQ ID NO: 738067 - DNA, 25 bp, Mus musculus
taagcaggtaagttgctccagcacc

SEQ ID NO: 738068 - DNA, 25 bp, Mus musculus
taagcagtcactctttagtccagaa

SEQ ID NO: 738069 - DNA, 25 bp, Mus musculus
taagcagtcactgtttagtccagaa

SEQ ID NO: 738070 - DNA, 25 bp, Mus musculus
taagcagtccatctacattgtaacc

SEQ ID NO: 738071 - DNA, 25 bp, Mus musculus
taagcagtccatgtacattgtaacc

SEQ ID NO: 738072 - DNA, 25 bp, Mus musculus
taagcagtgactcccatgcgggaac

SEQ ID NO: 738073 - DNA, 25 bp, Mus musculus
taagcagtgactgccatgcgggaac

SEQ ID NO: 738074 - DNA, 25 bp, Mus musculus
taagcagtgcatccgtctgtgaccc

SEQ ID NO: 738075 - DNA, 25 bp, Mus musculus
taagcagtgcatgcgtctgtgaccc

SEQ ID NO: 738076 - DNA, 25 bp, Mus musculus
taagcagtttgcaatgcaggcagag

SEQ ID NO: 738077 - DNA, 25 bp, Mus musculus
taagcagtttgctatgcaggcagag

SEQ ID NO: 738078 - DNA, 25 bp, Mus musculus
taagcataagacacgcaggtcacct

SEQ ID NO: 738079 - DNA, 25 bp, Mus musculus
taagcataagactcgcaggtcacct

SEQ ID NO: 738080 - DNA, 25 bp, Mus musculus
taagcatactgaaaccctaaggagg

SEQ ID NO: 738081 - DNA, 25 bp, Mus musculus
taagcatactgataccctaaggagg

SEQ ID NO: 738082 - DNA, 25 bp, Mus musculus
taagcatatcttactgtcggagcag

SEQ ID NO: 738083 - DNA, 25 bp, Mus musculus
taagcatatctttctgtcggagcag

SEQ ID NO: 738084 - DNA, 25 bp, Mus musculus
taagcatcaggacctagacactctg

SEQ ID NO: 738085 - DNA, 25 bp, Mus musculus
taagcatcaggagctagacactctg

SEQ ID NO: 738086 - DNA, 25 bp, Mus musculus
taagcatcgactcatacctcagggc

SEQ ID NO: 738087 - DNA, 25 bp, Mus musculus
taagcatcgactgatacctcagggc

SEQ ID NO: 738088 - DNA, 25 bp, Mus musculus
taagcatcgggtctcttgtgatcta

SEQ ID NO: 738089 - DNA, 25 bp, Mus musculus
taagcatcgggtgtcttgtgatcta

SEQ ID NO: 738090 - DNA, 25 bp, Mus musculus
taagcatcttcacgtccccttgggc

SEQ ID NO: 738091 - DNA, 25 bp, Mus musculus
taagcatcttcaggtccccttgggc

SEQ ID NO: 738092 - DNA, 25 bp, Mus musculus
taagcatgattccatcgggcaggat

SEQ ID NO: 738093 - DNA, 25 bp, Mus musculus
taagcatgattcgatcgggcaggat

SEQ ID NO: 738094 - DNA, 25 bp, Mus musculus
taagcatgccgacaagatcgaggag

SEQ ID NO: 738095 - DNA, 25 bp, Mus musculus
taagcatgccgagaagatcgaggag

SEQ ID NO: 738096 - DNA, 25 bp, Mus musculus
taagcatggaacagtagcttcccgc

SEQ ID NO: 738097 - DNA, 25 bp, Mus musculus
taagcatggaactgtagcttcccgc

SEQ ID NO: 738098 - DNA, 25 bp, Mus musculus
taagcatggttaagtgcccaaagaa

SEQ ID NO: 738099 - DNA, 25 bp, Mus musculus
taagcatggttatgtgcccaaagaa

SEQ ID NO: 738100 - DNA, 25 bp, Mus musculus
taagcatgtctactactacctcaag

SEQ ID NO: 738101 - DNA, 25 bp, Mus musculus
taagcatgtctagtactacctcaag

SEQ ID NO: 738102 - DNA, 25 bp, Mus musculus
taagcattacaacctaactgacacg

SEQ ID NO: 738103 - DNA, 25 bp, Mus musculus
taagcattacaagctaactgacacg

SEQ ID NO: 738104 - DNA, 25 bp, Mus musculus
taagcattagggactgttttggccc

SEQ ID NO: 738105 - DNA, 25 bp, Mus musculus
taagcattagggtctgttttggccc

SEQ ID NO: 738106 - DNA, 25 bp, Mus musculus
taagcattgaaaatggagcaagtgt

SEQ ID NO: 738107 - DNA, 25 bp, Mus musculus
taagcattgaaattggagcaagtgt

SEQ ID NO: 738108 - DNA, 25 bp, Mus musculus
taagcattttagatccacctgccat

SEQ ID NO: 738109 - DNA, 25 bp, Mus musculus
taagcattttagttccacctgccat

SEQ ID NO: 738110 - DNA, 25 bp, Mus musculus
taagccaagaaaacagcctgccaag

SEQ ID NO: 738111 - DNA, 25 bp, Mus musculus
taagccaagaaatcagcctgccaag

SEQ ID NO: 738112 - DNA, 25 bp, Mus musculus
taagccaagagcagaggattcaggc

SEQ ID NO: 738113 - DNA, 25 bp, Mus musculus
taagccaagagctgaggattcaggc

SEQ ID NO: 738114 - DNA, 25 bp, Mus musculus
taagccaagagtcgcgactccagaa

SEQ ID NO: 738115 - DNA, 25 bp, Mus musculus
taagccaagagtggcgactccagaa

SEQ ID NO: 738116 - DNA, 25 bp, Mus musculus
taagccaagccaacactggaggagt

SEQ ID NO: 738117 - DNA, 25 bp, Mus musculus
taagccaagccatcactggaggagt

SEQ ID NO: 738118 - DNA, 25 bp, Mus musculus
taagccaaggtcaagagcctatccc

SEQ ID NO: 738119 - DNA, 25 bp, Mus musculus
taagccaaggtctagagcctatccc

SEQ ID NO: 738120 - DNA, 25 bp, Mus musculus
taagccaatcacctctgagaaaatc

SEQ ID NO: 738121 - DNA, 25 bp, Mus musculus
taagccaatcacgtctgagaaaatc

SEQ ID NO: 738122 - DNA, 25 bp, Mus musculus
taagccacaaccactgctcagagaa

SEQ ID NO: 738123 - DNA, 25 bp, Mus musculus
taagccacaacctctgctcagagaa

SEQ ID NO: 738124 - DNA, 25 bp, Mus musculus
taagccacatccatagaaggcgcca

SEQ ID NO: 738125 - DNA, 25 bp, Mus musculus
taagccacatccttagaaggcgcca

SEQ ID NO: 738126 - DNA, 25 bp, Mus musculus
taagccacgaggaaagcaggaaagc

SEQ ID NO: 738127 - DNA, 25 bp, Mus musculus
taagccacgaggtaagcaggaaagc

SEQ ID NO: 738128 - DNA, 25 bp, Mus musculus
taagccacttttcacttgagatcag

SEQ ID NO: 738129 - DNA, 25 bp, Mus musculus
taagccacttttgacttgagatcag

SEQ ID NO: 738130 - DNA, 25 bp, Mus musculus
taagccagagaacttggctccttcc

SEQ ID NO: 738131 - DNA, 25 bp, Mus musculus
taagccagagaagttggctccttcc

SEQ ID NO: 738132 - DNA, 25 bp, Mus musculus
taagccagaggcacaggatttggaa

SEQ ID NO: 738133 - DNA, 25 bp, Mus musculus
taagccagaggctcaggatttggaa

SEQ ID NO: 738134 - DNA, 25 bp, Mus musculus
taagccagcaagctgttaattccaa

SEQ ID NO: 738135 - DNA, 25 bp, Mus musculus
taagccagcaaggtgttaattccaa

SEQ ID NO: 738136 - DNA, 25 bp, Mus musculus
taagccagcagcactggagcaaggt

SEQ ID NO: 738137 - DNA, 25 bp, Mus musculus
taagccagcagctctggagcaaggt

SEQ ID NO: 738138 - DNA, 25 bp, Mus musculus
taagccagcatgaccgggacccgag

SEQ ID NO: 738139 - DNA, 25 bp, Mus musculus
taagccagcatgtccgggacccgag

SEQ ID NO: 738140 - DNA, 25 bp, Mus musculus
taagccaggcttcagagtgaacgac

SEQ ID NO: 738141 - DNA, 25 bp, Mus musculus
taagccaggcttgagagtgaacgac

SEQ ID NO: 738142 - DNA, 25 bp, Mus musculus
taagccaggtttacctaagaggcca

SEQ ID NO: 738143 - DNA, 25 bp, Mus musculus
taagccaggttttcctaagaggcca

SEQ ID NO: 738144 - DNA, 25 bp, Mus musculus
taagccagtgggagccctaaatgcg

SEQ ID NO: 738145 - DNA, 25 bp, Mus musculus
taagccagtgggtgccctaaatgcg

SEQ ID NO: 738146 - DNA, 25 bp, Mus musculus
taagccatgctcagcagtaccgatg

SEQ ID NO: 738147 - DNA, 25 bp, Mus musculus
taagccatgctctgcagtaccgatg

SEQ ID NO: 738148 - DNA, 25 bp, Mus musculus
taagccatgtggactttttggcaag

SEQ ID NO: 738149 - DNA, 25 bp, Mus musculus
taagccatgtggtctttttggcaag

SEQ ID NO: 738150 - DNA, 25 bp, Mus musculus
taagccattactcctgaagaatggg

SEQ ID NO: 738151 - DNA, 25 bp, Mus musculus
taagccattactgctgaagaatggg

SEQ ID NO: 738152 - DNA, 25 bp, Mus musculus
taagcccaaagtcgtatgtcaccct

SEQ ID NO: 738153 - DNA, 25 bp, Mus musculus
taagcccaaagtggtatgtcaccct

SEQ ID NO: 738154 - DNA, 25 bp, Mus musculus
taagcccaatgtcgagacggagcct

SEQ ID NO: 738155 - DNA, 25 bp, Mus musculus
taagcccaatgtggagacggagcct

SEQ ID NO: 738156 - DNA, 25 bp, Mus musculus
taagcccacacgaggctggctgcat

SEQ ID NO: 738157 - DNA, 25 bp, Mus musculus
taagcccacacgtggctggctgcat

SEQ ID NO: 738158 - DNA, 25 bp, Mus musculus
taagcccagagtccgaagtatccgc

SEQ ID NO: 738159 - DNA, 25 bp, Mus musculus
taagcccagagtgcgaagtatccgc

SEQ ID NO: 738160 - DNA, 25 bp, Mus musculus
taagcccagataccctgtaagccag

SEQ ID NO: 738161 - DNA, 25 bp, Mus musculus
taagcccagatagcctgtaagccag

SEQ ID NO: 738162 - DNA, 25 bp, Mus musculus
taagcccaggcacggacttgctcat

SEQ ID NO: 738163 - DNA, 25 bp, Mus musculus
taagcccaggcagggacttgctcat

SEQ ID NO: 738164 - DNA, 25 bp, Mus musculus
taagcccatcgacaagaaggcacct

SEQ ID NO: 738165 - DNA, 25 bp, Mus musculus
taagcccatcgagaagaaggcacct

SEQ ID NO: 738166 - DNA, 25 bp, Mus musculus
taagccccatctcgttggtggcctc

SEQ ID NO: 738167 - DNA, 25 bp, Mus musculus
taagccccatctggttggtggcctc

SEQ ID NO: 738168 - DNA, 25 bp, Mus musculus
taagccccggaacaagcaaaatcac

SEQ ID NO: 738169 - DNA, 25 bp, Mus musculus
taagccccggaagaagcaaaatcac

SEQ ID NO: 738170 - DNA, 25 bp, Mus musculus
taagcccctccactagctgttcagt

SEQ ID NO: 738171 - DNA, 25 bp, Mus musculus
taagcccctccagtagctgttcagt

SEQ ID NO: 738172 - DNA, 25 bp, Mus musculus
taagcccctcctcatggagtggtgg

SEQ ID NO: 738173 - DNA, 25 bp, Mus musculus
taagcccctcctgatggagtggtgg

SEQ ID NO: 738174 - DNA, 25 bp, Mus musculus
taagcccggacacagggctgtgtat

SEQ ID NO: 738175 - DNA, 25 bp, Mus musculus
taagcccggacagagggctgtgtat

SEQ ID NO: 738176 - DNA, 25 bp, Mus musculus
taagcccgggatccaaggtagcatg

SEQ ID NO: 738177 - DNA, 25 bp, Mus musculus
taagcccgggatgcaaggtagcatg

SEQ ID NO: 738178 - DNA, 25 bp, Mus musculus
taagcccggtatctattgctgtgct

SEQ ID NO: 738179 - DNA, 25 bp, Mus musculus
taagcccggtatgtattgctgtgct

SEQ ID NO: 738180 - DNA, 25 bp, Mus musculus
taagccctatgtcagggtgactatg

SEQ ID NO: 738181 - DNA, 25 bp, Mus musculus
taagccctatgtgagggtgactatg

SEQ ID NO: 738182 - DNA, 25 bp, Mus musculus
taagccctctaacgcaaagccggca

SEQ ID NO: 738183 - DNA, 25 bp, Mus musculus
taagccctctaaggcaaagccggca

SEQ ID NO: 738184 - DNA, 25 bp, Mus musculus
taagccctgggaccatagactgttc

SEQ ID NO: 738185 - DNA, 25 bp, Mus musculus
taagccctgggagcatagactgttc

SEQ ID NO: 738186 - DNA, 25 bp, Mus musculus
taagccctttgtactccctgggaat

SEQ ID NO: 738187 - DNA, 25 bp, Mus musculus
taagccctttgttctccctgggaat

SEQ ID NO: 738188 - DNA, 25 bp, Mus musculus
taagccgatctcaccaaggtgcctg

SEQ ID NO: 738189 - DNA, 25 bp, Mus musculus
taagccgatctctccaaggtgcctg

SEQ ID NO: 738190 - DNA, 25 bp, Mus musculus
taagccgccagccaaaatgtgtaag

SEQ ID NO: 738191 - DNA, 25 bp, Mus musculus
taagccgccagcgaaaatgtgtaag

SEQ ID NO: 738192 - DNA, 25 bp, Mus musculus
taagccggacctcacgttggaggaa

SEQ ID NO: 738193 - DNA, 25 bp, Mus musculus
taagccggacctgacgttggaggaa

SEQ ID NO: 738194 - DNA, 25 bp, Mus musculus
taagccggcgacctctggctttaag

SEQ ID NO: 738195 - DNA, 25 bp, Mus musculus
taagccggcgacgtctggctttaag

SEQ ID NO: 738196 - DNA, 25 bp, Mus musculus
taagccgggacacttccagaacact

SEQ ID NO: 738197 - DNA, 25 bp, Mus musculus
taagccgggacagttccagaacact

SEQ ID NO: 738198 - DNA, 25 bp, Mus musculus
taagccgggtgtccgagcagtcccc

SEQ ID NO: 738199 - DNA, 25 bp, Mus musculus
taagccgggtgtgcgagcagtcccc

SEQ ID NO: 738200 - DNA, 25 bp, Mus musculus
taagcctaagacaacctgactgtgc

SEQ ID NO: 738201 - DNA, 25 bp, Mus musculus
taagcctaagactacctgactgtgc

SEQ ID NO: 738202 - DNA, 25 bp, Mus musculus
taagcctaaggtagactatgtggag

SEQ ID NO: 738203 - DNA, 25 bp, Mus musculus
taagcctaaggttgactatgtggag

SEQ ID NO: 738204 - DNA, 25 bp, Mus musculus
taagcctaccctccagtatctgagg

SEQ ID NO: 738205 - DNA, 25 bp, Mus musculus
taagcctaccctgcagtatctgagg

SEQ ID NO: 738206 - DNA, 25 bp, Mus musculus
taagcctacctcctgccgtgtggtg

SEQ ID NO: 738207 - DNA, 25 bp, Mus musculus
taagcctacctcgtgccgtgtggtg

SEQ ID NO: 738208 - DNA, 25 bp, Mus musculus
taagcctatggaaaagaccacaccg

SEQ ID NO: 738209 - DNA, 25 bp, Mus musculus
taagcctatggataagaccacaccg

SEQ ID NO: 738210 - DNA, 25 bp, Mus musculus
taagcctattgccaaggtcactgcc

SEQ ID NO: 738211 - DNA, 25 bp, Mus musculus
taagcctattgcgaaggtcactgcc

SEQ ID NO: 738212 - DNA, 25 bp, Mus musculus
taagcctcctcgacgtctcagttta

SEQ ID NO: 738213 - DNA, 25 bp, Mus musculus
taagcctcctcgtcgtctcagttta

SEQ ID NO: 738214 - DNA, 25 bp, Mus musculus
taagcctcgattcaagagttatgcc

SEQ ID NO: 738215 - DNA, 25 bp, Mus musculus
taagcctcgattgaagagttatgcc

SEQ ID NO: 738216 - DNA, 25 bp, Mus musculus
taagcctcggacacttcacctgtgg

SEQ ID NO: 738217 - DNA, 25 bp, Mus musculus
taagcctcggactcttcacctgtgg

SEQ ID NO: 738218 - DNA, 25 bp, Mus musculus
taagcctgccgtataaaagagcctg

SEQ ID NO: 738219 - DNA, 25 bp, Mus musculus
taagcctgccgtttaaaagagcctg

SEQ ID NO: 738220 - DNA, 25 bp, Mus musculus
taagcctggaaaaatacttctgatg

SEQ ID NO: 738221 - DNA, 25 bp, Mus musculus
taagcctggaaatatacttctgatg

SEQ ID NO: 738222 - DNA, 25 bp, Mus musculus
taagcctggagcaggcctaaagttc

SEQ ID NO: 738223 - DNA, 25 bp, Mus musculus
taagcctggagctggcctaaagttc

SEQ ID NO: 738224 - DNA, 25 bp, Mus musculus
taagcctggtgtctttaactttgtc

SEQ ID NO: 738225 - DNA, 25 bp, Mus musculus
taagcctggtgtgtttaactttgtc

SEQ ID NO: 738226 - DNA, 25 bp, Mus musculus
taagcctgtatgagaaggacaacac

SEQ ID NO: 738227 - DNA, 25 bp, Mus musculus
taagcctgtatgtgaaggacaacac

SEQ ID NO: 738228 - DNA, 25 bp, Mus musculus
taagcctgtcaaaaaagggaggaag

SEQ ID NO: 738229 - DNA, 25 bp, Mus musculus
taagcctgtcaataaagggaggaag

SEQ ID NO: 738230 - DNA, 25 bp, Mus musculus
taagcctgtccacgcagagtatctg

SEQ ID NO: 738231 - DNA, 25 bp, Mus musculus
taagcctgtccaggcagagtatctg

SEQ ID NO: 738232 - DNA, 25 bp, Mus musculus
taagcctgttttcactaggctctgg

SEQ ID NO: 738233 - DNA, 25 bp, Mus musculus
taagcctgttttgactaggctctgg

SEQ ID NO: 738234 - DNA, 25 bp, Mus musculus
taagccttagcacctgagttagaac

SEQ ID NO: 738235 - DNA, 25 bp, Mus musculus
taagccttagcagctgagttagaac

SEQ ID NO: 738236 - DNA, 25 bp, Mus musculus
taagccttaggaatatagcactgga

SEQ ID NO: 738237 - DNA, 25 bp, Mus musculus
taagccttaggattatagcactgga

SEQ ID NO: 738238 - DNA, 25 bp, Mus musculus
taagcctttgcaacccctggtgagg

SEQ ID NO: 738239 - DNA, 25 bp, Mus musculus
taagcctttgcatcccctggtgagg

SEQ ID NO: 738240 - DNA, 25 bp, Mus musculus
taagcgaacgaaccataaatggaga

SEQ ID NO: 738241 - DNA, 25 bp, Mus musculus
taagcgaacgaagcataaatggaga

SEQ ID NO: 738242 - DNA, 25 bp, Mus musculus
taagcgaagaagaagtcgctcctgg

SEQ ID NO: 738243 - DNA, 25 bp, Mus musculus
taagcgaagaagtagtcgctcctgg

SEQ ID NO: 738244 - DNA, 25 bp, Mus musculus
taagcgagatgtagtaacagagacg

SEQ ID NO: 738245 - DNA, 25 bp, Mus musculus
taagcgagatgttgtaacagagacg

SEQ ID NO: 738246 - DNA, 25 bp, Mus musculus
taagcgagtgctagagctcgaccag

SEQ ID NO: 738247 - DNA, 25 bp, Mus musculus
taagcgagtgcttgagctcgaccag

SEQ ID NO: 738248 - DNA, 25 bp, Mus musculus
taagcgagttcaagttatcaagaat

SEQ ID NO: 738249 - DNA, 25 bp, Mus musculus
taagcgagttcatgttatcaagaat

SEQ ID NO: 738250 - DNA, 25 bp, Mus musculus
taagcgattctgaaagaccaacccc

SEQ ID NO: 738251 - DNA, 25 bp, Mus musculus
taagcgattctgtaagaccaacccc

SEQ ID NO: 738252 - DNA, 25 bp, Mus musculus
taagcgattgctcgatggagacgaa

SEQ ID NO: 738253 - DNA, 25 bp, Mus musculus
taagcgattgctggatggagacgaa

SEQ ID NO: 738254 - DNA, 25 bp, Mus musculus
taagcgcatttgcagcactaggaga

SEQ ID NO: 738255 - DNA, 25 bp, Mus musculus
taagcgcatttggagcactaggaga

SEQ ID NO: 738256 - DNA, 25 bp, Mus musculus
taagcgcgcctaccgagaactagtt

SEQ ID NO: 738257 - DNA, 25 bp, Mus musculus
taagcgcgcctagcgagaactagtt

SEQ ID NO: 738258 - DNA, 25 bp, Mus musculus
taagcgcttcctcggagaaaactgg

SEQ ID NO: 738259 - DNA, 25 bp, Mus musculus
taagcgcttcctgggagaaaactgg

SEQ ID NO: 738260 - DNA, 25 bp, Mus musculus
taagcggacctacgccagtggtgtc

SEQ ID NO: 738261 - DNA, 25 bp, Mus musculus
taagcggacctaggccagtggtgtc

SEQ ID NO: 738262 - DNA, 25 bp, Mus musculus
taagcggagtttcacccagagccat

SEQ ID NO: 738263 - DNA, 25 bp, Mus musculus
taagcggagtttgacccagagccat

SEQ ID NO: 738264 - DNA, 25 bp, Mus musculus
taagcggctgaccttaggtgaagcc

SEQ ID NO: 738265 - DNA, 25 bp, Mus musculus
taagcggctgacgttaggtgaagcc

SEQ ID NO: 738266 - DNA, 25 bp, Mus musculus
taagcggtacatcgagacagatcca

SEQ ID NO: 738267 - DNA, 25 bp, Mus musculus
taagcggtacatggagacagatcca

SEQ ID NO: 738268 - DNA, 25 bp, Mus musculus
taagcggttcccagcttttggcttc

SEQ ID NO: 738269 - DNA, 25 bp, Mus musculus
taagcggttccctgcttttggcttc

SEQ ID NO: 738270 - DNA, 25 bp, Mus musculus
taagcgtcctgcatatgcatctagc

SEQ ID NO: 738271 - DNA, 25 bp, Mus musculus
taagcgtcctgcttatgcatctagc

SEQ ID NO: 738272 - DNA, 25 bp, Mus musculus
taagcgtctcaccagaagggacagc

SEQ ID NO: 738273 - DNA, 25 bp, Mus musculus
taagcgtctcacgagaagggacagc

SEQ ID NO: 738274 - DNA, 25 bp, Mus musculus
taagcgtcttgtacctggaggtgga

SEQ ID NO: 738275 - DNA, 25 bp, Mus musculus
taagcgtcttgttcctggaggtgga

SEQ ID NO: 738276 - DNA, 25 bp, Mus musculus
taagcgtgaggcaccttttggatta

SEQ ID NO: 738277 - DNA, 25 bp, Mus musculus
taagcgtgaggctccttttggatta

SEQ ID NO: 738278 - DNA, 25 bp, Mus musculus
taagcgtgttatccctcctgcccgt

SEQ ID NO: 738279 - DNA, 25 bp, Mus musculus
taagcgtgttatgcctcctgcccgt

SEQ ID NO: 738280 - DNA, 25 bp, Mus musculus
taagcgttacctcttcgtccagaaa

SEQ ID NO: 738281 - DNA, 25 bp, Mus musculus
taagcgttacctgttcgtccagaaa

SEQ ID NO: 738282 - DNA, 25 bp, Mus musculus
taagctaaatgaaggcaagtgtagt

SEQ ID NO: 738283 - DNA, 25 bp, Mus musculus
taagctaaatgatggcaagtgtagt

SEQ ID NO: 738284 - DNA, 25 bp, Mus musculus
taagctaaccttacctagacagatt

SEQ ID NO: 738285 - DNA, 25 bp, Mus musculus
taagctaacctttcctagacagatt

SEQ ID NO: 738286 - DNA, 25 bp, Mus musculus
taagctaagcgtcttatccctcctg

SEQ ID NO: 738287 - DNA, 25 bp, Mus musculus
taagctaagcgtgttatccctcctg

SEQ ID NO: 738288 - DNA, 25 bp, Mus musculus
taagctacactgataggcatgcact

SEQ ID NO: 738289 - DNA, 25 bp, Mus musculus
taagctacactgttaggcatgcact

SEQ ID NO: 738290 - DNA, 25 bp, Mus musculus
taagctaggcagactgtggccagga

SEQ ID NO: 738291 - DNA, 25 bp, Mus musculus
taagctaggcagtctgtggccagga

SEQ ID NO: 738292 - DNA, 25 bp, Mus musculus
taagctatgctccagaggctgccga

SEQ ID NO: 738293 - DNA, 25 bp, Mus musculus
taagctatgctcgagaggctgccga

SEQ ID NO: 738294 - DNA, 25 bp, Mus musculus
taagctattgttccccaggaaacag

SEQ ID NO: 738295 - DNA, 25 bp, Mus musculus
taagctattgttgcccaggaaacag

SEQ ID NO: 738296 - DNA, 25 bp, Mus musculus
taagctattttcacaaagtcacagc

SEQ ID NO: 738297 - DNA, 25 bp, Mus musculus
taagctattttctcaaagtcacagc

SEQ ID NO: 738298 - DNA, 25 bp, Mus musculus
taagctcacgtaactaagcagccat

SEQ ID NO: 738299 - DNA, 25 bp, Mus musculus
taagctcacgtatctaagcagccat

SEQ ID NO: 738300 - DNA, 25 bp, Mus musculus
taagctcactgtacctacactgaag

SEQ ID NO: 738301 - DNA, 25 bp, Mus musculus
taagctcactgttcctacactgaag

SEQ ID NO: 738302 - DNA, 25 bp, Mus musculus
taagctcagcgtccagctgctccta

SEQ ID NO: 738303 - DNA, 25 bp, Mus musculus
taagctcagcgtgcagctgctccta

SEQ ID NO: 738304 - DNA, 25 bp, Mus musculus
taagctcatagaatggctgcctcaa

SEQ ID NO: 738305 - DNA, 25 bp, Mus musculus
taagctcatagattggctgcctcaa

SEQ ID NO: 738306 - DNA, 25 bp, Mus musculus
taagctcatcataaacaaactacgg

SEQ ID NO: 738307 - DNA, 25 bp, Mus musculus
taagctcatcattaacaaactacgg

SEQ ID NO: 738308 - DNA, 25 bp, Mus musculus
taagctcatccccaatgccattcag

SEQ ID NO: 738309 - DNA, 25 bp, Mus musculus
taagctcatcccgaatgccattcag

SEQ ID NO: 738310 - DNA, 25 bp, Mus musculus
taagctcatcgactttggcatcgcg

SEQ ID NO: 738311 - DNA, 25 bp, Mus musculus
taagctcatcgagtttggcatcgcg

SEQ ID NO: 738312 - DNA, 25 bp, Mus musculus
taagctccaagacttattgaaaggc

SEQ ID NO: 738313 - DNA, 25 bp, Mus musculus
taagctccaagagttattgaaaggc

SEQ ID NO: 738314 - DNA, 25 bp, Mus musculus
taagctccacaacggcaagaacatg

SEQ ID NO: 738315 - DNA, 25 bp, Mus musculus
taagctccacaagggcaagaacatg

SEQ ID NO: 738316 - DNA, 25 bp, Mus musculus
taagctccgctcagttcagcatgct

SEQ ID NO: 738317 - DNA, 25 bp, Mus musculus
taagctccgctctgttcagcatgct

SEQ ID NO: 738318 - DNA, 25 bp, Mus musculus
taagctcctaccaccaattgattga

SEQ ID NO: 738319 - DNA, 25 bp, Mus musculus
taagctcctacctccaattgattga

SEQ ID NO: 738320 - DNA, 25 bp, Mus musculus
taagctcctccactatgacatcacg

SEQ ID NO: 738321 - DNA, 25 bp, Mus musculus
taagctcctccagtatgacatcacg

SEQ ID NO: 738322 - DNA, 25 bp, Mus musculus
taagctcctgagagagataatccaa

SEQ ID NO: 738323 - DNA, 25 bp, Mus musculus
taagctcctgagtgagataatccaa

SEQ ID NO: 738324 - DNA, 25 bp, Mus musculus
taagctcgatatatttcttgtcgtg

SEQ ID NO: 738325 - DNA, 25 bp, Mus musculus
taagctcgatatttttcttgtcgtg

SEQ ID NO: 738326 - DNA, 25 bp, Mus musculus
taagctcgccagagtgactgctgcc

SEQ ID NO: 738327 - DNA, 25 bp, Mus musculus
taagctcgccagtgtgactgctgcc

SEQ ID NO: 738328 - DNA, 25 bp, Mus musculus
taagctcggtgaagacgtagtactc

SEQ ID NO: 738329 - DNA, 25 bp, Mus musculus
taagctcggtgatgacgtagtactc

SEQ ID NO: 738330 - DNA, 25 bp, Mus musculus
taagctcgtctacagcagggacaat

SEQ ID NO: 738331 - DNA, 25 bp, Mus musculus
taagctcgtctagagcagggacaat

SEQ ID NO: 738332 - DNA, 25 bp, Mus musculus
taagctctaatgctatcagatagtt

SEQ ID NO: 738333 - DNA, 25 bp, Mus musculus
taagctctaatggtatcagatagtt

SEQ ID NO: 738334 - DNA, 25 bp, Mus musculus
taagctctctgtcggttcccagtcc

SEQ ID NO: 738335 - DNA, 25 bp, Mus musculus
taagctctctgtgggttcccagtcc

SEQ ID NO: 738336 - DNA, 25 bp, Mus musculus
taagctctggcacccggcgtgtttt

SEQ ID NO: 738337 - DNA, 25 bp, Mus musculus
taagctctggcagccggcgtgtttt

SEQ ID NO: 738338 - DNA, 25 bp, Mus musculus
taagctcttctacaagctcaactga

SEQ ID NO: 738339 - DNA, 25 bp, Mus musculus
taagctcttctagaagctcaactga

SEQ ID NO: 738340 - DNA, 25 bp, Mus musculus
taagctctttaaatttaagcaccgc

SEQ ID NO: 738341 - DNA, 25 bp, Mus musculus
taagctctttaattttaagcaccgc

SEQ ID NO: 738342 - DNA, 25 bp, Mus musculus
taagctctttggattactggtgaag

SEQ ID NO: 738343 - DNA, 25 bp, Mus musculus
taagctctttggtttactggtgaag

SEQ ID NO: 738344 - DNA, 25 bp, Mus musculus
taagctgaagccaggaaccagagtt

SEQ ID NO: 738345 - DNA, 25 bp, Mus musculus
taagctgaagcctggaaccagagtt

SEQ ID NO: 738346 - DNA, 25 bp, Mus musculus
taagctgacatactgtgatttgcca

SEQ ID NO: 738347 - DNA, 25 bp, Mus musculus
taagctgacatagtgtgatttgcca

SEQ ID NO: 738348 - DNA, 25 bp, Mus musculus
taagctgacttaacacaggaaaccc

SEQ ID NO: 738349 - DNA, 25 bp, Mus musculus
taagctgacttatcacaggaaaccc

SEQ ID NO: 738350 - DNA, 25 bp, Mus musculus
taagctgagcttcattagtagcacg

SEQ ID NO: 738351 - DNA, 25 bp, Mus musculus
taagctgagcttgattagtagcacg

SEQ ID NO: 738352 - DNA, 25 bp, Mus musculus
taagctgagtgtccatgaccgctcg

SEQ ID NO: 738353 - DNA, 25 bp, Mus musculus
taagctgagtgtgcatgaccgctcg

SEQ ID NO: 738354 - DNA, 25 bp, Mus musculus
taagctgcaagtaggtttcattgac

SEQ ID NO: 738355 - DNA, 25 bp, Mus musculus
taagctgcaagttggtttcattgac

SEQ ID NO: 738356 - DNA, 25 bp, Mus musculus
taagctgccttcacccaatgattag

SEQ ID NO: 738357 - DNA, 25 bp, Mus musculus
taagctgccttctcccaatgattag

SEQ ID NO: 738358 - DNA, 25 bp, Mus musculus
taagctgcttatatgtaggccataa

SEQ ID NO: 738359 - DNA, 25 bp, Mus musculus
taagctgcttatttgtaggccataa

SEQ ID NO: 738360 - DNA, 25 bp, Mus musculus
taagctgcttttagtcttcagaagc

SEQ ID NO: 738361 - DNA, 25 bp, Mus musculus
taagctgctttttgtcttcagaagc

SEQ ID NO: 738362 - DNA, 25 bp, Mus musculus
taagctggaaaccatgctgggctca

SEQ ID NO: 738363 - DNA, 25 bp, Mus musculus
taagctggaaacgatgctgggctca

SEQ ID NO: 738364 - DNA, 25 bp, Mus musculus
taagctggaccaagccttggtggca

SEQ ID NO: 738365 - DNA, 25 bp, Mus musculus
taagctggaccatgccttggtggca

SEQ ID NO: 738366 - DNA, 25 bp, Mus musculus
taagctggagctacctcagtgcacg

SEQ ID NO: 738367 - DNA, 25 bp, Mus musculus
taagctggagcttcctcagtgcacg

SEQ ID NO: 738368 - DNA, 25 bp, Mus musculus
taagctggaggacttcatcaacaac

SEQ ID NO: 738369 - DNA, 25 bp, Mus musculus
taagctggaggagttcatcaacaac

SEQ ID NO: 738370 - DNA, 25 bp, Mus musculus
taagctggcccaaaatttatcatca

SEQ ID NO: 738371 - DNA, 25 bp, Mus musculus
taagctggcccacgactttctggac

SEQ ID NO: 738372 - DNA, 25 bp, Mus musculus
taagctggcccaggactttctggac

SEQ ID NO: 738373 - DNA, 25 bp, Mus musculus
taagctggcccataatttatcatca

SEQ ID NO: 738374 - DNA, 25 bp, Mus musculus
taagctggctttcacacaactagac

SEQ ID NO: 738375 - DNA, 25 bp, Mus musculus
taagctggctttgacacaactagac

SEQ ID NO: 738376 - DNA, 25 bp, Mus musculus
taagctgggagaaaaccagttgtac

SEQ ID NO: 738377 - DNA, 25 bp, Mus musculus
taagctgggagataaccagttgtac

SEQ ID NO: 738378 - DNA, 25 bp, Mus musculus
taagctggtcatcatcgagagcgac

SEQ ID NO: 738379 - DNA, 25 bp, Mus musculus
taagctggtcatgatcgagagcgac

SEQ ID NO: 738380 - DNA, 25 bp, Mus musculus
taagctggttccatgggaccatcgt

SEQ ID NO: 738381 - DNA, 25 bp, Mus musculus
taagctggttccttgggaccatcgt

SEQ ID NO: 738382 - DNA, 25 bp, Mus musculus
taagctggttcgatgaccataagaa

SEQ ID NO: 738383 - DNA, 25 bp, Mus musculus
taagctggttcgttgaccataagaa

SEQ ID NO: 738384 - DNA, 25 bp, Mus musculus
taagctgtacacagccctccagcag

SEQ ID NO: 738385 - DNA, 25 bp, Mus musculus
taagctgtacactgccctccagcag

SEQ ID NO: 738386 - DNA, 25 bp, Mus musculus
taagctgtacatcttctggccactt

SEQ ID NO: 738387 - DNA, 25 bp, Mus musculus
taagctgtacatgttctggccactt

SEQ ID NO: 738388 - DNA, 25 bp, Mus musculus
taagctgtaccaccggaaagagcct

SEQ ID NO: 738389 - DNA, 25 bp, Mus musculus
taagctgtaccagcggaaagagcct

SEQ ID NO: 738390 - DNA, 25 bp, Mus musculus
taagctgtctctcaacaggagggag

SEQ ID NO: 738391 - DNA, 25 bp, Mus musculus
taagctgtctctgaacaggagggag

SEQ ID NO: 738392 - DNA, 25 bp, Mus musculus
taagctgtgactagaagatccatgg

SEQ ID NO: 738393 - DNA, 25 bp, Mus musculus
taagctgtgacttgaagatccatgg

SEQ ID NO: 738394 - DNA, 25 bp, Mus musculus
taagctgtggttcaaacaagatgat

SEQ ID NO: 738395 - DNA, 25 bp, Mus musculus
taagctgtggttgaaacaagatgat

SEQ ID NO: 738396 - DNA, 25 bp, Mus musculus
taagcttacccgagtcacagcactg

SEQ ID NO: 738397 - DNA, 25 bp, Mus musculus
taagcttacccgtgtcacagcactg

SEQ ID NO: 738398 - DNA, 25 bp, Mus musculus
taagcttagtttagctggattaaca

SEQ ID NO: 738399 - DNA, 25 bp, Mus musculus
taagcttagttttgctggattaaca

SEQ ID NO: 738400 - DNA, 25 bp, Mus musculus
taagcttattgactttggactcagc

SEQ ID NO: 738401 - DNA, 25 bp, Mus musculus
taagcttattgagtttggactcagc

SEQ ID NO: 738402 - DNA, 25 bp, Mus musculus
taagcttccaacaaagaatgaattt

SEQ ID NO: 738403 - DNA, 25 bp, Mus musculus
taagcttccaactaagaatgaattt

SEQ ID NO: 738404 - DNA, 25 bp, Mus musculus
taagcttcgacaactgtcagttgtc

SEQ ID NO: 738405 - DNA, 25 bp, Mus musculus
taagcttcgacatctgtcagttgtc

SEQ ID NO: 738406 - DNA, 25 bp, Mus musculus
taagcttctggaagagaatgccaac

SEQ ID NO: 738407 - DNA, 25 bp, Mus musculus
taagcttctggatgagaatgccaac

SEQ ID NO: 738408 - DNA, 25 bp, Mus musculus
taagcttctgtacttggagtggcaa

SEQ ID NO: 738409 - DNA, 25 bp, Mus musculus
taagcttctgtagttggagtggcaa

SEQ ID NO: 738410 - DNA, 25 bp, Mus musculus
taagcttgaaatcagttgtttgtca

SEQ ID NO: 738411 - DNA, 25 bp, Mus musculus
taagcttgaaatgagttgtttgtca

SEQ ID NO: 738412 - DNA, 25 bp, Mus musculus
taagcttgccaaaagcatatacttg

SEQ ID NO: 738413 - DNA, 25 bp, Mus musculus
taagcttgccaatagcatatacttg

SEQ ID NO: 738414 - DNA, 25 bp, Mus musculus
taagcttgcccacaagtgagaccac

SEQ ID NO: 738415 - DNA, 25 bp, Mus musculus
taagcttgcccagaagtgagaccac

SEQ ID NO: 738416 - DNA, 25 bp, Mus musculus
taagcttggattattgcgattgtcc

SEQ ID NO: 738417 - DNA, 25 bp, Mus musculus
taagcttggatttttgcgattgtcc

SEQ ID NO: 738418 - DNA, 25 bp, Mus musculus
taagcttggtaacatcactttcatc

SEQ ID NO: 738419 - DNA, 25 bp, Mus musculus
taagcttggtaagatcactttcatc

SEQ ID NO: 738420 - DNA, 25 bp, Mus musculus
taagcttggtttctgccgctgcagc

SEQ ID NO: 738421 - DNA, 25 bp, Mus musculus
taagcttggtttgtgccgctgcagc

SEQ ID NO: 738422 - DNA, 25 bp, Mus musculus
taagcttgttacagatgaatgtcga

SEQ ID NO: 738423 - DNA, 25 bp, Mus musculus
taagcttgttactgatgaatgtcga

SEQ ID NO: 738424 - DNA, 25 bp, Mus musculus
taaggaaaaaccaagcactcagcca

SEQ ID NO: 738425 - DNA, 25 bp, Mus musculus
taaggaaaaacctagcactcagcca

SEQ ID NO: 738426 - DNA, 25 bp, Mus musculus
taaggaaaaatgagctgtgtgggaa

SEQ ID NO: 738427 - DNA, 25 bp, Mus musculus
taaggaaaaatgtgctgtgtgggaa

SEQ ID NO: 738428 - DNA, 25 bp, Mus musculus
taaggaaaagcacagaagatattcc

SEQ ID NO: 738429 - DNA, 25 bp, Mus musculus
taaggaaaagcagagaagatattcc

SEQ ID NO: 738430 - DNA, 25 bp, Mus musculus
taaggaaacattcccctcacctggc

SEQ ID NO: 738431 - DNA, 25 bp, Mus musculus
taaggaaacattgccctcacctggc

SEQ ID NO: 738432 - DNA, 25 bp, Mus musculus
taaggaaaccatacccctccaggag

SEQ ID NO: 738433 - DNA, 25 bp, Mus musculus
taaggaaaccattcccctccaggag

SEQ ID NO: 738434 - DNA, 25 bp, Mus musculus
taaggaaacctcagctactggagtc

SEQ ID NO: 738435 - DNA, 25 bp, Mus musculus
taaggaaacctctgctactggagtc

SEQ ID NO: 738436 - DNA, 25 bp, Mus musculus
taaggaaagaccctttgctgttcca

SEQ ID NO: 738437 - DNA, 25 bp, Mus musculus
taaggaaagaccgtttgctgttcca

SEQ ID NO: 738438 - DNA, 25 bp, Mus musculus
taaggaaagcacctccttccaggat

SEQ ID NO: 738439 - DNA, 25 bp, Mus musculus
taaggaaagcacgtccttccaggat

SEQ ID NO: 738440 - DNA, 25 bp, Mus musculus
taaggaaagtgaagccatgttcgct

SEQ ID NO: 738441 - DNA, 25 bp, Mus musculus
taaggaaagtgatgccatgttcgct

SEQ ID NO: 738442 - DNA, 25 bp, Mus musculus
taaggaaatgataaacgatggagct

SEQ ID NO: 738443 - DNA, 25 bp, Mus musculus
taaggaaatgattaacgatggagct

SEQ ID NO: 738444 - DNA, 25 bp, Mus musculus
taaggaaatgtgctgacgtcatcac

SEQ ID NO: 738445 - DNA, 25 bp, Mus musculus
taaggaaatgtggtgacgtcatcac

SEQ ID NO: 738446 - DNA, 25 bp, Mus musculus
taaggaacaactaagaaatggaagg

SEQ ID NO: 738447 - DNA, 25 bp, Mus musculus
taaggaacaacttagaaatggaagg

SEQ ID NO: 738448 - DNA, 25 bp, Mus musculus
taaggaacagttagtcacacctgac

SEQ ID NO: 738449 - DNA, 25 bp, Mus musculus
taaggaacagtttgtcacacctgac

SEQ ID NO: 738450 - DNA, 25 bp, Mus musculus
taaggaaccaataccactcttcggg

SEQ ID NO: 738451 - DNA, 25 bp, Mus musculus
taaggaaccaattccactcttcggg

SEQ ID NO: 738452 - DNA, 25 bp, Mus musculus
taaggaacctatcttgcagagcccc

SEQ ID NO: 738453 - DNA, 25 bp, Mus musculus
taaggaacctatgttgcagagcccc

SEQ ID NO: 738454 - DNA, 25 bp, Mus musculus
taaggaacctgaaagaaggcatcca

SEQ ID NO: 738455 - DNA, 25 bp, Mus musculus
taaggaacctgatagaaggcatcca

SEQ ID NO: 738456 - DNA, 25 bp, Mus musculus
taaggaactagcacgcaacagcaca

SEQ ID NO: 738457 - DNA, 25 bp, Mus musculus
taaggaactagctcgcaacagcaca

SEQ ID NO: 738458 - DNA, 25 bp, Mus musculus
taaggaactggccactcagcaactg

SEQ ID NO: 738459 - DNA, 25 bp, Mus musculus
taaggaactggcgactcagcaactg

SEQ ID NO: 738460 - DNA, 25 bp, Mus musculus
taaggaagcactagagaaagccaga

SEQ ID NO: 738461 - DNA, 25 bp, Mus musculus
taaggaagcacttgagaaagccaga

SEQ ID NO: 738462 - DNA, 25 bp, Mus musculus
taaggaagcctccagcactcaggac

SEQ ID NO: 738463 - DNA, 25 bp, Mus musculus
taaggaagcctcgagcactcaggac

SEQ ID NO: 738464 - DNA, 25 bp, Mus musculus
taaggaagctgcaaaaccacatgcc

SEQ ID NO: 738465 - DNA, 25 bp, Mus musculus
taaggaagctgcacggcttgcaaag

SEQ ID NO: 738466 - DNA, 25 bp, Mus musculus
taaggaagctgctaaaccacatgcc

SEQ ID NO: 738467 - DNA, 25 bp, Mus musculus
taaggaagctgctcggcttgcaaag

SEQ ID NO: 738468 - DNA, 25 bp, Mus musculus
taaggaaggactcctcctctggtgc

SEQ ID NO: 738469 - DNA, 25 bp, Mus musculus
taaggaaggactgctcctctggtgc

SEQ ID NO: 738470 - DNA, 25 bp, Mus musculus
taaggaagtcccatacacaggactg

SEQ ID NO: 738471 - DNA, 25 bp, Mus musculus
taaggaagtcccttacacaggactg

SEQ ID NO: 738472 - DNA, 25 bp, Mus musculus
taaggaagttagagaagcttagcgc

SEQ ID NO: 738473 - DNA, 25 bp, Mus musculus
taaggaagttagtgaagcttagcgc

SEQ ID NO: 738474 - DNA, 25 bp, Mus musculus
taaggaataagaccctggtagacac

SEQ ID NO: 738475 - DNA, 25 bp, Mus musculus
taaggaataagagcctggtagacac

SEQ ID NO: 738476 - DNA, 25 bp, Mus musculus
taaggaatccaaaatgctacaaaga

SEQ ID NO: 738477 - DNA, 25 bp, Mus musculus
taaggaatccaatatgctacaaaga

SEQ ID NO: 738478 - DNA, 25 bp, Mus musculus
taaggaatgcctactgaggacttat

SEQ ID NO: 738479 - DNA, 25 bp, Mus musculus
taaggaatgccttctgaggacttat

SEQ ID NO: 738480 - DNA, 25 bp, Mus musculus
taaggaatggcgaccccagcaccct

SEQ ID NO: 738481 - DNA, 25 bp, Mus musculus
taaggaatggcgtccccagcaccct

SEQ ID NO: 738482 - DNA, 25 bp, Mus musculus
taaggaattgcaagcggaggctctc

SEQ ID NO: 738483 - DNA, 25 bp, Mus musculus
taaggaattgcatgcggaggctctc

SEQ ID NO: 738484 - DNA, 25 bp, Mus musculus
taaggacaacaccagtgacatcatg

SEQ ID NO: 738485 - DNA, 25 bp, Mus musculus
taaggacaacacgagtgacatcatg

SEQ ID NO: 738486 - DNA, 25 bp, Mus musculus
taaggacaagatcagcgtgagcacg

SEQ ID NO: 738487 - DNA, 25 bp, Mus musculus
taaggacaagatgagcgtgagcacg

SEQ ID NO: 738488 - DNA, 25 bp, Mus musculus
taaggacaaggaagagagcagcacc

SEQ ID NO: 738489 - DNA, 25 bp, Mus musculus
taaggacaaggatgagagcagcacc

SEQ ID NO: 738490 - DNA, 25 bp, Mus musculus
taaggacaagtaacttgggttctgc

SEQ ID NO: 738491 - DNA, 25 bp, Mus musculus
taaggacaagtatcttgggttctgc

SEQ ID NO: 738492 - DNA, 25 bp, Mus musculus
taaggacacaaaatccaggcagtcg

SEQ ID NO: 738493 - DNA, 25 bp, Mus musculus
taaggacacaaattccaggcagtcg

SEQ ID NO: 738494 - DNA, 25 bp, Mus musculus
taaggacagaataaccagcccgtct

SEQ ID NO: 738495 - DNA, 25 bp, Mus musculus
taaggacagaattaccagcccgtct

SEQ ID NO: 738496 - DNA, 25 bp, Mus musculus
taaggacagagaaaggcacagacgg

SEQ ID NO: 738497 - DNA, 25 bp, Mus musculus
taaggacagagataggcacagacgg

SEQ ID NO: 738498 - DNA, 25 bp, Mus musculus
taaggacatttcctacctgtaccgg

SEQ ID NO: 738499 - DNA, 25 bp, Mus musculus
taaggacatttcgtacctgtaccgg

SEQ ID NO: 738500 - DNA, 25 bp, Mus musculus
taaggaccaaccatcttgatcttga

SEQ ID NO: 738501 - DNA, 25 bp, Mus musculus
taaggaccaaccttcttgatcttga

SEQ ID NO: 738502 - DNA, 25 bp, Mus musculus
taaggaccagcaacgtagaaggttc

SEQ ID NO: 738503 - DNA, 25 bp, Mus musculus
taaggaccagcatcgtagaaggttc

SEQ ID NO: 738504 - DNA, 25 bp, Mus musculus
taaggaccatctacgtgcaggcaag

SEQ ID NO: 738505 - DNA, 25 bp, Mus musculus
taaggaccatcttcgtgcaggcaag

SEQ ID NO: 738506 - DNA, 25 bp, Mus musculus
taaggaccctggaattcagtgtgag

SEQ ID NO: 738507 - DNA, 25 bp, Mus musculus
taaggaccctggtattcagtgtgag

SEQ ID NO: 738508 - DNA, 25 bp, Mus musculus
taaggaccgcgtaacctctagccat

SEQ ID NO: 738509 - DNA, 25 bp, Mus musculus
taaggaccgcgttacctctagccat

SEQ ID NO: 738510 - DNA, 25 bp, Mus musculus
taaggacctagactactcacagggc

SEQ ID NO: 738511 - DNA, 25 bp, Mus musculus
taaggacctagagtactcacagggc

SEQ ID NO: 738512 - DNA, 25 bp, Mus musculus
taaggacctcccctgatgtggcact

SEQ ID NO: 738513 - DNA, 25 bp, Mus musculus
taaggacctcccgtgatgtggcact

SEQ ID NO: 738514 - DNA, 25 bp, Mus musculus
taaggacctgaacacctgtacttgc

SEQ ID NO: 738515 - DNA, 25 bp, Mus musculus
taaggacctgaagacctgtacttgc

SEQ ID NO: 738516 - DNA, 25 bp, Mus musculus
taaggacgcaccagatgggcccaca

SEQ ID NO: 738517 - DNA, 25 bp, Mus musculus
taaggacgcacctgatgggcccaca

SEQ ID NO: 738518 - DNA, 25 bp, Mus musculus
taaggacgtccaccactattacacc

SEQ ID NO: 738519 - DNA, 25 bp, Mus musculus
taaggacgtccagcactattacacc

SEQ ID NO: 738520 - DNA, 25 bp, Mus musculus
taaggactaattctggcaccccttg

SEQ ID NO: 738521 - DNA, 25 bp, Mus musculus
taaggactaattgtggcaccccttg

SEQ ID NO: 738522 - DNA, 25 bp, Mus musculus
taaggactacccagatgaagtgatc

SEQ ID NO: 738523 - DNA, 25 bp, Mus musculus
taaggactaccctgatgaagtgatc

SEQ ID NO: 738524 - DNA, 25 bp, Mus musculus
taaggactccagagtacggcaccat

SEQ ID NO: 738525 - DNA, 25 bp, Mus musculus
taaggactccagtgtacggcaccat

SEQ ID NO: 738526 - DNA, 25 bp, Mus musculus
taaggactctcactgcagatcccca

SEQ ID NO: 738527 - DNA, 25 bp, Mus musculus
taaggactctcagtgcagatcccca

SEQ ID NO: 738528 - DNA, 25 bp, Mus musculus
taaggactgagccttagggacccat

SEQ ID NO: 738529 - DNA, 25 bp, Mus musculus
taaggactgagcgttagggacccat

SEQ ID NO: 738530 - DNA, 25 bp, Mus musculus
taaggactgaggacccattatcagc

SEQ ID NO: 738531 - DNA, 25 bp, Mus musculus
taaggactgaggtcccattatcagc

SEQ ID NO: 738532 - DNA, 25 bp, Mus musculus
taaggactgcgtcttggcttctgac

SEQ ID NO: 738533 - DNA, 25 bp, Mus musculus
taaggactgcgtgttggcttctgac

SEQ ID NO: 738534 - DNA, 25 bp, Mus musculus
taaggactgtttcatcccttgcaga

SEQ ID NO: 738535 - DNA, 25 bp, Mus musculus
taaggactgtttgatcccttgcaga

SEQ ID NO: 738536 - DNA, 25 bp, Mus musculus
taaggacttctaatggctcaaactc

SEQ ID NO: 738537 - DNA, 25 bp, Mus musculus
taaggacttctattggctcaaactc

SEQ ID NO: 738538 - DNA, 25 bp, Mus musculus
taaggacttggtattatctgtacac

SEQ ID NO: 738539 - DNA, 25 bp, Mus musculus
taaggacttggttttatctgtacac

SEQ ID NO: 738540 - DNA, 25 bp, Mus musculus
taaggacttgttacggaaggagctg

SEQ ID NO: 738541 - DNA, 25 bp, Mus musculus
taaggacttgtttcggaaggagctg

SEQ ID NO: 738542 - DNA, 25 bp, Mus musculus
taaggactttatcgtggcatctgac

SEQ ID NO: 738543 - DNA, 25 bp, Mus musculus
taaggactttatggtggcatctgac

SEQ ID NO: 738544 - DNA, 25 bp, Mus musculus
taaggagaaacgcacccatctgcgt

SEQ ID NO: 738545 - DNA, 25 bp, Mus musculus
taaggagaaacggacccatctgcgt

SEQ ID NO: 738546 - DNA, 25 bp, Mus musculus
taaggagaaatcagagctctttggc

SEQ ID NO: 738547 - DNA, 25 bp, Mus musculus
taaggagaaatctgagctctttggc

SEQ ID NO: 738548 - DNA, 25 bp, Mus musculus
taaggagaacaacatcacaggcaag

SEQ ID NO: 738549 - DNA, 25 bp, Mus musculus
taaggagaacaagatcacaggcaag

SEQ ID NO: 738550 - DNA, 25 bp, Mus musculus
taaggagaacacacttggcccatgg

SEQ ID NO: 738551 - DNA, 25 bp, Mus musculus
taaggagaacactcttggcccatgg

SEQ ID NO: 738552 - DNA, 25 bp, Mus musculus
taaggagaagctcctagaagactcc

SEQ ID NO: 738553 - DNA, 25 bp, Mus musculus
taaggagaagctgctagaagactcc

SEQ ID NO: 738554 - DNA, 25 bp, Mus musculus
taaggagaagttagatgccaccatg

SEQ ID NO: 738555 - DNA, 25 bp, Mus musculus
taaggagaagtttgatgccaccatg

SEQ ID NO: 738556 - DNA, 25 bp, Mus musculus
taaggagaccttcagcttggaacaa

SEQ ID NO: 738557 - DNA, 25 bp, Mus musculus
taaggagaccttgagcttggaacaa

SEQ ID NO: 738558 - DNA, 25 bp, Mus musculus
taaggagactcacaacaccgtgtgt

SEQ ID NO: 738559 - DNA, 25 bp, Mus musculus
taaggagactcagaacaccgtgtgt

SEQ ID NO: 738560 - DNA, 25 bp, Mus musculus
taaggagactccataccagtgtctg

SEQ ID NO: 738561 - DNA, 25 bp, Mus musculus
taaggagactccttaccagtgtctg

SEQ ID NO: 738562 - DNA, 25 bp, Mus musculus
taaggagatgctccccagcggcaga

SEQ ID NO: 738563 - DNA, 25 bp, Mus musculus
taaggagatgctgcccagcggcaga

SEQ ID NO: 738564 - DNA, 25 bp, Mus musculus
taaggagatgtcactggaagaagtt

SEQ ID NO: 738565 - DNA, 25 bp, Mus musculus
taaggagatgtctctggaagaagtt

SEQ ID NO: 738566 - DNA, 25 bp, Mus musculus
taaggagcaacccactcattgactc

SEQ ID NO: 738567 - DNA, 25 bp, Mus musculus
taaggagcaaccgactcattgactc

SEQ ID NO: 738568 - DNA, 25 bp, Mus musculus
taaggagcaagaccacattataata

SEQ ID NO: 738569 - DNA, 25 bp, Mus musculus
taaggagcaagagcacattataata

SEQ ID NO: 738570 - DNA, 25 bp, Mus musculus
taaggagccgctacttcgtgagagc

SEQ ID NO: 738571 - DNA, 25 bp, Mus musculus
taaggagccgcttcttcgtgagagc

SEQ ID NO: 738572 - DNA, 25 bp, Mus musculus
taaggagccttgaatccagccagga

SEQ ID NO: 738573 - DNA, 25 bp, Mus musculus
taaggagccttgtatccagccagga

SEQ ID NO: 738574 - DNA, 25 bp, Mus musculus
taaggagcgctcactgttgcacggt

SEQ ID NO: 738575 - DNA, 25 bp, Mus musculus
taaggagcgctctctgttgcacggt

SEQ ID NO: 738576 - DNA, 25 bp, Mus musculus
taaggagctaggaactctgatcccc

SEQ ID NO: 738577 - DNA, 25 bp, Mus musculus
taaggagctaggtactctgatcccc

SEQ ID NO: 738578 - DNA, 25 bp, Mus musculus
taaggagctgttcttaactagccca

SEQ ID NO: 738579 - DNA, 25 bp, Mus musculus
taaggagctgttgttaactagccca

SEQ ID NO: 738580 - DNA, 25 bp, Mus musculus
taaggagcttcgcaagccactggaa

SEQ ID NO: 738581 - DNA, 25 bp, Mus musculus
taaggagcttcggaagccactggaa

SEQ ID NO: 738582 - DNA, 25 bp, Mus musculus
taaggaggatgacaggatacccagt

SEQ ID NO: 738583 - DNA, 25 bp, Mus musculus
taaggaggatgagaggatacccagt

SEQ ID NO: 738584 - DNA, 25 bp, Mus musculus
taaggaggcagccaccaccatcgcg

SEQ ID NO: 738585 - DNA, 25 bp, Mus musculus
taaggaggcagcgaccaccatcgcg

SEQ ID NO: 738586 - DNA, 25 bp, Mus musculus
taaggaggctggaggcctttgaaca

SEQ ID NO: 738587 - DNA, 25 bp, Mus musculus
taaggaggctggtggcctttgaaca

SEQ ID NO: 738588 - DNA, 25 bp, Mus musculus
taaggagtacgcagaatccataggt

SEQ ID NO: 738589 - DNA, 25 bp, Mus musculus
taaggagtacgctgaatccataggt

SEQ ID NO: 738590 - DNA, 25 bp, Mus musculus
taaggagtcggcctggaggaagcag

SEQ ID NO: 738591 - DNA, 25 bp, Mus musculus
taaggagtcggcgtggaggaagcag

SEQ ID NO: 738592 - DNA, 25 bp, Mus musculus
taaggagtgccacaggctccaaaag

SEQ ID NO: 738593 - DNA, 25 bp, Mus musculus
taaggagtgccagaggctccaaaag

SEQ ID NO: 738594 - DNA, 25 bp, Mus musculus
taaggagtgggtactggatccccag

SEQ ID NO: 738595 - DNA, 25 bp, Mus musculus
taaggagtgggttctggatccccag

SEQ ID NO: 738596 - DNA, 25 bp, Mus musculus
taaggagtgtgacctgccatagaca

SEQ ID NO: 738597 - DNA, 25 bp, Mus musculus
taaggagtgtgagctgccatagaca

SEQ ID NO: 738598 - DNA, 25 bp, Mus musculus
taaggagttccacgtgaatccggct

SEQ ID NO: 738599 - DNA, 25 bp, Mus musculus
taaggagttccaggtgaatccggct

SEQ ID NO: 738600 - DNA, 25 bp, Mus musculus
taaggataagttactgaggactgca

SEQ ID NO: 738601 - DNA, 25 bp, Mus musculus
taaggataagtttctgaggactgca

SEQ ID NO: 738602 - DNA, 25 bp, Mus musculus
taaggataatgaaagcctggctgcc

SEQ ID NO: 738603 - DNA, 25 bp, Mus musculus
taaggataatgatagcctggctgcc

SEQ ID NO: 738604 - DNA, 25 bp, Mus musculus
taaggatagtttcattgacagcagc

SEQ ID NO: 738605 - DNA, 25 bp, Mus musculus
taaggatagtttgattgacagcagc

SEQ ID NO: 738606 - DNA, 25 bp, Mus musculus
taaggatattctaagccaaagctga

SEQ ID NO: 738607 - DNA, 25 bp, Mus musculus
taaggatattcttagccaaagctga

SEQ ID NO: 738608 - DNA, 25 bp, Mus musculus
taaggatcaccacacagttgctagg

SEQ ID NO: 738609 - DNA, 25 bp, Mus musculus
taaggatcaccagacagttgctagg

SEQ ID NO: 738610 - DNA, 25 bp, Mus musculus
taaggatccactctacatcgggctg

SEQ ID NO: 738611 - DNA, 25 bp, Mus musculus
taaggatccactgtacatcgggctg

SEQ ID NO: 738612 - DNA, 25 bp, Mus musculus
taaggatcccaacggcctcgaatgg

SEQ ID NO: 738613 - DNA, 25 bp, Mus musculus
taaggatcccaagggcctcgaatgg

SEQ ID NO: 738614 - DNA, 25 bp, Mus musculus
taaggatctcccactaaccttgaga

SEQ ID NO: 738615 - DNA, 25 bp, Mus musculus
taaggatctccctctaaccttgaga

SEQ ID NO: 738616 - DNA, 25 bp, Mus musculus
taaggatctcgtcggctacattttc

SEQ ID NO: 738617 - DNA, 25 bp, Mus musculus
taaggatctcgtgggctacattttc

SEQ ID NO: 738618 - DNA, 25 bp, Mus musculus
taaggatctgggataccacacagaa

SEQ ID NO: 738619 - DNA, 25 bp, Mus musculus
taaggatctgggttaccacacagaa

SEQ ID NO: 738620 - DNA, 25 bp, Mus musculus
taaggatgaaagagtttctgcactg

SEQ ID NO: 738621 - DNA, 25 bp, Mus musculus
taaggatgaaagtgtttctgcactg

SEQ ID NO: 738622 - DNA, 25 bp, Mus musculus
taaggatgaacgaacagtaacgcca

SEQ ID NO: 738623 - DNA, 25 bp, Mus musculus
taaggatgaacgtacagtaacgcca

SEQ ID NO: 738624 - DNA, 25 bp, Mus musculus
taaggatgacaactgacgagggcac

SEQ ID NO: 738625 - DNA, 25 bp, Mus musculus
taaggatgacaagtgacgagggcac

SEQ ID NO: 738626 - DNA, 25 bp, Mus musculus
taaggatgacctaatgtcactcagc

SEQ ID NO: 738627 - DNA, 25 bp, Mus musculus
taaggatgaccttatgtcactcagc

SEQ ID NO: 738628 - DNA, 25 bp, Mus musculus
taaggatgagcaccgcggatctgat

SEQ ID NO: 738629 - DNA, 25 bp, Mus musculus
taaggatgagcagcgcggatctgat

SEQ ID NO: 738630 - DNA, 25 bp, Mus musculus
taaggatgcctgctacccgtgcttt

SEQ ID NO: 738631 - DNA, 25 bp, Mus musculus
taaggatgcctggtacccgtgcttt

SEQ ID NO: 738632 - DNA, 25 bp, Mus musculus
taaggatgctccagggattacacat

SEQ ID NO: 738633 - DNA, 25 bp, Mus musculus
taaggatgctcctgggattacacat

SEQ ID NO: 738634 - DNA, 25 bp, Mus musculus
taaggatggacaatttgccctggaa

SEQ ID NO: 738635 - DNA, 25 bp, Mus musculus
taaggatggacattttgccctggaa

SEQ ID NO: 738636 - DNA, 25 bp, Mus musculus
taaggatggtgtaactggcctcacc

SEQ ID NO: 738637 - DNA, 25 bp, Mus musculus
taaggatggtgttactggcctcacc

SEQ ID NO: 738638 - DNA, 25 bp, Mus musculus
taaggatgtcagatttggcccacac

SEQ ID NO: 738639 - DNA, 25 bp, Mus musculus
taaggatgtcagttttggcccacac

SEQ ID NO: 738640 - DNA, 25 bp, Mus musculus
taaggatgtcatcgcgaagaccgag

SEQ ID NO: 738641 - DNA, 25 bp, Mus musculus
taaggatgtcatggcgaagaccgag

SEQ ID NO: 738642 - DNA, 25 bp, Mus musculus
taaggatgtctcacttctgagcact

SEQ ID NO: 738643 - DNA, 25 bp, Mus musculus
taaggatgtctctcttctgagcact

SEQ ID NO: 738644 - DNA, 25 bp, Mus musculus
taaggatgtgcaactggtaaagcac

SEQ ID NO: 738645 - DNA, 25 bp, Mus musculus
taaggatgtgcatctggtaaagcac

SEQ ID NO: 738646 - DNA, 25 bp, Mus musculus
taaggatgttctccaccgacactgc

SEQ ID NO: 738647 - DNA, 25 bp, Mus musculus
taaggatgttctgcaccgacactgc

SEQ ID NO: 738648 - DNA, 25 bp, Mus musculus
taaggatgttggagacctcacccag

SEQ ID NO: 738649 - DNA, 25 bp, Mus musculus
taaggatgttggtgacctcacccag

SEQ ID NO: 738650 - DNA, 25 bp, Mus musculus
taaggattacagagaggccgatggc

SEQ ID NO: 738651 - DNA, 25 bp, Mus musculus
taaggattacagtgaggccgatggc

SEQ ID NO: 738652 - DNA, 25 bp, Mus musculus
taaggattccttctatgtcagtctc

SEQ ID NO: 738653 - DNA, 25 bp, Mus musculus
taaggattccttgtatgtcagtctc

SEQ ID NO: 738654 - DNA, 25 bp, Mus musculus
taaggattggaaaatcctccatagg

SEQ ID NO: 738655 - DNA, 25 bp, Mus musculus
taaggattggaatatcctccatagg

SEQ ID NO: 738656 - DNA, 25 bp, Mus musculus
taaggattttgacaacggcattggg

SEQ ID NO: 738657 - DNA, 25 bp, Mus musculus
taaggattttgagaacggcattggg

SEQ ID NO: 738658 - DNA, 25 bp, Mus musculus
taaggcaaagccctagaaccttctg

SEQ ID NO: 738659 - DNA, 25 bp, Mus musculus
taaggcaaagccgtagaaccttctg

SEQ ID NO: 738660 - DNA, 25 bp, Mus musculus
taaggcacaaagatccgtaccagct

SEQ ID NO: 738661 - DNA, 25 bp, Mus musculus
taaggcacaaagttccgtaccagct

SEQ ID NO: 738662 - DNA, 25 bp, Mus musculus
taaggcacacaacgtgctcaagcag

SEQ ID NO: 738663 - DNA, 25 bp, Mus musculus
taaggcacacaaggtgctcaagcag

SEQ ID NO: 738664 - DNA, 25 bp, Mus musculus
taaggcacagagacggtagaatcag

SEQ ID NO: 738665 - DNA, 25 bp, Mus musculus
taaggcacagagtcggtagaatcag

SEQ ID NO: 738666 - DNA, 25 bp, Mus musculus
taaggcaccaggaatcctccacggg

SEQ ID NO: 738667 - DNA, 25 bp, Mus musculus
taaggcaccaggtatcctccacggg

SEQ ID NO: 738668 - DNA, 25 bp, Mus musculus
taaggcaccctcaagacccctggat

SEQ ID NO: 738669 - DNA, 25 bp, Mus musculus
taaggcaccctctagacccctggat

SEQ ID NO: 738670 - DNA, 25 bp, Mus musculus
taaggcactagtctacaccacgtgg

SEQ ID NO: 738671 - DNA, 25 bp, Mus musculus
taaggcactagtgtacaccacgtgg

SEQ ID NO: 738672 - DNA, 25 bp, Mus musculus
taaggcagagacaagcaaggataag

SEQ ID NO: 738673 - DNA, 25 bp, Mus musculus
taaggcagagactagcaaggataag

SEQ ID NO: 738674 - DNA, 25 bp, Mus musculus
taaggcagatgccaagcaccgagag

SEQ ID NO: 738675 - DNA, 25 bp, Mus musculus
taaggcagatgcgaagcaccgagag

SEQ ID NO: 738676 - DNA, 25 bp, Mus musculus
taaggcagcgaactctctgcaacaa

SEQ ID NO: 738677 - DNA, 25 bp, Mus musculus
taaggcagcgaagtctctgcaacaa

SEQ ID NO: 738678 - DNA, 25 bp, Mus musculus
taaggcaggagtcggaccctagaac

SEQ ID NO: 738679 - DNA, 25 bp, Mus musculus
taaggcaggagtgggaccctagaac

SEQ ID NO: 738680 - DNA, 25 bp, Mus musculus
taaggcaggattagacaggtccagg

SEQ ID NO: 738681 - DNA, 25 bp, Mus musculus
taaggcaggatttgacaggtccagg

SEQ ID NO: 738682 - DNA, 25 bp, Mus musculus
taaggccaaataatccaaacagatg

SEQ ID NO: 738683 - DNA, 25 bp, Mus musculus
taaggccaaatattccaaacagatg

SEQ ID NO: 738684 - DNA, 25 bp, Mus musculus
taaggccaagacatgtaccatcatc

SEQ ID NO: 738685 - DNA, 25 bp, Mus musculus
taaggccaagacttgtaccatcatc

SEQ ID NO: 738686 - DNA, 25 bp, Mus musculus
taaggccaagcaattatttgctgtc

SEQ ID NO: 738687 - DNA, 25 bp, Mus musculus
taaggccaagcatttatttgctgtc

SEQ ID NO: 738688 - DNA, 25 bp, Mus musculus
taaggccacaatcgtacgtgcgctg

SEQ ID NO: 738689 - DNA, 25 bp, Mus musculus
taaggccacaatggtacgtgcgctg

SEQ ID NO: 738690 - DNA, 25 bp, Mus musculus
taaggccacgctataatgaagataa

SEQ ID NO: 738691 - DNA, 25 bp, Mus musculus
taaggccacgctttaatgaagataa

SEQ ID NO: 738692 - DNA, 25 bp, Mus musculus
taaggccagaagagcaagataaact

SEQ ID NO: 738693 - DNA, 25 bp, Mus musculus
taaggccagaagtgcaagataaact

SEQ ID NO: 738694 - DNA, 25 bp, Mus musculus
taaggccagctacgatgacagtgaa

SEQ ID NO: 738695 - DNA, 25 bp, Mus musculus
taaggccagctaggatgacagtgaa

SEQ ID NO: 738696 - DNA, 25 bp, Mus musculus
taaggccagggtattctagccagct

SEQ ID NO: 738697 - DNA, 25 bp, Mus musculus
taaggccagggttttctagccagct

SEQ ID NO: 738698 - DNA, 25 bp, Mus musculus
taaggccagtatagaagaccgttgt

SEQ ID NO: 738699 - DNA, 25 bp, Mus musculus
taaggccagtattgaagaccgttgt

SEQ ID NO: 738700 - DNA, 25 bp, Mus musculus
taaggccccataaatgcgtgtgcga

SEQ ID NO: 738701 - DNA, 25 bp, Mus musculus
taaggccccatatatgcgtgtgcga

SEQ ID NO: 738702 - DNA, 25 bp, Mus musculus
taaggccccgtgatcaattgctggc

SEQ ID NO: 738703 - DNA, 25 bp, Mus musculus
taaggccccgtgttcaattgctggc

SEQ ID NO: 738704 - DNA, 25 bp, Mus musculus
taaggccctattaggctacgttggc

SEQ ID NO: 738705 - DNA, 25 bp, Mus musculus
taaggccctatttggctacgttggc

SEQ ID NO: 738706 - DNA, 25 bp, Mus musculus
taaggcctatcaagcatatcgtgag

SEQ ID NO: 738707 - DNA, 25 bp, Mus musculus
taaggcctatcatgcatatcgtgag

SEQ ID NO: 738708 - DNA, 25 bp, Mus musculus
taaggcctcagcaggacccaggact

SEQ ID NO: 738709 - DNA, 25 bp, Mus musculus
taaggcctcagctggacccaggact

SEQ ID NO: 738710 - DNA, 25 bp, Mus musculus
taaggcctgtaacacagaggcggac

SEQ ID NO: 738711 - DNA, 25 bp, Mus musculus
taaggcctgtaagacagaggcggac

SEQ ID NO: 738712 - DNA, 25 bp, Mus musculus
taaggcctgttgagtccccactgaa

SEQ ID NO: 738713 - DNA, 25 bp, Mus musculus
taaggcctgttgtgtccccactgaa

SEQ ID NO: 738714 - DNA, 25 bp, Mus musculus
taaggccttaggctctagcccagca

SEQ ID NO: 738715 - DNA, 25 bp, Mus musculus
taaggccttagggtctagcccagca

SEQ ID NO: 738716 - DNA, 25 bp, Mus musculus
taaggccttcatacctcagctgctg

SEQ ID NO: 738717 - DNA, 25 bp, Mus musculus
taaggccttcattcctcagctgctg

SEQ ID NO: 738718 - DNA, 25 bp, Mus musculus
taaggccttgatagtcatacgcgag

SEQ ID NO: 738719 - DNA, 25 bp, Mus musculus
taaggccttgattgtcatacgcgag

SEQ ID NO: 738720 - DNA, 25 bp, Mus musculus
taaggccttgctagaaaacggtgca

SEQ ID NO: 738721 - DNA, 25 bp, Mus musculus
taaggccttgcttgaaaacggtgca

SEQ ID NO: 738722 - DNA, 25 bp, Mus musculus
taaggcctttccaatcccagaatca

SEQ ID NO: 738723 - DNA, 25 bp, Mus musculus
taaggcctttcctatcccagaatca

SEQ ID NO: 738724 - DNA, 25 bp, Mus musculus
taaggcgcttcacgactatcgcaag

SEQ ID NO: 738725 - DNA, 25 bp, Mus musculus
taaggcgcttcaggactatcgcaag

SEQ ID NO: 738726 - DNA, 25 bp, Mus musculus
taaggcggttaaaccacagcgtggc

SEQ ID NO: 738727 - DNA, 25 bp, Mus musculus
taaggcggttaatccacagcgtggc

SEQ ID NO: 738728 - DNA, 25 bp, Mus musculus
taaggcgtatctccggaggatcaag

SEQ ID NO: 738729 - DNA, 25 bp, Mus musculus
taaggcgtatctgcggaggatcaag

SEQ ID NO: 738730 - DNA, 25 bp, Mus musculus
taaggcgtctctacccctagaaggc

SEQ ID NO: 738731 - DNA, 25 bp, Mus musculus
taaggcgtctcttcccctagaaggc

SEQ ID NO: 738732 - DNA, 25 bp, Mus musculus
taaggctacacgattaatatgagag

SEQ ID NO: 738733 - DNA, 25 bp, Mus musculus
taaggctacacgtttaatatgagag

SEQ ID NO: 738734 - DNA, 25 bp, Mus musculus
taaggctacctcagcttggctcttg

SEQ ID NO: 738735 - DNA, 25 bp, Mus musculus
taaggctacctctgcttggctcttg

SEQ ID NO: 738736 - DNA, 25 bp, Mus musculus
taaggctatatcatacctgacagca

SEQ ID NO: 738737 - DNA, 25 bp, Mus musculus
taaggctatatcttacctgacagca

SEQ ID NO: 738738 - DNA, 25 bp, Mus musculus
taaggctatcccagtcgcacgttgg

SEQ ID NO: 738739 - DNA, 25 bp, Mus musculus
taaggctatccctgtcgcacgttgg

SEQ ID NO: 738740 - DNA, 25 bp, Mus musculus
taaggctccaccctgttgtgccgat

SEQ ID NO: 738741 - DNA, 25 bp, Mus musculus
taaggctccaccgtgttgtgccgat

SEQ ID NO: 738742 - DNA, 25 bp, Mus musculus
taaggctcctgaatgaacaaaacaa

SEQ ID NO: 738743 - DNA, 25 bp, Mus musculus
taaggctcctgattgaacaaaacaa

SEQ ID NO: 738744 - DNA, 25 bp, Mus musculus
taaggctcgagacgaaatggcaaaa

SEQ ID NO: 738745 - DNA, 25 bp, Mus musculus
taaggctcgagaggaaatggcaaaa

SEQ ID NO: 738746 - DNA, 25 bp, Mus musculus
taaggctctcctcgaagggtataac

SEQ ID NO: 738747 - DNA, 25 bp, Mus musculus
taaggctctcctggaagggtataac

SEQ ID NO: 738748 - DNA, 25 bp, Mus musculus
taaggctctgcaccgggtggccatc

SEQ ID NO: 738749 - DNA, 25 bp, Mus musculus
taaggctctgcagcgggtggccatc

SEQ ID NO: 738750 - DNA, 25 bp, Mus musculus
taaggctcttggacagaaggctgag

SEQ ID NO: 738751 - DNA, 25 bp, Mus musculus
taaggctcttggtcagaaggctgag

SEQ ID NO: 738752 - DNA, 25 bp, Mus musculus
taaggctgacatctgtgctgtggat

SEQ ID NO: 738753 - DNA, 25 bp, Mus musculus
taaggctgacatgtgtgctgtggat

SEQ ID NO: 738754 - DNA, 25 bp, Mus musculus
taaggctgcagtcgcctgggaggcg

SEQ ID NO: 738755 - DNA, 25 bp, Mus musculus
taaggctgcagtggcctgggaggcg

SEQ ID NO: 738756 - DNA, 25 bp, Mus musculus
taaggctgctgacgcacatgtggat

SEQ ID NO: 738757 - DNA, 25 bp, Mus musculus
taaggctgctgaggcacatgtggat

SEQ ID NO: 738758 - DNA, 25 bp, Mus musculus
taaggctgctgcatgcatcaaacac

SEQ ID NO: 738759 - DNA, 25 bp, Mus musculus
taaggctgctgcttgcatcaaacac

SEQ ID NO: 738760 - DNA, 25 bp, Mus musculus
taaggctggcaacttcattggctgg

SEQ ID NO: 738761 - DNA, 25 bp, Mus musculus
taaggctggcaagttcattggctgg

SEQ ID NO: 738762 - DNA, 25 bp, Mus musculus
taaggctgggtcatccctctgaggt

SEQ ID NO: 738763 - DNA, 25 bp, Mus musculus
taaggctgggtcttccctctgaggt

SEQ ID NO: 738764 - DNA, 25 bp, Mus musculus
taaggctgggttccaaaatacttgc

SEQ ID NO: 738765 - DNA, 25 bp, Mus musculus
taaggctgggttgcaaaatacttgc

SEQ ID NO: 738766 - DNA, 25 bp, Mus musculus
taaggctgtgctagctcagggccag

SEQ ID NO: 738767 - DNA, 25 bp, Mus musculus
taaggctgtgcttgctcagggccag

SEQ ID NO: 738768 - DNA, 25 bp, Mus musculus
taaggcttggccaacgtggcagccg

SEQ ID NO: 738769 - DNA, 25 bp, Mus musculus
taaggcttggcctacgtggcagccg

SEQ ID NO: 738770 - DNA, 25 bp, Mus musculus
taaggctttggaagaatcttgggag

SEQ ID NO: 738771 - DNA, 25 bp, Mus musculus
taaggctttggatgaatcttgggag

SEQ ID NO: 738772 - DNA, 25 bp, Mus musculus
taagggaaaggtagctggaccagac

SEQ ID NO: 738773 - DNA, 25 bp, Mus musculus
taagggaaaggttgctggaccagac

SEQ ID NO: 738774 - DNA, 25 bp, Mus musculus
taagggaaccttacactggtctggc

SEQ ID NO: 738775 - DNA, 25 bp, Mus musculus
taagggaacctttcactggtctggc

SEQ ID NO: 738776 - DNA, 25 bp, Mus musculus
taagggaacgctatgcttatccaat

SEQ ID NO: 738777 - DNA, 25 bp, Mus musculus
taagggaacgctttgcttatccaat

SEQ ID NO: 738778 - DNA, 25 bp, Mus musculus
taagggaactgcagacggcgatgct

SEQ ID NO: 738779 - DNA, 25 bp, Mus musculus
taagggaactgctgacggcgatgct

SEQ ID NO: 738780 - DNA, 25 bp, Mus musculus
taagggaagagcagacaagaacttc

SEQ ID NO: 738781 - DNA, 25 bp, Mus musculus
taagggaagagctgacaagaacttc

SEQ ID NO: 738782 - DNA, 25 bp, Mus musculus
taagggacaccacatagaaattgcc

SEQ ID NO: 738783 - DNA, 25 bp, Mus musculus
taagggacaccagatagaaattgcc

SEQ ID NO: 738784 - DNA, 25 bp, Mus musculus
taagggacacctagttgtccgtgcc

SEQ ID NO: 738785 - DNA, 25 bp, Mus musculus
taagggacaccttgttgtccgtgcc

SEQ ID NO: 738786 - DNA, 25 bp, Mus musculus
taagggaccaggatcccagtccatc

SEQ ID NO: 738787 - DNA, 25 bp, Mus musculus
taagggaccaggttcccagtccatc

SEQ ID NO: 738788 - DNA, 25 bp, Mus musculus
taagggaccgctatgccatctttgc

SEQ ID NO: 738789 - DNA, 25 bp, Mus musculus
taagggaccgctttgccatctttgc

SEQ ID NO: 738790 - DNA, 25 bp, Mus musculus
taagggacgcatctaccatcagaga

SEQ ID NO: 738791 - DNA, 25 bp, Mus musculus
taagggacgcatgtaccatcagaga

SEQ ID NO: 738792 - DNA, 25 bp, Mus musculus
taagggactggcagctctgccgcac

SEQ ID NO: 738793 - DNA, 25 bp, Mus musculus
taagggactggctgctctgccgcac

SEQ ID NO: 738794 - DNA, 25 bp, Mus musculus
taagggaggccaagccagccttttt

SEQ ID NO: 738795 - DNA, 25 bp, Mus musculus
taagggaggccatgccagccttttt

SEQ ID NO: 738796 - DNA, 25 bp, Mus musculus
taagggagtcagagcttcactccac

SEQ ID NO: 738797 - DNA, 25 bp, Mus musculus
taagggagtcagtgcttcactccac

SEQ ID NO: 738798 - DNA, 25 bp, Mus musculus
taagggagtttgcagatacctcagg

SEQ ID NO: 738799 - DNA, 25 bp, Mus musculus
taagggagtttggagatacctcagg

SEQ ID NO: 738800 - DNA, 25 bp, Mus musculus
taagggatcaacagtccactcttgc

SEQ ID NO: 738801 - DNA, 25 bp, Mus musculus
taagggatcaactgtccactcttgc

SEQ ID NO: 738802 - DNA, 25 bp, Mus musculus
taagggattatgcacctgtacttcc

SEQ ID NO: 738803 - DNA, 25 bp, Mus musculus
taagggattatggacctgtacttcc

SEQ ID NO: 738804 - DNA, 25 bp, Mus musculus
taagggattgccaggccttgtttgg

SEQ ID NO: 738805 - DNA, 25 bp, Mus musculus
taagggattgcctggccttgtttgg

SEQ ID NO: 738806 - DNA, 25 bp, Mus musculus
taagggcacactaaaggataaaact

SEQ ID NO: 738807 - DNA, 25 bp, Mus musculus
taagggcacacttaaggataaaact

SEQ ID NO: 738808 - DNA, 25 bp, Mus musculus
taagggcacatgacccatcagttgg

SEQ ID NO: 738809 - DNA, 25 bp, Mus musculus
taagggcacatgtcccatcagttgg

SEQ ID NO: 738810 - DNA, 25 bp, Mus musculus
taagggcactggaaggcaaaggctc

SEQ ID NO: 738811 - DNA, 25 bp, Mus musculus
taagggcactggtaggcaaaggctc

SEQ ID NO: 738812 - DNA, 25 bp, Mus musculus
taagggcagactcctccaatattga

SEQ ID NO: 738813 - DNA, 25 bp, Mus musculus
taagggcagactgctccaatattga

SEQ ID NO: 738814 - DNA, 25 bp, Mus musculus
taagggcatcgcattgactcaggca

SEQ ID NO: 738815 - DNA, 25 bp, Mus musculus
taagggcatcgctttgactcaggca

SEQ ID NO: 738816 - DNA, 25 bp, Mus musculus
taagggcatgtccaaaggatgccac

SEQ ID NO: 738817 - DNA, 25 bp, Mus musculus
taagggcatgtcgaaaggatgccac

SEQ ID NO: 738818 - DNA, 25 bp, Mus musculus
taagggcattgcctgacgacttttc

SEQ ID NO: 738819 - DNA, 25 bp, Mus musculus
taagggcattgcgtgacgacttttc

SEQ ID NO: 738820 - DNA, 25 bp, Mus musculus
taagggcccaggcaactttgacact

SEQ ID NO: 738821 - DNA, 25 bp, Mus musculus
taagggcccagggaactttgacact

SEQ ID NO: 738822 - DNA, 25 bp, Mus musculus
taagggcctgagagtgtagagcctc

SEQ ID NO: 738823 - DNA, 25 bp, Mus musculus
taagggcctgagtgtgtagagcctc

SEQ ID NO: 738824 - DNA, 25 bp, Mus musculus
taagggcctgtgagagccacggata

SEQ ID NO: 738825 - DNA, 25 bp, Mus musculus
taagggcctgtgtgagccacggata

SEQ ID NO: 738826 - DNA, 25 bp, Mus musculus
taagggccttggcatagatgtttct

SEQ ID NO: 738827 - DNA, 25 bp, Mus musculus
taagggccttgggatagatgtttct

SEQ ID NO: 738828 - DNA, 25 bp, Mus musculus
taagggctaggaccactaactaacc

SEQ ID NO: 738829 - DNA, 25 bp, Mus musculus
taagggctaggagcactaactaacc

SEQ ID NO: 738830 - DNA, 25 bp, Mus musculus
taagggctatcaacccagaaaacgg

SEQ ID NO: 738831 - DNA, 25 bp, Mus musculus
taagggctatcatcccagaaaacgg

SEQ ID NO: 738832 - DNA, 25 bp, Mus musculus
taagggctgaagataatgcagacac

SEQ ID NO: 738833 - DNA, 25 bp, Mus musculus
taagggctgaagttaatgcagacac

SEQ ID NO: 738834 - DNA, 25 bp, Mus musculus
taagggctgactagaatcccaggct

SEQ ID NO: 738835 - DNA, 25 bp, Mus musculus
taagggctgacttgaatcccaggct

SEQ ID NO: 738836 - DNA, 25 bp, Mus musculus
taagggctgcatatgggcactgacc

SEQ ID NO: 738837 - DNA, 25 bp, Mus musculus
taagggctgcatttgggcactgacc

SEQ ID NO: 738838 - DNA, 25 bp, Mus musculus
taagggctgtcaacatcaacctctg

SEQ ID NO: 738839 - DNA, 25 bp, Mus musculus
taagggctgtcatcatcaacctctg

SEQ ID NO: 738840 - DNA, 25 bp, Mus musculus
taagggtaaaaacactgccaatggc

SEQ ID NO: 738841 - DNA, 25 bp, Mus musculus
taagggtaaaaagactgccaatggc

SEQ ID NO: 738842 - DNA, 25 bp, Mus musculus
taagggtatagaagtatttccaagg

SEQ ID NO: 738843 - DNA, 25 bp, Mus musculus
taagggtatagatgtatttccaagg

SEQ ID NO: 738844 - DNA, 25 bp, Mus musculus
taagggtatattagttcatcgatac

SEQ ID NO: 738845 - DNA, 25 bp, Mus musculus
taagggtatatttgttcatcgatac

SEQ ID NO: 738846 - DNA, 25 bp, Mus musculus
taagggtatcctcccattcagtgac

SEQ ID NO: 738847 - DNA, 25 bp, Mus musculus
taagggtatcctgccattcagtgac

SEQ ID NO: 738848 - DNA, 25 bp, Mus musculus
taagggtccctgaggtgacacttcg

SEQ ID NO: 738849 - DNA, 25 bp, Mus musculus
taagggtccctgtggtgacacttcg

SEQ ID NO: 738850 - DNA, 25 bp, Mus musculus
taagggtcttacacctctgcagcag

SEQ ID NO: 738851 - DNA, 25 bp, Mus musculus
taagggtcttactcctctgcagcag

SEQ ID NO: 738852 - DNA, 25 bp, Mus musculus
taagggtgaactagcctcctatgat

SEQ ID NO: 738853 - DNA, 25 bp, Mus musculus
taagggtgaacttgcctcctatgat

SEQ ID NO: 738854 - DNA, 25 bp, Mus musculus
taagggtgcttgcatcccgggcatt

SEQ ID NO: 738855 - DNA, 25 bp, Mus musculus
taagggtgcttggatcccgggcatt

SEQ ID NO: 738856 - DNA, 25 bp, Mus musculus
taagggtgtgccagttcccaagcct

SEQ ID NO: 738857 - DNA, 25 bp, Mus musculus
taagggtgtgcctgttcccaagcct

SEQ ID NO: 738858 - DNA, 25 bp, Mus musculus
taagggtgtttcacagacgatctgc

SEQ ID NO: 738859 - DNA, 25 bp, Mus musculus
taagggtgtttctcagacgatctgc

SEQ ID NO: 738860 - DNA, 25 bp, Mus musculus
taagggttcaggacagcgacttctg

SEQ ID NO: 738861 - DNA, 25 bp, Mus musculus
taagggttcaggtcagcgacttctg

SEQ ID NO: 738862 - DNA, 25 bp, Mus musculus
taagggttcctaagagagcgcacgc

SEQ ID NO: 738863 - DNA, 25 bp, Mus musculus
taagggttcctatgagagcgcacgc

SEQ ID NO: 738864 - DNA, 25 bp, Mus musculus
taaggtaagtcccttccagctgcct

SEQ ID NO: 738865 - DNA, 25 bp, Mus musculus
taaggtaagtccgttccagctgcct

SEQ ID NO: 738866 - DNA, 25 bp, Mus musculus
taaggtaatagccacaagatactca

SEQ ID NO: 738867 - DNA, 25 bp, Mus musculus
taaggtaatagcgacaagatactca

SEQ ID NO: 738868 - DNA, 25 bp, Mus musculus
taaggtagaattacatatgaactgc

SEQ ID NO: 738869 - DNA, 25 bp, Mus musculus
taaggtagaatttcatatgaactgc

SEQ ID NO: 738870 - DNA, 25 bp, Mus musculus
taaggtagcctgagttagggccctg

SEQ ID NO: 738871 - DNA, 25 bp, Mus musculus
taaggtagcctgtgttagggccctg

SEQ ID NO: 738872 - DNA, 25 bp, Mus musculus
taaggtagctgtctgctgatgcacg

SEQ ID NO: 738873 - DNA, 25 bp, Mus musculus
taaggtagctgtgtgctgatgcacg

SEQ ID NO: 738874 - DNA, 25 bp, Mus musculus
taaggtagtgaacagactccggcgc

SEQ ID NO: 738875 - DNA, 25 bp, Mus musculus
taaggtagtgaagagactccggcgc

SEQ ID NO: 738876 - DNA, 25 bp, Mus musculus
taaggtataaccaaactgagtgccc

SEQ ID NO: 738877 - DNA, 25 bp, Mus musculus
taaggtataacctaactgagtgccc

SEQ ID NO: 738878 - DNA, 25 bp, Mus musculus
taaggtattcagatgcccctactgg

SEQ ID NO: 738879 - DNA, 25 bp, Mus musculus
taaggtattcagttgcccctactgg

SEQ ID NO: 738880 - DNA, 25 bp, Mus musculus
taaggtattgggacagctgacagag

SEQ ID NO: 738881 - DNA, 25 bp, Mus musculus
taaggtattgggtcagctgacagag

SEQ ID NO: 738882 - DNA, 25 bp, Mus musculus
taaggtcaacatagactatacagcg

SEQ ID NO: 738883 - DNA, 25 bp, Mus musculus
taaggtcaacattgactatacagcg

SEQ ID NO: 738884 - DNA, 25 bp, Mus musculus
taaggtcaccttctgtgagatgaag

SEQ ID NO: 738885 - DNA, 25 bp, Mus musculus
taaggtcaccttgtgtgagatgaag

SEQ ID NO: 738886 - DNA, 25 bp, Mus musculus
taaggtcagagaccaattagccagg

SEQ ID NO: 738887 - DNA, 25 bp, Mus musculus
taaggtcagagagcaattagccagg

SEQ ID NO: 738888 - DNA, 25 bp, Mus musculus
taaggtcatcaccattgttttggac

SEQ ID NO: 738889 - DNA, 25 bp, Mus musculus
taaggtcatcacgattgttttggac

SEQ ID NO: 738890 - DNA, 25 bp, Mus musculus
taaggtcattctacttgcctcaaga

SEQ ID NO: 738891 - DNA, 25 bp, Mus musculus
taaggtcattcttcttgcctcaaga

SEQ ID NO: 738892 - DNA, 25 bp, Mus musculus
taaggtcccagcaccaacttgagct

SEQ ID NO: 738893 - DNA, 25 bp, Mus musculus
taaggtcccagctccaacttgagct

SEQ ID NO: 738894 - DNA, 25 bp, Mus musculus
taaggtccgccgattagatgggtta

SEQ ID NO: 738895 - DNA, 25 bp, Mus musculus
taaggtccgccgtttagatgggtta

SEQ ID NO: 738896 - DNA, 25 bp, Mus musculus
taaggtcctattcctagaagatagc

SEQ ID NO: 738897 - DNA, 25 bp, Mus musculus
taaggtcctattgctagaagatagc

SEQ ID NO: 738898 - DNA, 25 bp, Mus musculus
taaggtctacacaaagagctcgcac

SEQ ID NO: 738899 - DNA, 25 bp, Mus musculus
taaggtctacactaagagctcgcac

SEQ ID NO: 738900 - DNA, 25 bp, Mus musculus
taaggtctcgccatatagcccaggc

SEQ ID NO: 738901 - DNA, 25 bp, Mus musculus
taaggtctcgccttatagcccaggc

SEQ ID NO: 738902 - DNA, 25 bp, Mus musculus
taaggtcttcttaatcggcagtgta

SEQ ID NO: 738903 - DNA, 25 bp, Mus musculus
taaggtcttctttatcggcagtgta

SEQ ID NO: 738904 - DNA, 25 bp, Mus musculus
taaggtgaacctacagtcatccctg

SEQ ID NO: 738905 - DNA, 25 bp, Mus musculus
taaggtgaaccttcagtcatccctg

SEQ ID NO: 738906 - DNA, 25 bp, Mus musculus
taaggtgaagatcgcacaaggtgtc

SEQ ID NO: 738907 - DNA, 25 bp, Mus musculus
taaggtgaagatggcacaaggtgtc

SEQ ID NO: 738908 - DNA, 25 bp, Mus musculus
taaggtgaatggcaccacggtgtcc

SEQ ID NO: 738909 - DNA, 25 bp, Mus musculus
taaggtgaatgggaccacggtgtcc

SEQ ID NO: 738910 - DNA, 25 bp, Mus musculus
taaggtgacttgacttctagtgagc

SEQ ID NO: 738911 - DNA, 25 bp, Mus musculus
taaggtgacttgtcttctagtgagc

SEQ ID NO: 738912 - DNA, 25 bp, Mus musculus
taaggtgaggtacgatcagttgctc

SEQ ID NO: 738913 - DNA, 25 bp, Mus musculus
taaggtgaggtaggatcagttgctc

SEQ ID NO: 738914 - DNA, 25 bp, Mus musculus
taaggtgatccgagacaagcgcaca

SEQ ID NO: 738915 - DNA, 25 bp, Mus musculus
taaggtgatccgtgacaagcgcaca

SEQ ID NO: 738916 - DNA, 25 bp, Mus musculus
taaggtgcatcgcaagacgctgaac

SEQ ID NO: 738917 - DNA, 25 bp, Mus musculus
taaggtgcatcggaagacgctgaac

SEQ ID NO: 738918 - DNA, 25 bp, Mus musculus
taaggtgccactcctcctacaagca

SEQ ID NO: 738919 - DNA, 25 bp, Mus musculus
taaggtgccactgctcctacaagca

SEQ ID NO: 738920 - DNA, 25 bp, Mus musculus
taaggtgcccagaataaaagctaac

SEQ ID NO: 738921 - DNA, 25 bp, Mus musculus
taaggtgcccagtataaaagctaac

SEQ ID NO: 738922 - DNA, 25 bp, Mus musculus
taaggtgcccttattgcttccaaat

SEQ ID NO: 738923 - DNA, 25 bp, Mus musculus
taaggtgccctttttgcttccaaat

SEQ ID NO: 738924 - DNA, 25 bp, Mus musculus
taaggtgcctaaactgcggagtggc

SEQ ID NO: 738925 - DNA, 25 bp, Mus musculus
taaggtgcctaatctgcggagtggc

SEQ ID NO: 738926 - DNA, 25 bp, Mus musculus
taaggtgcctgtaagtcccctacaa

SEQ ID NO: 738927 - DNA, 25 bp, Mus musculus
taaggtgcctgttagtcccctacaa

SEQ ID NO: 738928 - DNA, 25 bp, Mus musculus
taaggtgccttcacgtttccgccct

SEQ ID NO: 738929 - DNA, 25 bp, Mus musculus
taaggtgccttctcgtttccgccct

SEQ ID NO: 738930 - DNA, 25 bp, Mus musculus
taaggtgcggccaaacagtgacctc

SEQ ID NO: 738931 - DNA, 25 bp, Mus musculus
taaggtgcggcctaacagtgacctc

SEQ ID NO: 738932 - DNA, 25 bp, Mus musculus
taaggtgctgctaccaaaccagatg

SEQ ID NO: 738933 - DNA, 25 bp, Mus musculus
taaggtgctgcttccaaaccagatg

SEQ ID NO: 738934 - DNA, 25 bp, Mus musculus
taaggtggatgcaacaagttctgtc

SEQ ID NO: 738935 - DNA, 25 bp, Mus musculus
taaggtggatgctacaagttctgtc

SEQ ID NO: 738936 - DNA, 25 bp, Mus musculus
taaggtgtcctcattcttggacatg

SEQ ID NO: 738937 - DNA, 25 bp, Mus musculus
taaggtgtcctctttcttggacatg

SEQ ID NO: 738938 - DNA, 25 bp, Mus musculus
taaggtgtgaccatttgtggtgtcc

SEQ ID NO: 738939 - DNA, 25 bp, Mus musculus
taaggtgtgaccttttgtggtgtcc

SEQ ID NO: 738940 - DNA, 25 bp, Mus musculus
taaggtgtggaacaaccaattcctt

SEQ ID NO: 738941 - DNA, 25 bp, Mus musculus
taaggtgtggaagaaccaattcctt

SEQ ID NO: 738942 - DNA, 25 bp, Mus musculus
taaggttaaatgcacccacgaggag

SEQ ID NO: 738943 - DNA, 25 bp, Mus musculus
taaggttaaatggacccacgaggag

SEQ ID NO: 738944 - DNA, 25 bp, Mus musculus
taaggttaacatacgaaatgccaat

SEQ ID NO: 738945 - DNA, 25 bp, Mus musculus
taaggttaacattcgaaatgccaat

SEQ ID NO: 738946 - DNA, 25 bp, Mus musculus
taaggttcaagacgattcctccagt

SEQ ID NO: 738947 - DNA, 25 bp, Mus musculus
taaggttcaagaggattcctccagt

SEQ ID NO: 738948 - DNA, 25 bp, Mus musculus
taaggttcacaacccctgcttttat

SEQ ID NO: 738949 - DNA, 25 bp, Mus musculus
taaggttcacaagccctgcttttat

SEQ ID NO: 738950 - DNA, 25 bp, Mus musculus
taaggttcatctcttcatggccggt

SEQ ID NO: 738951 - DNA, 25 bp, Mus musculus
taaggttcatctgttcatggccggt

SEQ ID NO: 738952 - DNA, 25 bp, Mus musculus
taaggttgaccaagtgatcacggga

SEQ ID NO: 738953 - DNA, 25 bp, Mus musculus
taaggttgaccatgtgatcacggga

SEQ ID NO: 738954 - DNA, 25 bp, Mus musculus
taaggttggccaatattcctgtttt

SEQ ID NO: 738955 - DNA, 25 bp, Mus musculus
taaggttggccattattcctgtttt

SEQ ID NO: 738956 - DNA, 25 bp, Mus musculus
taaggttggcttaactgtacgcctg

SEQ ID NO: 738957 - DNA, 25 bp, Mus musculus
taaggttggctttactgtacgcctg

SEQ ID NO: 738958 - DNA, 25 bp, Mus musculus
taaggttggtcactctggctgagac

SEQ ID NO: 738959 - DNA, 25 bp, Mus musculus
taaggttggtcagtctggctgagac

SEQ ID NO: 738960 - DNA, 25 bp, Mus musculus
taaggtttcactaggccagtgcaga

SEQ ID NO: 738961 - DNA, 25 bp, Mus musculus
taaggtttcacttggccagtgcaga

SEQ ID NO: 738962 - DNA, 25 bp, Mus musculus
taagtaactaaccaaatgagcctgg

SEQ ID NO: 738963 - DNA, 25 bp, Mus musculus
taagtaactaacgaaatgagcctgg

SEQ ID NO: 738964 - DNA, 25 bp, Mus musculus
taagtaactgtgaggtatgagggca

SEQ ID NO: 738965 - DNA, 25 bp, Mus musculus
taagtaactgtgtggtatgagggca

SEQ ID NO: 738966 - DNA, 25 bp, Mus musculus
taagtaagagcccatagcacagcac

SEQ ID NO: 738967 - DNA, 25 bp, Mus musculus
taagtaagagccgatagcacagcac

SEQ ID NO: 738968 - DNA, 25 bp, Mus musculus
taagtaagcctcagtaaaatctgcc

SEQ ID NO: 738969 - DNA, 25 bp, Mus musculus
taagtaagcctctgtaaaatctgcc

SEQ ID NO: 738970 - DNA, 25 bp, Mus musculus
taagtaataaccagacaagtaggag

SEQ ID NO: 738971 - DNA, 25 bp, Mus musculus
taagtaataacctgacaagtaggag

SEQ ID NO: 738972 - DNA, 25 bp, Mus musculus
taagtacaaaatcgcaaatggtggc

SEQ ID NO: 738973 - DNA, 25 bp, Mus musculus
taagtacaaaatggcaaatggtggc

SEQ ID NO: 738974 - DNA, 25 bp, Mus musculus
taagtacaaggtcggttgggtcaat

SEQ ID NO: 738975 - DNA, 25 bp, Mus musculus
taagtacaaggtgggttgggtcaat

SEQ ID NO: 738976 - DNA, 25 bp, Mus musculus
taagtacagaggaacaacagaccag

SEQ ID NO: 738977 - DNA, 25 bp, Mus musculus
taagtacagaggtacaacagaccag

SEQ ID NO: 738978 - DNA, 25 bp, Mus musculus
taagtacagctaaaagtgtgacaac

SEQ ID NO: 738979 - DNA, 25 bp, Mus musculus
taagtacagctataagtgtgacaac

SEQ ID NO: 738980 - DNA, 25 bp, Mus musculus
taagtaccaaacagcccgacaagac

SEQ ID NO: 738981 - DNA, 25 bp, Mus musculus
taagtaccaaactgcccgacaagac

SEQ ID NO: 738982 - DNA, 25 bp, Mus musculus
taagtaccaagcaaccatggcaggc

SEQ ID NO: 738983 - DNA, 25 bp, Mus musculus
taagtaccaagctaccatggcaggc

SEQ ID NO: 738984 - DNA, 25 bp, Mus musculus
taagtaccacccagatgaggtggga

SEQ ID NO: 738985 - DNA, 25 bp, Mus musculus
taagtaccaccctgatgaggtggga

SEQ ID NO: 738986 - DNA, 25 bp, Mus musculus
taagtacccagaaagtcaccaaccc

SEQ ID NO: 738987 - DNA, 25 bp, Mus musculus
taagtacccagacctgatagctgag

SEQ ID NO: 738988 - DNA, 25 bp, Mus musculus
taagtacccagagctgatagctgag

SEQ ID NO: 738989 - DNA, 25 bp, Mus musculus
taagtacccagatagtcaccaaccc

SEQ ID NO: 738990 - DNA, 25 bp, Mus musculus
taagtacctgcaaaggaaggcagtc

SEQ ID NO: 738991 - DNA, 25 bp, Mus musculus
taagtacctgcataggaaggcagtc

SEQ ID NO: 738992 - DNA, 25 bp, Mus musculus
taagtacgcagtcgccattggctct

SEQ ID NO: 738993 - DNA, 25 bp, Mus musculus
taagtacgcagtggccattggctct

SEQ ID NO: 738994 - DNA, 25 bp, Mus musculus
taagtacggcagctctcacacagat

SEQ ID NO: 738995 - DNA, 25 bp, Mus musculus
taagtacggcaggtctcacacagat

SEQ ID NO: 738996 - DNA, 25 bp, Mus musculus
taagtactatgtcctctccctttcc

SEQ ID NO: 738997 - DNA, 25 bp, Mus musculus
taagtactatgtgctctccctttcc

SEQ ID NO: 738998 - DNA, 25 bp, Mus musculus
taagtactcattccctctgcacgtg

SEQ ID NO: 738999 - DNA, 25 bp, Mus musculus
taagtactcattgcctctgcacgtg

SEQ ID NO: 739000 - DNA, 25 bp, Mus musculus
taagtacttcctcggcacaccagtc

SEQ ID NO: 739001 - DNA, 25 bp, Mus musculus
taagtacttcctgggcacaccagtc

SEQ ID NO: 739002 - DNA, 25 bp, Mus musculus
taagtactttccagggactcctgtg

SEQ ID NO: 739003 - DNA, 25 bp, Mus musculus
taagtactttcctgggactcctgtg

SEQ ID NO: 739004 - DNA, 25 bp, Mus musculus
taagtagatatgaggtagtagtagc

SEQ ID NO: 739005 - DNA, 25 bp, Mus musculus
taagtagatatgtggtagtagtagc

SEQ ID NO: 739006 - DNA, 25 bp, Mus musculus
taagtagatttccaatgagatgtgc

SEQ ID NO: 739007 - DNA, 25 bp, Mus musculus
taagtagatttcgaatgagatgtgc

SEQ ID NO: 739008 - DNA, 25 bp, Mus musculus
taagtagcagaccttcgctcacgct

SEQ ID NO: 739009 - DNA, 25 bp, Mus musculus
taagtagcagacgttcgctcacgct

SEQ ID NO: 739010 - DNA, 25 bp, Mus musculus
taagtagccacaatgtcatttccac

SEQ ID NO: 739011 - DNA, 25 bp, Mus musculus
taagtagccacattgtcatttccac

SEQ ID NO: 739012 - DNA, 25 bp, Mus musculus
taagtagcgaccagctgactctcta

SEQ ID NO: 739013 - DNA, 25 bp, Mus musculus
taagtagcgacctgctgactctcta

SEQ ID NO: 739014 - DNA, 25 bp, Mus musculus
taagtagctcagactcgggtgcaca

SEQ ID NO: 739015 - DNA, 25 bp, Mus musculus
taagtagctcagtctcgggtgcaca

SEQ ID NO: 739016 - DNA, 25 bp, Mus musculus
taagtagctggtcttggctcaaaca

SEQ ID NO: 739017 - DNA, 25 bp, Mus musculus
taagtagctggtgttggctcaaaca

SEQ ID NO: 739018 - DNA, 25 bp, Mus musculus
taagtaggacctctgtataatcctc

SEQ ID NO: 739019 - DNA, 25 bp, Mus musculus
taagtaggacctgtgtataatcctc

SEQ ID NO: 739020 - DNA, 25 bp, Mus musculus
taagtaggccctcagacagtttgct

SEQ ID NO: 739021 - DNA, 25 bp, Mus musculus
taagtaggccctgagacagtttgct

SEQ ID NO: 739022 - DNA, 25 bp, Mus musculus
taagtatacttacgcagacctggtg

SEQ ID NO: 739023 - DNA, 25 bp, Mus musculus
taagtatacttaggcagacctggtg

SEQ ID NO: 739024 - DNA, 25 bp, Mus musculus
taagtatataccagtgggtcccact

SEQ ID NO: 739025 - DNA, 25 bp, Mus musculus
taagtatatacctgtgggtcccact

SEQ ID NO: 739026 - DNA, 25 bp, Mus musculus
taagtatcgctgaggtcgctgatgg

SEQ ID NO: 739027 - DNA, 25 bp, Mus musculus
taagtatcgctgtggtcgctgatgg

SEQ ID NO: 739028 - DNA, 25 bp, Mus musculus
taagtatggtgacctggccaactgg

SEQ ID NO: 739029 - DNA, 25 bp, Mus musculus
taagtatggtgagctggccaactgg

SEQ ID NO: 739030 - DNA, 25 bp, Mus musculus
taagtattaatacaagccttcctgt

SEQ ID NO: 739031 - DNA, 25 bp, Mus musculus
taagtattaatagaagccttcctgt

SEQ ID NO: 739032 - DNA, 25 bp, Mus musculus
taagtattccttcgtggaccagaca

SEQ ID NO: 739033 - DNA, 25 bp, Mus musculus
taagtattccttggtggaccagaca

SEQ ID NO: 739034 - DNA, 25 bp, Mus musculus
taagtattgcgcagacccggatgca

SEQ ID NO: 739035 - DNA, 25 bp, Mus musculus
taagtattgcgctgacccggatgca

SEQ ID NO: 739036 - DNA, 25 bp, Mus musculus
taagtattgtaccttcagcgtgcag

SEQ ID NO: 739037 - DNA, 25 bp, Mus musculus
taagtattgtacgttcagcgtgcag

SEQ ID NO: 739038 - DNA, 25 bp, Mus musculus
taagtattttgtaccgcaagcccaa

SEQ ID NO: 739039 - DNA, 25 bp, Mus musculus
taagtattttgttccgcaagcccaa

SEQ ID NO: 739040 - DNA, 25 bp, Mus musculus
taagtcaaaggcaagtgaaggtggc

SEQ ID NO: 739041 - DNA, 25 bp, Mus musculus
taagtcaaaggctagtgaaggtggc

SEQ ID NO: 739042 - DNA, 25 bp, Mus musculus
taagtcacagaaagacagccaaggc

SEQ ID NO: 739043 - DNA, 25 bp, Mus musculus
taagtcacagaatgacagccaaggc

SEQ ID NO: 739044 - DNA, 25 bp, Mus musculus
taagtcacagcgaggctgtggccat

SEQ ID NO: 739045 - DNA, 25 bp, Mus musculus
taagtcacagcgtggctgtggccat

SEQ ID NO: 739046 - DNA, 25 bp, Mus musculus
taagtcaccatcagctagtaagagc

SEQ ID NO: 739047 - DNA, 25 bp, Mus musculus
taagtcaccatctgctagtaagagc

SEQ ID NO: 739048 - DNA, 25 bp, Mus musculus
taagtcacctttaaaggcagtctca

SEQ ID NO: 739049 - DNA, 25 bp, Mus musculus
taagtcaccttttaaggcagtctca

SEQ ID NO: 739050 - DNA, 25 bp, Mus musculus
taagtcactgctagagaacagggca

SEQ ID NO: 739051 - DNA, 25 bp, Mus musculus
taagtcactgcttgagaacagggca

SEQ ID NO: 739052 - DNA, 25 bp, Mus musculus
taagtcagagcaccgtccatcttcc

SEQ ID NO: 739053 - DNA, 25 bp, Mus musculus
taagtcagagcagcgtccatcttcc

SEQ ID NO: 739054 - DNA, 25 bp, Mus musculus
taagtcagataacctcccagaagag

SEQ ID NO: 739055 - DNA, 25 bp, Mus musculus
taagtcagataagctcccagaagag

SEQ ID NO: 739056 - DNA, 25 bp, Mus musculus
taagtcagatacagggaagccttac

SEQ ID NO: 739057 - DNA, 25 bp, Mus musculus
taagtcagatactgggaagccttac

SEQ ID NO: 739058 - DNA, 25 bp, Mus musculus
taagtcagcctgcagcataaccctc

SEQ ID NO: 739059 - DNA, 25 bp, Mus musculus
taagtcagcctggagcataaccctc

SEQ ID NO: 739060 - DNA, 25 bp, Mus musculus
taagtcagtctcacctggctaggag

SEQ ID NO: 739061 - DNA, 25 bp, Mus musculus
taagtcagtctctcctggctaggag

SEQ ID NO: 739062 - DNA, 25 bp, Mus musculus
taagtcagtgacacaaaagatggaa

SEQ ID NO: 739063 - DNA, 25 bp, Mus musculus
taagtcagtgactcaaaagatggaa

SEQ ID NO: 739064 - DNA, 25 bp, Mus musculus
taagtcatcattccgggaaaaggag

SEQ ID NO: 739065 - DNA, 25 bp, Mus musculus
taagtcatcattgcgggaaaaggag

SEQ ID NO: 739066 - DNA, 25 bp, Mus musculus
taagtcatgaaaatgagggccctgc

SEQ ID NO: 739067 - DNA, 25 bp, Mus musculus
taagtcatgaaattgagggccctgc

SEQ ID NO: 739068 - DNA, 25 bp, Mus musculus
taagtcattacactgaaagcggtac

SEQ ID NO: 739069 - DNA, 25 bp, Mus musculus
taagtcattacagtgaaagcggtac

SEQ ID NO: 739070 - DNA, 25 bp, Mus musculus
taagtcattgtgatgccaagcatat

SEQ ID NO: 739071 - DNA, 25 bp, Mus musculus
taagtcattgtgttgccaagcatat

SEQ ID NO: 739072 - DNA, 25 bp, Mus musculus
taagtccaatgcagctgcatacctg

SEQ ID NO: 739073 - DNA, 25 bp, Mus musculus
taagtccaatgctgctgcatacctg

SEQ ID NO: 739074 - DNA, 25 bp, Mus musculus
taagtccacagtcatgtgatgcgca

SEQ ID NO: 739075 - DNA, 25 bp, Mus musculus
taagtccacagtgatgtgatgcgca

SEQ ID NO: 739076 - DNA, 25 bp, Mus musculus
taagtcccagtgctcagacacggag

SEQ ID NO: 739077 - DNA, 25 bp, Mus musculus
taagtcccagtggtcagacacggag

SEQ ID NO: 739078 - DNA, 25 bp, Mus musculus
taagtcccggcaaacaatgctgaag

SEQ ID NO: 739079 - DNA, 25 bp, Mus musculus
taagtcccggcatacaatgctgaag

SEQ ID NO: 739080 - DNA, 25 bp, Mus musculus
taagtccctgcaatctgctggaccc

SEQ ID NO: 739081 - DNA, 25 bp, Mus musculus
taagtccctgcattctgctggaccc

SEQ ID NO: 739082 - DNA, 25 bp, Mus musculus
taagtccctgtgacattgggatttg

SEQ ID NO: 739083 - DNA, 25 bp, Mus musculus
taagtccctgtgtcattgggatttg

SEQ ID NO: 739084 - DNA, 25 bp, Mus musculus
taagtcctaacaagaccaataagcg

SEQ ID NO: 739085 - DNA, 25 bp, Mus musculus
taagtcctaacatgaccaataagcg

SEQ ID NO: 739086 - DNA, 25 bp, Mus musculus
taagtcctgcttcaacacattcttc

SEQ ID NO: 739087 - DNA, 25 bp, Mus musculus
taagtcctgcttgaacacattcttc

SEQ ID NO: 739088 - DNA, 25 bp, Mus musculus
taagtcctggcaccacaaacacaga

SEQ ID NO: 739089 - DNA, 25 bp, Mus musculus
taagtcctggcagcacaaacacaga

SEQ ID NO: 739090 - DNA, 25 bp, Mus musculus
taagtcgaccagattacgagtggcg

SEQ ID NO: 739091 - DNA, 25 bp, Mus musculus
taagtcgaccagtttacgagtggcg

SEQ ID NO: 739092 - DNA, 25 bp, Mus musculus
taagtcgacgatccctctgcagggt

SEQ ID NO: 739093 - DNA, 25 bp, Mus musculus
taagtcgacgatgcctctgcagggt

SEQ ID NO: 739094 - DNA, 25 bp, Mus musculus
taagtcgcccagacaagaagagcaa

SEQ ID NO: 739095 - DNA, 25 bp, Mus musculus
taagtcgcccagtcaagaagagcaa

SEQ ID NO: 739096 - DNA, 25 bp, Mus musculus
taagtcggatccaggttgagaggcc

SEQ ID NO: 739097 - DNA, 25 bp, Mus musculus
taagtcggatcctggttgagaggcc

SEQ ID NO: 739098 - DNA, 25 bp, Mus musculus
taagtcggatgacccggtctgtgcc

SEQ ID NO: 739099 - DNA, 25 bp, Mus musculus
taagtcggatgagccggtctgtgcc

SEQ ID NO: 739100 - DNA, 25 bp, Mus musculus
taagtcggcaggagtcacgctacgg

SEQ ID NO: 739101 - DNA, 25 bp, Mus musculus
taagtcggcaggtgtcacgctacgg

SEQ ID NO: 739102 - DNA, 25 bp, Mus musculus
taagtcgggcccagttgcctcagta

SEQ ID NO: 739103 - DNA, 25 bp, Mus musculus
taagtcgggccctgttgcctcagta

SEQ ID NO: 739104 - DNA, 25 bp, Mus musculus
taagtcgggctaactgagatacagc

SEQ ID NO: 739105 - DNA, 25 bp, Mus musculus
taagtcgggctatctgagatacagc

SEQ ID NO: 739106 - DNA, 25 bp, Mus musculus
taagtcggtagactacaagttctca

SEQ ID NO: 739107 - DNA, 25 bp, Mus musculus
taagtcggtagagtacaagttctca

SEQ ID NO: 739108 - DNA, 25 bp, Mus musculus
taagtctaaggaagatggtcccact

SEQ ID NO: 739109 - DNA, 25 bp, Mus musculus
taagtctaaggatgatggtcccact

SEQ ID NO: 739110 - DNA, 25 bp, Mus musculus
taagtctcagctccgagatgacagc

SEQ ID NO: 739111 - DNA, 25 bp, Mus musculus
taagtctcagctgcgagatgacagc

SEQ ID NO: 739112 - DNA, 25 bp, Mus musculus
taagtctcattgcaaagtttagaag

SEQ ID NO: 739113 - DNA, 25 bp, Mus musculus
taagtctcattggaaagtttagaag

SEQ ID NO: 739114 - DNA, 25 bp, Mus musculus
taagtctccgaactatgtatggccg

SEQ ID NO: 739115 - DNA, 25 bp, Mus musculus
taagtctccgaagtatgtatggccg

SEQ ID NO: 739116 - DNA, 25 bp, Mus musculus
taagtctctgaccatcagcgtgcac

SEQ ID NO: 739117 - DNA, 25 bp, Mus musculus
taagtctctgacgatcagcgtgcac

SEQ ID NO: 739118 - DNA, 25 bp, Mus musculus
taagtctctgcaccaagcactttgc

SEQ ID NO: 739119 - DNA, 25 bp, Mus musculus
taagtctctgcagcaagcactttgc

SEQ ID NO: 739120 - DNA, 25 bp, Mus musculus
taagtctcttctacaccgtgatttg

SEQ ID NO: 739121 - DNA, 25 bp, Mus musculus
taagtctcttcttcaccgtgatttg

SEQ ID NO: 739122 - DNA, 25 bp, Mus musculus
taagtctgcagacaggttgacgcca

SEQ ID NO: 739123 - DNA, 25 bp, Mus musculus
taagtctgcagagaggttgacgcca

SEQ ID NO: 739124 - DNA, 25 bp, Mus musculus
taagtctgtctactaactgatcctc

SEQ ID NO: 739125 - DNA, 25 bp, Mus musculus
taagtctgtctagtaactgatcctc

SEQ ID NO: 739126 - DNA, 25 bp, Mus musculus
taagtctgtctgatcacccaagtag

SEQ ID NO: 739127 - DNA, 25 bp, Mus musculus
taagtctgtctgttcacccaagtag

SEQ ID NO: 739128 - DNA, 25 bp, Mus musculus
taagtctgtgatcctttctggtaca

SEQ ID NO: 739129 - DNA, 25 bp, Mus musculus
taagtctgtgatgctttctggtaca

SEQ ID NO: 739130 - DNA, 25 bp, Mus musculus
taagtcttgcttccagccactgttt

SEQ ID NO: 739131 - DNA, 25 bp, Mus musculus
taagtcttgcttgcagccactgttt

SEQ ID NO: 739132 - DNA, 25 bp, Mus musculus
taagtctttagcaagcaagctcatg

SEQ ID NO: 739133 - DNA, 25 bp, Mus musculus
taagtctttagctagcaagctcatg

SEQ ID NO: 739134 - DNA, 25 bp, Mus musculus
taagtctttgcaaccaacattcggc

SEQ ID NO: 739135 - DNA, 25 bp, Mus musculus
taagtctttgcatccaacattcggc

SEQ ID NO: 739136 - DNA, 25 bp, Mus musculus
taagtgaaaaatcaacctgctttct

SEQ ID NO: 739137 - DNA, 25 bp, Mus musculus
taagtgaaaaatgaacctgctttct

SEQ ID NO: 739138 - DNA, 25 bp, Mus musculus
taagtgaagaagctgccaccctagg

SEQ ID NO: 739139 - DNA, 25 bp, Mus musculus
taagtgaagaaggtgccaccctagg

SEQ ID NO: 739140 - DNA, 25 bp, Mus musculus
taagtgaagaggaaccccaagttgg

SEQ ID NO: 739141 - DNA, 25 bp, Mus musculus
taagtgaagaggaattttactcgca

SEQ ID NO: 739142 - DNA, 25 bp, Mus musculus
taagtgaagaggtaccccaagttgg

SEQ ID NO: 739143 - DNA, 25 bp, Mus musculus
taagtgaagaggtattttactcgca

SEQ ID NO: 739144 - DNA, 25 bp, Mus musculus
taagtgaagagtcgtacaaagacag

SEQ ID NO: 739145 - DNA, 25 bp, Mus musculus
taagtgaagagtggtacaaagacag

SEQ ID NO: 739146 - DNA, 25 bp, Mus musculus
taagtgaagtacaccccaacctcag

SEQ ID NO: 739147 - DNA, 25 bp, Mus musculus
taagtgaagtactccccaacctcag

SEQ ID NO: 739148 - DNA, 25 bp, Mus musculus
taagtgaatgtgctcggtcagctcg

SEQ ID NO: 739149 - DNA, 25 bp, Mus musculus
taagtgaatgtggtcggtcagctcg

SEQ ID NO: 739150 - DNA, 25 bp, Mus musculus
taagtgaatttacacctttaccgag

SEQ ID NO: 739151 - DNA, 25 bp, Mus musculus
taagtgaatttagacctttaccgag

SEQ ID NO: 739152 - DNA, 25 bp, Mus musculus
taagtgacaagcaactgcacttccg

SEQ ID NO: 739153 - DNA, 25 bp, Mus musculus
taagtgacaagctactgcacttccg

SEQ ID NO: 739154 - DNA, 25 bp, Mus musculus
taagtgaccaccagggtcagtccga

SEQ ID NO: 739155 - DNA, 25 bp, Mus musculus
taagtgaccacctgggtcagtccga

SEQ ID NO: 739156 - DNA, 25 bp, Mus musculus
taagtgactgttatccaaggaggca

SEQ ID NO: 739157 - DNA, 25 bp, Mus musculus
taagtgactgttttccaaggaggca

SEQ ID NO: 739158 - DNA, 25 bp, Mus musculus
taagtgagaagaagcaggcgtttaa

SEQ ID NO: 739159 - DNA, 25 bp, Mus musculus
taagtgagaagatgcaggcgtttaa

SEQ ID NO: 739160 - DNA, 25 bp, Mus musculus
taagtgagacatctacagacagatc

SEQ ID NO: 739161 - DNA, 25 bp, Mus musculus
taagtgagacatgtacagacagatc

SEQ ID NO: 739162 - DNA, 25 bp, Mus musculus
taagtgagaggtacctatgtggccc

SEQ ID NO: 739163 - DNA, 25 bp, Mus musculus
taagtgagaggttcctatgtggccc

SEQ ID NO: 739164 - DNA, 25 bp, Mus musculus
taagtgagcctgaagagaagctcca

SEQ ID NO: 739165 - DNA, 25 bp, Mus musculus
taagtgagcctgtagagaagctcca

SEQ ID NO: 739166 - DNA, 25 bp, Mus musculus
taagtgagtctgctgtttatccaag

SEQ ID NO: 739167 - DNA, 25 bp, Mus musculus
taagtgagtctggtgtttatccaag

SEQ ID NO: 739168 - DNA, 25 bp, Mus musculus
taagtgagttctccctcgcccgctt

SEQ ID NO: 739169 - DNA, 25 bp, Mus musculus
taagtgagttctgcctcgcccgctt

SEQ ID NO: 739170 - DNA, 25 bp, Mus musculus
taagtgatcagacccgcttcgccaa

SEQ ID NO: 739171 - DNA, 25 bp, Mus musculus
taagtgatcagagccgcttcgccaa

SEQ ID NO: 739172 - DNA, 25 bp, Mus musculus
taagtgatgtgccagcatgcagcga

SEQ ID NO: 739173 - DNA, 25 bp, Mus musculus
taagtgatgtgcgagcatgcagcga

SEQ ID NO: 739174 - DNA, 25 bp, Mus musculus
taagtgcaacacaggcagtgaggga

SEQ ID NO: 739175 - DNA, 25 bp, Mus musculus
taagtgcaacactggcagtgaggga

SEQ ID NO: 739176 - DNA, 25 bp, Mus musculus
taagtgcaagttctgctccttcctt

SEQ ID NO: 739177 - DNA, 25 bp, Mus musculus
taagtgcaagttgtgctccttcctt

SEQ ID NO: 739178 - DNA, 25 bp, Mus musculus
taagtgcacagtaacaaaacactgc

SEQ ID NO: 739179 - DNA, 25 bp, Mus musculus
taagtgcacagttacaaaacactgc

SEQ ID NO: 739180 - DNA, 25 bp, Mus musculus
taagtgcagacccttgcctacaaga

SEQ ID NO: 739181 - DNA, 25 bp, Mus musculus
taagtgcagaccgttgcctacaaga

SEQ ID NO: 739182 - DNA, 25 bp, Mus musculus
taagtgcccatgcagccatttttcc

SEQ ID NO: 739183 - DNA, 25 bp, Mus musculus
taagtgcccatggagccatttttcc

SEQ ID NO: 739184 - DNA, 25 bp, Mus musculus
taagtgcccgacacctctctagggc

SEQ ID NO: 739185 - DNA, 25 bp, Mus musculus
taagtgcccgactcctctctagggc

SEQ ID NO: 739186 - DNA, 25 bp, Mus musculus
taagtgccctggagactcaggttgc

SEQ ID NO: 739187 - DNA, 25 bp, Mus musculus
taagtgccctggtgactcaggttgc

SEQ ID NO: 739188 - DNA, 25 bp, Mus musculus
taagtgcctctaaagcaaccactct

SEQ ID NO: 739189 - DNA, 25 bp, Mus musculus
taagtgcctctatagcaaccactct

SEQ ID NO: 739190 - DNA, 25 bp, Mus musculus
taagtgcctgtccaaagccaagacc

SEQ ID NO: 739191 - DNA, 25 bp, Mus musculus
taagtgcctgtcgaaagccaagacc

SEQ ID NO: 739192 - DNA, 25 bp, Mus musculus
taagtgccttttcctctccatcaag

SEQ ID NO: 739193 - DNA, 25 bp, Mus musculus
taagtgccttttgctctccatcaag

SEQ ID NO: 739194 - DNA, 25 bp, Mus musculus
taagtgcgtgaaccgcaacctgctg

SEQ ID NO: 739195 - DNA, 25 bp, Mus musculus
taagtgcgtgaagcgcaacctgctg

SEQ ID NO: 739196 - DNA, 25 bp, Mus musculus
taagtgctacatctgccagttgttg

SEQ ID NO: 739197 - DNA, 25 bp, Mus musculus
taagtgctacatgtgccagttgttg

SEQ ID NO: 739198 - DNA, 25 bp, Mus musculus
taagtgctatatactccgcgcaacc

SEQ ID NO: 739199 - DNA, 25 bp, Mus musculus
taagtgctatattctccgcgcaacc

SEQ ID NO: 739200 - DNA, 25 bp, Mus musculus
taagtgctatgacgaaatcagccgg

SEQ ID NO: 739201 - DNA, 25 bp, Mus musculus
taagtgctatgaggaaatcagccgg

SEQ ID NO: 739202 - DNA, 25 bp, Mus musculus
taagtgctcccaaaaggccagaaga

SEQ ID NO: 739203 - DNA, 25 bp, Mus musculus
taagtgctcccataaggccagaaga

SEQ ID NO: 739204 - DNA, 25 bp, Mus musculus
taagtgctcccgcaagccagaaact

SEQ ID NO: 739205 - DNA, 25 bp, Mus musculus
taagtgctcccggaagccagaaact

SEQ ID NO: 739206 - DNA, 25 bp, Mus musculus
taagtgctttcacgtttctcaagtt

SEQ ID NO: 739207 - DNA, 25 bp, Mus musculus
taagtgctttcaggtttctcaagtt

SEQ ID NO: 739208 - DNA, 25 bp, Mus musculus
taagtgctttgtccctctccacatg

SEQ ID NO: 739209 - DNA, 25 bp, Mus musculus
taagtgctttgtgcctctccacatg

SEQ ID NO: 739210 - DNA, 25 bp, Mus musculus
taagtggccagaatgctctacagtg

SEQ ID NO: 739211 - DNA, 25 bp, Mus musculus
taagtggccagaccccttagccttc

SEQ ID NO: 739212 - DNA, 25 bp, Mus musculus
taagtggccagagcccttagccttc

SEQ ID NO: 739213 - DNA, 25 bp, Mus musculus
taagtggccagattgctctacagtg

SEQ ID NO: 739214 - DNA, 25 bp, Mus musculus
taagtggcgccaagcccgactccta

SEQ ID NO: 739215 - DNA, 25 bp, Mus musculus
taagtggcgccatgcccgactccta

SEQ ID NO: 739216 - DNA, 25 bp, Mus musculus
taagtgggactcacaaactggattc

SEQ ID NO: 739217 - DNA, 25 bp, Mus musculus
taagtgggactctcaaactggattc

SEQ ID NO: 739218 - DNA, 25 bp, Mus musculus
taagtgggacttcaccgaactagag

SEQ ID NO: 739219 - DNA, 25 bp, Mus musculus
taagtgggacttgaccgaactagag

SEQ ID NO: 739220 - DNA, 25 bp, Mus musculus
taagtgggcagcatatgcctggcca

SEQ ID NO: 739221 - DNA, 25 bp, Mus musculus
taagtgggcagcttatgcctggcca

SEQ ID NO: 739222 - DNA, 25 bp, Mus musculus
taagtggggagaagcctgcgacaac

SEQ ID NO: 739223 - DNA, 25 bp, Mus musculus
taagtggggagatgcctgcgacaac

SEQ ID NO: 739224 - DNA, 25 bp, Mus musculus
taagtggtatcacctgactgcggca

SEQ ID NO: 739225 - DNA, 25 bp, Mus musculus
taagtggtatcagctgactgcggca

SEQ ID NO: 739226 - DNA, 25 bp, Mus musculus
taagtggtccctatagtgcagcaaa

SEQ ID NO: 739227 - DNA, 25 bp, Mus musculus
taagtggtccctttagtgcagcaaa

SEQ ID NO: 739228 - DNA, 25 bp, Mus musculus
taagtggtgctcaggaacatggctt

SEQ ID NO: 739229 - DNA, 25 bp, Mus musculus
taagtggtgctctggaacatggctt

SEQ ID NO: 739230 - DNA, 25 bp, Mus musculus
taagtgtaaccactgcggcaaagcc

SEQ ID NO: 739231 - DNA, 25 bp, Mus musculus
taagtgtaaccagtgcggcaaagcc

SEQ ID NO: 739232 - DNA, 25 bp, Mus musculus
taagtgtaagcaaggttatgtgccc

SEQ ID NO: 739233 - DNA, 25 bp, Mus musculus
taagtgtaagcatggttatgtgccc

SEQ ID NO: 739234 - DNA, 25 bp, Mus musculus
taagtgtcaaggagatgagagactc

SEQ ID NO: 739235 - DNA, 25 bp, Mus musculus
taagtgtcaaggtgatgagagactc

SEQ ID NO: 739236 - DNA, 25 bp, Mus musculus
taagtgtccaataacaaccaaattg

SEQ ID NO: 739237 - DNA, 25 bp, Mus musculus
taagtgtccaattacaaccaaattg

SEQ ID NO: 739238 - DNA, 25 bp, Mus musculus
taagtgtctggaatgatacacacag

SEQ ID NO: 739239 - DNA, 25 bp, Mus musculus
taagtgtctggattgatacacacag

SEQ ID NO: 739240 - DNA, 25 bp, Mus musculus
taagtgtgagctcaactgcattccc

SEQ ID NO: 739241 - DNA, 25 bp, Mus musculus
taagtgtgagctgaactgcattccc

SEQ ID NO: 739242 - DNA, 25 bp, Mus musculus
taagtgtgccgtcgtgtcttctgca

SEQ ID NO: 739243 - DNA, 25 bp, Mus musculus
taagtgtgccgtggtgtcttctgca

SEQ ID NO: 739244 - DNA, 25 bp, Mus musculus
taagtgtgtcctcgcagaggtgcca

SEQ ID NO: 739245 - DNA, 25 bp, Mus musculus
taagtgtgtcctggcagaggtgcca

SEQ ID NO: 739246 - DNA, 25 bp, Mus musculus
taagtgtgttagcagatagtcgtcc

SEQ ID NO: 739247 - DNA, 25 bp, Mus musculus
taagtgtgttaggagatagtcgtcc

SEQ ID NO: 739248 - DNA, 25 bp, Mus musculus
taagtgttaactcagaacctgcaga

SEQ ID NO: 739249 - DNA, 25 bp, Mus musculus
taagtgttaactgagaacctgcaga

SEQ ID NO: 739250 - DNA, 25 bp, Mus musculus
taagtgttcatacattgtcaggaga

SEQ ID NO: 739251 - DNA, 25 bp, Mus musculus
taagtgttcatagattgtcaggaga

SEQ ID NO: 739252 - DNA, 25 bp, Mus musculus
taagtgttccagctccaaagctcgg

SEQ ID NO: 739253 - DNA, 25 bp, Mus musculus
taagtgttccaggtccaaagctcgg

SEQ ID NO: 739254 - DNA, 25 bp, Mus musculus
taagttaaaagtagccttccctcat

SEQ ID NO: 739255 - DNA, 25 bp, Mus musculus
taagttaaaagttgccttccctcat

SEQ ID NO: 739256 - DNA, 25 bp, Mus musculus
taagttagagacacagggccaagga

SEQ ID NO: 739257 - DNA, 25 bp, Mus musculus
taagttagagactcagggccaagga

SEQ ID NO: 739258 - DNA, 25 bp, Mus musculus
taagttagctggactcttaactgct

SEQ ID NO: 739259 - DNA, 25 bp, Mus musculus
taagttagctggtctcttaactgct

SEQ ID NO: 739260 - DNA, 25 bp, Mus musculus
taagttagcttcatactctaagttg

SEQ ID NO: 739261 - DNA, 25 bp, Mus musculus
taagttagcttcttactctaagttg

SEQ ID NO: 739262 - DNA, 25 bp, Mus musculus
taagttatgtccacatgagctgggc

SEQ ID NO: 739263 - DNA, 25 bp, Mus musculus
taagttatgtcctcatgagctgggc

SEQ ID NO: 739264 - DNA, 25 bp, Mus musculus
taagttatttctacatgaatgagag

SEQ ID NO: 739265 - DNA, 25 bp, Mus musculus
taagttatttcttcatgaatgagag

SEQ ID NO: 739266 - DNA, 25 bp, Mus musculus
taagttcaaacgcagccgcgaatcg

SEQ ID NO: 739267 - DNA, 25 bp, Mus musculus
taagttcaaacggagccgcgaatcg

SEQ ID NO: 739268 - DNA, 25 bp, Mus musculus
taagttcaagtccaatcttactggt

SEQ ID NO: 739269 - DNA, 25 bp, Mus musculus
taagttcaagtcgaatcttactggt

SEQ ID NO: 739270 - DNA, 25 bp, Mus musculus
taagttcccaagacatatctgctgc

SEQ ID NO: 739271 - DNA, 25 bp, Mus musculus
taagttcccaagtcatatctgctgc

SEQ ID NO: 739272 - DNA, 25 bp, Mus musculus
taagttcccagtcaagtggtgccca

SEQ ID NO: 739273 - DNA, 25 bp, Mus musculus
taagttcccagtgaagtggtgccca

SEQ ID NO: 739274 - DNA, 25 bp, Mus musculus
taagttccggctctcttactaccca

SEQ ID NO: 739275 - DNA, 25 bp, Mus musculus
taagttccggctgtcttactaccca

SEQ ID NO: 739276 - DNA, 25 bp, Mus musculus
taagttcgaataaccctgggacagg

SEQ ID NO: 739277 - DNA, 25 bp, Mus musculus
taagttcgaatatccctgggacagg

SEQ ID NO: 739278 - DNA, 25 bp, Mus musculus
taagttctacttcgagttccactca

SEQ ID NO: 739279 - DNA, 25 bp, Mus musculus
taagttctacttggagttccactca

SEQ ID NO: 739280 - DNA, 25 bp, Mus musculus
taagttctataacgtgcataaaacc

SEQ ID NO: 739281 - DNA, 25 bp, Mus musculus
taagttctataaggtgcataaaacc

SEQ ID NO: 739282 - DNA, 25 bp, Mus musculus
taagttctcaggagctctctggccc

SEQ ID NO: 739283 - DNA, 25 bp, Mus musculus
taagttctcaggtgctctctggccc

SEQ ID NO: 739284 - DNA, 25 bp, Mus musculus
taagttctccaaccatgaaactgaa

SEQ ID NO: 739285 - DNA, 25 bp, Mus musculus
taagttctccaagcatgaaactgaa

SEQ ID NO: 739286 - DNA, 25 bp, Mus musculus
taagttctgtttacccatggagacc

SEQ ID NO: 739287 - DNA, 25 bp, Mus musculus
taagttctgttttcccatggagacc

SEQ ID NO: 739288 - DNA, 25 bp, Mus musculus
taagttcttagacttcaagatccag

SEQ ID NO: 739289 - DNA, 25 bp, Mus musculus
taagttcttagagttcaagatccag

SEQ ID NO: 739290 - DNA, 25 bp, Mus musculus
taagttcttgtgagaaattagcatc

SEQ ID NO: 739291 - DNA, 25 bp, Mus musculus
taagttcttgtgtgaaattagcatc

SEQ ID NO: 739292 - DNA, 25 bp, Mus musculus
taagttctttatcaatctgcagtgt

SEQ ID NO: 739293 - DNA, 25 bp, Mus musculus
taagttctttatgaatctgcagtgt

SEQ ID NO: 739294 - DNA, 25 bp, Mus musculus
taagttgacatgcatccgctcagag

SEQ ID NO: 739295 - DNA, 25 bp, Mus musculus
taagttgacatggatccgctcagag

SEQ ID NO: 739296 - DNA, 25 bp, Mus musculus
taagttgcagaaacctggccagtgc

SEQ ID NO: 739297 - DNA, 25 bp, Mus musculus
taagttgcagaatcctggccagtgc

SEQ ID NO: 739298 - DNA, 25 bp, Mus musculus
taagttgctaaaattccttggcggg

SEQ ID NO: 739299 - DNA, 25 bp, Mus musculus
taagttgctaaatttccttggcggg

SEQ ID NO: 739300 - DNA, 25 bp, Mus musculus
taagttgctgctctatgtcccagga

SEQ ID NO: 739301 - DNA, 25 bp, Mus musculus
taagttgctgctgtatgtcccagga

SEQ ID NO: 739302 - DNA, 25 bp, Mus musculus
taagttgcttacattctgggcagag

SEQ ID NO: 739303 - DNA, 25 bp, Mus musculus
taagttgcttactttctgggcagag

SEQ ID NO: 739304 - DNA, 25 bp, Mus musculus
taagttggacaacgacaaatgatgc

SEQ ID NO: 739305 - DNA, 25 bp, Mus musculus
taagttggacaaggacaaatgatgc

SEQ ID NO: 739306 - DNA, 25 bp, Mus musculus
taagttggctatcaacctgggctac

SEQ ID NO: 739307 - DNA, 25 bp, Mus musculus
taagttggctatgaacctgggctac

SEQ ID NO: 739308 - DNA, 25 bp, Mus musculus
taagttgggactcttagtgccggca

SEQ ID NO: 739309 - DNA, 25 bp, Mus musculus
taagttgggactgttagtgccggca

SEQ ID NO: 739310 - DNA, 25 bp, Mus musculus
taagttggttccagagtcacattct

SEQ ID NO: 739311 - DNA, 25 bp, Mus musculus
taagttggttcctgagtcacattct

SEQ ID NO: 739312 - DNA, 25 bp, Mus musculus
taagttgtcacaaacaagtaatgtg

SEQ ID NO: 739313 - DNA, 25 bp, Mus musculus
taagttgtcacatacaagtaatgtg

SEQ ID NO: 739314 - DNA, 25 bp, Mus musculus
taagttgtgacaattcctacagagc

SEQ ID NO: 739315 - DNA, 25 bp, Mus musculus
taagttgtgacatttcctacagagc

SEQ ID NO: 739316 - DNA, 25 bp, Mus musculus
taagtttaccaaatctggtctcaaa

SEQ ID NO: 739317 - DNA, 25 bp, Mus musculus
taagtttaccaattctggtctcaaa

SEQ ID NO: 739318 - DNA, 25 bp, Mus musculus
taagtttagaacaagcctgggcagt

SEQ ID NO: 739319 - DNA, 25 bp, Mus musculus
taagtttagaactagcctgggcagt

SEQ ID NO: 739320 - DNA, 25 bp, Mus musculus
taagtttagagacattcctggacgc

SEQ ID NO: 739321 - DNA, 25 bp, Mus musculus
taagtttagagagattcctggacgc

SEQ ID NO: 739322 - DNA, 25 bp, Mus musculus
taagtttccagccagccaaccctgg

SEQ ID NO: 739323 - DNA, 25 bp, Mus musculus
taagtttccagcgagccaaccctgg

SEQ ID NO: 739324 - DNA, 25 bp, Mus musculus
taagtttccgcgattctctcaaccg

SEQ ID NO: 739325 - DNA, 25 bp, Mus musculus
taagtttccgcgtttctctcaaccg

SEQ ID NO: 739326 - DNA, 25 bp, Mus musculus
taagtttgactcattgctgctgaag

SEQ ID NO: 739327 - DNA, 25 bp, Mus musculus
taagtttgactctttgctgctgaag

SEQ ID NO: 739328 - DNA, 25 bp, Mus musculus
taagtttgacttctcagtgatgtct

SEQ ID NO: 739329 - DNA, 25 bp, Mus musculus
taagtttgacttgtcagtgatgtct

SEQ ID NO: 739330 - DNA, 25 bp, Mus musculus
taagtttgcccgaatctgtgaagtg

SEQ ID NO: 739331 - DNA, 25 bp, Mus musculus
taagtttgcccgtatctgtgaagtg

SEQ ID NO: 739332 - DNA, 25 bp, Mus musculus
taataaaaaggaccgcagtgactct

SEQ ID NO: 739333 - DNA, 25 bp, Mus musculus
taataaaaaggagcgcagtgactct

SEQ ID NO: 739334 - DNA, 25 bp, Mus musculus
taataaacataactgtagggacaga

SEQ ID NO: 739335 - DNA, 25 bp, Mus musculus
taataaacataagtgtagggacaga

SEQ ID NO: 739336 - DNA, 25 bp, Mus musculus
taataaacatataaagctgagcttc

SEQ ID NO: 739337 - DNA, 25 bp, Mus musculus
taataaacatattaagctgagcttc

SEQ ID NO: 739338 - DNA, 25 bp, Mus musculus
taataaacctgacattgaagctgct

SEQ ID NO: 739339 - DNA, 25 bp, Mus musculus
taataaacctgagattgaagctgct

SEQ ID NO: 739340 - DNA, 25 bp, Mus musculus
taataaactagacacgcttccagag

SEQ ID NO: 739341 - DNA, 25 bp, Mus musculus
taataaactagagacgcttccagag

SEQ ID NO: 739342 - DNA, 25 bp, Mus musculus
taataaacttcgagtggtgggaggc

SEQ ID NO: 739343 - DNA, 25 bp, Mus musculus
taataaacttcgtgtggtgggaggc

SEQ ID NO: 739344 - DNA, 25 bp, Mus musculus
taataaagagggatccgaacaagct

SEQ ID NO: 739345 - DNA, 25 bp, Mus musculus
taataaagagggttccgaacaagct

SEQ ID NO: 739346 - DNA, 25 bp, Mus musculus
taataaagcaagcaggtccactcgg

SEQ ID NO: 739347 - DNA, 25 bp, Mus musculus
taataaagcaaggaggtccactcgg

SEQ ID NO: 739348 - DNA, 25 bp, Mus musculus
taataaagctttagtgcgttcaccg

SEQ ID NO: 739349 - DNA, 25 bp, Mus musculus
taataaagcttttgtgcgttcaccg

SEQ ID NO: 739350 - DNA, 25 bp, Mus musculus
taataaaggatactaatgtgtcttc

SEQ ID NO: 739351 - DNA, 25 bp, Mus musculus
taataaaggatagtaatgtgtcttc

SEQ ID NO: 739352 - DNA, 25 bp, Mus musculus
taataaaggccacggcaggtcagga

SEQ ID NO: 739353 - DNA, 25 bp, Mus musculus
taataaaggccagggcaggtcagga

SEQ ID NO: 739354 - DNA, 25 bp, Mus musculus
taataaaggcgacttctgcagcggg

SEQ ID NO: 739355 - DNA, 25 bp, Mus musculus
taataaaggcgagttctgcagcggg

SEQ ID NO: 739356 - DNA, 25 bp, Mus musculus
taataaaggtggagcaagcagagag

SEQ ID NO: 739357 - DNA, 25 bp, Mus musculus
taataaaggtggtgcaagcagagag

SEQ ID NO: 739358 - DNA, 25 bp, Mus musculus
taataacagactatgacatgactct

SEQ ID NO: 739359 - DNA, 25 bp, Mus musculus
taataacagactttgacatgactct

SEQ ID NO: 739360 - DNA, 25 bp, Mus musculus
taataaccaaaactgtgaggagctc

SEQ ID NO: 739361 - DNA, 25 bp, Mus musculus
taataaccaaaagtgtgaggagctc

SEQ ID NO: 739362 - DNA, 25 bp, Mus musculus
taataaccacacagcaaacgcctag

SEQ ID NO: 739363 - DNA, 25 bp, Mus musculus
taataaccacactgcaaacgcctag

SEQ ID NO: 739364 - DNA, 25 bp, Mus musculus
taataacccacgaccagggcaactg

SEQ ID NO: 739365 - DNA, 25 bp, Mus musculus
taataacccacgtccagggcaactg

SEQ ID NO: 739366 - DNA, 25 bp, Mus musculus
taataaccttcacggccacgcactt

SEQ ID NO: 739367 - DNA, 25 bp, Mus musculus
taataaccttcagggccacgcactt

SEQ ID NO: 739368 - DNA, 25 bp, Mus musculus
taataagaaattcgtgactcggcct

SEQ ID NO: 739369 - DNA, 25 bp, Mus musculus
taataagaaattggtgactcggcct

SEQ ID NO: 739370 - DNA, 25 bp, Mus musculus
taataagaagtgaagtcggatccag

SEQ ID NO: 739371 - DNA, 25 bp, Mus musculus
taataagaagtgtagtcggatccag

SEQ ID NO: 739372 - DNA, 25 bp, Mus musculus
taataagacttgcttcaggtggttg

SEQ ID NO: 739373 - DNA, 25 bp, Mus musculus
taataagacttggttcaggtggttg

SEQ ID NO: 739374 - DNA, 25 bp, Mus musculus
taataagctaagaatgggcttccca

SEQ ID NO: 739375 - DNA, 25 bp, Mus musculus
taataagctaagtatgggcttccca

SEQ ID NO: 739376 - DNA, 25 bp, Mus musculus
taataaggaactagatcctgtacag

SEQ ID NO: 739377 - DNA, 25 bp, Mus musculus
taataaggaacttgatcctgtacag

SEQ ID NO: 739378 - DNA, 25 bp, Mus musculus
taataagtgtaaacaactcttgcag

SEQ ID NO: 739379 - DNA, 25 bp, Mus musculus
taataagtgtaatcaactcttgcag

SEQ ID NO: 739380 - DNA, 25 bp, Mus musculus
taataatcaacccagcctttcaaaa

SEQ ID NO: 739381 - DNA, 25 bp, Mus musculus
taataatcaaccgagcctttcaaaa

SEQ ID NO: 739382 - DNA, 25 bp, Mus musculus
taataatcagagagcaccacttgcc

SEQ ID NO: 739383 - DNA, 25 bp, Mus musculus
taataatcagagtgcaccacttgcc

SEQ ID NO: 739384 - DNA, 25 bp, Mus musculus
taataattcccacaggcctctcttt

SEQ ID NO: 739385 - DNA, 25 bp, Mus musculus
taataattcccagaggcctctcttt

SEQ ID NO: 739386 - DNA, 25 bp, Mus musculus
taatacagcctgatctcgccgtaaa

SEQ ID NO: 739387 - DNA, 25 bp, Mus musculus
taatacagcctgttctcgccgtaaa

SEQ ID NO: 739388 - DNA, 25 bp, Mus musculus
taataccaccgacaaggaaatggag

SEQ ID NO: 739389 - DNA, 25 bp, Mus musculus
taataccaccgagaaggaaatggag

SEQ ID NO: 739390 - DNA, 25 bp, Mus musculus
taataccacggaaagacagccagct

SEQ ID NO: 739391 - DNA, 25 bp, Mus musculus
taataccacggatagacagccagct

SEQ ID NO: 739392 - DNA, 25 bp, Mus musculus
taataccagagaagaattcacttag

SEQ ID NO: 739393 - DNA, 25 bp, Mus musculus
taataccagagatgaattcacttag

SEQ ID NO: 739394 - DNA, 25 bp, Mus musculus
taataccaggtcagtggctgctact

SEQ ID NO: 739395 - DNA, 25 bp, Mus musculus
taataccaggtctgtggctgctact

SEQ ID NO: 739396 - DNA, 25 bp, Mus musculus
taataccgctccaggttggcggaga

SEQ ID NO: 739397 - DNA, 25 bp, Mus musculus
taataccgctcctggttggcggaga

SEQ ID NO: 739398 - DNA, 25 bp, Mus musculus
taataccgtgatctaatagtgtgag

SEQ ID NO: 739399 - DNA, 25 bp, Mus musculus
taataccgtgatgtaatagtgtgag

SEQ ID NO: 739400 - DNA, 25 bp, Mus musculus
taatacctccaaaaggctgtttgct

SEQ ID NO: 739401 - DNA, 25 bp, Mus musculus
taatacctccaataggctgtttgct

SEQ ID NO: 739402 - DNA, 25 bp, Mus musculus
taatacctcctccaaaccaagctgg

SEQ ID NO: 739403 - DNA, 25 bp, Mus musculus
taatacctcctcgaaaccaagctgg

SEQ ID NO: 739404 - DNA, 25 bp, Mus musculus
taatacgaagacaaccacctggttg

SEQ ID NO: 739405 - DNA, 25 bp, Mus musculus
taatacgaagactaccacctggttg

SEQ ID NO: 739406 - DNA, 25 bp, Mus musculus
taatacgcagttcaaggtgccagtc

SEQ ID NO: 739407 - DNA, 25 bp, Mus musculus
taatacgcagttgaaggtgccagtc

SEQ ID NO: 739408 - DNA, 25 bp, Mus musculus
taatacggacccaggtgacaggagg

SEQ ID NO: 739409 - DNA, 25 bp, Mus musculus
taatacggaccctggtgacaggagg

SEQ ID NO: 739410 - DNA, 25 bp, Mus musculus
taatactaggttcatgccagacatg

SEQ ID NO: 739411 - DNA, 25 bp, Mus musculus
taatactaggttgatgccagacatg

SEQ ID NO: 739412 - DNA, 25 bp, Mus musculus
taatactgagatcggcaagatccgg

SEQ ID NO: 739413 - DNA, 25 bp, Mus musculus
taatactgagatgggcaagatccgg

SEQ ID NO: 739414 - DNA, 25 bp, Mus musculus
taatactggtaaacagtggacaccc

SEQ ID NO: 739415 - DNA, 25 bp, Mus musculus
taatactggtaatcagtggacaccc

SEQ ID NO: 739416 - DNA, 25 bp, Mus musculus
taatactgtgtactcatgtgtgcgc

SEQ ID NO: 739417 - DNA, 25 bp, Mus musculus
taatactgtgtagtcatgtgtgcgc

SEQ ID NO: 739418 - DNA, 25 bp, Mus musculus
taatactgttgtaattcgaccccag

SEQ ID NO: 739419 - DNA, 25 bp, Mus musculus
taatactgttgttattcgaccccag

SEQ ID NO: 739420 - DNA, 25 bp, Mus musculus
taatacttgcgactcttcttaggcc

SEQ ID NO: 739421 - DNA, 25 bp, Mus musculus
taatacttgcgagtcttcttaggcc

SEQ ID NO: 739422 - DNA, 25 bp, Mus musculus
taatacttgtttcgtcatggtgaaa

SEQ ID NO: 739423 - DNA, 25 bp, Mus musculus
taatacttgtttggtcatggtgaaa

SEQ ID NO: 739424 - DNA, 25 bp, Mus musculus
taatactttctaattgccagaggga

SEQ ID NO: 739425 - DNA, 25 bp, Mus musculus
taatactttctatttgccagaggga

SEQ ID NO: 739426 - DNA, 25 bp, Mus musculus
taatagaaaaatctgtctccaaagg

SEQ ID NO: 739427 - DNA, 25 bp, Mus musculus
taatagaaaaatgtgtctccaaagg

SEQ ID NO: 739428 - DNA, 25 bp, Mus musculus
taatagaaatgtcggtagatgaact

SEQ ID NO: 739429 - DNA, 25 bp, Mus musculus
taatagaaatgtgggtagatgaact

SEQ ID NO: 739430 - DNA, 25 bp, Mus musculus
taatagaaccatcgctcagtttccc

SEQ ID NO: 739431 - DNA, 25 bp, Mus musculus
taatagaaccatggctcagtttccc

SEQ ID NO: 739432 - DNA, 25 bp, Mus musculus
taatagaagacaacgtgcgtgatgg

SEQ ID NO: 739433 - DNA, 25 bp, Mus musculus
taatagaagacatcgtgcgtgatgg

SEQ ID NO: 739434 - DNA, 25 bp, Mus musculus
taatagaccataaccgcccagggcc

SEQ ID NO: 739435 - DNA, 25 bp, Mus musculus
taatagaccatatccgcccagggcc

SEQ ID NO: 739436 - DNA, 25 bp, Mus musculus
taatagacctaaagtattgaggcaa

SEQ ID NO: 739437 - DNA, 25 bp, Mus musculus
taatagacctaatgtattgaggcaa

SEQ ID NO: 739438 - DNA, 25 bp, Mus musculus
taatagacttctctcaagtgacctc

SEQ ID NO: 739439 - DNA, 25 bp, Mus musculus
taatagacttctgtcaagtgacctc

SEQ ID NO: 739440 - DNA, 25 bp, Mus musculus
taatagagacctcatcctggatgct

SEQ ID NO: 739441 - DNA, 25 bp, Mus musculus
taatagagacctgatcctggatgct

SEQ ID NO: 739442 - DNA, 25 bp, Mus musculus
taatagcaaacactctatttcggcg

SEQ ID NO: 739443 - DNA, 25 bp, Mus musculus
taatagcaaacagtctatttcggcg

SEQ ID NO: 739444 - DNA, 25 bp, Mus musculus
taatagcagggaatccttacccttg

SEQ ID NO: 739445 - DNA, 25 bp, Mus musculus
taatagcagggattccttacccttg

SEQ ID NO: 739446 - DNA, 25 bp, Mus musculus
taatagcatcggctccaccagtgcc

SEQ ID NO: 739447 - DNA, 25 bp, Mus musculus
taatagcatcgggtccaccagtgcc

SEQ ID NO: 739448 - DNA, 25 bp, Mus musculus
taatagccatcacgttttatgcgat

SEQ ID NO: 739449 - DNA, 25 bp, Mus musculus
taatagccatcaggttttatgcgat

SEQ ID NO: 739450 - DNA, 25 bp, Mus musculus
taatagctactcattcccagtgtaa

SEQ ID NO: 739451 - DNA, 25 bp, Mus musculus
taatagctactctttcccagtgtaa

SEQ ID NO: 739452 - DNA, 25 bp, Mus musculus
taatagctcccgagagatctgggtc

SEQ ID NO: 739453 - DNA, 25 bp, Mus musculus
taatagctcccgtgagatctgggtc

SEQ ID NO: 739454 - DNA, 25 bp, Mus musculus
taatagctgaggagaatgcacttcg

SEQ ID NO: 739455 - DNA, 25 bp, Mus musculus
taatagctgaggtgaatgcacttcg

SEQ ID NO: 739456 - DNA, 25 bp, Mus musculus
taatagctggctattatgtccacta

SEQ ID NO: 739457 - DNA, 25 bp, Mus musculus
taatagctggcttttatgtccacta

SEQ ID NO: 739458 - DNA, 25 bp, Mus musculus
taatagggtgtaatactgtatccca

SEQ ID NO: 739459 - DNA, 25 bp, Mus musculus
taatagggtgtattactgtatccca

SEQ ID NO: 739460 - DNA, 25 bp, Mus musculus
taataggtgcccaccttgccatctg

SEQ ID NO: 739461 - DNA, 25 bp, Mus musculus
taataggtgccctccttgccatctg

SEQ ID NO: 739462 - DNA, 25 bp, Mus musculus
taatagtagatcaagtccaaaagct

SEQ ID NO: 739463 - DNA, 25 bp, Mus musculus
taatagtagatctagtccaaaagct

SEQ ID NO: 739464 - DNA, 25 bp, Mus musculus
taatagtatctccagaatcctggcc

SEQ ID NO: 739465 - DNA, 25 bp, Mus musculus
taatagtatctcgagaatcctggcc

SEQ ID NO: 739466 - DNA, 25 bp, Mus musculus
taatagttttggatccattcaagag

SEQ ID NO: 739467 - DNA, 25 bp, Mus musculus
taatagttttggttccattcaagag

SEQ ID NO: 739468 - DNA, 25 bp, Mus musculus
taatagtttttgctcagggctatac

SEQ ID NO: 739469 - DNA, 25 bp, Mus musculus
taatagtttttggtcagggctatac

SEQ ID NO: 739470 - DNA, 25 bp, Mus musculus
taatatacttcaaagactcgtcaaa

SEQ ID NO: 739471 - DNA, 25 bp, Mus musculus
taatatacttcatagactcgtcaaa

SEQ ID NO: 739472 - DNA, 25 bp, Mus musculus
taatataggccccagtcactgggcc

SEQ ID NO: 739473 - DNA, 25 bp, Mus musculus
taatataggcccgagtcactgggcc

SEQ ID NO: 739474 - DNA, 25 bp, Mus musculus
taatatagtaccactaagacctggc

SEQ ID NO: 739475 - DNA, 25 bp, Mus musculus
taatatagtacctctaagacctggc

SEQ ID NO: 739476 - DNA, 25 bp, Mus musculus
taatatagtagtcaaatcagactgc

SEQ ID NO: 739477 - DNA, 25 bp, Mus musculus
taatatagtagtgaaatcagactgc

SEQ ID NO: 739478 - DNA, 25 bp, Mus musculus
taatatagtcaacctagcagagcag

SEQ ID NO: 739479 - DNA, 25 bp, Mus musculus
taatatagtcaagctagcagagcag

SEQ ID NO: 739480 - DNA, 25 bp, Mus musculus
taatatcaaacacgtcccgggtgga

SEQ ID NO: 739481 - DNA, 25 bp, Mus musculus
taatatcaaacaggtcccgggtgga

SEQ ID NO: 739482 - DNA, 25 bp, Mus musculus
taatatcacccacgtccctggagga

SEQ ID NO: 739483 - DNA, 25 bp, Mus musculus
taatatcacccaggtccctggagga

SEQ ID NO: 739484 - DNA, 25 bp, Mus musculus
taatatcaggatcttcacaactgca

SEQ ID NO: 739485 - DNA, 25 bp, Mus musculus
taatatcaggatgttcacaactgca

SEQ ID NO: 739486 - DNA, 25 bp, Mus musculus
taatatcctatacagtgcatgttcc

SEQ ID NO: 739487 - DNA, 25 bp, Mus musculus
taatatcctatagagtgcatgttcc

SEQ ID NO: 739488 - DNA, 25 bp, Mus musculus
taatatgagagtatggaattcgttg

SEQ ID NO: 739489 - DNA, 25 bp, Mus musculus
taatatgagagtttggaattcgttg

SEQ ID NO: 739490 - DNA, 25 bp, Mus musculus
taatatgatgtcagctaaggggtgg

SEQ ID NO: 739491 - DNA, 25 bp, Mus musculus
taatatgatgtctgctaaggggtgg

SEQ ID NO: 739492 - DNA, 25 bp, Mus musculus
taatatggtcctcgtgacaaacatc

SEQ ID NO: 739493 - DNA, 25 bp, Mus musculus
taatatggtcctggtgacaaacatc

SEQ ID NO: 739494 - DNA, 25 bp, Mus musculus
taatatgtacttagctgacagccag

SEQ ID NO: 739495 - DNA, 25 bp, Mus musculus
taatatgtactttgctgacagccag

SEQ ID NO: 739496 - DNA, 25 bp, Mus musculus
taatatgtgaacaaactctgagaag

SEQ ID NO: 739497 - DNA, 25 bp, Mus musculus
taatatgtgaactaactctgagaag

SEQ ID NO: 739498 - DNA, 25 bp, Mus musculus
taatattaaaccaggaagtctggca

SEQ ID NO: 739499 - DNA, 25 bp, Mus musculus
taatattaaacctggaagtctggca

SEQ ID NO: 739500 - DNA, 25 bp, Mus musculus
taatattagtccatgggcggcagac

SEQ ID NO: 739501 - DNA, 25 bp, Mus musculus
taatattagtccttgggcggcagac

SEQ ID NO: 739502 - DNA, 25 bp, Mus musculus
taatattattgcacctgctcccaga

SEQ ID NO: 739503 - DNA, 25 bp, Mus musculus
taatattattgctcctgctcccaga

SEQ ID NO: 739504 - DNA, 25 bp, Mus musculus
taatattcagaacgccttgaccaag

SEQ ID NO: 739505 - DNA, 25 bp, Mus musculus
taatattcagaaggccttgaccaag

SEQ ID NO: 739506 - DNA, 25 bp, Mus musculus
taatattgcacccaggctctccctg

SEQ ID NO: 739507 - DNA, 25 bp, Mus musculus
taatattgcaccgaggctctccctg

SEQ ID NO: 739508 - DNA, 25 bp, Mus musculus
taatatttcttgcaaggtaggcaag

SEQ ID NO: 739509 - DNA, 25 bp, Mus musculus
taatatttcttggaaggtaggcaag

SEQ ID NO: 739510 - DNA, 25 bp, Mus musculus
taatattttggaccccagaatcaaa

SEQ ID NO: 739511 - DNA, 25 bp, Mus musculus
taatattttggagcccagaatcaaa

SEQ ID NO: 739512 - DNA, 25 bp, Mus musculus
taatcaaacattatcaagaagaagg

SEQ ID NO: 739513 - DNA, 25 bp, Mus musculus
taatcaaacattttcaagaagaagg

SEQ ID NO: 739514 - DNA, 25 bp, Mus musculus
taatcaacgactcaccagtgctcag

SEQ ID NO: 739515 - DNA, 25 bp, Mus musculus
taatcaacgactgaccagtgctcag

SEQ ID NO: 739516 - DNA, 25 bp, Mus musculus
taatcaagaaacaccaatggagatc

SEQ ID NO: 739517 - DNA, 25 bp, Mus musculus
taatcaagaaactccaatggagatc

SEQ ID NO: 739518 - DNA, 25 bp, Mus musculus
taatcaagagtgaaaaacctgaaga

SEQ ID NO: 739519 - DNA, 25 bp, Mus musculus
taatcaagagtgtaaaacctgaaga

SEQ ID NO: 739520 - DNA, 25 bp, Mus musculus
taatcaagggctaaaggtgtcctca

SEQ ID NO: 739521 - DNA, 25 bp, Mus musculus
taatcaagggcttaaggtgtcctca

SEQ ID NO: 739522 - DNA, 25 bp, Mus musculus
taatcaatctaacgcagattcagga

SEQ ID NO: 739523 - DNA, 25 bp, Mus musculus
taatcaatctaaggcagattcagga

SEQ ID NO: 739524 - DNA, 25 bp, Mus musculus
taatcaatggatatctgaacttcaa

SEQ ID NO: 739525 - DNA, 25 bp, Mus musculus
taatcaatggatttctgaacttcaa

SEQ ID NO: 739526 - DNA, 25 bp, Mus musculus
taatcacataggctatgggcacaaa

SEQ ID NO: 739527 - DNA, 25 bp, Mus musculus
taatcacatagggtatgggcacaaa

SEQ ID NO: 739528 - DNA, 25 bp, Mus musculus
taatcaccagaaagagcatcactgg

SEQ ID NO: 739529 - DNA, 25 bp, Mus musculus
taatcaccagaatgagcatcactgg

SEQ ID NO: 739530 - DNA, 25 bp, Mus musculus
taatcacgctagagagcccgaataa

SEQ ID NO: 739531 - DNA, 25 bp, Mus musculus
taatcacgctagtgagcccgaataa

SEQ ID NO: 739532 - DNA, 25 bp, Mus musculus
taatcactcaggagtggaagccttt

SEQ ID NO: 739533 - DNA, 25 bp, Mus musculus
taatcactcaggtgtggaagccttt

SEQ ID NO: 739534 - DNA, 25 bp, Mus musculus
taatcactgcttactggctagtcag

SEQ ID NO: 739535 - DNA, 25 bp, Mus musculus
taatcactgctttctggctagtcag

SEQ ID NO: 739536 - DNA, 25 bp, Mus musculus
taatcactgtgcatatcaaccctgc

SEQ ID NO: 739537 - DNA, 25 bp, Mus musculus
taatcactgtgcttatcaaccctgc

SEQ ID NO: 739538 - DNA, 25 bp, Mus musculus
taatcacttgttaggatactgtatc

SEQ ID NO: 739539 - DNA, 25 bp, Mus musculus
taatcacttgtttggatactgtatc

SEQ ID NO: 739540 - DNA, 25 bp, Mus musculus
taatcagcctttatatgccctaccc

SEQ ID NO: 739541 - DNA, 25 bp, Mus musculus
taatcagcctttttatgccctaccc

SEQ ID NO: 739542 - DNA, 25 bp, Mus musculus
taatcagctacaacaattggaacag

SEQ ID NO: 739543 - DNA, 25 bp, Mus musculus
taatcagctacatcaattggaacag

SEQ ID NO: 739544 - DNA, 25 bp, Mus musculus
taatcagctagacgcgatcaatgct

SEQ ID NO: 739545 - DNA, 25 bp, Mus musculus
taatcagctagaggcgatcaatgct

SEQ ID NO: 739546 - DNA, 25 bp, Mus musculus
taatcagctcacaaagatcccagag

SEQ ID NO: 739547 - DNA, 25 bp, Mus musculus
taatcagctcactaagatcccagag

SEQ ID NO: 739548 - DNA, 25 bp, Mus musculus
taatcagctctgcaaagggtaactc

SEQ ID NO: 739549 - DNA, 25 bp, Mus musculus
taatcagctctggaaagggtaactc

SEQ ID NO: 739550 - DNA, 25 bp, Mus musculus
taatcaggataaagggttccagtca

SEQ ID NO: 739551 - DNA, 25 bp, Mus musculus
taatcaggataatgggttccagtca

SEQ ID NO: 739552 - DNA, 25 bp, Mus musculus
taatcaggcattaatctcagatagc

SEQ ID NO: 739553 - DNA, 25 bp, Mus musculus
taatcaggcatttatctcagatagc

SEQ ID NO: 739554 - DNA, 25 bp, Mus musculus
taatcaggccggacctgaagggagc

SEQ ID NO: 739555 - DNA, 25 bp, Mus musculus
taatcaggccggtcctgaagggagc

SEQ ID NO: 739556 - DNA, 25 bp, Mus musculus
taatcagggctaatcacagagccgg

SEQ ID NO: 739557 - DNA, 25 bp, Mus musculus
taatcagggctattcacagagccgg

SEQ ID NO: 739558 - DNA, 25 bp, Mus musculus
taatcaggtgtaagtggctacagcc

SEQ ID NO: 739559 - DNA, 25 bp, Mus musculus
taatcaggtgtatgtggctacagcc

SEQ ID NO: 739560 - DNA, 25 bp, Mus musculus
taatcagtggccacctcttgggcgc

SEQ ID NO: 739561 - DNA, 25 bp, Mus musculus
taatcagtggcctcctcttgggcgc

SEQ ID NO: 739562 - DNA, 25 bp, Mus musculus
taatcagtgtacatgggaggccaca

SEQ ID NO: 739563 - DNA, 25 bp, Mus musculus
taatcagtgtacttgggaggccaca

SEQ ID NO: 739564 - DNA, 25 bp, Mus musculus
taatcatacgaacgagagggtgaca

SEQ ID NO: 739565 - DNA, 25 bp, Mus musculus
taatcatacgaaggagagggtgaca

SEQ ID NO: 739566 - DNA, 25 bp, Mus musculus
taatcatcatctcggtgggtttgct

SEQ ID NO: 739567 - DNA, 25 bp, Mus musculus
taatcatcatctgggtgggtttgct

SEQ ID NO: 739568 - DNA, 25 bp, Mus musculus
taatcatcatggcagtacacaagca

SEQ ID NO: 739569 - DNA, 25 bp, Mus musculus
taatcatcatgggagtacacaagca

SEQ ID NO: 739570 - DNA, 25 bp, Mus musculus
taatcatcgttactctggaaaccag

SEQ ID NO: 739571 - DNA, 25 bp, Mus musculus
taatcatcgttagtctggaaaccag

SEQ ID NO: 739572 - DNA, 25 bp, Mus musculus
taatcatgaagaacccggaagtgga

SEQ ID NO: 739573 - DNA, 25 bp, Mus musculus
taatcatgaagatcccggaagtgga

SEQ ID NO: 739574 - DNA, 25 bp, Mus musculus
taatcatgcacaaacatctatgtgg

SEQ ID NO: 739575 - DNA, 25 bp, Mus musculus
taatcatgcacatacatctatgtgg

SEQ ID NO: 739576 - DNA, 25 bp, Mus musculus
taatcatgcgctcgggatatcctgg

SEQ ID NO: 739577 - DNA, 25 bp, Mus musculus
taatcatgcgctggggatatcctgg

SEQ ID NO: 739578 - DNA, 25 bp, Mus musculus
taatcattgatgcacagcagctaag

SEQ ID NO: 739579 - DNA, 25 bp, Mus musculus
taatcattgatggacagcagctaag

SEQ ID NO: 739580 - DNA, 25 bp, Mus musculus
taatcattgcctaggaagtcacgaa

SEQ ID NO: 739581 - DNA, 25 bp, Mus musculus
taatcattgccttggaagtcacgaa

SEQ ID NO: 739582 - DNA, 25 bp, Mus musculus
taatcattgtgtcgtggctccgacc

SEQ ID NO: 739583 - DNA, 25 bp, Mus musculus
taatcattgtgtggtggctccgacc

SEQ ID NO: 739584 - DNA, 25 bp, Mus musculus
taatcatttgtaacagctggaccag

SEQ ID NO: 739585 - DNA, 25 bp, Mus musculus
taatcatttgtatcagctggaccag

SEQ ID NO: 739586 - DNA, 25 bp, Mus musculus
taatcatttgtgctacagcatagct

SEQ ID NO: 739587 - DNA, 25 bp, Mus musculus
taatcatttgtggtacagcatagct

SEQ ID NO: 739588 - DNA, 25 bp, Mus musculus
taatccaaagatctagccagccctg

SEQ ID NO: 739589 - DNA, 25 bp, Mus musculus
taatccaaagatgtagccagccctg

SEQ ID NO: 739590 - DNA, 25 bp, Mus musculus
taatccaacatgaactggagcatgg

SEQ ID NO: 739591 - DNA, 25 bp, Mus musculus
taatccaacatgtactggagcatgg

SEQ ID NO: 739592 - DNA, 25 bp, Mus musculus
taatccaagagtcggttgaactccc

SEQ ID NO: 739593 - DNA, 25 bp, Mus musculus
taatccaagagtgggttgaactccc

SEQ ID NO: 739594 - DNA, 25 bp, Mus musculus
taatccacaacccagaacctgagga

SEQ ID NO: 739595 - DNA, 25 bp, Mus musculus
taatccacaaccgagaacctgagga

SEQ ID NO: 739596 - DNA, 25 bp, Mus musculus
taatccacccatctttgaaacagtt

SEQ ID NO: 739597 - DNA, 25 bp, Mus musculus
taatccacccatgtttgaaacagtt

SEQ ID NO: 739598 - DNA, 25 bp, Mus musculus
taatccaccccgagctcaacgaagg

SEQ ID NO: 739599 - DNA, 25 bp, Mus musculus
taatccaccccgtgctcaacgaagg

SEQ ID NO: 739600 - DNA, 25 bp, Mus musculus
taatccacgtggctttgtcccagac

SEQ ID NO: 739601 - DNA, 25 bp, Mus musculus
taatccacgtgggtttgtcccagac

SEQ ID NO: 739602 - DNA, 25 bp, Mus musculus
taatccagaagaagttgccagactg

SEQ ID NO: 739603 - DNA, 25 bp, Mus musculus
taatccagaagatgttgccagactg

SEQ ID NO: 739604 - DNA, 25 bp, Mus musculus
taatccagatacaggactccagtct

SEQ ID NO: 739605 - DNA, 25 bp, Mus musculus
taatccagatactggactccagtct

SEQ ID NO: 739606 - DNA, 25 bp, Mus musculus
taatccagcaggctcgagagatgcc

SEQ ID NO: 739607 - DNA, 25 bp, Mus musculus
taatccagcagggtcgagagatgcc

SEQ ID NO: 739608 - DNA, 25 bp, Mus musculus
taatccaggcagaccaccgtggatc

SEQ ID NO: 739609 - DNA, 25 bp, Mus musculus
taatccaggcagtccaccgtggatc

SEQ ID NO: 739610 - DNA, 25 bp, Mus musculus
taatccaggcttcaggatcattagc

SEQ ID NO: 739611 - DNA, 25 bp, Mus musculus
taatccaggcttgaggatcattagc

SEQ ID NO: 739612 - DNA, 25 bp, Mus musculus
taatccagtccacatctgaagagaa

SEQ ID NO: 739613 - DNA, 25 bp, Mus musculus
taatccagtccagatctgaagagaa

SEQ ID NO: 739614 - DNA, 25 bp, Mus musculus
taatccagtcggattaccacaggcg

SEQ ID NO: 739615 - DNA, 25 bp, Mus musculus
taatccagtcggtttaccacaggcg

SEQ ID NO: 739616 - DNA, 25 bp, Mus musculus
taatccagtgccagtttgggccact

SEQ ID NO: 739617 - DNA, 25 bp, Mus musculus
taatccagtgcctgtttgggccact

SEQ ID NO: 739618 - DNA, 25 bp, Mus musculus
taatccatttgcagagtacatgtgg

SEQ ID NO: 739619 - DNA, 25 bp, Mus musculus
taatccatttgctgagtacatgtgg

SEQ ID NO: 739620 - DNA, 25 bp, Mus musculus
taatcccctaagagagttccttatt

SEQ ID NO: 739621 - DNA, 25 bp, Mus musculus
taatcccctaagtgagttccttatt

SEQ ID NO: 739622 - DNA, 25 bp, Mus musculus
taatcccctattagctggaaatcct

SEQ ID NO: 739623 - DNA, 25 bp, Mus musculus
taatcccctatttgctggaaatcct

SEQ ID NO: 739624 - DNA, 25 bp, Mus musculus
taatcccgggcaccacgaaggtgca

SEQ ID NO: 739625 - DNA, 25 bp, Mus musculus
taatcccgggcagcacgaaggtgca

SEQ ID NO: 739626 - DNA, 25 bp, Mus musculus
taatcccggtacataggaggctgaa

SEQ ID NO: 739627 - DNA, 25 bp, Mus musculus
taatcccggtacttaggaggctgaa

SEQ ID NO: 739628 - DNA, 25 bp, Mus musculus
taatccgaggacacaataccattcc

SEQ ID NO: 739629 - DNA, 25 bp, Mus musculus
taatccgaggactcaataccattcc

SEQ ID NO: 739630 - DNA, 25 bp, Mus musculus
taatccgcactgaaacacccctttg

SEQ ID NO: 739631 - DNA, 25 bp, Mus musculus
taatccgcactgtaacacccctttg

SEQ ID NO: 739632 - DNA, 25 bp, Mus musculus
taatccggaagacgatccacctgag

SEQ ID NO: 739633 - DNA, 25 bp, Mus musculus
taatccggaagacttttgtgcagag

SEQ ID NO: 739634 - DNA, 25 bp, Mus musculus
taatccggaagaggatccacctgag

SEQ ID NO: 739635 - DNA, 25 bp, Mus musculus
taatccggaagagttttgtgcagag

SEQ ID NO: 739636 - DNA, 25 bp, Mus musculus
taatccggacggatctgagcggccc

SEQ ID NO: 739637 - DNA, 25 bp, Mus musculus
taatccggacggttctgagcggccc

SEQ ID NO: 739638 - DNA, 25 bp, Mus musculus
taatccggactgcaaaacccataga

SEQ ID NO: 739639 - DNA, 25 bp, Mus musculus
taatccggactggaaaacccataga

SEQ ID NO: 739640 - DNA, 25 bp, Mus musculus
taatccgttgttaacacattcctgt

SEQ ID NO: 739641 - DNA, 25 bp, Mus musculus
taatccgttgtttacacattcctgt

SEQ ID NO: 739642 - DNA, 25 bp, Mus musculus
taatcctaacgcagggaagacatat

SEQ ID NO: 739643 - DNA, 25 bp, Mus musculus
taatcctaacgctgggaagacatat

SEQ ID NO: 739644 - DNA, 25 bp, Mus musculus
taatcctacgcacctgggcttgctc

SEQ ID NO: 739645 - DNA, 25 bp, Mus musculus
taatcctacgcagctgggcttgctc

SEQ ID NO: 739646 - DNA, 25 bp, Mus musculus
taatcctagtaacagaggcacttta

SEQ ID NO: 739647 - DNA, 25 bp, Mus musculus
taatcctagtaagagaggcacttta

SEQ ID NO: 739648 - DNA, 25 bp, Mus musculus
taatcctagtatccctagttggtgg

SEQ ID NO: 739649 - DNA, 25 bp, Mus musculus
taatcctagtatgcctagttggtgg

SEQ ID NO: 739650 - DNA, 25 bp, Mus musculus
taatcctatggaaggcatgacagag

SEQ ID NO: 739651 - DNA, 25 bp, Mus musculus
taatcctatggatggcatgacagag

SEQ ID NO: 739652 - DNA, 25 bp, Mus musculus
taatcctcagcaattaaagagtcaa

SEQ ID NO: 739653 - DNA, 25 bp, Mus musculus
taatcctcagcatttaaagagtcaa

SEQ ID NO: 739654 - DNA, 25 bp, Mus musculus
taatcctcgggtcaaatgacctgaa

SEQ ID NO: 739655 - DNA, 25 bp, Mus musculus
taatcctcgggtgaaatgacctgaa

SEQ ID NO: 739656 - DNA, 25 bp, Mus musculus
taatcctctgggactaaccactggt

SEQ ID NO: 739657 - DNA, 25 bp, Mus musculus
taatcctctgggtctaaccactggt

SEQ ID NO: 739658 - DNA, 25 bp, Mus musculus
taatcctgcccactcatgccgaaga

SEQ ID NO: 739659 - DNA, 25 bp, Mus musculus
taatcctgcccagtcatgccgaaga

SEQ ID NO: 739660 - DNA, 25 bp, Mus musculus
taatcctgtagaagcaatataccag

SEQ ID NO: 739661 - DNA, 25 bp, Mus musculus
taatcctgtagatgcaatataccag

SEQ ID NO: 739662 - DNA, 25 bp, Mus musculus
taatccttcaaaagaatactgcctc

SEQ ID NO: 739663 - DNA, 25 bp, Mus musculus
taatccttcaaatgaatactgcctc

SEQ ID NO: 739664 - DNA, 25 bp, Mus musculus
taatcctttctcctggaagaacttt

SEQ ID NO: 739665 - DNA, 25 bp, Mus musculus
taatcctttctcgtggaagaacttt

SEQ ID NO: 739666 - DNA, 25 bp, Mus musculus
taatcgaagggccaaatggagaaga

SEQ ID NO: 739667 - DNA, 25 bp, Mus musculus
taatcgaagggcgaaatggagaaga

SEQ ID NO: 739668 - DNA, 25 bp, Mus musculus
taatcgataatcctactgagaaagt

SEQ ID NO: 739669 - DNA, 25 bp, Mus musculus
taatcgataatcgtactgagaaagt

SEQ ID NO: 739670 - DNA, 25 bp, Mus musculus
taatcgcaattgcaaaaggcagctc

SEQ ID NO: 739671 - DNA, 25 bp, Mus musculus
taatcgcaattggaaaaggcagctc

SEQ ID NO: 739672 - DNA, 25 bp, Mus musculus
taatcgcacccgcaaatatggagcg

SEQ ID NO: 739673 - DNA, 25 bp, Mus musculus
taatcgcacccggaaatatggagcg

SEQ ID NO: 739674 - DNA, 25 bp, Mus musculus
taatcgccactgagacctcaggcgc

SEQ ID NO: 739675 - DNA, 25 bp, Mus musculus
taatcgccactgtgacctcaggcgc

SEQ ID NO: 739676 - DNA, 25 bp, Mus musculus
taatcgccatgcagtgatcatggag

SEQ ID NO: 739677 - DNA, 25 bp, Mus musculus
taatcgccatgctgtgatcatggag

SEQ ID NO: 739678 - DNA, 25 bp, Mus musculus
taatcgctggccatgttcccaagga

SEQ ID NO: 739679 - DNA, 25 bp, Mus musculus
taatcgctggccttgttcccaagga

SEQ ID NO: 739680 - DNA, 25 bp, Mus musculus
taatcggaggcaatgagatcagtcc

SEQ ID NO: 739681 - DNA, 25 bp, Mus musculus
taatcggaggcattgagatcagtcc

SEQ ID NO: 739682 - DNA, 25 bp, Mus musculus
taatcggattcacctggttagctct

SEQ ID NO: 739683 - DNA, 25 bp, Mus musculus
taatcggattcagctggttagctct

SEQ ID NO: 739684 - DNA, 25 bp, Mus musculus
taatcgggagctatctcagaagacc

SEQ ID NO: 739685 - DNA, 25 bp, Mus musculus
taatcgggagctttctcagaagacc

SEQ ID NO: 739686 - DNA, 25 bp, Mus musculus
taatcgtaaagtactggctgccgcc

SEQ ID NO: 739687 - DNA, 25 bp, Mus musculus
taatcgtaaagttctggctgccgcc

SEQ ID NO: 739688 - DNA, 25 bp, Mus musculus
taatcgtaagaacagtgaaggagct

SEQ ID NO: 739689 - DNA, 25 bp, Mus musculus
taatcgtaagaagagtgaaggagct

SEQ ID NO: 739690 - DNA, 25 bp, Mus musculus
taatcgtcccatctcgtgctgggca

SEQ ID NO: 739691 - DNA, 25 bp, Mus musculus
taatcgtcccatgtcgtgctgggca

SEQ ID NO: 739692 - DNA, 25 bp, Mus musculus
taatcgtggattcggatgttcatca

SEQ ID NO: 739693 - DNA, 25 bp, Mus musculus
taatcgtggattgggatgttcatca

SEQ ID NO: 739694 - DNA, 25 bp, Mus musculus
taatcgtggcttagtatcaaacctg

SEQ ID NO: 739695 - DNA, 25 bp, Mus musculus
taatcgtggctttgtatcaaacctg

SEQ ID NO: 739696 - DNA, 25 bp, Mus musculus
taatcgttctgcacgactgttctga

SEQ ID NO: 739697 - DNA, 25 bp, Mus musculus
taatcgttctgctcgactgttctga

SEQ ID NO: 739698 - DNA, 25 bp, Mus musculus
taatcgttctttcattgttaccacc

SEQ ID NO: 739699 - DNA, 25 bp, Mus musculus
taatcgttctttgattgttaccacc

SEQ ID NO: 739700 - DNA, 25 bp, Mus musculus
taatcgttggatcctttggtgtgga

SEQ ID NO: 739701 - DNA, 25 bp, Mus musculus
taatcgttggatgctttggtgtgga

SEQ ID NO: 739702 - DNA, 25 bp, Mus musculus
taatctaatgaaatataagccgttc

SEQ ID NO: 739703 - DNA, 25 bp, Mus musculus
taatctaatgaattataagccgttc

SEQ ID NO: 739704 - DNA, 25 bp, Mus musculus
taatctacagaaagatcaaacccag

SEQ ID NO: 739705 - DNA, 25 bp, Mus musculus
taatctacagaatgatcaaacccag

SEQ ID NO: 739706 - DNA, 25 bp, Mus musculus
taatctactcaaagcaccccttcat

SEQ ID NO: 739707 - DNA, 25 bp, Mus musculus
taatctactcaatgcaccccttcat

SEQ ID NO: 739708 - DNA, 25 bp, Mus musculus
taatctataagcctatcttaaggtg

SEQ ID NO: 739709 - DNA, 25 bp, Mus musculus
taatctataagcgtatcttaaggtg

SEQ ID NO: 739710 - DNA, 25 bp, Mus musculus
taatctcagcctaggtacgtgccgg

SEQ ID NO: 739711 - DNA, 25 bp, Mus musculus
taatctcagccttggtacgtgccgg

SEQ ID NO: 739712 - DNA, 25 bp, Mus musculus
taatctcaggagatggtaacgctca

SEQ ID NO: 739713 - DNA, 25 bp, Mus musculus
taatctcaggagttggtaacgctca

SEQ ID NO: 739714 - DNA, 25 bp, Mus musculus
taatctccaggaccaggactctgct

SEQ ID NO: 739715 - DNA, 25 bp, Mus musculus
taatctccaggagcaggactctgct

SEQ ID NO: 739716 - DNA, 25 bp, Mus musculus
taatctccttttcgccacttatgac

SEQ ID NO: 739717 - DNA, 25 bp, Mus musculus
taatctccttttggccacttatgac

SEQ ID NO: 739718 - DNA, 25 bp, Mus musculus
taatctcgtaaaagaaaccatgcca

SEQ ID NO: 739719 - DNA, 25 bp, Mus musculus
taatctcgtaaatgaaaccatgcca

SEQ ID NO: 739720 - DNA, 25 bp, Mus musculus
taatctctaaagcagccccttggac

SEQ ID NO: 739721 - DNA, 25 bp, Mus musculus
taatctctaaaggagccccttggac

SEQ ID NO: 739722 - DNA, 25 bp, Mus musculus
taatctctatttcagaaccatccca

SEQ ID NO: 739723 - DNA, 25 bp, Mus musculus
taatctctatttgagaaccatccca

SEQ ID NO: 739724 - DNA, 25 bp, Mus musculus
taatctcttcacaaaacaggaaggg

SEQ ID NO: 739725 - DNA, 25 bp, Mus musculus
taatctcttcactaaacaggaaggg

SEQ ID NO: 739726 - DNA, 25 bp, Mus musculus
taatctcttcagatgaagttggcgc

SEQ ID NO: 739727 - DNA, 25 bp, Mus musculus
taatctcttcagttgaagttggcgc

SEQ ID NO: 739728 - DNA, 25 bp, Mus musculus
taatctcttcataccgaggagcacc

SEQ ID NO: 739729 - DNA, 25 bp, Mus musculus
taatctcttcattccgaggagcacc

SEQ ID NO: 739730 - DNA, 25 bp, Mus musculus
taatctgaaaagaccagaggaggct

SEQ ID NO: 739731 - DNA, 25 bp, Mus musculus
taatctgaaaagtccagaggaggct

SEQ ID NO: 739732 - DNA, 25 bp, Mus musculus
taatctgaaactaaaactccacacc

SEQ ID NO: 739733 - DNA, 25 bp, Mus musculus
taatctgaaacttaaactccacacc

SEQ ID NO: 739734 - DNA, 25 bp, Mus musculus
taatctgacagcctgcttctgctcc

SEQ ID NO: 739735 - DNA, 25 bp, Mus musculus
taatctgacagcgtgcttctgctcc

SEQ ID NO: 739736 - DNA, 25 bp, Mus musculus
taatctgaggtgaagcaaacagaaa

SEQ ID NO: 739737 - DNA, 25 bp, Mus musculus
taatctgaggtgtagcaaacagaaa

SEQ ID NO: 739738 - DNA, 25 bp, Mus musculus
taatctgatgtccaaggataacctg

SEQ ID NO: 739739 - DNA, 25 bp, Mus musculus
taatctgatgtcgaaggataacctg

SEQ ID NO: 739740 - DNA, 25 bp, Mus musculus
taatctgcagaaatcgggacaccct

SEQ ID NO: 739741 - DNA, 25 bp, Mus musculus
taatctgcagaattcgggacaccct

SEQ ID NO: 739742 - DNA, 25 bp, Mus musculus
taatctgcggagaggctcttccctc

SEQ ID NO: 739743 - DNA, 25 bp, Mus musculus
taatctgcggagtggctcttccctc

SEQ ID NO: 739744 - DNA, 25 bp, Mus musculus
taatctggaacgacagtatcacctg

SEQ ID NO: 739745 - DNA, 25 bp, Mus musculus
taatctggaacgtcagtatcacctg

SEQ ID NO: 739746 - DNA, 25 bp, Mus musculus
taatctggagcacgaaattgctgcc

SEQ ID NO: 739747 - DNA, 25 bp, Mus musculus
taatctggagcaggaaattgctgcc

SEQ ID NO: 739748 - DNA, 25 bp, Mus musculus
taatctggatagcacatctgcccac

SEQ ID NO: 739749 - DNA, 25 bp, Mus musculus
taatctggataggacatctgcccac

SEQ ID NO: 739750 - DNA, 25 bp, Mus musculus
taatctgggaccagccaggcagggc

SEQ ID NO: 739751 - DNA, 25 bp, Mus musculus
taatctgggacctgccaggcagggc

SEQ ID NO: 739752 - DNA, 25 bp, Mus musculus
taatctgtaagtccggcgcggcctc

SEQ ID NO: 739753 - DNA, 25 bp, Mus musculus
taatctgtaagtgcggcgcggcctc

SEQ ID NO: 739754 - DNA, 25 bp, Mus musculus
taatctgtcactctggactcaggct

SEQ ID NO: 739755 - DNA, 25 bp, Mus musculus
taatctgtcactgtggactcaggct

SEQ ID NO: 739756 - DNA, 25 bp, Mus musculus
taatctgttcgactttacagctgaa

SEQ ID NO: 739757 - DNA, 25 bp, Mus musculus
taatctgttcgagtttacagctgaa

SEQ ID NO: 739758 - DNA, 25 bp, Mus musculus
taatctgttttcatgaagctagctc

SEQ ID NO: 739759 - DNA, 25 bp, Mus musculus
taatctgttttcttgaagctagctc

SEQ ID NO: 739760 - DNA, 25 bp, Mus musculus
taatcttaccctactctaaggctcc

SEQ ID NO: 739761 - DNA, 25 bp, Mus musculus
taatcttacccttctctaaggctcc

SEQ ID NO: 739762 - DNA, 25 bp, Mus musculus
taatcttagaaaatgactcattgga

SEQ ID NO: 739763 - DNA, 25 bp, Mus musculus
taatcttagaaattgactcattgga

SEQ ID NO: 739764 - DNA, 25 bp, Mus musculus
taatcttcaccaaccaaatgggcat

SEQ ID NO: 739765 - DNA, 25 bp, Mus musculus
taatcttcaccatccaaatgggcat

SEQ ID NO: 739766 - DNA, 25 bp, Mus musculus
taatcttccagtctgagcttgccta

SEQ ID NO: 739767 - DNA, 25 bp, Mus musculus
taatcttccagtgtgagcttgccta

SEQ ID NO: 739768 - DNA, 25 bp, Mus musculus
taatctttccctcgcagccgcgtgt

SEQ ID NO: 739769 - DNA, 25 bp, Mus musculus
taatctttccctggcagccgcgtgt

SEQ ID NO: 739770 - DNA, 25 bp, Mus musculus
taatcttttcggctgccatccatga

SEQ ID NO: 739771 - DNA, 25 bp, Mus musculus
taatcttttcgggtgccatccatga

SEQ ID NO: 739772 - DNA, 25 bp, Mus musculus
taatcttttgagcaatcggaaggaa

SEQ ID NO: 739773 - DNA, 25 bp, Mus musculus
taatcttttgaggaatcggaaggaa

SEQ ID NO: 739774 - DNA, 25 bp, Mus musculus
taatgaaaacaaacgacgttgttcg

SEQ ID NO: 739775 - DNA, 25 bp, Mus musculus
taatgaaaacaatcgacgttgttcg

SEQ ID NO: 739776 - DNA, 25 bp, Mus musculus
taatgaaaatgacttttacgatggg

SEQ ID NO: 739777 - DNA, 25 bp, Mus musculus
taatgaaaatgagttttacgatggg

SEQ ID NO: 739778 - DNA, 25 bp, Mus musculus
taatgaaaatggagacctgctttgg

SEQ ID NO: 739779 - DNA, 25 bp, Mus musculus
taatgaaaatggtgacctgctttgg

SEQ ID NO: 739780 - DNA, 25 bp, Mus musculus
taatgaaaattgagccaaagcctac

SEQ ID NO: 739781 - DNA, 25 bp, Mus musculus
taatgaaaattgtgccaaagcctac

SEQ ID NO: 739782 - DNA, 25 bp, Mus musculus
taatgaaagtaacgttgatgtccct

SEQ ID NO: 739783 - DNA, 25 bp, Mus musculus
taatgaaagtaaggttgatgtccct

SEQ ID NO: 739784 - DNA, 25 bp, Mus musculus
taatgaaattgaaagcctgggatcc

SEQ ID NO: 739785 - DNA, 25 bp, Mus musculus
taatgaaattgatagcctgggatcc

SEQ ID NO: 739786 - DNA, 25 bp, Mus musculus
taatgaacactgcaaccatctctcc

SEQ ID NO: 739787 - DNA, 25 bp, Mus musculus
taatgaacactggaaccatctctcc

SEQ ID NO: 739788 - DNA, 25 bp, Mus musculus
taatgaaccggacctaaggaaccaa

SEQ ID NO: 739789 - DNA, 25 bp, Mus musculus
taatgaaccggagctaaggaaccaa

SEQ ID NO: 739790 - DNA, 25 bp, Mus musculus
taatgaagccacatggcactgggtg

SEQ ID NO: 739791 - DNA, 25 bp, Mus musculus
taatgaagccacttggcactgggtg

SEQ ID NO: 739792 - DNA, 25 bp, Mus musculus
taatgaagccctcaagaggtaccgg

SEQ ID NO: 739793 - DNA, 25 bp, Mus musculus
taatgaagccctctgacagctcacc

SEQ ID NO: 739794 - DNA, 25 bp, Mus musculus
taatgaagccctgaagaggtaccgg

SEQ ID NO: 739795 - DNA, 25 bp, Mus musculus
taatgaagccctgtgacagctcacc

SEQ ID NO: 739796 - DNA, 25 bp, Mus musculus
taatgaagctccatacactagagag

SEQ ID NO: 739797 - DNA, 25 bp, Mus musculus
taatgaagctccctcaactttggat

SEQ ID NO: 739798 - DNA, 25 bp, Mus musculus
taatgaagctccgtcaactttggat

SEQ ID NO: 739799 - DNA, 25 bp, Mus musculus
taatgaagctccttacactagagag

SEQ ID NO: 739800 - DNA, 25 bp, Mus musculus
taatgaagcttacaaaacctagaat

SEQ ID NO: 739801 - DNA, 25 bp, Mus musculus
taatgaagcttagaaaacctagaat

SEQ ID NO: 739802 - DNA, 25 bp, Mus musculus
taatgaagctttccaccgagaaagg

SEQ ID NO: 739803 - DNA, 25 bp, Mus musculus
taatgaagctttgcaccgagaaagg

SEQ ID NO: 739804 - DNA, 25 bp, Mus musculus
taatgaaggattctgggagatagat

SEQ ID NO: 739805 - DNA, 25 bp, Mus musculus
taatgaaggattgtgggagatagat

SEQ ID NO: 739806 - DNA, 25 bp, Mus musculus
taatgaaggccaaagcacaggctgc

SEQ ID NO: 739807 - DNA, 25 bp, Mus musculus
taatgaaggccatagcacaggctgc

SEQ ID NO: 739808 - DNA, 25 bp, Mus musculus
taatgaatacaactagccccagtgc

SEQ ID NO: 739809 - DNA, 25 bp, Mus musculus
taatgaatacaagtagccccagtgc

SEQ ID NO: 739810 - DNA, 25 bp, Mus musculus
taatgaatcaggagataggctggtt

SEQ ID NO: 739811 - DNA, 25 bp, Mus musculus
taatgaatcaggtgataggctggtt

SEQ ID NO: 739812 - DNA, 25 bp, Mus musculus
taatgaatgtggaaatcggtggaag

SEQ ID NO: 739813 - DNA, 25 bp, Mus musculus
taatgaatgtggtaatcggtggaag

SEQ ID NO: 739814 - DNA, 25 bp, Mus musculus
taatgaatttccagtacctgcttgg

SEQ ID NO: 739815 - DNA, 25 bp, Mus musculus
taatgaatttcctgtacctgcttgg

SEQ ID NO: 739816 - DNA, 25 bp, Mus musculus
taatgacacaggcttcgtggatatc

SEQ ID NO: 739817 - DNA, 25 bp, Mus musculus
taatgacacagggttcgtggatatc

SEQ ID NO: 739818 - DNA, 25 bp, Mus musculus
taatgacagcagagagacccgctct

SEQ ID NO: 739819 - DNA, 25 bp, Mus musculus
taatgacagcagtgagacccgctct

SEQ ID NO: 739820 - DNA, 25 bp, Mus musculus
taatgaccagaacggtactggcgtc

SEQ ID NO: 739821 - DNA, 25 bp, Mus musculus
taatgaccagaagggtactggcgtc

SEQ ID NO: 739822 - DNA, 25 bp, Mus musculus
taatgaccaggtagcaatcagctcc

SEQ ID NO: 739823 - DNA, 25 bp, Mus musculus
taatgaccaggttgcaatcagctcc

SEQ ID NO: 739824 - DNA, 25 bp, Mus musculus
taatgaccatttaccaactactgca

SEQ ID NO: 739825 - DNA, 25 bp, Mus musculus
taatgaccattttccaactactgca

SEQ ID NO: 739826 - DNA, 25 bp, Mus musculus
taatgacccatactgagacctatag

SEQ ID NO: 739827 - DNA, 25 bp, Mus musculus
taatgacccatagtgagacctatag

SEQ ID NO: 739828 - DNA, 25 bp, Mus musculus
taatgaccgagaccgggtcaatgag

SEQ ID NO: 739829 - DNA, 25 bp, Mus musculus
taatgaccgagagcgggtcaatgag

SEQ ID NO: 739830 - DNA, 25 bp, Mus musculus
taatgaccgagtagtggcacaagag

SEQ ID NO: 739831 - DNA, 25 bp, Mus musculus
taatgaccgagttgtggcacaagag

SEQ ID NO: 739832 - DNA, 25 bp, Mus musculus
taatgaccttgtaatcagtgatggc

SEQ ID NO: 739833 - DNA, 25 bp, Mus musculus
taatgaccttgttatcagtgatggc

SEQ ID NO: 739834 - DNA, 25 bp, Mus musculus
taatgacgaaggatacacgcctttg

SEQ ID NO: 739835 - DNA, 25 bp, Mus musculus
taatgacgaaggttacacgcctttg

SEQ ID NO: 739836 - DNA, 25 bp, Mus musculus
taatgacgctggagaaatacaggac

SEQ ID NO: 739837 - DNA, 25 bp, Mus musculus
taatgacgctggtgaaatacaggac

SEQ ID NO: 739838 - DNA, 25 bp, Mus musculus
taatgacggtgcagactttccagag

SEQ ID NO: 739839 - DNA, 25 bp, Mus musculus
taatgacggtgctgactttccagag

SEQ ID NO: 739840 - DNA, 25 bp, Mus musculus
taatgacgtcttagtgattgaagag

SEQ ID NO: 739841 - DNA, 25 bp, Mus musculus
taatgacgtctttgtgattgaagag

SEQ ID NO: 739842 - DNA, 25 bp, Mus musculus
taatgacgtggaagtgcagaagata

SEQ ID NO: 739843 - DNA, 25 bp, Mus musculus
taatgacgtggatgtgcagaagata

SEQ ID NO: 739844 - DNA, 25 bp, Mus musculus
taatgacttccactgcgagtgccgg

SEQ ID NO: 739845 - DNA, 25 bp, Mus musculus
taatgacttccagtgcgagtgccgg

SEQ ID NO: 739846 - DNA, 25 bp, Mus musculus
taatgagaaacaacctatgccaaag

SEQ ID NO: 739847 - DNA, 25 bp, Mus musculus
taatgagaaacatcctatgccaaag

SEQ ID NO: 739848 - DNA, 25 bp, Mus musculus
taatgagaaactcccaaccttaaaa

SEQ ID NO: 739849 - DNA, 25 bp, Mus musculus
taatgagaaactgccaaccttaaaa

SEQ ID NO: 739850 - DNA, 25 bp, Mus musculus
taatgagagtgccaaggagactaaa

SEQ ID NO: 739851 - DNA, 25 bp, Mus musculus
taatgagagtgcgaaggagactaaa

SEQ ID NO: 739852 - DNA, 25 bp, Mus musculus
taatgagatgagcacagtattccag

SEQ ID NO: 739853 - DNA, 25 bp, Mus musculus
taatgagatgaggacagtattccag

SEQ ID NO: 739854 - DNA, 25 bp, Mus musculus
taatgagcactgatcccagcggcaa

SEQ ID NO: 739855 - DNA, 25 bp, Mus musculus
taatgagcactgttcccagcggcaa

SEQ ID NO: 739856 - DNA, 25 bp, Mus musculus
taatgagctatgaagttccggaatt

SEQ ID NO: 739857 - DNA, 25 bp, Mus musculus
taatgagctatgtagttccggaatt

SEQ ID NO: 739858 - DNA, 25 bp, Mus musculus
taatgaggacatccctcctgcagca

SEQ ID NO: 739859 - DNA, 25 bp, Mus musculus
taatgaggacatgcctcctgcagca

SEQ ID NO: 739860 - DNA, 25 bp, Mus musculus
taatgaggctacagatagtggctgc

SEQ ID NO: 739861 - DNA, 25 bp, Mus musculus
taatgaggctactgatagtggctgc

SEQ ID NO: 739862 - DNA, 25 bp, Mus musculus
taatgaggtcatcgttttggtaaag

SEQ ID NO: 739863 - DNA, 25 bp, Mus musculus
taatgaggtcatggttttggtaaag

SEQ ID NO: 739864 - DNA, 25 bp, Mus musculus
taatgaggtttgcatgaaggattcc

SEQ ID NO: 739865 - DNA, 25 bp, Mus musculus
taatgaggtttggatgaaggattcc

SEQ ID NO: 739866 - DNA, 25 bp, Mus musculus
taatgagtacttcagggatttgaat

SEQ ID NO: 739867 - DNA, 25 bp, Mus musculus
taatgagtacttgagggatttgaat

SEQ ID NO: 739868 - DNA, 25 bp, Mus musculus
taatgagtaggtcccagacaggctc

SEQ ID NO: 739869 - DNA, 25 bp, Mus musculus
taatgagtaggtgccagacaggctc

SEQ ID NO: 739870 - DNA, 25 bp, Mus musculus
taatgagtgtccagacagagactcg

SEQ ID NO: 739871 - DNA, 25 bp, Mus musculus
taatgagtgtcctgacagagactcg

SEQ ID NO: 739872 - DNA, 25 bp, Mus musculus
taatgagttcagcataactggatcc

SEQ ID NO: 739873 - DNA, 25 bp, Mus musculus
taatgagttcaggataactggatcc

SEQ ID NO: 739874 - DNA, 25 bp, Mus musculus
taatgataagaacccacacgtggct

SEQ ID NO: 739875 - DNA, 25 bp, Mus musculus
taatgataagaagccacacgtggct

SEQ ID NO: 739876 - DNA, 25 bp, Mus musculus
taatgatagcctcgctgcccggctg

SEQ ID NO: 739877 - DNA, 25 bp, Mus musculus
taatgatagcctggctgcccggctg

SEQ ID NO: 739878 - DNA, 25 bp, Mus musculus
taatgataggtgcacagagtagccc

SEQ ID NO: 739879 - DNA, 25 bp, Mus musculus
taatgataggtggacagagtagccc

SEQ ID NO: 739880 - DNA, 25 bp, Mus musculus
taatgatcagcacgacttagtggag

SEQ ID NO: 739881 - DNA, 25 bp, Mus musculus
taatgatcagcaggacttagtggag

SEQ ID NO: 739882 - DNA, 25 bp, Mus musculus
taatgatgaacaaacagacggccac

SEQ ID NO: 739883 - DNA, 25 bp, Mus musculus
taatgatgaacatacagacggccac

SEQ ID NO: 739884 - DNA, 25 bp, Mus musculus
taatgatgaagaccccaagacactc

SEQ ID NO: 739885 - DNA, 25 bp, Mus musculus
taatgatgaagagcccaagacactc

SEQ ID NO: 739886 - DNA, 25 bp, Mus musculus
taatgatgactccatcaagtaccct

SEQ ID NO: 739887 - DNA, 25 bp, Mus musculus
taatgatgactcgatcaagtaccct

SEQ ID NO: 739888 - DNA, 25 bp, Mus musculus
taatgatgaggaagatggacctcag

SEQ ID NO: 739889 - DNA, 25 bp, Mus musculus
taatgatgaggatgatggacctcag

SEQ ID NO: 739890 - DNA, 25 bp, Mus musculus
taatgatgaggcactgagggctact

SEQ ID NO: 739891 - DNA, 25 bp, Mus musculus
taatgatgaggctctgagggctact

SEQ ID NO: 739892 - DNA, 25 bp, Mus musculus
taatgatgccaaatggttcaggaaa

SEQ ID NO: 739893 - DNA, 25 bp, Mus musculus
taatgatgccaattggttcaggaaa

SEQ ID NO: 739894 - DNA, 25 bp, Mus musculus
taatgatgctggcagacctgacgct

SEQ ID NO: 739895 - DNA, 25 bp, Mus musculus
taatgatgctgggagacctgacgct

SEQ ID NO: 739896 - DNA, 25 bp, Mus musculus
taatgatgtcataagggcagcaaca

SEQ ID NO: 739897 - DNA, 25 bp, Mus musculus
taatgatgtcattagggcagcaaca

SEQ ID NO: 739898 - DNA, 25 bp, Mus musculus
taatgattatgaacagaagaggctg

SEQ ID NO: 739899 - DNA, 25 bp, Mus musculus
taatgattatgatcagaagaggctg

SEQ ID NO: 739900 - DNA, 25 bp, Mus musculus
taatgattgccaagaggtaaccaga

SEQ ID NO: 739901 - DNA, 25 bp, Mus musculus
taatgattgccatgaggtaaccaga

SEQ ID NO: 739902 - DNA, 25 bp, Mus musculus
taatgatttgggagatcaccgactg

SEQ ID NO: 739903 - DNA, 25 bp, Mus musculus
taatgatttgggtgatcaccgactg

SEQ ID NO: 739904 - DNA, 25 bp, Mus musculus
taatgatttttaaagcacctggact

SEQ ID NO: 739905 - DNA, 25 bp, Mus musculus
taatgatttttatagcacctggact

SEQ ID NO: 739906 - DNA, 25 bp, Mus musculus
taatgcaaaaatagcttgtcttgac

SEQ ID NO: 739907 - DNA, 25 bp, Mus musculus
taatgcaaaaattgcttgtcttgac

SEQ ID NO: 739908 - DNA, 25 bp, Mus musculus
taatgcaaaggacatagaagggcct

SEQ ID NO: 739909 - DNA, 25 bp, Mus musculus
taatgcaaaggagatagaagggcct

SEQ ID NO: 739910 - DNA, 25 bp, Mus musculus
taatgcaactgcacaaactcaccca

SEQ ID NO: 739911 - DNA, 25 bp, Mus musculus
taatgcaactgctcaaactcaccca

SEQ ID NO: 739912 - DNA, 25 bp, Mus musculus
taatgcaaggctcgaacaacatcgg

SEQ ID NO: 739913 - DNA, 25 bp, Mus musculus
taatgcaaggctggaacaacatcgg

SEQ ID NO: 739914 - DNA, 25 bp, Mus musculus
taatgcacaatcaggagccttttgg

SEQ ID NO: 739915 - DNA, 25 bp, Mus musculus
taatgcacaatctggagccttttgg

SEQ ID NO: 739916 - DNA, 25 bp, Mus musculus
taatgcacaatgaattgaactgcac

SEQ ID NO: 739917 - DNA, 25 bp, Mus musculus
taatgcacaatgtattgaactgcac

SEQ ID NO: 739918 - DNA, 25 bp, Mus musculus
taatgcacagagactcctatccccg

SEQ ID NO: 739919 - DNA, 25 bp, Mus musculus
taatgcacagagtctcctatccccg

SEQ ID NO: 739920 - DNA, 25 bp, Mus musculus
taatgcacgccaacctcagaatgga

SEQ ID NO: 739921 - DNA, 25 bp, Mus musculus
taatgcacgccatcctcagaatgga

SEQ ID NO: 739922 - DNA, 25 bp, Mus musculus
taatgcactgcccagaaagagccat

SEQ ID NO: 739923 - DNA, 25 bp, Mus musculus
taatgcactgccgagaaagagccat

SEQ ID NO: 739924 - DNA, 25 bp, Mus musculus
taatgcagagctcctacaccgaggc

SEQ ID NO: 739925 - DNA, 25 bp, Mus musculus
taatgcagagctgctacaccgaggc

SEQ ID NO: 739926 - DNA, 25 bp, Mus musculus
taatgcagcagcacaactcggagag

SEQ ID NO: 739927 - DNA, 25 bp, Mus musculus
taatgcagcagctcaactcggagag

SEQ ID NO: 739928 - DNA, 25 bp, Mus musculus
taatgcagccatacacgttgtgcag

SEQ ID NO: 739929 - DNA, 25 bp, Mus musculus
taatgcagccattcacgttgtgcag

SEQ ID NO: 739930 - DNA, 25 bp, Mus musculus
taatgcagcgagactgtggcaatgg

SEQ ID NO: 739931 - DNA, 25 bp, Mus musculus
taatgcagcgagtctgtggcaatgg

SEQ ID NO: 739932 - DNA, 25 bp, Mus musculus
taatgcagcggaaaataagcttacc

SEQ ID NO: 739933 - DNA, 25 bp, Mus musculus
taatgcagcggataataagcttacc

SEQ ID NO: 739934 - DNA, 25 bp, Mus musculus
taatgcagtaccatggctgtcgcag

SEQ ID NO: 739935 - DNA, 25 bp, Mus musculus
taatgcagtaccttggctgtcgcag

SEQ ID NO: 739936 - DNA, 25 bp, Mus musculus
taatgcagtgtgatgcctccaatcc

SEQ ID NO: 739937 - DNA, 25 bp, Mus musculus
taatgcagtgtgttgcctccaatcc

SEQ ID NO: 739938 - DNA, 25 bp, Mus musculus
taatgcataaggatggccccactgg

SEQ ID NO: 739939 - DNA, 25 bp, Mus musculus
taatgcataaggttggccccactgg

SEQ ID NO: 739940 - DNA, 25 bp, Mus musculus
taatgcatgtcacgactgtgcaaag

SEQ ID NO: 739941 - DNA, 25 bp, Mus musculus
taatgcatgtcaggactgtgcaaag

SEQ ID NO: 739942 - DNA, 25 bp, Mus musculus
taatgccaagaacacagttcaaggc

SEQ ID NO: 739943 - DNA, 25 bp, Mus musculus
taatgccaagaagacagttcaaggc

SEQ ID NO: 739944 - DNA, 25 bp, Mus musculus
taatgccaggagctctgtccggcag

SEQ ID NO: 739945 - DNA, 25 bp, Mus musculus
taatgccaggaggtctgtccggcag

SEQ ID NO: 739946 - DNA, 25 bp, Mus musculus
taatgccaggcactctgctgagagg

SEQ ID NO: 739947 - DNA, 25 bp, Mus musculus
taatgccaggcagtctgctgagagg

SEQ ID NO: 739948 - DNA, 25 bp, Mus musculus
taatgccaggcgacgagttgtcttg

SEQ ID NO: 739949 - DNA, 25 bp, Mus musculus
taatgccaggcgtcgagttgtcttg

SEQ ID NO: 739950 - DNA, 25 bp, Mus musculus
taatgccagtctctttcctaaactc

SEQ ID NO: 739951 - DNA, 25 bp, Mus musculus
taatgccagtctgtttcctaaactc

SEQ ID NO: 739952 - DNA, 25 bp, Mus musculus
taatgccatgtgatcctctattctt

SEQ ID NO: 739953 - DNA, 25 bp, Mus musculus
taatgccatgtgttcctctattctt

SEQ ID NO: 739954 - DNA, 25 bp, Mus musculus
taatgcccatctataatcacatagg

SEQ ID NO: 739955 - DNA, 25 bp, Mus musculus
taatgcccatctctaaaaactggat

SEQ ID NO: 739956 - DNA, 25 bp, Mus musculus
taatgcccatctgtaaaaactggat

SEQ ID NO: 739957 - DNA, 25 bp, Mus musculus
taatgcccatctttaatcacatagg

SEQ ID NO: 739958 - DNA, 25 bp, Mus musculus
taatgcccgaagcagcggacacggt

SEQ ID NO: 739959 - DNA, 25 bp, Mus musculus
taatgcccgaaggagcggacacggt

SEQ ID NO: 739960 - DNA, 25 bp, Mus musculus
taatgccgagggagagcctgtatgt

SEQ ID NO: 739961 - DNA, 25 bp, Mus musculus
taatgccgagggtgagcctgtatgt

SEQ ID NO: 739962 - DNA, 25 bp, Mus musculus
taatgccgtggtcgctctgcgtgac

SEQ ID NO: 739963 - DNA, 25 bp, Mus musculus
taatgccgtggtggctctgcgtgac

SEQ ID NO: 739964 - DNA, 25 bp, Mus musculus
taatgcctacagcactcgagagcac

SEQ ID NO: 739965 - DNA, 25 bp, Mus musculus
taatgcctacaggactcgagagcac

SEQ ID NO: 739966 - DNA, 25 bp, Mus musculus
taatgcctacgacaagacagccttg

SEQ ID NO: 739967 - DNA, 25 bp, Mus musculus
taatgcctacgagaagacagccttg

SEQ ID NO: 739968 - DNA, 25 bp, Mus musculus
taatgcctcagtcgtcaatcctggg

SEQ ID NO: 739969 - DNA, 25 bp, Mus musculus
taatgcctcagtggtcaatcctggg

SEQ ID NO: 739970 - DNA, 25 bp, Mus musculus
taatgcctgactatgccttcttggt

SEQ ID NO: 739971 - DNA, 25 bp, Mus musculus
taatgcctgactttgccttcttggt

SEQ ID NO: 739972 - DNA, 25 bp, Mus musculus
taatgcctgctaactctggaccaca

SEQ ID NO: 739973 - DNA, 25 bp, Mus musculus
taatgcctgctatctctggaccaca

SEQ ID NO: 739974 - DNA, 25 bp, Mus musculus
taatgccttcaacgtgggtgatgac

SEQ ID NO: 739975 - DNA, 25 bp, Mus musculus
taatgccttcaaggtgggtgatgac

SEQ ID NO: 739976 - DNA, 25 bp, Mus musculus
taatgcctttggcagctgtgggcgc

SEQ ID NO: 739977 - DNA, 25 bp, Mus musculus
taatgcctttgggagctgtgggcgc

SEQ ID NO: 739978 - DNA, 25 bp, Mus musculus
taatgcgccaggattccatggagcc

SEQ ID NO: 739979 - DNA, 25 bp, Mus musculus
taatgcgccaggtttccatggagcc

SEQ ID NO: 739980 - DNA, 25 bp, Mus musculus
taatgcggagcaccacgcagatgga

SEQ ID NO: 739981 - DNA, 25 bp, Mus musculus
taatgcggagcagcacgcagatgga

SEQ ID NO: 739982 - DNA, 25 bp, Mus musculus
taatgcggcgctccaagacgtgaga

SEQ ID NO: 739983 - DNA, 25 bp, Mus musculus
taatgcggcgctgcaagacgtgaga

SEQ ID NO: 739984 - DNA, 25 bp, Mus musculus
taatgcgtgaacaaaccaacctgtg

SEQ ID NO: 739985 - DNA, 25 bp, Mus musculus
taatgcgtgaactaaccaacctgtg

SEQ ID NO: 739986 - DNA, 25 bp, Mus musculus
taatgcgttgaacacaaagagtatg

SEQ ID NO: 739987 - DNA, 25 bp, Mus musculus
taatgcgttgaagacaaagagtatg

SEQ ID NO: 739988 - DNA, 25 bp, Mus musculus
taatgctacttacgtgcagcctaga

SEQ ID NO: 739989 - DNA, 25 bp, Mus musculus
taatgctacttaggtgcagcctaga

SEQ ID NO: 739990 - DNA, 25 bp, Mus musculus
taatgctagagtataaaaccaaggc

SEQ ID NO: 739991 - DNA, 25 bp, Mus musculus
taatgctagagtttaaaaccaaggc

SEQ ID NO: 739992 - DNA, 25 bp, Mus musculus
taatgctagatgagaagcgcgtgat

SEQ ID NO: 739993 - DNA, 25 bp, Mus musculus
taatgctagatgtgaagcgcgtgat

SEQ ID NO: 739994 - DNA, 25 bp, Mus musculus
taatgctaggtgagaaacggctggc

SEQ ID NO: 739995 - DNA, 25 bp, Mus musculus
taatgctaggtgtgaaacggctggc

SEQ ID NO: 739996 - DNA, 25 bp, Mus musculus
taatgctcagatagagaccaaccgg

SEQ ID NO: 739997 - DNA, 25 bp, Mus musculus
taatgctcagattgagaccaaccgg

SEQ ID NO: 739998 - DNA, 25 bp, Mus musculus
taatgctcatacaccaagaacgatc

SEQ ID NO: 739999 - DNA, 25 bp, Mus musculus
taatgctcatactccaagaacgatc

SEQ ID NO: 740000 - DNA, 25 bp, Mus musculus
taatgctctctcactaggtgaggga

SEQ ID NO: 740001 - DNA, 25 bp, Mus musculus
taatgctctctctctaggtgaggga

SEQ ID NO: 740002 - DNA, 25 bp, Mus musculus
taatgctctgtgcaactcccatcac

SEQ ID NO: 740003 - DNA, 25 bp, Mus musculus
taatgctctgtggaactcccatcac

SEQ ID NO: 740004 - DNA, 25 bp, Mus musculus
taatgctcttcaagcaagcagccct

SEQ ID NO: 740005 - DNA, 25 bp, Mus musculus
taatgctcttcatgcaagcagccct

SEQ ID NO: 740006 - DNA, 25 bp, Mus musculus
taatgctgaccaataaaccaggcga

SEQ ID NO: 740007 - DNA, 25 bp, Mus musculus
taatgctgaccattaaaccaggcga

SEQ ID NO: 740008 - DNA, 25 bp, Mus musculus
taatgctgaggacggtacattcctg

SEQ ID NO: 740009 - DNA, 25 bp, Mus musculus
taatgctgaggagggtacattcctg

SEQ ID NO: 740010 - DNA, 25 bp, Mus musculus
taatgctgcagaccgtctctgacca

SEQ ID NO: 740011 - DNA, 25 bp, Mus musculus
taatgctgcagagcgtctctgacca

SEQ ID NO: 740012 - DNA, 25 bp, Mus musculus
taatgctgcctactttgttggaaag

SEQ ID NO: 740013 - DNA, 25 bp, Mus musculus
taatgctgcctagtttgttggaaag

SEQ ID NO: 740014 - DNA, 25 bp, Mus musculus
taatgctgctctaaaaatttgtctc

SEQ ID NO: 740015 - DNA, 25 bp, Mus musculus
taatgctgctcttaaaatttgtctc

SEQ ID NO: 740016 - DNA, 25 bp, Mus musculus
taatgctgctgaaaacaaacaaagg

SEQ ID NO: 740017 - DNA, 25 bp, Mus musculus
taatgctgctgataacaaacaaagg

SEQ ID NO: 740018 - DNA, 25 bp, Mus musculus
taatgctgggttagagaaaacaagc

SEQ ID NO: 740019 - DNA, 25 bp, Mus musculus
taatgctgggtttgagaaaacaagc

SEQ ID NO: 740020 - DNA, 25 bp, Mus musculus
taatgctggtctacgtgtggagccg

SEQ ID NO: 740021 - DNA, 25 bp, Mus musculus
taatgctggtcttcgtgtggagccg

SEQ ID NO: 740022 - DNA, 25 bp, Mus musculus
taatgctgtgcaacaatggtggacc

SEQ ID NO: 740023 - DNA, 25 bp, Mus musculus
taatgctgtgcatcaatggtggacc

SEQ ID NO: 740024 - DNA, 25 bp, Mus musculus
taatgctgtgtcacacgtaaccaga

SEQ ID NO: 740025 - DNA, 25 bp, Mus musculus
taatgctgtgtctcacgtaaccaga

SEQ ID NO: 740026 - DNA, 25 bp, Mus musculus
taatgcttacaacgctcagcgggag

SEQ ID NO: 740027 - DNA, 25 bp, Mus musculus
taatgcttacaaggctcagcgggag

SEQ ID NO: 740028 - DNA, 25 bp, Mus musculus
taatgcttacagatgtgacccaagg

SEQ ID NO: 740029 - DNA, 25 bp, Mus musculus
taatgcttacagttgtgacccaagg

SEQ ID NO: 740030 - DNA, 25 bp, Mus musculus
taatgcttatggatcccagagtgac

SEQ ID NO: 740031 - DNA, 25 bp, Mus musculus
taatgcttatggttcccagagtgac

SEQ ID NO: 740032 - DNA, 25 bp, Mus musculus
taatgcttccagagatgttctacgg

SEQ ID NO: 740033 - DNA, 25 bp, Mus musculus
taatgcttccagtgatgttctacgg

SEQ ID NO: 740034 - DNA, 25 bp, Mus musculus
taatgcttctctagtacagagactc

SEQ ID NO: 740035 - DNA, 25 bp, Mus musculus
taatgcttctcttgtacagagactc

SEQ ID NO: 740036 - DNA, 25 bp, Mus musculus
taatggaaaaatccatccagcttcc

SEQ ID NO: 740037 - DNA, 25 bp, Mus musculus
taatggaaaaatgcatccagcttcc

SEQ ID NO: 740038 - DNA, 25 bp, Mus musculus
taatggaaattccagtcttcccaga

SEQ ID NO: 740039 - DNA, 25 bp, Mus musculus
taatggaaattcgagtcttcccaga

SEQ ID NO: 740040 - DNA, 25 bp, Mus musculus
taatggaacaaaccggatgctgggc

SEQ ID NO: 740041 - DNA, 25 bp, Mus musculus
taatggaacaaagcggatgctgggc

SEQ ID NO: 740042 - DNA, 25 bp, Mus musculus
taatggaactatatgggtatccaca

SEQ ID NO: 740043 - DNA, 25 bp, Mus musculus
taatggaactatttgggtatccaca

SEQ ID NO: 740044 - DNA, 25 bp, Mus musculus
taatggaagcaaatcttaaaacatg

SEQ ID NO: 740045 - DNA, 25 bp, Mus musculus
taatggaagcaattcttaaaacatg

SEQ ID NO: 740046 - DNA, 25 bp, Mus musculus
taatggaattggagtcagcagaacg

SEQ ID NO: 740047 - DNA, 25 bp, Mus musculus
taatggaattggtgtcagcagaacg

SEQ ID NO: 740048 - DNA, 25 bp, Mus musculus
taatggacaaatcggccagcctctc

SEQ ID NO: 740049 - DNA, 25 bp, Mus musculus
taatggacaaatgggccagcctctc

SEQ ID NO: 740050 - DNA, 25 bp, Mus musculus
taatggacacttatggcatccgatg

SEQ ID NO: 740051 - DNA, 25 bp, Mus musculus
taatggacacttttggcatccgatg

SEQ ID NO: 740052 - DNA, 25 bp, Mus musculus
taatggacatctatgtgcagtgcct

SEQ ID NO: 740053 - DNA, 25 bp, Mus musculus
taatggacatctttgtgcagtgcct

SEQ ID NO: 740054 - DNA, 25 bp, Mus musculus
taatggacctcaagccccataaacc

SEQ ID NO: 740055 - DNA, 25 bp, Mus musculus
taatggacctcatgccccataaacc

SEQ ID NO: 740056 - DNA, 25 bp, Mus musculus
taatggacggcaaccgtcgctatgc

SEQ ID NO: 740057 - DNA, 25 bp, Mus musculus
taatggacggcatccgtcgctatgc

SEQ ID NO: 740058 - DNA, 25 bp, Mus musculus
taatggactaacattctttagcact

SEQ ID NO: 740059 - DNA, 25 bp, Mus musculus
taatggactaactttctttagcact

SEQ ID NO: 740060 - DNA, 25 bp, Mus musculus
taatggactagcactctctgcccat

SEQ ID NO: 740061 - DNA, 25 bp, Mus musculus
taatggactagctctctctgcccat

SEQ ID NO: 740062 - DNA, 25 bp, Mus musculus
taatggactccgatgaagacgacgc

SEQ ID NO: 740063 - DNA, 25 bp, Mus musculus
taatggactccgttgaagacgacgc

SEQ ID NO: 740064 - DNA, 25 bp, Mus musculus
taatggacttagatgtggagcaact

SEQ ID NO: 740065 - DNA, 25 bp, Mus musculus
taatggacttagttgtggagcaact

SEQ ID NO: 740066 - DNA, 25 bp, Mus musculus
taatggacttcgatgcactggtgca

SEQ ID NO: 740067 - DNA, 25 bp, Mus musculus
taatggacttcgttgcactggtgca

SEQ ID NO: 740068 - DNA, 25 bp, Mus musculus
taatggagaccaacaaggactggac

SEQ ID NO: 740069 - DNA, 25 bp, Mus musculus
taatggagaccatcaaggactggac

SEQ ID NO: 740070 - DNA, 25 bp, Mus musculus
taatggagatacacacctgggtggg

SEQ ID NO: 740071 - DNA, 25 bp, Mus musculus
taatggagatactcacctgggtggg

SEQ ID NO: 740072 - DNA, 25 bp, Mus musculus
taatggagcagacctgagaaatgtt

SEQ ID NO: 740073 - DNA, 25 bp, Mus musculus
taatggagcagagctgagaaatgtt

SEQ ID NO: 740074 - DNA, 25 bp, Mus musculus
taatggagcaggctacacatggtgt

SEQ ID NO: 740075 - DNA, 25 bp, Mus musculus
taatggagcagggtacacatggtgt

SEQ ID NO: 740076 - DNA, 25 bp, Mus musculus
taatggagccagctacccatactaa

SEQ ID NO: 740077 - DNA, 25 bp, Mus musculus
taatggagccaggtacccatactaa

SEQ ID NO: 740078 - DNA, 25 bp, Mus musculus
taatggaggaagatgctgagcccat

SEQ ID NO: 740079 - DNA, 25 bp, Mus musculus
taatggaggaagttgctgagcccat

SEQ ID NO: 740080 - DNA, 25 bp, Mus musculus
taatggagtcagacaaagggtggac

SEQ ID NO: 740081 - DNA, 25 bp, Mus musculus
taatggagtcagtcaaagggtggac

SEQ ID NO: 740082 - DNA, 25 bp, Mus musculus
taatggagtccactttaactatccc

SEQ ID NO: 740083 - DNA, 25 bp, Mus musculus
taatggagtccagtttaactatccc

SEQ ID NO: 740084 - DNA, 25 bp, Mus musculus
taatggagtcccaaatcagtttttg

SEQ ID NO: 740085 - DNA, 25 bp, Mus musculus
taatggagtccctaatcagtttttg

SEQ ID NO: 740086 - DNA, 25 bp, Mus musculus
taatggatctccagaatcagaaatt

SEQ ID NO: 740087 - DNA, 25 bp, Mus musculus
taatggatctcctgaatcagaaatt

SEQ ID NO: 740088 - DNA, 25 bp, Mus musculus
taatggatgcaacctgagacctggg

SEQ ID NO: 740089 - DNA, 25 bp, Mus musculus
taatggatgcaagctgagacctggg

SEQ ID NO: 740090 - DNA, 25 bp, Mus musculus
taatggatggagaatcagaagatcg

SEQ ID NO: 740091 - DNA, 25 bp, Mus musculus
taatggatggagtatcagaagatcg

SEQ ID NO: 740092 - DNA, 25 bp, Mus musculus
taatggattacaccagaggaccacc

SEQ ID NO: 740093 - DNA, 25 bp, Mus musculus
taatggattacagcagaggaccacc

SEQ ID NO: 740094 - DNA, 25 bp, Mus musculus
taatggattaccaccatcgtttcct

SEQ ID NO: 740095 - DNA, 25 bp, Mus musculus
taatggattacctccatcgtttcct

SEQ ID NO: 740096 - DNA, 25 bp, Mus musculus
taatggatttggaggaacgaactaa

SEQ ID NO: 740097 - DNA, 25 bp, Mus musculus
taatggatttggtggaacgaactaa

SEQ ID NO: 740098 - DNA, 25 bp, Mus musculus
taatggcaaattcctctacagtgtc

SEQ ID NO: 740099 - DNA, 25 bp, Mus musculus
taatggcaaattgctctacagtgtc

SEQ ID NO: 740100 - DNA, 25 bp, Mus musculus
taatggcaattgcagttctctcccg

SEQ ID NO: 740101 - DNA, 25 bp, Mus musculus
taatggcaattggagttctctcccg

SEQ ID NO: 740102 - DNA, 25 bp, Mus musculus
taatggcactatattagagctgaga

SEQ ID NO: 740103 - DNA, 25 bp, Mus musculus
taatggcactattttagagctgaga

SEQ ID NO: 740104 - DNA, 25 bp, Mus musculus
taatggcataccctgtactgggctg

SEQ ID NO: 740105 - DNA, 25 bp, Mus musculus
taatggcataccgtgtactgggctg

SEQ ID NO: 740106 - DNA, 25 bp, Mus musculus
taatggcatcaacctgttcgatacg

SEQ ID NO: 740107 - DNA, 25 bp, Mus musculus
taatggcatcaagctgttcgatacg

SEQ ID NO: 740108 - DNA, 25 bp, Mus musculus
taatggcatctgatactccgaaaag

SEQ ID NO: 740109 - DNA, 25 bp, Mus musculus
taatggcatctgttactccgaaaag

SEQ ID NO: 740110 - DNA, 25 bp, Mus musculus
taatggcattggagcctcagtgcgg

SEQ ID NO: 740111 - DNA, 25 bp, Mus musculus
taatggcattggtgcctcagtgcgg

SEQ ID NO: 740112 - DNA, 25 bp, Mus musculus
taatggccatcaattgactgtacac

SEQ ID NO: 740113 - DNA, 25 bp, Mus musculus
taatggccatcatttgactgtacac

SEQ ID NO: 740114 - DNA, 25 bp, Mus musculus
taatggcccaggcttggacagagca

SEQ ID NO: 740115 - DNA, 25 bp, Mus musculus
taatggcccagggttggacagagca

SEQ ID NO: 740116 - DNA, 25 bp, Mus musculus
taatggcccattcatacccaagcag

SEQ ID NO: 740117 - DNA, 25 bp, Mus musculus
taatggcccattgatacccaagcag

SEQ ID NO: 740118 - DNA, 25 bp, Mus musculus
taatggcccttcaattgggagacca

SEQ ID NO: 740119 - DNA, 25 bp, Mus musculus
taatggcccttctattgggagacca

SEQ ID NO: 740120 - DNA, 25 bp, Mus musculus
taatggcccttgagagtcatgaaca

SEQ ID NO: 740121 - DNA, 25 bp, Mus musculus
taatggcccttgtgagtcatgaaca

SEQ ID NO: 740122 - DNA, 25 bp, Mus musculus
taatggcctgcaagattgtgaactt

SEQ ID NO: 740123 - DNA, 25 bp, Mus musculus
taatggcctgcatgattgtgaactt

SEQ ID NO: 740124 - DNA, 25 bp, Mus musculus
taatggccttggacacctcagtcac

SEQ ID NO: 740125 - DNA, 25 bp, Mus musculus
taatggccttggtcacctcagtcac

SEQ ID NO: 740126 - DNA, 25 bp, Mus musculus
taatggcgacgaagggacccatgac

SEQ ID NO: 740127 - DNA, 25 bp, Mus musculus
taatggcgacgatgggacccatgac

SEQ ID NO: 740128 - DNA, 25 bp, Mus musculus
taatggcgagcacattcgatatgca

SEQ ID NO: 740129 - DNA, 25 bp, Mus musculus
taatggcgagcagattcgatatgca

SEQ ID NO: 740130 - DNA, 25 bp, Mus musculus
taatggcggcgcaatagagtgtaca

SEQ ID NO: 740131 - DNA, 25 bp, Mus musculus
taatggcggcgctatagagtgtaca

SEQ ID NO: 740132 - DNA, 25 bp, Mus musculus
taatggcggtatcccggaaaccacg

SEQ ID NO: 740133 - DNA, 25 bp, Mus musculus
taatggcggtatgccggaaaccacg

SEQ ID NO: 740134 - DNA, 25 bp, Mus musculus
taatggctaccgagtaacatggcgg

SEQ ID NO: 740135 - DNA, 25 bp, Mus musculus
taatggctaccgtgtaacatggcgg

SEQ ID NO: 740136 - DNA, 25 bp, Mus musculus
taatggctccataagtggccgggag

SEQ ID NO: 740137 - DNA, 25 bp, Mus musculus
taatggctccattagtggccgggag

SEQ ID NO: 740138 - DNA, 25 bp, Mus musculus
taatggctcccacttctcctggaag

SEQ ID NO: 740139 - DNA, 25 bp, Mus musculus
taatggctcccagttctcctggaag

SEQ ID NO: 740140 - DNA, 25 bp, Mus musculus
taatggctcctgctcgggtctggat

SEQ ID NO: 740141 - DNA, 25 bp, Mus musculus
taatggctcctggtcgggtctggat

SEQ ID NO: 740142 - DNA, 25 bp, Mus musculus
taatggctcgcaccctactggacct

SEQ ID NO: 740143 - DNA, 25 bp, Mus musculus
taatggctcgcagcctactggacct

SEQ ID NO: 740144 - DNA, 25 bp, Mus musculus
taatggctcttaccagggcaaagac

SEQ ID NO: 740145 - DNA, 25 bp, Mus musculus
taatggctcttagcagggcaaagac

SEQ ID NO: 740146 - DNA, 25 bp, Mus musculus
taatggctgcctctgcagtgccgct

SEQ ID NO: 740147 - DNA, 25 bp, Mus musculus
taatggctgcctgtgcagtgccgct

SEQ ID NO: 740148 - DNA, 25 bp, Mus musculus
taatgggaacacagctcaccttggt

SEQ ID NO: 740149 - DNA, 25 bp, Mus musculus
taatgggaacactgctcaccttggt

SEQ ID NO: 740150 - DNA, 25 bp, Mus musculus
taatgggaccgtcaagctggctgac

SEQ ID NO: 740151 - DNA, 25 bp, Mus musculus
taatgggaccgtgaagctggctgac

SEQ ID NO: 740152 - DNA, 25 bp, Mus musculus
taatgggagatcctggtcctcatgg

SEQ ID NO: 740153 - DNA, 25 bp, Mus musculus
taatgggagatcgtggtcctcatgg

SEQ ID NO: 740154 - DNA, 25 bp, Mus musculus
taatgggcattaagagtgacgatga

SEQ ID NO: 740155 - DNA, 25 bp, Mus musculus
taatgggcattatgagtgacgatga

SEQ ID NO: 740156 - DNA, 25 bp, Mus musculus
taatgggcccctcgatttggtgttc

SEQ ID NO: 740157 - DNA, 25 bp, Mus musculus
taatgggcccctggatttggtgttc

SEQ ID NO: 740158 - DNA, 25 bp, Mus musculus
taatgggcctacctttcttcacagc

SEQ ID NO: 740159 - DNA, 25 bp, Mus musculus
taatgggcctacgtttcttcacagc

SEQ ID NO: 740160 - DNA, 25 bp, Mus musculus
taatgggcctcactattgacttcag

SEQ ID NO: 740161 - DNA, 25 bp, Mus musculus
taatgggcctcagtattgacttcag

SEQ ID NO: 740162 - DNA, 25 bp, Mus musculus
taatgggtaaccacgatctggtcca

SEQ ID NO: 740163 - DNA, 25 bp, Mus musculus
taatgggtaacctcgatctggtcca

SEQ ID NO: 740164 - DNA, 25 bp, Mus musculus
taatgggtatccctctcgtgagaca

SEQ ID NO: 740165 - DNA, 25 bp, Mus musculus
taatgggtatccgtctcgtgagaca

SEQ ID NO: 740166 - DNA, 25 bp, Mus musculus
taatgggtggaactacaaatcagcg

SEQ ID NO: 740167 - DNA, 25 bp, Mus musculus
taatgggtggaagtacaaatcagcg

SEQ ID NO: 740168 - DNA, 25 bp, Mus musculus
taatgggttggcatgtgggtttctc

SEQ ID NO: 740169 - DNA, 25 bp, Mus musculus
taatgggttggcttgtgggtttctc

SEQ ID NO: 740170 - DNA, 25 bp, Mus musculus
taatgggtttatagtggccactgtc

SEQ ID NO: 740171 - DNA, 25 bp, Mus musculus
taatgggtttattgtggccactgtc

SEQ ID NO: 740172 - DNA, 25 bp, Mus musculus
taatggtacaaaccactgagacctg

SEQ ID NO: 740173 - DNA, 25 bp, Mus musculus
taatggtacaaagcactgagacctg

SEQ ID NO: 740174 - DNA, 25 bp, Mus musculus
taatggtacaggcttagtcctggcc

SEQ ID NO: 740175 - DNA, 25 bp, Mus musculus
taatggtacagggttagtcctggcc

SEQ ID NO: 740176 - DNA, 25 bp, Mus musculus
taatggtactaccattgaagggcat

SEQ ID NO: 740177 - DNA, 25 bp, Mus musculus
taatggtactacgattgaagggcat

SEQ ID NO: 740178 - DNA, 25 bp, Mus musculus
taatggtccttgattaggttctcgg

SEQ ID NO: 740179 - DNA, 25 bp, Mus musculus
taatggtccttgtttaggttctcgg

SEQ ID NO: 740180 - DNA, 25 bp, Mus musculus
taatggtctgtacaattcgtcaggc

SEQ ID NO: 740181 - DNA, 25 bp, Mus musculus
taatggtctgtagaattcgtcaggc

SEQ ID NO: 740182 - DNA, 25 bp, Mus musculus
taatggtcttcccaccctggggaga

SEQ ID NO: 740183 - DNA, 25 bp, Mus musculus
taatggtcttccgaccctggggaga

SEQ ID NO: 740184 - DNA, 25 bp, Mus musculus
taatggtgcaacaagaaaactggct

SEQ ID NO: 740185 - DNA, 25 bp, Mus musculus
taatggtgcaactagaaaactggct

SEQ ID NO: 740186 - DNA, 25 bp, Mus musculus
taatggtggcttcaagacgttcgct

SEQ ID NO: 740187 - DNA, 25 bp, Mus musculus
taatggtggcttgaagacgttcgct

SEQ ID NO: 740188 - DNA, 25 bp, Mus musculus
taatggtggtggctcatgtagcccc

SEQ ID NO: 740189 - DNA, 25 bp, Mus musculus
taatggtggtgggtcatgtagcccc

SEQ ID NO: 740190 - DNA, 25 bp, Mus musculus
taatggtgtgttccttaggaagctc

SEQ ID NO: 740191 - DNA, 25 bp, Mus musculus
taatggtgtgttgcttaggaagctc

SEQ ID NO: 740192 - DNA, 25 bp, Mus musculus
taatggttttgtctgctctcgagag

SEQ ID NO: 740193 - DNA, 25 bp, Mus musculus
taatggttttgtgtgctctcgagag

SEQ ID NO: 740194 - DNA, 25 bp, Mus musculus
taatgtacatgcaccccacagctct

SEQ ID NO: 740195 - DNA, 25 bp, Mus musculus
taatgtacatgctccccacagctct

SEQ ID NO: 740196 - DNA, 25 bp, Mus musculus
taatgtacattcaatgggcgttgct

SEQ ID NO: 740197 - DNA, 25 bp, Mus musculus
taatgtacattctatgggcgttgct

SEQ ID NO: 740198 - DNA, 25 bp, Mus musculus
taatgtagaagaaagtaattgtcct

SEQ ID NO: 740199 - DNA, 25 bp, Mus musculus
taatgtagaagatagtaattgtcct

SEQ ID NO: 740200 - DNA, 25 bp, Mus musculus
taatgtatagtcacctgatgtctgc

SEQ ID NO: 740201 - DNA, 25 bp, Mus musculus
taatgtatagtctcctgatgtctgc

SEQ ID NO: 740202 - DNA, 25 bp, Mus musculus
taatgtatctaccagactcaatagg

SEQ ID NO: 740203 - DNA, 25 bp, Mus musculus
taatgtatctacgagactcaatagg

SEQ ID NO: 740204 - DNA, 25 bp, Mus musculus
taatgtatgataccccgggttcaaa

SEQ ID NO: 740205 - DNA, 25 bp, Mus musculus
taatgtatgatagcccgggttcaaa

SEQ ID NO: 740206 - DNA, 25 bp, Mus musculus
taatgtcaacatccgttagtgggcg

SEQ ID NO: 740207 - DNA, 25 bp, Mus musculus
taatgtcaacatgcgttagtgggcg

SEQ ID NO: 740208 - DNA, 25 bp, Mus musculus
taatgtcaagtcacctgttaagtag

SEQ ID NO: 740209 - DNA, 25 bp, Mus musculus
taatgtcaagtctcctgttaagtag

SEQ ID NO: 740210 - DNA, 25 bp, Mus musculus
taatgtcaatagaccgttcatccgt

SEQ ID NO: 740211 - DNA, 25 bp, Mus musculus
taatgtcaatagtccgttcatccgt

SEQ ID NO: 740212 - DNA, 25 bp, Mus musculus
taatgtcagatgatccagagtgcct

SEQ ID NO: 740213 - DNA, 25 bp, Mus musculus
taatgtcagatgttccagagtgcct

SEQ ID NO: 740214 - DNA, 25 bp, Mus musculus
taatgtcaggccatctgtgattttg

SEQ ID NO: 740215 - DNA, 25 bp, Mus musculus
taatgtcaggccttctgtgattttg

SEQ ID NO: 740216 - DNA, 25 bp, Mus musculus
taatgtcagggaaaccataggatcc

SEQ ID NO: 740217 - DNA, 25 bp, Mus musculus
taatgtcagggataccataggatcc

SEQ ID NO: 740218 - DNA, 25 bp, Mus musculus
taatgtcaggttctccgcgtatagg

SEQ ID NO: 740219 - DNA, 25 bp, Mus musculus
taatgtcaggttgtccgcgtatagg

SEQ ID NO: 740220 - DNA, 25 bp, Mus musculus
taatgtccacctcgtcaagctcctg

SEQ ID NO: 740221 - DNA, 25 bp, Mus musculus
taatgtccacctggtcaagctcctg

SEQ ID NO: 740222 - DNA, 25 bp, Mus musculus
taatgtccatggcatgggagaatca

SEQ ID NO: 740223 - DNA, 25 bp, Mus musculus
taatgtccatgggatgggagaatca

SEQ ID NO: 740224 - DNA, 25 bp, Mus musculus
taatgtccgagcagaagattatgag

SEQ ID NO: 740225 - DNA, 25 bp, Mus musculus
taatgtccgagctgaagattatgag

SEQ ID NO: 740226 - DNA, 25 bp, Mus musculus
taatgtcctggacgttcataatgga

SEQ ID NO: 740227 - DNA, 25 bp, Mus musculus
taatgtcctggaggttcataatgga

SEQ ID NO: 740228 - DNA, 25 bp, Mus musculus
taatgtcgggccacagccatctgat

SEQ ID NO: 740229 - DNA, 25 bp, Mus musculus
taatgtcgggcctcagccatctgat

SEQ ID NO: 740230 - DNA, 25 bp, Mus musculus
taatgtgaaagcaagtcctaagaga

SEQ ID NO: 740231 - DNA, 25 bp, Mus musculus
taatgtgaaagctagtcctaagaga

SEQ ID NO: 740232 - DNA, 25 bp, Mus musculus
taatgtgacagcaacagccatgatg

SEQ ID NO: 740233 - DNA, 25 bp, Mus musculus
taatgtgacagctacagccatgatg

SEQ ID NO: 740234 - DNA, 25 bp, Mus musculus
taatgtgagaccacactcaccggct

SEQ ID NO: 740235 - DNA, 25 bp, Mus musculus
taatgtgagacctcactcaccggct

SEQ ID NO: 740236 - DNA, 25 bp, Mus musculus
taatgtgagcttctcagatactgtc

SEQ ID NO: 740237 - DNA, 25 bp, Mus musculus
taatgtgagcttgtcagatactgtc

SEQ ID NO: 740238 - DNA, 25 bp, Mus musculus
taatgtgaggaaatgcagacatgag

SEQ ID NO: 740239 - DNA, 25 bp, Mus musculus
taatgtgaggaattgcagacatgag

SEQ ID NO: 740240 - DNA, 25 bp, Mus musculus
taatgtgcaagaaagggaagcacag

SEQ ID NO: 740241 - DNA, 25 bp, Mus musculus
taatgtgcaagatagggaagcacag

SEQ ID NO: 740242 - DNA, 25 bp, Mus musculus
taatgtgcagggacaaagtccctca

SEQ ID NO: 740243 - DNA, 25 bp, Mus musculus
taatgtgcagggtcaaagtccctca

SEQ ID NO: 740244 - DNA, 25 bp, Mus musculus
taatgtgctctcaggacagactcag

SEQ ID NO: 740245 - DNA, 25 bp, Mus musculus
taatgtgctctctggacagactcag

SEQ ID NO: 740246 - DNA, 25 bp, Mus musculus
taatgtgctgacattcctatgatgt

SEQ ID NO: 740247 - DNA, 25 bp, Mus musculus
taatgtgctgactttcctatgatgt

SEQ ID NO: 740248 - DNA, 25 bp, Mus musculus
taatgtgctttgagttctcaggcgc

SEQ ID NO: 740249 - DNA, 25 bp, Mus musculus
taatgtgctttgtgttctcaggcgc

SEQ ID NO: 740250 - DNA, 25 bp, Mus musculus
taatgtggacctacgagacaaccgg

SEQ ID NO: 740251 - DNA, 25 bp, Mus musculus
taatgtggaccttcgagacaaccgg

SEQ ID NO: 740252 - DNA, 25 bp, Mus musculus
taatgtggacttaactgaagaaggg

SEQ ID NO: 740253 - DNA, 25 bp, Mus musculus
taatgtggactttactgaagaaggg

SEQ ID NO: 740254 - DNA, 25 bp, Mus musculus
taatgtggagctaaggaagagtcat

SEQ ID NO: 740255 - DNA, 25 bp, Mus musculus
taatgtggagcttaggaagagtcat

SEQ ID NO: 740256 - DNA, 25 bp, Mus musculus
taatgtggataaagaataggaggcg

SEQ ID NO: 740257 - DNA, 25 bp, Mus musculus
taatgtggataatgaataggaggcg

SEQ ID NO: 740258 - DNA, 25 bp, Mus musculus
taatgtggatctatttctctggaga

SEQ ID NO: 740259 - DNA, 25 bp, Mus musculus
taatgtggatctttttctctggaga

SEQ ID NO: 740260 - DNA, 25 bp, Mus musculus
taatgtgggagaactttactttagg

SEQ ID NO: 740261 - DNA, 25 bp, Mus musculus
taatgtgggagatctttactttagg

SEQ ID NO: 740262 - DNA, 25 bp, Mus musculus
taatgtgtacccctatgccaagttt

SEQ ID NO: 740263 - DNA, 25 bp, Mus musculus
taatgtgtacccgtatgccaagttt

SEQ ID NO: 740264 - DNA, 25 bp, Mus musculus
taatgtgtgtatctgccccaccagt

SEQ ID NO: 740265 - DNA, 25 bp, Mus musculus
taatgtgtgtatgtgccccaccagt

SEQ ID NO: 740266 - DNA, 25 bp, Mus musculus
taatgttaaggaccatcagccagtg

SEQ ID NO: 740267 - DNA, 25 bp, Mus musculus
taatgttaaggagcatcagccagtg

SEQ ID NO: 740268 - DNA, 25 bp, Mus musculus
taatgttatatcaaacccgtagagc

SEQ ID NO: 740269 - DNA, 25 bp, Mus musculus
taatgttatatctaacccgtagagc

SEQ ID NO: 740270 - DNA, 25 bp, Mus musculus
taatgttcggaacaagatcttgtac

SEQ ID NO: 740271 - DNA, 25 bp, Mus musculus
taatgttcggaagaagatcttgtac

SEQ ID NO: 740272 - DNA, 25 bp, Mus musculus
taatgttgatcccagcagtgtgtgt

SEQ ID NO: 740273 - DNA, 25 bp, Mus musculus
taatgttgatccgagcagtgtgtgt

SEQ ID NO: 740274 - DNA, 25 bp, Mus musculus
taatgttggcagagtcaggcctctg

SEQ ID NO: 740275 - DNA, 25 bp, Mus musculus
taatgttggcagtgtcaggcctctg

SEQ ID NO: 740276 - DNA, 25 bp, Mus musculus
taatgttggcctacagtggtagcag

SEQ ID NO: 740277 - DNA, 25 bp, Mus musculus
taatgttggccttcagtggtagcag

SEQ ID NO: 740278 - DNA, 25 bp, Mus musculus
taatgtttacaaattgcctcaatca

SEQ ID NO: 740279 - DNA, 25 bp, Mus musculus
taatgtttacaatttgcctcaatca

SEQ ID NO: 740280 - DNA, 25 bp, Mus musculus
taatgtttagaaaactgtggacggc

SEQ ID NO: 740281 - DNA, 25 bp, Mus musculus
taatgtttagaatactgtggacggc

SEQ ID NO: 740282 - DNA, 25 bp, Mus musculus
taatgtttcacaagctccaatcggt

SEQ ID NO: 740283 - DNA, 25 bp, Mus musculus
taatgtttcacatgctccaatcggt

SEQ ID NO: 740284 - DNA, 25 bp, Mus musculus
taatgtttccctccaagatcacttc

SEQ ID NO: 740285 - DNA, 25 bp, Mus musculus
taatgtttccctgcaagatcacttc

SEQ ID NO: 740286 - DNA, 25 bp, Mus musculus
taatgtttctctcatgcatgcaagt

SEQ ID NO: 740287 - DNA, 25 bp, Mus musculus
taatgtttctctgatgcatgcaagt

SEQ ID NO: 740288 - DNA, 25 bp, Mus musculus
taattaactcccaccacaccaaagg

SEQ ID NO: 740289 - DNA, 25 bp, Mus musculus
taattaactccctccacaccaaagg

SEQ ID NO: 740290 - DNA, 25 bp, Mus musculus
taattaaggacgacccactttgcca

SEQ ID NO: 740291 - DNA, 25 bp, Mus musculus
taattaaggacgtcccactttgcca

SEQ ID NO: 740292 - DNA, 25 bp, Mus musculus
taattacatcgcagctttgagggct

SEQ ID NO: 740293 - DNA, 25 bp, Mus musculus
taattacatcgctgctttgagggct

SEQ ID NO: 740294 - DNA, 25 bp, Mus musculus
taattacctgtacacctacaaaatg

SEQ ID NO: 740295 - DNA, 25 bp, Mus musculus
taattacctgtagacctacaaaatg

SEQ ID NO: 740296 - DNA, 25 bp, Mus musculus
taattactaccactacaggccatct

SEQ ID NO: 740297 - DNA, 25 bp, Mus musculus
taattactaccagtacaggccatct

SEQ ID NO: 740298 - DNA, 25 bp, Mus musculus
taattactatacaaatatgcccctg

SEQ ID NO: 740299 - DNA, 25 bp, Mus musculus
taattactatactaatatgcccctg

SEQ ID NO: 740300 - DNA, 25 bp, Mus musculus
taattagatagtaaggagcccttcc

SEQ ID NO: 740301 - DNA, 25 bp, Mus musculus
taattagatagttaggagcccttcc

SEQ ID NO: 740302 - DNA, 25 bp, Mus musculus
taattagcctagagtggtggcacac

SEQ ID NO: 740303 - DNA, 25 bp, Mus musculus
taattagcctagtgtggtggcacac

SEQ ID NO: 740304 - DNA, 25 bp, Mus musculus
taattagggaaacaaacatgcgcac

SEQ ID NO: 740305 - DNA, 25 bp, Mus musculus
taattagggaaagaaacatgcgcac

SEQ ID NO: 740306 - DNA, 25 bp, Mus musculus
taattagtcgtcaccctggaattct

SEQ ID NO: 740307 - DNA, 25 bp, Mus musculus
taattagtcgtctccctggaattct

SEQ ID NO: 740308 - DNA, 25 bp, Mus musculus
taattagtgttaacctctgaatcca

SEQ ID NO: 740309 - DNA, 25 bp, Mus musculus
taattagtgttatcctctgaatcca

SEQ ID NO: 740310 - DNA, 25 bp, Mus musculus
taattatcaactacacccagctgtg

SEQ ID NO: 740311 - DNA, 25 bp, Mus musculus
taattatcaacttcacccagctgtg

SEQ ID NO: 740312 - DNA, 25 bp, Mus musculus
taattatgacatctgccaaagttgc

SEQ ID NO: 740313 - DNA, 25 bp, Mus musculus
taattatgacatgtgccaaagttgc

SEQ ID NO: 740314 - DNA, 25 bp, Mus musculus
taattatgtccaacgactggttgca

SEQ ID NO: 740315 - DNA, 25 bp, Mus musculus
taattatgtccatcgactggttgca

SEQ ID NO: 740316 - DNA, 25 bp, Mus musculus
taattatgtctcagagtggcagctg

SEQ ID NO: 740317 - DNA, 25 bp, Mus musculus
taattatgtctctgagtggcagctg

SEQ ID NO: 740318 - DNA, 25 bp, Mus musculus
taattatttcgtacggaagcaccgg

SEQ ID NO: 740319 - DNA, 25 bp, Mus musculus
taattatttcgttcggaagcaccgg

SEQ ID NO: 740320 - DNA, 25 bp, Mus musculus
taattatttgggatagctatacgac

SEQ ID NO: 740321 - DNA, 25 bp, Mus musculus
taattatttgggttagctatacgac

SEQ ID NO: 740322 - DNA, 25 bp, Mus musculus
taattcaagaaaagtgccagaggtg

SEQ ID NO: 740323 - DNA, 25 bp, Mus musculus
taattcaagaaatgtgccagaggtg

SEQ ID NO: 740324 - DNA, 25 bp, Mus musculus
taattcagctcaccaaacaaatgcc

SEQ ID NO: 740325 - DNA, 25 bp, Mus musculus
taattcagctcagcaaacaaatgcc

SEQ ID NO: 740326 - DNA, 25 bp, Mus musculus
taattcaggtgtagaatggaaaaac

SEQ ID NO: 740327 - DNA, 25 bp, Mus musculus
taattcaggtgttgaatggaaaaac

SEQ ID NO: 740328 - DNA, 25 bp, Mus musculus
taattccaactaagaagaaggagac

SEQ ID NO: 740329 - DNA, 25 bp, Mus musculus
taattccaactatgaagaaggagac

SEQ ID NO: 740330 - DNA, 25 bp, Mus musculus
taattccaacttctgactgccaaga

SEQ ID NO: 740331 - DNA, 25 bp, Mus musculus
taattccaacttgtgactgccaaga

SEQ ID NO: 740332 - DNA, 25 bp, Mus musculus
taattccaatcaacttacaaaactg

SEQ ID NO: 740333 - DNA, 25 bp, Mus musculus
taattccaatcatcttacaaaactg

SEQ ID NO: 740334 - DNA, 25 bp, Mus musculus
taattccaatctaactgctgtaagc

SEQ ID NO: 740335 - DNA, 25 bp, Mus musculus
taattccaatcttactgctgtaagc

SEQ ID NO: 740336 - DNA, 25 bp, Mus musculus
taattcccaactccatgtgtgtgcg

SEQ ID NO: 740337 - DNA, 25 bp, Mus musculus
taattcccaactgcatgtgtgtgcg

SEQ ID NO: 740338 - DNA, 25 bp, Mus musculus
taattcccatagagaacgggcagat

SEQ ID NO: 740339 - DNA, 25 bp, Mus musculus
taattcccatagtgaacgggcagat

SEQ ID NO: 740340 - DNA, 25 bp, Mus musculus
taattccgacatcatccctacagac

SEQ ID NO: 740341 - DNA, 25 bp, Mus musculus
taattccgacatgatccctacagac

SEQ ID NO: 740342 - DNA, 25 bp, Mus musculus
taattccgtgacaacatgtgtgctg

SEQ ID NO: 740343 - DNA, 25 bp, Mus musculus
taattccgtgactacatgtgtgctg

SEQ ID NO: 740344 - DNA, 25 bp, Mus musculus
taattcctgcccctaggtgcttggg

SEQ ID NO: 740345 - DNA, 25 bp, Mus musculus
taattcctgcccgtaggtgcttggg

SEQ ID NO: 740346 - DNA, 25 bp, Mus musculus
taattcgcttagcagaagcccatgc

SEQ ID NO: 740347 - DNA, 25 bp, Mus musculus
taattcgcttaggagaagcccatgc

SEQ ID NO: 740348 - DNA, 25 bp, Mus musculus
taattctatcggcatatcctttcac

SEQ ID NO: 740349 - DNA, 25 bp, Mus musculus
taattctatcgggatatcctttcac

SEQ ID NO: 740350 - DNA, 25 bp, Mus musculus
taattctatggacctagctgtagct

SEQ ID NO: 740351 - DNA, 25 bp, Mus musculus
taattctatggagctagctgtagct

SEQ ID NO: 740352 - DNA, 25 bp, Mus musculus
taattctccttcagccctcatctgg

SEQ ID NO: 740353 - DNA, 25 bp, Mus musculus
taattctccttctgccctcatctgg

SEQ ID NO: 740354 - DNA, 25 bp, Mus musculus
taattctcgcctcgaccctataaat

SEQ ID NO: 740355 - DNA, 25 bp, Mus musculus
taattctcgcctggaccctataaat

SEQ ID NO: 740356 - DNA, 25 bp, Mus musculus
taattctcggtaatctaacagtgct

SEQ ID NO: 740357 - DNA, 25 bp, Mus musculus
taattctcggtattctaacagtgct

SEQ ID NO: 740358 - DNA, 25 bp, Mus musculus
taattctgaaggacttctcctggaa

SEQ ID NO: 740359 - DNA, 25 bp, Mus musculus
taattctgaaggtcttctcctggaa

SEQ ID NO: 740360 - DNA, 25 bp, Mus musculus
taattctgaagtagcttgaactggg

SEQ ID NO: 740361 - DNA, 25 bp, Mus musculus
taattctgaagttgcttgaactggg

SEQ ID NO: 740362 - DNA, 25 bp, Mus musculus
taattctgacttccgagagcctgcc

SEQ ID NO: 740363 - DNA, 25 bp, Mus musculus
taattctgacttgcgagagcctgcc

SEQ ID NO: 740364 - DNA, 25 bp, Mus musculus
taattctgcataactacacctcccg

SEQ ID NO: 740365 - DNA, 25 bp, Mus musculus
taattctgcatatctacacctcccg

SEQ ID NO: 740366 - DNA, 25 bp, Mus musculus
taattctgctctaggtcatgtgaac

SEQ ID NO: 740367 - DNA, 25 bp, Mus musculus
taattctgctcttggtcatgtgaac

SEQ ID NO: 740368 - DNA, 25 bp, Mus musculus
taattctggcttataagaggccata

SEQ ID NO: 740369 - DNA, 25 bp, Mus musculus
taattctggcttttaagaggccata

SEQ ID NO: 740370 - DNA, 25 bp, Mus musculus
taattcttacttcaaaggagcccca

SEQ ID NO: 740371 - DNA, 25 bp, Mus musculus
taattcttacttgaaaggagcccca

SEQ ID NO: 740372 - DNA, 25 bp, Mus musculus
taattcttgatccaaggaggccttg

SEQ ID NO: 740373 - DNA, 25 bp, Mus musculus
taattcttgatcgaaggaggccttg

SEQ ID NO: 740374 - DNA, 25 bp, Mus musculus
taattcttgcttataggaggtccag

SEQ ID NO: 740375 - DNA, 25 bp, Mus musculus
taattcttgcttttaggaggtccag

SEQ ID NO: 740376 - DNA, 25 bp, Mus musculus
taattctttaaaaatccacgcggag

SEQ ID NO: 740377 - DNA, 25 bp, Mus musculus
taattctttaaatatccacgcggag

SEQ ID NO: 740378 - DNA, 25 bp, Mus musculus
taattctttgaactcgatctgtcct

SEQ ID NO: 740379 - DNA, 25 bp, Mus musculus
taattctttgaagtcgatctgtcct

SEQ ID NO: 740380 - DNA, 25 bp, Mus musculus
taattctttgtgctgtttgtgcatc

SEQ ID NO: 740381 - DNA, 25 bp, Mus musculus
taattctttgtggtgtttgtgcatc

SEQ ID NO: 740382 - DNA, 25 bp, Mus musculus
taattgaacactcagaagatccagc

SEQ ID NO: 740383 - DNA, 25 bp, Mus musculus
taattgaacactgagaagatccagc

SEQ ID NO: 740384 - DNA, 25 bp, Mus musculus
taattgaatcatatgagaagccctt

SEQ ID NO: 740385 - DNA, 25 bp, Mus musculus
taattgaatcatttgagaagccctt

SEQ ID NO: 740386 - DNA, 25 bp, Mus musculus
taattgaattagctttgagaggaag

SEQ ID NO: 740387 - DNA, 25 bp, Mus musculus
taattgaattaggtttgagaggaag

SEQ ID NO: 740388 - DNA, 25 bp, Mus musculus
taattgacaaaactcagttgaatcc

SEQ ID NO: 740389 - DNA, 25 bp, Mus musculus
taattgacaaaagtcagttgaatcc

SEQ ID NO: 740390 - DNA, 25 bp, Mus musculus
taattgacaatcaggctgctggcct

SEQ ID NO: 740391 - DNA, 25 bp, Mus musculus
taattgacaatctggctgctggcct

SEQ ID NO: 740392 - DNA, 25 bp, Mus musculus
taattgacactgctaaaacaatgca

SEQ ID NO: 740393 - DNA, 25 bp, Mus musculus
taattgacactggtaaaacaatgca

SEQ ID NO: 740394 - DNA, 25 bp, Mus musculus
taattgacgaaacctcccagactgg

SEQ ID NO: 740395 - DNA, 25 bp, Mus musculus
taattgacgaaagctcccagactgg

SEQ ID NO: 740396 - DNA, 25 bp, Mus musculus
taattgactcaacgcaaacaagtga

SEQ ID NO: 740397 - DNA, 25 bp, Mus musculus
taattgactcaaggcaaacaagtga

SEQ ID NO: 740398 - DNA, 25 bp, Mus musculus
taattgagactacagcccaggcctg

SEQ ID NO: 740399 - DNA, 25 bp, Mus musculus
taattgagactagagcccaggcctg

SEQ ID NO: 740400 - DNA, 25 bp, Mus musculus
taattgagcaaacagcttgtcacca

SEQ ID NO: 740401 - DNA, 25 bp, Mus musculus
taattgagcaaagagcttgtcacca

SEQ ID NO: 740402 - DNA, 25 bp, Mus musculus
taattgagcacgactcgacctggga

SEQ ID NO: 740403 - DNA, 25 bp, Mus musculus
taattgagcacgtctcgacctggga

SEQ ID NO: 740404 - DNA, 25 bp, Mus musculus
taattgatgcttatatggtggccca

SEQ ID NO: 740405 - DNA, 25 bp, Mus musculus
taattgatgcttttatggtggccca

SEQ ID NO: 740406 - DNA, 25 bp, Mus musculus
taattgatgggtcacacaaggtcac

SEQ ID NO: 740407 - DNA, 25 bp, Mus musculus
taattgatgggtgacacaaggtcac

SEQ ID NO: 740408 - DNA, 25 bp, Mus musculus
taattgcaaccacagttctacagca

SEQ ID NO: 740409 - DNA, 25 bp, Mus musculus
taattgcaaccagagttctacagca

SEQ ID NO: 740410 - DNA, 25 bp, Mus musculus
taattgcacaggactgcgggccgcg

SEQ ID NO: 740411 - DNA, 25 bp, Mus musculus
taattgcacaggtctgcgggccgcg

SEQ ID NO: 740412 - DNA, 25 bp, Mus musculus
taattgcagagcattgggatgccgg

SEQ ID NO: 740413 - DNA, 25 bp, Mus musculus
taattgcagagctttgggatgccgg

SEQ ID NO: 740414 - DNA, 25 bp, Mus musculus
taattgcagcgaacctttctcctac

SEQ ID NO: 740415 - DNA, 25 bp, Mus musculus
taattgcagcgatcctttctcctac

SEQ ID NO: 740416 - DNA, 25 bp, Mus musculus
taattgccagataggtctctgggca

SEQ ID NO: 740417 - DNA, 25 bp, Mus musculus
taattgccagattggtctctgggca

SEQ ID NO: 740418 - DNA, 25 bp, Mus musculus
taattgcccagaaacagcaaagagc

SEQ ID NO: 740419 - DNA, 25 bp, Mus musculus
taattgcccagatacagcaaagagc

SEQ ID NO: 740420 - DNA, 25 bp, Mus musculus
taattgccgcttaggtgatccggaa

SEQ ID NO: 740421 - DNA, 25 bp, Mus musculus
taattgccgctttggtgatccggaa

SEQ ID NO: 740422 - DNA, 25 bp, Mus musculus
taattgcctcttctcagagttcagg

SEQ ID NO: 740423 - DNA, 25 bp, Mus musculus
taattgcctcttgtcagagttcagg

SEQ ID NO: 740424 - DNA, 25 bp, Mus musculus
taattgcctggaactggtaaacaga

SEQ ID NO: 740425 - DNA, 25 bp, Mus musculus
taattgcctggatctggtaaacaga

SEQ ID NO: 740426 - DNA, 25 bp, Mus musculus
taattgccttacaggctggctgacg

SEQ ID NO: 740427 - DNA, 25 bp, Mus musculus
taattgccttactggctggctgacg

SEQ ID NO: 740428 - DNA, 25 bp, Mus musculus
taattgccttatctatttggacctt

SEQ ID NO: 740429 - DNA, 25 bp, Mus musculus
taattgccttatgtatttggacctt

SEQ ID NO: 740430 - DNA, 25 bp, Mus musculus
taattgcggctaacaattcaggcac

SEQ ID NO: 740431 - DNA, 25 bp, Mus musculus
taattgcggctatcaattcaggcac

SEQ ID NO: 740432 - DNA, 25 bp, Mus musculus
taattgctacagactattgaagact

SEQ ID NO: 740433 - DNA, 25 bp, Mus musculus
taattgctacagtctattgaagact

SEQ ID NO: 740434 - DNA, 25 bp, Mus musculus
taattgctatgacgatggaagactc

SEQ ID NO: 740435 - DNA, 25 bp, Mus musculus
taattgctatgaggatggaagactc

SEQ ID NO: 740436 - DNA, 25 bp, Mus musculus
taattgctgcgtcccttgctttggc

SEQ ID NO: 740437 - DNA, 25 bp, Mus musculus
taattgctgcgtgccttgctttggc

SEQ ID NO: 740438 - DNA, 25 bp, Mus musculus
taattgctggctataatcgccttcg

SEQ ID NO: 740439 - DNA, 25 bp, Mus musculus
taattgctggctttaatcgccttcg

SEQ ID NO: 740440 - DNA, 25 bp, Mus musculus
taattggaccggactgggatccgat

SEQ ID NO: 740441 - DNA, 25 bp, Mus musculus
taattggaccggtctgggatccgat

SEQ ID NO: 740442 - DNA, 25 bp, Mus musculus
taattggagaaaaatatcacacact

SEQ ID NO: 740443 - DNA, 25 bp, Mus musculus
taattggagaaatatatcacacact

SEQ ID NO: 740444 - DNA, 25 bp, Mus musculus
taattggagaatctgggctttctca

SEQ ID NO: 740445 - DNA, 25 bp, Mus musculus
taattggagaatgtgggctttctca

SEQ ID NO: 740446 - DNA, 25 bp, Mus musculus
taattggagaccaggagccctgggc

SEQ ID NO: 740447 - DNA, 25 bp, Mus musculus
taattggagacctggagccctgggc

SEQ ID NO: 740448 - DNA, 25 bp, Mus musculus
taattggattggagatgcatcctgc

SEQ ID NO: 740449 - DNA, 25 bp, Mus musculus
taattggattggtgatgcatcctgc

SEQ ID NO: 740450 - DNA, 25 bp, Mus musculus
taattggctatgctaatgccctggg

SEQ ID NO: 740451 - DNA, 25 bp, Mus musculus
taattggctatggtaatgccctggg

SEQ ID NO: 740452 - DNA, 25 bp, Mus musculus
taattggcttgaactgtcattccgc

SEQ ID NO: 740453 - DNA, 25 bp, Mus musculus
taattggcttgatctgtcattccgc

SEQ ID NO: 740454 - DNA, 25 bp, Mus musculus
taattgggcacgaaggtcctggaag

SEQ ID NO: 740455 - DNA, 25 bp, Mus musculus
taattgggcacgtaggtcctggaag

SEQ ID NO: 740456 - DNA, 25 bp, Mus musculus
taattgggtaagaacttggactaag

SEQ ID NO: 740457 - DNA, 25 bp, Mus musculus
taattgggtaagtacttggactaag

SEQ ID NO: 740458 - DNA, 25 bp, Mus musculus
taattggtactcatggcggtgagac

SEQ ID NO: 740459 - DNA, 25 bp, Mus musculus
taattggtactcttggcggtgagac

SEQ ID NO: 740460 - DNA, 25 bp, Mus musculus
taattggtcaaaatacggtttgaag

SEQ ID NO: 740461 - DNA, 25 bp, Mus musculus
taattggtcaaattacggtttgaag

SEQ ID NO: 740462 - DNA, 25 bp, Mus musculus
taattggtcataatgtgggaagcgc

SEQ ID NO: 740463 - DNA, 25 bp, Mus musculus
taattggtcatattgtgggaagcgc

SEQ ID NO: 740464 - DNA, 25 bp, Mus musculus
taattggtcctgagtggcgtctggt

SEQ ID NO: 740465 - DNA, 25 bp, Mus musculus
taattggtcctgtgtggcgtctggt

SEQ ID NO: 740466 - DNA, 25 bp, Mus musculus
taattggtggatatatttacctgga

SEQ ID NO: 740467 - DNA, 25 bp, Mus musculus
taattggtggatttatttacctgga

SEQ ID NO: 740468 - DNA, 25 bp, Mus musculus
taattggtgggccacaacccttctg

SEQ ID NO: 740469 - DNA, 25 bp, Mus musculus
taattggtgggcgacaacccttctg

SEQ ID NO: 740470 - DNA, 25 bp, Mus musculus
taattggtgtttcgcttgtgtagga

SEQ ID NO: 740471 - DNA, 25 bp, Mus musculus
taattggtgtttggcttgtgtagga

SEQ ID NO: 740472 - DNA, 25 bp, Mus musculus
taattgtcctttaaggatgcggcct

SEQ ID NO: 740473 - DNA, 25 bp, Mus musculus
taattgtccttttaggatgcggcct

SEQ ID NO: 740474 - DNA, 25 bp, Mus musculus
taattgtcttctctatctgaagaag

SEQ ID NO: 740475 - DNA, 25 bp, Mus musculus
taattgtcttctgtatctgaagaag

SEQ ID NO: 740476 - DNA, 25 bp, Mus musculus
taattgtgctggatagtttcatgtc

SEQ ID NO: 740477 - DNA, 25 bp, Mus musculus
taattgtgctggttagtttcatgtc

SEQ ID NO: 740478 - DNA, 25 bp, Mus musculus
taattgtggccgacataggaagaag

SEQ ID NO: 740479 - DNA, 25 bp, Mus musculus
taattgtggccgtcataggaagaag

SEQ ID NO: 740480 - DNA, 25 bp, Mus musculus
taattgtggttgctttgacaggcct

SEQ ID NO: 740481 - DNA, 25 bp, Mus musculus
taattgtggttggtttgacaggcct

SEQ ID NO: 740482 - DNA, 25 bp, Mus musculus
taattgtggtttaggagcagctcat

SEQ ID NO: 740483 - DNA, 25 bp, Mus musculus
taattgtggttttggagcagctcat

SEQ ID NO: 740484 - DNA, 25 bp, Mus musculus
taattgttcccaagagagcatctgt

SEQ ID NO: 740485 - DNA, 25 bp, Mus musculus
taattgttcccatgagagcatctgt

SEQ ID NO: 740486 - DNA, 25 bp, Mus musculus
taattgttgcgaccatcagttttgg

SEQ ID NO: 740487 - DNA, 25 bp, Mus musculus
taattgttgcgagcatcagttttgg

SEQ ID NO: 740488 - DNA, 25 bp, Mus musculus
taattgttgtcacttagtcgtagcc

SEQ ID NO: 740489 - DNA, 25 bp, Mus musculus
taattgttgtcagttagtcgtagcc

SEQ ID NO: 740490 - DNA, 25 bp, Mus musculus
taatttaaacaaatcaccagaggaa

SEQ ID NO: 740491 - DNA, 25 bp, Mus musculus
taatttaaacaattcaccagaggaa

SEQ ID NO: 740492 - DNA, 25 bp, Mus musculus
taatttaccgttcgaagactggatg

SEQ ID NO: 740493 - DNA, 25 bp, Mus musculus
taatttaccgttggaagactggatg

SEQ ID NO: 740494 - DNA, 25 bp, Mus musculus
taatttactaagagccctagagacc

SEQ ID NO: 740495 - DNA, 25 bp, Mus musculus
taatttactaagtgccctagagacc

SEQ ID NO: 740496 - DNA, 25 bp, Mus musculus
taatttagtgtgatccacccgcctg

SEQ ID NO: 740497 - DNA, 25 bp, Mus musculus
taatttagtgtgttccacccgcctg

SEQ ID NO: 740498 - DNA, 25 bp, Mus musculus
taatttattatccaaacaaaggcac

SEQ ID NO: 740499 - DNA, 25 bp, Mus musculus
taatttattatcgaaacaaaggcac

SEQ ID NO: 740500 - DNA, 25 bp, Mus musculus
taatttcaataaaagggtcaggagg

SEQ ID NO: 740501 - DNA, 25 bp, Mus musculus
taatttcaataatagggtcaggagg

SEQ ID NO: 740502 - DNA, 25 bp, Mus musculus
taatttcactgtatttccaaggaag

SEQ ID NO: 740503 - DNA, 25 bp, Mus musculus
taatttcactgtttttccaaggaag

SEQ ID NO: 740504 - DNA, 25 bp, Mus musculus
taatttcagactcggtcgcttgccc

SEQ ID NO: 740505 - DNA, 25 bp, Mus musculus
taatttcagactgggtcgcttgccc

SEQ ID NO: 740506 - DNA, 25 bp, Mus musculus
taatttccatggaacttccaagccc

SEQ ID NO: 740507 - DNA, 25 bp, Mus musculus
taatttccatggtacttccaagccc

SEQ ID NO: 740508 - DNA, 25 bp, Mus musculus
taatttcccacaataattggcggga

SEQ ID NO: 740509 - DNA, 25 bp, Mus musculus
taatttcccacattaattggcggga

SEQ ID NO: 740510 - DNA, 25 bp, Mus musculus
taatttcgcagccattttagagcag

SEQ ID NO: 740511 - DNA, 25 bp, Mus musculus
taatttcgcagcgattttagagcag

SEQ ID NO: 740512 - DNA, 25 bp, Mus musculus
taatttcgggatcctatgtgtcggc

SEQ ID NO: 740513 - DNA, 25 bp, Mus musculus
taatttcgggatgctatgtgtcggc

SEQ ID NO: 740514 - DNA, 25 bp, Mus musculus
taatttctccatactaaacaagcac

SEQ ID NO: 740515 - DNA, 25 bp, Mus musculus
taatttctccattctaaacaagcac

SEQ ID NO: 740516 - DNA, 25 bp, Mus musculus
taatttctcctgattccatgcctcg

SEQ ID NO: 740517 - DNA, 25 bp, Mus musculus
taatttctcctgtttccatgcctcg

SEQ ID NO: 740518 - DNA, 25 bp, Mus musculus
taatttctctatcccaaaagccaac

SEQ ID NO: 740519 - DNA, 25 bp, Mus musculus
taatttctctatgccaaaagccaac

SEQ ID NO: 740520 - DNA, 25 bp, Mus musculus
taatttgaaattaagggcagcagca

SEQ ID NO: 740521 - DNA, 25 bp, Mus musculus
taatttgaaatttagggcagcagca

SEQ ID NO: 740522 - DNA, 25 bp, Mus musculus
taatttgcgtttcacccaatagggc

SEQ ID NO: 740523 - DNA, 25 bp, Mus musculus
taatttgcgtttgacccaatagggc

SEQ ID NO: 740524 - DNA, 25 bp, Mus musculus
taatttggaagcctgtgtgtgcaca

SEQ ID NO: 740525 - DNA, 25 bp, Mus musculus
taatttggaagcgtgtgtgtgcaca

SEQ ID NO: 740526 - DNA, 25 bp, Mus musculus
taatttggaccaaaaggacaagcag

SEQ ID NO: 740527 - DNA, 25 bp, Mus musculus
taatttggaccataaggacaagcag

SEQ ID NO: 740528 - DNA, 25 bp, Mus musculus
taatttggcactcaagagagcggag

SEQ ID NO: 740529 - DNA, 25 bp, Mus musculus
taatttggcactgaagagagcggag

SEQ ID NO: 740530 - DNA, 25 bp, Mus musculus
taatttgggcttcccttatgaagag

SEQ ID NO: 740531 - DNA, 25 bp, Mus musculus
taatttgggcttgccttatgaagag

SEQ ID NO: 740532 - DNA, 25 bp, Mus musculus
taatttgtttcacaagtggaactac

SEQ ID NO: 740533 - DNA, 25 bp, Mus musculus
taatttgtttcagaagtggaactac

SEQ ID NO: 740534 - DNA, 25 bp, Mus musculus
taattttaaagaccaatcccagtgt

SEQ ID NO: 740535 - DNA, 25 bp, Mus musculus
taattttaaagagcaatcccagtgt

SEQ ID NO: 740536 - DNA, 25 bp, Mus musculus
taattttagaaaagatgctaatgac

SEQ ID NO: 740537 - DNA, 25 bp, Mus musculus
taattttagaaatgatgctaatgac

SEQ ID NO: 740538 - DNA, 25 bp, Mus musculus
taattttagttgagtgcagagggct

SEQ ID NO: 740539 - DNA, 25 bp, Mus musculus
taattttagttgtgtgcagagggct

SEQ ID NO: 740540 - DNA, 25 bp, Mus musculus
taattttcaagacccagattcaagc

SEQ ID NO: 740541 - DNA, 25 bp, Mus musculus
taattttcaagagccagattcaagc

SEQ ID NO: 740542 - DNA, 25 bp, Mus musculus
taattttcattgacaccctgaccgg

SEQ ID NO: 740543 - DNA, 25 bp, Mus musculus
taattttcattgtcaccctgaccgg

SEQ ID NO: 740544 - DNA, 25 bp, Mus musculus
taattttccatgcactttggaggct

SEQ ID NO: 740545 - DNA, 25 bp, Mus musculus
taattttccatgctatgcctcagga

SEQ ID NO: 740546 - DNA, 25 bp, Mus musculus
taattttccatggactttggaggct

SEQ ID NO: 740547 - DNA, 25 bp, Mus musculus
taattttccatggtatgcctcagga

SEQ ID NO: 740548 - DNA, 25 bp, Mus musculus
taattttcccagagagtgctggaga

SEQ ID NO: 740549 - DNA, 25 bp, Mus musculus
taattttcccagtgagtgctggaga

SEQ ID NO: 740550 - DNA, 25 bp, Mus musculus
taattttcctgaaggttagcccgag

SEQ ID NO: 740551 - DNA, 25 bp, Mus musculus
taattttcctgatggttagcccgag

SEQ ID NO: 740552 - DNA, 25 bp, Mus musculus
taattttctctgacatccttgttgt

SEQ ID NO: 740553 - DNA, 25 bp, Mus musculus
taattttctctgtcatccttgttgt

SEQ ID NO: 740554 - DNA, 25 bp, Mus musculus
taattttgaaaaagcatctcagaca

SEQ ID NO: 740555 - DNA, 25 bp, Mus musculus
taattttgaaaatgcatctcagaca

SEQ ID NO: 740556 - DNA, 25 bp, Mus musculus
taattttgccgtcttacaacttgct

SEQ ID NO: 740557 - DNA, 25 bp, Mus musculus
taattttgccgtgttacaacttgct

SEQ ID NO: 740558 - DNA, 25 bp, Mus musculus
taattttgggtaagccagggctact

SEQ ID NO: 740559 - DNA, 25 bp, Mus musculus
taattttgggtatgccagggctact

SEQ ID NO: 740560 - DNA, 25 bp, Mus musculus
taatttttagcgatgatctggagca

SEQ ID NO: 740561 - DNA, 25 bp, Mus musculus
taatttttagcgttgatctggagca

SEQ ID NO: 740562 - DNA, 25 bp, Mus musculus
taatttttggcaagattaggtagcc

SEQ ID NO: 740563 - DNA, 25 bp, Mus musculus
taatttttggcatgattaggtagcc

SEQ ID NO: 740564 - DNA, 25 bp, Mus musculus
tacaaaaacaagatgatggtgtgcc

SEQ ID NO: 740565 - DNA, 25 bp, Mus musculus
tacaaaaacaagttgatggtgtgcc

SEQ ID NO: 740566 - DNA, 25 bp, Mus musculus
tacaaaaagcccaaactgctctact

SEQ ID NO: 740567 - DNA, 25 bp, Mus musculus
tacaaaaagccctaactgctctact

SEQ ID NO: 740568 - DNA, 25 bp, Mus musculus
tacaaaaagtatcccgacatgaaat

SEQ ID NO: 740569 - DNA, 25 bp, Mus musculus
tacaaaaagtatgccgacatgaaat

SEQ ID NO: 740570 - DNA, 25 bp, Mus musculus
tacaaaacaaaaagtgcaatcgcag

SEQ ID NO: 740571 - DNA, 25 bp, Mus musculus
tacaaaacaaaatgtgcaatcgcag

SEQ ID NO: 740572 - DNA, 25 bp, Mus musculus
tacaaaacagacattacacaagcag

SEQ ID NO: 740573 - DNA, 25 bp, Mus musculus
tacaaaacagactttacacaagcag

SEQ ID NO: 740574 - DNA, 25 bp, Mus musculus
tacaaaacatcgctgggcgacaact

SEQ ID NO: 740575 - DNA, 25 bp, Mus musculus
tacaaaacatcggtgggcgacaact

SEQ ID NO: 740576 - DNA, 25 bp, Mus musculus
tacaaaaccctacagcctgttaagc

SEQ ID NO: 740577 - DNA, 25 bp, Mus musculus
tacaaaaccctagagcctgttaagc

SEQ ID NO: 740578 - DNA, 25 bp, Mus musculus
tacaaaaccggacgactggacctgc

SEQ ID NO: 740579 - DNA, 25 bp, Mus musculus
tacaaaaccggaggactggacctgc

SEQ ID NO: 740580 - DNA, 25 bp, Mus musculus
tacaaaacgaagattgtttgtgcgg

SEQ ID NO: 740581 - DNA, 25 bp, Mus musculus
tacaaaacgaagtttgtttgtgcgg

SEQ ID NO: 740582 - DNA, 25 bp, Mus musculus
tacaaaactcacaccgacagcatca

SEQ ID NO: 740583 - DNA, 25 bp, Mus musculus
tacaaaactcactccgacagcatca

SEQ ID NO: 740584 - DNA, 25 bp, Mus musculus
tacaaaactgttaccgaaatgcaga

SEQ ID NO: 740585 - DNA, 25 bp, Mus musculus
tacaaaactgtttccgaaatgcaga

SEQ ID NO: 740586 - DNA, 25 bp, Mus musculus
tacaaaagacttcttccacctttgt

SEQ ID NO: 740587 - DNA, 25 bp, Mus musculus
tacaaaagacttgttccacctttgt

SEQ ID NO: 740588 - DNA, 25 bp, Mus musculus
tacaaaagagccaagtgcctgctgc

SEQ ID NO: 740589 - DNA, 25 bp, Mus musculus
tacaaaagagcctagtgcctgctgc

SEQ ID NO: 740590 - DNA, 25 bp, Mus musculus
tacaaaagagcgatgatgccggctg

SEQ ID NO: 740591 - DNA, 25 bp, Mus musculus
tacaaaagagcgttgatgccggctg

SEQ ID NO: 740592 - DNA, 25 bp, Mus musculus
tacaaaaggaggcacggcctcatgc

SEQ ID NO: 740593 - DNA, 25 bp, Mus musculus
tacaaaaggagggacggcctcatgc

SEQ ID NO: 740594 - DNA, 25 bp, Mus musculus
tacaaaaggatcaagacatgattgc

SEQ ID NO: 740595 - DNA, 25 bp, Mus musculus
tacaaaaggatctagacatgattgc

SEQ ID NO: 740596 - DNA, 25 bp, Mus musculus
tacaaaaggatgaatatgcttcgcc

SEQ ID NO: 740597 - DNA, 25 bp, Mus musculus
tacaaaaggatgtatatgcttcgcc

SEQ ID NO: 740598 - DNA, 25 bp, Mus musculus
tacaaaaggcaaagggtctctaagg

SEQ ID NO: 740599 - DNA, 25 bp, Mus musculus
tacaaaaggcaatgggtctctaagg

SEQ ID NO: 740600 - DNA, 25 bp, Mus musculus
tacaaaaggtgtacaaagcagagct

SEQ ID NO: 740601 - DNA, 25 bp, Mus musculus
tacaaaaggtgttcaaagcagagct

SEQ ID NO: 740602 - DNA, 25 bp, Mus musculus
tacaaaagtgccagacaacctttgg

SEQ ID NO: 740603 - DNA, 25 bp, Mus musculus
tacaaaagtgcctgacaacctttgg

SEQ ID NO: 740604 - DNA, 25 bp, Mus musculus
tacaaaatacccagttctcaggaag

SEQ ID NO: 740605 - DNA, 25 bp, Mus musculus
tacaaaataccctgttctcaggaag

SEQ ID NO: 740606 - DNA, 25 bp, Mus musculus
tacaaaatagaaaacggcccctgtg

SEQ ID NO: 740607 - DNA, 25 bp, Mus musculus
tacaaaatagaatacggcccctgtg

SEQ ID NO: 740608 - DNA, 25 bp, Mus musculus
tacaaaatgaaacgcacatcttaag

SEQ ID NO: 740609 - DNA, 25 bp, Mus musculus
tacaaaatgaaaggcacatcttaag

SEQ ID NO: 740610 - DNA, 25 bp, Mus musculus
tacaaaatgcaacgtgtcccatgcc

SEQ ID NO: 740611 - DNA, 25 bp, Mus musculus
tacaaaatgcaaggtgtcccatgcc

SEQ ID NO: 740612 - DNA, 25 bp, Mus musculus
tacaaaatgccaagacagaaagtgg

SEQ ID NO: 740613 - DNA, 25 bp, Mus musculus
tacaaaatgccatgacagaaagtgg

SEQ ID NO: 740614 - DNA, 25 bp, Mus musculus
tacaaaatggcaaatggtggcgatc

SEQ ID NO: 740615 - DNA, 25 bp, Mus musculus
tacaaaatggcatatggtggcgatc

SEQ ID NO: 740616 - DNA, 25 bp, Mus musculus
tacaaacaacccatcgctgacctga

SEQ ID NO: 740617 - DNA, 25 bp, Mus musculus
tacaaacaacccttcgctgacctga

SEQ ID NO: 740618 - DNA, 25 bp, Mus musculus
tacaaacaacgcaacgaggacttcc

SEQ ID NO: 740619 - DNA, 25 bp, Mus musculus
tacaaacaacgctacgaggacttcc

SEQ ID NO: 740620 - DNA, 25 bp, Mus musculus
tacaaacacaagcacgccgtggtgg

SEQ ID NO: 740621 - DNA, 25 bp, Mus musculus
tacaaacacaaggacgccgtggtgg

SEQ ID NO: 740622 - DNA, 25 bp, Mus musculus
tacaaacacctgcatgtccaggaga

SEQ ID NO: 740623 - DNA, 25 bp, Mus musculus
tacaaacacctggatgtccaggaga

SEQ ID NO: 740624 - DNA, 25 bp, Mus musculus
tacaaacagaggaggaaggctacgc

SEQ ID NO: 740625 - DNA, 25 bp, Mus musculus
tacaaacagaggtggaaggctacgc

SEQ ID NO: 740626 - DNA, 25 bp, Mus musculus
tacaaaccacatagcgcttcctggg

SEQ ID NO: 740627 - DNA, 25 bp, Mus musculus
tacaaaccacattgcgcttcctggg

SEQ ID NO: 740628 - DNA, 25 bp, Mus musculus
tacaaaccgaagcagttcagcatgc

SEQ ID NO: 740629 - DNA, 25 bp, Mus musculus
tacaaaccgaaggagttcagcatgc

SEQ ID NO: 740630 - DNA, 25 bp, Mus musculus
tacaaaccgcttcgaaaattgaaga

SEQ ID NO: 740631 - DNA, 25 bp, Mus musculus
tacaaaccgcttggaaaattgaaga

SEQ ID NO: 740632 - DNA, 25 bp, Mus musculus
tacaaacctgtgagattcactagaa

SEQ ID NO: 740633 - DNA, 25 bp, Mus musculus
tacaaacctgtgtgattcactagaa

SEQ ID NO: 740634 - DNA, 25 bp, Mus musculus
tacaaaccttgacctgatgagggac

SEQ ID NO: 740635 - DNA, 25 bp, Mus musculus
tacaaaccttgagctgatgagggac

SEQ ID NO: 740636 - DNA, 25 bp, Mus musculus
tacaaacgaatcaagcagcgagacc

SEQ ID NO: 740637 - DNA, 25 bp, Mus musculus
tacaaacgaatctagcagcgagacc

SEQ ID NO: 740638 - DNA, 25 bp, Mus musculus
tacaaacgcaaccagacaggcctca

SEQ ID NO: 740639 - DNA, 25 bp, Mus musculus
tacaaacgcaacgagacaggcctca

SEQ ID NO: 740640 - DNA, 25 bp, Mus musculus
tacaaactacctcggcatcgagtgg

SEQ ID NO: 740641 - DNA, 25 bp, Mus musculus
tacaaactacctgggcatcgagtgg

SEQ ID NO: 740642 - DNA, 25 bp, Mus musculus
tacaaactagtgatgctgggtgccg

SEQ ID NO: 740643 - DNA, 25 bp, Mus musculus
tacaaactagtgttgctgggtgccg

SEQ ID NO: 740644 - DNA, 25 bp, Mus musculus
tacaaactccttcgagggcttgcgg

SEQ ID NO: 740645 - DNA, 25 bp, Mus musculus
tacaaactccttggagggcttgcgg

SEQ ID NO: 740646 - DNA, 25 bp, Mus musculus
tacaaactctggaaccgatatctga

SEQ ID NO: 740647 - DNA, 25 bp, Mus musculus
tacaaactctggtaccgatatctga

SEQ ID NO: 740648 - DNA, 25 bp, Mus musculus
tacaaactgatcctgaagagctgag

SEQ ID NO: 740649 - DNA, 25 bp, Mus musculus
tacaaactgatcgtgaagagctgag

SEQ ID NO: 740650 - DNA, 25 bp, Mus musculus
tacaaactgcatcaacgcaagtgtg

SEQ ID NO: 740651 - DNA, 25 bp, Mus musculus
tacaaactgcatgaacgcaagtgtg

SEQ ID NO: 740652 - DNA, 25 bp, Mus musculus
tacaaactgccactgagatttctgc

SEQ ID NO: 740653 - DNA, 25 bp, Mus musculus
tacaaactgccagtgagatttctgc

SEQ ID NO: 740654 - DNA, 25 bp, Mus musculus
tacaaactgctcagcactgaaggag

SEQ ID NO: 740655 - DNA, 25 bp, Mus musculus
tacaaactgctctgcactgaaggag

SEQ ID NO: 740656 - DNA, 25 bp, Mus musculus
tacaaacttccaagatatactcggg

SEQ ID NO: 740657 - DNA, 25 bp, Mus musculus
tacaaacttccatgatatactcggg

SEQ ID NO: 740658 - DNA, 25 bp, Mus musculus
tacaaactttctagcgcatgagaag

SEQ ID NO: 740659 - DNA, 25 bp, Mus musculus
tacaaactttcttgcgcatgagaag

SEQ ID NO: 740660 - DNA, 25 bp, Mus musculus
tacaaactttgccaatctgcctgga

SEQ ID NO: 740661 - DNA, 25 bp, Mus musculus
tacaaactttgcgaatctgcctgga

SEQ ID NO: 740662 - DNA, 25 bp, Mus musculus
tacaaagaaaagatggccactgttt

SEQ ID NO: 740663 - DNA, 25 bp, Mus musculus
tacaaagaaaagttggccactgttt

SEQ ID NO: 740664 - DNA, 25 bp, Mus musculus
tacaaagaaccaaacagagaaggaa

SEQ ID NO: 740665 - DNA, 25 bp, Mus musculus
tacaaagaaccacaaagaccagtgc

SEQ ID NO: 740666 - DNA, 25 bp, Mus musculus
tacaaagaaccagaaagaccagtgc

SEQ ID NO: 740667 - DNA, 25 bp, Mus musculus
tacaaagaaccatacagagaaggaa

SEQ ID NO: 740668 - DNA, 25 bp, Mus musculus
tacaaagacagaagagtgtggcccc

SEQ ID NO: 740669 - DNA, 25 bp, Mus musculus
tacaaagacagacctgggcattcat

SEQ ID NO: 740670 - DNA, 25 bp, Mus musculus
tacaaagacagagctgggcattcat

SEQ ID NO: 740671 - DNA, 25 bp, Mus musculus
tacaaagacagatgagtgtggcccc

SEQ ID NO: 740672 - DNA, 25 bp, Mus musculus
tacaaagacagcacgctaataatgc

SEQ ID NO: 740673 - DNA, 25 bp, Mus musculus
tacaaagacagctcgctaataatgc

SEQ ID NO: 740674 - DNA, 25 bp, Mus musculus
tacaaagagagtacattctggcttg

SEQ ID NO: 740675 - DNA, 25 bp, Mus musculus
tacaaagagagttcattctggcttg

SEQ ID NO: 740676 - DNA, 25 bp, Mus musculus
tacaaagagatcctgacctgtgccc

SEQ ID NO: 740677 - DNA, 25 bp, Mus musculus
tacaaagagatcgtgacctgtgccc

SEQ ID NO: 740678 - DNA, 25 bp, Mus musculus
tacaaagagggcagccgcctagcat

SEQ ID NO: 740679 - DNA, 25 bp, Mus musculus
tacaaagagggctgccgcctagcat

SEQ ID NO: 740680 - DNA, 25 bp, Mus musculus
tacaaagatagtagagccagcagac

SEQ ID NO: 740681 - DNA, 25 bp, Mus musculus
tacaaagatagttgagccagcagac

SEQ ID NO: 740682 - DNA, 25 bp, Mus musculus
tacaaagatgggaaacggctgaaga

SEQ ID NO: 740683 - DNA, 25 bp, Mus musculus
tacaaagatgggtaacggctgaaga

SEQ ID NO: 740684 - DNA, 25 bp, Mus musculus
tacaaagatgtacattcctcagcca

SEQ ID NO: 740685 - DNA, 25 bp, Mus musculus
tacaaagatgtagattcctcagcca

SEQ ID NO: 740686 - DNA, 25 bp, Mus musculus
tacaaagatttgcaatctcgggagg

SEQ ID NO: 740687 - DNA, 25 bp, Mus musculus
tacaaagatttggaatctcgggagg

SEQ ID NO: 740688 - DNA, 25 bp, Mus musculus
tacaaagcacagcatgccaccgtgt

SEQ ID NO: 740689 - DNA, 25 bp, Mus musculus
tacaaagcacaggatgccaccgtgt

SEQ ID NO: 740690 - DNA, 25 bp, Mus musculus
tacaaagccaagaatgaatttgcag

SEQ ID NO: 740691 - DNA, 25 bp, Mus musculus
tacaaagccaagtatgaatttgcag

SEQ ID NO: 740692 - DNA, 25 bp, Mus musculus
tacaaagcccctactgaaaactggg

SEQ ID NO: 740693 - DNA, 25 bp, Mus musculus
tacaaagccccttctgaaaactggg

SEQ ID NO: 740694 - DNA, 25 bp, Mus musculus
tacaaagcctaacatgagcgcaagt

SEQ ID NO: 740695 - DNA, 25 bp, Mus musculus
tacaaagcctaagatgagcgcaagt

SEQ ID NO: 740696 - DNA, 25 bp, Mus musculus
tacaaagcctgcactgaaaaccgtt

SEQ ID NO: 740697 - DNA, 25 bp, Mus musculus
tacaaagcctgctctgaaaaccgtt

SEQ ID NO: 740698 - DNA, 25 bp, Mus musculus
tacaaagcctgtataccaatagaga

SEQ ID NO: 740699 - DNA, 25 bp, Mus musculus
tacaaagcctgtttaccaatagaga

SEQ ID NO: 740700 - DNA, 25 bp, Mus musculus
tacaaagccttcaaaatccttagtt

SEQ ID NO: 740701 - DNA, 25 bp, Mus musculus
tacaaagccttctaaatccttagtt

SEQ ID NO: 740702 - DNA, 25 bp, Mus musculus
tacaaagcctttacctatgaccaca

SEQ ID NO: 740703 - DNA, 25 bp, Mus musculus
tacaaagccttttcctatgaccaca

SEQ ID NO: 740704 - DNA, 25 bp, Mus musculus
tacaaagctcgtctcgcccttgaga

SEQ ID NO: 740705 - DNA, 25 bp, Mus musculus
tacaaagctcgtgtcgcccttgaga

SEQ ID NO: 740706 - DNA, 25 bp, Mus musculus
tacaaagctgatcgaaatgacgcca

SEQ ID NO: 740707 - DNA, 25 bp, Mus musculus
tacaaagctgatggaaatgacgcca

SEQ ID NO: 740708 - DNA, 25 bp, Mus musculus
tacaaagctggtagcagagtacaca

SEQ ID NO: 740709 - DNA, 25 bp, Mus musculus
tacaaagctggttgcagagtacaca

SEQ ID NO: 740710 - DNA, 25 bp, Mus musculus
tacaaaggaaacctggaacataaga

SEQ ID NO: 740711 - DNA, 25 bp, Mus musculus
tacaaaggaaacgtggaacataaga

SEQ ID NO: 740712 - DNA, 25 bp, Mus musculus
tacaaaggaagaaccacagagctca

SEQ ID NO: 740713 - DNA, 25 bp, Mus musculus
tacaaaggaagatccacagagctca

SEQ ID NO: 740714 - DNA, 25 bp, Mus musculus
tacaaaggacgacgaacagtgagcc

SEQ ID NO: 740715 - DNA, 25 bp, Mus musculus
tacaaaggacgaggaacagtgagcc

SEQ ID NO: 740716 - DNA, 25 bp, Mus musculus
tacaaaggccctcaagtgggagcat

SEQ ID NO: 740717 - DNA, 25 bp, Mus musculus
tacaaaggccctgaagtgggagcat

SEQ ID NO: 740718 - DNA, 25 bp, Mus musculus
tacaaagggcctctatttccaggca

SEQ ID NO: 740719 - DNA, 25 bp, Mus musculus
tacaaagggcctgtatttccaggca

SEQ ID NO: 740720 - DNA, 25 bp, Mus musculus
tacaaaggtagaatgccaggcagcc

SEQ ID NO: 740721 - DNA, 25 bp, Mus musculus
tacaaaggtagattgccaggcagcc

SEQ ID NO: 740722 - DNA, 25 bp, Mus musculus
tacaaaggtgcacttcaaggaaacc

SEQ ID NO: 740723 - DNA, 25 bp, Mus musculus
tacaaaggtgcagttcaaggaaacc

SEQ ID NO: 740724 - DNA, 25 bp, Mus musculus
tacaaaggtgccaccaaagaccaaa

SEQ ID NO: 740725 - DNA, 25 bp, Mus musculus
tacaaaggtgcctccaaagaccaaa

SEQ ID NO: 740726 - DNA, 25 bp, Mus musculus
tacaaagtaactctggctgaggtac

SEQ ID NO: 740727 - DNA, 25 bp, Mus musculus
tacaaagtaactgtggctgaggtac

SEQ ID NO: 740728 - DNA, 25 bp, Mus musculus
tacaaagtaggaattactgggagga

SEQ ID NO: 740729 - DNA, 25 bp, Mus musculus
tacaaagtaggatttactgggagga

SEQ ID NO: 740730 - DNA, 25 bp, Mus musculus
tacaaagtcatccattatatcctcc

SEQ ID NO: 740731 - DNA, 25 bp, Mus musculus
tacaaagtcatcgattatatcctcc

SEQ ID NO: 740732 - DNA, 25 bp, Mus musculus
tacaaagtgagcaggaagccccagg

SEQ ID NO: 740733 - DNA, 25 bp, Mus musculus
tacaaagtgagctggaagccccagg

SEQ ID NO: 740734 - DNA, 25 bp, Mus musculus
tacaaagtgaggacccgaaggcctc

SEQ ID NO: 740735 - DNA, 25 bp, Mus musculus
tacaaagtgaggtcccgaaggcctc

SEQ ID NO: 740736 - DNA, 25 bp, Mus musculus
tacaaagtggttccttcgagggcaa

SEQ ID NO: 740737 - DNA, 25 bp, Mus musculus
tacaaagtggttgcttcgagggcaa

SEQ ID NO: 740738 - DNA, 25 bp, Mus musculus
tacaaagtgtacaagtatgaccgcg

SEQ ID NO: 740739 - DNA, 25 bp, Mus musculus
tacaaagtgtactagtatgaccgcg

SEQ ID NO: 740740 - DNA, 25 bp, Mus musculus
tacaaagtgtcaaggaaagccgggc

SEQ ID NO: 740741 - DNA, 25 bp, Mus musculus
tacaaagtgtcatggaaagccgggc

SEQ ID NO: 740742 - DNA, 25 bp, Mus musculus
tacaaagtgtgccatgtgcccttgg

SEQ ID NO: 740743 - DNA, 25 bp, Mus musculus
tacaaagtgtgcgatgtgcccttgg

SEQ ID NO: 740744 - DNA, 25 bp, Mus musculus
tacaaagttccactccccgtaactg

SEQ ID NO: 740745 - DNA, 25 bp, Mus musculus
tacaaagttccagtccccgtaactg

SEQ ID NO: 740746 - DNA, 25 bp, Mus musculus
tacaaagttttgctatttcagtagg

SEQ ID NO: 740747 - DNA, 25 bp, Mus musculus
tacaaagttttggtatttcagtagg

SEQ ID NO: 740748 - DNA, 25 bp, Mus musculus
tacaaatcagcgagaagccttacaa

SEQ ID NO: 740749 - DNA, 25 bp, Mus musculus
tacaaatcagcgtgaagccttacaa

SEQ ID NO: 740750 - DNA, 25 bp, Mus musculus
tacaaatccaacaatcggcccctgg

SEQ ID NO: 740751 - DNA, 25 bp, Mus musculus
tacaaatccaactatcggcccctgg

SEQ ID NO: 740752 - DNA, 25 bp, Mus musculus
tacaaatgagtacgtggctatcaag

SEQ ID NO: 740753 - DNA, 25 bp, Mus musculus
tacaaatgagtaggtggctatcaag

SEQ ID NO: 740754 - DNA, 25 bp, Mus musculus
tacaaatgatgtagagacagctcgt

SEQ ID NO: 740755 - DNA, 25 bp, Mus musculus
tacaaatgatgttgagacagctcgt

SEQ ID NO: 740756 - DNA, 25 bp, Mus musculus
tacaaatgcaacagctatcctggct

SEQ ID NO: 740757 - DNA, 25 bp, Mus musculus
tacaaatgcaactgctatcctggct

SEQ ID NO: 740758 - DNA, 25 bp, Mus musculus
tacaaatgccaactggacgaggctg

SEQ ID NO: 740759 - DNA, 25 bp, Mus musculus
tacaaatgccaagtggacgaggctg

SEQ ID NO: 740760 - DNA, 25 bp, Mus musculus
tacaaatgccagaaggcctcctcct

SEQ ID NO: 740761 - DNA, 25 bp, Mus musculus
tacaaatgccagtaggcctcctcct

SEQ ID NO: 740762 - DNA, 25 bp, Mus musculus
tacaaatgccttctaatctactgga

SEQ ID NO: 740763 - DNA, 25 bp, Mus musculus
tacaaatgccttgtaatctactgga

SEQ ID NO: 740764 - DNA, 25 bp, Mus musculus
tacaaatgcgaacaaggcgcacgct

SEQ ID NO: 740765 - DNA, 25 bp, Mus musculus
tacaaatgcgaagaaggcgcacgct

SEQ ID NO: 740766 - DNA, 25 bp, Mus musculus
tacaaatggaaactcagaggccatc

SEQ ID NO: 740767 - DNA, 25 bp, Mus musculus
tacaaatggaaagtcagaggccatc

SEQ ID NO: 740768 - DNA, 25 bp, Mus musculus
tacaaatgggcactactataggact

SEQ ID NO: 740769 - DNA, 25 bp, Mus musculus
tacaaatgggcagtactataggact

SEQ ID NO: 740770 - DNA, 25 bp, Mus musculus
tacaaatgtagaagggttactgtac

SEQ ID NO: 740771 - DNA, 25 bp, Mus musculus
tacaaatgtagatgggttactgtac

SEQ ID NO: 740772 - DNA, 25 bp, Mus musculus
tacaaatgtcacagacaaggatggg

SEQ ID NO: 740773 - DNA, 25 bp, Mus musculus
tacaaatgtcactgacaaggatggg

SEQ ID NO: 740774 - DNA, 25 bp, Mus musculus
tacaaattacccacactgtgagtgt

SEQ ID NO: 740775 - DNA, 25 bp, Mus musculus
tacaaattaccctcactgtgagtgt

SEQ ID NO: 740776 - DNA, 25 bp, Mus musculus
tacaaattacggaaagagccagcga

SEQ ID NO: 740777 - DNA, 25 bp, Mus musculus
tacaaattacggtaagagccagcga

SEQ ID NO: 740778 - DNA, 25 bp, Mus musculus
tacaaattattgagcggatcccagc

SEQ ID NO: 740779 - DNA, 25 bp, Mus musculus
tacaaattattgtgcggatcccagc

SEQ ID NO: 740780 - DNA, 25 bp, Mus musculus
tacaaattctgacctgtctaacccc

SEQ ID NO: 740781 - DNA, 25 bp, Mus musculus
tacaaattctgagctgtctaacccc

SEQ ID NO: 740782 - DNA, 25 bp, Mus musculus
tacaaattggagctgcagtgtccac

SEQ ID NO: 740783 - DNA, 25 bp, Mus musculus
tacaaattggaggtgcagtgtccac

SEQ ID NO: 740784 - DNA, 25 bp, Mus musculus
tacaaattgtctcactccctcagtg

SEQ ID NO: 740785 - DNA, 25 bp, Mus musculus
tacaaattgtctgactccctcagtg

SEQ ID NO: 740786 - DNA, 25 bp, Mus musculus
tacaacaacagacagcagcacaaaa

SEQ ID NO: 740787 - DNA, 25 bp, Mus musculus
tacaacaacagagagcagcacaaaa

SEQ ID NO: 740788 - DNA, 25 bp, Mus musculus
tacaacaacatgaagcagttcatcc

SEQ ID NO: 740789 - DNA, 25 bp, Mus musculus
tacaacaacatgtagcagttcatcc

SEQ ID NO: 740790 - DNA, 25 bp, Mus musculus
tacaacaactcactagggccggagc

SEQ ID NO: 740791 - DNA, 25 bp, Mus musculus
tacaacaactcagtagggccggagc

SEQ ID NO: 740792 - DNA, 25 bp, Mus musculus
tacaacaagcggctcaaagacgaca

SEQ ID NO: 740793 - DNA, 25 bp, Mus musculus
tacaacaagcgggtcaaagacgaca

SEQ ID NO: 740794 - DNA, 25 bp, Mus musculus
tacaacaagctcagcgattggtggt

SEQ ID NO: 740795 - DNA, 25 bp, Mus musculus
tacaacaagctctgcgattggtggt

SEQ ID NO: 740796 - DNA, 25 bp, Mus musculus
tacaacaagcttctggaatttgtcc

SEQ ID NO: 740797 - DNA, 25 bp, Mus musculus
tacaacaagcttgtggaatttgtcc

SEQ ID NO: 740798 - DNA, 25 bp, Mus musculus
tacaacacacaactatgaccgagac

SEQ ID NO: 740799 - DNA, 25 bp, Mus musculus
tacaacacacaagtatgaccgagac

SEQ ID NO: 740800 - DNA, 25 bp, Mus musculus
tacaacacagacaacggcgctgagc

SEQ ID NO: 740801 - DNA, 25 bp, Mus musculus
tacaacacagaccacgcacagaata

SEQ ID NO: 740802 - DNA, 25 bp, Mus musculus
tacaacacagacgacgcacagaata

SEQ ID NO: 740803 - DNA, 25 bp, Mus musculus
tacaacacagactacggcgctgagc

SEQ ID NO: 740804 - DNA, 25 bp, Mus musculus
tacaacaccagactaggagacaaag

SEQ ID NO: 740805 - DNA, 25 bp, Mus musculus
tacaacaccagagtaggagacaaag

SEQ ID NO: 740806 - DNA, 25 bp, Mus musculus
tacaacaccgtcaccggagccagag

SEQ ID NO: 740807 - DNA, 25 bp, Mus musculus
tacaacaccgtctccggagccagag

SEQ ID NO: 740808 - DNA, 25 bp, Mus musculus
tacaacacggttctcctgtgggtct

SEQ ID NO: 740809 - DNA, 25 bp, Mus musculus
tacaacacggttgtcctgtgggtct

SEQ ID NO: 740810 - DNA, 25 bp, Mus musculus
tacaacacgtacatgcgcaacacca

SEQ ID NO: 740811 - DNA, 25 bp, Mus musculus
tacaacacgtacttgcgcaacacca

SEQ ID NO: 740812 - DNA, 25 bp, Mus musculus
tacaacactcggctcttcaaggtcg

SEQ ID NO: 740813 - DNA, 25 bp, Mus musculus
tacaacactcgggtcttcaaggtcg

SEQ ID NO: 740814 - DNA, 25 bp, Mus musculus
tacaacagaatgctgttcaaaacca

SEQ ID NO: 740815 - DNA, 25 bp, Mus musculus
tacaacagaatggtgttcaaaacca

SEQ ID NO: 740816 - DNA, 25 bp, Mus musculus
tacaacagacgaactctggacccgt

SEQ ID NO: 740817 - DNA, 25 bp, Mus musculus
tacaacagacgatctctggacccgt

SEQ ID NO: 740818 - DNA, 25 bp, Mus musculus
tacaacagcataaccagcgcgagta

SEQ ID NO: 740819 - DNA, 25 bp, Mus musculus
tacaacagcatatccagcgcgagta

SEQ ID NO: 740820 - DNA, 25 bp, Mus musculus
tacaacagccagcaagagctcagct

SEQ ID NO: 740821 - DNA, 25 bp, Mus musculus
tacaacagccaggaagagctcagct

SEQ ID NO: 740822 - DNA, 25 bp, Mus musculus
tacaacagcggcacggtctgcgaga

SEQ ID NO: 740823 - DNA, 25 bp, Mus musculus
tacaacagcggctcggtctgcgaga

SEQ ID NO: 740824 - DNA, 25 bp, Mus musculus
tacaacaggaagcataattatctgc

SEQ ID NO: 740825 - DNA, 25 bp, Mus musculus
tacaacaggaaggataattatctgc

SEQ ID NO: 740826 - DNA, 25 bp, Mus musculus
tacaacagtgaccaagggaagcgac

SEQ ID NO: 740827 - DNA, 25 bp, Mus musculus
tacaacagtgacgaagggaagcgac

SEQ ID NO: 740828 - DNA, 25 bp, Mus musculus
tacaacagtgctctgatggagtctc

SEQ ID NO: 740829 - DNA, 25 bp, Mus musculus
tacaacagtgctgtgatggagtctc

SEQ ID NO: 740830 - DNA, 25 bp, Mus musculus
tacaacagttgactgctatgtggct

SEQ ID NO: 740831 - DNA, 25 bp, Mus musculus
tacaacagttgagtgctatgtggct

SEQ ID NO: 740832 - DNA, 25 bp, Mus musculus
tacaacatcacaactaccctggcag

SEQ ID NO: 740833 - DNA, 25 bp, Mus musculus
tacaacatcacatctaccctggcag

SEQ ID NO: 740834 - DNA, 25 bp, Mus musculus
tacaacatcattcgaggacttgatg

SEQ ID NO: 740835 - DNA, 25 bp, Mus musculus
tacaacatcattggaggacttgatg

SEQ ID NO: 740836 - DNA, 25 bp, Mus musculus
tacaacatcgtacaagcagaggtcc

SEQ ID NO: 740837 - DNA, 25 bp, Mus musculus
tacaacatcgtagaagcagaggtcc

SEQ ID NO: 740838 - DNA, 25 bp, Mus musculus
tacaacatgcatctggaatggctga

SEQ ID NO: 740839 - DNA, 25 bp, Mus musculus
tacaacatgcatgtggaatggctga

SEQ ID NO: 740840 - DNA, 25 bp, Mus musculus
tacaacattgatagaaccagtggcc

SEQ ID NO: 740841 - DNA, 25 bp, Mus musculus
tacaacattgattgaaccagtggcc

SEQ ID NO: 740842 - DNA, 25 bp, Mus musculus
tacaacattgggaggcagaaaattt

SEQ ID NO: 740843 - DNA, 25 bp, Mus musculus
tacaacattgggtggcagaaaattt

SEQ ID NO: 740844 - DNA, 25 bp, Mus musculus
tacaaccaacagaaaggacttatgt

SEQ ID NO: 740845 - DNA, 25 bp, Mus musculus
tacaaccaacagtaaggacttatgt

SEQ ID NO: 740846 - DNA, 25 bp, Mus musculus
tacaaccaacgactcaagcatctct

SEQ ID NO: 740847 - DNA, 25 bp, Mus musculus
tacaaccaacgagtcaagcatctct

SEQ ID NO: 740848 - DNA, 25 bp, Mus musculus
tacaaccaagatcaagcccctggtg

SEQ ID NO: 740849 - DNA, 25 bp, Mus musculus
tacaaccaagatgaagcccctggtg

SEQ ID NO: 740850 - DNA, 25 bp, Mus musculus
tacaaccaagcgaaaatgtgcctcc

SEQ ID NO: 740851 - DNA, 25 bp, Mus musculus
tacaaccaagcgtaaatgtgcctcc

SEQ ID NO: 740852 - DNA, 25 bp, Mus musculus
tacaaccaaggtccattctaggaga

SEQ ID NO: 740853 - DNA, 25 bp, Mus musculus
tacaaccaaggtgcattctaggaga

SEQ ID NO: 740854 - DNA, 25 bp, Mus musculus
tacaaccacacaatggaagtggaaa

SEQ ID NO: 740855 - DNA, 25 bp, Mus musculus
tacaaccacacattggaagtggaaa

SEQ ID NO: 740856 - DNA, 25 bp, Mus musculus
tacaaccacagcactgggcgcgtgt

SEQ ID NO: 740857 - DNA, 25 bp, Mus musculus
tacaaccacagctctgggcgcgtgt

SEQ ID NO: 740858 - DNA, 25 bp, Mus musculus
tacaaccaccttcttgcagtttctg

SEQ ID NO: 740859 - DNA, 25 bp, Mus musculus
tacaaccaccttgttgcagtttctg

SEQ ID NO: 740860 - DNA, 25 bp, Mus musculus
tacaaccactcacgtgtgactgtag

SEQ ID NO: 740861 - DNA, 25 bp, Mus musculus
tacaaccactcaggtgtgactgtag

SEQ ID NO: 740862 - DNA, 25 bp, Mus musculus
tacaaccaggagaacgcaaggtttg

SEQ ID NO: 740863 - DNA, 25 bp, Mus musculus
tacaaccaggagtacgcaaggtttg

SEQ ID NO: 740864 - DNA, 25 bp, Mus musculus
tacaaccatgaacagtgttgttggg

SEQ ID NO: 740865 - DNA, 25 bp, Mus musculus
tacaaccatgaagagtgttgttggg

SEQ ID NO: 740866 - DNA, 25 bp, Mus musculus
tacaacccagcccagtatgactatg

SEQ ID NO: 740867 - DNA, 25 bp, Mus musculus
tacaacccagccgagtatgactatg

SEQ ID NO: 740868 - DNA, 25 bp, Mus musculus
tacaacccagttaggaaagcccaag

SEQ ID NO: 740869 - DNA, 25 bp, Mus musculus
tacaacccagtttggaaagcccaag

SEQ ID NO: 740870 - DNA, 25 bp, Mus musculus
tacaaccccatgagcacctatgtga

SEQ ID NO: 740871 - DNA, 25 bp, Mus musculus
tacaaccccatgtgcacctatgtga

SEQ ID NO: 740872 - DNA, 25 bp, Mus musculus
tacaaccccgagcagaacctcaatg

SEQ ID NO: 740873 - DNA, 25 bp, Mus musculus
tacaaccccgaggagaacctcaatg

SEQ ID NO: 740874 - DNA, 25 bp, Mus musculus
tacaacccgctcatgggcgcggtca

SEQ ID NO: 740875 - DNA, 25 bp, Mus musculus
tacaacccgctcttgggcgcggtca

SEQ ID NO: 740876 - DNA, 25 bp, Mus musculus
tacaaccctgcgactgatagactta

SEQ ID NO: 740877 - DNA, 25 bp, Mus musculus
tacaaccctgcgtctgatagactta

SEQ ID NO: 740878 - DNA, 25 bp, Mus musculus
tacaacctgaaaactcgtgaaggga

SEQ ID NO: 740879 - DNA, 25 bp, Mus musculus
tacaacctgaaatctcgtgaaggga

SEQ ID NO: 740880 - DNA, 25 bp, Mus musculus
tacaacctgaagcaccagcatcaaa

SEQ ID NO: 740881 - DNA, 25 bp, Mus musculus
tacaacctgaaggaccagcatcaaa

SEQ ID NO: 740882 - DNA, 25 bp, Mus musculus
tacaacctggcgctgggatccacct

SEQ ID NO: 740883 - DNA, 25 bp, Mus musculus
tacaacctggcggtgggatccacct

SEQ ID NO: 740884 - DNA, 25 bp, Mus musculus
tacaacctgggtcaatactggatcg

SEQ ID NO: 740885 - DNA, 25 bp, Mus musculus
tacaacctgggtgaatactggatcg

SEQ ID NO: 740886 - DNA, 25 bp, Mus musculus
tacaacctggttcgtctggagccag

SEQ ID NO: 740887 - DNA, 25 bp, Mus musculus
tacaacctggttggtctggagccag

SEQ ID NO: 740888 - DNA, 25 bp, Mus musculus
tacaacctgtctaaggtgtgccctg

SEQ ID NO: 740889 - DNA, 25 bp, Mus musculus
tacaacctgtcttaggtgtgccctg

SEQ ID NO: 740890 - DNA, 25 bp, Mus musculus
tacaaccttggcatagaagcaagca

SEQ ID NO: 740891 - DNA, 25 bp, Mus musculus
tacaaccttggcttagaagcaagca

SEQ ID NO: 740892 - DNA, 25 bp, Mus musculus
tacaacgaagatctccatgacctgc

SEQ ID NO: 740893 - DNA, 25 bp, Mus musculus
tacaacgaagatgtccatgacctgc

SEQ ID NO: 740894 - DNA, 25 bp, Mus musculus
tacaacgaagtgatggctacctatc

SEQ ID NO: 740895 - DNA, 25 bp, Mus musculus
tacaacgaagtgttggctacctatc

SEQ ID NO: 740896 - DNA, 25 bp, Mus musculus
tacaacgaatggcaccctttagagg

SEQ ID NO: 740897 - DNA, 25 bp, Mus musculus
tacaacgaatgggaccctttagagg

SEQ ID NO: 740898 - DNA, 25 bp, Mus musculus
tacaacgatcccactgtgctctaca

SEQ ID NO: 740899 - DNA, 25 bp, Mus musculus
tacaacgatccctctgtgctctaca

SEQ ID NO: 740900 - DNA, 25 bp, Mus musculus
tacaacgatgtaatgacaaagcaac

SEQ ID NO: 740901 - DNA, 25 bp, Mus musculus
tacaacgatgtattgacaaagcaac

SEQ ID NO: 740902 - DNA, 25 bp, Mus musculus
tacaacgccactcaccattctggga

SEQ ID NO: 740903 - DNA, 25 bp, Mus musculus
tacaacgccactgaccattctggga

SEQ ID NO: 740904 - DNA, 25 bp, Mus musculus
tacaacgcgctcacctgtgagggct

SEQ ID NO: 740905 - DNA, 25 bp, Mus musculus
tacaacgcgctctcctgtgagggct

SEQ ID NO: 740906 - DNA, 25 bp, Mus musculus
tacaacgctttactcacctggatgg

SEQ ID NO: 740907 - DNA, 25 bp, Mus musculus
tacaacgctttagtcacctggatgg

SEQ ID NO: 740908 - DNA, 25 bp, Mus musculus
tacaacggatcactacacaggtggc

SEQ ID NO: 740909 - DNA, 25 bp, Mus musculus
tacaacggatcagtacacaggtggc

SEQ ID NO: 740910 - DNA, 25 bp, Mus musculus
tacaacggctggatcctcttcctgg

SEQ ID NO: 740911 - DNA, 25 bp, Mus musculus
tacaacggctggttcctcttcctgg

SEQ ID NO: 740912 - DNA, 25 bp, Mus musculus
tacaacgggaccaactccgacgctg

SEQ ID NO: 740913 - DNA, 25 bp, Mus musculus
tacaacgggacctactccgacgctg

SEQ ID NO: 740914 - DNA, 25 bp, Mus musculus
tacaacgtaaatctggcgtggacag

SEQ ID NO: 740915 - DNA, 25 bp, Mus musculus
tacaacgtaaatgtggcgtggacag

SEQ ID NO: 740916 - DNA, 25 bp, Mus musculus
tacaactacgttcaagggacagcac

SEQ ID NO: 740917 - DNA, 25 bp, Mus musculus
tacaactacgttgaagggacagcac

SEQ ID NO: 740918 - DNA, 25 bp, Mus musculus
tacaactagagcaagccggagctgg

SEQ ID NO: 740919 - DNA, 25 bp, Mus musculus
tacaactagagctagccggagctgg

SEQ ID NO: 740920 - DNA, 25 bp, Mus musculus
tacaactagtaccagccaacaccaa

SEQ ID NO: 740921 - DNA, 25 bp, Mus musculus
tacaactagtacgagccaacaccaa

SEQ ID NO: 740922 - DNA, 25 bp, Mus musculus
tacaactagtgacatggacccgtcc

SEQ ID NO: 740923 - DNA, 25 bp, Mus musculus
tacaactagtgagatggacccgtcc

SEQ ID NO: 740924 - DNA, 25 bp, Mus musculus
tacaactatggcagcttggacaact

SEQ ID NO: 740925 - DNA, 25 bp, Mus musculus
tacaactatggctgcttggacaact

SEQ ID NO: 740926 - DNA, 25 bp, Mus musculus
tacaactcagcgcatgactacatca

SEQ ID NO: 740927 - DNA, 25 bp, Mus musculus
tacaactcagcggatgactacatca

SEQ ID NO: 740928 - DNA, 25 bp, Mus musculus
tacaactcagtgctgaatagctgct

SEQ ID NO: 740929 - DNA, 25 bp, Mus musculus
tacaactcagtggtgaatagctgct

SEQ ID NO: 740930 - DNA, 25 bp, Mus musculus
tacaactcatgactggtcagcctgg

SEQ ID NO: 740931 - DNA, 25 bp, Mus musculus
tacaactcatgagtggtcagcctgg

SEQ ID NO: 740932 - DNA, 25 bp, Mus musculus
tacaactccttgaataagaagggcc

SEQ ID NO: 740933 - DNA, 25 bp, Mus musculus
tacaactccttgtataagaagggcc

SEQ ID NO: 740934 - DNA, 25 bp, Mus musculus
tacaactcgagaaataaaggccaca

SEQ ID NO: 740935 - DNA, 25 bp, Mus musculus
tacaactcgagatataaaggccaca

SEQ ID NO: 740936 - DNA, 25 bp, Mus musculus
tacaactgaaagaaaagggacaggg

SEQ ID NO: 740937 - DNA, 25 bp, Mus musculus
tacaactgaaagtaaagggacaggg

SEQ ID NO: 740938 - DNA, 25 bp, Mus musculus
tacaactgaattcctgtatgcagaa

SEQ ID NO: 740939 - DNA, 25 bp, Mus musculus
tacaactgaattgctgtatgcagaa

SEQ ID NO: 740940 - DNA, 25 bp, Mus musculus
tacaactggactctggatgaggtga

SEQ ID NO: 740941 - DNA, 25 bp, Mus musculus
tacaactggactgtggatgaggtga

SEQ ID NO: 740942 - DNA, 25 bp, Mus musculus
tacaactggctcctcggtgactcta

SEQ ID NO: 740943 - DNA, 25 bp, Mus musculus
tacaactggctcgtcggtgactcta

SEQ ID NO: 740944 - DNA, 25 bp, Mus musculus
tacaactgggagacttgctccgcag

SEQ ID NO: 740945 - DNA, 25 bp, Mus musculus
tacaactgggagtcttgctccgcag

SEQ ID NO: 740946 - DNA, 25 bp, Mus musculus
tacaactgggcaaggcaggataagg

SEQ ID NO: 740947 - DNA, 25 bp, Mus musculus
tacaactgggcatggcaggataagg

SEQ ID NO: 740948 - DNA, 25 bp, Mus musculus
tacaactgggtgaaagcccggaggc

SEQ ID NO: 740949 - DNA, 25 bp, Mus musculus
tacaactgggtgtaagcccggaggc

SEQ ID NO: 740950 - DNA, 25 bp, Mus musculus
tacaactgtttgacccttagagggc

SEQ ID NO: 740951 - DNA, 25 bp, Mus musculus
tacaactgtttgtcccttagagggc

SEQ ID NO: 740952 - DNA, 25 bp, Mus musculus
tacaacttaggccacaccagtgaga

SEQ ID NO: 740953 - DNA, 25 bp, Mus musculus
tacaacttaggcgacaccagtgaga

SEQ ID NO: 740954 - DNA, 25 bp, Mus musculus
tacaacttatccagagccatgtgca

SEQ ID NO: 740955 - DNA, 25 bp, Mus musculus
tacaacttatcctgagccatgtgca

SEQ ID NO: 740956 - DNA, 25 bp, Mus musculus
tacaacttcacccacttggatgcat

SEQ ID NO: 740957 - DNA, 25 bp, Mus musculus
tacaacttcaccgacttggatgcat

SEQ ID NO: 740958 - DNA, 25 bp, Mus musculus
tacaacttcagaagccgtcatttct

SEQ ID NO: 740959 - DNA, 25 bp, Mus musculus
tacaacttcagatgccgtcatttct

SEQ ID NO: 740960 - DNA, 25 bp, Mus musculus
tacaacttccagcatgctttgcggg

SEQ ID NO: 740961 - DNA, 25 bp, Mus musculus
tacaacttccaggatgctttgcggg

SEQ ID NO: 740962 - DNA, 25 bp, Mus musculus
tacaacttcctcatggccgacaaca

SEQ ID NO: 740963 - DNA, 25 bp, Mus musculus
tacaacttcctcttggccgacaaca

SEQ ID NO: 740964 - DNA, 25 bp, Mus musculus
tacaacttcggcaaatacctggccc

SEQ ID NO: 740965 - DNA, 25 bp, Mus musculus
tacaacttcggctaatacctggccc

SEQ ID NO: 740966 - DNA, 25 bp, Mus musculus
tacaacttctataccaatctccatg

SEQ ID NO: 740967 - DNA, 25 bp, Mus musculus
tacaacttctattccaatctccatg

SEQ ID NO: 740968 - DNA, 25 bp, Mus musculus
tacaacttctctccgaagagcgtag

SEQ ID NO: 740969 - DNA, 25 bp, Mus musculus
tacaacttctctgcgaagagcgtag

SEQ ID NO: 740970 - DNA, 25 bp, Mus musculus
tacaacttgcagagtcagaatctcg

SEQ ID NO: 740971 - DNA, 25 bp, Mus musculus
tacaacttgcagtgtcagaatctcg

SEQ ID NO: 740972 - DNA, 25 bp, Mus musculus
tacaacttgcttatcagtgtccctc

SEQ ID NO: 740973 - DNA, 25 bp, Mus musculus
tacaacttgcttttcagtgtccctc

SEQ ID NO: 740974 - DNA, 25 bp, Mus musculus
tacaactttctcaaaatgattaagg

SEQ ID NO: 740975 - DNA, 25 bp, Mus musculus
tacaactttctctaaatgattaagg

SEQ ID NO: 740976 - DNA, 25 bp, Mus musculus
tacaactttgagatccccaaaacca

SEQ ID NO: 740977 - DNA, 25 bp, Mus musculus
tacaactttgagttccccaaaacca

SEQ ID NO: 740978 - DNA, 25 bp, Mus musculus
tacaagaaaacgcacgaaaccctga

SEQ ID NO: 740979 - DNA, 25 bp, Mus musculus
tacaagaaaacggacgaaaccctga

SEQ ID NO: 740980 - DNA, 25 bp, Mus musculus
tacaagaaagcaatggcaaaggtcg

SEQ ID NO: 740981 - DNA, 25 bp, Mus musculus
tacaagaaagcattggcaaaggtcg

SEQ ID NO: 740982 - DNA, 25 bp, Mus musculus
tacaagaacactcagcccatcatgg

SEQ ID NO: 740983 - DNA, 25 bp, Mus musculus
tacaagaacactgagcccatcatgg

SEQ ID NO: 740984 - DNA, 25 bp, Mus musculus
tacaagaacggcaccatcctaaact

SEQ ID NO: 740985 - DNA, 25 bp, Mus musculus
tacaagaacggctccatcctaaact

SEQ ID NO: 740986 - DNA, 25 bp, Mus musculus
tacaagaactgcagacggtggctga

SEQ ID NO: 740987 - DNA, 25 bp, Mus musculus
tacaagaactgctgacggtggctga

SEQ ID NO: 740988 - DNA, 25 bp, Mus musculus
tacaagaaggttctgtatcgccagt

SEQ ID NO: 740989 - DNA, 25 bp, Mus musculus
tacaagaaggttgtgtatcgccagt

SEQ ID NO: 740990 - DNA, 25 bp, Mus musculus
tacaagaattccatggagacggtgg

SEQ ID NO: 740991 - DNA, 25 bp, Mus musculus
tacaagaattccttggagacggtgg

SEQ ID NO: 740992 - DNA, 25 bp, Mus musculus
tacaagacactgctctctacggttg

SEQ ID NO: 740993 - DNA, 25 bp, Mus musculus
tacaagacactggtctctacggttg

SEQ ID NO: 740994 - DNA, 25 bp, Mus musculus
tacaagaccatccacctgtcaagca

SEQ ID NO: 740995 - DNA, 25 bp, Mus musculus
tacaagaccatcgacctgtcaagca

SEQ ID NO: 740996 - DNA, 25 bp, Mus musculus
tacaagacggtcagatttccgagtt

SEQ ID NO: 740997 - DNA, 25 bp, Mus musculus
tacaagacggtctgatttccgagtt

SEQ ID NO: 740998 - DNA, 25 bp, Mus musculus
tacaagacgttcataatttgggtgt

SEQ ID NO: 740999 - DNA, 25 bp, Mus musculus
tacaagacgttcttaatttgggtgt

SEQ ID NO: 741000 - DNA, 25 bp, Mus musculus
tacaagactaccacaagctggccct

SEQ ID NO: 741001 - DNA, 25 bp, Mus musculus
tacaagactacctcaagctggccct

SEQ ID NO: 741002 - DNA, 25 bp, Mus musculus
tacaagagaatgagacgagcatgtt

SEQ ID NO: 741003 - DNA, 25 bp, Mus musculus
tacaagagaatgtgacgagcatgtt

SEQ ID NO: 741004 - DNA, 25 bp, Mus musculus
tacaagagagtgagatatgcaccca

SEQ ID NO: 741005 - DNA, 25 bp, Mus musculus
tacaagagagtgtgatatgcaccca

SEQ ID NO: 741006 - DNA, 25 bp, Mus musculus
tacaagagattccaaccttccagcc

SEQ ID NO: 741007 - DNA, 25 bp, Mus musculus
tacaagagattcgaaccttccagcc

SEQ ID NO: 741008 - DNA, 25 bp, Mus musculus
tacaagagcgccaggacaggctgga

SEQ ID NO: 741009 - DNA, 25 bp, Mus musculus
tacaagagcgcctggacaggctgga

SEQ ID NO: 741010 - DNA, 25 bp, Mus musculus
tacaagaggagaaggcgctgattct

SEQ ID NO: 741011 - DNA, 25 bp, Mus musculus
tacaagaggagatggcgctgattct

SEQ ID NO: 741012 - DNA, 25 bp, Mus musculus
tacaagaggcctcccctgtgttccg

SEQ ID NO: 741013 - DNA, 25 bp, Mus musculus
tacaagaggcctgccctgtgttccg

SEQ ID NO: 741014 - DNA, 25 bp, Mus musculus
tacaagaggctcaacagcacccact

SEQ ID NO: 741015 - DNA, 25 bp, Mus musculus
tacaagaggctctacagcacccact

SEQ ID NO: 741016 - DNA, 25 bp, Mus musculus
tacaagagggatatggctttgggtc

SEQ ID NO: 741017 - DNA, 25 bp, Mus musculus
tacaagagggatttggctttgggtc

SEQ ID NO: 741018 - DNA, 25 bp, Mus musculus
tacaagagtatcacaggcgacatgg

SEQ ID NO: 741019 - DNA, 25 bp, Mus musculus
tacaagagtatctcaggcgacatgg

SEQ ID NO: 741020 - DNA, 25 bp, Mus musculus
tacaagagttcaagccctgaacaat

SEQ ID NO: 741021 - DNA, 25 bp, Mus musculus
tacaagagttcatgccctgaacaat

SEQ ID NO: 741022 - DNA, 25 bp, Mus musculus
tacaagagttctaaggttgccaccc

SEQ ID NO: 741023 - DNA, 25 bp, Mus musculus
tacaagagttcttaggttgccaccc

SEQ ID NO: 741024 - DNA, 25 bp, Mus musculus
tacaagatagtgactacaaccccaa

SEQ ID NO: 741025 - DNA, 25 bp, Mus musculus
tacaagatagtgtctacaaccccaa

SEQ ID NO: 741026 - DNA, 25 bp, Mus musculus
tacaagatatggcaagccgtgtaca

SEQ ID NO: 741027 - DNA, 25 bp, Mus musculus
tacaagatatgggaagccgtgtaca

SEQ ID NO: 741028 - DNA, 25 bp, Mus musculus
tacaagatcaaacgtttggccaagg

SEQ ID NO: 741029 - DNA, 25 bp, Mus musculus
tacaagatcaaaggtttggccaagg

SEQ ID NO: 741030 - DNA, 25 bp, Mus musculus
tacaagatcgtacttgacgagcggg

SEQ ID NO: 741031 - DNA, 25 bp, Mus musculus
tacaagatcgtagttgacgagcggg

SEQ ID NO: 741032 - DNA, 25 bp, Mus musculus
tacaagatgcagcaaaacgagcctc

SEQ ID NO: 741033 - DNA, 25 bp, Mus musculus
tacaagatgcaggaaaacgagcctc

SEQ ID NO: 741034 - DNA, 25 bp, Mus musculus
tacaagatggagcacgcagtccatg

SEQ ID NO: 741035 - DNA, 25 bp, Mus musculus
tacaagatggaggacgcagtccatg

SEQ ID NO: 741036 - DNA, 25 bp, Mus musculus
tacaagatggtcaagctggctgcac

SEQ ID NO: 741037 - DNA, 25 bp, Mus musculus
tacaagatggtctagctggctgcac

SEQ ID NO: 741038 - DNA, 25 bp, Mus musculus
tacaagatgtcaagctggacccacc

SEQ ID NO: 741039 - DNA, 25 bp, Mus musculus
tacaagatgtcatgctggacccacc

SEQ ID NO: 741040 - DNA, 25 bp, Mus musculus
tacaagatgtctccatgaaatttcg

SEQ ID NO: 741041 - DNA, 25 bp, Mus musculus
tacaagatgtctgcatgaaatttcg

SEQ ID NO: 741042 - DNA, 25 bp, Mus musculus
tacaagattcctatgcagctcacca

SEQ ID NO: 741043 - DNA, 25 bp, Mus musculus
tacaagattcctttgcagctcacca

SEQ ID NO: 741044 - DNA, 25 bp, Mus musculus
tacaagattctacgtggttccgtcc

SEQ ID NO: 741045 - DNA, 25 bp, Mus musculus
tacaagattctaggtggttccgtcc

SEQ ID NO: 741046 - DNA, 25 bp, Mus musculus
tacaagcaaggcaaagcacctggct

SEQ ID NO: 741047 - DNA, 25 bp, Mus musculus
tacaagcaaggctaagcacctggct

SEQ ID NO: 741048 - DNA, 25 bp, Mus musculus
tacaagcacactcgaaggaaggact

SEQ ID NO: 741049 - DNA, 25 bp, Mus musculus
tacaagcacactggaaggaaggact

SEQ ID NO: 741050 - DNA, 25 bp, Mus musculus
tacaagcaccgtctgcagggaagag

SEQ ID NO: 741051 - DNA, 25 bp, Mus musculus
tacaagcaccgtgtgcagggaagag

SEQ ID NO: 741052 - DNA, 25 bp, Mus musculus
tacaagcacctgaacttcgagtccg

SEQ ID NO: 741053 - DNA, 25 bp, Mus musculus
tacaagcacctgaggagcagttacc

SEQ ID NO: 741054 - DNA, 25 bp, Mus musculus
tacaagcacctgtacttcgagtccg

SEQ ID NO: 741055 - DNA, 25 bp, Mus musculus
tacaagcacctgtggagcagttacc

SEQ ID NO: 741056 - DNA, 25 bp, Mus musculus
tacaagcacgatcagcaggttgcca

SEQ ID NO: 741057 - DNA, 25 bp, Mus musculus
tacaagcacgatgagcaggttgcca

SEQ ID NO: 741058 - DNA, 25 bp, Mus musculus
tacaagcagagtacaatcaccaacc

SEQ ID NO: 741059 - DNA, 25 bp, Mus musculus
tacaagcagagttcaatcaccaacc

SEQ ID NO: 741060 - DNA, 25 bp, Mus musculus
tacaagcaggtacaaaaaggttagg

SEQ ID NO: 741061 - DNA, 25 bp, Mus musculus
tacaagcaggtagaaaaaggttagg

SEQ ID NO: 741062 - DNA, 25 bp, Mus musculus
tacaagcaggtgatctttgaggagg

SEQ ID NO: 741063 - DNA, 25 bp, Mus musculus
tacaagcaggtgttctttgaggagg

SEQ ID NO: 741064 - DNA, 25 bp, Mus musculus
tacaagcagtaacatgattcctcag

SEQ ID NO: 741065 - DNA, 25 bp, Mus musculus
tacaagcagtaagatgattcctcag

SEQ ID NO: 741066 - DNA, 25 bp, Mus musculus
tacaagcatcatcctagcgatgtcc

SEQ ID NO: 741067 - DNA, 25 bp, Mus musculus
tacaagcatcatgctagcgatgtcc

SEQ ID NO: 741068 - DNA, 25 bp, Mus musculus
tacaagcatgagagctgtggccagt

SEQ ID NO: 741069 - DNA, 25 bp, Mus musculus
tacaagcatgagtgctgtggccagt

SEQ ID NO: 741070 - DNA, 25 bp, Mus musculus
tacaagcattccaataacaaggcca

SEQ ID NO: 741071 - DNA, 25 bp, Mus musculus
tacaagcattcctataacaaggcca

SEQ ID NO: 741072 - DNA, 25 bp, Mus musculus
tacaagccaagacctttggatcaac

SEQ ID NO: 741073 - DNA, 25 bp, Mus musculus
tacaagccaagagctttggatcaac

SEQ ID NO: 741074 - DNA, 25 bp, Mus musculus
tacaagcccaacaacaaggccatgg

SEQ ID NO: 741075 - DNA, 25 bp, Mus musculus
tacaagcccaactacaaggccatgg

SEQ ID NO: 741076 - DNA, 25 bp, Mus musculus
tacaagcccatcctggaattcattg

SEQ ID NO: 741077 - DNA, 25 bp, Mus musculus
tacaagcccatcgtggaattcattg

SEQ ID NO: 741078 - DNA, 25 bp, Mus musculus
tacaagcccctcatctcatgggaag

SEQ ID NO: 741079 - DNA, 25 bp, Mus musculus
tacaagcccctcttctcatgggaag

SEQ ID NO: 741080 - DNA, 25 bp, Mus musculus
tacaagcccgtgatcgtggtgcacg

SEQ ID NO: 741081 - DNA, 25 bp, Mus musculus
tacaagcccgtgttcgtggtgcacg

SEQ ID NO: 741082 - DNA, 25 bp, Mus musculus
tacaagccctatcgagacctggttc

SEQ ID NO: 741083 - DNA, 25 bp, Mus musculus
tacaagccctatggagacctggttc

SEQ ID NO: 741084 - DNA, 25 bp, Mus musculus
tacaagcccttcctctgcgagtttt

SEQ ID NO: 741085 - DNA, 25 bp, Mus musculus
tacaagcccttcgtctgcgagtttt

SEQ ID NO: 741086 - DNA, 25 bp, Mus musculus
tacaagccggtgattgtgaccgaga

SEQ ID NO: 741087 - DNA, 25 bp, Mus musculus
tacaagccggtgtttgtgaccgaga

SEQ ID NO: 741088 - DNA, 25 bp, Mus musculus
tacaagcctggcaacccaggaagta

SEQ ID NO: 741089 - DNA, 25 bp, Mus musculus
tacaagcctggctacccaggaagta

SEQ ID NO: 741090 - DNA, 25 bp, Mus musculus
tacaagcgagtacagatgctggaat

SEQ ID NO: 741091 - DNA, 25 bp, Mus musculus
tacaagcgagtagagatgctggaat

SEQ ID NO: 741092 - DNA, 25 bp, Mus musculus
tacaagcgcttcattaagtttgccc

SEQ ID NO: 741093 - DNA, 25 bp, Mus musculus
tacaagcgcttctttaagtttgccc

SEQ ID NO: 741094 - DNA, 25 bp, Mus musculus
tacaagcggtcacgcaccttgcaga

SEQ ID NO: 741095 - DNA, 25 bp, Mus musculus
tacaagcggtcaggcaccttgcaga

SEQ ID NO: 741096 - DNA, 25 bp, Mus musculus
tacaagctaatgatcagcaggactt

SEQ ID NO: 741097 - DNA, 25 bp, Mus musculus
tacaagctaatgttcagcaggactt

SEQ ID NO: 741098 - DNA, 25 bp, Mus musculus
tacaagctaattcaagaatcgtgtc

SEQ ID NO: 741099 - DNA, 25 bp, Mus musculus
tacaagctaattgaagaatcgtgtc

SEQ ID NO: 741100 - DNA, 25 bp, Mus musculus
tacaagctacggatcacagtggata

SEQ ID NO: 741101 - DNA, 25 bp, Mus musculus
tacaagctacggttcacagtggata

SEQ ID NO: 741102 - DNA, 25 bp, Mus musculus
tacaagctagcaccagataacaaga

SEQ ID NO: 741103 - DNA, 25 bp, Mus musculus
tacaagctagcagcagataacaaga

SEQ ID NO: 741104 - DNA, 25 bp, Mus musculus
tacaagctgagcaaattctgataga

SEQ ID NO: 741105 - DNA, 25 bp, Mus musculus
tacaagctgagctaattctgataga

SEQ ID NO: 741106 - DNA, 25 bp, Mus musculus
tacaagctgatgacacggctgggct

SEQ ID NO: 741107 - DNA, 25 bp, Mus musculus
tacaagctgatgtcacggctgggct

SEQ ID NO: 741108 - DNA, 25 bp, Mus musculus
tacaagctggaccagctctttgagc

SEQ ID NO: 741109 - DNA, 25 bp, Mus musculus
tacaagctggacgagctctttgagc

SEQ ID NO: 741110 - DNA, 25 bp, Mus musculus
tacaagctgtcgctactgaagccct

SEQ ID NO: 741111 - DNA, 25 bp, Mus musculus
tacaagctgtcggtactgaagccct

SEQ ID NO: 741112 - DNA, 25 bp, Mus musculus
tacaagctgtgaatgtggtaataaa

SEQ ID NO: 741113 - DNA, 25 bp, Mus musculus
tacaagctgtgattgtggtaataaa

SEQ ID NO: 741114 - DNA, 25 bp, Mus musculus
tacaagcttaaaaaacctgaggacg

SEQ ID NO: 741115 - DNA, 25 bp, Mus musculus
tacaagcttaaataacctgaggacg

SEQ ID NO: 741116 - DNA, 25 bp, Mus musculus
tacaagctttgccaagggacagctg

SEQ ID NO: 741117 - DNA, 25 bp, Mus musculus
tacaagctttgcgaagggacagctg

SEQ ID NO: 741118 - DNA, 25 bp, Mus musculus
tacaaggaacaaaggctctgagaac

SEQ ID NO: 741119 - DNA, 25 bp, Mus musculus
tacaaggaacaatggctctgagaac

SEQ ID NO: 741120 - DNA, 25 bp, Mus musculus
tacaaggaacagaacctttttgtgt

SEQ ID NO: 741121 - DNA, 25 bp, Mus musculus
tacaaggaacagtacctttttgtgt

SEQ ID NO: 741122 - DNA, 25 bp, Mus musculus
tacaaggaacccacgacctggtgaa

SEQ ID NO: 741123 - DNA, 25 bp, Mus musculus
tacaaggaaccctcgacctggtgaa

SEQ ID NO: 741124 - DNA, 25 bp, Mus musculus
tacaaggacaatatctagcctgtgg

SEQ ID NO: 741125 - DNA, 25 bp, Mus musculus
tacaaggacaatttctagcctgtgg

SEQ ID NO: 741126 - DNA, 25 bp, Mus musculus
tacaaggacaggagccagtgtactg

SEQ ID NO: 741127 - DNA, 25 bp, Mus musculus
tacaaggacaggtgccagtgtactg

SEQ ID NO: 741128 - DNA, 25 bp, Mus musculus
tacaaggagctacgcttccagggct

SEQ ID NO: 741129 - DNA, 25 bp, Mus musculus
tacaaggagctaggcttccagggct

SEQ ID NO: 741130 - DNA, 25 bp, Mus musculus
tacaaggaggcactaaaggactgca

SEQ ID NO: 741131 - DNA, 25 bp, Mus musculus
tacaaggaggcagtaaaggactgca

SEQ ID NO: 741132 - DNA, 25 bp, Mus musculus
tacaaggagtcacagtaaccccttc

SEQ ID NO: 741133 - DNA, 25 bp, Mus musculus
tacaaggagtcagagtaaccccttc

SEQ ID NO: 741134 - DNA, 25 bp, Mus musculus
tacaaggagtccaacaaagaccgga

SEQ ID NO: 741135 - DNA, 25 bp, Mus musculus
tacaaggagtccagaaatgctttcc

SEQ ID NO: 741136 - DNA, 25 bp, Mus musculus
tacaaggagtcctacaaagaccgga

SEQ ID NO: 741137 - DNA, 25 bp, Mus musculus
tacaaggagtcctgaaatgctttcc

SEQ ID NO: 741138 - DNA, 25 bp, Mus musculus
tacaaggatcggcactggcatgaag

SEQ ID NO: 741139 - DNA, 25 bp, Mus musculus
tacaaggatcgggactggcatgaag

SEQ ID NO: 741140 - DNA, 25 bp, Mus musculus
tacaaggcactgagcagccagattc

SEQ ID NO: 741141 - DNA, 25 bp, Mus musculus
tacaaggcactgtgcagccagattc

SEQ ID NO: 741142 - DNA, 25 bp, Mus musculus
tacaaggccgacagagcgaagtatg

SEQ ID NO: 741143 - DNA, 25 bp, Mus musculus
tacaaggccgactgagcgaagtatg

SEQ ID NO: 741144 - DNA, 25 bp, Mus musculus
tacaaggcctggactacctccacgg

SEQ ID NO: 741145 - DNA, 25 bp, Mus musculus
tacaaggcctggtctacctccacgg

SEQ ID NO: 741146 - DNA, 25 bp, Mus musculus
tacaaggccttgatgaggacacggc

SEQ ID NO: 741147 - DNA, 25 bp, Mus musculus
tacaaggccttgttgaggacacggc

SEQ ID NO: 741148 - DNA, 25 bp, Mus musculus
tacaaggctagaaggcctggatctc

SEQ ID NO: 741149 - DNA, 25 bp, Mus musculus
tacaaggctagatggcctggatctc

SEQ ID NO: 741150 - DNA, 25 bp, Mus musculus
tacaaggctgacatccaagctgaga

SEQ ID NO: 741151 - DNA, 25 bp, Mus musculus
tacaaggctgacttccaagctgaga

SEQ ID NO: 741152 - DNA, 25 bp, Mus musculus
tacaaggctgttaggaatgaattgg

SEQ ID NO: 741153 - DNA, 25 bp, Mus musculus
tacaaggctgtttggaatgaattgg

SEQ ID NO: 741154 - DNA, 25 bp, Mus musculus
tacaagggactgcatgggagtctcc

SEQ ID NO: 741155 - DNA, 25 bp, Mus musculus
tacaagggactggatgggagtctcc

SEQ ID NO: 741156 - DNA, 25 bp, Mus musculus
tacaagggagaactcaccacactga

SEQ ID NO: 741157 - DNA, 25 bp, Mus musculus
tacaagggagaagtcaccacactga

SEQ ID NO: 741158 - DNA, 25 bp, Mus musculus
tacaagggctgcagcctaatggtga

SEQ ID NO: 741159 - DNA, 25 bp, Mus musculus
tacaagggctgctgcctaatggtga

SEQ ID NO: 741160 - DNA, 25 bp, Mus musculus
tacaagggtcctacgtgattccagt

SEQ ID NO: 741161 - DNA, 25 bp, Mus musculus
tacaagggtccttcgtgattccagt

SEQ ID NO: 741162 - DNA, 25 bp, Mus musculus
tacaagggtctgaatgctgagcagc

SEQ ID NO: 741163 - DNA, 25 bp, Mus musculus
tacaagggtctgtatgctgagcagc

SEQ ID NO: 741164 - DNA, 25 bp, Mus musculus
tacaagggtttcctgcacaaggtgg

SEQ ID NO: 741165 - DNA, 25 bp, Mus musculus
tacaagggtttcgtgcacaaggtgg

SEQ ID NO: 741166 - DNA, 25 bp, Mus musculus
tacaaggtaagcaaggttgcccact

SEQ ID NO: 741167 - DNA, 25 bp, Mus musculus
tacaaggtaagctaggttgcccact

SEQ ID NO: 741168 - DNA, 25 bp, Mus musculus
tacaaggtcaagcaggacaagacct

SEQ ID NO: 741169 - DNA, 25 bp, Mus musculus
tacaaggtcaaggaggacaagacct

SEQ ID NO: 741170 - DNA, 25 bp, Mus musculus
tacaaggtctgcactgagaagattc

SEQ ID NO: 741171 - DNA, 25 bp, Mus musculus
tacaaggtctgctctgagaagattc

SEQ ID NO: 741172 - DNA, 25 bp, Mus musculus
tacaaggtgatgctcagataggagc

SEQ ID NO: 741173 - DNA, 25 bp, Mus musculus
tacaaggtgatggtcagataggagc

SEQ ID NO: 741174 - DNA, 25 bp, Mus musculus
tacaaggtgattataagctgctggc

SEQ ID NO: 741175 - DNA, 25 bp, Mus musculus
tacaaggtgattttaagctgctggc

SEQ ID NO: 741176 - DNA, 25 bp, Mus musculus
tacaaggtgcgccatgtgcactgga

SEQ ID NO: 741177 - DNA, 25 bp, Mus musculus
tacaaggtgcgcgatgtgcactgga

SEQ ID NO: 741178 - DNA, 25 bp, Mus musculus
tacaaggtgggcaaaaagtcacctt

SEQ ID NO: 741179 - DNA, 25 bp, Mus musculus
tacaaggtgggctaaaagtcacctt

SEQ ID NO: 741180 - DNA, 25 bp, Mus musculus
tacaaggtttccaagtgtgcatctc

SEQ ID NO: 741181 - DNA, 25 bp, Mus musculus
tacaaggtttcctagtgtgcatctc

SEQ ID NO: 741182 - DNA, 25 bp, Mus musculus
tacaagtaacacaggcatcaatggg

SEQ ID NO: 741183 - DNA, 25 bp, Mus musculus
tacaagtaacactggcatcaatggg

SEQ ID NO: 741184 - DNA, 25 bp, Mus musculus
tacaagtaacccacagacggcctaa

SEQ ID NO: 741185 - DNA, 25 bp, Mus musculus
tacaagtaaccctcagacggcctaa

SEQ ID NO: 741186 - DNA, 25 bp, Mus musculus
tacaagtaccttctgaagaacaaga

SEQ ID NO: 741187 - DNA, 25 bp, Mus musculus
tacaagtaccttgtgaagaacaaga

SEQ ID NO: 741188 - DNA, 25 bp, Mus musculus
tacaagtagcttcgcttgtagtgga

SEQ ID NO: 741189 - DNA, 25 bp, Mus musculus
tacaagtagcttggcttgtagtgga

SEQ ID NO: 741190 - DNA, 25 bp, Mus musculus
tacaagtatcgtcacctggattcca

SEQ ID NO: 741191 - DNA, 25 bp, Mus musculus
tacaagtatcgtgacctggattcca

SEQ ID NO: 741192 - DNA, 25 bp, Mus musculus
tacaagtatgtgatgaagcccacct

SEQ ID NO: 741193 - DNA, 25 bp, Mus musculus
tacaagtatgtgttgaagcccacct

SEQ ID NO: 741194 - DNA, 25 bp, Mus musculus
tacaagtcaaggagtggcccaaggt

SEQ ID NO: 741195 - DNA, 25 bp, Mus musculus
tacaagtcaaggtgtggcccaaggt

SEQ ID NO: 741196 - DNA, 25 bp, Mus musculus
tacaagtcaccaagccagaaggagt

SEQ ID NO: 741197 - DNA, 25 bp, Mus musculus
tacaagtcaccatgccagaaggagt

SEQ ID NO: 741198 - DNA, 25 bp, Mus musculus
tacaagtcagttccttaccagttag

SEQ ID NO: 741199 - DNA, 25 bp, Mus musculus
tacaagtcagttgcttaccagttag

SEQ ID NO: 741200 - DNA, 25 bp, Mus musculus
tacaagtcccagaatgcaatgcacc

SEQ ID NO: 741201 - DNA, 25 bp, Mus musculus
tacaagtcccagtatgcaatgcacc

SEQ ID NO: 741202 - DNA, 25 bp, Mus musculus
tacaagtccttgcagtggttcggag

SEQ ID NO: 741203 - DNA, 25 bp, Mus musculus
tacaagtccttggagtggttcggag

SEQ ID NO: 741204 - DNA, 25 bp, Mus musculus
tacaagtctattcgacggtcaggaa

SEQ ID NO: 741205 - DNA, 25 bp, Mus musculus
tacaagtctattggacggtcaggaa

SEQ ID NO: 741206 - DNA, 25 bp, Mus musculus
tacaagtctcggcaagaagacccga

SEQ ID NO: 741207 - DNA, 25 bp, Mus musculus
tacaagtctcgggaagaagacccga

SEQ ID NO: 741208 - DNA, 25 bp, Mus musculus
tacaagtgaaaaacggaggcatata

SEQ ID NO: 741209 - DNA, 25 bp, Mus musculus
tacaagtgaaaatcggaggcatata

SEQ ID NO: 741210 - DNA, 25 bp, Mus musculus
tacaagtgacatatgagagcctggc

SEQ ID NO: 741211 - DNA, 25 bp, Mus musculus
tacaagtgacatttgagagcctggc

SEQ ID NO: 741212 - DNA, 25 bp, Mus musculus
tacaagtgagtcagaaagattacag

SEQ ID NO: 741213 - DNA, 25 bp, Mus musculus
tacaagtgagtctgaaagattacag

SEQ ID NO: 741214 - DNA, 25 bp, Mus musculus
tacaagtgagttaggagaggccaag

SEQ ID NO: 741215 - DNA, 25 bp, Mus musculus
tacaagtgagtttggagaggccaag

SEQ ID NO: 741216 - DNA, 25 bp, Mus musculus
tacaagtgatcgcaaggagagtctg

SEQ ID NO: 741217 - DNA, 25 bp, Mus musculus
tacaagtgatcggaaggagagtctg

SEQ ID NO: 741218 - DNA, 25 bp, Mus musculus
tacaagtgcaacagtcctctgccat

SEQ ID NO: 741219 - DNA, 25 bp, Mus musculus
tacaagtgcaactgtcctctgccat

SEQ ID NO: 741220 - DNA, 25 bp, Mus musculus
tacaagtgcaagacgtgcgactacg

SEQ ID NO: 741221 - DNA, 25 bp, Mus musculus
tacaagtgcaagtcgtgcgactacg

SEQ ID NO: 741222 - DNA, 25 bp, Mus musculus
tacaagtgcgagctgtgcaactacg

SEQ ID NO: 741223 - DNA, 25 bp, Mus musculus
tacaagtgcgaggtgtgcaactacg

SEQ ID NO: 741224 - DNA, 25 bp, Mus musculus
tacaagtgctaactccgtgttcagc

SEQ ID NO: 741225 - DNA, 25 bp, Mus musculus
tacaagtgctaagtccgtgttcagc

SEQ ID NO: 741226 - DNA, 25 bp, Mus musculus
tacaagtggcacatcaatgagaccg

SEQ ID NO: 741227 - DNA, 25 bp, Mus musculus
tacaagtggcacttcaatgagaccg

SEQ ID NO: 741228 - DNA, 25 bp, Mus musculus
tacaagtgtgaaagtagtcgtggct

SEQ ID NO: 741229 - DNA, 25 bp, Mus musculus
tacaagtgtgaatgtagtcgtggct

SEQ ID NO: 741230 - DNA, 25 bp, Mus musculus
tacaagttactactacatgttgccc

SEQ ID NO: 741231 - DNA, 25 bp, Mus musculus
tacaagttactagtacatgttgccc

SEQ ID NO: 741232 - DNA, 25 bp, Mus musculus
tacaagttgcagcagcgttctgatc

SEQ ID NO: 741233 - DNA, 25 bp, Mus musculus
tacaagttgcaggagcgttctgatc

SEQ ID NO: 741234 - DNA, 25 bp, Mus musculus
tacaagttggctctaggtcaaataa

SEQ ID NO: 741235 - DNA, 25 bp, Mus musculus
tacaagttggctgtaggtcaaataa

SEQ ID NO: 741236 - DNA, 25 bp, Mus musculus
tacaagttgttgcaggacagcagcc

SEQ ID NO: 741237 - DNA, 25 bp, Mus musculus
tacaagttgttggaggacagcagcc

SEQ ID NO: 741238 - DNA, 25 bp, Mus musculus
tacaataaccgactgcaggcttact

SEQ ID NO: 741239 - DNA, 25 bp, Mus musculus
tacaataaccgagtgcaggcttact

SEQ ID NO: 741240 - DNA, 25 bp, Mus musculus
tacaataccaccacccaccggtgta

SEQ ID NO: 741241 - DNA, 25 bp, Mus musculus
tacaataccacctcccaccggtgta

SEQ ID NO: 741242 - DNA, 25 bp, Mus musculus
tacaatactcagctcaacttcatgg

SEQ ID NO: 741243 - DNA, 25 bp, Mus musculus
tacaatactcaggtcaacttcatgg

SEQ ID NO: 741244 - DNA, 25 bp, Mus musculus
tacaatagagtcagcttactaccag

SEQ ID NO: 741245 - DNA, 25 bp, Mus musculus
tacaatagagtctgcttactaccag

SEQ ID NO: 741246 - DNA, 25 bp, Mus musculus
tacaataggagtaaaacaggaaagc

SEQ ID NO: 741247 - DNA, 25 bp, Mus musculus
tacaataggagttaaacaggaaagc

SEQ ID NO: 741248 - DNA, 25 bp, Mus musculus
tacaatatccggcatagcttcggaa

SEQ ID NO: 741249 - DNA, 25 bp, Mus musculus
tacaatatccgggatagcttcggaa

SEQ ID NO: 741250 - DNA, 25 bp, Mus musculus
tacaatatgtacatcttccctgtcc

SEQ ID NO: 741251 - DNA, 25 bp, Mus musculus
tacaatatgtacttcttccctgtcc

SEQ ID NO: 741252 - DNA, 25 bp, Mus musculus
tacaatattacactccttgcgttag

SEQ ID NO: 741253 - DNA, 25 bp, Mus musculus
tacaatattacagtccttgcgttag

SEQ ID NO: 741254 - DNA, 25 bp, Mus musculus
tacaatcaagtaagtgcccctggcc

SEQ ID NO: 741255 - DNA, 25 bp, Mus musculus
tacaatcaagtatgtgcccctggcc

SEQ ID NO: 741256 - DNA, 25 bp, Mus musculus
tacaatcaggaccacaatcaccagg

SEQ ID NO: 741257 - DNA, 25 bp, Mus musculus
tacaatcaggacgacaatcaccagg

SEQ ID NO: 741258 - DNA, 25 bp, Mus musculus
tacaatcaggcaaaaggatggtaga

SEQ ID NO: 741259 - DNA, 25 bp, Mus musculus
tacaatcaggcataaggatggtaga

SEQ ID NO: 741260 - DNA, 25 bp, Mus musculus
tacaatcagggcacctgtgagccca

SEQ ID NO: 741261 - DNA, 25 bp, Mus musculus
tacaatcagggctcctgtgagccca

SEQ ID NO: 741262 - DNA, 25 bp, Mus musculus
tacaatccagtcagcaagagctgcc

SEQ ID NO: 741263 - DNA, 25 bp, Mus musculus
tacaatccagtctgcaagagctgcc

SEQ ID NO: 741264 - DNA, 25 bp, Mus musculus
tacaatccctacaagtactccgacg

SEQ ID NO: 741265 - DNA, 25 bp, Mus musculus
tacaatccctactagtactccgacg

SEQ ID NO: 741266 - DNA, 25 bp, Mus musculus
tacaatccctgtcgaaagtatatgg

SEQ ID NO: 741267 - DNA, 25 bp, Mus musculus
tacaatccctgtggaaagtatatgg

SEQ ID NO: 741268 - DNA, 25 bp, Mus musculus
tacaatcccttcaggaatctgtttg

SEQ ID NO: 741269 - DNA, 25 bp, Mus musculus
tacaatcccttctggaatctgtttg

SEQ ID NO: 741270 - DNA, 25 bp, Mus musculus
tacaatcctccacaccacgatgttg

SEQ ID NO: 741271 - DNA, 25 bp, Mus musculus
tacaatcctccagaccacgatgttg

SEQ ID NO: 741272 - DNA, 25 bp, Mus musculus
tacaatcgagtaaacacaggcttcc

SEQ ID NO: 741273 - DNA, 25 bp, Mus musculus
tacaatcgagtatacacaggcttcc

SEQ ID NO: 741274 - DNA, 25 bp, Mus musculus
tacaatctctatcctccgtgtgctg

SEQ ID NO: 741275 - DNA, 25 bp, Mus musculus
tacaatctctatgctccgtgtgctg

SEQ ID NO: 741276 - DNA, 25 bp, Mus musculus
tacaatctgcaacatgtcacagtgg

SEQ ID NO: 741277 - DNA, 25 bp, Mus musculus
tacaatctgcaagatgtcacagtgg

SEQ ID NO: 741278 - DNA, 25 bp, Mus musculus
tacaatctggccaacctcatctact

SEQ ID NO: 741279 - DNA, 25 bp, Mus musculus
tacaatctggcctacctcatctact

SEQ ID NO: 741280 - DNA, 25 bp, Mus musculus
tacaatctgtatccttcaggatgag

SEQ ID NO: 741281 - DNA, 25 bp, Mus musculus
tacaatctgtatgcttcaggatgag

SEQ ID NO: 741282 - DNA, 25 bp, Mus musculus
tacaatcttgggaagttacattcct

SEQ ID NO: 741283 - DNA, 25 bp, Mus musculus
tacaatcttgggtagttacattcct

SEQ ID NO: 741284 - DNA, 25 bp, Mus musculus
tacaatgactacaagctggacttcc

SEQ ID NO: 741285 - DNA, 25 bp, Mus musculus
tacaatgactactagctggacttcc

SEQ ID NO: 741286 - DNA, 25 bp, Mus musculus
tacaatgagaacagagccctaaggg

SEQ ID NO: 741287 - DNA, 25 bp, Mus musculus
tacaatgagaactgagccctaaggg

SEQ ID NO: 741288 - DNA, 25 bp, Mus musculus
tacaatgagctgatgctgaaatcag

SEQ ID NO: 741289 - DNA, 25 bp, Mus musculus
tacaatgagctgttgctgaaatcag

SEQ ID NO: 741290 - DNA, 25 bp, Mus musculus
tacaatgagtaacaggcgctgggcc

SEQ ID NO: 741291 - DNA, 25 bp, Mus musculus
tacaatgagtaagaggcgctgggcc

SEQ ID NO: 741292 - DNA, 25 bp, Mus musculus
tacaatgagtctattatgatcccag

SEQ ID NO: 741293 - DNA, 25 bp, Mus musculus
tacaatgagtcttttatgatcccag

SEQ ID NO: 741294 - DNA, 25 bp, Mus musculus
tacaatgatccgcaagtgctagcca

SEQ ID NO: 741295 - DNA, 25 bp, Mus musculus
tacaatgatccggaagtgctagcca

SEQ ID NO: 741296 - DNA, 25 bp, Mus musculus
tacaatgatggacattgatggtgac

SEQ ID NO: 741297 - DNA, 25 bp, Mus musculus
tacaatgatggagattgatggtgac

SEQ ID NO: 741298 - DNA, 25 bp, Mus musculus
tacaatgcaacgaggctgggtaggc

SEQ ID NO: 741299 - DNA, 25 bp, Mus musculus
tacaatgcaacgtggctgggtaggc

SEQ ID NO: 741300 - DNA, 25 bp, Mus musculus
tacaatgccaccctggtaggcatcc

SEQ ID NO: 741301 - DNA, 25 bp, Mus musculus
tacaatgccaccgtggtaggcatcc

SEQ ID NO: 741302 - DNA, 25 bp, Mus musculus
tacaatgccgggacccacatcacag

SEQ ID NO: 741303 - DNA, 25 bp, Mus musculus
tacaatgccgggtcccacatcacag

SEQ ID NO: 741304 - DNA, 25 bp, Mus musculus
tacaatggccagatcaacagcaacc

SEQ ID NO: 741305 - DNA, 25 bp, Mus musculus
tacaatggccagttcaacagcaacc

SEQ ID NO: 741306 - DNA, 25 bp, Mus musculus
tacaatggcgccctagatgccgcct

SEQ ID NO: 741307 - DNA, 25 bp, Mus musculus
tacaatggcgccgtagatgccgcct

SEQ ID NO: 741308 - DNA, 25 bp, Mus musculus
tacaatggcgtgatggtaaaaacaa

SEQ ID NO: 741309 - DNA, 25 bp, Mus musculus
tacaatggcgtgttggtaaaaacaa

SEQ ID NO: 741310 - DNA, 25 bp, Mus musculus
tacaatggctgtccctatgcctgcc

SEQ ID NO: 741311 - DNA, 25 bp, Mus musculus
tacaatggctgtgcctatgcctgcc

SEQ ID NO: 741312 - DNA, 25 bp, Mus musculus
tacaatgggcttcgtaacactcacc

SEQ ID NO: 741313 - DNA, 25 bp, Mus musculus
tacaatgggcttggtaacactcacc

SEQ ID NO: 741314 - DNA, 25 bp, Mus musculus
tacaatggtgctatacctaatggtg

SEQ ID NO: 741315 - DNA, 25 bp, Mus musculus
tacaatggtgctttacctaatggtg

SEQ ID NO: 741316 - DNA, 25 bp, Mus musculus
tacaatgtgagcatggatgtgcaca

SEQ ID NO: 741317 - DNA, 25 bp, Mus musculus
tacaatgtgagcttggatgtgcaca

SEQ ID NO: 741318 - DNA, 25 bp, Mus musculus
tacaatgttcttaccaccttaaagc

SEQ ID NO: 741319 - DNA, 25 bp, Mus musculus
tacaatgttctttccaccttaaagc

SEQ ID NO: 741320 - DNA, 25 bp, Mus musculus
tacaattaccatctcgtggaattac

SEQ ID NO: 741321 - DNA, 25 bp, Mus musculus
tacaattaccatgtcgtggaattac

SEQ ID NO: 741322 - DNA, 25 bp, Mus musculus
tacaattatcacacagcttgactac

SEQ ID NO: 741323 - DNA, 25 bp, Mus musculus
tacaattatcactcagcttgactac

SEQ ID NO: 741324 - DNA, 25 bp, Mus musculus
tacaattccaagaatatcaaggagt

SEQ ID NO: 741325 - DNA, 25 bp, Mus musculus
tacaattccaagtatatcaaggagt

SEQ ID NO: 741326 - DNA, 25 bp, Mus musculus
tacaattggcatccttcgagaatca

SEQ ID NO: 741327 - DNA, 25 bp, Mus musculus
tacaattggcatgcttcgagaatca

SEQ ID NO: 741328 - DNA, 25 bp, Mus musculus
tacaattgtcacagcaaccgaggct

SEQ ID NO: 741329 - DNA, 25 bp, Mus musculus
tacaattgtcactgcaaccgaggct

SEQ ID NO: 741330 - DNA, 25 bp, Mus musculus
tacaattgtggaatccggcttaaag

SEQ ID NO: 741331 - DNA, 25 bp, Mus musculus
tacaattgtggattccggcttaaag

SEQ ID NO: 741332 - DNA, 25 bp, Mus musculus
tacaatttatgaacgtctggagcaa

SEQ ID NO: 741333 - DNA, 25 bp, Mus musculus
tacaatttatgatcgtctggagcaa

SEQ ID NO: 741334 - DNA, 25 bp, Mus musculus
tacaatttggcaactatctctgagt

SEQ ID NO: 741335 - DNA, 25 bp, Mus musculus
tacaatttggcatctatctctgagt

SEQ ID NO: 741336 - DNA, 25 bp, Mus musculus
tacaatttggtcctcaggaaaaatt

SEQ ID NO: 741337 - DNA, 25 bp, Mus musculus
tacaatttggtcgtcaggaaaaatt

SEQ ID NO: 741338 - DNA, 25 bp, Mus musculus
tacaattttgacatcaggcctgaga

SEQ ID NO: 741339 - DNA, 25 bp, Mus musculus
tacaattttgacttcaggcctgaga

SEQ ID NO: 741340 - DNA, 25 bp, Mus musculus
tacacaaaagaccaatctcctgttg

SEQ ID NO: 741341 - DNA, 25 bp, Mus musculus
tacacaaaagacgaatctcctgttg

SEQ ID NO: 741342 - DNA, 25 bp, Mus musculus
tacacaaaaggtagtgatgaccctg

SEQ ID NO: 741343 - DNA, 25 bp, Mus musculus
tacacaaaaggttgtgatgaccctg

SEQ ID NO: 741344 - DNA, 25 bp, Mus musculus
tacacaaaattgactgatcctgcca

SEQ ID NO: 741345 - DNA, 25 bp, Mus musculus
tacacaaaattgtctgatcctgcca

SEQ ID NO: 741346 - DNA, 25 bp, Mus musculus
tacacaaacgcgctcattcatgagg

SEQ ID NO: 741347 - DNA, 25 bp, Mus musculus
tacacaaacgcggtcattcatgagg

SEQ ID NO: 741348 - DNA, 25 bp, Mus musculus
tacacaaagttgaaggctacataca

SEQ ID NO: 741349 - DNA, 25 bp, Mus musculus
tacacaaagttgtaggctacataca

SEQ ID NO: 741350 - DNA, 25 bp, Mus musculus
tacacaaatggacatagcgtgccag

SEQ ID NO: 741351 - DNA, 25 bp, Mus musculus
tacacaaatggagatagcgtgccag

SEQ ID NO: 741352 - DNA, 25 bp, Mus musculus
tacacaacacctcccagtgaggaac

SEQ ID NO: 741353 - DNA, 25 bp, Mus musculus
tacacaacacctgccagtgaggaac

SEQ ID NO: 741354 - DNA, 25 bp, Mus musculus
tacacaacaggtctgacaactgggc

SEQ ID NO: 741355 - DNA, 25 bp, Mus musculus
tacacaacaggtgtgacaactgggc

SEQ ID NO: 741356 - DNA, 25 bp, Mus musculus
tacacaaccccaatgtcaaagacaa

SEQ ID NO: 741357 - DNA, 25 bp, Mus musculus
tacacaaccccattgtcaaagacaa

SEQ ID NO: 741358 - DNA, 25 bp, Mus musculus
tacacaacctacaagacggcagacg

SEQ ID NO: 741359 - DNA, 25 bp, Mus musculus
tacacaacctactagacggcagacg

SEQ ID NO: 741360 - DNA, 25 bp, Mus musculus
tacacaacgtatcggtggctgcagc

SEQ ID NO: 741361 - DNA, 25 bp, Mus musculus
tacacaacgtatgggtggctgcagc

SEQ ID NO: 741362 - DNA, 25 bp, Mus musculus
tacacaagaatgagctcctgaccat

SEQ ID NO: 741363 - DNA, 25 bp, Mus musculus
tacacaagaatgtgctcctgaccat

SEQ ID NO: 741364 - DNA, 25 bp, Mus musculus
tacacaagagctcgacttgggcccc

SEQ ID NO: 741365 - DNA, 25 bp, Mus musculus
tacacaagagctggacttgggcccc

SEQ ID NO: 741366 - DNA, 25 bp, Mus musculus
tacacaagcctaatggtagtagtgg

SEQ ID NO: 741367 - DNA, 25 bp, Mus musculus
tacacaagcctattggtagtagtgg

SEQ ID NO: 741368 - DNA, 25 bp, Mus musculus
tacacaaggaacagagaatgaagtc

SEQ ID NO: 741369 - DNA, 25 bp, Mus musculus
tacacaaggaactgagaatgaagtc

SEQ ID NO: 741370 - DNA, 25 bp, Mus musculus
tacacaaggaatatccccatcagtt

SEQ ID NO: 741371 - DNA, 25 bp, Mus musculus
tacacaaggaatttccccatcagtt

SEQ ID NO: 741372 - DNA, 25 bp, Mus musculus
tacacaaggaggaaatatagagaac

SEQ ID NO: 741373 - DNA, 25 bp, Mus musculus
tacacaaggaggtaatatagagaac

SEQ ID NO: 741374 - DNA, 25 bp, Mus musculus
tacacaagtgagctctaccctacag

SEQ ID NO: 741375 - DNA, 25 bp, Mus musculus
tacacaagtgaggtctaccctacag

SEQ ID NO: 741376 - DNA, 25 bp, Mus musculus
tacacaataaagaagatgatcatga

SEQ ID NO: 741377 - DNA, 25 bp, Mus musculus
tacacaataaagtagatgatcatga

SEQ ID NO: 741378 - DNA, 25 bp, Mus musculus
tacacaatagcaaccagatttggtg

SEQ ID NO: 741379 - DNA, 25 bp, Mus musculus
tacacaatagcatccagatttggtg

SEQ ID NO: 741380 - DNA, 25 bp, Mus musculus
tacacacaaaaacagtgcagctgtc

SEQ ID NO: 741381 - DNA, 25 bp, Mus musculus
tacacacaaaaagagtgcagctgtc

SEQ ID NO: 741382 - DNA, 25 bp, Mus musculus
tacacacacttgcagagagctcagc

SEQ ID NO: 741383 - DNA, 25 bp, Mus musculus
tacacacacttggagagagctcagc

SEQ ID NO: 741384 - DNA, 25 bp, Mus musculus
tacacacaggaccaagtcgcaacga

SEQ ID NO: 741385 - DNA, 25 bp, Mus musculus
tacacacaggacgaagtcgcaacga

SEQ ID NO: 741386 - DNA, 25 bp, Mus musculus
tacacacagggcaggaagcaggatc

SEQ ID NO: 741387 - DNA, 25 bp, Mus musculus
tacacacagggctggaagcaggatc

SEQ ID NO: 741388 - DNA, 25 bp, Mus musculus
tacacacagtcacagattcttcaga

SEQ ID NO: 741389 - DNA, 25 bp, Mus musculus
tacacacagtcagagattcttcaga

SEQ ID NO: 741390 - DNA, 25 bp, Mus musculus
tacacacagtgcacccagtcgatgt

SEQ ID NO: 741391 - DNA, 25 bp, Mus musculus
tacacacagtgctcccagtcgatgt

SEQ ID NO: 741392 - DNA, 25 bp, Mus musculus
tacacacatgacatggaggccgcac

SEQ ID NO: 741393 - DNA, 25 bp, Mus musculus
tacacacatgacttggaggccgcac

SEQ ID NO: 741394 - DNA, 25 bp, Mus musculus
tacacacatgcacaccgcggcggtg

SEQ ID NO: 741395 - DNA, 25 bp, Mus musculus
tacacacatgcagaccgcggcggtg

SEQ ID NO: 741396 - DNA, 25 bp, Mus musculus
tacacacatgcgaaacagctgacag

SEQ ID NO: 741397 - DNA, 25 bp, Mus musculus
tacacacatgcgtaacagctgacag

SEQ ID NO: 741398 - DNA, 25 bp, Mus musculus
tacacaccaagccagaagtggctgc

SEQ ID NO: 741399 - DNA, 25 bp, Mus musculus
tacacaccaagcgagaagtggctgc

SEQ ID NO: 741400 - DNA, 25 bp, Mus musculus
tacacacgaaagagatgatgctcgc

SEQ ID NO: 741401 - DNA, 25 bp, Mus musculus
tacacacgaaagtgatgatgctcgc

SEQ ID NO: 741402 - DNA, 25 bp, Mus musculus
tacacacgcaagactggttctcatc

SEQ ID NO: 741403 - DNA, 25 bp, Mus musculus
tacacacgcaagtctggttctcatc

SEQ ID NO: 741404 - DNA, 25 bp, Mus musculus
tacacacgctgaaagaaggctctgc

SEQ ID NO: 741405 - DNA, 25 bp, Mus musculus
tacacacgctgatagaaggctctgc

SEQ ID NO: 741406 - DNA, 25 bp, Mus musculus
tacacacggaatccagatgacttcc

SEQ ID NO: 741407 - DNA, 25 bp, Mus musculus
tacacacggaatgcagatgacttcc

SEQ ID NO: 741408 - DNA, 25 bp, Mus musculus
tacacacgggaacagatccaggact

SEQ ID NO: 741409 - DNA, 25 bp, Mus musculus
tacacacgggaagagatccaggact

SEQ ID NO: 741410 - DNA, 25 bp, Mus musculus
tacacacgtggaaagcctggatctg

SEQ ID NO: 741411 - DNA, 25 bp, Mus musculus
tacacacgtggatagcctggatctg

SEQ ID NO: 741412 - DNA, 25 bp, Mus musculus
tacacactacatattaaggttggcc

SEQ ID NO: 741413 - DNA, 25 bp, Mus musculus
tacacactacattttaaggttggcc

SEQ ID NO: 741414 - DNA, 25 bp, Mus musculus
tacacactagtcaccctcagagaca

SEQ ID NO: 741415 - DNA, 25 bp, Mus musculus
tacacactagtctccctcagagaca

SEQ ID NO: 741416 - DNA, 25 bp, Mus musculus
tacacactcaaacaacctgtgaggg

SEQ ID NO: 741417 - DNA, 25 bp, Mus musculus
tacacactcaaagaacctgtgaggg

SEQ ID NO: 741418 - DNA, 25 bp, Mus musculus
tacacactgcgaattgagtcctcct

SEQ ID NO: 741419 - DNA, 25 bp, Mus musculus
tacacactgcgatttgagtcctcct

SEQ ID NO: 741420 - DNA, 25 bp, Mus musculus
tacacactggaactttgcctggtca

SEQ ID NO: 741421 - DNA, 25 bp, Mus musculus
tacacactggaagtttgcctggtca

SEQ ID NO: 741422 - DNA, 25 bp, Mus musculus
tacacactggacctttctatggccg

SEQ ID NO: 741423 - DNA, 25 bp, Mus musculus
tacacactggacgtttctatggccg

SEQ ID NO: 741424 - DNA, 25 bp, Mus musculus
tacacactgtttcagtggccgtggc

SEQ ID NO: 741425 - DNA, 25 bp, Mus musculus
tacacactgtttgagtggccgtggc

SEQ ID NO: 741426 - DNA, 25 bp, Mus musculus
tacacacttgttcgattgccagatg

SEQ ID NO: 741427 - DNA, 25 bp, Mus musculus
tacacacttgttggattgccagatg

SEQ ID NO: 741428 - DNA, 25 bp, Mus musculus
tacacagaacatccccatcaagtgg

SEQ ID NO: 741429 - DNA, 25 bp, Mus musculus
tacacagaacatgcccatcaagtgg

SEQ ID NO: 741430 - DNA, 25 bp, Mus musculus
tacacagacaccagggaaattctac

SEQ ID NO: 741431 - DNA, 25 bp, Mus musculus
tacacagacacctgggaaattctac

SEQ ID NO: 741432 - DNA, 25 bp, Mus musculus
tacacagacattctcaaaatgctgc

SEQ ID NO: 741433 - DNA, 25 bp, Mus musculus
tacacagacattgtcaaaatgctgc

SEQ ID NO: 741434 - DNA, 25 bp, Mus musculus
tacacagaccccaaggtggtggccc

SEQ ID NO: 741435 - DNA, 25 bp, Mus musculus
tacacagacccctaggtggtggccc

SEQ ID NO: 741436 - DNA, 25 bp, Mus musculus
tacacagagattccaaacgcttcca

SEQ ID NO: 741437 - DNA, 25 bp, Mus musculus
tacacagagattgcaaacgcttcca

SEQ ID NO: 741438 - DNA, 25 bp, Mus musculus
tacacagagcgtaacatgggtctcc

SEQ ID NO: 741439 - DNA, 25 bp, Mus musculus
tacacagagcgttacatgggtctcc

SEQ ID NO: 741440 - DNA, 25 bp, Mus musculus
tacacagaggcaatatgaagctgag

SEQ ID NO: 741441 - DNA, 25 bp, Mus musculus
tacacagaggcattatgaagctgag

SEQ ID NO: 741442 - DNA, 25 bp, Mus musculus
tacacagaggccatccaaagccaga

SEQ ID NO: 741443 - DNA, 25 bp, Mus musculus
tacacagaggccttccaaagccaga

SEQ ID NO: 741444 - DNA, 25 bp, Mus musculus
tacacagataagcacacaggatgaa

SEQ ID NO: 741445 - DNA, 25 bp, Mus musculus
tacacagataaggacacaggatgaa

SEQ ID NO: 741446 - DNA, 25 bp, Mus musculus
tacacagatcccctggaagctgtaa

SEQ ID NO: 741447 - DNA, 25 bp, Mus musculus
tacacagatcccgtggaagctgtaa

SEQ ID NO: 741448 - DNA, 25 bp, Mus musculus
tacacagatgcactgatccacgaag

SEQ ID NO: 741449 - DNA, 25 bp, Mus musculus
tacacagatgcagtgatccacgaag

SEQ ID NO: 741450 - DNA, 25 bp, Mus musculus
tacacagatgtcaatgataaaaaca

SEQ ID NO: 741451 - DNA, 25 bp, Mus musculus
tacacagatgtctatgataaaaaca

SEQ ID NO: 741452 - DNA, 25 bp, Mus musculus
tacacagatgtgatgtgcaacccct

SEQ ID NO: 741453 - DNA, 25 bp, Mus musculus
tacacagatgtgttgtgcaacccct

SEQ ID NO: 741454 - DNA, 25 bp, Mus musculus
tacacagatttactcgccatacaaa

SEQ ID NO: 741455 - DNA, 25 bp, Mus musculus
tacacagatttagtcgccatacaaa

SEQ ID NO: 741456 - DNA, 25 bp, Mus musculus
tacacagcaacaaccctgatgcaga

SEQ ID NO: 741457 - DNA, 25 bp, Mus musculus
tacacagcaacatccctgatgcaga

SEQ ID NO: 741458 - DNA, 25 bp, Mus musculus
tacacagcacagattacgagagggc

SEQ ID NO: 741459 - DNA, 25 bp, Mus musculus
tacacagcacagtttacgagagggc

SEQ ID NO: 741460 - DNA, 25 bp, Mus musculus
tacacagcacgcatattcgcggcag

SEQ ID NO: 741461 - DNA, 25 bp, Mus musculus
tacacagcacgcttattcgcggcag

SEQ ID NO: 741462 - DNA, 25 bp, Mus musculus
tacacagcagaacccattgatgact

SEQ ID NO: 741463 - DNA, 25 bp, Mus musculus
tacacagcagaagccattgatgact

SEQ ID NO: 741464 - DNA, 25 bp, Mus musculus
tacacagccaggaacagcctaggtg

SEQ ID NO: 741465 - DNA, 25 bp, Mus musculus
tacacagccaggtacagcctaggtg

SEQ ID NO: 741466 - DNA, 25 bp, Mus musculus
tacacagctgcaccgcccagaatga

SEQ ID NO: 741467 - DNA, 25 bp, Mus musculus
tacacagctgcagcgcccagaatga

SEQ ID NO: 741468 - DNA, 25 bp, Mus musculus
tacacagctgctcactgtggagcag

SEQ ID NO: 741469 - DNA, 25 bp, Mus musculus
tacacagctgctgactgtggagcag

SEQ ID NO: 741470 - DNA, 25 bp, Mus musculus
tacacagcttcaaacaacatttatg

SEQ ID NO: 741471 - DNA, 25 bp, Mus musculus
tacacagcttcatacaacatttatg

SEQ ID NO: 741472 - DNA, 25 bp, Mus musculus
tacacaggacggagctcttcgctgc

SEQ ID NO: 741473 - DNA, 25 bp, Mus musculus
tacacaggacggtgctcttcgctgc

SEQ ID NO: 741474 - DNA, 25 bp, Mus musculus
tacacaggactgagcaactttgtgg

SEQ ID NO: 741475 - DNA, 25 bp, Mus musculus
tacacaggactgtgcaactttgtgg

SEQ ID NO: 741476 - DNA, 25 bp, Mus musculus
tacacaggagccacttgtcacagct

SEQ ID NO: 741477 - DNA, 25 bp, Mus musculus
tacacaggagcctcttgtcacagct

SEQ ID NO: 741478 - DNA, 25 bp, Mus musculus
tacacaggcaaaaactttgacaaag

SEQ ID NO: 741479 - DNA, 25 bp, Mus musculus
tacacaggcaaatactttgacaaag

SEQ ID NO: 741480 - DNA, 25 bp, Mus musculus
tacacaggctttaagagaacgactc

SEQ ID NO: 741481 - DNA, 25 bp, Mus musculus
tacacaggcttttagagaacgactc

SEQ ID NO: 741482 - DNA, 25 bp, Mus musculus
tacacagggacaatcaagaccaatc

SEQ ID NO: 741483 - DNA, 25 bp, Mus musculus
tacacagggacattcaagaccaatc

SEQ ID NO: 741484 - DNA, 25 bp, Mus musculus
tacacagggtctagcagataacgcc

SEQ ID NO: 741485 - DNA, 25 bp, Mus musculus
tacacagggtcttgcagataacgcc

SEQ ID NO: 741486 - DNA, 25 bp, Mus musculus
tacacagggttgatcatgacattcc

SEQ ID NO: 741487 - DNA, 25 bp, Mus musculus
tacacagggttgttcatgacattcc

SEQ ID NO: 741488 - DNA, 25 bp, Mus musculus
tacacaggtgtccaagcagagactc

SEQ ID NO: 741489 - DNA, 25 bp, Mus musculus
tacacaggtgtcgaagcagagactc

SEQ ID NO: 741490 - DNA, 25 bp, Mus musculus
tacacagtaaggacacagccatggg

SEQ ID NO: 741491 - DNA, 25 bp, Mus musculus
tacacagtaaggtcacagccatggg

SEQ ID NO: 741492 - DNA, 25 bp, Mus musculus
tacacagtacagcatctgtgctgcc

SEQ ID NO: 741493 - DNA, 25 bp, Mus musculus
tacacagtacaggatctgtgctgcc

SEQ ID NO: 741494 - DNA, 25 bp, Mus musculus
tacacagtcaggaccttccacttgc

SEQ ID NO: 741495 - DNA, 25 bp, Mus musculus
tacacagtcaggtccttccacttgc

SEQ ID NO: 741496 - DNA, 25 bp, Mus musculus
tacacagtcatcagccactacagtg

SEQ ID NO: 741497 - DNA, 25 bp, Mus musculus
tacacagtcatctgccactacagtg

SEQ ID NO: 741498 - DNA, 25 bp, Mus musculus
tacacagtgttcaaccacgttcaag

SEQ ID NO: 741499 - DNA, 25 bp, Mus musculus
tacacagtgttctaccacgttcaag

SEQ ID NO: 741500 - DNA, 25 bp, Mus musculus
tacacagttattcattagtccaagt

SEQ ID NO: 741501 - DNA, 25 bp, Mus musculus
tacacagttattgattagtccaagt

SEQ ID NO: 741502 - DNA, 25 bp, Mus musculus
tacacagttcctccctgggtcacag

SEQ ID NO: 741503 - DNA, 25 bp, Mus musculus
tacacagttcctgcctgggtcacag

SEQ ID NO: 741504 - DNA, 25 bp, Mus musculus
tacacatacgagagttctgagcaag

SEQ ID NO: 741505 - DNA, 25 bp, Mus musculus
tacacatacgagtgttctgagcaag

SEQ ID NO: 741506 - DNA, 25 bp, Mus musculus
tacacatagaccacactgcggggcg

SEQ ID NO: 741507 - DNA, 25 bp, Mus musculus
tacacatagacctcactgcggggcg

SEQ ID NO: 741508 - DNA, 25 bp, Mus musculus
tacacatcacgtcatgagattgcca

SEQ ID NO: 741509 - DNA, 25 bp, Mus musculus
tacacatcacgtgatgagattgcca

SEQ ID NO: 741510 - DNA, 25 bp, Mus musculus
tacacatgaccaagggtcctaccac

SEQ ID NO: 741511 - DNA, 25 bp, Mus musculus
tacacatgaccatgggtcctaccac

SEQ ID NO: 741512 - DNA, 25 bp, Mus musculus
tacacatgacttccagtccaaaggc

SEQ ID NO: 741513 - DNA, 25 bp, Mus musculus
tacacatgacttgcagtccaaaggc

SEQ ID NO: 741514 - DNA, 25 bp, Mus musculus
tacacatggaagctcctgtcaaggt

SEQ ID NO: 741515 - DNA, 25 bp, Mus musculus
tacacatggaaggtcctgtcaaggt

SEQ ID NO: 741516 - DNA, 25 bp, Mus musculus
tacacatggacaaaccccacctgtt

SEQ ID NO: 741517 - DNA, 25 bp, Mus musculus
tacacatggacataccccacctgtt

SEQ ID NO: 741518 - DNA, 25 bp, Mus musculus
tacacatgtacaacttgcaaacagc

SEQ ID NO: 741519 - DNA, 25 bp, Mus musculus
tacacatgtacatcttgcaaacagc

SEQ ID NO: 741520 - DNA, 25 bp, Mus musculus
tacacattagttctgtcatctaaca

SEQ ID NO: 741521 - DNA, 25 bp, Mus musculus
tacacattagttgtgtcatctaaca

SEQ ID NO: 741522 - DNA, 25 bp, Mus musculus
tacacattcacgctctgagttcctg

SEQ ID NO: 741523 - DNA, 25 bp, Mus musculus
tacacattcacggtctgagttcctg

SEQ ID NO: 741524 - DNA, 25 bp, Mus musculus
tacacatttagcaagaagtttcggc

SEQ ID NO: 741525 - DNA, 25 bp, Mus musculus
tacacatttagctagaagtttcggc

SEQ ID NO: 741526 - DNA, 25 bp, Mus musculus
tacacatttcaacgatacccagcat

SEQ ID NO: 741527 - DNA, 25 bp, Mus musculus
tacacatttcaaggatacccagcat

SEQ ID NO: 741528 - DNA, 25 bp, Mus musculus
tacacatttgacctgaaccgtgaag

SEQ ID NO: 741529 - DNA, 25 bp, Mus musculus
tacacatttgacgtgaaccgtgaag

SEQ ID NO: 741530 - DNA, 25 bp, Mus musculus
tacacatttgatatcaacctgtctg

SEQ ID NO: 741531 - DNA, 25 bp, Mus musculus
tacacatttgatttcaacctgtctg

SEQ ID NO: 741532 - DNA, 25 bp, Mus musculus
tacacatttgcaccccacatggatg

SEQ ID NO: 741533 - DNA, 25 bp, Mus musculus
tacacatttgcagcccacatggatg

SEQ ID NO: 741534 - DNA, 25 bp, Mus musculus
tacaccaaaatgaagcctcggaggg

SEQ ID NO: 741535 - DNA, 25 bp, Mus musculus
tacaccaaaatgtagcctcggaggg

SEQ ID NO: 741536 - DNA, 25 bp, Mus musculus
tacaccaaaggcctggagattacag

SEQ ID NO: 741537 - DNA, 25 bp, Mus musculus
tacaccaaaggcgtggagattacag

SEQ ID NO: 741538 - DNA, 25 bp, Mus musculus
tacaccaagctcactgacgctcagg

SEQ ID NO: 741539 - DNA, 25 bp, Mus musculus
tacaccaagctctctgacgctcagg

SEQ ID NO: 741540 - DNA, 25 bp, Mus musculus
tacaccaaggaccacactgtgcgct

SEQ ID NO: 741541 - DNA, 25 bp, Mus musculus
tacaccaaggacgacactgtgcgct

SEQ ID NO: 741542 - DNA, 25 bp, Mus musculus
tacaccaaggctagctaaaggatgg

SEQ ID NO: 741543 - DNA, 25 bp, Mus musculus
tacaccaaggcttgctaaaggatgg

SEQ ID NO: 741544 - DNA, 25 bp, Mus musculus
tacaccaatgccaagaagcagatgc

SEQ ID NO: 741545 - DNA, 25 bp, Mus musculus
tacaccaatgcctagaagcagatgc

SEQ ID NO: 741546 - DNA, 25 bp, Mus musculus
tacaccaatggcaagtgcgtcatcc

SEQ ID NO: 741547 - DNA, 25 bp, Mus musculus
tacaccaatggctagtgcgtcatcc

SEQ ID NO: 741548 - DNA, 25 bp, Mus musculus
tacaccacaaatccatccacaaaag

SEQ ID NO: 741549 - DNA, 25 bp, Mus musculus
tacaccacaaatgcatccacaaaag

SEQ ID NO: 741550 - DNA, 25 bp, Mus musculus
tacaccacagagatcctatacaacc

SEQ ID NO: 741551 - DNA, 25 bp, Mus musculus
tacaccacagagttcctatacaacc

SEQ ID NO: 741552 - DNA, 25 bp, Mus musculus
tacaccacaggccaggtgtttgatt

SEQ ID NO: 741553 - DNA, 25 bp, Mus musculus
tacaccacaggcgaggtgtttgatt

SEQ ID NO: 741554 - DNA, 25 bp, Mus musculus
tacaccacgagaacacatgctctgg

SEQ ID NO: 741555 - DNA, 25 bp, Mus musculus
tacaccacgagatcacatgctctgg

SEQ ID NO: 741556 - DNA, 25 bp, Mus musculus
tacaccactacgcacgggctgtgat

SEQ ID NO: 741557 - DNA, 25 bp, Mus musculus
tacaccactacggacgggctgtgat

SEQ ID NO: 741558 - DNA, 25 bp, Mus musculus
tacaccacttacaaccagacgggat

SEQ ID NO: 741559 - DNA, 25 bp, Mus musculus
tacaccacttactaccagacgggat

SEQ ID NO: 741560 - DNA, 25 bp, Mus musculus
tacaccagacttcatgccattcagg

SEQ ID NO: 741561 - DNA, 25 bp, Mus musculus
tacaccagacttgatgccattcagg

SEQ ID NO: 741562 - DNA, 25 bp, Mus musculus
tacaccaggtgaagaggacaggcat

SEQ ID NO: 741563 - DNA, 25 bp, Mus musculus
tacaccaggtgatgaggacaggcat

SEQ ID NO: 741564 - DNA, 25 bp, Mus musculus
tacaccagtaagatcataagcagcg

SEQ ID NO: 741565 - DNA, 25 bp, Mus musculus
tacaccagtaagttcataagcagcg

SEQ ID NO: 741566 - DNA, 25 bp, Mus musculus
tacaccagtgaaaggagttttacaa

SEQ ID NO: 741567 - DNA, 25 bp, Mus musculus
tacaccagtgaatggagttttacaa

SEQ ID NO: 741568 - DNA, 25 bp, Mus musculus
tacaccagtgagaaagaaagttcct

SEQ ID NO: 741569 - DNA, 25 bp, Mus musculus
tacaccagtgagtaagaaagttcct

SEQ ID NO: 741570 - DNA, 25 bp, Mus musculus
tacaccatcatgaatcccatcgggc

SEQ ID NO: 741571 - DNA, 25 bp, Mus musculus
tacaccatcatgtatcccatcgggc

SEQ ID NO: 741572 - DNA, 25 bp, Mus musculus
tacaccatcctgaagcctcggaaag

SEQ ID NO: 741573 - DNA, 25 bp, Mus musculus
tacaccatcctgtagcctcggaaag

SEQ ID NO: 741574 - DNA, 25 bp, Mus musculus
tacaccatctacctgggttttgggc

SEQ ID NO: 741575 - DNA, 25 bp, Mus musculus
tacaccatctacgtgggttttgggc

SEQ ID NO: 741576 - DNA, 25 bp, Mus musculus
tacaccatcttgactgtgcagctct

SEQ ID NO: 741577 - DNA, 25 bp, Mus musculus
tacaccatcttgtctgtgcagctct

SEQ ID NO: 741578 - DNA, 25 bp, Mus musculus
tacaccatgatcacaccatttttag

SEQ ID NO: 741579 - DNA, 25 bp, Mus musculus
tacaccatgatcatccacaccagag

SEQ ID NO: 741580 - DNA, 25 bp, Mus musculus
tacaccatgatctcaccatttttag

SEQ ID NO: 741581 - DNA, 25 bp, Mus musculus
tacaccatgatcttccacaccagag

SEQ ID NO: 741582 - DNA, 25 bp, Mus musculus
tacaccatgatgaaggatcagtatg

SEQ ID NO: 741583 - DNA, 25 bp, Mus musculus
tacaccatgatgtaggatcagtatg

SEQ ID NO: 741584 - DNA, 25 bp, Mus musculus
tacaccatgcttctgtgagcatatg

SEQ ID NO: 741585 - DNA, 25 bp, Mus musculus
tacaccatgcttgtgtgagcatatg

SEQ ID NO: 741586 - DNA, 25 bp, Mus musculus
tacaccatggccatgaatgaactgt

SEQ ID NO: 741587 - DNA, 25 bp, Mus musculus
tacaccatggccttgaatgaactgt

SEQ ID NO: 741588 - DNA, 25 bp, Mus musculus
tacaccatgtcgcacagtcgggacc

SEQ ID NO: 741589 - DNA, 25 bp, Mus musculus
tacaccatgtcggacagtcgggacc

SEQ ID NO: 741590 - DNA, 25 bp, Mus musculus
tacaccattcctccttctgaaacaa

SEQ ID NO: 741591 - DNA, 25 bp, Mus musculus
tacaccattcctgcttctgaaacaa

SEQ ID NO: 741592 - DNA, 25 bp, Mus musculus
tacacccaaattagcatatggaaaa

SEQ ID NO: 741593 - DNA, 25 bp, Mus musculus
tacacccaaatttgcatatggaaaa

SEQ ID NO: 741594 - DNA, 25 bp, Mus musculus
tacacccaacagcatggtagccagt

SEQ ID NO: 741595 - DNA, 25 bp, Mus musculus
tacacccaacaggatggtagccagt

SEQ ID NO: 741596 - DNA, 25 bp, Mus musculus
tacacccagacaagtatatactcaa

SEQ ID NO: 741597 - DNA, 25 bp, Mus musculus
tacacccagacatgtatatactcaa

SEQ ID NO: 741598 - DNA, 25 bp, Mus musculus
tacacccagactctgagaaagagca

SEQ ID NO: 741599 - DNA, 25 bp, Mus musculus
tacacccagactgtgagaaagagca

SEQ ID NO: 741600 - DNA, 25 bp, Mus musculus
tacacccagctcagtcgttaagtgc

SEQ ID NO: 741601 - DNA, 25 bp, Mus musculus
tacacccagctctgtcgttaagtgc

SEQ ID NO: 741602 - DNA, 25 bp, Mus musculus
tacacccaggagcttcggttggaac

SEQ ID NO: 741603 - DNA, 25 bp, Mus musculus
tacacccaggaggttcggttggaac

SEQ ID NO: 741604 - DNA, 25 bp, Mus musculus
tacacccagtatccctatgtatggc

SEQ ID NO: 741605 - DNA, 25 bp, Mus musculus
tacacccagtatgcctatgtatggc

SEQ ID NO: 741606 - DNA, 25 bp, Mus musculus
tacacccagtctaatccaatgagaa

SEQ ID NO: 741607 - DNA, 25 bp, Mus musculus
tacacccagtcttatccaatgagaa

SEQ ID NO: 741608 - DNA, 25 bp, Mus musculus
tacaccccaatgcatctcgcagtgg

SEQ ID NO: 741609 - DNA, 25 bp, Mus musculus
tacaccccaatggatctcgcagtgg

SEQ ID NO: 741610 - DNA, 25 bp, Mus musculus
tacaccccaggacacttactttaag

SEQ ID NO: 741611 - DNA, 25 bp, Mus musculus
tacaccccaggagacttactttaag

SEQ ID NO: 741612 - DNA, 25 bp, Mus musculus
tacaccccagtcatggaaagcctct

SEQ ID NO: 741613 - DNA, 25 bp, Mus musculus
tacaccccagtcttggaaagcctct

SEQ ID NO: 741614 - DNA, 25 bp, Mus musculus
tacacccctgtgacgagcgatgatg

SEQ ID NO: 741615 - DNA, 25 bp, Mus musculus
tacacccctgtgtcgagcgatgatg

SEQ ID NO: 741616 - DNA, 25 bp, Mus musculus
tacacccgccgcagcgaataattcg

SEQ ID NO: 741617 - DNA, 25 bp, Mus musculus
tacacccgccgctgcgaataattcg

SEQ ID NO: 741618 - DNA, 25 bp, Mus musculus
tacacccggaaacatgtgcgtcgcc

SEQ ID NO: 741619 - DNA, 25 bp, Mus musculus
tacacccggaaagatgtgcgtcgcc

SEQ ID NO: 741620 - DNA, 25 bp, Mus musculus
tacaccctggtgaggcagccacaca

SEQ ID NO: 741621 - DNA, 25 bp, Mus musculus
tacaccctggtgtggcagccacaca

SEQ ID NO: 741622 - DNA, 25 bp, Mus musculus
tacaccgaacttcactttcagtctg

SEQ ID NO: 741623 - DNA, 25 bp, Mus musculus
tacaccgaacttgactttcagtctg

SEQ ID NO: 741624 - DNA, 25 bp, Mus musculus
tacaccgacgtgcttcagaaaatca

SEQ ID NO: 741625 - DNA, 25 bp, Mus musculus
tacaccgacgtggttcagaaaatca

SEQ ID NO: 741626 - DNA, 25 bp, Mus musculus
tacaccgaggagctgaaagtggccc

SEQ ID NO: 741627 - DNA, 25 bp, Mus musculus
tacaccgaggaggtgaaagtggccc

SEQ ID NO: 741628 - DNA, 25 bp, Mus musculus
tacaccgaggccaacgtgtgtgtgt

SEQ ID NO: 741629 - DNA, 25 bp, Mus musculus
tacaccgaggcctacgtgtgtgtgt

SEQ ID NO: 741630 - DNA, 25 bp, Mus musculus
tacaccgagtagagaacgtcagcca

SEQ ID NO: 741631 - DNA, 25 bp, Mus musculus
tacaccgagtagtgaacgtcagcca

SEQ ID NO: 741632 - DNA, 25 bp, Mus musculus
tacaccgagtttcgcaagatgtccc

SEQ ID NO: 741633 - DNA, 25 bp, Mus musculus
tacaccgagtttggcaagatgtccc

SEQ ID NO: 741634 - DNA, 25 bp, Mus musculus
tacaccgatgtgcaaagcttcgatt

SEQ ID NO: 741635 - DNA, 25 bp, Mus musculus
tacaccgatgtggaaagcttcgatt

SEQ ID NO: 741636 - DNA, 25 bp, Mus musculus
tacaccggcattcgctgtgagcagc

SEQ ID NO: 741637 - DNA, 25 bp, Mus musculus
tacaccggcattggctgtgagcagc

SEQ ID NO: 741638 - DNA, 25 bp, Mus musculus
tacaccggcggcctcaagcacgaga

SEQ ID NO: 741639 - DNA, 25 bp, Mus musculus
tacaccggcggcgtcaagcacgaga

SEQ ID NO: 741640 - DNA, 25 bp, Mus musculus
tacaccgggatgagtgagaaccttg

SEQ ID NO: 741641 - DNA, 25 bp, Mus musculus
tacaccgggatgtgtgagaaccttg

SEQ ID NO: 741642 - DNA, 25 bp, Mus musculus
tacaccgtcttcatggccttgccgt

SEQ ID NO: 741643 - DNA, 25 bp, Mus musculus
tacaccgtcttcttggccttgccgt

SEQ ID NO: 741644 - DNA, 25 bp, Mus musculus
tacaccgtggcactaaggtcagttg

SEQ ID NO: 741645 - DNA, 25 bp, Mus musculus
tacaccgtggcagtaaggtcagttg

SEQ ID NO: 741646 - DNA, 25 bp, Mus musculus
tacaccgtgggaaattccatgtctc

SEQ ID NO: 741647 - DNA, 25 bp, Mus musculus
tacaccgtgggatattccatgtctc

SEQ ID NO: 741648 - DNA, 25 bp, Mus musculus
tacaccgttgtccatgggaagctga

SEQ ID NO: 741649 - DNA, 25 bp, Mus musculus
tacaccgttgtcgatgggaagctga

SEQ ID NO: 741650 - DNA, 25 bp, Mus musculus
tacaccgtttacctagagctggaga

SEQ ID NO: 741651 - DNA, 25 bp, Mus musculus
tacaccgtttacgtagagctggaga

SEQ ID NO: 741652 - DNA, 25 bp, Mus musculus
tacaccgtttctctatgacctggtt

SEQ ID NO: 741653 - DNA, 25 bp, Mus musculus
tacaccgtttctgtatgacctggtt

SEQ ID NO: 741654 - DNA, 25 bp, Mus musculus
tacacctatggcaagcacatcctgg

SEQ ID NO: 741655 - DNA, 25 bp, Mus musculus
tacacctatggctagcacatcctgg

SEQ ID NO: 741656 - DNA, 25 bp, Mus musculus
tacacctatgggaaagagtacaatg

SEQ ID NO: 741657 - DNA, 25 bp, Mus musculus
tacacctatgggtaagagtacaatg

SEQ ID NO: 741658 - DNA, 25 bp, Mus musculus
tacacctcacgccagctcaggagga

SEQ ID NO: 741659 - DNA, 25 bp, Mus musculus
tacacctcacgcgagctcaggagga

SEQ ID NO: 741660 - DNA, 25 bp, Mus musculus
tacacctcaggacggcccagtgttg

SEQ ID NO: 741661 - DNA, 25 bp, Mus musculus
tacacctcaggagggcccagtgttg

SEQ ID NO: 741662 - DNA, 25 bp, Mus musculus
tacacctctcaaatagtgggtagat

SEQ ID NO: 741663 - DNA, 25 bp, Mus musculus
tacacctctcaattagtgggtagat

SEQ ID NO: 741664 - DNA, 25 bp, Mus musculus
tacacctctcatcgaggcttctcag

SEQ ID NO: 741665 - DNA, 25 bp, Mus musculus
tacacctctcatggaggcttctcag

SEQ ID NO: 741666 - DNA, 25 bp, Mus musculus
tacacctctggacgtggctaagaca

SEQ ID NO: 741667 - DNA, 25 bp, Mus musculus
tacacctctggaggtggctaagaca

SEQ ID NO: 741668 - DNA, 25 bp, Mus musculus
tacacctgagctaatctgcacaagg

SEQ ID NO: 741669 - DNA, 25 bp, Mus musculus
tacacctgagcttatctgcacaagg

SEQ ID NO: 741670 - DNA, 25 bp, Mus musculus
tacacctgcatcctggagaatgagt

SEQ ID NO: 741671 - DNA, 25 bp, Mus musculus
tacacctgcatcgtggagaatgagt

SEQ ID NO: 741672 - DNA, 25 bp, Mus musculus
tacacctgccgtctggatcacaggg

SEQ ID NO: 741673 - DNA, 25 bp, Mus musculus
tacacctgccgtgtggatcacaggg

SEQ ID NO: 741674 - DNA, 25 bp, Mus musculus
tacacctggatcagcacactcacag

SEQ ID NO: 741675 - DNA, 25 bp, Mus musculus
tacacctggatctgcacactcacag

SEQ ID NO: 741676 - DNA, 25 bp, Mus musculus
tacacctgggtcaggcactgtccat

SEQ ID NO: 741677 - DNA, 25 bp, Mus musculus
tacacctgggtctggcactgtccat

SEQ ID NO: 741678 - DNA, 25 bp, Mus musculus
tacaccttaactccgtatatccatc

SEQ ID NO: 741679 - DNA, 25 bp, Mus musculus
tacaccttaactgcgtatatccatc

SEQ ID NO: 741680 - DNA, 25 bp, Mus musculus
tacaccttatgtcgagcaggagaca

SEQ ID NO: 741681 - DNA, 25 bp, Mus musculus
tacaccttatgtggagcaggagaca

SEQ ID NO: 741682 - DNA, 25 bp, Mus musculus
tacaccttcactcaacgcatgatgg

SEQ ID NO: 741683 - DNA, 25 bp, Mus musculus
tacaccttcactgaacgcatgatgg

SEQ ID NO: 741684 - DNA, 25 bp, Mus musculus
tacaccttgaagagtgttctgagtg

SEQ ID NO: 741685 - DNA, 25 bp, Mus musculus
tacaccttgaagtgtgttctgagtg

SEQ ID NO: 741686 - DNA, 25 bp, Mus musculus
tacaccttgcgacagaccaggtcgg

SEQ ID NO: 741687 - DNA, 25 bp, Mus musculus
tacaccttgcgagagaccaggtcgg

SEQ ID NO: 741688 - DNA, 25 bp, Mus musculus
tacaccttggcgattgagcatgacc

SEQ ID NO: 741689 - DNA, 25 bp, Mus musculus
tacaccttggcgtttgagcatgacc

SEQ ID NO: 741690 - DNA, 25 bp, Mus musculus
tacaccttttggaactcgaggagaa

SEQ ID NO: 741691 - DNA, 25 bp, Mus musculus
tacaccttttggtactcgaggagaa

SEQ ID NO: 741692 - DNA, 25 bp, Mus musculus
tacacgaaactactgaacgaggcga

SEQ ID NO: 741693 - DNA, 25 bp, Mus musculus
tacacgaaactagtgaacgaggcga

SEQ ID NO: 741694 - DNA, 25 bp, Mus musculus
tacacgacgaacctcttgactgccg

SEQ ID NO: 741695 - DNA, 25 bp, Mus musculus
tacacgacgaacgtcttgactgccg

SEQ ID NO: 741696 - DNA, 25 bp, Mus musculus
tacacgagctgtagggccatggcag

SEQ ID NO: 741697 - DNA, 25 bp, Mus musculus
tacacgagctgttgggccatggcag

SEQ ID NO: 741698 - DNA, 25 bp, Mus musculus
tacacgagtgacagtgctgggtcat

SEQ ID NO: 741699 - DNA, 25 bp, Mus musculus
tacacgagtgactgtgctgggtcat

SEQ ID NO: 741700 - DNA, 25 bp, Mus musculus
tacacgagttccatgctgatctacg

SEQ ID NO: 741701 - DNA, 25 bp, Mus musculus
tacacgagttccttgctgatctacg

SEQ ID NO: 741702 - DNA, 25 bp, Mus musculus
tacacgatcagactgtcattcgcaa

SEQ ID NO: 741703 - DNA, 25 bp, Mus musculus
tacacgatcagagtgtcattcgcaa

SEQ ID NO: 741704 - DNA, 25 bp, Mus musculus
tacacgatttcaaattaaccagcct

SEQ ID NO: 741705 - DNA, 25 bp, Mus musculus
tacacgatttcatattaaccagcct

SEQ ID NO: 741706 - DNA, 25 bp, Mus musculus
tacacgcatcgtctctcagatcaag

SEQ ID NO: 741707 - DNA, 25 bp, Mus musculus
tacacgcatcgtgtctcagatcaag

SEQ ID NO: 741708 - DNA, 25 bp, Mus musculus
tacacgctggaaattgatgggaaga

SEQ ID NO: 741709 - DNA, 25 bp, Mus musculus
tacacgctggaatttgatgggaaga

SEQ ID NO: 741710 - DNA, 25 bp, Mus musculus
tacacggacatcctgaggttgctgc

SEQ ID NO: 741711 - DNA, 25 bp, Mus musculus
tacacggacatcgtgaggttgctgc

SEQ ID NO: 741712 - DNA, 25 bp, Mus musculus
tacacggaccccagtgggatggtgc

SEQ ID NO: 741713 - DNA, 25 bp, Mus musculus
tacacggacccctgtgggatggtgc

SEQ ID NO: 741714 - DNA, 25 bp, Mus musculus
tacacggacttcaaagagggtacca

SEQ ID NO: 741715 - DNA, 25 bp, Mus musculus
tacacggacttctaagagggtacca

SEQ ID NO: 741716 - DNA, 25 bp, Mus musculus
tacacggagttccttccaagaactg

SEQ ID NO: 741717 - DNA, 25 bp, Mus musculus
tacacggagttcgttccaagaactg

SEQ ID NO: 741718 - DNA, 25 bp, Mus musculus
tacacggatgaacaccacgggatcg

SEQ ID NO: 741719 - DNA, 25 bp, Mus musculus
tacacggatgaagaccacgggatcg

SEQ ID NO: 741720 - DNA, 25 bp, Mus musculus
tacacggccaaaaaagtcggtggtg

SEQ ID NO: 741721 - DNA, 25 bp, Mus musculus
tacacggccaaataagtcggtggtg

SEQ ID NO: 741722 - DNA, 25 bp, Mus musculus
tacacggctcaacgagagaactgac

SEQ ID NO: 741723 - DNA, 25 bp, Mus musculus
tacacggctcaaggagagaactgac

SEQ ID NO: 741724 - DNA, 25 bp, Mus musculus
tacacgggattgacacgggtatctg

SEQ ID NO: 741725 - DNA, 25 bp, Mus musculus
tacacgggattgtcacgggtatctg

SEQ ID NO: 741726 - DNA, 25 bp, Mus musculus
tacacgggtgatctaacaattctac

SEQ ID NO: 741727 - DNA, 25 bp, Mus musculus
tacacgggtgatgtaacaattctac

SEQ ID NO: 741728 - DNA, 25 bp, Mus musculus
tacacggtccagctaaagggataag

SEQ ID NO: 741729 - DNA, 25 bp, Mus musculus
tacacggtccaggtaaagggataag

SEQ ID NO: 741730 - DNA, 25 bp, Mus musculus
tacacggtccttccacagtgccgga

SEQ ID NO: 741731 - DNA, 25 bp, Mus musculus
tacacggtccttgcacagtgccgga

SEQ ID NO: 741732 - DNA, 25 bp, Mus musculus
tacacggtgcaactgctggaagcca

SEQ ID NO: 741733 - DNA, 25 bp, Mus musculus
tacacggtgcaagtgctggaagcca

SEQ ID NO: 741734 - DNA, 25 bp, Mus musculus
tacacggtgccgatttcagcacgaa

SEQ ID NO: 741735 - DNA, 25 bp, Mus musculus
tacacggtgccgttttcagcacgaa

SEQ ID NO: 741736 - DNA, 25 bp, Mus musculus
tacacgtacgatctgaacgggaaac

SEQ ID NO: 741737 - DNA, 25 bp, Mus musculus
tacacgtacgatgtgaacgggaaac

SEQ ID NO: 741738 - DNA, 25 bp, Mus musculus
tacacgtcaacaccaagggccatgt

SEQ ID NO: 741739 - DNA, 25 bp, Mus musculus
tacacgtcaacagcaagggccatgt

SEQ ID NO: 741740 - DNA, 25 bp, Mus musculus
tacacgtcacccatagtcaagaacc

SEQ ID NO: 741741 - DNA, 25 bp, Mus musculus
tacacgtcacccttagtcaagaacc

SEQ ID NO: 741742 - DNA, 25 bp, Mus musculus
tacacgtggactactgtcaggcctg

SEQ ID NO: 741743 - DNA, 25 bp, Mus musculus
tacacgtggacttctgtcaggcctg

SEQ ID NO: 741744 - DNA, 25 bp, Mus musculus
tacacgtgtggaacacgaaacagcc

SEQ ID NO: 741745 - DNA, 25 bp, Mus musculus
tacacgtgtggatcacgaaacagcc

SEQ ID NO: 741746 - DNA, 25 bp, Mus musculus
tacacgttctatcagggaatgggcc

SEQ ID NO: 741747 - DNA, 25 bp, Mus musculus
tacacgttctatgagggaatgggcc

SEQ ID NO: 741748 - DNA, 25 bp, Mus musculus
tacacgttggagactttgtgtgggt

SEQ ID NO: 741749 - DNA, 25 bp, Mus musculus
tacacgttggagtctttgtgtgggt

SEQ ID NO: 741750 - DNA, 25 bp, Mus musculus
tacactaaagaaaattgacattccg

SEQ ID NO: 741751 - DNA, 25 bp, Mus musculus
tacactaaagaatattgacattccg

SEQ ID NO: 741752 - DNA, 25 bp, Mus musculus
tacactaccactcacgggcaaacag

SEQ ID NO: 741753 - DNA, 25 bp, Mus musculus
tacactaccactgacgggcaaacag

SEQ ID NO: 741754 - DNA, 25 bp, Mus musculus
tacactaccaggacgtggactcaga

SEQ ID NO: 741755 - DNA, 25 bp, Mus musculus
tacactaccaggtcgtggactcaga

SEQ ID NO: 741756 - DNA, 25 bp, Mus musculus
tacactacttgtcgatgttgaacct

SEQ ID NO: 741757 - DNA, 25 bp, Mus musculus
tacactacttgtggatgttgaacct

SEQ ID NO: 741758 - DNA, 25 bp, Mus musculus
tacactagaaggatacttccaaaag

SEQ ID NO: 741759 - DNA, 25 bp, Mus musculus
tacactagaaggttacttccaaaag

SEQ ID NO: 741760 - DNA, 25 bp, Mus musculus
tacactaggaaactgtctgcggtac

SEQ ID NO: 741761 - DNA, 25 bp, Mus musculus
tacactaggaaagtgtctgcggtac

SEQ ID NO: 741762 - DNA, 25 bp, Mus musculus
tacactaggagaaaacattgctgat

SEQ ID NO: 741763 - DNA, 25 bp, Mus musculus
tacactaggagataacattgctgat

SEQ ID NO: 741764 - DNA, 25 bp, Mus musculus
tacactaggaggcagcaactgcccc

SEQ ID NO: 741765 - DNA, 25 bp, Mus musculus
tacactaggagggagcaactgcccc

SEQ ID NO: 741766 - DNA, 25 bp, Mus musculus
tacactagtccgagagattcggcag

SEQ ID NO: 741767 - DNA, 25 bp, Mus musculus
tacactagtccgtgagattcggcag

SEQ ID NO: 741768 - DNA, 25 bp, Mus musculus
tacactcaaaggcttgaggtcctgg

SEQ ID NO: 741769 - DNA, 25 bp, Mus musculus
tacactcaaagggttgaggtcctgg

SEQ ID NO: 741770 - DNA, 25 bp, Mus musculus
tacactcacaaccacaactttgtga

SEQ ID NO: 741771 - DNA, 25 bp, Mus musculus
tacactcacaacgacaactttgtga

SEQ ID NO: 741772 - DNA, 25 bp, Mus musculus
tacactcactgcacattgcccgggt

SEQ ID NO: 741773 - DNA, 25 bp, Mus musculus
tacactcactgctcattgcccgggt

SEQ ID NO: 741774 - DNA, 25 bp, Mus musculus
tacactcccattacatcttggtgga

SEQ ID NO: 741775 - DNA, 25 bp, Mus musculus
tacactcccatttcatcttggtgga

SEQ ID NO: 741776 - DNA, 25 bp, Mus musculus
tacactccgagcaacgagcactttg

SEQ ID NO: 741777 - DNA, 25 bp, Mus musculus
tacactccgagctacgagcactttg

SEQ ID NO: 741778 - DNA, 25 bp, Mus musculus
tacactcctgcgcacttttcaaaga

SEQ ID NO: 741779 - DNA, 25 bp, Mus musculus
tacactcctgcggacttttcaaaga

SEQ ID NO: 741780 - DNA, 25 bp, Mus musculus
tacactccttggcaggtgacactgc

SEQ ID NO: 741781 - DNA, 25 bp, Mus musculus
tacactccttgggaggtgacactgc

SEQ ID NO: 741782 - DNA, 25 bp, Mus musculus
tacactcgggcacaggctttcaaca

SEQ ID NO: 741783 - DNA, 25 bp, Mus musculus
tacactcgggcagaggctttcaaca

SEQ ID NO: 741784 - DNA, 25 bp, Mus musculus
tacactcgtgaaccttagcgctcga

SEQ ID NO: 741785 - DNA, 25 bp, Mus musculus
tacactcgtgaagcttagcgctcga

SEQ ID NO: 741786 - DNA, 25 bp, Mus musculus
tacactcgttagcaaaggctcgcac

SEQ ID NO: 741787 - DNA, 25 bp, Mus musculus
tacactcgttaggaaaggctcgcac

SEQ ID NO: 741788 - DNA, 25 bp, Mus musculus
tacactctacatcgtagcacggatc

SEQ ID NO: 741789 - DNA, 25 bp, Mus musculus
tacactctacatggtagcacggatc

SEQ ID NO: 741790 - DNA, 25 bp, Mus musculus
tacactcttccacacctggatggta

SEQ ID NO: 741791 - DNA, 25 bp, Mus musculus
tacactcttccagacctggatggta

SEQ ID NO: 741792 - DNA, 25 bp, Mus musculus
tacactgaagctcatagctgcagcc

SEQ ID NO: 741793 - DNA, 25 bp, Mus musculus
tacactgaagctgatagctgcagcc

SEQ ID NO: 741794 - DNA, 25 bp, Mus musculus
tacactgagcagagaggctgtgcct

SEQ ID NO: 741795 - DNA, 25 bp, Mus musculus
tacactgagcagtgaggctgtgcct

SEQ ID NO: 741796 - DNA, 25 bp, Mus musculus
tacactgaggccattaaaaacatgg

SEQ ID NO: 741797 - DNA, 25 bp, Mus musculus
tacactgaggcctttaaaaacatgg

SEQ ID NO: 741798 - DNA, 25 bp, Mus musculus
tacactgagggcctttaccgcaagt

SEQ ID NO: 741799 - DNA, 25 bp, Mus musculus
tacactgagggcgtttaccgcaagt

SEQ ID NO: 741800 - DNA, 25 bp, Mus musculus
tacactgatattcttaactatttgc

SEQ ID NO: 741801 - DNA, 25 bp, Mus musculus
tacactgatattgttaactatttgc

SEQ ID NO: 741802 - DNA, 25 bp, Mus musculus
tacactgattggattgaggtataca

SEQ ID NO: 741803 - DNA, 25 bp, Mus musculus
tacactgattggtttgaggtataca

SEQ ID NO: 741804 - DNA, 25 bp, Mus musculus
tacactgcccaaagagttgcactgc

SEQ ID NO: 741805 - DNA, 25 bp, Mus musculus
tacactgcccaatgagttgcactgc

SEQ ID NO: 741806 - DNA, 25 bp, Mus musculus
tacactgcgaacaggaatccactcg

SEQ ID NO: 741807 - DNA, 25 bp, Mus musculus
tacactgcgaactggaatccactcg

SEQ ID NO: 741808 - DNA, 25 bp, Mus musculus
tacactgcgagtactttgcttctcc

SEQ ID NO: 741809 - DNA, 25 bp, Mus musculus
tacactgcgagttctttgcttctcc

SEQ ID NO: 741810 - DNA, 25 bp, Mus musculus
tacactgcgggacaaaatcatggaa

SEQ ID NO: 741811 - DNA, 25 bp, Mus musculus
tacactgcgggagaaaatcatggaa

SEQ ID NO: 741812 - DNA, 25 bp, Mus musculus
tacactgcttctccgtggtgagacc

SEQ ID NO: 741813 - DNA, 25 bp, Mus musculus
tacactgcttctgcgtggtgagacc

SEQ ID NO: 741814 - DNA, 25 bp, Mus musculus
tacactgcttggcaagggtgctaaa

SEQ ID NO: 741815 - DNA, 25 bp, Mus musculus
tacactgcttgggaagggtgctaaa

SEQ ID NO: 741816 - DNA, 25 bp, Mus musculus
tacactggagatcaccaactgattt

SEQ ID NO: 741817 - DNA, 25 bp, Mus musculus
tacactggagatgaccaactgattt

SEQ ID NO: 741818 - DNA, 25 bp, Mus musculus
tacactggatatatttgcgacttgg

SEQ ID NO: 741819 - DNA, 25 bp, Mus musculus
tacactggatatttttgcgacttgg

SEQ ID NO: 741820 - DNA, 25 bp, Mus musculus
tacactggcaccatgcagccaaagg

SEQ ID NO: 741821 - DNA, 25 bp, Mus musculus
tacactggcaccttgcagccaaagg

SEQ ID NO: 741822 - DNA, 25 bp, Mus musculus
tacactgggagtactaaccagccag

SEQ ID NO: 741823 - DNA, 25 bp, Mus musculus
tacactgggagttctaaccagccag

SEQ ID NO: 741824 - DNA, 25 bp, Mus musculus
tacactgggccaaaaagaaggttgt

SEQ ID NO: 741825 - DNA, 25 bp, Mus musculus
tacactgggccataaagaaggttgt

SEQ ID NO: 741826 - DNA, 25 bp, Mus musculus
tacactgggcctcttgtcgaggact

SEQ ID NO: 741827 - DNA, 25 bp, Mus musculus
tacactgggcctgttgtcgaggact

SEQ ID NO: 741828 - DNA, 25 bp, Mus musculus
tacactggtcaacattatagtaccc

SEQ ID NO: 741829 - DNA, 25 bp, Mus musculus
tacactggtcaagattatagtaccc

SEQ ID NO: 741830 - DNA, 25 bp, Mus musculus
tacactggtgtcagcccagatgtct

SEQ ID NO: 741831 - DNA, 25 bp, Mus musculus
tacactggtgtctgcccagatgtct

SEQ ID NO: 741832 - DNA, 25 bp, Mus musculus
tacactggtgtgctatccctgcagc

SEQ ID NO: 741833 - DNA, 25 bp, Mus musculus
tacactggtgtggtatccctgcagc

SEQ ID NO: 741834 - DNA, 25 bp, Mus musculus
tacactgtacgcatcggcccctggg

SEQ ID NO: 741835 - DNA, 25 bp, Mus musculus
tacactgtacgcttcggcccctggg

SEQ ID NO: 741836 - DNA, 25 bp, Mus musculus
tacactgtacttcacggctggcctc

SEQ ID NO: 741837 - DNA, 25 bp, Mus musculus
tacactgtacttgacggctggcctc

SEQ ID NO: 741838 - DNA, 25 bp, Mus musculus
tacactgtagaaccgtagtgggctg

SEQ ID NO: 741839 - DNA, 25 bp, Mus musculus
tacactgtagaagcgtagtgggctg

SEQ ID NO: 741840 - DNA, 25 bp, Mus musculus
tacactgtcaaacctgtacaagcta

SEQ ID NO: 741841 - DNA, 25 bp, Mus musculus
tacactgtcaaagctgtacaagcta

SEQ ID NO: 741842 - DNA, 25 bp, Mus musculus
tacactgtccaacgtagccggtgaa

SEQ ID NO: 741843 - DNA, 25 bp, Mus musculus
tacactgtccaaggtagccggtgaa

SEQ ID NO: 741844 - DNA, 25 bp, Mus musculus
tacactgtccgaaatgttgcccggt

SEQ ID NO: 741845 - DNA, 25 bp, Mus musculus
tacactgtccgatatgttgcccggt

SEQ ID NO: 741846 - DNA, 25 bp, Mus musculus
tacactgtgaaccagtgccagcggc

SEQ ID NO: 741847 - DNA, 25 bp, Mus musculus
tacactgtgaacgagtgccagcggc

SEQ ID NO: 741848 - DNA, 25 bp, Mus musculus
tacactgtgaccagtcagctgatgc

SEQ ID NO: 741849 - DNA, 25 bp, Mus musculus
tacactgtgacctgtcagctgatgc

SEQ ID NO: 741850 - DNA, 25 bp, Mus musculus
tacactgtgaggagggaagcatcct

SEQ ID NO: 741851 - DNA, 25 bp, Mus musculus
tacactgtgaggtgggaagcatcct

SEQ ID NO: 741852 - DNA, 25 bp, Mus musculus
tacactgtgggcaccaagtatcgaa

SEQ ID NO: 741853 - DNA, 25 bp, Mus musculus
tacactgtgggctccaagtatcgaa

SEQ ID NO: 741854 - DNA, 25 bp, Mus musculus
tacactgtgtttctcatataaaggc

SEQ ID NO: 741855 - DNA, 25 bp, Mus musculus
tacactgtgtttgtcatataaaggc

SEQ ID NO: 741856 - DNA, 25 bp, Mus musculus
tacactgttttaccagtagaacaag

SEQ ID NO: 741857 - DNA, 25 bp, Mus musculus
tacactgttttagcagtagaacaag

SEQ ID NO: 741858 - DNA, 25 bp, Mus musculus
tacacttacaggattctgcccaatg

SEQ ID NO: 741859 - DNA, 25 bp, Mus musculus
tacacttacaggtttctgcccaatg

SEQ ID NO: 741860 - DNA, 25 bp, Mus musculus
tacacttcctatcttactatcaaag

SEQ ID NO: 741861 - DNA, 25 bp, Mus musculus
tacacttcctatgttactatcaaag

SEQ ID NO: 741862 - DNA, 25 bp, Mus musculus
tacacttggattcaggaccacttcc

SEQ ID NO: 741863 - DNA, 25 bp, Mus musculus
tacacttggattgaggaccacttcc

SEQ ID NO: 741864 - DNA, 25 bp, Mus musculus
tacacttggcctcacaaatgtcgga

SEQ ID NO: 741865 - DNA, 25 bp, Mus musculus
tacacttggcctgacaaatgtcgga

SEQ ID NO: 741866 - DNA, 25 bp, Mus musculus
tacacttggtacctcagaaagcaac

SEQ ID NO: 741867 - DNA, 25 bp, Mus musculus
tacacttggtacgtcagaaagcaac

SEQ ID NO: 741868 - DNA, 25 bp, Mus musculus
tacacttgtgacacctaagccagag

SEQ ID NO: 741869 - DNA, 25 bp, Mus musculus
tacacttgtgactcctaagccagag

SEQ ID NO: 741870 - DNA, 25 bp, Mus musculus
tacactttaacaagcagtttatagc

SEQ ID NO: 741871 - DNA, 25 bp, Mus musculus
tacactttaacatgcagtttatagc

SEQ ID NO: 741872 - DNA, 25 bp, Mus musculus
tacactttgcgaactgctccctggt

SEQ ID NO: 741873 - DNA, 25 bp, Mus musculus
tacactttgcgatctgctccctggt

SEQ ID NO: 741874 - DNA, 25 bp, Mus musculus
tacacttttggcctcatggatcggt

SEQ ID NO: 741875 - DNA, 25 bp, Mus musculus
tacacttttggcgtcatggatcggt

SEQ ID NO: 741876 - DNA, 25 bp, Mus musculus
tacagaaaacatcatagtagctagc

SEQ ID NO: 741877 - DNA, 25 bp, Mus musculus
tacagaaaacatgatagtagctagc

SEQ ID NO: 741878 - DNA, 25 bp, Mus musculus
tacagaaaatgactgagcctgaagc

SEQ ID NO: 741879 - DNA, 25 bp, Mus musculus
tacagaaaatgagtgagcctgaagc

SEQ ID NO: 741880 - DNA, 25 bp, Mus musculus
tacagaaaatgtcctggcccatcct

SEQ ID NO: 741881 - DNA, 25 bp, Mus musculus
tacagaaaatgtgctggcccatcct

SEQ ID NO: 741882 - DNA, 25 bp, Mus musculus
tacagaaacactctgaaagaatcaa

SEQ ID NO: 741883 - DNA, 25 bp, Mus musculus
tacagaaacactgtgaaagaatcaa

SEQ ID NO: 741884 - DNA, 25 bp, Mus musculus
tacagaaacagcctctggcatcggg

SEQ ID NO: 741885 - DNA, 25 bp, Mus musculus
tacagaaacagcgtctggcatcggg

SEQ ID NO: 741886 - DNA, 25 bp, Mus musculus
tacagaaaccggacatgcgtcatca

SEQ ID NO: 741887 - DNA, 25 bp, Mus musculus
tacagaaaccggtcatgcgtcatca

SEQ ID NO: 741888 - DNA, 25 bp, Mus musculus
tacagaaagataacacagacccagg

SEQ ID NO: 741889 - DNA, 25 bp, Mus musculus
tacagaaagatatcacagacccagg

SEQ ID NO: 741890 - DNA, 25 bp, Mus musculus
tacagaaagccaagtcccatgtgtg

SEQ ID NO: 741891 - DNA, 25 bp, Mus musculus
tacagaaagccatgtcccatgtgtg

SEQ ID NO: 741892 - DNA, 25 bp, Mus musculus
tacagaaagtagagggaggaggact

SEQ ID NO: 741893 - DNA, 25 bp, Mus musculus
tacagaaagtagtgggaggaggact

SEQ ID NO: 741894 - DNA, 25 bp, Mus musculus
tacagaaagtcaatgatcaatttgg

SEQ ID NO: 741895 - DNA, 25 bp, Mus musculus
tacagaaagtcattgatcaatttgg

SEQ ID NO: 741896 - DNA, 25 bp, Mus musculus
tacagaaagtgcaaatagcttcact

SEQ ID NO: 741897 - DNA, 25 bp, Mus musculus
tacagaaagtgctaatagcttcact

SEQ ID NO: 741898 - DNA, 25 bp, Mus musculus
tacagaaagtgtctgcttggtttgg

SEQ ID NO: 741899 - DNA, 25 bp, Mus musculus
tacagaaagtgtgtgcttggtttgg

SEQ ID NO: 741900 - DNA, 25 bp, Mus musculus
tacagaaatattcctggcgcagaca

SEQ ID NO: 741901 - DNA, 25 bp, Mus musculus
tacagaaatattgctggcgcagaca

SEQ ID NO: 741902 - DNA, 25 bp, Mus musculus
tacagaacacacctgagcctcttgg

SEQ ID NO: 741903 - DNA, 25 bp, Mus musculus
tacagaacacacgtgagcctcttgg

SEQ ID NO: 741904 - DNA, 25 bp, Mus musculus
tacagaacaggcaatacgtaccgcc

SEQ ID NO: 741905 - DNA, 25 bp, Mus musculus
tacagaacaggcaatgcgtacaggc

SEQ ID NO: 741906 - DNA, 25 bp, Mus musculus
tacagaacaggctatacgtaccgcc

SEQ ID NO: 741907 - DNA, 25 bp, Mus musculus
tacagaacaggctatgcgtacaggc

SEQ ID NO: 741908 - DNA, 25 bp, Mus musculus
tacagaacatctatggagtgatcct

SEQ ID NO: 741909 - DNA, 25 bp, Mus musculus
tacagaacatctttggagtgatcct

SEQ ID NO: 741910 - DNA, 25 bp, Mus musculus
tacagaaccactcttgcctgacctg

SEQ ID NO: 741911 - DNA, 25 bp, Mus musculus
tacagaaccactgttgcctgacctg

SEQ ID NO: 741912 - DNA, 25 bp, Mus musculus
tacagaactactcaggaggatgcgg

SEQ ID NO: 741913 - DNA, 25 bp, Mus musculus
tacagaactactgaggaggatgcgg

SEQ ID NO: 741914 - DNA, 25 bp, Mus musculus
tacagaagaaaacatgaattgtgct

SEQ ID NO: 741915 - DNA, 25 bp, Mus musculus
tacagaagaaaagatgaattgtgct

SEQ ID NO: 741916 - DNA, 25 bp, Mus musculus
tacagaagaataaggtgcgagagtt

SEQ ID NO: 741917 - DNA, 25 bp, Mus musculus
tacagaagaatatggtgcgagagtt

SEQ ID NO: 741918 - DNA, 25 bp, Mus musculus
tacagaagaccgctccggaacacct

SEQ ID NO: 741919 - DNA, 25 bp, Mus musculus
tacagaagaccggtccggaacacct

SEQ ID NO: 741920 - DNA, 25 bp, Mus musculus
tacagaagatcaatgagacactgtc

SEQ ID NO: 741921 - DNA, 25 bp, Mus musculus
tacagaagatcattgagacactgtc

SEQ ID NO: 741922 - DNA, 25 bp, Mus musculus
tacagaagatctcggtgcccgtcga

SEQ ID NO: 741923 - DNA, 25 bp, Mus musculus
tacagaagatctgggtgcccgtcga

SEQ ID NO: 741924 - DNA, 25 bp, Mus musculus
tacagaagattcaaaaggaggacat

SEQ ID NO: 741925 - DNA, 25 bp, Mus musculus
tacagaagattctaaaggaggacat

SEQ ID NO: 741926 - DNA, 25 bp, Mus musculus
tacagaagccgactttggataagcc

SEQ ID NO: 741927 - DNA, 25 bp, Mus musculus
tacagaagccgagtttggataagcc

SEQ ID NO: 741928 - DNA, 25 bp, Mus musculus
tacagaaggacacccgactctattt

SEQ ID NO: 741929 - DNA, 25 bp, Mus musculus
tacagaaggacagccgactctattt

SEQ ID NO: 741930 - DNA, 25 bp, Mus musculus
tacagaaggcaaaggatgaaagaag

SEQ ID NO: 741931 - DNA, 25 bp, Mus musculus
tacagaaggcaatggatgaaagaag

SEQ ID NO: 741932 - DNA, 25 bp, Mus musculus
tacagaaggcacaatcattcgatgt

SEQ ID NO: 741933 - DNA, 25 bp, Mus musculus
tacagaaggcactatcattcgatgt

SEQ ID NO: 741934 - DNA, 25 bp, Mus musculus
tacagaaggcttcgcaaaggctatg

SEQ ID NO: 741935 - DNA, 25 bp, Mus musculus
tacagaaggcttggcaaaggctatg

SEQ ID NO: 741936 - DNA, 25 bp, Mus musculus
tacagaaggttcatgcatcctatgc

SEQ ID NO: 741937 - DNA, 25 bp, Mus musculus
tacagaaggttcttgcatcctatgc

SEQ ID NO: 741938 - DNA, 25 bp, Mus musculus
tacagaatagccaggacaaggctcc

SEQ ID NO: 741939 - DNA, 25 bp, Mus musculus
tacagaatagcctggacaaggctcc

SEQ ID NO: 741940 - DNA, 25 bp, Mus musculus
tacagaatatcaccgcgggcgaccg

SEQ ID NO: 741941 - DNA, 25 bp, Mus musculus
tacagaatatcagcgcgggcgaccg

SEQ ID NO: 741942 - DNA, 25 bp, Mus musculus
tacagaatccagatcggggccaaaa

SEQ ID NO: 741943 - DNA, 25 bp, Mus musculus
tacagaatccagttcggggccaaaa

SEQ ID NO: 741944 - DNA, 25 bp, Mus musculus
tacagaatccctcgaaagcgtgcgc

SEQ ID NO: 741945 - DNA, 25 bp, Mus musculus
tacagaatccctggaaagcgtgcgc

SEQ ID NO: 741946 - DNA, 25 bp, Mus musculus
tacagaatgaatccatacagccaag

SEQ ID NO: 741947 - DNA, 25 bp, Mus musculus
tacagaatgaatgcatacagccaag

SEQ ID NO: 741948 - DNA, 25 bp, Mus musculus
tacagaatgacgaggtggcagcttt

SEQ ID NO: 741949 - DNA, 25 bp, Mus musculus
tacagaatgacgtggtggcagcttt

SEQ ID NO: 741950 - DNA, 25 bp, Mus musculus
tacagaatgaggataaaggcatcaa

SEQ ID NO: 741951 - DNA, 25 bp, Mus musculus
tacagaatgaggttaaaggcatcaa

SEQ ID NO: 741952 - DNA, 25 bp, Mus musculus
tacagaatgatcaaacccagaattg

SEQ ID NO: 741953 - DNA, 25 bp, Mus musculus
tacagaatgatctaacccagaattg

SEQ ID NO: 741954 - DNA, 25 bp, Mus musculus
tacagaatgtatagccaagtacaac

SEQ ID NO: 741955 - DNA, 25 bp, Mus musculus
tacagaatgtattgccaagtacaac

SEQ ID NO: 741956 - DNA, 25 bp, Mus musculus
tacagaattaagaggagaaatagca

SEQ ID NO: 741957 - DNA, 25 bp, Mus musculus
tacagaattaagtggagaaatagca

SEQ ID NO: 741958 - DNA, 25 bp, Mus musculus
tacagaattaggagagtctttgaaa

SEQ ID NO: 741959 - DNA, 25 bp, Mus musculus
tacagaattaggtgagtctttgaaa

SEQ ID NO: 741960 - DNA, 25 bp, Mus musculus
tacagacaagtcactctgacggccg

SEQ ID NO: 741961 - DNA, 25 bp, Mus musculus
tacagacaagtctctctgacggccg

SEQ ID NO: 741962 - DNA, 25 bp, Mus musculus
tacagacacaggaacaaaatttggg

SEQ ID NO: 741963 - DNA, 25 bp, Mus musculus
tacagacacaggtacaaaatttggg

SEQ ID NO: 741964 - DNA, 25 bp, Mus musculus
tacagacagcagactagaagcatca

SEQ ID NO: 741965 - DNA, 25 bp, Mus musculus
tacagacagcagtctagaagcatca

SEQ ID NO: 741966 - DNA, 25 bp, Mus musculus
tacagacaggagaaaagcgtcacta

SEQ ID NO: 741967 - DNA, 25 bp, Mus musculus
tacagacaggagtaaagcgtcacta

SEQ ID NO: 741968 - DNA, 25 bp, Mus musculus
tacagacatctgagaactggcacgt

SEQ ID NO: 741969 - DNA, 25 bp, Mus musculus
tacagacatctgtgaactggcacgt

SEQ ID NO: 741970 - DNA, 25 bp, Mus musculus
tacagaccattgaagctcaacgaaa

SEQ ID NO: 741971 - DNA, 25 bp, Mus musculus
tacagaccattgtagctcaacgaaa

SEQ ID NO: 741972 - DNA, 25 bp, Mus musculus
tacagaccgccacaacctcgggatt

SEQ ID NO: 741973 - DNA, 25 bp, Mus musculus
tacagaccgccagaacctcgggatt

SEQ ID NO: 741974 - DNA, 25 bp, Mus musculus
tacagacctgatagtgcagaggatc

SEQ ID NO: 741975 - DNA, 25 bp, Mus musculus
tacagacctgattgtgcagaggatc

SEQ ID NO: 741976 - DNA, 25 bp, Mus musculus
tacagacctgggactttagggctaa

SEQ ID NO: 741977 - DNA, 25 bp, Mus musculus
tacagacctgggtctttagggctaa

SEQ ID NO: 741978 - DNA, 25 bp, Mus musculus
tacagacctggtctgttggaaggac

SEQ ID NO: 741979 - DNA, 25 bp, Mus musculus
tacagacctggtgtgttggaaggac

SEQ ID NO: 741980 - DNA, 25 bp, Mus musculus
tacagacgcactcgtttacccggag

SEQ ID NO: 741981 - DNA, 25 bp, Mus musculus
tacagacgcactggtttacccggag

SEQ ID NO: 741982 - DNA, 25 bp, Mus musculus
tacagacggacaacaaacatggttg

SEQ ID NO: 741983 - DNA, 25 bp, Mus musculus
tacagacggacatcaaacatggttg

SEQ ID NO: 741984 - DNA, 25 bp, Mus musculus
tacagacggagacggaagtgactac

SEQ ID NO: 741985 - DNA, 25 bp, Mus musculus
tacagacggagagggaagtgactac

SEQ ID NO: 741986 - DNA, 25 bp, Mus musculus
tacagacgggctcaagcctacaagg

SEQ ID NO: 741987 - DNA, 25 bp, Mus musculus
tacagacgggctgaagcctacaagg

SEQ ID NO: 741988 - DNA, 25 bp, Mus musculus
tacagacgttggaccccgggctggc

SEQ ID NO: 741989 - DNA, 25 bp, Mus musculus
tacagacgttggtccccgggctggc

SEQ ID NO: 741990 - DNA, 25 bp, Mus musculus
tacagactctacaggaccctagtgc

SEQ ID NO: 741991 - DNA, 25 bp, Mus musculus
tacagactctactggaccctagtgc

SEQ ID NO: 741992 - DNA, 25 bp, Mus musculus
tacagactctctatccccaagtcaa

SEQ ID NO: 741993 - DNA, 25 bp, Mus musculus
tacagactctctttccccaagtcaa

SEQ ID NO: 741994 - DNA, 25 bp, Mus musculus
tacagactcttcacatcataccggc

SEQ ID NO: 741995 - DNA, 25 bp, Mus musculus
tacagactcttctcatcataccggc

SEQ ID NO: 741996 - DNA, 25 bp, Mus musculus
tacagactgactcctaaactgatgg

SEQ ID NO: 741997 - DNA, 25 bp, Mus musculus
tacagactgactgctaaactgatgg

SEQ ID NO: 741998 - DNA, 25 bp, Mus musculus
tacagactgcacattgctcaagata

SEQ ID NO: 741999 - DNA, 25 bp, Mus musculus
tacagactgcactttgctcaagata

SEQ ID NO: 742000 - DNA, 25 bp, Mus musculus
tacagactgcttctttgacaagtgt

SEQ ID NO: 742001 - DNA, 25 bp, Mus musculus
tacagactgcttgtttgacaagtgt

SEQ ID NO: 742002 - DNA, 25 bp, Mus musculus
tacagactggttccctagttttggc

SEQ ID NO: 742003 - DNA, 25 bp, Mus musculus
tacagactggttcgaaaggcaatca

SEQ ID NO: 742004 - DNA, 25 bp, Mus musculus
tacagactggttgcctagttttggc

SEQ ID NO: 742005 - DNA, 25 bp, Mus musculus
tacagactggttggaaaggcaatca

SEQ ID NO: 742006 - DNA, 25 bp, Mus musculus
tacagacttattctggagaatttgt

SEQ ID NO: 742007 - DNA, 25 bp, Mus musculus
tacagacttattgtggagaatttgt

SEQ ID NO: 742008 - DNA, 25 bp, Mus musculus
tacagacttgtaaacccaggacaga

SEQ ID NO: 742009 - DNA, 25 bp, Mus musculus
tacagacttgtatacccaggacaga

SEQ ID NO: 742010 - DNA, 25 bp, Mus musculus
tacagactttgaatccagccaacag

SEQ ID NO: 742011 - DNA, 25 bp, Mus musculus
tacagactttgattccagccaacag

SEQ ID NO: 742012 - DNA, 25 bp, Mus musculus
tacagacttttgctcaaccagcagg

SEQ ID NO: 742013 - DNA, 25 bp, Mus musculus
tacagacttttggtcaaccagcagg

SEQ ID NO: 742014 - DNA, 25 bp, Mus musculus
tacagagaaaggcttacacagggca

SEQ ID NO: 742015 - DNA, 25 bp, Mus musculus
tacagagaaagggttacacagggca

SEQ ID NO: 742016 - DNA, 25 bp, Mus musculus
tacagagaagtcaaggtgtttgcta

SEQ ID NO: 742017 - DNA, 25 bp, Mus musculus
tacagagaagtccagctccctgaca

SEQ ID NO: 742018 - DNA, 25 bp, Mus musculus
tacagagaagtcgagctccctgaca

SEQ ID NO: 742019 - DNA, 25 bp, Mus musculus
tacagagaagtctaggtgtttgcta

SEQ ID NO: 742020 - DNA, 25 bp, Mus musculus
tacagagacaaactatgccccagtg

SEQ ID NO: 742021 - DNA, 25 bp, Mus musculus
tacagagacaaagtatgccccagtg

SEQ ID NO: 742022 - DNA, 25 bp, Mus musculus
tacagagacgggaaaatccaactga

SEQ ID NO: 742023 - DNA, 25 bp, Mus musculus
tacagagacgggtaaatccaactga

SEQ ID NO: 742024 - DNA, 25 bp, Mus musculus
tacagagactgtattcatcgtggag

SEQ ID NO: 742025 - DNA, 25 bp, Mus musculus
tacagagactgttttcatcgtggag

SEQ ID NO: 742026 - DNA, 25 bp, Mus musculus
tacagagagaagatcgagacggagc

SEQ ID NO: 742027 - DNA, 25 bp, Mus musculus
tacagagagaagttcgagacggagc

SEQ ID NO: 742028 - DNA, 25 bp, Mus musculus
tacagagagccaccttgtgaagagc

SEQ ID NO: 742029 - DNA, 25 bp, Mus musculus
tacagagagccagcttgtgaagagc

SEQ ID NO: 742030 - DNA, 25 bp, Mus musculus
tacagagatgaaaggtagaattgtg

SEQ ID NO: 742031 - DNA, 25 bp, Mus musculus
tacagagatgaatggtagaattgtg

SEQ ID NO: 742032 - DNA, 25 bp, Mus musculus
tacagagatgatataatgtccgtga

SEQ ID NO: 742033 - DNA, 25 bp, Mus musculus
tacagagatgatttaatgtccgtga

SEQ ID NO: 742034 - DNA, 25 bp, Mus musculus
tacagagatgctccacagtaacgga

SEQ ID NO: 742035 - DNA, 25 bp, Mus musculus
tacagagatgctgcacagtaacgga

SEQ ID NO: 742036 - DNA, 25 bp, Mus musculus
tacagagatggcatccagctctaat

SEQ ID NO: 742037 - DNA, 25 bp, Mus musculus
tacagagatggcttccagctctaat

SEQ ID NO: 742038 - DNA, 25 bp, Mus musculus
tacagagatggtcacgtacaaggac

SEQ ID NO: 742039 - DNA, 25 bp, Mus musculus
tacagagatggtgacgtacaaggac

SEQ ID NO: 742040 - DNA, 25 bp, Mus musculus
tacagagcaactattaaaacaccct

SEQ ID NO: 742041 - DNA, 25 bp, Mus musculus
tacagagcaacttttaaaacaccct

SEQ ID NO: 742042 - DNA, 25 bp, Mus musculus
tacagagccctacaattaaggcggg

SEQ ID NO: 742043 - DNA, 25 bp, Mus musculus
tacagagccctagaattaaggcggg

SEQ ID NO: 742044 - DNA, 25 bp, Mus musculus
tacagagcctcgaggaattgggcac

SEQ ID NO: 742045 - DNA, 25 bp, Mus musculus
tacagagcctcgtggaattgggcac

SEQ ID NO: 742046 - DNA, 25 bp, Mus musculus
tacagagcgcaaatgaccgggtgaa

SEQ ID NO: 742047 - DNA, 25 bp, Mus musculus
tacagagcgcaattgaccgggtgaa

SEQ ID NO: 742048 - DNA, 25 bp, Mus musculus
tacagagcgcccctctaagctttgt

SEQ ID NO: 742049 - DNA, 25 bp, Mus musculus
tacagagcgcccgtctaagctttgt

SEQ ID NO: 742050 - DNA, 25 bp, Mus musculus
tacagagcgggaagaacctccagat

SEQ ID NO: 742051 - DNA, 25 bp, Mus musculus
tacagagcgggatgaacctccagat

SEQ ID NO: 742052 - DNA, 25 bp, Mus musculus
tacagagctagtaacaagattgcca

SEQ ID NO: 742053 - DNA, 25 bp, Mus musculus
tacagagctagttacaagattgcca

SEQ ID NO: 742054 - DNA, 25 bp, Mus musculus
tacagagctctcctgcttacaacct

SEQ ID NO: 742055 - DNA, 25 bp, Mus musculus
tacagagctctcgtgcttacaacct

SEQ ID NO: 742056 - DNA, 25 bp, Mus musculus
tacagaggaagccattctacccagc

SEQ ID NO: 742057 - DNA, 25 bp, Mus musculus
tacagaggaagcgattctacccagc

SEQ ID NO: 742058 - DNA, 25 bp, Mus musculus
tacagaggagcccatggcatcatag

SEQ ID NO: 742059 - DNA, 25 bp, Mus musculus
tacagaggagccgatggcatcatag

SEQ ID NO: 742060 - DNA, 25 bp, Mus musculus
tacagaggagtgagcaaggatccca

SEQ ID NO: 742061 - DNA, 25 bp, Mus musculus
tacagaggagtgtgcaaggatccca

SEQ ID NO: 742062 - DNA, 25 bp, Mus musculus
tacagaggccagattcagaacacgc

SEQ ID NO: 742063 - DNA, 25 bp, Mus musculus
tacagaggccagtttcagaacacgc

SEQ ID NO: 742064 - DNA, 25 bp, Mus musculus
tacagaggccctcagctgcagtcct

SEQ ID NO: 742065 - DNA, 25 bp, Mus musculus
tacagaggccctgagctgcagtcct

SEQ ID NO: 742066 - DNA, 25 bp, Mus musculus
tacagaggcctgcttttagagacca

SEQ ID NO: 742067 - DNA, 25 bp, Mus musculus
tacagaggcctggttttagagacca

SEQ ID NO: 742068 - DNA, 25 bp, Mus musculus
tacagagggaagatttatggttgat

SEQ ID NO: 742069 - DNA, 25 bp, Mus musculus
tacagagggaagttttatggttgat

SEQ ID NO: 742070 - DNA, 25 bp, Mus musculus
tacagagggctaataagcgacggtc

SEQ ID NO: 742071 - DNA, 25 bp, Mus musculus
tacagagggctattaagcgacggtc

SEQ ID NO: 742072 - DNA, 25 bp, Mus musculus
tacagaggggctacactgccaagga

SEQ ID NO: 742073 - DNA, 25 bp, Mus musculus
tacagaggggcttcactgccaagga

SEQ ID NO: 742074 - DNA, 25 bp, Mus musculus
tacagaggtatacatcaagagctgg

SEQ ID NO: 742075 - DNA, 25 bp, Mus musculus
tacagaggtatagatcaagagctgg

SEQ ID NO: 742076 - DNA, 25 bp, Mus musculus
tacagaggtatcatccaacacgcac

SEQ ID NO: 742077 - DNA, 25 bp, Mus musculus
tacagaggtatcttccaacacgcac

SEQ ID NO: 742078 - DNA, 25 bp, Mus musculus
tacagagtaccgaggcgtggccagc

SEQ ID NO: 742079 - DNA, 25 bp, Mus musculus
tacagagtaccgtggcgtggccagc

SEQ ID NO: 742080 - DNA, 25 bp, Mus musculus
tacagagtatggaagacttgcaatg

SEQ ID NO: 742081 - DNA, 25 bp, Mus musculus
tacagagtatggtagacttgcaatg

SEQ ID NO: 742082 - DNA, 25 bp, Mus musculus
tacagagtcctgaacagtgacgatg

SEQ ID NO: 742083 - DNA, 25 bp, Mus musculus
tacagagtcctgtacagtgacgatg

SEQ ID NO: 742084 - DNA, 25 bp, Mus musculus
tacagagtccttctaggcatatctg

SEQ ID NO: 742085 - DNA, 25 bp, Mus musculus
tacagagtccttgtaggcatatctg

SEQ ID NO: 742086 - DNA, 25 bp, Mus musculus
tacagagtctttcccgaccagtgac

SEQ ID NO: 742087 - DNA, 25 bp, Mus musculus
tacagagtctttgccgaccagtgac

SEQ ID NO: 742088 - DNA, 25 bp, Mus musculus
tacagagtgcttcacgacctttgga

SEQ ID NO: 742089 - DNA, 25 bp, Mus musculus
tacagagtgcttgacgacctttgga

SEQ ID NO: 742090 - DNA, 25 bp, Mus musculus
tacagagttcccaagcactgcaggt

SEQ ID NO: 742091 - DNA, 25 bp, Mus musculus
tacagagttccctagcactgcaggt

SEQ ID NO: 742092 - DNA, 25 bp, Mus musculus
tacagagtttcactgacaggttaaa

SEQ ID NO: 742093 - DNA, 25 bp, Mus musculus
tacagagtttcagtgacaggttaaa

SEQ ID NO: 742094 - DNA, 25 bp, Mus musculus
tacagagttttacccactgagtacc

SEQ ID NO: 742095 - DNA, 25 bp, Mus musculus
tacagagttttagccactgagtacc

SEQ ID NO: 742096 - DNA, 25 bp, Mus musculus
tacagagttttcacagaagacaggg

SEQ ID NO: 742097 - DNA, 25 bp, Mus musculus
tacagagttttctcagaagacaggg

SEQ ID NO: 742098 - DNA, 25 bp, Mus musculus
tacagataaagccatatggattgct

SEQ ID NO: 742099 - DNA, 25 bp, Mus musculus
tacagataaagcgatatggattgct

SEQ ID NO: 742100 - DNA, 25 bp, Mus musculus
tacagatacggacaacggcacatgg

SEQ ID NO: 742101 - DNA, 25 bp, Mus musculus
tacagatacggagaacggcacatgg

SEQ ID NO: 742102 - DNA, 25 bp, Mus musculus
tacagatactcgaaacatggtcaga

SEQ ID NO: 742103 - DNA, 25 bp, Mus musculus
tacagatactcgtaacatggtcaga

SEQ ID NO: 742104 - DNA, 25 bp, Mus musculus
tacagatagccacaatggctgaaaa

SEQ ID NO: 742105 - DNA, 25 bp, Mus musculus
tacagatagccagaatggctgaaaa

SEQ ID NO: 742106 - DNA, 25 bp, Mus musculus
tacagatagtcaagagggtgcctcg

SEQ ID NO: 742107 - DNA, 25 bp, Mus musculus
tacagatagtcatgagggtgcctcg

SEQ ID NO: 742108 - DNA, 25 bp, Mus musculus
tacagatcagtgagcgagatatact

SEQ ID NO: 742109 - DNA, 25 bp, Mus musculus
tacagatcagtgtgcgagatatact

SEQ ID NO: 742110 - DNA, 25 bp, Mus musculus
tacagatcatcaaatacagcagctc

SEQ ID NO: 742111 - DNA, 25 bp, Mus musculus
tacagatcatcatatacagcagctc

SEQ ID NO: 742112 - DNA, 25 bp, Mus musculus
tacagatcattaaaaagagtattct

SEQ ID NO: 742113 - DNA, 25 bp, Mus musculus
tacagatcattataaagagtattct

SEQ ID NO: 742114 - DNA, 25 bp, Mus musculus
tacagatcctacaagtcatcaagac

SEQ ID NO: 742115 - DNA, 25 bp, Mus musculus
tacagatcctactagtcatcaagac

SEQ ID NO: 742116 - DNA, 25 bp, Mus musculus
tacagatcgacaaggctttcaacgt

SEQ ID NO: 742117 - DNA, 25 bp, Mus musculus
tacagatcgacatggctttcaacgt

SEQ ID NO: 742118 - DNA, 25 bp, Mus musculus
tacagatcgtcaagttctctcatgg

SEQ ID NO: 742119 - DNA, 25 bp, Mus musculus
tacagatcgtcatgttctctcatgg

SEQ ID NO: 742120 - DNA, 25 bp, Mus musculus
tacagatctctccatctagtgggac

SEQ ID NO: 742121 - DNA, 25 bp, Mus musculus
tacagatctctcgatctagtgggac

SEQ ID NO: 742122 - DNA, 25 bp, Mus musculus
tacagatctgaaagacacagtcatc

SEQ ID NO: 742123 - DNA, 25 bp, Mus musculus
tacagatctgaatgacacagtcatc

SEQ ID NO: 742124 - DNA, 25 bp, Mus musculus
tacagatctgccatgtcgcagagca

SEQ ID NO: 742125 - DNA, 25 bp, Mus musculus
tacagatctgccttgtcgcagagca

SEQ ID NO: 742126 - DNA, 25 bp, Mus musculus
tacagatgaaaacgtgtcacttggt

SEQ ID NO: 742127 - DNA, 25 bp, Mus musculus
tacagatgaaaaggtgtcacttggt

SEQ ID NO: 742128 - DNA, 25 bp, Mus musculus
tacagatgaagcaagagcttttgca

SEQ ID NO: 742129 - DNA, 25 bp, Mus musculus
tacagatgaagctagagcttttgca

SEQ ID NO: 742130 - DNA, 25 bp, Mus musculus
tacagatgagcacatgagaggcttg

SEQ ID NO: 742131 - DNA, 25 bp, Mus musculus
tacagatgagcagatgagaggcttg

SEQ ID NO: 742132 - DNA, 25 bp, Mus musculus
tacagatgaggaacgtgtgttgagc

SEQ ID NO: 742133 - DNA, 25 bp, Mus musculus
tacagatgaggatcgtgtgttgagc

SEQ ID NO: 742134 - DNA, 25 bp, Mus musculus
tacagatgcgggatcagaaagaatc

SEQ ID NO: 742135 - DNA, 25 bp, Mus musculus
tacagatgcgggttcagaaagaatc

SEQ ID NO: 742136 - DNA, 25 bp, Mus musculus
tacagatgctacaccacttttgggc

SEQ ID NO: 742137 - DNA, 25 bp, Mus musculus
tacagatgctactccacttttgggc

SEQ ID NO: 742138 - DNA, 25 bp, Mus musculus
tacagatgctgaagctactattttc

SEQ ID NO: 742139 - DNA, 25 bp, Mus musculus
tacagatgctgatgctactattttc

SEQ ID NO: 742140 - DNA, 25 bp, Mus musculus
tacagatgctgcaagacgccatcag

SEQ ID NO: 742141 - DNA, 25 bp, Mus musculus
tacagatgctgctagacgccatcag

SEQ ID NO: 742142 - DNA, 25 bp, Mus musculus
tacagatggaagcagaagccttagc

SEQ ID NO: 742143 - DNA, 25 bp, Mus musculus
tacagatggaaggagaagccttagc

SEQ ID NO: 742144 - DNA, 25 bp, Mus musculus
tacagatggatcagtactaaaaccc

SEQ ID NO: 742145 - DNA, 25 bp, Mus musculus
tacagatggatctgtactaaaaccc

SEQ ID NO: 742146 - DNA, 25 bp, Mus musculus
tacagatggtgtctgtagcttcctt

SEQ ID NO: 742147 - DNA, 25 bp, Mus musculus
tacagatggtgtgtgtagcttcctt

SEQ ID NO: 742148 - DNA, 25 bp, Mus musculus
tacagatgtacaacctggaaactac

SEQ ID NO: 742149 - DNA, 25 bp, Mus musculus
tacagatgtacatcctggaaactac

SEQ ID NO: 742150 - DNA, 25 bp, Mus musculus
tacagatgtgaacagagtagctgcc

SEQ ID NO: 742151 - DNA, 25 bp, Mus musculus
tacagatgtgaagagagtagctgcc

SEQ ID NO: 742152 - DNA, 25 bp, Mus musculus
tacagatgttacaacgggcaggagc

SEQ ID NO: 742153 - DNA, 25 bp, Mus musculus
tacagatgttactacgggcaggagc

SEQ ID NO: 742154 - DNA, 25 bp, Mus musculus
tacagattcattctctaatcgttct

SEQ ID NO: 742155 - DNA, 25 bp, Mus musculus
tacagattcattgtctaatcgttct

SEQ ID NO: 742156 - DNA, 25 bp, Mus musculus
tacagattctcgaagaattcacaaa

SEQ ID NO: 742157 - DNA, 25 bp, Mus musculus
tacagattctcgtagaattcacaaa

SEQ ID NO: 742158 - DNA, 25 bp, Mus musculus
tacagattgcagcagcattaatatc

SEQ ID NO: 742159 - DNA, 25 bp, Mus musculus
tacagattgcaggagcattaatatc

SEQ ID NO: 742160 - DNA, 25 bp, Mus musculus
tacagattgttcacgcccatgaaga

SEQ ID NO: 742161 - DNA, 25 bp, Mus musculus
tacagattgttctcgcccatgaaga

SEQ ID NO: 742162 - DNA, 25 bp, Mus musculus
tacagcaaacatctcaagtccgagc

SEQ ID NO: 742163 - DNA, 25 bp, Mus musculus
tacagcaaacatgtcaagtccgagc

SEQ ID NO: 742164 - DNA, 25 bp, Mus musculus
tacagcaaagtcaagtccattctat

SEQ ID NO: 742165 - DNA, 25 bp, Mus musculus
tacagcaaagtctagtccattctat

SEQ ID NO: 742166 - DNA, 25 bp, Mus musculus
tacagcaacagcctgatagagcttt

SEQ ID NO: 742167 - DNA, 25 bp, Mus musculus
tacagcaacagcgtgatagagcttt

SEQ ID NO: 742168 - DNA, 25 bp, Mus musculus
tacagcaacatacaggagttcgcag

SEQ ID NO: 742169 - DNA, 25 bp, Mus musculus
tacagcaacatagaggagttcgcag

SEQ ID NO: 742170 - DNA, 25 bp, Mus musculus
tacagcaacccgaggatcggaaagt

SEQ ID NO: 742171 - DNA, 25 bp, Mus musculus
tacagcaacccgtggatcggaaagt

SEQ ID NO: 742172 - DNA, 25 bp, Mus musculus
tacagcaacgccctgccagtggggt

SEQ ID NO: 742173 - DNA, 25 bp, Mus musculus
tacagcaacgccgtgccagtggggt

SEQ ID NO: 742174 - DNA, 25 bp, Mus musculus
tacagcaagaatccatccaacaagg

SEQ ID NO: 742175 - DNA, 25 bp, Mus musculus
tacagcaagaatgcatccaacaagg

SEQ ID NO: 742176 - DNA, 25 bp, Mus musculus
tacagcaagacaagttggaaacact

SEQ ID NO: 742177 - DNA, 25 bp, Mus musculus
tacagcaagacatgttggaaacact

SEQ ID NO: 742178 - DNA, 25 bp, Mus musculus
tacagcaagactcgagtgcagtgcc

SEQ ID NO: 742179 - DNA, 25 bp, Mus musculus
tacagcaagactggagtgcagtgcc

SEQ ID NO: 742180 - DNA, 25 bp, Mus musculus
tacagcaagctcaatgtgcagaaga

SEQ ID NO: 742181 - DNA, 25 bp, Mus musculus
tacagcaagctctatgtgcagaaga

SEQ ID NO: 742182 - DNA, 25 bp, Mus musculus
tacagcaagctgcattccgacatga

SEQ ID NO: 742183 - DNA, 25 bp, Mus musculus
tacagcaagctggattccgacatga

SEQ ID NO: 742184 - DNA, 25 bp, Mus musculus
tacagcaagggacaactggaaattc

SEQ ID NO: 742185 - DNA, 25 bp, Mus musculus
tacagcaagggagaactggaaattc

SEQ ID NO: 742186 - DNA, 25 bp, Mus musculus
tacagcaagtcccagtcgtatcagc

SEQ ID NO: 742187 - DNA, 25 bp, Mus musculus
tacagcaagtccgagtcgtatcagc

SEQ ID NO: 742188 - DNA, 25 bp, Mus musculus
tacagcacagggaaggtattacctg

SEQ ID NO: 742189 - DNA, 25 bp, Mus musculus
tacagcacagggtaggtattacctg

SEQ ID NO: 742190 - DNA, 25 bp, Mus musculus
tacagcacggggagcagtggcatct

SEQ ID NO: 742191 - DNA, 25 bp, Mus musculus
tacagcacggggtgcagtggcatct

SEQ ID NO: 742192 - DNA, 25 bp, Mus musculus
tacagcacggttacagcttgtcatc

SEQ ID NO: 742193 - DNA, 25 bp, Mus musculus
tacagcacggtttcagcttgtcatc

SEQ ID NO: 742194 - DNA, 25 bp, Mus musculus
tacagcactagtcaagtcagtcacc

SEQ ID NO: 742195 - DNA, 25 bp, Mus musculus
tacagcactagtgaagtcagtcacc

SEQ ID NO: 742196 - DNA, 25 bp, Mus musculus
tacagcactcgacagcacactgctt

SEQ ID NO: 742197 - DNA, 25 bp, Mus musculus
tacagcactcgagagcacactgctt

SEQ ID NO: 742198 - DNA, 25 bp, Mus musculus
tacagcactgtcatggcagctgcct

SEQ ID NO: 742199 - DNA, 25 bp, Mus musculus
tacagcactgtcttggcagctgcct

SEQ ID NO: 742200 - DNA, 25 bp, Mus musculus
tacagcagaaccatccaagccctag

SEQ ID NO: 742201 - DNA, 25 bp, Mus musculus
tacagcagaaccttccaagccctag

SEQ ID NO: 742202 - DNA, 25 bp, Mus musculus
tacagcagcacaacaggccttgttg

SEQ ID NO: 742203 - DNA, 25 bp, Mus musculus
tacagcagcacatcaggccttgttg

SEQ ID NO: 742204 - DNA, 25 bp, Mus musculus
tacagcagcccgcagatttaaagga

SEQ ID NO: 742205 - DNA, 25 bp, Mus musculus
tacagcagcccggagatttaaagga

SEQ ID NO: 742206 - DNA, 25 bp, Mus musculus
tacagcagcggtcgcgaagatggtt

SEQ ID NO: 742207 - DNA, 25 bp, Mus musculus
tacagcagcggtggcgaagatggtt

SEQ ID NO: 742208 - DNA, 25 bp, Mus musculus
tacagcaggaagatgatgatgaacc

SEQ ID NO: 742209 - DNA, 25 bp, Mus musculus
tacagcaggaagttgatgatgaacc

SEQ ID NO: 742210 - DNA, 25 bp, Mus musculus
tacagcagtgaacctcaatgaagtt

SEQ ID NO: 742211 - DNA, 25 bp, Mus musculus
tacagcagtgaagctcaatgaagtt

SEQ ID NO: 742212 - DNA, 25 bp, Mus musculus
tacagcagtgatcctccctttgaag

SEQ ID NO: 742213 - DNA, 25 bp, Mus musculus
tacagcagtgatgctccctttgaag

SEQ ID NO: 742214 - DNA, 25 bp, Mus musculus
tacagcataatgcactagcaaaaga

SEQ ID NO: 742215 - DNA, 25 bp, Mus musculus
tacagcataatggactagcaaaaga

SEQ ID NO: 742216 - DNA, 25 bp, Mus musculus
tacagcatcaagagtgagtactcgg

SEQ ID NO: 742217 - DNA, 25 bp, Mus musculus
tacagcatcaagtgtgagtactcgg

SEQ ID NO: 742218 - DNA, 25 bp, Mus musculus
tacagcatcggtcggcacagcatca

SEQ ID NO: 742219 - DNA, 25 bp, Mus musculus
tacagcatcggtgggcacagcatca

SEQ ID NO: 742220 - DNA, 25 bp, Mus musculus
tacagcatctgccatgagggccctg

SEQ ID NO: 742221 - DNA, 25 bp, Mus musculus
tacagcatctgcgatgagggccctg

SEQ ID NO: 742222 - DNA, 25 bp, Mus musculus
tacagcatgcctatgagggctacaa

SEQ ID NO: 742223 - DNA, 25 bp, Mus musculus
tacagcatgcctttgagggctacaa

SEQ ID NO: 742224 - DNA, 25 bp, Mus musculus
tacagcatgcgtcccgccgatgtgc

SEQ ID NO: 742225 - DNA, 25 bp, Mus musculus
tacagcatgcgtgccgccgatgtgc

SEQ ID NO: 742226 - DNA, 25 bp, Mus musculus
tacagcatgctgctggcctttacaa

SEQ ID NO: 742227 - DNA, 25 bp, Mus musculus
tacagcatgctggtggcctttacaa

SEQ ID NO: 742228 - DNA, 25 bp, Mus musculus
tacagcatggtaactccataaacag

SEQ ID NO: 742229 - DNA, 25 bp, Mus musculus
tacagcatggtatctccataaacag

SEQ ID NO: 742230 - DNA, 25 bp, Mus musculus
tacagcatgttaagggacacagtta

SEQ ID NO: 742231 - DNA, 25 bp, Mus musculus
tacagcatgttatgggacacagtta

SEQ ID NO: 742232 - DNA, 25 bp, Mus musculus
tacagcattaagcttatgaatcgcc

SEQ ID NO: 742233 - DNA, 25 bp, Mus musculus
tacagcattaaggttatgaatcgcc

SEQ ID NO: 742234 - DNA, 25 bp, Mus musculus
tacagcattactcaggtaaccccag

SEQ ID NO: 742235 - DNA, 25 bp, Mus musculus
tacagcattactgaggtaaccccag

SEQ ID NO: 742236 - DNA, 25 bp, Mus musculus
tacagccaaacccagaagccaggct

SEQ ID NO: 742237 - DNA, 25 bp, Mus musculus
tacagccaaaccgagaagccaggct

SEQ ID NO: 742238 - DNA, 25 bp, Mus musculus
tacagccaagctctacatctgaatc

SEQ ID NO: 742239 - DNA, 25 bp, Mus musculus
tacagccaagctgtacatctgaatc

SEQ ID NO: 742240 - DNA, 25 bp, Mus musculus
tacagccaagtcactgtgcagcgcg

SEQ ID NO: 742241 - DNA, 25 bp, Mus musculus
tacagccaagtctctgtgcagcgcg

SEQ ID NO: 742242 - DNA, 25 bp, Mus musculus
tacagccaatgcaacgagctcacca

SEQ ID NO: 742243 - DNA, 25 bp, Mus musculus
tacagccaatgctacgagctcacca

SEQ ID NO: 742244 - DNA, 25 bp, Mus musculus
tacagccacatactggaatccgagt

SEQ ID NO: 742245 - DNA, 25 bp, Mus musculus
tacagccacatagtggaatccgagt

SEQ ID NO: 742246 - DNA, 25 bp, Mus musculus
tacagccactttattacaccagact

SEQ ID NO: 742247 - DNA, 25 bp, Mus musculus
tacagccacttttttacaccagact

SEQ ID NO: 742248 - DNA, 25 bp, Mus musculus
tacagccagcttcagggcttcagtg

SEQ ID NO: 742249 - DNA, 25 bp, Mus musculus
tacagccagcttgagggcttcagtg

SEQ ID NO: 742250 - DNA, 25 bp, Mus musculus
tacagccaggatcctagagagtgca

SEQ ID NO: 742251 - DNA, 25 bp, Mus musculus
tacagccaggatgctagagagtgca

SEQ ID NO: 742252 - DNA, 25 bp, Mus musculus
tacagccatcacagctgcacaagtt

SEQ ID NO: 742253 - DNA, 25 bp, Mus musculus
tacagccatcactgctgcacaagtt

SEQ ID NO: 742254 - DNA, 25 bp, Mus musculus
tacagccatgatcattaaagcggtg

SEQ ID NO: 742255 - DNA, 25 bp, Mus musculus
tacagccatgatgattaaagcggtg

SEQ ID NO: 742256 - DNA, 25 bp, Mus musculus
tacagccattccattcccgagaaca

SEQ ID NO: 742257 - DNA, 25 bp, Mus musculus
tacagccattcctttcccgagaaca

SEQ ID NO: 742258 - DNA, 25 bp, Mus musculus
tacagccattgaacaatctttatgg

SEQ ID NO: 742259 - DNA, 25 bp, Mus musculus
tacagccattgatcaatctttatgg

SEQ ID NO: 742260 - DNA, 25 bp, Mus musculus
tacagccccaaaatggttaaggttg

SEQ ID NO: 742261 - DNA, 25 bp, Mus musculus
tacagccccaaattggttaaggttg

SEQ ID NO: 742262 - DNA, 25 bp, Mus musculus
tacagccccgataacggtggtacac

SEQ ID NO: 742263 - DNA, 25 bp, Mus musculus
tacagccccgattacggtggtacac

SEQ ID NO: 742264 - DNA, 25 bp, Mus musculus
tacagccctgctaagctccgaacta

SEQ ID NO: 742265 - DNA, 25 bp, Mus musculus
tacagccctgcttagctccgaacta

SEQ ID NO: 742266 - DNA, 25 bp, Mus musculus
tacagccgagccattgctggtgtca

SEQ ID NO: 742267 - DNA, 25 bp, Mus musculus
tacagccgagcctttgctggtgtca

SEQ ID NO: 742268 - DNA, 25 bp, Mus musculus
tacagccgctgtctagagctgatgc

SEQ ID NO: 742269 - DNA, 25 bp, Mus musculus
tacagccgctgtgtagagctgatgc

SEQ ID NO: 742270 - DNA, 25 bp, Mus musculus
tacagccgtgtcatcagatgatgca

SEQ ID NO: 742271 - DNA, 25 bp, Mus musculus
tacagccgtgtcttcagatgatgca

SEQ ID NO: 742272 - DNA, 25 bp, Mus musculus
tacagccgtgtgctggcgattcaca

SEQ ID NO: 742273 - DNA, 25 bp, Mus musculus
tacagccgtgtggtggcgattcaca

SEQ ID NO: 742274 - DNA, 25 bp, Mus musculus
tacagcctatagctgtgaggaaaaa

SEQ ID NO: 742275 - DNA, 25 bp, Mus musculus
tacagcctataggtgtgaggaaaaa

SEQ ID NO: 742276 - DNA, 25 bp, Mus musculus
tacagcctcctgagtgcgagctcag

SEQ ID NO: 742277 - DNA, 25 bp, Mus musculus
tacagcctcctgtgtgcgagctcag

SEQ ID NO: 742278 - DNA, 25 bp, Mus musculus
tacagcctgacaagcagccaaacat

SEQ ID NO: 742279 - DNA, 25 bp, Mus musculus
tacagcctgacatgcagccaaacat

SEQ ID NO: 742280 - DNA, 25 bp, Mus musculus
tacagccttattcccttacctggtg

SEQ ID NO: 742281 - DNA, 25 bp, Mus musculus
tacagccttattgccttacctggtg

SEQ ID NO: 742282 - DNA, 25 bp, Mus musculus
tacagcgacactcagccagaaaact

SEQ ID NO: 742283 - DNA, 25 bp, Mus musculus
tacagcgacactgagccagaaaact

SEQ ID NO: 742284 - DNA, 25 bp, Mus musculus
tacagcgacctcagcaagggagtgc

SEQ ID NO: 742285 - DNA, 25 bp, Mus musculus
tacagcgacctctgcaagggagtgc

SEQ ID NO: 742286 - DNA, 25 bp, Mus musculus
tacagcgacgacaaactcgagagga

SEQ ID NO: 742287 - DNA, 25 bp, Mus musculus
tacagcgacgactaactcgagagga

SEQ ID NO: 742288 - DNA, 25 bp, Mus musculus
tacagcgagatcactctggcaacag

SEQ ID NO: 742289 - DNA, 25 bp, Mus musculus
tacagcgagatctctctggcaacag

SEQ ID NO: 742290 - DNA, 25 bp, Mus musculus
tacagcgagctgacgtgggctctct

SEQ ID NO: 742291 - DNA, 25 bp, Mus musculus
tacagcgagctgtcgtgggctctct

SEQ ID NO: 742292 - DNA, 25 bp, Mus musculus
tacagcgagtgcctcaagttcatga

SEQ ID NO: 742293 - DNA, 25 bp, Mus musculus
tacagcgagtgcgtcaagttcatga

SEQ ID NO: 742294 - DNA, 25 bp, Mus musculus
tacagcgccgccaattgtgtggatg

SEQ ID NO: 742295 - DNA, 25 bp, Mus musculus
tacagcgccgcctattgtgtggatg

SEQ ID NO: 742296 - DNA, 25 bp, Mus musculus
tacagcgctggccttatggcaaggt

SEQ ID NO: 742297 - DNA, 25 bp, Mus musculus
tacagcgctggcgttatggcaaggt

SEQ ID NO: 742298 - DNA, 25 bp, Mus musculus
tacagcggacgtaggaactggtgtt

SEQ ID NO: 742299 - DNA, 25 bp, Mus musculus
tacagcggacgttggaactggtgtt

SEQ ID NO: 742300 - DNA, 25 bp, Mus musculus
tacagcggactcatctacatcaaaa

SEQ ID NO: 742301 - DNA, 25 bp, Mus musculus
tacagcggactcttctacatcaaaa

SEQ ID NO: 742302 - DNA, 25 bp, Mus musculus
tacagcggctgcagtgcaaggaccc

SEQ ID NO: 742303 - DNA, 25 bp, Mus musculus
tacagcggctgctgtgcaaggaccc

SEQ ID NO: 742304 - DNA, 25 bp, Mus musculus
tacagcggtgagaccttgagagaga

SEQ ID NO: 742305 - DNA, 25 bp, Mus musculus
tacagcggtgagtccttgagagaga

SEQ ID NO: 742306 - DNA, 25 bp, Mus musculus
tacagcgtatccctgccaagggaac

SEQ ID NO: 742307 - DNA, 25 bp, Mus musculus
tacagcgtatccgtgccaagggaac

SEQ ID NO: 742308 - DNA, 25 bp, Mus musculus
tacagcgtcactcggccaggagctg

SEQ ID NO: 742309 - DNA, 25 bp, Mus musculus
tacagcgtcactgggccaggagctg

SEQ ID NO: 742310 - DNA, 25 bp, Mus musculus
tacagcgtggaaatctcagaggaac

SEQ ID NO: 742311 - DNA, 25 bp, Mus musculus
tacagcgtggaattctcagaggaac

SEQ ID NO: 742312 - DNA, 25 bp, Mus musculus
tacagcgttctaccagcttcggagt

SEQ ID NO: 742313 - DNA, 25 bp, Mus musculus
tacagcgttctagcagcttcggagt

SEQ ID NO: 742314 - DNA, 25 bp, Mus musculus
tacagctacctgaataagcttccgg

SEQ ID NO: 742315 - DNA, 25 bp, Mus musculus
tacagctacctgtataagcttccgg

SEQ ID NO: 742316 - DNA, 25 bp, Mus musculus
tacagctagtgacccttccccaagt

SEQ ID NO: 742317 - DNA, 25 bp, Mus musculus
tacagctagtgagccttccccaagt

SEQ ID NO: 742318 - DNA, 25 bp, Mus musculus
tacagctataagagtgacaacgggt

SEQ ID NO: 742319 - DNA, 25 bp, Mus musculus
tacagctataagtgtgacaacgggt

SEQ ID NO: 742320 - DNA, 25 bp, Mus musculus
tacagctatgtgaatcaagatgggc

SEQ ID NO: 742321 - DNA, 25 bp, Mus musculus
tacagctatgtgtatcaagatgggc

SEQ ID NO: 742322 - DNA, 25 bp, Mus musculus
tacagctcatcaacagttacaccgg

SEQ ID NO: 742323 - DNA, 25 bp, Mus musculus
tacagctcatcatcagttacaccgg

SEQ ID NO: 742324 - DNA, 25 bp, Mus musculus
tacagctccaaaccaagcacgatgc

SEQ ID NO: 742325 - DNA, 25 bp, Mus musculus
tacagctccaaagcaagcacgatgc

SEQ ID NO: 742326 - DNA, 25 bp, Mus musculus
tacagctccagtactaggtgatctg

SEQ ID NO: 742327 - DNA, 25 bp, Mus musculus
tacagctccagttctaggtgatctg

SEQ ID NO: 742328 - DNA, 25 bp, Mus musculus
tacagctcttgaccttgagtgcaat

SEQ ID NO: 742329 - DNA, 25 bp, Mus musculus
tacagctcttgagcttgagtgcaat

SEQ ID NO: 742330 - DNA, 25 bp, Mus musculus
tacagctgaagcacaagttggtgga

SEQ ID NO: 742331 - DNA, 25 bp, Mus musculus
tacagctgaagctcaagttggtgga

SEQ ID NO: 742332 - DNA, 25 bp, Mus musculus
tacagctgacagagagtccttgagc

SEQ ID NO: 742333 - DNA, 25 bp, Mus musculus
tacagctgacagtgagtccttgagc

SEQ ID NO: 742334 - DNA, 25 bp, Mus musculus
tacagctgcacgaggcttttaagca

SEQ ID NO: 742335 - DNA, 25 bp, Mus musculus
tacagctgcacgtggcttttaagca

SEQ ID NO: 742336 - DNA, 25 bp, Mus musculus
tacagctgcatgacgcctggtagag

SEQ ID NO: 742337 - DNA, 25 bp, Mus musculus
tacagctgcatgtcgcctggtagag

SEQ ID NO: 742338 - DNA, 25 bp, Mus musculus
tacagctgctgtctggcgagcacaa

SEQ ID NO: 742339 - DNA, 25 bp, Mus musculus
tacagctgctgtctggtctgcctgc

SEQ ID NO: 742340 - DNA, 25 bp, Mus musculus
tacagctgctgtgtggcgagcacaa

SEQ ID NO: 742341 - DNA, 25 bp, Mus musculus
tacagctgctgtgtggtctgcctgc

SEQ ID NO: 742342 - DNA, 25 bp, Mus musculus
tacagctggaagagttacaacgccc

SEQ ID NO: 742343 - DNA, 25 bp, Mus musculus
tacagctggaagtgttacaacgccc

SEQ ID NO: 742344 - DNA, 25 bp, Mus musculus
tacagctggatcaaagctgagagaa

SEQ ID NO: 742345 - DNA, 25 bp, Mus musculus
tacagctggatctaagctgagagaa

SEQ ID NO: 742346 - DNA, 25 bp, Mus musculus
tacagctggctcaggccctatcaca

SEQ ID NO: 742347 - DNA, 25 bp, Mus musculus
tacagctggctctggccctatcaca

SEQ ID NO: 742348 - DNA, 25 bp, Mus musculus
tacagctggcttctgccacgacatc

SEQ ID NO: 742349 - DNA, 25 bp, Mus musculus
tacagctggcttgtgccacgacatc

SEQ ID NO: 742350 - DNA, 25 bp, Mus musculus
tacagctgggatctacctggagaga

SEQ ID NO: 742351 - DNA, 25 bp, Mus musculus
tacagctgggatgtacctggagaga

SEQ ID NO: 742352 - DNA, 25 bp, Mus musculus
tacagctgggctctcatcactccag

SEQ ID NO: 742353 - DNA, 25 bp, Mus musculus
tacagctgggctgtcatcactccag

SEQ ID NO: 742354 - DNA, 25 bp, Mus musculus
tacagctggtatcgcagcacccggc

SEQ ID NO: 742355 - DNA, 25 bp, Mus musculus
tacagctggtatggcagcacccggc

SEQ ID NO: 742356 - DNA, 25 bp, Mus musculus
tacagctgtacaccgttctaccagc

SEQ ID NO: 742357 - DNA, 25 bp, Mus musculus
tacagctgtacagcgttctaccagc

SEQ ID NO: 742358 - DNA, 25 bp, Mus musculus
tacagctgtactattccctggagga

SEQ ID NO: 742359 - DNA, 25 bp, Mus musculus
tacagctgtacttttccctggagga

SEQ ID NO: 742360 - DNA, 25 bp, Mus musculus
tacagctgtagtctctgaacgtgca

SEQ ID NO: 742361 - DNA, 25 bp, Mus musculus
tacagctgtagtgtctgaacgtgca

SEQ ID NO: 742362 - DNA, 25 bp, Mus musculus
tacagctgtggcctttaataaggaa

SEQ ID NO: 742363 - DNA, 25 bp, Mus musculus
tacagctgtggcgtttaataaggaa

SEQ ID NO: 742364 - DNA, 25 bp, Mus musculus
tacagctgtggtagtccaacaagag

SEQ ID NO: 742365 - DNA, 25 bp, Mus musculus
tacagctgtggttgtccaacaagag

SEQ ID NO: 742366 - DNA, 25 bp, Mus musculus
tacagctgtgtaataaagatgccgt

SEQ ID NO: 742367 - DNA, 25 bp, Mus musculus
tacagctgtgtattaaagatgccgt

SEQ ID NO: 742368 - DNA, 25 bp, Mus musculus
tacagctgttgtaaccacccagggc

SEQ ID NO: 742369 - DNA, 25 bp, Mus musculus
tacagctgttgttaccacccagggc

SEQ ID NO: 742370 - DNA, 25 bp, Mus musculus
tacagcttaatcattttggtcttct

SEQ ID NO: 742371 - DNA, 25 bp, Mus musculus
tacagcttaatctttttggtcttct

SEQ ID NO: 742372 - DNA, 25 bp, Mus musculus
tacagcttacttcataatacagaat

SEQ ID NO: 742373 - DNA, 25 bp, Mus musculus
tacagcttacttgataatacagaat

SEQ ID NO: 742374 - DNA, 25 bp, Mus musculus
tacagcttcacacgtggcgctgggc

SEQ ID NO: 742375 - DNA, 25 bp, Mus musculus
tacagcttcacaggtggcgctgggc

SEQ ID NO: 742376 - DNA, 25 bp, Mus musculus
tacagcttcgctctcggcttcgcga

SEQ ID NO: 742377 - DNA, 25 bp, Mus musculus
tacagcttcgctgtcggcttcgcga

SEQ ID NO: 742378 - DNA, 25 bp, Mus musculus
tacaggaaattcaccaccgagagcg

SEQ ID NO: 742379 - DNA, 25 bp, Mus musculus
tacaggaaattcattagagcaaatg

SEQ ID NO: 742380 - DNA, 25 bp, Mus musculus
tacaggaaattctccaccgagagcg

SEQ ID NO: 742381 - DNA, 25 bp, Mus musculus
tacaggaaattctttagagcaaatg

SEQ ID NO: 742382 - DNA, 25 bp, Mus musculus
tacaggaacggccaatagtgtgttc

SEQ ID NO: 742383 - DNA, 25 bp, Mus musculus
tacaggaacggcgaatagtgtgttc

SEQ ID NO: 742384 - DNA, 25 bp, Mus musculus
tacaggaagaggcaggtctagtata

SEQ ID NO: 742385 - DNA, 25 bp, Mus musculus
tacaggaagagggaggtctagtata

SEQ ID NO: 742386 - DNA, 25 bp, Mus musculus
tacaggaagatactgtcctggctgg

SEQ ID NO: 742387 - DNA, 25 bp, Mus musculus
tacaggaagatagtgtcctggctgg

SEQ ID NO: 742388 - DNA, 25 bp, Mus musculus
tacaggaagcatacgagtttcaagc

SEQ ID NO: 742389 - DNA, 25 bp, Mus musculus
tacaggaagcattcgagtttcaagc

SEQ ID NO: 742390 - DNA, 25 bp, Mus musculus
tacaggaagttcaagaagatcatta

SEQ ID NO: 742391 - DNA, 25 bp, Mus musculus
tacaggaagttctagaagatcatta

SEQ ID NO: 742392 - DNA, 25 bp, Mus musculus
tacaggaatggtaatgaatttgacc

SEQ ID NO: 742393 - DNA, 25 bp, Mus musculus
tacaggaatggttatgaatttgacc

SEQ ID NO: 742394 - DNA, 25 bp, Mus musculus
tacaggaattcaaagagaagggctc

SEQ ID NO: 742395 - DNA, 25 bp, Mus musculus
tacaggaattcatagagaagggctc

SEQ ID NO: 742396 - DNA, 25 bp, Mus musculus
tacaggaattggactccaaatatgg

SEQ ID NO: 742397 - DNA, 25 bp, Mus musculus
tacaggaattggtctccaaatatgg

SEQ ID NO: 742398 - DNA, 25 bp, Mus musculus
tacaggaattttcggaaagcaagca

SEQ ID NO: 742399 - DNA, 25 bp, Mus musculus
tacaggaattttgggaaagcaagca

SEQ ID NO: 742400 - DNA, 25 bp, Mus musculus
tacaggacaaaactttactccaaat

SEQ ID NO: 742401 - DNA, 25 bp, Mus musculus
tacaggacaaaagtttactccaaat

SEQ ID NO: 742402 - DNA, 25 bp, Mus musculus
tacaggacatccagcgtggggtgac

SEQ ID NO: 742403 - DNA, 25 bp, Mus musculus
tacaggacatcctgcgtggggtgac

SEQ ID NO: 742404 - DNA, 25 bp, Mus musculus
tacaggacctaaaacccggagactg

SEQ ID NO: 742405 - DNA, 25 bp, Mus musculus
tacaggacctaaaagccaagggcgt

SEQ ID NO: 742406 - DNA, 25 bp, Mus musculus
tacaggacctaatacccggagactg

SEQ ID NO: 742407 - DNA, 25 bp, Mus musculus
tacaggacctaatagccaagggcgt

SEQ ID NO: 742408 - DNA, 25 bp, Mus musculus
tacaggacgcttcccgtaaggagaa

SEQ ID NO: 742409 - DNA, 25 bp, Mus musculus
tacaggacgcttgccgtaaggagaa

SEQ ID NO: 742410 - DNA, 25 bp, Mus musculus
tacaggacgtagaagccacgtctac

SEQ ID NO: 742411 - DNA, 25 bp, Mus musculus
tacaggacgtagtagccacgtctac

SEQ ID NO: 742412 - DNA, 25 bp, Mus musculus
tacaggacgtttcgagattcttcag

SEQ ID NO: 742413 - DNA, 25 bp, Mus musculus
tacaggacgtttggagattcttcag

SEQ ID NO: 742414 - DNA, 25 bp, Mus musculus
tacaggagaaaaagataacatgcat

SEQ ID NO: 742415 - DNA, 25 bp, Mus musculus
tacaggagaaaatgataacatgcat

SEQ ID NO: 742416 - DNA, 25 bp, Mus musculus
tacaggagccgtcgccattatgact

SEQ ID NO: 742417 - DNA, 25 bp, Mus musculus
tacaggagccgtggccattatgact

SEQ ID NO: 742418 - DNA, 25 bp, Mus musculus
tacaggagctgaagcaactggcacg

SEQ ID NO: 742419 - DNA, 25 bp, Mus musculus
tacaggagctgatgcaactggcacg

SEQ ID NO: 742420 - DNA, 25 bp, Mus musculus
tacaggaggagcaagtgaccgttct

SEQ ID NO: 742421 - DNA, 25 bp, Mus musculus
tacaggaggagctagtgaccgttct

SEQ ID NO: 742422 - DNA, 25 bp, Mus musculus
tacaggagtagaagggtcgcctctc

SEQ ID NO: 742423 - DNA, 25 bp, Mus musculus
tacaggagtagatgggtcgcctctc

SEQ ID NO: 742424 - DNA, 25 bp, Mus musculus
tacaggagttaaagtgcataaatgc

SEQ ID NO: 742425 - DNA, 25 bp, Mus musculus
tacaggagttaatgtgcataaatgc

SEQ ID NO: 742426 - DNA, 25 bp, Mus musculus
tacaggatatgcatagcagccacca

SEQ ID NO: 742427 - DNA, 25 bp, Mus musculus
tacaggatatgcttagcagccacca

SEQ ID NO: 742428 - DNA, 25 bp, Mus musculus
tacaggatcattagagccaagaggt

SEQ ID NO: 742429 - DNA, 25 bp, Mus musculus
tacaggatcatttgagccaagaggt

SEQ ID NO: 742430 - DNA, 25 bp, Mus musculus
tacaggatgcccctcagcaaagtta

SEQ ID NO: 742431 - DNA, 25 bp, Mus musculus
tacaggatgcccgtcagcaaagtta

SEQ ID NO: 742432 - DNA, 25 bp, Mus musculus
tacaggatgtcacctgcgcttggaa

SEQ ID NO: 742433 - DNA, 25 bp, Mus musculus
tacaggatgtcagctgcgcttggaa

SEQ ID NO: 742434 - DNA, 25 bp, Mus musculus
tacaggatgtggaccactactgccc

SEQ ID NO: 742435 - DNA, 25 bp, Mus musculus
tacaggatgtggtccactactgccc

SEQ ID NO: 742436 - DNA, 25 bp, Mus musculus
tacaggattctgcaacctggaccgc

SEQ ID NO: 742437 - DNA, 25 bp, Mus musculus
tacaggattctggaacctggaccgc

SEQ ID NO: 742438 - DNA, 25 bp, Mus musculus
tacaggcaaacaaaccaagctttat

SEQ ID NO: 742439 - DNA, 25 bp, Mus musculus
tacaggcaaacataccaagctttat

SEQ ID NO: 742440 - DNA, 25 bp, Mus musculus
tacaggcaaccaaaccgagaggcat

SEQ ID NO: 742441 - DNA, 25 bp, Mus musculus
tacaggcaaccataccgagaggcat

SEQ ID NO: 742442 - DNA, 25 bp, Mus musculus
tacaggcaagacagactgcatggca

SEQ ID NO: 742443 - DNA, 25 bp, Mus musculus
tacaggcaagactgactgcatggca

SEQ ID NO: 742444 - DNA, 25 bp, Mus musculus
tacaggcagaacagtgctcacacca

SEQ ID NO: 742445 - DNA, 25 bp, Mus musculus
tacaggcagaactgtgctcacacca

SEQ ID NO: 742446 - DNA, 25 bp, Mus musculus
tacaggcagagaataagaggaaatg

SEQ ID NO: 742447 - DNA, 25 bp, Mus musculus
tacaggcagagattaagaggaaatg

SEQ ID NO: 742448 - DNA, 25 bp, Mus musculus
tacaggcagcctatcaattaatgac

SEQ ID NO: 742449 - DNA, 25 bp, Mus musculus
tacaggcagcctttcaattaatgac

SEQ ID NO: 742450 - DNA, 25 bp, Mus musculus
tacaggcagttaatcaacagccacg

SEQ ID NO: 742451 - DNA, 25 bp, Mus musculus
tacaggcagttattcaacagccacg

SEQ ID NO: 742452 - DNA, 25 bp, Mus musculus
tacaggcatgggacctgctggcaaa

SEQ ID NO: 742453 - DNA, 25 bp, Mus musculus
tacaggcatgggtcctgctggcaaa

SEQ ID NO: 742454 - DNA, 25 bp, Mus musculus
tacaggccagcaacagagggaagcc

SEQ ID NO: 742455 - DNA, 25 bp, Mus musculus
tacaggccagcatcagagggaagcc

SEQ ID NO: 742456 - DNA, 25 bp, Mus musculus
tacaggccatcaagtgggtggatga

SEQ ID NO: 742457 - DNA, 25 bp, Mus musculus
tacaggccatcatgtgggtggatga

SEQ ID NO: 742458 - DNA, 25 bp, Mus musculus
tacaggcccggcagggcagcagttg

SEQ ID NO: 742459 - DNA, 25 bp, Mus musculus
tacaggcccggctgggcagcagttg

SEQ ID NO: 742460 - DNA, 25 bp, Mus musculus
tacaggccgtgtcgtgtcaccgttt

SEQ ID NO: 742461 - DNA, 25 bp, Mus musculus
tacaggccgtgtggtgtcaccgttt

SEQ ID NO: 742462 - DNA, 25 bp, Mus musculus
tacaggccttggaacagagtgatcg

SEQ ID NO: 742463 - DNA, 25 bp, Mus musculus
tacaggccttggtacagagtgatcg

SEQ ID NO: 742464 - DNA, 25 bp, Mus musculus
tacaggcgatggatctgcagcacgg

SEQ ID NO: 742465 - DNA, 25 bp, Mus musculus
tacaggcgatggttctgcagcacgg

SEQ ID NO: 742466 - DNA, 25 bp, Mus musculus
tacaggctacggacgagttttctct

SEQ ID NO: 742467 - DNA, 25 bp, Mus musculus
tacaggctacggtcgagttttctct

SEQ ID NO: 742468 - DNA, 25 bp, Mus musculus
tacaggctctgtcctccggctggta

SEQ ID NO: 742469 - DNA, 25 bp, Mus musculus
tacaggctctgtgctccggctggta

SEQ ID NO: 742470 - DNA, 25 bp, Mus musculus
tacaggctcttcaccaggccgtcaa

SEQ ID NO: 742471 - DNA, 25 bp, Mus musculus
tacaggctcttctccaggccgtcaa

SEQ ID NO: 742472 - DNA, 25 bp, Mus musculus
tacaggctgtggataaagctaatgg

SEQ ID NO: 742473 - DNA, 25 bp, Mus musculus
tacaggctgtggttaaagctaatgg

SEQ ID NO: 742474 - DNA, 25 bp, Mus musculus
tacagggaagtaatgaagatgagac

SEQ ID NO: 742475 - DNA, 25 bp, Mus musculus
tacagggaagtacgcacgccactgt

SEQ ID NO: 742476 - DNA, 25 bp, Mus musculus
tacagggaagtaggcacgccactgt

SEQ ID NO: 742477 - DNA, 25 bp, Mus musculus
tacagggaagtattgaagatgagac

SEQ ID NO: 742478 - DNA, 25 bp, Mus musculus
tacagggacttaacatcccgaacag

SEQ ID NO: 742479 - DNA, 25 bp, Mus musculus
tacagggacttatcatcccgaacag

SEQ ID NO: 742480 - DNA, 25 bp, Mus musculus
tacagggagcaacacttagagccat

SEQ ID NO: 742481 - DNA, 25 bp, Mus musculus
tacagggagcaagacttagagccat

SEQ ID NO: 742482 - DNA, 25 bp, Mus musculus
tacagggagcatacgtttctctagc

SEQ ID NO: 742483 - DNA, 25 bp, Mus musculus
tacagggagcattcgtttctctagc

SEQ ID NO: 742484 - DNA, 25 bp, Mus musculus
tacagggatactcatgtggaatacc

SEQ ID NO: 742485 - DNA, 25 bp, Mus musculus
tacagggatactgatgtggaatacc

SEQ ID NO: 742486 - DNA, 25 bp, Mus musculus
tacagggatagcagtgtcttgcaat

SEQ ID NO: 742487 - DNA, 25 bp, Mus musculus
tacagggatagctgtgtcttgcaat

SEQ ID NO: 742488 - DNA, 25 bp, Mus musculus
tacagggatcaaatcacagaccagc

SEQ ID NO: 742489 - DNA, 25 bp, Mus musculus
tacagggatcaattcacagaccagc

SEQ ID NO: 742490 - DNA, 25 bp, Mus musculus
tacagggcatgaaccaactcaatgg

SEQ ID NO: 742491 - DNA, 25 bp, Mus musculus
tacagggcatgatccaactcaatgg

SEQ ID NO: 742492 - DNA, 25 bp, Mus musculus
tacagggcccctaccttactgcccg

SEQ ID NO: 742493 - DNA, 25 bp, Mus musculus
tacagggccccttccttactgcccg

SEQ ID NO: 742494 - DNA, 25 bp, Mus musculus
tacagggctgctctgactcgaagtc

SEQ ID NO: 742495 - DNA, 25 bp, Mus musculus
tacagggctgctgtgactcgaagtc

SEQ ID NO: 742496 - DNA, 25 bp, Mus musculus
tacagggcttctcagtaaaacagcc

SEQ ID NO: 742497 - DNA, 25 bp, Mus musculus
tacagggcttctgagtaaaacagcc

SEQ ID NO: 742498 - DNA, 25 bp, Mus musculus
tacagggtatatcagccacaaagag

SEQ ID NO: 742499 - DNA, 25 bp, Mus musculus
tacagggtatatgagccacaaagag

SEQ ID NO: 742500 - DNA, 25 bp, Mus musculus
tacagggtatccaacagaagtccag

SEQ ID NO: 742501 - DNA, 25 bp, Mus musculus
tacagggtatcctacagaagtccag

SEQ ID NO: 742502 - DNA, 25 bp, Mus musculus
tacagggtgactacagctctgagac

SEQ ID NO: 742503 - DNA, 25 bp, Mus musculus
tacagggtgactacttggatcctcc

SEQ ID NO: 742504 - DNA, 25 bp, Mus musculus
tacagggtgacttcagctctgagac

SEQ ID NO: 742505 - DNA, 25 bp, Mus musculus
tacagggtgacttcttggatcctcc

SEQ ID NO: 742506 - DNA, 25 bp, Mus musculus
tacagggtgatacgctggctaccag

SEQ ID NO: 742507 - DNA, 25 bp, Mus musculus
tacagggtgataggctggctaccag

SEQ ID NO: 742508 - DNA, 25 bp, Mus musculus
tacagggtgcaactagtgactccac

SEQ ID NO: 742509 - DNA, 25 bp, Mus musculus
tacagggtgcaagtagtgactccac

SEQ ID NO: 742510 - DNA, 25 bp, Mus musculus
tacagggtggccctttatctctccc

SEQ ID NO: 742511 - DNA, 25 bp, Mus musculus
tacagggtggccgtttatctctccc

SEQ ID NO: 742512 - DNA, 25 bp, Mus musculus
tacagggtgttcatgcagcgtctac

SEQ ID NO: 742513 - DNA, 25 bp, Mus musculus
tacagggtgttcttgcagcgtctac

SEQ ID NO: 742514 - DNA, 25 bp, Mus musculus
tacagggttagtcctggccgtagat

SEQ ID NO: 742515 - DNA, 25 bp, Mus musculus
tacagggttagtgctggccgtagat

SEQ ID NO: 742516 - DNA, 25 bp, Mus musculus
tacagggttccactatgatgtcatc

SEQ ID NO: 742517 - DNA, 25 bp, Mus musculus
tacagggttccagtatgatgtcatc

SEQ ID NO: 742518 - DNA, 25 bp, Mus musculus
tacagggtttcactagctggagctc

SEQ ID NO: 742519 - DNA, 25 bp, Mus musculus
tacagggtttcagtagctggagctc

SEQ ID NO: 742520 - DNA, 25 bp, Mus musculus
tacaggtacgagctgatgaaggcct

SEQ ID NO: 742521 - DNA, 25 bp, Mus musculus
tacaggtacgaggtgatgaaggcct

SEQ ID NO: 742522 - DNA, 25 bp, Mus musculus
tacaggtcaaggaaaaaacacttgg

SEQ ID NO: 742523 - DNA, 25 bp, Mus musculus
tacaggtcaaggtaaaaacacttgg

SEQ ID NO: 742524 - DNA, 25 bp, Mus musculus
tacaggtcacttatttcccagaagt

SEQ ID NO: 742525 - DNA, 25 bp, Mus musculus
tacaggtcacttttttcccagaagt

SEQ ID NO: 742526 - DNA, 25 bp, Mus musculus
tacaggtccggaagaataagcgccg

SEQ ID NO: 742527 - DNA, 25 bp, Mus musculus
tacaggtccggatgaataagcgccg

SEQ ID NO: 742528 - DNA, 25 bp, Mus musculus
tacaggtcgcaactgtgagagtgac

SEQ ID NO: 742529 - DNA, 25 bp, Mus musculus
tacaggtcgcaagtgtgagagtgac

SEQ ID NO: 742530 - DNA, 25 bp, Mus musculus
tacaggtcgccaagtacttcctgcg

SEQ ID NO: 742531 - DNA, 25 bp, Mus musculus
tacaggtcgccatgtacttcctgcg

SEQ ID NO: 742532 - DNA, 25 bp, Mus musculus
tacaggtctactctgtgcgacagag

SEQ ID NO: 742533 - DNA, 25 bp, Mus musculus
tacaggtctactgtgtgcgacagag

SEQ ID NO: 742534 - DNA, 25 bp, Mus musculus
tacaggtgaatgactggcccactct

SEQ ID NO: 742535 - DNA, 25 bp, Mus musculus
tacaggtgaatgtctggcccactct

SEQ ID NO: 742536 - DNA, 25 bp, Mus musculus
tacaggtgatccaagagcagcaggt

SEQ ID NO: 742537 - DNA, 25 bp, Mus musculus
tacaggtgatcctagagcagcaggt

SEQ ID NO: 742538 - DNA, 25 bp, Mus musculus
tacaggtgctcacattacacccagc

SEQ ID NO: 742539 - DNA, 25 bp, Mus musculus
tacaggtgctcagattacacccagc

SEQ ID NO: 742540 - DNA, 25 bp, Mus musculus
tacaggtggagaattctgatgcagt

SEQ ID NO: 742541 - DNA, 25 bp, Mus musculus
tacaggtggagatttctgatgcagt

SEQ ID NO: 742542 - DNA, 25 bp, Mus musculus
tacaggtggtccaggtgtcagagaa

SEQ ID NO: 742543 - DNA, 25 bp, Mus musculus
tacaggtggtcctggtgtcagagaa

SEQ ID NO: 742544 - DNA, 25 bp, Mus musculus
tacaggtgtttgacaggtagactgc

SEQ ID NO: 742545 - DNA, 25 bp, Mus musculus
tacaggtgtttgtcaggtagactgc

SEQ ID NO: 742546 - DNA, 25 bp, Mus musculus
tacaggtgttttacgcagccacggc

SEQ ID NO: 742547 - DNA, 25 bp, Mus musculus
tacaggtgtttttcgcagccacggc

SEQ ID NO: 742548 - DNA, 25 bp, Mus musculus
tacaggttgttcaaggagcaccaca

SEQ ID NO: 742549 - DNA, 25 bp, Mus musculus
tacaggttgttctaggagcaccaca

SEQ ID NO: 742550 - DNA, 25 bp, Mus musculus
tacaggtttctgagcactcgatgca

SEQ ID NO: 742551 - DNA, 25 bp, Mus musculus
tacaggtttctgtgcactcgatgca

SEQ ID NO: 742552 - DNA, 25 bp, Mus musculus
tacagtaaccgactggtcgacctcc

SEQ ID NO: 742553 - DNA, 25 bp, Mus musculus
tacagtaaccgagtggtcgacctcc

SEQ ID NO: 742554 - DNA, 25 bp, Mus musculus
tacagtaagccgcagctgcccgcaa

SEQ ID NO: 742555 - DNA, 25 bp, Mus musculus
tacagtaagccggagctgcccgcaa

SEQ ID NO: 742556 - DNA, 25 bp, Mus musculus
tacagtaagcttactttcagtcaag

SEQ ID NO: 742557 - DNA, 25 bp, Mus musculus
tacagtaagctttctttcagtcaag

SEQ ID NO: 742558 - DNA, 25 bp, Mus musculus
tacagtacagctaacaaaatggcct

SEQ ID NO: 742559 - DNA, 25 bp, Mus musculus
tacagtacagcttacaaaatggcct

SEQ ID NO: 742560 - DNA, 25 bp, Mus musculus
tacagtacgacgaccagaagatagt

SEQ ID NO: 742561 - DNA, 25 bp, Mus musculus
tacagtacgacgtccagaagatagt

SEQ ID NO: 742562 - DNA, 25 bp, Mus musculus
tacagtacgcggcaaacattattcc

SEQ ID NO: 742563 - DNA, 25 bp, Mus musculus
tacagtacgcgggaaacattattcc

SEQ ID NO: 742564 - DNA, 25 bp, Mus musculus
tacagtactatactagtttaataag

SEQ ID NO: 742565 - DNA, 25 bp, Mus musculus
tacagtactatagtagtttaataag

SEQ ID NO: 742566 - DNA, 25 bp, Mus musculus
tacagtagagaaccacccaagggtg

SEQ ID NO: 742567 - DNA, 25 bp, Mus musculus
tacagtagagaagcacccaagggtg

SEQ ID NO: 742568 - DNA, 25 bp, Mus musculus
tacagtagcgtaaggaagttagtga

SEQ ID NO: 742569 - DNA, 25 bp, Mus musculus
tacagtagcgtatggaagttagtga

SEQ ID NO: 742570 - DNA, 25 bp, Mus musculus
tacagtagctttccccattcattgg

SEQ ID NO: 742571 - DNA, 25 bp, Mus musculus
tacagtagctttgcccattcattgg

SEQ ID NO: 742572 - DNA, 25 bp, Mus musculus
tacagtaggccacttcccagaaatg

SEQ ID NO: 742573 - DNA, 25 bp, Mus musculus
tacagtaggccagttcccagaaatg

SEQ ID NO: 742574 - DNA, 25 bp, Mus musculus
tacagtagggtgattgcaggcttgc

SEQ ID NO: 742575 - DNA, 25 bp, Mus musculus
tacagtagggtgtttgcaggcttgc

SEQ ID NO: 742576 - DNA, 25 bp, Mus musculus
tacagtatagaaacctctgacttgg

SEQ ID NO: 742577 - DNA, 25 bp, Mus musculus
tacagtatagaatcctctgacttgg

SEQ ID NO: 742578 - DNA, 25 bp, Mus musculus
tacagtattgccacaaaccgaatga

SEQ ID NO: 742579 - DNA, 25 bp, Mus musculus
tacagtattgcctcaaaccgaatga

SEQ ID NO: 742580 - DNA, 25 bp, Mus musculus
tacagtattgcgactttctgggctc

SEQ ID NO: 742581 - DNA, 25 bp, Mus musculus
tacagtattgcgtctttctgggctc

SEQ ID NO: 742582 - DNA, 25 bp, Mus musculus
tacagtattggaaatggatctgtct

SEQ ID NO: 742583 - DNA, 25 bp, Mus musculus
tacagtattggatatggatctgtct

SEQ ID NO: 742584 - DNA, 25 bp, Mus musculus
tacagtattggtctggtaggaatat

SEQ ID NO: 742585 - DNA, 25 bp, Mus musculus
tacagtattggtgtggtaggaatat

SEQ ID NO: 742586 - DNA, 25 bp, Mus musculus
tacagtcagatcacaggaatggaag

SEQ ID NO: 742587 - DNA, 25 bp, Mus musculus
tacagtcagatctcaggaatggaag

SEQ ID NO: 742588 - DNA, 25 bp, Mus musculus
tacagtcagcctcgacgacaggaac

SEQ ID NO: 742589 - DNA, 25 bp, Mus musculus
tacagtcagcctggacgacaggaac

SEQ ID NO: 742590 - DNA, 25 bp, Mus musculus
tacagtcaggaaaggttccttctca

SEQ ID NO: 742591 - DNA, 25 bp, Mus musculus
tacagtcaggaatggttccttctca

SEQ ID NO: 742592 - DNA, 25 bp, Mus musculus
tacagtcaggctcttcagttttcta

SEQ ID NO: 742593 - DNA, 25 bp, Mus musculus
tacagtcaggctgttcagttttcta

SEQ ID NO: 742594 - DNA, 25 bp, Mus musculus
tacagtcagtgtcgcttagcggacg

SEQ ID NO: 742595 - DNA, 25 bp, Mus musculus
tacagtcagtgtggcttagcggacg

SEQ ID NO: 742596 - DNA, 25 bp, Mus musculus
tacagtcatcatcaacgaggccagc

SEQ ID NO: 742597 - DNA, 25 bp, Mus musculus
tacagtcatcatgaacgaggccagc

SEQ ID NO: 742598 - DNA, 25 bp, Mus musculus
tacagtcatcccatagctgtggagg

SEQ ID NO: 742599 - DNA, 25 bp, Mus musculus
tacagtcatcccttagctgtggagg

SEQ ID NO: 742600 - DNA, 25 bp, Mus musculus
tacagtccagagatctcctggcatc

SEQ ID NO: 742601 - DNA, 25 bp, Mus musculus
tacagtccagagcaaggtatccact

SEQ ID NO: 742602 - DNA, 25 bp, Mus musculus
tacagtccagaggaaggtatccact

SEQ ID NO: 742603 - DNA, 25 bp, Mus musculus
tacagtccagagttctcctggcatc

SEQ ID NO: 742604 - DNA, 25 bp, Mus musculus
tacagtcccatgagcaaggcgagac

SEQ ID NO: 742605 - DNA, 25 bp, Mus musculus
tacagtcccatgtgcaaggcgagac

SEQ ID NO: 742606 - DNA, 25 bp, Mus musculus
tacagtcccctgactgggtatttta

SEQ ID NO: 742607 - DNA, 25 bp, Mus musculus
tacagtcccctgtctgggtatttta

SEQ ID NO: 742608 - DNA, 25 bp, Mus musculus
tacagtcccttgatcaacagagagc

SEQ ID NO: 742609 - DNA, 25 bp, Mus musculus
tacagtcccttgttcaacagagagc

SEQ ID NO: 742610 - DNA, 25 bp, Mus musculus
tacagtcggcgcatctggcaaggta

SEQ ID NO: 742611 - DNA, 25 bp, Mus musculus
tacagtcggcgcttctggcaaggta

SEQ ID NO: 742612 - DNA, 25 bp, Mus musculus
tacagtcgtgtacctgtttctccga

SEQ ID NO: 742613 - DNA, 25 bp, Mus musculus
tacagtcgtgtagctgtttctccga

SEQ ID NO: 742614 - DNA, 25 bp, Mus musculus
tacagtctaggcattcatcagcagg

SEQ ID NO: 742615 - DNA, 25 bp, Mus musculus
tacagtctaggctttcatcagcagg

SEQ ID NO: 742616 - DNA, 25 bp, Mus musculus
tacagtctagtgagtcaggccctct

SEQ ID NO: 742617 - DNA, 25 bp, Mus musculus
tacagtctagtgtgtcaggccctct

SEQ ID NO: 742618 - DNA, 25 bp, Mus musculus
tacagtcttgggaccaggcttcagc

SEQ ID NO: 742619 - DNA, 25 bp, Mus musculus
tacagtcttgggtccaggcttcagc

SEQ ID NO: 742620 - DNA, 25 bp, Mus musculus
tacagtgaaagcctctcatgccagg

SEQ ID NO: 742621 - DNA, 25 bp, Mus musculus
tacagtgaaagcgtctcatgccagg

SEQ ID NO: 742622 - DNA, 25 bp, Mus musculus
tacagtgaagggatgaagcacgtcc

SEQ ID NO: 742623 - DNA, 25 bp, Mus musculus
tacagtgaagggttgaagcacgtcc

SEQ ID NO: 742624 - DNA, 25 bp, Mus musculus
tacagtgacaacagcctggatcctg

SEQ ID NO: 742625 - DNA, 25 bp, Mus musculus
tacagtgacaactgcctggatcctg

SEQ ID NO: 742626 - DNA, 25 bp, Mus musculus
tacagtgacagcaaaatcacatcag

SEQ ID NO: 742627 - DNA, 25 bp, Mus musculus
tacagtgacagctaaatcacatcag

SEQ ID NO: 742628 - DNA, 25 bp, Mus musculus
tacagtgacaggaaagacaccagac

SEQ ID NO: 742629 - DNA, 25 bp, Mus musculus
tacagtgacaggtaagacaccagac

SEQ ID NO: 742630 - DNA, 25 bp, Mus musculus
tacagtgaccccacaactctgactt

SEQ ID NO: 742631 - DNA, 25 bp, Mus musculus
tacagtgacccctcaactctgactt

SEQ ID NO: 742632 - DNA, 25 bp, Mus musculus
tacagtgacgaactacggaatgagc

SEQ ID NO: 742633 - DNA, 25 bp, Mus musculus
tacagtgacgaagtacggaatgagc

SEQ ID NO: 742634 - DNA, 25 bp, Mus musculus
tacagtgacggccttggagcaaact

SEQ ID NO: 742635 - DNA, 25 bp, Mus musculus
tacagtgacggcgttggagcaaact

SEQ ID NO: 742636 - DNA, 25 bp, Mus musculus
tacagtgacgtcatacctgaaacaa

SEQ ID NO: 742637 - DNA, 25 bp, Mus musculus
tacagtgacgtcttacctgaaacaa

SEQ ID NO: 742638 - DNA, 25 bp, Mus musculus
tacagtgactccaaagtaagtggca

SEQ ID NO: 742639 - DNA, 25 bp, Mus musculus
tacagtgactcctaagtaagtggca

SEQ ID NO: 742640 - DNA, 25 bp, Mus musculus
tacagtgactgcacttgggacagac

SEQ ID NO: 742641 - DNA, 25 bp, Mus musculus
tacagtgactgctcttgggacagac

SEQ ID NO: 742642 - DNA, 25 bp, Mus musculus
tacagtgagacacgctacctcagca

SEQ ID NO: 742643 - DNA, 25 bp, Mus musculus
tacagtgagacaggctacctcagca

SEQ ID NO: 742644 - DNA, 25 bp, Mus musculus
tacagtgagacgacaggctgtggat

SEQ ID NO: 742645 - DNA, 25 bp, Mus musculus
tacagtgagacgtcaggctgtggat

SEQ ID NO: 742646 - DNA, 25 bp, Mus musculus
tacagtgagtagaatacgttttcta

SEQ ID NO: 742647 - DNA, 25 bp, Mus musculus
tacagtgagtagtatacgttttcta

SEQ ID NO: 742648 - DNA, 25 bp, Mus musculus
tacagtgattgtacaaccagagcca

SEQ ID NO: 742649 - DNA, 25 bp, Mus musculus
tacagtgattgttcaaccagagcca

SEQ ID NO: 742650 - DNA, 25 bp, Mus musculus
tacagtgattttcatgacctacatg

SEQ ID NO: 742651 - DNA, 25 bp, Mus musculus
tacagtgattttgatgacctacatg

SEQ ID NO: 742652 - DNA, 25 bp, Mus musculus
tacagtgcaccacacacagatggga

SEQ ID NO: 742653 - DNA, 25 bp, Mus musculus
tacagtgcaccagacacagatggga

SEQ ID NO: 742654 - DNA, 25 bp, Mus musculus
tacagtgcagttagccctcaggaag

SEQ ID NO: 742655 - DNA, 25 bp, Mus musculus
tacagtgcagtttgccctcaggaag

SEQ ID NO: 742656 - DNA, 25 bp, Mus musculus
tacagtgccacacaagatcatcacc

SEQ ID NO: 742657 - DNA, 25 bp, Mus musculus
tacagtgccacagaagatcatcacc

SEQ ID NO: 742658 - DNA, 25 bp, Mus musculus
tacagtgccctaattgactggattg

SEQ ID NO: 742659 - DNA, 25 bp, Mus musculus
tacagtgccctatttgactggattg

SEQ ID NO: 742660 - DNA, 25 bp, Mus musculus
tacagtgcgactcgccttcctctga

SEQ ID NO: 742661 - DNA, 25 bp, Mus musculus
tacagtgcgactggccttcctctga

SEQ ID NO: 742662 - DNA, 25 bp, Mus musculus
tacagtgcgcagatggcagtgtccc

SEQ ID NO: 742663 - DNA, 25 bp, Mus musculus
tacagtgcgcagttggcagtgtccc

SEQ ID NO: 742664 - DNA, 25 bp, Mus musculus
tacagtgcgtgacctggatgaactc

SEQ ID NO: 742665 - DNA, 25 bp, Mus musculus
tacagtgcgtgagctggatgaactc

SEQ ID NO: 742666 - DNA, 25 bp, Mus musculus
tacagtgctcccacgggaaaatatg

SEQ ID NO: 742667 - DNA, 25 bp, Mus musculus
tacagtgctccctcgggaaaatatg

SEQ ID NO: 742668 - DNA, 25 bp, Mus musculus
tacagtgcttagaactggctatctg

SEQ ID NO: 742669 - DNA, 25 bp, Mus musculus
tacagtgcttagtactggctatctg

SEQ ID NO: 742670 - DNA, 25 bp, Mus musculus
tacagtggaaccagagaaccagaca

SEQ ID NO: 742671 - DNA, 25 bp, Mus musculus
tacagtggaacctgagaaccagaca

SEQ ID NO: 742672 - DNA, 25 bp, Mus musculus
tacagtggacgaccacaggcgtcac

SEQ ID NO: 742673 - DNA, 25 bp, Mus musculus
tacagtggacgagcacaggcgtcac

SEQ ID NO: 742674 - DNA, 25 bp, Mus musculus
tacagtggagcacaggactggattt

SEQ ID NO: 742675 - DNA, 25 bp, Mus musculus
tacagtggagcagaggactggattt

SEQ ID NO: 742676 - DNA, 25 bp, Mus musculus
tacagtggagtaatccgaactcagc

SEQ ID NO: 742677 - DNA, 25 bp, Mus musculus
tacagtggagtattccgaactcagc

SEQ ID NO: 742678 - DNA, 25 bp, Mus musculus
tacagtggatttccctaaaagaact

SEQ ID NO: 742679 - DNA, 25 bp, Mus musculus
tacagtggatttgcctaaaagaact

SEQ ID NO: 742680 - DNA, 25 bp, Mus musculus
tacagtggccggcaaagggtctact

SEQ ID NO: 742681 - DNA, 25 bp, Mus musculus
tacagtggccgggaaagggtctact

SEQ ID NO: 742682 - DNA, 25 bp, Mus musculus
tacagtggcggaagaagatggtcca

SEQ ID NO: 742683 - DNA, 25 bp, Mus musculus
tacagtggcggatgaagatggtcca

SEQ ID NO: 742684 - DNA, 25 bp, Mus musculus
tacagtggctcaatacgtatgtgga

SEQ ID NO: 742685 - DNA, 25 bp, Mus musculus
tacagtggctcactcagtgcctcct

SEQ ID NO: 742686 - DNA, 25 bp, Mus musculus
tacagtggctcagtcagtgcctcct

SEQ ID NO: 742687 - DNA, 25 bp, Mus musculus
tacagtggctcattacgtatgtgga

SEQ ID NO: 742688 - DNA, 25 bp, Mus musculus
tacagtggtatcagcagttctgaag

SEQ ID NO: 742689 - DNA, 25 bp, Mus musculus
tacagtggtatctgcagttctgaag

SEQ ID NO: 742690 - DNA, 25 bp, Mus musculus
tacagtggttacaacacaggaggtt

SEQ ID NO: 742691 - DNA, 25 bp, Mus musculus
tacagtggttactacacaggaggtt

SEQ ID NO: 742692 - DNA, 25 bp, Mus musculus
tacagtgtaagcattgtgaccgcca

SEQ ID NO: 742693 - DNA, 25 bp, Mus musculus
tacagtgtaagctttgtgaccgcca

SEQ ID NO: 742694 - DNA, 25 bp, Mus musculus
tacagtgtacagagataagctctgg

SEQ ID NO: 742695 - DNA, 25 bp, Mus musculus
tacagtgtacagtgataagctctgg

SEQ ID NO: 742696 - DNA, 25 bp, Mus musculus
tacagtgtcactccttcaagatgaa

SEQ ID NO: 742697 - DNA, 25 bp, Mus musculus
tacagtgtcactgcttcaagatgaa

SEQ ID NO: 742698 - DNA, 25 bp, Mus musculus
tacagtgtcccaccaagtcaaaagt

SEQ ID NO: 742699 - DNA, 25 bp, Mus musculus
tacagtgtcccagcaagtcaaaagt

SEQ ID NO: 742700 - DNA, 25 bp, Mus musculus
tacagtgtcgtaaagactagaagac

SEQ ID NO: 742701 - DNA, 25 bp, Mus musculus
tacagtgtcgtatagactagaagac

SEQ ID NO: 742702 - DNA, 25 bp, Mus musculus
tacagtgtgatgctttacaaaatca

SEQ ID NO: 742703 - DNA, 25 bp, Mus musculus
tacagtgtgatggtttacaaaatca

SEQ ID NO: 742704 - DNA, 25 bp, Mus musculus
tacagtgttgaaaccttcctcctcc

SEQ ID NO: 742705 - DNA, 25 bp, Mus musculus
tacagtgttgaatccttcctcctcc

SEQ ID NO: 742706 - DNA, 25 bp, Mus musculus
tacagtgttgacaaatctctcagtc

SEQ ID NO: 742707 - DNA, 25 bp, Mus musculus
tacagtgttgactaatctctcagtc

SEQ ID NO: 742708 - DNA, 25 bp, Mus musculus
tacagttatctgcaccacaggaggc

SEQ ID NO: 742709 - DNA, 25 bp, Mus musculus
tacagttatctggaccacaggaggc

SEQ ID NO: 742710 - DNA, 25 bp, Mus musculus
tacagttcaagaacaagaggcacac

SEQ ID NO: 742711 - DNA, 25 bp, Mus musculus
tacagttcaagatcaagaggcacac

SEQ ID NO: 742712 - DNA, 25 bp, Mus musculus
tacagttccactcgctcgtgtgtac

SEQ ID NO: 742713 - DNA, 25 bp, Mus musculus
tacagttccactggctcgtgtgtac

SEQ ID NO: 742714 - DNA, 25 bp, Mus musculus
tacagttccagaaaccaagacagtg

SEQ ID NO: 742715 - DNA, 25 bp, Mus musculus
tacagttccagataccaagacagtg

SEQ ID NO: 742716 - DNA, 25 bp, Mus musculus
tacagttcctccaagcatgaccgag

SEQ ID NO: 742717 - DNA, 25 bp, Mus musculus
tacagttcctcctagcatgaccgag

SEQ ID NO: 742718 - DNA, 25 bp, Mus musculus
tacagttctggaagatgtgggccat

SEQ ID NO: 742719 - DNA, 25 bp, Mus musculus
tacagttctggatgatgtgggccat

SEQ ID NO: 742720 - DNA, 25 bp, Mus musculus
tacagttcttcgaagagcggcgacg

SEQ ID NO: 742721 - DNA, 25 bp, Mus musculus
tacagttcttcgtagagcggcgacg

SEQ ID NO: 742722 - DNA, 25 bp, Mus musculus
tacagttcttgactgctacacacag

SEQ ID NO: 742723 - DNA, 25 bp, Mus musculus
tacagttcttgagtgctacacacag

SEQ ID NO: 742724 - DNA, 25 bp, Mus musculus
tacagttgaaccatattcttcaagc

SEQ ID NO: 742725 - DNA, 25 bp, Mus musculus
tacagttgaaccttattcttcaagc

SEQ ID NO: 742726 - DNA, 25 bp, Mus musculus
tacagttgacaccaagtttaatgga

SEQ ID NO: 742727 - DNA, 25 bp, Mus musculus
tacagttgacacgaagtttaatgga

SEQ ID NO: 742728 - DNA, 25 bp, Mus musculus
tacagttgataaatctcagcccttc

SEQ ID NO: 742729 - DNA, 25 bp, Mus musculus
tacagttgataattctcagcccttc

SEQ ID NO: 742730 - DNA, 25 bp, Mus musculus
tacagttggaccacccatttgggag

SEQ ID NO: 742731 - DNA, 25 bp, Mus musculus
tacagttggacctcccatttgggag

SEQ ID NO: 742732 - DNA, 25 bp, Mus musculus
tacagttgggatacactgcccagga

SEQ ID NO: 742733 - DNA, 25 bp, Mus musculus
tacagttgggattcactgcccagga

SEQ ID NO: 742734 - DNA, 25 bp, Mus musculus
tacagttggtttactcaccagaagt

SEQ ID NO: 742735 - DNA, 25 bp, Mus musculus
tacagttggttttctcaccagaagt

SEQ ID NO: 742736 - DNA, 25 bp, Mus musculus
tacagttgtaacagcctgcagttgc

SEQ ID NO: 742737 - DNA, 25 bp, Mus musculus
tacagttgtaactgcctgcagttgc

SEQ ID NO: 742738 - DNA, 25 bp, Mus musculus
tacagttgtatgcataggcaggcct

SEQ ID NO: 742739 - DNA, 25 bp, Mus musculus
tacagttgtatggataggcaggcct

SEQ ID NO: 742740 - DNA, 25 bp, Mus musculus
tacagttgtccgagtctgctgcctt

SEQ ID NO: 742741 - DNA, 25 bp, Mus musculus
tacagttgtccgtgtctgctgcctt

SEQ ID NO: 742742 - DNA, 25 bp, Mus musculus
tacagttgtgcaaaatgggagacca

SEQ ID NO: 742743 - DNA, 25 bp, Mus musculus
tacagttgtgcataatgggagacca

SEQ ID NO: 742744 - DNA, 25 bp, Mus musculus
tacagtttccaaacgaaccctggag

SEQ ID NO: 742745 - DNA, 25 bp, Mus musculus
tacagtttccaatcgaaccctggag

SEQ ID NO: 742746 - DNA, 25 bp, Mus musculus
tacagtttgaaaacttgaagtgtga

SEQ ID NO: 742747 - DNA, 25 bp, Mus musculus
tacagtttgaaatcttgaagtgtga

SEQ ID NO: 742748 - DNA, 25 bp, Mus musculus
tacagtttgcacaatatgggaatat

SEQ ID NO: 742749 - DNA, 25 bp, Mus musculus
tacagtttgcactatatgggaatat

SEQ ID NO: 742750 - DNA, 25 bp, Mus musculus
tacagtttggcaatccggaagccaa

SEQ ID NO: 742751 - DNA, 25 bp, Mus musculus
tacagtttggcattccggaagccaa

SEQ ID NO: 742752 - DNA, 25 bp, Mus musculus
tacagttttgccatacggatgacaa

SEQ ID NO: 742753 - DNA, 25 bp, Mus musculus
tacagttttgccttacggatgacaa

SEQ ID NO: 742754 - DNA, 25 bp, Mus musculus
tacagtttttggaggcagtctgtca

SEQ ID NO: 742755 - DNA, 25 bp, Mus musculus
tacagtttttggtggcagtctgtca

SEQ ID NO: 742756 - DNA, 25 bp, Mus musculus
tacataaaggaccacccctcaaatg

SEQ ID NO: 742757 - DNA, 25 bp, Mus musculus
tacataaaggacgacccctcaaatg

SEQ ID NO: 742758 - DNA, 25 bp, Mus musculus
tacataaggcagcagtcgatgggct

SEQ ID NO: 742759 - DNA, 25 bp, Mus musculus
tacataaggcaggagtcgatgggct

SEQ ID NO: 742760 - DNA, 25 bp, Mus musculus
tacataatagtaaagggacctagga

SEQ ID NO: 742761 - DNA, 25 bp, Mus musculus
tacataatagtatagggacctagga

SEQ ID NO: 742762 - DNA, 25 bp, Mus musculus
tacataattggtactcatggcggtg

SEQ ID NO: 742763 - DNA, 25 bp, Mus musculus
tacataattggttctcatggcggtg

SEQ ID NO: 742764 - DNA, 25 bp, Mus musculus
tacatacacaccaattctgtggctg

SEQ ID NO: 742765 - DNA, 25 bp, Mus musculus
tacatacacacctattctgtggctg

SEQ ID NO: 742766 - DNA, 25 bp, Mus musculus
tacatacagaccctgcttcccggga

SEQ ID NO: 742767 - DNA, 25 bp, Mus musculus
tacatacagaccgtgcttcccggga

SEQ ID NO: 742768 - DNA, 25 bp, Mus musculus
tacatacataacacaacccgcaagg

SEQ ID NO: 742769 - DNA, 25 bp, Mus musculus
tacatacataactcaacccgcaagg

SEQ ID NO: 742770 - DNA, 25 bp, Mus musculus
tacatacattcaatagagaccggga

SEQ ID NO: 742771 - DNA, 25 bp, Mus musculus
tacatacattcattagagaccggga

SEQ ID NO: 742772 - DNA, 25 bp, Mus musculus
tacatacctacacctgggaagtgag

SEQ ID NO: 742773 - DNA, 25 bp, Mus musculus
tacatacctacagctgggaagtgag

SEQ ID NO: 742774 - DNA, 25 bp, Mus musculus
tacataccttgcattgcactatgtg

SEQ ID NO: 742775 - DNA, 25 bp, Mus musculus
tacataccttgctttgcactatgtg

SEQ ID NO: 742776 - DNA, 25 bp, Mus musculus
tacatacgacagagtcactcgacag

SEQ ID NO: 742777 - DNA, 25 bp, Mus musculus
tacatacgacagtgtcactcgacag

SEQ ID NO: 742778 - DNA, 25 bp, Mus musculus
tacatacgcaacacccgtggacatg

SEQ ID NO: 742779 - DNA, 25 bp, Mus musculus
tacatacgcaactcccgtggacatg

SEQ ID NO: 742780 - DNA, 25 bp, Mus musculus
tacatacgggtgaggtagctagtac

SEQ ID NO: 742781 - DNA, 25 bp, Mus musculus
tacatacgggtgtggtagctagtac

SEQ ID NO: 742782 - DNA, 25 bp, Mus musculus
tacatactcggaagcgagtggcgat

SEQ ID NO: 742783 - DNA, 25 bp, Mus musculus
tacatactcggatgcgagtggcgat

SEQ ID NO: 742784 - DNA, 25 bp, Mus musculus
tacatagaatcgatgaagcccaaca

SEQ ID NO: 742785 - DNA, 25 bp, Mus musculus
tacatagaatcgttgaagcccaaca

SEQ ID NO: 742786 - DNA, 25 bp, Mus musculus
tacatagacccaacaggaagccctt

SEQ ID NO: 742787 - DNA, 25 bp, Mus musculus
tacatagacccatcaggaagccctt

SEQ ID NO: 742788 - DNA, 25 bp, Mus musculus
tacatagaccttccttcacttggaa

SEQ ID NO: 742789 - DNA, 25 bp, Mus musculus
tacatagaccttgcttcacttggaa

SEQ ID NO: 742790 - DNA, 25 bp, Mus musculus
tacatagactatcaaggacgctccg

SEQ ID NO: 742791 - DNA, 25 bp, Mus musculus
tacatagactatgaaggacgctccg

SEQ ID NO: 742792 - DNA, 25 bp, Mus musculus
tacatagacttcctctaccaggttc

SEQ ID NO: 742793 - DNA, 25 bp, Mus musculus
tacatagacttcgtctaccaggttc

SEQ ID NO: 742794 - DNA, 25 bp, Mus musculus
tacatagcaaagactgtgccaagcc

SEQ ID NO: 742795 - DNA, 25 bp, Mus musculus
tacatagcaaagtctgtgccaagcc

SEQ ID NO: 742796 - DNA, 25 bp, Mus musculus
tacatagcccatctagaaagtgaac

SEQ ID NO: 742797 - DNA, 25 bp, Mus musculus
tacatagcccatgtagaaagtgaac

SEQ ID NO: 742798 - DNA, 25 bp, Mus musculus
tacatagcgcctccaagttcggcgt

SEQ ID NO: 742799 - DNA, 25 bp, Mus musculus
tacatagcgcctgcaagttcggcgt

SEQ ID NO: 742800 - DNA, 25 bp, Mus musculus
tacatagcttgtacctttaccacgg

SEQ ID NO: 742801 - DNA, 25 bp, Mus musculus
tacatagcttgttcctttaccacgg

SEQ ID NO: 742802 - DNA, 25 bp, Mus musculus
tacataggtgccctacctcacagtg

SEQ ID NO: 742803 - DNA, 25 bp, Mus musculus
tacataggtgccgtacctcacagtg

SEQ ID NO: 742804 - DNA, 25 bp, Mus musculus
tacataggtgttcctatttgcgtag

SEQ ID NO: 742805 - DNA, 25 bp, Mus musculus
tacataggtgttgctatttgcgtag

SEQ ID NO: 742806 - DNA, 25 bp, Mus musculus
tacatagtacgcaggaggacaccag

SEQ ID NO: 742807 - DNA, 25 bp, Mus musculus
tacatagtacgctggaggacaccag

SEQ ID NO: 742808 - DNA, 25 bp, Mus musculus
tacatagtactcaacttagacaatc

SEQ ID NO: 742809 - DNA, 25 bp, Mus musculus
tacatagtactctacttagacaatc

SEQ ID NO: 742810 - DNA, 25 bp, Mus musculus
tacatagtctggaaagagctgggag

SEQ ID NO: 742811 - DNA, 25 bp, Mus musculus
tacatagtctggtaagagctgggag

SEQ ID NO: 742812 - DNA, 25 bp, Mus musculus
tacatataaacactctcactctggc

SEQ ID NO: 742813 - DNA, 25 bp, Mus musculus
tacatataaacagtctcactctggc

SEQ ID NO: 742814 - DNA, 25 bp, Mus musculus
tacatatattctcatcaaacacaat

SEQ ID NO: 742815 - DNA, 25 bp, Mus musculus
tacatatattctgatcaaacacaat

SEQ ID NO: 742816 - DNA, 25 bp, Mus musculus
tacatatcaagcatgaggattctcc

SEQ ID NO: 742817 - DNA, 25 bp, Mus musculus
tacatatcaagcttgaggattctcc

SEQ ID NO: 742818 - DNA, 25 bp, Mus musculus
tacatatggaagaggtatgaccagc

SEQ ID NO: 742819 - DNA, 25 bp, Mus musculus
tacatatggaagtggtatgaccagc

SEQ ID NO: 742820 - DNA, 25 bp, Mus musculus
tacatatggcgtaagacaagactgc

SEQ ID NO: 742821 - DNA, 25 bp, Mus musculus
tacatatggcgttagacaagactgc

SEQ ID NO: 742822 - DNA, 25 bp, Mus musculus
tacatatgggctatagtgcactaga

SEQ ID NO: 742823 - DNA, 25 bp, Mus musculus
tacatatgggctttagtgcactaga

SEQ ID NO: 742824 - DNA, 25 bp, Mus musculus
tacatatttaatctggcactggctg

SEQ ID NO: 742825 - DNA, 25 bp, Mus musculus
tacatatttaatgtggcactggctg

SEQ ID NO: 742826 - DNA, 25 bp, Mus musculus
tacatatttacgctgaggacccatc

SEQ ID NO: 742827 - DNA, 25 bp, Mus musculus
tacatatttacggtgaggacccatc

SEQ ID NO: 742828 - DNA, 25 bp, Mus musculus
tacatatttgatatgaaccacggac

SEQ ID NO: 742829 - DNA, 25 bp, Mus musculus
tacatatttgatttgaaccacggac

SEQ ID NO: 742830 - DNA, 25 bp, Mus musculus
tacatcaaaatacccaaagaccggg

SEQ ID NO: 742831 - DNA, 25 bp, Mus musculus
tacatcaaaatagccaaagaccggg

SEQ ID NO: 742832 - DNA, 25 bp, Mus musculus
tacatcaaactccttacggactgca

SEQ ID NO: 742833 - DNA, 25 bp, Mus musculus
tacatcaaactcgttacggactgca

SEQ ID NO: 742834 - DNA, 25 bp, Mus musculus
tacatcaaatggctctttggagggc

SEQ ID NO: 742835 - DNA, 25 bp, Mus musculus
tacatcaaatgggtctttggagggc

SEQ ID NO: 742836 - DNA, 25 bp, Mus musculus
tacatcaaccatcccctggacgttg

SEQ ID NO: 742837 - DNA, 25 bp, Mus musculus
tacatcaaccatgccctggacgttg

SEQ ID NO: 742838 - DNA, 25 bp, Mus musculus
tacatcaacgttaggtacgacccgg

SEQ ID NO: 742839 - DNA, 25 bp, Mus musculus
tacatcaacgtttggtacgacccgg

SEQ ID NO: 742840 - DNA, 25 bp, Mus musculus
tacatcaagcgacctgctgagatct

SEQ ID NO: 742841 - DNA, 25 bp, Mus musculus
tacatcaagcgagctgctgagatct

SEQ ID NO: 742842 - DNA, 25 bp, Mus musculus
tacatcaagctcatcatcacactga

SEQ ID NO: 742843 - DNA, 25 bp, Mus musculus
tacatcaagctcttcatcacactga

SEQ ID NO: 742844 - DNA, 25 bp, Mus musculus
tacatcaaggaaatactgtcccgga

SEQ ID NO: 742845 - DNA, 25 bp, Mus musculus
tacatcaaggaaccagagcctggaa

SEQ ID NO: 742846 - DNA, 25 bp, Mus musculus
tacatcaaggaagcagagcctggaa

SEQ ID NO: 742847 - DNA, 25 bp, Mus musculus
tacatcaaggaattactgtcccgga

SEQ ID NO: 742848 - DNA, 25 bp, Mus musculus
tacatcaatggacagaccgtagtag

SEQ ID NO: 742849 - DNA, 25 bp, Mus musculus
tacatcaatggagagaccgtagtag

SEQ ID NO: 742850 - DNA, 25 bp, Mus musculus
tacatcaccgaaagacatctcttcc

SEQ ID NO: 742851 - DNA, 25 bp, Mus musculus
tacatcaccgaatgacatctcttcc

SEQ ID NO: 742852 - DNA, 25 bp, Mus musculus
tacatcacttgcacggtggtaaatg

SEQ ID NO: 742853 - DNA, 25 bp, Mus musculus
tacatcacttgctcggtggtaaatg

SEQ ID NO: 742854 - DNA, 25 bp, Mus musculus
tacatcagaaacagcaacatggaga

SEQ ID NO: 742855 - DNA, 25 bp, Mus musculus
tacatcagaaactgcaacatggaga

SEQ ID NO: 742856 - DNA, 25 bp, Mus musculus
tacatcagagcactatgacagccta

SEQ ID NO: 742857 - DNA, 25 bp, Mus musculus
tacatcagagcagtatgacagccta

SEQ ID NO: 742858 - DNA, 25 bp, Mus musculus
tacatcaggaagacaacactgagcc

SEQ ID NO: 742859 - DNA, 25 bp, Mus musculus
tacatcaggaagtcaacactgagcc

SEQ ID NO: 742860 - DNA, 25 bp, Mus musculus
tacatcaggagaactgctcgtacca

SEQ ID NO: 742861 - DNA, 25 bp, Mus musculus
tacatcaggagatctgctcgtacca

SEQ ID NO: 742862 - DNA, 25 bp, Mus musculus
tacatcagtcatagctgtcaccatc

SEQ ID NO: 742863 - DNA, 25 bp, Mus musculus
tacatcagtcattgctgtcaccatc

SEQ ID NO: 742864 - DNA, 25 bp, Mus musculus
tacatcatagcgcatgttccagtgg

SEQ ID NO: 742865 - DNA, 25 bp, Mus musculus
tacatcatagcggatgttccagtgg

SEQ ID NO: 742866 - DNA, 25 bp, Mus musculus
tacatcatcatgctcattgtggagg

SEQ ID NO: 742867 - DNA, 25 bp, Mus musculus
tacatcatcatggtcattgtggagg

SEQ ID NO: 742868 - DNA, 25 bp, Mus musculus
tacatcatggaacgtgtaaaggcca

SEQ ID NO: 742869 - DNA, 25 bp, Mus musculus
tacatcatggaaggtgtaaaggcca

SEQ ID NO: 742870 - DNA, 25 bp, Mus musculus
tacatcattatgcaactggtcccag

SEQ ID NO: 742871 - DNA, 25 bp, Mus musculus
tacatcattatggaactggtcccag

SEQ ID NO: 742872 - DNA, 25 bp, Mus musculus
tacatcattcctcattgacaaggag

SEQ ID NO: 742873 - DNA, 25 bp, Mus musculus
tacatcattcctgattgacaaggag

SEQ ID NO: 742874 - DNA, 25 bp, Mus musculus
tacatccaatggcacaaggctttct

SEQ ID NO: 742875 - DNA, 25 bp, Mus musculus
tacatccaatgggacaaggctttct

SEQ ID NO: 742876 - DNA, 25 bp, Mus musculus
tacatccaatgtcccaaagatgcag

SEQ ID NO: 742877 - DNA, 25 bp, Mus musculus
tacatccaatgtgccaaagatgcag

SEQ ID NO: 742878 - DNA, 25 bp, Mus musculus
tacatccacgctactcaaagagctg

SEQ ID NO: 742879 - DNA, 25 bp, Mus musculus
tacatccacgcttctcaaagagctg

SEQ ID NO: 742880 - DNA, 25 bp, Mus musculus
tacatccagaagaacgcaacggaag

SEQ ID NO: 742881 - DNA, 25 bp, Mus musculus
tacatccagaagtacgcaacggaag

SEQ ID NO: 742882 - DNA, 25 bp, Mus musculus
tacatccagcacaggtgttacagtg

SEQ ID NO: 742883 - DNA, 25 bp, Mus musculus
tacatccagcactggtgttacagtg

SEQ ID NO: 742884 - DNA, 25 bp, Mus musculus
tacatccagcctcataattgagccg

SEQ ID NO: 742885 - DNA, 25 bp, Mus musculus
tacatccagcctgataattgagccg

SEQ ID NO: 742886 - DNA, 25 bp, Mus musculus
tacatccaggcaagtagaggactaa

SEQ ID NO: 742887 - DNA, 25 bp, Mus musculus
tacatccaggcatgtagaggactaa

SEQ ID NO: 742888 - DNA, 25 bp, Mus musculus
tacatccaggccatccaggtggtca

SEQ ID NO: 742889 - DNA, 25 bp, Mus musculus
tacatccaggccttccaggtggtca

SEQ ID NO: 742890 - DNA, 25 bp, Mus musculus
tacatccatgagaattacaccaagg

SEQ ID NO: 742891 - DNA, 25 bp, Mus musculus
tacatccatgagtattacaccaagg

SEQ ID NO: 742892 - DNA, 25 bp, Mus musculus
tacatcccgtctcaatcagcattgc

SEQ ID NO: 742893 - DNA, 25 bp, Mus musculus
tacatcccgtctgaatcagcattgc

SEQ ID NO: 742894 - DNA, 25 bp, Mus musculus
tacatcccgtttctcctcatggtgc

SEQ ID NO: 742895 - DNA, 25 bp, Mus musculus
tacatcccgtttgtcctcatggtgc

SEQ ID NO: 742896 - DNA, 25 bp, Mus musculus
tacatccctagcacgagactttcct

SEQ ID NO: 742897 - DNA, 25 bp, Mus musculus
tacatccctagctcgagactttcct

SEQ ID NO: 742898 - DNA, 25 bp, Mus musculus
tacatccctcgcacatccaatgatt

SEQ ID NO: 742899 - DNA, 25 bp, Mus musculus
tacatccctcgctcatccaatgatt

SEQ ID NO: 742900 - DNA, 25 bp, Mus musculus
tacatccctttcaacggcatcttgg

SEQ ID NO: 742901 - DNA, 25 bp, Mus musculus
tacatccctttctacggcatcttgg

SEQ ID NO: 742902 - DNA, 25 bp, Mus musculus
tacatccgatccaagaagctggagc

SEQ ID NO: 742903 - DNA, 25 bp, Mus musculus
tacatccgatcctagaagctggagc

SEQ ID NO: 742904 - DNA, 25 bp, Mus musculus
tacatccgggaacccattaaacacc

SEQ ID NO: 742905 - DNA, 25 bp, Mus musculus
tacatccgggaagccattaaacacc

SEQ ID NO: 742906 - DNA, 25 bp, Mus musculus
tacatccgtggacgcatcgtcagtc

SEQ ID NO: 742907 - DNA, 25 bp, Mus musculus
tacatccgtggaggcatcgtcagtc

SEQ ID NO: 742908 - DNA, 25 bp, Mus musculus
tacatcctaaggacagagcaagact

SEQ ID NO: 742909 - DNA, 25 bp, Mus musculus
tacatcctaaggtcagagcaagact

SEQ ID NO: 742910 - DNA, 25 bp, Mus musculus
tacatcctgagcagtggtgttccag

SEQ ID NO: 742911 - DNA, 25 bp, Mus musculus
tacatcctgagctgtggtgttccag

SEQ ID NO: 742912 - DNA, 25 bp, Mus musculus
tacatcctgaggaccatcatgaagt

SEQ ID NO: 742913 - DNA, 25 bp, Mus musculus
tacatcctgaggtccatcatgaagt

SEQ ID NO: 742914 - DNA, 25 bp, Mus musculus
tacatcctgcccaatgacattggtg

SEQ ID NO: 742915 - DNA, 25 bp, Mus musculus
tacatcctgccctatgacattggtg

SEQ ID NO: 742916 - DNA, 25 bp, Mus musculus
tacatcctgcttaactaggtcaagt

SEQ ID NO: 742917 - DNA, 25 bp, Mus musculus
tacatcctgcttagtggctacccgc

SEQ ID NO: 742918 - DNA, 25 bp, Mus musculus
tacatcctgctttactaggtcaagt

SEQ ID NO: 742919 - DNA, 25 bp, Mus musculus
tacatcctgctttgtggctacccgc

SEQ ID NO: 742920 - DNA, 25 bp, Mus musculus
tacatcctggaaacacgagcgagca

SEQ ID NO: 742921 - DNA, 25 bp, Mus musculus
tacatcctggaatcacgagcgagca

SEQ ID NO: 742922 - DNA, 25 bp, Mus musculus
tacatcctggaccaaagtggcacca

SEQ ID NO: 742923 - DNA, 25 bp, Mus musculus
tacatcctggacgaaagtggcacca

SEQ ID NO: 742924 - DNA, 25 bp, Mus musculus
tacatcctgggtagtagaactctcc

SEQ ID NO: 742925 - DNA, 25 bp, Mus musculus
tacatcctgggttgtagaactctcc

SEQ ID NO: 742926 - DNA, 25 bp, Mus musculus
tacatccttacaaagaggcagctgg

SEQ ID NO: 742927 - DNA, 25 bp, Mus musculus
tacatccttacaccgatttatggtg

SEQ ID NO: 742928 - DNA, 25 bp, Mus musculus
tacatccttacagcgatttatggtg

SEQ ID NO: 742929 - DNA, 25 bp, Mus musculus
tacatccttacatagaggcagctgg

SEQ ID NO: 742930 - DNA, 25 bp, Mus musculus
tacatccttcagaccgatagagaac

SEQ ID NO: 742931 - DNA, 25 bp, Mus musculus
tacatccttcagtccgatagagaac

SEQ ID NO: 742932 - DNA, 25 bp, Mus musculus
tacatcgagcagagccaggatagcc

SEQ ID NO: 742933 - DNA, 25 bp, Mus musculus
tacatcgagcagtgccaggatagcc

SEQ ID NO: 742934 - DNA, 25 bp, Mus musculus
tacatcgagcgcatgaattatatcc

SEQ ID NO: 742935 - DNA, 25 bp, Mus musculus
tacatcgagcgcttgaattatatcc

SEQ ID NO: 742936 - DNA, 25 bp, Mus musculus
tacatcgagcttcccattggccagc

SEQ ID NO: 742937 - DNA, 25 bp, Mus musculus
tacatcgagcttgccattggccagc

SEQ ID NO: 742938 - DNA, 25 bp, Mus musculus
tacatcgagggacgcacactcaaag

SEQ ID NO: 742939 - DNA, 25 bp, Mus musculus
tacatcgagggaggcacactcaaag

SEQ ID NO: 742940 - DNA, 25 bp, Mus musculus
tacatcgagggtaatggacactacc

SEQ ID NO: 742941 - DNA, 25 bp, Mus musculus
tacatcgagggttatggacactacc

SEQ ID NO: 742942 - DNA, 25 bp, Mus musculus
tacatcgagtcacatgcctggcagg

SEQ ID NO: 742943 - DNA, 25 bp, Mus musculus
tacatcgagtcagatgcctggcagg

SEQ ID NO: 742944 - DNA, 25 bp, Mus musculus
tacatcgatccccagaaaggagaca

SEQ ID NO: 742945 - DNA, 25 bp, Mus musculus
tacatcgatcccgagaaaggagaca

SEQ ID NO: 742946 - DNA, 25 bp, Mus musculus
tacatcgattctacccagacaagat

SEQ ID NO: 742947 - DNA, 25 bp, Mus musculus
tacatcgattcttcccagacaagat

SEQ ID NO: 742948 - DNA, 25 bp, Mus musculus
tacatcggccatcaagagggtggcc

SEQ ID NO: 742949 - DNA, 25 bp, Mus musculus
tacatcggccatgaagagggtggcc

SEQ ID NO: 742950 - DNA, 25 bp, Mus musculus
tacatcggccgcctgagctaccagg

SEQ ID NO: 742951 - DNA, 25 bp, Mus musculus
tacatcggccgcgtgagctaccagg

SEQ ID NO: 742952 - DNA, 25 bp, Mus musculus
tacatcgggctcatccttctcaatg

SEQ ID NO: 742953 - DNA, 25 bp, Mus musculus
tacatcgggctcttccttctcaatg

SEQ ID NO: 742954 - DNA, 25 bp, Mus musculus
tacatcgtcacgcagtacatgagca

SEQ ID NO: 742955 - DNA, 25 bp, Mus musculus
tacatcgtcacggagtacatgagca

SEQ ID NO: 742956 - DNA, 25 bp, Mus musculus
tacatcgtgttcatgctgggctcct

SEQ ID NO: 742957 - DNA, 25 bp, Mus musculus
tacatcgtgttcttgctgggctcct

SEQ ID NO: 742958 - DNA, 25 bp, Mus musculus
tacatctacactacagaagttcaca

SEQ ID NO: 742959 - DNA, 25 bp, Mus musculus
tacatctacacttcagaagttcaca

SEQ ID NO: 742960 - DNA, 25 bp, Mus musculus
tacatctaccacagcaatgcacaga

SEQ ID NO: 742961 - DNA, 25 bp, Mus musculus
tacatctaccactgcaatgcacaga

SEQ ID NO: 742962 - DNA, 25 bp, Mus musculus
tacatctcaggactccatccggaac

SEQ ID NO: 742963 - DNA, 25 bp, Mus musculus
tacatctcaggagtccatccggaac

SEQ ID NO: 742964 - DNA, 25 bp, Mus musculus
tacatctccaaacacaggcgctaat

SEQ ID NO: 742965 - DNA, 25 bp, Mus musculus
tacatctccaaagacaggcgctaat

SEQ ID NO: 742966 - DNA, 25 bp, Mus musculus
tacatctccaagaaccacctggtgg

SEQ ID NO: 742967 - DNA, 25 bp, Mus musculus
tacatctccaagaagctgactcgct

SEQ ID NO: 742968 - DNA, 25 bp, Mus musculus
tacatctccaagtaccacctggtgg

SEQ ID NO: 742969 - DNA, 25 bp, Mus musculus
tacatctccaagtagctgactcgct

SEQ ID NO: 742970 - DNA, 25 bp, Mus musculus
tacatctccttcacctggaattcaa

SEQ ID NO: 742971 - DNA, 25 bp, Mus musculus
tacatctccttctcctggaattcaa

SEQ ID NO: 742972 - DNA, 25 bp, Mus musculus
tacatctcggccaaagcgggcttgg

SEQ ID NO: 742973 - DNA, 25 bp, Mus musculus
tacatctcggcctaagcgggcttgg

SEQ ID NO: 742974 - DNA, 25 bp, Mus musculus
tacatctctccaagtgcggccatct

SEQ ID NO: 742975 - DNA, 25 bp, Mus musculus
tacatctctccatgtgcggccatct

SEQ ID NO: 742976 - DNA, 25 bp, Mus musculus
tacatctgatataaggctaatatcc

SEQ ID NO: 742977 - DNA, 25 bp, Mus musculus
tacatctgatattaggctaatatcc

SEQ ID NO: 742978 - DNA, 25 bp, Mus musculus
tacatctgcacccaacagaatattt

SEQ ID NO: 742979 - DNA, 25 bp, Mus musculus
tacatctgcaccgaacagaatattt

SEQ ID NO: 742980 - DNA, 25 bp, Mus musculus
tacatctgcagcaacaggttgtgcc

SEQ ID NO: 742981 - DNA, 25 bp, Mus musculus
tacatctgcagctacaggttgtgcc

SEQ ID NO: 742982 - DNA, 25 bp, Mus musculus
tacatctgcccactgaatgtgtatc

SEQ ID NO: 742983 - DNA, 25 bp, Mus musculus
tacatctgcccagtgaatgtgtatc

SEQ ID NO: 742984 - DNA, 25 bp, Mus musculus
tacatctggcctcccgcaagggtga

SEQ ID NO: 742985 - DNA, 25 bp, Mus musculus
tacatctggcctgccgcaagggtga

SEQ ID NO: 742986 - DNA, 25 bp, Mus musculus
tacatctgtataccgcaatgcctgg

SEQ ID NO: 742987 - DNA, 25 bp, Mus musculus
tacatctgtatagcgcaatgcctgg

SEQ ID NO: 742988 - DNA, 25 bp, Mus musculus
tacatctgtggacaagagacggcac

SEQ ID NO: 742989 - DNA, 25 bp, Mus musculus
tacatctgtggagaagagacggcac

SEQ ID NO: 742990 - DNA, 25 bp, Mus musculus
tacatcttcaacctgaggcctgagg

SEQ ID NO: 742991 - DNA, 25 bp, Mus musculus
tacatcttcaacgtgaggcctgagg

SEQ ID NO: 742992 - DNA, 25 bp, Mus musculus
tacatcttgaagctgcatttaatac

SEQ ID NO: 742993 - DNA, 25 bp, Mus musculus
tacatcttgaaggtgcatttaatac

SEQ ID NO: 742994 - DNA, 25 bp, Mus musculus
tacatcttggaactgcaggctgtca

SEQ ID NO: 742995 - DNA, 25 bp, Mus musculus
tacatcttggaagtgcaggctgtca

SEQ ID NO: 742996 - DNA, 25 bp, Mus musculus
tacatcttggacctgctgagcacag

SEQ ID NO: 742997 - DNA, 25 bp, Mus musculus
tacatcttggacgtgctgagcacag

SEQ ID NO: 742998 - DNA, 25 bp, Mus musculus
tacatcttggcaatgtgagctgccg

SEQ ID NO: 742999 - DNA, 25 bp, Mus musculus
tacatcttggcattgtgagctgccg

SEQ ID NO: 743000 - DNA, 25 bp, Mus musculus
tacatcttggctcactttgcgaagg

SEQ ID NO: 743001 - DNA, 25 bp, Mus musculus
tacatcttggctgactttgcgaagg

SEQ ID NO: 743002 - DNA, 25 bp, Mus musculus
tacatgaaagttatgggaggatatg

SEQ ID NO: 743003 - DNA, 25 bp, Mus musculus
tacatgaaagttttgggaggatatg

SEQ ID NO: 743004 - DNA, 25 bp, Mus musculus
tacatgaaggctacactcacggtgc

SEQ ID NO: 743005 - DNA, 25 bp, Mus musculus
tacatgaaggcttcactcacggtgc

SEQ ID NO: 743006 - DNA, 25 bp, Mus musculus
tacatgaagggaccagacgtcgtca

SEQ ID NO: 743007 - DNA, 25 bp, Mus musculus
tacatgaagggagcagacgtcgtca

SEQ ID NO: 743008 - DNA, 25 bp, Mus musculus
tacatgaagtatctttacccctatg

SEQ ID NO: 743009 - DNA, 25 bp, Mus musculus
tacatgaagtatgtttacccctatg

SEQ ID NO: 743010 - DNA, 25 bp, Mus musculus
tacatgaatgacagccttcgcacag

SEQ ID NO: 743011 - DNA, 25 bp, Mus musculus
tacatgaatgactgccttcgcacag

SEQ ID NO: 743012 - DNA, 25 bp, Mus musculus
tacatgaattgtcgtcaaacctgca

SEQ ID NO: 743013 - DNA, 25 bp, Mus musculus
tacatgaattgtggtcaaacctgca

SEQ ID NO: 743014 - DNA, 25 bp, Mus musculus
tacatgacgaagacaactcaaacat

SEQ ID NO: 743015 - DNA, 25 bp, Mus musculus
tacatgacgaagtcaactcaaacat

SEQ ID NO: 743016 - DNA, 25 bp, Mus musculus
tacatgactagtcctgcgaggcttg

SEQ ID NO: 743017 - DNA, 25 bp, Mus musculus
tacatgactagtgctgcgaggcttg

SEQ ID NO: 743018 - DNA, 25 bp, Mus musculus
tacatgactccacagcagtcagcca

SEQ ID NO: 743019 - DNA, 25 bp, Mus musculus
tacatgactccagagcagtcagcca

SEQ ID NO: 743020 - DNA, 25 bp, Mus musculus
tacatgactgccatatgaaagctct

SEQ ID NO: 743021 - DNA, 25 bp, Mus musculus
tacatgactgccttatgaaagctct

SEQ ID NO: 743022 - DNA, 25 bp, Mus musculus
tacatgagagaaacctcaccctgct

SEQ ID NO: 743023 - DNA, 25 bp, Mus musculus
tacatgagagaatcctcaccctgct

SEQ ID NO: 743024 - DNA, 25 bp, Mus musculus
tacatgagcaggatacaggtgggcc

SEQ ID NO: 743025 - DNA, 25 bp, Mus musculus
tacatgagcaggttacaggtgggcc

SEQ ID NO: 743026 - DNA, 25 bp, Mus musculus
tacatgagccgccatgacttcagag

SEQ ID NO: 743027 - DNA, 25 bp, Mus musculus
tacatgagccgcgatgacttcagag

SEQ ID NO: 743028 - DNA, 25 bp, Mus musculus
tacatgaggcctcagggtacacctg

SEQ ID NO: 743029 - DNA, 25 bp, Mus musculus
tacatgaggcctgagggtacacctg

SEQ ID NO: 743030 - DNA, 25 bp, Mus musculus
tacatgagggatctttgatcacccc

SEQ ID NO: 743031 - DNA, 25 bp, Mus musculus
tacatgagggatgtttgatcacccc

SEQ ID NO: 743032 - DNA, 25 bp, Mus musculus
tacatgagtagcaatccagaaatcc

SEQ ID NO: 743033 - DNA, 25 bp, Mus musculus
tacatgagtagctatccagaaatcc

SEQ ID NO: 743034 - DNA, 25 bp, Mus musculus
tacatgatatctctctagccttggc

SEQ ID NO: 743035 - DNA, 25 bp, Mus musculus
tacatgatatctgtctagccttggc

SEQ ID NO: 743036 - DNA, 25 bp, Mus musculus
tacatgatccgaatccactccttct

SEQ ID NO: 743037 - DNA, 25 bp, Mus musculus
tacatgatccgattccactccttct

SEQ ID NO: 743038 - DNA, 25 bp, Mus musculus
tacatgatgccacatgaggagacac

SEQ ID NO: 743039 - DNA, 25 bp, Mus musculus
tacatgatgccagatgaggagacac

SEQ ID NO: 743040 - DNA, 25 bp, Mus musculus
tacatgatgggcctatatgcaccaa

SEQ ID NO: 743041 - DNA, 25 bp, Mus musculus
tacatgatgggcgtatatgcaccaa

SEQ ID NO: 743042 - DNA, 25 bp, Mus musculus
tacatgattggaagacggaaaagtc

SEQ ID NO: 743043 - DNA, 25 bp, Mus musculus
tacatgattggatgacggaaaagtc

SEQ ID NO: 743044 - DNA, 25 bp, Mus musculus
tacatgcactttatgagggagaccc

SEQ ID NO: 743045 - DNA, 25 bp, Mus musculus
tacatgcactttttgagggagaccc

SEQ ID NO: 743046 - DNA, 25 bp, Mus musculus
tacatgcagatgctcggacgtgcat

SEQ ID NO: 743047 - DNA, 25 bp, Mus musculus
tacatgcagatggtcggacgtgcat

SEQ ID NO: 743048 - DNA, 25 bp, Mus musculus
tacatgcagcttcgaggaagggtcc

SEQ ID NO: 743049 - DNA, 25 bp, Mus musculus
tacatgcagcttggaggaagggtcc

SEQ ID NO: 743050 - DNA, 25 bp, Mus musculus
tacatgccaaagacccagatgctgc

SEQ ID NO: 743051 - DNA, 25 bp, Mus musculus
tacatgccaaagtcccagatgctgc

SEQ ID NO: 743052 - DNA, 25 bp, Mus musculus
tacatgccattgctcgtgttggaca

SEQ ID NO: 743053 - DNA, 25 bp, Mus musculus
tacatgccattggtcgtgttggaca

SEQ ID NO: 743054 - DNA, 25 bp, Mus musculus
tacatgccccagaacgtctactgtg

SEQ ID NO: 743055 - DNA, 25 bp, Mus musculus
tacatgccccagtacgtctactgtg

SEQ ID NO: 743056 - DNA, 25 bp, Mus musculus
tacatgcctgctcgaacgcttggaa

SEQ ID NO: 743057 - DNA, 25 bp, Mus musculus
tacatgcctgctggaacgcttggaa

SEQ ID NO: 743058 - DNA, 25 bp, Mus musculus
tacatgccttgtcacacccaaaaca

SEQ ID NO: 743059 - DNA, 25 bp, Mus musculus
tacatgccttgtgacacccaaaaca

SEQ ID NO: 743060 - DNA, 25 bp, Mus musculus
tacatgcgatgcaatagctacacca

SEQ ID NO: 743061 - DNA, 25 bp, Mus musculus
tacatgcgatgctatagctacacca

SEQ ID NO: 743062 - DNA, 25 bp, Mus musculus
tacatgcgcaacaccagtaagcagc

SEQ ID NO: 743063 - DNA, 25 bp, Mus musculus
tacatgcgcaactccagtaagcagc

SEQ ID NO: 743064 - DNA, 25 bp, Mus musculus
tacatgcgcaggaagtgccaggagt

SEQ ID NO: 743065 - DNA, 25 bp, Mus musculus
tacatgcgcaggtagtgccaggagt

SEQ ID NO: 743066 - DNA, 25 bp, Mus musculus
tacatgcggcctcacatcgtggcac

SEQ ID NO: 743067 - DNA, 25 bp, Mus musculus
tacatgcggcctgacatcgtggcac

SEQ ID NO: 743068 - DNA, 25 bp, Mus musculus
tacatgcgggacaggcatcaggaag

SEQ ID NO: 743069 - DNA, 25 bp, Mus musculus
tacatgcgggactggcatcaggaag

SEQ ID NO: 743070 - DNA, 25 bp, Mus musculus
tacatgctagtgagtggtcctgtga

SEQ ID NO: 743071 - DNA, 25 bp, Mus musculus
tacatgctagtgtgtggtcctgtga

SEQ ID NO: 743072 - DNA, 25 bp, Mus musculus
tacatgcttgtcagttgtgggcaca

SEQ ID NO: 743073 - DNA, 25 bp, Mus musculus
tacatgcttgtctgttgtgggcaca

SEQ ID NO: 743074 - DNA, 25 bp, Mus musculus
tacatgcttttgagccacccttggg

SEQ ID NO: 743075 - DNA, 25 bp, Mus musculus
tacatgcttttgtgccacccttggg

SEQ ID NO: 743076 - DNA, 25 bp, Mus musculus
tacatggaaacactatggagaagct

SEQ ID NO: 743077 - DNA, 25 bp, Mus musculus
tacatggaaacagtatggagaagct

SEQ ID NO: 743078 - DNA, 25 bp, Mus musculus
tacatggaacaaccctccaagacgg

SEQ ID NO: 743079 - DNA, 25 bp, Mus musculus
tacatggaacaagcctccaagacgg

SEQ ID NO: 743080 - DNA, 25 bp, Mus musculus
tacatggaaccccagaccaaaagcg

SEQ ID NO: 743081 - DNA, 25 bp, Mus musculus
tacatggaacccgagaccaaaagcg

SEQ ID NO: 743082 - DNA, 25 bp, Mus musculus
tacatggaactgaatgccctcatgc

SEQ ID NO: 743083 - DNA, 25 bp, Mus musculus
tacatggaactgtatgccctcatgc

SEQ ID NO: 743084 - DNA, 25 bp, Mus musculus
tacatggaaggcctccctgagttag

SEQ ID NO: 743085 - DNA, 25 bp, Mus musculus
tacatggaaggcgtccctgagttag

SEQ ID NO: 743086 - DNA, 25 bp, Mus musculus
tacatggactccatttaacccagtg

SEQ ID NO: 743087 - DNA, 25 bp, Mus musculus
tacatggactccttttaacccagtg

SEQ ID NO: 743088 - DNA, 25 bp, Mus musculus
tacatggagcacacgtacctcatcc

SEQ ID NO: 743089 - DNA, 25 bp, Mus musculus
tacatggagcactcgtacctcatcc

SEQ ID NO: 743090 - DNA, 25 bp, Mus musculus
tacatggagcagagcaagccccaag

SEQ ID NO: 743091 - DNA, 25 bp, Mus musculus
tacatggagcagtgcaagccccaag

SEQ ID NO: 743092 - DNA, 25 bp, Mus musculus
tacatggagcggctacagctgctgt

SEQ ID NO: 743093 - DNA, 25 bp, Mus musculus
tacatggagcgggtacagctgctgt

SEQ ID NO: 743094 - DNA, 25 bp, Mus musculus
tacatggagtccagaaaggcacaaa

SEQ ID NO: 743095 - DNA, 25 bp, Mus musculus
tacatggagtcctgaaaggcacaaa

SEQ ID NO: 743096 - DNA, 25 bp, Mus musculus
tacatggagtttcatctgaatggaa

SEQ ID NO: 743097 - DNA, 25 bp, Mus musculus
tacatggagtttgatctgaatggaa

SEQ ID NO: 743098 - DNA, 25 bp, Mus musculus
tacatggcaagacttgaaagcagct

SEQ ID NO: 743099 - DNA, 25 bp, Mus musculus
tacatggcaagagttgaaagcagct

SEQ ID NO: 743100 - DNA, 25 bp, Mus musculus
tacatggcacgtctgaggtttgtga

SEQ ID NO: 743101 - DNA, 25 bp, Mus musculus
tacatggcacgtgtgaggtttgtga

SEQ ID NO: 743102 - DNA, 25 bp, Mus musculus
tacatggcagatatggatgagctct

SEQ ID NO: 743103 - DNA, 25 bp, Mus musculus
tacatggcagatttggatgagctct

SEQ ID NO: 743104 - DNA, 25 bp, Mus musculus
tacatggcagtgactgggcctctga

SEQ ID NO: 743105 - DNA, 25 bp, Mus musculus
tacatggcagtgtctgggcctctga

SEQ ID NO: 743106 - DNA, 25 bp, Mus musculus
tacatggcatccaacagcttcggcc

SEQ ID NO: 743107 - DNA, 25 bp, Mus musculus
tacatggcatcctacagcttcggcc

SEQ ID NO: 743108 - DNA, 25 bp, Mus musculus
tacatggcatggattttaagaagga

SEQ ID NO: 743109 - DNA, 25 bp, Mus musculus
tacatggcatggtttttaagaagga

SEQ ID NO: 743110 - DNA, 25 bp, Mus musculus
tacatggcgaaacgaggtcattcca

SEQ ID NO: 743111 - DNA, 25 bp, Mus musculus
tacatggcgaaaggaggtcattcca

SEQ ID NO: 743112 - DNA, 25 bp, Mus musculus
tacatggcgcggcttcatggagcca

SEQ ID NO: 743113 - DNA, 25 bp, Mus musculus
tacatggcgcgggttcatggagcca

SEQ ID NO: 743114 - DNA, 25 bp, Mus musculus
tacatggcgtgcaatggccgccagt

SEQ ID NO: 743115 - DNA, 25 bp, Mus musculus
tacatggcgtgctatggccgccagt

SEQ ID NO: 743116 - DNA, 25 bp, Mus musculus
tacatggctaagaagcccaagacca

SEQ ID NO: 743117 - DNA, 25 bp, Mus musculus
tacatggctaagtagcccaagacca

SEQ ID NO: 743118 - DNA, 25 bp, Mus musculus
tacatggctttcagaaaaagaagat

SEQ ID NO: 743119 - DNA, 25 bp, Mus musculus
tacatggctttctgaaaaagaagat

SEQ ID NO: 743120 - DNA, 25 bp, Mus musculus
tacatgggacagaccatggtcctct

SEQ ID NO: 743121 - DNA, 25 bp, Mus musculus
tacatgggacagtccatggtcctct

SEQ ID NO: 743122 - DNA, 25 bp, Mus musculus
tacatgggcggcacagccttctctg

SEQ ID NO: 743123 - DNA, 25 bp, Mus musculus
tacatgggcggctcagccttctctg

SEQ ID NO: 743124 - DNA, 25 bp, Mus musculus
tacatgggctgtctggaggtcttac

SEQ ID NO: 743125 - DNA, 25 bp, Mus musculus
tacatgggctgtgtggaggtcttac

SEQ ID NO: 743126 - DNA, 25 bp, Mus musculus
tacatgggtatgaccaagaggagcc

SEQ ID NO: 743127 - DNA, 25 bp, Mus musculus
tacatgggtatgtccaagaggagcc

SEQ ID NO: 743128 - DNA, 25 bp, Mus musculus
tacatggtagtgctcaaggaaaacg

SEQ ID NO: 743129 - DNA, 25 bp, Mus musculus
tacatggtagtggtcaaggaaaacg

SEQ ID NO: 743130 - DNA, 25 bp, Mus musculus
tacatggtcacaacaggcagtggcc

SEQ ID NO: 743131 - DNA, 25 bp, Mus musculus
tacatggtcacatcaggcagtggcc

SEQ ID NO: 743132 - DNA, 25 bp, Mus musculus
tacatggtgcacacgtctctggatg

SEQ ID NO: 743133 - DNA, 25 bp, Mus musculus
tacatggtgcactcgtctctggatg

SEQ ID NO: 743134 - DNA, 25 bp, Mus musculus
tacatggtggcccacaagttcacag

SEQ ID NO: 743135 - DNA, 25 bp, Mus musculus
tacatggtggccgacaagttcacag

SEQ ID NO: 743136 - DNA, 25 bp, Mus musculus
tacatggtgggcatgatagccagct

SEQ ID NO: 743137 - DNA, 25 bp, Mus musculus
tacatggtgggcttgatagccagct

SEQ ID NO: 743138 - DNA, 25 bp, Mus musculus
tacatggttatgctcagaaggcctc

SEQ ID NO: 743139 - DNA, 25 bp, Mus musculus
tacatggttatggtcagaaggcctc

SEQ ID NO: 743140 - DNA, 25 bp, Mus musculus
tacatggttcctatcataccgctct

SEQ ID NO: 743141 - DNA, 25 bp, Mus musculus
tacatggttcctttcataccgctct

SEQ ID NO: 743142 - DNA, 25 bp, Mus musculus
tacatgtacaaacgccaatgggcaa

SEQ ID NO: 743143 - DNA, 25 bp, Mus musculus
tacatgtacaaaggccaatgggcaa

SEQ ID NO: 743144 - DNA, 25 bp, Mus musculus
tacatgtacatcacatcaaggcctg

SEQ ID NO: 743145 - DNA, 25 bp, Mus musculus
tacatgtacatctcatcaaggcctg

SEQ ID NO: 743146 - DNA, 25 bp, Mus musculus
tacatgtacccaacaggtgcccctg

SEQ ID NO: 743147 - DNA, 25 bp, Mus musculus
tacatgtacccatcaggtgcccctg

SEQ ID NO: 743148 - DNA, 25 bp, Mus musculus
tacatgtacctgagagtaatatgaa

SEQ ID NO: 743149 - DNA, 25 bp, Mus musculus
tacatgtacctgtgagtaatatgaa

SEQ ID NO: 743150 - DNA, 25 bp, Mus musculus
tacatgtatatcaggtactgctgtg

SEQ ID NO: 743151 - DNA, 25 bp, Mus musculus
tacatgtatatctggtactgctgtg

SEQ ID NO: 743152 - DNA, 25 bp, Mus musculus
tacatgtcaccccagagaatccatg

SEQ ID NO: 743153 - DNA, 25 bp, Mus musculus
tacatgtcacccgagagaatccatg

SEQ ID NO: 743154 - DNA, 25 bp, Mus musculus
tacatgtcagccaacgctcatgaaa

SEQ ID NO: 743155 - DNA, 25 bp, Mus musculus
tacatgtcagcctacgctcatgaaa

SEQ ID NO: 743156 - DNA, 25 bp, Mus musculus
tacatgtcagctctgaggacaacag

SEQ ID NO: 743157 - DNA, 25 bp, Mus musculus
tacatgtcagctgtgaggacaacag

SEQ ID NO: 743158 - DNA, 25 bp, Mus musculus
tacatgtcggatatcgagtttgagt

SEQ ID NO: 743159 - DNA, 25 bp, Mus musculus
tacatgtcggatttcgagtttgagt

SEQ ID NO: 743160 - DNA, 25 bp, Mus musculus
tacatgtgactcatgggcctgcaga

SEQ ID NO: 743161 - DNA, 25 bp, Mus musculus
tacatgtgactcttgggcctgcaga

SEQ ID NO: 743162 - DNA, 25 bp, Mus musculus
tacatgtgcatcctgggttctggga

SEQ ID NO: 743163 - DNA, 25 bp, Mus musculus
tacatgtgcatcgtgggttctggga

SEQ ID NO: 743164 - DNA, 25 bp, Mus musculus
tacatgtgctcacgatataagcagc

SEQ ID NO: 743165 - DNA, 25 bp, Mus musculus
tacatgtgctcaggatataagcagc

SEQ ID NO: 743166 - DNA, 25 bp, Mus musculus
tacatgtggacaatcctcgctggca

SEQ ID NO: 743167 - DNA, 25 bp, Mus musculus
tacatgtggacattcctcgctggca

SEQ ID NO: 743168 - DNA, 25 bp, Mus musculus
tacatgtgtcccagtgtccaggcaa

SEQ ID NO: 743169 - DNA, 25 bp, Mus musculus
tacatgtgtccctgtgtccaggcaa

SEQ ID NO: 743170 - DNA, 25 bp, Mus musculus
tacatgtgtgatatgagggtaccag

SEQ ID NO: 743171 - DNA, 25 bp, Mus musculus
tacatgtgtgatttgagggtaccag

SEQ ID NO: 743172 - DNA, 25 bp, Mus musculus
tacatgttccagagcggcgcagacg

SEQ ID NO: 743173 - DNA, 25 bp, Mus musculus
tacatgttccagtgcggcgcagacg

SEQ ID NO: 743174 - DNA, 25 bp, Mus musculus
tacatgttcggtaggtagtacagca

SEQ ID NO: 743175 - DNA, 25 bp, Mus musculus
tacatgttcggtctcgtaggcatcc

SEQ ID NO: 743176 - DNA, 25 bp, Mus musculus
tacatgttcggtgtcgtaggcatcc

SEQ ID NO: 743177 - DNA, 25 bp, Mus musculus
tacatgttcggttggtagtacagca

SEQ ID NO: 743178 - DNA, 25 bp, Mus musculus
tacatgttcgtcaatctggcctgtg

SEQ ID NO: 743179 - DNA, 25 bp, Mus musculus
tacatgttcgtctatctggcctgtg

SEQ ID NO: 743180 - DNA, 25 bp, Mus musculus
tacatgttgcccatgaaagtgcggg

SEQ ID NO: 743181 - DNA, 25 bp, Mus musculus
tacatgttgcccttgaaagtgcggg

SEQ ID NO: 743182 - DNA, 25 bp, Mus musculus
tacatgttggttacatcgtgccacc

SEQ ID NO: 743183 - DNA, 25 bp, Mus musculus
tacatgttggtttcatcgtgccacc

SEQ ID NO: 743184 - DNA, 25 bp, Mus musculus
tacatgtttgtgctggagccagagc

SEQ ID NO: 743185 - DNA, 25 bp, Mus musculus
tacatgtttgtggtggagccagagc

SEQ ID NO: 743186 - DNA, 25 bp, Mus musculus
tacattaacagcaacaggagtgaag

SEQ ID NO: 743187 - DNA, 25 bp, Mus musculus
tacattaacagctacaggagtgaag

SEQ ID NO: 743188 - DNA, 25 bp, Mus musculus
tacattaacattctccttggagttt

SEQ ID NO: 743189 - DNA, 25 bp, Mus musculus
tacattaacattgtccttggagttt

SEQ ID NO: 743190 - DNA, 25 bp, Mus musculus
tacattaacgagaacaggccagctc

SEQ ID NO: 743191 - DNA, 25 bp, Mus musculus
tacattaacgagtacaggccagctc

SEQ ID NO: 743192 - DNA, 25 bp, Mus musculus
tacattaactccagagctgtgcagc

SEQ ID NO: 743193 - DNA, 25 bp, Mus musculus
tacattaactcctgagctgtgcagc

SEQ ID NO: 743194 - DNA, 25 bp, Mus musculus
tacattaagaacatggatgacacca

SEQ ID NO: 743195 - DNA, 25 bp, Mus musculus
tacattaagaacttggatgacacca

SEQ ID NO: 743196 - DNA, 25 bp, Mus musculus
tacattaagacacattatactgggc

SEQ ID NO: 743197 - DNA, 25 bp, Mus musculus
tacattaagacagattatactgggc

SEQ ID NO: 743198 - DNA, 25 bp, Mus musculus
tacattacagatattttcaacagga

SEQ ID NO: 743199 - DNA, 25 bp, Mus musculus
tacattacagattttttcaacagga

SEQ ID NO: 743200 - DNA, 25 bp, Mus musculus
tacattaggcatcgatctaagccca

SEQ ID NO: 743201 - DNA, 25 bp, Mus musculus
tacattaggcatggatctaagccca

SEQ ID NO: 743202 - DNA, 25 bp, Mus musculus
tacattatgatcctaatgaaaaaac

SEQ ID NO: 743203 - DNA, 25 bp, Mus musculus
tacattatgatcgtaatgaaaaaac

SEQ ID NO: 743204 - DNA, 25 bp, Mus musculus
tacattatttccactaggccagtag

SEQ ID NO: 743205 - DNA, 25 bp, Mus musculus
tacattatttcctctaggccagtag

SEQ ID NO: 743206 - DNA, 25 bp, Mus musculus
tacattcaacagaaggtccgcgtgc

SEQ ID NO: 743207 - DNA, 25 bp, Mus musculus
tacattcaacagtaggtccgcgtgc

SEQ ID NO: 743208 - DNA, 25 bp, Mus musculus
tacattcagcccaacagtggaacgg

SEQ ID NO: 743209 - DNA, 25 bp, Mus musculus
tacattcagccctacagtggaacgg

SEQ ID NO: 743210 - DNA, 25 bp, Mus musculus
tacattcagtctctggcccagatgc

SEQ ID NO: 743211 - DNA, 25 bp, Mus musculus
tacattcagtctgtggcccagatgc

SEQ ID NO: 743212 - DNA, 25 bp, Mus musculus
tacattcatcgcagacagccatcag

SEQ ID NO: 743213 - DNA, 25 bp, Mus musculus
tacattcatcgctgacagccatcag

SEQ ID NO: 743214 - DNA, 25 bp, Mus musculus
tacattcatggaatcaaacacgcca

SEQ ID NO: 743215 - DNA, 25 bp, Mus musculus
tacattcatggattcaaacacgcca

SEQ ID NO: 743216 - DNA, 25 bp, Mus musculus
tacattccaaaaatactgttgtgag

SEQ ID NO: 743217 - DNA, 25 bp, Mus musculus
tacattccaaaattactgttgtgag

SEQ ID NO: 743218 - DNA, 25 bp, Mus musculus
tacattccagaaatggtggagctct

SEQ ID NO: 743219 - DNA, 25 bp, Mus musculus
tacattccagaattggtggagctct

SEQ ID NO: 743220 - DNA, 25 bp, Mus musculus
tacattccgctcacttcacatttga

SEQ ID NO: 743221 - DNA, 25 bp, Mus musculus
tacattccgctctcttcacatttga

SEQ ID NO: 743222 - DNA, 25 bp, Mus musculus
tacattccgtatacatcgcccctgg

SEQ ID NO: 743223 - DNA, 25 bp, Mus musculus
tacattccgtattcatcgcccctgg

SEQ ID NO: 743224 - DNA, 25 bp, Mus musculus
tacattcctcgaatctggaccttcg

SEQ ID NO: 743225 - DNA, 25 bp, Mus musculus
tacattcctcgattctggaccttcg

SEQ ID NO: 743226 - DNA, 25 bp, Mus musculus
tacattcgagacaccactgtggcag

SEQ ID NO: 743227 - DNA, 25 bp, Mus musculus
tacattcgagactccactgtggcag

SEQ ID NO: 743228 - DNA, 25 bp, Mus musculus
tacattcggctgacataattcacag

SEQ ID NO: 743229 - DNA, 25 bp, Mus musculus
tacattcggctgtcataattcacag

SEQ ID NO: 743230 - DNA, 25 bp, Mus musculus
tacattctaaagcaggagaacccac

SEQ ID NO: 743231 - DNA, 25 bp, Mus musculus
tacattctaaaggaggagaacccac

SEQ ID NO: 743232 - DNA, 25 bp, Mus musculus
tacattctaatccactggttggtgg

SEQ ID NO: 743233 - DNA, 25 bp, Mus musculus
tacattctaatcgactggttggtgg

SEQ ID NO: 743234 - DNA, 25 bp, Mus musculus
tacattctcagactaactaaggact

SEQ ID NO: 743235 - DNA, 25 bp, Mus musculus
tacattctcagagtaactaaggact

SEQ ID NO: 743236 - DNA, 25 bp, Mus musculus
tacattctcattcctgtgggagctg

SEQ ID NO: 743237 - DNA, 25 bp, Mus musculus
tacattctcattgctgtgggagctg

SEQ ID NO: 743238 - DNA, 25 bp, Mus musculus
tacattctgcgaaagaagttcacag

SEQ ID NO: 743239 - DNA, 25 bp, Mus musculus
tacattctgcgatagaagttcacag

SEQ ID NO: 743240 - DNA, 25 bp, Mus musculus
tacattcttcgccatgacggagccc

SEQ ID NO: 743241 - DNA, 25 bp, Mus musculus
tacattcttcgcgatgacggagccc

SEQ ID NO: 743242 - DNA, 25 bp, Mus musculus
tacattcttggaagttgtggttccc

SEQ ID NO: 743243 - DNA, 25 bp, Mus musculus
tacattcttggatgttgtggttccc

SEQ ID NO: 743244 - DNA, 25 bp, Mus musculus
tacattgaagccctcagtagtgccc

SEQ ID NO: 743245 - DNA, 25 bp, Mus musculus
tacattgaagccgtcagtagtgccc

SEQ ID NO: 743246 - DNA, 25 bp, Mus musculus
tacattgaaggaccgcttccggtgc

SEQ ID NO: 743247 - DNA, 25 bp, Mus musculus
tacattgaaggagcgcttccggtgc

SEQ ID NO: 743248 - DNA, 25 bp, Mus musculus
tacattgacacgcttttacaaaagg

SEQ ID NO: 743249 - DNA, 25 bp, Mus musculus
tacattgacacggttttacaaaagg

SEQ ID NO: 743250 - DNA, 25 bp, Mus musculus
tacattgacttcctgaacgtggtga

SEQ ID NO: 743251 - DNA, 25 bp, Mus musculus
tacattgacttcgtgaacgtggtga

SEQ ID NO: 743252 - DNA, 25 bp, Mus musculus
tacattgagaagattgtccgccggg

SEQ ID NO: 743253 - DNA, 25 bp, Mus musculus
tacattgagaagtttgtccgccggg

SEQ ID NO: 743254 - DNA, 25 bp, Mus musculus
tacattgatctgatggagacaaccc

SEQ ID NO: 743255 - DNA, 25 bp, Mus musculus
tacattgatctgttggagacaaccc

SEQ ID NO: 743256 - DNA, 25 bp, Mus musculus
tacattgatgagctgtacggaggcc

SEQ ID NO: 743257 - DNA, 25 bp, Mus musculus
tacattgatgaggtgtacggaggcc

SEQ ID NO: 743258 - DNA, 25 bp, Mus musculus
tacattgcacctacagatttggagc

SEQ ID NO: 743259 - DNA, 25 bp, Mus musculus
tacattgcaccttcagatttggagc

SEQ ID NO: 743260 - DNA, 25 bp, Mus musculus
tacattgcagcacttccggagaaag

SEQ ID NO: 743261 - DNA, 25 bp, Mus musculus
tacattgcagcagttccggagaaag

SEQ ID NO: 743262 - DNA, 25 bp, Mus musculus
tacattgcatatccccatagtacca

SEQ ID NO: 743263 - DNA, 25 bp, Mus musculus
tacattgcatatgcccatagtacca

SEQ ID NO: 743264 - DNA, 25 bp, Mus musculus
tacattgccacgagcagtgaccact

SEQ ID NO: 743265 - DNA, 25 bp, Mus musculus
tacattgccacgtgcagtgaccact

SEQ ID NO: 743266 - DNA, 25 bp, Mus musculus
tacattgccactcaaggctgcctgc

SEQ ID NO: 743267 - DNA, 25 bp, Mus musculus
tacattgccactgaaggctgcctgc

SEQ ID NO: 743268 - DNA, 25 bp, Mus musculus
tacattgcccaacctcggcgacagt

SEQ ID NO: 743269 - DNA, 25 bp, Mus musculus
tacattgcccaagctcggcgacagt

SEQ ID NO: 743270 - DNA, 25 bp, Mus musculus
tacattgcccctcctttgtgcgagt

SEQ ID NO: 743271 - DNA, 25 bp, Mus musculus
tacattgcccctgctttgtgcgagt

SEQ ID NO: 743272 - DNA, 25 bp, Mus musculus
tacattgcccgaatcctggcggctg

SEQ ID NO: 743273 - DNA, 25 bp, Mus musculus
tacattgcccgattcctggcggctg

SEQ ID NO: 743274 - DNA, 25 bp, Mus musculus
tacattgccctgcaggaatgggccg

SEQ ID NO: 743275 - DNA, 25 bp, Mus musculus
tacattgccctggaggaatgggccg

SEQ ID NO: 743276 - DNA, 25 bp, Mus musculus
tacattgcggtgaatccacatttgt

SEQ ID NO: 743277 - DNA, 25 bp, Mus musculus
tacattgcggtgtatccacatttgt

SEQ ID NO: 743278 - DNA, 25 bp, Mus musculus
tacattgcggttatgaactacctgc

SEQ ID NO: 743279 - DNA, 25 bp, Mus musculus
tacattgcggttttgaactacctgc

SEQ ID NO: 743280 - DNA, 25 bp, Mus musculus
tacattgctgctatcctgcacatcc

SEQ ID NO: 743281 - DNA, 25 bp, Mus musculus
tacattgctgctttcctgcacatcc

SEQ ID NO: 743282 - DNA, 25 bp, Mus musculus
tacattgctggcactatggaagaca

SEQ ID NO: 743283 - DNA, 25 bp, Mus musculus
tacattgctggctctatggaagaca

SEQ ID NO: 743284 - DNA, 25 bp, Mus musculus
tacattgctttgaagcttgtagctg

SEQ ID NO: 743285 - DNA, 25 bp, Mus musculus
tacattgctttgtagcttgtagctg

SEQ ID NO: 743286 - DNA, 25 bp, Mus musculus
tacattggaattctgacgatcctca

SEQ ID NO: 743287 - DNA, 25 bp, Mus musculus
tacattggaattgtgacgatcctca

SEQ ID NO: 743288 - DNA, 25 bp, Mus musculus
tacattggagcactaggagcccttt

SEQ ID NO: 743289 - DNA, 25 bp, Mus musculus
tacattggagcagtaggagcccttt

SEQ ID NO: 743290 - DNA, 25 bp, Mus musculus
tacattggcctgatatcttctcaag

SEQ ID NO: 743291 - DNA, 25 bp, Mus musculus
tacattggcctgttatcttctcaag

SEQ ID NO: 743292 - DNA, 25 bp, Mus musculus
tacattggctaacggtacagggaag

SEQ ID NO: 743293 - DNA, 25 bp, Mus musculus
tacattggctaagggtacagggaag

SEQ ID NO: 743294 - DNA, 25 bp, Mus musculus
tacattgggaatagcttctgtgccg

SEQ ID NO: 743295 - DNA, 25 bp, Mus musculus
tacattgggaattgcttctgtgccg

SEQ ID NO: 743296 - DNA, 25 bp, Mus musculus
tacattgggtataatgacagcagcc

SEQ ID NO: 743297 - DNA, 25 bp, Mus musculus
tacattgggtattatgacagcagcc

SEQ ID NO: 743298 - DNA, 25 bp, Mus musculus
tacattgtagaaattgaagggaaca

SEQ ID NO: 743299 - DNA, 25 bp, Mus musculus
tacattgtagaatttgaagggaaca

SEQ ID NO: 743300 - DNA, 25 bp, Mus musculus
tacattgtagttagaagttcaggca

SEQ ID NO: 743301 - DNA, 25 bp, Mus musculus
tacattgtagtttgaagttcaggca

SEQ ID NO: 743302 - DNA, 25 bp, Mus musculus
tacattgtatctagctggaggtcag

SEQ ID NO: 743303 - DNA, 25 bp, Mus musculus
tacattgtatcttgctggaggtcag

SEQ ID NO: 743304 - DNA, 25 bp, Mus musculus
tacattgtcaaaaagtgcattgggc

SEQ ID NO: 743305 - DNA, 25 bp, Mus musculus
tacattgtcaaatagtgcattgggc

SEQ ID NO: 743306 - DNA, 25 bp, Mus musculus
tacattgtggctacagaagggccag

SEQ ID NO: 743307 - DNA, 25 bp, Mus musculus
tacattgtggcttcagaagggccag

SEQ ID NO: 743308 - DNA, 25 bp, Mus musculus
tacattgtgtgtcatggaaagagga

SEQ ID NO: 743309 - DNA, 25 bp, Mus musculus
tacattgtgtgtgatggaaagagga

SEQ ID NO: 743310 - DNA, 25 bp, Mus musculus
tacattgttctccacaaggcaagca

SEQ ID NO: 743311 - DNA, 25 bp, Mus musculus
tacattgttctcgacaaggcaagca

SEQ ID NO: 743312 - DNA, 25 bp, Mus musculus
tacattgttgccaatgaagccgggc

SEQ ID NO: 743313 - DNA, 25 bp, Mus musculus
tacattgttgcctatgaagccgggc

SEQ ID NO: 743314 - DNA, 25 bp, Mus musculus
tacatttacaatcgccgagtcgatg

SEQ ID NO: 743315 - DNA, 25 bp, Mus musculus
tacatttacaatggccgagtcgatg

SEQ ID NO: 743316 - DNA, 25 bp, Mus musculus
tacatttaccagcaaagaaccccag

SEQ ID NO: 743317 - DNA, 25 bp, Mus musculus
tacatttaccaggaaagaaccccag

SEQ ID NO: 743318 - DNA, 25 bp, Mus musculus
tacatttatcccagacaaaatacag

SEQ ID NO: 743319 - DNA, 25 bp, Mus musculus
tacatttatccctgacaaaatacag

SEQ ID NO: 743320 - DNA, 25 bp, Mus musculus
tacatttatgacatcaaccacaaag

SEQ ID NO: 743321 - DNA, 25 bp, Mus musculus
tacatttatgacttcaaccacaaag

SEQ ID NO: 743322 - DNA, 25 bp, Mus musculus
tacatttatgctcacaaagtccttc

SEQ ID NO: 743323 - DNA, 25 bp, Mus musculus
tacatttatgctgacaaagtccttc

SEQ ID NO: 743324 - DNA, 25 bp, Mus musculus
tacatttattacaaaaggagcctgg

SEQ ID NO: 743325 - DNA, 25 bp, Mus musculus
tacatttattactaaaggagcctgg

SEQ ID NO: 743326 - DNA, 25 bp, Mus musculus
tacatttcaccacaattaataaaca

SEQ ID NO: 743327 - DNA, 25 bp, Mus musculus
tacatttcaccagaattaataaaca

SEQ ID NO: 743328 - DNA, 25 bp, Mus musculus
tacatttcacccagtgtggcgggcc

SEQ ID NO: 743329 - DNA, 25 bp, Mus musculus
tacatttcaccctgtgtggcgggcc

SEQ ID NO: 743330 - DNA, 25 bp, Mus musculus
tacatttcactcaacaacacctgca

SEQ ID NO: 743331 - DNA, 25 bp, Mus musculus
tacatttcactctacaacacctgca

SEQ ID NO: 743332 - DNA, 25 bp, Mus musculus
tacatttcagaaaggtggttcttaa

SEQ ID NO: 743333 - DNA, 25 bp, Mus musculus
tacatttcagaatggtggttcttaa

SEQ ID NO: 743334 - DNA, 25 bp, Mus musculus
tacatttctgaacgaactcactcga

SEQ ID NO: 743335 - DNA, 25 bp, Mus musculus
tacatttctgaaggaactcactcga

SEQ ID NO: 743336 - DNA, 25 bp, Mus musculus
tacatttggagtatgccaagcgggc

SEQ ID NO: 743337 - DNA, 25 bp, Mus musculus
tacatttggagtttgccaagcgggc

SEQ ID NO: 743338 - DNA, 25 bp, Mus musculus
tacattttatccagatcagactaca

SEQ ID NO: 743339 - DNA, 25 bp, Mus musculus
tacattttatcctgatcagactaca

SEQ ID NO: 743340 - DNA, 25 bp, Mus musculus
tacattttgtgtcgaatatgaagac

SEQ ID NO: 743341 - DNA, 25 bp, Mus musculus
tacattttgtgtggaatatgaagac

SEQ ID NO: 743342 - DNA, 25 bp, Mus musculus
taccaaaaaggaagttgatgtccag

SEQ ID NO: 743343 - DNA, 25 bp, Mus musculus
taccaaaaaggatgttgatgtccag

SEQ ID NO: 743344 - DNA, 25 bp, Mus musculus
taccaaaactttcatgtcttcatgg

SEQ ID NO: 743345 - DNA, 25 bp, Mus musculus
taccaaaactttgatgtcttcatgg

SEQ ID NO: 743346 - DNA, 25 bp, Mus musculus
taccaaaagcctaggatttggattg

SEQ ID NO: 743347 - DNA, 25 bp, Mus musculus
taccaaaagccttggatttggattg

SEQ ID NO: 743348 - DNA, 25 bp, Mus musculus
taccaaacctgacactgctggcaca

SEQ ID NO: 743349 - DNA, 25 bp, Mus musculus
taccaaacctgagactgctggcaca

SEQ ID NO: 743350 - DNA, 25 bp, Mus musculus
taccaaacttacctgcccacggaga

SEQ ID NO: 743351 - DNA, 25 bp, Mus musculus
taccaaacttacgtgcccacggaga

SEQ ID NO: 743352 - DNA, 25 bp, Mus musculus
taccaaagaaggagatttgccccag

SEQ ID NO: 743353 - DNA, 25 bp, Mus musculus
taccaaagaaggtgatttgccccag

SEQ ID NO: 743354 - DNA, 25 bp, Mus musculus
taccaaagatgaatcggaggagacg

SEQ ID NO: 743355 - DNA, 25 bp, Mus musculus
taccaaagatgattcggaggagacg

SEQ ID NO: 743356 - DNA, 25 bp, Mus musculus
taccaaagccttacgcagagggacc

SEQ ID NO: 743357 - DNA, 25 bp, Mus musculus
taccaaagcctttcgcagagggacc

SEQ ID NO: 743358 - DNA, 25 bp, Mus musculus
taccaaaggataaagtccagagttt

SEQ ID NO: 743359 - DNA, 25 bp, Mus musculus
taccaaaggatatagtccagagttt

SEQ ID NO: 743360 - DNA, 25 bp, Mus musculus
taccaaatagctctgaacctaaccg

SEQ ID NO: 743361 - DNA, 25 bp, Mus musculus
taccaaatagctgtgaacctaaccg

SEQ ID NO: 743362 - DNA, 25 bp, Mus musculus
taccaaatcacaagatgctaaagat

SEQ ID NO: 743363 - DNA, 25 bp, Mus musculus
taccaaatcacatgatgctaaagat

SEQ ID NO: 743364 - DNA, 25 bp, Mus musculus
taccaaatccgccaagaaagtcagg

SEQ ID NO: 743365 - DNA, 25 bp, Mus musculus
taccaaatccgcgaagaaagtcagg

SEQ ID NO: 743366 - DNA, 25 bp, Mus musculus
taccaacacaagatcagcaacctca

SEQ ID NO: 743367 - DNA, 25 bp, Mus musculus
taccaacacaagttcagcaacctca

SEQ ID NO: 743368 - DNA, 25 bp, Mus musculus
taccaacacagtaatagcaaagaag

SEQ ID NO: 743369 - DNA, 25 bp, Mus musculus
taccaacacagttatagcaaagaag

SEQ ID NO: 743370 - DNA, 25 bp, Mus musculus
taccaacagattccagagtcaagct

SEQ ID NO: 743371 - DNA, 25 bp, Mus musculus
taccaacagattgcagagtcaagct

SEQ ID NO: 743372 - DNA, 25 bp, Mus musculus
taccaacagctcaccttgcaaatca

SEQ ID NO: 743373 - DNA, 25 bp, Mus musculus
taccaacagctctccttgcaaatca

SEQ ID NO: 743374 - DNA, 25 bp, Mus musculus
taccaacatcaaccagagtctctac

SEQ ID NO: 743375 - DNA, 25 bp, Mus musculus
taccaacatcaagcagagtctctac

SEQ ID NO: 743376 - DNA, 25 bp, Mus musculus
taccaacattgtctacctctgtggc

SEQ ID NO: 743377 - DNA, 25 bp, Mus musculus
taccaacattgtgtacctctgtggc

SEQ ID NO: 743378 - DNA, 25 bp, Mus musculus
taccaaccactgcagagggctgggt

SEQ ID NO: 743379 - DNA, 25 bp, Mus musculus
taccaaccactggagagggctgggt

SEQ ID NO: 743380 - DNA, 25 bp, Mus musculus
taccaacctgttaggccgaggcatg

SEQ ID NO: 743381 - DNA, 25 bp, Mus musculus
taccaacctgtttggccgaggcatg

SEQ ID NO: 743382 - DNA, 25 bp, Mus musculus
taccaacgcagacagagcgtgggac

SEQ ID NO: 743383 - DNA, 25 bp, Mus musculus
taccaacgcagagagagcgtgggac

SEQ ID NO: 743384 - DNA, 25 bp, Mus musculus
taccaacggtaccttcctgagtgcg

SEQ ID NO: 743385 - DNA, 25 bp, Mus musculus
taccaacggtacgttcctgagtgcg

SEQ ID NO: 743386 - DNA, 25 bp, Mus musculus
taccaacggtgtcctggtgatgcac

SEQ ID NO: 743387 - DNA, 25 bp, Mus musculus
taccaacggtgtgctggtgatgcac

SEQ ID NO: 743388 - DNA, 25 bp, Mus musculus
taccaacggtttcactcttggagca

SEQ ID NO: 743389 - DNA, 25 bp, Mus musculus
taccaacggtttgactcttggagca

SEQ ID NO: 743390 - DNA, 25 bp, Mus musculus
taccaactctaccttcatgatgacg

SEQ ID NO: 743391 - DNA, 25 bp, Mus musculus
taccaactctacgttcatgatgacg

SEQ ID NO: 743392 - DNA, 25 bp, Mus musculus
taccaactgcaaagcagtcattttt

SEQ ID NO: 743393 - DNA, 25 bp, Mus musculus
taccaactgcaatgcagtcattttt

SEQ ID NO: 743394 - DNA, 25 bp, Mus musculus
taccaactggatcattgagatcgtc

SEQ ID NO: 743395 - DNA, 25 bp, Mus musculus
taccaactggatgattgagatcgtc

SEQ ID NO: 743396 - DNA, 25 bp, Mus musculus
taccaagaacatcaaactggcagat

SEQ ID NO: 743397 - DNA, 25 bp, Mus musculus
taccaagaacatgaaactggcagat

SEQ ID NO: 743398 - DNA, 25 bp, Mus musculus
taccaagaactacctgagctacctg

SEQ ID NO: 743399 - DNA, 25 bp, Mus musculus
taccaagaactagctgagctacctg

SEQ ID NO: 743400 - DNA, 25 bp, Mus musculus
taccaagaactgacccagttgaagg

SEQ ID NO: 743401 - DNA, 25 bp, Mus musculus
taccaagaactgtcccagttgaagg

SEQ ID NO: 743402 - DNA, 25 bp, Mus musculus
taccaagacttccaggcagacatcc

SEQ ID NO: 743403 - DNA, 25 bp, Mus musculus
taccaagacttcgaggcagacatcc

SEQ ID NO: 743404 - DNA, 25 bp, Mus musculus
taccaagcagtaagaaaagtctgaa

SEQ ID NO: 743405 - DNA, 25 bp, Mus musculus
taccaagcagtatgaaaagtctgaa

SEQ ID NO: 743406 - DNA, 25 bp, Mus musculus
taccaagccatcatctatgctgtgg

SEQ ID NO: 743407 - DNA, 25 bp, Mus musculus
taccaagccatcttctatgctgtgg

SEQ ID NO: 743408 - DNA, 25 bp, Mus musculus
taccaagctaatcagcgtgtgaagg

SEQ ID NO: 743409 - DNA, 25 bp, Mus musculus
taccaagctaatgagcgtgtgaagg

SEQ ID NO: 743410 - DNA, 25 bp, Mus musculus
taccaagctaggaggtagctacaaa

SEQ ID NO: 743411 - DNA, 25 bp, Mus musculus
taccaagctaggtggtagctacaaa

SEQ ID NO: 743412 - DNA, 25 bp, Mus musculus
taccaagcttacatcgacttcgaga

SEQ ID NO: 743413 - DNA, 25 bp, Mus musculus
taccaagcttacttcgacttcgaga

SEQ ID NO: 743414 - DNA, 25 bp, Mus musculus
taccaaggacgaaatcatcagattc

SEQ ID NO: 743415 - DNA, 25 bp, Mus musculus
taccaaggacgatatcatcagattc

SEQ ID NO: 743416 - DNA, 25 bp, Mus musculus
taccaaggagtacccaggaaaataa

SEQ ID NO: 743417 - DNA, 25 bp, Mus musculus
taccaaggagtagccaggaaaataa

SEQ ID NO: 743418 - DNA, 25 bp, Mus musculus
taccaaggctggctagccttttagc

SEQ ID NO: 743419 - DNA, 25 bp, Mus musculus
taccaaggctgggtagccttttagc

SEQ ID NO: 743420 - DNA, 25 bp, Mus musculus
taccaagggacccagcagtccaggg

SEQ ID NO: 743421 - DNA, 25 bp, Mus musculus
taccaagggaccgagcagtccaggg

SEQ ID NO: 743422 - DNA, 25 bp, Mus musculus
taccaagggtcccaagtcggagcca

SEQ ID NO: 743423 - DNA, 25 bp, Mus musculus
taccaagggtccgaagtcggagcca

SEQ ID NO: 743424 - DNA, 25 bp, Mus musculus
taccaaggttttcacgctgacacct

SEQ ID NO: 743425 - DNA, 25 bp, Mus musculus
taccaaggttttgacgctgacacct

SEQ ID NO: 743426 - DNA, 25 bp, Mus musculus
taccaagtagccagtcagaagtact

SEQ ID NO: 743427 - DNA, 25 bp, Mus musculus
taccaagtagcctgtcagaagtact

SEQ ID NO: 743428 - DNA, 25 bp, Mus musculus
taccaagtgactctggttgccctct

SEQ ID NO: 743429 - DNA, 25 bp, Mus musculus
taccaagtgactgtggttgccctct

SEQ ID NO: 743430 - DNA, 25 bp, Mus musculus
taccaagtggaaagtgaaatagttc

SEQ ID NO: 743431 - DNA, 25 bp, Mus musculus
taccaagtggaatgtgaaatagttc

SEQ ID NO: 743432 - DNA, 25 bp, Mus musculus
taccaagtgtcccttgagaatgcag

SEQ ID NO: 743433 - DNA, 25 bp, Mus musculus
taccaagtgtccgttgagaatgcag

SEQ ID NO: 743434 - DNA, 25 bp, Mus musculus
taccaagttgaccagaggacatgtg

SEQ ID NO: 743435 - DNA, 25 bp, Mus musculus
taccaagttgacgagaggacatgtg

SEQ ID NO: 743436 - DNA, 25 bp, Mus musculus
taccaagttggaaaggtctggaggc

SEQ ID NO: 743437 - DNA, 25 bp, Mus musculus
taccaagttggataggtctggaggc

SEQ ID NO: 743438 - DNA, 25 bp, Mus musculus
taccaataagcacggagaaaagttc

SEQ ID NO: 743439 - DNA, 25 bp, Mus musculus
taccaataagcagggagaaaagttc

SEQ ID NO: 743440 - DNA, 25 bp, Mus musculus
taccaatacaatagagtctgcttac

SEQ ID NO: 743441 - DNA, 25 bp, Mus musculus
taccaatacaattgagtctgcttac

SEQ ID NO: 743442 - DNA, 25 bp, Mus musculus
taccaatatccaaacgttgaggcga

SEQ ID NO: 743443 - DNA, 25 bp, Mus musculus
taccaatatccatacgttgaggcga

SEQ ID NO: 743444 - DNA, 25 bp, Mus musculus
taccaatatgcaattctcggaagcg

SEQ ID NO: 743445 - DNA, 25 bp, Mus musculus
taccaatatgcatttctcggaagcg

SEQ ID NO: 743446 - DNA, 25 bp, Mus musculus
taccaatgcaacagtggaagacatc

SEQ ID NO: 743447 - DNA, 25 bp, Mus musculus
taccaatgcaactgtggaagacatc

SEQ ID NO: 743448 - DNA, 25 bp, Mus musculus
taccaatgcctcagtcaccagggct

SEQ ID NO: 743449 - DNA, 25 bp, Mus musculus
taccaatgcctctgtcaccagggct

SEQ ID NO: 743450 - DNA, 25 bp, Mus musculus
taccaatggctgagcaccaggctga

SEQ ID NO: 743451 - DNA, 25 bp, Mus musculus
taccaatggctgtgcaccaggctga

SEQ ID NO: 743452 - DNA, 25 bp, Mus musculus
taccaatgtcacacagcaggaatgc

SEQ ID NO: 743453 - DNA, 25 bp, Mus musculus
taccaatgtcactcagcaggaatgc

SEQ ID NO: 743454 - DNA, 25 bp, Mus musculus
taccacaagaacattacgagaaacc

SEQ ID NO: 743455 - DNA, 25 bp, Mus musculus
taccacaagaactttacgagaaacc

SEQ ID NO: 743456 - DNA, 25 bp, Mus musculus
taccacacagacatgatggcgctta

SEQ ID NO: 743457 - DNA, 25 bp, Mus musculus
taccacacagacttgatggcgctta

SEQ ID NO: 743458 - DNA, 25 bp, Mus musculus
taccacacagtacttccaggtggcg

SEQ ID NO: 743459 - DNA, 25 bp, Mus musculus
taccacacagtagttccaggtggcg

SEQ ID NO: 743460 - DNA, 25 bp, Mus musculus
taccacacattcatctggctgtagg

SEQ ID NO: 743461 - DNA, 25 bp, Mus musculus
taccacacattcttctggctgtagg

SEQ ID NO: 743462 - DNA, 25 bp, Mus musculus
taccacactgctcatgggcggcgct

SEQ ID NO: 743463 - DNA, 25 bp, Mus musculus
taccacactgctgatgggcggcgct

SEQ ID NO: 743464 - DNA, 25 bp, Mus musculus
taccacacttgcatttttccagtct

SEQ ID NO: 743465 - DNA, 25 bp, Mus musculus
taccacacttgcttttttccagtct

SEQ ID NO: 743466 - DNA, 25 bp, Mus musculus
taccacagaacactggctagtcagg

SEQ ID NO: 743467 - DNA, 25 bp, Mus musculus
taccacagaacagtggctagtcagg

SEQ ID NO: 743468 - DNA, 25 bp, Mus musculus
taccacagcaacagctagaacccaa

SEQ ID NO: 743469 - DNA, 25 bp, Mus musculus
taccacagcaactgctagaacccaa

SEQ ID NO: 743470 - DNA, 25 bp, Mus musculus
taccacagcacaccagataatggag

SEQ ID NO: 743471 - DNA, 25 bp, Mus musculus
taccacagcacagcagataatggag

SEQ ID NO: 743472 - DNA, 25 bp, Mus musculus
taccacagcgtgctctgagaggtca

SEQ ID NO: 743473 - DNA, 25 bp, Mus musculus
taccacagcgtggtctgagaggtca

SEQ ID NO: 743474 - DNA, 25 bp, Mus musculus
taccacaggcgcattgcgtgcactg

SEQ ID NO: 743475 - DNA, 25 bp, Mus musculus
taccacaggcgctttgcgtgcactg

SEQ ID NO: 743476 - DNA, 25 bp, Mus musculus
taccacaggcgtatatggccaggac

SEQ ID NO: 743477 - DNA, 25 bp, Mus musculus
taccacaggcgtttatggccaggac

SEQ ID NO: 743478 - DNA, 25 bp, Mus musculus
taccacagtatgcacatcttcactc

SEQ ID NO: 743479 - DNA, 25 bp, Mus musculus
taccacagtatggacatcttcactc

SEQ ID NO: 743480 - DNA, 25 bp, Mus musculus
taccacagtgaaactcaaagttaca

SEQ ID NO: 743481 - DNA, 25 bp, Mus musculus
taccacagtgaatctcaaagttaca

SEQ ID NO: 743482 - DNA, 25 bp, Mus musculus
taccacagtggcaatgacatgccct

SEQ ID NO: 743483 - DNA, 25 bp, Mus musculus
taccacagtggctatgacatgccct

SEQ ID NO: 743484 - DNA, 25 bp, Mus musculus
taccacagtggtaaacaaatgtctg

SEQ ID NO: 743485 - DNA, 25 bp, Mus musculus
taccacagtggtcctgggaagtact

SEQ ID NO: 743486 - DNA, 25 bp, Mus musculus
taccacagtggtgctgggaagtact

SEQ ID NO: 743487 - DNA, 25 bp, Mus musculus
taccacagtggttaacaaatgtctg

SEQ ID NO: 743488 - DNA, 25 bp, Mus musculus
taccacataaaccaggcgtggccaa

SEQ ID NO: 743489 - DNA, 25 bp, Mus musculus
taccacataaacgaggcgtggccaa

SEQ ID NO: 743490 - DNA, 25 bp, Mus musculus
taccacatccaaaaatgaaggactc

SEQ ID NO: 743491 - DNA, 25 bp, Mus musculus
taccacatccaataatgaaggactc

SEQ ID NO: 743492 - DNA, 25 bp, Mus musculus
taccacatgactccggcatccggtt

SEQ ID NO: 743493 - DNA, 25 bp, Mus musculus
taccacatgactgcggcatccggtt

SEQ ID NO: 743494 - DNA, 25 bp, Mus musculus
taccacatggacaatcacttgccca

SEQ ID NO: 743495 - DNA, 25 bp, Mus musculus
taccacatggactatcacttgccca

SEQ ID NO: 743496 - DNA, 25 bp, Mus musculus
taccacatgttcatagcgggcctat

SEQ ID NO: 743497 - DNA, 25 bp, Mus musculus
taccacatgttcttagcgggcctat

SEQ ID NO: 743498 - DNA, 25 bp, Mus musculus
taccacattacacatgaccgtacca

SEQ ID NO: 743499 - DNA, 25 bp, Mus musculus
taccacattacagatgaccgtacca

SEQ ID NO: 743500 - DNA, 25 bp, Mus musculus
taccacattcacaggacattcttgg

SEQ ID NO: 743501 - DNA, 25 bp, Mus musculus
taccacattcactggacattcttgg

SEQ ID NO: 743502 - DNA, 25 bp, Mus musculus
taccacatttgtcccaagcttgcca

SEQ ID NO: 743503 - DNA, 25 bp, Mus musculus
taccacatttgtgccaagcttgcca

SEQ ID NO: 743504 - DNA, 25 bp, Mus musculus
taccaccaacctatcagttctcaag

SEQ ID NO: 743505 - DNA, 25 bp, Mus musculus
taccaccaacctttcagttctcaag

SEQ ID NO: 743506 - DNA, 25 bp, Mus musculus
taccaccaacttcataaacgacaca

SEQ ID NO: 743507 - DNA, 25 bp, Mus musculus
taccaccaacttgataaacgacaca

SEQ ID NO: 743508 - DNA, 25 bp, Mus musculus
taccaccaagagctagtgggtgtgc

SEQ ID NO: 743509 - DNA, 25 bp, Mus musculus
taccaccaagaggtagtgggtgtgc

SEQ ID NO: 743510 - DNA, 25 bp, Mus musculus
taccaccaattaaagaaacttggca

SEQ ID NO: 743511 - DNA, 25 bp, Mus musculus
taccaccaattatagaaacttggca

SEQ ID NO: 743512 - DNA, 25 bp, Mus musculus
taccaccactctcctgtggtctatg

SEQ ID NO: 743513 - DNA, 25 bp, Mus musculus
taccaccactctgctgtggtctatg

SEQ ID NO: 743514 - DNA, 25 bp, Mus musculus
taccaccaggcgattcccatggtca

SEQ ID NO: 743515 - DNA, 25 bp, Mus musculus
taccaccaggcgtttcccatggtca

SEQ ID NO: 743516 - DNA, 25 bp, Mus musculus
taccaccatggtataagtgtcctga

SEQ ID NO: 743517 - DNA, 25 bp, Mus musculus
taccaccatggtttaagtgtcctga

SEQ ID NO: 743518 - DNA, 25 bp, Mus musculus
taccacccaaagatcaggatcatca

SEQ ID NO: 743519 - DNA, 25 bp, Mus musculus
taccacccaaagttcaggatcatca

SEQ ID NO: 743520 - DNA, 25 bp, Mus musculus
taccacccggccacaaagctggttt

SEQ ID NO: 743521 - DNA, 25 bp, Mus musculus
taccacccggcctcaaagctggttt

SEQ ID NO: 743522 - DNA, 25 bp, Mus musculus
taccaccctacaaaagatggcatga

SEQ ID NO: 743523 - DNA, 25 bp, Mus musculus
taccaccctacataagatggcatga

SEQ ID NO: 743524 - DNA, 25 bp, Mus musculus
taccaccctgataagaatccaaatg

SEQ ID NO: 743525 - DNA, 25 bp, Mus musculus
taccaccctgattagaatccaaatg

SEQ ID NO: 743526 - DNA, 25 bp, Mus musculus
taccaccgagtgaagacgcggcttc

SEQ ID NO: 743527 - DNA, 25 bp, Mus musculus
taccaccgagtgtagacgcggcttc

SEQ ID NO: 743528 - DNA, 25 bp, Mus musculus
taccaccgcatgaagccctatctat

SEQ ID NO: 743529 - DNA, 25 bp, Mus musculus
taccaccgcatgtagccctatctat

SEQ ID NO: 743530 - DNA, 25 bp, Mus musculus
taccacctagaaaacgcaggctgca

SEQ ID NO: 743531 - DNA, 25 bp, Mus musculus
taccacctagaatacgcaggctgca

SEQ ID NO: 743532 - DNA, 25 bp, Mus musculus
taccacctcagcctttgctgtaaga

SEQ ID NO: 743533 - DNA, 25 bp, Mus musculus
taccacctcagcgtttgctgtaaga

SEQ ID NO: 743534 - DNA, 25 bp, Mus musculus
taccacctcaggatcagtgccgagg

SEQ ID NO: 743535 - DNA, 25 bp, Mus musculus
taccacctcaggttcagtgccgagg

SEQ ID NO: 743536 - DNA, 25 bp, Mus musculus
taccacctcatccttgaataccatg

SEQ ID NO: 743537 - DNA, 25 bp, Mus musculus
taccacctcatcgttgaataccatg

SEQ ID NO: 743538 - DNA, 25 bp, Mus musculus
taccacctcttgaccggcagcagat

SEQ ID NO: 743539 - DNA, 25 bp, Mus musculus
taccacctcttgtccggcagcagat

SEQ ID NO: 743540 - DNA, 25 bp, Mus musculus
taccacctgcgcattgaggcagaag

SEQ ID NO: 743541 - DNA, 25 bp, Mus musculus
taccacctgcgctttgaggcagaag

SEQ ID NO: 743542 - DNA, 25 bp, Mus musculus
taccacctggagcttcatgtctgga

SEQ ID NO: 743543 - DNA, 25 bp, Mus musculus
taccacctggaggttcatgtctgga

SEQ ID NO: 743544 - DNA, 25 bp, Mus musculus
taccacctgtagaccccaaagaaat

SEQ ID NO: 743545 - DNA, 25 bp, Mus musculus
taccacctgtagtccccaaagaaat

SEQ ID NO: 743546 - DNA, 25 bp, Mus musculus
taccaccttgggactgctttaccac

SEQ ID NO: 743547 - DNA, 25 bp, Mus musculus
taccaccttgggtctgctttaccac

SEQ ID NO: 743548 - DNA, 25 bp, Mus musculus
taccacgccatcattggagggattg

SEQ ID NO: 743549 - DNA, 25 bp, Mus musculus
taccacgccatctttggagggattg

SEQ ID NO: 743550 - DNA, 25 bp, Mus musculus
taccacgccatgcaaggttaccata

SEQ ID NO: 743551 - DNA, 25 bp, Mus musculus
taccacgccatggaaggttaccata

SEQ ID NO: 743552 - DNA, 25 bp, Mus musculus
taccacgcggccatttttggaggaa

SEQ ID NO: 743553 - DNA, 25 bp, Mus musculus
taccacgcggccttttttggaggaa

SEQ ID NO: 743554 - DNA, 25 bp, Mus musculus
taccacgctactaccgaagcatttt

SEQ ID NO: 743555 - DNA, 25 bp, Mus musculus
taccacgctacttccgaagcatttt

SEQ ID NO: 743556 - DNA, 25 bp, Mus musculus
taccacgctgcgctggccgtgataa

SEQ ID NO: 743557 - DNA, 25 bp, Mus musculus
taccacgctgcggtggccgtgataa

SEQ ID NO: 743558 - DNA, 25 bp, Mus musculus
taccacggaacaagtgactgccatg

SEQ ID NO: 743559 - DNA, 25 bp, Mus musculus
taccacggaacatgtgactgccatg

SEQ ID NO: 743560 - DNA, 25 bp, Mus musculus
taccacggagacatctacacaagga

SEQ ID NO: 743561 - DNA, 25 bp, Mus musculus
taccacggagacttctacacaagga

SEQ ID NO: 743562 - DNA, 25 bp, Mus musculus
taccacggagctcgacagctggatt

SEQ ID NO: 743563 - DNA, 25 bp, Mus musculus
taccacggagctggacagctggatt

SEQ ID NO: 743564 - DNA, 25 bp, Mus musculus
taccacggcataaggaagactctcc

SEQ ID NO: 743565 - DNA, 25 bp, Mus musculus
taccacggcatatggaagactctcc

SEQ ID NO: 743566 - DNA, 25 bp, Mus musculus
taccacgtagagaggatacggacag

SEQ ID NO: 743567 - DNA, 25 bp, Mus musculus
taccacgtagagtggatacggacag

SEQ ID NO: 743568 - DNA, 25 bp, Mus musculus
taccacgttaacatatgatacacag

SEQ ID NO: 743569 - DNA, 25 bp, Mus musculus
taccacgttaacttatgatacacag

SEQ ID NO: 743570 - DNA, 25 bp, Mus musculus
taccactacggacttcacgcatgtg

SEQ ID NO: 743571 - DNA, 25 bp, Mus musculus
taccactacggagttcacgcatgtg

SEQ ID NO: 743572 - DNA, 25 bp, Mus musculus
taccactactttcagaagggccggc

SEQ ID NO: 743573 - DNA, 25 bp, Mus musculus
taccactactttgagaagggccggc

SEQ ID NO: 743574 - DNA, 25 bp, Mus musculus
taccactatcagagagtagagacgc

SEQ ID NO: 743575 - DNA, 25 bp, Mus musculus
taccactatcagtgagtagagacgc

SEQ ID NO: 743576 - DNA, 25 bp, Mus musculus
taccactatgctctctattacaggg

SEQ ID NO: 743577 - DNA, 25 bp, Mus musculus
taccactatgctgtctattacaggg

SEQ ID NO: 743578 - DNA, 25 bp, Mus musculus
taccactcctgaaataaaaaacacg

SEQ ID NO: 743579 - DNA, 25 bp, Mus musculus
taccactcctgatataaaaaacacg

SEQ ID NO: 743580 - DNA, 25 bp, Mus musculus
taccactcgagtctgtgccatctct

SEQ ID NO: 743581 - DNA, 25 bp, Mus musculus
taccactcgagtgtgtgccatctct

SEQ ID NO: 743582 - DNA, 25 bp, Mus musculus
taccactctccgctaaaagcacaga

SEQ ID NO: 743583 - DNA, 25 bp, Mus musculus
taccactctccggtaaaagcacaga

SEQ ID NO: 743584 - DNA, 25 bp, Mus musculus
taccactctgcacgtatgtgggccc

SEQ ID NO: 743585 - DNA, 25 bp, Mus musculus
taccactctgcaggtatgtgggccc

SEQ ID NO: 743586 - DNA, 25 bp, Mus musculus
taccactgagcgaactctctaagtg

SEQ ID NO: 743587 - DNA, 25 bp, Mus musculus
taccactgagcgtactctctaagtg

SEQ ID NO: 743588 - DNA, 25 bp, Mus musculus
taccactgagctcgatagtctggga

SEQ ID NO: 743589 - DNA, 25 bp, Mus musculus
taccactgagctggatagtctggga

SEQ ID NO: 743590 - DNA, 25 bp, Mus musculus
taccactgagtgagagtcccagcat

SEQ ID NO: 743591 - DNA, 25 bp, Mus musculus
taccactgagtgtgagtcccagcat

SEQ ID NO: 743592 - DNA, 25 bp, Mus musculus
taccactgatggaattcgaagatca

SEQ ID NO: 743593 - DNA, 25 bp, Mus musculus
taccactgatggtattcgaagatca

SEQ ID NO: 743594 - DNA, 25 bp, Mus musculus
taccactgcagtcaagttgatccag

SEQ ID NO: 743595 - DNA, 25 bp, Mus musculus
taccactgcagtgaagttgatccag

SEQ ID NO: 743596 - DNA, 25 bp, Mus musculus
taccactgctacagctttgaattat

SEQ ID NO: 743597 - DNA, 25 bp, Mus musculus
taccactgctactgctttgaattat

SEQ ID NO: 743598 - DNA, 25 bp, Mus musculus
taccactggcacacatgtatgagca

SEQ ID NO: 743599 - DNA, 25 bp, Mus musculus
taccactggcactcatgtatgagca

SEQ ID NO: 743600 - DNA, 25 bp, Mus musculus
taccactgtagcctttccaagagca

SEQ ID NO: 743601 - DNA, 25 bp, Mus musculus
taccactgtagcgtttccaagagca

SEQ ID NO: 743602 - DNA, 25 bp, Mus musculus
taccactgtgaacgtgtgctcagag

SEQ ID NO: 743603 - DNA, 25 bp, Mus musculus
taccactgtgaaggtgtgctcagag

SEQ ID NO: 743604 - DNA, 25 bp, Mus musculus
taccactgtgctcttgaagaatttc

SEQ ID NO: 743605 - DNA, 25 bp, Mus musculus
taccactgtgctgttgaagaatttc

SEQ ID NO: 743606 - DNA, 25 bp, Mus musculus
taccactgtggtcatgactcctcgc

SEQ ID NO: 743607 - DNA, 25 bp, Mus musculus
taccactgtggtccgcgtgtgtgaa

SEQ ID NO: 743608 - DNA, 25 bp, Mus musculus
taccactgtggtgatgactcctcgc

SEQ ID NO: 743609 - DNA, 25 bp, Mus musculus
taccactgtggtgcgcgtgtgtgaa

SEQ ID NO: 743610 - DNA, 25 bp, Mus musculus
taccacttctaacccgagccatttg

SEQ ID NO: 743611 - DNA, 25 bp, Mus musculus
taccacttctaagccgagccatttg

SEQ ID NO: 743612 - DNA, 25 bp, Mus musculus
taccagaaacatatccatttaaccc

SEQ ID NO: 743613 - DNA, 25 bp, Mus musculus
taccagaaacatcgcgaccagcgct

SEQ ID NO: 743614 - DNA, 25 bp, Mus musculus
taccagaaacatggcgaccagcgct

SEQ ID NO: 743615 - DNA, 25 bp, Mus musculus
taccagaaacatttccatttaaccc

SEQ ID NO: 743616 - DNA, 25 bp, Mus musculus
taccagaaatttcggaaggccacaa

SEQ ID NO: 743617 - DNA, 25 bp, Mus musculus
taccagaaatttgggaaggccacaa

SEQ ID NO: 743618 - DNA, 25 bp, Mus musculus
taccagaacagactgctcagacaac

SEQ ID NO: 743619 - DNA, 25 bp, Mus musculus
taccagaacagagtgctcagacaac

SEQ ID NO: 743620 - DNA, 25 bp, Mus musculus
taccagaacctgaccccggtgggct

SEQ ID NO: 743621 - DNA, 25 bp, Mus musculus
taccagaacctgtccccggtgggct

SEQ ID NO: 743622 - DNA, 25 bp, Mus musculus
taccagaactatcacaaggcccatg

SEQ ID NO: 743623 - DNA, 25 bp, Mus musculus
taccagaactatgacaaggcccatg

SEQ ID NO: 743624 - DNA, 25 bp, Mus musculus
taccagaagacgcacatcgatggaa

SEQ ID NO: 743625 - DNA, 25 bp, Mus musculus
taccagaagacggacatcgatggaa

SEQ ID NO: 743626 - DNA, 25 bp, Mus musculus
taccagaaggctatcgacatctatg

SEQ ID NO: 743627 - DNA, 25 bp, Mus musculus
taccagaaggctttcgacatctatg

SEQ ID NO: 743628 - DNA, 25 bp, Mus musculus
taccagaatgctcgttgggcaagcc

SEQ ID NO: 743629 - DNA, 25 bp, Mus musculus
taccagaatgctggttgggcaagcc

SEQ ID NO: 743630 - DNA, 25 bp, Mus musculus
taccagacactgctggtccacggtc

SEQ ID NO: 743631 - DNA, 25 bp, Mus musculus
taccagacactggtggtccacggtc

SEQ ID NO: 743632 - DNA, 25 bp, Mus musculus
taccagaccctgaggctgtgggcca

SEQ ID NO: 743633 - DNA, 25 bp, Mus musculus
taccagaccctgtggctgtgggcca

SEQ ID NO: 743634 - DNA, 25 bp, Mus musculus
taccagaccttcagcagtactacaa

SEQ ID NO: 743635 - DNA, 25 bp, Mus musculus
taccagaccttctgcagtactacaa

SEQ ID NO: 743636 - DNA, 25 bp, Mus musculus
taccagacggtgcagaggctcatcc

SEQ ID NO: 743637 - DNA, 25 bp, Mus musculus
taccagacggtggagaggctcatcc

SEQ ID NO: 743638 - DNA, 25 bp, Mus musculus
taccagacgtccaggtcagctacgg

SEQ ID NO: 743639 - DNA, 25 bp, Mus musculus
taccagacgtcctggtcagctacgg

SEQ ID NO: 743640 - DNA, 25 bp, Mus musculus
taccagacttgccaactaccttaga

SEQ ID NO: 743641 - DNA, 25 bp, Mus musculus
taccagacttgcgaactaccttaga

SEQ ID NO: 743642 - DNA, 25 bp, Mus musculus
taccagagagccctggcagcacatc

SEQ ID NO: 743643 - DNA, 25 bp, Mus musculus
taccagagagccgtggcagcacatc

SEQ ID NO: 743644 - DNA, 25 bp, Mus musculus
taccagagaggcacgttcaagaggc

SEQ ID NO: 743645 - DNA, 25 bp, Mus musculus
taccagagaggctcgttcaagaggc

SEQ ID NO: 743646 - DNA, 25 bp, Mus musculus
taccagaggagaaccttgcatgttc

SEQ ID NO: 743647 - DNA, 25 bp, Mus musculus
taccagaggagatccttgcatgttc

SEQ ID NO: 743648 - DNA, 25 bp, Mus musculus
taccagaggataatattccagttgc

SEQ ID NO: 743649 - DNA, 25 bp, Mus musculus
taccagaggatattattccagttgc

SEQ ID NO: 743650 - DNA, 25 bp, Mus musculus
taccagaggatgagtgaatgtcagc

SEQ ID NO: 743651 - DNA, 25 bp, Mus musculus
taccagaggatgtgtgaatgtcagc

SEQ ID NO: 743652 - DNA, 25 bp, Mus musculus
taccagagggtcagccttcttacct

SEQ ID NO: 743653 - DNA, 25 bp, Mus musculus
taccagagggtctgccttcttacct

SEQ ID NO: 743654 - DNA, 25 bp, Mus musculus
taccagaggtggaagcaaggaacat

SEQ ID NO: 743655 - DNA, 25 bp, Mus musculus
taccagaggtggtagcaaggaacat

SEQ ID NO: 743656 - DNA, 25 bp, Mus musculus
taccagagtcctaccgtgggtcaaa

SEQ ID NO: 743657 - DNA, 25 bp, Mus musculus
taccagagtccttccgtgggtcaaa

SEQ ID NO: 743658 - DNA, 25 bp, Mus musculus
taccagagtgccagttggttcaaac

SEQ ID NO: 743659 - DNA, 25 bp, Mus musculus
taccagagtgcctgttggttcaaac

SEQ ID NO: 743660 - DNA, 25 bp, Mus musculus
taccagatcctgattgagttatgtg

SEQ ID NO: 743661 - DNA, 25 bp, Mus musculus
taccagatcctgctctacaacggag

SEQ ID NO: 743662 - DNA, 25 bp, Mus musculus
taccagatcctggtctacaacggag

SEQ ID NO: 743663 - DNA, 25 bp, Mus musculus
taccagatcctgtttgagttatgtg

SEQ ID NO: 743664 - DNA, 25 bp, Mus musculus
taccagatcgttctcagtaacctgg

SEQ ID NO: 743665 - DNA, 25 bp, Mus musculus
taccagatcgttgtcagtaacctgg

SEQ ID NO: 743666 - DNA, 25 bp, Mus musculus
taccagatctccagagtttgccagg

SEQ ID NO: 743667 - DNA, 25 bp, Mus musculus
taccagatctcctgagtttgccagg

SEQ ID NO: 743668 - DNA, 25 bp, Mus musculus
taccagatctgcagaggtccaagcg

SEQ ID NO: 743669 - DNA, 25 bp, Mus musculus
taccagatctgcaggaatgatcggg

SEQ ID NO: 743670 - DNA, 25 bp, Mus musculus
taccagatctgctgaggtccaagcg

SEQ ID NO: 743671 - DNA, 25 bp, Mus musculus
taccagatctgctggaatgatcggg

SEQ ID NO: 743672 - DNA, 25 bp, Mus musculus
taccagatctttccggacgaggtgc

SEQ ID NO: 743673 - DNA, 25 bp, Mus musculus
taccagatctttgcggacgaggtgc

SEQ ID NO: 743674 - DNA, 25 bp, Mus musculus
taccagatgatgaagttcaacaagt

SEQ ID NO: 743675 - DNA, 25 bp, Mus musculus
taccagatgatgtagttcaacaagt

SEQ ID NO: 743676 - DNA, 25 bp, Mus musculus
taccagatgctaaaccaggctggtg

SEQ ID NO: 743677 - DNA, 25 bp, Mus musculus
taccagatgctataccaggctggtg

SEQ ID NO: 743678 - DNA, 25 bp, Mus musculus
taccagatggttcttcacaaggacc

SEQ ID NO: 743679 - DNA, 25 bp, Mus musculus
taccagatggttgttcacaaggacc

SEQ ID NO: 743680 - DNA, 25 bp, Mus musculus
taccagatgtagcaagaacactgcc

SEQ ID NO: 743681 - DNA, 25 bp, Mus musculus
taccagatgtaggaagaacactgcc

SEQ ID NO: 743682 - DNA, 25 bp, Mus musculus
taccagatttacaggcgccccactg

SEQ ID NO: 743683 - DNA, 25 bp, Mus musculus
taccagatttactggcgccccactg

SEQ ID NO: 743684 - DNA, 25 bp, Mus musculus
taccagatttcaaggtgcctgtgcg

SEQ ID NO: 743685 - DNA, 25 bp, Mus musculus
taccagatttcatggtgcctgtgcg

SEQ ID NO: 743686 - DNA, 25 bp, Mus musculus
taccagcaaaaaagacttaaaggat

SEQ ID NO: 743687 - DNA, 25 bp, Mus musculus
taccagcaaaaatgacttaaaggat

SEQ ID NO: 743688 - DNA, 25 bp, Mus musculus
taccagcaacagacattgctgaaga

SEQ ID NO: 743689 - DNA, 25 bp, Mus musculus
taccagcaacagtcattgctgaaga

SEQ ID NO: 743690 - DNA, 25 bp, Mus musculus
taccagcaaggtcaaccttgtgaag

SEQ ID NO: 743691 - DNA, 25 bp, Mus musculus
taccagcaaggtgaaccttgtgaag

SEQ ID NO: 743692 - DNA, 25 bp, Mus musculus
taccagcagataaagagttcagccc

SEQ ID NO: 743693 - DNA, 25 bp, Mus musculus
taccagcagatatagagttcagccc

SEQ ID NO: 743694 - DNA, 25 bp, Mus musculus
taccagcagctaatagaagacatcg

SEQ ID NO: 743695 - DNA, 25 bp, Mus musculus
taccagcagctattagaagacatcg

SEQ ID NO: 743696 - DNA, 25 bp, Mus musculus
taccagcaggctattggcaacagca

SEQ ID NO: 743697 - DNA, 25 bp, Mus musculus
taccagcaggcttttggcaacagca

SEQ ID NO: 743698 - DNA, 25 bp, Mus musculus
taccagcaggtacatgaggagttcc

SEQ ID NO: 743699 - DNA, 25 bp, Mus musculus
taccagcaggtagatgaggagttcc

SEQ ID NO: 743700 - DNA, 25 bp, Mus musculus
taccagcagtggaaggacttcaaag

SEQ ID NO: 743701 - DNA, 25 bp, Mus musculus
taccagcagtggctcatcagggact

SEQ ID NO: 743702 - DNA, 25 bp, Mus musculus
taccagcagtgggtcatcagggact

SEQ ID NO: 743703 - DNA, 25 bp, Mus musculus
taccagcagtggtaggacttcaaag

SEQ ID NO: 743704 - DNA, 25 bp, Mus musculus
taccagcatgctctggagtatttcc

SEQ ID NO: 743705 - DNA, 25 bp, Mus musculus
taccagcatgctgtggagtatttcc

SEQ ID NO: 743706 - DNA, 25 bp, Mus musculus
taccagccacatctggttttagcta

SEQ ID NO: 743707 - DNA, 25 bp, Mus musculus
taccagccacatgtggttttagcta

SEQ ID NO: 743708 - DNA, 25 bp, Mus musculus
taccagccacgcacttctgagggct

SEQ ID NO: 743709 - DNA, 25 bp, Mus musculus
taccagccacgctcttctgagggct

SEQ ID NO: 743710 - DNA, 25 bp, Mus musculus
taccagccagaaatccaaaagcgct

SEQ ID NO: 743711 - DNA, 25 bp, Mus musculus
taccagccagaattccaaaagcgct

SEQ ID NO: 743712 - DNA, 25 bp, Mus musculus
taccagccagtaatatttgccaaag

SEQ ID NO: 743713 - DNA, 25 bp, Mus musculus
taccagccagtattatttgccaaag

SEQ ID NO: 743714 - DNA, 25 bp, Mus musculus
taccagccatgacttgtgcaaaggg

SEQ ID NO: 743715 - DNA, 25 bp, Mus musculus
taccagccatgagttgtgcaaaggg

SEQ ID NO: 743716 - DNA, 25 bp, Mus musculus
taccagccattcagcaaaggagatc

SEQ ID NO: 743717 - DNA, 25 bp, Mus musculus
taccagccattctgcaaaggagatc

SEQ ID NO: 743718 - DNA, 25 bp, Mus musculus
taccagccctacaaaaggaggacgc

SEQ ID NO: 743719 - DNA, 25 bp, Mus musculus
taccagccctactaaaggaggacgc

SEQ ID NO: 743720 - DNA, 25 bp, Mus musculus
taccagccggaacagaggaacaaag

SEQ ID NO: 743721 - DNA, 25 bp, Mus musculus
taccagccggaagagaggaacaaag

SEQ ID NO: 743722 - DNA, 25 bp, Mus musculus
taccagcctagtcccttggaacctg

SEQ ID NO: 743723 - DNA, 25 bp, Mus musculus
taccagcctagtgccttggaacctg

SEQ ID NO: 743724 - DNA, 25 bp, Mus musculus
taccagcctgttccaagggcagagc

SEQ ID NO: 743725 - DNA, 25 bp, Mus musculus
taccagcctgttgcaagggcagagc

SEQ ID NO: 743726 - DNA, 25 bp, Mus musculus
taccagcgaggtatgaccggcttcc

SEQ ID NO: 743727 - DNA, 25 bp, Mus musculus
taccagcgaggtttgaccggcttcc

SEQ ID NO: 743728 - DNA, 25 bp, Mus musculus
taccagcgccagaacttcaaggagg

SEQ ID NO: 743729 - DNA, 25 bp, Mus musculus
taccagcgccagtacttcaaggagg

SEQ ID NO: 743730 - DNA, 25 bp, Mus musculus
taccagcgcgacaaccaggaaatag

SEQ ID NO: 743731 - DNA, 25 bp, Mus musculus
taccagcgcgactaccaggaaatag

SEQ ID NO: 743732 - DNA, 25 bp, Mus musculus
taccagcgtgatcgccccatgtgca

SEQ ID NO: 743733 - DNA, 25 bp, Mus musculus
taccagcgtgatggccccatgtgca

SEQ ID NO: 743734 - DNA, 25 bp, Mus musculus
taccagctagagcagttaatggcgc

SEQ ID NO: 743735 - DNA, 25 bp, Mus musculus
taccagctagaggagttaatggcgc

SEQ ID NO: 743736 - DNA, 25 bp, Mus musculus
taccagctcacaatgacaggccctg

SEQ ID NO: 743737 - DNA, 25 bp, Mus musculus
taccagctcacattgacaggccctg

SEQ ID NO: 743738 - DNA, 25 bp, Mus musculus
taccagctcaggaagcacctgtctc

SEQ ID NO: 743739 - DNA, 25 bp, Mus musculus
taccagctcaggtagcacctgtctc

SEQ ID NO: 743740 - DNA, 25 bp, Mus musculus
taccagctctcactgcagcgagagc

SEQ ID NO: 743741 - DNA, 25 bp, Mus musculus
taccagctctcagtgcagcgagagc

SEQ ID NO: 743742 - DNA, 25 bp, Mus musculus
taccagctgatgaaaaattggacaa

SEQ ID NO: 743743 - DNA, 25 bp, Mus musculus
taccagctgatgtaaaattggacaa

SEQ ID NO: 743744 - DNA, 25 bp, Mus musculus
taccagctgcttaagaaaatgacac

SEQ ID NO: 743745 - DNA, 25 bp, Mus musculus
taccagctgcttacagcatgcgagg

SEQ ID NO: 743746 - DNA, 25 bp, Mus musculus
taccagctgctttagaaaatgacac

SEQ ID NO: 743747 - DNA, 25 bp, Mus musculus
taccagctgctttcagcatgcgagg

SEQ ID NO: 743748 - DNA, 25 bp, Mus musculus
taccagctgtggacaaaagggcatg

SEQ ID NO: 743749 - DNA, 25 bp, Mus musculus
taccagctgtggtcaaaagggcatg

SEQ ID NO: 743750 - DNA, 25 bp, Mus musculus
taccagcttcagatcacccaggctg

SEQ ID NO: 743751 - DNA, 25 bp, Mus musculus
taccagcttcagttcacccaggctg

SEQ ID NO: 743752 - DNA, 25 bp, Mus musculus
taccaggaacgaagggacagtgtcg

SEQ ID NO: 743753 - DNA, 25 bp, Mus musculus
taccaggaacgatgggacagtgtcg

SEQ ID NO: 743754 - DNA, 25 bp, Mus musculus
taccaggaagagatcaagaggctaa

SEQ ID NO: 743755 - DNA, 25 bp, Mus musculus
taccaggaagagttcaagaggctaa

SEQ ID NO: 743756 - DNA, 25 bp, Mus musculus
taccaggaatggaccctccaatgat

SEQ ID NO: 743757 - DNA, 25 bp, Mus musculus
taccaggaatggtccctccaatgat

SEQ ID NO: 743758 - DNA, 25 bp, Mus musculus
taccaggacaatctgggaaaagagc

SEQ ID NO: 743759 - DNA, 25 bp, Mus musculus
taccaggacaatgtgggaaaagagc

SEQ ID NO: 743760 - DNA, 25 bp, Mus musculus
taccaggacagccaccataaaagag

SEQ ID NO: 743761 - DNA, 25 bp, Mus musculus
taccaggacagcgaccataaaagag

SEQ ID NO: 743762 - DNA, 25 bp, Mus musculus
taccaggagaggagcttggatcttg

SEQ ID NO: 743763 - DNA, 25 bp, Mus musculus
taccaggagaggtgcttggatcttg

SEQ ID NO: 743764 - DNA, 25 bp, Mus musculus
taccaggagccaccacgatggtcct

SEQ ID NO: 743765 - DNA, 25 bp, Mus musculus
taccaggagccagcacgatggtcct

SEQ ID NO: 743766 - DNA, 25 bp, Mus musculus
taccaggagctcatgcaactgaagg

SEQ ID NO: 743767 - DNA, 25 bp, Mus musculus
taccaggagctcttgcaactgaagg

SEQ ID NO: 743768 - DNA, 25 bp, Mus musculus
taccaggaggtgaagaggagtaatt

SEQ ID NO: 743769 - DNA, 25 bp, Mus musculus
taccaggaggtgtagaggagtaatt

SEQ ID NO: 743770 - DNA, 25 bp, Mus musculus
taccaggagttacgaggcaagaccc

SEQ ID NO: 743771 - DNA, 25 bp, Mus musculus
taccaggagttaggaggcaagaccc

SEQ ID NO: 743772 - DNA, 25 bp, Mus musculus
taccaggatcgacgacctccaaatg

SEQ ID NO: 743773 - DNA, 25 bp, Mus musculus
taccaggatcgactggccacaccag

SEQ ID NO: 743774 - DNA, 25 bp, Mus musculus
taccaggatcgaggacctccaaatg

SEQ ID NO: 743775 - DNA, 25 bp, Mus musculus
taccaggatcgagtggccacaccag

SEQ ID NO: 743776 - DNA, 25 bp, Mus musculus
taccaggatctgagagatatatgag

SEQ ID NO: 743777 - DNA, 25 bp, Mus musculus
taccaggatctgtgagatatatgag

SEQ ID NO: 743778 - DNA, 25 bp, Mus musculus
taccaggatcttctccaacgcctgg

SEQ ID NO: 743779 - DNA, 25 bp, Mus musculus
taccaggatcttgtccaacgcctgg

SEQ ID NO: 743780 - DNA, 25 bp, Mus musculus
taccaggattctaagcttcaggaga

SEQ ID NO: 743781 - DNA, 25 bp, Mus musculus
taccaggattcttagcttcaggaga

SEQ ID NO: 743782 - DNA, 25 bp, Mus musculus
taccaggccaggaagtagctgttcc

SEQ ID NO: 743783 - DNA, 25 bp, Mus musculus
taccaggccaggtagtagctgttcc

SEQ ID NO: 743784 - DNA, 25 bp, Mus musculus
taccaggcctacatcaggaccattg

SEQ ID NO: 743785 - DNA, 25 bp, Mus musculus
taccaggcctacttcaggaccattg

SEQ ID NO: 743786 - DNA, 25 bp, Mus musculus
taccagggagaaccggatgagattt

SEQ ID NO: 743787 - DNA, 25 bp, Mus musculus
taccagggagaagcggatgagattt

SEQ ID NO: 743788 - DNA, 25 bp, Mus musculus
taccagggagccatcgcacggagga

SEQ ID NO: 743789 - DNA, 25 bp, Mus musculus
taccagggagccttcgcacggagga

SEQ ID NO: 743790 - DNA, 25 bp, Mus musculus
taccagggcaccagtcgctgcgagg

SEQ ID NO: 743791 - DNA, 25 bp, Mus musculus
taccagggcacctgtcgctgcgagg

SEQ ID NO: 743792 - DNA, 25 bp, Mus musculus
taccagggccagaatgcgtggttcc

SEQ ID NO: 743793 - DNA, 25 bp, Mus musculus
taccagggccagtatgcgtggttcc

SEQ ID NO: 743794 - DNA, 25 bp, Mus musculus
taccagggctctccacaaataagct

SEQ ID NO: 743795 - DNA, 25 bp, Mus musculus
taccagggctctgcacaaataagct

SEQ ID NO: 743796 - DNA, 25 bp, Mus musculus
taccagggtcgtactgcatgatggg

SEQ ID NO: 743797 - DNA, 25 bp, Mus musculus
taccagggtcgttctgcatgatggg

SEQ ID NO: 743798 - DNA, 25 bp, Mus musculus
taccaggtctcacggcagtgacaat

SEQ ID NO: 743799 - DNA, 25 bp, Mus musculus
taccaggtctcagggcagtgacaat

SEQ ID NO: 743800 - DNA, 25 bp, Mus musculus
taccaggtgaaacctagactgaact

SEQ ID NO: 743801 - DNA, 25 bp, Mus musculus
taccaggtgaaagctagactgaact

SEQ ID NO: 743802 - DNA, 25 bp, Mus musculus
taccaggtgagcagatgcctctatc

SEQ ID NO: 743803 - DNA, 25 bp, Mus musculus
taccaggtgagctgatgcctctatc

SEQ ID NO: 743804 - DNA, 25 bp, Mus musculus
taccaggtgccacagaccatcgagt

SEQ ID NO: 743805 - DNA, 25 bp, Mus musculus
taccaggtgccagagaccatcgagt

SEQ ID NO: 743806 - DNA, 25 bp, Mus musculus
taccaggtgctaatggctaccgtgt

SEQ ID NO: 743807 - DNA, 25 bp, Mus musculus
taccaggtgctattggctaccgtgt

SEQ ID NO: 743808 - DNA, 25 bp, Mus musculus
taccaggtggctcgagatgtgcccc

SEQ ID NO: 743809 - DNA, 25 bp, Mus musculus
taccaggtggctggagatgtgcccc

SEQ ID NO: 743810 - DNA, 25 bp, Mus musculus
taccaggtgtctcagatcttcaaca

SEQ ID NO: 743811 - DNA, 25 bp, Mus musculus
taccaggtgtctgagatcttcaaca

SEQ ID NO: 743812 - DNA, 25 bp, Mus musculus
taccaggtgtggcttctacctacaa

SEQ ID NO: 743813 - DNA, 25 bp, Mus musculus
taccaggtgtgggttctacctacaa

SEQ ID NO: 743814 - DNA, 25 bp, Mus musculus
taccaggttctccagagcgacgaga

SEQ ID NO: 743815 - DNA, 25 bp, Mus musculus
taccaggttctcgagagcgacgaga

SEQ ID NO: 743816 - DNA, 25 bp, Mus musculus
taccagtacagtccgcagatggcag

SEQ ID NO: 743817 - DNA, 25 bp, Mus musculus
taccagtacagtgcgcagatggcag

SEQ ID NO: 743818 - DNA, 25 bp, Mus musculus
taccagtagaacaaggtaaatcaag

SEQ ID NO: 743819 - DNA, 25 bp, Mus musculus
taccagtagaactaggtaaatcaag

SEQ ID NO: 743820 - DNA, 25 bp, Mus musculus
taccagtagcagaggcgaggcaagt

SEQ ID NO: 743821 - DNA, 25 bp, Mus musculus
taccagtagcagtggcgaggcaagt

SEQ ID NO: 743822 - DNA, 25 bp, Mus musculus
taccagtatccacacccagaggacg

SEQ ID NO: 743823 - DNA, 25 bp, Mus musculus
taccagtatccagacccagaggacg

SEQ ID NO: 743824 - DNA, 25 bp, Mus musculus
taccagtcatctccactttttggga

SEQ ID NO: 743825 - DNA, 25 bp, Mus musculus
taccagtcatctgcactttttggga

SEQ ID NO: 743826 - DNA, 25 bp, Mus musculus
taccagtcccctatcggaagaagag

SEQ ID NO: 743827 - DNA, 25 bp, Mus musculus
taccagtcccctttcggaagaagag

SEQ ID NO: 743828 - DNA, 25 bp, Mus musculus
taccagtgaactccctgaaggatgg

SEQ ID NO: 743829 - DNA, 25 bp, Mus musculus
taccagtgaactgcctgaaggatgg

SEQ ID NO: 743830 - DNA, 25 bp, Mus musculus
taccagtgacaccaatgacatcgac

SEQ ID NO: 743831 - DNA, 25 bp, Mus musculus
taccagtgacacgaatgacatcgac

SEQ ID NO: 743832 - DNA, 25 bp, Mus musculus
taccagtgaccgattctaatgttag

SEQ ID NO: 743833 - DNA, 25 bp, Mus musculus
taccagtgaccgtttctaatgttag

SEQ ID NO: 743834 - DNA, 25 bp, Mus musculus
taccagtgacttcagcatagcgagt

SEQ ID NO: 743835 - DNA, 25 bp, Mus musculus
taccagtgacttgagcatagcgagt

SEQ ID NO: 743836 - DNA, 25 bp, Mus musculus
taccagtgcaaaaatctcagtctca

SEQ ID NO: 743837 - DNA, 25 bp, Mus musculus
taccagtgcaaatatctcagtctca

SEQ ID NO: 743838 - DNA, 25 bp, Mus musculus
taccagtggccccatggctcatggg

SEQ ID NO: 743839 - DNA, 25 bp, Mus musculus
taccagtggcccgatggctcatggg

SEQ ID NO: 743840 - DNA, 25 bp, Mus musculus
taccagtggctaatgaggtcccgac

SEQ ID NO: 743841 - DNA, 25 bp, Mus musculus
taccagtggctattgaggtcccgac

SEQ ID NO: 743842 - DNA, 25 bp, Mus musculus
taccagtggtatctgacaggcttcc

SEQ ID NO: 743843 - DNA, 25 bp, Mus musculus
taccagtggtatgtgacaggcttcc

SEQ ID NO: 743844 - DNA, 25 bp, Mus musculus
taccagtgtaatcgtgacacactat

SEQ ID NO: 743845 - DNA, 25 bp, Mus musculus
taccagtgtaatggtgacacactat

SEQ ID NO: 743846 - DNA, 25 bp, Mus musculus
taccagttagaaataaggcacagga

SEQ ID NO: 743847 - DNA, 25 bp, Mus musculus
taccagttagaattaaggcacagga

SEQ ID NO: 743848 - DNA, 25 bp, Mus musculus
taccagttcaacctctatccagaaa

SEQ ID NO: 743849 - DNA, 25 bp, Mus musculus
taccagttcaacgtctatccagaaa

SEQ ID NO: 743850 - DNA, 25 bp, Mus musculus
taccagttcaggcagagactacaaa

SEQ ID NO: 743851 - DNA, 25 bp, Mus musculus
taccagttcagggagagactacaaa

SEQ ID NO: 743852 - DNA, 25 bp, Mus musculus
taccagttccggcatcggagatgga

SEQ ID NO: 743853 - DNA, 25 bp, Mus musculus
taccagttccgggatcggagatgga

SEQ ID NO: 743854 - DNA, 25 bp, Mus musculus
taccagttgctaataaaagtccagg

SEQ ID NO: 743855 - DNA, 25 bp, Mus musculus
taccagttgctattaaaagtccagg

SEQ ID NO: 743856 - DNA, 25 bp, Mus musculus
taccagttggcgcagccttgcagtt

SEQ ID NO: 743857 - DNA, 25 bp, Mus musculus
taccagttggcggagccttgcagtt

SEQ ID NO: 743858 - DNA, 25 bp, Mus musculus
taccagttggctattcgatacaaag

SEQ ID NO: 743859 - DNA, 25 bp, Mus musculus
taccagttggcttttcgatacaaag

SEQ ID NO: 743860 - DNA, 25 bp, Mus musculus
taccagtttcaaaggtcataaaccc

SEQ ID NO: 743861 - DNA, 25 bp, Mus musculus
taccagtttcaatggtcataaaccc

SEQ ID NO: 743862 - DNA, 25 bp, Mus musculus
taccagtttgatctgctcgtgatgc

SEQ ID NO: 743863 - DNA, 25 bp, Mus musculus
taccagtttgatgtgctcgtgatgc

SEQ ID NO: 743864 - DNA, 25 bp, Mus musculus
taccagtttttgcaagatgcagtga

SEQ ID NO: 743865 - DNA, 25 bp, Mus musculus
taccagtttttggaagatgcagtga

SEQ ID NO: 743866 - DNA, 25 bp, Mus musculus
taccataactagacaagtttgaaga

SEQ ID NO: 743867 - DNA, 25 bp, Mus musculus
taccataactagtcaagtttgaaga

SEQ ID NO: 743868 - DNA, 25 bp, Mus musculus
taccataactccatagagcaaagag

SEQ ID NO: 743869 - DNA, 25 bp, Mus musculus
taccataactccttagagcaaagag

SEQ ID NO: 743870 - DNA, 25 bp, Mus musculus
taccataagctacagcgtatccggc

SEQ ID NO: 743871 - DNA, 25 bp, Mus musculus
taccataagctagagcgtatccggc

SEQ ID NO: 743872 - DNA, 25 bp, Mus musculus
taccataagctgatcacactaggaa

SEQ ID NO: 743873 - DNA, 25 bp, Mus musculus
taccataagctgttcacactaggaa

SEQ ID NO: 743874 - DNA, 25 bp, Mus musculus
taccataattaaacgatgccccaac

SEQ ID NO: 743875 - DNA, 25 bp, Mus musculus
taccataattaatcgatgccccaac

SEQ ID NO: 743876 - DNA, 25 bp, Mus musculus
taccatacctttctctgtggatgag

SEQ ID NO: 743877 - DNA, 25 bp, Mus musculus
taccatacctttgtctgtggatgag

SEQ ID NO: 743878 - DNA, 25 bp, Mus musculus
taccatactttcatagtgactgaga

SEQ ID NO: 743879 - DNA, 25 bp, Mus musculus
taccatactttcttagtgactgaga

SEQ ID NO: 743880 - DNA, 25 bp, Mus musculus
taccatagggaacatagcctttagc

SEQ ID NO: 743881 - DNA, 25 bp, Mus musculus
taccatagggaagatagcctttagc

SEQ ID NO: 743882 - DNA, 25 bp, Mus musculus
taccatagggatagtcgagggcacg

SEQ ID NO: 743883 - DNA, 25 bp, Mus musculus
taccatagggattgtcgagggcacg

SEQ ID NO: 743884 - DNA, 25 bp, Mus musculus
taccatatttacctcagtgtgtgaa

SEQ ID NO: 743885 - DNA, 25 bp, Mus musculus
taccatatttacgtcagtgtgtgaa

SEQ ID NO: 743886 - DNA, 25 bp, Mus musculus
taccatcaatgtaccttggaaccag

SEQ ID NO: 743887 - DNA, 25 bp, Mus musculus
taccatcaatgttccttggaaccag

SEQ ID NO: 743888 - DNA, 25 bp, Mus musculus
taccatcagagcaaaagtgactagg

SEQ ID NO: 743889 - DNA, 25 bp, Mus musculus
taccatcagagctaaagtgactagg

SEQ ID NO: 743890 - DNA, 25 bp, Mus musculus
taccatcagagtcgatgtaccattg

SEQ ID NO: 743891 - DNA, 25 bp, Mus musculus
taccatcagagtggatgtaccattg

SEQ ID NO: 743892 - DNA, 25 bp, Mus musculus
taccatcatagaaaggaccgtgtgg

SEQ ID NO: 743893 - DNA, 25 bp, Mus musculus
taccatcatagataggaccgtgtgg

SEQ ID NO: 743894 - DNA, 25 bp, Mus musculus
taccatccagaacctgcgctataag

SEQ ID NO: 743895 - DNA, 25 bp, Mus musculus
taccatccagaagctgcgctataag

SEQ ID NO: 743896 - DNA, 25 bp, Mus musculus
taccatccagacactgtttagtaaa

SEQ ID NO: 743897 - DNA, 25 bp, Mus musculus
taccatccagactctgtttagtaaa

SEQ ID NO: 743898 - DNA, 25 bp, Mus musculus
taccatccgcctagtgaactctcag

SEQ ID NO: 743899 - DNA, 25 bp, Mus musculus
taccatccgccttgtgaactctcag

SEQ ID NO: 743900 - DNA, 25 bp, Mus musculus
taccatcgacatcgtgcgggatgca

SEQ ID NO: 743901 - DNA, 25 bp, Mus musculus
taccatcgacatggtgcgggatgca

SEQ ID NO: 743902 - DNA, 25 bp, Mus musculus
taccatcgatgtccaggacaaagag

SEQ ID NO: 743903 - DNA, 25 bp, Mus musculus
taccatcgatgtgcaggacaaagag

SEQ ID NO: 743904 - DNA, 25 bp, Mus musculus
taccatcggaatatgagttacctca

SEQ ID NO: 743905 - DNA, 25 bp, Mus musculus
taccatcggaatttgagttacctca

SEQ ID NO: 743906 - DNA, 25 bp, Mus musculus
taccatcgggttctcagcctggagg

SEQ ID NO: 743907 - DNA, 25 bp, Mus musculus
taccatcgggttgtcagcctggagg

SEQ ID NO: 743908 - DNA, 25 bp, Mus musculus
taccatcgtgagcttggcatcaaga

SEQ ID NO: 743909 - DNA, 25 bp, Mus musculus
taccatcgtgaggttggcatcaaga

SEQ ID NO: 743910 - DNA, 25 bp, Mus musculus
taccatcgtggaaacggaactgaca

SEQ ID NO: 743911 - DNA, 25 bp, Mus musculus
taccatcgtggatacggaactgaca

SEQ ID NO: 743912 - DNA, 25 bp, Mus musculus
taccatctacaccatgtttcccgtg

SEQ ID NO: 743913 - DNA, 25 bp, Mus musculus
taccatctacacgatgtttcccgtg

SEQ ID NO: 743914 - DNA, 25 bp, Mus musculus
taccatctacctctgtcggcatggc

SEQ ID NO: 743915 - DNA, 25 bp, Mus musculus
taccatctacctgtgtcggcatggc

SEQ ID NO: 743916 - DNA, 25 bp, Mus musculus
taccatctatgaagtcctatcaaca

SEQ ID NO: 743917 - DNA, 25 bp, Mus musculus
taccatctatgatgtcctatcaaca

SEQ ID NO: 743918 - DNA, 25 bp, Mus musculus
taccatctcaaacctagatgctcgg

SEQ ID NO: 743919 - DNA, 25 bp, Mus musculus
taccatctcaaagctagatgctcgg

SEQ ID NO: 743920 - DNA, 25 bp, Mus musculus
taccatctgcagctctaactttaag

SEQ ID NO: 743921 - DNA, 25 bp, Mus musculus
taccatctgcaggtctaactttaag

SEQ ID NO: 743922 - DNA, 25 bp, Mus musculus
taccatctgggtaatgacgtcattc

SEQ ID NO: 743923 - DNA, 25 bp, Mus musculus
taccatctgggttatgacgtcattc

SEQ ID NO: 743924 - DNA, 25 bp, Mus musculus
taccatctggtccagtccgccatgc

SEQ ID NO: 743925 - DNA, 25 bp, Mus musculus
taccatctggtcgagtccgccatgc

SEQ ID NO: 743926 - DNA, 25 bp, Mus musculus
taccatcttattatggaaggaatcc

SEQ ID NO: 743927 - DNA, 25 bp, Mus musculus
taccatcttattttggaaggaatcc

SEQ ID NO: 743928 - DNA, 25 bp, Mus musculus
taccatcttggcactctggcttcca

SEQ ID NO: 743929 - DNA, 25 bp, Mus musculus
taccatcttggctctctggcttcca

SEQ ID NO: 743930 - DNA, 25 bp, Mus musculus
taccatgaagctcagtcccagccag

SEQ ID NO: 743931 - DNA, 25 bp, Mus musculus
taccatgaagctgagtcccagccag

SEQ ID NO: 743932 - DNA, 25 bp, Mus musculus
taccatgaatgaccttactgaactt

SEQ ID NO: 743933 - DNA, 25 bp, Mus musculus
taccatgaatgagcttactgaactt

SEQ ID NO: 743934 - DNA, 25 bp, Mus musculus
taccatgaccccctgtacgaacagg

SEQ ID NO: 743935 - DNA, 25 bp, Mus musculus
taccatgaccccgtgtacgaacagg

SEQ ID NO: 743936 - DNA, 25 bp, Mus musculus
taccatgactccctggcttgggctt

SEQ ID NO: 743937 - DNA, 25 bp, Mus musculus
taccatgactccgtggcttgggctt

SEQ ID NO: 743938 - DNA, 25 bp, Mus musculus
taccatgagttcagcagactactgg

SEQ ID NO: 743939 - DNA, 25 bp, Mus musculus
taccatgagttctgcagactactgg

SEQ ID NO: 743940 - DNA, 25 bp, Mus musculus
taccatgatagaacacagttactat

SEQ ID NO: 743941 - DNA, 25 bp, Mus musculus
taccatgatagatcacagttactat

SEQ ID NO: 743942 - DNA, 25 bp, Mus musculus
taccatgcaagacgctcgaagcagc

SEQ ID NO: 743943 - DNA, 25 bp, Mus musculus
taccatgcaagaggctcgaagcagc

SEQ ID NO: 743944 - DNA, 25 bp, Mus musculus
taccatgcagaacaaatccagtgca

SEQ ID NO: 743945 - DNA, 25 bp, Mus musculus
taccatgcagaagaaatccagtgca

SEQ ID NO: 743946 - DNA, 25 bp, Mus musculus
taccatgcaggtcgaaagggactgt

SEQ ID NO: 743947 - DNA, 25 bp, Mus musculus
taccatgcaggtggaaagggactgt

SEQ ID NO: 743948 - DNA, 25 bp, Mus musculus
taccatgccaatccggttttggatg

SEQ ID NO: 743949 - DNA, 25 bp, Mus musculus
taccatgccaatgcggttttggatg

SEQ ID NO: 743950 - DNA, 25 bp, Mus musculus
taccatgccttacggatgtggccgg

SEQ ID NO: 743951 - DNA, 25 bp, Mus musculus
taccatgccttagggatgtggccgg

SEQ ID NO: 743952 - DNA, 25 bp, Mus musculus
taccatgcctttacaggagcgcaga

SEQ ID NO: 743953 - DNA, 25 bp, Mus musculus
taccatgccttttcaggagcgcaga

SEQ ID NO: 743954 - DNA, 25 bp, Mus musculus
taccatgcgggcctcagtgactctg

SEQ ID NO: 743955 - DNA, 25 bp, Mus musculus
taccatgcgggcgtcagtgactctg

SEQ ID NO: 743956 - DNA, 25 bp, Mus musculus
taccatgcgggtaccatgccggttc

SEQ ID NO: 743957 - DNA, 25 bp, Mus musculus
taccatgcgggttccatgccggttc

SEQ ID NO: 743958 - DNA, 25 bp, Mus musculus
taccatgctaggagtgggtcacgtg

SEQ ID NO: 743959 - DNA, 25 bp, Mus musculus
taccatgctaggtgtgggtcacgtg

SEQ ID NO: 743960 - DNA, 25 bp, Mus musculus
taccatgctcggcattaccatctca

SEQ ID NO: 743961 - DNA, 25 bp, Mus musculus
taccatgctcgggattaccatctca

SEQ ID NO: 743962 - DNA, 25 bp, Mus musculus
taccatggaggactcgggaaagacc

SEQ ID NO: 743963 - DNA, 25 bp, Mus musculus
taccatggaggagtcgggaaagacc

SEQ ID NO: 743964 - DNA, 25 bp, Mus musculus
taccatgggaatacacggccttgcc

SEQ ID NO: 743965 - DNA, 25 bp, Mus musculus
taccatgggaattcacggccttgcc

SEQ ID NO: 743966 - DNA, 25 bp, Mus musculus
taccatggtgatagcggtggaattg

SEQ ID NO: 743967 - DNA, 25 bp, Mus musculus
taccatggtgattgcggtggaattg

SEQ ID NO: 743968 - DNA, 25 bp, Mus musculus
taccatgtcccgcagccttgatgga

SEQ ID NO: 743969 - DNA, 25 bp, Mus musculus
taccatgtcccggagccttgatgga

SEQ ID NO: 743970 - DNA, 25 bp, Mus musculus
taccatgtcgctagcaccaatcacc

SEQ ID NO: 743971 - DNA, 25 bp, Mus musculus
taccatgtcgctctctacgaggaga

SEQ ID NO: 743972 - DNA, 25 bp, Mus musculus
taccatgtcgctgtctacgaggaga

SEQ ID NO: 743973 - DNA, 25 bp, Mus musculus
taccatgtcgcttgcaccaatcacc

SEQ ID NO: 743974 - DNA, 25 bp, Mus musculus
taccatgtgatcagcccaccatatt

SEQ ID NO: 743975 - DNA, 25 bp, Mus musculus
taccatgtgatctgcccaccatatt

SEQ ID NO: 743976 - DNA, 25 bp, Mus musculus
taccatgtggaacagctggacccgg

SEQ ID NO: 743977 - DNA, 25 bp, Mus musculus
taccatgtggaagagctggacccgg

SEQ ID NO: 743978 - DNA, 25 bp, Mus musculus
taccatgtggttaggagagaggacc

SEQ ID NO: 743979 - DNA, 25 bp, Mus musculus
taccatgtggtttggagagaggacc

SEQ ID NO: 743980 - DNA, 25 bp, Mus musculus
taccatgtgtttaattatctgctgc

SEQ ID NO: 743981 - DNA, 25 bp, Mus musculus
taccatgtgttttattatctgctgc

SEQ ID NO: 743982 - DNA, 25 bp, Mus musculus
taccattagcctagcagatgtatgg

SEQ ID NO: 743983 - DNA, 25 bp, Mus musculus
taccattagccttgcagatgtatgg

SEQ ID NO: 743984 - DNA, 25 bp, Mus musculus
taccattcctgacctagcaaacctg

SEQ ID NO: 743985 - DNA, 25 bp, Mus musculus
taccattcctgagctagcaaacctg

SEQ ID NO: 743986 - DNA, 25 bp, Mus musculus
taccattcgaatcagctttgtcaag

SEQ ID NO: 743987 - DNA, 25 bp, Mus musculus
taccattcgaatgagctttgtcaag

SEQ ID NO: 743988 - DNA, 25 bp, Mus musculus
taccattgcgcaccgggaaggaagc

SEQ ID NO: 743989 - DNA, 25 bp, Mus musculus
taccattgcgcagcgggaaggaagc

SEQ ID NO: 743990 - DNA, 25 bp, Mus musculus
taccattgctatagggaggaagcag

SEQ ID NO: 743991 - DNA, 25 bp, Mus musculus
taccattgctattgggaggaagcag

SEQ ID NO: 743992 - DNA, 25 bp, Mus musculus
taccattggagtagagtttgcaaca

SEQ ID NO: 743993 - DNA, 25 bp, Mus musculus
taccattggagttgagtttgcaaca

SEQ ID NO: 743994 - DNA, 25 bp, Mus musculus
taccattgggttcttccctgctgtg

SEQ ID NO: 743995 - DNA, 25 bp, Mus musculus
taccattgggttgttccctgctgtg

SEQ ID NO: 743996 - DNA, 25 bp, Mus musculus
tacccaaaagatacaccctgtagag

SEQ ID NO: 743997 - DNA, 25 bp, Mus musculus
tacccaaaagattcaccctgtagag

SEQ ID NO: 743998 - DNA, 25 bp, Mus musculus
tacccaaaagctctaaccatgatgc

SEQ ID NO: 743999 - DNA, 25 bp, Mus musculus
tacccaaaagctgtaaccatgatgc

SEQ ID NO: 744000 - DNA, 25 bp, Mus musculus
tacccaaagcataggaaagcgttcc

SEQ ID NO: 744001 - DNA, 25 bp, Mus musculus
tacccaaagcattggaaagcgttcc

SEQ ID NO: 744002 - DNA, 25 bp, Mus musculus
tacccaacagacacctatgggattc

SEQ ID NO: 744003 - DNA, 25 bp, Mus musculus
tacccaacagactcctatgggattc

SEQ ID NO: 744004 - DNA, 25 bp, Mus musculus
tacccaacatgcctgtacagtgagg

SEQ ID NO: 744005 - DNA, 25 bp, Mus musculus
tacccaacatgcgtgtacagtgagg

SEQ ID NO: 744006 - DNA, 25 bp, Mus musculus
tacccaaggtgactgctcatcatgg

SEQ ID NO: 744007 - DNA, 25 bp, Mus musculus
tacccaaggtgagtgctcatcatgg

SEQ ID NO: 744008 - DNA, 25 bp, Mus musculus
tacccaaggttgaagccataaagaa

SEQ ID NO: 744009 - DNA, 25 bp, Mus musculus
tacccaaggttgtagccataaagaa

SEQ ID NO: 744010 - DNA, 25 bp, Mus musculus
tacccaagtgggaggtgaataagtc

SEQ ID NO: 744011 - DNA, 25 bp, Mus musculus
tacccaagtgggtggtgaataagtc

SEQ ID NO: 744012 - DNA, 25 bp, Mus musculus
tacccaatgaggaggtggtccagag

SEQ ID NO: 744013 - DNA, 25 bp, Mus musculus
tacccaatgaggtggtggtccagag

SEQ ID NO: 744014 - DNA, 25 bp, Mus musculus
tacccaatgctacaaggaaccctat

SEQ ID NO: 744015 - DNA, 25 bp, Mus musculus
tacccaatgctagaaggaaccctat

SEQ ID NO: 744016 - DNA, 25 bp, Mus musculus
tacccaatgcttacgcgatgctgcc

SEQ ID NO: 744017 - DNA, 25 bp, Mus musculus
tacccaatgctttcgcgatgctgcc

SEQ ID NO: 744018 - DNA, 25 bp, Mus musculus
tacccaatggctccctgtggctgtc

SEQ ID NO: 744019 - DNA, 25 bp, Mus musculus
tacccaatggctgcctgtggctgtc

SEQ ID NO: 744020 - DNA, 25 bp, Mus musculus
tacccaatgtgtctgaatggcctgc

SEQ ID NO: 744021 - DNA, 25 bp, Mus musculus
tacccaatgtgtgtgaatggcctgc

SEQ ID NO: 744022 - DNA, 25 bp, Mus musculus
tacccacacgagagcgagctgccgg

SEQ ID NO: 744023 - DNA, 25 bp, Mus musculus
tacccacacgagtgcgagctgccgg

SEQ ID NO: 744024 - DNA, 25 bp, Mus musculus
tacccacagatcaccccactgaaga

SEQ ID NO: 744025 - DNA, 25 bp, Mus musculus
tacccacagatctccccactgaaga

SEQ ID NO: 744026 - DNA, 25 bp, Mus musculus
tacccacatggcaccgcttgggcag

SEQ ID NO: 744027 - DNA, 25 bp, Mus musculus
tacccacatggctccgcttgggcag

SEQ ID NO: 744028 - DNA, 25 bp, Mus musculus
tacccacattgcagacgacaggtgt

SEQ ID NO: 744029 - DNA, 25 bp, Mus musculus
tacccacattgctgacgacaggtgt

SEQ ID NO: 744030 - DNA, 25 bp, Mus musculus
tacccacctggaccaaaattttgtg

SEQ ID NO: 744031 - DNA, 25 bp, Mus musculus
tacccacctggagcaaaattttgtg

SEQ ID NO: 744032 - DNA, 25 bp, Mus musculus
tacccaccttgtactctgttcagga

SEQ ID NO: 744033 - DNA, 25 bp, Mus musculus
tacccaccttgttctctgttcagga

SEQ ID NO: 744034 - DNA, 25 bp, Mus musculus
tacccacgctgaacgaaagggacac

SEQ ID NO: 744035 - DNA, 25 bp, Mus musculus
tacccacgctgatcgaaagggacac

SEQ ID NO: 744036 - DNA, 25 bp, Mus musculus
tacccacgcttcagtgactggctgt

SEQ ID NO: 744037 - DNA, 25 bp, Mus musculus
tacccacgcttctgtgactggctgt

SEQ ID NO: 744038 - DNA, 25 bp, Mus musculus
tacccacggctcctggtgaagctca

SEQ ID NO: 744039 - DNA, 25 bp, Mus musculus
tacccacggctcgtggtgaagctca

SEQ ID NO: 744040 - DNA, 25 bp, Mus musculus
tacccactcattctcttttctcatg

SEQ ID NO: 744041 - DNA, 25 bp, Mus musculus
tacccactcattgtcttttctcatg

SEQ ID NO: 744042 - DNA, 25 bp, Mus musculus
tacccactgggaatgtctgccaaca

SEQ ID NO: 744043 - DNA, 25 bp, Mus musculus
tacccactgggattgtctgccaaca

SEQ ID NO: 744044 - DNA, 25 bp, Mus musculus
tacccagaagagagcttgagcctct

SEQ ID NO: 744045 - DNA, 25 bp, Mus musculus
tacccagaagagtgcttgagcctct

SEQ ID NO: 744046 - DNA, 25 bp, Mus musculus
tacccagaccaaaggattgtcccag

SEQ ID NO: 744047 - DNA, 25 bp, Mus musculus
tacccagaccaatggattgtcccag

SEQ ID NO: 744048 - DNA, 25 bp, Mus musculus
tacccagagattcgctactgccagg

SEQ ID NO: 744049 - DNA, 25 bp, Mus musculus
tacccagagattggctactgccagg

SEQ ID NO: 744050 - DNA, 25 bp, Mus musculus
tacccagagtctcacctagggagag

SEQ ID NO: 744051 - DNA, 25 bp, Mus musculus
tacccagagtctgacctagggagag

SEQ ID NO: 744052 - DNA, 25 bp, Mus musculus
tacccagatagtcaccaacccagga

SEQ ID NO: 744053 - DNA, 25 bp, Mus musculus
tacccagatagtgaccaacccagga

SEQ ID NO: 744054 - DNA, 25 bp, Mus musculus
tacccagatcaccacatctgttgca

SEQ ID NO: 744055 - DNA, 25 bp, Mus musculus
tacccagatcacgacatctgttgca

SEQ ID NO: 744056 - DNA, 25 bp, Mus musculus
tacccagatgaacaggctatccaga

SEQ ID NO: 744057 - DNA, 25 bp, Mus musculus
tacccagatgaagaggctatccaga

SEQ ID NO: 744058 - DNA, 25 bp, Mus musculus
tacccagcagacacttactttctat

SEQ ID NO: 744059 - DNA, 25 bp, Mus musculus
tacccagcagactcttactttctat

SEQ ID NO: 744060 - DNA, 25 bp, Mus musculus
tacccagcaggacacgtgtttcaga

SEQ ID NO: 744061 - DNA, 25 bp, Mus musculus
tacccagcaggactaaaagcaacct

SEQ ID NO: 744062 - DNA, 25 bp, Mus musculus
tacccagcaggagacgtgtttcaga

SEQ ID NO: 744063 - DNA, 25 bp, Mus musculus
tacccagcaggagtaaaagcaacct

SEQ ID NO: 744064 - DNA, 25 bp, Mus musculus
tacccagcatcaataactcaggaac

SEQ ID NO: 744065 - DNA, 25 bp, Mus musculus
tacccagcatcattaactcaggaac

SEQ ID NO: 744066 - DNA, 25 bp, Mus musculus
tacccagccaaacccaagggtacat

SEQ ID NO: 744067 - DNA, 25 bp, Mus musculus
tacccagccaaagccaagggtacat

SEQ ID NO: 744068 - DNA, 25 bp, Mus musculus
tacccagcggaactgtaacctcacg

SEQ ID NO: 744069 - DNA, 25 bp, Mus musculus
tacccagcggaagtgtaacctcacg

SEQ ID NO: 744070 - DNA, 25 bp, Mus musculus
tacccagctcttatcagctacatga

SEQ ID NO: 744071 - DNA, 25 bp, Mus musculus
tacccagctcttttcagctacatga

SEQ ID NO: 744072 - DNA, 25 bp, Mus musculus
tacccaggaatcagtattaacaatg

SEQ ID NO: 744073 - DNA, 25 bp, Mus musculus
tacccaggaatctgtattaacaatg

SEQ ID NO: 744074 - DNA, 25 bp, Mus musculus
tacccaggctttatgcgagtggcac

SEQ ID NO: 744075 - DNA, 25 bp, Mus musculus
tacccaggctttttgcgagtggcac

SEQ ID NO: 744076 - DNA, 25 bp, Mus musculus
tacccagggcatctggagtctgacc

SEQ ID NO: 744077 - DNA, 25 bp, Mus musculus
tacccagggcatgtggagtctgacc

SEQ ID NO: 744078 - DNA, 25 bp, Mus musculus
tacccaggtctgcaaccagtttcgt

SEQ ID NO: 744079 - DNA, 25 bp, Mus musculus
tacccaggtctggaaccagtttcgt

SEQ ID NO: 744080 - DNA, 25 bp, Mus musculus
tacccaggttgacgactgaagaatc

SEQ ID NO: 744081 - DNA, 25 bp, Mus musculus
tacccaggttgaggactgaagaatc

SEQ ID NO: 744082 - DNA, 25 bp, Mus musculus
tacccagtaacaagtgaataaacct

SEQ ID NO: 744083 - DNA, 25 bp, Mus musculus
tacccagtaacatgtgaataaacct

SEQ ID NO: 744084 - DNA, 25 bp, Mus musculus
tacccagtcacaccagctttcttga

SEQ ID NO: 744085 - DNA, 25 bp, Mus musculus
tacccagtcacagcagctttcttga

SEQ ID NO: 744086 - DNA, 25 bp, Mus musculus
tacccagtcggcagaagatatactg

SEQ ID NO: 744087 - DNA, 25 bp, Mus musculus
tacccagtcggctgaagatatactg

SEQ ID NO: 744088 - DNA, 25 bp, Mus musculus
tacccagtttgtcaaagacttcttg

SEQ ID NO: 744089 - DNA, 25 bp, Mus musculus
tacccagtttgtgaaagacttcttg

SEQ ID NO: 744090 - DNA, 25 bp, Mus musculus
tacccatatttcacgagtagggcag

SEQ ID NO: 744091 - DNA, 25 bp, Mus musculus
tacccatatttctcgagtagggcag

SEQ ID NO: 744092 - DNA, 25 bp, Mus musculus
tacccatcacggacgacaatacctt

SEQ ID NO: 744093 - DNA, 25 bp, Mus musculus
tacccatcacggtcgacaatacctt

SEQ ID NO: 744094 - DNA, 25 bp, Mus musculus
tacccatcagctcagtgaaacactg

SEQ ID NO: 744095 - DNA, 25 bp, Mus musculus
tacccatcagctgagtgaaacactg

SEQ ID NO: 744096 - DNA, 25 bp, Mus musculus
tacccatctgttactcgtctagtga

SEQ ID NO: 744097 - DNA, 25 bp, Mus musculus
tacccatctgtttctcgtctagtga

SEQ ID NO: 744098 - DNA, 25 bp, Mus musculus
tacccatgaaggctcgaaataaaga

SEQ ID NO: 744099 - DNA, 25 bp, Mus musculus
tacccatgaagggtcgaaataaaga

SEQ ID NO: 744100 - DNA, 25 bp, Mus musculus
tacccatgcagtaaagcccttgctg

SEQ ID NO: 744101 - DNA, 25 bp, Mus musculus
tacccatgcagttaagcccttgctg

SEQ ID NO: 744102 - DNA, 25 bp, Mus musculus
tacccatggatcagccttttctcag

SEQ ID NO: 744103 - DNA, 25 bp, Mus musculus
tacccatggatctgccttttctcag

SEQ ID NO: 744104 - DNA, 25 bp, Mus musculus
tacccatgggcaaggaggtgacttc

SEQ ID NO: 744105 - DNA, 25 bp, Mus musculus
tacccatgggcatggaggtgacttc

SEQ ID NO: 744106 - DNA, 25 bp, Mus musculus
tacccatgggtcctggctctcagag

SEQ ID NO: 744107 - DNA, 25 bp, Mus musculus
tacccatgggtcgtggctctcagag

SEQ ID NO: 744108 - DNA, 25 bp, Mus musculus
tacccatgtccaagatcgctgactt

SEQ ID NO: 744109 - DNA, 25 bp, Mus musculus
tacccatgtccatgatcgctgactt

SEQ ID NO: 744110 - DNA, 25 bp, Mus musculus
tacccatgtgacctcagactctgac

SEQ ID NO: 744111 - DNA, 25 bp, Mus musculus
tacccatgtgacgtcagactctgac

SEQ ID NO: 744112 - DNA, 25 bp, Mus musculus
tacccattaaggatattagaaatct

SEQ ID NO: 744113 - DNA, 25 bp, Mus musculus
tacccattaaggttattagaaatct

SEQ ID NO: 744114 - DNA, 25 bp, Mus musculus
tacccattcctgcacacgaaggagg

SEQ ID NO: 744115 - DNA, 25 bp, Mus musculus
tacccattcctggacacgaaggagg

SEQ ID NO: 744116 - DNA, 25 bp, Mus musculus
tacccattcgctactggattttgga

SEQ ID NO: 744117 - DNA, 25 bp, Mus musculus
tacccattcgcttctggattttgga

SEQ ID NO: 744118 - DNA, 25 bp, Mus musculus
taccccaaactaaggcagacattga

SEQ ID NO: 744119 - DNA, 25 bp, Mus musculus
taccccaaactatggcagacattga

SEQ ID NO: 744120 - DNA, 25 bp, Mus musculus
taccccaaacttatccaagatgtct

SEQ ID NO: 744121 - DNA, 25 bp, Mus musculus
taccccaaacttttccaagatgtct

SEQ ID NO: 744122 - DNA, 25 bp, Mus musculus
taccccaacaccagagaaagaacct

SEQ ID NO: 744123 - DNA, 25 bp, Mus musculus
taccccaacacctgagaaagaacct

SEQ ID NO: 744124 - DNA, 25 bp, Mus musculus
taccccaagtgaagactcccatgtg

SEQ ID NO: 744125 - DNA, 25 bp, Mus musculus
taccccaagtgatgactcccatgtg

SEQ ID NO: 744126 - DNA, 25 bp, Mus musculus
taccccacagcaaggtaacagtgag

SEQ ID NO: 744127 - DNA, 25 bp, Mus musculus
taccccacagcatggtaacagtgag

SEQ ID NO: 744128 - DNA, 25 bp, Mus musculus
taccccaccatgcatgagctagctg

SEQ ID NO: 744129 - DNA, 25 bp, Mus musculus
taccccaccatggatgagctagctg

SEQ ID NO: 744130 - DNA, 25 bp, Mus musculus
taccccacctagatatccatatggg

SEQ ID NO: 744131 - DNA, 25 bp, Mus musculus
taccccacctagttatccatatggg

SEQ ID NO: 744132 - DNA, 25 bp, Mus musculus
taccccacgattacaaggcctcttg

SEQ ID NO: 744133 - DNA, 25 bp, Mus musculus
taccccacgatttcaaggcctcttg

SEQ ID NO: 744134 - DNA, 25 bp, Mus musculus
taccccagctgaatgtgtaagccag

SEQ ID NO: 744135 - DNA, 25 bp, Mus musculus
taccccagctgattgtgtaagccag

SEQ ID NO: 744136 - DNA, 25 bp, Mus musculus
taccccaggtctcgcttcagtttgc

SEQ ID NO: 744137 - DNA, 25 bp, Mus musculus
taccccaggtctggcttcagtttgc

SEQ ID NO: 744138 - DNA, 25 bp, Mus musculus
taccccagtaggatgtgttgaagac

SEQ ID NO: 744139 - DNA, 25 bp, Mus musculus
taccccagtaggttgtgttgaagac

SEQ ID NO: 744140 - DNA, 25 bp, Mus musculus
taccccatatttcagggctggaggg

SEQ ID NO: 744141 - DNA, 25 bp, Mus musculus
taccccatatttgagggctggaggg

SEQ ID NO: 744142 - DNA, 25 bp, Mus musculus
taccccatggccactctgtacgtgg

SEQ ID NO: 744143 - DNA, 25 bp, Mus musculus
taccccatggcctctctgtacgtgg

SEQ ID NO: 744144 - DNA, 25 bp, Mus musculus
taccccatggttcaagctaccagat

SEQ ID NO: 744145 - DNA, 25 bp, Mus musculus
taccccatggttgaagctaccagat

SEQ ID NO: 744146 - DNA, 25 bp, Mus musculus
taccccatgtttctgagagcctcat

SEQ ID NO: 744147 - DNA, 25 bp, Mus musculus
taccccatgtttgtgagagcctcat

SEQ ID NO: 744148 - DNA, 25 bp, Mus musculus
taccccgagattaacagtagcaggc

SEQ ID NO: 744149 - DNA, 25 bp, Mus musculus
taccccgagatttacagtagcaggc

SEQ ID NO: 744150 - DNA, 25 bp, Mus musculus
taccccgagtccaagggcgcggata

SEQ ID NO: 744151 - DNA, 25 bp, Mus musculus
taccccgagtcctagggcgcggata

SEQ ID NO: 744152 - DNA, 25 bp, Mus musculus
taccccgcgagcacaagatgtgtgg

SEQ ID NO: 744153 - DNA, 25 bp, Mus musculus
taccccgcgagctcaagatgtgtgg

SEQ ID NO: 744154 - DNA, 25 bp, Mus musculus
taccccgcttctactgggaggaccg

SEQ ID NO: 744155 - DNA, 25 bp, Mus musculus
taccccgcttcttctgggaggaccg

SEQ ID NO: 744156 - DNA, 25 bp, Mus musculus
taccccggccccagatttgttcaag

SEQ ID NO: 744157 - DNA, 25 bp, Mus musculus
taccccggcccctgatttgttcaag

SEQ ID NO: 744158 - DNA, 25 bp, Mus musculus
taccccgggcaactcatccttaagt

SEQ ID NO: 744159 - DNA, 25 bp, Mus musculus
taccccgggcaagtcatccttaagt

SEQ ID NO: 744160 - DNA, 25 bp, Mus musculus
taccccgtcggtagtacagatctga

SEQ ID NO: 744161 - DNA, 25 bp, Mus musculus
taccccgtcggttgtacagatctga

SEQ ID NO: 744162 - DNA, 25 bp, Mus musculus
taccccgtgcagcttgtggtgtgct

SEQ ID NO: 744163 - DNA, 25 bp, Mus musculus
taccccgtgcaggttgtggtgtgct

SEQ ID NO: 744164 - DNA, 25 bp, Mus musculus
taccccgttggtcgcctgtgttact

SEQ ID NO: 744165 - DNA, 25 bp, Mus musculus
taccccgttggtggcctgtgttact

SEQ ID NO: 744166 - DNA, 25 bp, Mus musculus
tacccctatctgctgctcatgatgg

SEQ ID NO: 744167 - DNA, 25 bp, Mus musculus
tacccctatctggtgctcatgatgg

SEQ ID NO: 744168 - DNA, 25 bp, Mus musculus
tacccctatgagagtgagaggcgag

SEQ ID NO: 744169 - DNA, 25 bp, Mus musculus
tacccctatgagtgtgagaggcgag

SEQ ID NO: 744170 - DNA, 25 bp, Mus musculus
tacccctatggccagtaccagttcg

SEQ ID NO: 744171 - DNA, 25 bp, Mus musculus
tacccctatggcgagtaccagttcg

SEQ ID NO: 744172 - DNA, 25 bp, Mus musculus
tacccctctgttcggctgtagaagt

SEQ ID NO: 744173 - DNA, 25 bp, Mus musculus
tacccctctgttgggctgtagaagt

SEQ ID NO: 744174 - DNA, 25 bp, Mus musculus
tacccctgaatgcaagtttaaagag

SEQ ID NO: 744175 - DNA, 25 bp, Mus musculus
tacccctgaatggaagtttaaagag

SEQ ID NO: 744176 - DNA, 25 bp, Mus musculus
tacccctgcagtctccaggatcgag

SEQ ID NO: 744177 - DNA, 25 bp, Mus musculus
tacccctgcagtgtccaggatcgag

SEQ ID NO: 744178 - DNA, 25 bp, Mus musculus
tacccctgcgacagtgatggatgaa

SEQ ID NO: 744179 - DNA, 25 bp, Mus musculus
tacccctgcgactgtgatggatgaa

SEQ ID NO: 744180 - DNA, 25 bp, Mus musculus
tacccctgggccactagtcgtgtta

SEQ ID NO: 744181 - DNA, 25 bp, Mus musculus
tacccctgggcctctagtcgtgtta

SEQ ID NO: 744182 - DNA, 25 bp, Mus musculus
taccccttcggcagacatgtctacg

SEQ ID NO: 744183 - DNA, 25 bp, Mus musculus
taccccttcggctgacatgtctacg

SEQ ID NO: 744184 - DNA, 25 bp, Mus musculus
taccccttctggacaaagtcttcca

SEQ ID NO: 744185 - DNA, 25 bp, Mus musculus
taccccttctggtcaaagtcttcca

SEQ ID NO: 744186 - DNA, 25 bp, Mus musculus
tacccgacagggatgggtctgaccc

SEQ ID NO: 744187 - DNA, 25 bp, Mus musculus
tacccgacagggttgggtctgaccc

SEQ ID NO: 744188 - DNA, 25 bp, Mus musculus
tacccgagggagctgaaacagggag

SEQ ID NO: 744189 - DNA, 25 bp, Mus musculus
tacccgagggaggtgaaacagggag

SEQ ID NO: 744190 - DNA, 25 bp, Mus musculus
tacccgaggtatagatatacaagct

SEQ ID NO: 744191 - DNA, 25 bp, Mus musculus
tacccgaggtattgatatacaagct

SEQ ID NO: 744192 - DNA, 25 bp, Mus musculus
tacccgcaagatcgaatacaagggc

SEQ ID NO: 744193 - DNA, 25 bp, Mus musculus
tacccgcaagatggaatacaagggc

SEQ ID NO: 744194 - DNA, 25 bp, Mus musculus
tacccgccatgaccctgtgggcgtg

SEQ ID NO: 744195 - DNA, 25 bp, Mus musculus
tacccgccatgagcctgtgggcgtg

SEQ ID NO: 744196 - DNA, 25 bp, Mus musculus
tacccgcgatgtcctgctggtctct

SEQ ID NO: 744197 - DNA, 25 bp, Mus musculus
tacccgcgatgtgctgctggtctct

SEQ ID NO: 744198 - DNA, 25 bp, Mus musculus
tacccgcgtctgcagttggaactac

SEQ ID NO: 744199 - DNA, 25 bp, Mus musculus
tacccgcgtctggagttggaactac

SEQ ID NO: 744200 - DNA, 25 bp, Mus musculus
tacccgctagttcctggcagtggac

SEQ ID NO: 744201 - DNA, 25 bp, Mus musculus
tacccgctagttgctggcagtggac

SEQ ID NO: 744202 - DNA, 25 bp, Mus musculus
tacccgctgaacaaccaactgaatg

SEQ ID NO: 744203 - DNA, 25 bp, Mus musculus
tacccgctgaactaccaactgaatg

SEQ ID NO: 744204 - DNA, 25 bp, Mus musculus
tacccgctggtgcatgtggtctgtc

SEQ ID NO: 744205 - DNA, 25 bp, Mus musculus
tacccgctggtggatgtggtctgtc

SEQ ID NO: 744206 - DNA, 25 bp, Mus musculus
tacccgctgtatagctacctcgagg

SEQ ID NO: 744207 - DNA, 25 bp, Mus musculus
tacccgctgtattgctacctcgagg

SEQ ID NO: 744208 - DNA, 25 bp, Mus musculus
tacccgctgtgcaacgagaacttca

SEQ ID NO: 744209 - DNA, 25 bp, Mus musculus
tacccgctgtgctacgagaacttca

SEQ ID NO: 744210 - DNA, 25 bp, Mus musculus
tacccgcttaccaattatacttttg

SEQ ID NO: 744211 - DNA, 25 bp, Mus musculus
tacccgcttacctattatacttttg

SEQ ID NO: 744212 - DNA, 25 bp, Mus musculus
tacccgcttcccagctgaaaaggtg

SEQ ID NO: 744213 - DNA, 25 bp, Mus musculus
tacccgcttccctgctgaaaaggtg

SEQ ID NO: 744214 - DNA, 25 bp, Mus musculus
tacccggagcagatctcctacatgc

SEQ ID NO: 744215 - DNA, 25 bp, Mus musculus
tacccggagcagttctcctacatgc

SEQ ID NO: 744216 - DNA, 25 bp, Mus musculus
tacccggatgctattgttcgagaag

SEQ ID NO: 744217 - DNA, 25 bp, Mus musculus
tacccggatgcttttgttcgagaag

SEQ ID NO: 744218 - DNA, 25 bp, Mus musculus
tacccggatttaagatgtaccccat

SEQ ID NO: 744219 - DNA, 25 bp, Mus musculus
tacccggatttatgatgtaccccat

SEQ ID NO: 744220 - DNA, 25 bp, Mus musculus
tacccggcatgaactggagagaagt

SEQ ID NO: 744221 - DNA, 25 bp, Mus musculus
tacccggcatgatctggagagaagt

SEQ ID NO: 744222 - DNA, 25 bp, Mus musculus
tacccggccctcatggactgcatga

SEQ ID NO: 744223 - DNA, 25 bp, Mus musculus
tacccggccctcttggactgcatga

SEQ ID NO: 744224 - DNA, 25 bp, Mus musculus
tacccgggaggaagatggagcaaac

SEQ ID NO: 744225 - DNA, 25 bp, Mus musculus
tacccgggaggatgatggagcaaac

SEQ ID NO: 744226 - DNA, 25 bp, Mus musculus
tacccgggcttgaagcctagtgcgg

SEQ ID NO: 744227 - DNA, 25 bp, Mus musculus
tacccgggcttgtagcctagtgcgg

SEQ ID NO: 744228 - DNA, 25 bp, Mus musculus
tacccggggctgatctgggaaaatg

SEQ ID NO: 744229 - DNA, 25 bp, Mus musculus
tacccggggctgttctgggaaaatg

SEQ ID NO: 744230 - DNA, 25 bp, Mus musculus
tacccgggttttcgagcaccgcgag

SEQ ID NO: 744231 - DNA, 25 bp, Mus musculus
tacccgggttttggagcaccgcgag

SEQ ID NO: 744232 - DNA, 25 bp, Mus musculus
tacccggtcacacgaacctttgatg

SEQ ID NO: 744233 - DNA, 25 bp, Mus musculus
tacccggtcacaggaacctttgatg

SEQ ID NO: 744234 - DNA, 25 bp, Mus musculus
tacccggtcctcaaggaagatgctc

SEQ ID NO: 744235 - DNA, 25 bp, Mus musculus
tacccggtcctctaggaagatgctc

SEQ ID NO: 744236 - DNA, 25 bp, Mus musculus
tacccggtccttagacagtggcagc

SEQ ID NO: 744237 - DNA, 25 bp, Mus musculus
tacccggtcctttgacagtggcagc

SEQ ID NO: 744238 - DNA, 25 bp, Mus musculus
tacccggtggaacttctgctgaaag

SEQ ID NO: 744239 - DNA, 25 bp, Mus musculus
tacccggtggaagttctgctgaaag

SEQ ID NO: 744240 - DNA, 25 bp, Mus musculus
tacccggtgtgtattgctgcagcca

SEQ ID NO: 744241 - DNA, 25 bp, Mus musculus
tacccggtgtgttttgctgcagcca

SEQ ID NO: 744242 - DNA, 25 bp, Mus musculus
tacccggtttgaagaggtcttctgg

SEQ ID NO: 744243 - DNA, 25 bp, Mus musculus
tacccggtttgatgaggtcttctgg

SEQ ID NO: 744244 - DNA, 25 bp, Mus musculus
tacccgtactgtcgaaatgagcatg

SEQ ID NO: 744245 - DNA, 25 bp, Mus musculus
tacccgtactgtggaaatgagcatg

SEQ ID NO: 744246 - DNA, 25 bp, Mus musculus
tacccgtcccgcctgtttgtgggag

SEQ ID NO: 744247 - DNA, 25 bp, Mus musculus
tacccgtcccgcgtgtttgtgggag

SEQ ID NO: 744248 - DNA, 25 bp, Mus musculus
tacccgtctctgcaaacttgatcga

SEQ ID NO: 744249 - DNA, 25 bp, Mus musculus
tacccgtctctggaaacttgatcga

SEQ ID NO: 744250 - DNA, 25 bp, Mus musculus
tacccgtgatgaccagagcttggcc

SEQ ID NO: 744251 - DNA, 25 bp, Mus musculus
tacccgtgatgagcagagcttggcc

SEQ ID NO: 744252 - DNA, 25 bp, Mus musculus
tacccgtggctaacaatcttcatgg

SEQ ID NO: 744253 - DNA, 25 bp, Mus musculus
tacccgtggctatcaatcttcatgg

SEQ ID NO: 744254 - DNA, 25 bp, Mus musculus
tacccgttgaagagaagaacgagac

SEQ ID NO: 744255 - DNA, 25 bp, Mus musculus
tacccgttgaagtgaagaacgagac

SEQ ID NO: 744256 - DNA, 25 bp, Mus musculus
taccctaagggaaacggtactgctg

SEQ ID NO: 744257 - DNA, 25 bp, Mus musculus
taccctaagggatacggtactgctg

SEQ ID NO: 744258 - DNA, 25 bp, Mus musculus
taccctaagtgcacactgcacgaag

SEQ ID NO: 744259 - DNA, 25 bp, Mus musculus
taccctaagtgctcactgcacgaag

SEQ ID NO: 744260 - DNA, 25 bp, Mus musculus
taccctacactcaggaccgagcaag

SEQ ID NO: 744261 - DNA, 25 bp, Mus musculus
taccctacactctggaccgagcaag

SEQ ID NO: 744262 - DNA, 25 bp, Mus musculus
taccctacccacaaacagatgagtt

SEQ ID NO: 744263 - DNA, 25 bp, Mus musculus
taccctacccactaacagatgagtt

SEQ ID NO: 744264 - DNA, 25 bp, Mus musculus
taccctacgggactcgctgatgaga

SEQ ID NO: 744265 - DNA, 25 bp, Mus musculus
taccctacgggagtcgctgatgaga

SEQ ID NO: 744266 - DNA, 25 bp, Mus musculus
taccctactgccatgcgaatgagga

SEQ ID NO: 744267 - DNA, 25 bp, Mus musculus
taccctactgccttgcgaatgagga

SEQ ID NO: 744268 - DNA, 25 bp, Mus musculus
taccctagccaacctgggtaggtgg

SEQ ID NO: 744269 - DNA, 25 bp, Mus musculus
taccctagccaagctgggtaggtgg

SEQ ID NO: 744270 - DNA, 25 bp, Mus musculus
taccctagccggatgattgtgtatg

SEQ ID NO: 744271 - DNA, 25 bp, Mus musculus
taccctagccggttgattgtgtatg

SEQ ID NO: 744272 - DNA, 25 bp, Mus musculus
taccctagtggacgacaaaaccaag

SEQ ID NO: 744273 - DNA, 25 bp, Mus musculus
taccctagtggaggacaaaaccaag

SEQ ID NO: 744274 - DNA, 25 bp, Mus musculus
taccctagttacaaaaactacacag

SEQ ID NO: 744275 - DNA, 25 bp, Mus musculus
taccctagttactaaaactacacag

SEQ ID NO: 744276 - DNA, 25 bp, Mus musculus
taccctatccgtagcacagtgatgg

SEQ ID NO: 744277 - DNA, 25 bp, Mus musculus
taccctatccgttgcacagtgatgg

SEQ ID NO: 744278 - DNA, 25 bp, Mus musculus
taccctatctggcacctaggattgc

SEQ ID NO: 744279 - DNA, 25 bp, Mus musculus
taccctatctgggacctaggattgc

SEQ ID NO: 744280 - DNA, 25 bp, Mus musculus
taccctcagggcaggtctgccacga

SEQ ID NO: 744281 - DNA, 25 bp, Mus musculus
taccctcagggctggtctgccacga

SEQ ID NO: 744282 - DNA, 25 bp, Mus musculus
taccctcccttcctatgatcgtagg

SEQ ID NO: 744283 - DNA, 25 bp, Mus musculus
taccctcccttcgtatgatcgtagg

SEQ ID NO: 744284 - DNA, 25 bp, Mus musculus
taccctctcaggcatatgagattct

SEQ ID NO: 744285 - DNA, 25 bp, Mus musculus
taccctctcagggatatgagattct

SEQ ID NO: 744286 - DNA, 25 bp, Mus musculus
taccctctctgcattgctgcggact

SEQ ID NO: 744287 - DNA, 25 bp, Mus musculus
taccctctctgctttgctgcggact

SEQ ID NO: 744288 - DNA, 25 bp, Mus musculus
taccctctgagcataacagtttcaa

SEQ ID NO: 744289 - DNA, 25 bp, Mus musculus
taccctctgagcttaacagtttcaa

SEQ ID NO: 744290 - DNA, 25 bp, Mus musculus
taccctctgcccatctaataaatgc

SEQ ID NO: 744291 - DNA, 25 bp, Mus musculus
taccctctgcccttctaataaatgc

SEQ ID NO: 744292 - DNA, 25 bp, Mus musculus
taccctcttaccctggaatgcctgg

SEQ ID NO: 744293 - DNA, 25 bp, Mus musculus
taccctcttaccgtggaatgcctgg

SEQ ID NO: 744294 - DNA, 25 bp, Mus musculus
taccctcttataccagttggcaaac

SEQ ID NO: 744295 - DNA, 25 bp, Mus musculus
taccctcttatagcagttggcaaac

SEQ ID NO: 744296 - DNA, 25 bp, Mus musculus
taccctgaaactcggaatcagttca

SEQ ID NO: 744297 - DNA, 25 bp, Mus musculus
taccctgaaactgggaatcagttca

SEQ ID NO: 744298 - DNA, 25 bp, Mus musculus
taccctgaactgaagctagcttatg

SEQ ID NO: 744299 - DNA, 25 bp, Mus musculus
taccctgaactgtagctagcttatg

SEQ ID NO: 744300 - DNA, 25 bp, Mus musculus
taccctgagaccagtgtcctttttc

SEQ ID NO: 744301 - DNA, 25 bp, Mus musculus
taccctgagacctgtgtcctttttc

SEQ ID NO: 744302 - DNA, 25 bp, Mus musculus
taccctgagcggagctgaccccgag

SEQ ID NO: 744303 - DNA, 25 bp, Mus musculus
taccctgagcggtgctgaccccgag

SEQ ID NO: 744304 - DNA, 25 bp, Mus musculus
taccctgaggcaccggcgaccaagg

SEQ ID NO: 744305 - DNA, 25 bp, Mus musculus
taccctgaggcagcggcgaccaagg

SEQ ID NO: 744306 - DNA, 25 bp, Mus musculus
taccctgatcgtctggactacgtcg

SEQ ID NO: 744307 - DNA, 25 bp, Mus musculus
taccctgatcgtgtggactacgtcg

SEQ ID NO: 744308 - DNA, 25 bp, Mus musculus
taccctgatgaaagcgcgaagtgaa

SEQ ID NO: 744309 - DNA, 25 bp, Mus musculus
taccctgatgaatgcgcgaagtgaa

SEQ ID NO: 744310 - DNA, 25 bp, Mus musculus
taccctgatgctcgctgtcgtcaca

SEQ ID NO: 744311 - DNA, 25 bp, Mus musculus
taccctgatgctggctgtcgtcaca

SEQ ID NO: 744312 - DNA, 25 bp, Mus musculus
taccctgattcccacttgtaatttc

SEQ ID NO: 744313 - DNA, 25 bp, Mus musculus
taccctgattccgacttgtaatttc

SEQ ID NO: 744314 - DNA, 25 bp, Mus musculus
taccctgcacccattagtctgcagg

SEQ ID NO: 744315 - DNA, 25 bp, Mus musculus
taccctgcaccctttagtctgcagg

SEQ ID NO: 744316 - DNA, 25 bp, Mus musculus
taccctgcatagagcaaggaccctg

SEQ ID NO: 744317 - DNA, 25 bp, Mus musculus
taccctgcatagtgcaaggaccctg

SEQ ID NO: 744318 - DNA, 25 bp, Mus musculus
taccctgcattcagcaaatccagag

SEQ ID NO: 744319 - DNA, 25 bp, Mus musculus
taccctgcattctgcaaatccagag

SEQ ID NO: 744320 - DNA, 25 bp, Mus musculus
taccctgccctcaaggaaaaggaag

SEQ ID NO: 744321 - DNA, 25 bp, Mus musculus
taccctgccctctaggaaaaggaag

SEQ ID NO: 744322 - DNA, 25 bp, Mus musculus
taccctgcgcttcgaatggttgctc

SEQ ID NO: 744323 - DNA, 25 bp, Mus musculus
taccctgcgcttggaatggttgctc

SEQ ID NO: 744324 - DNA, 25 bp, Mus musculus
taccctgctgggagtccagactgac

SEQ ID NO: 744325 - DNA, 25 bp, Mus musculus
taccctgctgggtgtccagactgac

SEQ ID NO: 744326 - DNA, 25 bp, Mus musculus
taccctgctgtgcaaatgtgatgga

SEQ ID NO: 744327 - DNA, 25 bp, Mus musculus
taccctgctgtggaaatgtgatgga

SEQ ID NO: 744328 - DNA, 25 bp, Mus musculus
taccctggaagcatttcggtcgtag

SEQ ID NO: 744329 - DNA, 25 bp, Mus musculus
taccctggaagcttttcggtcgtag

SEQ ID NO: 744330 - DNA, 25 bp, Mus musculus
taccctggagacaacacactgtgtg

SEQ ID NO: 744331 - DNA, 25 bp, Mus musculus
taccctggagactacacactgtgtg

SEQ ID NO: 744332 - DNA, 25 bp, Mus musculus
taccctggataccttggacctgctg

SEQ ID NO: 744333 - DNA, 25 bp, Mus musculus
taccctggatacgttggacctgctg

SEQ ID NO: 744334 - DNA, 25 bp, Mus musculus
taccctggccctagggtcaaggcta

SEQ ID NO: 744335 - DNA, 25 bp, Mus musculus
taccctggcccttgggtcaaggcta

SEQ ID NO: 744336 - DNA, 25 bp, Mus musculus
taccctggcgagcagcaaaagagac

SEQ ID NO: 744337 - DNA, 25 bp, Mus musculus
taccctggcgaggagcaaaagagac

SEQ ID NO: 744338 - DNA, 25 bp, Mus musculus
taccctggcttaaggagcgacagcc

SEQ ID NO: 744339 - DNA, 25 bp, Mus musculus
taccctggcttatggagcgacagcc

SEQ ID NO: 744340 - DNA, 25 bp, Mus musculus
taccctgggagtcgctggacatttt

SEQ ID NO: 744341 - DNA, 25 bp, Mus musculus
taccctgggagtggctggacatttt

SEQ ID NO: 744342 - DNA, 25 bp, Mus musculus
taccctgggcaccagtgagccatac

SEQ ID NO: 744343 - DNA, 25 bp, Mus musculus
taccctgggcacgagtgagccatac

SEQ ID NO: 744344 - DNA, 25 bp, Mus musculus
taccctgggtacagaaatgtggcat

SEQ ID NO: 744345 - DNA, 25 bp, Mus musculus
taccctgggtactgaaatgtggcat

SEQ ID NO: 744346 - DNA, 25 bp, Mus musculus
taccctgggtgaatttggaagtccg

SEQ ID NO: 744347 - DNA, 25 bp, Mus musculus
taccctgggtgattttggaagtccg

SEQ ID NO: 744348 - DNA, 25 bp, Mus musculus
taccctggtgatcgccctctgcagt

SEQ ID NO: 744349 - DNA, 25 bp, Mus musculus
taccctggtgatggccctctgcagt

SEQ ID NO: 744350 - DNA, 25 bp, Mus musculus
taccctgtgactactggactcttgc

SEQ ID NO: 744351 - DNA, 25 bp, Mus musculus
taccctgtgacttctggactcttgc

SEQ ID NO: 744352 - DNA, 25 bp, Mus musculus
taccctgtggaccatggtgtcccct

SEQ ID NO: 744353 - DNA, 25 bp, Mus musculus
taccctgtggacgatggtgtcccct

SEQ ID NO: 744354 - DNA, 25 bp, Mus musculus
taccctgtggccataagtcttgcat

SEQ ID NO: 744355 - DNA, 25 bp, Mus musculus
taccctgtggccttaagtcttgcat

SEQ ID NO: 744356 - DNA, 25 bp, Mus musculus
taccctgtgggcagggctgtgtccc

SEQ ID NO: 744357 - DNA, 25 bp, Mus musculus
taccctgtgggctgggctgtgtccc

SEQ ID NO: 744358 - DNA, 25 bp, Mus musculus
taccctgtgtccagagccttcataa

SEQ ID NO: 744359 - DNA, 25 bp, Mus musculus
taccctgtgtcctgagccttcataa

SEQ ID NO: 744360 - DNA, 25 bp, Mus musculus
taccctgtgtgaagacgccatctgg

SEQ ID NO: 744361 - DNA, 25 bp, Mus musculus
taccctgtgtgatgacgccatctgg

SEQ ID NO: 744362 - DNA, 25 bp, Mus musculus
tacccttacaagcaagacaccatac

SEQ ID NO: 744363 - DNA, 25 bp, Mus musculus
tacccttacaaggaagacaccatac

SEQ ID NO: 744364 - DNA, 25 bp, Mus musculus
tacccttcagcacacgccggagaga

SEQ ID NO: 744365 - DNA, 25 bp, Mus musculus
tacccttcagcagacgccggagaga

SEQ ID NO: 744366 - DNA, 25 bp, Mus musculus
tacccttcggtcaggactcaagttg

SEQ ID NO: 744367 - DNA, 25 bp, Mus musculus
tacccttcggtctggactcaagttg

SEQ ID NO: 744368 - DNA, 25 bp, Mus musculus
tacccttcgtctagggaaacagatt

SEQ ID NO: 744369 - DNA, 25 bp, Mus musculus
tacccttcgtcttgggaaacagatt

SEQ ID NO: 744370 - DNA, 25 bp, Mus musculus
tacccttcttcacggaccaagtatc

SEQ ID NO: 744371 - DNA, 25 bp, Mus musculus
tacccttcttcagggaccaagtatc

SEQ ID NO: 744372 - DNA, 25 bp, Mus musculus
tacccttgataaagttctaggccgg

SEQ ID NO: 744373 - DNA, 25 bp, Mus musculus
tacccttgataatgttctaggccgg

SEQ ID NO: 744374 - DNA, 25 bp, Mus musculus
tacccttgattgaaaggctccaaag

SEQ ID NO: 744375 - DNA, 25 bp, Mus musculus
tacccttgattgtaaggctccaaag

SEQ ID NO: 744376 - DNA, 25 bp, Mus musculus
tacccttggtcaaggtcagtgtgaa

SEQ ID NO: 744377 - DNA, 25 bp, Mus musculus
tacccttggtcatggtcagtgtgaa

SEQ ID NO: 744378 - DNA, 25 bp, Mus musculus
tacccttgtcttcctttcaggagag

SEQ ID NO: 744379 - DNA, 25 bp, Mus musculus
tacccttgtcttgctttcaggagag

SEQ ID NO: 744380 - DNA, 25 bp, Mus musculus
tacccttgtgctataggacggacct

SEQ ID NO: 744381 - DNA, 25 bp, Mus musculus
tacccttgtgctttaggacggacct

SEQ ID NO: 744382 - DNA, 25 bp, Mus musculus
taccctttgtctcaccacaaggtgg

SEQ ID NO: 744383 - DNA, 25 bp, Mus musculus
taccctttgtctgaccacaaggtgg

SEQ ID NO: 744384 - DNA, 25 bp, Mus musculus
taccgaaaagaaccacccatgttgt

SEQ ID NO: 744385 - DNA, 25 bp, Mus musculus
taccgaaaagaacttctacagaaat

SEQ ID NO: 744386 - DNA, 25 bp, Mus musculus
taccgaaaagaagcacccatgttgt

SEQ ID NO: 744387 - DNA, 25 bp, Mus musculus
taccgaaaagaagttctacagaaat

SEQ ID NO: 744388 - DNA, 25 bp, Mus musculus
taccgaaaagtgagggaaatctacg

SEQ ID NO: 744389 - DNA, 25 bp, Mus musculus
taccgaaaagtgtgggaaatctacg

SEQ ID NO: 744390 - DNA, 25 bp, Mus musculus
taccgaaagaacctccagaaaacag

SEQ ID NO: 744391 - DNA, 25 bp, Mus musculus
taccgaaagaacgtccagaaaacag

SEQ ID NO: 744392 - DNA, 25 bp, Mus musculus
taccgaaagaggattggcttgaagc

SEQ ID NO: 744393 - DNA, 25 bp, Mus musculus
taccgaaagaggtttggcttgaagc

SEQ ID NO: 744394 - DNA, 25 bp, Mus musculus
taccgaaagctgagcagcaaccttg

SEQ ID NO: 744395 - DNA, 25 bp, Mus musculus
taccgaaagctgtgcagcaaccttg

SEQ ID NO: 744396 - DNA, 25 bp, Mus musculus
taccgaagccatccttcttgcagca

SEQ ID NO: 744397 - DNA, 25 bp, Mus musculus
taccgaagccatgcttcttgcagca

SEQ ID NO: 744398 - DNA, 25 bp, Mus musculus
taccgaaggatgagcacgaaggaca

SEQ ID NO: 744399 - DNA, 25 bp, Mus musculus
taccgaaggatgtgcacgaaggaca

SEQ ID NO: 744400 - DNA, 25 bp, Mus musculus
taccgaagggagatcttacctgaag

SEQ ID NO: 744401 - DNA, 25 bp, Mus musculus
taccgaagggagttcttacctgaag

SEQ ID NO: 744402 - DNA, 25 bp, Mus musculus
taccgaatggtgacacagacgggcc

SEQ ID NO: 744403 - DNA, 25 bp, Mus musculus
taccgaatggtgtcacagacgggcc

SEQ ID NO: 744404 - DNA, 25 bp, Mus musculus
taccgaatttgtcctatccctagag

SEQ ID NO: 744405 - DNA, 25 bp, Mus musculus
taccgaatttgtgctatccctagag

SEQ ID NO: 744406 - DNA, 25 bp, Mus musculus
taccgacaaaacaggcctctcctta

SEQ ID NO: 744407 - DNA, 25 bp, Mus musculus
taccgacaaaactggcctctcctta

SEQ ID NO: 744408 - DNA, 25 bp, Mus musculus
taccgacaccctaggttctgcagag

SEQ ID NO: 744409 - DNA, 25 bp, Mus musculus
taccgacacccttggttctgcagag

SEQ ID NO: 744410 - DNA, 25 bp, Mus musculus
taccgacagctcaatgagaagctgg

SEQ ID NO: 744411 - DNA, 25 bp, Mus musculus
taccgacagctctatgagaagctgg

SEQ ID NO: 744412 - DNA, 25 bp, Mus musculus
taccgacctaccaagaactacctga

SEQ ID NO: 744413 - DNA, 25 bp, Mus musculus
taccgacctacctagaactacctga

SEQ ID NO: 744414 - DNA, 25 bp, Mus musculus
taccgacctctgaagcaggaactcc

SEQ ID NO: 744415 - DNA, 25 bp, Mus musculus
taccgacctctgtagcaggaactcc

SEQ ID NO: 744416 - DNA, 25 bp, Mus musculus
taccgacttgttccctatggaaatc

SEQ ID NO: 744417 - DNA, 25 bp, Mus musculus
taccgacttgttgcctatggaaatc

SEQ ID NO: 744418 - DNA, 25 bp, Mus musculus
taccgagaagagactctgagcatca

SEQ ID NO: 744419 - DNA, 25 bp, Mus musculus
taccgagaagagtctctgagcatca

SEQ ID NO: 744420 - DNA, 25 bp, Mus musculus
taccgagaagcgacgggaatggcac

SEQ ID NO: 744421 - DNA, 25 bp, Mus musculus
taccgagaagcgtcgggaatggcac

SEQ ID NO: 744422 - DNA, 25 bp, Mus musculus
taccgagactgcctcaccaagtgga

SEQ ID NO: 744423 - DNA, 25 bp, Mus musculus
taccgagactgcgtcaccaagtgga

SEQ ID NO: 744424 - DNA, 25 bp, Mus musculus
taccgagagtctcagtcctggacag

SEQ ID NO: 744425 - DNA, 25 bp, Mus musculus
taccgagagtctgagtcctggacag

SEQ ID NO: 744426 - DNA, 25 bp, Mus musculus
taccgagcgctgaacccctttgaat

SEQ ID NO: 744427 - DNA, 25 bp, Mus musculus
taccgagcgctgtacccctttgaat

SEQ ID NO: 744428 - DNA, 25 bp, Mus musculus
taccgagctgtcctggcattgagag

SEQ ID NO: 744429 - DNA, 25 bp, Mus musculus
taccgagctgtcgtggcattgagag

SEQ ID NO: 744430 - DNA, 25 bp, Mus musculus
taccgaggacgactgcagggccacc

SEQ ID NO: 744431 - DNA, 25 bp, Mus musculus
taccgaggacgagtgcagggccacc

SEQ ID NO: 744432 - DNA, 25 bp, Mus musculus
taccgaggcaggcatcttggcttcc

SEQ ID NO: 744433 - DNA, 25 bp, Mus musculus
taccgaggcagggatcttggcttcc

SEQ ID NO: 744434 - DNA, 25 bp, Mus musculus
taccgaggccagaacaacacctatc

SEQ ID NO: 744435 - DNA, 25 bp, Mus musculus
taccgaggccagtacaacacctatc

SEQ ID NO: 744436 - DNA, 25 bp, Mus musculus
taccgaggctataaaagcacagttt

SEQ ID NO: 744437 - DNA, 25 bp, Mus musculus
taccgaggctattaaagcacagttt

SEQ ID NO: 744438 - DNA, 25 bp, Mus musculus
taccgaggcttcacccatcaatctg

SEQ ID NO: 744439 - DNA, 25 bp, Mus musculus
taccgaggcttctcccatcaatctg

SEQ ID NO: 744440 - DNA, 25 bp, Mus musculus
taccgagggaagctcattgaagcag

SEQ ID NO: 744441 - DNA, 25 bp, Mus musculus
taccgagggaaggtcattgaagcag

SEQ ID NO: 744442 - DNA, 25 bp, Mus musculus
taccgagtacgtcggaacttgatcc

SEQ ID NO: 744443 - DNA, 25 bp, Mus musculus
taccgagtacgtgggaacttgatcc

SEQ ID NO: 744444 - DNA, 25 bp, Mus musculus
taccgagtccggatttcagctggca

SEQ ID NO: 744445 - DNA, 25 bp, Mus musculus
taccgagtccggttttcagctggca

SEQ ID NO: 744446 - DNA, 25 bp, Mus musculus
taccgagtctatagcatgctgggag

SEQ ID NO: 744447 - DNA, 25 bp, Mus musculus
taccgagtctattgcatgctgggag

SEQ ID NO: 744448 - DNA, 25 bp, Mus musculus
taccgagtgcaactgcagcattgcc

SEQ ID NO: 744449 - DNA, 25 bp, Mus musculus
taccgagtgcaagtgcagcattgcc

SEQ ID NO: 744450 - DNA, 25 bp, Mus musculus
taccgagtgggacagaagatcctct

SEQ ID NO: 744451 - DNA, 25 bp, Mus musculus
taccgagtgggagagaagatcctct

SEQ ID NO: 744452 - DNA, 25 bp, Mus musculus
taccgagttgccagtaaattctcac

SEQ ID NO: 744453 - DNA, 25 bp, Mus musculus
taccgagttgcctgtaaattctcac

SEQ ID NO: 744454 - DNA, 25 bp, Mus musculus
taccgatatctgaaggcacgccggg

SEQ ID NO: 744455 - DNA, 25 bp, Mus musculus
taccgatatctgtaggcacgccggg

SEQ ID NO: 744456 - DNA, 25 bp, Mus musculus
taccgatatgggatatgcagtgtcc

SEQ ID NO: 744457 - DNA, 25 bp, Mus musculus
taccgatatgggttatgcagtgtcc

SEQ ID NO: 744458 - DNA, 25 bp, Mus musculus
taccgatcagaacaacaatataaac

SEQ ID NO: 744459 - DNA, 25 bp, Mus musculus
taccgatcagaagaacaatataaac

SEQ ID NO: 744460 - DNA, 25 bp, Mus musculus
taccgatccagtctgaaatctctcc

SEQ ID NO: 744461 - DNA, 25 bp, Mus musculus
taccgatccagtgtgaaatctctcc

SEQ ID NO: 744462 - DNA, 25 bp, Mus musculus
taccgatgaggaattagcacactcc

SEQ ID NO: 744463 - DNA, 25 bp, Mus musculus
taccgatgaggatttagcacactcc

SEQ ID NO: 744464 - DNA, 25 bp, Mus musculus
taccgatgccagagtcatcttcgag

SEQ ID NO: 744465 - DNA, 25 bp, Mus musculus
taccgatgccagtgtcatcttcgag

SEQ ID NO: 744466 - DNA, 25 bp, Mus musculus
taccgatggcaaccatgagtggacg

SEQ ID NO: 744467 - DNA, 25 bp, Mus musculus
taccgatggcaagcatgagtggacg

SEQ ID NO: 744468 - DNA, 25 bp, Mus musculus
taccgattctgcagaagacctcgcg

SEQ ID NO: 744469 - DNA, 25 bp, Mus musculus
taccgattctgctgaagacctcgcg

SEQ ID NO: 744470 - DNA, 25 bp, Mus musculus
taccgatttctgcacttgtctcatt

SEQ ID NO: 744471 - DNA, 25 bp, Mus musculus
taccgatttctggacttgtctcatt

SEQ ID NO: 744472 - DNA, 25 bp, Mus musculus
taccgcaacggcaagtatgatctgg

SEQ ID NO: 744473 - DNA, 25 bp, Mus musculus
taccgcaacggctagtatgatctgg

SEQ ID NO: 744474 - DNA, 25 bp, Mus musculus
taccgcaagtcactgaagtggaccc

SEQ ID NO: 744475 - DNA, 25 bp, Mus musculus
taccgcaagtcagtgaagtggaccc

SEQ ID NO: 744476 - DNA, 25 bp, Mus musculus
taccgcagaactcatttgtgggagc

SEQ ID NO: 744477 - DNA, 25 bp, Mus musculus
taccgcagaactgatttgtgggagc

SEQ ID NO: 744478 - DNA, 25 bp, Mus musculus
taccgcagcaaacggctgcagcgtg

SEQ ID NO: 744479 - DNA, 25 bp, Mus musculus
taccgcagcaaagggctgcagcgtg

SEQ ID NO: 744480 - DNA, 25 bp, Mus musculus
taccgcaggttcagatgccaggtgc

SEQ ID NO: 744481 - DNA, 25 bp, Mus musculus
taccgcaggttctgatgccaggtgc

SEQ ID NO: 744482 - DNA, 25 bp, Mus musculus
taccgcagtgccaacttcatggagc

SEQ ID NO: 744483 - DNA, 25 bp, Mus musculus
taccgcagtgcctacttcatggagc

SEQ ID NO: 744484 - DNA, 25 bp, Mus musculus
taccgcatggttcgaggtgtgctgg

SEQ ID NO: 744485 - DNA, 25 bp, Mus musculus
taccgcatggttggaggtgtgctgg

SEQ ID NO: 744486 - DNA, 25 bp, Mus musculus
taccgcatgttgcagtttctctggc

SEQ ID NO: 744487 - DNA, 25 bp, Mus musculus
taccgcatgttggagtttctctggc

SEQ ID NO: 744488 - DNA, 25 bp, Mus musculus
taccgccaatgtctggatttccatc

SEQ ID NO: 744489 - DNA, 25 bp, Mus musculus
taccgccaatgtgtggatttccatc

SEQ ID NO: 744490 - DNA, 25 bp, Mus musculus
taccgccagctcagcaagccagtaa

SEQ ID NO: 744491 - DNA, 25 bp, Mus musculus
taccgccagctctgcaagccagtaa

SEQ ID NO: 744492 - DNA, 25 bp, Mus musculus
taccgccagtttaccgagggctgag

SEQ ID NO: 744493 - DNA, 25 bp, Mus musculus
taccgccagttttccgagggctgag

SEQ ID NO: 744494 - DNA, 25 bp, Mus musculus
taccgccctcagcacattttctttg

SEQ ID NO: 744495 - DNA, 25 bp, Mus musculus
taccgccctcaggacattttctttg

SEQ ID NO: 744496 - DNA, 25 bp, Mus musculus
taccgccgactcacagaagttctgg

SEQ ID NO: 744497 - DNA, 25 bp, Mus musculus
taccgccgactctcagaagttctgg

SEQ ID NO: 744498 - DNA, 25 bp, Mus musculus
taccgccgtcgcagatggacgttag

SEQ ID NO: 744499 - DNA, 25 bp, Mus musculus
taccgccgtcgctgatggacgttag

SEQ ID NO: 744500 - DNA, 25 bp, Mus musculus
taccgcctctttccaggactgcgag

SEQ ID NO: 744501 - DNA, 25 bp, Mus musculus
taccgcctctttgcaggactgcgag

SEQ ID NO: 744502 - DNA, 25 bp, Mus musculus
taccgcctgcagacctggctgtatg

SEQ ID NO: 744503 - DNA, 25 bp, Mus musculus
taccgcctgcagtcctggctgtatg

SEQ ID NO: 744504 - DNA, 25 bp, Mus musculus
taccgccttctgcaggaagacgaag

SEQ ID NO: 744505 - DNA, 25 bp, Mus musculus
taccgccttctggaggaagacgaag

SEQ ID NO: 744506 - DNA, 25 bp, Mus musculus
taccgcgtactcagggagaagaaaa

SEQ ID NO: 744507 - DNA, 25 bp, Mus musculus
taccgcgtactctgggagaagaaaa

SEQ ID NO: 744508 - DNA, 25 bp, Mus musculus
taccgctaccacctgggttgcaatt

SEQ ID NO: 744509 - DNA, 25 bp, Mus musculus
taccgctaccacgtgggttgcaatt

SEQ ID NO: 744510 - DNA, 25 bp, Mus musculus
taccgctactaccaggtggctcgag

SEQ ID NO: 744511 - DNA, 25 bp, Mus musculus
taccgctactacgaggtggctcgag

SEQ ID NO: 744512 - DNA, 25 bp, Mus musculus
taccgctatgtactcagtgagccgc

SEQ ID NO: 744513 - DNA, 25 bp, Mus musculus
taccgctatgtagtcagtgagccgc

SEQ ID NO: 744514 - DNA, 25 bp, Mus musculus
taccgctattaccagaatgtgtgca

SEQ ID NO: 744515 - DNA, 25 bp, Mus musculus
taccgctattacgagaatgtgtgca

SEQ ID NO: 744516 - DNA, 25 bp, Mus musculus
taccgctgaaaaagaacgcagtcct

SEQ ID NO: 744517 - DNA, 25 bp, Mus musculus
taccgctgaaaatgaacgcagtcct

SEQ ID NO: 744518 - DNA, 25 bp, Mus musculus
taccgctgcgagaatgactttgtca

SEQ ID NO: 744519 - DNA, 25 bp, Mus musculus
taccgctgcgagtatgactttgtca

SEQ ID NO: 744520 - DNA, 25 bp, Mus musculus
taccgctgtgaaaccaaagaaacgt

SEQ ID NO: 744521 - DNA, 25 bp, Mus musculus
taccgctgtgaatccaaagaaacgt

SEQ ID NO: 744522 - DNA, 25 bp, Mus musculus
taccgcttgacaactgtacttggaa

SEQ ID NO: 744523 - DNA, 25 bp, Mus musculus
taccgcttgacatctgtacttggaa

SEQ ID NO: 744524 - DNA, 25 bp, Mus musculus
taccgcttggatcgttctactaatg

SEQ ID NO: 744525 - DNA, 25 bp, Mus musculus
taccgcttggatggttctactaatg

SEQ ID NO: 744526 - DNA, 25 bp, Mus musculus
taccgcttttacaagcagctcagca

SEQ ID NO: 744527 - DNA, 25 bp, Mus musculus
taccgcttttactagcagctcagca

SEQ ID NO: 744528 - DNA, 25 bp, Mus musculus
taccggaacttccaggcttgtctgc

SEQ ID NO: 744529 - DNA, 25 bp, Mus musculus
taccggaacttcgaggcttgtctgc

SEQ ID NO: 744530 - DNA, 25 bp, Mus musculus
taccggaagcaaacaaaggaccagt

SEQ ID NO: 744531 - DNA, 25 bp, Mus musculus
taccggaagcaatcaaaggaccagt

SEQ ID NO: 744532 - DNA, 25 bp, Mus musculus
taccggaagctgacgggactgcctg

SEQ ID NO: 744533 - DNA, 25 bp, Mus musculus
taccggaagctgtcgggactgcctg

SEQ ID NO: 744534 - DNA, 25 bp, Mus musculus
taccggaagggcatcatctccggct

SEQ ID NO: 744535 - DNA, 25 bp, Mus musculus
taccggaagggcttcatctccggct

SEQ ID NO: 744536 - DNA, 25 bp, Mus musculus
taccggaagtacctctatgttttgg

SEQ ID NO: 744537 - DNA, 25 bp, Mus musculus
taccggaagtacgtctatgttttgg

SEQ ID NO: 744538 - DNA, 25 bp, Mus musculus
taccggactgagctgtatcgctacc

SEQ ID NO: 744539 - DNA, 25 bp, Mus musculus
taccggactgaggtgtatcgctacc

SEQ ID NO: 744540 - DNA, 25 bp, Mus musculus
taccggagccagacaaatactttag

SEQ ID NO: 744541 - DNA, 25 bp, Mus musculus
taccggagccagtcaaatactttag

SEQ ID NO: 744542 - DNA, 25 bp, Mus musculus
taccggatcgcgaacctcagttcca

SEQ ID NO: 744543 - DNA, 25 bp, Mus musculus
taccggatcgcgtacctcagttcca

SEQ ID NO: 744544 - DNA, 25 bp, Mus musculus
taccggcaatatccagctctctttg

SEQ ID NO: 744545 - DNA, 25 bp, Mus musculus
taccggcaatatgcagctctctttg

SEQ ID NO: 744546 - DNA, 25 bp, Mus musculus
taccggcagactctgaatatcacat

SEQ ID NO: 744547 - DNA, 25 bp, Mus musculus
taccggcagactgtgaatatcacat

SEQ ID NO: 744548 - DNA, 25 bp, Mus musculus
taccggccagagaatgcagtcaatt

SEQ ID NO: 744549 - DNA, 25 bp, Mus musculus
taccggccagagtatgcagtcaatt

SEQ ID NO: 744550 - DNA, 25 bp, Mus musculus
taccggcctaagcagagactgaggt

SEQ ID NO: 744551 - DNA, 25 bp, Mus musculus
taccggcctaaggagagactgaggt

SEQ ID NO: 744552 - DNA, 25 bp, Mus musculus
taccggcgagacactgtgtatagct

SEQ ID NO: 744553 - DNA, 25 bp, Mus musculus
taccggcgagactctgtgtatagct

SEQ ID NO: 744554 - DNA, 25 bp, Mus musculus
taccggcggtccagacgttcccagg

SEQ ID NO: 744555 - DNA, 25 bp, Mus musculus
taccggcggtcctgacgttcccagg

SEQ ID NO: 744556 - DNA, 25 bp, Mus musculus
taccggctccttaagaccattggca

SEQ ID NO: 744557 - DNA, 25 bp, Mus musculus
taccggctcctttagaccattggca

SEQ ID NO: 744558 - DNA, 25 bp, Mus musculus
taccggctggatacaattcattgaa

SEQ ID NO: 744559 - DNA, 25 bp, Mus musculus
taccggctggattcaattcattgaa

SEQ ID NO: 744560 - DNA, 25 bp, Mus musculus
taccgggaagtcaaagggatatggc

SEQ ID NO: 744561 - DNA, 25 bp, Mus musculus
taccgggaagtctaagggatatggc

SEQ ID NO: 744562 - DNA, 25 bp, Mus musculus
taccgggaatatcctgacagttttg

SEQ ID NO: 744563 - DNA, 25 bp, Mus musculus
taccgggaatatgctgacagttttg

SEQ ID NO: 744564 - DNA, 25 bp, Mus musculus
taccgggacgaaagcgaactgcgca

SEQ ID NO: 744565 - DNA, 25 bp, Mus musculus
taccgggacgaatgcgaactgcgca

SEQ ID NO: 744566 - DNA, 25 bp, Mus musculus
taccgggagaaaatctacatgacgc

SEQ ID NO: 744567 - DNA, 25 bp, Mus musculus
taccgggagaaattctacatgacgc

SEQ ID NO: 744568 - DNA, 25 bp, Mus musculus
taccgggcagaacgaagtagcactg

SEQ ID NO: 744569 - DNA, 25 bp, Mus musculus
taccgggcagaaggaagtagcactg

SEQ ID NO: 744570 - DNA, 25 bp, Mus musculus
taccgggctcctcaagtcttactaa

SEQ ID NO: 744571 - DNA, 25 bp, Mus musculus
taccgggctcctgaagtcttactaa

SEQ ID NO: 744572 - DNA, 25 bp, Mus musculus
taccggtacccgcattgggcaattg

SEQ ID NO: 744573 - DNA, 25 bp, Mus musculus
taccggtacccggattgggcaattg

SEQ ID NO: 744574 - DNA, 25 bp, Mus musculus
taccggtagccgagaagttttctct

SEQ ID NO: 744575 - DNA, 25 bp, Mus musculus
taccggtagccgtgaagttttctct

SEQ ID NO: 744576 - DNA, 25 bp, Mus musculus
taccggtcaagcaatgactatggcg

SEQ ID NO: 744577 - DNA, 25 bp, Mus musculus
taccggtcaagctatgactatggcg

SEQ ID NO: 744578 - DNA, 25 bp, Mus musculus
taccggtcacggaaatactccagtt

SEQ ID NO: 744579 - DNA, 25 bp, Mus musculus
taccggtcacggtaatactccagtt

SEQ ID NO: 744580 - DNA, 25 bp, Mus musculus
taccggtggccgattcgccatagac

SEQ ID NO: 744581 - DNA, 25 bp, Mus musculus
taccggtggccgtttcgccatagac

SEQ ID NO: 744582 - DNA, 25 bp, Mus musculus
taccggtggctgagggttttgaatc

SEQ ID NO: 744583 - DNA, 25 bp, Mus musculus
taccggtggctgtgggttttgaatc

SEQ ID NO: 744584 - DNA, 25 bp, Mus musculus
taccggtttatcaacatggctgtcc

SEQ ID NO: 744585 - DNA, 25 bp, Mus musculus
taccggtttatctacatggctgtcc

SEQ ID NO: 744586 - DNA, 25 bp, Mus musculus
taccggtttgcacaaagtaggatct

SEQ ID NO: 744587 - DNA, 25 bp, Mus musculus
taccggtttgcagaaagtaggatct

SEQ ID NO: 744588 - DNA, 25 bp, Mus musculus
taccggtttgttcctgatcagaagg

SEQ ID NO: 744589 - DNA, 25 bp, Mus musculus
taccggtttgttgctgatcagaagg

SEQ ID NO: 744590 - DNA, 25 bp, Mus musculus
taccgtagtttgctgcacacagccc

SEQ ID NO: 744591 - DNA, 25 bp, Mus musculus
taccgtagtttggtgcacacagccc

SEQ ID NO: 744592 - DNA, 25 bp, Mus musculus
taccgtcaagttcgactgaacgagc

SEQ ID NO: 744593 - DNA, 25 bp, Mus musculus
taccgtcaagttggactgaacgagc

SEQ ID NO: 744594 - DNA, 25 bp, Mus musculus
taccgtccacgtcgagatatggaag

SEQ ID NO: 744595 - DNA, 25 bp, Mus musculus
taccgtccacgtggagatatggaag

SEQ ID NO: 744596 - DNA, 25 bp, Mus musculus
taccgtcccaaaagtgagattgcaa

SEQ ID NO: 744597 - DNA, 25 bp, Mus musculus
taccgtcccaaatgtgagattgcaa

SEQ ID NO: 744598 - DNA, 25 bp, Mus musculus
taccgtcggcaacgacacgttcttt

SEQ ID NO: 744599 - DNA, 25 bp, Mus musculus
taccgtcggcaaggacacgttcttt

SEQ ID NO: 744600 - DNA, 25 bp, Mus musculus
taccgtctcacgctgtatactctgc

SEQ ID NO: 744601 - DNA, 25 bp, Mus musculus
taccgtctcacggtgtatactctgc

SEQ ID NO: 744602 - DNA, 25 bp, Mus musculus
taccgtgaccagattcgaatgcgtg

SEQ ID NO: 744603 - DNA, 25 bp, Mus musculus
taccgtgaccagtttcgaatgcgtg

SEQ ID NO: 744604 - DNA, 25 bp, Mus musculus
taccgtgaggacatgttagcgcatc

SEQ ID NO: 744605 - DNA, 25 bp, Mus musculus
taccgtgaggacttgttagcgcatc

SEQ ID NO: 744606 - DNA, 25 bp, Mus musculus
taccgtgcactccagggagcactga

SEQ ID NO: 744607 - DNA, 25 bp, Mus musculus
taccgtgcactcgagggagcactga

SEQ ID NO: 744608 - DNA, 25 bp, Mus musculus
taccgtgcagatctgcgcacagtgt

SEQ ID NO: 744609 - DNA, 25 bp, Mus musculus
taccgtgcagatgtgcgcacagtgt

SEQ ID NO: 744610 - DNA, 25 bp, Mus musculus
taccgtgctagccatcaagaacggg

SEQ ID NO: 744611 - DNA, 25 bp, Mus musculus
taccgtgctagcgatcaagaacggg

SEQ ID NO: 744612 - DNA, 25 bp, Mus musculus
taccgtggaaacaacacaggacatt

SEQ ID NO: 744613 - DNA, 25 bp, Mus musculus
taccgtggaaactacacaggacatt

SEQ ID NO: 744614 - DNA, 25 bp, Mus musculus
taccgtgggcacatttgaaatggct

SEQ ID NO: 744615 - DNA, 25 bp, Mus musculus
taccgtgggcacttttgaaatggct

SEQ ID NO: 744616 - DNA, 25 bp, Mus musculus
taccgtgtaacaaggcgggacctca

SEQ ID NO: 744617 - DNA, 25 bp, Mus musculus
taccgtgtaacatggcgggacctca

SEQ ID NO: 744618 - DNA, 25 bp, Mus musculus
taccgtgtacagctctaaaagcctt

SEQ ID NO: 744619 - DNA, 25 bp, Mus musculus
taccgtgtacaggtctaaaagcctt

SEQ ID NO: 744620 - DNA, 25 bp, Mus musculus
taccgtgtcttcagaagagaagcca

SEQ ID NO: 744621 - DNA, 25 bp, Mus musculus
taccgtgtcttctgaagagaagcca

SEQ ID NO: 744622 - DNA, 25 bp, Mus musculus
taccgtgtgaggaaattcttggccc

SEQ ID NO: 744623 - DNA, 25 bp, Mus musculus
taccgtgtgaggtaattcttggccc

SEQ ID NO: 744624 - DNA, 25 bp, Mus musculus
taccgttattgtcgaatgctagaag

SEQ ID NO: 744625 - DNA, 25 bp, Mus musculus
taccgttattgtggaatgctagaag

SEQ ID NO: 744626 - DNA, 25 bp, Mus musculus
taccgttcctgcagaaacagcacaa

SEQ ID NO: 744627 - DNA, 25 bp, Mus musculus
taccgttcctgctgaaacagcacaa

SEQ ID NO: 744628 - DNA, 25 bp, Mus musculus
taccgttgtcagcacacagcgttca

SEQ ID NO: 744629 - DNA, 25 bp, Mus musculus
taccgttgtcaggacacagcgttca

SEQ ID NO: 744630 - DNA, 25 bp, Mus musculus
taccgtttcctgaagccgtggctag

SEQ ID NO: 744631 - DNA, 25 bp, Mus musculus
taccgtttcctgtagccgtggctag

SEQ ID NO: 744632 - DNA, 25 bp, Mus musculus
taccgtttgcatcagcaggctccaa

SEQ ID NO: 744633 - DNA, 25 bp, Mus musculus
taccgtttgcatgagcaggctccaa

SEQ ID NO: 744634 - DNA, 25 bp, Mus musculus
tacctaaagttcaatgagcctcaag

SEQ ID NO: 744635 - DNA, 25 bp, Mus musculus
tacctaaagttctatgagcctcaag

SEQ ID NO: 744636 - DNA, 25 bp, Mus musculus
tacctaaattagcatcagttgacaa

SEQ ID NO: 744637 - DNA, 25 bp, Mus musculus
tacctaaattaggatcagttgacaa

SEQ ID NO: 744638 - DNA, 25 bp, Mus musculus
tacctaagcaagcagtagaatatga

SEQ ID NO: 744639 - DNA, 25 bp, Mus musculus
tacctaagcaaggagtagaatatga

SEQ ID NO: 744640 - DNA, 25 bp, Mus musculus
tacctaagccccatatggtagactt

SEQ ID NO: 744641 - DNA, 25 bp, Mus musculus
tacctaagccccttatggtagactt

SEQ ID NO: 744642 - DNA, 25 bp, Mus musculus
tacctaagtcctacatgatcagtgc

SEQ ID NO: 744643 - DNA, 25 bp, Mus musculus
tacctaagtccttcatgatcagtgc

SEQ ID NO: 744644 - DNA, 25 bp, Mus musculus
tacctaattggcagaagaaagacct

SEQ ID NO: 744645 - DNA, 25 bp, Mus musculus
tacctaattggctgaagaaagacct

SEQ ID NO: 744646 - DNA, 25 bp, Mus musculus
tacctaattttacagcagtgccaaa

SEQ ID NO: 744647 - DNA, 25 bp, Mus musculus
tacctaattttagagcagtgccaaa

SEQ ID NO: 744648 - DNA, 25 bp, Mus musculus
tacctacacggtcataattccgaca

SEQ ID NO: 744649 - DNA, 25 bp, Mus musculus
tacctacacggtgataattccgaca

SEQ ID NO: 744650 - DNA, 25 bp, Mus musculus
tacctacagactcgtggctccaaat

SEQ ID NO: 744651 - DNA, 25 bp, Mus musculus
tacctacagactggtggctccaaat

SEQ ID NO: 744652 - DNA, 25 bp, Mus musculus
tacctaccacgccatcattggaggg

SEQ ID NO: 744653 - DNA, 25 bp, Mus musculus
tacctaccacgcgatcattggaggg

SEQ ID NO: 744654 - DNA, 25 bp, Mus musculus
tacctaccaggcctgggtgtgatca

SEQ ID NO: 744655 - DNA, 25 bp, Mus musculus
tacctaccaggcgtgggtgtgatca

SEQ ID NO: 744656 - DNA, 25 bp, Mus musculus
tacctacccactcataaaactctta

SEQ ID NO: 744657 - DNA, 25 bp, Mus musculus
tacctacccactgataaaactctta

SEQ ID NO: 744658 - DNA, 25 bp, Mus musculus
tacctacctgttcgcccctagtgtg

SEQ ID NO: 744659 - DNA, 25 bp, Mus musculus
tacctacctgttggcccctagtgtg

SEQ ID NO: 744660 - DNA, 25 bp, Mus musculus
tacctacgatgtacaaagagcccag

SEQ ID NO: 744661 - DNA, 25 bp, Mus musculus
tacctacgatgttcaaagagcccag

SEQ ID NO: 744662 - DNA, 25 bp, Mus musculus
tacctactctgacgagaaccgcatc

SEQ ID NO: 744663 - DNA, 25 bp, Mus musculus
tacctactctgaggagaaccgcatc

SEQ ID NO: 744664 - DNA, 25 bp, Mus musculus
tacctactgctacctgggcagacgc

SEQ ID NO: 744665 - DNA, 25 bp, Mus musculus
tacctactgctagctgggcagacgc

SEQ ID NO: 744666 - DNA, 25 bp, Mus musculus
tacctactggcaaagcgtcacgtgg

SEQ ID NO: 744667 - DNA, 25 bp, Mus musculus
tacctactggcatagcgtcacgtgg

SEQ ID NO: 744668 - DNA, 25 bp, Mus musculus
tacctactggtgctaaaccatccag

SEQ ID NO: 744669 - DNA, 25 bp, Mus musculus
tacctactggtggtaaaccatccag

SEQ ID NO: 744670 - DNA, 25 bp, Mus musculus
tacctacttcagaggtggtccctga

SEQ ID NO: 744671 - DNA, 25 bp, Mus musculus
tacctacttcagtggtggtccctga

SEQ ID NO: 744672 - DNA, 25 bp, Mus musculus
tacctagaaactaggcagagcagct

SEQ ID NO: 744673 - DNA, 25 bp, Mus musculus
tacctagaaacttggcagagcagct

SEQ ID NO: 744674 - DNA, 25 bp, Mus musculus
tacctagacagaccggagaagctga

SEQ ID NO: 744675 - DNA, 25 bp, Mus musculus
tacctagacagagcggagaagctga

SEQ ID NO: 744676 - DNA, 25 bp, Mus musculus
tacctagaggagacactccactcaa

SEQ ID NO: 744677 - DNA, 25 bp, Mus musculus
tacctagaggagtcactccactcaa

SEQ ID NO: 744678 - DNA, 25 bp, Mus musculus
tacctagatgacagagggctcaggc

SEQ ID NO: 744679 - DNA, 25 bp, Mus musculus
tacctagatgactgagggctcaggc

SEQ ID NO: 744680 - DNA, 25 bp, Mus musculus
tacctagatgtcaggcaaaagtggg

SEQ ID NO: 744681 - DNA, 25 bp, Mus musculus
tacctagatgtctggcaaaagtggg

SEQ ID NO: 744682 - DNA, 25 bp, Mus musculus
tacctagcactccaaactcttgctg

SEQ ID NO: 744683 - DNA, 25 bp, Mus musculus
tacctagcactcgaaactcttgctg

SEQ ID NO: 744684 - DNA, 25 bp, Mus musculus
tacctagcggcgacatggatgctgc

SEQ ID NO: 744685 - DNA, 25 bp, Mus musculus
tacctagcggcgtcatggatgctgc

SEQ ID NO: 744686 - DNA, 25 bp, Mus musculus
tacctagctcaacacgaggagagtg

SEQ ID NO: 744687 - DNA, 25 bp, Mus musculus
tacctagctcaagacgaggagagtg

SEQ ID NO: 744688 - DNA, 25 bp, Mus musculus
tacctagctttcagtgcaaagagcc

SEQ ID NO: 744689 - DNA, 25 bp, Mus musculus
tacctagctttctgtgcaaagagcc

SEQ ID NO: 744690 - DNA, 25 bp, Mus musculus
tacctaggtcgcactggccaacatg

SEQ ID NO: 744691 - DNA, 25 bp, Mus musculus
tacctaggtcgctctggccaacatg

SEQ ID NO: 744692 - DNA, 25 bp, Mus musculus
tacctatatatgagatatgatgggc

SEQ ID NO: 744693 - DNA, 25 bp, Mus musculus
tacctatatatgtgatatgatgggc

SEQ ID NO: 744694 - DNA, 25 bp, Mus musculus
tacctatatgcaatcctcactgcgc

SEQ ID NO: 744695 - DNA, 25 bp, Mus musculus
tacctatatgcattcctcactgcgc

SEQ ID NO: 744696 - DNA, 25 bp, Mus musculus
tacctatcctatcctgtttaaattg

SEQ ID NO: 744697 - DNA, 25 bp, Mus musculus
tacctatcctatgctgtttaaattg

SEQ ID NO: 744698 - DNA, 25 bp, Mus musculus
tacctatcggatctgtgctctgcat

SEQ ID NO: 744699 - DNA, 25 bp, Mus musculus
tacctatcggatgtgtgctctgcat

SEQ ID NO: 744700 - DNA, 25 bp, Mus musculus
tacctatctgctccttggctacaag

SEQ ID NO: 744701 - DNA, 25 bp, Mus musculus
tacctatctgctgcttggctacaag

SEQ ID NO: 744702 - DNA, 25 bp, Mus musculus
tacctatgaaccatcacagtgggtg

SEQ ID NO: 744703 - DNA, 25 bp, Mus musculus
tacctatgaaccttcacagtgggtg

SEQ ID NO: 744704 - DNA, 25 bp, Mus musculus
tacctatgaaggcaacagcaatgac

SEQ ID NO: 744705 - DNA, 25 bp, Mus musculus
tacctatgaagggaacagcaatgac

SEQ ID NO: 744706 - DNA, 25 bp, Mus musculus
tacctatgacaaagctgcggtgaca

SEQ ID NO: 744707 - DNA, 25 bp, Mus musculus
tacctatgacaatgctgcggtgaca

SEQ ID NO: 744708 - DNA, 25 bp, Mus musculus
tacctatgagaactatcctttcttc

SEQ ID NO: 744709 - DNA, 25 bp, Mus musculus
tacctatgagaagtatcctttcttc

SEQ ID NO: 744710 - DNA, 25 bp, Mus musculus
tacctattccacactttccagaagg

SEQ ID NO: 744711 - DNA, 25 bp, Mus musculus
tacctattccactctttccagaagg

SEQ ID NO: 744712 - DNA, 25 bp, Mus musculus
tacctatttgacacactgtagttct

SEQ ID NO: 744713 - DNA, 25 bp, Mus musculus
tacctatttgactcactgtagttct

SEQ ID NO: 744714 - DNA, 25 bp, Mus musculus
tacctattttgtatcaagggcaagg

SEQ ID NO: 744715 - DNA, 25 bp, Mus musculus
tacctattttgtttcaagggcaagg

SEQ ID NO: 744716 - DNA, 25 bp, Mus musculus
tacctcaacagacattacaaagccc

SEQ ID NO: 744717 - DNA, 25 bp, Mus musculus
tacctcaacagagattacaaagccc

SEQ ID NO: 744718 - DNA, 25 bp, Mus musculus
tacctcaaccggaactactgggaga

SEQ ID NO: 744719 - DNA, 25 bp, Mus musculus
tacctcaaccggtactactgggaga

SEQ ID NO: 744720 - DNA, 25 bp, Mus musculus
tacctcaccaagcaggatgtggaaa

SEQ ID NO: 744721 - DNA, 25 bp, Mus musculus
tacctcaccaaggaggatgtggaaa

SEQ ID NO: 744722 - DNA, 25 bp, Mus musculus
tacctcacctttattagaactacag

SEQ ID NO: 744723 - DNA, 25 bp, Mus musculus
tacctcaccttttttagaactacag

SEQ ID NO: 744724 - DNA, 25 bp, Mus musculus
tacctcacggacacacagtgcaagc

SEQ ID NO: 744725 - DNA, 25 bp, Mus musculus
tacctcacggactcacagtgcaagc

SEQ ID NO: 744726 - DNA, 25 bp, Mus musculus
tacctcagagagcacttgtcaaccg

SEQ ID NO: 744727 - DNA, 25 bp, Mus musculus
tacctcagagaggacttgtcaaccg

SEQ ID NO: 744728 - DNA, 25 bp, Mus musculus
tacctcagaggaacctccaacagga

SEQ ID NO: 744729 - DNA, 25 bp, Mus musculus
tacctcagaggatcctccaacagga

SEQ ID NO: 744730 - DNA, 25 bp, Mus musculus
tacctcagcctgacttagcacaaat

SEQ ID NO: 744731 - DNA, 25 bp, Mus musculus
tacctcagcctgtcttagcacaaat

SEQ ID NO: 744732 - DNA, 25 bp, Mus musculus
tacctcagcgtgctacacctcaaag

SEQ ID NO: 744733 - DNA, 25 bp, Mus musculus
tacctcagcgtggtacacctcaaag

SEQ ID NO: 744734 - DNA, 25 bp, Mus musculus
tacctcagctgcagtcacggctgca

SEQ ID NO: 744735 - DNA, 25 bp, Mus musculus
tacctcagctgctgtcacggctgca

SEQ ID NO: 744736 - DNA, 25 bp, Mus musculus
tacctcaggcctaagaagacagtga

SEQ ID NO: 744737 - DNA, 25 bp, Mus musculus
tacctcaggccttagaagacagtga

SEQ ID NO: 744738 - DNA, 25 bp, Mus musculus
tacctcagtgcacagaagcctctct

SEQ ID NO: 744739 - DNA, 25 bp, Mus musculus
tacctcagtgcagagaagcctctct

SEQ ID NO: 744740 - DNA, 25 bp, Mus musculus
tacctcagtgccacagttctggaag

SEQ ID NO: 744741 - DNA, 25 bp, Mus musculus
tacctcagtgcctcagttctggaag

SEQ ID NO: 744742 - DNA, 25 bp, Mus musculus
tacctcagtggtcagacgctaccag

SEQ ID NO: 744743 - DNA, 25 bp, Mus musculus
tacctcagtggtgagacgctaccag

SEQ ID NO: 744744 - DNA, 25 bp, Mus musculus
tacctcagtgtgagaagatcatttg

SEQ ID NO: 744745 - DNA, 25 bp, Mus musculus
tacctcagtgtgtgaagatcatttg

SEQ ID NO: 744746 - DNA, 25 bp, Mus musculus
tacctcatagcacggatccagcatg

SEQ ID NO: 744747 - DNA, 25 bp, Mus musculus
tacctcatagcagggatccagcatg

SEQ ID NO: 744748 - DNA, 25 bp, Mus musculus
tacctcatcaggcttttgcaatgag

SEQ ID NO: 744749 - DNA, 25 bp, Mus musculus
tacctcatcagggttttgcaatgag

SEQ ID NO: 744750 - DNA, 25 bp, Mus musculus
tacctcatccccatacttgaaaggc

SEQ ID NO: 744751 - DNA, 25 bp, Mus musculus
tacctcatccccttacttgaaaggc

SEQ ID NO: 744752 - DNA, 25 bp, Mus musculus
tacctcatcctgcagtgcctcagtg

SEQ ID NO: 744753 - DNA, 25 bp, Mus musculus
tacctcatcctggagtgcctcagtg

SEQ ID NO: 744754 - DNA, 25 bp, Mus musculus
tacctcatggagctgatgacaccag

SEQ ID NO: 744755 - DNA, 25 bp, Mus musculus
tacctcatggaggtgatgacaccag

SEQ ID NO: 744756 - DNA, 25 bp, Mus musculus
tacctcatgtaacacagcctcaaca

SEQ ID NO: 744757 - DNA, 25 bp, Mus musculus
tacctcatgtaagacagcctcaaca

SEQ ID NO: 744758 - DNA, 25 bp, Mus musculus
tacctcatgtttaccatggtccttg

SEQ ID NO: 744759 - DNA, 25 bp, Mus musculus
tacctcatgttttccatggtccttg

SEQ ID NO: 744760 - DNA, 25 bp, Mus musculus
tacctcattgcacggaagtatgccc

SEQ ID NO: 744761 - DNA, 25 bp, Mus musculus
tacctcattgcagggaagtatgccc

SEQ ID NO: 744762 - DNA, 25 bp, Mus musculus
tacctccacaacagtgagacacgca

SEQ ID NO: 744763 - DNA, 25 bp, Mus musculus
tacctccacaactgtgagacacgca

SEQ ID NO: 744764 - DNA, 25 bp, Mus musculus
tacctccaggccatggagaaagagg

SEQ ID NO: 744765 - DNA, 25 bp, Mus musculus
tacctccaggccttggagaaagagg

SEQ ID NO: 744766 - DNA, 25 bp, Mus musculus
tacctccaggtcagatctcaacaag

SEQ ID NO: 744767 - DNA, 25 bp, Mus musculus
tacctccaggtctgatctcaacaag

SEQ ID NO: 744768 - DNA, 25 bp, Mus musculus
tacctccaggttcaaggaacagcag

SEQ ID NO: 744769 - DNA, 25 bp, Mus musculus
tacctccaggttgaaggaacagcag

SEQ ID NO: 744770 - DNA, 25 bp, Mus musculus
tacctccagtataagtgcctcgtca

SEQ ID NO: 744771 - DNA, 25 bp, Mus musculus
tacctccagtattagtgcctcgtca

SEQ ID NO: 744772 - DNA, 25 bp, Mus musculus
tacctcccaacaccattatggaata

SEQ ID NO: 744773 - DNA, 25 bp, Mus musculus
tacctcccaacagcattatggaata

SEQ ID NO: 744774 - DNA, 25 bp, Mus musculus
tacctcccaggacgacagaagttct

SEQ ID NO: 744775 - DNA, 25 bp, Mus musculus
tacctcccaggaggacagaagttct

SEQ ID NO: 744776 - DNA, 25 bp, Mus musculus
tacctcccatgtctacagaacatct

SEQ ID NO: 744777 - DNA, 25 bp, Mus musculus
tacctcccatgtgtacagaacatct

SEQ ID NO: 744778 - DNA, 25 bp, Mus musculus
tacctccctagcaccttaaagactt

SEQ ID NO: 744779 - DNA, 25 bp, Mus musculus
tacctccctagctccttaaagactt

SEQ ID NO: 744780 - DNA, 25 bp, Mus musculus
tacctccgcagcagaacagcgatgg

SEQ ID NO: 744781 - DNA, 25 bp, Mus musculus
tacctccgcagctgaacagcgatgg

SEQ ID NO: 744782 - DNA, 25 bp, Mus musculus
tacctccgcttgctgatgactgaag

SEQ ID NO: 744783 - DNA, 25 bp, Mus musculus
tacctccgcttggtgatgactgaag

SEQ ID NO: 744784 - DNA, 25 bp, Mus musculus
tacctccggcatctacaatggctgc

SEQ ID NO: 744785 - DNA, 25 bp, Mus musculus
tacctccggcatgtacaatggctgc

SEQ ID NO: 744786 - DNA, 25 bp, Mus musculus
tacctccgtcacctgtgctgtcggg

SEQ ID NO: 744787 - DNA, 25 bp, Mus musculus
tacctccgtcacgtgtgctgtcggg

SEQ ID NO: 744788 - DNA, 25 bp, Mus musculus
tacctcctccaaaccaagctgggta

SEQ ID NO: 744789 - DNA, 25 bp, Mus musculus
tacctcctccaatccaagctgggta

SEQ ID NO: 744790 - DNA, 25 bp, Mus musculus
tacctcctctgtcggctgcaaggga

SEQ ID NO: 744791 - DNA, 25 bp, Mus musculus
tacctcctctgtgggctgcaaggga

SEQ ID NO: 744792 - DNA, 25 bp, Mus musculus
tacctcctgagcagcatcggttttg

SEQ ID NO: 744793 - DNA, 25 bp, Mus musculus
tacctcctgagctgcatcggttttg

SEQ ID NO: 744794 - DNA, 25 bp, Mus musculus
tacctccttattcatggaacggcag

SEQ ID NO: 744795 - DNA, 25 bp, Mus musculus
tacctccttattgatggaacggcag

SEQ ID NO: 744796 - DNA, 25 bp, Mus musculus
tacctcctttacctgcaagagagac

SEQ ID NO: 744797 - DNA, 25 bp, Mus musculus
tacctcctttacgtgcaagagagac

SEQ ID NO: 744798 - DNA, 25 bp, Mus musculus
tacctcgactacctgaggagaaggg

SEQ ID NO: 744799 - DNA, 25 bp, Mus musculus
tacctcgactacgtgaggagaaggg

SEQ ID NO: 744800 - DNA, 25 bp, Mus musculus
tacctcgcaatgcagaaaatcattc

SEQ ID NO: 744801 - DNA, 25 bp, Mus musculus
tacctcgcaatggagaaaatcattc

SEQ ID NO: 744802 - DNA, 25 bp, Mus musculus
tacctcgcccacaaggatgtggaag

SEQ ID NO: 744803 - DNA, 25 bp, Mus musculus
tacctcgcccactaggatgtggaag

SEQ ID NO: 744804 - DNA, 25 bp, Mus musculus
tacctcgcctccctgggaatacagt

SEQ ID NO: 744805 - DNA, 25 bp, Mus musculus
tacctcgcctccgtgggaatacagt

SEQ ID NO: 744806 - DNA, 25 bp, Mus musculus
tacctcggagtccacctgagaagga

SEQ ID NO: 744807 - DNA, 25 bp, Mus musculus
tacctcggagtcgacctgagaagga

SEQ ID NO: 744808 - DNA, 25 bp, Mus musculus
tacctcgggagcaaaccatagagtg

SEQ ID NO: 744809 - DNA, 25 bp, Mus musculus
tacctcgggagctaaccatagagtg

SEQ ID NO: 744810 - DNA, 25 bp, Mus musculus
tacctcgggccaatggcaggtggtc

SEQ ID NO: 744811 - DNA, 25 bp, Mus musculus
tacctcgggccattggcaggtggtc

SEQ ID NO: 744812 - DNA, 25 bp, Mus musculus
tacctctaacgacaagcttatgctg

SEQ ID NO: 744813 - DNA, 25 bp, Mus musculus
tacctctaacgagaagcttatgctg

SEQ ID NO: 744814 - DNA, 25 bp, Mus musculus
tacctctacacacgacggtgctctt

SEQ ID NO: 744815 - DNA, 25 bp, Mus musculus
tacctctacacaggacggtgctctt

SEQ ID NO: 744816 - DNA, 25 bp, Mus musculus
tacctctacagcaacgtgacggtgg

SEQ ID NO: 744817 - DNA, 25 bp, Mus musculus
tacctctacagctacgtgacggtgg

SEQ ID NO: 744818 - DNA, 25 bp, Mus musculus
tacctctacatcatccggaacctgg

SEQ ID NO: 744819 - DNA, 25 bp, Mus musculus
tacctctacatcttccggaacctgg

SEQ ID NO: 744820 - DNA, 25 bp, Mus musculus
tacctctacgataccttccagctgg

SEQ ID NO: 744821 - DNA, 25 bp, Mus musculus
tacctctacgattccttccagctgg

SEQ ID NO: 744822 - DNA, 25 bp, Mus musculus
tacctctactatcgattgtctgccc

SEQ ID NO: 744823 - DNA, 25 bp, Mus musculus
tacctctactatggattgtctgccc

SEQ ID NO: 744824 - DNA, 25 bp, Mus musculus
tacctctcaggcactctgtacagga

SEQ ID NO: 744825 - DNA, 25 bp, Mus musculus
tacctctcaggctctctgtacagga

SEQ ID NO: 744826 - DNA, 25 bp, Mus musculus
tacctctcgactaggatcgatggca

SEQ ID NO: 744827 - DNA, 25 bp, Mus musculus
tacctctcgacttggatcgatggca

SEQ ID NO: 744828 - DNA, 25 bp, Mus musculus
tacctctcggccatccatgcaggaa

SEQ ID NO: 744829 - DNA, 25 bp, Mus musculus
tacctctcggccttccatgcaggaa

SEQ ID NO: 744830 - DNA, 25 bp, Mus musculus
tacctctctcaacctgccgatggag

SEQ ID NO: 744831 - DNA, 25 bp, Mus musculus
tacctctctcaagctgccgatggag

SEQ ID NO: 744832 - DNA, 25 bp, Mus musculus
tacctctctgtgactcggtggcctg

SEQ ID NO: 744833 - DNA, 25 bp, Mus musculus
tacctctctgtgtctcggtggcctg

SEQ ID NO: 744834 - DNA, 25 bp, Mus musculus
tacctctgactcaggcatgctcttc

SEQ ID NO: 744835 - DNA, 25 bp, Mus musculus
tacctctgactctggcatgctcttc

SEQ ID NO: 744836 - DNA, 25 bp, Mus musculus
tacctctgcctgcatgtagtcaagg

SEQ ID NO: 744837 - DNA, 25 bp, Mus musculus
tacctctgcctggatgtagtcaagg

SEQ ID NO: 744838 - DNA, 25 bp, Mus musculus
tacctctgcttaagcctcaagggaa

SEQ ID NO: 744839 - DNA, 25 bp, Mus musculus
tacctctgcttatgcctcaagggaa

SEQ ID NO: 744840 - DNA, 25 bp, Mus musculus
tacctctgggatcccttcaggctct

SEQ ID NO: 744841 - DNA, 25 bp, Mus musculus
tacctctgggatgccttcaggctct

SEQ ID NO: 744842 - DNA, 25 bp, Mus musculus
tacctctggtcccttatagataacc

SEQ ID NO: 744843 - DNA, 25 bp, Mus musculus
tacctctggtccgttatagataacc

SEQ ID NO: 744844 - DNA, 25 bp, Mus musculus
tacctctgtgccaccgggacgggaa

SEQ ID NO: 744845 - DNA, 25 bp, Mus musculus
tacctctgtgcctccgggacgggaa

SEQ ID NO: 744846 - DNA, 25 bp, Mus musculus
tacctctgtgggacactataagatg

SEQ ID NO: 744847 - DNA, 25 bp, Mus musculus
tacctctgtgggtcactataagatg

SEQ ID NO: 744848 - DNA, 25 bp, Mus musculus
tacctcttagatcagcagacaccta

SEQ ID NO: 744849 - DNA, 25 bp, Mus musculus
tacctcttagatgagcagacaccta

SEQ ID NO: 744850 - DNA, 25 bp, Mus musculus
tacctcttcagcaaaggaagtcctc

SEQ ID NO: 744851 - DNA, 25 bp, Mus musculus
tacctcttcagctaaggaagtcctc

SEQ ID NO: 744852 - DNA, 25 bp, Mus musculus
tacctcttggagagtatggcacaac

SEQ ID NO: 744853 - DNA, 25 bp, Mus musculus
tacctcttggagtgtatggcacaac

SEQ ID NO: 744854 - DNA, 25 bp, Mus musculus
tacctctttcctaagcggcagagcc

SEQ ID NO: 744855 - DNA, 25 bp, Mus musculus
tacctctttccttagcggcagagcc

SEQ ID NO: 744856 - DNA, 25 bp, Mus musculus
tacctctttgtcagctccctggatg

SEQ ID NO: 744857 - DNA, 25 bp, Mus musculus
tacctctttgtctgctccctggatg

SEQ ID NO: 744858 - DNA, 25 bp, Mus musculus
tacctctttttaccttagtctctga

SEQ ID NO: 744859 - DNA, 25 bp, Mus musculus
tacctctttttagcttagtctctga

SEQ ID NO: 744860 - DNA, 25 bp, Mus musculus
tacctgaaatgtccgctccacactg

SEQ ID NO: 744861 - DNA, 25 bp, Mus musculus
tacctgaaatgtgcgctccacactg

SEQ ID NO: 744862 - DNA, 25 bp, Mus musculus
tacctgaacaaccaagttttctcaa

SEQ ID NO: 744863 - DNA, 25 bp, Mus musculus
tacctgaacaacgaagttttctcaa

SEQ ID NO: 744864 - DNA, 25 bp, Mus musculus
tacctgaacccacagatgaaagaaa

SEQ ID NO: 744865 - DNA, 25 bp, Mus musculus
tacctgaacccagagatgaaagaaa

SEQ ID NO: 744866 - DNA, 25 bp, Mus musculus
tacctgaacctgacttagaaattca

SEQ ID NO: 744867 - DNA, 25 bp, Mus musculus
tacctgaacctgtcttagaaattca

SEQ ID NO: 744868 - DNA, 25 bp, Mus musculus
tacctgaagcatacagagattgaca

SEQ ID NO: 744869 - DNA, 25 bp, Mus musculus
tacctgaagcattcagagattgaca

SEQ ID NO: 744870 - DNA, 25 bp, Mus musculus
tacctgaagctactgggcaagggca

SEQ ID NO: 744871 - DNA, 25 bp, Mus musculus
tacctgaagctagtgggcaagggca

SEQ ID NO: 744872 - DNA, 25 bp, Mus musculus
tacctgaagctcagcgcacagctgc

SEQ ID NO: 744873 - DNA, 25 bp, Mus musculus
tacctgaagctctgcgcacagctgc

SEQ ID NO: 744874 - DNA, 25 bp, Mus musculus
tacctgaagttacggtgtgacctgc

SEQ ID NO: 744875 - DNA, 25 bp, Mus musculus
tacctgaagttagggtgtgacctgc

SEQ ID NO: 744876 - DNA, 25 bp, Mus musculus
tacctgaataagcttccggtgaaga

SEQ ID NO: 744877 - DNA, 25 bp, Mus musculus
tacctgaataaggttccggtgaaga

SEQ ID NO: 744878 - DNA, 25 bp, Mus musculus
tacctgaatcaactactaagactca

SEQ ID NO: 744879 - DNA, 25 bp, Mus musculus
tacctgaatcaagtactaagactca

SEQ ID NO: 744880 - DNA, 25 bp, Mus musculus
tacctgaatgacatatatattctcg

SEQ ID NO: 744881 - DNA, 25 bp, Mus musculus
tacctgaatgacttatatattctcg

SEQ ID NO: 744882 - DNA, 25 bp, Mus musculus
tacctgaatgggaggtgggaaagcc

SEQ ID NO: 744883 - DNA, 25 bp, Mus musculus
tacctgaatgggtggtgggaaagcc

SEQ ID NO: 744884 - DNA, 25 bp, Mus musculus
tacctgacacaccaagcgaagggtt

SEQ ID NO: 744885 - DNA, 25 bp, Mus musculus
tacctgacacacgaagcgaagggtt

SEQ ID NO: 744886 - DNA, 25 bp, Mus musculus
tacctgacaggcatccacaagcgga

SEQ ID NO: 744887 - DNA, 25 bp, Mus musculus
tacctgacaggcttccacaagcgga

SEQ ID NO: 744888 - DNA, 25 bp, Mus musculus
tacctgacatctctactagggaaag

SEQ ID NO: 744889 - DNA, 25 bp, Mus musculus
tacctgacatctgtactagggaaag

SEQ ID NO: 744890 - DNA, 25 bp, Mus musculus
tacctgaccctgctgaagagttctc

SEQ ID NO: 744891 - DNA, 25 bp, Mus musculus
tacctgaccctggtgaagagttctc

SEQ ID NO: 744892 - DNA, 25 bp, Mus musculus
tacctgagaattatgcaacgagcct

SEQ ID NO: 744893 - DNA, 25 bp, Mus musculus
tacctgagaattttgcaacgagcct

SEQ ID NO: 744894 - DNA, 25 bp, Mus musculus
tacctgagagcaacaaggtggatgg

SEQ ID NO: 744895 - DNA, 25 bp, Mus musculus
tacctgagagcatcaaggtggatgg

SEQ ID NO: 744896 - DNA, 25 bp, Mus musculus
tacctgagagtaatatgaatgaaga

SEQ ID NO: 744897 - DNA, 25 bp, Mus musculus
tacctgagagtattatgaatgaaga

SEQ ID NO: 744898 - DNA, 25 bp, Mus musculus
tacctgagccgtcacttctgacttc

SEQ ID NO: 744899 - DNA, 25 bp, Mus musculus
tacctgagccgtgacttctgacttc

SEQ ID NO: 744900 - DNA, 25 bp, Mus musculus
tacctgaggcaccaggatgagaccc

SEQ ID NO: 744901 - DNA, 25 bp, Mus musculus
tacctgaggcacgaggatgagaccc

SEQ ID NO: 744902 - DNA, 25 bp, Mus musculus
tacctgaggttaattggaattgctg

SEQ ID NO: 744903 - DNA, 25 bp, Mus musculus
tacctgaggttatttggaattgctg

SEQ ID NO: 744904 - DNA, 25 bp, Mus musculus
tacctgatagcaatgaggatcctga

SEQ ID NO: 744905 - DNA, 25 bp, Mus musculus
tacctgatagcattgaggatcctga

SEQ ID NO: 744906 - DNA, 25 bp, Mus musculus
tacctgatatgtctgctgagaacca

SEQ ID NO: 744907 - DNA, 25 bp, Mus musculus
tacctgatatgtgtgctgagaacca

SEQ ID NO: 744908 - DNA, 25 bp, Mus musculus
tacctgatccgaagagcccaggaga

SEQ ID NO: 744909 - DNA, 25 bp, Mus musculus
tacctgatccgatgagcccaggaga

SEQ ID NO: 744910 - DNA, 25 bp, Mus musculus
tacctgatgaccacagcagttacac

SEQ ID NO: 744911 - DNA, 25 bp, Mus musculus
tacctgatgacctcagcagttacac

SEQ ID NO: 744912 - DNA, 25 bp, Mus musculus
tacctgatgatgcaaatgacagctg

SEQ ID NO: 744913 - DNA, 25 bp, Mus musculus
tacctgatgatggaaatgacagctg

SEQ ID NO: 744914 - DNA, 25 bp, Mus musculus
tacctgatgccgctgctgttcatct

SEQ ID NO: 744915 - DNA, 25 bp, Mus musculus
tacctgatgccggtgctgttcatct

SEQ ID NO: 744916 - DNA, 25 bp, Mus musculus
tacctgatgcctacctagtgaagag

SEQ ID NO: 744917 - DNA, 25 bp, Mus musculus
tacctgatgccttcctagtgaagag

SEQ ID NO: 744918 - DNA, 25 bp, Mus musculus
tacctgatgcgtatggtgaaggccc

SEQ ID NO: 744919 - DNA, 25 bp, Mus musculus
tacctgatgcgtttggtgaaggccc

SEQ ID NO: 744920 - DNA, 25 bp, Mus musculus
tacctgcaagagcaattggcacaag

SEQ ID NO: 744921 - DNA, 25 bp, Mus musculus
tacctgcaagaggaattggcacaag

SEQ ID NO: 744922 - DNA, 25 bp, Mus musculus
tacctgcaaggacaggtctccctgg

SEQ ID NO: 744923 - DNA, 25 bp, Mus musculus
tacctgcaaggagaggtctccctgg

SEQ ID NO: 744924 - DNA, 25 bp, Mus musculus
tacctgcaaggtaccaggaattact

SEQ ID NO: 744925 - DNA, 25 bp, Mus musculus
tacctgcaaggtccttgcgtggagt

SEQ ID NO: 744926 - DNA, 25 bp, Mus musculus
tacctgcaaggtgcttgcgtggagt

SEQ ID NO: 744927 - DNA, 25 bp, Mus musculus
tacctgcaaggttccaggaattact

SEQ ID NO: 744928 - DNA, 25 bp, Mus musculus
tacctgcacaagcaggaaagcgacg

SEQ ID NO: 744929 - DNA, 25 bp, Mus musculus
tacctgcacaaggaggaaagcgacg

SEQ ID NO: 744930 - DNA, 25 bp, Mus musculus
tacctgcacaccctcctggtagcca

SEQ ID NO: 744931 - DNA, 25 bp, Mus musculus
tacctgcacaccgtcctggtagcca

SEQ ID NO: 744932 - DNA, 25 bp, Mus musculus
tacctgcaccgaatgactacactct

SEQ ID NO: 744933 - DNA, 25 bp, Mus musculus
tacctgcaccgattgactacactct

SEQ ID NO: 744934 - DNA, 25 bp, Mus musculus
tacctgcacctgcatgtaatggacg

SEQ ID NO: 744935 - DNA, 25 bp, Mus musculus
tacctgcacctggatgtaatggacg

SEQ ID NO: 744936 - DNA, 25 bp, Mus musculus
tacctgcactgactatctcggcggc

SEQ ID NO: 744937 - DNA, 25 bp, Mus musculus
tacctgcactgagtatctcggcggc

SEQ ID NO: 744938 - DNA, 25 bp, Mus musculus
tacctgcactggctcaacgagaggg

SEQ ID NO: 744939 - DNA, 25 bp, Mus musculus
tacctgcactgggtcaacgagaggg

SEQ ID NO: 744940 - DNA, 25 bp, Mus musculus
tacctgcagaaacgagggactcagc

SEQ ID NO: 744941 - DNA, 25 bp, Mus musculus
tacctgcagaaaggagggactcagc

SEQ ID NO: 744942 - DNA, 25 bp, Mus musculus
tacctgcagaacaaagtcagtgcac

SEQ ID NO: 744943 - DNA, 25 bp, Mus musculus
tacctgcagaactaagtcagtgcac

SEQ ID NO: 744944 - DNA, 25 bp, Mus musculus
tacctgcagaatctgctggctgagc

SEQ ID NO: 744945 - DNA, 25 bp, Mus musculus
tacctgcagaatgtgctggctgagc

SEQ ID NO: 744946 - DNA, 25 bp, Mus musculus
tacctgcagcccagcagatagtggg

SEQ ID NO: 744947 - DNA, 25 bp, Mus musculus
tacctgcagccctgcagatagtggg

SEQ ID NO: 744948 - DNA, 25 bp, Mus musculus
tacctgcaggcacaaattagacttc

SEQ ID NO: 744949 - DNA, 25 bp, Mus musculus
tacctgcaggcagaaattagacttc

SEQ ID NO: 744950 - DNA, 25 bp, Mus musculus
tacctgcaggccatgcgcacagtgg

SEQ ID NO: 744951 - DNA, 25 bp, Mus musculus
tacctgcaggccttgcgcacagtgg

SEQ ID NO: 744952 - DNA, 25 bp, Mus musculus
tacctgcatagtccacacttaaggg

SEQ ID NO: 744953 - DNA, 25 bp, Mus musculus
tacctgcatagtgcacacttaaggg

SEQ ID NO: 744954 - DNA, 25 bp, Mus musculus
tacctgcatgtacaaggagggaatt

SEQ ID NO: 744955 - DNA, 25 bp, Mus musculus
tacctgcatgtagaaggagggaatt

SEQ ID NO: 744956 - DNA, 25 bp, Mus musculus
tacctgcatgtgcaatgtgactgca

SEQ ID NO: 744957 - DNA, 25 bp, Mus musculus
tacctgcatgtgcatctgagcctcc

SEQ ID NO: 744958 - DNA, 25 bp, Mus musculus
tacctgcatgtggaatgtgactgca

SEQ ID NO: 744959 - DNA, 25 bp, Mus musculus
tacctgcatgtggatctgagcctcc

SEQ ID NO: 744960 - DNA, 25 bp, Mus musculus
tacctgcattgaactgaccaactcc

SEQ ID NO: 744961 - DNA, 25 bp, Mus musculus
tacctgcattgatctgaccaactcc

SEQ ID NO: 744962 - DNA, 25 bp, Mus musculus
tacctgccaaagactctttcccaga

SEQ ID NO: 744963 - DNA, 25 bp, Mus musculus
tacctgccaaagtctctttcccaga

SEQ ID NO: 744964 - DNA, 25 bp, Mus musculus
tacctgccagtccaagattaaagag

SEQ ID NO: 744965 - DNA, 25 bp, Mus musculus
tacctgccagtcgaagattaaagag

SEQ ID NO: 744966 - DNA, 25 bp, Mus musculus
tacctgccattcagaagctaatggc

SEQ ID NO: 744967 - DNA, 25 bp, Mus musculus
tacctgccattctgaagctaatggc

SEQ ID NO: 744968 - DNA, 25 bp, Mus musculus
tacctgcccaccattcttgtggatg

SEQ ID NO: 744969 - DNA, 25 bp, Mus musculus
tacctgcccacctttcttgtggatg

SEQ ID NO: 744970 - DNA, 25 bp, Mus musculus
tacctgcccaggatagctgggctct

SEQ ID NO: 744971 - DNA, 25 bp, Mus musculus
tacctgcccaggttagctgggctct

SEQ ID NO: 744972 - DNA, 25 bp, Mus musculus
tacctgccgcgcctctgatggattc

SEQ ID NO: 744973 - DNA, 25 bp, Mus musculus
tacctgccgcgcgtctgatggattc

SEQ ID NO: 744974 - DNA, 25 bp, Mus musculus
tacctgcctaatctgctgggcatca

SEQ ID NO: 744975 - DNA, 25 bp, Mus musculus
tacctgcctaatgtgctgggcatca

SEQ ID NO: 744976 - DNA, 25 bp, Mus musculus
tacctgcctatgcaaaacggtctca

SEQ ID NO: 744977 - DNA, 25 bp, Mus musculus
tacctgcctatggaaaacggtctca

SEQ ID NO: 744978 - DNA, 25 bp, Mus musculus
tacctgcctcgcatagacaaactgt

SEQ ID NO: 744979 - DNA, 25 bp, Mus musculus
tacctgcctcgcttagacaaactgt

SEQ ID NO: 744980 - DNA, 25 bp, Mus musculus
tacctgcctgggagatgatagcaca

SEQ ID NO: 744981 - DNA, 25 bp, Mus musculus
tacctgcctgggtgatgatagcaca

SEQ ID NO: 744982 - DNA, 25 bp, Mus musculus
tacctgccttcgcaaggtgactggc

SEQ ID NO: 744983 - DNA, 25 bp, Mus musculus
tacctgccttcggaaggtgactggc

SEQ ID NO: 744984 - DNA, 25 bp, Mus musculus
tacctgcgatacaagccagtcttgg

SEQ ID NO: 744985 - DNA, 25 bp, Mus musculus
tacctgcgatactagccagtcttgg

SEQ ID NO: 744986 - DNA, 25 bp, Mus musculus
tacctgcgcattcccggagaaaatg

SEQ ID NO: 744987 - DNA, 25 bp, Mus musculus
tacctgcgcattgccggagaaaatg

SEQ ID NO: 744988 - DNA, 25 bp, Mus musculus
tacctgcgctgccaggcgatgacag

SEQ ID NO: 744989 - DNA, 25 bp, Mus musculus
tacctgcgctgcgaggcgatgacag

SEQ ID NO: 744990 - DNA, 25 bp, Mus musculus
tacctgcggagccttcgaccgctta

SEQ ID NO: 744991 - DNA, 25 bp, Mus musculus
tacctgcggagcgttcgaccgctta

SEQ ID NO: 744992 - DNA, 25 bp, Mus musculus
tacctgcggcaaagactgcatccga

SEQ ID NO: 744993 - DNA, 25 bp, Mus musculus
tacctgcggcaacgccaagagctgc

SEQ ID NO: 744994 - DNA, 25 bp, Mus musculus
tacctgcggcaaggccaagagctgc

SEQ ID NO: 744995 - DNA, 25 bp, Mus musculus
tacctgcggcaatgactgcatccga

SEQ ID NO: 744996 - DNA, 25 bp, Mus musculus
tacctgcgggtgaacgtggctgacg

SEQ ID NO: 744997 - DNA, 25 bp, Mus musculus
tacctgcgggtgtacgtggctgacg

SEQ ID NO: 744998 - DNA, 25 bp, Mus musculus
tacctgctaagaagccagtattggg

SEQ ID NO: 744999 - DNA, 25 bp, Mus musculus
tacctgctaagatgccagtattggg

SEQ ID NO: 745000 - DNA, 25 bp, Mus musculus
tacctgctagtgaggaaggaatcct

SEQ ID NO: 745001 - DNA, 25 bp, Mus musculus
tacctgctagtgtggaaggaatcct

SEQ ID NO: 745002 - DNA, 25 bp, Mus musculus
tacctgctcagccaaagctttagga

SEQ ID NO: 745003 - DNA, 25 bp, Mus musculus
tacctgctcagcctaccttcagtga

SEQ ID NO: 745004 - DNA, 25 bp, Mus musculus
tacctgctcagcgaaagctttagga

SEQ ID NO: 745005 - DNA, 25 bp, Mus musculus
tacctgctcagcgtaccttcagtga

SEQ ID NO: 745006 - DNA, 25 bp, Mus musculus
tacctgctctacatctatgaccgaa

SEQ ID NO: 745007 - DNA, 25 bp, Mus musculus
tacctgctctacttctatgaccgaa

SEQ ID NO: 745008 - DNA, 25 bp, Mus musculus
tacctgctcttcctcttcaatttcg

SEQ ID NO: 745009 - DNA, 25 bp, Mus musculus
tacctgctcttcgtcttcaatttcg

SEQ ID NO: 745010 - DNA, 25 bp, Mus musculus
tacctgctggcaaaaagactttaat

SEQ ID NO: 745011 - DNA, 25 bp, Mus musculus
tacctgctggcataaagactttaat

SEQ ID NO: 745012 - DNA, 25 bp, Mus musculus
tacctgctgtaaactgtgtatggca

SEQ ID NO: 745013 - DNA, 25 bp, Mus musculus
tacctgctgtaatctgtgtatggca

SEQ ID NO: 745014 - DNA, 25 bp, Mus musculus
tacctgcttctcaacagaaaatgac

SEQ ID NO: 745015 - DNA, 25 bp, Mus musculus
tacctgcttctctacagaaaatgac

SEQ ID NO: 745016 - DNA, 25 bp, Mus musculus
tacctgcttgagcacctggcgtctg

SEQ ID NO: 745017 - DNA, 25 bp, Mus musculus
tacctgcttgaggacctggcgtctg

SEQ ID NO: 745018 - DNA, 25 bp, Mus musculus
tacctgcttggacaagtactaaaca

SEQ ID NO: 745019 - DNA, 25 bp, Mus musculus
tacctgcttggagaagtactaaaca

SEQ ID NO: 745020 - DNA, 25 bp, Mus musculus
tacctgcttggcaactagagaaaca

SEQ ID NO: 745021 - DNA, 25 bp, Mus musculus
tacctgcttggctactagagaaaca

SEQ ID NO: 745022 - DNA, 25 bp, Mus musculus
tacctggaaaacaatgcaacaagca

SEQ ID NO: 745023 - DNA, 25 bp, Mus musculus
tacctggaaaacaatgcccagactc

SEQ ID NO: 745024 - DNA, 25 bp, Mus musculus
tacctggaaaactatgcaacaagca

SEQ ID NO: 745025 - DNA, 25 bp, Mus musculus
tacctggaaaactatgcccagactc

SEQ ID NO: 745026 - DNA, 25 bp, Mus musculus
tacctggaactgctcctgtgttggg

SEQ ID NO: 745027 - DNA, 25 bp, Mus musculus
tacctggaactggtcctgtgttggg

SEQ ID NO: 745028 - DNA, 25 bp, Mus musculus
tacctggaagcccactggattgtga

SEQ ID NO: 745029 - DNA, 25 bp, Mus musculus
tacctggaagccgactggattgtga

SEQ ID NO: 745030 - DNA, 25 bp, Mus musculus
tacctggaagttcgacagctatccc

SEQ ID NO: 745031 - DNA, 25 bp, Mus musculus
tacctggaagttggacagctatccc

SEQ ID NO: 745032 - DNA, 25 bp, Mus musculus
tacctggaatggaaagcacacagga

SEQ ID NO: 745033 - DNA, 25 bp, Mus musculus
tacctggaatggaaatacaaaagta

SEQ ID NO: 745034 - DNA, 25 bp, Mus musculus
tacctggaatggcaggacaatcctc

SEQ ID NO: 745035 - DNA, 25 bp, Mus musculus
tacctggaatgggaggacaatcctc

SEQ ID NO: 745036 - DNA, 25 bp, Mus musculus
tacctggaatggtaagcacacagga

SEQ ID NO: 745037 - DNA, 25 bp, Mus musculus
tacctggaatggtaatacaaaagta

SEQ ID NO: 745038 - DNA, 25 bp, Mus musculus
tacctggaatgtcttcattatctgc

SEQ ID NO: 745039 - DNA, 25 bp, Mus musculus
tacctggaatgtgttcattatctgc

SEQ ID NO: 745040 - DNA, 25 bp, Mus musculus
tacctggacaagaacaaccccagca

SEQ ID NO: 745041 - DNA, 25 bp, Mus musculus
tacctggacaagtacaaccccagca

SEQ ID NO: 745042 - DNA, 25 bp, Mus musculus
tacctggacctgcaagatattgcca

SEQ ID NO: 745043 - DNA, 25 bp, Mus musculus
tacctggacctgctggcaatgttgc

SEQ ID NO: 745044 - DNA, 25 bp, Mus musculus
tacctggacctggaagatattgcca

SEQ ID NO: 745045 - DNA, 25 bp, Mus musculus
tacctggacctggtggcaatgttgc

SEQ ID NO: 745046 - DNA, 25 bp, Mus musculus
tacctggacgagacgtgcacgtgct

SEQ ID NO: 745047 - DNA, 25 bp, Mus musculus
tacctggacgagtcgtgcacgtgct

SEQ ID NO: 745048 - DNA, 25 bp, Mus musculus
tacctggagaggagctgctatattc

SEQ ID NO: 745049 - DNA, 25 bp, Mus musculus
tacctggagaggtgctgctatattc

SEQ ID NO: 745050 - DNA, 25 bp, Mus musculus
tacctggaggagaccgatgacgatg

SEQ ID NO: 745051 - DNA, 25 bp, Mus musculus
tacctggaggagtccgatgacgatg

SEQ ID NO: 745052 - DNA, 25 bp, Mus musculus
tacctggagggtaacaattttgtgc

SEQ ID NO: 745053 - DNA, 25 bp, Mus musculus
tacctggagggttacaattttgtgc

SEQ ID NO: 745054 - DNA, 25 bp, Mus musculus
tacctggagtatcgttccttctgca

SEQ ID NO: 745055 - DNA, 25 bp, Mus musculus
tacctggagtatggttccttctgca

SEQ ID NO: 745056 - DNA, 25 bp, Mus musculus
tacctggagttgagggtgacaccca

SEQ ID NO: 745057 - DNA, 25 bp, Mus musculus
tacctggagttgtgggtgacaccca

SEQ ID NO: 745058 - DNA, 25 bp, Mus musculus
tacctggatcctacgtgcttcatgc

SEQ ID NO: 745059 - DNA, 25 bp, Mus musculus
tacctggatccttcgtgcttcatgc

SEQ ID NO: 745060 - DNA, 25 bp, Mus musculus
tacctggatgctagtatactttgct

SEQ ID NO: 745061 - DNA, 25 bp, Mus musculus
tacctggatgcttgtatactttgct

SEQ ID NO: 745062 - DNA, 25 bp, Mus musculus
tacctggcagagatcacactagccc

SEQ ID NO: 745063 - DNA, 25 bp, Mus musculus
tacctggcagagttcacactagccc

SEQ ID NO: 745064 - DNA, 25 bp, Mus musculus
tacctggcagcaatcatcacagtga

SEQ ID NO: 745065 - DNA, 25 bp, Mus musculus
tacctggcagcattcatcacagtga

SEQ ID NO: 745066 - DNA, 25 bp, Mus musculus
tacctggcctgaacaatgtgtgtca

SEQ ID NO: 745067 - DNA, 25 bp, Mus musculus
tacctggcctgatcaatgtgtgtca

SEQ ID NO: 745068 - DNA, 25 bp, Mus musculus
tacctggcgctccatgtgtacttcc

SEQ ID NO: 745069 - DNA, 25 bp, Mus musculus
tacctggcgctcgatgtgtacttcc

SEQ ID NO: 745070 - DNA, 25 bp, Mus musculus
tacctggcgcttatgacaaagggcc

SEQ ID NO: 745071 - DNA, 25 bp, Mus musculus
tacctggcgcttttgacaaagggcc

SEQ ID NO: 745072 - DNA, 25 bp, Mus musculus
tacctggcggacaggtcagtcctgg

SEQ ID NO: 745073 - DNA, 25 bp, Mus musculus
tacctggcggactggtcagtcctgg

SEQ ID NO: 745074 - DNA, 25 bp, Mus musculus
tacctggcggatcatacagtagtgc

SEQ ID NO: 745075 - DNA, 25 bp, Mus musculus
tacctggcggatgatacagtagtgc

SEQ ID NO: 745076 - DNA, 25 bp, Mus musculus
tacctggcgtcccaacactttgtgc

SEQ ID NO: 745077 - DNA, 25 bp, Mus musculus
tacctggcgtccgaacactttgtgc

SEQ ID NO: 745078 - DNA, 25 bp, Mus musculus
tacctggctaaccagatcctgtggg

SEQ ID NO: 745079 - DNA, 25 bp, Mus musculus
tacctggctaacgagatcctgtggg

SEQ ID NO: 745080 - DNA, 25 bp, Mus musculus
tacctggcttcaccgatccacgaag

SEQ ID NO: 745081 - DNA, 25 bp, Mus musculus
tacctggcttcagcgatccacgaag

SEQ ID NO: 745082 - DNA, 25 bp, Mus musculus
tacctgggccacacaaacgcttgtt

SEQ ID NO: 745083 - DNA, 25 bp, Mus musculus
tacctgggccactcaaacgcttgtt

SEQ ID NO: 745084 - DNA, 25 bp, Mus musculus
tacctgggtgacaggtacaatcgaa

SEQ ID NO: 745085 - DNA, 25 bp, Mus musculus
tacctgggtgactggtacaatcgaa

SEQ ID NO: 745086 - DNA, 25 bp, Mus musculus
tacctgggtgccaagcctaggagct

SEQ ID NO: 745087 - DNA, 25 bp, Mus musculus
tacctgggtgcctagcctaggagct

SEQ ID NO: 745088 - DNA, 25 bp, Mus musculus
tacctggtacccaccctgggttgag

SEQ ID NO: 745089 - DNA, 25 bp, Mus musculus
tacctggtaccctccctgggttgag

SEQ ID NO: 745090 - DNA, 25 bp, Mus musculus
tacctggtatgcaaaatccactacg

SEQ ID NO: 745091 - DNA, 25 bp, Mus musculus
tacctggtatgctaaatccactacg

SEQ ID NO: 745092 - DNA, 25 bp, Mus musculus
tacctggtcacacatcctagtggcc

SEQ ID NO: 745093 - DNA, 25 bp, Mus musculus
tacctggtcacagatcctagtggcc

SEQ ID NO: 745094 - DNA, 25 bp, Mus musculus
tacctggtcagaccacgatatcctg

SEQ ID NO: 745095 - DNA, 25 bp, Mus musculus
tacctggtcagagcacgatatcctg

SEQ ID NO: 745096 - DNA, 25 bp, Mus musculus
tacctggtccacatagggcttggcc

SEQ ID NO: 745097 - DNA, 25 bp, Mus musculus
tacctggtccacttagggcttggcc

SEQ ID NO: 745098 - DNA, 25 bp, Mus musculus
tacctggtccttctgaggctggtct

SEQ ID NO: 745099 - DNA, 25 bp, Mus musculus
tacctggtccttgtgaggctggtct

SEQ ID NO: 745100 - DNA, 25 bp, Mus musculus
tacctggtctacacgagcagcatgg

SEQ ID NO: 745101 - DNA, 25 bp, Mus musculus
tacctggtctactcgagcagcatgg

SEQ ID NO: 745102 - DNA, 25 bp, Mus musculus
tacctggtcttaccccaggaagcca

SEQ ID NO: 745103 - DNA, 25 bp, Mus musculus
tacctggtcttagcccaggaagcca

SEQ ID NO: 745104 - DNA, 25 bp, Mus musculus
tacctggtgacaagcgtgttgcgtg

SEQ ID NO: 745105 - DNA, 25 bp, Mus musculus
tacctggtgacatgcgtgttgcgtg

SEQ ID NO: 745106 - DNA, 25 bp, Mus musculus
tacctggtgcctcaatcagactaca

SEQ ID NO: 745107 - DNA, 25 bp, Mus musculus
tacctggtgcctctcttgagactgc

SEQ ID NO: 745108 - DNA, 25 bp, Mus musculus
tacctggtgcctgaatcagactaca

SEQ ID NO: 745109 - DNA, 25 bp, Mus musculus
tacctggtgcctgtcttgagactgc

SEQ ID NO: 745110 - DNA, 25 bp, Mus musculus
tacctggtgcgtctggacgcagccc

SEQ ID NO: 745111 - DNA, 25 bp, Mus musculus
tacctggtgcgtgtggacgcagccc

SEQ ID NO: 745112 - DNA, 25 bp, Mus musculus
tacctggtgctcagtctggacaact

SEQ ID NO: 745113 - DNA, 25 bp, Mus musculus
tacctggtgctctgtctggacaact

SEQ ID NO: 745114 - DNA, 25 bp, Mus musculus
tacctggttatcaggtgcattgacc

SEQ ID NO: 745115 - DNA, 25 bp, Mus musculus
tacctggttatctggtgcattgacc

SEQ ID NO: 745116 - DNA, 25 bp, Mus musculus
tacctggttggaacaggcccggaaa

SEQ ID NO: 745117 - DNA, 25 bp, Mus musculus
tacctggttggatcaggcccggaaa

SEQ ID NO: 745118 - DNA, 25 bp, Mus musculus
tacctgtagaagagtctgaggcagc

SEQ ID NO: 745119 - DNA, 25 bp, Mus musculus
tacctgtagaagtgtctgaggcagc

SEQ ID NO: 745120 - DNA, 25 bp, Mus musculus
tacctgtcaacacactggagcgaga

SEQ ID NO: 745121 - DNA, 25 bp, Mus musculus
tacctgtcaacagactggagcgaga

SEQ ID NO: 745122 - DNA, 25 bp, Mus musculus
tacctgtcagacagggccatggcga

SEQ ID NO: 745123 - DNA, 25 bp, Mus musculus
tacctgtcagactgggccatggcga

SEQ ID NO: 745124 - DNA, 25 bp, Mus musculus
tacctgtcagctcgagaatgtgctc

SEQ ID NO: 745125 - DNA, 25 bp, Mus musculus
tacctgtcagctggagaatgtgctc

SEQ ID NO: 745126 - DNA, 25 bp, Mus musculus
tacctgtccaaaatggtgcccaaca

SEQ ID NO: 745127 - DNA, 25 bp, Mus musculus
tacctgtccaaattggtgcccaaca

SEQ ID NO: 745128 - DNA, 25 bp, Mus musculus
tacctgtccgtgctctcgctttttt

SEQ ID NO: 745129 - DNA, 25 bp, Mus musculus
tacctgtccgtggtctcgctttttt

SEQ ID NO: 745130 - DNA, 25 bp, Mus musculus
tacctgtcctggaagagcggaccag

SEQ ID NO: 745131 - DNA, 25 bp, Mus musculus
tacctgtcctggtagagcggaccag

SEQ ID NO: 745132 - DNA, 25 bp, Mus musculus
tacctgtcctttccctgttggtcaa

SEQ ID NO: 745133 - DNA, 25 bp, Mus musculus
tacctgtcctttgcctgttggtcaa

SEQ ID NO: 745134 - DNA, 25 bp, Mus musculus
tacctgtcgcttaacctgttgttgg

SEQ ID NO: 745135 - DNA, 25 bp, Mus musculus
tacctgtcgctttacctgttgttgg

SEQ ID NO: 745136 - DNA, 25 bp, Mus musculus
tacctgtcggtgaaggccctctaca

SEQ ID NO: 745137 - DNA, 25 bp, Mus musculus
tacctgtcggtgtaggccctctaca

SEQ ID NO: 745138 - DNA, 25 bp, Mus musculus
tacctgtgaaagaaagtcacacaca

SEQ ID NO: 745139 - DNA, 25 bp, Mus musculus
tacctgtgaaagtaagtcacacaca

SEQ ID NO: 745140 - DNA, 25 bp, Mus musculus
tacctgtgaattcgtaaggacccta

SEQ ID NO: 745141 - DNA, 25 bp, Mus musculus
tacctgtgaattggtaaggacccta

SEQ ID NO: 745142 - DNA, 25 bp, Mus musculus
tacctgtgacagaactcgagaatgg

SEQ ID NO: 745143 - DNA, 25 bp, Mus musculus
tacctgtgacagtactcgagaatgg

SEQ ID NO: 745144 - DNA, 25 bp, Mus musculus
tacctgtgcattaataccgggaaga

SEQ ID NO: 745145 - DNA, 25 bp, Mus musculus
tacctgtgcatttataccgggaaga

SEQ ID NO: 745146 - DNA, 25 bp, Mus musculus
tacctgtgccagacccacggaggag

SEQ ID NO: 745147 - DNA, 25 bp, Mus musculus
tacctgtgccagtcccacggaggag

SEQ ID NO: 745148 - DNA, 25 bp, Mus musculus
tacctgtggaatccccggataccca

SEQ ID NO: 745149 - DNA, 25 bp, Mus musculus
tacctgtggaatgcccggataccca

SEQ ID NO: 745150 - DNA, 25 bp, Mus musculus
tacctgtgggataccatggccgagc

SEQ ID NO: 745151 - DNA, 25 bp, Mus musculus
tacctgtgggattccatggccgagc

SEQ ID NO: 745152 - DNA, 25 bp, Mus musculus
tacctgtggtagactcacagctgcc

SEQ ID NO: 745153 - DNA, 25 bp, Mus musculus
tacctgtggtagtctcacagctgcc

SEQ ID NO: 745154 - DNA, 25 bp, Mus musculus
tacctgtggttcatcattgagaagg

SEQ ID NO: 745155 - DNA, 25 bp, Mus musculus
tacctgtggttcttcattgagaagg

SEQ ID NO: 745156 - DNA, 25 bp, Mus musculus
tacctgtgtgacaaggttgttcctg

SEQ ID NO: 745157 - DNA, 25 bp, Mus musculus
tacctgtgtgactaggttgttcctg

SEQ ID NO: 745158 - DNA, 25 bp, Mus musculus
tacctgtgtggcactaagagtgacc

SEQ ID NO: 745159 - DNA, 25 bp, Mus musculus
tacctgtgtggctctaagagtgacc

SEQ ID NO: 745160 - DNA, 25 bp, Mus musculus
tacctgtgtgtacatatggcttcag

SEQ ID NO: 745161 - DNA, 25 bp, Mus musculus
tacctgtgtgtagatatggcttcag

SEQ ID NO: 745162 - DNA, 25 bp, Mus musculus
tacctgttccggaggagactgagcc

SEQ ID NO: 745163 - DNA, 25 bp, Mus musculus
tacctgttccggtggagactgagcc

SEQ ID NO: 745164 - DNA, 25 bp, Mus musculus
tacctgttcttgcattcgactcaca

SEQ ID NO: 745165 - DNA, 25 bp, Mus musculus
tacctgttcttggattcgactcaca

SEQ ID NO: 745166 - DNA, 25 bp, Mus musculus
tacctgttggccacatccttcgtgt

SEQ ID NO: 745167 - DNA, 25 bp, Mus musculus
tacctgttggcctcatccttcgtgt

SEQ ID NO: 745168 - DNA, 25 bp, Mus musculus
tacctgttggtcaatgcatcatatg

SEQ ID NO: 745169 - DNA, 25 bp, Mus musculus
tacctgttggtctatgcatcatatg

SEQ ID NO: 745170 - DNA, 25 bp, Mus musculus
tacctgttgttgctcagctgtccaa

SEQ ID NO: 745171 - DNA, 25 bp, Mus musculus
tacctgttgttggtcagctgtccaa

SEQ ID NO: 745172 - DNA, 25 bp, Mus musculus
tacctgtttatcactggccctgaag

SEQ ID NO: 745173 - DNA, 25 bp, Mus musculus
tacctgtttatctctggccctgaag

SEQ ID NO: 745174 - DNA, 25 bp, Mus musculus
tacctgtttcctaggcaactgctag

SEQ ID NO: 745175 - DNA, 25 bp, Mus musculus
tacctgtttccttggcaactgctag

SEQ ID NO: 745176 - DNA, 25 bp, Mus musculus
tacctgtttggcagtgacgtggtcg

SEQ ID NO: 745177 - DNA, 25 bp, Mus musculus
tacctgtttggctgtgacgtggtcg

SEQ ID NO: 745178 - DNA, 25 bp, Mus musculus
taccttaagaggaagcctttggact

SEQ ID NO: 745179 - DNA, 25 bp, Mus musculus
taccttaagaggtagcctttggact

SEQ ID NO: 745180 - DNA, 25 bp, Mus musculus
taccttaagccgaacttcctggaag

SEQ ID NO: 745181 - DNA, 25 bp, Mus musculus
taccttaagccgtacttcctggaag

SEQ ID NO: 745182 - DNA, 25 bp, Mus musculus
taccttaaggatacagaaagaatgt

SEQ ID NO: 745183 - DNA, 25 bp, Mus musculus
taccttaaggattcagaaagaatgt

SEQ ID NO: 745184 - DNA, 25 bp, Mus musculus
taccttacacgaaagactggaacaa

SEQ ID NO: 745185 - DNA, 25 bp, Mus musculus
taccttacacgatagactggaacaa

SEQ ID NO: 745186 - DNA, 25 bp, Mus musculus
taccttacccaccatggaccaaatg

SEQ ID NO: 745187 - DNA, 25 bp, Mus musculus
taccttacccacgatggaccaaatg

SEQ ID NO: 745188 - DNA, 25 bp, Mus musculus
taccttacgtaaaggcttggctcct

SEQ ID NO: 745189 - DNA, 25 bp, Mus musculus
taccttacgtaatggcttggctcct

SEQ ID NO: 745190 - DNA, 25 bp, Mus musculus
taccttaggtctaggcccttgagct

SEQ ID NO: 745191 - DNA, 25 bp, Mus musculus
taccttaggtcttggcccttgagct

SEQ ID NO: 745192 - DNA, 25 bp, Mus musculus
taccttatgactaccaggaggcaga

SEQ ID NO: 745193 - DNA, 25 bp, Mus musculus
taccttatgacttccaggaggcaga

SEQ ID NO: 745194 - DNA, 25 bp, Mus musculus
taccttatgagtatgggtcttttgc

SEQ ID NO: 745195 - DNA, 25 bp, Mus musculus
taccttatgagtttgggtcttttgc

SEQ ID NO: 745196 - DNA, 25 bp, Mus musculus
taccttatggacctgagctactcaa

SEQ ID NO: 745197 - DNA, 25 bp, Mus musculus
taccttatggacgtgagctactcaa

SEQ ID NO: 745198 - DNA, 25 bp, Mus musculus
taccttatggttcattgctgttggc

SEQ ID NO: 745199 - DNA, 25 bp, Mus musculus
taccttatggttgattgctgttggc

SEQ ID NO: 745200 - DNA, 25 bp, Mus musculus
taccttcactgacttgggccgatgt

SEQ ID NO: 745201 - DNA, 25 bp, Mus musculus
taccttcactgagttgggccgatgt

SEQ ID NO: 745202 - DNA, 25 bp, Mus musculus
taccttcagattcttgaccaaaatg

SEQ ID NO: 745203 - DNA, 25 bp, Mus musculus
taccttcagattgttgaccaaaatg

SEQ ID NO: 745204 - DNA, 25 bp, Mus musculus
taccttcaggtgatagaatgtgagc

SEQ ID NO: 745205 - DNA, 25 bp, Mus musculus
taccttcaggtgttagaatgtgagc

SEQ ID NO: 745206 - DNA, 25 bp, Mus musculus
taccttcagtgacatggccaatcct

SEQ ID NO: 745207 - DNA, 25 bp, Mus musculus
taccttcagtgagatggccaatcct

SEQ ID NO: 745208 - DNA, 25 bp, Mus musculus
taccttcagttcaagaatggattgt

SEQ ID NO: 745209 - DNA, 25 bp, Mus musculus
taccttcagttctagaatggattgt

SEQ ID NO: 745210 - DNA, 25 bp, Mus musculus
taccttccaaggcatgttaaccaag

SEQ ID NO: 745211 - DNA, 25 bp, Mus musculus
taccttccaagggatgttaaccaag

SEQ ID NO: 745212 - DNA, 25 bp, Mus musculus
taccttcccaaacaggatctaagcc

SEQ ID NO: 745213 - DNA, 25 bp, Mus musculus
taccttcccaaagaggatctaagcc

SEQ ID NO: 745214 - DNA, 25 bp, Mus musculus
taccttccggatagaggataaacag

SEQ ID NO: 745215 - DNA, 25 bp, Mus musculus
taccttccggattgaggataaacag

SEQ ID NO: 745216 - DNA, 25 bp, Mus musculus
taccttcctgagagcggaactggcc

SEQ ID NO: 745217 - DNA, 25 bp, Mus musculus
taccttcctgagtgcggaactggcc

SEQ ID NO: 745218 - DNA, 25 bp, Mus musculus
taccttccttgcactatcccattag

SEQ ID NO: 745219 - DNA, 25 bp, Mus musculus
taccttccttgctctatcccattag

SEQ ID NO: 745220 - DNA, 25 bp, Mus musculus
taccttcgagagaggaacatgtctc

SEQ ID NO: 745221 - DNA, 25 bp, Mus musculus
taccttcgagagtggaacatgtctc

SEQ ID NO: 745222 - DNA, 25 bp, Mus musculus
taccttcgatttaccacagaacagc

SEQ ID NO: 745223 - DNA, 25 bp, Mus musculus
taccttcgattttccacagaacagc

SEQ ID NO: 745224 - DNA, 25 bp, Mus musculus
taccttctaaaaaggaagtggagcg

SEQ ID NO: 745225 - DNA, 25 bp, Mus musculus
taccttctaaaatggaagtggagcg

SEQ ID NO: 745226 - DNA, 25 bp, Mus musculus
taccttctatgtcgtgatcggtgac

SEQ ID NO: 745227 - DNA, 25 bp, Mus musculus
taccttctatgtggtgatcggtgac

SEQ ID NO: 745228 - DNA, 25 bp, Mus musculus
taccttctggccatggagcgacatg

SEQ ID NO: 745229 - DNA, 25 bp, Mus musculus
taccttctggccttggagcgacatg

SEQ ID NO: 745230 - DNA, 25 bp, Mus musculus
taccttcttgaaaagtctcgcctgg

SEQ ID NO: 745231 - DNA, 25 bp, Mus musculus
taccttcttgaatagtctcgcctgg

SEQ ID NO: 745232 - DNA, 25 bp, Mus musculus
taccttctttaactgcacagtggat

SEQ ID NO: 745233 - DNA, 25 bp, Mus musculus
taccttctttaagtgcacagtggat

SEQ ID NO: 745234 - DNA, 25 bp, Mus musculus
taccttgaaaccactgacggcactg

SEQ ID NO: 745235 - DNA, 25 bp, Mus musculus
taccttgaaacctctgacggcactg

SEQ ID NO: 745236 - DNA, 25 bp, Mus musculus
taccttgaaagaacactgacatact

SEQ ID NO: 745237 - DNA, 25 bp, Mus musculus
taccttgaaagatcactgacatact

SEQ ID NO: 745238 - DNA, 25 bp, Mus musculus
taccttgaagagcaaactgtgtggc

SEQ ID NO: 745239 - DNA, 25 bp, Mus musculus
taccttgaagaggaaactgtgtggc

SEQ ID NO: 745240 - DNA, 25 bp, Mus musculus
taccttgacgatctcccatttaaga

SEQ ID NO: 745241 - DNA, 25 bp, Mus musculus
taccttgacgatgtcccatttaaga

SEQ ID NO: 745242 - DNA, 25 bp, Mus musculus
taccttgataaacgacctgtgtgac

SEQ ID NO: 745243 - DNA, 25 bp, Mus musculus
taccttgataaaggacctgtgtgac

SEQ ID NO: 745244 - DNA, 25 bp, Mus musculus
taccttgataatccaggcagaccac

SEQ ID NO: 745245 - DNA, 25 bp, Mus musculus
taccttgataatgcaggcagaccac

SEQ ID NO: 745246 - DNA, 25 bp, Mus musculus
taccttgatgatcctcttatgaagc

SEQ ID NO: 745247 - DNA, 25 bp, Mus musculus
taccttgatgatgctcttatgaagc

SEQ ID NO: 745248 - DNA, 25 bp, Mus musculus
taccttgattccagacattgtgcag

SEQ ID NO: 745249 - DNA, 25 bp, Mus musculus
taccttgattcctgacattgtgcag

SEQ ID NO: 745250 - DNA, 25 bp, Mus musculus
taccttgcaagaatgtcttgctgcc

SEQ ID NO: 745251 - DNA, 25 bp, Mus musculus
taccttgcaagattgtcttgctgcc

SEQ ID NO: 745252 - DNA, 25 bp, Mus musculus
taccttgcagagctgatagaagagt

SEQ ID NO: 745253 - DNA, 25 bp, Mus musculus
taccttgcagaggtgatagaagagt

SEQ ID NO: 745254 - DNA, 25 bp, Mus musculus
taccttgcagcacgtgctcaggtcc

SEQ ID NO: 745255 - DNA, 25 bp, Mus musculus
taccttgcagcaggtgctcaggtcc

SEQ ID NO: 745256 - DNA, 25 bp, Mus musculus
taccttgcatctctctcattcagtg

SEQ ID NO: 745257 - DNA, 25 bp, Mus musculus
taccttgcatctgtctcattcagtg

SEQ ID NO: 745258 - DNA, 25 bp, Mus musculus
taccttgccactcggccaaagttgg

SEQ ID NO: 745259 - DNA, 25 bp, Mus musculus
taccttgccactgggccaaagttgg

SEQ ID NO: 745260 - DNA, 25 bp, Mus musculus
taccttgcggagagttcagctgctc

SEQ ID NO: 745261 - DNA, 25 bp, Mus musculus
taccttgcggagtgttcagctgctc

SEQ ID NO: 745262 - DNA, 25 bp, Mus musculus
taccttgctcgaaatggcaaggatg

SEQ ID NO: 745263 - DNA, 25 bp, Mus musculus
taccttgctcgatatggcaaggatg

SEQ ID NO: 745264 - DNA, 25 bp, Mus musculus
taccttggaccgcagcagttgccag

SEQ ID NO: 745265 - DNA, 25 bp, Mus musculus
taccttggaccggagcagttgccag

SEQ ID NO: 745266 - DNA, 25 bp, Mus musculus
taccttggactccatcagaggcttc

SEQ ID NO: 745267 - DNA, 25 bp, Mus musculus
taccttggactcgatcagaggcttc

SEQ ID NO: 745268 - DNA, 25 bp, Mus musculus
taccttggactgatcatgctttgtg

SEQ ID NO: 745269 - DNA, 25 bp, Mus musculus
taccttggactgttcatgctttgtg

SEQ ID NO: 745270 - DNA, 25 bp, Mus musculus
taccttggatggatcggctttcctc

SEQ ID NO: 745271 - DNA, 25 bp, Mus musculus
taccttggatggttcggctttcctc

SEQ ID NO: 745272 - DNA, 25 bp, Mus musculus
taccttggccacaagtgggcggcct

SEQ ID NO: 745273 - DNA, 25 bp, Mus musculus
taccttggccactagtgggcggcct

SEQ ID NO: 745274 - DNA, 25 bp, Mus musculus
taccttggccagaggcttgaacacc

SEQ ID NO: 745275 - DNA, 25 bp, Mus musculus
taccttggccagtggcttgaacacc

SEQ ID NO: 745276 - DNA, 25 bp, Mus musculus
taccttggctgcacggtcactcatg

SEQ ID NO: 745277 - DNA, 25 bp, Mus musculus
taccttggctgctcggtcactcatg

SEQ ID NO: 745278 - DNA, 25 bp, Mus musculus
taccttgggactctgaatgtcaccc

SEQ ID NO: 745279 - DNA, 25 bp, Mus musculus
taccttgggactgtgaatgtcaccc

SEQ ID NO: 745280 - DNA, 25 bp, Mus musculus
taccttgggcctacagaggacctct

SEQ ID NO: 745281 - DNA, 25 bp, Mus musculus
taccttgggccttcagaggacctct

SEQ ID NO: 745282 - DNA, 25 bp, Mus musculus
taccttgggtaactggccagagccc

SEQ ID NO: 745283 - DNA, 25 bp, Mus musculus
taccttgggtaagtggccagagccc

SEQ ID NO: 745284 - DNA, 25 bp, Mus musculus
taccttggtagaaagtggctgctca

SEQ ID NO: 745285 - DNA, 25 bp, Mus musculus
taccttggtagatagtggctgctca

SEQ ID NO: 745286 - DNA, 25 bp, Mus musculus
taccttggtagcctcctagggaggc

SEQ ID NO: 745287 - DNA, 25 bp, Mus musculus
taccttggtagcgtcctagggaggc

SEQ ID NO: 745288 - DNA, 25 bp, Mus musculus
taccttgtagctctggataaatggc

SEQ ID NO: 745289 - DNA, 25 bp, Mus musculus
taccttgtagctgtggataaatggc

SEQ ID NO: 745290 - DNA, 25 bp, Mus musculus
taccttgtagggaaacatttcaacg

SEQ ID NO: 745291 - DNA, 25 bp, Mus musculus
taccttgtagggtaacatttcaacg

SEQ ID NO: 745292 - DNA, 25 bp, Mus musculus
taccttgtcaacaactatgggaacc

SEQ ID NO: 745293 - DNA, 25 bp, Mus musculus
taccttgtcaactactatgggaacc

SEQ ID NO: 745294 - DNA, 25 bp, Mus musculus
taccttgtcccgattacatttatga

SEQ ID NO: 745295 - DNA, 25 bp, Mus musculus
taccttgtcccgtttacatttatga

SEQ ID NO: 745296 - DNA, 25 bp, Mus musculus
taccttgttcctcgcgctgacatcg

SEQ ID NO: 745297 - DNA, 25 bp, Mus musculus
taccttgttcctggcgctgacatcg

SEQ ID NO: 745298 - DNA, 25 bp, Mus musculus
tacctttagaagcataagaaggcga

SEQ ID NO: 745299 - DNA, 25 bp, Mus musculus
tacctttagaaggataagaaggcga

SEQ ID NO: 745300 - DNA, 25 bp, Mus musculus
tacctttaggagctccgatccggga

SEQ ID NO: 745301 - DNA, 25 bp, Mus musculus
tacctttaggaggtccgatccggga

SEQ ID NO: 745302 - DNA, 25 bp, Mus musculus
tacctttagtatctgtgacacttcc

SEQ ID NO: 745303 - DNA, 25 bp, Mus musculus
tacctttagtatgtgtgacacttcc

SEQ ID NO: 745304 - DNA, 25 bp, Mus musculus
tacctttatggaagatcagtaccac

SEQ ID NO: 745305 - DNA, 25 bp, Mus musculus
tacctttatggatgatcagtaccac

SEQ ID NO: 745306 - DNA, 25 bp, Mus musculus
tacctttattcacctcgctcttcag

SEQ ID NO: 745307 - DNA, 25 bp, Mus musculus
tacctttattcagctcgctcttcag

SEQ ID NO: 745308 - DNA, 25 bp, Mus musculus
tacctttccacccaataagtaactg

SEQ ID NO: 745309 - DNA, 25 bp, Mus musculus
tacctttccaccgaataagtaactg

SEQ ID NO: 745310 - DNA, 25 bp, Mus musculus
tacctttcggcacatgcttatgctg

SEQ ID NO: 745311 - DNA, 25 bp, Mus musculus
tacctttcggcagatgcttatgctg

SEQ ID NO: 745312 - DNA, 25 bp, Mus musculus
tacctttctcggaggattttgttgt

SEQ ID NO: 745313 - DNA, 25 bp, Mus musculus
tacctttctcggtggattttgttgt

SEQ ID NO: 745314 - DNA, 25 bp, Mus musculus
tacctttgacctatgaacctgggag

SEQ ID NO: 745315 - DNA, 25 bp, Mus musculus
tacctttgacctttgaacctgggag

SEQ ID NO: 745316 - DNA, 25 bp, Mus musculus
tacctttgaggaagaatgtgggact

SEQ ID NO: 745317 - DNA, 25 bp, Mus musculus
tacctttgaggaccagggaacaact

SEQ ID NO: 745318 - DNA, 25 bp, Mus musculus
tacctttgaggagcagggaacaact

SEQ ID NO: 745319 - DNA, 25 bp, Mus musculus
tacctttgaggatgaatgtgggact

SEQ ID NO: 745320 - DNA, 25 bp, Mus musculus
tacctttgcaatccctgcggactct

SEQ ID NO: 745321 - DNA, 25 bp, Mus musculus
tacctttgcaatgcctgcggactct

SEQ ID NO: 745322 - DNA, 25 bp, Mus musculus
tacctttggactacatcacatacaa

SEQ ID NO: 745323 - DNA, 25 bp, Mus musculus
tacctttggacttcatcacatacaa

SEQ ID NO: 745324 - DNA, 25 bp, Mus musculus
taccttttcttaagtgaagccctgg

SEQ ID NO: 745325 - DNA, 25 bp, Mus musculus
taccttttcttatgtgaagccctgg

SEQ ID NO: 745326 - DNA, 25 bp, Mus musculus
taccttttgaaaaagcctcggaatg

SEQ ID NO: 745327 - DNA, 25 bp, Mus musculus
taccttttgaaatagcctcggaatg

SEQ ID NO: 745328 - DNA, 25 bp, Mus musculus
taccttttgaacatcggaggctgga

SEQ ID NO: 745329 - DNA, 25 bp, Mus musculus
taccttttgaacttcggaggctgga

SEQ ID NO: 745330 - DNA, 25 bp, Mus musculus
tacgaaaaagccaattggaactgga

SEQ ID NO: 745331 - DNA, 25 bp, Mus musculus
tacgaaaaagcctattggaactgga

SEQ ID NO: 745332 - DNA, 25 bp, Mus musculus
tacgaaagccaacaaagacgaagat

SEQ ID NO: 745333 - DNA, 25 bp, Mus musculus
tacgaaagccaagaaagacgaagat

SEQ ID NO: 745334 - DNA, 25 bp, Mus musculus
tacgaaagctcgacttaaggagggc

SEQ ID NO: 745335 - DNA, 25 bp, Mus musculus
tacgaaagctcgtcttaaggagggc

SEQ ID NO: 745336 - DNA, 25 bp, Mus musculus
tacgaaatcgttccagttctgacca

SEQ ID NO: 745337 - DNA, 25 bp, Mus musculus
tacgaaatcgttgcagttctgacca

SEQ ID NO: 745338 - DNA, 25 bp, Mus musculus
tacgaaatgtagctgacaactgtcc

SEQ ID NO: 745339 - DNA, 25 bp, Mus musculus
tacgaaatgtaggtgacaactgtcc

SEQ ID NO: 745340 - DNA, 25 bp, Mus musculus
tacgaacatttcagcagtccacacc

SEQ ID NO: 745341 - DNA, 25 bp, Mus musculus
tacgaacatttctgcagtccacacc

SEQ ID NO: 745342 - DNA, 25 bp, Mus musculus
tacgaaccacacagtgagtgatgtg

SEQ ID NO: 745343 - DNA, 25 bp, Mus musculus
tacgaaccacactgtgagtgatgtg

SEQ ID NO: 745344 - DNA, 25 bp, Mus musculus
tacgaacctggacagagaaatccgg

SEQ ID NO: 745345 - DNA, 25 bp, Mus musculus
tacgaacctggagagagaaatccgg

SEQ ID NO: 745346 - DNA, 25 bp, Mus musculus
tacgaacgagggaactgcagtggaa

SEQ ID NO: 745347 - DNA, 25 bp, Mus musculus
tacgaacgagggtactgcagtggaa

SEQ ID NO: 745348 - DNA, 25 bp, Mus musculus
tacgaactatagagttagatgggaa

SEQ ID NO: 745349 - DNA, 25 bp, Mus musculus
tacgaactatagtgttagatgggaa

SEQ ID NO: 745350 - DNA, 25 bp, Mus musculus
tacgaactcaccaacaacctagaga

SEQ ID NO: 745351 - DNA, 25 bp, Mus musculus
tacgaactcacctacaacctagaga

SEQ ID NO: 745352 - DNA, 25 bp, Mus musculus
tacgaactcttcaccaagatcgcct

SEQ ID NO: 745353 - DNA, 25 bp, Mus musculus
tacgaactcttctccaagatcgcct

SEQ ID NO: 745354 - DNA, 25 bp, Mus musculus
tacgaactgctgctcaaggaatatg

SEQ ID NO: 745355 - DNA, 25 bp, Mus musculus
tacgaactgctggtcaaggaatatg

SEQ ID NO: 745356 - DNA, 25 bp, Mus musculus
tacgaactgtgacgagcatatgggc

SEQ ID NO: 745357 - DNA, 25 bp, Mus musculus
tacgaactgtgaggagcatatgggc

SEQ ID NO: 745358 - DNA, 25 bp, Mus musculus
tacgaacttcgtaatttccagatta

SEQ ID NO: 745359 - DNA, 25 bp, Mus musculus
tacgaacttcgttatttccagatta

SEQ ID NO: 745360 - DNA, 25 bp, Mus musculus
tacgaagaagctatatacagatcca

SEQ ID NO: 745361 - DNA, 25 bp, Mus musculus
tacgaagaagctttatacagatcca

SEQ ID NO: 745362 - DNA, 25 bp, Mus musculus
tacgaagaatagaggcctctgcatc

SEQ ID NO: 745363 - DNA, 25 bp, Mus musculus
tacgaagaatagtggcctctgcatc

SEQ ID NO: 745364 - DNA, 25 bp, Mus musculus
tacgaagacaaccacctggttggat

SEQ ID NO: 745365 - DNA, 25 bp, Mus musculus
tacgaagacaacgacctggttggat

SEQ ID NO: 745366 - DNA, 25 bp, Mus musculus
tacgaagccaaccagcttaatgagt

SEQ ID NO: 745367 - DNA, 25 bp, Mus musculus
tacgaagccaacgagcttaatgagt

SEQ ID NO: 745368 - DNA, 25 bp, Mus musculus
tacgaagggataacgggctctcggt

SEQ ID NO: 745369 - DNA, 25 bp, Mus musculus
tacgaagggatatcgggctctcggt

SEQ ID NO: 745370 - DNA, 25 bp, Mus musculus
tacgaaggtttcctctggatgctgc

SEQ ID NO: 745371 - DNA, 25 bp, Mus musculus
tacgaaggtttcgtctggatgctgc

SEQ ID NO: 745372 - DNA, 25 bp, Mus musculus
tacgaagtctgtctggcaacctcaa

SEQ ID NO: 745373 - DNA, 25 bp, Mus musculus
tacgaagtctgtgtggcaacctcaa

SEQ ID NO: 745374 - DNA, 25 bp, Mus musculus
tacgaatgagctaccgtggtgacgg

SEQ ID NO: 745375 - DNA, 25 bp, Mus musculus
tacgaatgagcttccgtggtgacgg

SEQ ID NO: 745376 - DNA, 25 bp, Mus musculus
tacgaatgggacaggaagttatacc

SEQ ID NO: 745377 - DNA, 25 bp, Mus musculus
tacgaatgggactggaagttatacc

SEQ ID NO: 745378 - DNA, 25 bp, Mus musculus
tacgaatgtgccagtgaaccaggct

SEQ ID NO: 745379 - DNA, 25 bp, Mus musculus
tacgaatgtgcctgtgaaccaggct

SEQ ID NO: 745380 - DNA, 25 bp, Mus musculus
tacgaattagctcttgccaatactg

SEQ ID NO: 745381 - DNA, 25 bp, Mus musculus
tacgaattagctgttgccaatactg

SEQ ID NO: 745382 - DNA, 25 bp, Mus musculus
tacgaattctctcacccatgaactc

SEQ ID NO: 745383 - DNA, 25 bp, Mus musculus
tacgaattctctgacccatgaactc

SEQ ID NO: 745384 - DNA, 25 bp, Mus musculus
tacgaatttgtcaaacaaacaagtc

SEQ ID NO: 745385 - DNA, 25 bp, Mus musculus
tacgaatttgtctaacaaacaagtc

SEQ ID NO: 745386 - DNA, 25 bp, Mus musculus
tacgacaacgggaacttctttccag

SEQ ID NO: 745387 - DNA, 25 bp, Mus musculus
tacgacaacgggtacttctttccag

SEQ ID NO: 745388 - DNA, 25 bp, Mus musculus
tacgacaaggcgatcgtccctgaga

SEQ ID NO: 745389 - DNA, 25 bp, Mus musculus
tacgacaaggcgttcgtccctgaga

SEQ ID NO: 745390 - DNA, 25 bp, Mus musculus
tacgacaagtgtcatcggagctgca

SEQ ID NO: 745391 - DNA, 25 bp, Mus musculus
tacgacaagtgtgatcggagctgca

SEQ ID NO: 745392 - DNA, 25 bp, Mus musculus
tacgacaagttccagcgtgccacat

SEQ ID NO: 745393 - DNA, 25 bp, Mus musculus
tacgacaagttcgagcgtgccacat

SEQ ID NO: 745394 - DNA, 25 bp, Mus musculus
tacgacacaaaacgctgaacgggag

SEQ ID NO: 745395 - DNA, 25 bp, Mus musculus
tacgacacaaaaggctgaacgggag

SEQ ID NO: 745396 - DNA, 25 bp, Mus musculus
tacgacacaatgcagtacatcctga

SEQ ID NO: 745397 - DNA, 25 bp, Mus musculus
tacgacacaatggagtacatcctga

SEQ ID NO: 745398 - DNA, 25 bp, Mus musculus
tacgacaccatcatcagtgaggacc

SEQ ID NO: 745399 - DNA, 25 bp, Mus musculus
tacgacaccatcttcagtgaggacc

SEQ ID NO: 745400 - DNA, 25 bp, Mus musculus
tacgacagccacattaagagcagca

SEQ ID NO: 745401 - DNA, 25 bp, Mus musculus
tacgacagccactttaagagcagca

SEQ ID NO: 745402 - DNA, 25 bp, Mus musculus
tacgacattggcaagtctaatgatt

SEQ ID NO: 745403 - DNA, 25 bp, Mus musculus
tacgacattggctagtctaatgatt

SEQ ID NO: 745404 - DNA, 25 bp, Mus musculus
tacgaccaactgaccctagtgagat

SEQ ID NO: 745405 - DNA, 25 bp, Mus musculus
tacgaccaactgtccctagtgagat

SEQ ID NO: 745406 - DNA, 25 bp, Mus musculus
tacgacccatgcaccagtttgggct

SEQ ID NO: 745407 - DNA, 25 bp, Mus musculus
tacgacccatgctccagtttgggct

SEQ ID NO: 745408 - DNA, 25 bp, Mus musculus
tacgaccgacggcagtacaggcgct

SEQ ID NO: 745409 - DNA, 25 bp, Mus musculus
tacgaccgacgggagtacaggcgct

SEQ ID NO: 745410 - DNA, 25 bp, Mus musculus
tacgaccgctaacttatccacagac

SEQ ID NO: 745411 - DNA, 25 bp, Mus musculus
tacgaccgctaagttatccacagac

SEQ ID NO: 745412 - DNA, 25 bp, Mus musculus
tacgacctggagattatcaagaagc

SEQ ID NO: 745413 - DNA, 25 bp, Mus musculus
tacgacctggagtttatcaagaagc

SEQ ID NO: 745414 - DNA, 25 bp, Mus musculus
tacgacctggccatgggcgcagacc

SEQ ID NO: 745415 - DNA, 25 bp, Mus musculus
tacgacctggccttgggcgcagacc

SEQ ID NO: 745416 - DNA, 25 bp, Mus musculus
tacgacctgtttctcaacctggagg

SEQ ID NO: 745417 - DNA, 25 bp, Mus musculus
tacgacctgtttgtcaacctggagg

SEQ ID NO: 745418 - DNA, 25 bp, Mus musculus
tacgacgaaatccagacagaggccg

SEQ ID NO: 745419 - DNA, 25 bp, Mus musculus
tacgacgaaatcgagacagaggccg

SEQ ID NO: 745420 - DNA, 25 bp, Mus musculus
tacgacgagaagaaaccctcaccca

SEQ ID NO: 745421 - DNA, 25 bp, Mus musculus
tacgacgagaagtaaccctcaccca

SEQ ID NO: 745422 - DNA, 25 bp, Mus musculus
tacgacgatggcactaacaccttct

SEQ ID NO: 745423 - DNA, 25 bp, Mus musculus
tacgacgatggctctaacaccttct

SEQ ID NO: 745424 - DNA, 25 bp, Mus musculus
tacgacgatgtcagaaccatgtacg

SEQ ID NO: 745425 - DNA, 25 bp, Mus musculus
tacgacgatgtctgaaccatgtacg

SEQ ID NO: 745426 - DNA, 25 bp, Mus musculus
tacgacgccccactgagcgaggctg

SEQ ID NO: 745427 - DNA, 25 bp, Mus musculus
tacgacgccccagtgagcgaggctg

SEQ ID NO: 745428 - DNA, 25 bp, Mus musculus
tacgacgctgtccttgacagaaatg

SEQ ID NO: 745429 - DNA, 25 bp, Mus musculus
tacgacgctgtcgttgacagaaatg

SEQ ID NO: 745430 - DNA, 25 bp, Mus musculus
tacgacgggcctctgcatgaagtga

SEQ ID NO: 745431 - DNA, 25 bp, Mus musculus
tacgacgggcctgtgcatgaagtga

SEQ ID NO: 745432 - DNA, 25 bp, Mus musculus
tacgacggtgaaattcgagttctat

SEQ ID NO: 745433 - DNA, 25 bp, Mus musculus
tacgacggtgaatttcgagttctat

SEQ ID NO: 745434 - DNA, 25 bp, Mus musculus
tacgacggttacattagtatcgcca

SEQ ID NO: 745435 - DNA, 25 bp, Mus musculus
tacgacggttactttagtatcgcca

SEQ ID NO: 745436 - DNA, 25 bp, Mus musculus
tacgacgtcagtactgacagtcaac

SEQ ID NO: 745437 - DNA, 25 bp, Mus musculus
tacgacgtcagttctgacagtcaac

SEQ ID NO: 745438 - DNA, 25 bp, Mus musculus
tacgactacctacgcttcctggtgc

SEQ ID NO: 745439 - DNA, 25 bp, Mus musculus
tacgactacctaggcttcctggtgc

SEQ ID NO: 745440 - DNA, 25 bp, Mus musculus
tacgactacctgacggatgaggagg

SEQ ID NO: 745441 - DNA, 25 bp, Mus musculus
tacgactacctgtcggatgaggagg

SEQ ID NO: 745442 - DNA, 25 bp, Mus musculus
tacgactccaccacgacctggtttg

SEQ ID NO: 745443 - DNA, 25 bp, Mus musculus
tacgactccacctcgacctggtttg

SEQ ID NO: 745444 - DNA, 25 bp, Mus musculus
tacgactcgaggagtttcgggtaga

SEQ ID NO: 745445 - DNA, 25 bp, Mus musculus
tacgactcgaggtgtttcgggtaga

SEQ ID NO: 745446 - DNA, 25 bp, Mus musculus
tacgactcggaccagttcaagacgc

SEQ ID NO: 745447 - DNA, 25 bp, Mus musculus
tacgactcggacgagttcaagacgc

SEQ ID NO: 745448 - DNA, 25 bp, Mus musculus
tacgactcggtgcaatgcccgttct

SEQ ID NO: 745449 - DNA, 25 bp, Mus musculus
tacgactcggtggaatgcccgttct

SEQ ID NO: 745450 - DNA, 25 bp, Mus musculus
tacgactctgagctcttcgggaacc

SEQ ID NO: 745451 - DNA, 25 bp, Mus musculus
tacgactctgaggtcttcgggaacc

SEQ ID NO: 745452 - DNA, 25 bp, Mus musculus
tacgactgccacctcacgagaatgg

SEQ ID NO: 745453 - DNA, 25 bp, Mus musculus
tacgactgccacgtcacgagaatgg

SEQ ID NO: 745454 - DNA, 25 bp, Mus musculus
tacgacttcaagatggctgacctgc

SEQ ID NO: 745455 - DNA, 25 bp, Mus musculus
tacgacttcaagttggctgacctgc

SEQ ID NO: 745456 - DNA, 25 bp, Mus musculus
tacgagaactatcgttatggctatg

SEQ ID NO: 745457 - DNA, 25 bp, Mus musculus
tacgagaactatggttatggctatg

SEQ ID NO: 745458 - DNA, 25 bp, Mus musculus
tacgagaagaagaacggccaagtcc

SEQ ID NO: 745459 - DNA, 25 bp, Mus musculus
tacgagaagaagtacggccaagtcc

SEQ ID NO: 745460 - DNA, 25 bp, Mus musculus
tacgagaagctcagccgggctatga

SEQ ID NO: 745461 - DNA, 25 bp, Mus musculus
tacgagaagctctgccgggctatga

SEQ ID NO: 745462 - DNA, 25 bp, Mus musculus
tacgagaataagaagattgccagcg

SEQ ID NO: 745463 - DNA, 25 bp, Mus musculus
tacgagaataagtagattgccagcg

SEQ ID NO: 745464 - DNA, 25 bp, Mus musculus
tacgagaatgagcttggaaagaagc

SEQ ID NO: 745465 - DNA, 25 bp, Mus musculus
tacgagaatgaggttggaaagaagc

SEQ ID NO: 745466 - DNA, 25 bp, Mus musculus
tacgagacaattcaacagaagaagg

SEQ ID NO: 745467 - DNA, 25 bp, Mus musculus
tacgagacaattgaacagaagaagg

SEQ ID NO: 745468 - DNA, 25 bp, Mus musculus
tacgagaccaagagtaatcccatgg

SEQ ID NO: 745469 - DNA, 25 bp, Mus musculus
tacgagaccaagtgtaatcccatgg

SEQ ID NO: 745470 - DNA, 25 bp, Mus musculus
tacgagacccagacctaagtgcagt

SEQ ID NO: 745471 - DNA, 25 bp, Mus musculus
tacgagacccagtcctaagtgcagt

SEQ ID NO: 745472 - DNA, 25 bp, Mus musculus
tacgagacttgtcgccgaagtgaga

SEQ ID NO: 745473 - DNA, 25 bp, Mus musculus
tacgagacttgtggccgaagtgaga

SEQ ID NO: 745474 - DNA, 25 bp, Mus musculus
tacgagagaactaactcccaaagtt

SEQ ID NO: 745475 - DNA, 25 bp, Mus musculus
tacgagagaacttactcccaaagtt

SEQ ID NO: 745476 - DNA, 25 bp, Mus musculus
tacgagagagatcagggcaacaacc

SEQ ID NO: 745477 - DNA, 25 bp, Mus musculus
tacgagagagatgagggcaacaacc

SEQ ID NO: 745478 - DNA, 25 bp, Mus musculus
tacgagagcaagcatagcagcagcg

SEQ ID NO: 745479 - DNA, 25 bp, Mus musculus
tacgagagcaaggatagcagcagcg

SEQ ID NO: 745480 - DNA, 25 bp, Mus musculus
tacgagagcactcgacgtggacgtc

SEQ ID NO: 745481 - DNA, 25 bp, Mus musculus
tacgagagcactggacgtggacgtc

SEQ ID NO: 745482 - DNA, 25 bp, Mus musculus
tacgagagctttcctgatcgggacc

SEQ ID NO: 745483 - DNA, 25 bp, Mus musculus
tacgagagctttgctgatcgggacc

SEQ ID NO: 745484 - DNA, 25 bp, Mus musculus
tacgagagttatctacaatccttgg

SEQ ID NO: 745485 - DNA, 25 bp, Mus musculus
tacgagagttatgtacaatccttgg

SEQ ID NO: 745486 - DNA, 25 bp, Mus musculus
tacgagataattaggccaagctact

SEQ ID NO: 745487 - DNA, 25 bp, Mus musculus
tacgagataatttggccaagctact

SEQ ID NO: 745488 - DNA, 25 bp, Mus musculus
tacgagatagaccatcaaacagaga

SEQ ID NO: 745489 - DNA, 25 bp, Mus musculus
tacgagatagacgatcaaacagaga

SEQ ID NO: 745490 - DNA, 25 bp, Mus musculus
tacgagatagtgactaacaagagga

SEQ ID NO: 745491 - DNA, 25 bp, Mus musculus
tacgagatagtgtctaacaagagga

SEQ ID NO: 745492 - DNA, 25 bp, Mus musculus
tacgagatctcaccagaagcttacg

SEQ ID NO: 745493 - DNA, 25 bp, Mus musculus
tacgagatctcagcagaagcttacg

SEQ ID NO: 745494 - DNA, 25 bp, Mus musculus
tacgagatggctcctggttacccac

SEQ ID NO: 745495 - DNA, 25 bp, Mus musculus
tacgagatggctgctggttacccac

SEQ ID NO: 745496 - DNA, 25 bp, Mus musculus
tacgagattctacacgtaccgcgga

SEQ ID NO: 745497 - DNA, 25 bp, Mus musculus
tacgagattctagacgtaccgcgga

SEQ ID NO: 745498 - DNA, 25 bp, Mus musculus
tacgagcactatatgggcacagaga

SEQ ID NO: 745499 - DNA, 25 bp, Mus musculus
tacgagcactatttgggcacagaga

SEQ ID NO: 745500 - DNA, 25 bp, Mus musculus
tacgagcaggtgatgtgagagctcc

SEQ ID NO: 745501 - DNA, 25 bp, Mus musculus
tacgagcaggtgttgtgagagctcc

SEQ ID NO: 745502 - DNA, 25 bp, Mus musculus
tacgagcagtggaaggcactcaacg

SEQ ID NO: 745503 - DNA, 25 bp, Mus musculus
tacgagcagtggtaggcactcaacg

SEQ ID NO: 745504 - DNA, 25 bp, Mus musculus
tacgagcgagctacgagaggccatg

SEQ ID NO: 745505 - DNA, 25 bp, Mus musculus
tacgagcgagcttcgagaggccatg

SEQ ID NO: 745506 - DNA, 25 bp, Mus musculus
tacgaggaacagaaagcctcggatg

SEQ ID NO: 745507 - DNA, 25 bp, Mus musculus
tacgaggaacagtaagcctcggatg

SEQ ID NO: 745508 - DNA, 25 bp, Mus musculus
tacgaggaagatactgacagcgaca

SEQ ID NO: 745509 - DNA, 25 bp, Mus musculus
tacgaggaagattctgacagcgaca

SEQ ID NO: 745510 - DNA, 25 bp, Mus musculus
tacgaggacaaacaagtggaacccg

SEQ ID NO: 745511 - DNA, 25 bp, Mus musculus
tacgaggacaaagaagtggaacccg

SEQ ID NO: 745512 - DNA, 25 bp, Mus musculus
tacgaggacacacagcttgaacagg

SEQ ID NO: 745513 - DNA, 25 bp, Mus musculus
tacgaggacacagagcttgaacagg

SEQ ID NO: 745514 - DNA, 25 bp, Mus musculus
tacgaggacagcaacgtgtggcacg

SEQ ID NO: 745515 - DNA, 25 bp, Mus musculus
tacgaggacagctacgtgtggcacg

SEQ ID NO: 745516 - DNA, 25 bp, Mus musculus
tacgaggacgcacctgaagagttcc

SEQ ID NO: 745517 - DNA, 25 bp, Mus musculus
tacgaggacgcagctgaagagttcc

SEQ ID NO: 745518 - DNA, 25 bp, Mus musculus
tacgaggacgccatccagttcatcc

SEQ ID NO: 745519 - DNA, 25 bp, Mus musculus
tacgaggacgccttccagttcatcc

SEQ ID NO: 745520 - DNA, 25 bp, Mus musculus
tacgaggagaagaggagacagtcac

SEQ ID NO: 745521 - DNA, 25 bp, Mus musculus
tacgaggagaagtggagacagtcac

SEQ ID NO: 745522 - DNA, 25 bp, Mus musculus
tacgaggaggcactccgtctctacc

SEQ ID NO: 745523 - DNA, 25 bp, Mus musculus
tacgaggaggcagtccgtctctacc

SEQ ID NO: 745524 - DNA, 25 bp, Mus musculus
tacgaggaggctctatgctcaaccc

SEQ ID NO: 745525 - DNA, 25 bp, Mus musculus
tacgaggaggctgtatgctcaaccc

SEQ ID NO: 745526 - DNA, 25 bp, Mus musculus
tacgaggagtttacagcaacaaatt

SEQ ID NO: 745527 - DNA, 25 bp, Mus musculus
tacgaggagttttcagcaacaaatt

SEQ ID NO: 745528 - DNA, 25 bp, Mus musculus
tacgaggattctagcatttcgagaa

SEQ ID NO: 745529 - DNA, 25 bp, Mus musculus
tacgaggattcttgcatttcgagaa

SEQ ID NO: 745530 - DNA, 25 bp, Mus musculus
tacgaggcagttctaattgcttcac

SEQ ID NO: 745531 - DNA, 25 bp, Mus musculus
tacgaggcagttgtaattgcttcac

SEQ ID NO: 745532 - DNA, 25 bp, Mus musculus
tacgaggcggtgcaacgctattatc

SEQ ID NO: 745533 - DNA, 25 bp, Mus musculus
tacgaggcggtggaacgctattatc

SEQ ID NO: 745534 - DNA, 25 bp, Mus musculus
tacgaggctttgacttgggcccact

SEQ ID NO: 745535 - DNA, 25 bp, Mus musculus
tacgaggctttgtcttgggcccact

SEQ ID NO: 745536 - DNA, 25 bp, Mus musculus
tacgagggagacagctacatcgtcc

SEQ ID NO: 745537 - DNA, 25 bp, Mus musculus
tacgagggagactgctacatcgtcc

SEQ ID NO: 745538 - DNA, 25 bp, Mus musculus
tacgagggtggccaaccttctgcta

SEQ ID NO: 745539 - DNA, 25 bp, Mus musculus
tacgagggtggcgaaccttctgcta

SEQ ID NO: 745540 - DNA, 25 bp, Mus musculus
tacgaggtcagaagctccagagact

SEQ ID NO: 745541 - DNA, 25 bp, Mus musculus
tacgaggtcagatgctccagagact

SEQ ID NO: 745542 - DNA, 25 bp, Mus musculus
tacgaggtgaagctcgtagctttca

SEQ ID NO: 745543 - DNA, 25 bp, Mus musculus
tacgaggtgaaggtcgtagctttca

SEQ ID NO: 745544 - DNA, 25 bp, Mus musculus
tacgaggtgaccacctttttgccct

SEQ ID NO: 745545 - DNA, 25 bp, Mus musculus
tacgaggtgacctcctttttgccct

SEQ ID NO: 745546 - DNA, 25 bp, Mus musculus
tacgaggtgcgtacgccaccggagc

SEQ ID NO: 745547 - DNA, 25 bp, Mus musculus
tacgaggtgcgttcgccaccggagc

SEQ ID NO: 745548 - DNA, 25 bp, Mus musculus
tacgagtaaaaaccccaaggtagag

SEQ ID NO: 745549 - DNA, 25 bp, Mus musculus
tacgagtaaaaagcccaaggtagag

SEQ ID NO: 745550 - DNA, 25 bp, Mus musculus
tacgagtatccgcaatactttctgg

SEQ ID NO: 745551 - DNA, 25 bp, Mus musculus
tacgagtatccggaatactttctgg

SEQ ID NO: 745552 - DNA, 25 bp, Mus musculus
tacgagtatgacagggccggcaagc

SEQ ID NO: 745553 - DNA, 25 bp, Mus musculus
tacgagtatgactgggccggcaagc

SEQ ID NO: 745554 - DNA, 25 bp, Mus musculus
tacgagtcagtccaaagccaccctt

SEQ ID NO: 745555 - DNA, 25 bp, Mus musculus
tacgagtcagtcgaaagccaccctt

SEQ ID NO: 745556 - DNA, 25 bp, Mus musculus
tacgagtccatgctcaacaccgtgc

SEQ ID NO: 745557 - DNA, 25 bp, Mus musculus
tacgagtccatggtcaacaccgtgc

SEQ ID NO: 745558 - DNA, 25 bp, Mus musculus
tacgagtccctcagtgaaaatccca

SEQ ID NO: 745559 - DNA, 25 bp, Mus musculus
tacgagtccctctgtgaaaatccca

SEQ ID NO: 745560 - DNA, 25 bp, Mus musculus
tacgagtccttacagcagttgtggc

SEQ ID NO: 745561 - DNA, 25 bp, Mus musculus
tacgagtccttagagcagttgtggc

SEQ ID NO: 745562 - DNA, 25 bp, Mus musculus
tacgagtcgatccaggactacaagc

SEQ ID NO: 745563 - DNA, 25 bp, Mus musculus
tacgagtcgatcgaggactacaagc

SEQ ID NO: 745564 - DNA, 25 bp, Mus musculus
tacgagtgctacagcaagcagggct

SEQ ID NO: 745565 - DNA, 25 bp, Mus musculus
tacgagtgctactgcaagcagggct

SEQ ID NO: 745566 - DNA, 25 bp, Mus musculus
tacgagtgctatcgagtgccaattg

SEQ ID NO: 745567 - DNA, 25 bp, Mus musculus
tacgagtgctatggagtgccaattg

SEQ ID NO: 745568 - DNA, 25 bp, Mus musculus
tacgagtgctgaacctgcttatcct

SEQ ID NO: 745569 - DNA, 25 bp, Mus musculus
tacgagtgctgatcctgcttatcct

SEQ ID NO: 745570 - DNA, 25 bp, Mus musculus
tacgagtggcgcattcaagaagaaa

SEQ ID NO: 745571 - DNA, 25 bp, Mus musculus
tacgagtggcgctttcaagaagaaa

SEQ ID NO: 745572 - DNA, 25 bp, Mus musculus
tacgagtgggttctatcagatcccc

SEQ ID NO: 745573 - DNA, 25 bp, Mus musculus
tacgagtgggttgtatcagatcccc

SEQ ID NO: 745574 - DNA, 25 bp, Mus musculus
tacgagttcatgcaactggcctgcc

SEQ ID NO: 745575 - DNA, 25 bp, Mus musculus
tacgagttcatggaactggcctgcc

SEQ ID NO: 745576 - DNA, 25 bp, Mus musculus
tacgagttggctatgattctgaaag

SEQ ID NO: 745577 - DNA, 25 bp, Mus musculus
tacgagttggctttgattctgaaag

SEQ ID NO: 745578 - DNA, 25 bp, Mus musculus
tacgagtttttgcagtcgatcctcc

SEQ ID NO: 745579 - DNA, 25 bp, Mus musculus
tacgagtttttggagtcgatcctcc

SEQ ID NO: 745580 - DNA, 25 bp, Mus musculus
tacgataagaacatcgatccccggc

SEQ ID NO: 745581 - DNA, 25 bp, Mus musculus
tacgataagaacttcgatccccggc

SEQ ID NO: 745582 - DNA, 25 bp, Mus musculus
tacgataccctcagaaacagatgcg

SEQ ID NO: 745583 - DNA, 25 bp, Mus musculus
tacgataccctctgaaacagatgcg

SEQ ID NO: 745584 - DNA, 25 bp, Mus musculus
tacgatacttgcattgagccgtggc

SEQ ID NO: 745585 - DNA, 25 bp, Mus musculus
tacgatacttgctttgagccgtggc

SEQ ID NO: 745586 - DNA, 25 bp, Mus musculus
tacgatatcgctcacacacctggtg

SEQ ID NO: 745587 - DNA, 25 bp, Mus musculus
tacgatatcgctgacacacctggtg

SEQ ID NO: 745588 - DNA, 25 bp, Mus musculus
tacgatcagagcagagagccctgag

SEQ ID NO: 745589 - DNA, 25 bp, Mus musculus
tacgatcagagctgagagccctgag

SEQ ID NO: 745590 - DNA, 25 bp, Mus musculus
tacgatcggcggaactgtggcagct

SEQ ID NO: 745591 - DNA, 25 bp, Mus musculus
tacgatcggcggtactgtggcagct

SEQ ID NO: 745592 - DNA, 25 bp, Mus musculus
tacgatctgtcacctcgccaaggag

SEQ ID NO: 745593 - DNA, 25 bp, Mus musculus
tacgatctgtcagctcgccaaggag

SEQ ID NO: 745594 - DNA, 25 bp, Mus musculus
tacgatcttcggcatcccaatggca

SEQ ID NO: 745595 - DNA, 25 bp, Mus musculus
tacgatcttcgggatcccaatggca

SEQ ID NO: 745596 - DNA, 25 bp, Mus musculus
tacgatgaagatcttggcattaact

SEQ ID NO: 745597 - DNA, 25 bp, Mus musculus
tacgatgaagatgttggcattaact

SEQ ID NO: 745598 - DNA, 25 bp, Mus musculus
tacgatgacaagctggcatacgccg

SEQ ID NO: 745599 - DNA, 25 bp, Mus musculus
tacgatgacaaggtggcatacgccg

SEQ ID NO: 745600 - DNA, 25 bp, Mus musculus
tacgatgagcctatactgaagcgtc

SEQ ID NO: 745601 - DNA, 25 bp, Mus musculus
tacgatgagcctttactgaagcgtc

SEQ ID NO: 745602 - DNA, 25 bp, Mus musculus
tacgatgatgtgcatgcctcagact

SEQ ID NO: 745603 - DNA, 25 bp, Mus musculus
tacgatgatgtggatgcctcagact

SEQ ID NO: 745604 - DNA, 25 bp, Mus musculus
tacgatgcccacacgtctaggaatg

SEQ ID NO: 745605 - DNA, 25 bp, Mus musculus
tacgatgcccactcgtctaggaatg

SEQ ID NO: 745606 - DNA, 25 bp, Mus musculus
tacgatgctacaccaatgcaccggg

SEQ ID NO: 745607 - DNA, 25 bp, Mus musculus
tacgatgctacagcaatgcaccggg

SEQ ID NO: 745608 - DNA, 25 bp, Mus musculus
tacgatgggcagctagctgtatttg

SEQ ID NO: 745609 - DNA, 25 bp, Mus musculus
tacgatgggcaggtagctgtatttg

SEQ ID NO: 745610 - DNA, 25 bp, Mus musculus
tacgatgtcgccctactaggctgct

SEQ ID NO: 745611 - DNA, 25 bp, Mus musculus
tacgatgtcgccgtactaggctgct

SEQ ID NO: 745612 - DNA, 25 bp, Mus musculus
tacgatgtctttccaagtgtcctga

SEQ ID NO: 745613 - DNA, 25 bp, Mus musculus
tacgatgtctttgcaagtgtcctga

SEQ ID NO: 745614 - DNA, 25 bp, Mus musculus
tacgatgtgcttcagaggaaccaag

SEQ ID NO: 745615 - DNA, 25 bp, Mus musculus
tacgatgtgcttgagaggaaccaag

SEQ ID NO: 745616 - DNA, 25 bp, Mus musculus
tacgatgtgtaccttgatgtcattg

SEQ ID NO: 745617 - DNA, 25 bp, Mus musculus
tacgatgtgtacgttgatgtcattg

SEQ ID NO: 745618 - DNA, 25 bp, Mus musculus
tacgatgttctcatcattggtacag

SEQ ID NO: 745619 - DNA, 25 bp, Mus musculus
tacgatgttctcttcattggtacag

SEQ ID NO: 745620 - DNA, 25 bp, Mus musculus
tacgatgtttacctagatgtctggc

SEQ ID NO: 745621 - DNA, 25 bp, Mus musculus
tacgatgtttacgtagatgtctggc

SEQ ID NO: 745622 - DNA, 25 bp, Mus musculus
tacgattcggaacacaccttcagaa

SEQ ID NO: 745623 - DNA, 25 bp, Mus musculus
tacgattcggaagacaccttcagaa

SEQ ID NO: 745624 - DNA, 25 bp, Mus musculus
tacgattgtcagaggatctgacgac

SEQ ID NO: 745625 - DNA, 25 bp, Mus musculus
tacgattgtcagtggatctgacgac

SEQ ID NO: 745626 - DNA, 25 bp, Mus musculus
tacgcaaactttaccgagggagctt

SEQ ID NO: 745627 - DNA, 25 bp, Mus musculus
tacgcaaacttttccgagggagctt

SEQ ID NO: 745628 - DNA, 25 bp, Mus musculus
tacgcaaaggtcctagaagacaact

SEQ ID NO: 745629 - DNA, 25 bp, Mus musculus
tacgcaaaggtcgtagaagacaact

SEQ ID NO: 745630 - DNA, 25 bp, Mus musculus
tacgcaacacccctggacatgtgga

SEQ ID NO: 745631 - DNA, 25 bp, Mus musculus
tacgcaacacccgtggacatgtgga

SEQ ID NO: 745632 - DNA, 25 bp, Mus musculus
tacgcaacgaggagctggcgaagct

SEQ ID NO: 745633 - DNA, 25 bp, Mus musculus
tacgcaacgaggtgctggcgaagct

SEQ ID NO: 745634 - DNA, 25 bp, Mus musculus
tacgcaagagtgaccgcaaaaagcg

SEQ ID NO: 745635 - DNA, 25 bp, Mus musculus
tacgcaagagtgtccgcaaaaagcg

SEQ ID NO: 745636 - DNA, 25 bp, Mus musculus
tacgcaagctacacgttggagactt

SEQ ID NO: 745637 - DNA, 25 bp, Mus musculus
tacgcaagctactcgttggagactt

SEQ ID NO: 745638 - DNA, 25 bp, Mus musculus
tacgcaatcgggagcgccatgtcag

SEQ ID NO: 745639 - DNA, 25 bp, Mus musculus
tacgcaatcgggtgcgccatgtcag

SEQ ID NO: 745640 - DNA, 25 bp, Mus musculus
tacgcaatctgaccgggcaggtcac

SEQ ID NO: 745641 - DNA, 25 bp, Mus musculus
tacgcaatctgagcgggcaggtcac

SEQ ID NO: 745642 - DNA, 25 bp, Mus musculus
tacgcacaatacaaatccattgagc

SEQ ID NO: 745643 - DNA, 25 bp, Mus musculus
tacgcacaatactaatccattgagc

SEQ ID NO: 745644 - DNA, 25 bp, Mus musculus
tacgcaccatgcagaatacaaatga

SEQ ID NO: 745645 - DNA, 25 bp, Mus musculus
tacgcaccatgctgaatacaaatga

SEQ ID NO: 745646 - DNA, 25 bp, Mus musculus
tacgcacgccacagttctctgtggg

SEQ ID NO: 745647 - DNA, 25 bp, Mus musculus
tacgcacgccactgttctctgtggg

SEQ ID NO: 745648 - DNA, 25 bp, Mus musculus
tacgcactcctactcggggactgga

SEQ ID NO: 745649 - DNA, 25 bp, Mus musculus
tacgcactcctagtcggggactgga

SEQ ID NO: 745650 - DNA, 25 bp, Mus musculus
tacgcactgcgtcaacaggacaagt

SEQ ID NO: 745651 - DNA, 25 bp, Mus musculus
tacgcactgcgtgaacaggacaagt

SEQ ID NO: 745652 - DNA, 25 bp, Mus musculus
tacgcagaagagcaacactatcggc

SEQ ID NO: 745653 - DNA, 25 bp, Mus musculus
tacgcagaagaggaacactatcggc

SEQ ID NO: 745654 - DNA, 25 bp, Mus musculus
tacgcagacatcatcccatccaagg

SEQ ID NO: 745655 - DNA, 25 bp, Mus musculus
tacgcagacatcttcccatccaagg

SEQ ID NO: 745656 - DNA, 25 bp, Mus musculus
tacgcagacctcatccatagcagtg

SEQ ID NO: 745657 - DNA, 25 bp, Mus musculus
tacgcagacctcttccatagcagtg

SEQ ID NO: 745658 - DNA, 25 bp, Mus musculus
tacgcagcaagcctcatcattagac

SEQ ID NO: 745659 - DNA, 25 bp, Mus musculus
tacgcagcaagcgtcatcattagac

SEQ ID NO: 745660 - DNA, 25 bp, Mus musculus
tacgcagcatctactcccaaatggc

SEQ ID NO: 745661 - DNA, 25 bp, Mus musculus
tacgcagcatcttctcccaaatggc

SEQ ID NO: 745662 - DNA, 25 bp, Mus musculus
tacgcaggctgcagctgcaaggcag

SEQ ID NO: 745663 - DNA, 25 bp, Mus musculus
tacgcaggctgctgctgcaaggcag

SEQ ID NO: 745664 - DNA, 25 bp, Mus musculus
tacgcatatgtaacggagcgccaaa

SEQ ID NO: 745665 - DNA, 25 bp, Mus musculus
tacgcatatgtatcggagcgccaaa

SEQ ID NO: 745666 - DNA, 25 bp, Mus musculus
tacgcatccaggactctttgtcaga

SEQ ID NO: 745667 - DNA, 25 bp, Mus musculus
tacgcatccaggtctctttgtcaga

SEQ ID NO: 745668 - DNA, 25 bp, Mus musculus
tacgcatcgcataaatgttgggagg

SEQ ID NO: 745669 - DNA, 25 bp, Mus musculus
tacgcatcgcattaatgttgggagg

SEQ ID NO: 745670 - DNA, 25 bp, Mus musculus
tacgcatgctacaccatatgtgctt

SEQ ID NO: 745671 - DNA, 25 bp, Mus musculus
tacgcatgctactccatatgtgctt

SEQ ID NO: 745672 - DNA, 25 bp, Mus musculus
tacgcatggccgattctcacatgaa

SEQ ID NO: 745673 - DNA, 25 bp, Mus musculus
tacgcatggccgtttctcacatgaa

SEQ ID NO: 745674 - DNA, 25 bp, Mus musculus
tacgccaagtatattcaaggagatc

SEQ ID NO: 745675 - DNA, 25 bp, Mus musculus
tacgccaagtattttcaaggagatc

SEQ ID NO: 745676 - DNA, 25 bp, Mus musculus
tacgccaatcctcctaactacggaa

SEQ ID NO: 745677 - DNA, 25 bp, Mus musculus
tacgccaatcctgctaactacggaa

SEQ ID NO: 745678 - DNA, 25 bp, Mus musculus
tacgccacaggaactggtacattca

SEQ ID NO: 745679 - DNA, 25 bp, Mus musculus
tacgccacaggatctggtacattca

SEQ ID NO: 745680 - DNA, 25 bp, Mus musculus
tacgccacagtgcattttggaacag

SEQ ID NO: 745681 - DNA, 25 bp, Mus musculus
tacgccacagtggattttggaacag

SEQ ID NO: 745682 - DNA, 25 bp, Mus musculus
tacgccaccatacgagctggtgtgg

SEQ ID NO: 745683 - DNA, 25 bp, Mus musculus
tacgccaccataggagctggtgtgg

SEQ ID NO: 745684 - DNA, 25 bp, Mus musculus
tacgccacctggatgcctgtgagac

SEQ ID NO: 745685 - DNA, 25 bp, Mus musculus
tacgccacctggttgcctgtgagac

SEQ ID NO: 745686 - DNA, 25 bp, Mus musculus
tacgccacgcccagtttgtagtgag

SEQ ID NO: 745687 - DNA, 25 bp, Mus musculus
tacgccacgccctgtttgtagtgag

SEQ ID NO: 745688 - DNA, 25 bp, Mus musculus
tacgccactgagctttctgaaacaa

SEQ ID NO: 745689 - DNA, 25 bp, Mus musculus
tacgccactgaggtttctgaaacaa

SEQ ID NO: 745690 - DNA, 25 bp, Mus musculus
tacgccagatgacgatcccaattac

SEQ ID NO: 745691 - DNA, 25 bp, Mus musculus
tacgccagatgaggatcccaattac

SEQ ID NO: 745692 - DNA, 25 bp, Mus musculus
tacgccaggtcgcactgagacatct

SEQ ID NO: 745693 - DNA, 25 bp, Mus musculus
tacgccaggtcggactgagacatct

SEQ ID NO: 745694 - DNA, 25 bp, Mus musculus
tacgccatcacgacactgcataatc

SEQ ID NO: 745695 - DNA, 25 bp, Mus musculus
tacgccatcacgtcactgcataatc

SEQ ID NO: 745696 - DNA, 25 bp, Mus musculus
tacgccatggagcattttcagacag

SEQ ID NO: 745697 - DNA, 25 bp, Mus musculus
tacgccatggaggattttcagacag

SEQ ID NO: 745698 - DNA, 25 bp, Mus musculus
tacgccatgggcatcaatcgaccgt

SEQ ID NO: 745699 - DNA, 25 bp, Mus musculus
tacgccatgggcttcaatcgaccgt

SEQ ID NO: 745700 - DNA, 25 bp, Mus musculus
tacgccatgtataaagccgggcccg

SEQ ID NO: 745701 - DNA, 25 bp, Mus musculus
tacgccatgtattaagccgggcccg

SEQ ID NO: 745702 - DNA, 25 bp, Mus musculus
tacgccattacaccattcggatttc

SEQ ID NO: 745703 - DNA, 25 bp, Mus musculus
tacgccattacagcattcggatttc

SEQ ID NO: 745704 - DNA, 25 bp, Mus musculus
tacgcccacgccaaagaatggcctg

SEQ ID NO: 745705 - DNA, 25 bp, Mus musculus
tacgcccacgcctaagaatggcctg

SEQ ID NO: 745706 - DNA, 25 bp, Mus musculus
tacgccctcagtcagctgaataacc

SEQ ID NO: 745707 - DNA, 25 bp, Mus musculus
tacgccctcagtgagctgaataacc

SEQ ID NO: 745708 - DNA, 25 bp, Mus musculus
tacgccgaggctacggcgctgtacg

SEQ ID NO: 745709 - DNA, 25 bp, Mus musculus
tacgccgaggcttcggcgctgtacg

SEQ ID NO: 745710 - DNA, 25 bp, Mus musculus
tacgccggcggtagactaggcctgt

SEQ ID NO: 745711 - DNA, 25 bp, Mus musculus
tacgccggcggttgactaggcctgt

SEQ ID NO: 745712 - DNA, 25 bp, Mus musculus
tacgccgggagtctacacaaaactt

SEQ ID NO: 745713 - DNA, 25 bp, Mus musculus
tacgccgggagtgtacacaaaactt

SEQ ID NO: 745714 - DNA, 25 bp, Mus musculus
tacgccgtacacaggagcaggtgga

SEQ ID NO: 745715 - DNA, 25 bp, Mus musculus
tacgccgtacactggagcaggtgga

SEQ ID NO: 745716 - DNA, 25 bp, Mus musculus
tacgccgtcatcagtgaggcctgga

SEQ ID NO: 745717 - DNA, 25 bp, Mus musculus
tacgccgtcatctgtgaggcctgga

SEQ ID NO: 745718 - DNA, 25 bp, Mus musculus
tacgccgtttggctcttgtctactt

SEQ ID NO: 745719 - DNA, 25 bp, Mus musculus
tacgccgtttgggtcttgtctactt

SEQ ID NO: 745720 - DNA, 25 bp, Mus musculus
tacgcctacatgaacaacagtgaca

SEQ ID NO: 745721 - DNA, 25 bp, Mus musculus
tacgcctacatgtacaacagtgaca

SEQ ID NO: 745722 - DNA, 25 bp, Mus musculus
tacgcctacgaaagttagtgcgtat

SEQ ID NO: 745723 - DNA, 25 bp, Mus musculus
tacgcctacgaatgttagtgcgtat

SEQ ID NO: 745724 - DNA, 25 bp, Mus musculus
tacgcctactataacaccgggattg

SEQ ID NO: 745725 - DNA, 25 bp, Mus musculus
tacgcctactattacaccgggattg

SEQ ID NO: 745726 - DNA, 25 bp, Mus musculus
tacgcctgcgctatggcgagctctg

SEQ ID NO: 745727 - DNA, 25 bp, Mus musculus
tacgcctgcgctttggcgagctctg

SEQ ID NO: 745728 - DNA, 25 bp, Mus musculus
tacgcctgcttcaatcactacacgg

SEQ ID NO: 745729 - DNA, 25 bp, Mus musculus
tacgcctgcttctatcactacacgg

SEQ ID NO: 745730 - DNA, 25 bp, Mus musculus
tacgccttacatccagatggtcgga

SEQ ID NO: 745731 - DNA, 25 bp, Mus musculus
tacgccttacatgcagatggtcgga

SEQ ID NO: 745732 - DNA, 25 bp, Mus musculus
tacgccttgtgcaccagcggctgtg

SEQ ID NO: 745733 - DNA, 25 bp, Mus musculus
tacgccttgtgctccagcggctgtg

SEQ ID NO: 745734 - DNA, 25 bp, Mus musculus
tacgcgaatcggctcaaaagttatg

SEQ ID NO: 745735 - DNA, 25 bp, Mus musculus
tacgcgaatcgggtcaaaagttatg

SEQ ID NO: 745736 - DNA, 25 bp, Mus musculus
tacgcgacagtgcttggctacagcg

SEQ ID NO: 745737 - DNA, 25 bp, Mus musculus
tacgcgacagtggttggctacagcg

SEQ ID NO: 745738 - DNA, 25 bp, Mus musculus
tacgcgacctttctgttggaaaatg

SEQ ID NO: 745739 - DNA, 25 bp, Mus musculus
tacgcgacctttgtgttggaaaatg

SEQ ID NO: 745740 - DNA, 25 bp, Mus musculus
tacgcgagaaataagctcatctgct

SEQ ID NO: 745741 - DNA, 25 bp, Mus musculus
tacgcgagaaattagctcatctgct

SEQ ID NO: 745742 - DNA, 25 bp, Mus musculus
tacgcggcatcaatagcttccgcca

SEQ ID NO: 745743 - DNA, 25 bp, Mus musculus
tacgcggcatcattagcttccgcca

SEQ ID NO: 745744 - DNA, 25 bp, Mus musculus
tacgcggcgcagatcgtcctgacct

SEQ ID NO: 745745 - DNA, 25 bp, Mus musculus
tacgcggcgcagttcgtcctgacct

SEQ ID NO: 745746 - DNA, 25 bp, Mus musculus
tacgcgggaaacattattccaaggc

SEQ ID NO: 745747 - DNA, 25 bp, Mus musculus
tacgcgggaaactttattccaaggc

SEQ ID NO: 745748 - DNA, 25 bp, Mus musculus
tacgcgtacgtgaacttccagcagc

SEQ ID NO: 745749 - DNA, 25 bp, Mus musculus
tacgcgtacgtgtacttccagcagc

SEQ ID NO: 745750 - DNA, 25 bp, Mus musculus
tacgcgtggtggatacctctattga

SEQ ID NO: 745751 - DNA, 25 bp, Mus musculus
tacgcgtggtggttacctctattga

SEQ ID NO: 745752 - DNA, 25 bp, Mus musculus
tacgcgtgtgcacagggcttttcgc

SEQ ID NO: 745753 - DNA, 25 bp, Mus musculus
tacgcgtgtgcagagggcttttcgc

SEQ ID NO: 745754 - DNA, 25 bp, Mus musculus
tacgcgttcgcccaggcaactgtgc

SEQ ID NO: 745755 - DNA, 25 bp, Mus musculus
tacgcgttcgccgaggcaactgtgc

SEQ ID NO: 745756 - DNA, 25 bp, Mus musculus
tacgctaagaaaagtgctgggtgca

SEQ ID NO: 745757 - DNA, 25 bp, Mus musculus
tacgctaagaaatgtgctgggtgca

SEQ ID NO: 745758 - DNA, 25 bp, Mus musculus
tacgctacctcaccatggttctgag

SEQ ID NO: 745759 - DNA, 25 bp, Mus musculus
tacgctacctcagcatggttctgag

SEQ ID NO: 745760 - DNA, 25 bp, Mus musculus
tacgctaggctgctaacatggctgc

SEQ ID NO: 745761 - DNA, 25 bp, Mus musculus
tacgctaggctggtaacatggctgc

SEQ ID NO: 745762 - DNA, 25 bp, Mus musculus
tacgctatgtgaataagtttgcctc

SEQ ID NO: 745763 - DNA, 25 bp, Mus musculus
tacgctatgtgattaagtttgcctc

SEQ ID NO: 745764 - DNA, 25 bp, Mus musculus
tacgctattggcaccactatctgca

SEQ ID NO: 745765 - DNA, 25 bp, Mus musculus
tacgctattggctccactatctgca

SEQ ID NO: 745766 - DNA, 25 bp, Mus musculus
tacgctcagggtaggagctctgagt

SEQ ID NO: 745767 - DNA, 25 bp, Mus musculus
tacgctcagggttggagctctgagt

SEQ ID NO: 745768 - DNA, 25 bp, Mus musculus
tacgctcatcagaattatatgcaat

SEQ ID NO: 745769 - DNA, 25 bp, Mus musculus
tacgctcatcagtattatatgcaat

SEQ ID NO: 745770 - DNA, 25 bp, Mus musculus
tacgctcattccaaaacatgaagac

SEQ ID NO: 745771 - DNA, 25 bp, Mus musculus
tacgctcattcctaaacatgaagac

SEQ ID NO: 745772 - DNA, 25 bp, Mus musculus
tacgctcctaaactccaagagtttg

SEQ ID NO: 745773 - DNA, 25 bp, Mus musculus
tacgctcctaaagtccaagagtttg

SEQ ID NO: 745774 - DNA, 25 bp, Mus musculus
tacgctccttctcggaattatgtgg

SEQ ID NO: 745775 - DNA, 25 bp, Mus musculus
tacgctccttctgggaattatgtgg

SEQ ID NO: 745776 - DNA, 25 bp, Mus musculus
tacgctctatggatgaattgaatca

SEQ ID NO: 745777 - DNA, 25 bp, Mus musculus
tacgctctatggttgaattgaatca

SEQ ID NO: 745778 - DNA, 25 bp, Mus musculus
tacgctctgcaaagactgctcagac

SEQ ID NO: 745779 - DNA, 25 bp, Mus musculus
tacgctctgcaatgactgctcagac

SEQ ID NO: 745780 - DNA, 25 bp, Mus musculus
tacgctctgctcacagcgatcgtca

SEQ ID NO: 745781 - DNA, 25 bp, Mus musculus
tacgctctgctctcagcgatcgtca

SEQ ID NO: 745782 - DNA, 25 bp, Mus musculus
tacgctctggccagtgtcaagcagg

SEQ ID NO: 745783 - DNA, 25 bp, Mus musculus
tacgctctggcctgtgtcaagcagg

SEQ ID NO: 745784 - DNA, 25 bp, Mus musculus
tacgctctgggcactctccgtggcc

SEQ ID NO: 745785 - DNA, 25 bp, Mus musculus
tacgctctgggctctctccgtggcc

SEQ ID NO: 745786 - DNA, 25 bp, Mus musculus
tacgctgaatccataggtgccatcg

SEQ ID NO: 745787 - DNA, 25 bp, Mus musculus
tacgctgaatccttaggtgccatcg

SEQ ID NO: 745788 - DNA, 25 bp, Mus musculus
tacgctgagcagctctcgggatcag

SEQ ID NO: 745789 - DNA, 25 bp, Mus musculus
tacgctgagcaggtctcgggatcag

SEQ ID NO: 745790 - DNA, 25 bp, Mus musculus
tacgctgagtgtcttagtgacagca

SEQ ID NO: 745791 - DNA, 25 bp, Mus musculus
tacgctgagtgtgttagtgacagca

SEQ ID NO: 745792 - DNA, 25 bp, Mus musculus
tacgctgatatcatcaaccacagag

SEQ ID NO: 745793 - DNA, 25 bp, Mus musculus
tacgctgatatcttcaaccacagag

SEQ ID NO: 745794 - DNA, 25 bp, Mus musculus
tacgctgcacagcaataggcatccc

SEQ ID NO: 745795 - DNA, 25 bp, Mus musculus
tacgctgcacaggaataggcatccc

SEQ ID NO: 745796 - DNA, 25 bp, Mus musculus
tacgctgcgctaagctaacagggcc

SEQ ID NO: 745797 - DNA, 25 bp, Mus musculus
tacgctgcgctatgctaacagggcc

SEQ ID NO: 745798 - DNA, 25 bp, Mus musculus
tacgctgctcccagtataggaaagc

SEQ ID NO: 745799 - DNA, 25 bp, Mus musculus
tacgctgctccctgtataggaaagc

SEQ ID NO: 745800 - DNA, 25 bp, Mus musculus
tacgctggaaagcaaggtacagtga

SEQ ID NO: 745801 - DNA, 25 bp, Mus musculus
tacgctggaaaggaaggtacagtga

SEQ ID NO: 745802 - DNA, 25 bp, Mus musculus
tacgctggatatagctttgagaaac

SEQ ID NO: 745803 - DNA, 25 bp, Mus musculus
tacgctggatattgctttgagaaac

SEQ ID NO: 745804 - DNA, 25 bp, Mus musculus
tacgctggctttcttttcggctacc

SEQ ID NO: 745805 - DNA, 25 bp, Mus musculus
tacgctggctttgttttcggctacc

SEQ ID NO: 745806 - DNA, 25 bp, Mus musculus
tacgctgggacaacattggcaagaa

SEQ ID NO: 745807 - DNA, 25 bp, Mus musculus
tacgctgggacatcattggcaagaa

SEQ ID NO: 745808 - DNA, 25 bp, Mus musculus
tacgctgggcagaccgttacgctag

SEQ ID NO: 745809 - DNA, 25 bp, Mus musculus
tacgctgggcagtccgttacgctag

SEQ ID NO: 745810 - DNA, 25 bp, Mus musculus
tacgctgggcatcctgcgccttaag

SEQ ID NO: 745811 - DNA, 25 bp, Mus musculus
tacgctgggcatgctgcgccttaag

SEQ ID NO: 745812 - DNA, 25 bp, Mus musculus
tacgctgtgctgagggttcttagcc

SEQ ID NO: 745813 - DNA, 25 bp, Mus musculus
tacgctgtgctgtgggttcttagcc

SEQ ID NO: 745814 - DNA, 25 bp, Mus musculus
tacgctgtggtgcagcgctggctaa

SEQ ID NO: 745815 - DNA, 25 bp, Mus musculus
tacgctgtggtggagcgctggctaa

SEQ ID NO: 745816 - DNA, 25 bp, Mus musculus
tacgctgtgtctccaaggatgccca

SEQ ID NO: 745817 - DNA, 25 bp, Mus musculus
tacgctgtgtctgcaaggatgccca

SEQ ID NO: 745818 - DNA, 25 bp, Mus musculus
tacgcttcagccatgatgactgcca

SEQ ID NO: 745819 - DNA, 25 bp, Mus musculus
tacgcttcagccttgatgactgcca

SEQ ID NO: 745820 - DNA, 25 bp, Mus musculus
tacgcttcggtcatcgctctcttgg

SEQ ID NO: 745821 - DNA, 25 bp, Mus musculus
tacgcttcggtcttcgctctcttgg

SEQ ID NO: 745822 - DNA, 25 bp, Mus musculus
tacgcttctggcagagtatgcctac

SEQ ID NO: 745823 - DNA, 25 bp, Mus musculus
tacgcttctggctgagtatgcctac

SEQ ID NO: 745824 - DNA, 25 bp, Mus musculus
tacgctttgagtcgaagccagcctc

SEQ ID NO: 745825 - DNA, 25 bp, Mus musculus
tacgctttgagtggaagccagcctc

SEQ ID NO: 745826 - DNA, 25 bp, Mus musculus
tacgctttgtctaggctactgccaa

SEQ ID NO: 745827 - DNA, 25 bp, Mus musculus
tacgctttgtcttggctactgccaa

SEQ ID NO: 745828 - DNA, 25 bp, Mus musculus
tacgcttttcgacctcaagcccaga

SEQ ID NO: 745829 - DNA, 25 bp, Mus musculus
tacgcttttcgagctcaagcccaga

SEQ ID NO: 745830 - DNA, 25 bp, Mus musculus
tacggaaactccctcagggctacgg

SEQ ID NO: 745831 - DNA, 25 bp, Mus musculus
tacggaaactccgtcagggctacgg

SEQ ID NO: 745832 - DNA, 25 bp, Mus musculus
tacggaaccactagtgtgcagaatg

SEQ ID NO: 745833 - DNA, 25 bp, Mus musculus
tacggaaccacttgtgtgcagaatg

SEQ ID NO: 745834 - DNA, 25 bp, Mus musculus
tacggaagacaacacgatcagcgac

SEQ ID NO: 745835 - DNA, 25 bp, Mus musculus
tacggaagacaagacgatcagcgac

SEQ ID NO: 745836 - DNA, 25 bp, Mus musculus
tacggaagccgcattcccgacgaga

SEQ ID NO: 745837 - DNA, 25 bp, Mus musculus
tacggaagccgctttcccgacgaga

SEQ ID NO: 745838 - DNA, 25 bp, Mus musculus
tacggaatgtctcctttgaggatgc

SEQ ID NO: 745839 - DNA, 25 bp, Mus musculus
tacggaatgtctgctttgaggatgc

SEQ ID NO: 745840 - DNA, 25 bp, Mus musculus
tacggacaaagcatcatcctccagg

SEQ ID NO: 745841 - DNA, 25 bp, Mus musculus
tacggacaaagcttcatcctccagg

SEQ ID NO: 745842 - DNA, 25 bp, Mus musculus
tacggacacaccatggtggcctttg

SEQ ID NO: 745843 - DNA, 25 bp, Mus musculus
tacggacacaccttggtggcctttg

SEQ ID NO: 745844 - DNA, 25 bp, Mus musculus
tacggacagcaaatagaccgagtct

SEQ ID NO: 745845 - DNA, 25 bp, Mus musculus
tacggacagcaattagaccgagtct

SEQ ID NO: 745846 - DNA, 25 bp, Mus musculus
tacggaccaagtcatgctcaaagcc

SEQ ID NO: 745847 - DNA, 25 bp, Mus musculus
tacggaccaagtgatgctcaaagcc

SEQ ID NO: 745848 - DNA, 25 bp, Mus musculus
tacggacccgcactaagggctgcag

SEQ ID NO: 745849 - DNA, 25 bp, Mus musculus
tacggacccgcagtaagggctgcag

SEQ ID NO: 745850 - DNA, 25 bp, Mus musculus
tacggaccggctaagtgggtcagca

SEQ ID NO: 745851 - DNA, 25 bp, Mus musculus
tacggaccggcttagtgggtcagca

SEQ ID NO: 745852 - DNA, 25 bp, Mus musculus
tacggacgagttatctctttctgaa

SEQ ID NO: 745853 - DNA, 25 bp, Mus musculus
tacggacgagttttctctttctgaa

SEQ ID NO: 745854 - DNA, 25 bp, Mus musculus
tacggactcgagacatgggaggcta

SEQ ID NO: 745855 - DNA, 25 bp, Mus musculus
tacggactcgagtcatgggaggcta

SEQ ID NO: 745856 - DNA, 25 bp, Mus musculus
tacggactcgatcgtcaagatggcg

SEQ ID NO: 745857 - DNA, 25 bp, Mus musculus
tacggactcgatggtcaagatggcg

SEQ ID NO: 745858 - DNA, 25 bp, Mus musculus
tacggactgcgcacttcagatggct

SEQ ID NO: 745859 - DNA, 25 bp, Mus musculus
tacggactgcgctcttcagatggct

SEQ ID NO: 745860 - DNA, 25 bp, Mus musculus
tacggagagaatcaccagagactgg

SEQ ID NO: 745861 - DNA, 25 bp, Mus musculus
tacggagagaatgaccagagactgg

SEQ ID NO: 745862 - DNA, 25 bp, Mus musculus
tacggagcatctctcaaggagcttg

SEQ ID NO: 745863 - DNA, 25 bp, Mus musculus
tacggagcatctgtcaaggagcttg

SEQ ID NO: 745864 - DNA, 25 bp, Mus musculus
tacggagcccaacgccattggccat

SEQ ID NO: 745865 - DNA, 25 bp, Mus musculus
tacggagcccaaggccattggccat

SEQ ID NO: 745866 - DNA, 25 bp, Mus musculus
tacggagtggccacctgcgaggctt

SEQ ID NO: 745867 - DNA, 25 bp, Mus musculus
tacggagtggcctcctgcgaggctt

SEQ ID NO: 745868 - DNA, 25 bp, Mus musculus
tacggagtgggtacctgtggtcctc

SEQ ID NO: 745869 - DNA, 25 bp, Mus musculus
tacggagtgggttcctgtggtcctc

SEQ ID NO: 745870 - DNA, 25 bp, Mus musculus
tacggataaaacatcatccagaaac

SEQ ID NO: 745871 - DNA, 25 bp, Mus musculus
tacggataaaacttcatccagaaac

SEQ ID NO: 745872 - DNA, 25 bp, Mus musculus
tacggatcgccactcttacatcgca

SEQ ID NO: 745873 - DNA, 25 bp, Mus musculus
tacggatcgccagtcttacatcgca

SEQ ID NO: 745874 - DNA, 25 bp, Mus musculus
tacggatgactgaaagttcagggag

SEQ ID NO: 745875 - DNA, 25 bp, Mus musculus
tacggatgactgtaagttcagggag

SEQ ID NO: 745876 - DNA, 25 bp, Mus musculus
tacggatgatgcactagttacgttt

SEQ ID NO: 745877 - DNA, 25 bp, Mus musculus
tacggatgatgctctagttacgttt

SEQ ID NO: 745878 - DNA, 25 bp, Mus musculus
tacggattgaacatcgagatgcaca

SEQ ID NO: 745879 - DNA, 25 bp, Mus musculus
tacggattgaacttcgagatgcaca

SEQ ID NO: 745880 - DNA, 25 bp, Mus musculus
tacggattttgcagagaacgagctg

SEQ ID NO: 745881 - DNA, 25 bp, Mus musculus
tacggattttgctgagaacgagctg

SEQ ID NO: 745882 - DNA, 25 bp, Mus musculus
tacggcaacagtcaggaccgtgcct

SEQ ID NO: 745883 - DNA, 25 bp, Mus musculus
tacggcaacagtgaggaccgtgcct

SEQ ID NO: 745884 - DNA, 25 bp, Mus musculus
tacggcaaccctctccggtattggg

SEQ ID NO: 745885 - DNA, 25 bp, Mus musculus
tacggcaaccctgtccggtattggg

SEQ ID NO: 745886 - DNA, 25 bp, Mus musculus
tacggcaagaagaacattctaaagg

SEQ ID NO: 745887 - DNA, 25 bp, Mus musculus
tacggcaagaagtacattctaaagg

SEQ ID NO: 745888 - DNA, 25 bp, Mus musculus
tacggcaagcacaggtgtggaactt

SEQ ID NO: 745889 - DNA, 25 bp, Mus musculus
tacggcaagcactggtgtggaactt

SEQ ID NO: 745890 - DNA, 25 bp, Mus musculus
tacggcacagccatggaaaaagctc

SEQ ID NO: 745891 - DNA, 25 bp, Mus musculus
tacggcacagccttggaaaaagctc

SEQ ID NO: 745892 - DNA, 25 bp, Mus musculus
tacggcagccagctcctttttctga

SEQ ID NO: 745893 - DNA, 25 bp, Mus musculus
tacggcagccaggtcctttttctga

SEQ ID NO: 745894 - DNA, 25 bp, Mus musculus
tacggcagcgagacgtttttggcca

SEQ ID NO: 745895 - DNA, 25 bp, Mus musculus
tacggcagcgagtcgtttttggcca

SEQ ID NO: 745896 - DNA, 25 bp, Mus musculus
tacggcatcgtgctgtacgagctga

SEQ ID NO: 745897 - DNA, 25 bp, Mus musculus
tacggcatcgtggtgtacgagctga

SEQ ID NO: 745898 - DNA, 25 bp, Mus musculus
tacggcatgggacgaaggatacaca

SEQ ID NO: 745899 - DNA, 25 bp, Mus musculus
tacggcatgggaggaaggatacaca

SEQ ID NO: 745900 - DNA, 25 bp, Mus musculus
tacggccactgcaagatctggaagt

SEQ ID NO: 745901 - DNA, 25 bp, Mus musculus
tacggccactgctagatctggaagt

SEQ ID NO: 745902 - DNA, 25 bp, Mus musculus
tacggccaggctcggtccgagcatc

SEQ ID NO: 745903 - DNA, 25 bp, Mus musculus
tacggccaggctgggtccgagcatc

SEQ ID NO: 745904 - DNA, 25 bp, Mus musculus
tacggccattgtcaacgaggtccag

SEQ ID NO: 745905 - DNA, 25 bp, Mus musculus
tacggccattgtgaacgaggtccag

SEQ ID NO: 745906 - DNA, 25 bp, Mus musculus
tacggccatttgactgtcatcttcc

SEQ ID NO: 745907 - DNA, 25 bp, Mus musculus
tacggccatttgtctgtcatcttcc

SEQ ID NO: 745908 - DNA, 25 bp, Mus musculus
tacggcccagtcatcgaatgtgaca

SEQ ID NO: 745909 - DNA, 25 bp, Mus musculus
tacggcccagtcttcgaatgtgaca

SEQ ID NO: 745910 - DNA, 25 bp, Mus musculus
tacggcccgcccattgacctttggg

SEQ ID NO: 745911 - DNA, 25 bp, Mus musculus
tacggcccgccctttgacctttggg

SEQ ID NO: 745912 - DNA, 25 bp, Mus musculus
tacggccggcttagctgatgcttca

SEQ ID NO: 745913 - DNA, 25 bp, Mus musculus
tacggccggctttgctgatgcttca

SEQ ID NO: 745914 - DNA, 25 bp, Mus musculus
tacggccgtcctatcacgtgtcatg

SEQ ID NO: 745915 - DNA, 25 bp, Mus musculus
tacggccgtcctttcacgtgtcatg

SEQ ID NO: 745916 - DNA, 25 bp, Mus musculus
tacggccgtggtcccgcaaagcgct

SEQ ID NO: 745917 - DNA, 25 bp, Mus musculus
tacggccgtggtgccgcaaagcgct

SEQ ID NO: 745918 - DNA, 25 bp, Mus musculus
tacggcctacgaccctcggcgattg

SEQ ID NO: 745919 - DNA, 25 bp, Mus musculus
tacggcctacgagcctcggcgattg

SEQ ID NO: 745920 - DNA, 25 bp, Mus musculus
tacggcctgacaacagagccatgga

SEQ ID NO: 745921 - DNA, 25 bp, Mus musculus
tacggcctgacatcagagccatgga

SEQ ID NO: 745922 - DNA, 25 bp, Mus musculus
tacggcctgttcctcaagggcattg

SEQ ID NO: 745923 - DNA, 25 bp, Mus musculus
tacggcctgttcgtcaagggcattg

SEQ ID NO: 745924 - DNA, 25 bp, Mus musculus
tacggcctttttaactccgcaccag

SEQ ID NO: 745925 - DNA, 25 bp, Mus musculus
tacggccttttttactccgcaccag

SEQ ID NO: 745926 - DNA, 25 bp, Mus musculus
tacggcgagtttcgtgcccgtgtcc

SEQ ID NO: 745927 - DNA, 25 bp, Mus musculus
tacggcgagtttggtgcccgtgtcc

SEQ ID NO: 745928 - DNA, 25 bp, Mus musculus
tacggcgcaggtaaaacgaacacat

SEQ ID NO: 745929 - DNA, 25 bp, Mus musculus
tacggcgcaggttaaacgaacacat

SEQ ID NO: 745930 - DNA, 25 bp, Mus musculus
tacggcgcgggcaacatgaatgcca

SEQ ID NO: 745931 - DNA, 25 bp, Mus musculus
tacggcgcgggctacatgaatgcca

SEQ ID NO: 745932 - DNA, 25 bp, Mus musculus
tacggcgctgcgagctgatcaaaga

SEQ ID NO: 745933 - DNA, 25 bp, Mus musculus
tacggcgctgcgtgctgatcaaaga

SEQ ID NO: 745934 - DNA, 25 bp, Mus musculus
tacggcgtcacgcagtcagctacgt

SEQ ID NO: 745935 - DNA, 25 bp, Mus musculus
tacggcgtcacggagtcagctacgt

SEQ ID NO: 745936 - DNA, 25 bp, Mus musculus
tacggctatgtgaacgcaggctgca

SEQ ID NO: 745937 - DNA, 25 bp, Mus musculus
tacggctatgtgtacgcaggctgca

SEQ ID NO: 745938 - DNA, 25 bp, Mus musculus
tacggctgagcacttcctgggcttt

SEQ ID NO: 745939 - DNA, 25 bp, Mus musculus
tacggctgagcagttcctgggcttt

SEQ ID NO: 745940 - DNA, 25 bp, Mus musculus
tacggctgagccaaaactcagggtg

SEQ ID NO: 745941 - DNA, 25 bp, Mus musculus
tacggctgagcctaaactcagggtg

SEQ ID NO: 745942 - DNA, 25 bp, Mus musculus
tacggctgccgactcatccagaaag

SEQ ID NO: 745943 - DNA, 25 bp, Mus musculus
tacggctgccgagtcatccagaaag

SEQ ID NO: 745944 - DNA, 25 bp, Mus musculus
tacggctgctccctaggacaaatga

SEQ ID NO: 745945 - DNA, 25 bp, Mus musculus
tacggctgctccgtaggacaaatga

SEQ ID NO: 745946 - DNA, 25 bp, Mus musculus
tacggcttcccacaattacctcagg

SEQ ID NO: 745947 - DNA, 25 bp, Mus musculus
tacggcttcccagaattacctcagg

SEQ ID NO: 745948 - DNA, 25 bp, Mus musculus
tacggcttcgccaggcgttccggtc

SEQ ID NO: 745949 - DNA, 25 bp, Mus musculus
tacggcttcgcctggcgttccggtc

SEQ ID NO: 745950 - DNA, 25 bp, Mus musculus
tacggcttctggctgccttcacctg

SEQ ID NO: 745951 - DNA, 25 bp, Mus musculus
tacggcttctgggtgccttcacctg

SEQ ID NO: 745952 - DNA, 25 bp, Mus musculus
tacggcttgggcactggcatttctc

SEQ ID NO: 745953 - DNA, 25 bp, Mus musculus
tacggcttgggctctggcatttctc

SEQ ID NO: 745954 - DNA, 25 bp, Mus musculus
tacggctttcacctgcatggcgaga

SEQ ID NO: 745955 - DNA, 25 bp, Mus musculus
tacggctttcacgtgcatggcgaga

SEQ ID NO: 745956 - DNA, 25 bp, Mus musculus
tacggctttgtaaggaagggctacg

SEQ ID NO: 745957 - DNA, 25 bp, Mus musculus
tacggctttgtatggaagggctacg

SEQ ID NO: 745958 - DNA, 25 bp, Mus musculus
tacgggaagaccaagcagtccggct

SEQ ID NO: 745959 - DNA, 25 bp, Mus musculus
tacgggaagacctagcagtccggct

SEQ ID NO: 745960 - DNA, 25 bp, Mus musculus
tacgggacctatcagaatgccaagg

SEQ ID NO: 745961 - DNA, 25 bp, Mus musculus
tacgggacctatgagaatgccaagg

SEQ ID NO: 745962 - DNA, 25 bp, Mus musculus
tacgggactcgcagatgagacgaca

SEQ ID NO: 745963 - DNA, 25 bp, Mus musculus
tacgggactcgctgatgagacgaca

SEQ ID NO: 745964 - DNA, 25 bp, Mus musculus
tacgggactttactgcgactggatt

SEQ ID NO: 745965 - DNA, 25 bp, Mus musculus
tacgggactttagtgcgactggatt

SEQ ID NO: 745966 - DNA, 25 bp, Mus musculus
tacgggagagcaccatgtaaagaca

SEQ ID NO: 745967 - DNA, 25 bp, Mus musculus
tacgggagagcagcatgtaaagaca

SEQ ID NO: 745968 - DNA, 25 bp, Mus musculus
tacgggagctcaaagagaccaacca

SEQ ID NO: 745969 - DNA, 25 bp, Mus musculus
tacgggagctcatagagaccaacca

SEQ ID NO: 745970 - DNA, 25 bp, Mus musculus
tacgggagtgtcaggcgtctctacc

SEQ ID NO: 745971 - DNA, 25 bp, Mus musculus
tacgggagtgtctggcgtctctacc

SEQ ID NO: 745972 - DNA, 25 bp, Mus musculus
tacgggatccagcagcagcggcttc

SEQ ID NO: 745973 - DNA, 25 bp, Mus musculus
tacgggatccaggagcagcggcttc

SEQ ID NO: 745974 - DNA, 25 bp, Mus musculus
tacgggatctcgcacaccaacctgg

SEQ ID NO: 745975 - DNA, 25 bp, Mus musculus
tacgggatctcggacaccaacctgg

SEQ ID NO: 745976 - DNA, 25 bp, Mus musculus
tacgggatggtcagcgatagttact

SEQ ID NO: 745977 - DNA, 25 bp, Mus musculus
tacgggatggtctgcgatagttact

SEQ ID NO: 745978 - DNA, 25 bp, Mus musculus
tacgggcagactctcaagcttgtgt

SEQ ID NO: 745979 - DNA, 25 bp, Mus musculus
tacgggcagactgtcaagcttgtgt

SEQ ID NO: 745980 - DNA, 25 bp, Mus musculus
tacgggcagttcaatggaggcgaca

SEQ ID NO: 745981 - DNA, 25 bp, Mus musculus
tacgggcagttctatggaggcgaca

SEQ ID NO: 745982 - DNA, 25 bp, Mus musculus
tacgggccgaacctttgtcgccaag

SEQ ID NO: 745983 - DNA, 25 bp, Mus musculus
tacgggccgaacgtttgtcgccaag

SEQ ID NO: 745984 - DNA, 25 bp, Mus musculus
tacgggccttcgcagaagctgcctc

SEQ ID NO: 745985 - DNA, 25 bp, Mus musculus
tacgggccttcggagaagctgcctc

SEQ ID NO: 745986 - DNA, 25 bp, Mus musculus
tacgggcgagaaaaactcaaccctg

SEQ ID NO: 745987 - DNA, 25 bp, Mus musculus
tacgggcgagaataactcaaccctg

SEQ ID NO: 745988 - DNA, 25 bp, Mus musculus
tacgggctacgcagtgtgactgaag

SEQ ID NO: 745989 - DNA, 25 bp, Mus musculus
tacgggctacgctgtgtgactgaag

SEQ ID NO: 745990 - DNA, 25 bp, Mus musculus
tacgggctccagactcagactggtg

SEQ ID NO: 745991 - DNA, 25 bp, Mus musculus
tacgggctccagtctcagactggtg

SEQ ID NO: 745992 - DNA, 25 bp, Mus musculus
tacgggctgagcctattgtgctttt

SEQ ID NO: 745993 - DNA, 25 bp, Mus musculus
tacgggctgagcgtattgtgctttt

SEQ ID NO: 745994 - DNA, 25 bp, Mus musculus
tacgggcttccacgtcgccgttggc

SEQ ID NO: 745995 - DNA, 25 bp, Mus musculus
tacgggcttccaggtcgccgttggc

SEQ ID NO: 745996 - DNA, 25 bp, Mus musculus
tacgggctttggactgttcctcagg

SEQ ID NO: 745997 - DNA, 25 bp, Mus musculus
tacgggctttggtctgttcctcagg

SEQ ID NO: 745998 - DNA, 25 bp, Mus musculus
tacgggtcacatcctttctacctgg

SEQ ID NO: 745999 - DNA, 25 bp, Mus musculus
tacgggtcacatgctttctacctgg

SEQ ID NO: 746000 - DNA, 25 bp, Mus musculus
tacgggtccatgcagctacaggtac

SEQ ID NO: 746001 - DNA, 25 bp, Mus musculus
tacgggtccatggagctacaggtac

SEQ ID NO: 746002 - DNA, 25 bp, Mus musculus
tacgggtcctacattgcctgcgatt

SEQ ID NO: 746003 - DNA, 25 bp, Mus musculus
tacgggtcctactttgcctgcgatt

SEQ ID NO: 746004 - DNA, 25 bp, Mus musculus
tacgggtctgctaggaacagtcatt

SEQ ID NO: 746005 - DNA, 25 bp, Mus musculus
tacgggtctgcttggaacagtcatt

SEQ ID NO: 746006 - DNA, 25 bp, Mus musculus
tacgggtgcatacgtgatgcaagat

SEQ ID NO: 746007 - DNA, 25 bp, Mus musculus
tacgggtgcataggtgatgcaagat

SEQ ID NO: 746008 - DNA, 25 bp, Mus musculus
tacgggttcaacctgcatagtgaca

SEQ ID NO: 746009 - DNA, 25 bp, Mus musculus
tacgggttcaacgtgcatagtgaca

SEQ ID NO: 746010 - DNA, 25 bp, Mus musculus
tacgggttcaggagtcaaagcctgg

SEQ ID NO: 746011 - DNA, 25 bp, Mus musculus
tacgggttcaggtgtcaaagcctgg

SEQ ID NO: 746012 - DNA, 25 bp, Mus musculus
tacgggttctgaccccttcatctgg

SEQ ID NO: 746013 - DNA, 25 bp, Mus musculus
tacgggttctgagcccttcatctgg

SEQ ID NO: 746014 - DNA, 25 bp, Mus musculus
tacggtacgtgacaagatacagtgc

SEQ ID NO: 746015 - DNA, 25 bp, Mus musculus
tacggtacgtgagaagatacagtgc

SEQ ID NO: 746016 - DNA, 25 bp, Mus musculus
tacggtactgctccgcaaggagtcc

SEQ ID NO: 746017 - DNA, 25 bp, Mus musculus
tacggtactgctgcgcaaggagtcc

SEQ ID NO: 746018 - DNA, 25 bp, Mus musculus
tacggtatgataaacggtgtcacaa

SEQ ID NO: 746019 - DNA, 25 bp, Mus musculus
tacggtatgatatacggtgtcacaa

SEQ ID NO: 746020 - DNA, 25 bp, Mus musculus
tacggtcacttaactggaccaatgg

SEQ ID NO: 746021 - DNA, 25 bp, Mus musculus
tacggtcacttatctggaccaatgg

SEQ ID NO: 746022 - DNA, 25 bp, Mus musculus
tacggtccaaagatctctgaggcac

SEQ ID NO: 746023 - DNA, 25 bp, Mus musculus
tacggtccaaagttctctgaggcac

SEQ ID NO: 746024 - DNA, 25 bp, Mus musculus
tacggtcgagtactctcatcggtgg

SEQ ID NO: 746025 - DNA, 25 bp, Mus musculus
tacggtcgagtagtctcatcggtgg

SEQ ID NO: 746026 - DNA, 25 bp, Mus musculus
tacggtctttggacaagcaattaga

SEQ ID NO: 746027 - DNA, 25 bp, Mus musculus
tacggtctttggtcaagcaattaga

SEQ ID NO: 746028 - DNA, 25 bp, Mus musculus
tacggtgacaagaggatcatcgaca

SEQ ID NO: 746029 - DNA, 25 bp, Mus musculus
tacggtgacaagtggatcatcgaca

SEQ ID NO: 746030 - DNA, 25 bp, Mus musculus
tacggtgacatccatgctttagagt

SEQ ID NO: 746031 - DNA, 25 bp, Mus musculus
tacggtgacatcgatgctttagagt

SEQ ID NO: 746032 - DNA, 25 bp, Mus musculus
tacggtgactgtctaccccacaaag

SEQ ID NO: 746033 - DNA, 25 bp, Mus musculus
tacggtgactgtgtaccccacaaag

SEQ ID NO: 746034 - DNA, 25 bp, Mus musculus
tacggtgatctgctggactacctgc

SEQ ID NO: 746035 - DNA, 25 bp, Mus musculus
tacggtgatctggtggactacctgc

SEQ ID NO: 746036 - DNA, 25 bp, Mus musculus
tacggtgcaggtatcatgctaatcc

SEQ ID NO: 746037 - DNA, 25 bp, Mus musculus
tacggtgcaggtttcatgctaatcc

SEQ ID NO: 746038 - DNA, 25 bp, Mus musculus
tacggtggaatgatgtagctggact

SEQ ID NO: 746039 - DNA, 25 bp, Mus musculus
tacggtggaatgttgtagctggact

SEQ ID NO: 746040 - DNA, 25 bp, Mus musculus
tacggtggagagattcatcgccatg

SEQ ID NO: 746041 - DNA, 25 bp, Mus musculus
tacggtggagagtttcatcgccatg

SEQ ID NO: 746042 - DNA, 25 bp, Mus musculus
tacggtggcaggacgcccttctatt

SEQ ID NO: 746043 - DNA, 25 bp, Mus musculus
tacggtggcaggtcgcccttctatt

SEQ ID NO: 746044 - DNA, 25 bp, Mus musculus
tacggtggccgcatgctgcactcct

SEQ ID NO: 746045 - DNA, 25 bp, Mus musculus
tacggtggccgcttgctgcactcct

SEQ ID NO: 746046 - DNA, 25 bp, Mus musculus
tacggtggcctgctggtcttttgca

SEQ ID NO: 746047 - DNA, 25 bp, Mus musculus
tacggtggcctggtggtcttttgca

SEQ ID NO: 746048 - DNA, 25 bp, Mus musculus
tacggtgtgaagactggtgtccgcc

SEQ ID NO: 746049 - DNA, 25 bp, Mus musculus
tacggtgtgaagtctggtgtccgcc

SEQ ID NO: 746050 - DNA, 25 bp, Mus musculus
tacggttcacctagtcatcaaaaca

SEQ ID NO: 746051 - DNA, 25 bp, Mus musculus
tacggttcaccttgtcatcaaaaca

SEQ ID NO: 746052 - DNA, 25 bp, Mus musculus
tacggttcactacacagctctgatc

SEQ ID NO: 746053 - DNA, 25 bp, Mus musculus
tacggttcactagacagctctgatc

SEQ ID NO: 746054 - DNA, 25 bp, Mus musculus
tacggttcctaacctgagtcaaaat

SEQ ID NO: 746055 - DNA, 25 bp, Mus musculus
tacggttcctaagctgagtcaaaat

SEQ ID NO: 746056 - DNA, 25 bp, Mus musculus
tacggttgacaacaggatacagacg

SEQ ID NO: 746057 - DNA, 25 bp, Mus musculus
tacggttgacaagaggatacagacg

SEQ ID NO: 746058 - DNA, 25 bp, Mus musculus
tacggttgcatcacaactggtgaca

SEQ ID NO: 746059 - DNA, 25 bp, Mus musculus
tacggttgcatctcaactggtgaca

SEQ ID NO: 746060 - DNA, 25 bp, Mus musculus
tacggtttcggtcacaaagccgaga

SEQ ID NO: 746061 - DNA, 25 bp, Mus musculus
tacggtttcggtgacaaagccgaga

SEQ ID NO: 746062 - DNA, 25 bp, Mus musculus
tacggtttggagagactcttcccaa

SEQ ID NO: 746063 - DNA, 25 bp, Mus musculus
tacggtttggagtgactcttcccaa

SEQ ID NO: 746064 - DNA, 25 bp, Mus musculus
tacggttttgtgaactatgtgactg

SEQ ID NO: 746065 - DNA, 25 bp, Mus musculus
tacggttttgtgtactatgtgactg

SEQ ID NO: 746066 - DNA, 25 bp, Mus musculus
tacgtacaagctagtgaacaacggg

SEQ ID NO: 746067 - DNA, 25 bp, Mus musculus
tacgtacaagcttgtgaacaacggg

SEQ ID NO: 746068 - DNA, 25 bp, Mus musculus
tacgtacagtacattgtcaagttct

SEQ ID NO: 746069 - DNA, 25 bp, Mus musculus
tacgtacagtactttgtcaagttct

SEQ ID NO: 746070 - DNA, 25 bp, Mus musculus
tacgtacggaatcttgtatgcaagc

SEQ ID NO: 746071 - DNA, 25 bp, Mus musculus
tacgtacggaatgttgtatgcaagc

SEQ ID NO: 746072 - DNA, 25 bp, Mus musculus
tacgtagctcccaagaaatgctcgt

SEQ ID NO: 746073 - DNA, 25 bp, Mus musculus
tacgtagctccctagaaatgctcgt

SEQ ID NO: 746074 - DNA, 25 bp, Mus musculus
tacgtaggtaacctctccagagatg

SEQ ID NO: 746075 - DNA, 25 bp, Mus musculus
tacgtaggtaacgtctccagagatg

SEQ ID NO: 746076 - DNA, 25 bp, Mus musculus
tacgtaggtgaacctacgggcccca

SEQ ID NO: 746077 - DNA, 25 bp, Mus musculus
tacgtaggtgaagctacgggcccca

SEQ ID NO: 746078 - DNA, 25 bp, Mus musculus
tacgtaggtgccatgcagccccgga

SEQ ID NO: 746079 - DNA, 25 bp, Mus musculus
tacgtaggtgccttgcagccccgga

SEQ ID NO: 746080 - DNA, 25 bp, Mus musculus
tacgtagtgtccatcttgtgaagcc

SEQ ID NO: 746081 - DNA, 25 bp, Mus musculus
tacgtagtgtccttcttgtgaagcc

SEQ ID NO: 746082 - DNA, 25 bp, Mus musculus
tacgtatacggaaagctacatcagc

SEQ ID NO: 746083 - DNA, 25 bp, Mus musculus
tacgtatacggatagctacatcagc

SEQ ID NO: 746084 - DNA, 25 bp, Mus musculus
tacgtatgcaccagccgagaaggct

SEQ ID NO: 746085 - DNA, 25 bp, Mus musculus
tacgtatgcacctgccgagaaggct

SEQ ID NO: 746086 - DNA, 25 bp, Mus musculus
tacgtattgatacatgtgcaaagga

SEQ ID NO: 746087 - DNA, 25 bp, Mus musculus
tacgtattgatagatgtgcaaagga

SEQ ID NO: 746088 - DNA, 25 bp, Mus musculus
tacgtattgatgagcgggctggacc

SEQ ID NO: 746089 - DNA, 25 bp, Mus musculus
tacgtattgatgtgcgggctggacc

SEQ ID NO: 746090 - DNA, 25 bp, Mus musculus
tacgtcaacattaatcccgcttgcc

SEQ ID NO: 746091 - DNA, 25 bp, Mus musculus
tacgtcaacatttatcccgcttgcc

SEQ ID NO: 746092 - DNA, 25 bp, Mus musculus
tacgtcaagatcaacctgttgcctg

SEQ ID NO: 746093 - DNA, 25 bp, Mus musculus
tacgtcaagatctacctgttgcctg

SEQ ID NO: 746094 - DNA, 25 bp, Mus musculus
tacgtcaccaccctggagacactgg

SEQ ID NO: 746095 - DNA, 25 bp, Mus musculus
tacgtcaccaccgtggagacactgg

SEQ ID NO: 746096 - DNA, 25 bp, Mus musculus
tacgtcactgatcgtgcttgcagtg

SEQ ID NO: 746097 - DNA, 25 bp, Mus musculus
tacgtcactgatggtgcttgcagtg

SEQ ID NO: 746098 - DNA, 25 bp, Mus musculus
tacgtcagcttcactgatgccacca

SEQ ID NO: 746099 - DNA, 25 bp, Mus musculus
tacgtcagcttctctgatgccacca

SEQ ID NO: 746100 - DNA, 25 bp, Mus musculus
tacgtcaggactcccctccatgggt

SEQ ID NO: 746101 - DNA, 25 bp, Mus musculus
tacgtcaggactgccctccatgggt

SEQ ID NO: 746102 - DNA, 25 bp, Mus musculus
tacgtcagggaaccccaggaaagag

SEQ ID NO: 746103 - DNA, 25 bp, Mus musculus
tacgtcagggaagcccaggaaagag

SEQ ID NO: 746104 - DNA, 25 bp, Mus musculus
tacgtcatcaatcaggtgaggtttg

SEQ ID NO: 746105 - DNA, 25 bp, Mus musculus
tacgtcatcaatgaggtgaggtttg

SEQ ID NO: 746106 - DNA, 25 bp, Mus musculus
tacgtcatgatcatcatcccagcgc

SEQ ID NO: 746107 - DNA, 25 bp, Mus musculus
tacgtcatgatcttcatcccagcgc

SEQ ID NO: 746108 - DNA, 25 bp, Mus musculus
tacgtcatgcctactgatttgcgga

SEQ ID NO: 746109 - DNA, 25 bp, Mus musculus
tacgtcatgccttctgatttgcgga

SEQ ID NO: 746110 - DNA, 25 bp, Mus musculus
tacgtccaagatagcaggaaagttg

SEQ ID NO: 746111 - DNA, 25 bp, Mus musculus
tacgtccaagattgcaggaaagttg

SEQ ID NO: 746112 - DNA, 25 bp, Mus musculus
tacgtccaccccagatataactggc

SEQ ID NO: 746113 - DNA, 25 bp, Mus musculus
tacgtccacccctgatataactggc

SEQ ID NO: 746114 - DNA, 25 bp, Mus musculus
tacgtccagaagatgtctatgtaca

SEQ ID NO: 746115 - DNA, 25 bp, Mus musculus
tacgtccagaagttgtctatgtaca

SEQ ID NO: 746116 - DNA, 25 bp, Mus musculus
tacgtccagtccagcaggaggtttt

SEQ ID NO: 746117 - DNA, 25 bp, Mus musculus
tacgtccagtcctgcaggaggtttt

SEQ ID NO: 746118 - DNA, 25 bp, Mus musculus
tacgtccccattctgtactaacaga

SEQ ID NO: 746119 - DNA, 25 bp, Mus musculus
tacgtccccattgtgtactaacaga

SEQ ID NO: 746120 - DNA, 25 bp, Mus musculus
tacgtcccgagcacgcgtgctggag

SEQ ID NO: 746121 - DNA, 25 bp, Mus musculus
tacgtcccgagctcgcgtgctggag

SEQ ID NO: 746122 - DNA, 25 bp, Mus musculus
tacgtcctacaacgttacgccgagg

SEQ ID NO: 746123 - DNA, 25 bp, Mus musculus
tacgtcctacaaggttacgccgagg

SEQ ID NO: 746124 - DNA, 25 bp, Mus musculus
tacgtcctctttacaagtattgtgg

SEQ ID NO: 746125 - DNA, 25 bp, Mus musculus
tacgtcctcttttcaagtattgtgg

SEQ ID NO: 746126 - DNA, 25 bp, Mus musculus
tacgtcctgtctctagagattggga

SEQ ID NO: 746127 - DNA, 25 bp, Mus musculus
tacgtcctgtctgtagagattggga

SEQ ID NO: 746128 - DNA, 25 bp, Mus musculus
tacgtcgaactcctttgatgtgatc

SEQ ID NO: 746129 - DNA, 25 bp, Mus musculus
tacgtcgaactcgtttgatgtgatc

SEQ ID NO: 746130 - DNA, 25 bp, Mus musculus
tacgtcgccgtgcattgagcctgct

SEQ ID NO: 746131 - DNA, 25 bp, Mus musculus
tacgtcgccgtggattgagcctgct

SEQ ID NO: 746132 - DNA, 25 bp, Mus musculus
tacgtcggaactagatccagtctcg

SEQ ID NO: 746133 - DNA, 25 bp, Mus musculus
tacgtcggaacttgatccagtctcg

SEQ ID NO: 746134 - DNA, 25 bp, Mus musculus
tacgtcggtgacactgtagcttctt

SEQ ID NO: 746135 - DNA, 25 bp, Mus musculus
tacgtcggtgactctgtagcttctt

SEQ ID NO: 746136 - DNA, 25 bp, Mus musculus
tacgtctacgccaaaggtcaaggca

SEQ ID NO: 746137 - DNA, 25 bp, Mus musculus
tacgtctacgcctaaggtcaaggca

SEQ ID NO: 746138 - DNA, 25 bp, Mus musculus
tacgtctcattcaccgcaacgcagt

SEQ ID NO: 746139 - DNA, 25 bp, Mus musculus
tacgtctcattctccgcaacgcagt

SEQ ID NO: 746140 - DNA, 25 bp, Mus musculus
tacgtctgatgcaattagggccact

SEQ ID NO: 746141 - DNA, 25 bp, Mus musculus
tacgtctgatgctattagggccact

SEQ ID NO: 746142 - DNA, 25 bp, Mus musculus
tacgtctgcagtcccagagtggcag

SEQ ID NO: 746143 - DNA, 25 bp, Mus musculus
tacgtctgcagtgccagagtggcag

SEQ ID NO: 746144 - DNA, 25 bp, Mus musculus
tacgtctggacgctgagtgacccag

SEQ ID NO: 746145 - DNA, 25 bp, Mus musculus
tacgtctggacggtgagtgacccag

SEQ ID NO: 746146 - DNA, 25 bp, Mus musculus
tacgtcttaaggcagagactagcaa

SEQ ID NO: 746147 - DNA, 25 bp, Mus musculus
tacgtcttaagggagagactagcaa

SEQ ID NO: 746148 - DNA, 25 bp, Mus musculus
tacgtcttccataccggacatgatt

SEQ ID NO: 746149 - DNA, 25 bp, Mus musculus
tacgtcttccattccggacatgatt

SEQ ID NO: 746150 - DNA, 25 bp, Mus musculus
tacgtgaaactgaaggacaacgaga

SEQ ID NO: 746151 - DNA, 25 bp, Mus musculus
tacgtgaaactgtaggacaacgaga

SEQ ID NO: 746152 - DNA, 25 bp, Mus musculus
tacgtgaacagacggaaacttggac

SEQ ID NO: 746153 - DNA, 25 bp, Mus musculus
tacgtgaacagagggaaacttggac

SEQ ID NO: 746154 - DNA, 25 bp, Mus musculus
tacgtgaacgacatgcagctggtca

SEQ ID NO: 746155 - DNA, 25 bp, Mus musculus
tacgtgaacgacttgcagctggtca

SEQ ID NO: 746156 - DNA, 25 bp, Mus musculus
tacgtgaagaacattgagcgggccg

SEQ ID NO: 746157 - DNA, 25 bp, Mus musculus
tacgtgaagaactttgagcgggccg

SEQ ID NO: 746158 - DNA, 25 bp, Mus musculus
tacgtgaagatccagcttatgttaa

SEQ ID NO: 746159 - DNA, 25 bp, Mus musculus
tacgtgaagatcgagcttatgttaa

SEQ ID NO: 746160 - DNA, 25 bp, Mus musculus
tacgtgaataccatccacaacattg

SEQ ID NO: 746161 - DNA, 25 bp, Mus musculus
tacgtgaataccttccacaacattg

SEQ ID NO: 746162 - DNA, 25 bp, Mus musculus
tacgtgacatacaagggagtctgac

SEQ ID NO: 746163 - DNA, 25 bp, Mus musculus
tacgtgacatactagggagtctgac

SEQ ID NO: 746164 - DNA, 25 bp, Mus musculus
tacgtgagaagaaacagtgctcgcc

SEQ ID NO: 746165 - DNA, 25 bp, Mus musculus
tacgtgagaagatacagtgctcgcc

SEQ ID NO: 746166 - DNA, 25 bp, Mus musculus
tacgtgagcctgcacaactccgtgt

SEQ ID NO: 746167 - DNA, 25 bp, Mus musculus
tacgtgagcctggacaactccgtgt

SEQ ID NO: 746168 - DNA, 25 bp, Mus musculus
tacgtgaggcatcttgacaatcccc

SEQ ID NO: 746169 - DNA, 25 bp, Mus musculus
tacgtgaggcatgttgacaatcccc

SEQ ID NO: 746170 - DNA, 25 bp, Mus musculus
tacgtgaggtctaagtcagccaagc

SEQ ID NO: 746171 - DNA, 25 bp, Mus musculus
tacgtgaggtcttagtcagccaagc

SEQ ID NO: 746172 - DNA, 25 bp, Mus musculus
tacgtgagtgtacgccataagcttg

SEQ ID NO: 746173 - DNA, 25 bp, Mus musculus
tacgtgagtgtaggccataagcttg

SEQ ID NO: 746174 - DNA, 25 bp, Mus musculus
tacgtgatcaacattgcacctatag

SEQ ID NO: 746175 - DNA, 25 bp, Mus musculus
tacgtgatcaactttgcacctatag

SEQ ID NO: 746176 - DNA, 25 bp, Mus musculus
tacgtgatgcaacatcagaatgtcc

SEQ ID NO: 746177 - DNA, 25 bp, Mus musculus
tacgtgatgcaagatcagaatgtcc

SEQ ID NO: 746178 - DNA, 25 bp, Mus musculus
tacgtgattgtgcaatgtgccgcca

SEQ ID NO: 746179 - DNA, 25 bp, Mus musculus
tacgtgattgtggaatgtgccgcca

SEQ ID NO: 746180 - DNA, 25 bp, Mus musculus
tacgtgcaagagaagatcgtgcttg

SEQ ID NO: 746181 - DNA, 25 bp, Mus musculus
tacgtgcaagagtagatcgtgcttg

SEQ ID NO: 746182 - DNA, 25 bp, Mus musculus
tacgtgcaggagcattctgtagttg

SEQ ID NO: 746183 - DNA, 25 bp, Mus musculus
tacgtgcaggaggattctgtagttg

SEQ ID NO: 746184 - DNA, 25 bp, Mus musculus
tacgtgcgcgtactcaccgagaaat

SEQ ID NO: 746185 - DNA, 25 bp, Mus musculus
tacgtgcgcgtagtcaccgagaaat

SEQ ID NO: 746186 - DNA, 25 bp, Mus musculus
tacgtgctactaaggaggcccaagg

SEQ ID NO: 746187 - DNA, 25 bp, Mus musculus
tacgtgctactatggaggcccaagg

SEQ ID NO: 746188 - DNA, 25 bp, Mus musculus
tacgtgctgagcaggctgtcgctgt

SEQ ID NO: 746189 - DNA, 25 bp, Mus musculus
tacgtgctgagctggctgtcgctgt

SEQ ID NO: 746190 - DNA, 25 bp, Mus musculus
tacgtgctgtccctggacctgcatg

SEQ ID NO: 746191 - DNA, 25 bp, Mus musculus
tacgtgctgtccgtggacctgcatg

SEQ ID NO: 746192 - DNA, 25 bp, Mus musculus
tacgtgctgtttctctccggcgagg

SEQ ID NO: 746193 - DNA, 25 bp, Mus musculus
tacgtgctgtttgtctccggcgagg

SEQ ID NO: 746194 - DNA, 25 bp, Mus musculus
tacgtgcttgtcaactacaacctgg

SEQ ID NO: 746195 - DNA, 25 bp, Mus musculus
tacgtgcttgtctactacaacctgg

SEQ ID NO: 746196 - DNA, 25 bp, Mus musculus
tacgtgctttgtaagggatgggaaa

SEQ ID NO: 746197 - DNA, 25 bp, Mus musculus
tacgtgctttgttagggatgggaaa

SEQ ID NO: 746198 - DNA, 25 bp, Mus musculus
tacgtggacattctgcagggccgtc

SEQ ID NO: 746199 - DNA, 25 bp, Mus musculus
tacgtggacattgtgcagggccgtc

SEQ ID NO: 746200 - DNA, 25 bp, Mus musculus
tacgtggagattacagggactgccg

SEQ ID NO: 746201 - DNA, 25 bp, Mus musculus
tacgtggagatttcagggactgccg

SEQ ID NO: 746202 - DNA, 25 bp, Mus musculus
tacgtggatcaaccatgtgaggcca

SEQ ID NO: 746203 - DNA, 25 bp, Mus musculus
tacgtggatcaagcatgtgaggcca

SEQ ID NO: 746204 - DNA, 25 bp, Mus musculus
tacgtggatgtgctttttgccaacc

SEQ ID NO: 746205 - DNA, 25 bp, Mus musculus
tacgtggatgtggtttttgccaacc

SEQ ID NO: 746206 - DNA, 25 bp, Mus musculus
tacgtggcagcaagatccgatttct

SEQ ID NO: 746207 - DNA, 25 bp, Mus musculus
tacgtggcagcatgatccgatttct

SEQ ID NO: 746208 - DNA, 25 bp, Mus musculus
tacgtggccctccatgtgatttgcg

SEQ ID NO: 746209 - DNA, 25 bp, Mus musculus
tacgtggccctcgatgtgatttgcg

SEQ ID NO: 746210 - DNA, 25 bp, Mus musculus
tacgtggccgggatcgcctggtttc

SEQ ID NO: 746211 - DNA, 25 bp, Mus musculus
tacgtggccgggttcgcctggtttc

SEQ ID NO: 746212 - DNA, 25 bp, Mus musculus
tacgtggcctttcgagggtcctgcc

SEQ ID NO: 746213 - DNA, 25 bp, Mus musculus
tacgtggcctttggagggtcctgcc

SEQ ID NO: 746214 - DNA, 25 bp, Mus musculus
tacgtggctcaccagcgtctcagct

SEQ ID NO: 746215 - DNA, 25 bp, Mus musculus
tacgtggctcacgagcgtctcagct

SEQ ID NO: 746216 - DNA, 25 bp, Mus musculus
tacgtggctgtaagttaattgaatt

SEQ ID NO: 746217 - DNA, 25 bp, Mus musculus
tacgtggctgtatgttaattgaatt

SEQ ID NO: 746218 - DNA, 25 bp, Mus musculus
tacgtggtccttcgatgtcttttcc

SEQ ID NO: 746219 - DNA, 25 bp, Mus musculus
tacgtggtccttggatgtcttttcc

SEQ ID NO: 746220 - DNA, 25 bp, Mus musculus
tacgtggtgaccaagacaagagcga

SEQ ID NO: 746221 - DNA, 25 bp, Mus musculus
tacgtggtgacctagacaagagcga

SEQ ID NO: 746222 - DNA, 25 bp, Mus musculus
tacgtggttcttagctgccgggaga

SEQ ID NO: 746223 - DNA, 25 bp, Mus musculus
tacgtggttctttgctgccgggaga

SEQ ID NO: 746224 - DNA, 25 bp, Mus musculus
tacgtgtatgcacgcatcctggcca

SEQ ID NO: 746225 - DNA, 25 bp, Mus musculus
tacgtgtatgcaggcatcctggcca

SEQ ID NO: 746226 - DNA, 25 bp, Mus musculus
tacgtgtcagaactgatcctggtac

SEQ ID NO: 746227 - DNA, 25 bp, Mus musculus
tacgtgtcagaagtgatcctggtac

SEQ ID NO: 746228 - DNA, 25 bp, Mus musculus
tacgtgtccgccagaacctggtgcg

SEQ ID NO: 746229 - DNA, 25 bp, Mus musculus
tacgtgtccgcctgaacctggtgcg

SEQ ID NO: 746230 - DNA, 25 bp, Mus musculus
tacgtgtgaggacatttttatgcac

SEQ ID NO: 746231 - DNA, 25 bp, Mus musculus
tacgtgtgaggagatttttatgcac

SEQ ID NO: 746232 - DNA, 25 bp, Mus musculus
tacgtgtgcgcacagctgcaagccc

SEQ ID NO: 746233 - DNA, 25 bp, Mus musculus
tacgtgtgcgcagagctgcaagccc

SEQ ID NO: 746234 - DNA, 25 bp, Mus musculus
tacgtgtgctggaggtagccaagaa

SEQ ID NO: 746235 - DNA, 25 bp, Mus musculus
tacgtgtgctggtggtagccaagaa

SEQ ID NO: 746236 - DNA, 25 bp, Mus musculus
tacgttaaactcacttcagccaaac

SEQ ID NO: 746237 - DNA, 25 bp, Mus musculus
tacgttaaactctcttcagccaaac

SEQ ID NO: 746238 - DNA, 25 bp, Mus musculus
tacgttaacacgaacggaaggatca

SEQ ID NO: 746239 - DNA, 25 bp, Mus musculus
tacgttaacacgtacggaaggatca

SEQ ID NO: 746240 - DNA, 25 bp, Mus musculus
tacgttaataatacaagccacagac

SEQ ID NO: 746241 - DNA, 25 bp, Mus musculus
tacgttaataattcaagccacagac

SEQ ID NO: 746242 - DNA, 25 bp, Mus musculus
tacgttcaggaaccatggacctact

SEQ ID NO: 746243 - DNA, 25 bp, Mus musculus
tacgttcaggaagcatggacctact

SEQ ID NO: 746244 - DNA, 25 bp, Mus musculus
tacgttcataggcacaccctactgg

SEQ ID NO: 746245 - DNA, 25 bp, Mus musculus
tacgttcatagggacaccctactgg

SEQ ID NO: 746246 - DNA, 25 bp, Mus musculus
tacgttccctgcaacttcatccatg

SEQ ID NO: 746247 - DNA, 25 bp, Mus musculus
tacgttccctgctacttcatccatg

SEQ ID NO: 746248 - DNA, 25 bp, Mus musculus
tacgttcgaggcaaaaacagaaggt

SEQ ID NO: 746249 - DNA, 25 bp, Mus musculus
tacgttcgaggctaaaacagaaggt

SEQ ID NO: 746250 - DNA, 25 bp, Mus musculus
tacgttctaatgctcactgctgttg

SEQ ID NO: 746251 - DNA, 25 bp, Mus musculus
tacgttctaatggtcactgctgttg

SEQ ID NO: 746252 - DNA, 25 bp, Mus musculus
tacgttctgatgatcctgaccagca

SEQ ID NO: 746253 - DNA, 25 bp, Mus musculus
tacgttctgatgttcctgaccagca

SEQ ID NO: 746254 - DNA, 25 bp, Mus musculus
tacgttctgtccattgagacttcca

SEQ ID NO: 746255 - DNA, 25 bp, Mus musculus
tacgttctgtcctttgagacttcca

SEQ ID NO: 746256 - DNA, 25 bp, Mus musculus
tacgttgactataagactgtgctgc

SEQ ID NO: 746257 - DNA, 25 bp, Mus musculus
tacgttgactattagactgtgctgc

SEQ ID NO: 746258 - DNA, 25 bp, Mus musculus
tacgttgcatttctcccgctgtgtt

SEQ ID NO: 746259 - DNA, 25 bp, Mus musculus
tacgttgcatttgtcccgctgtgtt

SEQ ID NO: 746260 - DNA, 25 bp, Mus musculus
tacgtttacaacctggaccagaggg

SEQ ID NO: 746261 - DNA, 25 bp, Mus musculus
tacgtttacaacgtggaccagaggg

SEQ ID NO: 746262 - DNA, 25 bp, Mus musculus
tacgtttgtagcaaaaccagttggc

SEQ ID NO: 746263 - DNA, 25 bp, Mus musculus
tacgtttgtagctaaaccagttggc

SEQ ID NO: 746264 - DNA, 25 bp, Mus musculus
tacgttttgggccatgaggcaatga

SEQ ID NO: 746265 - DNA, 25 bp, Mus musculus
tacgttttgggcgatgaggcaatga

SEQ ID NO: 746266 - DNA, 25 bp, Mus musculus
tacgttttttacctccaccagcagg

SEQ ID NO: 746267 - DNA, 25 bp, Mus musculus
tacgttttttacgtccaccagcagg

SEQ ID NO: 746268 - DNA, 25 bp, Mus musculus
tactaaaaaagcactgaagacccag

SEQ ID NO: 746269 - DNA, 25 bp, Mus musculus
tactaaaaaagctctgaagacccag

SEQ ID NO: 746270 - DNA, 25 bp, Mus musculus
tactaaaaatgtagtatggctcaca

SEQ ID NO: 746271 - DNA, 25 bp, Mus musculus
tactaaaaatgttgtatggctcaca

SEQ ID NO: 746272 - DNA, 25 bp, Mus musculus
tactaaaagctgcaagtgtatgtgc

SEQ ID NO: 746273 - DNA, 25 bp, Mus musculus
tactaaaagctggaagtgtatgtgc

SEQ ID NO: 746274 - DNA, 25 bp, Mus musculus
tactaaacccatcatcccaagtgag

SEQ ID NO: 746275 - DNA, 25 bp, Mus musculus
tactaaacccatgatcccaagtgag

SEQ ID NO: 746276 - DNA, 25 bp, Mus musculus
tactaaactgaaaagtaaggcgcct

SEQ ID NO: 746277 - DNA, 25 bp, Mus musculus
tactaaactgaatagtaaggcgcct

SEQ ID NO: 746278 - DNA, 25 bp, Mus musculus
tactaaagatcacaggaagagacca

SEQ ID NO: 746279 - DNA, 25 bp, Mus musculus
tactaaagatcagaggaagagacca

SEQ ID NO: 746280 - DNA, 25 bp, Mus musculus
tactaaatacaactaatcactcagg

SEQ ID NO: 746281 - DNA, 25 bp, Mus musculus
tactaaatacaagtaatcactcagg

SEQ ID NO: 746282 - DNA, 25 bp, Mus musculus
tactaaatatgcatatactcctgga

SEQ ID NO: 746283 - DNA, 25 bp, Mus musculus
tactaaatatgcttatactcctgga

SEQ ID NO: 746284 - DNA, 25 bp, Mus musculus
tactaaatgtggcagtgtgatgctc

SEQ ID NO: 746285 - DNA, 25 bp, Mus musculus
tactaaatgtgggagtgtgatgctc

SEQ ID NO: 746286 - DNA, 25 bp, Mus musculus
tactaacaagaacccagttacagag

SEQ ID NO: 746287 - DNA, 25 bp, Mus musculus
tactaacaagaagccagttacagag

SEQ ID NO: 746288 - DNA, 25 bp, Mus musculus
tactaacagacgactttaaaggtgt

SEQ ID NO: 746289 - DNA, 25 bp, Mus musculus
tactaacagacgtctttaaaggtgt

SEQ ID NO: 746290 - DNA, 25 bp, Mus musculus
tactaaccaagcaaccccaaggatt

SEQ ID NO: 746291 - DNA, 25 bp, Mus musculus
tactaaccaagctaccccaaggatt

SEQ ID NO: 746292 - DNA, 25 bp, Mus musculus
tactaacggatcacaaagagcagcg

SEQ ID NO: 746293 - DNA, 25 bp, Mus musculus
tactaacggatctcaaagagcagcg

SEQ ID NO: 746294 - DNA, 25 bp, Mus musculus
tactaactattcaggacttactgtt

SEQ ID NO: 746295 - DNA, 25 bp, Mus musculus
tactaactattctggacttactgtt

SEQ ID NO: 746296 - DNA, 25 bp, Mus musculus
tactaactggtgaaaaagagcaagt

SEQ ID NO: 746297 - DNA, 25 bp, Mus musculus
tactaactggtgtaaaagagcaagt

SEQ ID NO: 746298 - DNA, 25 bp, Mus musculus
tactaactttttctgacattctggc

SEQ ID NO: 746299 - DNA, 25 bp, Mus musculus
tactaactttttgtgacattctggc

SEQ ID NO: 746300 - DNA, 25 bp, Mus musculus
tactaagagaatctcctagcaagga

SEQ ID NO: 746301 - DNA, 25 bp, Mus musculus
tactaagagaatgtcctagcaagga

SEQ ID NO: 746302 - DNA, 25 bp, Mus musculus
tactaagagagtagaactgtctgtg

SEQ ID NO: 746303 - DNA, 25 bp, Mus musculus
tactaagagagttgaactgtctgtg

SEQ ID NO: 746304 - DNA, 25 bp, Mus musculus
tactaagcatcgactttcagctact

SEQ ID NO: 746305 - DNA, 25 bp, Mus musculus
tactaagcatcgatgaggatggcct

SEQ ID NO: 746306 - DNA, 25 bp, Mus musculus
tactaagcatcgtctttcagctact

SEQ ID NO: 746307 - DNA, 25 bp, Mus musculus
tactaagcatcgttgaggatggcct

SEQ ID NO: 746308 - DNA, 25 bp, Mus musculus
tactaagctgttaccccaatgcctt

SEQ ID NO: 746309 - DNA, 25 bp, Mus musculus
tactaagctgtttccccaatgcctt

SEQ ID NO: 746310 - DNA, 25 bp, Mus musculus
tactaaggctcgaacatctgcttca

SEQ ID NO: 746311 - DNA, 25 bp, Mus musculus
tactaaggctcgtacatctgcttca

SEQ ID NO: 746312 - DNA, 25 bp, Mus musculus
tactaaggtcttcggtgtacagctc

SEQ ID NO: 746313 - DNA, 25 bp, Mus musculus
tactaaggtcttgggtgtacagctc

SEQ ID NO: 746314 - DNA, 25 bp, Mus musculus
tactaagtgtgcagtgctgtgctca

SEQ ID NO: 746315 - DNA, 25 bp, Mus musculus
tactaagtgtgctgtgctgtgctca

SEQ ID NO: 746316 - DNA, 25 bp, Mus musculus
tactaagttctcaagcacccaccag

SEQ ID NO: 746317 - DNA, 25 bp, Mus musculus
tactaagttctctagcacccaccag

SEQ ID NO: 746318 - DNA, 25 bp, Mus musculus
tactaatgcacactcaaggaagaag

SEQ ID NO: 746319 - DNA, 25 bp, Mus musculus
tactaatgcacagtcaaggaagaag

SEQ ID NO: 746320 - DNA, 25 bp, Mus musculus
tactaatgcatcagcatttgaccag

SEQ ID NO: 746321 - DNA, 25 bp, Mus musculus
tactaatgcatctgcatttgaccag

SEQ ID NO: 746322 - DNA, 25 bp, Mus musculus
tactaatgtggtcattggaggtccc

SEQ ID NO: 746323 - DNA, 25 bp, Mus musculus
tactaatgtggtgattggaggtccc

SEQ ID NO: 746324 - DNA, 25 bp, Mus musculus
tactaatgttgaatgagatgtccct

SEQ ID NO: 746325 - DNA, 25 bp, Mus musculus
tactaatgttgattgagatgtccct

SEQ ID NO: 746326 - DNA, 25 bp, Mus musculus
tactaatgttgcaagaacctgtggc

SEQ ID NO: 746327 - DNA, 25 bp, Mus musculus
tactaatgttgctagaacctgtggc

SEQ ID NO: 746328 - DNA, 25 bp, Mus musculus
tactaattctttctggtgtttgtgc

SEQ ID NO: 746329 - DNA, 25 bp, Mus musculus
tactaattctttgtggtgtttgtgc

SEQ ID NO: 746330 - DNA, 25 bp, Mus musculus
tactacaaatgtagggagcctctcc

SEQ ID NO: 746331 - DNA, 25 bp, Mus musculus
tactacaaatgttgggagcctctcc

SEQ ID NO: 746332 - DNA, 25 bp, Mus musculus
tactacaacacgcttctcctgtggg

SEQ ID NO: 746333 - DNA, 25 bp, Mus musculus
tactacaacacggttctcctgtggg

SEQ ID NO: 746334 - DNA, 25 bp, Mus musculus
tactacaactgaagagctagctcct

SEQ ID NO: 746335 - DNA, 25 bp, Mus musculus
tactacaactgatgagctagctcct

SEQ ID NO: 746336 - DNA, 25 bp, Mus musculus
tactacaagcacactcgaaggaagg

SEQ ID NO: 746337 - DNA, 25 bp, Mus musculus
tactacaagcactctcgaaggaagg

SEQ ID NO: 746338 - DNA, 25 bp, Mus musculus
tactacaaggaacccacgacctggt

SEQ ID NO: 746339 - DNA, 25 bp, Mus musculus
tactacaaggaagccacgacctggt

SEQ ID NO: 746340 - DNA, 25 bp, Mus musculus
tactacaagtttagacagagaagtt

SEQ ID NO: 746341 - DNA, 25 bp, Mus musculus
tactacaagttttgacagagaagtt

SEQ ID NO: 746342 - DNA, 25 bp, Mus musculus
tactacaatgcccagaacaccagtg

SEQ ID NO: 746343 - DNA, 25 bp, Mus musculus
tactacaatgccgagaacaccagtg

SEQ ID NO: 746344 - DNA, 25 bp, Mus musculus
tactacaccaaacccctgcgtggag

SEQ ID NO: 746345 - DNA, 25 bp, Mus musculus
tactacaccaaagccctgcgtggag

SEQ ID NO: 746346 - DNA, 25 bp, Mus musculus
tactacaccactagggtgattctct

SEQ ID NO: 746347 - DNA, 25 bp, Mus musculus
tactacaccacttgggtgattctct

SEQ ID NO: 746348 - DNA, 25 bp, Mus musculus
tactacacggagctcctggaccttt

SEQ ID NO: 746349 - DNA, 25 bp, Mus musculus
tactacacggaggtcctggaccttt

SEQ ID NO: 746350 - DNA, 25 bp, Mus musculus
tactacactcctaggcaggtgacac

SEQ ID NO: 746351 - DNA, 25 bp, Mus musculus
tactacactccttggcaggtgacac

SEQ ID NO: 746352 - DNA, 25 bp, Mus musculus
tactacactctacacaactacaaag

SEQ ID NO: 746353 - DNA, 25 bp, Mus musculus
tactacactctagacaactacaaag

SEQ ID NO: 746354 - DNA, 25 bp, Mus musculus
tactacactgctagggaagggtgct

SEQ ID NO: 746355 - DNA, 25 bp, Mus musculus
tactacactgcttgggaagggtgct

SEQ ID NO: 746356 - DNA, 25 bp, Mus musculus
tactacactggtcccaatgacaagg

SEQ ID NO: 746357 - DNA, 25 bp, Mus musculus
tactacactggtgccaatgacaagg

SEQ ID NO: 746358 - DNA, 25 bp, Mus musculus
tactacactgtgattgacagagaca

SEQ ID NO: 746359 - DNA, 25 bp, Mus musculus
tactacactgtgtttgacagagaca

SEQ ID NO: 746360 - DNA, 25 bp, Mus musculus
tactacagcaccagcgaggatgagg

SEQ ID NO: 746361 - DNA, 25 bp, Mus musculus
tactacagcacctgcgaggatgagg

SEQ ID NO: 746362 - DNA, 25 bp, Mus musculus
tactacagcgacatcatttctgcct

SEQ ID NO: 746363 - DNA, 25 bp, Mus musculus
tactacagcgacttcatttctgcct

SEQ ID NO: 746364 - DNA, 25 bp, Mus musculus
tactacagctcgacccaaactaggt

SEQ ID NO: 746365 - DNA, 25 bp, Mus musculus
tactacagctcgtcccaaactaggt

SEQ ID NO: 746366 - DNA, 25 bp, Mus musculus
tactacagcttccactctggccctg

SEQ ID NO: 746367 - DNA, 25 bp, Mus musculus
tactacagcttcgactctggccctg

SEQ ID NO: 746368 - DNA, 25 bp, Mus musculus
tactacagggccaactgtggtctgc

SEQ ID NO: 746369 - DNA, 25 bp, Mus musculus
tactacagggcctactgtggtctgc

SEQ ID NO: 746370 - DNA, 25 bp, Mus musculus
tactacagtccacataaagtccagg

SEQ ID NO: 746371 - DNA, 25 bp, Mus musculus
tactacagtccagataaagtccagg

SEQ ID NO: 746372 - DNA, 25 bp, Mus musculus
tactacataggtattgagggaaatg

SEQ ID NO: 746373 - DNA, 25 bp, Mus musculus
tactacataggttttgagggaaatg

SEQ ID NO: 746374 - DNA, 25 bp, Mus musculus
tactacatcggacgggaggtctttg

SEQ ID NO: 746375 - DNA, 25 bp, Mus musculus
tactacatcggaggggaggtctttg

SEQ ID NO: 746376 - DNA, 25 bp, Mus musculus
tactacatgaaaagactatagttgg

SEQ ID NO: 746377 - DNA, 25 bp, Mus musculus
tactacatgaaatgactatagttgg

SEQ ID NO: 746378 - DNA, 25 bp, Mus musculus
tactacatgtcacccgagagaatcc

SEQ ID NO: 746379 - DNA, 25 bp, Mus musculus
tactacatgtcagccgagagaatcc

SEQ ID NO: 746380 - DNA, 25 bp, Mus musculus
tactacattggaaaggctgataagc

SEQ ID NO: 746381 - DNA, 25 bp, Mus musculus
tactacattggataggctgataagc

SEQ ID NO: 746382 - DNA, 25 bp, Mus musculus
tactaccaccgactttgatggctcc

SEQ ID NO: 746383 - DNA, 25 bp, Mus musculus
tactaccaccgagtttgatggctcc

SEQ ID NO: 746384 - DNA, 25 bp, Mus musculus
tactaccactatatatttacgactc

SEQ ID NO: 746385 - DNA, 25 bp, Mus musculus
tactaccactatttatttacgactc

SEQ ID NO: 746386 - DNA, 25 bp, Mus musculus
tactaccagggaaagactaacctct

SEQ ID NO: 746387 - DNA, 25 bp, Mus musculus
tactaccagggactgcgctttggag

SEQ ID NO: 746388 - DNA, 25 bp, Mus musculus
tactaccagggagtgcgctttggag

SEQ ID NO: 746389 - DNA, 25 bp, Mus musculus
tactaccagggatagactaacctct

SEQ ID NO: 746390 - DNA, 25 bp, Mus musculus
tactaccatgccaatgcggttttgg

SEQ ID NO: 746391 - DNA, 25 bp, Mus musculus
tactaccatgcctatgcggttttgg

SEQ ID NO: 746392 - DNA, 25 bp, Mus musculus
tactaccatggcagcctgaccaagc

SEQ ID NO: 746393 - DNA, 25 bp, Mus musculus
tactaccatggctgcctgaccaagc

SEQ ID NO: 746394 - DNA, 25 bp, Mus musculus
tactaccccaacaggaaggattctc

SEQ ID NO: 746395 - DNA, 25 bp, Mus musculus
tactaccccaactggaaggattctc

SEQ ID NO: 746396 - DNA, 25 bp, Mus musculus
tactacccctctcttgggctgtaga

SEQ ID NO: 746397 - DNA, 25 bp, Mus musculus
tactacccctctgttgggctgtaga

SEQ ID NO: 746398 - DNA, 25 bp, Mus musculus
tactacccggtgcaagttctgctga

SEQ ID NO: 746399 - DNA, 25 bp, Mus musculus
tactacccggtggaagttctgctga

SEQ ID NO: 746400 - DNA, 25 bp, Mus musculus
tactaccgcaacacaggcagcgtga

SEQ ID NO: 746401 - DNA, 25 bp, Mus musculus
tactaccgcaactcaggcagcgtga

SEQ ID NO: 746402 - DNA, 25 bp, Mus musculus
tactaccgtgttctgttcgaggctc

SEQ ID NO: 746403 - DNA, 25 bp, Mus musculus
tactaccgtgttgtgttcgaggctc

SEQ ID NO: 746404 - DNA, 25 bp, Mus musculus
tactaccgttacatggccgaggttg

SEQ ID NO: 746405 - DNA, 25 bp, Mus musculus
tactaccgttacttggccgaggttg

SEQ ID NO: 746406 - DNA, 25 bp, Mus musculus
tactacctacaaaccatggacgccg

SEQ ID NO: 746407 - DNA, 25 bp, Mus musculus
tactacctacaatccatggacgccg

SEQ ID NO: 746408 - DNA, 25 bp, Mus musculus
tactacctgagaaatccctgggccg

SEQ ID NO: 746409 - DNA, 25 bp, Mus musculus
tactacctgagatatccctgggccg

SEQ ID NO: 746410 - DNA, 25 bp, Mus musculus
tactacctgtcgctgaaggccctct

SEQ ID NO: 746411 - DNA, 25 bp, Mus musculus
tactacctgtcggtgaaggccctct

SEQ ID NO: 746412 - DNA, 25 bp, Mus musculus
tactacgacactaacgaaagcatgg

SEQ ID NO: 746413 - DNA, 25 bp, Mus musculus
tactacgacacttacgaaagcatgg

SEQ ID NO: 746414 - DNA, 25 bp, Mus musculus
tactacgacatccaccaagagattg

SEQ ID NO: 746415 - DNA, 25 bp, Mus musculus
tactacgacatcgaccaagagattg

SEQ ID NO: 746416 - DNA, 25 bp, Mus musculus
tactacgacggacagctgcaggcct

SEQ ID NO: 746417 - DNA, 25 bp, Mus musculus
tactacgacggagagctgcaggcct

SEQ ID NO: 746418 - DNA, 25 bp, Mus musculus
tactacgagctgaaccagcgagttg

SEQ ID NO: 746419 - DNA, 25 bp, Mus musculus
tactacgagctgtaccagcgagttg

SEQ ID NO: 746420 - DNA, 25 bp, Mus musculus
tactacgaggagcaggcccgtctga

SEQ ID NO: 746421 - DNA, 25 bp, Mus musculus
tactacgaggaggaggcccgtctga

SEQ ID NO: 746422 - DNA, 25 bp, Mus musculus
tactacgatgatcaagggtggacct

SEQ ID NO: 746423 - DNA, 25 bp, Mus musculus
tactacgatgatgaagggtggacct

SEQ ID NO: 746424 - DNA, 25 bp, Mus musculus
tactacgatggcaacctgctggagt

SEQ ID NO: 746425 - DNA, 25 bp, Mus musculus
tactacgatggctacctgctggagt

SEQ ID NO: 746426 - DNA, 25 bp, Mus musculus
tactacgcatatctaacggagcgcc

SEQ ID NO: 746427 - DNA, 25 bp, Mus musculus
tactacgcatatgtaacggagcgcc

SEQ ID NO: 746428 - DNA, 25 bp, Mus musculus
tactacgggctgctcatggacctgc

SEQ ID NO: 746429 - DNA, 25 bp, Mus musculus
tactacgggctggtcatggacctgc

SEQ ID NO: 746430 - DNA, 25 bp, Mus musculus
tactacgtggctcctgtgtacgagc

SEQ ID NO: 746431 - DNA, 25 bp, Mus musculus
tactacgtggctgctgtgtacgagc

SEQ ID NO: 746432 - DNA, 25 bp, Mus musculus
tactactaatgcagtgatcgccggc

SEQ ID NO: 746433 - DNA, 25 bp, Mus musculus
tactactaatgctgtgatcgccggc

SEQ ID NO: 746434 - DNA, 25 bp, Mus musculus
tactactacaatcctgatgataagc

SEQ ID NO: 746435 - DNA, 25 bp, Mus musculus
tactactacaatgctgatgataagc

SEQ ID NO: 746436 - DNA, 25 bp, Mus musculus
tactactacagcaccagcgaggatg

SEQ ID NO: 746437 - DNA, 25 bp, Mus musculus
tactactacagctccagcgaggatg

SEQ ID NO: 746438 - DNA, 25 bp, Mus musculus
tactactagtcgctgggcctgcagg

SEQ ID NO: 746439 - DNA, 25 bp, Mus musculus
tactactagtcggtgggcctgcagg

SEQ ID NO: 746440 - DNA, 25 bp, Mus musculus
tactactatcgcaatcccacgggag

SEQ ID NO: 746441 - DNA, 25 bp, Mus musculus
tactactatcgctatcccacgggag

SEQ ID NO: 746442 - DNA, 25 bp, Mus musculus
tactactcactactggaagtcctga

SEQ ID NO: 746443 - DNA, 25 bp, Mus musculus
tactactcactagtggaagtcctga

SEQ ID NO: 746444 - DNA, 25 bp, Mus musculus
tactactccctgaaggagtccacca

SEQ ID NO: 746445 - DNA, 25 bp, Mus musculus
tactactccctgtaggagtccacca

SEQ ID NO: 746446 - DNA, 25 bp, Mus musculus
tactactcttgacagcgcgctcaga

SEQ ID NO: 746447 - DNA, 25 bp, Mus musculus
tactactcttgagagcgcgctcaga

SEQ ID NO: 746448 - DNA, 25 bp, Mus musculus
tactactgcaagatgcccggctgtc

SEQ ID NO: 746449 - DNA, 25 bp, Mus musculus
tactactgcaagttgcccggctgtc

SEQ ID NO: 746450 - DNA, 25 bp, Mus musculus
tactactgcagtacctatggccctg

SEQ ID NO: 746451 - DNA, 25 bp, Mus musculus
tactactgcagtcaaccaaccttgg

SEQ ID NO: 746452 - DNA, 25 bp, Mus musculus
tactactgcagtgaaccaaccttgg

SEQ ID NO: 746453 - DNA, 25 bp, Mus musculus
tactactgcagttcctatggccctg

SEQ ID NO: 746454 - DNA, 25 bp, Mus musculus
tactactggtttcgttgtcccaagg

SEQ ID NO: 746455 - DNA, 25 bp, Mus musculus
tactactggtttggttgtcccaagg

SEQ ID NO: 746456 - DNA, 25 bp, Mus musculus
tactacttagctatagatgtgatag

SEQ ID NO: 746457 - DNA, 25 bp, Mus musculus
tactacttagctttagatgtgatag

SEQ ID NO: 746458 - DNA, 25 bp, Mus musculus
tactacttcattccaactttcatcg

SEQ ID NO: 746459 - DNA, 25 bp, Mus musculus
tactacttcattgcaactttcatcg

SEQ ID NO: 746460 - DNA, 25 bp, Mus musculus
tactacttggaacgagtctccaatg

SEQ ID NO: 746461 - DNA, 25 bp, Mus musculus
tactacttggaaggagtctccaatg

SEQ ID NO: 746462 - DNA, 25 bp, Mus musculus
tactactttaagattgccgtggccc

SEQ ID NO: 746463 - DNA, 25 bp, Mus musculus
tactactttaagtttgccgtggccc

SEQ ID NO: 746464 - DNA, 25 bp, Mus musculus
tactactttgacacctatgcccact

SEQ ID NO: 746465 - DNA, 25 bp, Mus musculus
tactactttgactcctatgcccact

SEQ ID NO: 746466 - DNA, 25 bp, Mus musculus
tactactttgggattggcttgccct

SEQ ID NO: 746467 - DNA, 25 bp, Mus musculus
tactactttgggtttggcttgccct

SEQ ID NO: 746468 - DNA, 25 bp, Mus musculus
tactagacatggactgttacactgc

SEQ ID NO: 746469 - DNA, 25 bp, Mus musculus
tactagacatggtctgttacactgc

SEQ ID NO: 746470 - DNA, 25 bp, Mus musculus
tactagactaacaacactcttgccc

SEQ ID NO: 746471 - DNA, 25 bp, Mus musculus
tactagactaactacactcttgccc

SEQ ID NO: 746472 - DNA, 25 bp, Mus musculus
tactagagaaacaatctatcgttct

SEQ ID NO: 746473 - DNA, 25 bp, Mus musculus
tactagagaaactatctatcgttct

SEQ ID NO: 746474 - DNA, 25 bp, Mus musculus
tactagagctaaaaatgaccttgga

SEQ ID NO: 746475 - DNA, 25 bp, Mus musculus
tactagagctaataatgaccttgga

SEQ ID NO: 746476 - DNA, 25 bp, Mus musculus
tactagagctagagcagcagcatgt

SEQ ID NO: 746477 - DNA, 25 bp, Mus musculus
tactagagctagtgcagcagcatgt

SEQ ID NO: 746478 - DNA, 25 bp, Mus musculus
tactagagttgtaactgaaaattgc

SEQ ID NO: 746479 - DNA, 25 bp, Mus musculus
tactagagttgttactgaaaattgc

SEQ ID NO: 746480 - DNA, 25 bp, Mus musculus
tactagatacacaggaacaagagat

SEQ ID NO: 746481 - DNA, 25 bp, Mus musculus
tactagatacactggaacaagagat

SEQ ID NO: 746482 - DNA, 25 bp, Mus musculus
tactagcaaacaacatggcaagcag

SEQ ID NO: 746483 - DNA, 25 bp, Mus musculus
tactagcaaacatcatggcaagcag

SEQ ID NO: 746484 - DNA, 25 bp, Mus musculus
tactagccaagtcttctattactga

SEQ ID NO: 746485 - DNA, 25 bp, Mus musculus
tactagccaagtgttctattactga

SEQ ID NO: 746486 - DNA, 25 bp, Mus musculus
tactagcctactacctcgacaagag

SEQ ID NO: 746487 - DNA, 25 bp, Mus musculus
tactagcctacttcctcgacaagag

SEQ ID NO: 746488 - DNA, 25 bp, Mus musculus
tactagcgaagtcctttaaacctgc

SEQ ID NO: 746489 - DNA, 25 bp, Mus musculus
tactagcgaagtgctttaaacctgc

SEQ ID NO: 746490 - DNA, 25 bp, Mus musculus
tactaggatgcaagtactctgctgg

SEQ ID NO: 746491 - DNA, 25 bp, Mus musculus
tactaggatgcatgtactctgctgg

SEQ ID NO: 746492 - DNA, 25 bp, Mus musculus
tactaggcatctcggtatctaccac

SEQ ID NO: 746493 - DNA, 25 bp, Mus musculus
tactaggcatctgggtatctaccac

SEQ ID NO: 746494 - DNA, 25 bp, Mus musculus
tactaggccctgagagtggaaccct

SEQ ID NO: 746495 - DNA, 25 bp, Mus musculus
tactaggccctgtgagtggaaccct

SEQ ID NO: 746496 - DNA, 25 bp, Mus musculus
tactagggccttcgcctacacactg

SEQ ID NO: 746497 - DNA, 25 bp, Mus musculus
tactagggccttggcctacacactg

SEQ ID NO: 746498 - DNA, 25 bp, Mus musculus
tactaggtcaagactctcttagacc

SEQ ID NO: 746499 - DNA, 25 bp, Mus musculus
tactaggtcaagtctctcttagacc

SEQ ID NO: 746500 - DNA, 25 bp, Mus musculus
tactaggtcttacgcagacacaaag

SEQ ID NO: 746501 - DNA, 25 bp, Mus musculus
tactaggtcttaggcagacacaaag

SEQ ID NO: 746502 - DNA, 25 bp, Mus musculus
tactagtcagtgcttcgcaagatgg

SEQ ID NO: 746503 - DNA, 25 bp, Mus musculus
tactagtcagtggttcgcaagatgg

SEQ ID NO: 746504 - DNA, 25 bp, Mus musculus
tactagtggtatcatggaggactcc

SEQ ID NO: 746505 - DNA, 25 bp, Mus musculus
tactagtggtatgatggaggactcc

SEQ ID NO: 746506 - DNA, 25 bp, Mus musculus
tactagtgttaaccatgatgcgaag

SEQ ID NO: 746507 - DNA, 25 bp, Mus musculus
tactagtgttaagcatgatgcgaag

SEQ ID NO: 746508 - DNA, 25 bp, Mus musculus
tactagttggctatggctttacagg

SEQ ID NO: 746509 - DNA, 25 bp, Mus musculus
tactagttggctttggctttacagg

SEQ ID NO: 746510 - DNA, 25 bp, Mus musculus
tactataaagaactggagagcagac

SEQ ID NO: 746511 - DNA, 25 bp, Mus musculus
tactataaagaagtggagagcagac

SEQ ID NO: 746512 - DNA, 25 bp, Mus musculus
tactataactatatgcaaacatctg

SEQ ID NO: 746513 - DNA, 25 bp, Mus musculus
tactataactatttgcaaacatctg

SEQ ID NO: 746514 - DNA, 25 bp, Mus musculus
tactataagtccctcctggagtctc

SEQ ID NO: 746515 - DNA, 25 bp, Mus musculus
tactataagtccgtcctggagtctc

SEQ ID NO: 746516 - DNA, 25 bp, Mus musculus
tactatacactgaccaaggtagccg

SEQ ID NO: 746517 - DNA, 25 bp, Mus musculus
tactatacactgtccaaggtagccg

SEQ ID NO: 746518 - DNA, 25 bp, Mus musculus
tactatagaaacagctacaacagca

SEQ ID NO: 746519 - DNA, 25 bp, Mus musculus
tactatagaaactgctacaacagca

SEQ ID NO: 746520 - DNA, 25 bp, Mus musculus
tactataggaatcaccccaacaccg

SEQ ID NO: 746521 - DNA, 25 bp, Mus musculus
tactataggaatgaccccaacaccg

SEQ ID NO: 746522 - DNA, 25 bp, Mus musculus
tactatatctaactttcttcaagag

SEQ ID NO: 746523 - DNA, 25 bp, Mus musculus
tactatatctaagtttcttcaagag

SEQ ID NO: 746524 - DNA, 25 bp, Mus musculus
tactatatcttgctatgcctttgga

SEQ ID NO: 746525 - DNA, 25 bp, Mus musculus
tactatatcttggtatgcctttgga

SEQ ID NO: 746526 - DNA, 25 bp, Mus musculus
tactatatgcttcaggagcaagtca

SEQ ID NO: 746527 - DNA, 25 bp, Mus musculus
tactatatgcttgaggagcaagtca

SEQ ID NO: 746528 - DNA, 25 bp, Mus musculus
tactatcaagagcagacttgaaaac

SEQ ID NO: 746529 - DNA, 25 bp, Mus musculus
tactatcaagaggagacttgaaaac

SEQ ID NO: 746530 - DNA, 25 bp, Mus musculus
tactatcagaagctgagcatcgatg

SEQ ID NO: 746531 - DNA, 25 bp, Mus musculus
tactatcagaaggtgagcatcgatg

SEQ ID NO: 746532 - DNA, 25 bp, Mus musculus
tactatccgggtattcttgccgaat

SEQ ID NO: 746533 - DNA, 25 bp, Mus musculus
tactatccgggttttcttgccgaat

SEQ ID NO: 746534 - DNA, 25 bp, Mus musculus
tactatcctactattgcacataagg

SEQ ID NO: 746535 - DNA, 25 bp, Mus musculus
tactatcctacttttgcacataagg

SEQ ID NO: 746536 - DNA, 25 bp, Mus musculus
tactatcctaggagatgtgtgggcc

SEQ ID NO: 746537 - DNA, 25 bp, Mus musculus
tactatcctaggtgatgtgtgggcc

SEQ ID NO: 746538 - DNA, 25 bp, Mus musculus
tactatcgcggacctatgggtttcc

SEQ ID NO: 746539 - DNA, 25 bp, Mus musculus
tactatcgcggagctatgggtttcc

SEQ ID NO: 746540 - DNA, 25 bp, Mus musculus
tactatcgtggaccagtaggtgcct

SEQ ID NO: 746541 - DNA, 25 bp, Mus musculus
tactatcgtggagcagtaggtgcct

SEQ ID NO: 746542 - DNA, 25 bp, Mus musculus
tactatctcaatcggcactggacca

SEQ ID NO: 746543 - DNA, 25 bp, Mus musculus
tactatctcaatgggcactggacca

SEQ ID NO: 746544 - DNA, 25 bp, Mus musculus
tactatctgcccaacaagaatcaaa

SEQ ID NO: 746545 - DNA, 25 bp, Mus musculus
tactatctgccctacaagaatcaaa

SEQ ID NO: 746546 - DNA, 25 bp, Mus musculus
tactatgaaactctgcgcatggcag

SEQ ID NO: 746547 - DNA, 25 bp, Mus musculus
tactatgaaactgtgcgcatggcag

SEQ ID NO: 746548 - DNA, 25 bp, Mus musculus
tactatgaacatcgtaaaggttcct

SEQ ID NO: 746549 - DNA, 25 bp, Mus musculus
tactatgaacatggtaaaggttcct

SEQ ID NO: 746550 - DNA, 25 bp, Mus musculus
tactatgaagaaaggcgagatctgc

SEQ ID NO: 746551 - DNA, 25 bp, Mus musculus
tactatgaagaatggcgagatctgc

SEQ ID NO: 746552 - DNA, 25 bp, Mus musculus
tactatgaccatcagcgcatgcagg

SEQ ID NO: 746553 - DNA, 25 bp, Mus musculus
tactatgaccatgagcgcatgcagg

SEQ ID NO: 746554 - DNA, 25 bp, Mus musculus
tactatgactcccacaacgtcaaca

SEQ ID NO: 746555 - DNA, 25 bp, Mus musculus
tactatgactccgacaacgtcaaca

SEQ ID NO: 746556 - DNA, 25 bp, Mus musculus
tactatgaggaacagagctgcatga

SEQ ID NO: 746557 - DNA, 25 bp, Mus musculus
tactatgaggaagagagctgcatga

SEQ ID NO: 746558 - DNA, 25 bp, Mus musculus
tactatgaggtcagggcattacact

SEQ ID NO: 746559 - DNA, 25 bp, Mus musculus
tactatgaggtctgggcattacact

SEQ ID NO: 746560 - DNA, 25 bp, Mus musculus
tactatgagtggctgcccgtttgca

SEQ ID NO: 746561 - DNA, 25 bp, Mus musculus
tactatgagtgggtgcccgtttgca

SEQ ID NO: 746562 - DNA, 25 bp, Mus musculus
tactatgattgaccacggtgacacg

SEQ ID NO: 746563 - DNA, 25 bp, Mus musculus
tactatgattgagcacggtgacacg

SEQ ID NO: 746564 - DNA, 25 bp, Mus musculus
tactatgcaaatctctcagcagcaa

SEQ ID NO: 746565 - DNA, 25 bp, Mus musculus
tactatgcaaatgtctcagcagcaa

SEQ ID NO: 746566 - DNA, 25 bp, Mus musculus
tactatgcaaggagatgatgtggct

SEQ ID NO: 746567 - DNA, 25 bp, Mus musculus
tactatgcaaggtgatgatgtggct

SEQ ID NO: 746568 - DNA, 25 bp, Mus musculus
tactatgcagctagtggtgtatgcc

SEQ ID NO: 746569 - DNA, 25 bp, Mus musculus
tactatgcagcttgtggtgtatgcc

SEQ ID NO: 746570 - DNA, 25 bp, Mus musculus
tactatgcataacgacagcagtgga

SEQ ID NO: 746571 - DNA, 25 bp, Mus musculus
tactatgcataaggacagcagtgga

SEQ ID NO: 746572 - DNA, 25 bp, Mus musculus
tactatgcctgtccccggttggctg

SEQ ID NO: 746573 - DNA, 25 bp, Mus musculus
tactatgcctgtgcccggttggctg

SEQ ID NO: 746574 - DNA, 25 bp, Mus musculus
tactatgcgtttagctgctcaggag

SEQ ID NO: 746575 - DNA, 25 bp, Mus musculus
tactatgcgttttgctgctcaggag

SEQ ID NO: 746576 - DNA, 25 bp, Mus musculus
tactatggaaacacaaatggtgccc

SEQ ID NO: 746577 - DNA, 25 bp, Mus musculus
tactatggaaactcaaatggtgccc

SEQ ID NO: 746578 - DNA, 25 bp, Mus musculus
tactatggaccacggcgactcttta

SEQ ID NO: 746579 - DNA, 25 bp, Mus musculus
tactatggaccagggcgactcttta

SEQ ID NO: 746580 - DNA, 25 bp, Mus musculus
tactatggaggaaactgggccagtt

SEQ ID NO: 746581 - DNA, 25 bp, Mus musculus
tactatggaggatactgggccagtt

SEQ ID NO: 746582 - DNA, 25 bp, Mus musculus
tactatggagtgaccgccctgacag

SEQ ID NO: 746583 - DNA, 25 bp, Mus musculus
tactatggagtgtccgccctgacag

SEQ ID NO: 746584 - DNA, 25 bp, Mus musculus
tactatggcatgacggagatgaact

SEQ ID NO: 746585 - DNA, 25 bp, Mus musculus
tactatggcatgtcggagatgaact

SEQ ID NO: 746586 - DNA, 25 bp, Mus musculus
tactatggccaccaggaagagctgc

SEQ ID NO: 746587 - DNA, 25 bp, Mus musculus
tactatggccacgaggaagagctgc

SEQ ID NO: 746588 - DNA, 25 bp, Mus musculus
tactatggcgatatcggcatcggaa

SEQ ID NO: 746589 - DNA, 25 bp, Mus musculus
tactatggcgatttcggcatcggaa

SEQ ID NO: 746590 - DNA, 25 bp, Mus musculus
tactatggctgaagatctggagcag

SEQ ID NO: 746591 - DNA, 25 bp, Mus musculus
tactatggctgatgatctggagcag

SEQ ID NO: 746592 - DNA, 25 bp, Mus musculus
tactatgggccacgaggatcccctg

SEQ ID NO: 746593 - DNA, 25 bp, Mus musculus
tactatgggccaggaggatcccctg

SEQ ID NO: 746594 - DNA, 25 bp, Mus musculus
tactatggtagaaaagcgaatgctt

SEQ ID NO: 746595 - DNA, 25 bp, Mus musculus
tactatggtagataagcgaatgctt

SEQ ID NO: 746596 - DNA, 25 bp, Mus musculus
tactatgtaagactaagcccctcca

SEQ ID NO: 746597 - DNA, 25 bp, Mus musculus
tactatgtaagagtaagcccctcca

SEQ ID NO: 746598 - DNA, 25 bp, Mus musculus
tactatgtcgacacagctgtgcgcc

SEQ ID NO: 746599 - DNA, 25 bp, Mus musculus
tactatgtcgactcagctgtgcgcc

SEQ ID NO: 746600 - DNA, 25 bp, Mus musculus
tactatgtctccaacgccatcttct

SEQ ID NO: 746601 - DNA, 25 bp, Mus musculus
tactatgtctcctacgccatcttct

SEQ ID NO: 746602 - DNA, 25 bp, Mus musculus
tactatgtgatcagtattgagggca

SEQ ID NO: 746603 - DNA, 25 bp, Mus musculus
tactatgtgatctgtattgagggca

SEQ ID NO: 746604 - DNA, 25 bp, Mus musculus
tactatgtgcttcttggcctgactg

SEQ ID NO: 746605 - DNA, 25 bp, Mus musculus
tactatgtgcttgttggcctgactg

SEQ ID NO: 746606 - DNA, 25 bp, Mus musculus
tactatgtggaccagcgcactgtgg

SEQ ID NO: 746607 - DNA, 25 bp, Mus musculus
tactatgtggacgagcgcactgtgg

SEQ ID NO: 746608 - DNA, 25 bp, Mus musculus
tactatgtggcccagagtttcaatg

SEQ ID NO: 746609 - DNA, 25 bp, Mus musculus
tactatgtggccgagagtttcaatg

SEQ ID NO: 746610 - DNA, 25 bp, Mus musculus
tactattactaaagcatgcggtgcc

SEQ ID NO: 746611 - DNA, 25 bp, Mus musculus
tactattactaatgcatgcggtgcc

SEQ ID NO: 746612 - DNA, 25 bp, Mus musculus
tactattatgagaaaggcatcatgc

SEQ ID NO: 746613 - DNA, 25 bp, Mus musculus
tactattatgagtaaggcatcatgc

SEQ ID NO: 746614 - DNA, 25 bp, Mus musculus
tactattccagtaagagctgctggc

SEQ ID NO: 746615 - DNA, 25 bp, Mus musculus
tactattccagttagagctgctggc

SEQ ID NO: 746616 - DNA, 25 bp, Mus musculus
tactattcgtgacatcctaggaggc

SEQ ID NO: 746617 - DNA, 25 bp, Mus musculus
tactattcgtgagatcctaggaggc

SEQ ID NO: 746618 - DNA, 25 bp, Mus musculus
tactattgactgcaatgtctgttct

SEQ ID NO: 746619 - DNA, 25 bp, Mus musculus
tactattgactggaatgtctgttct

SEQ ID NO: 746620 - DNA, 25 bp, Mus musculus
tactattgaggaaggcacaatgccc

SEQ ID NO: 746621 - DNA, 25 bp, Mus musculus
tactattgaggatggcacaatgccc

SEQ ID NO: 746622 - DNA, 25 bp, Mus musculus
tactattgcacaaaaggccatgaaa

SEQ ID NO: 746623 - DNA, 25 bp, Mus musculus
tactattgcacataaggccatgaaa

SEQ ID NO: 746624 - DNA, 25 bp, Mus musculus
tactatttgcaaactacattccaga

SEQ ID NO: 746625 - DNA, 25 bp, Mus musculus
tactatttgcaatctacattccaga

SEQ ID NO: 746626 - DNA, 25 bp, Mus musculus
tactattttgatctacagctccttg

SEQ ID NO: 746627 - DNA, 25 bp, Mus musculus
tactattttgatgtacagctccttg

SEQ ID NO: 746628 - DNA, 25 bp, Mus musculus
tactattttggccttaccattccgg

SEQ ID NO: 746629 - DNA, 25 bp, Mus musculus
tactattttggcgttaccattccgg

SEQ ID NO: 746630 - DNA, 25 bp, Mus musculus
tactcaaaacggctccacctgatga

SEQ ID NO: 746631 - DNA, 25 bp, Mus musculus
tactcaaaacgggtccacctgatga

SEQ ID NO: 746632 - DNA, 25 bp, Mus musculus
tactcaaaacttaaccccaggctgc

SEQ ID NO: 746633 - DNA, 25 bp, Mus musculus
tactcaaaactttaccccaggctgc

SEQ ID NO: 746634 - DNA, 25 bp, Mus musculus
tactcaaaccggctctacgcttatg

SEQ ID NO: 746635 - DNA, 25 bp, Mus musculus
tactcaaaccgggtctacgcttatg

SEQ ID NO: 746636 - DNA, 25 bp, Mus musculus
tactcaacaagcagatcagaagcaa

SEQ ID NO: 746637 - DNA, 25 bp, Mus musculus
tactcaacaagctgatcagaagcaa

SEQ ID NO: 746638 - DNA, 25 bp, Mus musculus
tactcaacaatgatcggcagaacgc

SEQ ID NO: 746639 - DNA, 25 bp, Mus musculus
tactcaacaatgttcggcagaacgc

SEQ ID NO: 746640 - DNA, 25 bp, Mus musculus
tactcaacaggcagaaacgcaaagc

SEQ ID NO: 746641 - DNA, 25 bp, Mus musculus
tactcaacaggctgaaacgcaaagc

SEQ ID NO: 746642 - DNA, 25 bp, Mus musculus
tactcaacctttctacatgcaacaa

SEQ ID NO: 746643 - DNA, 25 bp, Mus musculus
tactcaacctttgtacatgcaacaa

SEQ ID NO: 746644 - DNA, 25 bp, Mus musculus
tactcaacgtttccatggatgccaa

SEQ ID NO: 746645 - DNA, 25 bp, Mus musculus
tactcaacgtttgcatggatgccaa

SEQ ID NO: 746646 - DNA, 25 bp, Mus musculus
tactcaagacagctttccagccggt

SEQ ID NO: 746647 - DNA, 25 bp, Mus musculus
tactcaagacaggtttccagccggt

SEQ ID NO: 746648 - DNA, 25 bp, Mus musculus
tactcaagaccaactcagctgtccg

SEQ ID NO: 746649 - DNA, 25 bp, Mus musculus
tactcaagaccatctcagctgtccg

SEQ ID NO: 746650 - DNA, 25 bp, Mus musculus
tactcaagaggcaagcactgttgtg

SEQ ID NO: 746651 - DNA, 25 bp, Mus musculus
tactcaagaggctagcactgttgtg

SEQ ID NO: 746652 - DNA, 25 bp, Mus musculus
tactcaaggacaatgtgagaagtgt

SEQ ID NO: 746653 - DNA, 25 bp, Mus musculus
tactcaaggacattgtgagaagtgt

SEQ ID NO: 746654 - DNA, 25 bp, Mus musculus
tactcaatgaacagaagcgccgtgg

SEQ ID NO: 746655 - DNA, 25 bp, Mus musculus
tactcaatgaactgaagcgccgtgg

SEQ ID NO: 746656 - DNA, 25 bp, Mus musculus
tactcaatgaagcacgacttggaac

SEQ ID NO: 746657 - DNA, 25 bp, Mus musculus
tactcaatgaaggacgacttggaac

SEQ ID NO: 746658 - DNA, 25 bp, Mus musculus
tactcaatgagcatccagcgcaatg

SEQ ID NO: 746659 - DNA, 25 bp, Mus musculus
tactcaatgagcttccagcgcaatg

SEQ ID NO: 746660 - DNA, 25 bp, Mus musculus
tactcaatggacaacgctatcgtgc

SEQ ID NO: 746661 - DNA, 25 bp, Mus musculus
tactcaatggactacgctatcgtgc

SEQ ID NO: 746662 - DNA, 25 bp, Mus musculus
tactcacacgttatgacctgatcag

SEQ ID NO: 746663 - DNA, 25 bp, Mus musculus
tactcacacgttttgacctgatcag

SEQ ID NO: 746664 - DNA, 25 bp, Mus musculus
tactcacagattattaaagaaggcc

SEQ ID NO: 746665 - DNA, 25 bp, Mus musculus
tactcacagatttttaaagaaggcc

SEQ ID NO: 746666 - DNA, 25 bp, Mus musculus
tactcacagcagagggtgtgcagac

SEQ ID NO: 746667 - DNA, 25 bp, Mus musculus
tactcacagcagtgggtgtgcagac

SEQ ID NO: 746668 - DNA, 25 bp, Mus musculus
tactcacaggtacaacagttagcat

SEQ ID NO: 746669 - DNA, 25 bp, Mus musculus
tactcacaggtagaacagttagcat

SEQ ID NO: 746670 - DNA, 25 bp, Mus musculus
tactcacagttcattccacagggag

SEQ ID NO: 746671 - DNA, 25 bp, Mus musculus
tactcacagttctttccacagggag

SEQ ID NO: 746672 - DNA, 25 bp, Mus musculus
tactcaccagaacatgtcatcggca

SEQ ID NO: 746673 - DNA, 25 bp, Mus musculus
tactcaccagaagatgtcatcggca

SEQ ID NO: 746674 - DNA, 25 bp, Mus musculus
tactcaccagatcagcttcggtact

SEQ ID NO: 746675 - DNA, 25 bp, Mus musculus
tactcaccagatgagcttcggtact

SEQ ID NO: 746676 - DNA, 25 bp, Mus musculus
tactcaccaggactcacagggtctg

SEQ ID NO: 746677 - DNA, 25 bp, Mus musculus
tactcaccaggagtcacagggtctg

SEQ ID NO: 746678 - DNA, 25 bp, Mus musculus
tactcacccctgatctcagactaag

SEQ ID NO: 746679 - DNA, 25 bp, Mus musculus
tactcacccctgttctcagactaag

SEQ ID NO: 746680 - DNA, 25 bp, Mus musculus
tactcacctgtcacctatttagaag

SEQ ID NO: 746681 - DNA, 25 bp, Mus musculus
tactcacctgtctcctatttagaag

SEQ ID NO: 746682 - DNA, 25 bp, Mus musculus
tactcacggcttacgtacatctggg

SEQ ID NO: 746683 - DNA, 25 bp, Mus musculus
tactcacggctttcgtacatctggg

SEQ ID NO: 746684 - DNA, 25 bp, Mus musculus
tactcactcatgagttggtcagtgt

SEQ ID NO: 746685 - DNA, 25 bp, Mus musculus
tactcactcatgtgttggtcagtgt

SEQ ID NO: 746686 - DNA, 25 bp, Mus musculus
tactcactgatgatctggtcccata

SEQ ID NO: 746687 - DNA, 25 bp, Mus musculus
tactcactgatgttctggtcccata

SEQ ID NO: 746688 - DNA, 25 bp, Mus musculus
tactcactgtcaaactaatagggtg

SEQ ID NO: 746689 - DNA, 25 bp, Mus musculus
tactcactgtcatactaatagggtg

SEQ ID NO: 746690 - DNA, 25 bp, Mus musculus
tactcactgttaccatcttggcact

SEQ ID NO: 746691 - DNA, 25 bp, Mus musculus
tactcactgttagcatcttggcact

SEQ ID NO: 746692 - DNA, 25 bp, Mus musculus
tactcacttggcagaggcgctgcac

SEQ ID NO: 746693 - DNA, 25 bp, Mus musculus
tactcacttggctgaggcgctgcac

SEQ ID NO: 746694 - DNA, 25 bp, Mus musculus
tactcagaagcccatacacagggtc

SEQ ID NO: 746695 - DNA, 25 bp, Mus musculus
tactcagaagccgatacacagggtc

SEQ ID NO: 746696 - DNA, 25 bp, Mus musculus
tactcagactacagggagcggacgc

SEQ ID NO: 746697 - DNA, 25 bp, Mus musculus
tactcagactactgggagcggacgc

SEQ ID NO: 746698 - DNA, 25 bp, Mus musculus
tactcagagagcagctgaaggtagc

SEQ ID NO: 746699 - DNA, 25 bp, Mus musculus
tactcagagagctgctgaaggtagc

SEQ ID NO: 746700 - DNA, 25 bp, Mus musculus
tactcagagtggaacaatttcattc

SEQ ID NO: 746701 - DNA, 25 bp, Mus musculus
tactcagagtggaccacagccaagg

SEQ ID NO: 746702 - DNA, 25 bp, Mus musculus
tactcagagtggtacaatttcattc

SEQ ID NO: 746703 - DNA, 25 bp, Mus musculus
tactcagagtggtccacagccaagg

SEQ ID NO: 746704 - DNA, 25 bp, Mus musculus
tactcagagttcagcagccgccaca

SEQ ID NO: 746705 - DNA, 25 bp, Mus musculus
tactcagagttctgcagccgccaca

SEQ ID NO: 746706 - DNA, 25 bp, Mus musculus
tactcagcaacccagagaaaaggaa

SEQ ID NO: 746707 - DNA, 25 bp, Mus musculus
tactcagcaaccgagagaaaaggaa

SEQ ID NO: 746708 - DNA, 25 bp, Mus musculus
tactcagcagccacgtgtgtgcagc

SEQ ID NO: 746709 - DNA, 25 bp, Mus musculus
tactcagcagcctcgtgtgtgcagc

SEQ ID NO: 746710 - DNA, 25 bp, Mus musculus
tactcagcatgcactggatggacat

SEQ ID NO: 746711 - DNA, 25 bp, Mus musculus
tactcagcatgctctggatggacat

SEQ ID NO: 746712 - DNA, 25 bp, Mus musculus
tactcagccacaatgtcttcagagg

SEQ ID NO: 746713 - DNA, 25 bp, Mus musculus
tactcagccacattgtcttcagagg

SEQ ID NO: 746714 - DNA, 25 bp, Mus musculus
tactcagccagacagagatgttccg

SEQ ID NO: 746715 - DNA, 25 bp, Mus musculus
tactcagccagagagagatgttccg

SEQ ID NO: 746716 - DNA, 25 bp, Mus musculus
tactcagcctaaagaccatggatcg

SEQ ID NO: 746717 - DNA, 25 bp, Mus musculus
tactcagcctaatgaccatggatcg

SEQ ID NO: 746718 - DNA, 25 bp, Mus musculus
tactcagctttgctggtctacgttg

SEQ ID NO: 746719 - DNA, 25 bp, Mus musculus
tactcagctttggtggtctacgttg

SEQ ID NO: 746720 - DNA, 25 bp, Mus musculus
tactcaggacccatgatcagtgtct

SEQ ID NO: 746721 - DNA, 25 bp, Mus musculus
tactcaggacccttgatcagtgtct

SEQ ID NO: 746722 - DNA, 25 bp, Mus musculus
tactcaggacttctcagacacccag

SEQ ID NO: 746723 - DNA, 25 bp, Mus musculus
tactcaggacttgtcagacacccag

SEQ ID NO: 746724 - DNA, 25 bp, Mus musculus
tactcaggagagctcaagtttgaga

SEQ ID NO: 746725 - DNA, 25 bp, Mus musculus
tactcaggagaggtcaagtttgaga

SEQ ID NO: 746726 - DNA, 25 bp, Mus musculus
tactcaggagatcgatttcattctt

SEQ ID NO: 746727 - DNA, 25 bp, Mus musculus
tactcaggagatggatttcattctt

SEQ ID NO: 746728 - DNA, 25 bp, Mus musculus
tactcaggcccacgaacacctgatg

SEQ ID NO: 746729 - DNA, 25 bp, Mus musculus
tactcaggcccaggaacacctgatg

SEQ ID NO: 746730 - DNA, 25 bp, Mus musculus
tactcaggctctcctgcagaagcac

SEQ ID NO: 746731 - DNA, 25 bp, Mus musculus
tactcaggctctgctgcagaagcac

SEQ ID NO: 746732 - DNA, 25 bp, Mus musculus
tactcagggcgaacaggacaattat

SEQ ID NO: 746733 - DNA, 25 bp, Mus musculus
tactcagggcgatcaggacaattat

SEQ ID NO: 746734 - DNA, 25 bp, Mus musculus
tactcaggtctacctactggcggct

SEQ ID NO: 746735 - DNA, 25 bp, Mus musculus
tactcaggtctagctactggcggct

SEQ ID NO: 746736 - DNA, 25 bp, Mus musculus
tactcagtagctacagtgctgtggg

SEQ ID NO: 746737 - DNA, 25 bp, Mus musculus
tactcagtagcttcagtgctgtggg

SEQ ID NO: 746738 - DNA, 25 bp, Mus musculus
tactcagtgaccagttaaaacaagt

SEQ ID NO: 746739 - DNA, 25 bp, Mus musculus
tactcagtgacctgttaaaacaagt

SEQ ID NO: 746740 - DNA, 25 bp, Mus musculus
tactcagtgatacctcagccaggaa

SEQ ID NO: 746741 - DNA, 25 bp, Mus musculus
tactcagtgatagctcagccaggaa

SEQ ID NO: 746742 - DNA, 25 bp, Mus musculus
tactcagtgtatccccgtgtcctgg

SEQ ID NO: 746743 - DNA, 25 bp, Mus musculus
tactcagtgtatgcccgtgtcctgg

SEQ ID NO: 746744 - DNA, 25 bp, Mus musculus
tactcagttcatagtgctcctgcct

SEQ ID NO: 746745 - DNA, 25 bp, Mus musculus
tactcagttcattgtgctcctgcct

SEQ ID NO: 746746 - DNA, 25 bp, Mus musculus
tactcatatactcatggcggctgtg

SEQ ID NO: 746747 - DNA, 25 bp, Mus musculus
tactcatatactgatggcggctgtg

SEQ ID NO: 746748 - DNA, 25 bp, Mus musculus
tactcatatgatagtgtcctgagag

SEQ ID NO: 746749 - DNA, 25 bp, Mus musculus
tactcatatgattgtgtcctgagag

SEQ ID NO: 746750 - DNA, 25 bp, Mus musculus
tactcatcagtcacaagtactgttg

SEQ ID NO: 746751 - DNA, 25 bp, Mus musculus
tactcatcagtctcaagtactgttg

SEQ ID NO: 746752 - DNA, 25 bp, Mus musculus
tactcatcctccagtgaggagtctg

SEQ ID NO: 746753 - DNA, 25 bp, Mus musculus
tactcatcctcctgtgaggagtctg

SEQ ID NO: 746754 - DNA, 25 bp, Mus musculus
tactcatcgacaccagataccagca

SEQ ID NO: 746755 - DNA, 25 bp, Mus musculus
tactcatcgacagcagataccagca

SEQ ID NO: 746756 - DNA, 25 bp, Mus musculus
tactcattgtttacaacatccctca

SEQ ID NO: 746757 - DNA, 25 bp, Mus musculus
tactcattgttttcaacatccctca

SEQ ID NO: 746758 - DNA, 25 bp, Mus musculus
tactccaaaaagcaaagacgcttca

SEQ ID NO: 746759 - DNA, 25 bp, Mus musculus
tactccaaaaaggaaagacgcttca

SEQ ID NO: 746760 - DNA, 25 bp, Mus musculus
tactccaagcacaagagactccagg

SEQ ID NO: 746761 - DNA, 25 bp, Mus musculus
tactccaagcactagagactccagg

SEQ ID NO: 746762 - DNA, 25 bp, Mus musculus
tactccaaggcaaaggtgtttgagc

SEQ ID NO: 746763 - DNA, 25 bp, Mus musculus
tactccaaggcataggtgtttgagc

SEQ ID NO: 746764 - DNA, 25 bp, Mus musculus
tactccaatgaactggttaccttgt

SEQ ID NO: 746765 - DNA, 25 bp, Mus musculus
tactccaatgaagtggttaccttgt

SEQ ID NO: 746766 - DNA, 25 bp, Mus musculus
tactccaatggtcaaagacttcatg

SEQ ID NO: 746767 - DNA, 25 bp, Mus musculus
tactccaatggtgaaagacttcatg

SEQ ID NO: 746768 - DNA, 25 bp, Mus musculus
tactccaattatcaatttattagtg

SEQ ID NO: 746769 - DNA, 25 bp, Mus musculus
tactccaattatgaatttattagtg

SEQ ID NO: 746770 - DNA, 25 bp, Mus musculus
tactccaccgtgcttatggctgacg

SEQ ID NO: 746771 - DNA, 25 bp, Mus musculus
tactccaccgtggttatggctgacg

SEQ ID NO: 746772 - DNA, 25 bp, Mus musculus
tactccacgatgcagtaatgaatcc

SEQ ID NO: 746773 - DNA, 25 bp, Mus musculus
tactccacgatggagtaatgaatcc

SEQ ID NO: 746774 - DNA, 25 bp, Mus musculus
tactccactcagaacgttgcctaca

SEQ ID NO: 746775 - DNA, 25 bp, Mus musculus
tactccactcagtacgttgcctaca

SEQ ID NO: 746776 - DNA, 25 bp, Mus musculus
tactccactgatacccaaatctgtg

SEQ ID NO: 746777 - DNA, 25 bp, Mus musculus
tactccactgattcccaaatctgtg

SEQ ID NO: 746778 - DNA, 25 bp, Mus musculus
tactccactgttccgagcctgtgag

SEQ ID NO: 746779 - DNA, 25 bp, Mus musculus
tactccactgttgcgagcctgtgag

SEQ ID NO: 746780 - DNA, 25 bp, Mus musculus
tactccacttggagatgagcagcag

SEQ ID NO: 746781 - DNA, 25 bp, Mus musculus
tactccacttggtgatgagcagcag

SEQ ID NO: 746782 - DNA, 25 bp, Mus musculus
tactccagcacacagtttgactctg

SEQ ID NO: 746783 - DNA, 25 bp, Mus musculus
tactccagcacagagtttgactctg

SEQ ID NO: 746784 - DNA, 25 bp, Mus musculus
tactccagcactacggagacaggct

SEQ ID NO: 746785 - DNA, 25 bp, Mus musculus
tactccagcacttcggagacaggct

SEQ ID NO: 746786 - DNA, 25 bp, Mus musculus
tactccaggactaagataaaaaaga

SEQ ID NO: 746787 - DNA, 25 bp, Mus musculus
tactccaggacttagataaaaaaga

SEQ ID NO: 746788 - DNA, 25 bp, Mus musculus
tactccagggaaccagagacatcag

SEQ ID NO: 746789 - DNA, 25 bp, Mus musculus
tactccagggaagcagagacatcag

SEQ ID NO: 746790 - DNA, 25 bp, Mus musculus
tactccatcatacacaaacttggga

SEQ ID NO: 746791 - DNA, 25 bp, Mus musculus
tactccatcatagacaaacttggga

SEQ ID NO: 746792 - DNA, 25 bp, Mus musculus
tactccatgagcagatgaaggaggc

SEQ ID NO: 746793 - DNA, 25 bp, Mus musculus
tactccatgagctgatgaaggaggc

SEQ ID NO: 746794 - DNA, 25 bp, Mus musculus
tactccatttgcacttcagggattg

SEQ ID NO: 746795 - DNA, 25 bp, Mus musculus
tactccatttgctcttcagggattg

SEQ ID NO: 746796 - DNA, 25 bp, Mus musculus
tactcccaaaagacagcgatgtttg

SEQ ID NO: 746797 - DNA, 25 bp, Mus musculus
tactcccaaaagtcagcgatgtttg

SEQ ID NO: 746798 - DNA, 25 bp, Mus musculus
tactcccaagggagagcgctcttcc

SEQ ID NO: 746799 - DNA, 25 bp, Mus musculus
tactcccaagggtgagcgctcttcc

SEQ ID NO: 746800 - DNA, 25 bp, Mus musculus
tactcccagaccaggcagagcagtt

SEQ ID NO: 746801 - DNA, 25 bp, Mus musculus
tactcccagacctggcagagcagtt

SEQ ID NO: 746802 - DNA, 25 bp, Mus musculus
tactcccagttgctgaggactctca

SEQ ID NO: 746803 - DNA, 25 bp, Mus musculus
tactcccagttggtgaggactctca

SEQ ID NO: 746804 - DNA, 25 bp, Mus musculus
tactccccagcaattggtgccattt

SEQ ID NO: 746805 - DNA, 25 bp, Mus musculus
tactccccagcatttggtgccattt

SEQ ID NO: 746806 - DNA, 25 bp, Mus musculus
tactcccgcctgctgctctgtaaga

SEQ ID NO: 746807 - DNA, 25 bp, Mus musculus
tactcccgcctggtgctctgtaaga

SEQ ID NO: 746808 - DNA, 25 bp, Mus musculus
tactccctcgccatgcgctgctggg

SEQ ID NO: 746809 - DNA, 25 bp, Mus musculus
tactccctcgccttgcgctgctggg

SEQ ID NO: 746810 - DNA, 25 bp, Mus musculus
tactccctgaagatcagttccctca

SEQ ID NO: 746811 - DNA, 25 bp, Mus musculus
tactccctgaagttcagttccctca

SEQ ID NO: 746812 - DNA, 25 bp, Mus musculus
tactccctgataacttcatagctgc

SEQ ID NO: 746813 - DNA, 25 bp, Mus musculus
tactccctgatatcttcatagctgc

SEQ ID NO: 746814 - DNA, 25 bp, Mus musculus
tactccctggacatgacctcaatca

SEQ ID NO: 746815 - DNA, 25 bp, Mus musculus
tactccctggacttgacctcaatca

SEQ ID NO: 746816 - DNA, 25 bp, Mus musculus
tactcccttttgcagagcccagagg

SEQ ID NO: 746817 - DNA, 25 bp, Mus musculus
tactcccttttggagagcccagagg

SEQ ID NO: 746818 - DNA, 25 bp, Mus musculus
tactccgaatcactacatggtactg

SEQ ID NO: 746819 - DNA, 25 bp, Mus musculus
tactccgaatcagtacatggtactg

SEQ ID NO: 746820 - DNA, 25 bp, Mus musculus
tactccgaatgcaatgaatcatggc

SEQ ID NO: 746821 - DNA, 25 bp, Mus musculus
tactccgaatgctatgaatcatggc

SEQ ID NO: 746822 - DNA, 25 bp, Mus musculus
tactccgcgggaagtacagaatccc

SEQ ID NO: 746823 - DNA, 25 bp, Mus musculus
tactccgcgggatgtacagaatccc

SEQ ID NO: 746824 - DNA, 25 bp, Mus musculus
tactccggaccgaagcatgattgct

SEQ ID NO: 746825 - DNA, 25 bp, Mus musculus
tactccggaccgtagcatgattgct

SEQ ID NO: 746826 - DNA, 25 bp, Mus musculus
tactccgtgacaccggagctcctga

SEQ ID NO: 746827 - DNA, 25 bp, Mus musculus
tactccgtgacagcggagctcctga

SEQ ID NO: 746828 - DNA, 25 bp, Mus musculus
tactcctgaactctgtgctaaagat

SEQ ID NO: 746829 - DNA, 25 bp, Mus musculus
tactcctgaactgtgtgctaaagat

SEQ ID NO: 746830 - DNA, 25 bp, Mus musculus
tactcctgacttaaccactgacgat

SEQ ID NO: 746831 - DNA, 25 bp, Mus musculus
tactcctgactttaccactgacgat

SEQ ID NO: 746832 - DNA, 25 bp, Mus musculus
tactcctgccctcctgacagtgtta

SEQ ID NO: 746833 - DNA, 25 bp, Mus musculus
tactcctgccctgctgacagtgtta

SEQ ID NO: 746834 - DNA, 25 bp, Mus musculus
tactcctgctgtcgtaatgggcagg

SEQ ID NO: 746835 - DNA, 25 bp, Mus musculus
tactcctgctgtctggcctatcttg

SEQ ID NO: 746836 - DNA, 25 bp, Mus musculus
tactcctgctgtggtaatgggcagg

SEQ ID NO: 746837 - DNA, 25 bp, Mus musculus
tactcctgctgtgtggcctatcttg

SEQ ID NO: 746838 - DNA, 25 bp, Mus musculus
tactcctgggacatcgttgtccaga

SEQ ID NO: 746839 - DNA, 25 bp, Mus musculus
tactcctgggaccacggagattagc

SEQ ID NO: 746840 - DNA, 25 bp, Mus musculus
tactcctgggacgacggagattagc

SEQ ID NO: 746841 - DNA, 25 bp, Mus musculus
tactcctgggacttcgttgtccaga

SEQ ID NO: 746842 - DNA, 25 bp, Mus musculus
tactcctgggagaggcacagctgtc

SEQ ID NO: 746843 - DNA, 25 bp, Mus musculus
tactcctgggagtggcacagctgtc

SEQ ID NO: 746844 - DNA, 25 bp, Mus musculus
tactcctgggatatcatggagccag

SEQ ID NO: 746845 - DNA, 25 bp, Mus musculus
tactcctgggatttcatggagccag

SEQ ID NO: 746846 - DNA, 25 bp, Mus musculus
tactcctgttccagcaaggctgcgc

SEQ ID NO: 746847 - DNA, 25 bp, Mus musculus
tactcctgttcctgcaaggctgcgc

SEQ ID NO: 746848 - DNA, 25 bp, Mus musculus
tactccttaaacatttgcctgatga

SEQ ID NO: 746849 - DNA, 25 bp, Mus musculus
tactccttaaacttttgcctgatga

SEQ ID NO: 746850 - DNA, 25 bp, Mus musculus
tactccttactcaagaacagcctgg

SEQ ID NO: 746851 - DNA, 25 bp, Mus musculus
tactccttactctagaacagcctgg

SEQ ID NO: 746852 - DNA, 25 bp, Mus musculus
tactccttcaacagtcccgatggtg

SEQ ID NO: 746853 - DNA, 25 bp, Mus musculus
tactccttcaactgtcccgatggtg

SEQ ID NO: 746854 - DNA, 25 bp, Mus musculus
tactccttgctgatcttgacaaaga

SEQ ID NO: 746855 - DNA, 25 bp, Mus musculus
tactccttgctgttcttgacaaaga

SEQ ID NO: 746856 - DNA, 25 bp, Mus musculus
tactccttggttctgaatgagaccc

SEQ ID NO: 746857 - DNA, 25 bp, Mus musculus
tactccttggttgtgaatgagaccc

SEQ ID NO: 746858 - DNA, 25 bp, Mus musculus
tactccttgtaacgactacctgaaa

SEQ ID NO: 746859 - DNA, 25 bp, Mus musculus
tactccttgtaaggactacctgaaa

SEQ ID NO: 746860 - DNA, 25 bp, Mus musculus
tactcctttggacttgttcaagttc

SEQ ID NO: 746861 - DNA, 25 bp, Mus musculus
tactcctttggagttgttcaagttc

SEQ ID NO: 746862 - DNA, 25 bp, Mus musculus
tactcgaaatctagtggatcaagga

SEQ ID NO: 746863 - DNA, 25 bp, Mus musculus
tactcgaaatcttgtggatcaagga

SEQ ID NO: 746864 - DNA, 25 bp, Mus musculus
tactcgaagacgacccgattcgctt

SEQ ID NO: 746865 - DNA, 25 bp, Mus musculus
tactcgaagacgtcccgattcgctt

SEQ ID NO: 746866 - DNA, 25 bp, Mus musculus
tactcgaagagcaaactggatgcag

SEQ ID NO: 746867 - DNA, 25 bp, Mus musculus
tactcgaagagctaactggatgcag

SEQ ID NO: 746868 - DNA, 25 bp, Mus musculus
tactcgacagtacgtggatcagata

SEQ ID NO: 746869 - DNA, 25 bp, Mus musculus
tactcgacagtaggtggatcagata

SEQ ID NO: 746870 - DNA, 25 bp, Mus musculus
tactcgaccagtagcccaatcttgc

SEQ ID NO: 746871 - DNA, 25 bp, Mus musculus
tactcgaccagttgcccaatcttgc

SEQ ID NO: 746872 - DNA, 25 bp, Mus musculus
tactcgacctcaaccagccttatgg

SEQ ID NO: 746873 - DNA, 25 bp, Mus musculus
tactcgacctcatccagccttatgg

SEQ ID NO: 746874 - DNA, 25 bp, Mus musculus
tactcgaggctgatgcgggaacgca

SEQ ID NO: 746875 - DNA, 25 bp, Mus musculus
tactcgaggctgttgcgggaacgca

SEQ ID NO: 746876 - DNA, 25 bp, Mus musculus
tactcgaggtggatgtcgcgtcctg

SEQ ID NO: 746877 - DNA, 25 bp, Mus musculus
tactcgaggtggttgtcgcgtcctg

SEQ ID NO: 746878 - DNA, 25 bp, Mus musculus
tactcgattactaaatggcctcgcc

SEQ ID NO: 746879 - DNA, 25 bp, Mus musculus
tactcgattacttaatggcctcgcc

SEQ ID NO: 746880 - DNA, 25 bp, Mus musculus
tactcgcacagcctacggaccaaat

SEQ ID NO: 746881 - DNA, 25 bp, Mus musculus
tactcgcacagcgtacggaccaaat

SEQ ID NO: 746882 - DNA, 25 bp, Mus musculus
tactcgcagtgtacagctccaggct

SEQ ID NO: 746883 - DNA, 25 bp, Mus musculus
tactcgcagtgttcagctccaggct

SEQ ID NO: 746884 - DNA, 25 bp, Mus musculus
tactcgcctattcgtgtttggtgga

SEQ ID NO: 746885 - DNA, 25 bp, Mus musculus
tactcgcctattggtgtttggtgga

SEQ ID NO: 746886 - DNA, 25 bp, Mus musculus
tactcgcgtcggcacagaggcttcc

SEQ ID NO: 746887 - DNA, 25 bp, Mus musculus
tactcgcgtcgggacagaggcttcc

SEQ ID NO: 746888 - DNA, 25 bp, Mus musculus
tactcgcttctcagatggttaccgc

SEQ ID NO: 746889 - DNA, 25 bp, Mus musculus
tactcgcttctctgatggttaccgc

SEQ ID NO: 746890 - DNA, 25 bp, Mus musculus
tactcggagaaacttcagaccggac

SEQ ID NO: 746891 - DNA, 25 bp, Mus musculus
tactcggagaaagttcagaccggac

SEQ ID NO: 746892 - DNA, 25 bp, Mus musculus
tactcggataccatctgtaaaaatc

SEQ ID NO: 746893 - DNA, 25 bp, Mus musculus
tactcggataccttctgtaaaaatc

SEQ ID NO: 746894 - DNA, 25 bp, Mus musculus
tactcggatcggctcaggttccttt

SEQ ID NO: 746895 - DNA, 25 bp, Mus musculus
tactcggatcgggtcaggttccttt

SEQ ID NO: 746896 - DNA, 25 bp, Mus musculus
tactcggatctcatctcctactgcg

SEQ ID NO: 746897 - DNA, 25 bp, Mus musculus
tactcggatctcttctcctactgcg

SEQ ID NO: 746898 - DNA, 25 bp, Mus musculus
tactcggatggtcgctttagagacc

SEQ ID NO: 746899 - DNA, 25 bp, Mus musculus
tactcggatggtggctttagagacc

SEQ ID NO: 746900 - DNA, 25 bp, Mus musculus
tactcggcacacaaagaaggtgttc

SEQ ID NO: 746901 - DNA, 25 bp, Mus musculus
tactcggcacactaagaaggtgttc

SEQ ID NO: 746902 - DNA, 25 bp, Mus musculus
tactcggcatagaacaagaacattg

SEQ ID NO: 746903 - DNA, 25 bp, Mus musculus
tactcggcatagtacaagaacattg

SEQ ID NO: 746904 - DNA, 25 bp, Mus musculus
tactcggcgctacaggacaaagaat

SEQ ID NO: 746905 - DNA, 25 bp, Mus musculus
tactcggcgctagaggacaaagaat

SEQ ID NO: 746906 - DNA, 25 bp, Mus musculus
tactcggctgacctcggaaacaaaa

SEQ ID NO: 746907 - DNA, 25 bp, Mus musculus
tactcggctgacgtcggaaacaaaa

SEQ ID NO: 746908 - DNA, 25 bp, Mus musculus
tactcgggacacacttcattctcta

SEQ ID NO: 746909 - DNA, 25 bp, Mus musculus
tactcgggacactcttcattctcta

SEQ ID NO: 746910 - DNA, 25 bp, Mus musculus
tactcgggactacttgggacctctg

SEQ ID NO: 746911 - DNA, 25 bp, Mus musculus
tactcgggactagttgggacctctg

SEQ ID NO: 746912 - DNA, 25 bp, Mus musculus
tactcgggccaaatttgaagagctg

SEQ ID NO: 746913 - DNA, 25 bp, Mus musculus
tactcgggccaattttgaagagctg

SEQ ID NO: 746914 - DNA, 25 bp, Mus musculus
tactcggtggagatcacggtcgaga

SEQ ID NO: 746915 - DNA, 25 bp, Mus musculus
tactcggtggagttcacggtcgaga

SEQ ID NO: 746916 - DNA, 25 bp, Mus musculus
tactcggtttgcatctctcacatgg

SEQ ID NO: 746917 - DNA, 25 bp, Mus musculus
tactcggtttgcttctctcacatgg

SEQ ID NO: 746918 - DNA, 25 bp, Mus musculus
tactcgtacctgatgacaagccagc

SEQ ID NO: 746919 - DNA, 25 bp, Mus musculus
tactcgtacctgttgacaagccagc

SEQ ID NO: 746920 - DNA, 25 bp, Mus musculus
tactcgtccaggaacaaatagggct

SEQ ID NO: 746921 - DNA, 25 bp, Mus musculus
tactcgtccaggtacaaatagggct

SEQ ID NO: 746922 - DNA, 25 bp, Mus musculus
tactcgtcctatacagagctctgcc

SEQ ID NO: 746923 - DNA, 25 bp, Mus musculus
tactcgtcctattcagagctctgcc

SEQ ID NO: 746924 - DNA, 25 bp, Mus musculus
tactcgtcttttagctgtgctgaga

SEQ ID NO: 746925 - DNA, 25 bp, Mus musculus
tactcgtctttttgctgtgctgaga

SEQ ID NO: 746926 - DNA, 25 bp, Mus musculus
tactcgtgctcgcatatgctgtgac

SEQ ID NO: 746927 - DNA, 25 bp, Mus musculus
tactcgtgctcggatatgctgtgac

SEQ ID NO: 746928 - DNA, 25 bp, Mus musculus
tactcgttatggcagtcccaaaaga

SEQ ID NO: 746929 - DNA, 25 bp, Mus musculus
tactcgttatgggagtcccaaaaga

SEQ ID NO: 746930 - DNA, 25 bp, Mus musculus
tactcgttcagaagctgtattacag

SEQ ID NO: 746931 - DNA, 25 bp, Mus musculus
tactcgttcagatgctgtattacag

SEQ ID NO: 746932 - DNA, 25 bp, Mus musculus
tactcgttttggctccaacaaggga

SEQ ID NO: 746933 - DNA, 25 bp, Mus musculus
tactcgttttgggtccaacaaggga

SEQ ID NO: 746934 - DNA, 25 bp, Mus musculus
tactctaacctcagaagagcggagc

SEQ ID NO: 746935 - DNA, 25 bp, Mus musculus
tactctaacctctgaagagcggagc

SEQ ID NO: 746936 - DNA, 25 bp, Mus musculus
tactctaaggctccaccctgttgtg

SEQ ID NO: 746937 - DNA, 25 bp, Mus musculus
tactctaaggctgcaccctgttgtg

SEQ ID NO: 746938 - DNA, 25 bp, Mus musculus
tactctaagtgacgcttctatgcga

SEQ ID NO: 746939 - DNA, 25 bp, Mus musculus
tactctaagtgaggcttctatgcga

SEQ ID NO: 746940 - DNA, 25 bp, Mus musculus
tactctaagttccagcctcagagcc

SEQ ID NO: 746941 - DNA, 25 bp, Mus musculus
tactctaagttcgagcctcagagcc

SEQ ID NO: 746942 - DNA, 25 bp, Mus musculus
tactctacagatcaccagtgttgtg

SEQ ID NO: 746943 - DNA, 25 bp, Mus musculus
tactctacagatgaccagtgttgtg

SEQ ID NO: 746944 - DNA, 25 bp, Mus musculus
tactctacagtacaggaagccgttg

SEQ ID NO: 746945 - DNA, 25 bp, Mus musculus
tactctacagtagaggaagccgttg

SEQ ID NO: 746946 - DNA, 25 bp, Mus musculus
tactctacattgacatccagaggct

SEQ ID NO: 746947 - DNA, 25 bp, Mus musculus
tactctacattgtcatccagaggct

SEQ ID NO: 746948 - DNA, 25 bp, Mus musculus
tactctaccacgagactgtggcctc

SEQ ID NO: 746949 - DNA, 25 bp, Mus musculus
tactctaccacgtgactgtggcctc

SEQ ID NO: 746950 - DNA, 25 bp, Mus musculus
tactctagaagacatcatgctagcc

SEQ ID NO: 746951 - DNA, 25 bp, Mus musculus
tactctagaagagatcatgctagcc

SEQ ID NO: 746952 - DNA, 25 bp, Mus musculus
tactctagattaatctcattgcagc

SEQ ID NO: 746953 - DNA, 25 bp, Mus musculus
tactctagattattctcattgcagc

SEQ ID NO: 746954 - DNA, 25 bp, Mus musculus
tactctaggtcccagggaaatttga

SEQ ID NO: 746955 - DNA, 25 bp, Mus musculus
tactctaggtccgagggaaatttga

SEQ ID NO: 746956 - DNA, 25 bp, Mus musculus
tactctatatttcggcaggaagccc

SEQ ID NO: 746957 - DNA, 25 bp, Mus musculus
tactctatatttgggcaggaagccc

SEQ ID NO: 746958 - DNA, 25 bp, Mus musculus
tactctatgtcacgttatgggacag

SEQ ID NO: 746959 - DNA, 25 bp, Mus musculus
tactctatgtcaggttatgggacag

SEQ ID NO: 746960 - DNA, 25 bp, Mus musculus
tactctatgtgaagctttggcttct

SEQ ID NO: 746961 - DNA, 25 bp, Mus musculus
tactctatgtgatgctttggcttct

SEQ ID NO: 746962 - DNA, 25 bp, Mus musculus
tactctcacaagcttattggcccat

SEQ ID NO: 746963 - DNA, 25 bp, Mus musculus
tactctcacaaggttattggcccat

SEQ ID NO: 746964 - DNA, 25 bp, Mus musculus
tactctcacctaatgctctgttcct

SEQ ID NO: 746965 - DNA, 25 bp, Mus musculus
tactctcacctattgctctgttcct

SEQ ID NO: 746966 - DNA, 25 bp, Mus musculus
tactctcagaaacttacctggaagc

SEQ ID NO: 746967 - DNA, 25 bp, Mus musculus
tactctcagaaagttacctggaagc

SEQ ID NO: 746968 - DNA, 25 bp, Mus musculus
tactctcagaagcaagacaaatatg

SEQ ID NO: 746969 - DNA, 25 bp, Mus musculus
tactctcagaaggaagacaaatatg

SEQ ID NO: 746970 - DNA, 25 bp, Mus musculus
tactctcatacacatcaaggacgcc

SEQ ID NO: 746971 - DNA, 25 bp, Mus musculus
tactctcatacagatcaaggacgcc

SEQ ID NO: 746972 - DNA, 25 bp, Mus musculus
tactctcatcggaggttcttgaaaa

SEQ ID NO: 746973 - DNA, 25 bp, Mus musculus
tactctcatcggtggttcttgaaaa

SEQ ID NO: 746974 - DNA, 25 bp, Mus musculus
tactctcatgacctctctgacagtc

SEQ ID NO: 746975 - DNA, 25 bp, Mus musculus
tactctcatgacgtctctgacagtc

SEQ ID NO: 746976 - DNA, 25 bp, Mus musculus
tactctccaggacgtgcgacgaact

SEQ ID NO: 746977 - DNA, 25 bp, Mus musculus
tactctccaggaggtgcgacgaact

SEQ ID NO: 746978 - DNA, 25 bp, Mus musculus
tactctcccactcccaggaggaaga

SEQ ID NO: 746979 - DNA, 25 bp, Mus musculus
tactctcccactgccaggaggaaga

SEQ ID NO: 746980 - DNA, 25 bp, Mus musculus
tactctcctgtgaatcacatggaca

SEQ ID NO: 746981 - DNA, 25 bp, Mus musculus
tactctcctgtgtatcacatggaca

SEQ ID NO: 746982 - DNA, 25 bp, Mus musculus
tactctccttgacatcttctccagg

SEQ ID NO: 746983 - DNA, 25 bp, Mus musculus
tactctccttgacctaaaagagtga

SEQ ID NO: 746984 - DNA, 25 bp, Mus musculus
tactctccttgagatcttctccagg

SEQ ID NO: 746985 - DNA, 25 bp, Mus musculus
tactctccttgagctaaaagagtga

SEQ ID NO: 746986 - DNA, 25 bp, Mus musculus
tactctcggtctccatagttgcatc

SEQ ID NO: 746987 - DNA, 25 bp, Mus musculus
tactctcggtctgcatagttgcatc

SEQ ID NO: 746988 - DNA, 25 bp, Mus musculus
tactctctaagtctgtcagtgccta

SEQ ID NO: 746989 - DNA, 25 bp, Mus musculus
tactctctaagtgtgtcagtgccta

SEQ ID NO: 746990 - DNA, 25 bp, Mus musculus
tactctctgaggctttagcaatgga

SEQ ID NO: 746991 - DNA, 25 bp, Mus musculus
tactctctgagggtttagcaatgga

SEQ ID NO: 746992 - DNA, 25 bp, Mus musculus
tactctctgctgcacggaggaacct

SEQ ID NO: 746993 - DNA, 25 bp, Mus musculus
tactctctgctggacggaggaacct

SEQ ID NO: 746994 - DNA, 25 bp, Mus musculus
tactctctggtaaatgcccttttcc

SEQ ID NO: 746995 - DNA, 25 bp, Mus musculus
tactctctggtatatgcccttttcc

SEQ ID NO: 746996 - DNA, 25 bp, Mus musculus
tactctcttgcaaacccctgtattg

SEQ ID NO: 746997 - DNA, 25 bp, Mus musculus
tactctcttgcatacccctgtattg

SEQ ID NO: 746998 - DNA, 25 bp, Mus musculus
tactctctttagcatgttcgcaacc

SEQ ID NO: 746999 - DNA, 25 bp, Mus musculus
tactctctttaggatgttcgcaacc

SEQ ID NO: 747000 - DNA, 25 bp, Mus musculus
tactctgaaaatctcagtcggattc

SEQ ID NO: 747001 - DNA, 25 bp, Mus musculus
tactctgaaaatgtcagtcggattc

SEQ ID NO: 747002 - DNA, 25 bp, Mus musculus
tactctgaacatcctggtcgacatt

SEQ ID NO: 747003 - DNA, 25 bp, Mus musculus
tactctgaacatgctggtcgacatt

SEQ ID NO: 747004 - DNA, 25 bp, Mus musculus
tactctgaagacatgccgcgagaca

SEQ ID NO: 747005 - DNA, 25 bp, Mus musculus
tactctgaagacttgccgcgagaca

SEQ ID NO: 747006 - DNA, 25 bp, Mus musculus
tactctgaagatcggttcaatgcgc

SEQ ID NO: 747007 - DNA, 25 bp, Mus musculus
tactctgaagatgggttcaatgcgc

SEQ ID NO: 747008 - DNA, 25 bp, Mus musculus
tactctgaagcacgcaaatgggtct

SEQ ID NO: 747009 - DNA, 25 bp, Mus musculus
tactctgaagcaggcaaatgggtct

SEQ ID NO: 747010 - DNA, 25 bp, Mus musculus
tactctgacattcctgcgagggcct

SEQ ID NO: 747011 - DNA, 25 bp, Mus musculus
tactctgacattgctgcgagggcct

SEQ ID NO: 747012 - DNA, 25 bp, Mus musculus
tactctgagaacaaacccaggttgg

SEQ ID NO: 747013 - DNA, 25 bp, Mus musculus
tactctgagaactaacccaggttgg

SEQ ID NO: 747014 - DNA, 25 bp, Mus musculus
tactctgagcaccatgacactgaga

SEQ ID NO: 747015 - DNA, 25 bp, Mus musculus
tactctgagcacgatgacactgaga

SEQ ID NO: 747016 - DNA, 25 bp, Mus musculus
tactctgagcatcattcgccaaaac

SEQ ID NO: 747017 - DNA, 25 bp, Mus musculus
tactctgagcatgattcgccaaaac

SEQ ID NO: 747018 - DNA, 25 bp, Mus musculus
tactctgagggtaaagaggaaccac

SEQ ID NO: 747019 - DNA, 25 bp, Mus musculus
tactctgagggttaagaggaaccac

SEQ ID NO: 747020 - DNA, 25 bp, Mus musculus
tactctgatatgaaaagagctttgg

SEQ ID NO: 747021 - DNA, 25 bp, Mus musculus
tactctgatatgtaaagagctttgg

SEQ ID NO: 747022 - DNA, 25 bp, Mus musculus
tactctgcaagcaaggtggctgtca

SEQ ID NO: 747023 - DNA, 25 bp, Mus musculus
tactctgcaagcaagtttgctctgg

SEQ ID NO: 747024 - DNA, 25 bp, Mus musculus
tactctgcaagctaggtggctgtca

SEQ ID NO: 747025 - DNA, 25 bp, Mus musculus
tactctgcaagctagtttgctctgg

SEQ ID NO: 747026 - DNA, 25 bp, Mus musculus
tactctgcatctcgcttaccactgg

SEQ ID NO: 747027 - DNA, 25 bp, Mus musculus
tactctgcatctggcttaccactgg

SEQ ID NO: 747028 - DNA, 25 bp, Mus musculus
tactctgccagtacatggaggaccg

SEQ ID NO: 747029 - DNA, 25 bp, Mus musculus
tactctgccagttcatggaggaccg

SEQ ID NO: 747030 - DNA, 25 bp, Mus musculus
tactctgccgtgcttaaatacttta

SEQ ID NO: 747031 - DNA, 25 bp, Mus musculus
tactctgccgtggttaaatacttta

SEQ ID NO: 747032 - DNA, 25 bp, Mus musculus
tactctgccttcaatctgctcatgc

SEQ ID NO: 747033 - DNA, 25 bp, Mus musculus
tactctgccttctatctgctcatgc

SEQ ID NO: 747034 - DNA, 25 bp, Mus musculus
tactctggagaaactgtatgagcgg

SEQ ID NO: 747035 - DNA, 25 bp, Mus musculus
tactctggagaatctgtatgagcgg

SEQ ID NO: 747036 - DNA, 25 bp, Mus musculus
tactctggatctagggactctactg

SEQ ID NO: 747037 - DNA, 25 bp, Mus musculus
tactctggatcttgggactctactg

SEQ ID NO: 747038 - DNA, 25 bp, Mus musculus
tactctggcttcacgctggatgagg

SEQ ID NO: 747039 - DNA, 25 bp, Mus musculus
tactctggcttctcgctggatgagg

SEQ ID NO: 747040 - DNA, 25 bp, Mus musculus
tactctgggtcccatgctgggagca

SEQ ID NO: 747041 - DNA, 25 bp, Mus musculus
tactctgggtccgatgctgggagca

SEQ ID NO: 747042 - DNA, 25 bp, Mus musculus
tactctgggtgtctgcaagtacacg

SEQ ID NO: 747043 - DNA, 25 bp, Mus musculus
tactctgggtgtgtgcaagtacacg

SEQ ID NO: 747044 - DNA, 25 bp, Mus musculus
tactctggtggtagccttggcctaa

SEQ ID NO: 747045 - DNA, 25 bp, Mus musculus
tactctggtggttgccttggcctaa

SEQ ID NO: 747046 - DNA, 25 bp, Mus musculus
tactctggtgtgatgacatgctcaa

SEQ ID NO: 747047 - DNA, 25 bp, Mus musculus
tactctggtgtgttgacatgctcaa

SEQ ID NO: 747048 - DNA, 25 bp, Mus musculus
tactctgtatgcctaaggatgcggc

SEQ ID NO: 747049 - DNA, 25 bp, Mus musculus
tactctgtatgcgtaaggatgcggc

SEQ ID NO: 747050 - DNA, 25 bp, Mus musculus
tactctgtcctactttaaagcctgg

SEQ ID NO: 747051 - DNA, 25 bp, Mus musculus
tactctgtcctagtttaaagcctgg

SEQ ID NO: 747052 - DNA, 25 bp, Mus musculus
tactctgtgacaaatttagtggcca

SEQ ID NO: 747053 - DNA, 25 bp, Mus musculus
tactctgtgacatatttagtggcca

SEQ ID NO: 747054 - DNA, 25 bp, Mus musculus
tactctgtgtatactgtggaggact

SEQ ID NO: 747055 - DNA, 25 bp, Mus musculus
tactctgtgtattctgtggaggact

SEQ ID NO: 747056 - DNA, 25 bp, Mus musculus
tactctgtgtggatgggtgctctgc

SEQ ID NO: 747057 - DNA, 25 bp, Mus musculus
tactctgtgtggttgggtgctctgc

SEQ ID NO: 747058 - DNA, 25 bp, Mus musculus
tactctgtgttaactaggctttctg

SEQ ID NO: 747059 - DNA, 25 bp, Mus musculus
tactctgtgttatctaggctttctg

SEQ ID NO: 747060 - DNA, 25 bp, Mus musculus
tactcttcatttagtccatccattg

SEQ ID NO: 747061 - DNA, 25 bp, Mus musculus
tactcttcattttgtccatccattg

SEQ ID NO: 747062 - DNA, 25 bp, Mus musculus
tactcttctcatccgagggtcccaa

SEQ ID NO: 747063 - DNA, 25 bp, Mus musculus
tactcttctcatgcgagggtcccaa

SEQ ID NO: 747064 - DNA, 25 bp, Mus musculus
tactcttctccacgctatgtgctct

SEQ ID NO: 747065 - DNA, 25 bp, Mus musculus
tactcttctccaggctatgtgctct

SEQ ID NO: 747066 - DNA, 25 bp, Mus musculus
tactcttggccaatatagcccactg

SEQ ID NO: 747067 - DNA, 25 bp, Mus musculus
tactcttggccattatagcccactg

SEQ ID NO: 747068 - DNA, 25 bp, Mus musculus
tactcttgtccgattgatggcatga

SEQ ID NO: 747069 - DNA, 25 bp, Mus musculus
tactcttgtccgtttgatggcatga

SEQ ID NO: 747070 - DNA, 25 bp, Mus musculus
tactcttgttggctagacaatgcca

SEQ ID NO: 747071 - DNA, 25 bp, Mus musculus
tactcttgttgggtagacaatgcca

SEQ ID NO: 747072 - DNA, 25 bp, Mus musculus
tactctttctggagagtgagtgact

SEQ ID NO: 747073 - DNA, 25 bp, Mus musculus
tactctttctggtgagtgagtgact

SEQ ID NO: 747074 - DNA, 25 bp, Mus musculus
tactctttgaagactagctcatggg

SEQ ID NO: 747075 - DNA, 25 bp, Mus musculus
tactctttgaagtctagctcatggg

SEQ ID NO: 747076 - DNA, 25 bp, Mus musculus
tactgaaaagaactctgcctctgag

SEQ ID NO: 747077 - DNA, 25 bp, Mus musculus
tactgaaaagaagtctgcctctgag

SEQ ID NO: 747078 - DNA, 25 bp, Mus musculus
tactgaaaagagatcacccgagtcc

SEQ ID NO: 747079 - DNA, 25 bp, Mus musculus
tactgaaaagagttcacccgagtcc

SEQ ID NO: 747080 - DNA, 25 bp, Mus musculus
tactgaaacagtatgggatcgatgg

SEQ ID NO: 747081 - DNA, 25 bp, Mus musculus
tactgaaacagtttgggatcgatgg

SEQ ID NO: 747082 - DNA, 25 bp, Mus musculus
tactgaaagataagaaccagagttc

SEQ ID NO: 747083 - DNA, 25 bp, Mus musculus
tactgaaagatatgaaccagagttc

SEQ ID NO: 747084 - DNA, 25 bp, Mus musculus
tactgaaagtccagctagtctaaag

SEQ ID NO: 747085 - DNA, 25 bp, Mus musculus
tactgaaagtcctgctagtctaaag

SEQ ID NO: 747086 - DNA, 25 bp, Mus musculus
tactgaaagtgactgcacactccgc

SEQ ID NO: 747087 - DNA, 25 bp, Mus musculus
tactgaaagtgagtgcacactccgc

SEQ ID NO: 747088 - DNA, 25 bp, Mus musculus
tactgaaatgggaacaacttaagga

SEQ ID NO: 747089 - DNA, 25 bp, Mus musculus
tactgaaatgggtacaacttaagga

SEQ ID NO: 747090 - DNA, 25 bp, Mus musculus
tactgaaatgtgaacctctgcctgg

SEQ ID NO: 747091 - DNA, 25 bp, Mus musculus
tactgaaatgtgtacctctgcctgg

SEQ ID NO: 747092 - DNA, 25 bp, Mus musculus
tactgaacaaaaatacctaacattg

SEQ ID NO: 747093 - DNA, 25 bp, Mus musculus
tactgaacaaaattacctaacattg

SEQ ID NO: 747094 - DNA, 25 bp, Mus musculus
tactgaacactccaccgacggtgtc

SEQ ID NO: 747095 - DNA, 25 bp, Mus musculus
tactgaacactcgaccgacggtgtc

SEQ ID NO: 747096 - DNA, 25 bp, Mus musculus
tactgaacaggaactcgttcttcca

SEQ ID NO: 747097 - DNA, 25 bp, Mus musculus
tactgaacaggatctcgttcttcca

SEQ ID NO: 747098 - DNA, 25 bp, Mus musculus
tactgaaccaccagggtttactctg

SEQ ID NO: 747099 - DNA, 25 bp, Mus musculus
tactgaaccacctgggtttactctg

SEQ ID NO: 747100 - DNA, 25 bp, Mus musculus
tactgaaccagcaggacggctttca

SEQ ID NO: 747101 - DNA, 25 bp, Mus musculus
tactgaaccagctggacggctttca

SEQ ID NO: 747102 - DNA, 25 bp, Mus musculus
tactgaacgtgcatgaggtcctgaa

SEQ ID NO: 747103 - DNA, 25 bp, Mus musculus
tactgaacgtgcttgaggtcctgaa

SEQ ID NO: 747104 - DNA, 25 bp, Mus musculus
tactgaactgaacgatggagacaca

SEQ ID NO: 747105 - DNA, 25 bp, Mus musculus
tactgaactgaaggatggagacaca

SEQ ID NO: 747106 - DNA, 25 bp, Mus musculus
tactgaactgggaaagctaggagac

SEQ ID NO: 747107 - DNA, 25 bp, Mus musculus
tactgaactgggtaagctaggagac

SEQ ID NO: 747108 - DNA, 25 bp, Mus musculus
tactgaacttatcaaaccatggcgg

SEQ ID NO: 747109 - DNA, 25 bp, Mus musculus
tactgaacttatgaaaccatggcgg

SEQ ID NO: 747110 - DNA, 25 bp, Mus musculus
tactgaagaacaagacctcacctta

SEQ ID NO: 747111 - DNA, 25 bp, Mus musculus
tactgaagaacatgacctcacctta

SEQ ID NO: 747112 - DNA, 25 bp, Mus musculus
tactgaagacaacatgagaacactg

SEQ ID NO: 747113 - DNA, 25 bp, Mus musculus
tactgaagacaagatgagaacactg

SEQ ID NO: 747114 - DNA, 25 bp, Mus musculus
tactgaagactgcagtaaaagatct

SEQ ID NO: 747115 - DNA, 25 bp, Mus musculus
tactgaagactggagtaaaagatct

SEQ ID NO: 747116 - DNA, 25 bp, Mus musculus
tactgaagaggacgtaagacagcca

SEQ ID NO: 747117 - DNA, 25 bp, Mus musculus
tactgaagaggaggtaagacagcca

SEQ ID NO: 747118 - DNA, 25 bp, Mus musculus
tactgaagatgacagatcggagcca

SEQ ID NO: 747119 - DNA, 25 bp, Mus musculus
tactgaagatgagagatcggagcca

SEQ ID NO: 747120 - DNA, 25 bp, Mus musculus
tactgaagattaagcccaggcaggg

SEQ ID NO: 747121 - DNA, 25 bp, Mus musculus
tactgaagattatgcccaggcaggg

SEQ ID NO: 747122 - DNA, 25 bp, Mus musculus
tactgaagcagtagagaaatgacct

SEQ ID NO: 747123 - DNA, 25 bp, Mus musculus
tactgaagcagttgagaaatgacct

SEQ ID NO: 747124 - DNA, 25 bp, Mus musculus
tactgaagcctaagcagcgtgtcac

SEQ ID NO: 747125 - DNA, 25 bp, Mus musculus
tactgaagcctatgcagcgtgtcac

SEQ ID NO: 747126 - DNA, 25 bp, Mus musculus
tactgaaggacaccaggttgcatgc

SEQ ID NO: 747127 - DNA, 25 bp, Mus musculus
tactgaaggacagcaggttgcatgc

SEQ ID NO: 747128 - DNA, 25 bp, Mus musculus
tactgaagggctattatacagctcc

SEQ ID NO: 747129 - DNA, 25 bp, Mus musculus
tactgaagggcttttatacagctcc

SEQ ID NO: 747130 - DNA, 25 bp, Mus musculus
tactgaagtcagcaagaagtttcct

SEQ ID NO: 747131 - DNA, 25 bp, Mus musculus
tactgaagtcaggaagaagtttcct

SEQ ID NO: 747132 - DNA, 25 bp, Mus musculus
tactgaagtgccacacatcctgtac

SEQ ID NO: 747133 - DNA, 25 bp, Mus musculus
tactgaagtgcctcacatcctgtac

SEQ ID NO: 747134 - DNA, 25 bp, Mus musculus
tactgaatagttataccctgttagg

SEQ ID NO: 747135 - DNA, 25 bp, Mus musculus
tactgaatagttttaccctgttagg

SEQ ID NO: 747136 - DNA, 25 bp, Mus musculus
tactgaatatgaaataatggaggag

SEQ ID NO: 747137 - DNA, 25 bp, Mus musculus
tactgaatatgatataatggaggag

SEQ ID NO: 747138 - DNA, 25 bp, Mus musculus
tactgaatattcaaatgagaagaac

SEQ ID NO: 747139 - DNA, 25 bp, Mus musculus
tactgaatattctaatgagaagaac

SEQ ID NO: 747140 - DNA, 25 bp, Mus musculus
tactgaatgagtccaagtacatctg

SEQ ID NO: 747141 - DNA, 25 bp, Mus musculus
tactgaatgagtgcaagtacatctg

SEQ ID NO: 747142 - DNA, 25 bp, Mus musculus
tactgaatttggaaaaatgcaaaat

SEQ ID NO: 747143 - DNA, 25 bp, Mus musculus
tactgaatttggtaaaatgcaaaat

SEQ ID NO: 747144 - DNA, 25 bp, Mus musculus
tactgacaaggaagctcgagactgt

SEQ ID NO: 747145 - DNA, 25 bp, Mus musculus
tactgacaaggatgctcgagactgt

SEQ ID NO: 747146 - DNA, 25 bp, Mus musculus
tactgacaatgaatatgtagaggcc

SEQ ID NO: 747147 - DNA, 25 bp, Mus musculus
tactgacaatgattatgtagaggcc

SEQ ID NO: 747148 - DNA, 25 bp, Mus musculus
tactgacacgtgaacgaaaccctct

SEQ ID NO: 747149 - DNA, 25 bp, Mus musculus
tactgacacgtgtacgaaaccctct

SEQ ID NO: 747150 - DNA, 25 bp, Mus musculus
tactgacacttgcaaattgcctgga

SEQ ID NO: 747151 - DNA, 25 bp, Mus musculus
tactgacacttggaaattgcctgga

SEQ ID NO: 747152 - DNA, 25 bp, Mus musculus
tactgacagcagacaagacacgtca

SEQ ID NO: 747153 - DNA, 25 bp, Mus musculus
tactgacagcagtcaagacacgtca

SEQ ID NO: 747154 - DNA, 25 bp, Mus musculus
tactgacagggtctccagtgacagt

SEQ ID NO: 747155 - DNA, 25 bp, Mus musculus
tactgacagggtgtccagtgacagt

SEQ ID NO: 747156 - DNA, 25 bp, Mus musculus
tactgaccctgtcgcggcggcactg

SEQ ID NO: 747157 - DNA, 25 bp, Mus musculus
tactgaccctgtggcggcggcactg

SEQ ID NO: 747158 - DNA, 25 bp, Mus musculus
tactgaccgcacagatgcgccttgt

SEQ ID NO: 747159 - DNA, 25 bp, Mus musculus
tactgaccgcactgatgcgccttgt

SEQ ID NO: 747160 - DNA, 25 bp, Mus musculus
tactgaccgcctctttagttacacg

SEQ ID NO: 747161 - DNA, 25 bp, Mus musculus
tactgaccgcctgtttagttacacg

SEQ ID NO: 747162 - DNA, 25 bp, Mus musculus
tactgacctcctcatgctgctgaca

SEQ ID NO: 747163 - DNA, 25 bp, Mus musculus
tactgacctcctgatgctgctgaca

SEQ ID NO: 747164 - DNA, 25 bp, Mus musculus
tactgacgtgatacactaccagcca

SEQ ID NO: 747165 - DNA, 25 bp, Mus musculus
tactgacgtgattcactaccagcca

SEQ ID NO: 747166 - DNA, 25 bp, Mus musculus
tactgactcaggaggccaaacatgc

SEQ ID NO: 747167 - DNA, 25 bp, Mus musculus
tactgactcaggtggccaaacatgc

SEQ ID NO: 747168 - DNA, 25 bp, Mus musculus
tactgactcggccagaggtcccttc

SEQ ID NO: 747169 - DNA, 25 bp, Mus musculus
tactgactcggcgagaggtcccttc

SEQ ID NO: 747170 - DNA, 25 bp, Mus musculus
tactgactctacacgggatgccttc

SEQ ID NO: 747171 - DNA, 25 bp, Mus musculus
tactgactctactcgggatgccttc

SEQ ID NO: 747172 - DNA, 25 bp, Mus musculus
tactgactgaagctcggatgggtcc

SEQ ID NO: 747173 - DNA, 25 bp, Mus musculus
tactgactgaaggtcggatgggtcc

SEQ ID NO: 747174 - DNA, 25 bp, Mus musculus
tactgactgctcactgaaaggctca

SEQ ID NO: 747175 - DNA, 25 bp, Mus musculus
tactgactgctctctgaaaggctca

SEQ ID NO: 747176 - DNA, 25 bp, Mus musculus
tactgactgctgagcccctggtcct

SEQ ID NO: 747177 - DNA, 25 bp, Mus musculus
tactgactgctgcacaaactttgtg

SEQ ID NO: 747178 - DNA, 25 bp, Mus musculus
tactgactgctggacaaactttgtg

SEQ ID NO: 747179 - DNA, 25 bp, Mus musculus
tactgactgctgtgcccctggtcct

SEQ ID NO: 747180 - DNA, 25 bp, Mus musculus
tactgactgtacaaaatacctatgg

SEQ ID NO: 747181 - DNA, 25 bp, Mus musculus
tactgactgtactaaatacctatgg

SEQ ID NO: 747182 - DNA, 25 bp, Mus musculus
tactgactgtttacaggcagggccg

SEQ ID NO: 747183 - DNA, 25 bp, Mus musculus
tactgactgttttcaggcagggccg

SEQ ID NO: 747184 - DNA, 25 bp, Mus musculus
tactgacttagactgctgactgcca

SEQ ID NO: 747185 - DNA, 25 bp, Mus musculus
tactgacttagagtgctgactgcca

SEQ ID NO: 747186 - DNA, 25 bp, Mus musculus
tactgacttatacgagggtcctttg

SEQ ID NO: 747187 - DNA, 25 bp, Mus musculus
tactgacttataggagggtcctttg

SEQ ID NO: 747188 - DNA, 25 bp, Mus musculus
tactgacttgtcactagcctggtgc

SEQ ID NO: 747189 - DNA, 25 bp, Mus musculus
tactgacttgtctctagcctggtgc

SEQ ID NO: 747190 - DNA, 25 bp, Mus musculus
tactgactttctagggccccttcct

SEQ ID NO: 747191 - DNA, 25 bp, Mus musculus
tactgactttcttgggccccttcct

SEQ ID NO: 747192 - DNA, 25 bp, Mus musculus
tactgacttttacttcttggacttc

SEQ ID NO: 747193 - DNA, 25 bp, Mus musculus
tactgacttttagttcttggacttc

SEQ ID NO: 747194 - DNA, 25 bp, Mus musculus
tactgagaaccgagtcctgcagaac

SEQ ID NO: 747195 - DNA, 25 bp, Mus musculus
tactgagaaccgtgtcctgcagaac

SEQ ID NO: 747196 - DNA, 25 bp, Mus musculus
tactgagaacgtactgcgtgatcct

SEQ ID NO: 747197 - DNA, 25 bp, Mus musculus
tactgagaacgttctgcgtgatcct

SEQ ID NO: 747198 - DNA, 25 bp, Mus musculus
tactgagaataacacctacgtgcct

SEQ ID NO: 747199 - DNA, 25 bp, Mus musculus
tactgagaataagacctacgtgcct

SEQ ID NO: 747200 - DNA, 25 bp, Mus musculus
tactgagaatgacaggagccgtcaa

SEQ ID NO: 747201 - DNA, 25 bp, Mus musculus
tactgagaatgagaggagccgtcaa

SEQ ID NO: 747202 - DNA, 25 bp, Mus musculus
tactgagataggagccattggttgg

SEQ ID NO: 747203 - DNA, 25 bp, Mus musculus
tactgagataggtgccattggttgg

SEQ ID NO: 747204 - DNA, 25 bp, Mus musculus
tactgagatggtacatcaggagaac

SEQ ID NO: 747205 - DNA, 25 bp, Mus musculus
tactgagatggttcatcaggagaac

SEQ ID NO: 747206 - DNA, 25 bp, Mus musculus
tactgagcctgtaaatgaggtttgc

SEQ ID NO: 747207 - DNA, 25 bp, Mus musculus
tactgagcctgttaatgaggtttgc

SEQ ID NO: 747208 - DNA, 25 bp, Mus musculus
tactgagcggctcgaggtctctgct

SEQ ID NO: 747209 - DNA, 25 bp, Mus musculus
tactgagcggctggaggtctctgct

SEQ ID NO: 747210 - DNA, 25 bp, Mus musculus
tactgagctctgcaagtgacacacc

SEQ ID NO: 747211 - DNA, 25 bp, Mus musculus
tactgagctctggaagtgacacacc

SEQ ID NO: 747212 - DNA, 25 bp, Mus musculus
tactgagctggcagatccatcatgg

SEQ ID NO: 747213 - DNA, 25 bp, Mus musculus
tactgagctggctgatccatcatgg

SEQ ID NO: 747214 - DNA, 25 bp, Mus musculus
tactgaggaattcgcaactcctggc

SEQ ID NO: 747215 - DNA, 25 bp, Mus musculus
tactgaggaattggcaactcctggc

SEQ ID NO: 747216 - DNA, 25 bp, Mus musculus
tactgaggaccgagaaacctgagtt

SEQ ID NO: 747217 - DNA, 25 bp, Mus musculus
tactgaggaccgtgaaacctgagtt

SEQ ID NO: 747218 - DNA, 25 bp, Mus musculus
tactgaggaggcctgcatgtttgct

SEQ ID NO: 747219 - DNA, 25 bp, Mus musculus
tactgaggaggcgtgcatgtttgct

SEQ ID NO: 747220 - DNA, 25 bp, Mus musculus
tactgaggagtcatcacccagcctg

SEQ ID NO: 747221 - DNA, 25 bp, Mus musculus
tactgaggagtcttcacccagcctg

SEQ ID NO: 747222 - DNA, 25 bp, Mus musculus
tactgaggctgtcattggccagaag

SEQ ID NO: 747223 - DNA, 25 bp, Mus musculus
tactgaggctgtgattggccagaag

SEQ ID NO: 747224 - DNA, 25 bp, Mus musculus
tactgagggaaaatcgtgtgttcca

SEQ ID NO: 747225 - DNA, 25 bp, Mus musculus
tactgagggaaattcgtgtgttcca

SEQ ID NO: 747226 - DNA, 25 bp, Mus musculus
tactgagggcttccgtgcctttcgg

SEQ ID NO: 747227 - DNA, 25 bp, Mus musculus
tactgagggcttgcgtgcctttcgg

SEQ ID NO: 747228 - DNA, 25 bp, Mus musculus
tactgaggtaccagtgtcctgggac

SEQ ID NO: 747229 - DNA, 25 bp, Mus musculus
tactgaggtacctgtgtcctgggac

SEQ ID NO: 747230 - DNA, 25 bp, Mus musculus
tactgagtccaacaacatagcaatt

SEQ ID NO: 747231 - DNA, 25 bp, Mus musculus
tactgagtccaagaacatagcaatt

SEQ ID NO: 747232 - DNA, 25 bp, Mus musculus
tactgagtccagacctgtgacagga

SEQ ID NO: 747233 - DNA, 25 bp, Mus musculus
tactgagtccagtcctgtgacagga

SEQ ID NO: 747234 - DNA, 25 bp, Mus musculus
tactgagtgactacgccttgcaaag

SEQ ID NO: 747235 - DNA, 25 bp, Mus musculus
tactgagtgacttcgccttgcaaag

SEQ ID NO: 747236 - DNA, 25 bp, Mus musculus
tactgagtgcatcgatgtaggcact

SEQ ID NO: 747237 - DNA, 25 bp, Mus musculus
tactgagtgcatggatgtaggcact

SEQ ID NO: 747238 - DNA, 25 bp, Mus musculus
tactgatcaaacagtctgtattcgt

SEQ ID NO: 747239 - DNA, 25 bp, Mus musculus
tactgatcaaactgtctgtattcgt

SEQ ID NO: 747240 - DNA, 25 bp, Mus musculus
tactgatcatggagctaatcaacaa

SEQ ID NO: 747241 - DNA, 25 bp, Mus musculus
tactgatcatggtgctaatcaacaa

SEQ ID NO: 747242 - DNA, 25 bp, Mus musculus
tactgatccccaaggagagcaactg

SEQ ID NO: 747243 - DNA, 25 bp, Mus musculus
tactgatccccatggagagcaactg

SEQ ID NO: 747244 - DNA, 25 bp, Mus musculus
tactgatcctgaagtctgcagacca

SEQ ID NO: 747245 - DNA, 25 bp, Mus musculus
tactgatcctgatgtctgcagacca

SEQ ID NO: 747246 - DNA, 25 bp, Mus musculus
tactgatccttcctcagatcatggc

SEQ ID NO: 747247 - DNA, 25 bp, Mus musculus
tactgatccttcgtcagatcatggc

SEQ ID NO: 747248 - DNA, 25 bp, Mus musculus
tactgatgaattcatagctgaggcc

SEQ ID NO: 747249 - DNA, 25 bp, Mus musculus
tactgatgaattgatagctgaggcc

SEQ ID NO: 747250 - DNA, 25 bp, Mus musculus
tactgatgacgtcatgctcctggac

SEQ ID NO: 747251 - DNA, 25 bp, Mus musculus
tactgatgacgtgatgctcctggac

SEQ ID NO: 747252 - DNA, 25 bp, Mus musculus
tactgatgacttagctcatgaaatg

SEQ ID NO: 747253 - DNA, 25 bp, Mus musculus
tactgatgactttgctcatgaaatg

SEQ ID NO: 747254 - DNA, 25 bp, Mus musculus
tactgatgatgacgtacgggaccga

SEQ ID NO: 747255 - DNA, 25 bp, Mus musculus
tactgatgatgaggtacgggaccga

SEQ ID NO: 747256 - DNA, 25 bp, Mus musculus
tactgatgctccacctgcatattca

SEQ ID NO: 747257 - DNA, 25 bp, Mus musculus
tactgatgctcctcctgcatattca

SEQ ID NO: 747258 - DNA, 25 bp, Mus musculus
tactgatgctctccacggtgtgcct

SEQ ID NO: 747259 - DNA, 25 bp, Mus musculus
tactgatgctctgcacggtgtgcct

SEQ ID NO: 747260 - DNA, 25 bp, Mus musculus
tactgatgctgtagatggtctacgc

SEQ ID NO: 747261 - DNA, 25 bp, Mus musculus
tactgatgctgttgatggtctacgc

SEQ ID NO: 747262 - DNA, 25 bp, Mus musculus
tactgatgttgtccgagggaacccc

SEQ ID NO: 747263 - DNA, 25 bp, Mus musculus
tactgatgttgtgcgagggaacccc

SEQ ID NO: 747264 - DNA, 25 bp, Mus musculus
tactgattgcccatggaagcctgca

SEQ ID NO: 747265 - DNA, 25 bp, Mus musculus
tactgattgcccttggaagcctgca

SEQ ID NO: 747266 - DNA, 25 bp, Mus musculus
tactgattgctcaagagaaggaaag

SEQ ID NO: 747267 - DNA, 25 bp, Mus musculus
tactgattgctctagagaaggaaag

SEQ ID NO: 747268 - DNA, 25 bp, Mus musculus
tactgattgcttcctttctcttgca

SEQ ID NO: 747269 - DNA, 25 bp, Mus musculus
tactgattgcttgctttctcttgca

SEQ ID NO: 747270 - DNA, 25 bp, Mus musculus
tactgattggtgacgggaagctttt

SEQ ID NO: 747271 - DNA, 25 bp, Mus musculus
tactgattggtgtcgggaagctttt

SEQ ID NO: 747272 - DNA, 25 bp, Mus musculus
tactgcaaacacaagtaccctgagc

SEQ ID NO: 747273 - DNA, 25 bp, Mus musculus
tactgcaaacactagtaccctgagc

SEQ ID NO: 747274 - DNA, 25 bp, Mus musculus
tactgcaaacatcgtcaacgtacca

SEQ ID NO: 747275 - DNA, 25 bp, Mus musculus
tactgcaaacatggtcaacgtacca

SEQ ID NO: 747276 - DNA, 25 bp, Mus musculus
tactgcaaacctacgggagaatggg

SEQ ID NO: 747277 - DNA, 25 bp, Mus musculus
tactgcaaaccttcgggagaatggg

SEQ ID NO: 747278 - DNA, 25 bp, Mus musculus
tactgcaaataaatggaccctgagc

SEQ ID NO: 747279 - DNA, 25 bp, Mus musculus
tactgcaaataattggaccctgagc

SEQ ID NO: 747280 - DNA, 25 bp, Mus musculus
tactgcaagagcagaccactggtgt

SEQ ID NO: 747281 - DNA, 25 bp, Mus musculus
tactgcaagagctgaccactggtgt

SEQ ID NO: 747282 - DNA, 25 bp, Mus musculus
tactgcaaggccagtcatgatgacg

SEQ ID NO: 747283 - DNA, 25 bp, Mus musculus
tactgcaaggcctgtcatgatgacg

SEQ ID NO: 747284 - DNA, 25 bp, Mus musculus
tactgcaagtccattgaatccatta

SEQ ID NO: 747285 - DNA, 25 bp, Mus musculus
tactgcaagtcctttgaatccatta

SEQ ID NO: 747286 - DNA, 25 bp, Mus musculus
tactgcaagtgcacgaaatgacatc

SEQ ID NO: 747287 - DNA, 25 bp, Mus musculus
tactgcaagtgcctctggatcagag

SEQ ID NO: 747288 - DNA, 25 bp, Mus musculus
tactgcaagtgcgtctggatcagag

SEQ ID NO: 747289 - DNA, 25 bp, Mus musculus
tactgcaagtgctcgaaatgacatc

SEQ ID NO: 747290 - DNA, 25 bp, Mus musculus
tactgcaatggcaaatcggacaatt

SEQ ID NO: 747291 - DNA, 25 bp, Mus musculus
tactgcaatggctaatcggacaatt

SEQ ID NO: 747292 - DNA, 25 bp, Mus musculus
tactgcacgcttagaaaatgagaga

SEQ ID NO: 747293 - DNA, 25 bp, Mus musculus
tactgcacgctttgaaaatgagaga

SEQ ID NO: 747294 - DNA, 25 bp, Mus musculus
tactgcactctacaagcccttgaac

SEQ ID NO: 747295 - DNA, 25 bp, Mus musculus
tactgcactctagaagcccttgaac

SEQ ID NO: 747296 - DNA, 25 bp, Mus musculus
tactgcactgacctggctgctgact

SEQ ID NO: 747297 - DNA, 25 bp, Mus musculus
tactgcactgacgtggctgctgact

SEQ ID NO: 747298 - DNA, 25 bp, Mus musculus
tactgcagaagacacattggaacat

SEQ ID NO: 747299 - DNA, 25 bp, Mus musculus
tactgcagaagagacattggaacat

SEQ ID NO: 747300 - DNA, 25 bp, Mus musculus
tactgcagcctgcacgaggaactgg

SEQ ID NO: 747301 - DNA, 25 bp, Mus musculus
tactgcagcctggacgaggaactgg

SEQ ID NO: 747302 - DNA, 25 bp, Mus musculus
tactgcagctttcgaaaccacagct

SEQ ID NO: 747303 - DNA, 25 bp, Mus musculus
tactgcagctttggaaaccacagct

SEQ ID NO: 747304 - DNA, 25 bp, Mus musculus
tactgcaggatactagaaaggttcc

SEQ ID NO: 747305 - DNA, 25 bp, Mus musculus
tactgcaggatagtagaaaggttcc

SEQ ID NO: 747306 - DNA, 25 bp, Mus musculus
tactgcaggcttaagaagtgcttcc

SEQ ID NO: 747307 - DNA, 25 bp, Mus musculus
tactgcaggctttagaagtgcttcc

SEQ ID NO: 747308 - DNA, 25 bp, Mus musculus
tactgcagggttccagtgtgatgca

SEQ ID NO: 747309 - DNA, 25 bp, Mus musculus
tactgcagggttgcagtgtgatgca

SEQ ID NO: 747310 - DNA, 25 bp, Mus musculus
tactgcagtaccaatggccctggag

SEQ ID NO: 747311 - DNA, 25 bp, Mus musculus
tactgcagtacctatggccctggag

SEQ ID NO: 747312 - DNA, 25 bp, Mus musculus
tactgcagtcgcaatgtcaatgccc

SEQ ID NO: 747313 - DNA, 25 bp, Mus musculus
tactgcagtcgcattcgtgtggctt

SEQ ID NO: 747314 - DNA, 25 bp, Mus musculus
tactgcagtcgctatgtcaatgccc

SEQ ID NO: 747315 - DNA, 25 bp, Mus musculus
tactgcagtcgctttcgtgtggctt

SEQ ID NO: 747316 - DNA, 25 bp, Mus musculus
tactgcagtgaaccaaccttggatg

SEQ ID NO: 747317 - DNA, 25 bp, Mus musculus
tactgcagtgaagcaaccttggatg

SEQ ID NO: 747318 - DNA, 25 bp, Mus musculus
tactgcagtgagcttcgatcgctgg

SEQ ID NO: 747319 - DNA, 25 bp, Mus musculus
tactgcagtgaggttcgatcgctgg

SEQ ID NO: 747320 - DNA, 25 bp, Mus musculus
tactgcatcattcgcgtcacaattt

SEQ ID NO: 747321 - DNA, 25 bp, Mus musculus
tactgcatcattggcgtcacaattt

SEQ ID NO: 747322 - DNA, 25 bp, Mus musculus
tactgcatcgtgaacgacagcaaca

SEQ ID NO: 747323 - DNA, 25 bp, Mus musculus
tactgcatcgtgtacgacagcaaca

SEQ ID NO: 747324 - DNA, 25 bp, Mus musculus
tactgcatctgtcgcaaaccggaca

SEQ ID NO: 747325 - DNA, 25 bp, Mus musculus
tactgcatctgtggcaaaccggaca

SEQ ID NO: 747326 - DNA, 25 bp, Mus musculus
tactgcatgccgcagaacaacggcg

SEQ ID NO: 747327 - DNA, 25 bp, Mus musculus
tactgcatgccggagaacaacggcg

SEQ ID NO: 747328 - DNA, 25 bp, Mus musculus
tactgccacctccatgagagcctgg

SEQ ID NO: 747329 - DNA, 25 bp, Mus musculus
tactgccacctcgatgagagcctgg

SEQ ID NO: 747330 - DNA, 25 bp, Mus musculus
tactgccaggagaggtatgctcgtc

SEQ ID NO: 747331 - DNA, 25 bp, Mus musculus
tactgccaggagtggtatgctcgtc

SEQ ID NO: 747332 - DNA, 25 bp, Mus musculus
tactgccaggtgctaaaggcggaca

SEQ ID NO: 747333 - DNA, 25 bp, Mus musculus
tactgccaggtggtaaaggcggaca

SEQ ID NO: 747334 - DNA, 25 bp, Mus musculus
tactgccatcccaaaagctggtgag

SEQ ID NO: 747335 - DNA, 25 bp, Mus musculus
tactgccatccctaaagctggtgag

SEQ ID NO: 747336 - DNA, 25 bp, Mus musculus
tactgccatgcgaaactcgtatgac

SEQ ID NO: 747337 - DNA, 25 bp, Mus musculus
tactgccatgcgtaactcgtatgac

SEQ ID NO: 747338 - DNA, 25 bp, Mus musculus
tactgcccatgcatacaggtgctgt

SEQ ID NO: 747339 - DNA, 25 bp, Mus musculus
tactgcccatgcttacaggtgctgt

SEQ ID NO: 747340 - DNA, 25 bp, Mus musculus
tactgcccattacaagttgacctcc

SEQ ID NO: 747341 - DNA, 25 bp, Mus musculus
tactgcccattagaagttgacctcc

SEQ ID NO: 747342 - DNA, 25 bp, Mus musculus
tactgccccagcatgaacatagagg

SEQ ID NO: 747343 - DNA, 25 bp, Mus musculus
tactgccccagcttgaacatagagg

SEQ ID NO: 747344 - DNA, 25 bp, Mus musculus
tactgccccgctatgaagctttgac

SEQ ID NO: 747345 - DNA, 25 bp, Mus musculus
tactgccccgctttgaagctttgac

SEQ ID NO: 747346 - DNA, 25 bp, Mus musculus
tactgccctgaaagtgattgtcgag

SEQ ID NO: 747347 - DNA, 25 bp, Mus musculus
tactgccctgaatgtgattgtcgag

SEQ ID NO: 747348 - DNA, 25 bp, Mus musculus
tactgccgcctgaggcgatggcccg

SEQ ID NO: 747349 - DNA, 25 bp, Mus musculus
tactgccgcctgtggcgatggcccg

SEQ ID NO: 747350 - DNA, 25 bp, Mus musculus
tactgccgctagacttcggccgcta

SEQ ID NO: 747351 - DNA, 25 bp, Mus musculus
tactgccgctagtcttcggccgcta

SEQ ID NO: 747352 - DNA, 25 bp, Mus musculus
tactgccggcaacctgactgttgtc

SEQ ID NO: 747353 - DNA, 25 bp, Mus musculus
tactgccggcaagctgactgttgtc

SEQ ID NO: 747354 - DNA, 25 bp, Mus musculus
tactgccggcccatgtagctttacc

SEQ ID NO: 747355 - DNA, 25 bp, Mus musculus
tactgccggcccttgtagctttacc

SEQ ID NO: 747356 - DNA, 25 bp, Mus musculus
tactgccgtgagaacaccatgtgtg

SEQ ID NO: 747357 - DNA, 25 bp, Mus musculus
tactgccgtgagtacaccatgtgtg

SEQ ID NO: 747358 - DNA, 25 bp, Mus musculus
tactgcctacagacagacggcaacc

SEQ ID NO: 747359 - DNA, 25 bp, Mus musculus
tactgcctacagtcagacggcaacc

SEQ ID NO: 747360 - DNA, 25 bp, Mus musculus
tactgcctatgcaggttcacaggcc

SEQ ID NO: 747361 - DNA, 25 bp, Mus musculus
tactgcctatgctggttcacaggcc

SEQ ID NO: 747362 - DNA, 25 bp, Mus musculus
tactgcctcaggaacacaagttctg

SEQ ID NO: 747363 - DNA, 25 bp, Mus musculus
tactgcctcaggagacgggtgtaac

SEQ ID NO: 747364 - DNA, 25 bp, Mus musculus
tactgcctcaggtacacaagttctg

SEQ ID NO: 747365 - DNA, 25 bp, Mus musculus
tactgcctcaggtgacgggtgtaac

SEQ ID NO: 747366 - DNA, 25 bp, Mus musculus
tactgcctccatcaagtcaagactc

SEQ ID NO: 747367 - DNA, 25 bp, Mus musculus
tactgcctccatgaagtcaagactc

SEQ ID NO: 747368 - DNA, 25 bp, Mus musculus
tactgcctcttcaacgagtccatgc

SEQ ID NO: 747369 - DNA, 25 bp, Mus musculus
tactgcctcttctacgagtccatgc

SEQ ID NO: 747370 - DNA, 25 bp, Mus musculus
tactgcctgcttaaagaagagccca

SEQ ID NO: 747371 - DNA, 25 bp, Mus musculus
tactgcctgctttaagaagagccca

SEQ ID NO: 747372 - DNA, 25 bp, Mus musculus
tactgcctggcgctaaaggagctct

SEQ ID NO: 747373 - DNA, 25 bp, Mus musculus
tactgcctggcggtaaaggagctct

SEQ ID NO: 747374 - DNA, 25 bp, Mus musculus
tactgcctgttcagtagactccagg

SEQ ID NO: 747375 - DNA, 25 bp, Mus musculus
tactgcctgttctgtagactccagg

SEQ ID NO: 747376 - DNA, 25 bp, Mus musculus
tactgccttacaagctttgccaagg

SEQ ID NO: 747377 - DNA, 25 bp, Mus musculus
tactgccttacatgctttgccaagg

SEQ ID NO: 747378 - DNA, 25 bp, Mus musculus
tactgcgaagttatgctcctggacg

SEQ ID NO: 747379 - DNA, 25 bp, Mus musculus
tactgcgaagttttgctcctggacg

SEQ ID NO: 747380 - DNA, 25 bp, Mus musculus
tactgcgaatgtccgcatgggcgca

SEQ ID NO: 747381 - DNA, 25 bp, Mus musculus
tactgcgaatgtgcgcatgggcgca

SEQ ID NO: 747382 - DNA, 25 bp, Mus musculus
tactgcgacatccagagcaccaaga

SEQ ID NO: 747383 - DNA, 25 bp, Mus musculus
tactgcgacatcgagagcaccaaga

SEQ ID NO: 747384 - DNA, 25 bp, Mus musculus
tactgcgacgccaaatacgtctggg

SEQ ID NO: 747385 - DNA, 25 bp, Mus musculus
tactgcgacgcctaatacgtctggg

SEQ ID NO: 747386 - DNA, 25 bp, Mus musculus
tactgcgactgtaaggacggttcag

SEQ ID NO: 747387 - DNA, 25 bp, Mus musculus
tactgcgactgttaggacggttcag

SEQ ID NO: 747388 - DNA, 25 bp, Mus musculus
tactgcgatttcatctacctctata

SEQ ID NO: 747389 - DNA, 25 bp, Mus musculus
tactgcgatttcttctacctctata

SEQ ID NO: 747390 - DNA, 25 bp, Mus musculus
tactgcgcaagaagttctccgccag

SEQ ID NO: 747391 - DNA, 25 bp, Mus musculus
tactgcgcaagatgttctccgccag

SEQ ID NO: 747392 - DNA, 25 bp, Mus musculus
tactgcgcctgcaactctggctaca

SEQ ID NO: 747393 - DNA, 25 bp, Mus musculus
tactgcgcctgctactctggctaca

SEQ ID NO: 747394 - DNA, 25 bp, Mus musculus
tactgcgcctggatgaaacgtcggg

SEQ ID NO: 747395 - DNA, 25 bp, Mus musculus
tactgcgcctggttgaaacgtcggg

SEQ ID NO: 747396 - DNA, 25 bp, Mus musculus
tactgcgcggaaagaaataggctgg

SEQ ID NO: 747397 - DNA, 25 bp, Mus musculus
tactgcgcggaatgaaataggctgg

SEQ ID NO: 747398 - DNA, 25 bp, Mus musculus
tactgcggaatacgaaaagtgtatt

SEQ ID NO: 747399 - DNA, 25 bp, Mus musculus
tactgcggaataggaaaagtgtatt

SEQ ID NO: 747400 - DNA, 25 bp, Mus musculus
tactgcggagccaaggcgccctagg

SEQ ID NO: 747401 - DNA, 25 bp, Mus musculus
tactgcggagcctaggcgccctagg

SEQ ID NO: 747402 - DNA, 25 bp, Mus musculus
tactgcggcaagcttttcaacgggc

SEQ ID NO: 747403 - DNA, 25 bp, Mus musculus
tactgcggcaaggttttcaacgggc

SEQ ID NO: 747404 - DNA, 25 bp, Mus musculus
tactgcggctccagcgtagatggcc

SEQ ID NO: 747405 - DNA, 25 bp, Mus musculus
tactgcggctcctgcgtagatggcc

SEQ ID NO: 747406 - DNA, 25 bp, Mus musculus
tactgctaaggtaaagtctacaggg

SEQ ID NO: 747407 - DNA, 25 bp, Mus musculus
tactgctaaggttaagtctacaggg

SEQ ID NO: 747408 - DNA, 25 bp, Mus musculus
tactgctaatccaggatgaggttgc

SEQ ID NO: 747409 - DNA, 25 bp, Mus musculus
tactgctaatcctggatgaggttgc

SEQ ID NO: 747410 - DNA, 25 bp, Mus musculus
tactgctaattcagaaaggactggg

SEQ ID NO: 747411 - DNA, 25 bp, Mus musculus
tactgctaattctgaaaggactggg

SEQ ID NO: 747412 - DNA, 25 bp, Mus musculus
tactgctagaagctgaagggatgtc

SEQ ID NO: 747413 - DNA, 25 bp, Mus musculus
tactgctagaaggtgaagggatgtc

SEQ ID NO: 747414 - DNA, 25 bp, Mus musculus
tactgctagagcctggtggccagaa

SEQ ID NO: 747415 - DNA, 25 bp, Mus musculus
tactgctagagcgtggtggccagaa

SEQ ID NO: 747416 - DNA, 25 bp, Mus musculus
tactgctagagtctccagctcaggc

SEQ ID NO: 747417 - DNA, 25 bp, Mus musculus
tactgctagagtgtccagctcaggc

SEQ ID NO: 747418 - DNA, 25 bp, Mus musculus
tactgctagattatgctgctttccc

SEQ ID NO: 747419 - DNA, 25 bp, Mus musculus
tactgctagattttgctgctttccc

SEQ ID NO: 747420 - DNA, 25 bp, Mus musculus
tactgctagggtcaggaagacactt

SEQ ID NO: 747421 - DNA, 25 bp, Mus musculus
tactgctagggtgaggaagacactt

SEQ ID NO: 747422 - DNA, 25 bp, Mus musculus
tactgctcacaactggcctgatctg

SEQ ID NO: 747423 - DNA, 25 bp, Mus musculus
tactgctcacaagtggcctgatctg

SEQ ID NO: 747424 - DNA, 25 bp, Mus musculus
tactgctcaggcaaataagaagtga

SEQ ID NO: 747425 - DNA, 25 bp, Mus musculus
tactgctcaggctaataagaagtga

SEQ ID NO: 747426 - DNA, 25 bp, Mus musculus
tactgctcatcaagggctcgggaga

SEQ ID NO: 747427 - DNA, 25 bp, Mus musculus
tactgctcatcatgggctcgggaga

SEQ ID NO: 747428 - DNA, 25 bp, Mus musculus
tactgctcccggagcttggctggcg

SEQ ID NO: 747429 - DNA, 25 bp, Mus musculus
tactgctcccggtgcttggctggcg

SEQ ID NO: 747430 - DNA, 25 bp, Mus musculus
tactgctgaaggcacaccaatcggt

SEQ ID NO: 747431 - DNA, 25 bp, Mus musculus
tactgctgaagggacaccaatcggt

SEQ ID NO: 747432 - DNA, 25 bp, Mus musculus
tactgctgactaatttggcctttgg

SEQ ID NO: 747433 - DNA, 25 bp, Mus musculus
tactgctgactattttggcctttgg

SEQ ID NO: 747434 - DNA, 25 bp, Mus musculus
tactgctgagctagcacttcccgag

SEQ ID NO: 747435 - DNA, 25 bp, Mus musculus
tactgctgagcttgcacttcccgag

SEQ ID NO: 747436 - DNA, 25 bp, Mus musculus
tactgctgatttagaaaggaaggag

SEQ ID NO: 747437 - DNA, 25 bp, Mus musculus
tactgctgattttgaaaggaaggag

SEQ ID NO: 747438 - DNA, 25 bp, Mus musculus
tactgctgcctgacgtccattgctg

SEQ ID NO: 747439 - DNA, 25 bp, Mus musculus
tactgctgcctgtcgtccattgctg

SEQ ID NO: 747440 - DNA, 25 bp, Mus musculus
tactgctgctacaacgaacttaggc

SEQ ID NO: 747441 - DNA, 25 bp, Mus musculus
tactgctgctacactgtctgtgcag

SEQ ID NO: 747442 - DNA, 25 bp, Mus musculus
tactgctgctactacgaacttaggc

SEQ ID NO: 747443 - DNA, 25 bp, Mus musculus
tactgctgctactctgtctgtgcag

SEQ ID NO: 747444 - DNA, 25 bp, Mus musculus
tactgctgctcaccgttgagagact

SEQ ID NO: 747445 - DNA, 25 bp, Mus musculus
tactgctgctcagcgttgagagact

SEQ ID NO: 747446 - DNA, 25 bp, Mus musculus
tactgctgctttcctcacgcttaaa

SEQ ID NO: 747447 - DNA, 25 bp, Mus musculus
tactgctgctttgctcacgcttaaa

SEQ ID NO: 747448 - DNA, 25 bp, Mus musculus
tactgctggagtctctaaaagaaca

SEQ ID NO: 747449 - DNA, 25 bp, Mus musculus
tactgctggagtgtctaaaagaaca

SEQ ID NO: 747450 - DNA, 25 bp, Mus musculus
tactgctggccaacctgctgtcgct

SEQ ID NO: 747451 - DNA, 25 bp, Mus musculus
tactgctggccatcctgctgtcgct

SEQ ID NO: 747452 - DNA, 25 bp, Mus musculus
tactgctgtccgatttttgggtcca

SEQ ID NO: 747453 - DNA, 25 bp, Mus musculus
tactgctgtccgttttttgggtcca

SEQ ID NO: 747454 - DNA, 25 bp, Mus musculus
tactgctgttctacatcccgggcgt

SEQ ID NO: 747455 - DNA, 25 bp, Mus musculus
tactgctgttcttcatcccgggcgt

SEQ ID NO: 747456 - DNA, 25 bp, Mus musculus
tactgcttacaacatattatgagag

SEQ ID NO: 747457 - DNA, 25 bp, Mus musculus
tactgcttacaagatattatgagag

SEQ ID NO: 747458 - DNA, 25 bp, Mus musculus
tactgcttagtacccaagttgactg

SEQ ID NO: 747459 - DNA, 25 bp, Mus musculus
tactgcttagtagccaagttgactg

SEQ ID NO: 747460 - DNA, 25 bp, Mus musculus
tactgcttctggacaagcttcggaa

SEQ ID NO: 747461 - DNA, 25 bp, Mus musculus
tactgcttctggtcaagcttcggaa

SEQ ID NO: 747462 - DNA, 25 bp, Mus musculus
tactgctttagcaacctgtctgatg

SEQ ID NO: 747463 - DNA, 25 bp, Mus musculus
tactgctttagctacctgtctgatg

SEQ ID NO: 747464 - DNA, 25 bp, Mus musculus
tactgctttcctaagtgttccggat

SEQ ID NO: 747465 - DNA, 25 bp, Mus musculus
tactgctttccttagtgttccggat

SEQ ID NO: 747466 - DNA, 25 bp, Mus musculus
tactgctttgagaaccgttggttca

SEQ ID NO: 747467 - DNA, 25 bp, Mus musculus
tactgctttgagtaccgttggttca

SEQ ID NO: 747468 - DNA, 25 bp, Mus musculus
tactgctttgtgaatggccaggact

SEQ ID NO: 747469 - DNA, 25 bp, Mus musculus
tactgctttgtgtatggccaggact

SEQ ID NO: 747470 - DNA, 25 bp, Mus musculus
tactggaaaatgcattttcctggaa

SEQ ID NO: 747471 - DNA, 25 bp, Mus musculus
tactggaaaatggattttcctggaa

SEQ ID NO: 747472 - DNA, 25 bp, Mus musculus
tactggaaacttactggatgatgca

SEQ ID NO: 747473 - DNA, 25 bp, Mus musculus
tactggaaactttctggatgatgca

SEQ ID NO: 747474 - DNA, 25 bp, Mus musculus
tactggaaatgcacagattgctgat

SEQ ID NO: 747475 - DNA, 25 bp, Mus musculus
tactggaaatgctcagattgctgat

SEQ ID NO: 747476 - DNA, 25 bp, Mus musculus
tactggaactttccaaccgggaaga

SEQ ID NO: 747477 - DNA, 25 bp, Mus musculus
tactggaactttgcaaccgggaaga

SEQ ID NO: 747478 - DNA, 25 bp, Mus musculus
tactggaagattacccttatgagga

SEQ ID NO: 747479 - DNA, 25 bp, Mus musculus
tactggaagatttcccttatgagga

SEQ ID NO: 747480 - DNA, 25 bp, Mus musculus
tactggaagtccagacccaggacca

SEQ ID NO: 747481 - DNA, 25 bp, Mus musculus
tactggaagtcctgacccaggacca

SEQ ID NO: 747482 - DNA, 25 bp, Mus musculus
tactggaatccaagccttctggcac

SEQ ID NO: 747483 - DNA, 25 bp, Mus musculus
tactggaatccatgccttctggcac

SEQ ID NO: 747484 - DNA, 25 bp, Mus musculus
tactggaatgtcaccgtgtatgggc

SEQ ID NO: 747485 - DNA, 25 bp, Mus musculus
tactggaatgtctccgtgtatgggc

SEQ ID NO: 747486 - DNA, 25 bp, Mus musculus
tactggaatgttacagtgcatcgga

SEQ ID NO: 747487 - DNA, 25 bp, Mus musculus
tactggaatgtttcagtgcatcgga

SEQ ID NO: 747488 - DNA, 25 bp, Mus musculus
tactggacaacaaaggaactgactt

SEQ ID NO: 747489 - DNA, 25 bp, Mus musculus
tactggacaacataggaactgactt

SEQ ID NO: 747490 - DNA, 25 bp, Mus musculus
tactggacacagaaagaatgttggc

SEQ ID NO: 747491 - DNA, 25 bp, Mus musculus
tactggacacagcaaacagcatctg

SEQ ID NO: 747492 - DNA, 25 bp, Mus musculus
tactggacacaggaaacagcatctg

SEQ ID NO: 747493 - DNA, 25 bp, Mus musculus
tactggacacagtaagaatgttggc

SEQ ID NO: 747494 - DNA, 25 bp, Mus musculus
tactggacacgtagataatggcatg

SEQ ID NO: 747495 - DNA, 25 bp, Mus musculus
tactggacacgttgataatggcatg

SEQ ID NO: 747496 - DNA, 25 bp, Mus musculus
tactggacatctaagacacagcagg

SEQ ID NO: 747497 - DNA, 25 bp, Mus musculus
tactggacatcttagacacagcagg

SEQ ID NO: 747498 - DNA, 25 bp, Mus musculus
tactggaccaaaaaccaggtgtggg

SEQ ID NO: 747499 - DNA, 25 bp, Mus musculus
tactggaccaaataccaggtgtggg

SEQ ID NO: 747500 - DNA, 25 bp, Mus musculus
tactggaccaatccaaggagggctg

SEQ ID NO: 747501 - DNA, 25 bp, Mus musculus
tactggaccaatgcaaggagggctg

SEQ ID NO: 747502 - DNA, 25 bp, Mus musculus
tactggaccagcatatcctgatcag

SEQ ID NO: 747503 - DNA, 25 bp, Mus musculus
tactggaccagcttatcctgatcag

SEQ ID NO: 747504 - DNA, 25 bp, Mus musculus
tactggaccatgctgcagcaactca

SEQ ID NO: 747505 - DNA, 25 bp, Mus musculus
tactggaccatggtgcagcaactca

SEQ ID NO: 747506 - DNA, 25 bp, Mus musculus
tactggaccattcctgaagtctcaa

SEQ ID NO: 747507 - DNA, 25 bp, Mus musculus
tactggaccattgctgaagtctcaa

SEQ ID NO: 747508 - DNA, 25 bp, Mus musculus
tactggaccctcacaaataatgaca

SEQ ID NO: 747509 - DNA, 25 bp, Mus musculus
tactggaccctctcaaataatgaca

SEQ ID NO: 747510 - DNA, 25 bp, Mus musculus
tactggacctcgctccttgaggaag

SEQ ID NO: 747511 - DNA, 25 bp, Mus musculus
tactggacctcggtccttgaggaag

SEQ ID NO: 747512 - DNA, 25 bp, Mus musculus
tactggacggagatgatggtcccct

SEQ ID NO: 747513 - DNA, 25 bp, Mus musculus
tactggacggagttgatggtcccct

SEQ ID NO: 747514 - DNA, 25 bp, Mus musculus
tactggacggcaattgcgggaattc

SEQ ID NO: 747515 - DNA, 25 bp, Mus musculus
tactggacggcatttgcgggaattc

SEQ ID NO: 747516 - DNA, 25 bp, Mus musculus
tactggactcagctcaacatgttcc

SEQ ID NO: 747517 - DNA, 25 bp, Mus musculus
tactggactcaggtcaacatgttcc

SEQ ID NO: 747518 - DNA, 25 bp, Mus musculus
tactggagaaatatatttgtgtggc

SEQ ID NO: 747519 - DNA, 25 bp, Mus musculus
tactggagaaatttatttgtgtggc

SEQ ID NO: 747520 - DNA, 25 bp, Mus musculus
tactggagagacattaagaagactg

SEQ ID NO: 747521 - DNA, 25 bp, Mus musculus
tactggagagactttaagaagactg

SEQ ID NO: 747522 - DNA, 25 bp, Mus musculus
tactggagcagtatcctggtggatc

SEQ ID NO: 747523 - DNA, 25 bp, Mus musculus
tactggagcagtttcctggtggatc

SEQ ID NO: 747524 - DNA, 25 bp, Mus musculus
tactggagggctaaatgaatctact

SEQ ID NO: 747525 - DNA, 25 bp, Mus musculus
tactggagggcttaatgaatctact

SEQ ID NO: 747526 - DNA, 25 bp, Mus musculus
tactggaggtagaacatcccgcagc

SEQ ID NO: 747527 - DNA, 25 bp, Mus musculus
tactggaggtagtacatcccgcagc

SEQ ID NO: 747528 - DNA, 25 bp, Mus musculus
tactggagtaccatcaggaaagccc

SEQ ID NO: 747529 - DNA, 25 bp, Mus musculus
tactggagtaccttcaggaaagccc

SEQ ID NO: 747530 - DNA, 25 bp, Mus musculus
tactggatgcagacgaccctgtatc

SEQ ID NO: 747531 - DNA, 25 bp, Mus musculus
tactggatgcagtcgaccctgtatc

SEQ ID NO: 747532 - DNA, 25 bp, Mus musculus
tactggatgcgactgattctggcct

SEQ ID NO: 747533 - DNA, 25 bp, Mus musculus
tactggatgcgagtgattctggcct

SEQ ID NO: 747534 - DNA, 25 bp, Mus musculus
tactggatgtccagagcgagattaa

SEQ ID NO: 747535 - DNA, 25 bp, Mus musculus
tactggatgtcctgagcgagattaa

SEQ ID NO: 747536 - DNA, 25 bp, Mus musculus
tactggattttgctgcaagccgggc

SEQ ID NO: 747537 - DNA, 25 bp, Mus musculus
tactggattttggtgcaagccgggc

SEQ ID NO: 747538 - DNA, 25 bp, Mus musculus
tactggcaactacagcaactaccgg

SEQ ID NO: 747539 - DNA, 25 bp, Mus musculus
tactggcaactagagcaactaccgg

SEQ ID NO: 747540 - DNA, 25 bp, Mus musculus
tactggcaagcactggagaactcga

SEQ ID NO: 747541 - DNA, 25 bp, Mus musculus
tactggcaagcagtggagaactcga

SEQ ID NO: 747542 - DNA, 25 bp, Mus musculus
tactggcaagccagcaggatccttt

SEQ ID NO: 747543 - DNA, 25 bp, Mus musculus
tactggcaagcctgcaggatccttt

SEQ ID NO: 747544 - DNA, 25 bp, Mus musculus
tactggcacagacaagagtgagctc

SEQ ID NO: 747545 - DNA, 25 bp, Mus musculus
tactggcacagagaagagtgagctc

SEQ ID NO: 747546 - DNA, 25 bp, Mus musculus
tactggcaccggcagccatgacgag

SEQ ID NO: 747547 - DNA, 25 bp, Mus musculus
tactggcaccgggagccatgacgag

SEQ ID NO: 747548 - DNA, 25 bp, Mus musculus
tactggcagcacaagcaagtgtgtg

SEQ ID NO: 747549 - DNA, 25 bp, Mus musculus
tactggcagcactagcaagtgtgtg

SEQ ID NO: 747550 - DNA, 25 bp, Mus musculus
tactggcagccaacactgtactggc

SEQ ID NO: 747551 - DNA, 25 bp, Mus musculus
tactggcagccatcactgtactggc

SEQ ID NO: 747552 - DNA, 25 bp, Mus musculus
tactggcatcgtcatctacgcacct

SEQ ID NO: 747553 - DNA, 25 bp, Mus musculus
tactggcatcgtgatctacgcacct

SEQ ID NO: 747554 - DNA, 25 bp, Mus musculus
tactggcatgatccgtacatcgagc

SEQ ID NO: 747555 - DNA, 25 bp, Mus musculus
tactggcatgatgcgtacatcgagc

SEQ ID NO: 747556 - DNA, 25 bp, Mus musculus
tactggccacagatgatgtgaacct

SEQ ID NO: 747557 - DNA, 25 bp, Mus musculus
tactggccacagttgatgtgaacct

SEQ ID NO: 747558 - DNA, 25 bp, Mus musculus
tactggccagttaccctgaagagga

SEQ ID NO: 747559 - DNA, 25 bp, Mus musculus
tactggccagtttccctgaagagga

SEQ ID NO: 747560 - DNA, 25 bp, Mus musculus
tactggccatgtattgataaagaat

SEQ ID NO: 747561 - DNA, 25 bp, Mus musculus
tactggccatgttttgataaagaat

SEQ ID NO: 747562 - DNA, 25 bp, Mus musculus
tactggcccagcacctacttctggt

SEQ ID NO: 747563 - DNA, 25 bp, Mus musculus
tactggcccagctcctacttctggt

SEQ ID NO: 747564 - DNA, 25 bp, Mus musculus
tactggccctacagaaagtcctgct

SEQ ID NO: 747565 - DNA, 25 bp, Mus musculus
tactggccctactgaaagtcctgct

SEQ ID NO: 747566 - DNA, 25 bp, Mus musculus
tactggccgtagcagagaatagctt

SEQ ID NO: 747567 - DNA, 25 bp, Mus musculus
tactggccgtaggagagaatagctt

SEQ ID NO: 747568 - DNA, 25 bp, Mus musculus
tactggcctgatcagtatgcgctca

SEQ ID NO: 747569 - DNA, 25 bp, Mus musculus
tactggcctgatgagtatgcgctca

SEQ ID NO: 747570 - DNA, 25 bp, Mus musculus
tactggcctggtctggctgaacact

SEQ ID NO: 747571 - DNA, 25 bp, Mus musculus
tactggcctggtgtggctgaacact

SEQ ID NO: 747572 - DNA, 25 bp, Mus musculus
tactggccttggctctgtatccttg

SEQ ID NO: 747573 - DNA, 25 bp, Mus musculus
tactggccttgggtctgtatccttg

SEQ ID NO: 747574 - DNA, 25 bp, Mus musculus
tactggcgatttactcgacctgaag

SEQ ID NO: 747575 - DNA, 25 bp, Mus musculus
tactggcgattttctcgacctgaag

SEQ ID NO: 747576 - DNA, 25 bp, Mus musculus
tactggcggcctattcttagctgaa

SEQ ID NO: 747577 - DNA, 25 bp, Mus musculus
tactggcggccttttcttagctgaa

SEQ ID NO: 747578 - DNA, 25 bp, Mus musculus
tactggcggtttaggctgtgtgtta

SEQ ID NO: 747579 - DNA, 25 bp, Mus musculus
tactggcggttttggctgtgtgtta

SEQ ID NO: 747580 - DNA, 25 bp, Mus musculus
tactggcgtggaataaacttatgaa

SEQ ID NO: 747581 - DNA, 25 bp, Mus musculus
tactggcgtggattaaacttatgaa

SEQ ID NO: 747582 - DNA, 25 bp, Mus musculus
tactggctcctcaaacctgtgggtc

SEQ ID NO: 747583 - DNA, 25 bp, Mus musculus
tactggctcctctaacctgtgggtc

SEQ ID NO: 747584 - DNA, 25 bp, Mus musculus
tactggctgaatcacatgtatctaa

SEQ ID NO: 747585 - DNA, 25 bp, Mus musculus
tactggctgaatgacatgtatctaa

SEQ ID NO: 747586 - DNA, 25 bp, Mus musculus
tactggctgctcagattggaatcgt

SEQ ID NO: 747587 - DNA, 25 bp, Mus musculus
tactggctgctctgattggaatcgt

SEQ ID NO: 747588 - DNA, 25 bp, Mus musculus
tactggctggtgcacaatgtgatcc

SEQ ID NO: 747589 - DNA, 25 bp, Mus musculus
tactggctggtggacaatgtgatcc

SEQ ID NO: 747590 - DNA, 25 bp, Mus musculus
tactggcttcctagaacagctgctg

SEQ ID NO: 747591 - DNA, 25 bp, Mus musculus
tactggcttccttgaacagctgctg

SEQ ID NO: 747592 - DNA, 25 bp, Mus musculus
tactggctttgcaggcaagcctgag

SEQ ID NO: 747593 - DNA, 25 bp, Mus musculus
tactggctttgctggcaagcctgag

SEQ ID NO: 747594 - DNA, 25 bp, Mus musculus
tactgggaatgtctctacttactca

SEQ ID NO: 747595 - DNA, 25 bp, Mus musculus
tactgggaatgtgtctacttactca

SEQ ID NO: 747596 - DNA, 25 bp, Mus musculus
tactgggacattaggttctgtcttc

SEQ ID NO: 747597 - DNA, 25 bp, Mus musculus
tactgggacatttggttctgtcttc

SEQ ID NO: 747598 - DNA, 25 bp, Mus musculus
tactgggacctcctgctgctcattc

SEQ ID NO: 747599 - DNA, 25 bp, Mus musculus
tactgggacctcgtgctgctcattc

SEQ ID NO: 747600 - DNA, 25 bp, Mus musculus
tactgggactccacaaggaaatcct

SEQ ID NO: 747601 - DNA, 25 bp, Mus musculus
tactgggactcctcaaggaaatcct

SEQ ID NO: 747602 - DNA, 25 bp, Mus musculus
tactgggagatccatgggcaaatat

SEQ ID NO: 747603 - DNA, 25 bp, Mus musculus
tactgggagatcgatgggcaaatat

SEQ ID NO: 747604 - DNA, 25 bp, Mus musculus
tactgggagccaagatgtttggcta

SEQ ID NO: 747605 - DNA, 25 bp, Mus musculus
tactgggagccaattgcctttcctg

SEQ ID NO: 747606 - DNA, 25 bp, Mus musculus
tactgggagccacgtaaatggaacc

SEQ ID NO: 747607 - DNA, 25 bp, Mus musculus
tactgggagccaggtaaatggaacc

SEQ ID NO: 747608 - DNA, 25 bp, Mus musculus
tactgggagccatgatgtttggcta

SEQ ID NO: 747609 - DNA, 25 bp, Mus musculus
tactgggagccatttgcctttcctg

SEQ ID NO: 747610 - DNA, 25 bp, Mus musculus
tactgggaggcaatcctacctgaag

SEQ ID NO: 747611 - DNA, 25 bp, Mus musculus
tactgggaggcattcctacctgaag

SEQ ID NO: 747612 - DNA, 25 bp, Mus musculus
tactgggagtaccaatttcagcagc

SEQ ID NO: 747613 - DNA, 25 bp, Mus musculus
tactgggagtacgaatttcagcagc

SEQ ID NO: 747614 - DNA, 25 bp, Mus musculus
tactgggatgatagtctgagacagg

SEQ ID NO: 747615 - DNA, 25 bp, Mus musculus
tactgggatgattgtctgagacagg

SEQ ID NO: 747616 - DNA, 25 bp, Mus musculus
tactgggattctagctggtgccaac

SEQ ID NO: 747617 - DNA, 25 bp, Mus musculus
tactgggattcttgctggtgccaac

SEQ ID NO: 747618 - DNA, 25 bp, Mus musculus
tactgggcaaatagagccatttaga

SEQ ID NO: 747619 - DNA, 25 bp, Mus musculus
tactgggcaaattgagccatttaga

SEQ ID NO: 747620 - DNA, 25 bp, Mus musculus
tactgggcataaacaacaaccggat

SEQ ID NO: 747621 - DNA, 25 bp, Mus musculus
tactgggcataatcaacaaccggat

SEQ ID NO: 747622 - DNA, 25 bp, Mus musculus
tactgggcattcaggaccgtaaccc

SEQ ID NO: 747623 - DNA, 25 bp, Mus musculus
tactgggcattctggaccgtaaccc

SEQ ID NO: 747624 - DNA, 25 bp, Mus musculus
tactgggccatgataggagaatcac

SEQ ID NO: 747625 - DNA, 25 bp, Mus musculus
tactgggccatgttaggagaatcac

SEQ ID NO: 747626 - DNA, 25 bp, Mus musculus
tactgggctcaaacacacttggtca

SEQ ID NO: 747627 - DNA, 25 bp, Mus musculus
tactgggctcaatcacacttggtca

SEQ ID NO: 747628 - DNA, 25 bp, Mus musculus
tactgggctgccacagaatgtatgc

SEQ ID NO: 747629 - DNA, 25 bp, Mus musculus
tactgggctgcctcagaatgtatgc

SEQ ID NO: 747630 - DNA, 25 bp, Mus musculus
tactggggaagtactggacatcttg

SEQ ID NO: 747631 - DNA, 25 bp, Mus musculus
tactggggaagttctggacatcttg

SEQ ID NO: 747632 - DNA, 25 bp, Mus musculus
tactgggtaccgaatgactcttggc

SEQ ID NO: 747633 - DNA, 25 bp, Mus musculus
tactgggtaccgtatgactcttggc

SEQ ID NO: 747634 - DNA, 25 bp, Mus musculus
tactgggtatctagaagagcttgaa

SEQ ID NO: 747635 - DNA, 25 bp, Mus musculus
tactgggtatcttgaagagcttgaa

SEQ ID NO: 747636 - DNA, 25 bp, Mus musculus
tactgggtcagcacttcttcaaccg

SEQ ID NO: 747637 - DNA, 25 bp, Mus musculus
tactgggtcagctcttcttcaaccg

SEQ ID NO: 747638 - DNA, 25 bp, Mus musculus
tactgggtcagtagacaagcaagcc

SEQ ID NO: 747639 - DNA, 25 bp, Mus musculus
tactgggtcagttgacaagcaagcc

SEQ ID NO: 747640 - DNA, 25 bp, Mus musculus
tactgggtcatactctgcgtagctg

SEQ ID NO: 747641 - DNA, 25 bp, Mus musculus
tactgggtcatagtctgcgtagctg

SEQ ID NO: 747642 - DNA, 25 bp, Mus musculus
tactgggtcgtgctagcccagaacc

SEQ ID NO: 747643 - DNA, 25 bp, Mus musculus
tactgggtcgtggtagcccagaacc

SEQ ID NO: 747644 - DNA, 25 bp, Mus musculus
tactgggtgaaccaagatggcactg

SEQ ID NO: 747645 - DNA, 25 bp, Mus musculus
tactgggtgaacgaagatggcactg

SEQ ID NO: 747646 - DNA, 25 bp, Mus musculus
tactgggtgataatggcagtgactg

SEQ ID NO: 747647 - DNA, 25 bp, Mus musculus
tactgggtgatattggcagtgactg

SEQ ID NO: 747648 - DNA, 25 bp, Mus musculus
tactgggtgatgcaaggcctgcttc

SEQ ID NO: 747649 - DNA, 25 bp, Mus musculus
tactgggtgatggaaggcctgcttc

SEQ ID NO: 747650 - DNA, 25 bp, Mus musculus
tactgggtgcttcatataggaactg

SEQ ID NO: 747651 - DNA, 25 bp, Mus musculus
tactgggtgcttgatataggaactg

SEQ ID NO: 747652 - DNA, 25 bp, Mus musculus
tactgggtggtcctgcaaaatcccc

SEQ ID NO: 747653 - DNA, 25 bp, Mus musculus
tactgggtggtcgtgcaaaatcccc

SEQ ID NO: 747654 - DNA, 25 bp, Mus musculus
tactgggttaacattgggaaatgca

SEQ ID NO: 747655 - DNA, 25 bp, Mus musculus
tactgggttaactttgggaaatgca

SEQ ID NO: 747656 - DNA, 25 bp, Mus musculus
tactgggtttacctcttcagagaca

SEQ ID NO: 747657 - DNA, 25 bp, Mus musculus
tactgggtttacgtcttcagagaca

SEQ ID NO: 747658 - DNA, 25 bp, Mus musculus
tactggtaacagagtgatttggtat

SEQ ID NO: 747659 - DNA, 25 bp, Mus musculus
tactggtaacagtgtgatttggtat

SEQ ID NO: 747660 - DNA, 25 bp, Mus musculus
tactggtacacaccagagtcgtggg

SEQ ID NO: 747661 - DNA, 25 bp, Mus musculus
tactggtacacagcagagtcgtggg

SEQ ID NO: 747662 - DNA, 25 bp, Mus musculus
tactggtactgacaggaagctcggg

SEQ ID NO: 747663 - DNA, 25 bp, Mus musculus
tactggtactgagaggaagctcggg

SEQ ID NO: 747664 - DNA, 25 bp, Mus musculus
tactggtagaagacacaaccgaaca

SEQ ID NO: 747665 - DNA, 25 bp, Mus musculus
tactggtagaagtcacaaccgaaca

SEQ ID NO: 747666 - DNA, 25 bp, Mus musculus
tactggtataccatcattggctggg

SEQ ID NO: 747667 - DNA, 25 bp, Mus musculus
tactggtataccttcattggctggg

SEQ ID NO: 747668 - DNA, 25 bp, Mus musculus
tactggtcagaacaagcagcaacac

SEQ ID NO: 747669 - DNA, 25 bp, Mus musculus
tactggtcagaagaagcagcaacac

SEQ ID NO: 747670 - DNA, 25 bp, Mus musculus
tactggtctaaacacgtctgttgca

SEQ ID NO: 747671 - DNA, 25 bp, Mus musculus
tactggtctaaagacgtctgttgca

SEQ ID NO: 747672 - DNA, 25 bp, Mus musculus
tactggtgaggtcagctgcagaccc

SEQ ID NO: 747673 - DNA, 25 bp, Mus musculus
tactggtgaggtgagctgcagaccc

SEQ ID NO: 747674 - DNA, 25 bp, Mus musculus
tactggtgatctatgagtctcgccc

SEQ ID NO: 747675 - DNA, 25 bp, Mus musculus
tactggtgatctttgagtctcgccc

SEQ ID NO: 747676 - DNA, 25 bp, Mus musculus
tactggtgcagtactctgctaaggg

SEQ ID NO: 747677 - DNA, 25 bp, Mus musculus
tactggtgcagttctctgctaaggg

SEQ ID NO: 747678 - DNA, 25 bp, Mus musculus
tactggtgctgaagtggattatctg

SEQ ID NO: 747679 - DNA, 25 bp, Mus musculus
tactggtgctgatgtggattatctg

SEQ ID NO: 747680 - DNA, 25 bp, Mus musculus
tactggtgtacacaatagcatccag

SEQ ID NO: 747681 - DNA, 25 bp, Mus musculus
tactggtgtacagaatagcatccag

SEQ ID NO: 747682 - DNA, 25 bp, Mus musculus
tactggtgtataacagtgtgaagcc

SEQ ID NO: 747683 - DNA, 25 bp, Mus musculus
tactggtgtatatcagtgtgaagcc

SEQ ID NO: 747684 - DNA, 25 bp, Mus musculus
tactggttccatcacaaagtactga

SEQ ID NO: 747685 - DNA, 25 bp, Mus musculus
tactggttccatgacaaagtactga

SEQ ID NO: 747686 - DNA, 25 bp, Mus musculus
tactggttccccatcttcacggagg

SEQ ID NO: 747687 - DNA, 25 bp, Mus musculus
tactggttccccttcttcacggagg

SEQ ID NO: 747688 - DNA, 25 bp, Mus musculus
tactggttctggaagggccaaaatg

SEQ ID NO: 747689 - DNA, 25 bp, Mus musculus
tactggttctggtagggccaaaatg

SEQ ID NO: 747690 - DNA, 25 bp, Mus musculus
tactggttctttctgggcctttcta

SEQ ID NO: 747691 - DNA, 25 bp, Mus musculus
tactggttctttgtgggcctttcta

SEQ ID NO: 747692 - DNA, 25 bp, Mus musculus
tactggttgtatcgagacaaaattc

SEQ ID NO: 747693 - DNA, 25 bp, Mus musculus
tactggttgtatggagacaaaattc

SEQ ID NO: 747694 - DNA, 25 bp, Mus musculus
tactggtttgtcacccgggacaagg

SEQ ID NO: 747695 - DNA, 25 bp, Mus musculus
tactggtttgtctcccgggacaagg

SEQ ID NO: 747696 - DNA, 25 bp, Mus musculus
tactgtaagagaagagatcgagagc

SEQ ID NO: 747697 - DNA, 25 bp, Mus musculus
tactgtaagagatgagatcgagagc

SEQ ID NO: 747698 - DNA, 25 bp, Mus musculus
tactgtaagccaagtcatcctgagg

SEQ ID NO: 747699 - DNA, 25 bp, Mus musculus
tactgtaagccatgtcatcctgagg

SEQ ID NO: 747700 - DNA, 25 bp, Mus musculus
tactgtaaggccaggagcacttgtg

SEQ ID NO: 747701 - DNA, 25 bp, Mus musculus
tactgtaaggcctggagcacttgtg

SEQ ID NO: 747702 - DNA, 25 bp, Mus musculus
tactgtaaggtgagctatgggcgca

SEQ ID NO: 747703 - DNA, 25 bp, Mus musculus
tactgtaaggtgtgctatgggcgca

SEQ ID NO: 747704 - DNA, 25 bp, Mus musculus
tactgtaatacgaatcccagccaaa

SEQ ID NO: 747705 - DNA, 25 bp, Mus musculus
tactgtaatacgtatcccagccaaa

SEQ ID NO: 747706 - DNA, 25 bp, Mus musculus
tactgtaccacaagtggactggtga

SEQ ID NO: 747707 - DNA, 25 bp, Mus musculus
tactgtaccacatgtggactggtga

SEQ ID NO: 747708 - DNA, 25 bp, Mus musculus
tactgtaccctgaggtccagatgcc

SEQ ID NO: 747709 - DNA, 25 bp, Mus musculus
tactgtaccctgtggtccagatgcc

SEQ ID NO: 747710 - DNA, 25 bp, Mus musculus
tactgtaccgtgcagaagcctgtgg

SEQ ID NO: 747711 - DNA, 25 bp, Mus musculus
tactgtaccgtggagaagcctgtgg

SEQ ID NO: 747712 - DNA, 25 bp, Mus musculus
tactgtacgcctccgctttggcgag

SEQ ID NO: 747713 - DNA, 25 bp, Mus musculus
tactgtacgcctgcgctttggcgag

SEQ ID NO: 747714 - DNA, 25 bp, Mus musculus
tactgtacggctacgaggtgccacc

SEQ ID NO: 747715 - DNA, 25 bp, Mus musculus
tactgtacggcttcgaggtgccacc

SEQ ID NO: 747716 - DNA, 25 bp, Mus musculus
tactgtagcaagaggctgggtccca

SEQ ID NO: 747717 - DNA, 25 bp, Mus musculus
tactgtagcaagtggctgggtccca

SEQ ID NO: 747718 - DNA, 25 bp, Mus musculus
tactgtagctatcgaagttgggacc

SEQ ID NO: 747719 - DNA, 25 bp, Mus musculus
tactgtagctatggaagttgggacc

SEQ ID NO: 747720 - DNA, 25 bp, Mus musculus
tactgtagctcaaaccgattgggcc

SEQ ID NO: 747721 - DNA, 25 bp, Mus musculus
tactgtagctcataccgattgggcc

SEQ ID NO: 747722 - DNA, 25 bp, Mus musculus
tactgtagctctcttttttgagtcc

SEQ ID NO: 747723 - DNA, 25 bp, Mus musculus
tactgtagctctgttttttgagtcc

SEQ ID NO: 747724 - DNA, 25 bp, Mus musculus
tactgtaggatactgatgaacgcct

SEQ ID NO: 747725 - DNA, 25 bp, Mus musculus
tactgtaggatagtgatgaacgcct

SEQ ID NO: 747726 - DNA, 25 bp, Mus musculus
tactgtaggctccttctcctgcaag

SEQ ID NO: 747727 - DNA, 25 bp, Mus musculus
tactgtaggctcgttctcctgcaag

SEQ ID NO: 747728 - DNA, 25 bp, Mus musculus
tactgtaggtctagaagtctccatg

SEQ ID NO: 747729 - DNA, 25 bp, Mus musculus
tactgtaggtcttgaagtctccatg

SEQ ID NO: 747730 - DNA, 25 bp, Mus musculus
tactgtagtactctgtgccagcaac

SEQ ID NO: 747731 - DNA, 25 bp, Mus musculus
tactgtagtactgtgtgccagcaac

SEQ ID NO: 747732 - DNA, 25 bp, Mus musculus
tactgtatactcacacctattgctc

SEQ ID NO: 747733 - DNA, 25 bp, Mus musculus
tactgtatactctcacctattgctc

SEQ ID NO: 747734 - DNA, 25 bp, Mus musculus
tactgtatatcacagggctccttgc

SEQ ID NO: 747735 - DNA, 25 bp, Mus musculus
tactgtatatcagagggctccttgc

SEQ ID NO: 747736 - DNA, 25 bp, Mus musculus
tactgtatctaaatttttggaacca

SEQ ID NO: 747737 - DNA, 25 bp, Mus musculus
tactgtatctaattttttggaacca

SEQ ID NO: 747738 - DNA, 25 bp, Mus musculus
tactgtatgctcctcttgtcctcta

SEQ ID NO: 747739 - DNA, 25 bp, Mus musculus
tactgtatgctcgtcttgtcctcta

SEQ ID NO: 747740 - DNA, 25 bp, Mus musculus
tactgtattgttcctccagacacag

SEQ ID NO: 747741 - DNA, 25 bp, Mus musculus
tactgtattgttgctccagacacag

SEQ ID NO: 747742 - DNA, 25 bp, Mus musculus
tactgtcacagcacctgggcaagcc

SEQ ID NO: 747743 - DNA, 25 bp, Mus musculus
tactgtcacagctcctgggcaagcc

SEQ ID NO: 747744 - DNA, 25 bp, Mus musculus
tactgtcaccagaagttcattgttc

SEQ ID NO: 747745 - DNA, 25 bp, Mus musculus
tactgtcaccagtagttcattgttc

SEQ ID NO: 747746 - DNA, 25 bp, Mus musculus
tactgtcacccacgaaaggcatctg

SEQ ID NO: 747747 - DNA, 25 bp, Mus musculus
tactgtcacccaggaaaggcatctg

SEQ ID NO: 747748 - DNA, 25 bp, Mus musculus
tactgtcacttacctggccataaac

SEQ ID NO: 747749 - DNA, 25 bp, Mus musculus
tactgtcacttagctggccataaac

SEQ ID NO: 747750 - DNA, 25 bp, Mus musculus
tactgtcagaagcacttctttctgc

SEQ ID NO: 747751 - DNA, 25 bp, Mus musculus
tactgtcagaaggacttctttctgc

SEQ ID NO: 747752 - DNA, 25 bp, Mus musculus
tactgtcaggcaacggcctgaagcc

SEQ ID NO: 747753 - DNA, 25 bp, Mus musculus
tactgtcaggcatcggcctgaagcc

SEQ ID NO: 747754 - DNA, 25 bp, Mus musculus
tactgtcaggccagcggaggaggaa

SEQ ID NO: 747755 - DNA, 25 bp, Mus musculus
tactgtcaggcctgcggaggaggaa

SEQ ID NO: 747756 - DNA, 25 bp, Mus musculus
tactgtcaggtaccctttagccaaa

SEQ ID NO: 747757 - DNA, 25 bp, Mus musculus
tactgtcaggtagcctttagccaaa

SEQ ID NO: 747758 - DNA, 25 bp, Mus musculus
tactgtcatagaacctccaggcacc

SEQ ID NO: 747759 - DNA, 25 bp, Mus musculus
tactgtcatagatcctccaggcacc

SEQ ID NO: 747760 - DNA, 25 bp, Mus musculus
tactgtcatctgcttttggctgcac

SEQ ID NO: 747761 - DNA, 25 bp, Mus musculus
tactgtcatctggttttggctgcac

SEQ ID NO: 747762 - DNA, 25 bp, Mus musculus
tactgtcatgatacaaaattcatag

SEQ ID NO: 747763 - DNA, 25 bp, Mus musculus
tactgtcatgattcaaaattcatag

SEQ ID NO: 747764 - DNA, 25 bp, Mus musculus
tactgtcattcgaaagattgcaaag

SEQ ID NO: 747765 - DNA, 25 bp, Mus musculus
tactgtcattcgtaagattgcaaag

SEQ ID NO: 747766 - DNA, 25 bp, Mus musculus
tactgtccatctacaggctactggt

SEQ ID NO: 747767 - DNA, 25 bp, Mus musculus
tactgtccatcttcaggctactggt

SEQ ID NO: 747768 - DNA, 25 bp, Mus musculus
tactgtcccagtacaaacagaggtg

SEQ ID NO: 747769 - DNA, 25 bp, Mus musculus
tactgtcccagttcaaacagaggtg

SEQ ID NO: 747770 - DNA, 25 bp, Mus musculus
tactgtccccagactgatgccatct

SEQ ID NO: 747771 - DNA, 25 bp, Mus musculus
tactgtccccagtctgatgccatct

SEQ ID NO: 747772 - DNA, 25 bp, Mus musculus
tactgtccctctattgaatcaaagg

SEQ ID NO: 747773 - DNA, 25 bp, Mus musculus
tactgtccctcttttgaatcaaagg

SEQ ID NO: 747774 - DNA, 25 bp, Mus musculus
tactgtccctttcagaggcgttctt

SEQ ID NO: 747775 - DNA, 25 bp, Mus musculus
tactgtccctttgagaggcgttctt

SEQ ID NO: 747776 - DNA, 25 bp, Mus musculus
tactgtccgacaacggatgccaggg

SEQ ID NO: 747777 - DNA, 25 bp, Mus musculus
tactgtccgacatcggatgccaggg

SEQ ID NO: 747778 - DNA, 25 bp, Mus musculus
tactgtccgggcctatctaaactgc

SEQ ID NO: 747779 - DNA, 25 bp, Mus musculus
tactgtccgggcgtatctaaactgc

SEQ ID NO: 747780 - DNA, 25 bp, Mus musculus
tactgtcctgacaacactgtgaggg

SEQ ID NO: 747781 - DNA, 25 bp, Mus musculus
tactgtcctgactacactgtgaggg

SEQ ID NO: 747782 - DNA, 25 bp, Mus musculus
tactgtcgcgatactctcgagagga

SEQ ID NO: 747783 - DNA, 25 bp, Mus musculus
tactgtcgcgattctctcgagagga

SEQ ID NO: 747784 - DNA, 25 bp, Mus musculus
tactgtcgctccagcccttgaggtc

SEQ ID NO: 747785 - DNA, 25 bp, Mus musculus
tactgtcgctcctgcccttgaggtc

SEQ ID NO: 747786 - DNA, 25 bp, Mus musculus
tactgtcggctcaagaagtgcttcc

SEQ ID NO: 747787 - DNA, 25 bp, Mus musculus
tactgtcggctctagaagtgcttcc

SEQ ID NO: 747788 - DNA, 25 bp, Mus musculus
tactgtctatccctgaacactggag

SEQ ID NO: 747789 - DNA, 25 bp, Mus musculus
tactgtctatccgtgaacactggag

SEQ ID NO: 747790 - DNA, 25 bp, Mus musculus
tactgtctgcagaactggtgccttg

SEQ ID NO: 747791 - DNA, 25 bp, Mus musculus
tactgtctgcagtactggtgccttg

SEQ ID NO: 747792 - DNA, 25 bp, Mus musculus
tactgtgaaaacataacggaatgca

SEQ ID NO: 747793 - DNA, 25 bp, Mus musculus
tactgtgaaaacttaacggaatgca

SEQ ID NO: 747794 - DNA, 25 bp, Mus musculus
tactgtgaactgaccaaaagtccct

SEQ ID NO: 747795 - DNA, 25 bp, Mus musculus
tactgtgaactgtccaaaagtccct

SEQ ID NO: 747796 - DNA, 25 bp, Mus musculus
tactgtgaagaaaggatctggcgac

SEQ ID NO: 747797 - DNA, 25 bp, Mus musculus
tactgtgaagaatggatctggcgac

SEQ ID NO: 747798 - DNA, 25 bp, Mus musculus
tactgtgactctcttgaccccgtga

SEQ ID NO: 747799 - DNA, 25 bp, Mus musculus
tactgtgactctgttgaccccgtga

SEQ ID NO: 747800 - DNA, 25 bp, Mus musculus
tactgtgagcggacatgcactgtga

SEQ ID NO: 747801 - DNA, 25 bp, Mus musculus
tactgtgagcggtcatgcactgtga

SEQ ID NO: 747802 - DNA, 25 bp, Mus musculus
tactgtgaggctaacactaggttct

SEQ ID NO: 747803 - DNA, 25 bp, Mus musculus
tactgtgaggcttacactaggttct

SEQ ID NO: 747804 - DNA, 25 bp, Mus musculus
tactgtgagggtagggcagcttaca

SEQ ID NO: 747805 - DNA, 25 bp, Mus musculus
tactgtgagggttgggcagcttaca

SEQ ID NO: 747806 - DNA, 25 bp, Mus musculus
tactgtgaggtaagcgccacttctg

SEQ ID NO: 747807 - DNA, 25 bp, Mus musculus
tactgtgaggtatgcgccacttctg

SEQ ID NO: 747808 - DNA, 25 bp, Mus musculus
tactgtgaggtgaccatgggctctc

SEQ ID NO: 747809 - DNA, 25 bp, Mus musculus
tactgtgaggtgtccatgggctctc

SEQ ID NO: 747810 - DNA, 25 bp, Mus musculus
tactgtgataacaaaaagtgctttc

SEQ ID NO: 747811 - DNA, 25 bp, Mus musculus
tactgtgataactaaaagtgctttc

SEQ ID NO: 747812 - DNA, 25 bp, Mus musculus
tactgtgatctacagataagagcgt

SEQ ID NO: 747813 - DNA, 25 bp, Mus musculus
tactgtgatctagagataagagcgt

SEQ ID NO: 747814 - DNA, 25 bp, Mus musculus
tactgtgatgccattaagctgtaca

SEQ ID NO: 747815 - DNA, 25 bp, Mus musculus
tactgtgatgcctttaagctgtaca

SEQ ID NO: 747816 - DNA, 25 bp, Mus musculus
tactgtgatttcaggttgggtcacc

SEQ ID NO: 747817 - DNA, 25 bp, Mus musculus
tactgtgatttctggttgggtcacc

SEQ ID NO: 747818 - DNA, 25 bp, Mus musculus
tactgtgcccaaagtcagaacatgg

SEQ ID NO: 747819 - DNA, 25 bp, Mus musculus
tactgtgcccaatgtcagaacatgg

SEQ ID NO: 747820 - DNA, 25 bp, Mus musculus
tactgtgccgagaagccgcaatgac

SEQ ID NO: 747821 - DNA, 25 bp, Mus musculus
tactgtgccgagtagccgcaatgac

SEQ ID NO: 747822 - DNA, 25 bp, Mus musculus
tactgtgcggagctttgccaacgag

SEQ ID NO: 747823 - DNA, 25 bp, Mus musculus
tactgtgcggaggtttgccaacgag

SEQ ID NO: 747824 - DNA, 25 bp, Mus musculus
tactgtgcgtgcatggcacaccagg

SEQ ID NO: 747825 - DNA, 25 bp, Mus musculus
tactgtgcgtgcttggcacaccagg

SEQ ID NO: 747826 - DNA, 25 bp, Mus musculus
tactgtgctcacaaagcctcggatc

SEQ ID NO: 747827 - DNA, 25 bp, Mus musculus
tactgtgctcactaagcctcggatc

SEQ ID NO: 747828 - DNA, 25 bp, Mus musculus
tactgtgctttgaggccctttgaag

SEQ ID NO: 747829 - DNA, 25 bp, Mus musculus
tactgtgctttgtggccctttgaag

SEQ ID NO: 747830 - DNA, 25 bp, Mus musculus
tactgtggaaacagccagtagagag

SEQ ID NO: 747831 - DNA, 25 bp, Mus musculus
tactgtggaaactgccagtagagag

SEQ ID NO: 747832 - DNA, 25 bp, Mus musculus
tactgtggaactctgcaatgaacaa

SEQ ID NO: 747833 - DNA, 25 bp, Mus musculus
tactgtggaactgtgcaatgaacaa

SEQ ID NO: 747834 - DNA, 25 bp, Mus musculus
tactgtggaggaataagaggccctg

SEQ ID NO: 747835 - DNA, 25 bp, Mus musculus
tactgtggaggattaagaggccctg

SEQ ID NO: 747836 - DNA, 25 bp, Mus musculus
tactgtggcactatctgttatccaa

SEQ ID NO: 747837 - DNA, 25 bp, Mus musculus
tactgtggcactttctgttatccaa

SEQ ID NO: 747838 - DNA, 25 bp, Mus musculus
tactgtggccatctcggactcatcc

SEQ ID NO: 747839 - DNA, 25 bp, Mus musculus
tactgtggccatgtcggactcatcc

SEQ ID NO: 747840 - DNA, 25 bp, Mus musculus
tactgtggctaacagtactgggcca

SEQ ID NO: 747841 - DNA, 25 bp, Mus musculus
tactgtggctaagagtactgggcca

SEQ ID NO: 747842 - DNA, 25 bp, Mus musculus
tactgtggctcactcaatgagggaa

SEQ ID NO: 747843 - DNA, 25 bp, Mus musculus
tactgtggctcagtcaatgagggaa

SEQ ID NO: 747844 - DNA, 25 bp, Mus musculus
tactgtgggctgcttatgttaaccg

SEQ ID NO: 747845 - DNA, 25 bp, Mus musculus
tactgtgggctggttatgttaaccg

SEQ ID NO: 747846 - DNA, 25 bp, Mus musculus
tactgtggtcacatatatggccttg

SEQ ID NO: 747847 - DNA, 25 bp, Mus musculus
tactgtggtcacttatatggccttg

SEQ ID NO: 747848 - DNA, 25 bp, Mus musculus
tactgtggtcgtctgcattggacag

SEQ ID NO: 747849 - DNA, 25 bp, Mus musculus
tactgtggtcgtgtgcattggacag

SEQ ID NO: 747850 - DNA, 25 bp, Mus musculus
tactgtgtactgagactagagaaag

SEQ ID NO: 747851 - DNA, 25 bp, Mus musculus
tactgtgtactgtgactagagaaag

SEQ ID NO: 747852 - DNA, 25 bp, Mus musculus
tactgtgtcaccaaggatgaccctg

SEQ ID NO: 747853 - DNA, 25 bp, Mus musculus
tactgtgtcacctaggatgaccctg

SEQ ID NO: 747854 - DNA, 25 bp, Mus musculus
tactgtgtgaaaaaacatcttcttc

SEQ ID NO: 747855 - DNA, 25 bp, Mus musculus
tactgtgtgaaataacatcttcttc

SEQ ID NO: 747856 - DNA, 25 bp, Mus musculus
tactgtgtgaagctttaaaggaacc

SEQ ID NO: 747857 - DNA, 25 bp, Mus musculus
tactgtgtgaaggtttaaaggaacc

SEQ ID NO: 747858 - DNA, 25 bp, Mus musculus
tactgtgtgacacgcaagagtctcg

SEQ ID NO: 747859 - DNA, 25 bp, Mus musculus
tactgtgtgacaggcaagagtctcg

SEQ ID NO: 747860 - DNA, 25 bp, Mus musculus
tactgtgtgactatccggtggttgg

SEQ ID NO: 747861 - DNA, 25 bp, Mus musculus
tactgtgtgactttccggtggttgg

SEQ ID NO: 747862 - DNA, 25 bp, Mus musculus
tactgtgtgccacgttggtaggacc

SEQ ID NO: 747863 - DNA, 25 bp, Mus musculus
tactgtgtgccaggttggtaggacc

SEQ ID NO: 747864 - DNA, 25 bp, Mus musculus
tactgtgtggctagtcaggagctcg

SEQ ID NO: 747865 - DNA, 25 bp, Mus musculus
tactgtgtggcttgtcaggagctcg

SEQ ID NO: 747866 - DNA, 25 bp, Mus musculus
tactgtgtgggaacacccagcctgg

SEQ ID NO: 747867 - DNA, 25 bp, Mus musculus
tactgtgtgggatcacccagcctgg

SEQ ID NO: 747868 - DNA, 25 bp, Mus musculus
tactgtgtgtaactgaattgaggtg

SEQ ID NO: 747869 - DNA, 25 bp, Mus musculus
tactgtgtgtaagtgaattgaggtg

SEQ ID NO: 747870 - DNA, 25 bp, Mus musculus
tactgtgtttcccaagatggagctg

SEQ ID NO: 747871 - DNA, 25 bp, Mus musculus
tactgtgtttccgaagatggagctg

SEQ ID NO: 747872 - DNA, 25 bp, Mus musculus
tactgttaaaaaagatggcatctac

SEQ ID NO: 747873 - DNA, 25 bp, Mus musculus
tactgttaaaaatgatggcatctac

SEQ ID NO: 747874 - DNA, 25 bp, Mus musculus
tactgttagcaaagtactcatccca

SEQ ID NO: 747875 - DNA, 25 bp, Mus musculus
tactgttagcaatgtactcatccca

SEQ ID NO: 747876 - DNA, 25 bp, Mus musculus
tactgttagcacctctcaaggttgc

SEQ ID NO: 747877 - DNA, 25 bp, Mus musculus
tactgttagcacgtctcaaggttgc

SEQ ID NO: 747878 - DNA, 25 bp, Mus musculus
tactgttcaagaagagcaatcagac

SEQ ID NO: 747879 - DNA, 25 bp, Mus musculus
tactgttcaagatgagcaatcagac

SEQ ID NO: 747880 - DNA, 25 bp, Mus musculus
tactgttcacgtattaaatgtctct

SEQ ID NO: 747881 - DNA, 25 bp, Mus musculus
tactgttcacgttttaaatgtctct

SEQ ID NO: 747882 - DNA, 25 bp, Mus musculus
tactgttccaacagtcacagcgatg

SEQ ID NO: 747883 - DNA, 25 bp, Mus musculus
tactgttccaactgtcacagcgatg

SEQ ID NO: 747884 - DNA, 25 bp, Mus musculus
tactgttccagaatacaaggagacc

SEQ ID NO: 747885 - DNA, 25 bp, Mus musculus
tactgttccagattacaaggagacc

SEQ ID NO: 747886 - DNA, 25 bp, Mus musculus
tactgttgccggcagacaccactgt

SEQ ID NO: 747887 - DNA, 25 bp, Mus musculus
tactgttgccgggagacaccactgt

SEQ ID NO: 747888 - DNA, 25 bp, Mus musculus
tactgttgccttcttgccttgcaca

SEQ ID NO: 747889 - DNA, 25 bp, Mus musculus
tactgttgccttgttgccttgcaca

SEQ ID NO: 747890 - DNA, 25 bp, Mus musculus
tactgttgctatattttggagtcac

SEQ ID NO: 747891 - DNA, 25 bp, Mus musculus
tactgttgctattttttggagtcac

SEQ ID NO: 747892 - DNA, 25 bp, Mus musculus
tactgttgctttacgtggcagctgg

SEQ ID NO: 747893 - DNA, 25 bp, Mus musculus
tactgttgcttttcgtggcagctgg

SEQ ID NO: 747894 - DNA, 25 bp, Mus musculus
tactgttggcagaaaactagacacg

SEQ ID NO: 747895 - DNA, 25 bp, Mus musculus
tactgttggcagtaaactagacacg

SEQ ID NO: 747896 - DNA, 25 bp, Mus musculus
tactgttggtgtaatcatttggagg

SEQ ID NO: 747897 - DNA, 25 bp, Mus musculus
tactgttggtgttatcatttggagg

SEQ ID NO: 747898 - DNA, 25 bp, Mus musculus
tactgttgtgagattctcgtggtca

SEQ ID NO: 747899 - DNA, 25 bp, Mus musculus
tactgttgtgagtttctcgtggtca

SEQ ID NO: 747900 - DNA, 25 bp, Mus musculus
tactgttgttatacgaccccaggaa

SEQ ID NO: 747901 - DNA, 25 bp, Mus musculus
tactgttgttattcgaccccaggaa

SEQ ID NO: 747902 - DNA, 25 bp, Mus musculus
tactgttgtttaaacctgcaaaagg

SEQ ID NO: 747903 - DNA, 25 bp, Mus musculus
tactgttgtttatacctgcaaaagg

SEQ ID NO: 747904 - DNA, 25 bp, Mus musculus
tactgtttaacaagcgccatatgtc

SEQ ID NO: 747905 - DNA, 25 bp, Mus musculus
tactgtttaacatgcgccatatgtc

SEQ ID NO: 747906 - DNA, 25 bp, Mus musculus
tactgtttacagaacgacgaccaga

SEQ ID NO: 747907 - DNA, 25 bp, Mus musculus
tactgtttacagtacgacgaccaga

SEQ ID NO: 747908 - DNA, 25 bp, Mus musculus
tactgtttatcacacaagccaaagc

SEQ ID NO: 747909 - DNA, 25 bp, Mus musculus
tactgtttatcagacaagccaaagc

SEQ ID NO: 747910 - DNA, 25 bp, Mus musculus
tactgtttgaaacgagagttgctaa

SEQ ID NO: 747911 - DNA, 25 bp, Mus musculus
tactgtttgaaaggagagttgctaa

SEQ ID NO: 747912 - DNA, 25 bp, Mus musculus
tactgttttgtgcagttccatgagc

SEQ ID NO: 747913 - DNA, 25 bp, Mus musculus
tactgttttgtggagttccatgagc

SEQ ID NO: 747914 - DNA, 25 bp, Mus musculus
tacttaaaagtacacgcccagttcg

SEQ ID NO: 747915 - DNA, 25 bp, Mus musculus
tacttaaaagtagacgcccagttcg

SEQ ID NO: 747916 - DNA, 25 bp, Mus musculus
tacttaaaatgaagaaaatctcagc

SEQ ID NO: 747917 - DNA, 25 bp, Mus musculus
tacttaaaatgatgaaaatctcagc

SEQ ID NO: 747918 - DNA, 25 bp, Mus musculus
tacttaaagtctatgggcctataca

SEQ ID NO: 747919 - DNA, 25 bp, Mus musculus
tacttaaagtctttgggcctataca

SEQ ID NO: 747920 - DNA, 25 bp, Mus musculus
tacttaaccaggcttggaaaggcag

SEQ ID NO: 747921 - DNA, 25 bp, Mus musculus
tacttaaccagggttggaaaggcag

SEQ ID NO: 747922 - DNA, 25 bp, Mus musculus
tacttaacttcgcagccccgggtgt

SEQ ID NO: 747923 - DNA, 25 bp, Mus musculus
tacttaacttcggagccccgggtgt

SEQ ID NO: 747924 - DNA, 25 bp, Mus musculus
tacttaaggagcaacccactcattg

SEQ ID NO: 747925 - DNA, 25 bp, Mus musculus
tacttaaggagctacccactcattg

SEQ ID NO: 747926 - DNA, 25 bp, Mus musculus
tacttaaggatccactgtacatcgg

SEQ ID NO: 747927 - DNA, 25 bp, Mus musculus
tacttaaggatcgactgtacatcgg

SEQ ID NO: 747928 - DNA, 25 bp, Mus musculus
tacttaaggtgacgcctgcggattc

SEQ ID NO: 747929 - DNA, 25 bp, Mus musculus
tacttaaggtgaggcctgcggattc

SEQ ID NO: 747930 - DNA, 25 bp, Mus musculus
tacttaagtgtaacatcaccgccaa

SEQ ID NO: 747931 - DNA, 25 bp, Mus musculus
tacttaagtgtatcatcaccgccaa

SEQ ID NO: 747932 - DNA, 25 bp, Mus musculus
tacttaatgattagggtgatcaccg

SEQ ID NO: 747933 - DNA, 25 bp, Mus musculus
tacttaatgatttgggtgatcaccg

SEQ ID NO: 747934 - DNA, 25 bp, Mus musculus
tacttaatgccaaaacgagaatcgt

SEQ ID NO: 747935 - DNA, 25 bp, Mus musculus
tacttaatgccataacgagaatcgt

SEQ ID NO: 747936 - DNA, 25 bp, Mus musculus
tacttaatgcccatttgtccagaaa

SEQ ID NO: 747937 - DNA, 25 bp, Mus musculus
tacttaatgcccttttgtccagaaa

SEQ ID NO: 747938 - DNA, 25 bp, Mus musculus
tacttaatgctacgtagagaccaga

SEQ ID NO: 747939 - DNA, 25 bp, Mus musculus
tacttaatgctaggtagagaccaga

SEQ ID NO: 747940 - DNA, 25 bp, Mus musculus
tacttaatgctgagtagactcggct

SEQ ID NO: 747941 - DNA, 25 bp, Mus musculus
tacttaatgctgtgtagactcggct

SEQ ID NO: 747942 - DNA, 25 bp, Mus musculus
tacttaattgatcggtcacacaagg

SEQ ID NO: 747943 - DNA, 25 bp, Mus musculus
tacttaattgatgggtcacacaagg

SEQ ID NO: 747944 - DNA, 25 bp, Mus musculus
tacttacaagacataaattgctcag

SEQ ID NO: 747945 - DNA, 25 bp, Mus musculus
tacttacaagacttaaattgctcag

SEQ ID NO: 747946 - DNA, 25 bp, Mus musculus
tacttacacacgaggatagcctgga

SEQ ID NO: 747947 - DNA, 25 bp, Mus musculus
tacttacacacgtggatagcctgga

SEQ ID NO: 747948 - DNA, 25 bp, Mus musculus
tacttacacatgcaagctcctgtca

SEQ ID NO: 747949 - DNA, 25 bp, Mus musculus
tacttacacatggaagctcctgtca

SEQ ID NO: 747950 - DNA, 25 bp, Mus musculus
tacttaccacagcatcgatctttca

SEQ ID NO: 747951 - DNA, 25 bp, Mus musculus
tacttaccacaggatcgatctttca

SEQ ID NO: 747952 - DNA, 25 bp, Mus musculus
tacttaccacataacagatgaccgt

SEQ ID NO: 747953 - DNA, 25 bp, Mus musculus
tacttaccacattacagatgaccgt

SEQ ID NO: 747954 - DNA, 25 bp, Mus musculus
tacttacctctgagagcagccggta

SEQ ID NO: 747955 - DNA, 25 bp, Mus musculus
tacttacctctgtgagcagccggta

SEQ ID NO: 747956 - DNA, 25 bp, Mus musculus
tacttacgtgcaccctagaaggaag

SEQ ID NO: 747957 - DNA, 25 bp, Mus musculus
tacttacgtgcagcctagaaggaag

SEQ ID NO: 747958 - DNA, 25 bp, Mus musculus
tacttactgaggaacaccagggtcg

SEQ ID NO: 747959 - DNA, 25 bp, Mus musculus
tacttactgaggtacaccagggtcg

SEQ ID NO: 747960 - DNA, 25 bp, Mus musculus
tacttactggaccagcatatcctga

SEQ ID NO: 747961 - DNA, 25 bp, Mus musculus
tacttactggacgagcatatcctga

SEQ ID NO: 747962 - DNA, 25 bp, Mus musculus
tacttactgggcaccggcatgagaa

SEQ ID NO: 747963 - DNA, 25 bp, Mus musculus
tacttactgggctccggcatgagaa

SEQ ID NO: 747964 - DNA, 25 bp, Mus musculus
tacttacttacaagacacagtggaa

SEQ ID NO: 747965 - DNA, 25 bp, Mus musculus
tacttacttacatgacacagtggaa

SEQ ID NO: 747966 - DNA, 25 bp, Mus musculus
tacttacttcgtaccatgggacaag

SEQ ID NO: 747967 - DNA, 25 bp, Mus musculus
tacttacttcgttccatgggacaag

SEQ ID NO: 747968 - DNA, 25 bp, Mus musculus
tacttacttgggaaaatactgggct

SEQ ID NO: 747969 - DNA, 25 bp, Mus musculus
tacttacttgggtaaatactgggct

SEQ ID NO: 747970 - DNA, 25 bp, Mus musculus
tacttagaaacaaacctggaggcat

SEQ ID NO: 747971 - DNA, 25 bp, Mus musculus
tacttagaaacatacctggaggcat

SEQ ID NO: 747972 - DNA, 25 bp, Mus musculus
tacttagaagaaatggcgcatctcc

SEQ ID NO: 747973 - DNA, 25 bp, Mus musculus
tacttagaagaattggcgcatctcc

SEQ ID NO: 747974 - DNA, 25 bp, Mus musculus
tacttagacaagcatgtggaggccc

SEQ ID NO: 747975 - DNA, 25 bp, Mus musculus
tacttagacaaggatgtggaggccc

SEQ ID NO: 747976 - DNA, 25 bp, Mus musculus
tacttagacaatcaactcagcagcc

SEQ ID NO: 747977 - DNA, 25 bp, Mus musculus
tacttagacaatgaactcagcagcc

SEQ ID NO: 747978 - DNA, 25 bp, Mus musculus
tacttagacattccgaaccagacag

SEQ ID NO: 747979 - DNA, 25 bp, Mus musculus
tacttagacattgcgaaccagacag

SEQ ID NO: 747980 - DNA, 25 bp, Mus musculus
tacttaggcagacctggtgttttag

SEQ ID NO: 747981 - DNA, 25 bp, Mus musculus
tacttaggcagagctggtgttttag

SEQ ID NO: 747982 - DNA, 25 bp, Mus musculus
tacttaggctgcagaaaggtttaaa

SEQ ID NO: 747983 - DNA, 25 bp, Mus musculus
tacttaggctgctgaaaggtttaaa

SEQ ID NO: 747984 - DNA, 25 bp, Mus musculus
tacttataaacacggccttcccttg

SEQ ID NO: 747985 - DNA, 25 bp, Mus musculus
tacttataaacagggccttcccttg

SEQ ID NO: 747986 - DNA, 25 bp, Mus musculus
tacttataccacaatgagagcgagg

SEQ ID NO: 747987 - DNA, 25 bp, Mus musculus
tacttataccactatgagagcgagg

SEQ ID NO: 747988 - DNA, 25 bp, Mus musculus
tacttatatttactcagaaactggg

SEQ ID NO: 747989 - DNA, 25 bp, Mus musculus
tacttatatttagtcagaaactggg

SEQ ID NO: 747990 - DNA, 25 bp, Mus musculus
tacttatcacagactcatttaatgc

SEQ ID NO: 747991 - DNA, 25 bp, Mus musculus
tacttatcacagtctcatttaatgc

SEQ ID NO: 747992 - DNA, 25 bp, Mus musculus
tacttatctggcaatacctttgaat

SEQ ID NO: 747993 - DNA, 25 bp, Mus musculus
tacttatctggctatacctttgaat

SEQ ID NO: 747994 - DNA, 25 bp, Mus musculus
tacttatgaatacacggctccagca

SEQ ID NO: 747995 - DNA, 25 bp, Mus musculus
tacttatgaatagacggctccagca

SEQ ID NO: 747996 - DNA, 25 bp, Mus musculus
tacttattcaaaaacaaacctcctg

SEQ ID NO: 747997 - DNA, 25 bp, Mus musculus
tacttattcaaatacaaacctcctg

SEQ ID NO: 747998 - DNA, 25 bp, Mus musculus
tacttattgcccagacggaatgtcg

SEQ ID NO: 747999 - DNA, 25 bp, Mus musculus
tacttattgccctgacggaatgtcg

SEQ ID NO: 748000 - DNA, 25 bp, Mus musculus
tacttatttagcctttactaccgtg

SEQ ID NO: 748001 - DNA, 25 bp, Mus musculus
tacttatttagcgtttactaccgtg

SEQ ID NO: 748002 - DNA, 25 bp, Mus musculus
tacttcaaaggacaatgcctagaag

SEQ ID NO: 748003 - DNA, 25 bp, Mus musculus
tacttcaaaggagaatgcctagaag

SEQ ID NO: 748004 - DNA, 25 bp, Mus musculus
tacttcaaccacaaacaagattacg

SEQ ID NO: 748005 - DNA, 25 bp, Mus musculus
tacttcaaccactaacaagattacg

SEQ ID NO: 748006 - DNA, 25 bp, Mus musculus
tacttcaactggcatcactgtggca

SEQ ID NO: 748007 - DNA, 25 bp, Mus musculus
tacttcaactgggatcactgtggca

SEQ ID NO: 748008 - DNA, 25 bp, Mus musculus
tacttcaagagtaagagggtggttt

SEQ ID NO: 748009 - DNA, 25 bp, Mus musculus
tacttcaagagttagagggtggttt

SEQ ID NO: 748010 - DNA, 25 bp, Mus musculus
tacttcaatatgagagactcttcgg

SEQ ID NO: 748011 - DNA, 25 bp, Mus musculus
tacttcaatatgtgagactcttcgg

SEQ ID NO: 748012 - DNA, 25 bp, Mus musculus
tacttcaatgatccccagcgacaag

SEQ ID NO: 748013 - DNA, 25 bp, Mus musculus
tacttcaatgatgcccagcgacaag

SEQ ID NO: 748014 - DNA, 25 bp, Mus musculus
tacttcaatgtcatcaacacctggg

SEQ ID NO: 748015 - DNA, 25 bp, Mus musculus
tacttcaatgtcttcaacacctggg

SEQ ID NO: 748016 - DNA, 25 bp, Mus musculus
tacttcacaatgacccaaactgagc

SEQ ID NO: 748017 - DNA, 25 bp, Mus musculus
tacttcacaatgtcccaaactgagc

SEQ ID NO: 748018 - DNA, 25 bp, Mus musculus
tacttcacacttcaaacccgtgaag

SEQ ID NO: 748019 - DNA, 25 bp, Mus musculus
tacttcacacttgaaacccgtgaag

SEQ ID NO: 748020 - DNA, 25 bp, Mus musculus
tacttcacatacacagcccttgagg

SEQ ID NO: 748021 - DNA, 25 bp, Mus musculus
tacttcacatactcagcccttgagg

SEQ ID NO: 748022 - DNA, 25 bp, Mus musculus
tacttcaccatgctagttggcatct

SEQ ID NO: 748023 - DNA, 25 bp, Mus musculus
tacttcaccatggtagttggcatct

SEQ ID NO: 748024 - DNA, 25 bp, Mus musculus
tacttcacccacattgacctggaac

SEQ ID NO: 748025 - DNA, 25 bp, Mus musculus
tacttcacccactttgacctggaac

SEQ ID NO: 748026 - DNA, 25 bp, Mus musculus
tacttcaccgcaacgatgccttact

SEQ ID NO: 748027 - DNA, 25 bp, Mus musculus
tacttcaccgcatcgatgccttact

SEQ ID NO: 748028 - DNA, 25 bp, Mus musculus
tacttcaccgctactttcccgtttg

SEQ ID NO: 748029 - DNA, 25 bp, Mus musculus
tacttcaccgcttctttcccgtttg

SEQ ID NO: 748030 - DNA, 25 bp, Mus musculus
tacttcacctccagcagacattgag

SEQ ID NO: 748031 - DNA, 25 bp, Mus musculus
tacttcacctcctgcagacattgag

SEQ ID NO: 748032 - DNA, 25 bp, Mus musculus
tacttcacctggctggcatttgact

SEQ ID NO: 748033 - DNA, 25 bp, Mus musculus
tacttcacctgggtggcatttgact

SEQ ID NO: 748034 - DNA, 25 bp, Mus musculus
tacttcacgctactgaccgaaggcg

SEQ ID NO: 748035 - DNA, 25 bp, Mus musculus
tacttcacgctagtgaccgaaggcg

SEQ ID NO: 748036 - DNA, 25 bp, Mus musculus
tacttcacggacattgatgacaagc

SEQ ID NO: 748037 - DNA, 25 bp, Mus musculus
tacttcacggactttgatgacaagc

SEQ ID NO: 748038 - DNA, 25 bp, Mus musculus
tacttcagcatcctctactggctgg

SEQ ID NO: 748039 - DNA, 25 bp, Mus musculus
tacttcagcatcgtctactggctgg

SEQ ID NO: 748040 - DNA, 25 bp, Mus musculus
tacttcagcttcattgcaccactca

SEQ ID NO: 748041 - DNA, 25 bp, Mus musculus
tacttcagcttctttgcaccactca

SEQ ID NO: 748042 - DNA, 25 bp, Mus musculus
tacttcagtcagaaacagcccggat

SEQ ID NO: 748043 - DNA, 25 bp, Mus musculus
tacttcagtcagtaacagcccggat

SEQ ID NO: 748044 - DNA, 25 bp, Mus musculus
tacttcatctgtcacgtgggcaacc

SEQ ID NO: 748045 - DNA, 25 bp, Mus musculus
tacttcatctgtgacgtgggcaacc

SEQ ID NO: 748046 - DNA, 25 bp, Mus musculus
tacttcatgagacagacggtcaata

SEQ ID NO: 748047 - DNA, 25 bp, Mus musculus
tacttcatgagagagacggtcaata

SEQ ID NO: 748048 - DNA, 25 bp, Mus musculus
tacttcatggcaatagtgtgttcac

SEQ ID NO: 748049 - DNA, 25 bp, Mus musculus
tacttcatggcattagtgtgttcac

SEQ ID NO: 748050 - DNA, 25 bp, Mus musculus
tacttcattcccctggcctgtttct

SEQ ID NO: 748051 - DNA, 25 bp, Mus musculus
tacttcattcccgtggcctgtttct

SEQ ID NO: 748052 - DNA, 25 bp, Mus musculus
tacttcattgcaactttcatcgctg

SEQ ID NO: 748053 - DNA, 25 bp, Mus musculus
tacttcattgcatctttcatcgctg

SEQ ID NO: 748054 - DNA, 25 bp, Mus musculus
tacttcatttacaccacaggaaccg

SEQ ID NO: 748055 - DNA, 25 bp, Mus musculus
tacttcatttactccacaggaaccg

SEQ ID NO: 748056 - DNA, 25 bp, Mus musculus
tacttccaaagaatgaccacaacct

SEQ ID NO: 748057 - DNA, 25 bp, Mus musculus
tacttccaaagattgaccacaacct

SEQ ID NO: 748058 - DNA, 25 bp, Mus musculus
tacttccaagatcaaccatgccttc

SEQ ID NO: 748059 - DNA, 25 bp, Mus musculus
tacttccaagatgaaccatgccttc

SEQ ID NO: 748060 - DNA, 25 bp, Mus musculus
tacttccaccacagacaattctgct

SEQ ID NO: 748061 - DNA, 25 bp, Mus musculus
tacttccaccactgacaattctgct

SEQ ID NO: 748062 - DNA, 25 bp, Mus musculus
tacttccacccaaaaagataattgg

SEQ ID NO: 748063 - DNA, 25 bp, Mus musculus
tacttccacccataaagataattgg

SEQ ID NO: 748064 - DNA, 25 bp, Mus musculus
tacttccactgcctaagaatagtgg

SEQ ID NO: 748065 - DNA, 25 bp, Mus musculus
tacttccactgcgtaagaatagtgg

SEQ ID NO: 748066 - DNA, 25 bp, Mus musculus
tacttccagagacaatggcgatttc

SEQ ID NO: 748067 - DNA, 25 bp, Mus musculus
tacttccagagagaatggcgatttc

SEQ ID NO: 748068 - DNA, 25 bp, Mus musculus
tacttccaggatccggatggtctct

SEQ ID NO: 748069 - DNA, 25 bp, Mus musculus
tacttccaggatgcggatggtctct

SEQ ID NO: 748070 - DNA, 25 bp, Mus musculus
tacttccagtaccagatcatcatga

SEQ ID NO: 748071 - DNA, 25 bp, Mus musculus
tacttccagtacgagatcatcatga

SEQ ID NO: 748072 - DNA, 25 bp, Mus musculus
tacttccagttccagctatttaaaa

SEQ ID NO: 748073 - DNA, 25 bp, Mus musculus
tacttccagttcgagctatttaaaa

SEQ ID NO: 748074 - DNA, 25 bp, Mus musculus
tacttccatcgtcgtgccaagtgga

SEQ ID NO: 748075 - DNA, 25 bp, Mus musculus
tacttccatcgtggtgccaagtgga

SEQ ID NO: 748076 - DNA, 25 bp, Mus musculus
tacttccctttgctgtaaacaatgt

SEQ ID NO: 748077 - DNA, 25 bp, Mus musculus
tacttccctttggtgtaaacaatgt

SEQ ID NO: 748078 - DNA, 25 bp, Mus musculus
tacttccgaagactgtacggttgca

SEQ ID NO: 748079 - DNA, 25 bp, Mus musculus
tacttccgaagagtgtacggttgca

SEQ ID NO: 748080 - DNA, 25 bp, Mus musculus
tacttccgcaagcagaatctcttgg

SEQ ID NO: 748081 - DNA, 25 bp, Mus musculus
tacttccgcaaggagaatctcttgg

SEQ ID NO: 748082 - DNA, 25 bp, Mus musculus
tacttcctgcaacgcatgggctaca

SEQ ID NO: 748083 - DNA, 25 bp, Mus musculus
tacttcctgcaaggcatgggctaca

SEQ ID NO: 748084 - DNA, 25 bp, Mus musculus
tacttcctgccactgattgggttgg

SEQ ID NO: 748085 - DNA, 25 bp, Mus musculus
tacttcctgccagtgattgggttgg

SEQ ID NO: 748086 - DNA, 25 bp, Mus musculus
tacttcctgcctagtgaccacacag

SEQ ID NO: 748087 - DNA, 25 bp, Mus musculus
tacttcctgccttgtgaccacacag

SEQ ID NO: 748088 - DNA, 25 bp, Mus musculus
tacttcctggaaccttatcggccca

SEQ ID NO: 748089 - DNA, 25 bp, Mus musculus
tacttcctggaagcttatcggccca

SEQ ID NO: 748090 - DNA, 25 bp, Mus musculus
tacttcctggtgctgcgtgtgttcc

SEQ ID NO: 748091 - DNA, 25 bp, Mus musculus
tacttcctggtggtgcgtgtgttcc

SEQ ID NO: 748092 - DNA, 25 bp, Mus musculus
tacttcctgtgtactctgtagagct

SEQ ID NO: 748093 - DNA, 25 bp, Mus musculus
tacttcctgtgttctctgtagagct

SEQ ID NO: 748094 - DNA, 25 bp, Mus musculus
tacttcctttcgcactgtcacaagg

SEQ ID NO: 748095 - DNA, 25 bp, Mus musculus
tacttcctttcggactgtcacaagg

SEQ ID NO: 748096 - DNA, 25 bp, Mus musculus
tacttcgatactccaagctgtacag

SEQ ID NO: 748097 - DNA, 25 bp, Mus musculus
tacttcgatactgcaagctgtacag

SEQ ID NO: 748098 - DNA, 25 bp, Mus musculus
tacttcgatccaagcagataaaacg

SEQ ID NO: 748099 - DNA, 25 bp, Mus musculus
tacttcgatccatgcagataaaacg

SEQ ID NO: 748100 - DNA, 25 bp, Mus musculus
tacttcgatgctagtgggtttgatg

SEQ ID NO: 748101 - DNA, 25 bp, Mus musculus
tacttcgatgcttgtgggtttgatg

SEQ ID NO: 748102 - DNA, 25 bp, Mus musculus
tacttcgccacaacgtctatcgtgc

SEQ ID NO: 748103 - DNA, 25 bp, Mus musculus
tacttcgccacatcgtctatcgtgc

SEQ ID NO: 748104 - DNA, 25 bp, Mus musculus
tacttcgccggcaccctgagagggc

SEQ ID NO: 748105 - DNA, 25 bp, Mus musculus
tacttcgccggctccctgagagggc

SEQ ID NO: 748106 - DNA, 25 bp, Mus musculus
tacttcggagagaggtaagaccacg

SEQ ID NO: 748107 - DNA, 25 bp, Mus musculus
tacttcggagagtggtaagaccacg

SEQ ID NO: 748108 - DNA, 25 bp, Mus musculus
tacttcggagccagtatggcacacc

SEQ ID NO: 748109 - DNA, 25 bp, Mus musculus
tacttcggagcctgtatggcacacc

SEQ ID NO: 748110 - DNA, 25 bp, Mus musculus
tacttcggcagaagtgggagaggat

SEQ ID NO: 748111 - DNA, 25 bp, Mus musculus
tacttcggcagatgtgggagaggat

SEQ ID NO: 748112 - DNA, 25 bp, Mus musculus
tacttcgggagcagaggacaaagca

SEQ ID NO: 748113 - DNA, 25 bp, Mus musculus
tacttcgggagctgaggacaaagca

SEQ ID NO: 748114 - DNA, 25 bp, Mus musculus
tacttcgggcctaggactgagctgt

SEQ ID NO: 748115 - DNA, 25 bp, Mus musculus
tacttcgggccttggactgagctgt

SEQ ID NO: 748116 - DNA, 25 bp, Mus musculus
tacttcggttgcatgaaggcggcgc

SEQ ID NO: 748117 - DNA, 25 bp, Mus musculus
tacttcggttgcttgaaggcggcgc

SEQ ID NO: 748118 - DNA, 25 bp, Mus musculus
tacttcgtgaacatggccgtggcgg

SEQ ID NO: 748119 - DNA, 25 bp, Mus musculus
tacttcgtgaacttggccgtggcgg

SEQ ID NO: 748120 - DNA, 25 bp, Mus musculus
tacttcgtgatgagaaagctgaagg

SEQ ID NO: 748121 - DNA, 25 bp, Mus musculus
tacttcgtgatgtgaaagctgaagg

SEQ ID NO: 748122 - DNA, 25 bp, Mus musculus
tacttcgtggctctggtgatcctgg

SEQ ID NO: 748123 - DNA, 25 bp, Mus musculus
tacttcgtggctgtggtgatcctgg

SEQ ID NO: 748124 - DNA, 25 bp, Mus musculus
tacttctcaaccaagggtggactgg

SEQ ID NO: 748125 - DNA, 25 bp, Mus musculus
tacttctcaacctagggtggactgg

SEQ ID NO: 748126 - DNA, 25 bp, Mus musculus
tacttctcagcgcatgggttcaagc

SEQ ID NO: 748127 - DNA, 25 bp, Mus musculus
tacttctcagcggatgggttcaagc

SEQ ID NO: 748128 - DNA, 25 bp, Mus musculus
tacttctccaaactagtggagttcc

SEQ ID NO: 748129 - DNA, 25 bp, Mus musculus
tacttctccaaagtagtggagttcc

SEQ ID NO: 748130 - DNA, 25 bp, Mus musculus
tacttctcggacacggatcaccttt

SEQ ID NO: 748131 - DNA, 25 bp, Mus musculus
tacttctcggactcggatcaccttt

SEQ ID NO: 748132 - DNA, 25 bp, Mus musculus
tacttctgattccatagtggccgtg

SEQ ID NO: 748133 - DNA, 25 bp, Mus musculus
tacttctgattcgatagtggccgtg

SEQ ID NO: 748134 - DNA, 25 bp, Mus musculus
tacttctgcaggacgtacaccctgg

SEQ ID NO: 748135 - DNA, 25 bp, Mus musculus
tacttctgcaggtcgtacaccctgg

SEQ ID NO: 748136 - DNA, 25 bp, Mus musculus
tacttctgccgcaactgcagtgagc

SEQ ID NO: 748137 - DNA, 25 bp, Mus musculus
tacttctgccgctactgcagtgagc

SEQ ID NO: 748138 - DNA, 25 bp, Mus musculus
tacttctgcttcagccgtggatgta

SEQ ID NO: 748139 - DNA, 25 bp, Mus musculus
tacttctgcttctgccgtggatgta

SEQ ID NO: 748140 - DNA, 25 bp, Mus musculus
tacttctggacgaagcaacatcagc

SEQ ID NO: 748141 - DNA, 25 bp, Mus musculus
tacttctggacgtagcaacatcagc

SEQ ID NO: 748142 - DNA, 25 bp, Mus musculus
tacttctggagaagatcttggaccc

SEQ ID NO: 748143 - DNA, 25 bp, Mus musculus
tacttctggagatgatcttggaccc

SEQ ID NO: 748144 - DNA, 25 bp, Mus musculus
tacttctggcgaagcaggctttcca

SEQ ID NO: 748145 - DNA, 25 bp, Mus musculus
tacttctggcgatgcaggctttcca

SEQ ID NO: 748146 - DNA, 25 bp, Mus musculus
tacttctgggaaaggttgaatacag

SEQ ID NO: 748147 - DNA, 25 bp, Mus musculus
tacttctgggaatggttgaatacag

SEQ ID NO: 748148 - DNA, 25 bp, Mus musculus
tacttctggtacaggaaaacactca

SEQ ID NO: 748149 - DNA, 25 bp, Mus musculus
tacttctggtactggaaaacactca

SEQ ID NO: 748150 - DNA, 25 bp, Mus musculus
tacttctggtgaagtgagatcctga

SEQ ID NO: 748151 - DNA, 25 bp, Mus musculus
tacttctggtgactcacgaccgcct

SEQ ID NO: 748152 - DNA, 25 bp, Mus musculus
tacttctggtgagtcacgaccgcct

SEQ ID NO: 748153 - DNA, 25 bp, Mus musculus
tacttctggtgatgtgagatcctga

SEQ ID NO: 748154 - DNA, 25 bp, Mus musculus
tacttctgtcttataggtgtctgcc

SEQ ID NO: 748155 - DNA, 25 bp, Mus musculus
tacttctgtcttttaggtgtctgcc

SEQ ID NO: 748156 - DNA, 25 bp, Mus musculus
tacttctgtgagacctccaactgga

SEQ ID NO: 748157 - DNA, 25 bp, Mus musculus
tacttctgtgagtcctccaactgga

SEQ ID NO: 748158 - DNA, 25 bp, Mus musculus
tacttcttaggcatgactccatcgg

SEQ ID NO: 748159 - DNA, 25 bp, Mus musculus
tacttcttaggcttgactccatcgg

SEQ ID NO: 748160 - DNA, 25 bp, Mus musculus
tacttcttcatgatgctaacactgg

SEQ ID NO: 748161 - DNA, 25 bp, Mus musculus
tacttcttcatgttgctaacactgg

SEQ ID NO: 748162 - DNA, 25 bp, Mus musculus
tacttcttggccctgcgagagatga

SEQ ID NO: 748163 - DNA, 25 bp, Mus musculus
tacttcttggccgtgcgagagatga

SEQ ID NO: 748164 - DNA, 25 bp, Mus musculus
tacttgaaaacgaagaagctattct

SEQ ID NO: 748165 - DNA, 25 bp, Mus musculus
tacttgaaaacgtagaagctattct

SEQ ID NO: 748166 - DNA, 25 bp, Mus musculus
tacttgaaatgtattaggtgcatca

SEQ ID NO: 748167 - DNA, 25 bp, Mus musculus
tacttgaaatgttttaggtgcatca

SEQ ID NO: 748168 - DNA, 25 bp, Mus musculus
tacttgaacaacaaagtggattgag

SEQ ID NO: 748169 - DNA, 25 bp, Mus musculus
tacttgaacaactaagtggattgag

SEQ ID NO: 748170 - DNA, 25 bp, Mus musculus
tacttgaagccccttagaggctctg

SEQ ID NO: 748171 - DNA, 25 bp, Mus musculus
tacttgaagcccgttagaggctctg

SEQ ID NO: 748172 - DNA, 25 bp, Mus musculus
tacttgaatcagactgggtgtacgg

SEQ ID NO: 748173 - DNA, 25 bp, Mus musculus
tacttgaatcagtctgggtgtacgg

SEQ ID NO: 748174 - DNA, 25 bp, Mus musculus
tacttgaatgtacaatcggtgagca

SEQ ID NO: 748175 - DNA, 25 bp, Mus musculus
tacttgaatgtagaatcggtgagca

SEQ ID NO: 748176 - DNA, 25 bp, Mus musculus
tacttgaatgtgatagctgatgacc

SEQ ID NO: 748177 - DNA, 25 bp, Mus musculus
tacttgaatgtgttagctgatgacc

SEQ ID NO: 748178 - DNA, 25 bp, Mus musculus
tacttgaatgttatagctgagcctg

SEQ ID NO: 748179 - DNA, 25 bp, Mus musculus
tacttgaatgttttagctgagcctg

SEQ ID NO: 748180 - DNA, 25 bp, Mus musculus
tacttgacattgcaccaagtgttta

SEQ ID NO: 748181 - DNA, 25 bp, Mus musculus
tacttgacattggaccaagtgttta

SEQ ID NO: 748182 - DNA, 25 bp, Mus musculus
tacttgacctagatgaccagtgccc

SEQ ID NO: 748183 - DNA, 25 bp, Mus musculus
tacttgacctagttgaccagtgccc

SEQ ID NO: 748184 - DNA, 25 bp, Mus musculus
tacttgactgagactcggagaggcg

SEQ ID NO: 748185 - DNA, 25 bp, Mus musculus
tacttgactgagtctcggagaggcg

SEQ ID NO: 748186 - DNA, 25 bp, Mus musculus
tacttgagaaagacagccaacagac

SEQ ID NO: 748187 - DNA, 25 bp, Mus musculus
tacttgagaaagtcagccaacagac

SEQ ID NO: 748188 - DNA, 25 bp, Mus musculus
tacttgagccacaggcctttttaaa

SEQ ID NO: 748189 - DNA, 25 bp, Mus musculus
tacttgagccactggcctttttaaa

SEQ ID NO: 748190 - DNA, 25 bp, Mus musculus
tacttgagcccgactgcggcggagc

SEQ ID NO: 748191 - DNA, 25 bp, Mus musculus
tacttgagcccgtctgcggcggagc

SEQ ID NO: 748192 - DNA, 25 bp, Mus musculus
tacttgagcggaaccgccgtgagca

SEQ ID NO: 748193 - DNA, 25 bp, Mus musculus
tacttgagcggatccgccgtgagca

SEQ ID NO: 748194 - DNA, 25 bp, Mus musculus
tacttgagctcactggcacaggcgg

SEQ ID NO: 748195 - DNA, 25 bp, Mus musculus
tacttgagctcagtggcacaggcgg

SEQ ID NO: 748196 - DNA, 25 bp, Mus musculus
tacttgaggactcccaaatccctgg

SEQ ID NO: 748197 - DNA, 25 bp, Mus musculus
tacttgaggactgccaaatccctgg

SEQ ID NO: 748198 - DNA, 25 bp, Mus musculus
tacttgagtgcaccatggaaacgct

SEQ ID NO: 748199 - DNA, 25 bp, Mus musculus
tacttgagtgcagcatggaaacgct

SEQ ID NO: 748200 - DNA, 25 bp, Mus musculus
tacttgatagctcagggtctacatt

SEQ ID NO: 748201 - DNA, 25 bp, Mus musculus
tacttgatagctgagggtctacatt

SEQ ID NO: 748202 - DNA, 25 bp, Mus musculus
tacttgatgtggaggaattggcaac

SEQ ID NO: 748203 - DNA, 25 bp, Mus musculus
tacttgatgtggtggaattggcaac

SEQ ID NO: 748204 - DNA, 25 bp, Mus musculus
tacttgcaaaatctaccctgggact

SEQ ID NO: 748205 - DNA, 25 bp, Mus musculus
tacttgcaaaatgtaccctgggact

SEQ ID NO: 748206 - DNA, 25 bp, Mus musculus
tacttgcactaaaaaagtgcactgc

SEQ ID NO: 748207 - DNA, 25 bp, Mus musculus
tacttgcactaataaagtgcactgc

SEQ ID NO: 748208 - DNA, 25 bp, Mus musculus
tacttgcactcccagaagaacgtgg

SEQ ID NO: 748209 - DNA, 25 bp, Mus musculus
tacttgcactccgagaagaacgtgg

SEQ ID NO: 748210 - DNA, 25 bp, Mus musculus
tacttgcagatgcaccccgatggag

SEQ ID NO: 748211 - DNA, 25 bp, Mus musculus
tacttgcagatggaccccgatggag

SEQ ID NO: 748212 - DNA, 25 bp, Mus musculus
tacttgcatgtcattggacaaaagc

SEQ ID NO: 748213 - DNA, 25 bp, Mus musculus
tacttgcatgtctttggacaaaagc

SEQ ID NO: 748214 - DNA, 25 bp, Mus musculus
tacttgcatgtgagggaggcctttg

SEQ ID NO: 748215 - DNA, 25 bp, Mus musculus
tacttgcatgtgtgggaggcctttg

SEQ ID NO: 748216 - DNA, 25 bp, Mus musculus
tacttgcattctcctgacacttttc

SEQ ID NO: 748217 - DNA, 25 bp, Mus musculus
tacttgcattctgctgacacttttc

SEQ ID NO: 748218 - DNA, 25 bp, Mus musculus
tacttgcccaggaggctctaacttt

SEQ ID NO: 748219 - DNA, 25 bp, Mus musculus
tacttgcccaggtggctctaacttt

SEQ ID NO: 748220 - DNA, 25 bp, Mus musculus
tacttgccccatagatgatgctgaa

SEQ ID NO: 748221 - DNA, 25 bp, Mus musculus
tacttgccccattgatgatgctgaa

SEQ ID NO: 748222 - DNA, 25 bp, Mus musculus
tacttgcctattatgagtaagctct

SEQ ID NO: 748223 - DNA, 25 bp, Mus musculus
tacttgcctattttgagtaagctct

SEQ ID NO: 748224 - DNA, 25 bp, Mus musculus
tacttgcctgctcagttggccagag

SEQ ID NO: 748225 - DNA, 25 bp, Mus musculus
tacttgcctgctgagttggccagag

SEQ ID NO: 748226 - DNA, 25 bp, Mus musculus
tacttgcgcaagcagactacctcta

SEQ ID NO: 748227 - DNA, 25 bp, Mus musculus
tacttgcgcaaggagactacctcta

SEQ ID NO: 748228 - DNA, 25 bp, Mus musculus
tacttgcggtttcactatggatctg

SEQ ID NO: 748229 - DNA, 25 bp, Mus musculus
tacttgcggtttgactatggatctg

SEQ ID NO: 748230 - DNA, 25 bp, Mus musculus
tacttgctgctcaacaaccaggagc

SEQ ID NO: 748231 - DNA, 25 bp, Mus musculus
tacttgctgctctacaaccaggagc

SEQ ID NO: 748232 - DNA, 25 bp, Mus musculus
tacttgctgtacaagcctagagacc

SEQ ID NO: 748233 - DNA, 25 bp, Mus musculus
tacttgctgtactagcctagagacc

SEQ ID NO: 748234 - DNA, 25 bp, Mus musculus
tacttggaaggacggacttaccaca

SEQ ID NO: 748235 - DNA, 25 bp, Mus musculus
tacttggaaggagggacttaccaca

SEQ ID NO: 748236 - DNA, 25 bp, Mus musculus
tacttggaaggcacttccccggagc

SEQ ID NO: 748237 - DNA, 25 bp, Mus musculus
tacttggaaggctcttccccggagc

SEQ ID NO: 748238 - DNA, 25 bp, Mus musculus
tacttggaatagcaatacggccacc

SEQ ID NO: 748239 - DNA, 25 bp, Mus musculus
tacttggaataggaatacggccacc

SEQ ID NO: 748240 - DNA, 25 bp, Mus musculus
tacttggaccggactccttgctctc

SEQ ID NO: 748241 - DNA, 25 bp, Mus musculus
tacttggaccggtctccttgctctc

SEQ ID NO: 748242 - DNA, 25 bp, Mus musculus
tacttggaccttctgtgggacccct

SEQ ID NO: 748243 - DNA, 25 bp, Mus musculus
tacttggaccttgtgtgggacccct

SEQ ID NO: 748244 - DNA, 25 bp, Mus musculus
tacttggacttacagcatcacgggt

SEQ ID NO: 748245 - DNA, 25 bp, Mus musculus
tacttggacttagagcatcacgggt

SEQ ID NO: 748246 - DNA, 25 bp, Mus musculus
tacttggagaagatcgcagagcaga

SEQ ID NO: 748247 - DNA, 25 bp, Mus musculus
tacttggagaagttcgcagagcaga

SEQ ID NO: 748248 - DNA, 25 bp, Mus musculus
tacttggagcggacgaggaagccaa

SEQ ID NO: 748249 - DNA, 25 bp, Mus musculus
tacttggagcggtcgaggaagccaa

SEQ ID NO: 748250 - DNA, 25 bp, Mus musculus
tacttggagtgaacacagtgtcctc

SEQ ID NO: 748251 - DNA, 25 bp, Mus musculus
tacttggagtgatcacagtgtcctc

SEQ ID NO: 748252 - DNA, 25 bp, Mus musculus
tacttggatagaagaagcagggtgt

SEQ ID NO: 748253 - DNA, 25 bp, Mus musculus
tacttggatagatgaagcagggtgt

SEQ ID NO: 748254 - DNA, 25 bp, Mus musculus
tacttggatcctcgagccagtccct

SEQ ID NO: 748255 - DNA, 25 bp, Mus musculus
tacttggatcctggagccagtccct

SEQ ID NO: 748256 - DNA, 25 bp, Mus musculus
tacttggatggaagctgagacaaaa

SEQ ID NO: 748257 - DNA, 25 bp, Mus musculus
tacttggatggatgctgagacaaaa

SEQ ID NO: 748258 - DNA, 25 bp, Mus musculus
tacttggcaaatagaggcaggaagc

SEQ ID NO: 748259 - DNA, 25 bp, Mus musculus
tacttggcaaatcagacagagctgg

SEQ ID NO: 748260 - DNA, 25 bp, Mus musculus
tacttggcaaatgagacagagctgg

SEQ ID NO: 748261 - DNA, 25 bp, Mus musculus
tacttggcaaattgaggcaggaagc

SEQ ID NO: 748262 - DNA, 25 bp, Mus musculus
tacttggccatgcacaccgaagggc

SEQ ID NO: 748263 - DNA, 25 bp, Mus musculus
tacttggccatggacaccgaagggc

SEQ ID NO: 748264 - DNA, 25 bp, Mus musculus
tacttggctacacgacaggtctgga

SEQ ID NO: 748265 - DNA, 25 bp, Mus musculus
tacttggctacaggacaggtctgga

SEQ ID NO: 748266 - DNA, 25 bp, Mus musculus
tacttggctacgacacgggtgacat

SEQ ID NO: 748267 - DNA, 25 bp, Mus musculus
tacttggctacgtcacgggtgacat

SEQ ID NO: 748268 - DNA, 25 bp, Mus musculus
tacttggctatcctcgttggcgcag

SEQ ID NO: 748269 - DNA, 25 bp, Mus musculus
tacttggctatcgtcgttggcgcag

SEQ ID NO: 748270 - DNA, 25 bp, Mus musculus
tacttggctgagaggcagaatatca

SEQ ID NO: 748271 - DNA, 25 bp, Mus musculus
tacttggctgagtggcagaatatca

SEQ ID NO: 748272 - DNA, 25 bp, Mus musculus
tacttggcttttcaggttgacgcac

SEQ ID NO: 748273 - DNA, 25 bp, Mus musculus
tacttggcttttgaggttgacgcac

SEQ ID NO: 748274 - DNA, 25 bp, Mus musculus
tacttgggagggaggcaagcaaaac

SEQ ID NO: 748275 - DNA, 25 bp, Mus musculus
tacttgggagggtggcaagcaaaac

SEQ ID NO: 748276 - DNA, 25 bp, Mus musculus
tacttgggaggtcgtcaccctgaaa

SEQ ID NO: 748277 - DNA, 25 bp, Mus musculus
tacttgggaggtggtcaccctgaaa

SEQ ID NO: 748278 - DNA, 25 bp, Mus musculus
tacttgggatcacggctactagtcg

SEQ ID NO: 748279 - DNA, 25 bp, Mus musculus
tacttgggatcagggctactagtcg

SEQ ID NO: 748280 - DNA, 25 bp, Mus musculus
tacttgggatgcaaaacaaggacct

SEQ ID NO: 748281 - DNA, 25 bp, Mus musculus
tacttgggatgctaaacaaggacct

SEQ ID NO: 748282 - DNA, 25 bp, Mus musculus
tacttgggcacgacatttgcaggcg

SEQ ID NO: 748283 - DNA, 25 bp, Mus musculus
tacttgggcacgtcatttgcaggcg

SEQ ID NO: 748284 - DNA, 25 bp, Mus musculus
tacttgggcggcaactattgctcct

SEQ ID NO: 748285 - DNA, 25 bp, Mus musculus
tacttgggcggctactattgctcct

SEQ ID NO: 748286 - DNA, 25 bp, Mus musculus
tacttgggggagacgcaggcaaacc

SEQ ID NO: 748287 - DNA, 25 bp, Mus musculus
tacttgggggagtcgcaggcaaacc

SEQ ID NO: 748288 - DNA, 25 bp, Mus musculus
tacttgggtcaacttgcaatcctcc

SEQ ID NO: 748289 - DNA, 25 bp, Mus musculus
tacttgggtcaagttgcaatcctcc

SEQ ID NO: 748290 - DNA, 25 bp, Mus musculus
tacttgggtgacatggtacttattg

SEQ ID NO: 748291 - DNA, 25 bp, Mus musculus
tacttgggtgacttggtacttattg

SEQ ID NO: 748292 - DNA, 25 bp, Mus musculus
tacttgggtgtcagttgtgtgctct

SEQ ID NO: 748293 - DNA, 25 bp, Mus musculus
tacttgggtgtctgttgtgtgctct

SEQ ID NO: 748294 - DNA, 25 bp, Mus musculus
tacttggtgattaatgtgtcttctg

SEQ ID NO: 748295 - DNA, 25 bp, Mus musculus
tacttggtgatttatgtgtcttctg

SEQ ID NO: 748296 - DNA, 25 bp, Mus musculus
tacttggtggctattggctccctct

SEQ ID NO: 748297 - DNA, 25 bp, Mus musculus
tacttggtggcttttggctccctct

SEQ ID NO: 748298 - DNA, 25 bp, Mus musculus
tacttggtgtacagcgctctgtggg

SEQ ID NO: 748299 - DNA, 25 bp, Mus musculus
tacttggtgtactgcgctctgtggg

SEQ ID NO: 748300 - DNA, 25 bp, Mus musculus
tacttgtaagtgctcccataaggcc

SEQ ID NO: 748301 - DNA, 25 bp, Mus musculus
tacttgtaagtggtcccataaggcc

SEQ ID NO: 748302 - DNA, 25 bp, Mus musculus
tacttgtatcaaattgcccatctcg

SEQ ID NO: 748303 - DNA, 25 bp, Mus musculus
tacttgtatcaatttgcccatctcg

SEQ ID NO: 748304 - DNA, 25 bp, Mus musculus
tacttgtcacagctgaaggatgcac

SEQ ID NO: 748305 - DNA, 25 bp, Mus musculus
tacttgtcacaggtgaaggatgcac

SEQ ID NO: 748306 - DNA, 25 bp, Mus musculus
tacttgtcacgtatctgtggtccat

SEQ ID NO: 748307 - DNA, 25 bp, Mus musculus
tacttgtcacgtttctgtggtccat

SEQ ID NO: 748308 - DNA, 25 bp, Mus musculus
tacttgtcccatcatgcctggaggc

SEQ ID NO: 748309 - DNA, 25 bp, Mus musculus
tacttgtcccatgatgcctggaggc

SEQ ID NO: 748310 - DNA, 25 bp, Mus musculus
tacttgtcgacaaaaagcatctctt

SEQ ID NO: 748311 - DNA, 25 bp, Mus musculus
tacttgtcgacataaagcatctctt

SEQ ID NO: 748312 - DNA, 25 bp, Mus musculus
tacttgtgccggcagcggaacatat

SEQ ID NO: 748313 - DNA, 25 bp, Mus musculus
tacttgtgccgggagcggaacatat

SEQ ID NO: 748314 - DNA, 25 bp, Mus musculus
tacttgtggatgatgaacctaaggt

SEQ ID NO: 748315 - DNA, 25 bp, Mus musculus
tacttgtggatgttgaacctaaggt

SEQ ID NO: 748316 - DNA, 25 bp, Mus musculus
tacttgtggcctcaatggcactgcc

SEQ ID NO: 748317 - DNA, 25 bp, Mus musculus
tacttgtggcctgaatggcactgcc

SEQ ID NO: 748318 - DNA, 25 bp, Mus musculus
tacttgtgtgacaacaaggtagcaa

SEQ ID NO: 748319 - DNA, 25 bp, Mus musculus
tacttgtgtgactacaaggtagcaa

SEQ ID NO: 748320 - DNA, 25 bp, Mus musculus
tacttgtgtggcctgaaggccaacg

SEQ ID NO: 748321 - DNA, 25 bp, Mus musculus
tacttgtgtggcgtgaaggccaacg

SEQ ID NO: 748322 - DNA, 25 bp, Mus musculus
tacttgttacttagacccgagcgga

SEQ ID NO: 748323 - DNA, 25 bp, Mus musculus
tacttgttactttgacccgagcgga

SEQ ID NO: 748324 - DNA, 25 bp, Mus musculus
tacttgttatatcaacgcggcgctg

SEQ ID NO: 748325 - DNA, 25 bp, Mus musculus
tacttgttatatgaacgcggcgctg

SEQ ID NO: 748326 - DNA, 25 bp, Mus musculus
tacttgttgcctagaggaatttaca

SEQ ID NO: 748327 - DNA, 25 bp, Mus musculus
tacttgttgccttgaggaatttaca

SEQ ID NO: 748328 - DNA, 25 bp, Mus musculus
tacttgttggcgaactttgcgctgt

SEQ ID NO: 748329 - DNA, 25 bp, Mus musculus
tacttgttggcgtactttgcgctgt

SEQ ID NO: 748330 - DNA, 25 bp, Mus musculus
tacttgtttcagaggtgcacgcata

SEQ ID NO: 748331 - DNA, 25 bp, Mus musculus
tacttgtttcagtggtgcacgcata

SEQ ID NO: 748332 - DNA, 25 bp, Mus musculus
tacttgtttcccacagtgtttgatg

SEQ ID NO: 748333 - DNA, 25 bp, Mus musculus
tacttgtttccctcagtgtttgatg

SEQ ID NO: 748334 - DNA, 25 bp, Mus musculus
tacttgtttctgaaggcagttttcc

SEQ ID NO: 748335 - DNA, 25 bp, Mus musculus
tacttgtttctgtaggcagttttcc

SEQ ID NO: 748336 - DNA, 25 bp, Mus musculus
tacttgtttgaaagagactgtagtg

SEQ ID NO: 748337 - DNA, 25 bp, Mus musculus
tacttgtttgaatgagactgtagtg

SEQ ID NO: 748338 - DNA, 25 bp, Mus musculus
tacttgtttgctcggagctttgaag

SEQ ID NO: 748339 - DNA, 25 bp, Mus musculus
tacttgtttgctgggagctttgaag

SEQ ID NO: 748340 - DNA, 25 bp, Mus musculus
tactttaaacggcaggaagatgcaa

SEQ ID NO: 748341 - DNA, 25 bp, Mus musculus
tactttaaacgggaggaagatgcaa

SEQ ID NO: 748342 - DNA, 25 bp, Mus musculus
tactttaagcacattgccaagccag

SEQ ID NO: 748343 - DNA, 25 bp, Mus musculus
tactttaagcactttgccaagccag

SEQ ID NO: 748344 - DNA, 25 bp, Mus musculus
tactttaagggcattggtcagcatg

SEQ ID NO: 748345 - DNA, 25 bp, Mus musculus
tactttaagggctttggtcagcatg

SEQ ID NO: 748346 - DNA, 25 bp, Mus musculus
tactttacacacataggtatgaggg

SEQ ID NO: 748347 - DNA, 25 bp, Mus musculus
tactttacacacttaggtatgaggg

SEQ ID NO: 748348 - DNA, 25 bp, Mus musculus
tactttagccacaccaggactagtg

SEQ ID NO: 748349 - DNA, 25 bp, Mus musculus
tactttagccactccaggactagtg

SEQ ID NO: 748350 - DNA, 25 bp, Mus musculus
tactttagccatcagccagtttctc

SEQ ID NO: 748351 - DNA, 25 bp, Mus musculus
tactttagccatgagccagtttctc

SEQ ID NO: 748352 - DNA, 25 bp, Mus musculus
tactttatctggctgtgcagagaca

SEQ ID NO: 748353 - DNA, 25 bp, Mus musculus
tactttatctgggtgtgcagagaca

SEQ ID NO: 748354 - DNA, 25 bp, Mus musculus
tactttatgcagaatggctcctgtg

SEQ ID NO: 748355 - DNA, 25 bp, Mus musculus
tactttatgcagtatggctcctgtg

SEQ ID NO: 748356 - DNA, 25 bp, Mus musculus
tactttatgtccaagggtatcctag

SEQ ID NO: 748357 - DNA, 25 bp, Mus musculus
tactttatgtcctagggtatcctag

SEQ ID NO: 748358 - DNA, 25 bp, Mus musculus
tactttattaagagggaatcgtggg

SEQ ID NO: 748359 - DNA, 25 bp, Mus musculus
tactttattaagtgggaatcgtggg

SEQ ID NO: 748360 - DNA, 25 bp, Mus musculus
tactttatttctatactgtccaggg

SEQ ID NO: 748361 - DNA, 25 bp, Mus musculus
tactttatttctttactgtccaggg

SEQ ID NO: 748362 - DNA, 25 bp, Mus musculus
tactttcaagaaatgcggacccaaa

SEQ ID NO: 748363 - DNA, 25 bp, Mus musculus
tactttcaagaattgcggacccaaa

SEQ ID NO: 748364 - DNA, 25 bp, Mus musculus
tactttcagtctcgtcacgccatgg

SEQ ID NO: 748365 - DNA, 25 bp, Mus musculus
tactttcagtctggtcacgccatgg

SEQ ID NO: 748366 - DNA, 25 bp, Mus musculus
tactttcatgggagtctacctccca

SEQ ID NO: 748367 - DNA, 25 bp, Mus musculus
tactttcatgggtgtctacctccca

SEQ ID NO: 748368 - DNA, 25 bp, Mus musculus
tactttccacagcatatgcagtacc

SEQ ID NO: 748369 - DNA, 25 bp, Mus musculus
tactttccacaggatatgcagtacc

SEQ ID NO: 748370 - DNA, 25 bp, Mus musculus
tactttccaggacaatcctgacctc

SEQ ID NO: 748371 - DNA, 25 bp, Mus musculus
tactttccaggagaatcctgacctc

SEQ ID NO: 748372 - DNA, 25 bp, Mus musculus
tactttccagggactcctgtgaagt

SEQ ID NO: 748373 - DNA, 25 bp, Mus musculus
tactttccagggtctcctgtgaagt

SEQ ID NO: 748374 - DNA, 25 bp, Mus musculus
tactttccatatccagacttaaggg

SEQ ID NO: 748375 - DNA, 25 bp, Mus musculus
tactttccatatgcagacttaaggg

SEQ ID NO: 748376 - DNA, 25 bp, Mus musculus
tactttccatcgagctaatgcattg

SEQ ID NO: 748377 - DNA, 25 bp, Mus musculus
tactttccatcgtgctaatgcattg

SEQ ID NO: 748378 - DNA, 25 bp, Mus musculus
tactttcccattctgaacttgtgtg

SEQ ID NO: 748379 - DNA, 25 bp, Mus musculus
tactttcccattgtgaacttgtgtg

SEQ ID NO: 748380 - DNA, 25 bp, Mus musculus
tactttcccggccaggccattggca

SEQ ID NO: 748381 - DNA, 25 bp, Mus musculus
tactttcccggcgaggccattggca

SEQ ID NO: 748382 - DNA, 25 bp, Mus musculus
tactttccctctaagtgtacaaaag

SEQ ID NO: 748383 - DNA, 25 bp, Mus musculus
tactttccctcttagtgtacaaaag

SEQ ID NO: 748384 - DNA, 25 bp, Mus musculus
tactttccggatcactggaagcaca

SEQ ID NO: 748385 - DNA, 25 bp, Mus musculus
tactttccggatgactggaagcaca

SEQ ID NO: 748386 - DNA, 25 bp, Mus musculus
tactttcctccccaggtggagcgcg

SEQ ID NO: 748387 - DNA, 25 bp, Mus musculus
tactttcctcccgaggtggagcgcg

SEQ ID NO: 748388 - DNA, 25 bp, Mus musculus
tactttcgatcgagactgggtggcc

SEQ ID NO: 748389 - DNA, 25 bp, Mus musculus
tactttcgatcgtgactgggtggcc

SEQ ID NO: 748390 - DNA, 25 bp, Mus musculus
tactttcggcacagaaaaataagtc

SEQ ID NO: 748391 - DNA, 25 bp, Mus musculus
tactttcggcactgaaaaataagtc

SEQ ID NO: 748392 - DNA, 25 bp, Mus musculus
tactttctatgaactggaccttggc

SEQ ID NO: 748393 - DNA, 25 bp, Mus musculus
tactttctatgatctggaccttggc

SEQ ID NO: 748394 - DNA, 25 bp, Mus musculus
tactttctgctcaggatctgatctg

SEQ ID NO: 748395 - DNA, 25 bp, Mus musculus
tactttctgctctggatctgatctg

SEQ ID NO: 748396 - DNA, 25 bp, Mus musculus
tactttctggaaattcccgacttgg

SEQ ID NO: 748397 - DNA, 25 bp, Mus musculus
tactttctggaatttcccgacttgg

SEQ ID NO: 748398 - DNA, 25 bp, Mus musculus
tactttctgttgctgcgacttgact

SEQ ID NO: 748399 - DNA, 25 bp, Mus musculus
tactttctgttggtgcgacttgact

SEQ ID NO: 748400 - DNA, 25 bp, Mus musculus
tactttgaactaataatcagctctg

SEQ ID NO: 748401 - DNA, 25 bp, Mus musculus
tactttgaactattaatcagctctg

SEQ ID NO: 748402 - DNA, 25 bp, Mus musculus
tactttgaactcagcagtctggctg

SEQ ID NO: 748403 - DNA, 25 bp, Mus musculus
tactttgaactctgcagtctggctg

SEQ ID NO: 748404 - DNA, 25 bp, Mus musculus
tactttgacaagagggagctgccca

SEQ ID NO: 748405 - DNA, 25 bp, Mus musculus
tactttgacaagtgggagctgccca

SEQ ID NO: 748406 - DNA, 25 bp, Mus musculus
tactttgactccaatgcccactttg

SEQ ID NO: 748407 - DNA, 25 bp, Mus musculus
tactttgactcctatgcccactttg

SEQ ID NO: 748408 - DNA, 25 bp, Mus musculus
tactttgagagcaacctggcagttg

SEQ ID NO: 748409 - DNA, 25 bp, Mus musculus
tactttgagagctacctggcagttg

SEQ ID NO: 748410 - DNA, 25 bp, Mus musculus
tactttgaggtcacccacgatatca

SEQ ID NO: 748411 - DNA, 25 bp, Mus musculus
tactttgaggtctcccacgatatca

SEQ ID NO: 748412 - DNA, 25 bp, Mus musculus
tactttgcaaatcaaactagaaatg

SEQ ID NO: 748413 - DNA, 25 bp, Mus musculus
tactttgcaaatgaaactagaaatg

SEQ ID NO: 748414 - DNA, 25 bp, Mus musculus
tactttgcacaactcgactgcagag

SEQ ID NO: 748415 - DNA, 25 bp, Mus musculus
tactttgcacaagtcgactgcagag

SEQ ID NO: 748416 - DNA, 25 bp, Mus musculus
tactttgcagaaatagcccatggtt

SEQ ID NO: 748417 - DNA, 25 bp, Mus musculus
tactttgcagaattagcccatggtt

SEQ ID NO: 748418 - DNA, 25 bp, Mus musculus
tactttgcagctcttctgagcatga

SEQ ID NO: 748419 - DNA, 25 bp, Mus musculus
tactttgcagctgttctgagcatga

SEQ ID NO: 748420 - DNA, 25 bp, Mus musculus
tactttgccatgctggtgggtgcca

SEQ ID NO: 748421 - DNA, 25 bp, Mus musculus
tactttgccatggtggtgggtgcca

SEQ ID NO: 748422 - DNA, 25 bp, Mus musculus
tactttgcgggcatgacttttgccg

SEQ ID NO: 748423 - DNA, 25 bp, Mus musculus
tactttgcgggcttgacttttgccg

SEQ ID NO: 748424 - DNA, 25 bp, Mus musculus
tactttgctagtatgtgccttccgg

SEQ ID NO: 748425 - DNA, 25 bp, Mus musculus
tactttgctagtttgtgccttccgg

SEQ ID NO: 748426 - DNA, 25 bp, Mus musculus
tactttgctcagaaccacgaccctg

SEQ ID NO: 748427 - DNA, 25 bp, Mus musculus
tactttgctcagtaccacgaccctg

SEQ ID NO: 748428 - DNA, 25 bp, Mus musculus
tactttgctgatagggacatgttct

SEQ ID NO: 748429 - DNA, 25 bp, Mus musculus
tactttgctgatcaacatgcgtgtg

SEQ ID NO: 748430 - DNA, 25 bp, Mus musculus
tactttgctgatgaacatgcgtgtg

SEQ ID NO: 748431 - DNA, 25 bp, Mus musculus
tactttgctgattgggacatgttct

SEQ ID NO: 748432 - DNA, 25 bp, Mus musculus
tactttgctggactgtccgtcctgg

SEQ ID NO: 748433 - DNA, 25 bp, Mus musculus
tactttgctggagtgtccgtcctgg

SEQ ID NO: 748434 - DNA, 25 bp, Mus musculus
tactttggaaaacttggccgcaaag

SEQ ID NO: 748435 - DNA, 25 bp, Mus musculus
tactttggaaaagttggccgcaaag

SEQ ID NO: 748436 - DNA, 25 bp, Mus musculus
tactttggatgccaatgaccctgaa

SEQ ID NO: 748437 - DNA, 25 bp, Mus musculus
tactttggatgcgaatgaccctgaa

SEQ ID NO: 748438 - DNA, 25 bp, Mus musculus
tactttggcgtgaccgccgctctca

SEQ ID NO: 748439 - DNA, 25 bp, Mus musculus
tactttggcgtgtccgccgctctca

SEQ ID NO: 748440 - DNA, 25 bp, Mus musculus
tactttgggaagaagttgagccctg

SEQ ID NO: 748441 - DNA, 25 bp, Mus musculus
tactttgggaagtagttgagccctg

SEQ ID NO: 748442 - DNA, 25 bp, Mus musculus
tactttgggaatatctatagcaccc

SEQ ID NO: 748443 - DNA, 25 bp, Mus musculus
tactttgggaatttctatagcaccc

SEQ ID NO: 748444 - DNA, 25 bp, Mus musculus
tactttgggctcaggggtttcaaca

SEQ ID NO: 748445 - DNA, 25 bp, Mus musculus
tactttgggctctggggtttcaaca

SEQ ID NO: 748446 - DNA, 25 bp, Mus musculus
tactttgggtttcgcttgcccttgg

SEQ ID NO: 748447 - DNA, 25 bp, Mus musculus
tactttgggtttggcttgcccttgg

SEQ ID NO: 748448 - DNA, 25 bp, Mus musculus
tactttggtgacacagacatgtacc

SEQ ID NO: 748449 - DNA, 25 bp, Mus musculus
tactttggtgactcagacatgtacc

SEQ ID NO: 748450 - DNA, 25 bp, Mus musculus
tactttgtacccatgtccaagatcg

SEQ ID NO: 748451 - DNA, 25 bp, Mus musculus
tactttgtacccttgtccaagatcg

SEQ ID NO: 748452 - DNA, 25 bp, Mus musculus
tactttgtacgtcgcgagggcctcc

SEQ ID NO: 748453 - DNA, 25 bp, Mus musculus
tactttgtacgtggcgagggcctcc

SEQ ID NO: 748454 - DNA, 25 bp, Mus musculus
tactttgtagcgagcggtcctttga

SEQ ID NO: 748455 - DNA, 25 bp, Mus musculus
tactttgtagcgtgcggtcctttga

SEQ ID NO: 748456 - DNA, 25 bp, Mus musculus
tactttgtgaccagggagatgatgc

SEQ ID NO: 748457 - DNA, 25 bp, Mus musculus
tactttgtgacctgggagatgatgc

SEQ ID NO: 748458 - DNA, 25 bp, Mus musculus
tactttgtgatcaggatccaggatg

SEQ ID NO: 748459 - DNA, 25 bp, Mus musculus
tactttgtgatctggatccaggatg

SEQ ID NO: 748460 - DNA, 25 bp, Mus musculus
tactttgttctcaataaatggataa

SEQ ID NO: 748461 - DNA, 25 bp, Mus musculus
tactttgttctctataaatggataa

SEQ ID NO: 748462 - DNA, 25 bp, Mus musculus
tacttttaagcacctggtggaagct

SEQ ID NO: 748463 - DNA, 25 bp, Mus musculus
tacttttaagcagctggtggaagct

SEQ ID NO: 748464 - DNA, 25 bp, Mus musculus
tacttttatgaccaatgtccagcag

SEQ ID NO: 748465 - DNA, 25 bp, Mus musculus
tacttttatgacgaatgtccagcag

SEQ ID NO: 748466 - DNA, 25 bp, Mus musculus
tacttttcagtgcagagtcataatg

SEQ ID NO: 748467 - DNA, 25 bp, Mus musculus
tacttttcagtggagagtcataatg

SEQ ID NO: 748468 - DNA, 25 bp, Mus musculus
tacttttgagagcatgaaatgcttc

SEQ ID NO: 748469 - DNA, 25 bp, Mus musculus
tacttttgagaggatgaaatgcttc

SEQ ID NO: 748470 - DNA, 25 bp, Mus musculus
tacttttgccataatttaagaacac

SEQ ID NO: 748471 - DNA, 25 bp, Mus musculus
tacttttgccattatttaagaacac

SEQ ID NO: 748472 - DNA, 25 bp, Mus musculus
tactttttacttcctgaaaggatcc

SEQ ID NO: 748473 - DNA, 25 bp, Mus musculus
tactttttacttgctgaaaggatcc

SEQ ID NO: 748474 - DNA, 25 bp, Mus musculus
tactttttcagcaatcaagaattcc

SEQ ID NO: 748475 - DNA, 25 bp, Mus musculus
tactttttcagctatcaagaattcc

SEQ ID NO: 748476 - DNA, 25 bp, Mus musculus
tactttttcatcaaactgaccagag

SEQ ID NO: 748477 - DNA, 25 bp, Mus musculus
tactttttcatctaactgaccagag

SEQ ID NO: 748478 - DNA, 25 bp, Mus musculus
tactttttcctcagggactgcacag

SEQ ID NO: 748479 - DNA, 25 bp, Mus musculus
tactttttcctctgggactgcacag

SEQ ID NO: 748480 - DNA, 25 bp, Mus musculus
tactttttcgaacatcccttcacca

SEQ ID NO: 748481 - DNA, 25 bp, Mus musculus
tactttttcgaagatcccttcacca

SEQ ID NO: 748482 - DNA, 25 bp, Mus musculus
tacttttttgaacaccaggtggctg

SEQ ID NO: 748483 - DNA, 25 bp, Mus musculus
tacttttttgaagaccaggtggctg

SEQ ID NO: 748484 - DNA, 25 bp, Mus musculus
tagaaaaaactgagctggaagtgca

SEQ ID NO: 748485 - DNA, 25 bp, Mus musculus
tagaaaaaactgtgctggaagtgca

SEQ ID NO: 748486 - DNA, 25 bp, Mus musculus
tagaaaaacattaggagggtatatc

SEQ ID NO: 748487 - DNA, 25 bp, Mus musculus
tagaaaaacatttggagggtatatc

SEQ ID NO: 748488 - DNA, 25 bp, Mus musculus
tagaaaaacgaacagcggcactgga

SEQ ID NO: 748489 - DNA, 25 bp, Mus musculus
tagaaaaacgaagagcggcactgga

SEQ ID NO: 748490 - DNA, 25 bp, Mus musculus
tagaaaaagcctctgtcctttcggc

SEQ ID NO: 748491 - DNA, 25 bp, Mus musculus
tagaaaaagcctgtgtcctttcggc

SEQ ID NO: 748492 - DNA, 25 bp, Mus musculus
tagaaaaatggacttggaccctggc

SEQ ID NO: 748493 - DNA, 25 bp, Mus musculus
tagaaaaatggagttggaccctggc

SEQ ID NO: 748494 - DNA, 25 bp, Mus musculus
tagaaaaatgtgactccaaaggcta

SEQ ID NO: 748495 - DNA, 25 bp, Mus musculus
tagaaaaatgtgtctccaaaggcta

SEQ ID NO: 748496 - DNA, 25 bp, Mus musculus
tagaaaacaacaatatcaagtccat

SEQ ID NO: 748497 - DNA, 25 bp, Mus musculus
tagaaaacaacattatcaagtccat

SEQ ID NO: 748498 - DNA, 25 bp, Mus musculus
tagaaaacctagaattacagctaca

SEQ ID NO: 748499 - DNA, 25 bp, Mus musculus
tagaaaacctagtattacagctaca

SEQ ID NO: 748500 - DNA, 25 bp, Mus musculus
tagaaaacctccagcattgccagtt

SEQ ID NO: 748501 - DNA, 25 bp, Mus musculus
tagaaaacctcctgcattgccagtt

SEQ ID NO: 748502 - DNA, 25 bp, Mus musculus
tagaaaacctggcaatcactgactt

SEQ ID NO: 748503 - DNA, 25 bp, Mus musculus
tagaaaacctgggaatcactgactt

SEQ ID NO: 748504 - DNA, 25 bp, Mus musculus
tagaaaacgtctctcctttcagcct

SEQ ID NO: 748505 - DNA, 25 bp, Mus musculus
tagaaaacgtctgtcctttcagcct

SEQ ID NO: 748506 - DNA, 25 bp, Mus musculus
tagaaaagactacctgagggtgacc

SEQ ID NO: 748507 - DNA, 25 bp, Mus musculus
tagaaaagactagctgagggtgacc

SEQ ID NO: 748508 - DNA, 25 bp, Mus musculus
tagaaaagccatatactgtgtgaca

SEQ ID NO: 748509 - DNA, 25 bp, Mus musculus
tagaaaagccatttactgtgtgaca

SEQ ID NO: 748510 - DNA, 25 bp, Mus musculus
tagaaaaggacaaactgcgcgtgcg

SEQ ID NO: 748511 - DNA, 25 bp, Mus musculus
tagaaaaggacatactgcgcgtgcg

SEQ ID NO: 748512 - DNA, 25 bp, Mus musculus
tagaaaaggcagatactccctgaca

SEQ ID NO: 748513 - DNA, 25 bp, Mus musculus
tagaaaaggcagttactccctgaca

SEQ ID NO: 748514 - DNA, 25 bp, Mus musculus
tagaaaagtatcacgtgccacctgg

SEQ ID NO: 748515 - DNA, 25 bp, Mus musculus
tagaaaagtatctcgtgccacctgg

SEQ ID NO: 748516 - DNA, 25 bp, Mus musculus
tagaaaagtggacctgtctgagtct

SEQ ID NO: 748517 - DNA, 25 bp, Mus musculus
tagaaaagtggagctgtctgagtct

SEQ ID NO: 748518 - DNA, 25 bp, Mus musculus
tagaaaatacagctatcaccaagcc

SEQ ID NO: 748519 - DNA, 25 bp, Mus musculus
tagaaaatacaggtatcaccaagcc

SEQ ID NO: 748520 - DNA, 25 bp, Mus musculus
tagaaaatattgagcttcccatgga

SEQ ID NO: 748521 - DNA, 25 bp, Mus musculus
tagaaaatattgtgcttcccatgga

SEQ ID NO: 748522 - DNA, 25 bp, Mus musculus
tagaaaatctctccaacttcatcaa

SEQ ID NO: 748523 - DNA, 25 bp, Mus musculus
tagaaaatctctgcaacttcatcaa

SEQ ID NO: 748524 - DNA, 25 bp, Mus musculus
tagaaaatgcatcaaccatgagctg

SEQ ID NO: 748525 - DNA, 25 bp, Mus musculus
tagaaaatgcatgaaccatgagctg

SEQ ID NO: 748526 - DNA, 25 bp, Mus musculus
tagaaaatgcgtatcacatggaagc

SEQ ID NO: 748527 - DNA, 25 bp, Mus musculus
tagaaaatgcgtttcacatggaagc

SEQ ID NO: 748528 - DNA, 25 bp, Mus musculus
tagaaaatgggtatcaggcagcact

SEQ ID NO: 748529 - DNA, 25 bp, Mus musculus
tagaaaatgggtttcaggcagcact

SEQ ID NO: 748530 - DNA, 25 bp, Mus musculus
tagaaaatgtaaatgcagcatgggt

SEQ ID NO: 748531 - DNA, 25 bp, Mus musculus
tagaaaatgtaattgcagcatgggt

SEQ ID NO: 748532 - DNA, 25 bp, Mus musculus
tagaaaattaggaactcctccttca

SEQ ID NO: 748533 - DNA, 25 bp, Mus musculus
tagaaaattaggtactcctccttca

SEQ ID NO: 748534 - DNA, 25 bp, Mus musculus
tagaaaattcctccaggaaaactca

SEQ ID NO: 748535 - DNA, 25 bp, Mus musculus
tagaaaattcctgcaggaaaactca

SEQ ID NO: 748536 - DNA, 25 bp, Mus musculus
tagaaaattggtaattggtacacgt

SEQ ID NO: 748537 - DNA, 25 bp, Mus musculus
tagaaaattggttattggtacacgt

SEQ ID NO: 748538 - DNA, 25 bp, Mus musculus
tagaaacaatttcaaacggtcacag

SEQ ID NO: 748539 - DNA, 25 bp, Mus musculus
tagaaacaatttgaaacggtcacag

SEQ ID NO: 748540 - DNA, 25 bp, Mus musculus
tagaaacaggagctatactacctaa

SEQ ID NO: 748541 - DNA, 25 bp, Mus musculus
tagaaacaggaggtatactacctaa

SEQ ID NO: 748542 - DNA, 25 bp, Mus musculus
tagaaacgaccacttcagccaggag

SEQ ID NO: 748543 - DNA, 25 bp, Mus musculus
tagaaacgaccagttcagccaggag

SEQ ID NO: 748544 - DNA, 25 bp, Mus musculus
tagaaacggaggagcgtgcattgct

SEQ ID NO: 748545 - DNA, 25 bp, Mus musculus
tagaaacggaggtgcgtgcattgct

SEQ ID NO: 748546 - DNA, 25 bp, Mus musculus
tagaaacggcttaacagtactggca

SEQ ID NO: 748547 - DNA, 25 bp, Mus musculus
tagaaacggctttacagtactggca

SEQ ID NO: 748548 - DNA, 25 bp, Mus musculus
tagaaactcaatagcttcctgtgca

SEQ ID NO: 748549 - DNA, 25 bp, Mus musculus
tagaaactcaattgcttcctgtgca

SEQ ID NO: 748550 - DNA, 25 bp, Mus musculus
tagaaactgaagcttaccttataac

SEQ ID NO: 748551 - DNA, 25 bp, Mus musculus
tagaaactgaaggttaccttataac

SEQ ID NO: 748552 - DNA, 25 bp, Mus musculus
tagaaactgcagcttggaatcagag

SEQ ID NO: 748553 - DNA, 25 bp, Mus musculus
tagaaactgcaggttggaatcagag

SEQ ID NO: 748554 - DNA, 25 bp, Mus musculus
tagaaactgtcaaatgtcatacata

SEQ ID NO: 748555 - DNA, 25 bp, Mus musculus
tagaaactgtcatatgtcatacata

SEQ ID NO: 748556 - DNA, 25 bp, Mus musculus
tagaaactgtgtcgaaaagtgtccc

SEQ ID NO: 748557 - DNA, 25 bp, Mus musculus
tagaaactgtgtggaaaagtgtccc

SEQ ID NO: 748558 - DNA, 25 bp, Mus musculus
tagaaacttcgacatcagatctgcc

SEQ ID NO: 748559 - DNA, 25 bp, Mus musculus
tagaaacttcgagatcagatctgcc

SEQ ID NO: 748560 - DNA, 25 bp, Mus musculus
tagaaacttctaagaactgagccct

SEQ ID NO: 748561 - DNA, 25 bp, Mus musculus
tagaaacttctatgaactgagccct

SEQ ID NO: 748562 - DNA, 25 bp, Mus musculus
tagaaagaaaatccccttgagggct

SEQ ID NO: 748563 - DNA, 25 bp, Mus musculus
tagaaagaaaatgcccttgagggct

SEQ ID NO: 748564 - DNA, 25 bp, Mus musculus
tagaaagaaaggagaatggaaaatc

SEQ ID NO: 748565 - DNA, 25 bp, Mus musculus
tagaaagaaaggtgaatggaaaatc

SEQ ID NO: 748566 - DNA, 25 bp, Mus musculus
tagaaagaagcccagttcccagtgg

SEQ ID NO: 748567 - DNA, 25 bp, Mus musculus
tagaaagaagccgagttcccagtgg

SEQ ID NO: 748568 - DNA, 25 bp, Mus musculus
tagaaagaaggcagctgagagcaga

SEQ ID NO: 748569 - DNA, 25 bp, Mus musculus
tagaaagaaggctgctgagagcaga

SEQ ID NO: 748570 - DNA, 25 bp, Mus musculus
tagaaaggacataggcttccgtgct

SEQ ID NO: 748571 - DNA, 25 bp, Mus musculus
tagaaaggacattggcttccgtgct

SEQ ID NO: 748572 - DNA, 25 bp, Mus musculus
tagaaaggccatactgaattggaga

SEQ ID NO: 748573 - DNA, 25 bp, Mus musculus
tagaaaggccattctgaattggaga

SEQ ID NO: 748574 - DNA, 25 bp, Mus musculus
tagaaaggctgaaggaccaaggcag

SEQ ID NO: 748575 - DNA, 25 bp, Mus musculus
tagaaaggctgatggaccaaggcag

SEQ ID NO: 748576 - DNA, 25 bp, Mus musculus
tagaaagggacaactcagaagaatt

SEQ ID NO: 748577 - DNA, 25 bp, Mus musculus
tagaaagggacatctcagaagaatt

SEQ ID NO: 748578 - DNA, 25 bp, Mus musculus
tagaaagggagaccgtgcagactca

SEQ ID NO: 748579 - DNA, 25 bp, Mus musculus
tagaaagggagagcgtgcagactca

SEQ ID NO: 748580 - DNA, 25 bp, Mus musculus
tagaaagggaggcaagccagcttct

SEQ ID NO: 748581 - DNA, 25 bp, Mus musculus
tagaaagggagggaagccagcttct

SEQ ID NO: 748582 - DNA, 25 bp, Mus musculus
tagaaagggcgtctcgtctctgcgt

SEQ ID NO: 748583 - DNA, 25 bp, Mus musculus
tagaaagggcgtgtcgtctctgcgt

SEQ ID NO: 748584 - DNA, 25 bp, Mus musculus
tagaaagggtccagtcagaagcagt

SEQ ID NO: 748585 - DNA, 25 bp, Mus musculus
tagaaagggtcctgtcagaagcagt

SEQ ID NO: 748586 - DNA, 25 bp, Mus musculus
tagaaaggttaacgatagtgacacc

SEQ ID NO: 748587 - DNA, 25 bp, Mus musculus
tagaaaggttaaggatagtgacacc

SEQ ID NO: 748588 - DNA, 25 bp, Mus musculus
tagaaagtatagacctcgaggaagt

SEQ ID NO: 748589 - DNA, 25 bp, Mus musculus
tagaaagtatagtcctcgaggaagt

SEQ ID NO: 748590 - DNA, 25 bp, Mus musculus
tagaaagtgaacacggaagtcccct

SEQ ID NO: 748591 - DNA, 25 bp, Mus musculus
tagaaagtgaactcggaagtcccct

SEQ ID NO: 748592 - DNA, 25 bp, Mus musculus
tagaaagtggtaaatcttcatttcc

SEQ ID NO: 748593 - DNA, 25 bp, Mus musculus
tagaaagtggtatatcttcatttcc

SEQ ID NO: 748594 - DNA, 25 bp, Mus musculus
tagaaataattaaaatgcaagccct

SEQ ID NO: 748595 - DNA, 25 bp, Mus musculus
tagaaataattataatgcaagccct

SEQ ID NO: 748596 - DNA, 25 bp, Mus musculus
tagaaatacaataacgggcttggtg

SEQ ID NO: 748597 - DNA, 25 bp, Mus musculus
tagaaatacaattacgggcttggtg

SEQ ID NO: 748598 - DNA, 25 bp, Mus musculus
tagaaatagtgaaagatccattcct

SEQ ID NO: 748599 - DNA, 25 bp, Mus musculus
tagaaatagtgatagatccattcct

SEQ ID NO: 748600 - DNA, 25 bp, Mus musculus
tagaaatatacacgcctgcaaggag

SEQ ID NO: 748601 - DNA, 25 bp, Mus musculus
tagaaatatacaggcctgcaaggag

SEQ ID NO: 748602 - DNA, 25 bp, Mus musculus
tagaaatcagttcttgccgaatgca

SEQ ID NO: 748603 - DNA, 25 bp, Mus musculus
tagaaatcagttgttgccgaatgca

SEQ ID NO: 748604 - DNA, 25 bp, Mus musculus
tagaaatcatgtaggatgccagctg

SEQ ID NO: 748605 - DNA, 25 bp, Mus musculus
tagaaatcatgttggatgccagctg

SEQ ID NO: 748606 - DNA, 25 bp, Mus musculus
tagaaatcctcactaaggcagtggg

SEQ ID NO: 748607 - DNA, 25 bp, Mus musculus
tagaaatcctcagtaaggcagtggg

SEQ ID NO: 748608 - DNA, 25 bp, Mus musculus
tagaaatcctttagcccctgacagg

SEQ ID NO: 748609 - DNA, 25 bp, Mus musculus
tagaaatccttttgcccctgacagg

SEQ ID NO: 748610 - DNA, 25 bp, Mus musculus
tagaaatcgacacggctccgggacc

SEQ ID NO: 748611 - DNA, 25 bp, Mus musculus
tagaaatcgacagggctccgggacc

SEQ ID NO: 748612 - DNA, 25 bp, Mus musculus
tagaaatctacaccacaggtcggat

SEQ ID NO: 748613 - DNA, 25 bp, Mus musculus
tagaaatctacagcacaggtcggat

SEQ ID NO: 748614 - DNA, 25 bp, Mus musculus
tagaaatgatgtaccaggagccagc

SEQ ID NO: 748615 - DNA, 25 bp, Mus musculus
tagaaatgatgttccaggagccagc

SEQ ID NO: 748616 - DNA, 25 bp, Mus musculus
tagaaatggcaaaactacctgtctg

SEQ ID NO: 748617 - DNA, 25 bp, Mus musculus
tagaaatggcaatactacctgtctg

SEQ ID NO: 748618 - DNA, 25 bp, Mus musculus
tagaaatgtgccctggtgtgcagca

SEQ ID NO: 748619 - DNA, 25 bp, Mus musculus
tagaaatgtgccgtggtgtgcagca

SEQ ID NO: 748620 - DNA, 25 bp, Mus musculus
tagaaattcttaagaggcctaccat

SEQ ID NO: 748621 - DNA, 25 bp, Mus musculus
tagaaattcttatgaggcctaccat

SEQ ID NO: 748622 - DNA, 25 bp, Mus musculus
tagaaattgagaacgacgggactga

SEQ ID NO: 748623 - DNA, 25 bp, Mus musculus
tagaaattgagatcgacgggactga

SEQ ID NO: 748624 - DNA, 25 bp, Mus musculus
tagaaattgaggatgcttcacctac

SEQ ID NO: 748625 - DNA, 25 bp, Mus musculus
tagaaattgaggttgcttcacctac

SEQ ID NO: 748626 - DNA, 25 bp, Mus musculus
tagaaattggtgagtcagatccgga

SEQ ID NO: 748627 - DNA, 25 bp, Mus musculus
tagaaattggtgtgtcagatccgga

SEQ ID NO: 748628 - DNA, 25 bp, Mus musculus
tagaacaagctacaccatcagacag

SEQ ID NO: 748629 - DNA, 25 bp, Mus musculus
tagaacaagctagaccatcagacag

SEQ ID NO: 748630 - DNA, 25 bp, Mus musculus
tagaacaaggtaaatcaagatgaat

SEQ ID NO: 748631 - DNA, 25 bp, Mus musculus
tagaacaaggtatatcaagatgaat

SEQ ID NO: 748632 - DNA, 25 bp, Mus musculus
tagaacacaggtacagaacgagtgg

SEQ ID NO: 748633 - DNA, 25 bp, Mus musculus
tagaacacaggttcagaacgagtgg

SEQ ID NO: 748634 - DNA, 25 bp, Mus musculus
tagaacaccgtcaaaagcttagtac

SEQ ID NO: 748635 - DNA, 25 bp, Mus musculus
tagaacaccgtctaaagcttagtac

SEQ ID NO: 748636 - DNA, 25 bp, Mus musculus
tagaacacggctctgcttatgaacg

SEQ ID NO: 748637 - DNA, 25 bp, Mus musculus
tagaacacggctgtgcttatgaacg

SEQ ID NO: 748638 - DNA, 25 bp, Mus musculus
tagaacagagagaaatgactgcacg

SEQ ID NO: 748639 - DNA, 25 bp, Mus musculus
tagaacagagagtaatgactgcacg

SEQ ID NO: 748640 - DNA, 25 bp, Mus musculus
tagaacagcttgagtgcctaaagca

SEQ ID NO: 748641 - DNA, 25 bp, Mus musculus
tagaacagcttgtgtgcctaaagca

SEQ ID NO: 748642 - DNA, 25 bp, Mus musculus
tagaacaggcttagaaaacataccc

SEQ ID NO: 748643 - DNA, 25 bp, Mus musculus
tagaacaggctttgaaaacataccc

SEQ ID NO: 748644 - DNA, 25 bp, Mus musculus
tagaacagtttgataaaactccgtg

SEQ ID NO: 748645 - DNA, 25 bp, Mus musculus
tagaacagtttgttaaaactccgtg

SEQ ID NO: 748646 - DNA, 25 bp, Mus musculus
tagaacatcagaatcaagtcagacc

SEQ ID NO: 748647 - DNA, 25 bp, Mus musculus
tagaacatcagattcaagtcagacc

SEQ ID NO: 748648 - DNA, 25 bp, Mus musculus
tagaacatggagacctttcctggta

SEQ ID NO: 748649 - DNA, 25 bp, Mus musculus
tagaacatggagtcctttcctggta

SEQ ID NO: 748650 - DNA, 25 bp, Mus musculus
tagaacatggccctgtcagtcccat

SEQ ID NO: 748651 - DNA, 25 bp, Mus musculus
tagaacatggccgtgtcagtcccat

SEQ ID NO: 748652 - DNA, 25 bp, Mus musculus
tagaacattagaactgagcccgatg

SEQ ID NO: 748653 - DNA, 25 bp, Mus musculus
tagaacattagatctgagcccgatg

SEQ ID NO: 748654 - DNA, 25 bp, Mus musculus
tagaacattctaccatacaagatgg

SEQ ID NO: 748655 - DNA, 25 bp, Mus musculus
tagaacattctagcatacaagatgg

SEQ ID NO: 748656 - DNA, 25 bp, Mus musculus
tagaacattctgaagtcacaggaca

SEQ ID NO: 748657 - DNA, 25 bp, Mus musculus
tagaacattctgtagtcacaggaca

SEQ ID NO: 748658 - DNA, 25 bp, Mus musculus
tagaaccatcttccagggatcccag

SEQ ID NO: 748659 - DNA, 25 bp, Mus musculus
tagaaccatcttgcagggatcccag

SEQ ID NO: 748660 - DNA, 25 bp, Mus musculus
tagaacccaagtcacagcattttcc

SEQ ID NO: 748661 - DNA, 25 bp, Mus musculus
tagaacccaagtgacagcattttcc

SEQ ID NO: 748662 - DNA, 25 bp, Mus musculus
tagaaccctttgaaagaactccctg

SEQ ID NO: 748663 - DNA, 25 bp, Mus musculus
tagaaccctttgtaagaactccctg

SEQ ID NO: 748664 - DNA, 25 bp, Mus musculus
tagaacctccacctgactccaggaa

SEQ ID NO: 748665 - DNA, 25 bp, Mus musculus
tagaacctccacgtgactccaggaa

SEQ ID NO: 748666 - DNA, 25 bp, Mus musculus
tagaacctccttcgtggtacaggag

SEQ ID NO: 748667 - DNA, 25 bp, Mus musculus
tagaacctccttggtggtacaggag

SEQ ID NO: 748668 - DNA, 25 bp, Mus musculus
tagaacctgctcaccttgttttggc

SEQ ID NO: 748669 - DNA, 25 bp, Mus musculus
tagaacctgctctccttgttttggc

SEQ ID NO: 748670 - DNA, 25 bp, Mus musculus
tagaacctgtcgaggatctaaagga

SEQ ID NO: 748671 - DNA, 25 bp, Mus musculus
tagaacctgtcgtggatctaaagga

SEQ ID NO: 748672 - DNA, 25 bp, Mus musculus
tagaaccttctgcaaagggcttgca

SEQ ID NO: 748673 - DNA, 25 bp, Mus musculus
tagaaccttctggaaagggcttgca

SEQ ID NO: 748674 - DNA, 25 bp, Mus musculus
tagaacgaagccatgcacaacagct

SEQ ID NO: 748675 - DNA, 25 bp, Mus musculus
tagaacgaagccttgcacaacagct

SEQ ID NO: 748676 - DNA, 25 bp, Mus musculus
tagaacgagtagaccagaaattgtt

SEQ ID NO: 748677 - DNA, 25 bp, Mus musculus
tagaacgagtagtccagaaattgtt

SEQ ID NO: 748678 - DNA, 25 bp, Mus musculus
tagaacgatctgacacctcccatct

SEQ ID NO: 748679 - DNA, 25 bp, Mus musculus
tagaacgatctgtcacctcccatct

SEQ ID NO: 748680 - DNA, 25 bp, Mus musculus
tagaacgattgactaggacttagga

SEQ ID NO: 748681 - DNA, 25 bp, Mus musculus
tagaacgattgagtaggacttagga

SEQ ID NO: 748682 - DNA, 25 bp, Mus musculus
tagaacgcaggcacacaagtgtgtg

SEQ ID NO: 748683 - DNA, 25 bp, Mus musculus
tagaacgcaggctcacaagtgtgtg

SEQ ID NO: 748684 - DNA, 25 bp, Mus musculus
tagaacgccagacgccacgttgaga

SEQ ID NO: 748685 - DNA, 25 bp, Mus musculus
tagaacgccagaggccacgttgaga

SEQ ID NO: 748686 - DNA, 25 bp, Mus musculus
tagaacgcccatcttaaaatcgacg

SEQ ID NO: 748687 - DNA, 25 bp, Mus musculus
tagaacgcccatgttaaaatcgacg

SEQ ID NO: 748688 - DNA, 25 bp, Mus musculus
tagaactaatttattgcccctgagg

SEQ ID NO: 748689 - DNA, 25 bp, Mus musculus
tagaactaattttttgcccctgagg

SEQ ID NO: 748690 - DNA, 25 bp, Mus musculus
tagaactagaccagggagtttccag

SEQ ID NO: 748691 - DNA, 25 bp, Mus musculus
tagaactagacctgggagtttccag

SEQ ID NO: 748692 - DNA, 25 bp, Mus musculus
tagaactagggacagagcagtcaca

SEQ ID NO: 748693 - DNA, 25 bp, Mus musculus
tagaactagggagagagcagtcaca

SEQ ID NO: 748694 - DNA, 25 bp, Mus musculus
tagaactcagaacagcttgcccatg

SEQ ID NO: 748695 - DNA, 25 bp, Mus musculus
tagaactcagaagagcttgcccatg

SEQ ID NO: 748696 - DNA, 25 bp, Mus musculus
tagaactcttccagaatatcagacc

SEQ ID NO: 748697 - DNA, 25 bp, Mus musculus
tagaactcttcctgaatatcagacc

SEQ ID NO: 748698 - DNA, 25 bp, Mus musculus
tagaactgcaagaagtagaaaaacg

SEQ ID NO: 748699 - DNA, 25 bp, Mus musculus
tagaactgcaagtagtagaaaaacg

SEQ ID NO: 748700 - DNA, 25 bp, Mus musculus
tagaactgcgctacagccgagcggt

SEQ ID NO: 748701 - DNA, 25 bp, Mus musculus
tagaactgcgcttcagccgagcggt

SEQ ID NO: 748702 - DNA, 25 bp, Mus musculus
tagaactggaaaacatacctgctgg

SEQ ID NO: 748703 - DNA, 25 bp, Mus musculus
tagaactggaaatcatacctgctgg

SEQ ID NO: 748704 - DNA, 25 bp, Mus musculus
tagaactggcctatgctttccagac

SEQ ID NO: 748705 - DNA, 25 bp, Mus musculus
tagaactggcctttgctttccagac

SEQ ID NO: 748706 - DNA, 25 bp, Mus musculus
tagaactgtaatccctgccaataag

SEQ ID NO: 748707 - DNA, 25 bp, Mus musculus
tagaactgtaatgcctgccaataag

SEQ ID NO: 748708 - DNA, 25 bp, Mus musculus
tagaactgtactctccaagggagaa

SEQ ID NO: 748709 - DNA, 25 bp, Mus musculus
tagaactgtactgtccaagggagaa

SEQ ID NO: 748710 - DNA, 25 bp, Mus musculus
tagaacttactaacagaaggtgagc

SEQ ID NO: 748711 - DNA, 25 bp, Mus musculus
tagaacttactatcagaaggtgagc

SEQ ID NO: 748712 - DNA, 25 bp, Mus musculus
tagaacttagtaccttagtggccag

SEQ ID NO: 748713 - DNA, 25 bp, Mus musculus
tagaacttagtagcttagtggccag

SEQ ID NO: 748714 - DNA, 25 bp, Mus musculus
tagaacttccttaccagaataagca

SEQ ID NO: 748715 - DNA, 25 bp, Mus musculus
tagaacttcctttccagaataagca

SEQ ID NO: 748716 - DNA, 25 bp, Mus musculus
tagaacttggaccaatgcgaatccc

SEQ ID NO: 748717 - DNA, 25 bp, Mus musculus
tagaacttggacgaatgcgaatccc

SEQ ID NO: 748718 - DNA, 25 bp, Mus musculus
tagaagaaaaccaccgtcctgacag

SEQ ID NO: 748719 - DNA, 25 bp, Mus musculus
tagaagaaaacctccgtcctgacag

SEQ ID NO: 748720 - DNA, 25 bp, Mus musculus
tagaagaaaattagccacacagtag

SEQ ID NO: 748721 - DNA, 25 bp, Mus musculus
tagaagaaaatttgccacacagtag

SEQ ID NO: 748722 - DNA, 25 bp, Mus musculus
tagaagaaatctaagggaagatgac

SEQ ID NO: 748723 - DNA, 25 bp, Mus musculus
tagaagaaatcttagggaagatgac

SEQ ID NO: 748724 - DNA, 25 bp, Mus musculus
tagaagaaatgaccatggtcatcgg

SEQ ID NO: 748725 - DNA, 25 bp, Mus musculus
tagaagaaatgagcatggtcatcgg

SEQ ID NO: 748726 - DNA, 25 bp, Mus musculus
tagaagaacattagtcagctccgac

SEQ ID NO: 748727 - DNA, 25 bp, Mus musculus
tagaagaacatttgtcagctccgac

SEQ ID NO: 748728 - DNA, 25 bp, Mus musculus
tagaagaactacagaaggaagcagc

SEQ ID NO: 748729 - DNA, 25 bp, Mus musculus
tagaagaactactgaaggaagcagc

SEQ ID NO: 748730 - DNA, 25 bp, Mus musculus
tagaagaactggaagtggtcacaga

SEQ ID NO: 748731 - DNA, 25 bp, Mus musculus
tagaagaactggtagtggtcacaga

SEQ ID NO: 748732 - DNA, 25 bp, Mus musculus
tagaagaacttcaccaacacacaga

SEQ ID NO: 748733 - DNA, 25 bp, Mus musculus
tagaagaacttctccaacacacaga

SEQ ID NO: 748734 - DNA, 25 bp, Mus musculus
tagaagaagtgactcacccctgtaa

SEQ ID NO: 748735 - DNA, 25 bp, Mus musculus
tagaagaagtgagtcacccctgtaa

SEQ ID NO: 748736 - DNA, 25 bp, Mus musculus
tagaagaagtgcaagatggattccg

SEQ ID NO: 748737 - DNA, 25 bp, Mus musculus
tagaagaagtgctagatggattccg

SEQ ID NO: 748738 - DNA, 25 bp, Mus musculus
tagaagaatggtctgtggaaaagca

SEQ ID NO: 748739 - DNA, 25 bp, Mus musculus
tagaagaatggtgtgtggaaaagca

SEQ ID NO: 748740 - DNA, 25 bp, Mus musculus
tagaagacaaaacccgaaagcgagg

SEQ ID NO: 748741 - DNA, 25 bp, Mus musculus
tagaagacaaaagccgaaagcgagg

SEQ ID NO: 748742 - DNA, 25 bp, Mus musculus
tagaagacaactccgtacctcaggt

SEQ ID NO: 748743 - DNA, 25 bp, Mus musculus
tagaagacaactgcgtacctcaggt

SEQ ID NO: 748744 - DNA, 25 bp, Mus musculus
tagaagacacaacgatgagccagcc

SEQ ID NO: 748745 - DNA, 25 bp, Mus musculus
tagaagacacaaggatgagccagcc

SEQ ID NO: 748746 - DNA, 25 bp, Mus musculus
tagaagacactcatatcgagcatgc

SEQ ID NO: 748747 - DNA, 25 bp, Mus musculus
tagaagacactccagacaatataga

SEQ ID NO: 748748 - DNA, 25 bp, Mus musculus
tagaagacactcgagacaatataga

SEQ ID NO: 748749 - DNA, 25 bp, Mus musculus
tagaagacactcttatcgagcatgc

SEQ ID NO: 748750 - DNA, 25 bp, Mus musculus
tagaagacagctattagcctcctgc

SEQ ID NO: 748751 - DNA, 25 bp, Mus musculus
tagaagacagcttttagcctcctgc

SEQ ID NO: 748752 - DNA, 25 bp, Mus musculus
tagaagacaggaccctggttttctt

SEQ ID NO: 748753 - DNA, 25 bp, Mus musculus
tagaagacaggagcctggttttctt

SEQ ID NO: 748754 - DNA, 25 bp, Mus musculus
tagaagacctagactgatgggagat

SEQ ID NO: 748755 - DNA, 25 bp, Mus musculus
tagaagacctagtctgatgggagat

SEQ ID NO: 748756 - DNA, 25 bp, Mus musculus
tagaagacgaaaacacaacattacg

SEQ ID NO: 748757 - DNA, 25 bp, Mus musculus
tagaagacgaaatcacaacattacg

SEQ ID NO: 748758 - DNA, 25 bp, Mus musculus
tagaagacgaccacttgcaaatggc

SEQ ID NO: 748759 - DNA, 25 bp, Mus musculus
tagaagacgacctcttgcaaatggc

SEQ ID NO: 748760 - DNA, 25 bp, Mus musculus
tagaagacggacctgaagcagaagc

SEQ ID NO: 748761 - DNA, 25 bp, Mus musculus
tagaagacggacgtgaagcagaagc

SEQ ID NO: 748762 - DNA, 25 bp, Mus musculus
tagaagactcagctgccaggcagaa

SEQ ID NO: 748763 - DNA, 25 bp, Mus musculus
tagaagactcaggtgccaggcagaa

SEQ ID NO: 748764 - DNA, 25 bp, Mus musculus
tagaagacttgaatcggaaggacag

SEQ ID NO: 748765 - DNA, 25 bp, Mus musculus
tagaagacttgattcggaaggacag

SEQ ID NO: 748766 - DNA, 25 bp, Mus musculus
tagaagagaccaaagcatatacaac

SEQ ID NO: 748767 - DNA, 25 bp, Mus musculus
tagaagagaccatagcatatacaac

SEQ ID NO: 748768 - DNA, 25 bp, Mus musculus
tagaagagatgcagagacctctggt

SEQ ID NO: 748769 - DNA, 25 bp, Mus musculus
tagaagagatgctgagacctctggt

SEQ ID NO: 748770 - DNA, 25 bp, Mus musculus
tagaagagcgtccacggaagactct

SEQ ID NO: 748771 - DNA, 25 bp, Mus musculus
tagaagagcgtcgacggaagactct

SEQ ID NO: 748772 - DNA, 25 bp, Mus musculus
tagaagaggagcagatgccacagga

SEQ ID NO: 748773 - DNA, 25 bp, Mus musculus
tagaagaggagctgatgccacagga

SEQ ID NO: 748774 - DNA, 25 bp, Mus musculus
tagaagaggcagcttgtagatccga

SEQ ID NO: 748775 - DNA, 25 bp, Mus musculus
tagaagaggcaggttgtagatccga

SEQ ID NO: 748776 - DNA, 25 bp, Mus musculus
tagaagaggccaatagtgaggaact

SEQ ID NO: 748777 - DNA, 25 bp, Mus musculus
tagaagaggccattagtgaggaact

SEQ ID NO: 748778 - DNA, 25 bp, Mus musculus
tagaagagtagaaaatgcgtatcac

SEQ ID NO: 748779 - DNA, 25 bp, Mus musculus
tagaagagtagataatgcgtatcac

SEQ ID NO: 748780 - DNA, 25 bp, Mus musculus
tagaagagttttctagtcgcggagc

SEQ ID NO: 748781 - DNA, 25 bp, Mus musculus
tagaagagttttgtagtcgcggagc

SEQ ID NO: 748782 - DNA, 25 bp, Mus musculus
tagaagatctagatcttgcagaacc

SEQ ID NO: 748783 - DNA, 25 bp, Mus musculus
tagaagatctagttcttgcagaacc

SEQ ID NO: 748784 - DNA, 25 bp, Mus musculus
tagaagatgacaatcctgagctaat

SEQ ID NO: 748785 - DNA, 25 bp, Mus musculus
tagaagatgacattcctgagctaat

SEQ ID NO: 748786 - DNA, 25 bp, Mus musculus
tagaagatgagacaccccaggacct

SEQ ID NO: 748787 - DNA, 25 bp, Mus musculus
tagaagatgagagaccccaggacct

SEQ ID NO: 748788 - DNA, 25 bp, Mus musculus
tagaagatgtgaaagaggagtgtca

SEQ ID NO: 748789 - DNA, 25 bp, Mus musculus
tagaagatgtgatagaggagtgtca

SEQ ID NO: 748790 - DNA, 25 bp, Mus musculus
tagaagcaccaaagaaccatgggcg

SEQ ID NO: 748791 - DNA, 25 bp, Mus musculus
tagaagcaccaatgaaccatgggcg

SEQ ID NO: 748792 - DNA, 25 bp, Mus musculus
tagaagcacccaaggcatggcgctc

SEQ ID NO: 748793 - DNA, 25 bp, Mus musculus
tagaagcacccatggcatggcgctc

SEQ ID NO: 748794 - DNA, 25 bp, Mus musculus
tagaagcaggagcttttcaacccag

SEQ ID NO: 748795 - DNA, 25 bp, Mus musculus
tagaagcaggaggttttcaacccag

SEQ ID NO: 748796 - DNA, 25 bp, Mus musculus
tagaagcatcagctggacctctggg

SEQ ID NO: 748797 - DNA, 25 bp, Mus musculus
tagaagcatcaggtggacctctggg

SEQ ID NO: 748798 - DNA, 25 bp, Mus musculus
tagaagcatctacatcctggatgac

SEQ ID NO: 748799 - DNA, 25 bp, Mus musculus
tagaagcatctagatcctggatgac

SEQ ID NO: 748800 - DNA, 25 bp, Mus musculus
tagaagccaaccctatggatgatgg

SEQ ID NO: 748801 - DNA, 25 bp, Mus musculus
tagaagccaaccgtatggatgatgg

SEQ ID NO: 748802 - DNA, 25 bp, Mus musculus
tagaagccagtgaactcagagggac

SEQ ID NO: 748803 - DNA, 25 bp, Mus musculus
tagaagccagtgtactcagagggac

SEQ ID NO: 748804 - DNA, 25 bp, Mus musculus
tagaagccatggagaggatccaaga

SEQ ID NO: 748805 - DNA, 25 bp, Mus musculus
tagaagccatggtgaggatccaaga

SEQ ID NO: 748806 - DNA, 25 bp, Mus musculus
tagaagcccttgaacccttctggga

SEQ ID NO: 748807 - DNA, 25 bp, Mus musculus
tagaagcccttgtacccttctggga

SEQ ID NO: 748808 - DNA, 25 bp, Mus musculus
tagaagcctctgagattgtagatcc

SEQ ID NO: 748809 - DNA, 25 bp, Mus musculus
tagaagcctctgtgattgtagatcc

SEQ ID NO: 748810 - DNA, 25 bp, Mus musculus
tagaagcgatcaaagctcgagtcag

SEQ ID NO: 748811 - DNA, 25 bp, Mus musculus
tagaagcgatcatagctcgagtcag

SEQ ID NO: 748812 - DNA, 25 bp, Mus musculus
tagaagcggcaccagccggtcaaga

SEQ ID NO: 748813 - DNA, 25 bp, Mus musculus
tagaagcggcacgagccggtcaaga

SEQ ID NO: 748814 - DNA, 25 bp, Mus musculus
tagaagcgtactccaaacacaagta

SEQ ID NO: 748815 - DNA, 25 bp, Mus musculus
tagaagcgtactgcaaacacaagta

SEQ ID NO: 748816 - DNA, 25 bp, Mus musculus
tagaagcgttgaaacccaagcccag

SEQ ID NO: 748817 - DNA, 25 bp, Mus musculus
tagaagcgttgatacccaagcccag

SEQ ID NO: 748818 - DNA, 25 bp, Mus musculus
tagaagctaggaatgaactggatca

SEQ ID NO: 748819 - DNA, 25 bp, Mus musculus
tagaagctaggattgaactggatca

SEQ ID NO: 748820 - DNA, 25 bp, Mus musculus
tagaagctctcaaggcaaagaacat

SEQ ID NO: 748821 - DNA, 25 bp, Mus musculus
tagaagctctcatggcaaagaacat

SEQ ID NO: 748822 - DNA, 25 bp, Mus musculus
tagaagcttgcaattgggccacacc

SEQ ID NO: 748823 - DNA, 25 bp, Mus musculus
tagaagcttgcatttgggccacacc

SEQ ID NO: 748824 - DNA, 25 bp, Mus musculus
tagaagcttgggagcaaagggtttc

SEQ ID NO: 748825 - DNA, 25 bp, Mus musculus
tagaagcttgggtgcaaagggtttc

SEQ ID NO: 748826 - DNA, 25 bp, Mus musculus
tagaaggaatgtccataatcgagac

SEQ ID NO: 748827 - DNA, 25 bp, Mus musculus
tagaaggaatgtgcataatcgagac

SEQ ID NO: 748828 - DNA, 25 bp, Mus musculus
tagaaggagacactaaccagaagct

SEQ ID NO: 748829 - DNA, 25 bp, Mus musculus
tagaaggagacagtaaccagaagct

SEQ ID NO: 748830 - DNA, 25 bp, Mus musculus
tagaaggagcacaacccaatcattc

SEQ ID NO: 748831 - DNA, 25 bp, Mus musculus
tagaaggagcactacccaatcattc

SEQ ID NO: 748832 - DNA, 25 bp, Mus musculus
tagaaggagcagactgagcgaggcg

SEQ ID NO: 748833 - DNA, 25 bp, Mus musculus
tagaaggagcagtctgagcgaggcg

SEQ ID NO: 748834 - DNA, 25 bp, Mus musculus
tagaaggagctgctgtcttgcccga

SEQ ID NO: 748835 - DNA, 25 bp, Mus musculus
tagaaggagctggtgtcttgcccga

SEQ ID NO: 748836 - DNA, 25 bp, Mus musculus
tagaaggcaactatccaccctggca

SEQ ID NO: 748837 - DNA, 25 bp, Mus musculus
tagaaggcaactttccaccctggca

SEQ ID NO: 748838 - DNA, 25 bp, Mus musculus
tagaaggcagaaagctccagggaca

SEQ ID NO: 748839 - DNA, 25 bp, Mus musculus
tagaaggcagaatgctccagggaca

SEQ ID NO: 748840 - DNA, 25 bp, Mus musculus
tagaaggcattaatcctggagcaaa

SEQ ID NO: 748841 - DNA, 25 bp, Mus musculus
tagaaggcattattcctggagcaaa

SEQ ID NO: 748842 - DNA, 25 bp, Mus musculus
tagaaggcattgagctgaagccctg

SEQ ID NO: 748843 - DNA, 25 bp, Mus musculus
tagaaggcattgtgctgaagccctg

SEQ ID NO: 748844 - DNA, 25 bp, Mus musculus
tagaaggccctcaccgtgttgtcag

SEQ ID NO: 748845 - DNA, 25 bp, Mus musculus
tagaaggccctctccgtgttgtcag

SEQ ID NO: 748846 - DNA, 25 bp, Mus musculus
tagaaggcgccactttaacgagctg

SEQ ID NO: 748847 - DNA, 25 bp, Mus musculus
tagaaggcgccagtttaacgagctg

SEQ ID NO: 748848 - DNA, 25 bp, Mus musculus
tagaaggcgtccagtacattgcaga

SEQ ID NO: 748849 - DNA, 25 bp, Mus musculus
tagaaggcgtcctgtacattgcaga

SEQ ID NO: 748850 - DNA, 25 bp, Mus musculus
tagaagggaaaactgaacccagtca

SEQ ID NO: 748851 - DNA, 25 bp, Mus musculus
tagaagggaaaagtgaacccagtca

SEQ ID NO: 748852 - DNA, 25 bp, Mus musculus
tagaagggaaagcattaatgtctgg

SEQ ID NO: 748853 - DNA, 25 bp, Mus musculus
tagaagggaaaggattaatgtctgg

SEQ ID NO: 748854 - DNA, 25 bp, Mus musculus
tagaagggacagacctgaacagaga

SEQ ID NO: 748855 - DNA, 25 bp, Mus musculus
tagaagggacagtcctgaacagaga

SEQ ID NO: 748856 - DNA, 25 bp, Mus musculus
tagaagggatgactgtgcgccagct

SEQ ID NO: 748857 - DNA, 25 bp, Mus musculus
tagaagggatgagtgtgcgccagct

SEQ ID NO: 748858 - DNA, 25 bp, Mus musculus
tagaagggtctacaggtacatcgcg

SEQ ID NO: 748859 - DNA, 25 bp, Mus musculus
tagaagggtctagaggtacatcgcg

SEQ ID NO: 748860 - DNA, 25 bp, Mus musculus
tagaagggtgtactggagctctcca

SEQ ID NO: 748861 - DNA, 25 bp, Mus musculus
tagaagggtgtagtggagctctcca

SEQ ID NO: 748862 - DNA, 25 bp, Mus musculus
tagaagggttagcaaggccagattt

SEQ ID NO: 748863 - DNA, 25 bp, Mus musculus
tagaagggttaggaaggccagattt

SEQ ID NO: 748864 - DNA, 25 bp, Mus musculus
tagaaggtaaccaagtaggtgagcc

SEQ ID NO: 748865 - DNA, 25 bp, Mus musculus
tagaaggtaacctagtaggtgagcc

SEQ ID NO: 748866 - DNA, 25 bp, Mus musculus
tagaagtacacaagcatgtcactaa

SEQ ID NO: 748867 - DNA, 25 bp, Mus musculus
tagaagtacacatgcatgtcactaa

SEQ ID NO: 748868 - DNA, 25 bp, Mus musculus
tagaagtacccgatatcccaggtgg

SEQ ID NO: 748869 - DNA, 25 bp, Mus musculus
tagaagtacccgttatcccaggtgg

SEQ ID NO: 748870 - DNA, 25 bp, Mus musculus
tagaagtactaactgaattttcttc

SEQ ID NO: 748871 - DNA, 25 bp, Mus musculus
tagaagtactaagtgaattttcttc

SEQ ID NO: 748872 - DNA, 25 bp, Mus musculus
tagaagtagaggagaaagaagaaga

SEQ ID NO: 748873 - DNA, 25 bp, Mus musculus
tagaagtagaggtgaaagaagaaga

SEQ ID NO: 748874 - DNA, 25 bp, Mus musculus
tagaagtagtcaactagtacagcct

SEQ ID NO: 748875 - DNA, 25 bp, Mus musculus
tagaagtagtcatctagtacagcct

SEQ ID NO: 748876 - DNA, 25 bp, Mus musculus
tagaagtctgagaccggagcagaac

SEQ ID NO: 748877 - DNA, 25 bp, Mus musculus
tagaagtctgagtccggagcagaac

SEQ ID NO: 748878 - DNA, 25 bp, Mus musculus
tagaagtgaaacaactaaaagacaa

SEQ ID NO: 748879 - DNA, 25 bp, Mus musculus
tagaagtgaaactactaaaagacaa

SEQ ID NO: 748880 - DNA, 25 bp, Mus musculus
tagaagtgacataggccagacgttg

SEQ ID NO: 748881 - DNA, 25 bp, Mus musculus
tagaagtgacattggccagacgttg

SEQ ID NO: 748882 - DNA, 25 bp, Mus musculus
tagaagtgatccctgaagctgtgct

SEQ ID NO: 748883 - DNA, 25 bp, Mus musculus
tagaagtgatccgtgaagctgtgct

SEQ ID NO: 748884 - DNA, 25 bp, Mus musculus
tagaagtgatgtctccacctgggca

SEQ ID NO: 748885 - DNA, 25 bp, Mus musculus
tagaagtgatgtgtccacctgggca

SEQ ID NO: 748886 - DNA, 25 bp, Mus musculus
tagaagtgcccgatggtaaacaacc

SEQ ID NO: 748887 - DNA, 25 bp, Mus musculus
tagaagtgcccgttggtaaacaacc

SEQ ID NO: 748888 - DNA, 25 bp, Mus musculus
tagaagtgttctacaatgagctgat

SEQ ID NO: 748889 - DNA, 25 bp, Mus musculus
tagaagtgttcttcaatgagctgat

SEQ ID NO: 748890 - DNA, 25 bp, Mus musculus
tagaagttaataaaggtctcatctc

SEQ ID NO: 748891 - DNA, 25 bp, Mus musculus
tagaagttaatataggtctcatctc

SEQ ID NO: 748892 - DNA, 25 bp, Mus musculus
tagaagttacccctccagcaatgat

SEQ ID NO: 748893 - DNA, 25 bp, Mus musculus
tagaagttacccgtccagcaatgat

SEQ ID NO: 748894 - DNA, 25 bp, Mus musculus
tagaagttcttacgcatctccaaag

SEQ ID NO: 748895 - DNA, 25 bp, Mus musculus
tagaagttcttaggcatctccaaag

SEQ ID NO: 748896 - DNA, 25 bp, Mus musculus
tagaataagacaagtttcaagcaca

SEQ ID NO: 748897 - DNA, 25 bp, Mus musculus
tagaataagacatgtttcaagcaca

SEQ ID NO: 748898 - DNA, 25 bp, Mus musculus
tagaataccacacccgaatccgaga

SEQ ID NO: 748899 - DNA, 25 bp, Mus musculus
tagaataccacagccgaatccgaga

SEQ ID NO: 748900 - DNA, 25 bp, Mus musculus
tagaatagctcaaagaataggcctt

SEQ ID NO: 748901 - DNA, 25 bp, Mus musculus
tagaatagctcatagaataggcctt

SEQ ID NO: 748902 - DNA, 25 bp, Mus musculus
tagaatatgatacagggattgcacc

SEQ ID NO: 748903 - DNA, 25 bp, Mus musculus
tagaatatgatagagggattgcacc

SEQ ID NO: 748904 - DNA, 25 bp, Mus musculus
tagaatatgtacacgcagctgacgc

SEQ ID NO: 748905 - DNA, 25 bp, Mus musculus
tagaatatgtactcgcagctgacgc

SEQ ID NO: 748906 - DNA, 25 bp, Mus musculus
tagaatatgtataaagttcctctcc

SEQ ID NO: 748907 - DNA, 25 bp, Mus musculus
tagaatatgtattaagttcctctcc

SEQ ID NO: 748908 - DNA, 25 bp, Mus musculus
tagaatatgttcctttcatgagtgt

SEQ ID NO: 748909 - DNA, 25 bp, Mus musculus
tagaatatgttcgtttcatgagtgt

SEQ ID NO: 748910 - DNA, 25 bp, Mus musculus
tagaatcaaacgcaaaggcgaggga

SEQ ID NO: 748911 - DNA, 25 bp, Mus musculus
tagaatcaaacggaaaggcgaggga

SEQ ID NO: 748912 - DNA, 25 bp, Mus musculus
tagaatcagaaacgactcatcacac

SEQ ID NO: 748913 - DNA, 25 bp, Mus musculus
tagaatcagaaaggactcatcacac

SEQ ID NO: 748914 - DNA, 25 bp, Mus musculus
tagaatcagactagcgtgtacgact

SEQ ID NO: 748915 - DNA, 25 bp, Mus musculus
tagaatcagacttgcgtgtacgact

SEQ ID NO: 748916 - DNA, 25 bp, Mus musculus
tagaatccctgaaggaccgaggagc

SEQ ID NO: 748917 - DNA, 25 bp, Mus musculus
tagaatccctgatggaccgaggagc

SEQ ID NO: 748918 - DNA, 25 bp, Mus musculus
tagaatcggtgaccacacaccggga

SEQ ID NO: 748919 - DNA, 25 bp, Mus musculus
tagaatcggtgagcacacaccggga

SEQ ID NO: 748920 - DNA, 25 bp, Mus musculus
tagaatctcggcacgatgcagggct

SEQ ID NO: 748921 - DNA, 25 bp, Mus musculus
tagaatctcggctcgatgcagggct

SEQ ID NO: 748922 - DNA, 25 bp, Mus musculus
tagaatctggacacatccttggtgt

SEQ ID NO: 748923 - DNA, 25 bp, Mus musculus
tagaatctggactcatccttggtgt

SEQ ID NO: 748924 - DNA, 25 bp, Mus musculus
tagaatcttcagaggaccgcttaga

SEQ ID NO: 748925 - DNA, 25 bp, Mus musculus
tagaatcttcagtggaccgcttaga

SEQ ID NO: 748926 - DNA, 25 bp, Mus musculus
tagaatgcagtaacaccctggagga

SEQ ID NO: 748927 - DNA, 25 bp, Mus musculus
tagaatgcagtatcaccctggagga

SEQ ID NO: 748928 - DNA, 25 bp, Mus musculus
tagaatgctaatcaggaaggcccgg

SEQ ID NO: 748929 - DNA, 25 bp, Mus musculus
tagaatgctaatgaggaaggcccgg

SEQ ID NO: 748930 - DNA, 25 bp, Mus musculus
tagaatggctaaagagatgggaagt

SEQ ID NO: 748931 - DNA, 25 bp, Mus musculus
tagaatggctaatgagatgggaagt

SEQ ID NO: 748932 - DNA, 25 bp, Mus musculus
tagaatggtcctcgttctgcaacag

SEQ ID NO: 748933 - DNA, 25 bp, Mus musculus
tagaatggtcctggttctgcaacag

SEQ ID NO: 748934 - DNA, 25 bp, Mus musculus
tagaatgtctgcctagcacttggga

SEQ ID NO: 748935 - DNA, 25 bp, Mus musculus
tagaatgtctgcgtagcacttggga

SEQ ID NO: 748936 - DNA, 25 bp, Mus musculus
tagaattaagcaactggtccagaaa

SEQ ID NO: 748937 - DNA, 25 bp, Mus musculus
tagaattaagcatctggtccagaaa

SEQ ID NO: 748938 - DNA, 25 bp, Mus musculus
tagaattacagcaacaatttggtcc

SEQ ID NO: 748939 - DNA, 25 bp, Mus musculus
tagaattacagctacaatttggtcc

SEQ ID NO: 748940 - DNA, 25 bp, Mus musculus
tagaattacttgctaagaggccaaa

SEQ ID NO: 748941 - DNA, 25 bp, Mus musculus
tagaattacttggtaagaggccaaa

SEQ ID NO: 748942 - DNA, 25 bp, Mus musculus
tagaattagagccagtgtaggcttg

SEQ ID NO: 748943 - DNA, 25 bp, Mus musculus
tagaattagagcgagtgtaggcttg

SEQ ID NO: 748944 - DNA, 25 bp, Mus musculus
tagaattagtgactccggagccgcc

SEQ ID NO: 748945 - DNA, 25 bp, Mus musculus
tagaattagtgagtccggagccgcc

SEQ ID NO: 748946 - DNA, 25 bp, Mus musculus
tagaattcacaaacgcatagctgcc

SEQ ID NO: 748947 - DNA, 25 bp, Mus musculus
tagaattcacaatcgcatagctgcc

SEQ ID NO: 748948 - DNA, 25 bp, Mus musculus
tagaattcatatcgaagaggacgcc

SEQ ID NO: 748949 - DNA, 25 bp, Mus musculus
tagaattcatatggaagaggacgcc

SEQ ID NO: 748950 - DNA, 25 bp, Mus musculus
tagaattcggtcatatagaactggt

SEQ ID NO: 748951 - DNA, 25 bp, Mus musculus
tagaattcggtcttatagaactggt

SEQ ID NO: 748952 - DNA, 25 bp, Mus musculus
tagaattcgtaactgggcctagaga

SEQ ID NO: 748953 - DNA, 25 bp, Mus musculus
tagaattcgtaagtgggcctagaga

SEQ ID NO: 748954 - DNA, 25 bp, Mus musculus
tagaattgcctcatacaaatccaga

SEQ ID NO: 748955 - DNA, 25 bp, Mus musculus
tagaattgcctcttacaaatccaga

SEQ ID NO: 748956 - DNA, 25 bp, Mus musculus
tagaattgtgtcctggaagccaggc

SEQ ID NO: 748957 - DNA, 25 bp, Mus musculus
tagaattgtgtcgtggaagccaggc

SEQ ID NO: 748958 - DNA, 25 bp, Mus musculus
tagaatttgcttaaaaagatctgcg

SEQ ID NO: 748959 - DNA, 25 bp, Mus musculus
tagaatttgctttaaaagatctgcg

SEQ ID NO: 748960 - DNA, 25 bp, Mus musculus
tagaattttccactgttgtgcttgg

SEQ ID NO: 748961 - DNA, 25 bp, Mus musculus
tagaattttccagtgttgtgcttgg

SEQ ID NO: 748962 - DNA, 25 bp, Mus musculus
tagaattttgtcatcctgaagacca

SEQ ID NO: 748963 - DNA, 25 bp, Mus musculus
tagaattttgtcttcctgaagacca

SEQ ID NO: 748964 - DNA, 25 bp, Mus musculus
tagacaaaaggcactggaactcgca

SEQ ID NO: 748965 - DNA, 25 bp, Mus musculus
tagacaaaaggctctggaactcgca

SEQ ID NO: 748966 - DNA, 25 bp, Mus musculus
tagacaaaccccaggactgggaggc

SEQ ID NO: 748967 - DNA, 25 bp, Mus musculus
tagacaaacccctggactgggaggc

SEQ ID NO: 748968 - DNA, 25 bp, Mus musculus
tagacaaactgtagcaggagcacga

SEQ ID NO: 748969 - DNA, 25 bp, Mus musculus
tagacaaactgttgcaggagcacga

SEQ ID NO: 748970 - DNA, 25 bp, Mus musculus
tagacaaagagaatgttctggaccg

SEQ ID NO: 748971 - DNA, 25 bp, Mus musculus
tagacaaagagattgttctggaccg

SEQ ID NO: 748972 - DNA, 25 bp, Mus musculus
tagacaaaggatccgccgaggaaga

SEQ ID NO: 748973 - DNA, 25 bp, Mus musculus
tagacaaaggatgcgccgaggaaga

SEQ ID NO: 748974 - DNA, 25 bp, Mus musculus
tagacaacaagaatgagcaggccat

SEQ ID NO: 748975 - DNA, 25 bp, Mus musculus
tagacaacaagattgagcaggccat

SEQ ID NO: 748976 - DNA, 25 bp, Mus musculus
tagacaacctctacagtgacctgca

SEQ ID NO: 748977 - DNA, 25 bp, Mus musculus
tagacaacctcttcagtgacctgca

SEQ ID NO: 748978 - DNA, 25 bp, Mus musculus
tagacaactcggaaaaacacgagac

SEQ ID NO: 748979 - DNA, 25 bp, Mus musculus
tagacaactcggtaaaacacgagac

SEQ ID NO: 748980 - DNA, 25 bp, Mus musculus
tagacaagaaccaccgtttggccac

SEQ ID NO: 748981 - DNA, 25 bp, Mus musculus
tagacaagaacctccgtttggccac

SEQ ID NO: 748982 - DNA, 25 bp, Mus musculus
tagacaagaacgagcccctggtctg

SEQ ID NO: 748983 - DNA, 25 bp, Mus musculus
tagacaagaacgtgcccctggtctg

SEQ ID NO: 748984 - DNA, 25 bp, Mus musculus
tagacaagagatcgcaagtgagagc

SEQ ID NO: 748985 - DNA, 25 bp, Mus musculus
tagacaagagatggcaagtgagagc

SEQ ID NO: 748986 - DNA, 25 bp, Mus musculus
tagacaagcatgaggaggcccagag

SEQ ID NO: 748987 - DNA, 25 bp, Mus musculus
tagacaagcatgtggaggcccagag

SEQ ID NO: 748988 - DNA, 25 bp, Mus musculus
tagacaaggccaagaactggcaaag

SEQ ID NO: 748989 - DNA, 25 bp, Mus musculus
tagacaaggccatgaactggcaaag

SEQ ID NO: 748990 - DNA, 25 bp, Mus musculus
tagacaagtacaatggtgaaagtgc

SEQ ID NO: 748991 - DNA, 25 bp, Mus musculus
tagacaagtacattggtgaaagtgc

SEQ ID NO: 748992 - DNA, 25 bp, Mus musculus
tagacaatcaacacagcagccccta

SEQ ID NO: 748993 - DNA, 25 bp, Mus musculus
tagacaatcaactcagcagccccta

SEQ ID NO: 748994 - DNA, 25 bp, Mus musculus
tagacaatctgcacgtactggatct

SEQ ID NO: 748995 - DNA, 25 bp, Mus musculus
tagacaatctgctcgtactggatct

SEQ ID NO: 748996 - DNA, 25 bp, Mus musculus
tagacaatgataaaatgcgctggcc

SEQ ID NO: 748997 - DNA, 25 bp, Mus musculus
tagacaatgatataatgcgctggcc

SEQ ID NO: 748998 - DNA, 25 bp, Mus musculus
tagacaccgcctacctgcgggaggt

SEQ ID NO: 748999 - DNA, 25 bp, Mus musculus
tagacaccgccttcctgcgggaggt

SEQ ID NO: 749000 - DNA, 25 bp, Mus musculus
tagacacgacttactgtgacccaag

SEQ ID NO: 749001 - DNA, 25 bp, Mus musculus
tagacacgactttctgtgacccaag

SEQ ID NO: 749002 - DNA, 25 bp, Mus musculus
tagacacggcgcagaggcaagagaa

SEQ ID NO: 749003 - DNA, 25 bp, Mus musculus
tagacacggcgctgaggcaagagaa

SEQ ID NO: 749004 - DNA, 25 bp, Mus musculus
tagacacgttttctggtagtcctcc

SEQ ID NO: 749005 - DNA, 25 bp, Mus musculus
tagacacgttttgtggtagtcctcc

SEQ ID NO: 749006 - DNA, 25 bp, Mus musculus
tagacactaagcaaacccacttggt

SEQ ID NO: 749007 - DNA, 25 bp, Mus musculus
tagacactaagctaacccacttggt

SEQ ID NO: 749008 - DNA, 25 bp, Mus musculus
tagacactcgttatgacatcagcag

SEQ ID NO: 749009 - DNA, 25 bp, Mus musculus
tagacactcgttttgacatcagcag

SEQ ID NO: 749010 - DNA, 25 bp, Mus musculus
tagacacttggcagaaggaccgtgc

SEQ ID NO: 749011 - DNA, 25 bp, Mus musculus
tagacacttggctgaaggaccgtgc

SEQ ID NO: 749012 - DNA, 25 bp, Mus musculus
tagacactttatacagagccgttgg

SEQ ID NO: 749013 - DNA, 25 bp, Mus musculus
tagacactttattcagagccgttgg

SEQ ID NO: 749014 - DNA, 25 bp, Mus musculus
tagacagaacttaggaggtcaacca

SEQ ID NO: 749015 - DNA, 25 bp, Mus musculus
tagacagaactttggaggtcaacca

SEQ ID NO: 749016 - DNA, 25 bp, Mus musculus
tagacagacggaaggctttcacggg

SEQ ID NO: 749017 - DNA, 25 bp, Mus musculus
tagacagacggatggctttcacggg

SEQ ID NO: 749018 - DNA, 25 bp, Mus musculus
tagacagagactacactgaggagtg

SEQ ID NO: 749019 - DNA, 25 bp, Mus musculus
tagacagagacttcactgaggagtg

SEQ ID NO: 749020 - DNA, 25 bp, Mus musculus
tagacagagcatccacgcagccatg

SEQ ID NO: 749021 - DNA, 25 bp, Mus musculus
tagacagagcatgcacgcagccatg

SEQ ID NO: 749022 - DNA, 25 bp, Mus musculus
tagacagcaagcattgttggccaag

SEQ ID NO: 749023 - DNA, 25 bp, Mus musculus
tagacagcaagctttgttggccaag

SEQ ID NO: 749024 - DNA, 25 bp, Mus musculus
tagacagccgcactggcaacaaggt

SEQ ID NO: 749025 - DNA, 25 bp, Mus musculus
tagacagccgcagtggcaacaaggt

SEQ ID NO: 749026 - DNA, 25 bp, Mus musculus
tagacagctggtcccatcactgccg

SEQ ID NO: 749027 - DNA, 25 bp, Mus musculus
tagacagctggtgccatcactgccg

SEQ ID NO: 749028 - DNA, 25 bp, Mus musculus
tagacagctgtgcttgcggccagat

SEQ ID NO: 749029 - DNA, 25 bp, Mus musculus
tagacagctgtggttgcggccagat

SEQ ID NO: 749030 - DNA, 25 bp, Mus musculus
tagacaggacccacacagacatctc

SEQ ID NO: 749031 - DNA, 25 bp, Mus musculus
tagacaggaccctcacagacatctc

SEQ ID NO: 749032 - DNA, 25 bp, Mus musculus
tagacagggcatcaggataccacac

SEQ ID NO: 749033 - DNA, 25 bp, Mus musculus
tagacagggcatgaggataccacac

SEQ ID NO: 749034 - DNA, 25 bp, Mus musculus
tagacagtgactaccagcttctggt

SEQ ID NO: 749035 - DNA, 25 bp, Mus musculus
tagacagtgacttccagcttctggt

SEQ ID NO: 749036 - DNA, 25 bp, Mus musculus
tagacagtgatacataacagagtcc

SEQ ID NO: 749037 - DNA, 25 bp, Mus musculus
tagacagtgatagataacagagtcc

SEQ ID NO: 749038 - DNA, 25 bp, Mus musculus
tagacagtgcacagaagccactgta

SEQ ID NO: 749039 - DNA, 25 bp, Mus musculus
tagacagtgcactgaagccactgta

SEQ ID NO: 749040 - DNA, 25 bp, Mus musculus
tagacagtggtgctcctcacgctgt

SEQ ID NO: 749041 - DNA, 25 bp, Mus musculus
tagacagtggtggtcctcacgctgt

SEQ ID NO: 749042 - DNA, 25 bp, Mus musculus
tagacagtgttgaagtcttcgtggc

SEQ ID NO: 749043 - DNA, 25 bp, Mus musculus
tagacagtgttgtagtcttcgtggc

SEQ ID NO: 749044 - DNA, 25 bp, Mus musculus
tagacagttcagaccgctaacttac

SEQ ID NO: 749045 - DNA, 25 bp, Mus musculus
tagacagttcagtccgctaacttac

SEQ ID NO: 749046 - DNA, 25 bp, Mus musculus
tagacagttgttaatcacgtgaaga

SEQ ID NO: 749047 - DNA, 25 bp, Mus musculus
tagacagttgtttatcacgtgaaga

SEQ ID NO: 749048 - DNA, 25 bp, Mus musculus
tagacataaagtactaggcactttc

SEQ ID NO: 749049 - DNA, 25 bp, Mus musculus
tagacataaagttctaggcactttc

SEQ ID NO: 749050 - DNA, 25 bp, Mus musculus
tagacataatacagttgccttctga

SEQ ID NO: 749051 - DNA, 25 bp, Mus musculus
tagacataatactgttgccttctga

SEQ ID NO: 749052 - DNA, 25 bp, Mus musculus
tagacatcagagcactcacactggt

SEQ ID NO: 749053 - DNA, 25 bp, Mus musculus
tagacatcagaggactcacactggt

SEQ ID NO: 749054 - DNA, 25 bp, Mus musculus
tagacatcagcaaggatgatcccga

SEQ ID NO: 749055 - DNA, 25 bp, Mus musculus
tagacatcagcatggatgatcccga

SEQ ID NO: 749056 - DNA, 25 bp, Mus musculus
tagacatcagttaccctggcctgga

SEQ ID NO: 749057 - DNA, 25 bp, Mus musculus
tagacatcagtttccctggcctgga

SEQ ID NO: 749058 - DNA, 25 bp, Mus musculus
tagacatcgcagctggaaatatgct

SEQ ID NO: 749059 - DNA, 25 bp, Mus musculus
tagacatcgcaggtggaaatatgct

SEQ ID NO: 749060 - DNA, 25 bp, Mus musculus
tagacatcgcctcgtgtccacacaa

SEQ ID NO: 749061 - DNA, 25 bp, Mus musculus
tagacatcgcctggtgtccacacaa

SEQ ID NO: 749062 - DNA, 25 bp, Mus musculus
tagacatctgttcccgccttcagga

SEQ ID NO: 749063 - DNA, 25 bp, Mus musculus
tagacatctgttgccgccttcagga

SEQ ID NO: 749064 - DNA, 25 bp, Mus musculus
tagacatgactgacgaggaacggcc

SEQ ID NO: 749065 - DNA, 25 bp, Mus musculus
tagacatgactgtcgaggaacggcc

SEQ ID NO: 749066 - DNA, 25 bp, Mus musculus
tagacatgctggaccctcgacagtg

SEQ ID NO: 749067 - DNA, 25 bp, Mus musculus
tagacatgctggtccctcgacagtg

SEQ ID NO: 749068 - DNA, 25 bp, Mus musculus
tagacatgttcgatcttggagcaac

SEQ ID NO: 749069 - DNA, 25 bp, Mus musculus
tagacatgttcgttcttggagcaac

SEQ ID NO: 749070 - DNA, 25 bp, Mus musculus
tagacattccagaatcatctgccat

SEQ ID NO: 749071 - DNA, 25 bp, Mus musculus
tagacattccagtatcatctgccat

SEQ ID NO: 749072 - DNA, 25 bp, Mus musculus
tagacattgcgaaccagacaggcag

SEQ ID NO: 749073 - DNA, 25 bp, Mus musculus
tagacattgcgatccagacaggcag

SEQ ID NO: 749074 - DNA, 25 bp, Mus musculus
tagacattggtacacacagcgcttc

SEQ ID NO: 749075 - DNA, 25 bp, Mus musculus
tagacattggtagacacagcgcttc

SEQ ID NO: 749076 - DNA, 25 bp, Mus musculus
tagacatttgagatgtacttcctgg

SEQ ID NO: 749077 - DNA, 25 bp, Mus musculus
tagacatttgagttgtacttcctgg

SEQ ID NO: 749078 - DNA, 25 bp, Mus musculus
tagacatttttaccatcccgccaac

SEQ ID NO: 749079 - DNA, 25 bp, Mus musculus
tagacatttttagcatcccgccaac

SEQ ID NO: 749080 - DNA, 25 bp, Mus musculus
tagaccaagacgcagacatagatcc

SEQ ID NO: 749081 - DNA, 25 bp, Mus musculus
tagaccaagacggagacatagatcc

SEQ ID NO: 749082 - DNA, 25 bp, Mus musculus
tagaccacatctcattccatcttgg

SEQ ID NO: 749083 - DNA, 25 bp, Mus musculus
tagaccacatctgattccatcttgg

SEQ ID NO: 749084 - DNA, 25 bp, Mus musculus
tagaccacattcacgcccttacatg

SEQ ID NO: 749085 - DNA, 25 bp, Mus musculus
tagaccacattctcgcccttacatg

SEQ ID NO: 749086 - DNA, 25 bp, Mus musculus
tagaccacccgacgctagtgtagcc

SEQ ID NO: 749087 - DNA, 25 bp, Mus musculus
tagaccacccgaggctagtgtagcc

SEQ ID NO: 749088 - DNA, 25 bp, Mus musculus
tagaccagagctagctgtggtgatg

SEQ ID NO: 749089 - DNA, 25 bp, Mus musculus
tagaccagagcttgctgtggtgatg

SEQ ID NO: 749090 - DNA, 25 bp, Mus musculus
tagaccagatttcatagacgaagct

SEQ ID NO: 749091 - DNA, 25 bp, Mus musculus
tagaccagatttgatagacgaagct

SEQ ID NO: 749092 - DNA, 25 bp, Mus musculus
tagaccagctcaacgagggcacccg

SEQ ID NO: 749093 - DNA, 25 bp, Mus musculus
tagaccagctcatcgagggcacccg

SEQ ID NO: 749094 - DNA, 25 bp, Mus musculus
tagaccaggaatcctggatttcggg

SEQ ID NO: 749095 - DNA, 25 bp, Mus musculus
tagaccaggaatgctggatttcggg

SEQ ID NO: 749096 - DNA, 25 bp, Mus musculus
tagaccaggagactgcattggctgc

SEQ ID NO: 749097 - DNA, 25 bp, Mus musculus
tagaccaggagagtgcattggctgc

SEQ ID NO: 749098 - DNA, 25 bp, Mus musculus
tagaccagtctgagtgtttgtccct

SEQ ID NO: 749099 - DNA, 25 bp, Mus musculus
tagaccagtctgtgtgtttgtccct

SEQ ID NO: 749100 - DNA, 25 bp, Mus musculus
tagaccagtgctctcaagccctttc

SEQ ID NO: 749101 - DNA, 25 bp, Mus musculus
tagaccagtgctgtcaagccctttc

SEQ ID NO: 749102 - DNA, 25 bp, Mus musculus
tagaccagtgggaggtaactcatca

SEQ ID NO: 749103 - DNA, 25 bp, Mus musculus
tagaccagtgggtggtaactcatca

SEQ ID NO: 749104 - DNA, 25 bp, Mus musculus
tagaccagttggctggtaaacctga

SEQ ID NO: 749105 - DNA, 25 bp, Mus musculus
tagaccagttgggtggtaaacctga

SEQ ID NO: 749106 - DNA, 25 bp, Mus musculus
tagaccatcgttctgtggctactgt

SEQ ID NO: 749107 - DNA, 25 bp, Mus musculus
tagaccatcgttgtgtggctactgt

SEQ ID NO: 749108 - DNA, 25 bp, Mus musculus
tagacccaggtcctttagagacagt

SEQ ID NO: 749109 - DNA, 25 bp, Mus musculus
tagacccaggtcgtttagagacagt

SEQ ID NO: 749110 - DNA, 25 bp, Mus musculus
tagacccatgtgatctcctatgaag

SEQ ID NO: 749111 - DNA, 25 bp, Mus musculus
tagacccatgtgttctcctatgaag

SEQ ID NO: 749112 - DNA, 25 bp, Mus musculus
tagacccattggaaggtgctgccct

SEQ ID NO: 749113 - DNA, 25 bp, Mus musculus
tagacccattggtaggtgctgccct

SEQ ID NO: 749114 - DNA, 25 bp, Mus musculus
tagaccccaagtcacagtggcgaag

SEQ ID NO: 749115 - DNA, 25 bp, Mus musculus
tagaccccaagtgacagtggcgaag

SEQ ID NO: 749116 - DNA, 25 bp, Mus musculus
tagaccccatgcagggaagcagtgt

SEQ ID NO: 749117 - DNA, 25 bp, Mus musculus
tagaccccatgctgggaagcagtgt

SEQ ID NO: 749118 - DNA, 25 bp, Mus musculus
tagaccccgtgaatgggcagatcac

SEQ ID NO: 749119 - DNA, 25 bp, Mus musculus
tagaccccgtgattgggcagatcac

SEQ ID NO: 749120 - DNA, 25 bp, Mus musculus
tagacccgctctcttggatataacc

SEQ ID NO: 749121 - DNA, 25 bp, Mus musculus
tagacccgctctgttggatataacc

SEQ ID NO: 749122 - DNA, 25 bp, Mus musculus
tagaccctacttaccacattacaga

SEQ ID NO: 749123 - DNA, 25 bp, Mus musculus
tagaccctactttccacattacaga

SEQ ID NO: 749124 - DNA, 25 bp, Mus musculus
tagaccctattgagtgtgagcagca

SEQ ID NO: 749125 - DNA, 25 bp, Mus musculus
tagaccctattgtgtgtgagcagca

SEQ ID NO: 749126 - DNA, 25 bp, Mus musculus
tagaccctcaagacaagtcagcgga

SEQ ID NO: 749127 - DNA, 25 bp, Mus musculus
tagaccctcaagtcaagtcagcgga

SEQ ID NO: 749128 - DNA, 25 bp, Mus musculus
tagaccctcgtcctccgtcagagat

SEQ ID NO: 749129 - DNA, 25 bp, Mus musculus
tagaccctcgtcgtccgtcagagat

SEQ ID NO: 749130 - DNA, 25 bp, Mus musculus
tagaccctgactatcatgagaatta

SEQ ID NO: 749131 - DNA, 25 bp, Mus musculus
tagaccctgactttcatgagaatta

SEQ ID NO: 749132 - DNA, 25 bp, Mus musculus
tagaccctgatgcttgtgctgccgg

SEQ ID NO: 749133 - DNA, 25 bp, Mus musculus
tagaccctgatggttgtgctgccgg

SEQ ID NO: 749134 - DNA, 25 bp, Mus musculus
tagacccttgggactagcgagttcc

SEQ ID NO: 749135 - DNA, 25 bp, Mus musculus
tagacccttgggtctagcgagttcc

SEQ ID NO: 749136 - DNA, 25 bp, Mus musculus
tagaccgatgtgcaaagcactttgg

SEQ ID NO: 749137 - DNA, 25 bp, Mus musculus
tagaccgatgtggaaagcactttgg

SEQ ID NO: 749138 - DNA, 25 bp, Mus musculus
tagaccgcatccacactgtgacatc

SEQ ID NO: 749139 - DNA, 25 bp, Mus musculus
tagaccgcatcctcactgtgacatc

SEQ ID NO: 749140 - DNA, 25 bp, Mus musculus
tagaccgccatgctaactgccaagc

SEQ ID NO: 749141 - DNA, 25 bp, Mus musculus
tagaccgccatggtaactgccaagc

SEQ ID NO: 749142 - DNA, 25 bp, Mus musculus
tagaccggtaccagcgaaggaggct

SEQ ID NO: 749143 - DNA, 25 bp, Mus musculus
tagaccggtacctgcgaaggaggct

SEQ ID NO: 749144 - DNA, 25 bp, Mus musculus
tagaccgtgtctagtcaggattcca

SEQ ID NO: 749145 - DNA, 25 bp, Mus musculus
tagaccgtgtcttgtcaggattcca

SEQ ID NO: 749146 - DNA, 25 bp, Mus musculus
tagaccgttatgaagctatctgcca

SEQ ID NO: 749147 - DNA, 25 bp, Mus musculus
tagaccgttatgtagctatctgcca

SEQ ID NO: 749148 - DNA, 25 bp, Mus musculus
tagacctaaaaaactgtgccagctg

SEQ ID NO: 749149 - DNA, 25 bp, Mus musculus
tagacctaaaaatctgtgccagctg

SEQ ID NO: 749150 - DNA, 25 bp, Mus musculus
tagacctactagcaacaaaagctct

SEQ ID NO: 749151 - DNA, 25 bp, Mus musculus
tagacctactaggaacaaaagctct

SEQ ID NO: 749152 - DNA, 25 bp, Mus musculus
tagacctagcctctgaatttgggcg

SEQ ID NO: 749153 - DNA, 25 bp, Mus musculus
tagacctagcctgtgaatttgggcg

SEQ ID NO: 749154 - DNA, 25 bp, Mus musculus
tagacctcagggagccatcttgcag

SEQ ID NO: 749155 - DNA, 25 bp, Mus musculus
tagacctcagggtgccatcttgcag

SEQ ID NO: 749156 - DNA, 25 bp, Mus musculus
tagacctccaaaccttcagggaagg

SEQ ID NO: 749157 - DNA, 25 bp, Mus musculus
tagacctccaaagcttcagggaagg

SEQ ID NO: 749158 - DNA, 25 bp, Mus musculus
tagacctcccgacccgagttggtca

SEQ ID NO: 749159 - DNA, 25 bp, Mus musculus
tagacctcccgagccgagttggtca

SEQ ID NO: 749160 - DNA, 25 bp, Mus musculus
tagacctcgctgcattcaggcttga

SEQ ID NO: 749161 - DNA, 25 bp, Mus musculus
tagacctcgctggattcaggcttga

SEQ ID NO: 749162 - DNA, 25 bp, Mus musculus
tagacctcttccctaatgcgggatg

SEQ ID NO: 749163 - DNA, 25 bp, Mus musculus
tagacctcttccgtaatgcgggatg

SEQ ID NO: 749164 - DNA, 25 bp, Mus musculus
tagacctcttggaaggccttacagg

SEQ ID NO: 749165 - DNA, 25 bp, Mus musculus
tagacctcttggtaggccttacagg

SEQ ID NO: 749166 - DNA, 25 bp, Mus musculus
tagacctgacctagattcgtgctcg

SEQ ID NO: 749167 - DNA, 25 bp, Mus musculus
tagacctgaccttgattcgtgctcg

SEQ ID NO: 749168 - DNA, 25 bp, Mus musculus
tagacctgagccacaacagcatctg

SEQ ID NO: 749169 - DNA, 25 bp, Mus musculus
tagacctgagcctcaacagcatctg

SEQ ID NO: 749170 - DNA, 25 bp, Mus musculus
tagacctgagtgacttccgagaccg

SEQ ID NO: 749171 - DNA, 25 bp, Mus musculus
tagacctgagtgtcttccgagaccg

SEQ ID NO: 749172 - DNA, 25 bp, Mus musculus
tagacctggacacacactaggctga

SEQ ID NO: 749173 - DNA, 25 bp, Mus musculus
tagacctggacagacactaggctga

SEQ ID NO: 749174 - DNA, 25 bp, Mus musculus
tagacctgggtgatctctctgcttg

SEQ ID NO: 749175 - DNA, 25 bp, Mus musculus
tagacctgggtgttctctctgcttg

SEQ ID NO: 749176 - DNA, 25 bp, Mus musculus
tagacctggtcaagtcagacgggct

SEQ ID NO: 749177 - DNA, 25 bp, Mus musculus
tagacctggtcatgtcagacgggct

SEQ ID NO: 749178 - DNA, 25 bp, Mus musculus
tagacctggttaacattcgagagca

SEQ ID NO: 749179 - DNA, 25 bp, Mus musculus
tagacctggttatcattcgagagca

SEQ ID NO: 749180 - DNA, 25 bp, Mus musculus
tagacctgtttcacgaccccgactt

SEQ ID NO: 749181 - DNA, 25 bp, Mus musculus
tagacctgtttctcgaccccgactt

SEQ ID NO: 749182 - DNA, 25 bp, Mus musculus
tagaccttcagacgtgatcagagag

SEQ ID NO: 749183 - DNA, 25 bp, Mus musculus
tagaccttcagaggtgatcagagag

SEQ ID NO: 749184 - DNA, 25 bp, Mus musculus
tagaccttgatgagctattacgggc

SEQ ID NO: 749185 - DNA, 25 bp, Mus musculus
tagaccttgatgtgctattacgggc

SEQ ID NO: 749186 - DNA, 25 bp, Mus musculus
tagaccttggccacatttatggaga

SEQ ID NO: 749187 - DNA, 25 bp, Mus musculus
tagaccttggcctcatttatggaga

SEQ ID NO: 749188 - DNA, 25 bp, Mus musculus
tagacgaaaaacactagccaaggcg

SEQ ID NO: 749189 - DNA, 25 bp, Mus musculus
tagacgaaaaactctagccaaggcg

SEQ ID NO: 749190 - DNA, 25 bp, Mus musculus
tagacgaaataacgaaaccaacacg

SEQ ID NO: 749191 - DNA, 25 bp, Mus musculus
tagacgaaataaggaaaccaacacg

SEQ ID NO: 749192 - DNA, 25 bp, Mus musculus
tagacgaagctcaccttcgacccgg

SEQ ID NO: 749193 - DNA, 25 bp, Mus musculus
tagacgaagctctccttcgacccgg

SEQ ID NO: 749194 - DNA, 25 bp, Mus musculus
tagacgaagggcagactacgaagca

SEQ ID NO: 749195 - DNA, 25 bp, Mus musculus
tagacgaagggctgactacgaagca

SEQ ID NO: 749196 - DNA, 25 bp, Mus musculus
tagacgaccaggacatcctgctacg

SEQ ID NO: 749197 - DNA, 25 bp, Mus musculus
tagacgaccaggtcatcctgctacg

SEQ ID NO: 749198 - DNA, 25 bp, Mus musculus
tagacgaccctaacctgaagtacca

SEQ ID NO: 749199 - DNA, 25 bp, Mus musculus
tagacgaccctatcctgaagtacca

SEQ ID NO: 749200 - DNA, 25 bp, Mus musculus
tagacgaccgcaaagcgccttatct

SEQ ID NO: 749201 - DNA, 25 bp, Mus musculus
tagacgaccgcatagcgccttatct

SEQ ID NO: 749202 - DNA, 25 bp, Mus musculus
tagacgagaagaactctgccatggg

SEQ ID NO: 749203 - DNA, 25 bp, Mus musculus
tagacgagaagatctctgccatggg

SEQ ID NO: 749204 - DNA, 25 bp, Mus musculus
tagacgagagccattactcccggca

SEQ ID NO: 749205 - DNA, 25 bp, Mus musculus
tagacgagagcctttactcccggca

SEQ ID NO: 749206 - DNA, 25 bp, Mus musculus
tagacgagaggcctatccatgctga

SEQ ID NO: 749207 - DNA, 25 bp, Mus musculus
tagacgagaggcgtatccatgctga

SEQ ID NO: 749208 - DNA, 25 bp, Mus musculus
tagacgatggttaattcaacaagaa

SEQ ID NO: 749209 - DNA, 25 bp, Mus musculus
tagacgatggtttattcaacaagaa

SEQ ID NO: 749210 - DNA, 25 bp, Mus musculus
tagacgattcagatacccagagaga

SEQ ID NO: 749211 - DNA, 25 bp, Mus musculus
tagacgattcagttacccagagaga

SEQ ID NO: 749212 - DNA, 25 bp, Mus musculus
tagacgccatctccttcttgtcggg

SEQ ID NO: 749213 - DNA, 25 bp, Mus musculus
tagacgccatctgcttcttgtcggg

SEQ ID NO: 749214 - DNA, 25 bp, Mus musculus
tagacgcccagtacggcggtgttga

SEQ ID NO: 749215 - DNA, 25 bp, Mus musculus
tagacgcccagttcggcggtgttga

SEQ ID NO: 749216 - DNA, 25 bp, Mus musculus
tagacgccctacaggatgtggacca

SEQ ID NO: 749217 - DNA, 25 bp, Mus musculus
tagacgccctactggatgtggacca

SEQ ID NO: 749218 - DNA, 25 bp, Mus musculus
tagacgctcataatcgcctctggga

SEQ ID NO: 749219 - DNA, 25 bp, Mus musculus
tagacgctcatattcgcctctggga

SEQ ID NO: 749220 - DNA, 25 bp, Mus musculus
tagacgctccctatgtgcgcctgca

SEQ ID NO: 749221 - DNA, 25 bp, Mus musculus
tagacgctccctttgtgcgcctgca

SEQ ID NO: 749222 - DNA, 25 bp, Mus musculus
tagacgcttctgagcaggcggacct

SEQ ID NO: 749223 - DNA, 25 bp, Mus musculus
tagacgcttctgtgcaggcggacct

SEQ ID NO: 749224 - DNA, 25 bp, Mus musculus
tagacggaaggtctgtgcttaagac

SEQ ID NO: 749225 - DNA, 25 bp, Mus musculus
tagacggaaggtgtgtgcttaagac

SEQ ID NO: 749226 - DNA, 25 bp, Mus musculus
tagacggagaagagcatgtcggctt

SEQ ID NO: 749227 - DNA, 25 bp, Mus musculus
tagacggagaagtgcatgtcggctt

SEQ ID NO: 749228 - DNA, 25 bp, Mus musculus
tagacggagccaagaggaagttcct

SEQ ID NO: 749229 - DNA, 25 bp, Mus musculus
tagacggagccatgaggaagttcct

SEQ ID NO: 749230 - DNA, 25 bp, Mus musculus
tagacggcaccacgttccagagcat

SEQ ID NO: 749231 - DNA, 25 bp, Mus musculus
tagacggcaccaggttccagagcat

SEQ ID NO: 749232 - DNA, 25 bp, Mus musculus
tagacggccgtgagtagatatctct

SEQ ID NO: 749233 - DNA, 25 bp, Mus musculus
tagacggccgtgtgtagatatctct

SEQ ID NO: 749234 - DNA, 25 bp, Mus musculus
tagacggctgcaacaagatgacttg

SEQ ID NO: 749235 - DNA, 25 bp, Mus musculus
tagacggctgcatcaagatgacttg

SEQ ID NO: 749236 - DNA, 25 bp, Mus musculus
tagacgggagaaagatcttaaggcc

SEQ ID NO: 749237 - DNA, 25 bp, Mus musculus
tagacgggagaatgatcttaaggcc

SEQ ID NO: 749238 - DNA, 25 bp, Mus musculus
tagacggtgtcaatacacggagttc

SEQ ID NO: 749239 - DNA, 25 bp, Mus musculus
tagacggtgtcattacacggagttc

SEQ ID NO: 749240 - DNA, 25 bp, Mus musculus
tagacggtgtccactacctgcactc

SEQ ID NO: 749241 - DNA, 25 bp, Mus musculus
tagacggtgtcctctacctgcactc

SEQ ID NO: 749242 - DNA, 25 bp, Mus musculus
tagacgtcccgccatggcactgtcg

SEQ ID NO: 749243 - DNA, 25 bp, Mus musculus
tagacgtcccgcgatggcactgtcg

SEQ ID NO: 749244 - DNA, 25 bp, Mus musculus
tagacgtcctctcgtgacggaggac

SEQ ID NO: 749245 - DNA, 25 bp, Mus musculus
tagacgtcctctggtgacggaggac

SEQ ID NO: 749246 - DNA, 25 bp, Mus musculus
tagacgtcgccaagaaagtgaagaa

SEQ ID NO: 749247 - DNA, 25 bp, Mus musculus
tagacgtcgccatgaaagtgaagaa

SEQ ID NO: 749248 - DNA, 25 bp, Mus musculus
tagacgttccctagcagtattgccg

SEQ ID NO: 749249 - DNA, 25 bp, Mus musculus
tagacgttcccttgcagtattgccg

SEQ ID NO: 749250 - DNA, 25 bp, Mus musculus
tagactaattgcatgccatcatgag

SEQ ID NO: 749251 - DNA, 25 bp, Mus musculus
tagactaattgcttgccatcatgag

SEQ ID NO: 749252 - DNA, 25 bp, Mus musculus
tagactacagtgacaacggcacttt

SEQ ID NO: 749253 - DNA, 25 bp, Mus musculus
tagactacagtgtcaacggcacttt

SEQ ID NO: 749254 - DNA, 25 bp, Mus musculus
tagactactgccagtttctcatgga

SEQ ID NO: 749255 - DNA, 25 bp, Mus musculus
tagactactgcctgtttctcatgga

SEQ ID NO: 749256 - DNA, 25 bp, Mus musculus
tagactagaattagtgagtccggag

SEQ ID NO: 749257 - DNA, 25 bp, Mus musculus
tagactagaatttgtgagtccggag

SEQ ID NO: 749258 - DNA, 25 bp, Mus musculus
tagactagcctaagattagcctatg

SEQ ID NO: 749259 - DNA, 25 bp, Mus musculus
tagactagcctatgattagcctatg

SEQ ID NO: 749260 - DNA, 25 bp, Mus musculus
tagactaggctactctagaagttga

SEQ ID NO: 749261 - DNA, 25 bp, Mus musculus
tagactaggctagtctagaagttga

SEQ ID NO: 749262 - DNA, 25 bp, Mus musculus
tagactatgagaccacccgggagtt

SEQ ID NO: 749263 - DNA, 25 bp, Mus musculus
tagactatgagagcacccgggagtt

SEQ ID NO: 749264 - DNA, 25 bp, Mus musculus
tagactatgtctacaacctgtgcga

SEQ ID NO: 749265 - DNA, 25 bp, Mus musculus
tagactatgtcttcaacctgtgcga

SEQ ID NO: 749266 - DNA, 25 bp, Mus musculus
tagactattgccaccgcaagctgat

SEQ ID NO: 749267 - DNA, 25 bp, Mus musculus
tagactattgcctccgcaagctgat

SEQ ID NO: 749268 - DNA, 25 bp, Mus musculus
tagactatttgtaacagcagaaagc

SEQ ID NO: 749269 - DNA, 25 bp, Mus musculus
tagactatttgttacagcagaaagc

SEQ ID NO: 749270 - DNA, 25 bp, Mus musculus
tagactattttacgtcagtcagagc

SEQ ID NO: 749271 - DNA, 25 bp, Mus musculus
tagactattttaggtcagtcagagc

SEQ ID NO: 749272 - DNA, 25 bp, Mus musculus
tagactcagttgagttgacaacctt

SEQ ID NO: 749273 - DNA, 25 bp, Mus musculus
tagactcagttgtgttgacaacctt

SEQ ID NO: 749274 - DNA, 25 bp, Mus musculus
tagactccaactattaactgtgtgt

SEQ ID NO: 749275 - DNA, 25 bp, Mus musculus
tagactccaacttttaactgtgtgt

SEQ ID NO: 749276 - DNA, 25 bp, Mus musculus
tagactcctacaaggaatcggctgg

SEQ ID NO: 749277 - DNA, 25 bp, Mus musculus
tagactcctacatggaatcggctgg

SEQ ID NO: 749278 - DNA, 25 bp, Mus musculus
tagactcctcatagggagcatgggc

SEQ ID NO: 749279 - DNA, 25 bp, Mus musculus
tagactcctcattgggagcatgggc

SEQ ID NO: 749280 - DNA, 25 bp, Mus musculus
tagactcctctcatttccttgtatg

SEQ ID NO: 749281 - DNA, 25 bp, Mus musculus
tagactcctctcttttccttgtatg

SEQ ID NO: 749282 - DNA, 25 bp, Mus musculus
tagactccttggagggaaaacaaga

SEQ ID NO: 749283 - DNA, 25 bp, Mus musculus
tagactccttggtgggaaaacaaga

SEQ ID NO: 749284 - DNA, 25 bp, Mus musculus
tagactcgaccaaccaaagtctagt

SEQ ID NO: 749285 - DNA, 25 bp, Mus musculus
tagactcgaccatccaaagtctagt

SEQ ID NO: 749286 - DNA, 25 bp, Mus musculus
tagactcggtgaactggatctgctc

SEQ ID NO: 749287 - DNA, 25 bp, Mus musculus
tagactcggtgatctggatctgctc

SEQ ID NO: 749288 - DNA, 25 bp, Mus musculus
tagactctgactatgacattgatga

SEQ ID NO: 749289 - DNA, 25 bp, Mus musculus
tagactctgactttgacattgatga

SEQ ID NO: 749290 - DNA, 25 bp, Mus musculus
tagactctgccccagcaaccaaagg

SEQ ID NO: 749291 - DNA, 25 bp, Mus musculus
tagactctgcccgagcaaccaaagg

SEQ ID NO: 749292 - DNA, 25 bp, Mus musculus
tagactcttggaactgagagataag

SEQ ID NO: 749293 - DNA, 25 bp, Mus musculus
tagactcttggatctgagagataag

SEQ ID NO: 749294 - DNA, 25 bp, Mus musculus
tagactgacccacctggaaaggctg

SEQ ID NO: 749295 - DNA, 25 bp, Mus musculus
tagactgacccagctggaaaggctg

SEQ ID NO: 749296 - DNA, 25 bp, Mus musculus
tagactgatgtccattatggattcg

SEQ ID NO: 749297 - DNA, 25 bp, Mus musculus
tagactgatgtcgattatggattcg

SEQ ID NO: 749298 - DNA, 25 bp, Mus musculus
tagactgcacgcctgacatctgggc

SEQ ID NO: 749299 - DNA, 25 bp, Mus musculus
tagactgcacgcgtgacatctgggc

SEQ ID NO: 749300 - DNA, 25 bp, Mus musculus
tagactgccatacctgtgtgaaggc

SEQ ID NO: 749301 - DNA, 25 bp, Mus musculus
tagactgccatagctgtgtgaaggc

SEQ ID NO: 749302 - DNA, 25 bp, Mus musculus
tagactgccctccatcctgagatgg

SEQ ID NO: 749303 - DNA, 25 bp, Mus musculus
tagactgccctcgatcctgagatgg

SEQ ID NO: 749304 - DNA, 25 bp, Mus musculus
tagactgctcatatggagaggacaa

SEQ ID NO: 749305 - DNA, 25 bp, Mus musculus
tagactgctcatttggagaggacaa

SEQ ID NO: 749306 - DNA, 25 bp, Mus musculus
tagactgctctccaggcataggctc

SEQ ID NO: 749307 - DNA, 25 bp, Mus musculus
tagactgctctcgaggcataggctc

SEQ ID NO: 749308 - DNA, 25 bp, Mus musculus
tagactggtggtatgcgcacccgat

SEQ ID NO: 749309 - DNA, 25 bp, Mus musculus
tagactggtggtttgcgcacccgat

SEQ ID NO: 749310 - DNA, 25 bp, Mus musculus
tagactggttccaccaagatttgga

SEQ ID NO: 749311 - DNA, 25 bp, Mus musculus
tagactggttcctccaagatttgga

SEQ ID NO: 749312 - DNA, 25 bp, Mus musculus
tagactggttttcgctaggccttgc

SEQ ID NO: 749313 - DNA, 25 bp, Mus musculus
tagactggttttggctaggccttgc

SEQ ID NO: 749314 - DNA, 25 bp, Mus musculus
tagactgtccagcatgctcaccaga

SEQ ID NO: 749315 - DNA, 25 bp, Mus musculus
tagactgtccaggatgctcaccaga

SEQ ID NO: 749316 - DNA, 25 bp, Mus musculus
tagactgtgtagaagccctcttggc

SEQ ID NO: 749317 - DNA, 25 bp, Mus musculus
tagactgtgtagtagccctcttggc

SEQ ID NO: 749318 - DNA, 25 bp, Mus musculus
tagacttatgctcgagacacatgcc

SEQ ID NO: 749319 - DNA, 25 bp, Mus musculus
tagacttatgctggagacacatgcc

SEQ ID NO: 749320 - DNA, 25 bp, Mus musculus
tagacttatggaccaagggactcgc

SEQ ID NO: 749321 - DNA, 25 bp, Mus musculus
tagacttatggagcaagggactcgc

SEQ ID NO: 749322 - DNA, 25 bp, Mus musculus
tagacttcggcaccacttcagccaa

SEQ ID NO: 749323 - DNA, 25 bp, Mus musculus
tagacttcggcagcacttcagccaa

SEQ ID NO: 749324 - DNA, 25 bp, Mus musculus
tagacttcgtaaagatcaacttaaa

SEQ ID NO: 749325 - DNA, 25 bp, Mus musculus
tagacttcgtaatgatcaacttaaa

SEQ ID NO: 749326 - DNA, 25 bp, Mus musculus
tagacttctctcaagtgacctccac

SEQ ID NO: 749327 - DNA, 25 bp, Mus musculus
tagacttctctctagtgacctccac

SEQ ID NO: 749328 - DNA, 25 bp, Mus musculus
tagacttctggaccatcatgggcaa

SEQ ID NO: 749329 - DNA, 25 bp, Mus musculus
tagacttctggagcatcatgggcaa

SEQ ID NO: 749330 - DNA, 25 bp, Mus musculus
tagacttgatgtcctacctccggca

SEQ ID NO: 749331 - DNA, 25 bp, Mus musculus
tagacttgatgtgctacctccggca

SEQ ID NO: 749332 - DNA, 25 bp, Mus musculus
tagactttctagacgatgtgcggcg

SEQ ID NO: 749333 - DNA, 25 bp, Mus musculus
tagactttctagtcgatgtgcggcg

SEQ ID NO: 749334 - DNA, 25 bp, Mus musculus
tagacttttataccctagactgcta

SEQ ID NO: 749335 - DNA, 25 bp, Mus musculus
tagacttttatagcctagactgcta

SEQ ID NO: 749336 - DNA, 25 bp, Mus musculus
tagacttttccaatagccctgaagc

SEQ ID NO: 749337 - DNA, 25 bp, Mus musculus
tagacttttccattagccctgaagc

SEQ ID NO: 749338 - DNA, 25 bp, Mus musculus
tagacttttcctctgggacctgaac

SEQ ID NO: 749339 - DNA, 25 bp, Mus musculus
tagacttttcctgtgggacctgaac

SEQ ID NO: 749340 - DNA, 25 bp, Mus musculus
tagagaaaaatgctcaaaagaggtc

SEQ ID NO: 749341 - DNA, 25 bp, Mus musculus
tagagaaaaatggtcaaaagaggtc

SEQ ID NO: 749342 - DNA, 25 bp, Mus musculus
tagagaaaaccacttgaaaatgttg

SEQ ID NO: 749343 - DNA, 25 bp, Mus musculus
tagagaaaaccagttgaaaatgttg

SEQ ID NO: 749344 - DNA, 25 bp, Mus musculus
tagagaaaacgaatcccacagagcc

SEQ ID NO: 749345 - DNA, 25 bp, Mus musculus
tagagaaaacgattcccacagagcc

SEQ ID NO: 749346 - DNA, 25 bp, Mus musculus
tagagaaaactgaaagccgcagtta

SEQ ID NO: 749347 - DNA, 25 bp, Mus musculus
tagagaaaactgtaagccgcagtta

SEQ ID NO: 749348 - DNA, 25 bp, Mus musculus
tagagaaaagagatccgggccgcgt

SEQ ID NO: 749349 - DNA, 25 bp, Mus musculus
tagagaaaagagttccgggccgcgt

SEQ ID NO: 749350 - DNA, 25 bp, Mus musculus
tagagaaaatgtcatctagagagag

SEQ ID NO: 749351 - DNA, 25 bp, Mus musculus
tagagaaaatgtgatctagagagag

SEQ ID NO: 749352 - DNA, 25 bp, Mus musculus
tagagaaactctaccaggagcccag

SEQ ID NO: 749353 - DNA, 25 bp, Mus musculus
tagagaaactcttccaggagcccag

SEQ ID NO: 749354 - DNA, 25 bp, Mus musculus
tagagaaagatcagtaaatcgctcg

SEQ ID NO: 749355 - DNA, 25 bp, Mus musculus
tagagaaagatctgtaaatcgctcg

SEQ ID NO: 749356 - DNA, 25 bp, Mus musculus
tagagaaagtcaaccggctgtacaa

SEQ ID NO: 749357 - DNA, 25 bp, Mus musculus
tagagaaagtcatccggctgtacaa

SEQ ID NO: 749358 - DNA, 25 bp, Mus musculus
tagagaaatctcctgttgttaagca

SEQ ID NO: 749359 - DNA, 25 bp, Mus musculus
tagagaaatctcgtgttgttaagca

SEQ ID NO: 749360 - DNA, 25 bp, Mus musculus
tagagaacatgaccggcttcacctg

SEQ ID NO: 749361 - DNA, 25 bp, Mus musculus
tagagaacatgagcggcttcacctg

SEQ ID NO: 749362 - DNA, 25 bp, Mus musculus
tagagaactgaacgatgaggtgacc

SEQ ID NO: 749363 - DNA, 25 bp, Mus musculus
tagagaactgaaggatgaggtgacc

SEQ ID NO: 749364 - DNA, 25 bp, Mus musculus
tagagaacttgacgttggcgaatcc

SEQ ID NO: 749365 - DNA, 25 bp, Mus musculus
tagagaacttgaggttggcgaatcc

SEQ ID NO: 749366 - DNA, 25 bp, Mus musculus
tagagaacttttcgaactgcttggg

SEQ ID NO: 749367 - DNA, 25 bp, Mus musculus
tagagaacttttggaactgcttggg

SEQ ID NO: 749368 - DNA, 25 bp, Mus musculus
tagagaagaagccacgcatagcacc

SEQ ID NO: 749369 - DNA, 25 bp, Mus musculus
tagagaagaagcgacgcatagcacc

SEQ ID NO: 749370 - DNA, 25 bp, Mus musculus
tagagaagagagagctgaatcagga

SEQ ID NO: 749371 - DNA, 25 bp, Mus musculus
tagagaagagagtgctgaatcagga

SEQ ID NO: 749372 - DNA, 25 bp, Mus musculus
tagagaagagcgatcatggttccga

SEQ ID NO: 749373 - DNA, 25 bp, Mus musculus
tagagaagagcgttcatggttccga

SEQ ID NO: 749374 - DNA, 25 bp, Mus musculus
tagagaagcagaagaatatgagtcc

SEQ ID NO: 749375 - DNA, 25 bp, Mus musculus
tagagaagcagatgaatatgagtcc

SEQ ID NO: 749376 - DNA, 25 bp, Mus musculus
tagagaagcttgagaacaactggcc

SEQ ID NO: 749377 - DNA, 25 bp, Mus musculus
tagagaagcttgtgaacaactggcc

SEQ ID NO: 749378 - DNA, 25 bp, Mus musculus
tagagaaggagtcagccctgagtcc

SEQ ID NO: 749379 - DNA, 25 bp, Mus musculus
tagagaaggagtgagccctgagtcc

SEQ ID NO: 749380 - DNA, 25 bp, Mus musculus
tagagaaggcatcctcaggactgtt

SEQ ID NO: 749381 - DNA, 25 bp, Mus musculus
tagagaaggcatgctcaggactgtt

SEQ ID NO: 749382 - DNA, 25 bp, Mus musculus
tagagaaggccaagaaggaatatga

SEQ ID NO: 749383 - DNA, 25 bp, Mus musculus
tagagaaggccaagtgcaccatcct

SEQ ID NO: 749384 - DNA, 25 bp, Mus musculus
tagagaaggccatgaaggaatatga

SEQ ID NO: 749385 - DNA, 25 bp, Mus musculus
tagagaaggccatgtgcaccatcct

SEQ ID NO: 749386 - DNA, 25 bp, Mus musculus
tagagaaggcgtctgtctgctgccc

SEQ ID NO: 749387 - DNA, 25 bp, Mus musculus
tagagaaggcgtgtgtctgctgccc

SEQ ID NO: 749388 - DNA, 25 bp, Mus musculus
tagagaaggtgtagccggtctacgc

SEQ ID NO: 749389 - DNA, 25 bp, Mus musculus
tagagaaggtgttgccggtctacgc

SEQ ID NO: 749390 - DNA, 25 bp, Mus musculus
tagagaagttctccacctggaccaa

SEQ ID NO: 749391 - DNA, 25 bp, Mus musculus
tagagaagttctgcacctggaccaa

SEQ ID NO: 749392 - DNA, 25 bp, Mus musculus
tagagaatataaagtgttcttttcc

SEQ ID NO: 749393 - DNA, 25 bp, Mus musculus
tagagaatataatgtgttcttttcc

SEQ ID NO: 749394 - DNA, 25 bp, Mus musculus
tagagaatgagaagcgtagtcttgg

SEQ ID NO: 749395 - DNA, 25 bp, Mus musculus
tagagaatgagatgcgtagtcttgg

SEQ ID NO: 749396 - DNA, 25 bp, Mus musculus
tagagaatgcaacgcctgcctgaac

SEQ ID NO: 749397 - DNA, 25 bp, Mus musculus
tagagaatgcaaggcctgcctgaac

SEQ ID NO: 749398 - DNA, 25 bp, Mus musculus
tagagaatgcccagtagatttagtc

SEQ ID NO: 749399 - DNA, 25 bp, Mus musculus
tagagaatgccctgtagatttagtc

SEQ ID NO: 749400 - DNA, 25 bp, Mus musculus
tagagaatgcgcctctggccaagag

SEQ ID NO: 749401 - DNA, 25 bp, Mus musculus
tagagaatgcgcgtctggccaagag

SEQ ID NO: 749402 - DNA, 25 bp, Mus musculus
tagagaatgctactcctgatggact

SEQ ID NO: 749403 - DNA, 25 bp, Mus musculus
tagagaatgctagtcctgatggact

SEQ ID NO: 749404 - DNA, 25 bp, Mus musculus
tagagaatgttacatgttaccaaca

SEQ ID NO: 749405 - DNA, 25 bp, Mus musculus
tagagaatgttagatgttaccaaca

SEQ ID NO: 749406 - DNA, 25 bp, Mus musculus
tagagaattcatagggtcccttccc

SEQ ID NO: 749407 - DNA, 25 bp, Mus musculus
tagagaattcattgggtcccttccc

SEQ ID NO: 749408 - DNA, 25 bp, Mus musculus
tagagacaaagtactttgacgatga

SEQ ID NO: 749409 - DNA, 25 bp, Mus musculus
tagagacaaagttctttgacgatga

SEQ ID NO: 749410 - DNA, 25 bp, Mus musculus
tagagacaatccagggcttgcctgg

SEQ ID NO: 749411 - DNA, 25 bp, Mus musculus
tagagacaatcctgggcttgcctgg

SEQ ID NO: 749412 - DNA, 25 bp, Mus musculus
tagagacagccgattagcaaagcct

SEQ ID NO: 749413 - DNA, 25 bp, Mus musculus
tagagacagccgtttagcaaagcct

SEQ ID NO: 749414 - DNA, 25 bp, Mus musculus
tagagaccacaccaaaggagatagt

SEQ ID NO: 749415 - DNA, 25 bp, Mus musculus
tagagaccacacgaaaggagatagt

SEQ ID NO: 749416 - DNA, 25 bp, Mus musculus
tagagaccagaaaaaacatttgagt

SEQ ID NO: 749417 - DNA, 25 bp, Mus musculus
tagagaccagaataaacatttgagt

SEQ ID NO: 749418 - DNA, 25 bp, Mus musculus
tagagaccatggactatgtaaactg

SEQ ID NO: 749419 - DNA, 25 bp, Mus musculus
tagagaccatggtctatgtaaactg

SEQ ID NO: 749420 - DNA, 25 bp, Mus musculus
tagagacccaatccaagtgaagaca

SEQ ID NO: 749421 - DNA, 25 bp, Mus musculus
tagagacccaatgcaagtgaagaca

SEQ ID NO: 749422 - DNA, 25 bp, Mus musculus
tagagaccgtgtcgttttgttcgcc

SEQ ID NO: 749423 - DNA, 25 bp, Mus musculus
tagagaccgtgtggttttgttcgcc

SEQ ID NO: 749424 - DNA, 25 bp, Mus musculus
tagagacctactacttgcctgatgg

SEQ ID NO: 749425 - DNA, 25 bp, Mus musculus
tagagacctacttcttgcctgatgg

SEQ ID NO: 749426 - DNA, 25 bp, Mus musculus
tagagacctggcacccaggcttggc

SEQ ID NO: 749427 - DNA, 25 bp, Mus musculus
tagagacctggctcccaggcttggc

SEQ ID NO: 749428 - DNA, 25 bp, Mus musculus
tagagacgctgcagcgccggatcga

SEQ ID NO: 749429 - DNA, 25 bp, Mus musculus
tagagacgctgctgcgccggatcga

SEQ ID NO: 749430 - DNA, 25 bp, Mus musculus
tagagacgctgtagtcactgctgcc

SEQ ID NO: 749431 - DNA, 25 bp, Mus musculus
tagagacgctgttgtcactgctgcc

SEQ ID NO: 749432 - DNA, 25 bp, Mus musculus
tagagacggaaaatgcatcgctagc

SEQ ID NO: 749433 - DNA, 25 bp, Mus musculus
tagagacggaaattgcatcgctagc

SEQ ID NO: 749434 - DNA, 25 bp, Mus musculus
tagagacggcagaggttcgttttga

SEQ ID NO: 749435 - DNA, 25 bp, Mus musculus
tagagacggcagtggttcgttttga

SEQ ID NO: 749436 - DNA, 25 bp, Mus musculus
tagagacgtacgaccacagttcggg

SEQ ID NO: 749437 - DNA, 25 bp, Mus musculus
tagagacgtacgtccacagttcggg

SEQ ID NO: 749438 - DNA, 25 bp, Mus musculus
tagagacttccaaagtagcacaacg

SEQ ID NO: 749439 - DNA, 25 bp, Mus musculus
tagagacttccatagtagcacaacg

SEQ ID NO: 749440 - DNA, 25 bp, Mus musculus
tagagacttcttcccatggctgccg

SEQ ID NO: 749441 - DNA, 25 bp, Mus musculus
tagagacttcttgccatggctgccg

SEQ ID NO: 749442 - DNA, 25 bp, Mus musculus
tagagacttgacatcgacagccaca

SEQ ID NO: 749443 - DNA, 25 bp, Mus musculus
tagagacttgacttcgacagccaca

SEQ ID NO: 749444 - DNA, 25 bp, Mus musculus
tagagagaaccactgacaaaggaca

SEQ ID NO: 749445 - DNA, 25 bp, Mus musculus
tagagagaaccagtgacaaaggaca

SEQ ID NO: 749446 - DNA, 25 bp, Mus musculus
tagagagaacgcacatgaaggaatg

SEQ ID NO: 749447 - DNA, 25 bp, Mus musculus
tagagagaacgctcatgaaggaatg

SEQ ID NO: 749448 - DNA, 25 bp, Mus musculus
tagagagaatccaagcagatcttga

SEQ ID NO: 749449 - DNA, 25 bp, Mus musculus
tagagagaatcctagcagatcttga

SEQ ID NO: 749450 - DNA, 25 bp, Mus musculus
tagagagactgactgagctggccct

SEQ ID NO: 749451 - DNA, 25 bp, Mus musculus
tagagagactgagtgagctggccct

SEQ ID NO: 749452 - DNA, 25 bp, Mus musculus
tagagagatctcctgctgccaagtg

SEQ ID NO: 749453 - DNA, 25 bp, Mus musculus
tagagagatctcgtgctgccaagtg

SEQ ID NO: 749454 - DNA, 25 bp, Mus musculus
tagagagcatgaagtccaggacata

SEQ ID NO: 749455 - DNA, 25 bp, Mus musculus
tagagagcatgatgtccaggacata

SEQ ID NO: 749456 - DNA, 25 bp, Mus musculus
tagagagcatggataaggctggcaa

SEQ ID NO: 749457 - DNA, 25 bp, Mus musculus
tagagagcatggttaaggctggcaa

SEQ ID NO: 749458 - DNA, 25 bp, Mus musculus
tagagagcctcaagtaccaactggc

SEQ ID NO: 749459 - DNA, 25 bp, Mus musculus
tagagagcctcatgtaccaactggc

SEQ ID NO: 749460 - DNA, 25 bp, Mus musculus
tagagagctaagaattgctgaaatc

SEQ ID NO: 749461 - DNA, 25 bp, Mus musculus
tagagagctaagtattgctgaaatc

SEQ ID NO: 749462 - DNA, 25 bp, Mus musculus
tagagagctacgcaatctgaccggg

SEQ ID NO: 749463 - DNA, 25 bp, Mus musculus
tagagagctacggaatctgaccggg

SEQ ID NO: 749464 - DNA, 25 bp, Mus musculus
tagagagctcgccagaagactgaaa

SEQ ID NO: 749465 - DNA, 25 bp, Mus musculus
tagagagctcgcgagaagactgaaa

SEQ ID NO: 749466 - DNA, 25 bp, Mus musculus
tagagagcttgtcacaaccttgggt

SEQ ID NO: 749467 - DNA, 25 bp, Mus musculus
tagagagcttgtgacaaccttgggt

SEQ ID NO: 749468 - DNA, 25 bp, Mus musculus
tagagaggatcaccatccagccggc

SEQ ID NO: 749469 - DNA, 25 bp, Mus musculus
tagagaggatcagcatccagccggc

SEQ ID NO: 749470 - DNA, 25 bp, Mus musculus
tagagaggcggtatggaccctctac

SEQ ID NO: 749471 - DNA, 25 bp, Mus musculus
tagagaggcggtttggaccctctac

SEQ ID NO: 749472 - DNA, 25 bp, Mus musculus
tagagaggctagctcaaagtcaccc

SEQ ID NO: 749473 - DNA, 25 bp, Mus musculus
tagagaggctaggtcaaagtcaccc

SEQ ID NO: 749474 - DNA, 25 bp, Mus musculus
tagagagtctcaaccagcgagtatc

SEQ ID NO: 749475 - DNA, 25 bp, Mus musculus
tagagagtctcatccagcgagtatc

SEQ ID NO: 749476 - DNA, 25 bp, Mus musculus
tagagagtctgaccggtctgcacaa

SEQ ID NO: 749477 - DNA, 25 bp, Mus musculus
tagagagtctgagcggtctgcacaa

SEQ ID NO: 749478 - DNA, 25 bp, Mus musculus
tagagagtggagcacaagaagttcc

SEQ ID NO: 749479 - DNA, 25 bp, Mus musculus
tagagagtggaggacaagaagttcc

SEQ ID NO: 749480 - DNA, 25 bp, Mus musculus
tagagataagaaaggtgacaagggt

SEQ ID NO: 749481 - DNA, 25 bp, Mus musculus
tagagataagaatggtgacaagggt

SEQ ID NO: 749482 - DNA, 25 bp, Mus musculus
tagagatacgatctgtggaaactgg

SEQ ID NO: 749483 - DNA, 25 bp, Mus musculus
tagagatacgatgtgtggaaactgg

SEQ ID NO: 749484 - DNA, 25 bp, Mus musculus
tagagatatggccaggcaagaagct

SEQ ID NO: 749485 - DNA, 25 bp, Mus musculus
tagagatatggcgaggcaagaagct

SEQ ID NO: 749486 - DNA, 25 bp, Mus musculus
tagagatcaattcccaggacccctc

SEQ ID NO: 749487 - DNA, 25 bp, Mus musculus
tagagatcaattgccaggacccctc

SEQ ID NO: 749488 - DNA, 25 bp, Mus musculus
tagagatcatcaatgcacgggagac

SEQ ID NO: 749489 - DNA, 25 bp, Mus musculus
tagagatcatcattgcacgggagac

SEQ ID NO: 749490 - DNA, 25 bp, Mus musculus
tagagatcatccattgcgtttgggc

SEQ ID NO: 749491 - DNA, 25 bp, Mus musculus
tagagatcatcctttgcgtttgggc

SEQ ID NO: 749492 - DNA, 25 bp, Mus musculus
tagagatcggagcaagatgaagatc

SEQ ID NO: 749493 - DNA, 25 bp, Mus musculus
tagagatcggaggaagatgaagatc

SEQ ID NO: 749494 - DNA, 25 bp, Mus musculus
tagagatctgggatatgcatgacgt

SEQ ID NO: 749495 - DNA, 25 bp, Mus musculus
tagagatctgggttatgcatgacgt

SEQ ID NO: 749496 - DNA, 25 bp, Mus musculus
tagagatgaacaagggaggacctca

SEQ ID NO: 749497 - DNA, 25 bp, Mus musculus
tagagatgaacatgggaggacctca

SEQ ID NO: 749498 - DNA, 25 bp, Mus musculus
tagagatgaagccattgcagcctgc

SEQ ID NO: 749499 - DNA, 25 bp, Mus musculus
tagagatgaagcgattgcagcctgc

SEQ ID NO: 749500 - DNA, 25 bp, Mus musculus
tagagatgagtcacttcccaaagtg

SEQ ID NO: 749501 - DNA, 25 bp, Mus musculus
tagagatgagtctcttcccaaagtg

SEQ ID NO: 749502 - DNA, 25 bp, Mus musculus
tagagatgccccaagtaggcaaggc

SEQ ID NO: 749503 - DNA, 25 bp, Mus musculus
tagagatgcccctagtaggcaaggc

SEQ ID NO: 749504 - DNA, 25 bp, Mus musculus
tagagatgctttccccgtggctgga

SEQ ID NO: 749505 - DNA, 25 bp, Mus musculus
tagagatgctttgcccgtggctgga

SEQ ID NO: 749506 - DNA, 25 bp, Mus musculus
tagagatgtcaacacttctcaaaca

SEQ ID NO: 749507 - DNA, 25 bp, Mus musculus
tagagatgtcaagacttctcaaaca

SEQ ID NO: 749508 - DNA, 25 bp, Mus musculus
tagagatgtcacctttggagatgga

SEQ ID NO: 749509 - DNA, 25 bp, Mus musculus
tagagatgtcacgtttggagatgga

SEQ ID NO: 749510 - DNA, 25 bp, Mus musculus
tagagatgtgtaatgccctcaacag

SEQ ID NO: 749511 - DNA, 25 bp, Mus musculus
tagagatgtgtattgccctcaacag

SEQ ID NO: 749512 - DNA, 25 bp, Mus musculus
tagagattctgcctaatggactaac

SEQ ID NO: 749513 - DNA, 25 bp, Mus musculus
tagagattctgcgtaatggactaac

SEQ ID NO: 749514 - DNA, 25 bp, Mus musculus
tagagattggagaggtctcccctgg

SEQ ID NO: 749515 - DNA, 25 bp, Mus musculus
tagagattggagtggtctcccctgg

SEQ ID NO: 749516 - DNA, 25 bp, Mus musculus
tagagcaaatgcaggaaagaaaatc

SEQ ID NO: 749517 - DNA, 25 bp, Mus musculus
tagagcaaatgctggaaagaaaatc

SEQ ID NO: 749518 - DNA, 25 bp, Mus musculus
tagagcaactaacgaacacggtggc

SEQ ID NO: 749519 - DNA, 25 bp, Mus musculus
tagagcaactaaggaacacggtggc

SEQ ID NO: 749520 - DNA, 25 bp, Mus musculus
tagagcaagggaaggctaagaaccc

SEQ ID NO: 749521 - DNA, 25 bp, Mus musculus
tagagcaagggatggctaagaaccc

SEQ ID NO: 749522 - DNA, 25 bp, Mus musculus
tagagcaatgatagacataatactg

SEQ ID NO: 749523 - DNA, 25 bp, Mus musculus
tagagcaatgattgacataatactg

SEQ ID NO: 749524 - DNA, 25 bp, Mus musculus
tagagcacaaggagattgacggccg

SEQ ID NO: 749525 - DNA, 25 bp, Mus musculus
tagagcacaaggtgattgacggccg

SEQ ID NO: 749526 - DNA, 25 bp, Mus musculus
tagagcactgtcaccctgaccagac

SEQ ID NO: 749527 - DNA, 25 bp, Mus musculus
tagagcactgtctccctgaccagac

SEQ ID NO: 749528 - DNA, 25 bp, Mus musculus
tagagcagacccacagagttcaggc

SEQ ID NO: 749529 - DNA, 25 bp, Mus musculus
tagagcagaccctcagagttcaggc

SEQ ID NO: 749530 - DNA, 25 bp, Mus musculus
tagagcagatgaatgaggatgacag

SEQ ID NO: 749531 - DNA, 25 bp, Mus musculus
tagagcagatgattgaggatgacag

SEQ ID NO: 749532 - DNA, 25 bp, Mus musculus
tagagcagcttaaaaggcaagggct

SEQ ID NO: 749533 - DNA, 25 bp, Mus musculus
tagagcagcttataaggcaagggct

SEQ ID NO: 749534 - DNA, 25 bp, Mus musculus
tagagcagtttgatcaggtgtcaga

SEQ ID NO: 749535 - DNA, 25 bp, Mus musculus
tagagcagtttgttcaggtgtcaga

SEQ ID NO: 749536 - DNA, 25 bp, Mus musculus
tagagcatgctgacagtatcaccgg

SEQ ID NO: 749537 - DNA, 25 bp, Mus musculus
tagagcatgctgtcagtatcaccgg

SEQ ID NO: 749538 - DNA, 25 bp, Mus musculus
tagagccaccagattgtgttgtgga

SEQ ID NO: 749539 - DNA, 25 bp, Mus musculus
tagagccaccagtttgtgttgtgga

SEQ ID NO: 749540 - DNA, 25 bp, Mus musculus
tagagccaccatactagcagtgacc

SEQ ID NO: 749541 - DNA, 25 bp, Mus musculus
tagagccaccattctagcagtgacc

SEQ ID NO: 749542 - DNA, 25 bp, Mus musculus
tagagccacgctctctaaggctttg

SEQ ID NO: 749543 - DNA, 25 bp, Mus musculus
tagagccacgctgtctaaggctttg

SEQ ID NO: 749544 - DNA, 25 bp, Mus musculus
tagagccaggtgagcagagtcataa

SEQ ID NO: 749545 - DNA, 25 bp, Mus musculus
tagagccaggtgtgcagagtcataa

SEQ ID NO: 749546 - DNA, 25 bp, Mus musculus
tagagcccagcgagctgttgctggc

SEQ ID NO: 749547 - DNA, 25 bp, Mus musculus
tagagcccagcgtgctgttgctggc

SEQ ID NO: 749548 - DNA, 25 bp, Mus musculus
tagagcccatcaaacaatacaaata

SEQ ID NO: 749549 - DNA, 25 bp, Mus musculus
tagagcccatcatacaatacaaata

SEQ ID NO: 749550 - DNA, 25 bp, Mus musculus
tagagcccatgcaggaacttatgtc

SEQ ID NO: 749551 - DNA, 25 bp, Mus musculus
tagagcccatgctggaacttatgtc

SEQ ID NO: 749552 - DNA, 25 bp, Mus musculus
tagagcccctggagcatgagcagat

SEQ ID NO: 749553 - DNA, 25 bp, Mus musculus
tagagcccctggtgcatgagcagat

SEQ ID NO: 749554 - DNA, 25 bp, Mus musculus
tagagcccggccagcggaatcagcc

SEQ ID NO: 749555 - DNA, 25 bp, Mus musculus
tagagcccggcctgcggaatcagcc

SEQ ID NO: 749556 - DNA, 25 bp, Mus musculus
tagagccctctgagaagatgactag

SEQ ID NO: 749557 - DNA, 25 bp, Mus musculus
tagagccctctgtgaagatgactag

SEQ ID NO: 749558 - DNA, 25 bp, Mus musculus
tagagcccttgtaagccagactgag

SEQ ID NO: 749559 - DNA, 25 bp, Mus musculus
tagagcccttgttagccagactgag

SEQ ID NO: 749560 - DNA, 25 bp, Mus musculus
tagagccggcaacacatgggctcca

SEQ ID NO: 749561 - DNA, 25 bp, Mus musculus
tagagccggcaagacatgggctcca

SEQ ID NO: 749562 - DNA, 25 bp, Mus musculus
tagagcctcagccaactgtgcagac

SEQ ID NO: 749563 - DNA, 25 bp, Mus musculus
tagagcctcagcgaactgtgcagac

SEQ ID NO: 749564 - DNA, 25 bp, Mus musculus
tagagcctcattagcaggactcgtg

SEQ ID NO: 749565 - DNA, 25 bp, Mus musculus
tagagcctcatttgcaggactcgtg

SEQ ID NO: 749566 - DNA, 25 bp, Mus musculus
tagagcctgcctagcagcaatgtaa

SEQ ID NO: 749567 - DNA, 25 bp, Mus musculus
tagagcctgccttgcagcaatgtaa

SEQ ID NO: 749568 - DNA, 25 bp, Mus musculus
tagagcctgtatcctggtgaagccc

SEQ ID NO: 749569 - DNA, 25 bp, Mus musculus
tagagcctgtatgctggtgaagccc

SEQ ID NO: 749570 - DNA, 25 bp, Mus musculus
tagagccttgtacagtgatagaagc

SEQ ID NO: 749571 - DNA, 25 bp, Mus musculus
tagagccttgtagagtgatagaagc

SEQ ID NO: 749572 - DNA, 25 bp, Mus musculus
tagagccttttcaaattttacaggg

SEQ ID NO: 749573 - DNA, 25 bp, Mus musculus
tagagccttttctaattttacaggg

SEQ ID NO: 749574 - DNA, 25 bp, Mus musculus
tagagcgagtgtagccatggaaccg

SEQ ID NO: 749575 - DNA, 25 bp, Mus musculus
tagagcgagtgttgccatggaaccg

SEQ ID NO: 749576 - DNA, 25 bp, Mus musculus
tagagcgatgctcaacaacctggtg

SEQ ID NO: 749577 - DNA, 25 bp, Mus musculus
tagagcgatgctgaacaacctggtg

SEQ ID NO: 749578 - DNA, 25 bp, Mus musculus
tagagcgcaagaaggcagccattga

SEQ ID NO: 749579 - DNA, 25 bp, Mus musculus
tagagcgcaagatggcagccattga

SEQ ID NO: 749580 - DNA, 25 bp, Mus musculus
tagagcgcagctcaggcactagagc

SEQ ID NO: 749581 - DNA, 25 bp, Mus musculus
tagagcgcagctgaggcactagagc

SEQ ID NO: 749582 - DNA, 25 bp, Mus musculus
tagagcggatggaaggagtcaaact

SEQ ID NO: 749583 - DNA, 25 bp, Mus musculus
tagagcggatggtaggagtcaaact

SEQ ID NO: 749584 - DNA, 25 bp, Mus musculus
tagagcgggagacacccgatctttc

SEQ ID NO: 749585 - DNA, 25 bp, Mus musculus
tagagcgggagagacccgatctttc

SEQ ID NO: 749586 - DNA, 25 bp, Mus musculus
tagagctaaaaaagaccttggactt

SEQ ID NO: 749587 - DNA, 25 bp, Mus musculus
tagagctaaaaatgaccttggactt

SEQ ID NO: 749588 - DNA, 25 bp, Mus musculus
tagagctcagcacacacacagtgtc

SEQ ID NO: 749589 - DNA, 25 bp, Mus musculus
tagagctcagcagacacacagtgtc

SEQ ID NO: 749590 - DNA, 25 bp, Mus musculus
tagagctcaggcacgagaattacga

SEQ ID NO: 749591 - DNA, 25 bp, Mus musculus
tagagctcaggctcgagaattacga

SEQ ID NO: 749592 - DNA, 25 bp, Mus musculus
tagagctccgggaacaaattgacaa

SEQ ID NO: 749593 - DNA, 25 bp, Mus musculus
tagagctccgggtacaaattgacaa

SEQ ID NO: 749594 - DNA, 25 bp, Mus musculus
tagagctcgagcatctaatgaagac

SEQ ID NO: 749595 - DNA, 25 bp, Mus musculus
tagagctcgagcttctaatgaagac

SEQ ID NO: 749596 - DNA, 25 bp, Mus musculus
tagagctctactattctgggtgtgc

SEQ ID NO: 749597 - DNA, 25 bp, Mus musculus
tagagctctacttttctgggtgtgc

SEQ ID NO: 749598 - DNA, 25 bp, Mus musculus
tagagctctagaagccacctcttga

SEQ ID NO: 749599 - DNA, 25 bp, Mus musculus
tagagctctagatgccacctcttga

SEQ ID NO: 749600 - DNA, 25 bp, Mus musculus
tagagctctcctcaaacatctggaa

SEQ ID NO: 749601 - DNA, 25 bp, Mus musculus
tagagctctcctgaaacatctggaa

SEQ ID NO: 749602 - DNA, 25 bp, Mus musculus
tagagctcttacatggcacacatga

SEQ ID NO: 749603 - DNA, 25 bp, Mus musculus
tagagctcttacttggcacacatga

SEQ ID NO: 749604 - DNA, 25 bp, Mus musculus
tagagctgacctcgctgtccgatga

SEQ ID NO: 749605 - DNA, 25 bp, Mus musculus
tagagctgacctggctgtccgatga

SEQ ID NO: 749606 - DNA, 25 bp, Mus musculus
tagagctgagaacccttctggaaga

SEQ ID NO: 749607 - DNA, 25 bp, Mus musculus
tagagctgagaagccttctggaaga

SEQ ID NO: 749608 - DNA, 25 bp, Mus musculus
tagagctgagcacccatagatgagg

SEQ ID NO: 749609 - DNA, 25 bp, Mus musculus
tagagctgagcagccatagatgagg

SEQ ID NO: 749610 - DNA, 25 bp, Mus musculus
tagagctgagtgagcatggtgtcac

SEQ ID NO: 749611 - DNA, 25 bp, Mus musculus
tagagctgagtgtgcatggtgtcac

SEQ ID NO: 749612 - DNA, 25 bp, Mus musculus
tagagctgatgcagcgctgcgtgtc

SEQ ID NO: 749613 - DNA, 25 bp, Mus musculus
tagagctgatgctgcgctgcgtgtc

SEQ ID NO: 749614 - DNA, 25 bp, Mus musculus
tagagctgcgccaggcccgcttcga

SEQ ID NO: 749615 - DNA, 25 bp, Mus musculus
tagagctgcgcctggcccgcttcga

SEQ ID NO: 749616 - DNA, 25 bp, Mus musculus
tagagctggctcagtactaggagac

SEQ ID NO: 749617 - DNA, 25 bp, Mus musculus
tagagctggctctgtactaggagac

SEQ ID NO: 749618 - DNA, 25 bp, Mus musculus
tagagctgttgactgcatcctgaca

SEQ ID NO: 749619 - DNA, 25 bp, Mus musculus
tagagctgttgagtgcatcctgaca

SEQ ID NO: 749620 - DNA, 25 bp, Mus musculus
tagagcttccaactgctgcaggatg

SEQ ID NO: 749621 - DNA, 25 bp, Mus musculus
tagagcttccaagtgctgcaggatg

SEQ ID NO: 749622 - DNA, 25 bp, Mus musculus
tagagcttcgggagtctcaaacaat

SEQ ID NO: 749623 - DNA, 25 bp, Mus musculus
tagagcttcgggtgtctcaaacaat

SEQ ID NO: 749624 - DNA, 25 bp, Mus musculus
tagagcttgagaaggccatcgacac

SEQ ID NO: 749625 - DNA, 25 bp, Mus musculus
tagagcttgagatggccatcgacac

SEQ ID NO: 749626 - DNA, 25 bp, Mus musculus
tagagcttgcctaccaccaagagct

SEQ ID NO: 749627 - DNA, 25 bp, Mus musculus
tagagcttgccttccaccaagagct

SEQ ID NO: 749628 - DNA, 25 bp, Mus musculus
tagagcttgtgcagaattacaccaa

SEQ ID NO: 749629 - DNA, 25 bp, Mus musculus
tagagcttgtgctgaattacaccaa

SEQ ID NO: 749630 - DNA, 25 bp, Mus musculus
tagagctttctccaaagcacctagc

SEQ ID NO: 749631 - DNA, 25 bp, Mus musculus
tagagctttctcgaaagcacctagc

SEQ ID NO: 749632 - DNA, 25 bp, Mus musculus
tagaggaaaagcaaccctcgctctt

SEQ ID NO: 749633 - DNA, 25 bp, Mus musculus
tagaggaaaagctaccctcgctctt

SEQ ID NO: 749634 - DNA, 25 bp, Mus musculus
tagaggaaagatactcaatgtgcga

SEQ ID NO: 749635 - DNA, 25 bp, Mus musculus
tagaggaaagattctcaatgtgcga

SEQ ID NO: 749636 - DNA, 25 bp, Mus musculus
tagaggaaattaacgctgtacagcc

SEQ ID NO: 749637 - DNA, 25 bp, Mus musculus
tagaggaaattatcgctgtacagcc

SEQ ID NO: 749638 - DNA, 25 bp, Mus musculus
tagaggaactcgacatcctcgcgtc

SEQ ID NO: 749639 - DNA, 25 bp, Mus musculus
tagaggaactcgtcatcctcgcgtc

SEQ ID NO: 749640 - DNA, 25 bp, Mus musculus
tagaggaactgtccacctcagcaac

SEQ ID NO: 749641 - DNA, 25 bp, Mus musculus
tagaggaactgtgcacctcagcaac

SEQ ID NO: 749642 - DNA, 25 bp, Mus musculus
tagaggaagcatccgagatctatgc

SEQ ID NO: 749643 - DNA, 25 bp, Mus musculus
tagaggaagcatgcgagatctatgc

SEQ ID NO: 749644 - DNA, 25 bp, Mus musculus
tagaggaagtcacgaagcactggca

SEQ ID NO: 749645 - DNA, 25 bp, Mus musculus
tagaggaagtcaggaagcactggca

SEQ ID NO: 749646 - DNA, 25 bp, Mus musculus
tagaggaattgcaaaaggaggcaaa

SEQ ID NO: 749647 - DNA, 25 bp, Mus musculus
tagaggaattgctaaaggaggcaaa

SEQ ID NO: 749648 - DNA, 25 bp, Mus musculus
tagaggacatgcaaggcaccaagtg

SEQ ID NO: 749649 - DNA, 25 bp, Mus musculus
tagaggacatgctaggcaccaagtg

SEQ ID NO: 749650 - DNA, 25 bp, Mus musculus
tagaggaccctcagtatggaacata

SEQ ID NO: 749651 - DNA, 25 bp, Mus musculus
tagaggaccctctgtatggaacata

SEQ ID NO: 749652 - DNA, 25 bp, Mus musculus
tagaggacgagaacgataattaccc

SEQ ID NO: 749653 - DNA, 25 bp, Mus musculus
tagaggacgagatcgataattaccc

SEQ ID NO: 749654 - DNA, 25 bp, Mus musculus
tagaggacgccaccattggtaacgg

SEQ ID NO: 749655 - DNA, 25 bp, Mus musculus
tagaggacgccagcattggtaacgg

SEQ ID NO: 749656 - DNA, 25 bp, Mus musculus
tagaggactcgcctggtcagtctgc

SEQ ID NO: 749657 - DNA, 25 bp, Mus musculus
tagaggactcgcgtggtcagtctgc

SEQ ID NO: 749658 - DNA, 25 bp, Mus musculus
tagaggagacacaccactcaaagtt

SEQ ID NO: 749659 - DNA, 25 bp, Mus musculus
tagaggagacactccactcaaagtt

SEQ ID NO: 749660 - DNA, 25 bp, Mus musculus
tagaggagacataaccacagccttg

SEQ ID NO: 749661 - DNA, 25 bp, Mus musculus
tagaggagacattaccacagccttg

SEQ ID NO: 749662 - DNA, 25 bp, Mus musculus
tagaggagatcccatgttatgtgcg

SEQ ID NO: 749663 - DNA, 25 bp, Mus musculus
tagaggagatccgatgttatgtgcg

SEQ ID NO: 749664 - DNA, 25 bp, Mus musculus
tagaggagcacaatgccaagcagcc

SEQ ID NO: 749665 - DNA, 25 bp, Mus musculus
tagaggagcacattgccaagcagcc

SEQ ID NO: 749666 - DNA, 25 bp, Mus musculus
tagaggagcctcagccatgtgagcc

SEQ ID NO: 749667 - DNA, 25 bp, Mus musculus
tagaggagcctctgccatgtgagcc

SEQ ID NO: 749668 - DNA, 25 bp, Mus musculus
tagaggatgaacaagcaaccatgca

SEQ ID NO: 749669 - DNA, 25 bp, Mus musculus
tagaggatgaactagcaaccatgca

SEQ ID NO: 749670 - DNA, 25 bp, Mus musculus
tagaggatttagaccgcatcctcac

SEQ ID NO: 749671 - DNA, 25 bp, Mus musculus
tagaggatttagtccgcatcctcac

SEQ ID NO: 749672 - DNA, 25 bp, Mus musculus
tagaggcacctgagctccagtccct

SEQ ID NO: 749673 - DNA, 25 bp, Mus musculus
tagaggcacctgtgctccagtccct

SEQ ID NO: 749674 - DNA, 25 bp, Mus musculus
tagaggcagaaaacgttaggatgac

SEQ ID NO: 749675 - DNA, 25 bp, Mus musculus
tagaggcagaaatcgttaggatgac

SEQ ID NO: 749676 - DNA, 25 bp, Mus musculus
tagaggcagatgctacacagtcaca

SEQ ID NO: 749677 - DNA, 25 bp, Mus musculus
tagaggcagatggtacacagtcaca

SEQ ID NO: 749678 - DNA, 25 bp, Mus musculus
tagaggcagtcaagacagagctgag

SEQ ID NO: 749679 - DNA, 25 bp, Mus musculus
tagaggcagtcatgacagagctgag

SEQ ID NO: 749680 - DNA, 25 bp, Mus musculus
tagaggccactgacgtcttgggaaa

SEQ ID NO: 749681 - DNA, 25 bp, Mus musculus
tagaggccactgtcgtcttgggaaa

SEQ ID NO: 749682 - DNA, 25 bp, Mus musculus
tagaggcccatgcatacagagacat

SEQ ID NO: 749683 - DNA, 25 bp, Mus musculus
tagaggcccatggatacagagacat

SEQ ID NO: 749684 - DNA, 25 bp, Mus musculus
tagaggccccagctagacgctggaa

SEQ ID NO: 749685 - DNA, 25 bp, Mus musculus
tagaggccccaggtagacgctggaa

SEQ ID NO: 749686 - DNA, 25 bp, Mus musculus
tagaggccctggatgaactcgcttc

SEQ ID NO: 749687 - DNA, 25 bp, Mus musculus
tagaggccctggttgaactcgcttc

SEQ ID NO: 749688 - DNA, 25 bp, Mus musculus
tagaggccctttcccaacaatcagg

SEQ ID NO: 749689 - DNA, 25 bp, Mus musculus
tagaggccctttgccaacaatcagg

SEQ ID NO: 749690 - DNA, 25 bp, Mus musculus
tagaggccggtcagtcactagtcat

SEQ ID NO: 749691 - DNA, 25 bp, Mus musculus
tagaggccggtctgtcactagtcat

SEQ ID NO: 749692 - DNA, 25 bp, Mus musculus
tagaggcctagtctgcttccctccg

SEQ ID NO: 749693 - DNA, 25 bp, Mus musculus
tagaggcctagtgtgcttccctccg

SEQ ID NO: 749694 - DNA, 25 bp, Mus musculus
tagaggcctcaaatgccattgaggc

SEQ ID NO: 749695 - DNA, 25 bp, Mus musculus
tagaggcctcaattgccattgaggc

SEQ ID NO: 749696 - DNA, 25 bp, Mus musculus
tagaggcctgccacaataaggaccc

SEQ ID NO: 749697 - DNA, 25 bp, Mus musculus
tagaggcctgcctcaataaggaccc

SEQ ID NO: 749698 - DNA, 25 bp, Mus musculus
tagaggcgatcaatgctgcgctgct

SEQ ID NO: 749699 - DNA, 25 bp, Mus musculus
tagaggcgatcattgctgcgctgct

SEQ ID NO: 749700 - DNA, 25 bp, Mus musculus
tagaggcgcgacctgagatccagcc

SEQ ID NO: 749701 - DNA, 25 bp, Mus musculus
tagaggcgcgacgtgagatccagcc

SEQ ID NO: 749702 - DNA, 25 bp, Mus musculus
tagaggctacaaagtggcccgtcca

SEQ ID NO: 749703 - DNA, 25 bp, Mus musculus
tagaggctacaatgtggcccgtcca

SEQ ID NO: 749704 - DNA, 25 bp, Mus musculus
tagaggctccccacgcgggacctga

SEQ ID NO: 749705 - DNA, 25 bp, Mus musculus
tagaggctcccctcgcgggacctga

SEQ ID NO: 749706 - DNA, 25 bp, Mus musculus
tagaggctcctaacatatattctgg

SEQ ID NO: 749707 - DNA, 25 bp, Mus musculus
tagaggctcctatcatatattctgg

SEQ ID NO: 749708 - DNA, 25 bp, Mus musculus
tagaggctgatcagtccctgaaagc

SEQ ID NO: 749709 - DNA, 25 bp, Mus musculus
tagaggctgatctgtccctgaaagc

SEQ ID NO: 749710 - DNA, 25 bp, Mus musculus
tagaggctgggtaccagatagcagt

SEQ ID NO: 749711 - DNA, 25 bp, Mus musculus
tagaggctgggttccagatagcagt

SEQ ID NO: 749712 - DNA, 25 bp, Mus musculus
tagagggaagaaccactgtacagaa

SEQ ID NO: 749713 - DNA, 25 bp, Mus musculus
tagagggaagaagcactgtacagaa

SEQ ID NO: 749714 - DNA, 25 bp, Mus musculus
tagagggatccgactcatgggccgt

SEQ ID NO: 749715 - DNA, 25 bp, Mus musculus
tagagggatccgtctcatgggccgt

SEQ ID NO: 749716 - DNA, 25 bp, Mus musculus
tagagggatcctagctgctgggctc

SEQ ID NO: 749717 - DNA, 25 bp, Mus musculus
tagagggatccttgctgctgggctc

SEQ ID NO: 749718 - DNA, 25 bp, Mus musculus
tagagggattgaaggcagttctgcc

SEQ ID NO: 749719 - DNA, 25 bp, Mus musculus
tagagggattgatggcagttctgcc

SEQ ID NO: 749720 - DNA, 25 bp, Mus musculus
tagagggccagcctgcctgtgtcac

SEQ ID NO: 749721 - DNA, 25 bp, Mus musculus
tagagggccagcgtgcctgtgtcac

SEQ ID NO: 749722 - DNA, 25 bp, Mus musculus
tagagggcccatcagacagtggtac

SEQ ID NO: 749723 - DNA, 25 bp, Mus musculus
tagagggcccatgagacagtggtac

SEQ ID NO: 749724 - DNA, 25 bp, Mus musculus
tagagggcgcctattccagaagatc

SEQ ID NO: 749725 - DNA, 25 bp, Mus musculus
tagagggcgccttttccagaagatc

SEQ ID NO: 749726 - DNA, 25 bp, Mus musculus
tagaggtcttgtatctgaggaacgt

SEQ ID NO: 749727 - DNA, 25 bp, Mus musculus
tagaggtcttgtttctgaggaacgt

SEQ ID NO: 749728 - DNA, 25 bp, Mus musculus
tagaggtgacctcactgctggagac

SEQ ID NO: 749729 - DNA, 25 bp, Mus musculus
tagaggtgacctgactgctggagac

SEQ ID NO: 749730 - DNA, 25 bp, Mus musculus
tagaggtgcaaacttaccagccgcc

SEQ ID NO: 749731 - DNA, 25 bp, Mus musculus
tagaggtgcaaagttaccagccgcc

SEQ ID NO: 749732 - DNA, 25 bp, Mus musculus
tagaggtgcaccctaggcactcgct

SEQ ID NO: 749733 - DNA, 25 bp, Mus musculus
tagaggtgcaccgtaggcactcgct

SEQ ID NO: 749734 - DNA, 25 bp, Mus musculus
tagaggtgccacaagtaacctggga

SEQ ID NO: 749735 - DNA, 25 bp, Mus musculus
tagaggtgccactagtaacctggga

SEQ ID NO: 749736 - DNA, 25 bp, Mus musculus
tagaggtgcccaccatctacaggca

SEQ ID NO: 749737 - DNA, 25 bp, Mus musculus
tagaggtgcccagcatctacaggca

SEQ ID NO: 749738 - DNA, 25 bp, Mus musculus
tagaggtggataaaggtacagtcct

SEQ ID NO: 749739 - DNA, 25 bp, Mus musculus
tagaggtggatataggtacagtcct

SEQ ID NO: 749740 - DNA, 25 bp, Mus musculus
tagaggttatggaactacaacttcc

SEQ ID NO: 749741 - DNA, 25 bp, Mus musculus
tagaggttatggtactacaacttcc

SEQ ID NO: 749742 - DNA, 25 bp, Mus musculus
tagaggttctagagtgccgtatcca

SEQ ID NO: 749743 - DNA, 25 bp, Mus musculus
tagaggttctagtgtgccgtatcca

SEQ ID NO: 749744 - DNA, 25 bp, Mus musculus
tagagtaactttcatttcgctggat

SEQ ID NO: 749745 - DNA, 25 bp, Mus musculus
tagagtaactttgatttcgctggat

SEQ ID NO: 749746 - DNA, 25 bp, Mus musculus
tagagtagctctcatctagtcgcca

SEQ ID NO: 749747 - DNA, 25 bp, Mus musculus
tagagtagctctgatctagtcgcca

SEQ ID NO: 749748 - DNA, 25 bp, Mus musculus
tagagtatgagcctgctaagcggct

SEQ ID NO: 749749 - DNA, 25 bp, Mus musculus
tagagtatgagcgtgctaagcggct

SEQ ID NO: 749750 - DNA, 25 bp, Mus musculus
tagagtcactgacttcatggatgac

SEQ ID NO: 749751 - DNA, 25 bp, Mus musculus
tagagtcactgagttcatggatgac

SEQ ID NO: 749752 - DNA, 25 bp, Mus musculus
tagagtcagatgagactgctcgtca

SEQ ID NO: 749753 - DNA, 25 bp, Mus musculus
tagagtcagatgtgactgctcgtca

SEQ ID NO: 749754 - DNA, 25 bp, Mus musculus
tagagtcaggtgcagcctagtctat

SEQ ID NO: 749755 - DNA, 25 bp, Mus musculus
tagagtcaggtggagcctagtctat

SEQ ID NO: 749756 - DNA, 25 bp, Mus musculus
tagagtccaagcacagtggccagga

SEQ ID NO: 749757 - DNA, 25 bp, Mus musculus
tagagtccaagctcagtggccagga

SEQ ID NO: 749758 - DNA, 25 bp, Mus musculus
tagagtccagcaacgcagaggctga

SEQ ID NO: 749759 - DNA, 25 bp, Mus musculus
tagagtccagcatcgcagaggctga

SEQ ID NO: 749760 - DNA, 25 bp, Mus musculus
tagagtccagggacatcagagagct

SEQ ID NO: 749761 - DNA, 25 bp, Mus musculus
tagagtccagggtcatcagagagct

SEQ ID NO: 749762 - DNA, 25 bp, Mus musculus
tagagtccaggtacttggcccacac

SEQ ID NO: 749763 - DNA, 25 bp, Mus musculus
tagagtccaggttcttggcccacac

SEQ ID NO: 749764 - DNA, 25 bp, Mus musculus
tagagtccatccaggccgaggatga

SEQ ID NO: 749765 - DNA, 25 bp, Mus musculus
tagagtccatcctggccgaggatga

SEQ ID NO: 749766 - DNA, 25 bp, Mus musculus
tagagtctaaagctgacaaagaggc

SEQ ID NO: 749767 - DNA, 25 bp, Mus musculus
tagagtctaaaggtgacaaagaggc

SEQ ID NO: 749768 - DNA, 25 bp, Mus musculus
tagagtctagacagaatgtggtcac

SEQ ID NO: 749769 - DNA, 25 bp, Mus musculus
tagagtctagactgaatgtggtcac

SEQ ID NO: 749770 - DNA, 25 bp, Mus musculus
tagagtctctccagcttgctaggga

SEQ ID NO: 749771 - DNA, 25 bp, Mus musculus
tagagtctctcctgcttgctaggga

SEQ ID NO: 749772 - DNA, 25 bp, Mus musculus
tagagtctgcctagcgcaggaagta

SEQ ID NO: 749773 - DNA, 25 bp, Mus musculus
tagagtctgccttgcgcaggaagta

SEQ ID NO: 749774 - DNA, 25 bp, Mus musculus
tagagtctgtcaaacactttgccac

SEQ ID NO: 749775 - DNA, 25 bp, Mus musculus
tagagtctgtcatacactttgccac

SEQ ID NO: 749776 - DNA, 25 bp, Mus musculus
tagagtgagaagcattactcagttc

SEQ ID NO: 749777 - DNA, 25 bp, Mus musculus
tagagtgagaaggattactcagttc

SEQ ID NO: 749778 - DNA, 25 bp, Mus musculus
tagagtgagttgagcatgctgtccc

SEQ ID NO: 749779 - DNA, 25 bp, Mus musculus
tagagtgagttgtgcatgctgtccc

SEQ ID NO: 749780 - DNA, 25 bp, Mus musculus
tagagtgcccagagtacaagaaatg

SEQ ID NO: 749781 - DNA, 25 bp, Mus musculus
tagagtgcccagtgtacaagaaatg

SEQ ID NO: 749782 - DNA, 25 bp, Mus musculus
tagagtgggcagcacccagtacgaa

SEQ ID NO: 749783 - DNA, 25 bp, Mus musculus
tagagtgggcaggacccagtacgaa

SEQ ID NO: 749784 - DNA, 25 bp, Mus musculus
tagagttacactacgggctgcaaac

SEQ ID NO: 749785 - DNA, 25 bp, Mus musculus
tagagttacacttcgggctgcaaac

SEQ ID NO: 749786 - DNA, 25 bp, Mus musculus
tagagttagttacgtcagcaggcag

SEQ ID NO: 749787 - DNA, 25 bp, Mus musculus
tagagttagttaggtcagcaggcag

SEQ ID NO: 749788 - DNA, 25 bp, Mus musculus
tagagttcacgaaaccttttgtgga

SEQ ID NO: 749789 - DNA, 25 bp, Mus musculus
tagagttcacgataccttttgtgga

SEQ ID NO: 749790 - DNA, 25 bp, Mus musculus
tagagttcagccacaggattcagga

SEQ ID NO: 749791 - DNA, 25 bp, Mus musculus
tagagttcagccacagttaagagcc

SEQ ID NO: 749792 - DNA, 25 bp, Mus musculus
tagagttcagcctcaggattcagga

SEQ ID NO: 749793 - DNA, 25 bp, Mus musculus
tagagttcagcctcagttaagagcc

SEQ ID NO: 749794 - DNA, 25 bp, Mus musculus
tagagttccgatagtcactgcgccc

SEQ ID NO: 749795 - DNA, 25 bp, Mus musculus
tagagttccgattgtcactgcgccc

SEQ ID NO: 749796 - DNA, 25 bp, Mus musculus
tagagttctactcgacaaggaagag

SEQ ID NO: 749797 - DNA, 25 bp, Mus musculus
tagagttctactggacaaggaagag

SEQ ID NO: 749798 - DNA, 25 bp, Mus musculus
tagagttctcggacaaagagtcagt

SEQ ID NO: 749799 - DNA, 25 bp, Mus musculus
tagagttctcggtcaaagagtcagt

SEQ ID NO: 749800 - DNA, 25 bp, Mus musculus
tagagttgaacactgccagcttggg

SEQ ID NO: 749801 - DNA, 25 bp, Mus musculus
tagagttgaacagtgccagcttggg

SEQ ID NO: 749802 - DNA, 25 bp, Mus musculus
tagagttgacgaaaataacaaggac

SEQ ID NO: 749803 - DNA, 25 bp, Mus musculus
tagagttgacgataataacaaggac

SEQ ID NO: 749804 - DNA, 25 bp, Mus musculus
tagagttgcatgatacagtcaagag

SEQ ID NO: 749805 - DNA, 25 bp, Mus musculus
tagagttgcatgttacagtcaagag

SEQ ID NO: 749806 - DNA, 25 bp, Mus musculus
tagagttggcgtcctacatctgcta

SEQ ID NO: 749807 - DNA, 25 bp, Mus musculus
tagagttggcgtgctacatctgcta

SEQ ID NO: 749808 - DNA, 25 bp, Mus musculus
tagagttgggacagctgattatgga

SEQ ID NO: 749809 - DNA, 25 bp, Mus musculus
tagagttgggactgctgattatgga

SEQ ID NO: 749810 - DNA, 25 bp, Mus musculus
tagagttgtaacagaaaattgcaac

SEQ ID NO: 749811 - DNA, 25 bp, Mus musculus
tagagttgtaactgaaaattgcaac

SEQ ID NO: 749812 - DNA, 25 bp, Mus musculus
tagagttgtgcacaagttgggcttc

SEQ ID NO: 749813 - DNA, 25 bp, Mus musculus
tagagttgtgcagaagttgggcttc

SEQ ID NO: 749814 - DNA, 25 bp, Mus musculus
tagagtttatctcggtgagagcagc

SEQ ID NO: 749815 - DNA, 25 bp, Mus musculus
tagagtttatctgggtgagagcagc

SEQ ID NO: 749816 - DNA, 25 bp, Mus musculus
tagagtttcttaattttcaccgagc

SEQ ID NO: 749817 - DNA, 25 bp, Mus musculus
tagagtttcttatttttcaccgagc

SEQ ID NO: 749818 - DNA, 25 bp, Mus musculus
tagagtttgcaacaagaagcatcca

SEQ ID NO: 749819 - DNA, 25 bp, Mus musculus
tagagtttgcaagaagaagcatcca

SEQ ID NO: 749820 - DNA, 25 bp, Mus musculus
tagagttttaatcgcctccagaggt

SEQ ID NO: 749821 - DNA, 25 bp, Mus musculus
tagagttttaatggcctccagaggt

SEQ ID NO: 749822 - DNA, 25 bp, Mus musculus
tagataaaaattcgccatcaagacc

SEQ ID NO: 749823 - DNA, 25 bp, Mus musculus
tagataaaaattggccatcaagacc

SEQ ID NO: 749824 - DNA, 25 bp, Mus musculus
tagataacatctcgactgcccggct

SEQ ID NO: 749825 - DNA, 25 bp, Mus musculus
tagataacatctggactgcccggct

SEQ ID NO: 749826 - DNA, 25 bp, Mus musculus
tagataacctagagtcccgtcagct

SEQ ID NO: 749827 - DNA, 25 bp, Mus musculus
tagataacctagtgtcccgtcagct

SEQ ID NO: 749828 - DNA, 25 bp, Mus musculus
tagataagctggaggacttcatcaa

SEQ ID NO: 749829 - DNA, 25 bp, Mus musculus
tagataagctggtggacttcatcaa

SEQ ID NO: 749830 - DNA, 25 bp, Mus musculus
tagataatgaataaagcaaggctgt

SEQ ID NO: 749831 - DNA, 25 bp, Mus musculus
tagataatgaattaagcaaggctgt

SEQ ID NO: 749832 - DNA, 25 bp, Mus musculus
tagataatggtgatggtcctccctg

SEQ ID NO: 749833 - DNA, 25 bp, Mus musculus
tagataatggtgttggtcctccctg

SEQ ID NO: 749834 - DNA, 25 bp, Mus musculus
tagatacactgtaactgtggaagga

SEQ ID NO: 749835 - DNA, 25 bp, Mus musculus
tagatacactgttactgtggaagga

SEQ ID NO: 749836 - DNA, 25 bp, Mus musculus
tagatacagataattgggaaacccc

SEQ ID NO: 749837 - DNA, 25 bp, Mus musculus
tagatacagatatttgggaaacccc

SEQ ID NO: 749838 - DNA, 25 bp, Mus musculus
tagatacagcaaaggcgagcacgtt

SEQ ID NO: 749839 - DNA, 25 bp, Mus musculus
tagatacagcaatggcgagcacgtt

SEQ ID NO: 749840 - DNA, 25 bp, Mus musculus
tagataccaagaatacatcctctgg

SEQ ID NO: 749841 - DNA, 25 bp, Mus musculus
tagataccaagattacatcctctgg

SEQ ID NO: 749842 - DNA, 25 bp, Mus musculus
tagatacccgacacctgatgggccc

SEQ ID NO: 749843 - DNA, 25 bp, Mus musculus
tagatacccgactcctgatgggccc

SEQ ID NO: 749844 - DNA, 25 bp, Mus musculus
tagatacgacccatctcaggatggc

SEQ ID NO: 749845 - DNA, 25 bp, Mus musculus
tagatacgacccttctcaggatggc

SEQ ID NO: 749846 - DNA, 25 bp, Mus musculus
tagatacggctaagtgtacgcaggc

SEQ ID NO: 749847 - DNA, 25 bp, Mus musculus
tagatacggctatgtgtacgcaggc

SEQ ID NO: 749848 - DNA, 25 bp, Mus musculus
tagatagacgagagcagcccagcaa

SEQ ID NO: 749849 - DNA, 25 bp, Mus musculus
tagatagacgagtgcagcccagcaa

SEQ ID NO: 749850 - DNA, 25 bp, Mus musculus
tagatagagctacacgtgtggcctg

SEQ ID NO: 749851 - DNA, 25 bp, Mus musculus
tagatagagctagacgtgtggcctg

SEQ ID NO: 749852 - DNA, 25 bp, Mus musculus
tagatagccaccaggttgttataga

SEQ ID NO: 749853 - DNA, 25 bp, Mus musculus
tagatagccacctggttgttataga

SEQ ID NO: 749854 - DNA, 25 bp, Mus musculus
tagatagccttacggaagatcagca

SEQ ID NO: 749855 - DNA, 25 bp, Mus musculus
tagatagccttagggaagatcagca

SEQ ID NO: 749856 - DNA, 25 bp, Mus musculus
tagatagctctgatgtcatcagccc

SEQ ID NO: 749857 - DNA, 25 bp, Mus musculus
tagatagctctgttgtcatcagccc

SEQ ID NO: 749858 - DNA, 25 bp, Mus musculus
tagataggctacaaagtctttatga

SEQ ID NO: 749859 - DNA, 25 bp, Mus musculus
tagataggctactaagtctttatga

SEQ ID NO: 749860 - DNA, 25 bp, Mus musculus
tagatatagactagatgccctgcct

SEQ ID NO: 749861 - DNA, 25 bp, Mus musculus
tagatatagacttgatgccctgcct

SEQ ID NO: 749862 - DNA, 25 bp, Mus musculus
tagatatattgaaaatccacgcagg

SEQ ID NO: 749863 - DNA, 25 bp, Mus musculus
tagatatattgataatccacgcagg

SEQ ID NO: 749864 - DNA, 25 bp, Mus musculus
tagatatgaggtagtagtagctact

SEQ ID NO: 749865 - DNA, 25 bp, Mus musculus
tagatatgaggttgtagtagctact

SEQ ID NO: 749866 - DNA, 25 bp, Mus musculus
tagatatgattgaaggaaaagaccg

SEQ ID NO: 749867 - DNA, 25 bp, Mus musculus
tagatatgattgtaggaaaagaccg

SEQ ID NO: 749868 - DNA, 25 bp, Mus musculus
tagatatggagcagggtgtatcccc

SEQ ID NO: 749869 - DNA, 25 bp, Mus musculus
tagatatggagctgggtgtatcccc

SEQ ID NO: 749870 - DNA, 25 bp, Mus musculus
tagatatggataagacccagacggg

SEQ ID NO: 749871 - DNA, 25 bp, Mus musculus
tagatatggatatgacccagacggg

SEQ ID NO: 749872 - DNA, 25 bp, Mus musculus
tagatatgggctaggctgctgatgt

SEQ ID NO: 749873 - DNA, 25 bp, Mus musculus
tagatatgggcttggctgctgatgt

SEQ ID NO: 749874 - DNA, 25 bp, Mus musculus
tagatatttcttcaaacctacccca

SEQ ID NO: 749875 - DNA, 25 bp, Mus musculus
tagatatttcttctgtgtcatcaga

SEQ ID NO: 749876 - DNA, 25 bp, Mus musculus
tagatatttcttgaaacctacccca

SEQ ID NO: 749877 - DNA, 25 bp, Mus musculus
tagatatttcttgtgtgtcatcaga

SEQ ID NO: 749878 - DNA, 25 bp, Mus musculus
tagatcaagtccaaaagctgacttc

SEQ ID NO: 749879 - DNA, 25 bp, Mus musculus
tagatcaagtcctaaagctgacttc

SEQ ID NO: 749880 - DNA, 25 bp, Mus musculus
tagatcagcactctaccctggaagg

SEQ ID NO: 749881 - DNA, 25 bp, Mus musculus
tagatcagcactgtaccctggaagg

SEQ ID NO: 749882 - DNA, 25 bp, Mus musculus
tagatcagcatgacaatcatcagcg

SEQ ID NO: 749883 - DNA, 25 bp, Mus musculus
tagatcagcatgtcaatcatcagcg

SEQ ID NO: 749884 - DNA, 25 bp, Mus musculus
tagatcagctgtcggctctgggcca

SEQ ID NO: 749885 - DNA, 25 bp, Mus musculus
tagatcagctgtgggctctgggcca

SEQ ID NO: 749886 - DNA, 25 bp, Mus musculus
tagatcaggcagctcagccatgttc

SEQ ID NO: 749887 - DNA, 25 bp, Mus musculus
tagatcaggcaggtcagccatgttc

SEQ ID NO: 749888 - DNA, 25 bp, Mus musculus
tagatcaggccaaactagatgagtg

SEQ ID NO: 749889 - DNA, 25 bp, Mus musculus
tagatcaggccaactcaggctcatg

SEQ ID NO: 749890 - DNA, 25 bp, Mus musculus
tagatcaggccatactagatgagtg

SEQ ID NO: 749891 - DNA, 25 bp, Mus musculus
tagatcaggccatctcaggctcatg

SEQ ID NO: 749892 - DNA, 25 bp, Mus musculus
tagatcatcttgaggcacacactgc

SEQ ID NO: 749893 - DNA, 25 bp, Mus musculus
tagatcatcttgtggcacacactgc

SEQ ID NO: 749894 - DNA, 25 bp, Mus musculus
tagatcatgaaacaatgtcctacct

SEQ ID NO: 749895 - DNA, 25 bp, Mus musculus
tagatcatgaaagaatgtcctacct

SEQ ID NO: 749896 - DNA, 25 bp, Mus musculus
tagatcatgagaaccggatgaggga

SEQ ID NO: 749897 - DNA, 25 bp, Mus musculus
tagatcatgagatccggatgaggga

SEQ ID NO: 749898 - DNA, 25 bp, Mus musculus
tagatccattgaagcctttaaggac

SEQ ID NO: 749899 - DNA, 25 bp, Mus musculus
tagatccattgatgcctttaaggac

SEQ ID NO: 749900 - DNA, 25 bp, Mus musculus
tagatcccaagtagaacaaaagacg

SEQ ID NO: 749901 - DNA, 25 bp, Mus musculus
tagatcccaagttgaacaaaagacg

SEQ ID NO: 749902 - DNA, 25 bp, Mus musculus
tagatcccctgtccttcgagtgcgg

SEQ ID NO: 749903 - DNA, 25 bp, Mus musculus
tagatcccctgtgcttcgagtgcgg

SEQ ID NO: 749904 - DNA, 25 bp, Mus musculus
tagatcccggagagccttggtgctc

SEQ ID NO: 749905 - DNA, 25 bp, Mus musculus
tagatcccggagtgccttggtgctc

SEQ ID NO: 749906 - DNA, 25 bp, Mus musculus
tagatccctggtccctgatcggctg

SEQ ID NO: 749907 - DNA, 25 bp, Mus musculus
tagatccctggtgcctgatcggctg

SEQ ID NO: 749908 - DNA, 25 bp, Mus musculus
tagatcctaaaaatgctcagaacct

SEQ ID NO: 749909 - DNA, 25 bp, Mus musculus
tagatcctaaaattgctcagaacct

SEQ ID NO: 749910 - DNA, 25 bp, Mus musculus
tagatcctaaggctgggactcccat

SEQ ID NO: 749911 - DNA, 25 bp, Mus musculus
tagatcctaagggtgggactcccat

SEQ ID NO: 749912 - DNA, 25 bp, Mus musculus
tagatcctaagtccgagtaggtttg

SEQ ID NO: 749913 - DNA, 25 bp, Mus musculus
tagatcctaagtgcgagtaggtttg

SEQ ID NO: 749914 - DNA, 25 bp, Mus musculus
tagatcctgatcagaccagccatct

SEQ ID NO: 749915 - DNA, 25 bp, Mus musculus
tagatcctgatctgaccagccatct

SEQ ID NO: 749916 - DNA, 25 bp, Mus musculus
tagatcgaggcacaattgctgagcc

SEQ ID NO: 749917 - DNA, 25 bp, Mus musculus
tagatcgaggcagaattgctgagcc

SEQ ID NO: 749918 - DNA, 25 bp, Mus musculus
tagatcgcccttacatttcagaggg

SEQ ID NO: 749919 - DNA, 25 bp, Mus musculus
tagatcgccctttcatttcagaggg

SEQ ID NO: 749920 - DNA, 25 bp, Mus musculus
tagatctaccttaagacttgagaac

SEQ ID NO: 749921 - DNA, 25 bp, Mus musculus
tagatctacctttagacttgagaac

SEQ ID NO: 749922 - DNA, 25 bp, Mus musculus
tagatctcacctaaacatgctgtcc

SEQ ID NO: 749923 - DNA, 25 bp, Mus musculus
tagatctcaccttaacatgctgtcc

SEQ ID NO: 749924 - DNA, 25 bp, Mus musculus
tagatctgagctacaaccccttgaa

SEQ ID NO: 749925 - DNA, 25 bp, Mus musculus
tagatctgagcttcaaccccttgaa

SEQ ID NO: 749926 - DNA, 25 bp, Mus musculus
tagatctgatcaatccccgaggctc

SEQ ID NO: 749927 - DNA, 25 bp, Mus musculus
tagatctgatcattccccgaggctc

SEQ ID NO: 749928 - DNA, 25 bp, Mus musculus
tagatctgtgcaatcatggaaagct

SEQ ID NO: 749929 - DNA, 25 bp, Mus musculus
tagatctgtgcattcatggaaagct

SEQ ID NO: 749930 - DNA, 25 bp, Mus musculus
tagatcttgataatccacaggagaa

SEQ ID NO: 749931 - DNA, 25 bp, Mus musculus
tagatcttgatattccacaggagaa

SEQ ID NO: 749932 - DNA, 25 bp, Mus musculus
tagatcttgctgaatgtcccaggct

SEQ ID NO: 749933 - DNA, 25 bp, Mus musculus
tagatcttgctgtatgtcccaggct

SEQ ID NO: 749934 - DNA, 25 bp, Mus musculus
tagatctttaaccttgcagctgccc

SEQ ID NO: 749935 - DNA, 25 bp, Mus musculus
tagatctttaacgttgcagctgccc

SEQ ID NO: 749936 - DNA, 25 bp, Mus musculus
tagatgaaagagaacaccaccgatt

SEQ ID NO: 749937 - DNA, 25 bp, Mus musculus
tagatgaaagagtacaccaccgatt

SEQ ID NO: 749938 - DNA, 25 bp, Mus musculus
tagatgaactggaaaaaagcatgaa

SEQ ID NO: 749939 - DNA, 25 bp, Mus musculus
tagatgaactggtaaaaagcatgaa

SEQ ID NO: 749940 - DNA, 25 bp, Mus musculus
tagatgaagtcaagatgcatttgcc

SEQ ID NO: 749941 - DNA, 25 bp, Mus musculus
tagatgaagtcatgatgcatttgcc

SEQ ID NO: 749942 - DNA, 25 bp, Mus musculus
tagatgaatccaataacatcggccc

SEQ ID NO: 749943 - DNA, 25 bp, Mus musculus
tagatgaatccattaacatcggccc

SEQ ID NO: 749944 - DNA, 25 bp, Mus musculus
tagatgacacttcggtgactgtgtt

SEQ ID NO: 749945 - DNA, 25 bp, Mus musculus
tagatgacacttgggtgactgtgtt

SEQ ID NO: 749946 - DNA, 25 bp, Mus musculus
tagatgacatcacaacccggaaaat

SEQ ID NO: 749947 - DNA, 25 bp, Mus musculus
tagatgacatcagaacccggaaaat

SEQ ID NO: 749948 - DNA, 25 bp, Mus musculus
tagatgacccgcagagtggagagct

SEQ ID NO: 749949 - DNA, 25 bp, Mus musculus
tagatgacccgctgagtggagagct

SEQ ID NO: 749950 - DNA, 25 bp, Mus musculus
tagatgacgtcaatacagatctgaa

SEQ ID NO: 749951 - DNA, 25 bp, Mus musculus
tagatgacgtcattacagatctgaa

SEQ ID NO: 749952 - DNA, 25 bp, Mus musculus
tagatgactactagggccttgggtg

SEQ ID NO: 749953 - DNA, 25 bp, Mus musculus
tagatgactacttgggccttgggtg

SEQ ID NO: 749954 - DNA, 25 bp, Mus musculus
tagatgactagtctagaggaagaac

SEQ ID NO: 749955 - DNA, 25 bp, Mus musculus
tagatgactagtgtagaggaagaac

SEQ ID NO: 749956 - DNA, 25 bp, Mus musculus
tagatgactgttcgatggctcccga

SEQ ID NO: 749957 - DNA, 25 bp, Mus musculus
tagatgactgttggatggctcccga

SEQ ID NO: 749958 - DNA, 25 bp, Mus musculus
tagatgacttgcagcgctgtgggat

SEQ ID NO: 749959 - DNA, 25 bp, Mus musculus
tagatgacttgctgcgctgtgggat

SEQ ID NO: 749960 - DNA, 25 bp, Mus musculus
tagatgagagggagcacacaataga

SEQ ID NO: 749961 - DNA, 25 bp, Mus musculus
tagatgagagggtgcacacaataga

SEQ ID NO: 749962 - DNA, 25 bp, Mus musculus
tagatgagccaaccacaggactgga

SEQ ID NO: 749963 - DNA, 25 bp, Mus musculus
tagatgagccaagcacaggactgga

SEQ ID NO: 749964 - DNA, 25 bp, Mus musculus
tagatgagctaacgactgaggtgct

SEQ ID NO: 749965 - DNA, 25 bp, Mus musculus
tagatgagctaaggactgaggtgct

SEQ ID NO: 749966 - DNA, 25 bp, Mus musculus
tagatgagctcaagttagcagtggc

SEQ ID NO: 749967 - DNA, 25 bp, Mus musculus
tagatgagctcatgttagcagtggc

SEQ ID NO: 749968 - DNA, 25 bp, Mus musculus
tagatgagctttcgaatgaattcag

SEQ ID NO: 749969 - DNA, 25 bp, Mus musculus
tagatgagctttggaatgaattcag

SEQ ID NO: 749970 - DNA, 25 bp, Mus musculus
tagatgagtctgaaaagaagaaacc

SEQ ID NO: 749971 - DNA, 25 bp, Mus musculus
tagatgagtctgtaaagaagaaacc

SEQ ID NO: 749972 - DNA, 25 bp, Mus musculus
tagatgagttcaatgaaagttgcca

SEQ ID NO: 749973 - DNA, 25 bp, Mus musculus
tagatgagttcattgaaagttgcca

SEQ ID NO: 749974 - DNA, 25 bp, Mus musculus
tagatgatgcggatgacccaagcac

SEQ ID NO: 749975 - DNA, 25 bp, Mus musculus
tagatgatgcggttgacccaagcac

SEQ ID NO: 749976 - DNA, 25 bp, Mus musculus
tagatgatgtcgcaaccacagagaa

SEQ ID NO: 749977 - DNA, 25 bp, Mus musculus
tagatgatgtcggaaccacagagaa

SEQ ID NO: 749978 - DNA, 25 bp, Mus musculus
tagatgcagtccaggccaacatccg

SEQ ID NO: 749979 - DNA, 25 bp, Mus musculus
tagatgcagtcctggccaacatccg

SEQ ID NO: 749980 - DNA, 25 bp, Mus musculus
tagatgccaatcactgccctggttc

SEQ ID NO: 749981 - DNA, 25 bp, Mus musculus
tagatgccaatctctgccctggttc

SEQ ID NO: 749982 - DNA, 25 bp, Mus musculus
tagatgccatccagacggtgcaggc

SEQ ID NO: 749983 - DNA, 25 bp, Mus musculus
tagatgccatcctgacggtgcaggc

SEQ ID NO: 749984 - DNA, 25 bp, Mus musculus
tagatgcccgcaagcttaacgggtg

SEQ ID NO: 749985 - DNA, 25 bp, Mus musculus
tagatgcccgcatgcttaacgggtg

SEQ ID NO: 749986 - DNA, 25 bp, Mus musculus
tagatgccctacaccctgtgggtga

SEQ ID NO: 749987 - DNA, 25 bp, Mus musculus
tagatgccctactccctgtgggtga

SEQ ID NO: 749988 - DNA, 25 bp, Mus musculus
tagatgccctgaagcgagtggccaa

SEQ ID NO: 749989 - DNA, 25 bp, Mus musculus
tagatgccctgatgcgagtggccaa

SEQ ID NO: 749990 - DNA, 25 bp, Mus musculus
tagatgccctgcagaatcaagtggc

SEQ ID NO: 749991 - DNA, 25 bp, Mus musculus
tagatgccctgctgaatcaagtggc

SEQ ID NO: 749992 - DNA, 25 bp, Mus musculus
tagatgccttggatgaagaagtagc

SEQ ID NO: 749993 - DNA, 25 bp, Mus musculus
tagatgccttggttgaagaagtagc

SEQ ID NO: 749994 - DNA, 25 bp, Mus musculus
tagatgcgctaccatattttgacca

SEQ ID NO: 749995 - DNA, 25 bp, Mus musculus
tagatgcgctacgatattttgacca

SEQ ID NO: 749996 - DNA, 25 bp, Mus musculus
tagatgctactccacctaaggccaa

SEQ ID NO: 749997 - DNA, 25 bp, Mus musculus
tagatgctactcgacctaaggccaa

SEQ ID NO: 749998 - DNA, 25 bp, Mus musculus
tagatgctagggacccaactctggc

SEQ ID NO: 749999 - DNA, 25 bp, Mus musculus
tagatgctagggtcccaactctggc

SEQ ID NO: 750000 - DNA, 25 bp, Mus musculus
tagatgctcaaaaccctgggaatgt

SEQ ID NO: 750001 - DNA, 25 bp, Mus musculus
tagatgctcaaatccctgggaatgt

SEQ ID NO: 750002 - DNA, 25 bp, Mus musculus
tagatgctcctgagagccgggctat

SEQ ID NO: 750003 - DNA, 25 bp, Mus musculus
tagatgctcctgtgagccgggctat

SEQ ID NO: 750004 - DNA, 25 bp, Mus musculus
tagatgctctgaacaaaaattggcg

SEQ ID NO: 750005 - DNA, 25 bp, Mus musculus
tagatgctctgatcaaaaattggcg

SEQ ID NO: 750006 - DNA, 25 bp, Mus musculus
tagatgctgggtactgactcaggag

SEQ ID NO: 750007 - DNA, 25 bp, Mus musculus
tagatgctgggttctgactcaggag

SEQ ID NO: 750008 - DNA, 25 bp, Mus musculus
tagatggcaaagaaataaagcaact

SEQ ID NO: 750009 - DNA, 25 bp, Mus musculus
tagatggcaaagtaataaagcaact

SEQ ID NO: 750010 - DNA, 25 bp, Mus musculus
tagatggcaagcatgtcgtgttcgg

SEQ ID NO: 750011 - DNA, 25 bp, Mus musculus
tagatggcaagcttgtcgtgttcgg

SEQ ID NO: 750012 - DNA, 25 bp, Mus musculus
tagatggccgagatggaataccagg

SEQ ID NO: 750013 - DNA, 25 bp, Mus musculus
tagatggccgagttggaataccagg

SEQ ID NO: 750014 - DNA, 25 bp, Mus musculus
tagatggtccctatgcagacttagg

SEQ ID NO: 750015 - DNA, 25 bp, Mus musculus
tagatggtccctttgcagacttagg

SEQ ID NO: 750016 - DNA, 25 bp, Mus musculus
tagatgtcgaccaacaaggtgtgcg

SEQ ID NO: 750017 - DNA, 25 bp, Mus musculus
tagatgtcgacctacaaggtgtgcg

SEQ ID NO: 750018 - DNA, 25 bp, Mus musculus
tagatgtgacataggatccttgccc

SEQ ID NO: 750019 - DNA, 25 bp, Mus musculus
tagatgtgacattggatccttgccc

SEQ ID NO: 750020 - DNA, 25 bp, Mus musculus
tagatgtggaagctcaactcaaaag

SEQ ID NO: 750021 - DNA, 25 bp, Mus musculus
tagatgtggaaggtcaactcaaaag

SEQ ID NO: 750022 - DNA, 25 bp, Mus musculus
tagatgtggccaaactcactgcact

SEQ ID NO: 750023 - DNA, 25 bp, Mus musculus
tagatgtggccatactcactgcact

SEQ ID NO: 750024 - DNA, 25 bp, Mus musculus
tagatgtgtgttagagttaatgcct

SEQ ID NO: 750025 - DNA, 25 bp, Mus musculus
tagatgtgtgtttgagttaatgcct

SEQ ID NO: 750026 - DNA, 25 bp, Mus musculus
tagatgttggttccccatttcctct

SEQ ID NO: 750027 - DNA, 25 bp, Mus musculus
tagatgttggttgcccatttcctct

SEQ ID NO: 750028 - DNA, 25 bp, Mus musculus
tagattaaacttcacctgtgcaagg

SEQ ID NO: 750029 - DNA, 25 bp, Mus musculus
tagattaaacttgacctgtgcaagg

SEQ ID NO: 750030 - DNA, 25 bp, Mus musculus
tagattagcctcagatagagaggaa

SEQ ID NO: 750031 - DNA, 25 bp, Mus musculus
tagattagcctctgatagagaggaa

SEQ ID NO: 750032 - DNA, 25 bp, Mus musculus
tagattcaagtcacgcaaagagcgg

SEQ ID NO: 750033 - DNA, 25 bp, Mus musculus
tagattcaagtctcgcaaagagcgg

SEQ ID NO: 750034 - DNA, 25 bp, Mus musculus
tagattcacaatcagccacagagga

SEQ ID NO: 750035 - DNA, 25 bp, Mus musculus
tagattcacaatgagccacagagga

SEQ ID NO: 750036 - DNA, 25 bp, Mus musculus
tagattccctctctgggtcacggaa

SEQ ID NO: 750037 - DNA, 25 bp, Mus musculus
tagattccctctgtgggtcacggaa

SEQ ID NO: 750038 - DNA, 25 bp, Mus musculus
tagattcctatcactaccaagtaga

SEQ ID NO: 750039 - DNA, 25 bp, Mus musculus
tagattcctatctctaccaagtaga

SEQ ID NO: 750040 - DNA, 25 bp, Mus musculus
tagattctgcggacaacactgagcc

SEQ ID NO: 750041 - DNA, 25 bp, Mus musculus
tagattctgcggtcaacactgagcc

SEQ ID NO: 750042 - DNA, 25 bp, Mus musculus
tagattggcaaaatataggacacta

SEQ ID NO: 750043 - DNA, 25 bp, Mus musculus
tagattggcaaattataggacacta

SEQ ID NO: 750044 - DNA, 25 bp, Mus musculus
tagattgttgccattcaccccggct

SEQ ID NO: 750045 - DNA, 25 bp, Mus musculus
tagattgttgcctttcaccccggct

SEQ ID NO: 750046 - DNA, 25 bp, Mus musculus
tagatttccaatcagatgtgctgga

SEQ ID NO: 750047 - DNA, 25 bp, Mus musculus
tagatttccaatgagatgtgctgga

SEQ ID NO: 750048 - DNA, 25 bp, Mus musculus
tagatttcttatccaatttcggaaa

SEQ ID NO: 750049 - DNA, 25 bp, Mus musculus
tagatttcttatgcaatttcggaaa

SEQ ID NO: 750050 - DNA, 25 bp, Mus musculus
tagatttcttcccttcctgtggcct

SEQ ID NO: 750051 - DNA, 25 bp, Mus musculus
tagatttcttccgttcctgtggcct

SEQ ID NO: 750052 - DNA, 25 bp, Mus musculus
tagatttgagatcctcatcccctgc

SEQ ID NO: 750053 - DNA, 25 bp, Mus musculus
tagatttgagatgctcatcccctgc

SEQ ID NO: 750054 - DNA, 25 bp, Mus musculus
tagatttggattctccggctcctgt

SEQ ID NO: 750055 - DNA, 25 bp, Mus musculus
tagatttggattgtccggctcctgt

SEQ ID NO: 750056 - DNA, 25 bp, Mus musculus
tagatttggctcctttttgtaccct

SEQ ID NO: 750057 - DNA, 25 bp, Mus musculus
tagatttggctcgtttttgtaccct

SEQ ID NO: 750058 - DNA, 25 bp, Mus musculus
tagcaaaaagaccttgagagaagtt

SEQ ID NO: 750059 - DNA, 25 bp, Mus musculus
tagcaaaaagacgttgagagaagtt

SEQ ID NO: 750060 - DNA, 25 bp, Mus musculus
tagcaaaaatctctatagacagctc

SEQ ID NO: 750061 - DNA, 25 bp, Mus musculus
tagcaaaaatctgtatagacagctc

SEQ ID NO: 750062 - DNA, 25 bp, Mus musculus
tagcaaaaccccaaaaagcctggag

SEQ ID NO: 750063 - DNA, 25 bp, Mus musculus
tagcaaaacccctaaaagcctggag

SEQ ID NO: 750064 - DNA, 25 bp, Mus musculus
tagcaaaactagcatcagtgtgccg

SEQ ID NO: 750065 - DNA, 25 bp, Mus musculus
tagcaaaactaggatcagtgtgccg

SEQ ID NO: 750066 - DNA, 25 bp, Mus musculus
tagcaaaagaggaaggtctccctgt

SEQ ID NO: 750067 - DNA, 25 bp, Mus musculus
tagcaaaagaggtaggtctccctgt

SEQ ID NO: 750068 - DNA, 25 bp, Mus musculus
tagcaaaataaaccgccgctgggtc

SEQ ID NO: 750069 - DNA, 25 bp, Mus musculus
tagcaaaataaagcgccgctgggtc

SEQ ID NO: 750070 - DNA, 25 bp, Mus musculus
tagcaaacaactaactatggtagaa

SEQ ID NO: 750071 - DNA, 25 bp, Mus musculus
tagcaaacaacttactatggtagaa

SEQ ID NO: 750072 - DNA, 25 bp, Mus musculus
tagcaaacagcaactccagaagcag

SEQ ID NO: 750073 - DNA, 25 bp, Mus musculus
tagcaaacagcatctccagaagcag

SEQ ID NO: 750074 - DNA, 25 bp, Mus musculus
tagcaaacagctctggcgaggttcc

SEQ ID NO: 750075 - DNA, 25 bp, Mus musculus
tagcaaacagctgtggcgaggttcc

SEQ ID NO: 750076 - DNA, 25 bp, Mus musculus
tagcaaacagtcaatttcggcgaat

SEQ ID NO: 750077 - DNA, 25 bp, Mus musculus
tagcaaacagtctatttcggcgaat

SEQ ID NO: 750078 - DNA, 25 bp, Mus musculus
tagcaaacatcgatggcctacaggg

SEQ ID NO: 750079 - DNA, 25 bp, Mus musculus
tagcaaacatcgttggcctacaggg

SEQ ID NO: 750080 - DNA, 25 bp, Mus musculus
tagcaaactaccagacctcagcaaa

SEQ ID NO: 750081 - DNA, 25 bp, Mus musculus
tagcaaactacctgacctcagcaaa

SEQ ID NO: 750082 - DNA, 25 bp, Mus musculus
tagcaaagagggaaacagcctgctc

SEQ ID NO: 750083 - DNA, 25 bp, Mus musculus
tagcaaagagggtaacagcctgctc

SEQ ID NO: 750084 - DNA, 25 bp, Mus musculus
tagcaaatgggtctgccagcttctg

SEQ ID NO: 750085 - DNA, 25 bp, Mus musculus
tagcaaatgggtgtgccagcttctg

SEQ ID NO: 750086 - DNA, 25 bp, Mus musculus
tagcaacaccatagaggaaaacagg

SEQ ID NO: 750087 - DNA, 25 bp, Mus musculus
tagcaacaccattgaggaaaacagg

SEQ ID NO: 750088 - DNA, 25 bp, Mus musculus
tagcaacagcacctagaggaatggc

SEQ ID NO: 750089 - DNA, 25 bp, Mus musculus
tagcaacagcacgtagaggaatggc

SEQ ID NO: 750090 - DNA, 25 bp, Mus musculus
tagcaacagggactgatgataactg

SEQ ID NO: 750091 - DNA, 25 bp, Mus musculus
tagcaacagggagtgatgataactg

SEQ ID NO: 750092 - DNA, 25 bp, Mus musculus
tagcaacaggtgctgtagatctctc

SEQ ID NO: 750093 - DNA, 25 bp, Mus musculus
tagcaacaggtggtgtagatctctc

SEQ ID NO: 750094 - DNA, 25 bp, Mus musculus
tagcaaccagctaggccccaagagc

SEQ ID NO: 750095 - DNA, 25 bp, Mus musculus
tagcaaccagcttggccccaagagc

SEQ ID NO: 750096 - DNA, 25 bp, Mus musculus
tagcaaccgttgacacccaactgtt

SEQ ID NO: 750097 - DNA, 25 bp, Mus musculus
tagcaaccgttgtcacccaactgtt

SEQ ID NO: 750098 - DNA, 25 bp, Mus musculus
tagcaacctattaggtaattccagc

SEQ ID NO: 750099 - DNA, 25 bp, Mus musculus
tagcaacctatttggtaattccagc

SEQ ID NO: 750100 - DNA, 25 bp, Mus musculus
tagcaactgaccctaaaggttttgt

SEQ ID NO: 750101 - DNA, 25 bp, Mus musculus
tagcaactgaccgtaaaggttttgt

SEQ ID NO: 750102 - DNA, 25 bp, Mus musculus
tagcaactgggcagaaacaccaagg

SEQ ID NO: 750103 - DNA, 25 bp, Mus musculus
tagcaactgggctgaaacaccaagg

SEQ ID NO: 750104 - DNA, 25 bp, Mus musculus
tagcaactgtctaactggacttaag

SEQ ID NO: 750105 - DNA, 25 bp, Mus musculus
tagcaactgtcttactggacttaag

SEQ ID NO: 750106 - DNA, 25 bp, Mus musculus
tagcaacttcgtcggcggatcctgg

SEQ ID NO: 750107 - DNA, 25 bp, Mus musculus
tagcaacttcgtgggcggatcctgg

SEQ ID NO: 750108 - DNA, 25 bp, Mus musculus
tagcaagaagcacttgaacattgac

SEQ ID NO: 750109 - DNA, 25 bp, Mus musculus
tagcaagaagcagttgaacattgac

SEQ ID NO: 750110 - DNA, 25 bp, Mus musculus
tagcaagactgtagtggatgatgag

SEQ ID NO: 750111 - DNA, 25 bp, Mus musculus
tagcaagactgttgtggatgatgag

SEQ ID NO: 750112 - DNA, 25 bp, Mus musculus
tagcaagagaagctactctggccat

SEQ ID NO: 750113 - DNA, 25 bp, Mus musculus
tagcaagagaaggtactctggccat

SEQ ID NO: 750114 - DNA, 25 bp, Mus musculus
tagcaagatcgcagtggacgtccat

SEQ ID NO: 750115 - DNA, 25 bp, Mus musculus
tagcaagatcgctgtggacgtccat

SEQ ID NO: 750116 - DNA, 25 bp, Mus musculus
tagcaagatgggaatggaggccgtg

SEQ ID NO: 750117 - DNA, 25 bp, Mus musculus
tagcaagatgggtatggaggccgtg

SEQ ID NO: 750118 - DNA, 25 bp, Mus musculus
tagcaagattccctggtacccctat

SEQ ID NO: 750119 - DNA, 25 bp, Mus musculus
tagcaagattccgtggtacccctat

SEQ ID NO: 750120 - DNA, 25 bp, Mus musculus
tagcaagcaagcacatggagaggcc

SEQ ID NO: 750121 - DNA, 25 bp, Mus musculus
tagcaagcaagctcatggagaggcc

SEQ ID NO: 750122 - DNA, 25 bp, Mus musculus
tagcaagcagtacacttccatatgg

SEQ ID NO: 750123 - DNA, 25 bp, Mus musculus
tagcaagcagtagacttccatatgg

SEQ ID NO: 750124 - DNA, 25 bp, Mus musculus
tagcaagcgtccacaaccagtgatg

SEQ ID NO: 750125 - DNA, 25 bp, Mus musculus
tagcaagcgtcctcaaccagtgatg

SEQ ID NO: 750126 - DNA, 25 bp, Mus musculus
tagcaagctggtcctaagagcagtg

SEQ ID NO: 750127 - DNA, 25 bp, Mus musculus
tagcaagctggtgctaagagcagtg

SEQ ID NO: 750128 - DNA, 25 bp, Mus musculus
tagcaagcttaacctgcagaacaaa

SEQ ID NO: 750129 - DNA, 25 bp, Mus musculus
tagcaagcttaagctgcagaacaaa

SEQ ID NO: 750130 - DNA, 25 bp, Mus musculus
tagcaaggacaaaacaattcaacat

SEQ ID NO: 750131 - DNA, 25 bp, Mus musculus
tagcaaggacaatacaattcaacat

SEQ ID NO: 750132 - DNA, 25 bp, Mus musculus
tagcaaggataacgtgccagctcaa

SEQ ID NO: 750133 - DNA, 25 bp, Mus musculus
tagcaaggataaggtgccagctcaa

SEQ ID NO: 750134 - DNA, 25 bp, Mus musculus
tagcaaggcccactaagagtaaccc

SEQ ID NO: 750135 - DNA, 25 bp, Mus musculus
tagcaaggcccagtaagagtaaccc

SEQ ID NO: 750136 - DNA, 25 bp, Mus musculus
tagcaagtcgatccctgcagacggg

SEQ ID NO: 750137 - DNA, 25 bp, Mus musculus
tagcaagtcgatgcctgcagacggg

SEQ ID NO: 750138 - DNA, 25 bp, Mus musculus
tagcaataacttccggtccctgctc

SEQ ID NO: 750139 - DNA, 25 bp, Mus musculus
tagcaataacttgcggtccctgctc

SEQ ID NO: 750140 - DNA, 25 bp, Mus musculus
tagcaatagtggatggaacactctc

SEQ ID NO: 750141 - DNA, 25 bp, Mus musculus
tagcaatagtggttggaacactctc

SEQ ID NO: 750142 - DNA, 25 bp, Mus musculus
tagcaatgccatcaaagagcaactg

SEQ ID NO: 750143 - DNA, 25 bp, Mus musculus
tagcaatgccatgaaagagcaactg

SEQ ID NO: 750144 - DNA, 25 bp, Mus musculus
tagcaatgcttgaacttacaggaca

SEQ ID NO: 750145 - DNA, 25 bp, Mus musculus
tagcaatgcttgtacttacaggaca

SEQ ID NO: 750146 - DNA, 25 bp, Mus musculus
tagcaatggccacaggtttcgggac

SEQ ID NO: 750147 - DNA, 25 bp, Mus musculus
tagcaatggccagaggtttcgggac

SEQ ID NO: 750148 - DNA, 25 bp, Mus musculus
tagcaatggtagaataagcccacct

SEQ ID NO: 750149 - DNA, 25 bp, Mus musculus
tagcaatggtagtataagcccacct

SEQ ID NO: 750150 - DNA, 25 bp, Mus musculus
tagcaatggtttcaactccaaagga

SEQ ID NO: 750151 - DNA, 25 bp, Mus musculus
tagcaatggtttgaactccaaagga

SEQ ID NO: 750152 - DNA, 25 bp, Mus musculus
tagcaatgtttacagaccagcctgc

SEQ ID NO: 750153 - DNA, 25 bp, Mus musculus
tagcaatgtttagagaccagcctgc

SEQ ID NO: 750154 - DNA, 25 bp, Mus musculus
tagcacaaactacgacaacaggatg

SEQ ID NO: 750155 - DNA, 25 bp, Mus musculus
tagcacaaactaggacaacaggatg

SEQ ID NO: 750156 - DNA, 25 bp, Mus musculus
tagcacaataaaccagggactcctt

SEQ ID NO: 750157 - DNA, 25 bp, Mus musculus
tagcacaataaagcagggactcctt

SEQ ID NO: 750158 - DNA, 25 bp, Mus musculus
tagcacagagcaaagaggacaagga

SEQ ID NO: 750159 - DNA, 25 bp, Mus musculus
tagcacagagcatagaggacaagga

SEQ ID NO: 750160 - DNA, 25 bp, Mus musculus
tagcacaggacactttaatgacagc

SEQ ID NO: 750161 - DNA, 25 bp, Mus musculus
tagcacaggacagtttaatgacagc

SEQ ID NO: 750162 - DNA, 25 bp, Mus musculus
tagcacagggctatgaacaaacttc

SEQ ID NO: 750163 - DNA, 25 bp, Mus musculus
tagcacagggctttgaacaaacttc

SEQ ID NO: 750164 - DNA, 25 bp, Mus musculus
tagcacatctgcagggtgaacagga

SEQ ID NO: 750165 - DNA, 25 bp, Mus musculus
tagcacatctgctgggtgaacagga

SEQ ID NO: 750166 - DNA, 25 bp, Mus musculus
tagcacatggctatcctacatcttt

SEQ ID NO: 750167 - DNA, 25 bp, Mus musculus
tagcacatggctttcctacatcttt

SEQ ID NO: 750168 - DNA, 25 bp, Mus musculus
tagcaccatgagagccgccatgaag

SEQ ID NO: 750169 - DNA, 25 bp, Mus musculus
tagcaccatgagtgccgccatgaag

SEQ ID NO: 750170 - DNA, 25 bp, Mus musculus
tagcaccgactaaggactcacagca

SEQ ID NO: 750171 - DNA, 25 bp, Mus musculus
tagcaccgactatggactcacagca

SEQ ID NO: 750172 - DNA, 25 bp, Mus musculus
tagcacctcctcatttatcattgag

SEQ ID NO: 750173 - DNA, 25 bp, Mus musculus
tagcacctcctcttttatcattgag

SEQ ID NO: 750174 - DNA, 25 bp, Mus musculus
tagcacctcttaacaagtcgctgtc

SEQ ID NO: 750175 - DNA, 25 bp, Mus musculus
tagcacctcttatcaagtcgctgtc

SEQ ID NO: 750176 - DNA, 25 bp, Mus musculus
tagcacctgagaatgtcaaccagag

SEQ ID NO: 750177 - DNA, 25 bp, Mus musculus
tagcacctgagattgtcaaccagag

SEQ ID NO: 750178 - DNA, 25 bp, Mus musculus
tagcacctgtgaaggtccaagtctg

SEQ ID NO: 750179 - DNA, 25 bp, Mus musculus
tagcacctgtgatggtccaagtctg

SEQ ID NO: 750180 - DNA, 25 bp, Mus musculus
tagcacgcagggacatcatgcccta

SEQ ID NO: 750181 - DNA, 25 bp, Mus musculus
tagcacgcagggtcatcatgcccta

SEQ ID NO: 750182 - DNA, 25 bp, Mus musculus
tagcacggcttgaaataaggcagac

SEQ ID NO: 750183 - DNA, 25 bp, Mus musculus
tagcacggcttgtaataaggcagac

SEQ ID NO: 750184 - DNA, 25 bp, Mus musculus
tagcacgggactacgcctatgtctg

SEQ ID NO: 750185 - DNA, 25 bp, Mus musculus
tagcacgggacttcgcctatgtctg

SEQ ID NO: 750186 - DNA, 25 bp, Mus musculus
tagcacgtgtagcaagagcagcttt

SEQ ID NO: 750187 - DNA, 25 bp, Mus musculus
tagcacgtgtaggaagagcagcttt

SEQ ID NO: 750188 - DNA, 25 bp, Mus musculus
tagcactaaaatccaaccctgtata

SEQ ID NO: 750189 - DNA, 25 bp, Mus musculus
tagcactaaaatgcaaccctgtata

SEQ ID NO: 750190 - DNA, 25 bp, Mus musculus
tagcactacaccctgtgaagggacc

SEQ ID NO: 750191 - DNA, 25 bp, Mus musculus
tagcactacaccgtgtgaagggacc

SEQ ID NO: 750192 - DNA, 25 bp, Mus musculus
tagcactaccctacgtcttgggaaa

SEQ ID NO: 750193 - DNA, 25 bp, Mus musculus
tagcactacccttcgtcttgggaaa

SEQ ID NO: 750194 - DNA, 25 bp, Mus musculus
tagcactctgagacaggacccacgg

SEQ ID NO: 750195 - DNA, 25 bp, Mus musculus
tagcactctgagtcaggacccacgg

SEQ ID NO: 750196 - DNA, 25 bp, Mus musculus
tagcactctgctctgttcattccac

SEQ ID NO: 750197 - DNA, 25 bp, Mus musculus
tagcactctgctgtgttcattccac

SEQ ID NO: 750198 - DNA, 25 bp, Mus musculus
tagcactcttccctgttcctggaga

SEQ ID NO: 750199 - DNA, 25 bp, Mus musculus
tagcactcttccgtgttcctggaga

SEQ ID NO: 750200 - DNA, 25 bp, Mus musculus
tagcactgcaccaagtgaagatacg

SEQ ID NO: 750201 - DNA, 25 bp, Mus musculus
tagcactgcacctagtgaagatacg

SEQ ID NO: 750202 - DNA, 25 bp, Mus musculus
tagcactgtaataaaactatcacgt

SEQ ID NO: 750203 - DNA, 25 bp, Mus musculus
tagcactgtaattaaactatcacgt

SEQ ID NO: 750204 - DNA, 25 bp, Mus musculus
tagcagaaccgcagagttctgagcc

SEQ ID NO: 750205 - DNA, 25 bp, Mus musculus
tagcagaaccgctgagttctgagcc

SEQ ID NO: 750206 - DNA, 25 bp, Mus musculus
tagcagaacgagaggatgagctgtc

SEQ ID NO: 750207 - DNA, 25 bp, Mus musculus
tagcagaacgagtggatgagctgtc

SEQ ID NO: 750208 - DNA, 25 bp, Mus musculus
tagcagaagcccatgctaaagtaag

SEQ ID NO: 750209 - DNA, 25 bp, Mus musculus
tagcagaagcccttgctaaagtaag

SEQ ID NO: 750210 - DNA, 25 bp, Mus musculus
tagcagaagctcatgttaactacaa

SEQ ID NO: 750211 - DNA, 25 bp, Mus musculus
tagcagaagctcttgttaactacaa

SEQ ID NO: 750212 - DNA, 25 bp, Mus musculus
tagcagaagttgagcaaaaggatcc

SEQ ID NO: 750213 - DNA, 25 bp, Mus musculus
tagcagaagttgtgcaaaaggatcc

SEQ ID NO: 750214 - DNA, 25 bp, Mus musculus
tagcagagaaccaccggttagtgac

SEQ ID NO: 750215 - DNA, 25 bp, Mus musculus
tagcagagaacctccggttagtgac

SEQ ID NO: 750216 - DNA, 25 bp, Mus musculus
tagcagagatccacggtgtgcctcg

SEQ ID NO: 750217 - DNA, 25 bp, Mus musculus
tagcagagatcccaggcaatgtact

SEQ ID NO: 750218 - DNA, 25 bp, Mus musculus
tagcagagatccgaggcaatgtact

SEQ ID NO: 750219 - DNA, 25 bp, Mus musculus
tagcagagatcctcggtgtgcctcg

SEQ ID NO: 750220 - DNA, 25 bp, Mus musculus
tagcagagcccacagagactggcaa

SEQ ID NO: 750221 - DNA, 25 bp, Mus musculus
tagcagagcccagagagactggcaa

SEQ ID NO: 750222 - DNA, 25 bp, Mus musculus
tagcagagcggcaactggactacag

SEQ ID NO: 750223 - DNA, 25 bp, Mus musculus
tagcagagcggctactggactacag

SEQ ID NO: 750224 - DNA, 25 bp, Mus musculus
tagcagagttgcagaggcccattgg

SEQ ID NO: 750225 - DNA, 25 bp, Mus musculus
tagcagagttgctgaggcccattgg

SEQ ID NO: 750226 - DNA, 25 bp, Mus musculus
tagcagatcaggacctactgccacc

SEQ ID NO: 750227 - DNA, 25 bp, Mus musculus
tagcagatcaggtcctactgccacc

SEQ ID NO: 750228 - DNA, 25 bp, Mus musculus
tagcagatgctacccacattctggt

SEQ ID NO: 750229 - DNA, 25 bp, Mus musculus
tagcagatgctagccacattctggt

SEQ ID NO: 750230 - DNA, 25 bp, Mus musculus
tagcagcaaacacaacgccacattt

SEQ ID NO: 750231 - DNA, 25 bp, Mus musculus
tagcagcaaacagaacgccacattt

SEQ ID NO: 750232 - DNA, 25 bp, Mus musculus
tagcagcaaggaaatgatactacac

SEQ ID NO: 750233 - DNA, 25 bp, Mus musculus
tagcagcaaggatatgatactacac

SEQ ID NO: 750234 - DNA, 25 bp, Mus musculus
tagcagcactgcatattgaaagagg

SEQ ID NO: 750235 - DNA, 25 bp, Mus musculus
tagcagcactgcttattgaaagagg

SEQ ID NO: 750236 - DNA, 25 bp, Mus musculus
tagcagcagacaaaggccactacaa

SEQ ID NO: 750237 - DNA, 25 bp, Mus musculus
tagcagcagacataggccactacaa

SEQ ID NO: 750238 - DNA, 25 bp, Mus musculus
tagcagcagcgtaggcaaaatgaac

SEQ ID NO: 750239 - DNA, 25 bp, Mus musculus
tagcagcagcgttggcaaaatgaac

SEQ ID NO: 750240 - DNA, 25 bp, Mus musculus
tagcagcaggcacgatctgtcacat

SEQ ID NO: 750241 - DNA, 25 bp, Mus musculus
tagcagcaggcaggatctgtcacat

SEQ ID NO: 750242 - DNA, 25 bp, Mus musculus
tagcagcagtagcaactcaggatgg

SEQ ID NO: 750243 - DNA, 25 bp, Mus musculus
tagcagcagtaggaactcaggatgg

SEQ ID NO: 750244 - DNA, 25 bp, Mus musculus
tagcagcatctcactatcctgagaa

SEQ ID NO: 750245 - DNA, 25 bp, Mus musculus
tagcagcatctctctatcctgagaa

SEQ ID NO: 750246 - DNA, 25 bp, Mus musculus
tagcagccaccaatacaagtcattc

SEQ ID NO: 750247 - DNA, 25 bp, Mus musculus
tagcagccaccattacaagtcattc

SEQ ID NO: 750248 - DNA, 25 bp, Mus musculus
tagcagccatgaatcccttggtagg

SEQ ID NO: 750249 - DNA, 25 bp, Mus musculus
tagcagccatgattcccttggtagg

SEQ ID NO: 750250 - DNA, 25 bp, Mus musculus
tagcagcccctcagggaatggttcg

SEQ ID NO: 750251 - DNA, 25 bp, Mus musculus
tagcagcccctctgggaatggttcg

SEQ ID NO: 750252 - DNA, 25 bp, Mus musculus
tagcagccctgccatgatcgtagat

SEQ ID NO: 750253 - DNA, 25 bp, Mus musculus
tagcagccctgcgatgatcgtagat

SEQ ID NO: 750254 - DNA, 25 bp, Mus musculus
tagcagccgccaaggaaatgtaact

SEQ ID NO: 750255 - DNA, 25 bp, Mus musculus
tagcagccgccatggaaatgtaact

SEQ ID NO: 750256 - DNA, 25 bp, Mus musculus
tagcagcctgtgctctgggtccctt

SEQ ID NO: 750257 - DNA, 25 bp, Mus musculus
tagcagcctgtggtctgggtccctt

SEQ ID NO: 750258 - DNA, 25 bp, Mus musculus
tagcagcgcctcctcactcgaagtg

SEQ ID NO: 750259 - DNA, 25 bp, Mus musculus
tagcagcgcctcgtcactcgaagtg

SEQ ID NO: 750260 - DNA, 25 bp, Mus musculus
tagcagctacaacataccagacgga

SEQ ID NO: 750261 - DNA, 25 bp, Mus musculus
tagcagctacaagataccagacgga

SEQ ID NO: 750262 - DNA, 25 bp, Mus musculus
tagcagctcaaacgagggaacctct

SEQ ID NO: 750263 - DNA, 25 bp, Mus musculus
tagcagctcaaaggagggaacctct

SEQ ID NO: 750264 - DNA, 25 bp, Mus musculus
tagcagctgctcctttgagaatgca

SEQ ID NO: 750265 - DNA, 25 bp, Mus musculus
tagcagctgctcgtttgagaatgca

SEQ ID NO: 750266 - DNA, 25 bp, Mus musculus
tagcagcttcataggtaagagggaa

SEQ ID NO: 750267 - DNA, 25 bp, Mus musculus
tagcagcttcattggtaagagggaa

SEQ ID NO: 750268 - DNA, 25 bp, Mus musculus
tagcagcttctaccagagcagggat

SEQ ID NO: 750269 - DNA, 25 bp, Mus musculus
tagcagcttctagcagagcagggat

SEQ ID NO: 750270 - DNA, 25 bp, Mus musculus
tagcagctttgacatgacatcaccc

SEQ ID NO: 750271 - DNA, 25 bp, Mus musculus
tagcagctttgagatgacatcaccc

SEQ ID NO: 750272 - DNA, 25 bp, Mus musculus
tagcaggacttgatgccgttctcca

SEQ ID NO: 750273 - DNA, 25 bp, Mus musculus
tagcaggacttgttgccgttctcca

SEQ ID NO: 750274 - DNA, 25 bp, Mus musculus
tagcaggactttactaggagagact

SEQ ID NO: 750275 - DNA, 25 bp, Mus musculus
tagcaggacttttctaggagagact

SEQ ID NO: 750276 - DNA, 25 bp, Mus musculus
tagcaggagcaacagatgtctattg

SEQ ID NO: 750277 - DNA, 25 bp, Mus musculus
tagcaggagcaagagatgtctattg

SEQ ID NO: 750278 - DNA, 25 bp, Mus musculus
tagcaggcagctacttaccagtggt

SEQ ID NO: 750279 - DNA, 25 bp, Mus musculus
tagcaggcagcttcttaccagtggt

SEQ ID NO: 750280 - DNA, 25 bp, Mus musculus
tagcaggccttgatatcaacaagac

SEQ ID NO: 750281 - DNA, 25 bp, Mus musculus
tagcaggccttgttatcaacaagac

SEQ ID NO: 750282 - DNA, 25 bp, Mus musculus
tagcaggcgtagagtattcattacg

SEQ ID NO: 750283 - DNA, 25 bp, Mus musculus
tagcaggcgtagtgtattcattacg

SEQ ID NO: 750284 - DNA, 25 bp, Mus musculus
tagcaggctcacctgcacagtgtgg

SEQ ID NO: 750285 - DNA, 25 bp, Mus musculus
tagcaggctcacgtgcacagtgtgg

SEQ ID NO: 750286 - DNA, 25 bp, Mus musculus
tagcaggctgtaactgagacagaca

SEQ ID NO: 750287 - DNA, 25 bp, Mus musculus
tagcaggctgtatctgagacagaca

SEQ ID NO: 750288 - DNA, 25 bp, Mus musculus
tagcagggagccagataccttgtgc

SEQ ID NO: 750289 - DNA, 25 bp, Mus musculus
tagcagggagcctgataccttgtgc

SEQ ID NO: 750290 - DNA, 25 bp, Mus musculus
tagcagggtagcaagatgtagcaca

SEQ ID NO: 750291 - DNA, 25 bp, Mus musculus
tagcagggtagctagatgtagcaca

SEQ ID NO: 750292 - DNA, 25 bp, Mus musculus
tagcagggttcaatatacaatttcc

SEQ ID NO: 750293 - DNA, 25 bp, Mus musculus
tagcagggttcattatacaatttcc

SEQ ID NO: 750294 - DNA, 25 bp, Mus musculus
tagcaggtaaatcagaagcgaagga

SEQ ID NO: 750295 - DNA, 25 bp, Mus musculus
tagcaggtaaatgagaagcgaagga

SEQ ID NO: 750296 - DNA, 25 bp, Mus musculus
tagcaggtacctattacacacagag

SEQ ID NO: 750297 - DNA, 25 bp, Mus musculus
tagcaggtaccttttacacacagag

SEQ ID NO: 750298 - DNA, 25 bp, Mus musculus
tagcaggtctgtaacttctttggga

SEQ ID NO: 750299 - DNA, 25 bp, Mus musculus
tagcaggtctgttacttctttggga

SEQ ID NO: 750300 - DNA, 25 bp, Mus musculus
tagcaggtgtgacaggctttctacc

SEQ ID NO: 750301 - DNA, 25 bp, Mus musculus
tagcaggtgtgagaggctttctacc

SEQ ID NO: 750302 - DNA, 25 bp, Mus musculus
tagcaggtgttcaagtcctgtggcc

SEQ ID NO: 750303 - DNA, 25 bp, Mus musculus
tagcaggtgttctagtcctgtggcc

SEQ ID NO: 750304 - DNA, 25 bp, Mus musculus
tagcagtaccccattgcacctaatg

SEQ ID NO: 750305 - DNA, 25 bp, Mus musculus
tagcagtacccctttgcacctaatg

SEQ ID NO: 750306 - DNA, 25 bp, Mus musculus
tagcagtcaaaacaaggatacgagc

SEQ ID NO: 750307 - DNA, 25 bp, Mus musculus
tagcagtcaaaagaaggatacgagc

SEQ ID NO: 750308 - DNA, 25 bp, Mus musculus
tagcagtcaaatctacttgttactc

SEQ ID NO: 750309 - DNA, 25 bp, Mus musculus
tagcagtcaaatgtacttgttactc

SEQ ID NO: 750310 - DNA, 25 bp, Mus musculus
tagcagtcattgcatgtatttcctg

SEQ ID NO: 750311 - DNA, 25 bp, Mus musculus
tagcagtcattggatgtatttcctg

SEQ ID NO: 750312 - DNA, 25 bp, Mus musculus
tagcagtcccataggctcacagcag

SEQ ID NO: 750313 - DNA, 25 bp, Mus musculus
tagcagtcccattggctcacagcag

SEQ ID NO: 750314 - DNA, 25 bp, Mus musculus
tagcagtctctacgaagtgtgggca

SEQ ID NO: 750315 - DNA, 25 bp, Mus musculus
tagcagtctctaggaagtgtgggca

SEQ ID NO: 750316 - DNA, 25 bp, Mus musculus
tagcagtgaaccatcacagcgtcat

SEQ ID NO: 750317 - DNA, 25 bp, Mus musculus
tagcagtgaaccttcacagcgtcat

SEQ ID NO: 750318 - DNA, 25 bp, Mus musculus
tagcagtgccttcagatgtatccca

SEQ ID NO: 750319 - DNA, 25 bp, Mus musculus
tagcagtgccttgagatgtatccca

SEQ ID NO: 750320 - DNA, 25 bp, Mus musculus
tagcagtggcacagtcctctcagat

SEQ ID NO: 750321 - DNA, 25 bp, Mus musculus
tagcagtggcactgtcctctcagat

SEQ ID NO: 750322 - DNA, 25 bp, Mus musculus
tagcagtggcctcctctggatgtaa

SEQ ID NO: 750323 - DNA, 25 bp, Mus musculus
tagcagtggcctgctctggatgtaa

SEQ ID NO: 750324 - DNA, 25 bp, Mus musculus
tagcagtgggccaggtcagcattcg

SEQ ID NO: 750325 - DNA, 25 bp, Mus musculus
tagcagtgggcctggtcagcattcg

SEQ ID NO: 750326 - DNA, 25 bp, Mus musculus
tagcagtgtaacctcagtggagtgc

SEQ ID NO: 750327 - DNA, 25 bp, Mus musculus
tagcagtgtaacgtcagtggagtgc

SEQ ID NO: 750328 - DNA, 25 bp, Mus musculus
tagcagtgtcttccaatggctcttc

SEQ ID NO: 750329 - DNA, 25 bp, Mus musculus
tagcagtgtcttgcaatggctcttc

SEQ ID NO: 750330 - DNA, 25 bp, Mus musculus
tagcagtgtgataaccagcggtatt

SEQ ID NO: 750331 - DNA, 25 bp, Mus musculus
tagcagtgtgattaccagcggtatt

SEQ ID NO: 750332 - DNA, 25 bp, Mus musculus
tagcagtgtgtacatacacaccccg

SEQ ID NO: 750333 - DNA, 25 bp, Mus musculus
tagcagtgtgtagatacacaccccg

SEQ ID NO: 750334 - DNA, 25 bp, Mus musculus
tagcagttaagtattatgaccccac

SEQ ID NO: 750335 - DNA, 25 bp, Mus musculus
tagcagttaagttttatgaccccac

SEQ ID NO: 750336 - DNA, 25 bp, Mus musculus
tagcagttctatactgcttcctgaa

SEQ ID NO: 750337 - DNA, 25 bp, Mus musculus
tagcagttctattctgcttcctgaa

SEQ ID NO: 750338 - DNA, 25 bp, Mus musculus
tagcagttgtacaaggagccaggcc

SEQ ID NO: 750339 - DNA, 25 bp, Mus musculus
tagcagttgtactaggagccaggcc

SEQ ID NO: 750340 - DNA, 25 bp, Mus musculus
tagcagttgtggaacccgacgttga

SEQ ID NO: 750341 - DNA, 25 bp, Mus musculus
tagcagttgtggtacccgacgttga

SEQ ID NO: 750342 - DNA, 25 bp, Mus musculus
tagcagtttccaaaatgggagatcc

SEQ ID NO: 750343 - DNA, 25 bp, Mus musculus
tagcagtttccataatgggagatcc

SEQ ID NO: 750344 - DNA, 25 bp, Mus musculus
tagcataaacataaggaggcagtcc

SEQ ID NO: 750345 - DNA, 25 bp, Mus musculus
tagcataaacattaggaggcagtcc

SEQ ID NO: 750346 - DNA, 25 bp, Mus musculus
tagcatagacttacttgactattta

SEQ ID NO: 750347 - DNA, 25 bp, Mus musculus
tagcatagactttcttgactattta

SEQ ID NO: 750348 - DNA, 25 bp, Mus musculus
tagcatagatgacctttggaatgaa

SEQ ID NO: 750349 - DNA, 25 bp, Mus musculus
tagcatagatgagctttggaatgaa

SEQ ID NO: 750350 - DNA, 25 bp, Mus musculus
tagcatagcttgagtgggacactgg

SEQ ID NO: 750351 - DNA, 25 bp, Mus musculus
tagcatagcttgtgtgggacactgg

SEQ ID NO: 750352 - DNA, 25 bp, Mus musculus
tagcatatagcccttggttgcaggt

SEQ ID NO: 750353 - DNA, 25 bp, Mus musculus
tagcatatagccgttggttgcaggt

SEQ ID NO: 750354 - DNA, 25 bp, Mus musculus
tagcatcaacacactcaccagcatg

SEQ ID NO: 750355 - DNA, 25 bp, Mus musculus
tagcatcaacactctcaccagcatg

SEQ ID NO: 750356 - DNA, 25 bp, Mus musculus
tagcatcagaaacctgcgtggtggc

SEQ ID NO: 750357 - DNA, 25 bp, Mus musculus
tagcatcagaaagctgcgtggtggc

SEQ ID NO: 750358 - DNA, 25 bp, Mus musculus
tagcatccaatgctcctggtcgccg

SEQ ID NO: 750359 - DNA, 25 bp, Mus musculus
tagcatccaatggtcctggtcgccg

SEQ ID NO: 750360 - DNA, 25 bp, Mus musculus
tagcatccccttcttctgacagagg

SEQ ID NO: 750361 - DNA, 25 bp, Mus musculus
tagcatccccttgttctgacagagg

SEQ ID NO: 750362 - DNA, 25 bp, Mus musculus
tagcatcggcctagcacgagagagg

SEQ ID NO: 750363 - DNA, 25 bp, Mus musculus
tagcatcggccttgcacgagagagg

SEQ ID NO: 750364 - DNA, 25 bp, Mus musculus
tagcatctattcattccactgtgag

SEQ ID NO: 750365 - DNA, 25 bp, Mus musculus
tagcatctattctttccactgtgag

SEQ ID NO: 750366 - DNA, 25 bp, Mus musculus
tagcatctcagaagataacggaagg

SEQ ID NO: 750367 - DNA, 25 bp, Mus musculus
tagcatctcagatgataacggaagg

SEQ ID NO: 750368 - DNA, 25 bp, Mus musculus
tagcatctcaggatcatgccgctgc

SEQ ID NO: 750369 - DNA, 25 bp, Mus musculus
tagcatctcaggttcatgccgctgc

SEQ ID NO: 750370 - DNA, 25 bp, Mus musculus
tagcatctccaactcctgtggaggg

SEQ ID NO: 750371 - DNA, 25 bp, Mus musculus
tagcatctccaagtcctgtggaggg

SEQ ID NO: 750372 - DNA, 25 bp, Mus musculus
tagcatctcctcacggagtggctct

SEQ ID NO: 750373 - DNA, 25 bp, Mus musculus
tagcatctcctctcggagtggctct

SEQ ID NO: 750374 - DNA, 25 bp, Mus musculus
tagcatctgctgattccaaatggag

SEQ ID NO: 750375 - DNA, 25 bp, Mus musculus
tagcatctgctgtttccaaatggag

SEQ ID NO: 750376 - DNA, 25 bp, Mus musculus
tagcatctgggaaggtataaaagcc

SEQ ID NO: 750377 - DNA, 25 bp, Mus musculus
tagcatctgggatggtataaaagcc

SEQ ID NO: 750378 - DNA, 25 bp, Mus musculus
tagcatctgttacgtcatatcttgt

SEQ ID NO: 750379 - DNA, 25 bp, Mus musculus
tagcatctgttaggtcatatcttgt

SEQ ID NO: 750380 - DNA, 25 bp, Mus musculus
tagcatgaaatccacatctccacct

SEQ ID NO: 750381 - DNA, 25 bp, Mus musculus
tagcatgaaatcgacatctccacct

SEQ ID NO: 750382 - DNA, 25 bp, Mus musculus
tagcatgaacaacggcagctgtgag

SEQ ID NO: 750383 - DNA, 25 bp, Mus musculus
tagcatgaacaagggcagctgtgag

SEQ ID NO: 750384 - DNA, 25 bp, Mus musculus
tagcatgaccgacatctgatcagcc

SEQ ID NO: 750385 - DNA, 25 bp, Mus musculus
tagcatgaccgagatctgatcagcc

SEQ ID NO: 750386 - DNA, 25 bp, Mus musculus
tagcatgccaccactcacagctgtt

SEQ ID NO: 750387 - DNA, 25 bp, Mus musculus
tagcatgccacctctcacagctgtt

SEQ ID NO: 750388 - DNA, 25 bp, Mus musculus
tagcatgccatcataattatcagtg

SEQ ID NO: 750389 - DNA, 25 bp, Mus musculus
tagcatgccatcttaattatcagtg

SEQ ID NO: 750390 - DNA, 25 bp, Mus musculus
tagcatggtacaatactgtgaaaac

SEQ ID NO: 750391 - DNA, 25 bp, Mus musculus
tagcatggtacattactgtgaaaac

SEQ ID NO: 750392 - DNA, 25 bp, Mus musculus
tagcatgtgagaactgcgagcagat

SEQ ID NO: 750393 - DNA, 25 bp, Mus musculus
tagcatgtgagatctgcgagcagat

SEQ ID NO: 750394 - DNA, 25 bp, Mus musculus
tagcattagaccagagtgacccaga

SEQ ID NO: 750395 - DNA, 25 bp, Mus musculus
tagcattagacctgagtgacccaga

SEQ ID NO: 750396 - DNA, 25 bp, Mus musculus
tagcattataacaacagctcttcta

SEQ ID NO: 750397 - DNA, 25 bp, Mus musculus
tagcattataactacagctcttcta

SEQ ID NO: 750398 - DNA, 25 bp, Mus musculus
tagcattcaaagaggccacggccaa

SEQ ID NO: 750399 - DNA, 25 bp, Mus musculus
tagcattcaaagtggccacggccaa

SEQ ID NO: 750400 - DNA, 25 bp, Mus musculus
tagcattcaggcctttgagttggga

SEQ ID NO: 750401 - DNA, 25 bp, Mus musculus
tagcattcaggcgtttgagttggga

SEQ ID NO: 750402 - DNA, 25 bp, Mus musculus
tagcattgatgaaaacgaactgaac

SEQ ID NO: 750403 - DNA, 25 bp, Mus musculus
tagcattgatgataacgaactgaac

SEQ ID NO: 750404 - DNA, 25 bp, Mus musculus
tagccaaaaggcatagttctcttaa

SEQ ID NO: 750405 - DNA, 25 bp, Mus musculus
tagccaaaaggcttagttctcttaa

SEQ ID NO: 750406 - DNA, 25 bp, Mus musculus
tagccaaaaggtcgtcgtcaccacg

SEQ ID NO: 750407 - DNA, 25 bp, Mus musculus
tagccaaaaggtggtcgtcaccacg

SEQ ID NO: 750408 - DNA, 25 bp, Mus musculus
tagccaaactgcatgggcaggctca

SEQ ID NO: 750409 - DNA, 25 bp, Mus musculus
tagccaaactgcttgggcaggctca

SEQ ID NO: 750410 - DNA, 25 bp, Mus musculus
tagccaaagattacaaagatataac

SEQ ID NO: 750411 - DNA, 25 bp, Mus musculus
tagccaaagatttcaaagatataac

SEQ ID NO: 750412 - DNA, 25 bp, Mus musculus
tagccaaaggtaacgctgcttgctg

SEQ ID NO: 750413 - DNA, 25 bp, Mus musculus
tagccaaaggtatcgctgcttgctg

SEQ ID NO: 750414 - DNA, 25 bp, Mus musculus
tagccaaagtggattcttccaatgg

SEQ ID NO: 750415 - DNA, 25 bp, Mus musculus
tagccaaagtggtttcttccaatgg

SEQ ID NO: 750416 - DNA, 25 bp, Mus musculus
tagccaaccattactgtagtgactt

SEQ ID NO: 750417 - DNA, 25 bp, Mus musculus
tagccaaccatttctgtagtgactt

SEQ ID NO: 750418 - DNA, 25 bp, Mus musculus
tagccaacgtccattgaccccaaat

SEQ ID NO: 750419 - DNA, 25 bp, Mus musculus
tagccaacgtcctttgaccccaaat

SEQ ID NO: 750420 - DNA, 25 bp, Mus musculus
tagccaacgtgcagtttgcccggga

SEQ ID NO: 750421 - DNA, 25 bp, Mus musculus
tagccaacgtgctgtttgcccggga

SEQ ID NO: 750422 - DNA, 25 bp, Mus musculus
tagccaactcccacttcatcgagga

SEQ ID NO: 750423 - DNA, 25 bp, Mus musculus
tagccaactccctcttcatcgagga

SEQ ID NO: 750424 - DNA, 25 bp, Mus musculus
tagccaagagagacagaggacactg

SEQ ID NO: 750425 - DNA, 25 bp, Mus musculus
tagccaagagagtcagaggacactg

SEQ ID NO: 750426 - DNA, 25 bp, Mus musculus
tagccaagggcacatcgagtttctt

SEQ ID NO: 750427 - DNA, 25 bp, Mus musculus
tagccaagggcagatcgagtttctt

SEQ ID NO: 750428 - DNA, 25 bp, Mus musculus
tagccaagtatgcacccagcggatt

SEQ ID NO: 750429 - DNA, 25 bp, Mus musculus
tagccaagtatggacccagcggatt

SEQ ID NO: 750430 - DNA, 25 bp, Mus musculus
tagccaagtctcacatcaaatcctg

SEQ ID NO: 750431 - DNA, 25 bp, Mus musculus
tagccaagtctctcatcaaatcctg

SEQ ID NO: 750432 - DNA, 25 bp, Mus musculus
tagccaagtttaacggttctccacc

SEQ ID NO: 750433 - DNA, 25 bp, Mus musculus
tagccaagtttatcggttctccacc

SEQ ID NO: 750434 - DNA, 25 bp, Mus musculus
tagccaatatgactgtgtgcccaga

SEQ ID NO: 750435 - DNA, 25 bp, Mus musculus
tagccaatatgagtgtgtgcccaga

SEQ ID NO: 750436 - DNA, 25 bp, Mus musculus
tagccaatccttccgagtacaatgg

SEQ ID NO: 750437 - DNA, 25 bp, Mus musculus
tagccaatccttgcgagtacaatgg

SEQ ID NO: 750438 - DNA, 25 bp, Mus musculus
tagccaatgagactgcacctcccaa

SEQ ID NO: 750439 - DNA, 25 bp, Mus musculus
tagccaatgagagtgcacctcccaa

SEQ ID NO: 750440 - DNA, 25 bp, Mus musculus
tagccaatgcaaacgtgggtgtgtg

SEQ ID NO: 750441 - DNA, 25 bp, Mus musculus
tagccaatgcaatcgtgggtgtgtg

SEQ ID NO: 750442 - DNA, 25 bp, Mus musculus
tagccacaagatactcaaatgagtc

SEQ ID NO: 750443 - DNA, 25 bp, Mus musculus
tagccacaagattctcaaatgagtc

SEQ ID NO: 750444 - DNA, 25 bp, Mus musculus
tagccacaagggatcaggctccata

SEQ ID NO: 750445 - DNA, 25 bp, Mus musculus
tagccacaagggttcaggctccata

SEQ ID NO: 750446 - DNA, 25 bp, Mus musculus
tagccacaatgactgttagattctc

SEQ ID NO: 750447 - DNA, 25 bp, Mus musculus
tagccacaatgagtgttagattctc

SEQ ID NO: 750448 - DNA, 25 bp, Mus musculus
tagccacacacccaaaggcatgagg

SEQ ID NO: 750449 - DNA, 25 bp, Mus musculus
tagccacacaccgaaaggcatgagg

SEQ ID NO: 750450 - DNA, 25 bp, Mus musculus
tagccaccaggcagtgtacggacat

SEQ ID NO: 750451 - DNA, 25 bp, Mus musculus
tagccaccaggctgtgtacggacat

SEQ ID NO: 750452 - DNA, 25 bp, Mus musculus
tagccaccatttacaaagccgtcgg

SEQ ID NO: 750453 - DNA, 25 bp, Mus musculus
tagccaccattttcaaagccgtcgg

SEQ ID NO: 750454 - DNA, 25 bp, Mus musculus
tagccaccctcacgtttatcctgtt

SEQ ID NO: 750455 - DNA, 25 bp, Mus musculus
tagccaccctcaggtttatcctgtt

SEQ ID NO: 750456 - DNA, 25 bp, Mus musculus
tagccaccctggatatggctgctgg

SEQ ID NO: 750457 - DNA, 25 bp, Mus musculus
tagccaccctggttatggctgctgg

SEQ ID NO: 750458 - DNA, 25 bp, Mus musculus
tagccacctgttcctacagacacgg

SEQ ID NO: 750459 - DNA, 25 bp, Mus musculus
tagccacctgttgctacagacacgg

SEQ ID NO: 750460 - DNA, 25 bp, Mus musculus
tagccaccttcgatctgcagagtcc

SEQ ID NO: 750461 - DNA, 25 bp, Mus musculus
tagccaccttcgttctgcagagtcc

SEQ ID NO: 750462 - DNA, 25 bp, Mus musculus
tagccacggcctacatcttagtggt

SEQ ID NO: 750463 - DNA, 25 bp, Mus musculus
tagccacggccttcatcttagtggt

SEQ ID NO: 750464 - DNA, 25 bp, Mus musculus
tagccacgggcaagtttcagttctg

SEQ ID NO: 750465 - DNA, 25 bp, Mus musculus
tagccacgggcatgtttcagttctg

SEQ ID NO: 750466 - DNA, 25 bp, Mus musculus
tagccacgtctactaagatactgag

SEQ ID NO: 750467 - DNA, 25 bp, Mus musculus
tagccacgtctagtaagatactgag

SEQ ID NO: 750468 - DNA, 25 bp, Mus musculus
tagccactcttcatgtagtgggcca

SEQ ID NO: 750469 - DNA, 25 bp, Mus musculus
tagccactcttcttgtagtgggcca

SEQ ID NO: 750470 - DNA, 25 bp, Mus musculus
tagccactgagtataggatacaccc

SEQ ID NO: 750471 - DNA, 25 bp, Mus musculus
tagccactgagtttaggatacaccc

SEQ ID NO: 750472 - DNA, 25 bp, Mus musculus
tagccactgctgatacagatgagga

SEQ ID NO: 750473 - DNA, 25 bp, Mus musculus
tagccactgctgttacagatgagga

SEQ ID NO: 750474 - DNA, 25 bp, Mus musculus
tagccactggtcatctcttccagga

SEQ ID NO: 750475 - DNA, 25 bp, Mus musculus
tagccactggtcttctcttccagga

SEQ ID NO: 750476 - DNA, 25 bp, Mus musculus
tagccactgtttctcacagcgcagt

SEQ ID NO: 750477 - DNA, 25 bp, Mus musculus
tagccactgtttgtcacagcgcagt

SEQ ID NO: 750478 - DNA, 25 bp, Mus musculus
tagccacttctaaccaggtcctgaa

SEQ ID NO: 750479 - DNA, 25 bp, Mus musculus
tagccacttctatccaggtcctgaa

SEQ ID NO: 750480 - DNA, 25 bp, Mus musculus
tagccactttgtcctgaagccccag

SEQ ID NO: 750481 - DNA, 25 bp, Mus musculus
tagccactttgtgctgaagccccag

SEQ ID NO: 750482 - DNA, 25 bp, Mus musculus
tagccagaagagaaacccacagact

SEQ ID NO: 750483 - DNA, 25 bp, Mus musculus
tagccagaagagtaacccacagact

SEQ ID NO: 750484 - DNA, 25 bp, Mus musculus
tagccagaatccagactgtcttgag

SEQ ID NO: 750485 - DNA, 25 bp, Mus musculus
tagccagaatcctgactgtcttgag

SEQ ID NO: 750486 - DNA, 25 bp, Mus musculus
tagccagaccccctagaaggtgact

SEQ ID NO: 750487 - DNA, 25 bp, Mus musculus
tagccagaccccgtagaaggtgact

SEQ ID NO: 750488 - DNA, 25 bp, Mus musculus
tagccagagccccttatatgccagt

SEQ ID NO: 750489 - DNA, 25 bp, Mus musculus
tagccagagcccgttatatgccagt

SEQ ID NO: 750490 - DNA, 25 bp, Mus musculus
tagccagatggcagtgcacaagctg

SEQ ID NO: 750491 - DNA, 25 bp, Mus musculus
tagccagatggctgtgcacaagctg

SEQ ID NO: 750492 - DNA, 25 bp, Mus musculus
tagccagattggaccttgtaaaaac

SEQ ID NO: 750493 - DNA, 25 bp, Mus musculus
tagccagattggtccttgtaaaaac

SEQ ID NO: 750494 - DNA, 25 bp, Mus musculus
tagccagcacacactgaggcaggaa

SEQ ID NO: 750495 - DNA, 25 bp, Mus musculus
tagccagcacactctgaggcaggaa

SEQ ID NO: 750496 - DNA, 25 bp, Mus musculus
tagccagccaggagtactgcaaggt

SEQ ID NO: 750497 - DNA, 25 bp, Mus musculus
tagccagccaggtgtactgcaaggt

SEQ ID NO: 750498 - DNA, 25 bp, Mus musculus
tagccagccgggattatcaccaggc

SEQ ID NO: 750499 - DNA, 25 bp, Mus musculus
tagccagccgggtttatcaccaggc

SEQ ID NO: 750500 - DNA, 25 bp, Mus musculus
tagccagctcccagtctttccttgg

SEQ ID NO: 750501 - DNA, 25 bp, Mus musculus
tagccagctccctgtctttccttgg

SEQ ID NO: 750502 - DNA, 25 bp, Mus musculus
tagccagctggacagtccaaatggc

SEQ ID NO: 750503 - DNA, 25 bp, Mus musculus
tagccagctggagagtccaaatggc

SEQ ID NO: 750504 - DNA, 25 bp, Mus musculus
tagccaggaaccacggcctacactg

SEQ ID NO: 750505 - DNA, 25 bp, Mus musculus
tagccaggaacctcggcctacactg

SEQ ID NO: 750506 - DNA, 25 bp, Mus musculus
tagccaggacagatcagagctgaga

SEQ ID NO: 750507 - DNA, 25 bp, Mus musculus
tagccaggacagttcagagctgaga

SEQ ID NO: 750508 - DNA, 25 bp, Mus musculus
tagccaggagtaacaggcttaatat

SEQ ID NO: 750509 - DNA, 25 bp, Mus musculus
tagccaggagtatcaggcttaatat

SEQ ID NO: 750510 - DNA, 25 bp, Mus musculus
tagccaggcagtatggtcacatgaa

SEQ ID NO: 750511 - DNA, 25 bp, Mus musculus
tagccaggcagtttggtcacatgaa

SEQ ID NO: 750512 - DNA, 25 bp, Mus musculus
tagccaggcctgcttgggcctcctt

SEQ ID NO: 750513 - DNA, 25 bp, Mus musculus
tagccaggcctggttgggcctcctt

SEQ ID NO: 750514 - DNA, 25 bp, Mus musculus
tagccagggtggatataagactaga

SEQ ID NO: 750515 - DNA, 25 bp, Mus musculus
tagccagggtggttataagactaga

SEQ ID NO: 750516 - DNA, 25 bp, Mus musculus
tagccagtccacaagtgtagcctag

SEQ ID NO: 750517 - DNA, 25 bp, Mus musculus
tagccagtccactagtgtagcctag

SEQ ID NO: 750518 - DNA, 25 bp, Mus musculus
tagccagtcgctcatatctctggac

SEQ ID NO: 750519 - DNA, 25 bp, Mus musculus
tagccagtcgctgatatctctggac

SEQ ID NO: 750520 - DNA, 25 bp, Mus musculus
tagccagtgatgagatcgcccagca

SEQ ID NO: 750521 - DNA, 25 bp, Mus musculus
tagccagtgatgtgatcgcccagca

SEQ ID NO: 750522 - DNA, 25 bp, Mus musculus
tagccagttcaccattgtgttggag

SEQ ID NO: 750523 - DNA, 25 bp, Mus musculus
tagccagttcacgattgtgttggag

SEQ ID NO: 750524 - DNA, 25 bp, Mus musculus
tagccatatctacagtgatcccgtg

SEQ ID NO: 750525 - DNA, 25 bp, Mus musculus
tagccatatctagagtgatcccgtg

SEQ ID NO: 750526 - DNA, 25 bp, Mus musculus
tagccatcacagctaaactcctgca

SEQ ID NO: 750527 - DNA, 25 bp, Mus musculus
tagccatcacaggtaaactcctgca

SEQ ID NO: 750528 - DNA, 25 bp, Mus musculus
tagccatccgaaccaagatagcaga

SEQ ID NO: 750529 - DNA, 25 bp, Mus musculus
tagccatccgaagcaagatagcaga

SEQ ID NO: 750530 - DNA, 25 bp, Mus musculus
tagccatccggtcgcgcaggtgtct

SEQ ID NO: 750531 - DNA, 25 bp, Mus musculus
tagccatccggtggcgcaggtgtct

SEQ ID NO: 750532 - DNA, 25 bp, Mus musculus
tagccatcctaaagtcccatgccaa

SEQ ID NO: 750533 - DNA, 25 bp, Mus musculus
tagccatcctaatgtcccatgccaa

SEQ ID NO: 750534 - DNA, 25 bp, Mus musculus
tagccatcgactctttagaatttca

SEQ ID NO: 750535 - DNA, 25 bp, Mus musculus
tagccatcgactgtttagaatttca

SEQ ID NO: 750536 - DNA, 25 bp, Mus musculus
tagccatcgaggaggaccccaggca

SEQ ID NO: 750537 - DNA, 25 bp, Mus musculus
tagccatcgaggtggaccccaggca

SEQ ID NO: 750538 - DNA, 25 bp, Mus musculus
tagccatgaagcatatcaaactgaa

SEQ ID NO: 750539 - DNA, 25 bp, Mus musculus
tagccatgaagcttatcaaactgaa

SEQ ID NO: 750540 - DNA, 25 bp, Mus musculus
tagccatgacacagctgctcggaag

SEQ ID NO: 750541 - DNA, 25 bp, Mus musculus
tagccatgacactgctgctcggaag

SEQ ID NO: 750542 - DNA, 25 bp, Mus musculus
tagccatgcagaatatgtgaccaga

SEQ ID NO: 750543 - DNA, 25 bp, Mus musculus
tagccatgcagattatgtgaccaga

SEQ ID NO: 750544 - DNA, 25 bp, Mus musculus
tagccatggagaagcctgctctgcc

SEQ ID NO: 750545 - DNA, 25 bp, Mus musculus
tagccatggagatgcctgctctgcc

SEQ ID NO: 750546 - DNA, 25 bp, Mus musculus
tagccatggcacctccgggaggaaa

SEQ ID NO: 750547 - DNA, 25 bp, Mus musculus
tagccatggcacgtccgggaggaaa

SEQ ID NO: 750548 - DNA, 25 bp, Mus musculus
tagccattacgacggtggccaacct

SEQ ID NO: 750549 - DNA, 25 bp, Mus musculus
tagccattacgagggtggccaacct

SEQ ID NO: 750550 - DNA, 25 bp, Mus musculus
tagccattcagaaaacggagacgcg

SEQ ID NO: 750551 - DNA, 25 bp, Mus musculus
tagccattcagataacggagacgcg

SEQ ID NO: 750552 - DNA, 25 bp, Mus musculus
tagccattgagcatctcgcggcctg

SEQ ID NO: 750553 - DNA, 25 bp, Mus musculus
tagccattgagcttctcgcggcctg

SEQ ID NO: 750554 - DNA, 25 bp, Mus musculus
tagccattgagtacaagtctgccaa

SEQ ID NO: 750555 - DNA, 25 bp, Mus musculus
tagccattgagttcaagtctgccaa

SEQ ID NO: 750556 - DNA, 25 bp, Mus musculus
tagccattgccactctgattagagt

SEQ ID NO: 750557 - DNA, 25 bp, Mus musculus
tagccattgccagtctgattagagt

SEQ ID NO: 750558 - DNA, 25 bp, Mus musculus
tagcccaaagtacagattctgggaa

SEQ ID NO: 750559 - DNA, 25 bp, Mus musculus
tagcccaaagtagagattctgggaa

SEQ ID NO: 750560 - DNA, 25 bp, Mus musculus
tagcccaaggagagtacatagcacc

SEQ ID NO: 750561 - DNA, 25 bp, Mus musculus
tagcccaaggagtgtacatagcacc

SEQ ID NO: 750562 - DNA, 25 bp, Mus musculus
tagcccacgcgccacgatggtgtgc

SEQ ID NO: 750563 - DNA, 25 bp, Mus musculus
tagcccacgcgcgacgatggtgtgc

SEQ ID NO: 750564 - DNA, 25 bp, Mus musculus
tagcccagaggcaatgctgcatctc

SEQ ID NO: 750565 - DNA, 25 bp, Mus musculus
tagcccagaggctatgctgcatctc

SEQ ID NO: 750566 - DNA, 25 bp, Mus musculus
tagcccaggctactccctaacttgg

SEQ ID NO: 750567 - DNA, 25 bp, Mus musculus
tagcccaggctagtccctaacttgg

SEQ ID NO: 750568 - DNA, 25 bp, Mus musculus
tagcccaggtctagaggtagtccag

SEQ ID NO: 750569 - DNA, 25 bp, Mus musculus
tagcccaggtcttgaggtagtccag

SEQ ID NO: 750570 - DNA, 25 bp, Mus musculus
tagcccagtataaacgggagtgccc

SEQ ID NO: 750571 - DNA, 25 bp, Mus musculus
tagcccagtatatacgggagtgccc

SEQ ID NO: 750572 - DNA, 25 bp, Mus musculus
tagcccagtctgaggttaggcctga

SEQ ID NO: 750573 - DNA, 25 bp, Mus musculus
tagcccagtctgtggttaggcctga

SEQ ID NO: 750574 - DNA, 25 bp, Mus musculus
tagcccagtgtgattgcagccgctg

SEQ ID NO: 750575 - DNA, 25 bp, Mus musculus
tagcccagtgtgtttgcagccgctg

SEQ ID NO: 750576 - DNA, 25 bp, Mus musculus
tagcccatgcatcgtgtgtatacac

SEQ ID NO: 750577 - DNA, 25 bp, Mus musculus
tagcccatgcatggtgtgtatacac

SEQ ID NO: 750578 - DNA, 25 bp, Mus musculus
tagccccaaggcaattagaaataca

SEQ ID NO: 750579 - DNA, 25 bp, Mus musculus
tagccccaaggctattagaaataca

SEQ ID NO: 750580 - DNA, 25 bp, Mus musculus
tagccccaccaccaggatcaagaag

SEQ ID NO: 750581 - DNA, 25 bp, Mus musculus
tagccccaccacgaggatcaagaag

SEQ ID NO: 750582 - DNA, 25 bp, Mus musculus
tagccccgaggaagtcttccgggag

SEQ ID NO: 750583 - DNA, 25 bp, Mus musculus
tagccccgaggatgtcttccgggag

SEQ ID NO: 750584 - DNA, 25 bp, Mus musculus
tagccccgccaccttagttgtgtca

SEQ ID NO: 750585 - DNA, 25 bp, Mus musculus
tagccccgccacgttagttgtgtca

SEQ ID NO: 750586 - DNA, 25 bp, Mus musculus
tagccccgccctacctgggaagaga

SEQ ID NO: 750587 - DNA, 25 bp, Mus musculus
tagccccgcccttcctgggaagaga

SEQ ID NO: 750588 - DNA, 25 bp, Mus musculus
tagcccctatgaacttagagcttag

SEQ ID NO: 750589 - DNA, 25 bp, Mus musculus
tagcccctatgatcttagagcttag

SEQ ID NO: 750590 - DNA, 25 bp, Mus musculus
tagcccctattaaggtcgctttgga

SEQ ID NO: 750591 - DNA, 25 bp, Mus musculus
tagcccctattatggtcgctttgga

SEQ ID NO: 750592 - DNA, 25 bp, Mus musculus
tagcccctggaactttgccttcaca

SEQ ID NO: 750593 - DNA, 25 bp, Mus musculus
tagcccctggaagtttgccttcaca

SEQ ID NO: 750594 - DNA, 25 bp, Mus musculus
tagcccggacacattctctgatgga

SEQ ID NO: 750595 - DNA, 25 bp, Mus musculus
tagcccggacactttctctgatgga

SEQ ID NO: 750596 - DNA, 25 bp, Mus musculus
tagcccgggttcaaatccaaaactg

SEQ ID NO: 750597 - DNA, 25 bp, Mus musculus
tagcccgggttctaatccaaaactg

SEQ ID NO: 750598 - DNA, 25 bp, Mus musculus
tagcccggtgagaggatcctgtcct

SEQ ID NO: 750599 - DNA, 25 bp, Mus musculus
tagcccggtgagtggatcctgtcct

SEQ ID NO: 750600 - DNA, 25 bp, Mus musculus
tagcccgtcttcaaagtggtcacca

SEQ ID NO: 750601 - DNA, 25 bp, Mus musculus
tagcccgtcttctaagtggtcacca

SEQ ID NO: 750602 - DNA, 25 bp, Mus musculus
tagcccgtgagtattgagacagcag

SEQ ID NO: 750603 - DNA, 25 bp, Mus musculus
tagcccgtgagttttgagacagcag

SEQ ID NO: 750604 - DNA, 25 bp, Mus musculus
tagccctaaactacgcagatttcca

SEQ ID NO: 750605 - DNA, 25 bp, Mus musculus
tagccctaaacttcgcagatttcca

SEQ ID NO: 750606 - DNA, 25 bp, Mus musculus
tagccctaggaacgagctgagatca

SEQ ID NO: 750607 - DNA, 25 bp, Mus musculus
tagccctaggaaggagctgagatca

SEQ ID NO: 750608 - DNA, 25 bp, Mus musculus
tagccctccagccagttctgagacc

SEQ ID NO: 750609 - DNA, 25 bp, Mus musculus
tagccctccagcgagttctgagacc

SEQ ID NO: 750610 - DNA, 25 bp, Mus musculus
tagccctccggaatgatgccgagtc

SEQ ID NO: 750611 - DNA, 25 bp, Mus musculus
tagccctccggattgatgccgagtc

SEQ ID NO: 750612 - DNA, 25 bp, Mus musculus
tagccctgactgaactccaactcag

SEQ ID NO: 750613 - DNA, 25 bp, Mus musculus
tagccctgactgtactccaactcag

SEQ ID NO: 750614 - DNA, 25 bp, Mus musculus
tagccctgagttccatgcctgctgc

SEQ ID NO: 750615 - DNA, 25 bp, Mus musculus
tagccctgagttgcatgcctgctgc

SEQ ID NO: 750616 - DNA, 25 bp, Mus musculus
tagccctgctgaaccatgtgcagag

SEQ ID NO: 750617 - DNA, 25 bp, Mus musculus
tagccctgctgatccatgtgcagag

SEQ ID NO: 750618 - DNA, 25 bp, Mus musculus
tagccctgctgtcatctttgctcgg

SEQ ID NO: 750619 - DNA, 25 bp, Mus musculus
tagccctgctgtgatctttgctcgg

SEQ ID NO: 750620 - DNA, 25 bp, Mus musculus
tagccctggagcctccaagtctggg

SEQ ID NO: 750621 - DNA, 25 bp, Mus musculus
tagccctggagcgtccaagtctggg

SEQ ID NO: 750622 - DNA, 25 bp, Mus musculus
tagccctggatcagctcaaggatga

SEQ ID NO: 750623 - DNA, 25 bp, Mus musculus
tagccctggatctgctcaaggatga

SEQ ID NO: 750624 - DNA, 25 bp, Mus musculus
tagccctgggccatgactagttaag

SEQ ID NO: 750625 - DNA, 25 bp, Mus musculus
tagccctgggccttgactagttaag

SEQ ID NO: 750626 - DNA, 25 bp, Mus musculus
tagcccttgcttcgcacaggaatca

SEQ ID NO: 750627 - DNA, 25 bp, Mus musculus
tagcccttgcttggcacaggaatca

SEQ ID NO: 750628 - DNA, 25 bp, Mus musculus
tagccctttgggagtcgtttgtgaa

SEQ ID NO: 750629 - DNA, 25 bp, Mus musculus
tagccctttgggtgtcgtttgtgaa

SEQ ID NO: 750630 - DNA, 25 bp, Mus musculus
tagccgaaagtgagggtcgcacgct

SEQ ID NO: 750631 - DNA, 25 bp, Mus musculus
tagccgaaagtgtgggtcgcacgct

SEQ ID NO: 750632 - DNA, 25 bp, Mus musculus
tagccgacagcaaacggaaagtcaa

SEQ ID NO: 750633 - DNA, 25 bp, Mus musculus
tagccgacagcatacggaaagtcaa

SEQ ID NO: 750634 - DNA, 25 bp, Mus musculus
tagccgagagacagccttcacgtat

SEQ ID NO: 750635 - DNA, 25 bp, Mus musculus
tagccgagagactgccttcacgtat

SEQ ID NO: 750636 - DNA, 25 bp, Mus musculus
tagccgagtaagaagcggctccctc

SEQ ID NO: 750637 - DNA, 25 bp, Mus musculus
tagccgagtaagtagcggctccctc

SEQ ID NO: 750638 - DNA, 25 bp, Mus musculus
tagccgagtgccagcgcaagctgaa

SEQ ID NO: 750639 - DNA, 25 bp, Mus musculus
tagccgagtgcctgcgcaagctgaa

SEQ ID NO: 750640 - DNA, 25 bp, Mus musculus
tagccgccagtgagaccgtgaacat

SEQ ID NO: 750641 - DNA, 25 bp, Mus musculus
tagccgccagtgtgaccgtgaacat

SEQ ID NO: 750642 - DNA, 25 bp, Mus musculus
tagccgcgctgcacttgcccgagaa

SEQ ID NO: 750643 - DNA, 25 bp, Mus musculus
tagccgcgctgctcttgcccgagaa

SEQ ID NO: 750644 - DNA, 25 bp, Mus musculus
tagccgcgctggaggcttcaatgct

SEQ ID NO: 750645 - DNA, 25 bp, Mus musculus
tagccgcgctggtggcttcaatgct

SEQ ID NO: 750646 - DNA, 25 bp, Mus musculus
tagccgcggcaaaggactttctcct

SEQ ID NO: 750647 - DNA, 25 bp, Mus musculus
tagccgcggcaatggactttctcct

SEQ ID NO: 750648 - DNA, 25 bp, Mus musculus
tagccgcggctgagacgcaaatgtg

SEQ ID NO: 750649 - DNA, 25 bp, Mus musculus
tagccgcggctgtgacgcaaatgtg

SEQ ID NO: 750650 - DNA, 25 bp, Mus musculus
tagccgctactaagtagaaatcccc

SEQ ID NO: 750651 - DNA, 25 bp, Mus musculus
tagccgctactatgtagaaatcccc

SEQ ID NO: 750652 - DNA, 25 bp, Mus musculus
tagccggccgagagtgatcgccgcc

SEQ ID NO: 750653 - DNA, 25 bp, Mus musculus
tagccggccgagtgtgatcgccgcc

SEQ ID NO: 750654 - DNA, 25 bp, Mus musculus
tagccggccggaaggtttagaggac

SEQ ID NO: 750655 - DNA, 25 bp, Mus musculus
tagccggccggatggtttagaggac

SEQ ID NO: 750656 - DNA, 25 bp, Mus musculus
tagccggctatgacgacttcaactg

SEQ ID NO: 750657 - DNA, 25 bp, Mus musculus
tagccggctatgtcgacttcaactg

SEQ ID NO: 750658 - DNA, 25 bp, Mus musculus
tagccggtagaaagcggaaaaagag

SEQ ID NO: 750659 - DNA, 25 bp, Mus musculus
tagccggtagaatgcggaaaaagag

SEQ ID NO: 750660 - DNA, 25 bp, Mus musculus
tagccgtcaccacgagcagttcatc

SEQ ID NO: 750661 - DNA, 25 bp, Mus musculus
tagccgtcaccaggagcagttcatc

SEQ ID NO: 750662 - DNA, 25 bp, Mus musculus
tagccgtcctcgcagcaaggaaagg

SEQ ID NO: 750663 - DNA, 25 bp, Mus musculus
tagccgtcctcggagcaaggaaagg

SEQ ID NO: 750664 - DNA, 25 bp, Mus musculus
tagccgtgactcagatggaatggat

SEQ ID NO: 750665 - DNA, 25 bp, Mus musculus
tagccgtgactctgatggaatggat

SEQ ID NO: 750666 - DNA, 25 bp, Mus musculus
tagccgttcctgagggcttcaggct

SEQ ID NO: 750667 - DNA, 25 bp, Mus musculus
tagccgttcctgtgggcttcaggct

SEQ ID NO: 750668 - DNA, 25 bp, Mus musculus
tagccgttggtgcatttcaatctga

SEQ ID NO: 750669 - DNA, 25 bp, Mus musculus
tagccgttggtggatttcaatctga

SEQ ID NO: 750670 - DNA, 25 bp, Mus musculus
tagcctacccggactgcagccctgt

SEQ ID NO: 750671 - DNA, 25 bp, Mus musculus
tagcctacccggtctgcagccctgt

SEQ ID NO: 750672 - DNA, 25 bp, Mus musculus
tagcctacttggcagactgctgctc

SEQ ID NO: 750673 - DNA, 25 bp, Mus musculus
tagcctacttgggagactgctgctc

SEQ ID NO: 750674 - DNA, 25 bp, Mus musculus
tagcctagactgctacctttcaaag

SEQ ID NO: 750675 - DNA, 25 bp, Mus musculus
tagcctagactggtacctttcaaag

SEQ ID NO: 750676 - DNA, 25 bp, Mus musculus
tagcctagattcctgtcaccaagtc

SEQ ID NO: 750677 - DNA, 25 bp, Mus musculus
tagcctagattcgtgtcaccaagtc

SEQ ID NO: 750678 - DNA, 25 bp, Mus musculus
tagcctaggtaacactctctcctgc

SEQ ID NO: 750679 - DNA, 25 bp, Mus musculus
tagcctaggtaagactctctcctgc

SEQ ID NO: 750680 - DNA, 25 bp, Mus musculus
tagcctatacgtagatggtgactgc

SEQ ID NO: 750681 - DNA, 25 bp, Mus musculus
tagcctatacgttgatggtgactgc

SEQ ID NO: 750682 - DNA, 25 bp, Mus musculus
tagcctcaacttccagtggcaaatg

SEQ ID NO: 750683 - DNA, 25 bp, Mus musculus
tagcctcaacttgcagtggcaaatg

SEQ ID NO: 750684 - DNA, 25 bp, Mus musculus
tagcctcacagaactctaagcacaa

SEQ ID NO: 750685 - DNA, 25 bp, Mus musculus
tagcctcacagatctctaagcacaa

SEQ ID NO: 750686 - DNA, 25 bp, Mus musculus
tagcctcaccatcgcagagttcaag

SEQ ID NO: 750687 - DNA, 25 bp, Mus musculus
tagcctcaccatggcagagttcaag

SEQ ID NO: 750688 - DNA, 25 bp, Mus musculus
tagcctcacggcactgagcttattc

SEQ ID NO: 750689 - DNA, 25 bp, Mus musculus
tagcctcacggctctgagcttattc

SEQ ID NO: 750690 - DNA, 25 bp, Mus musculus
tagcctcagagcctactccaggagg

SEQ ID NO: 750691 - DNA, 25 bp, Mus musculus
tagcctcagagcgtactccaggagg

SEQ ID NO: 750692 - DNA, 25 bp, Mus musculus
tagcctcatgctatggcccttcagg

SEQ ID NO: 750693 - DNA, 25 bp, Mus musculus
tagcctcatgctttggcccttcagg

SEQ ID NO: 750694 - DNA, 25 bp, Mus musculus
tagcctcattcccagttacatccgt

SEQ ID NO: 750695 - DNA, 25 bp, Mus musculus
tagcctcattccgagttacatccgt

SEQ ID NO: 750696 - DNA, 25 bp, Mus musculus
tagcctccgatcagtataagccctc

SEQ ID NO: 750697 - DNA, 25 bp, Mus musculus
tagcctccgatctgtataagccctc

SEQ ID NO: 750698 - DNA, 25 bp, Mus musculus
tagcctcctatgatatgcagctgag

SEQ ID NO: 750699 - DNA, 25 bp, Mus musculus
tagcctcctatgttatgcagctgag

SEQ ID NO: 750700 - DNA, 25 bp, Mus musculus
tagcctccttttccaatagtcatag

SEQ ID NO: 750701 - DNA, 25 bp, Mus musculus
tagcctccttttgcaatagtcatag

SEQ ID NO: 750702 - DNA, 25 bp, Mus musculus
tagcctcgggtcactagggaaagat

SEQ ID NO: 750703 - DNA, 25 bp, Mus musculus
tagcctcgggtctctagggaaagat

SEQ ID NO: 750704 - DNA, 25 bp, Mus musculus
tagcctctgatacagaggaagaaaa

SEQ ID NO: 750705 - DNA, 25 bp, Mus musculus
tagcctctgatagagaggaagaaaa

SEQ ID NO: 750706 - DNA, 25 bp, Mus musculus
tagcctctgcacattggagacggag

SEQ ID NO: 750707 - DNA, 25 bp, Mus musculus
tagcctctgcactttggagacggag

SEQ ID NO: 750708 - DNA, 25 bp, Mus musculus
tagcctgaacgtctgcagtctattt

SEQ ID NO: 750709 - DNA, 25 bp, Mus musculus
tagcctgaacgtgtgcagtctattt

SEQ ID NO: 750710 - DNA, 25 bp, Mus musculus
tagcctgaagcccatagcgggattt

SEQ ID NO: 750711 - DNA, 25 bp, Mus musculus
tagcctgaagccgatagcgggattt

SEQ ID NO: 750712 - DNA, 25 bp, Mus musculus
tagcctgacactccgagatctaaga

SEQ ID NO: 750713 - DNA, 25 bp, Mus musculus
tagcctgacactgcgagatctaaga

SEQ ID NO: 750714 - DNA, 25 bp, Mus musculus
tagcctgagagcctcttcttcgcgg

SEQ ID NO: 750715 - DNA, 25 bp, Mus musculus
tagcctgagagcgtcttcttcgcgg

SEQ ID NO: 750716 - DNA, 25 bp, Mus musculus
tagcctgagggcaagctgaaagtct

SEQ ID NO: 750717 - DNA, 25 bp, Mus musculus
tagcctgagggctagctgaaagtct

SEQ ID NO: 750718 - DNA, 25 bp, Mus musculus
tagcctgcacaactcctcgagtggg

SEQ ID NO: 750719 - DNA, 25 bp, Mus musculus
tagcctgcacaagtcctcgagtggg

SEQ ID NO: 750720 - DNA, 25 bp, Mus musculus
tagcctgcatggacgagaatggacc

SEQ ID NO: 750721 - DNA, 25 bp, Mus musculus
tagcctgcatggtcgagaatggacc

SEQ ID NO: 750722 - DNA, 25 bp, Mus musculus
tagcctgccgggagatgaccaggat

SEQ ID NO: 750723 - DNA, 25 bp, Mus musculus
tagcctgccgggtgatgaccaggat

SEQ ID NO: 750724 - DNA, 25 bp, Mus musculus
tagcctgctctacggactcttctgg

SEQ ID NO: 750725 - DNA, 25 bp, Mus musculus
tagcctgctctagggactcttctgg

SEQ ID NO: 750726 - DNA, 25 bp, Mus musculus
tagcctggatgtcgcatgtagtagc

SEQ ID NO: 750727 - DNA, 25 bp, Mus musculus
tagcctggatgtggcatgtagtagc

SEQ ID NO: 750728 - DNA, 25 bp, Mus musculus
tagcctggcaccccggaagctggtt

SEQ ID NO: 750729 - DNA, 25 bp, Mus musculus
tagcctggcaccgcggaagctggtt

SEQ ID NO: 750730 - DNA, 25 bp, Mus musculus
tagcctgggcaaaggtcctacttga

SEQ ID NO: 750731 - DNA, 25 bp, Mus musculus
tagcctgggcaatggtcctacttga

SEQ ID NO: 750732 - DNA, 25 bp, Mus musculus
tagcctgggcttagagattatgtct

SEQ ID NO: 750733 - DNA, 25 bp, Mus musculus
tagcctgggcttcgctcagggtaca

SEQ ID NO: 750734 - DNA, 25 bp, Mus musculus
tagcctgggcttggctcagggtaca

SEQ ID NO: 750735 - DNA, 25 bp, Mus musculus
tagcctgggctttgagattatgtct

SEQ ID NO: 750736 - DNA, 25 bp, Mus musculus
tagcctgtcagaagtacttcgagat

SEQ ID NO: 750737 - DNA, 25 bp, Mus musculus
tagcctgtcagatgtacttcgagat

SEQ ID NO: 750738 - DNA, 25 bp, Mus musculus
tagcctgtgaatatgggcggctcaa

SEQ ID NO: 750739 - DNA, 25 bp, Mus musculus
tagcctgtgaatttgggcggctcaa

SEQ ID NO: 750740 - DNA, 25 bp, Mus musculus
tagcctgtgcttatgccgtgatgtc

SEQ ID NO: 750741 - DNA, 25 bp, Mus musculus
tagcctgtgcttttgccgtgatgtc

SEQ ID NO: 750742 - DNA, 25 bp, Mus musculus
tagcctgttggcatgtgagtagccc

SEQ ID NO: 750743 - DNA, 25 bp, Mus musculus
tagcctgttggcttgtgagtagccc

SEQ ID NO: 750744 - DNA, 25 bp, Mus musculus
tagccttagcttaagggcccagaga

SEQ ID NO: 750745 - DNA, 25 bp, Mus musculus
tagccttagctttagggcccagaga

SEQ ID NO: 750746 - DNA, 25 bp, Mus musculus
tagccttcagctcatgtacaacaag

SEQ ID NO: 750747 - DNA, 25 bp, Mus musculus
tagccttcagctgatgtacaacaag

SEQ ID NO: 750748 - DNA, 25 bp, Mus musculus
tagccttccataatggtagggagga

SEQ ID NO: 750749 - DNA, 25 bp, Mus musculus
tagccttccatattggtagggagga

SEQ ID NO: 750750 - DNA, 25 bp, Mus musculus
tagccttcgagacatcgtggatgac

SEQ ID NO: 750751 - DNA, 25 bp, Mus musculus
tagccttcgagagatcgtggatgac

SEQ ID NO: 750752 - DNA, 25 bp, Mus musculus
tagccttctgcaaattccaggctgg

SEQ ID NO: 750753 - DNA, 25 bp, Mus musculus
tagccttctgcatattccaggctgg

SEQ ID NO: 750754 - DNA, 25 bp, Mus musculus
tagccttgcagaagtatggctgccg

SEQ ID NO: 750755 - DNA, 25 bp, Mus musculus
tagccttgcagatgtatggctgccg

SEQ ID NO: 750756 - DNA, 25 bp, Mus musculus
tagccttgccacagatatatgccag

SEQ ID NO: 750757 - DNA, 25 bp, Mus musculus
tagccttgccactgatatatgccag

SEQ ID NO: 750758 - DNA, 25 bp, Mus musculus
tagcctttagctattatgagaatgg

SEQ ID NO: 750759 - DNA, 25 bp, Mus musculus
tagcctttagcttttatgagaatgg

SEQ ID NO: 750760 - DNA, 25 bp, Mus musculus
tagcctttattcctgcctttttcag

SEQ ID NO: 750761 - DNA, 25 bp, Mus musculus
tagcctttattcgtgcctttttcag

SEQ ID NO: 750762 - DNA, 25 bp, Mus musculus
tagcctttgcctacaatgccaagac

SEQ ID NO: 750763 - DNA, 25 bp, Mus musculus
tagcctttgccttcaatgccaagac

SEQ ID NO: 750764 - DNA, 25 bp, Mus musculus
tagcctttggagatgcgcaggcctt

SEQ ID NO: 750765 - DNA, 25 bp, Mus musculus
tagcctttggagttgcgcaggcctt

SEQ ID NO: 750766 - DNA, 25 bp, Mus musculus
tagcctttgggcaaaacgaaacaca

SEQ ID NO: 750767 - DNA, 25 bp, Mus musculus
tagcctttgggctaaacgaaacaca

SEQ ID NO: 750768 - DNA, 25 bp, Mus musculus
tagccttttatcaaacagactcatg

SEQ ID NO: 750769 - DNA, 25 bp, Mus musculus
tagccttttatctaacagactcatg

SEQ ID NO: 750770 - DNA, 25 bp, Mus musculus
tagcgaacaatacaggtacgactcg

SEQ ID NO: 750771 - DNA, 25 bp, Mus musculus
tagcgaacaatagaggtacgactcg

SEQ ID NO: 750772 - DNA, 25 bp, Mus musculus
tagcgaagaagacatccgcgaggcc

SEQ ID NO: 750773 - DNA, 25 bp, Mus musculus
tagcgaagaagagatccgcgaggcc

SEQ ID NO: 750774 - DNA, 25 bp, Mus musculus
tagcgaagaagtcagtgaatctgag

SEQ ID NO: 750775 - DNA, 25 bp, Mus musculus
tagcgaagaagtgagtgaatctgag

SEQ ID NO: 750776 - DNA, 25 bp, Mus musculus
tagcgaagctgccatggaaaggccc

SEQ ID NO: 750777 - DNA, 25 bp, Mus musculus
tagcgaagctgcgatggaaaggccc

SEQ ID NO: 750778 - DNA, 25 bp, Mus musculus
tagcgacaactcatgaggtgaagcg

SEQ ID NO: 750779 - DNA, 25 bp, Mus musculus
tagcgacaactcttgaggtgaagcg

SEQ ID NO: 750780 - DNA, 25 bp, Mus musculus
tagcgactactacgacatccaccaa

SEQ ID NO: 750781 - DNA, 25 bp, Mus musculus
tagcgactactaggacatccaccaa

SEQ ID NO: 750782 - DNA, 25 bp, Mus musculus
tagcgactgattctcagagcggccc

SEQ ID NO: 750783 - DNA, 25 bp, Mus musculus
tagcgactgattgtcagagcggccc

SEQ ID NO: 750784 - DNA, 25 bp, Mus musculus
tagcgacttcaccaatcggaggcct

SEQ ID NO: 750785 - DNA, 25 bp, Mus musculus
tagcgacttcacgaatcggaggcct

SEQ ID NO: 750786 - DNA, 25 bp, Mus musculus
tagcgacttctcatgggtggccgtg

SEQ ID NO: 750787 - DNA, 25 bp, Mus musculus
tagcgacttctcttgggtggccgtg

SEQ ID NO: 750788 - DNA, 25 bp, Mus musculus
tagcgactttcaagtgtgccgtgga

SEQ ID NO: 750789 - DNA, 25 bp, Mus musculus
tagcgactttcatgtgtgccgtgga

SEQ ID NO: 750790 - DNA, 25 bp, Mus musculus
tagcgagacagacaaaattccctca

SEQ ID NO: 750791 - DNA, 25 bp, Mus musculus
tagcgagacagagaaaattccctca

SEQ ID NO: 750792 - DNA, 25 bp, Mus musculus
tagcgagtacagagtgctgttgtgt

SEQ ID NO: 750793 - DNA, 25 bp, Mus musculus
tagcgagtacagtgtgctgttgtgt

SEQ ID NO: 750794 - DNA, 25 bp, Mus musculus
tagcgatgcaacaaagttaaggcca

SEQ ID NO: 750795 - DNA, 25 bp, Mus musculus
tagcgatgcaactaagttaaggcca

SEQ ID NO: 750796 - DNA, 25 bp, Mus musculus
tagcgcaccacccaaagtctgtgtg

SEQ ID NO: 750797 - DNA, 25 bp, Mus musculus
tagcgcaccaccgaaagtctgtgtg

SEQ ID NO: 750798 - DNA, 25 bp, Mus musculus
tagcgcaggctaccgccacattgat

SEQ ID NO: 750799 - DNA, 25 bp, Mus musculus
tagcgcaggctagcgccacattgat

SEQ ID NO: 750800 - DNA, 25 bp, Mus musculus
tagcgccaagggaagacgtgaattc

SEQ ID NO: 750801 - DNA, 25 bp, Mus musculus
tagcgccaagggtagacgtgaattc

SEQ ID NO: 750802 - DNA, 25 bp, Mus musculus
tagcgccatttcactaaggagcctt

SEQ ID NO: 750803 - DNA, 25 bp, Mus musculus
tagcgccatttctctaaggagcctt

SEQ ID NO: 750804 - DNA, 25 bp, Mus musculus
tagcgccgaccgaaggtgattccag

SEQ ID NO: 750805 - DNA, 25 bp, Mus musculus
tagcgccgaccgtaggtgattccag

SEQ ID NO: 750806 - DNA, 25 bp, Mus musculus
tagcgccgccttacggcagaagctg

SEQ ID NO: 750807 - DNA, 25 bp, Mus musculus
tagcgccgcctttcggcagaagctg

SEQ ID NO: 750808 - DNA, 25 bp, Mus musculus
tagcgcctatgaagggccaagtgtg

SEQ ID NO: 750809 - DNA, 25 bp, Mus musculus
tagcgcctatgatgggccaagtgtg

SEQ ID NO: 750810 - DNA, 25 bp, Mus musculus
tagcgcctgggcattcagaactgtg

SEQ ID NO: 750811 - DNA, 25 bp, Mus musculus
tagcgcctgggctttcagaactgtg

SEQ ID NO: 750812 - DNA, 25 bp, Mus musculus
tagcgcgaagccagatcttcgtctt

SEQ ID NO: 750813 - DNA, 25 bp, Mus musculus
tagcgcgaagcctgatcttcgtctt

SEQ ID NO: 750814 - DNA, 25 bp, Mus musculus
tagcgcgaatggcttccagctcaga

SEQ ID NO: 750815 - DNA, 25 bp, Mus musculus
tagcgcgaatgggttccagctcaga

SEQ ID NO: 750816 - DNA, 25 bp, Mus musculus
tagcgcgcacagaatgcaattagcc

SEQ ID NO: 750817 - DNA, 25 bp, Mus musculus
tagcgcgcacagtatgcaattagcc

SEQ ID NO: 750818 - DNA, 25 bp, Mus musculus
tagcgcgggctcagatcttgtgtgc

SEQ ID NO: 750819 - DNA, 25 bp, Mus musculus
tagcgcgggctctgatcttgtgtgc

SEQ ID NO: 750820 - DNA, 25 bp, Mus musculus
tagcgcgtccacagtaggccctgtg

SEQ ID NO: 750821 - DNA, 25 bp, Mus musculus
tagcgcgtccactgtaggccctgtg

SEQ ID NO: 750822 - DNA, 25 bp, Mus musculus
tagcgctggctgatatctttggttc

SEQ ID NO: 750823 - DNA, 25 bp, Mus musculus
tagcgctggctgttatctttggttc

SEQ ID NO: 750824 - DNA, 25 bp, Mus musculus
tagcgctgggcaccagaacttgaac

SEQ ID NO: 750825 - DNA, 25 bp, Mus musculus
tagcgctgggcagcagaacttgaac

SEQ ID NO: 750826 - DNA, 25 bp, Mus musculus
tagcgctgtcttatgcggactacaa

SEQ ID NO: 750827 - DNA, 25 bp, Mus musculus
tagcgctgtcttttgcggactacaa

SEQ ID NO: 750828 - DNA, 25 bp, Mus musculus
tagcgcttgtgtctgtagattcagc

SEQ ID NO: 750829 - DNA, 25 bp, Mus musculus
tagcgcttgtgtgtgtagattcagc

SEQ ID NO: 750830 - DNA, 25 bp, Mus musculus
tagcggacacaaagatcggcaaagc

SEQ ID NO: 750831 - DNA, 25 bp, Mus musculus
tagcggacacaatgatcggcaaagc

SEQ ID NO: 750832 - DNA, 25 bp, Mus musculus
tagcggcacggcattttctcggcgg

SEQ ID NO: 750833 - DNA, 25 bp, Mus musculus
tagcggcacggctttttctcggcgg

SEQ ID NO: 750834 - DNA, 25 bp, Mus musculus
tagcggccaacgaacggatagctcc

SEQ ID NO: 750835 - DNA, 25 bp, Mus musculus
tagcggccaacgtacggatagctcc

SEQ ID NO: 750836 - DNA, 25 bp, Mus musculus
tagcggccctgcctgtattgtggat

SEQ ID NO: 750837 - DNA, 25 bp, Mus musculus
tagcggccctgcgtgtattgtggat

SEQ ID NO: 750838 - DNA, 25 bp, Mus musculus
tagcggcggcatattgcaggcagca

SEQ ID NO: 750839 - DNA, 25 bp, Mus musculus
tagcggcggcattttgcaggcagca

SEQ ID NO: 750840 - DNA, 25 bp, Mus musculus
tagcggcttgctctgagacaaaccc

SEQ ID NO: 750841 - DNA, 25 bp, Mus musculus
tagcggcttgctgtgagacaaaccc

SEQ ID NO: 750842 - DNA, 25 bp, Mus musculus
tagcgggctggcatttatctccact

SEQ ID NO: 750843 - DNA, 25 bp, Mus musculus
tagcgggctggcttttatctccact

SEQ ID NO: 750844 - DNA, 25 bp, Mus musculus
tagcgggtcacgaccctcctggcat

SEQ ID NO: 750845 - DNA, 25 bp, Mus musculus
tagcgggtcacgtccctcctggcat

SEQ ID NO: 750846 - DNA, 25 bp, Mus musculus
tagcggtcgacgaggaacagctgct

SEQ ID NO: 750847 - DNA, 25 bp, Mus musculus
tagcggtcgacgtggaacagctgct

SEQ ID NO: 750848 - DNA, 25 bp, Mus musculus
tagcggtgtaggaagcaatagatct

SEQ ID NO: 750849 - DNA, 25 bp, Mus musculus
tagcggtgtaggtagcaatagatct

SEQ ID NO: 750850 - DNA, 25 bp, Mus musculus
tagcggttctgccacccaaagagtc

SEQ ID NO: 750851 - DNA, 25 bp, Mus musculus
tagcggttctgcgacccaaagagtc

SEQ ID NO: 750852 - DNA, 25 bp, Mus musculus
tagcggttgtcaactctgccttccc

SEQ ID NO: 750853 - DNA, 25 bp, Mus musculus
tagcggttgtcatctctgccttccc

SEQ ID NO: 750854 - DNA, 25 bp, Mus musculus
tagcgtaaggaacttagtgaagctt

SEQ ID NO: 750855 - DNA, 25 bp, Mus musculus
tagcgtaaggaagttagtgaagctt

SEQ ID NO: 750856 - DNA, 25 bp, Mus musculus
tagcgtaagttgacgctttgaagac

SEQ ID NO: 750857 - DNA, 25 bp, Mus musculus
tagcgtaagttgtcgctttgaagac

SEQ ID NO: 750858 - DNA, 25 bp, Mus musculus
tagcgtcagtggagagcacgtacca

SEQ ID NO: 750859 - DNA, 25 bp, Mus musculus
tagcgtcagtggtgagcacgtacca

SEQ ID NO: 750860 - DNA, 25 bp, Mus musculus
tagcgtctcacgcttcagctttcgc

SEQ ID NO: 750861 - DNA, 25 bp, Mus musculus
tagcgtctcacggttcagctttcgc

SEQ ID NO: 750862 - DNA, 25 bp, Mus musculus
tagcgtctccgaaaactcgcgcgtc

SEQ ID NO: 750863 - DNA, 25 bp, Mus musculus
tagcgtctccgataactcgcgcgtc

SEQ ID NO: 750864 - DNA, 25 bp, Mus musculus
tagcgtgacagtacccggcacgcgg

SEQ ID NO: 750865 - DNA, 25 bp, Mus musculus
tagcgtgacagttcccggcacgcgg

SEQ ID NO: 750866 - DNA, 25 bp, Mus musculus
tagcgtgggttgcgctccaagcaca

SEQ ID NO: 750867 - DNA, 25 bp, Mus musculus
tagcgtgggttgggctccaagcaca

SEQ ID NO: 750868 - DNA, 25 bp, Mus musculus
tagcgtgtgccaagaagatcctggc

SEQ ID NO: 750869 - DNA, 25 bp, Mus musculus
tagcgtgtgccatgaagatcctggc

SEQ ID NO: 750870 - DNA, 25 bp, Mus musculus
tagcgtgtgctgacactagggccag

SEQ ID NO: 750871 - DNA, 25 bp, Mus musculus
tagcgtgtgctgtcactagggccag

SEQ ID NO: 750872 - DNA, 25 bp, Mus musculus
tagcgtttccaacaaaatgagaatg

SEQ ID NO: 750873 - DNA, 25 bp, Mus musculus
tagcgtttccaagaaaatgagaatg

SEQ ID NO: 750874 - DNA, 25 bp, Mus musculus
tagcgtttcccgctggttttgtcgc

SEQ ID NO: 750875 - DNA, 25 bp, Mus musculus
tagcgtttcccggtggttttgtcgc

SEQ ID NO: 750876 - DNA, 25 bp, Mus musculus
tagcgttttcgtcagtggctttgtg

SEQ ID NO: 750877 - DNA, 25 bp, Mus musculus
tagcgttttcgtgagtggctttgtg

SEQ ID NO: 750878 - DNA, 25 bp, Mus musculus
tagcgttttgtcagaaccgtccgcg

SEQ ID NO: 750879 - DNA, 25 bp, Mus musculus
tagcgttttgtctgaaccgtccgcg

SEQ ID NO: 750880 - DNA, 25 bp, Mus musculus
tagctaaaccagatggcaaagaaaa

SEQ ID NO: 750881 - DNA, 25 bp, Mus musculus
tagctaaaccagttggcaaagaaaa

SEQ ID NO: 750882 - DNA, 25 bp, Mus musculus
tagctaaaggcaatcagcacccacc

SEQ ID NO: 750883 - DNA, 25 bp, Mus musculus
tagctaaaggcattcagcacccacc

SEQ ID NO: 750884 - DNA, 25 bp, Mus musculus
tagctaaggatgacgccaccttcct

SEQ ID NO: 750885 - DNA, 25 bp, Mus musculus
tagctaaggatgtcgccaccttcct

SEQ ID NO: 750886 - DNA, 25 bp, Mus musculus
tagctaatagtgaaatctacaaacc

SEQ ID NO: 750887 - DNA, 25 bp, Mus musculus
tagctaatagtgtaatctacaaacc

SEQ ID NO: 750888 - DNA, 25 bp, Mus musculus
tagctacacggtccgggtgtctgct

SEQ ID NO: 750889 - DNA, 25 bp, Mus musculus
tagctacacggtgcgggtgtctgct

SEQ ID NO: 750890 - DNA, 25 bp, Mus musculus
tagctacatggcagccgtcaatagt

SEQ ID NO: 750891 - DNA, 25 bp, Mus musculus
tagctacatggctgccgtcaatagt

SEQ ID NO: 750892 - DNA, 25 bp, Mus musculus
tagctacattcgagactccactgtg

SEQ ID NO: 750893 - DNA, 25 bp, Mus musculus
tagctacattcgtgactccactgtg

SEQ ID NO: 750894 - DNA, 25 bp, Mus musculus
tagctacatttcatcttgcaaagcc

SEQ ID NO: 750895 - DNA, 25 bp, Mus musculus
tagctacatttcttcttgcaaagcc

SEQ ID NO: 750896 - DNA, 25 bp, Mus musculus
tagctacccattactggaccagaaa

SEQ ID NO: 750897 - DNA, 25 bp, Mus musculus
tagctacccatttctggaccagaaa

SEQ ID NO: 750898 - DNA, 25 bp, Mus musculus
tagctaccctcaaaggcaacaatgc

SEQ ID NO: 750899 - DNA, 25 bp, Mus musculus
tagctaccctcataggcaacaatgc

SEQ ID NO: 750900 - DNA, 25 bp, Mus musculus
tagctaccctgaaggtagctggaaa

SEQ ID NO: 750901 - DNA, 25 bp, Mus musculus
tagctaccctgatggtagctggaaa

SEQ ID NO: 750902 - DNA, 25 bp, Mus musculus
tagctaccttggcacatcatcagac

SEQ ID NO: 750903 - DNA, 25 bp, Mus musculus
tagctaccttgggacatcatcagac

SEQ ID NO: 750904 - DNA, 25 bp, Mus musculus
tagctacgaatgacagtgtcaccca

SEQ ID NO: 750905 - DNA, 25 bp, Mus musculus
tagctacgaatgtcagtgtcaccca

SEQ ID NO: 750906 - DNA, 25 bp, Mus musculus
tagctactctttcccagtgtaatga

SEQ ID NO: 750907 - DNA, 25 bp, Mus musculus
tagctactctttgccagtgtaatga

SEQ ID NO: 750908 - DNA, 25 bp, Mus musculus
tagctactgcgcataagacctgtat

SEQ ID NO: 750909 - DNA, 25 bp, Mus musculus
tagctactgcgcttaagacctgtat

SEQ ID NO: 750910 - DNA, 25 bp, Mus musculus
tagctactgctcatcaagggctcgg

SEQ ID NO: 750911 - DNA, 25 bp, Mus musculus
tagctactgctcttcaagggctcgg

SEQ ID NO: 750912 - DNA, 25 bp, Mus musculus
tagctactggatcaagcaaggaagc

SEQ ID NO: 750913 - DNA, 25 bp, Mus musculus
tagctactggatgaagcaaggaagc

SEQ ID NO: 750914 - DNA, 25 bp, Mus musculus
tagctacttgaaaggcacagggtgg

SEQ ID NO: 750915 - DNA, 25 bp, Mus musculus
tagctacttgaatggcacagggtgg

SEQ ID NO: 750916 - DNA, 25 bp, Mus musculus
tagctagcccaaagatgtggcccgt

SEQ ID NO: 750917 - DNA, 25 bp, Mus musculus
tagctagcccaatgatgtggcccgt

SEQ ID NO: 750918 - DNA, 25 bp, Mus musculus
tagctagggtagagaggcacacttc

SEQ ID NO: 750919 - DNA, 25 bp, Mus musculus
tagctagggtagtgaggcacacttc

SEQ ID NO: 750920 - DNA, 25 bp, Mus musculus
tagctagtccagcaaagatgcaggc

SEQ ID NO: 750921 - DNA, 25 bp, Mus musculus
tagctagtccaggaaagatgcaggc

SEQ ID NO: 750922 - DNA, 25 bp, Mus musculus
tagctatcatctatgcaccctgcct

SEQ ID NO: 750923 - DNA, 25 bp, Mus musculus
tagctatcatctttgcaccctgcct

SEQ ID NO: 750924 - DNA, 25 bp, Mus musculus
tagctatcgacaacaaaatagagca

SEQ ID NO: 750925 - DNA, 25 bp, Mus musculus
tagctatcgacatcaaaatagagca

SEQ ID NO: 750926 - DNA, 25 bp, Mus musculus
tagctatgcagaccgacccgcgggt

SEQ ID NO: 750927 - DNA, 25 bp, Mus musculus
tagctatgcagagcgacccgcgggt

SEQ ID NO: 750928 - DNA, 25 bp, Mus musculus
tagctcaaaccgattgggccaagtg

SEQ ID NO: 750929 - DNA, 25 bp, Mus musculus
tagctcaaaccgtttgggccaagtg

SEQ ID NO: 750930 - DNA, 25 bp, Mus musculus
tagctcactgaacgagtgcgcaggc

SEQ ID NO: 750931 - DNA, 25 bp, Mus musculus
tagctcactgaaggagtgcgcaggc

SEQ ID NO: 750932 - DNA, 25 bp, Mus musculus
tagctcagcaggacaatggcaccag

SEQ ID NO: 750933 - DNA, 25 bp, Mus musculus
tagctcagcaggtcaatggcaccag

SEQ ID NO: 750934 - DNA, 25 bp, Mus musculus
tagctcaggttgacttcaagctcag

SEQ ID NO: 750935 - DNA, 25 bp, Mus musculus
tagctcaggttgtcttcaagctcag

SEQ ID NO: 750936 - DNA, 25 bp, Mus musculus
tagctcatgtcactgaaaggcagaa

SEQ ID NO: 750937 - DNA, 25 bp, Mus musculus
tagctcatgtcagtgaaaggcagaa

SEQ ID NO: 750938 - DNA, 25 bp, Mus musculus
tagctccactggaggccaatacaga

SEQ ID NO: 750939 - DNA, 25 bp, Mus musculus
tagctccactggtggccaatacaga

SEQ ID NO: 750940 - DNA, 25 bp, Mus musculus
tagctccagtacagggcccggctgc

SEQ ID NO: 750941 - DNA, 25 bp, Mus musculus
tagctccagtactgggcccggctgc

SEQ ID NO: 750942 - DNA, 25 bp, Mus musculus
tagctccatggactttagaaattat

SEQ ID NO: 750943 - DNA, 25 bp, Mus musculus
tagctccatggagtttagaaattat

SEQ ID NO: 750944 - DNA, 25 bp, Mus musculus
tagctcccaagtcatttaaagtgtg

SEQ ID NO: 750945 - DNA, 25 bp, Mus musculus
tagctcccaagtgatttaaagtgtg

SEQ ID NO: 750946 - DNA, 25 bp, Mus musculus
tagctccgaagacgttgtcagtgag

SEQ ID NO: 750947 - DNA, 25 bp, Mus musculus
tagctccgaagaggttgtcagtgag

SEQ ID NO: 750948 - DNA, 25 bp, Mus musculus
tagctccgtggaccctgtttccatg

SEQ ID NO: 750949 - DNA, 25 bp, Mus musculus
tagctccgtggagcctgtttccatg

SEQ ID NO: 750950 - DNA, 25 bp, Mus musculus
tagctcctacatcagtgccctcgag

SEQ ID NO: 750951 - DNA, 25 bp, Mus musculus
tagctcctacatgagtgccctcgag

SEQ ID NO: 750952 - DNA, 25 bp, Mus musculus
tagctcctcagaagccctgctgtgt

SEQ ID NO: 750953 - DNA, 25 bp, Mus musculus
tagctcctcagatgccctgctgtgt

SEQ ID NO: 750954 - DNA, 25 bp, Mus musculus
tagctcctccagaggtgccccagac

SEQ ID NO: 750955 - DNA, 25 bp, Mus musculus
tagctcctccagtggtgccccagac

SEQ ID NO: 750956 - DNA, 25 bp, Mus musculus
tagctccttgtcatatgccgggcaa

SEQ ID NO: 750957 - DNA, 25 bp, Mus musculus
tagctccttgtcttatgccgggcaa

SEQ ID NO: 750958 - DNA, 25 bp, Mus musculus
tagctcgagactatcctttcttgac

SEQ ID NO: 750959 - DNA, 25 bp, Mus musculus
tagctcgagactttcctttcttgac

SEQ ID NO: 750960 - DNA, 25 bp, Mus musculus
tagctcgagtgtataaacaatcaga

SEQ ID NO: 750961 - DNA, 25 bp, Mus musculus
tagctcgagtgtttaaacaatcaga

SEQ ID NO: 750962 - DNA, 25 bp, Mus musculus
tagctcgcccggcatagcctgagag

SEQ ID NO: 750963 - DNA, 25 bp, Mus musculus
tagctcgcccgggatagcctgagag

SEQ ID NO: 750964 - DNA, 25 bp, Mus musculus
tagctcgggagaccagccatcagcc

SEQ ID NO: 750965 - DNA, 25 bp, Mus musculus
tagctcgggagagcagccatcagcc

SEQ ID NO: 750966 - DNA, 25 bp, Mus musculus
tagctcgggctgagcgccgagccat

SEQ ID NO: 750967 - DNA, 25 bp, Mus musculus
tagctcgggctgtgcgccgagccat

SEQ ID NO: 750968 - DNA, 25 bp, Mus musculus
tagctctagcagaactacttggatt

SEQ ID NO: 750969 - DNA, 25 bp, Mus musculus
tagctctagcagcacttcagggttg

SEQ ID NO: 750970 - DNA, 25 bp, Mus musculus
tagctctagcaggacttcagggttg

SEQ ID NO: 750971 - DNA, 25 bp, Mus musculus
tagctctagcagtactacttggatt

SEQ ID NO: 750972 - DNA, 25 bp, Mus musculus
tagctctcaagtcaggatgttgcgg

SEQ ID NO: 750973 - DNA, 25 bp, Mus musculus
tagctctcaagtgaggatgttgcgg

SEQ ID NO: 750974 - DNA, 25 bp, Mus musculus
tagctctcctaaaccagccttgaga

SEQ ID NO: 750975 - DNA, 25 bp, Mus musculus
tagctctcctaatccagccttgaga

SEQ ID NO: 750976 - DNA, 25 bp, Mus musculus
tagctctcggagatttgacagtccc

SEQ ID NO: 750977 - DNA, 25 bp, Mus musculus
tagctctcggagttttgacagtccc

SEQ ID NO: 750978 - DNA, 25 bp, Mus musculus
tagctctcgtaactgagtccctcgc

SEQ ID NO: 750979 - DNA, 25 bp, Mus musculus
tagctctcgtaagtgagtccctcgc

SEQ ID NO: 750980 - DNA, 25 bp, Mus musculus
tagctctgaaaacgctgtcttctag

SEQ ID NO: 750981 - DNA, 25 bp, Mus musculus
tagctctgaaaaggctgtcttctag

SEQ ID NO: 750982 - DNA, 25 bp, Mus musculus
tagctctgagcaacactcgagctgt

SEQ ID NO: 750983 - DNA, 25 bp, Mus musculus
tagctctgagcatcactcgagctgt

SEQ ID NO: 750984 - DNA, 25 bp, Mus musculus
tagctctgcattcttgaccacgtcc

SEQ ID NO: 750985 - DNA, 25 bp, Mus musculus
tagctctgcattgttgaccacgtcc

SEQ ID NO: 750986 - DNA, 25 bp, Mus musculus
tagctctgctttcccacgggcaggg

SEQ ID NO: 750987 - DNA, 25 bp, Mus musculus
tagctctgctttgccacgggcaggg

SEQ ID NO: 750988 - DNA, 25 bp, Mus musculus
tagctctgggctacacatctttggg

SEQ ID NO: 750989 - DNA, 25 bp, Mus musculus
tagctctgggcttcacatctttggg

SEQ ID NO: 750990 - DNA, 25 bp, Mus musculus
tagctctggttgctgacccagctgt

SEQ ID NO: 750991 - DNA, 25 bp, Mus musculus
tagctctggttggtgacccagctgt

SEQ ID NO: 750992 - DNA, 25 bp, Mus musculus
tagctctgtggtagcgtcatgatcc

SEQ ID NO: 750993 - DNA, 25 bp, Mus musculus
tagctctgtggttgcgtcatgatcc

SEQ ID NO: 750994 - DNA, 25 bp, Mus musculus
tagctcttcttactcccctagatta

SEQ ID NO: 750995 - DNA, 25 bp, Mus musculus
tagctcttcttagtcccctagatta

SEQ ID NO: 750996 - DNA, 25 bp, Mus musculus
tagctcttggaactcgtaggatggc

SEQ ID NO: 750997 - DNA, 25 bp, Mus musculus
tagctcttggaagtcgtaggatggc

SEQ ID NO: 750998 - DNA, 25 bp, Mus musculus
tagctgaacttgctacgcggctctt

SEQ ID NO: 750999 - DNA, 25 bp, Mus musculus
tagctgaacttggtacgcggctctt

SEQ ID NO: 751000 - DNA, 25 bp, Mus musculus
tagctgaagcttctgccccattgtc

SEQ ID NO: 751001 - DNA, 25 bp, Mus musculus
tagctgaagcttgtgccccattgtc

SEQ ID NO: 751002 - DNA, 25 bp, Mus musculus
tagctgaaggccacgccttctacca

SEQ ID NO: 751003 - DNA, 25 bp, Mus musculus
tagctgaaggcctcgccttctacca

SEQ ID NO: 751004 - DNA, 25 bp, Mus musculus
tagctgaagtagaggataactacaa

SEQ ID NO: 751005 - DNA, 25 bp, Mus musculus
tagctgaagtagtggataactacaa

SEQ ID NO: 751006 - DNA, 25 bp, Mus musculus
tagctgaattgcaggctcacaagat

SEQ ID NO: 751007 - DNA, 25 bp, Mus musculus
tagctgaattgctggctcacaagat

SEQ ID NO: 751008 - DNA, 25 bp, Mus musculus
tagctgaccagaagaggctcaacaa

SEQ ID NO: 751009 - DNA, 25 bp, Mus musculus
tagctgaccagatgaggctcaacaa

SEQ ID NO: 751010 - DNA, 25 bp, Mus musculus
tagctgaccagcacctagagggcag

SEQ ID NO: 751011 - DNA, 25 bp, Mus musculus
tagctgaccagctcctagagggcag

SEQ ID NO: 751012 - DNA, 25 bp, Mus musculus
tagctgacgagtatgaggccaaagt

SEQ ID NO: 751013 - DNA, 25 bp, Mus musculus
tagctgacgagtttgaggccaaagt

SEQ ID NO: 751014 - DNA, 25 bp, Mus musculus
tagctgacgggaaggtgttcaccac

SEQ ID NO: 751015 - DNA, 25 bp, Mus musculus
tagctgacgggatggtgttcaccac

SEQ ID NO: 751016 - DNA, 25 bp, Mus musculus
tagctgagcacgagcagtacatggc

SEQ ID NO: 751017 - DNA, 25 bp, Mus musculus
tagctgagcacgtgcagtacatggc

SEQ ID NO: 751018 - DNA, 25 bp, Mus musculus
tagctgaggctgacggaaggaccta

SEQ ID NO: 751019 - DNA, 25 bp, Mus musculus
tagctgaggctgtcggaaggaccta

SEQ ID NO: 751020 - DNA, 25 bp, Mus musculus
tagctgatgcttcccctggaaagcg

SEQ ID NO: 751021 - DNA, 25 bp, Mus musculus
tagctgatgcttgccctggaaagcg

SEQ ID NO: 751022 - DNA, 25 bp, Mus musculus
tagctgcacttacttttcgcctctg

SEQ ID NO: 751023 - DNA, 25 bp, Mus musculus
tagctgcacttagttttcgcctctg

SEQ ID NO: 751024 - DNA, 25 bp, Mus musculus
tagctgcagagcaggatcctcagga

SEQ ID NO: 751025 - DNA, 25 bp, Mus musculus
tagctgcagagctggatcctcagga

SEQ ID NO: 751026 - DNA, 25 bp, Mus musculus
tagctgcagctgattagaaaggccc

SEQ ID NO: 751027 - DNA, 25 bp, Mus musculus
tagctgcagctgtttagaaaggccc

SEQ ID NO: 751028 - DNA, 25 bp, Mus musculus
tagctgcagcttatgtaactcggaa

SEQ ID NO: 751029 - DNA, 25 bp, Mus musculus
tagctgcagcttttgtaactcggaa

SEQ ID NO: 751030 - DNA, 25 bp, Mus musculus
tagctgccaatcagcacctcattgt

SEQ ID NO: 751031 - DNA, 25 bp, Mus musculus
tagctgccaatctgcacctcattgt

SEQ ID NO: 751032 - DNA, 25 bp, Mus musculus
tagctgccagatactctcggccaac

SEQ ID NO: 751033 - DNA, 25 bp, Mus musculus
tagctgccagattctctcggccaac

SEQ ID NO: 751034 - DNA, 25 bp, Mus musculus
tagctgcccagtagctctcgaacct

SEQ ID NO: 751035 - DNA, 25 bp, Mus musculus
tagctgcccagttgctctcgaacct

SEQ ID NO: 751036 - DNA, 25 bp, Mus musculus
tagctgccctagaagaaagtcctgt

SEQ ID NO: 751037 - DNA, 25 bp, Mus musculus
tagctgccctagtagaaagtcctgt

SEQ ID NO: 751038 - DNA, 25 bp, Mus musculus
tagctgccgttcactacgtcatcgt

SEQ ID NO: 751039 - DNA, 25 bp, Mus musculus
tagctgccgttctctacgtcatcgt

SEQ ID NO: 751040 - DNA, 25 bp, Mus musculus
tagctgcctgccagatgaatcggcg

SEQ ID NO: 751041 - DNA, 25 bp, Mus musculus
tagctgcctgcctgatgaatcggcg

SEQ ID NO: 751042 - DNA, 25 bp, Mus musculus
tagctgcctgttaccctagccaggg

SEQ ID NO: 751043 - DNA, 25 bp, Mus musculus
tagctgcctgtttccctagccaggg

SEQ ID NO: 751044 - DNA, 25 bp, Mus musculus
tagctgccttgaatctaactctata

SEQ ID NO: 751045 - DNA, 25 bp, Mus musculus
tagctgccttgattctaactctata

SEQ ID NO: 751046 - DNA, 25 bp, Mus musculus
tagctgcgcagtatccccgaagtaa

SEQ ID NO: 751047 - DNA, 25 bp, Mus musculus
tagctgcgcagtttccccgaagtaa

SEQ ID NO: 751048 - DNA, 25 bp, Mus musculus
tagctgcggatgagttgtgaagcca

SEQ ID NO: 751049 - DNA, 25 bp, Mus musculus
tagctgcggatgtgttgtgaagcca

SEQ ID NO: 751050 - DNA, 25 bp, Mus musculus
tagctgcgggaaacactaaagtcca

SEQ ID NO: 751051 - DNA, 25 bp, Mus musculus
tagctgcgggaatcactaaagtcca

SEQ ID NO: 751052 - DNA, 25 bp, Mus musculus
tagctgctcagcagaactggcgcca

SEQ ID NO: 751053 - DNA, 25 bp, Mus musculus
tagctgctcagctgaactggcgcca

SEQ ID NO: 751054 - DNA, 25 bp, Mus musculus
tagctgctcagtacaccaccatcgg

SEQ ID NO: 751055 - DNA, 25 bp, Mus musculus
tagctgctcagttcaccaccatcgg

SEQ ID NO: 751056 - DNA, 25 bp, Mus musculus
tagctgctggagacaaaccaagcca

SEQ ID NO: 751057 - DNA, 25 bp, Mus musculus
tagctgctggagtcaaaccaagcca

SEQ ID NO: 751058 - DNA, 25 bp, Mus musculus
tagctgctgtgtccaacaaatttcg

SEQ ID NO: 751059 - DNA, 25 bp, Mus musculus
tagctgctgtgtgcaacaaatttcg

SEQ ID NO: 751060 - DNA, 25 bp, Mus musculus
tagctgctgttcaaacatcacagcc

SEQ ID NO: 751061 - DNA, 25 bp, Mus musculus
tagctgctgttctaacatcacagcc

SEQ ID NO: 751062 - DNA, 25 bp, Mus musculus
tagctgctttttcttcccttcctgg

SEQ ID NO: 751063 - DNA, 25 bp, Mus musculus
tagctgctttttgttcccttcctgg

SEQ ID NO: 751064 - DNA, 25 bp, Mus musculus
tagctggaaacacttctgtgtgaac

SEQ ID NO: 751065 - DNA, 25 bp, Mus musculus
tagctggaaacagttctgtgtgaac

SEQ ID NO: 751066 - DNA, 25 bp, Mus musculus
tagctggaaatgaggtgcgtgtcct

SEQ ID NO: 751067 - DNA, 25 bp, Mus musculus
tagctggaaatgtggtgcgtgtcct

SEQ ID NO: 751068 - DNA, 25 bp, Mus musculus
tagctggacacgacaaccgagtcag

SEQ ID NO: 751069 - DNA, 25 bp, Mus musculus
tagctggacacgtcaaccgagtcag

SEQ ID NO: 751070 - DNA, 25 bp, Mus musculus
tagctggagcctagttcatcttggg

SEQ ID NO: 751071 - DNA, 25 bp, Mus musculus
tagctggagccttgttcatcttggg

SEQ ID NO: 751072 - DNA, 25 bp, Mus musculus
tagctggagctcatagaaagatgcc

SEQ ID NO: 751073 - DNA, 25 bp, Mus musculus
tagctggagctcttagaaagatgcc

SEQ ID NO: 751074 - DNA, 25 bp, Mus musculus
tagctggaggaacaaactactgaac

SEQ ID NO: 751075 - DNA, 25 bp, Mus musculus
tagctggaggaagaaactactgaac

SEQ ID NO: 751076 - DNA, 25 bp, Mus musculus
tagctggagggacaaataagaaaac

SEQ ID NO: 751077 - DNA, 25 bp, Mus musculus
tagctggagggagaaataagaaaac

SEQ ID NO: 751078 - DNA, 25 bp, Mus musculus
tagctggaggttattaagcccctcc

SEQ ID NO: 751079 - DNA, 25 bp, Mus musculus
tagctggaggtttttaagcccctcc

SEQ ID NO: 751080 - DNA, 25 bp, Mus musculus
tagctggagttgctactattgtcca

SEQ ID NO: 751081 - DNA, 25 bp, Mus musculus
tagctggagttggtactattgtcca

SEQ ID NO: 751082 - DNA, 25 bp, Mus musculus
tagctggcacctctctgtcaggagc

SEQ ID NO: 751083 - DNA, 25 bp, Mus musculus
tagctggcacctgtctgtcaggagc

SEQ ID NO: 751084 - DNA, 25 bp, Mus musculus
tagctgggagtaaggccaccctact

SEQ ID NO: 751085 - DNA, 25 bp, Mus musculus
tagctgggagtatggccaccctact

SEQ ID NO: 751086 - DNA, 25 bp, Mus musculus
tagctgggatcaccgtctttcaaca

SEQ ID NO: 751087 - DNA, 25 bp, Mus musculus
tagctgggatcagcgtctttcaaca

SEQ ID NO: 751088 - DNA, 25 bp, Mus musculus
tagctggggcttagtcttcagagcc

SEQ ID NO: 751089 - DNA, 25 bp, Mus musculus
tagctggggctttgtcttcagagcc

SEQ ID NO: 751090 - DNA, 25 bp, Mus musculus
tagctgggtactaccatgccaatgc

SEQ ID NO: 751091 - DNA, 25 bp, Mus musculus
tagctgggtacttccatgccaatgc

SEQ ID NO: 751092 - DNA, 25 bp, Mus musculus
tagctgggttttcttcccgctggcg

SEQ ID NO: 751093 - DNA, 25 bp, Mus musculus
tagctgggttttgttcccgctggcg

SEQ ID NO: 751094 - DNA, 25 bp, Mus musculus
tagctggtctgaccatctctgccat

SEQ ID NO: 751095 - DNA, 25 bp, Mus musculus
tagctggtctgagcatctctgccat

SEQ ID NO: 751096 - DNA, 25 bp, Mus musculus
tagctggtgaatcaaggatgacagc

SEQ ID NO: 751097 - DNA, 25 bp, Mus musculus
tagctggtgaatgaaggatgacagc

SEQ ID NO: 751098 - DNA, 25 bp, Mus musculus
tagctggtgccaagataattgaagt

SEQ ID NO: 751099 - DNA, 25 bp, Mus musculus
tagctggtgccatgataattgaagt

SEQ ID NO: 751100 - DNA, 25 bp, Mus musculus
tagctggtttcgagaaggagtgttc

SEQ ID NO: 751101 - DNA, 25 bp, Mus musculus
tagctggtttcgtgaaggagtgttc

SEQ ID NO: 751102 - DNA, 25 bp, Mus musculus
tagctgtaaaccagagccgggagcc

SEQ ID NO: 751103 - DNA, 25 bp, Mus musculus
tagctgtaaacctgagccgggagcc

SEQ ID NO: 751104 - DNA, 25 bp, Mus musculus
tagctgtagcttagggctacagagg

SEQ ID NO: 751105 - DNA, 25 bp, Mus musculus
tagctgtagctttgggctacagagg

SEQ ID NO: 751106 - DNA, 25 bp, Mus musculus
tagctgtatcccagtgggtggccgt

SEQ ID NO: 751107 - DNA, 25 bp, Mus musculus
tagctgtatccctgtgggtggccgt

SEQ ID NO: 751108 - DNA, 25 bp, Mus musculus
tagctgtccatgcagagaacttcca

SEQ ID NO: 751109 - DNA, 25 bp, Mus musculus
tagctgtccatggagagaacttcca

SEQ ID NO: 751110 - DNA, 25 bp, Mus musculus
tagctgtgaagaacatcgacaagac

SEQ ID NO: 751111 - DNA, 25 bp, Mus musculus
tagctgtgaagatcatcgacaagac

SEQ ID NO: 751112 - DNA, 25 bp, Mus musculus
tagctgtgaccgcaaggatggtcac

SEQ ID NO: 751113 - DNA, 25 bp, Mus musculus
tagctgtgaccggaaggatggtcac

SEQ ID NO: 751114 - DNA, 25 bp, Mus musculus
tagctgtgacgtataaccgcgatgg

SEQ ID NO: 751115 - DNA, 25 bp, Mus musculus
tagctgtgacgtttaaccgcgatgg

SEQ ID NO: 751116 - DNA, 25 bp, Mus musculus
tagctgtgagctccaggcaaacttt

SEQ ID NO: 751117 - DNA, 25 bp, Mus musculus
tagctgtgagctgcaggcaaacttt

SEQ ID NO: 751118 - DNA, 25 bp, Mus musculus
tagctgtgcccaacaagagagatga

SEQ ID NO: 751119 - DNA, 25 bp, Mus musculus
tagctgtgcccatcaagagagatga

SEQ ID NO: 751120 - DNA, 25 bp, Mus musculus
tagctgtgctggaggcggaataatt

SEQ ID NO: 751121 - DNA, 25 bp, Mus musculus
tagctgtgctggtggcggaataatt

SEQ ID NO: 751122 - DNA, 25 bp, Mus musculus
tagctgtggaatacacctggcagga

SEQ ID NO: 751123 - DNA, 25 bp, Mus musculus
tagctgtggaattcacctggcagga

SEQ ID NO: 751124 - DNA, 25 bp, Mus musculus
tagctgtggcccatcattctgccgt

SEQ ID NO: 751125 - DNA, 25 bp, Mus musculus
tagctgtggcccttcattctgccgt

SEQ ID NO: 751126 - DNA, 25 bp, Mus musculus
tagctgtggcctagccagaagagcc

SEQ ID NO: 751127 - DNA, 25 bp, Mus musculus
tagctgtggccttgccagaagagcc

SEQ ID NO: 751128 - DNA, 25 bp, Mus musculus
tagctgtggcttctgaccgctgctc

SEQ ID NO: 751129 - DNA, 25 bp, Mus musculus
tagctgtggcttgtgaccgctgctc

SEQ ID NO: 751130 - DNA, 25 bp, Mus musculus
tagctgtgggctagaaatgtcctta

SEQ ID NO: 751131 - DNA, 25 bp, Mus musculus
tagctgtgggcttgaaatgtcctta

SEQ ID NO: 751132 - DNA, 25 bp, Mus musculus
tagctgtgtcagctgtcctcactag

SEQ ID NO: 751133 - DNA, 25 bp, Mus musculus
tagctgtgtcaggtgtcctcactag

SEQ ID NO: 751134 - DNA, 25 bp, Mus musculus
tagctgtgtcctccatcgttctggg

SEQ ID NO: 751135 - DNA, 25 bp, Mus musculus
tagctgtgtcctgcatcgttctggg

SEQ ID NO: 751136 - DNA, 25 bp, Mus musculus
tagctgtgtggtactcatggtactt

SEQ ID NO: 751137 - DNA, 25 bp, Mus musculus
tagctgtgtggttctcatggtactt

SEQ ID NO: 751138 - DNA, 25 bp, Mus musculus
tagctgttgccaatactgtaaggta

SEQ ID NO: 751139 - DNA, 25 bp, Mus musculus
tagctgttgccattactgtaaggta

SEQ ID NO: 751140 - DNA, 25 bp, Mus musculus
tagctgttgcccagtctggttttcc

SEQ ID NO: 751141 - DNA, 25 bp, Mus musculus
tagctgttgccctgtctggttttcc

SEQ ID NO: 751142 - DNA, 25 bp, Mus musculus
tagctgtttcacaccctggaatggg

SEQ ID NO: 751143 - DNA, 25 bp, Mus musculus
tagctgtttcactccctggaatggg

SEQ ID NO: 751144 - DNA, 25 bp, Mus musculus
tagcttaaggcaaacagttttacag

SEQ ID NO: 751145 - DNA, 25 bp, Mus musculus
tagcttaaggcatacagttttacag

SEQ ID NO: 751146 - DNA, 25 bp, Mus musculus
tagcttagaaccacctggagaacca

SEQ ID NO: 751147 - DNA, 25 bp, Mus musculus
tagcttagaacctcctggagaacca

SEQ ID NO: 751148 - DNA, 25 bp, Mus musculus
tagcttagtctcagagtccccaggg

SEQ ID NO: 751149 - DNA, 25 bp, Mus musculus
tagcttagtctctgagtccccaggg

SEQ ID NO: 751150 - DNA, 25 bp, Mus musculus
tagcttagtggtcaagtcattgccc

SEQ ID NO: 751151 - DNA, 25 bp, Mus musculus
tagcttagtggtgaagtcattgccc

SEQ ID NO: 751152 - DNA, 25 bp, Mus musculus
tagcttatacccatcacggacgaca

SEQ ID NO: 751153 - DNA, 25 bp, Mus musculus
tagcttatacccttcacggacgaca

SEQ ID NO: 751154 - DNA, 25 bp, Mus musculus
tagcttatgccacgaagttaatcgg

SEQ ID NO: 751155 - DNA, 25 bp, Mus musculus
tagcttatgccaggaagttaatcgg

SEQ ID NO: 751156 - DNA, 25 bp, Mus musculus
tagcttcagcaaacacagatgatga

SEQ ID NO: 751157 - DNA, 25 bp, Mus musculus
tagcttcagcaatcacagatgatga

SEQ ID NO: 751158 - DNA, 25 bp, Mus musculus
tagcttccgccaatacaagtatgat

SEQ ID NO: 751159 - DNA, 25 bp, Mus musculus
tagcttccgccattacaagtatgat

SEQ ID NO: 751160 - DNA, 25 bp, Mus musculus
tagcttccgctgcaacccatggaaa

SEQ ID NO: 751161 - DNA, 25 bp, Mus musculus
tagcttccgctggaacccatggaaa

SEQ ID NO: 751162 - DNA, 25 bp, Mus musculus
tagcttcgccatctacatggccctt

SEQ ID NO: 751163 - DNA, 25 bp, Mus musculus
tagcttcgccatgtacatggccctt

SEQ ID NO: 751164 - DNA, 25 bp, Mus musculus
tagcttgaccttagctagaaattgc

SEQ ID NO: 751165 - DNA, 25 bp, Mus musculus
tagcttgacctttgctagaaattgc

SEQ ID NO: 751166 - DNA, 25 bp, Mus musculus
tagcttgcatctcagcacttctttc

SEQ ID NO: 751167 - DNA, 25 bp, Mus musculus
tagcttgcatctgagcacttctttc

SEQ ID NO: 751168 - DNA, 25 bp, Mus musculus
tagcttgccagccacagagtacaga

SEQ ID NO: 751169 - DNA, 25 bp, Mus musculus
tagcttgccagcgacagagtacaga

SEQ ID NO: 751170 - DNA, 25 bp, Mus musculus
tagcttgcctatccacggtgctgtg

SEQ ID NO: 751171 - DNA, 25 bp, Mus musculus
tagcttgcctatgcacggtgctgtg

SEQ ID NO: 751172 - DNA, 25 bp, Mus musculus
tagcttgcctctatgtaataatgcg

SEQ ID NO: 751173 - DNA, 25 bp, Mus musculus
tagcttgcctctttgtaataatgcg

SEQ ID NO: 751174 - DNA, 25 bp, Mus musculus
tagcttggaagcagtgccatcttgc

SEQ ID NO: 751175 - DNA, 25 bp, Mus musculus
tagcttggaagctgtgccatcttgc

SEQ ID NO: 751176 - DNA, 25 bp, Mus musculus
tagcttggacaaaaggaagttctcc

SEQ ID NO: 751177 - DNA, 25 bp, Mus musculus
tagcttggacaataggaagttctcc

SEQ ID NO: 751178 - DNA, 25 bp, Mus musculus
tagcttggggccacccatggacatg

SEQ ID NO: 751179 - DNA, 25 bp, Mus musculus
tagcttggggcctcccatggacatg

SEQ ID NO: 751180 - DNA, 25 bp, Mus musculus
tagcttgggtctagcctactggcac

SEQ ID NO: 751181 - DNA, 25 bp, Mus musculus
tagcttgggtcttgcctactggcac

SEQ ID NO: 751182 - DNA, 25 bp, Mus musculus
tagcttggtggtctcgtttttggcc

SEQ ID NO: 751183 - DNA, 25 bp, Mus musculus
tagcttggtggtgtcgtttttggcc

SEQ ID NO: 751184 - DNA, 25 bp, Mus musculus
tagcttggttagcacatggctcagc

SEQ ID NO: 751185 - DNA, 25 bp, Mus musculus
tagcttggttaggacatggctcagc

SEQ ID NO: 751186 - DNA, 25 bp, Mus musculus
tagcttgtgagtcttcggtccgaag

SEQ ID NO: 751187 - DNA, 25 bp, Mus musculus
tagcttgtgagtgttcggtccgaag

SEQ ID NO: 751188 - DNA, 25 bp, Mus musculus
tagctttatttgctcatcgtgaaga

SEQ ID NO: 751189 - DNA, 25 bp, Mus musculus
tagctttatttggtcatcgtgaaga

SEQ ID NO: 751190 - DNA, 25 bp, Mus musculus
tagctttcaccactgtatggtgggt

SEQ ID NO: 751191 - DNA, 25 bp, Mus musculus
tagctttcaccagtgtatggtgggt

SEQ ID NO: 751192 - DNA, 25 bp, Mus musculus
tagctttcagctagcgccatgcctt

SEQ ID NO: 751193 - DNA, 25 bp, Mus musculus
tagctttcagcttgcgccatgcctt

SEQ ID NO: 751194 - DNA, 25 bp, Mus musculus
tagctttccggtctcagccacggtg

SEQ ID NO: 751195 - DNA, 25 bp, Mus musculus
tagctttccggtgtcagccacggtg

SEQ ID NO: 751196 - DNA, 25 bp, Mus musculus
tagctttcttcaaggagtatgtgaa

SEQ ID NO: 751197 - DNA, 25 bp, Mus musculus
tagctttcttcatggagtatgtgaa

SEQ ID NO: 751198 - DNA, 25 bp, Mus musculus
tagctttgagctcatgcgggaaccc

SEQ ID NO: 751199 - DNA, 25 bp, Mus musculus
tagctttgagctgatgcgggaaccc

SEQ ID NO: 751200 - DNA, 25 bp, Mus musculus
tagctttgccatcggtcgagatccg

SEQ ID NO: 751201 - DNA, 25 bp, Mus musculus
tagctttgccatgggtcgagatccg

SEQ ID NO: 751202 - DNA, 25 bp, Mus musculus
tagctttgggcgagtcactcccacc

SEQ ID NO: 751203 - DNA, 25 bp, Mus musculus
tagctttgggcgtgtcactcccacc

SEQ ID NO: 751204 - DNA, 25 bp, Mus musculus
tagctttgtactagctccagaacga

SEQ ID NO: 751205 - DNA, 25 bp, Mus musculus
tagctttgtacttgctccagaacga

SEQ ID NO: 751206 - DNA, 25 bp, Mus musculus
tagctttgtattccagccctggaag

SEQ ID NO: 751207 - DNA, 25 bp, Mus musculus
tagctttgtattgcagccctggaag

SEQ ID NO: 751208 - DNA, 25 bp, Mus musculus
tagcttttatgccagtgcacacagg

SEQ ID NO: 751209 - DNA, 25 bp, Mus musculus
tagcttttatgcgagtgcacacagg

SEQ ID NO: 751210 - DNA, 25 bp, Mus musculus
tagcttttccaacctggaagggctg

SEQ ID NO: 751211 - DNA, 25 bp, Mus musculus
tagcttttccaagctggaagggctg

SEQ ID NO: 751212 - DNA, 25 bp, Mus musculus
tagcttttctggactgtgtgcagca

SEQ ID NO: 751213 - DNA, 25 bp, Mus musculus
tagcttttctggtctgtgtgcagca

SEQ ID NO: 751214 - DNA, 25 bp, Mus musculus
tagcttttggtcaacaatccaacag

SEQ ID NO: 751215 - DNA, 25 bp, Mus musculus
tagcttttggtctacaatccaacag

SEQ ID NO: 751216 - DNA, 25 bp, Mus musculus
tagcttttggttcctcgccctggaa

SEQ ID NO: 751217 - DNA, 25 bp, Mus musculus
tagcttttggttgctcgccctggaa

SEQ ID NO: 751218 - DNA, 25 bp, Mus musculus
tagctttttagacggaacagctttt

SEQ ID NO: 751219 - DNA, 25 bp, Mus musculus
tagctttttagagggaacagctttt

SEQ ID NO: 751220 - DNA, 25 bp, Mus musculus
tagctttttctcacatgggccctgc

SEQ ID NO: 751221 - DNA, 25 bp, Mus musculus
tagctttttctctcatgggccctgc

SEQ ID NO: 751222 - DNA, 25 bp, Mus musculus
tagctttttgccaggtgtgctcccc

SEQ ID NO: 751223 - DNA, 25 bp, Mus musculus
tagctttttgcctggtgtgctcccc

SEQ ID NO: 751224 - DNA, 25 bp, Mus musculus
taggaaaaaagaagcgacagaagaa

SEQ ID NO: 751225 - DNA, 25 bp, Mus musculus
taggaaaaaagatgcgacagaagaa

SEQ ID NO: 751226 - DNA, 25 bp, Mus musculus
taggaaaaatgcaagggccgagagc

SEQ ID NO: 751227 - DNA, 25 bp, Mus musculus
taggaaaaatgctagggccgagagc

SEQ ID NO: 751228 - DNA, 25 bp, Mus musculus
taggaaaaatttaagagccagaggg

SEQ ID NO: 751229 - DNA, 25 bp, Mus musculus
taggaaaaattttagagccagaggg

SEQ ID NO: 751230 - DNA, 25 bp, Mus musculus
taggaaaacatgcagaaaatggagc

SEQ ID NO: 751231 - DNA, 25 bp, Mus musculus
taggaaaacatggagaaaatggagc

SEQ ID NO: 751232 - DNA, 25 bp, Mus musculus
taggaaaactggcattaacttcaaa

SEQ ID NO: 751233 - DNA, 25 bp, Mus musculus
taggaaaactgggattaacttcaaa

SEQ ID NO: 751234 - DNA, 25 bp, Mus musculus
taggaaaagaacaccctgagctggg

SEQ ID NO: 751235 - DNA, 25 bp, Mus musculus
taggaaaagaactccctgagctggg

SEQ ID NO: 751236 - DNA, 25 bp, Mus musculus
taggaaacaacactaagctcataga

SEQ ID NO: 751237 - DNA, 25 bp, Mus musculus
taggaaacaacagtaagctcataga

SEQ ID NO: 751238 - DNA, 25 bp, Mus musculus
taggaaaccaaaccaagtctgtgag

SEQ ID NO: 751239 - DNA, 25 bp, Mus musculus
taggaaaccaaagcaagtctgtgag

SEQ ID NO: 751240 - DNA, 25 bp, Mus musculus
taggaaacccatccaaatatacaag

SEQ ID NO: 751241 - DNA, 25 bp, Mus musculus
taggaaacccatgcaaatatacaag

SEQ ID NO: 751242 - DNA, 25 bp, Mus musculus
taggaaacgtcaaaaccttgcaagg

SEQ ID NO: 751243 - DNA, 25 bp, Mus musculus
taggaaacgtcataaccttgcaagg

SEQ ID NO: 751244 - DNA, 25 bp, Mus musculus
taggaaactacaccctgcaggaatg

SEQ ID NO: 751245 - DNA, 25 bp, Mus musculus
taggaaactacagcctgcaggaatg

SEQ ID NO: 751246 - DNA, 25 bp, Mus musculus
taggaaaggattctcactgacatct

SEQ ID NO: 751247 - DNA, 25 bp, Mus musculus
taggaaaggattgtcactgacatct

SEQ ID NO: 751248 - DNA, 25 bp, Mus musculus
taggaaaggctaaggactgcacagc

SEQ ID NO: 751249 - DNA, 25 bp, Mus musculus
taggaaaggctatggactgcacagc

SEQ ID NO: 751250 - DNA, 25 bp, Mus musculus
taggaaataagtacagctataagtg

SEQ ID NO: 751251 - DNA, 25 bp, Mus musculus
taggaaataagttcagctataagtg

SEQ ID NO: 751252 - DNA, 25 bp, Mus musculus
taggaaatacataggatatatcttc

SEQ ID NO: 751253 - DNA, 25 bp, Mus musculus
taggaaatacattggatatatcttc

SEQ ID NO: 751254 - DNA, 25 bp, Mus musculus
taggaaatataaaccgggcccacca

SEQ ID NO: 751255 - DNA, 25 bp, Mus musculus
taggaaatataatccgggcccacca

SEQ ID NO: 751256 - DNA, 25 bp, Mus musculus
taggaaatcgacattgaatcccaat

SEQ ID NO: 751257 - DNA, 25 bp, Mus musculus
taggaaatcgactttgaatcccaat

SEQ ID NO: 751258 - DNA, 25 bp, Mus musculus
taggaaatgataatgcagtccaaca

SEQ ID NO: 751259 - DNA, 25 bp, Mus musculus
taggaaatgatattgcagtccaaca

SEQ ID NO: 751260 - DNA, 25 bp, Mus musculus
taggaaattgtgagtcatgtgaaga

SEQ ID NO: 751261 - DNA, 25 bp, Mus musculus
taggaaattgtgtgtcatgtgaaga

SEQ ID NO: 751262 - DNA, 25 bp, Mus musculus
taggaacaaccaaccacctttgatg

SEQ ID NO: 751263 - DNA, 25 bp, Mus musculus
taggaacaaccatccacctttgatg

SEQ ID NO: 751264 - DNA, 25 bp, Mus musculus
taggaacatctgctttcaccatgct

SEQ ID NO: 751265 - DNA, 25 bp, Mus musculus
taggaacatctggtttcaccatgct

SEQ ID NO: 751266 - DNA, 25 bp, Mus musculus
taggaacatgaaccgtggacgacac

SEQ ID NO: 751267 - DNA, 25 bp, Mus musculus
taggaacatgaagcgtggacgacac

SEQ ID NO: 751268 - DNA, 25 bp, Mus musculus
taggaacccagtagtgtggcgtaaa

SEQ ID NO: 751269 - DNA, 25 bp, Mus musculus
taggaacccagttgtgtggcgtaaa

SEQ ID NO: 751270 - DNA, 25 bp, Mus musculus
taggaacccctgcttactatgacgg

SEQ ID NO: 751271 - DNA, 25 bp, Mus musculus
taggaacccctggttactatgacgg

SEQ ID NO: 751272 - DNA, 25 bp, Mus musculus
taggaacctcatccttggaacgcat

SEQ ID NO: 751273 - DNA, 25 bp, Mus musculus
taggaacctcatgcttggaacgcat

SEQ ID NO: 751274 - DNA, 25 bp, Mus musculus
taggaacctgtcaaacacctgtagt

SEQ ID NO: 751275 - DNA, 25 bp, Mus musculus
taggaacctgtctaacacctgtagt

SEQ ID NO: 751276 - DNA, 25 bp, Mus musculus
taggaaccttaaccagcccctttga

SEQ ID NO: 751277 - DNA, 25 bp, Mus musculus
taggaaccttaagcagcccctttga

SEQ ID NO: 751278 - DNA, 25 bp, Mus musculus
taggaacgacttccatcagtggatc

SEQ ID NO: 751279 - DNA, 25 bp, Mus musculus
taggaacgacttgcatcagtggatc

SEQ ID NO: 751280 - DNA, 25 bp, Mus musculus
taggaacgcacccatacaaaaggct

SEQ ID NO: 751281 - DNA, 25 bp, Mus musculus
taggaacgcaccgatacaaaaggct

SEQ ID NO: 751282 - DNA, 25 bp, Mus musculus
taggaacggttgatccaaagagccc

SEQ ID NO: 751283 - DNA, 25 bp, Mus musculus
taggaacggttgttccaaagagccc

SEQ ID NO: 751284 - DNA, 25 bp, Mus musculus
taggaacgtcaaagaaagtgccgcc

SEQ ID NO: 751285 - DNA, 25 bp, Mus musculus
taggaacgtcaatgaaagtgccgcc

SEQ ID NO: 751286 - DNA, 25 bp, Mus musculus
taggaactcctgagccctggtgagt

SEQ ID NO: 751287 - DNA, 25 bp, Mus musculus
taggaactcctgtgccctggtgagt

SEQ ID NO: 751288 - DNA, 25 bp, Mus musculus
taggaactctgaacgtaaagtggtg

SEQ ID NO: 751289 - DNA, 25 bp, Mus musculus
taggaactctgatcgtaaagtggtg

SEQ ID NO: 751290 - DNA, 25 bp, Mus musculus
taggaactcttcatcagtctgcttc

SEQ ID NO: 751291 - DNA, 25 bp, Mus musculus
taggaactcttcttcagtctgcttc

SEQ ID NO: 751292 - DNA, 25 bp, Mus musculus
taggaactgcaactttcaccatggc

SEQ ID NO: 751293 - DNA, 25 bp, Mus musculus
taggaactgcaagtttcaccatggc

SEQ ID NO: 751294 - DNA, 25 bp, Mus musculus
taggaactgggtaagagagactgca

SEQ ID NO: 751295 - DNA, 25 bp, Mus musculus
taggaactgggttagagagactgca

SEQ ID NO: 751296 - DNA, 25 bp, Mus musculus
taggaacttagactcccagcttggg

SEQ ID NO: 751297 - DNA, 25 bp, Mus musculus
taggaacttagagtcccagcttggg

SEQ ID NO: 751298 - DNA, 25 bp, Mus musculus
taggaagacatccaactgcagccag

SEQ ID NO: 751299 - DNA, 25 bp, Mus musculus
taggaagacatcgaactgcagccag

SEQ ID NO: 751300 - DNA, 25 bp, Mus musculus
taggaagataataccagagaagaat

SEQ ID NO: 751301 - DNA, 25 bp, Mus musculus
taggaagataattccagagaagaat

SEQ ID NO: 751302 - DNA, 25 bp, Mus musculus
taggaagcactgacatagtggatgg

SEQ ID NO: 751303 - DNA, 25 bp, Mus musculus
taggaagcactgtcatagtggatgg

SEQ ID NO: 751304 - DNA, 25 bp, Mus musculus
taggaagcctttaccacatggcaga

SEQ ID NO: 751305 - DNA, 25 bp, Mus musculus
taggaagccttttccacatggcaga

SEQ ID NO: 751306 - DNA, 25 bp, Mus musculus
taggaagcttcacttaaccgcgggc

SEQ ID NO: 751307 - DNA, 25 bp, Mus musculus
taggaagcttcagttaaccgcgggc

SEQ ID NO: 751308 - DNA, 25 bp, Mus musculus
taggaagggcatctcaaattcaagg

SEQ ID NO: 751309 - DNA, 25 bp, Mus musculus
taggaagggcatgtcaaattcaagg

SEQ ID NO: 751310 - DNA, 25 bp, Mus musculus
taggaaggtcctccagacaatgtgc

SEQ ID NO: 751311 - DNA, 25 bp, Mus musculus
taggaaggtcctgcagacaatgtgc

SEQ ID NO: 751312 - DNA, 25 bp, Mus musculus
taggaagtcaacaagttggaaaagg

SEQ ID NO: 751313 - DNA, 25 bp, Mus musculus
taggaagtcaactagttggaaaagg

SEQ ID NO: 751314 - DNA, 25 bp, Mus musculus
taggaagtcttgcagccgctggaca

SEQ ID NO: 751315 - DNA, 25 bp, Mus musculus
taggaagtcttggagccgctggaca

SEQ ID NO: 751316 - DNA, 25 bp, Mus musculus
taggaataagcacgctattgcagtt

SEQ ID NO: 751317 - DNA, 25 bp, Mus musculus
taggaataagcaggctattgcagtt

SEQ ID NO: 751318 - DNA, 25 bp, Mus musculus
taggaataatacctccaaaaggctg

SEQ ID NO: 751319 - DNA, 25 bp, Mus musculus
taggaataatacgtccaaaaggctg

SEQ ID NO: 751320 - DNA, 25 bp, Mus musculus
taggaatacgagcagttttcagcaa

SEQ ID NO: 751321 - DNA, 25 bp, Mus musculus
taggaatacgaggagttttcagcaa

SEQ ID NO: 751322 - DNA, 25 bp, Mus musculus
taggaatcagtgctctatgtctcga

SEQ ID NO: 751323 - DNA, 25 bp, Mus musculus
taggaatcagtggtctatgtctcga

SEQ ID NO: 751324 - DNA, 25 bp, Mus musculus
taggaatccattctatgcgtgcctg

SEQ ID NO: 751325 - DNA, 25 bp, Mus musculus
taggaatccattgtatgcgtgcctg

SEQ ID NO: 751326 - DNA, 25 bp, Mus musculus
taggaatcctagactaagatcagaa

SEQ ID NO: 751327 - DNA, 25 bp, Mus musculus
taggaatcctagtctaagatcagaa

SEQ ID NO: 751328 - DNA, 25 bp, Mus musculus
taggaatccttacaactatggctgc

SEQ ID NO: 751329 - DNA, 25 bp, Mus musculus
taggaatccttagaactatggctgc

SEQ ID NO: 751330 - DNA, 25 bp, Mus musculus
taggaatctcagaagctgggatgga

SEQ ID NO: 751331 - DNA, 25 bp, Mus musculus
taggaatctcagtagctgggatgga

SEQ ID NO: 751332 - DNA, 25 bp, Mus musculus
taggaatgaccgagaccaagtcagc

SEQ ID NO: 751333 - DNA, 25 bp, Mus musculus
taggaatgaccgtgaccaagtcagc

SEQ ID NO: 751334 - DNA, 25 bp, Mus musculus
taggaatgacgtcctttccgactgt

SEQ ID NO: 751335 - DNA, 25 bp, Mus musculus
taggaatgacgtgctttccgactgt

SEQ ID NO: 751336 - DNA, 25 bp, Mus musculus
taggaatgaggcagcaaaaggtcgc

SEQ ID NO: 751337 - DNA, 25 bp, Mus musculus
taggaatgaggctgcaaaaggtcgc

SEQ ID NO: 751338 - DNA, 25 bp, Mus musculus
taggaatgctgaaacagcgccagct

SEQ ID NO: 751339 - DNA, 25 bp, Mus musculus
taggaatgctgatacagcgccagct

SEQ ID NO: 751340 - DNA, 25 bp, Mus musculus
taggaatggctgaggaggaacttca

SEQ ID NO: 751341 - DNA, 25 bp, Mus musculus
taggaatggctgtggaggaacttca

SEQ ID NO: 751342 - DNA, 25 bp, Mus musculus
taggaattgattcagccacgtcgag

SEQ ID NO: 751343 - DNA, 25 bp, Mus musculus
taggaattgattgagccacgtcgag

SEQ ID NO: 751344 - DNA, 25 bp, Mus musculus
taggaattgcttcctacggcctggc

SEQ ID NO: 751345 - DNA, 25 bp, Mus musculus
taggaattgcttgctacggcctggc

SEQ ID NO: 751346 - DNA, 25 bp, Mus musculus
taggaatttacaagcatctgtttcc

SEQ ID NO: 751347 - DNA, 25 bp, Mus musculus
taggaatttacatgcatctgtttcc

SEQ ID NO: 751348 - DNA, 25 bp, Mus musculus
taggacaaattgaggctacagcaac

SEQ ID NO: 751349 - DNA, 25 bp, Mus musculus
taggacaaattgtggctacagcaac

SEQ ID NO: 751350 - DNA, 25 bp, Mus musculus
taggacacttgtcgaagacttgggt

SEQ ID NO: 751351 - DNA, 25 bp, Mus musculus
taggacacttgtggaagacttgggt

SEQ ID NO: 751352 - DNA, 25 bp, Mus musculus
taggacagaaacatctggtgatggg

SEQ ID NO: 751353 - DNA, 25 bp, Mus musculus
taggacagaaacttctggtgatggg

SEQ ID NO: 751354 - DNA, 25 bp, Mus musculus
taggacagacgacaaaactcaactc

SEQ ID NO: 751355 - DNA, 25 bp, Mus musculus
taggacagacgagaaaactcaactc

SEQ ID NO: 751356 - DNA, 25 bp, Mus musculus
taggacagcaaaacctggctgactt

SEQ ID NO: 751357 - DNA, 25 bp, Mus musculus
taggacagcaaatcctggctgactt

SEQ ID NO: 751358 - DNA, 25 bp, Mus musculus
taggacaggctgaaattcattctgc

SEQ ID NO: 751359 - DNA, 25 bp, Mus musculus
taggacaggctgtaattcattctgc

SEQ ID NO: 751360 - DNA, 25 bp, Mus musculus
taggacatatccaagcaaggcctgg

SEQ ID NO: 751361 - DNA, 25 bp, Mus musculus
taggacatatcctagcaaggcctgg

SEQ ID NO: 751362 - DNA, 25 bp, Mus musculus
taggaccaatgacaactgcgccctc

SEQ ID NO: 751363 - DNA, 25 bp, Mus musculus
taggaccaatgagaactgcgccctc

SEQ ID NO: 751364 - DNA, 25 bp, Mus musculus
taggaccaggttaacagagctttat

SEQ ID NO: 751365 - DNA, 25 bp, Mus musculus
taggaccaggtttacagagctttat

SEQ ID NO: 751366 - DNA, 25 bp, Mus musculus
taggacccagcaaggcctaacagtg

SEQ ID NO: 751367 - DNA, 25 bp, Mus musculus
taggacccagcatggcctaacagtg

SEQ ID NO: 751368 - DNA, 25 bp, Mus musculus
taggacccatgaagtcttgaagaaa

SEQ ID NO: 751369 - DNA, 25 bp, Mus musculus
taggacccatgatgtcttgaagaaa

SEQ ID NO: 751370 - DNA, 25 bp, Mus musculus
taggacccctttcccaacggtgaat

SEQ ID NO: 751371 - DNA, 25 bp, Mus musculus
taggacccctttgccaacggtgaat

SEQ ID NO: 751372 - DNA, 25 bp, Mus musculus
taggacccgatcattaccttctgga

SEQ ID NO: 751373 - DNA, 25 bp, Mus musculus
taggacccgatctttaccttctgga

SEQ ID NO: 751374 - DNA, 25 bp, Mus musculus
taggacccgctaagccttctgaacc

SEQ ID NO: 751375 - DNA, 25 bp, Mus musculus
taggacccgctatgccttctgaacc

SEQ ID NO: 751376 - DNA, 25 bp, Mus musculus
taggaccctagcagttcacaaaact

SEQ ID NO: 751377 - DNA, 25 bp, Mus musculus
taggaccctagctgttcacaaaact

SEQ ID NO: 751378 - DNA, 25 bp, Mus musculus
taggacctgcctagtgggcacactg

SEQ ID NO: 751379 - DNA, 25 bp, Mus musculus
taggacctgccttgtgggcacactg

SEQ ID NO: 751380 - DNA, 25 bp, Mus musculus
taggacgctaataaaacacccattt

SEQ ID NO: 751381 - DNA, 25 bp, Mus musculus
taggacgctaattaaacacccattt

SEQ ID NO: 751382 - DNA, 25 bp, Mus musculus
taggacgtgggcattcttcccaccc

SEQ ID NO: 751383 - DNA, 25 bp, Mus musculus
taggacgtgggctttcttcccaccc

SEQ ID NO: 751384 - DNA, 25 bp, Mus musculus
taggactcagagcacaaaccggttc

SEQ ID NO: 751385 - DNA, 25 bp, Mus musculus
taggactcagaggacaaaccggttc

SEQ ID NO: 751386 - DNA, 25 bp, Mus musculus
taggactccatcagttacagacact

SEQ ID NO: 751387 - DNA, 25 bp, Mus musculus
taggactccatctgttacagacact

SEQ ID NO: 751388 - DNA, 25 bp, Mus musculus
taggactcctgccttgtatgactgt

SEQ ID NO: 751389 - DNA, 25 bp, Mus musculus
taggactcctgcgttgtatgactgt

SEQ ID NO: 751390 - DNA, 25 bp, Mus musculus
taggactctaaaacaccacattctg

SEQ ID NO: 751391 - DNA, 25 bp, Mus musculus
taggactctaaatcaccacattctg

SEQ ID NO: 751392 - DNA, 25 bp, Mus musculus
taggactgacaccatgattcagact

SEQ ID NO: 751393 - DNA, 25 bp, Mus musculus
taggactgacacgatgattcagact

SEQ ID NO: 751394 - DNA, 25 bp, Mus musculus
taggactgccgacgacttcgtaggc

SEQ ID NO: 751395 - DNA, 25 bp, Mus musculus
taggactgccgaggacttcgtaggc

SEQ ID NO: 751396 - DNA, 25 bp, Mus musculus
taggactgctttagtggatggccac

SEQ ID NO: 751397 - DNA, 25 bp, Mus musculus
taggactgcttttgtggatggccac

SEQ ID NO: 751398 - DNA, 25 bp, Mus musculus
taggactgggcacagcttggttcca

SEQ ID NO: 751399 - DNA, 25 bp, Mus musculus
taggactgggcagagcttggttcca

SEQ ID NO: 751400 - DNA, 25 bp, Mus musculus
taggacttccggcccgtaggcctga

SEQ ID NO: 751401 - DNA, 25 bp, Mus musculus
taggacttccgggccgtaggcctga

SEQ ID NO: 751402 - DNA, 25 bp, Mus musculus
taggacttcctcctggtataactac

SEQ ID NO: 751403 - DNA, 25 bp, Mus musculus
taggacttcctcgtggtataactac

SEQ ID NO: 751404 - DNA, 25 bp, Mus musculus
taggacttgaatctgacagagtaca

SEQ ID NO: 751405 - DNA, 25 bp, Mus musculus
taggacttgaatgtgacagagtaca

SEQ ID NO: 751406 - DNA, 25 bp, Mus musculus
taggacttgcaaacaagagcgttaa

SEQ ID NO: 751407 - DNA, 25 bp, Mus musculus
taggacttgcaatcaagagcgttaa

SEQ ID NO: 751408 - DNA, 25 bp, Mus musculus
taggacttggataagcgtggcgttc

SEQ ID NO: 751409 - DNA, 25 bp, Mus musculus
taggacttggattagcgtggcgttc

SEQ ID NO: 751410 - DNA, 25 bp, Mus musculus
taggactttctacgagctccggttc

SEQ ID NO: 751411 - DNA, 25 bp, Mus musculus
taggactttctaggagctccggttc

SEQ ID NO: 751412 - DNA, 25 bp, Mus musculus
taggagaaccctccgttgccagctt

SEQ ID NO: 751413 - DNA, 25 bp, Mus musculus
taggagaaccctgcgttgccagctt

SEQ ID NO: 751414 - DNA, 25 bp, Mus musculus
taggagaacctcataaatttaaaag

SEQ ID NO: 751415 - DNA, 25 bp, Mus musculus
taggagaacctcttaaatttaaaag

SEQ ID NO: 751416 - DNA, 25 bp, Mus musculus
taggagaagccaatgctatgtgtgt

SEQ ID NO: 751417 - DNA, 25 bp, Mus musculus
taggagaagccacacgcagcttgaa

SEQ ID NO: 751418 - DNA, 25 bp, Mus musculus
taggagaagccagacgcagcttgaa

SEQ ID NO: 751419 - DNA, 25 bp, Mus musculus
taggagaagccattgctatgtgtgt

SEQ ID NO: 751420 - DNA, 25 bp, Mus musculus
taggagacaagtcccagacctgagc

SEQ ID NO: 751421 - DNA, 25 bp, Mus musculus
taggagacaagtgccagacctgagc

SEQ ID NO: 751422 - DNA, 25 bp, Mus musculus
taggagaccatgaatctagggccag

SEQ ID NO: 751423 - DNA, 25 bp, Mus musculus
taggagaccatgcagatgatgtcta

SEQ ID NO: 751424 - DNA, 25 bp, Mus musculus
taggagaccatggagatgatgtcta

SEQ ID NO: 751425 - DNA, 25 bp, Mus musculus
taggagaccatgtatctagggccag

SEQ ID NO: 751426 - DNA, 25 bp, Mus musculus
taggagacggctcgtccttgctgct

SEQ ID NO: 751427 - DNA, 25 bp, Mus musculus
taggagacggctggtccttgctgct

SEQ ID NO: 751428 - DNA, 25 bp, Mus musculus
taggagactacgaagcttgcatggg

SEQ ID NO: 751429 - DNA, 25 bp, Mus musculus
taggagactacgtagcttgcatggg

SEQ ID NO: 751430 - DNA, 25 bp, Mus musculus
taggagagagctccccggcacctcg

SEQ ID NO: 751431 - DNA, 25 bp, Mus musculus
taggagagagctgcccggcacctcg

SEQ ID NO: 751432 - DNA, 25 bp, Mus musculus
taggagagctctacgtggtacacca

SEQ ID NO: 751433 - DNA, 25 bp, Mus musculus
taggagagctcttcgtggtacacca

SEQ ID NO: 751434 - DNA, 25 bp, Mus musculus
taggagagtcgcagagagcattgac

SEQ ID NO: 751435 - DNA, 25 bp, Mus musculus
taggagagtcgctgagagcattgac

SEQ ID NO: 751436 - DNA, 25 bp, Mus musculus
taggagatacctcggcctcagagaa

SEQ ID NO: 751437 - DNA, 25 bp, Mus musculus
taggagatacctgggcctcagagaa

SEQ ID NO: 751438 - DNA, 25 bp, Mus musculus
taggagatcaagaactcctacacac

SEQ ID NO: 751439 - DNA, 25 bp, Mus musculus
taggagatcaagtactcctacacac

SEQ ID NO: 751440 - DNA, 25 bp, Mus musculus
taggagatccaaaagaacacaggcg

SEQ ID NO: 751441 - DNA, 25 bp, Mus musculus
taggagatccaatagaacacaggcg

SEQ ID NO: 751442 - DNA, 25 bp, Mus musculus
taggagatgaaccaccaaaggtgtt

SEQ ID NO: 751443 - DNA, 25 bp, Mus musculus
taggagatgaacgaccaaaggtgtt

SEQ ID NO: 751444 - DNA, 25 bp, Mus musculus
taggagatgcttatcaccaacccag

SEQ ID NO: 751445 - DNA, 25 bp, Mus musculus
taggagatgcttttcaccaacccag

SEQ ID NO: 751446 - DNA, 25 bp, Mus musculus
taggagcaaactcctaactcgacga

SEQ ID NO: 751447 - DNA, 25 bp, Mus musculus
taggagcaaactgctaactcgacga

SEQ ID NO: 751448 - DNA, 25 bp, Mus musculus
taggagcacacacgcgcactcactg

SEQ ID NO: 751449 - DNA, 25 bp, Mus musculus
taggagcacacaggcgcactcactg

SEQ ID NO: 751450 - DNA, 25 bp, Mus musculus
taggagcatgcacaatcttttatca

SEQ ID NO: 751451 - DNA, 25 bp, Mus musculus
taggagcatgcagaatcttttatca

SEQ ID NO: 751452 - DNA, 25 bp, Mus musculus
taggagcatggtacatcaggaagtc

SEQ ID NO: 751453 - DNA, 25 bp, Mus musculus
taggagcatggttcatcaggaagtc

SEQ ID NO: 751454 - DNA, 25 bp, Mus musculus
taggagcccacacaagcggttatag

SEQ ID NO: 751455 - DNA, 25 bp, Mus musculus
taggagcccacagaagcggttatag

SEQ ID NO: 751456 - DNA, 25 bp, Mus musculus
taggagccccgcaaacagggaagaa

SEQ ID NO: 751457 - DNA, 25 bp, Mus musculus
taggagccccgctaacagggaagaa

SEQ ID NO: 751458 - DNA, 25 bp, Mus musculus
taggagcctttgaggatgctgtaca

SEQ ID NO: 751459 - DNA, 25 bp, Mus musculus
taggagcctttgtggatgctgtaca

SEQ ID NO: 751460 - DNA, 25 bp, Mus musculus
taggagctgcgacacggcccagcct

SEQ ID NO: 751461 - DNA, 25 bp, Mus musculus
taggagctgcgagacggcccagcct

SEQ ID NO: 751462 - DNA, 25 bp, Mus musculus
taggagctttacagaagactggagt

SEQ ID NO: 751463 - DNA, 25 bp, Mus musculus
taggagctttactgaagactggagt

SEQ ID NO: 751464 - DNA, 25 bp, Mus musculus
taggaggacctcaactaaccactgc

SEQ ID NO: 751465 - DNA, 25 bp, Mus musculus
taggaggacctctactaaccactgc

SEQ ID NO: 751466 - DNA, 25 bp, Mus musculus
taggaggagatgcacctgaccagtc

SEQ ID NO: 751467 - DNA, 25 bp, Mus musculus
taggaggagatggacctgaccagtc

SEQ ID NO: 751468 - DNA, 25 bp, Mus musculus
taggaggagcagagaagttatctgt

SEQ ID NO: 751469 - DNA, 25 bp, Mus musculus
taggaggagcagtgaagttatctgt

SEQ ID NO: 751470 - DNA, 25 bp, Mus musculus
taggaggagttgacacttgtgcaag

SEQ ID NO: 751471 - DNA, 25 bp, Mus musculus
taggaggagttgtcacttgtgcaag

SEQ ID NO: 751472 - DNA, 25 bp, Mus musculus
taggaggcaagaacccgtgcatcgt

SEQ ID NO: 751473 - DNA, 25 bp, Mus musculus
taggaggcaagatcccgtgcatcgt

SEQ ID NO: 751474 - DNA, 25 bp, Mus musculus
taggaggcagctcctagcctgacct

SEQ ID NO: 751475 - DNA, 25 bp, Mus musculus
taggaggcagctgctagcctgacct

SEQ ID NO: 751476 - DNA, 25 bp, Mus musculus
taggaggccatccttgaatccagcc

SEQ ID NO: 751477 - DNA, 25 bp, Mus musculus
taggaggccatcgttgaatccagcc

SEQ ID NO: 751478 - DNA, 25 bp, Mus musculus
taggaggcctagaccctggacagat

SEQ ID NO: 751479 - DNA, 25 bp, Mus musculus
taggaggcctagtccctggacagat

SEQ ID NO: 751480 - DNA, 25 bp, Mus musculus
taggaggcgcgacccatgctagttt

SEQ ID NO: 751481 - DNA, 25 bp, Mus musculus
taggaggcgcgagccatgctagttt

SEQ ID NO: 751482 - DNA, 25 bp, Mus musculus
taggaggtgataagaggacaagcaa

SEQ ID NO: 751483 - DNA, 25 bp, Mus musculus
taggaggtgatatgaggacaagcaa

SEQ ID NO: 751484 - DNA, 25 bp, Mus musculus
taggaggtgtgcacttcagtctaga

SEQ ID NO: 751485 - DNA, 25 bp, Mus musculus
taggaggtgtgctcttcagtctaga

SEQ ID NO: 751486 - DNA, 25 bp, Mus musculus
taggagtaaaacaggaaagcccaga

SEQ ID NO: 751487 - DNA, 25 bp, Mus musculus
taggagtaaaactggaaagcccaga

SEQ ID NO: 751488 - DNA, 25 bp, Mus musculus
taggagtaatggaaatgagatcacc

SEQ ID NO: 751489 - DNA, 25 bp, Mus musculus
taggagtaatggtaatgagatcacc

SEQ ID NO: 751490 - DNA, 25 bp, Mus musculus
taggagtctaccagacagagtcacc

SEQ ID NO: 751491 - DNA, 25 bp, Mus musculus
taggagtctacctgacagagtcacc

SEQ ID NO: 751492 - DNA, 25 bp, Mus musculus
taggagtcttcccacagatgacatt

SEQ ID NO: 751493 - DNA, 25 bp, Mus musculus
taggagtcttccgacagatgacatt

SEQ ID NO: 751494 - DNA, 25 bp, Mus musculus
taggagttaaccctcatccaggcgg

SEQ ID NO: 751495 - DNA, 25 bp, Mus musculus
taggagttaaccgtcatccaggcgg

SEQ ID NO: 751496 - DNA, 25 bp, Mus musculus
taggagttgacacgtgtctggtaac

SEQ ID NO: 751497 - DNA, 25 bp, Mus musculus
taggagttgacaggtgtctggtaac

SEQ ID NO: 751498 - DNA, 25 bp, Mus musculus
taggataacctgactggcgcagcag

SEQ ID NO: 751499 - DNA, 25 bp, Mus musculus
taggataacctgtctggcgcagcag

SEQ ID NO: 751500 - DNA, 25 bp, Mus musculus
taggatagactaacaacccaacagt

SEQ ID NO: 751501 - DNA, 25 bp, Mus musculus
taggatagactatcaacccaacagt

SEQ ID NO: 751502 - DNA, 25 bp, Mus musculus
taggatcaagcaatctgaacgtctg

SEQ ID NO: 751503 - DNA, 25 bp, Mus musculus
taggatcaagcattctgaacgtctg

SEQ ID NO: 751504 - DNA, 25 bp, Mus musculus
taggatcagttgacaattgctggcc

SEQ ID NO: 751505 - DNA, 25 bp, Mus musculus
taggatcagttgtcaattgctggcc

SEQ ID NO: 751506 - DNA, 25 bp, Mus musculus
taggatcatacacgtgacagtcgca

SEQ ID NO: 751507 - DNA, 25 bp, Mus musculus
taggatcatacaggtgacagtcgca

SEQ ID NO: 751508 - DNA, 25 bp, Mus musculus
taggatcccggacaacgtggagcac

SEQ ID NO: 751509 - DNA, 25 bp, Mus musculus
taggatcccggagaacgtggagcac

SEQ ID NO: 751510 - DNA, 25 bp, Mus musculus
taggatcggacacggcactcccatt

SEQ ID NO: 751511 - DNA, 25 bp, Mus musculus
taggatcggacagggcactcccatt

SEQ ID NO: 751512 - DNA, 25 bp, Mus musculus
taggatctcacgctctaggcattgt

SEQ ID NO: 751513 - DNA, 25 bp, Mus musculus
taggatctcacggtctaggcattgt

SEQ ID NO: 751514 - DNA, 25 bp, Mus musculus
taggatctcattcctgcagctcccg

SEQ ID NO: 751515 - DNA, 25 bp, Mus musculus
taggatctcattgctgcagctcccg

SEQ ID NO: 751516 - DNA, 25 bp, Mus musculus
taggatctggatcaacagctaacca

SEQ ID NO: 751517 - DNA, 25 bp, Mus musculus
taggatctggatgaacagctaacca

SEQ ID NO: 751518 - DNA, 25 bp, Mus musculus
taggatctgtggctaagcacccgct

SEQ ID NO: 751519 - DNA, 25 bp, Mus musculus
taggatctgtgggtaagcacccgct

SEQ ID NO: 751520 - DNA, 25 bp, Mus musculus
taggatgaacctcgaatggacgccc

SEQ ID NO: 751521 - DNA, 25 bp, Mus musculus
taggatgaacctggaatggacgccc

SEQ ID NO: 751522 - DNA, 25 bp, Mus musculus
taggatgaagttcaagcccaaccag

SEQ ID NO: 751523 - DNA, 25 bp, Mus musculus
taggatgaagttgaagcccaaccag

SEQ ID NO: 751524 - DNA, 25 bp, Mus musculus
taggatgacggcactgcgagcagca

SEQ ID NO: 751525 - DNA, 25 bp, Mus musculus
taggatgacggctctgcgagcagca

SEQ ID NO: 751526 - DNA, 25 bp, Mus musculus
taggatgactggaataggcttagct

SEQ ID NO: 751527 - DNA, 25 bp, Mus musculus
taggatgactggtataggcttagct

SEQ ID NO: 751528 - DNA, 25 bp, Mus musculus
taggatgcagtacactgctacaaag

SEQ ID NO: 751529 - DNA, 25 bp, Mus musculus
taggatgcagtagactgctacaaag

SEQ ID NO: 751530 - DNA, 25 bp, Mus musculus
taggatgcagtcacctgagcctgcg

SEQ ID NO: 751531 - DNA, 25 bp, Mus musculus
taggatgcagtctcctgagcctgcg

SEQ ID NO: 751532 - DNA, 25 bp, Mus musculus
taggatgcggccatggcagcacctg

SEQ ID NO: 751533 - DNA, 25 bp, Mus musculus
taggatgcggccttggcagcacctg

SEQ ID NO: 751534 - DNA, 25 bp, Mus musculus
taggatggccaacagtgcacagact

SEQ ID NO: 751535 - DNA, 25 bp, Mus musculus
taggatggccaagagtgcacagact

SEQ ID NO: 751536 - DNA, 25 bp, Mus musculus
taggatgggtgcacaactgtattcc

SEQ ID NO: 751537 - DNA, 25 bp, Mus musculus
taggatgggtgctcaactgtattcc

SEQ ID NO: 751538 - DNA, 25 bp, Mus musculus
taggatggtcttccttctcccctgg

SEQ ID NO: 751539 - DNA, 25 bp, Mus musculus
taggatggtcttgcttctcccctgg

SEQ ID NO: 751540 - DNA, 25 bp, Mus musculus
taggattccttgagtggtctgacca

SEQ ID NO: 751541 - DNA, 25 bp, Mus musculus
taggattccttgtgtggtctgacca

SEQ ID NO: 751542 - DNA, 25 bp, Mus musculus
taggattgcctgatagaattgatct

SEQ ID NO: 751543 - DNA, 25 bp, Mus musculus
taggattgcctgttagaattgatct

SEQ ID NO: 751544 - DNA, 25 bp, Mus musculus
taggattggacgagccatgaagtgc

SEQ ID NO: 751545 - DNA, 25 bp, Mus musculus
taggattggacgtgccatgaagtgc

SEQ ID NO: 751546 - DNA, 25 bp, Mus musculus
taggattggatcagagtgggaacaa

SEQ ID NO: 751547 - DNA, 25 bp, Mus musculus
taggattggatctgagtgggaacaa

SEQ ID NO: 751548 - DNA, 25 bp, Mus musculus
taggattgggccagggtcttcccct

SEQ ID NO: 751549 - DNA, 25 bp, Mus musculus
taggattgggcctgggtcttcccct

SEQ ID NO: 751550 - DNA, 25 bp, Mus musculus
taggatttgcaaaaactgggctgga

SEQ ID NO: 751551 - DNA, 25 bp, Mus musculus
taggatttgcaataactgggctgga

SEQ ID NO: 751552 - DNA, 25 bp, Mus musculus
taggatttggccatgtcgccgttag

SEQ ID NO: 751553 - DNA, 25 bp, Mus musculus
taggatttggccttgtcgccgttag

SEQ ID NO: 751554 - DNA, 25 bp, Mus musculus
taggattttcctccgtggacgtttg

SEQ ID NO: 751555 - DNA, 25 bp, Mus musculus
taggattttcctgcgtggacgtttg

SEQ ID NO: 751556 - DNA, 25 bp, Mus musculus
taggatttttcaacgcaagtgatgc

SEQ ID NO: 751557 - DNA, 25 bp, Mus musculus
taggatttttcatcgcaagtgatgc

SEQ ID NO: 751558 - DNA, 25 bp, Mus musculus
taggcaaaccacatggcgagggctg

SEQ ID NO: 751559 - DNA, 25 bp, Mus musculus
taggcaaaccacttggcgagggctg

SEQ ID NO: 751560 - DNA, 25 bp, Mus musculus
taggcaaactctacatggcccaggc

SEQ ID NO: 751561 - DNA, 25 bp, Mus musculus
taggcaaactcttcatggcccaggc

SEQ ID NO: 751562 - DNA, 25 bp, Mus musculus
taggcaacaagaagatgcgggctcg

SEQ ID NO: 751563 - DNA, 25 bp, Mus musculus
taggcaacaagatgatgcgggctcg

SEQ ID NO: 751564 - DNA, 25 bp, Mus musculus
taggcaacctctatgccagaaatgt

SEQ ID NO: 751565 - DNA, 25 bp, Mus musculus
taggcaacctctttgccagaaatgt

SEQ ID NO: 751566 - DNA, 25 bp, Mus musculus
taggcaacgccaagctccagtcctt

SEQ ID NO: 751567 - DNA, 25 bp, Mus musculus
taggcaacgccatgctccagtcctt

SEQ ID NO: 751568 - DNA, 25 bp, Mus musculus
taggcaactcccaaatgcataaggt

SEQ ID NO: 751569 - DNA, 25 bp, Mus musculus
taggcaactccctaatgcataaggt

SEQ ID NO: 751570 - DNA, 25 bp, Mus musculus
taggcaacttggacttggctacgcc

SEQ ID NO: 751571 - DNA, 25 bp, Mus musculus
taggcaacttggtcttggctacgcc

SEQ ID NO: 751572 - DNA, 25 bp, Mus musculus
taggcaagctggaccctgtgagtat

SEQ ID NO: 751573 - DNA, 25 bp, Mus musculus
taggcaagctggtccctgtgagtat

SEQ ID NO: 751574 - DNA, 25 bp, Mus musculus
taggcaagttgcacacagtggagct

SEQ ID NO: 751575 - DNA, 25 bp, Mus musculus
taggcaagttgctcacagtggagct

SEQ ID NO: 751576 - DNA, 25 bp, Mus musculus
taggcaatagaaaagccaggcttgt

SEQ ID NO: 751577 - DNA, 25 bp, Mus musculus
taggcaatagaatagccaggcttgt

SEQ ID NO: 751578 - DNA, 25 bp, Mus musculus
taggcaatgtcacgcactgctgggt

SEQ ID NO: 751579 - DNA, 25 bp, Mus musculus
taggcaatgtcaggcactgctgggt

SEQ ID NO: 751580 - DNA, 25 bp, Mus musculus
taggcacagtctcgctcaaagagat

SEQ ID NO: 751581 - DNA, 25 bp, Mus musculus
taggcacagtctggctcaaagagat

SEQ ID NO: 751582 - DNA, 25 bp, Mus musculus
taggcaccaagcatccaaagcaaac

SEQ ID NO: 751583 - DNA, 25 bp, Mus musculus
taggcaccaagcttccaaagcaaac

SEQ ID NO: 751584 - DNA, 25 bp, Mus musculus
taggcaccagttctgcatgcagtca

SEQ ID NO: 751585 - DNA, 25 bp, Mus musculus
taggcaccagttgtgcatgcagtca

SEQ ID NO: 751586 - DNA, 25 bp, Mus musculus
taggcaccatctagtagccctggaa

SEQ ID NO: 751587 - DNA, 25 bp, Mus musculus
taggcaccatcttgtagccctggaa

SEQ ID NO: 751588 - DNA, 25 bp, Mus musculus
taggcaccatgacacagactctgga

SEQ ID NO: 751589 - DNA, 25 bp, Mus musculus
taggcaccatgagacagactctgga

SEQ ID NO: 751590 - DNA, 25 bp, Mus musculus
taggcaccctggacacttctgagga

SEQ ID NO: 751591 - DNA, 25 bp, Mus musculus
taggcaccctggtcacttctgagga

SEQ ID NO: 751592 - DNA, 25 bp, Mus musculus
taggcaccgagaccccagagtcaaa

SEQ ID NO: 751593 - DNA, 25 bp, Mus musculus
taggcaccgagagcccagagtcaaa

SEQ ID NO: 751594 - DNA, 25 bp, Mus musculus
taggcacctacaagggccacactgg

SEQ ID NO: 751595 - DNA, 25 bp, Mus musculus
taggcacctacatgggccacactgg

SEQ ID NO: 751596 - DNA, 25 bp, Mus musculus
taggcacgtgctccagggatgtcat

SEQ ID NO: 751597 - DNA, 25 bp, Mus musculus
taggcacgtgctgcagggatgtcat

SEQ ID NO: 751598 - DNA, 25 bp, Mus musculus
taggcactcagtaagaatgtagtct

SEQ ID NO: 751599 - DNA, 25 bp, Mus musculus
taggcactcagttagaatgtagtct

SEQ ID NO: 751600 - DNA, 25 bp, Mus musculus
taggcactgatgacaacaccctcat

SEQ ID NO: 751601 - DNA, 25 bp, Mus musculus
taggcactgatgtcaacaccctcat

SEQ ID NO: 751602 - DNA, 25 bp, Mus musculus
taggcactgtaaccagaaggcccag

SEQ ID NO: 751603 - DNA, 25 bp, Mus musculus
taggcactgtaagcagaaggcccag

SEQ ID NO: 751604 - DNA, 25 bp, Mus musculus
taggcagagtctaatggttttctcc

SEQ ID NO: 751605 - DNA, 25 bp, Mus musculus
taggcagagtcttatggttttctcc

SEQ ID NO: 751606 - DNA, 25 bp, Mus musculus
taggcagcacggacttgaacaacca

SEQ ID NO: 751607 - DNA, 25 bp, Mus musculus
taggcagcacggtcttgaacaacca

SEQ ID NO: 751608 - DNA, 25 bp, Mus musculus
taggcagcagctctctggccatgcc

SEQ ID NO: 751609 - DNA, 25 bp, Mus musculus
taggcagcagctgtctggccatgcc

SEQ ID NO: 751610 - DNA, 25 bp, Mus musculus
taggcagcatccactaggttttctg

SEQ ID NO: 751611 - DNA, 25 bp, Mus musculus
taggcagcatcctctaggttttctg

SEQ ID NO: 751612 - DNA, 25 bp, Mus musculus
taggcagccctaagggcactaccgg

SEQ ID NO: 751613 - DNA, 25 bp, Mus musculus
taggcagccctatgggcactaccgg

SEQ ID NO: 751614 - DNA, 25 bp, Mus musculus
taggcagcctgtcgacaccccaggg

SEQ ID NO: 751615 - DNA, 25 bp, Mus musculus
taggcagcctgtggacaccccaggg

SEQ ID NO: 751616 - DNA, 25 bp, Mus musculus
taggcagctcctatccggagatcct

SEQ ID NO: 751617 - DNA, 25 bp, Mus musculus
taggcagctcctttccggagatcct

SEQ ID NO: 751618 - DNA, 25 bp, Mus musculus
taggcagggtggaaccagcccctga

SEQ ID NO: 751619 - DNA, 25 bp, Mus musculus
taggcagggtggtaccagcccctga

SEQ ID NO: 751620 - DNA, 25 bp, Mus musculus
taggcaggtaagaccaaagggcaga

SEQ ID NO: 751621 - DNA, 25 bp, Mus musculus
taggcaggtaagtccaaagggcaga

SEQ ID NO: 751622 - DNA, 25 bp, Mus musculus
taggcaggttaaaggctactattcc

SEQ ID NO: 751623 - DNA, 25 bp, Mus musculus
taggcaggttaatggctactattcc

SEQ ID NO: 751624 - DNA, 25 bp, Mus musculus
taggcagtgtctaggctcctacgct

SEQ ID NO: 751625 - DNA, 25 bp, Mus musculus
taggcagtgtcttggctcctacgct

SEQ ID NO: 751626 - DNA, 25 bp, Mus musculus
taggcagttgtcacaattttgcctg

SEQ ID NO: 751627 - DNA, 25 bp, Mus musculus
taggcagttgtctcaattttgcctg

SEQ ID NO: 751628 - DNA, 25 bp, Mus musculus
taggcatccccgagaccgaaatcgc

SEQ ID NO: 751629 - DNA, 25 bp, Mus musculus
taggcatccccgtgaccgaaatcgc

SEQ ID NO: 751630 - DNA, 25 bp, Mus musculus
taggcatctatcaaggagagtcccc

SEQ ID NO: 751631 - DNA, 25 bp, Mus musculus
taggcatctatctaggagagtcccc

SEQ ID NO: 751632 - DNA, 25 bp, Mus musculus
taggcatcttgcaccagactacaga

SEQ ID NO: 751633 - DNA, 25 bp, Mus musculus
taggcatcttgctccagactacaga

SEQ ID NO: 751634 - DNA, 25 bp, Mus musculus
taggcatgatctaccttcaaggaga

SEQ ID NO: 751635 - DNA, 25 bp, Mus musculus
taggcatgatcttccttcaaggaga

SEQ ID NO: 751636 - DNA, 25 bp, Mus musculus
taggcatgcccgacaaagcagatgg

SEQ ID NO: 751637 - DNA, 25 bp, Mus musculus
taggcatgcccgtcaaagcagatgg

SEQ ID NO: 751638 - DNA, 25 bp, Mus musculus
taggcatgccctaccataagctaca

SEQ ID NO: 751639 - DNA, 25 bp, Mus musculus
taggcatgcccttccataagctaca

SEQ ID NO: 751640 - DNA, 25 bp, Mus musculus
taggcattcatcaacagatagaggc

SEQ ID NO: 751641 - DNA, 25 bp, Mus musculus
taggcattcatctacagatagaggc

SEQ ID NO: 751642 - DNA, 25 bp, Mus musculus
taggcatttgatcgacgtgggctct

SEQ ID NO: 751643 - DNA, 25 bp, Mus musculus
taggcatttgatggacgtgggctct

SEQ ID NO: 751644 - DNA, 25 bp, Mus musculus
taggccaaggtcacccttaacacag

SEQ ID NO: 751645 - DNA, 25 bp, Mus musculus
taggccaaggtctcccttaacacag

SEQ ID NO: 751646 - DNA, 25 bp, Mus musculus
taggccacactcaagacaagacagc

SEQ ID NO: 751647 - DNA, 25 bp, Mus musculus
taggccacactctagacaagacagc

SEQ ID NO: 751648 - DNA, 25 bp, Mus musculus
taggccacagaaccctccttaaggg

SEQ ID NO: 751649 - DNA, 25 bp, Mus musculus
taggccacagaagcctccttaaggg

SEQ ID NO: 751650 - DNA, 25 bp, Mus musculus
taggccacaggcacgttgtgacctg

SEQ ID NO: 751651 - DNA, 25 bp, Mus musculus
taggccacaggctcgttgtgacctg

SEQ ID NO: 751652 - DNA, 25 bp, Mus musculus
taggccacctgtacatatcccagag

SEQ ID NO: 751653 - DNA, 25 bp, Mus musculus
taggccacctgttcatatcccagag

SEQ ID NO: 751654 - DNA, 25 bp, Mus musculus
taggccagcggcatcgcggcttgtc

SEQ ID NO: 751655 - DNA, 25 bp, Mus musculus
taggccagcggcttcgcggcttgtc

SEQ ID NO: 751656 - DNA, 25 bp, Mus musculus
taggccagctgaaggaattattggg

SEQ ID NO: 751657 - DNA, 25 bp, Mus musculus
taggccagctgatggaattattggg

SEQ ID NO: 751658 - DNA, 25 bp, Mus musculus
taggccaggacccaaaacccaggag

SEQ ID NO: 751659 - DNA, 25 bp, Mus musculus
taggccaggaccgaaaacccaggag

SEQ ID NO: 751660 - DNA, 25 bp, Mus musculus
taggccaggcctatacaataatgct

SEQ ID NO: 751661 - DNA, 25 bp, Mus musculus
taggccaggcctttacaataatgct

SEQ ID NO: 751662 - DNA, 25 bp, Mus musculus
taggccataagtcgcattgctcagc

SEQ ID NO: 751663 - DNA, 25 bp, Mus musculus
taggccataagtggcattgctcagc

SEQ ID NO: 751664 - DNA, 25 bp, Mus musculus
taggccatggcaccaatgcagtggc

SEQ ID NO: 751665 - DNA, 25 bp, Mus musculus
taggccatggcagcaatgcagtggc

SEQ ID NO: 751666 - DNA, 25 bp, Mus musculus
taggcccaagttacacaggcaggac

SEQ ID NO: 751667 - DNA, 25 bp, Mus musculus
taggcccaagtttcacaggcaggac

SEQ ID NO: 751668 - DNA, 25 bp, Mus musculus
taggcccaccaacgctgtacacatt

SEQ ID NO: 751669 - DNA, 25 bp, Mus musculus
taggcccaccaaggctgtacacatt

SEQ ID NO: 751670 - DNA, 25 bp, Mus musculus
taggcccagacacttagcagacagg

SEQ ID NO: 751671 - DNA, 25 bp, Mus musculus
taggcccagacagttagcagacagg

SEQ ID NO: 751672 - DNA, 25 bp, Mus musculus
taggccccaagaccgcctctgtggt

SEQ ID NO: 751673 - DNA, 25 bp, Mus musculus
taggccccaagagcgcctctgtggt

SEQ ID NO: 751674 - DNA, 25 bp, Mus musculus
taggcccgtacaatgaagaactccg

SEQ ID NO: 751675 - DNA, 25 bp, Mus musculus
taggcccgtacattgaagaactccg

SEQ ID NO: 751676 - DNA, 25 bp, Mus musculus
taggccctcaccaggcaagtaacag

SEQ ID NO: 751677 - DNA, 25 bp, Mus musculus
taggccctcacctggcaagtaacag

SEQ ID NO: 751678 - DNA, 25 bp, Mus musculus
taggcccttacacaagtgtctctct

SEQ ID NO: 751679 - DNA, 25 bp, Mus musculus
taggcccttacagaagtgtctctct

SEQ ID NO: 751680 - DNA, 25 bp, Mus musculus
taggcccttcctaagccaggctgtg

SEQ ID NO: 751681 - DNA, 25 bp, Mus musculus
taggcccttccttagccaggctgtg

SEQ ID NO: 751682 - DNA, 25 bp, Mus musculus
taggcccttgagattacatggtagc

SEQ ID NO: 751683 - DNA, 25 bp, Mus musculus
taggcccttgagtttacatggtagc

SEQ ID NO: 751684 - DNA, 25 bp, Mus musculus
taggcccttgatactcatgacgagc

SEQ ID NO: 751685 - DNA, 25 bp, Mus musculus
taggcccttgattctcatgacgagc

SEQ ID NO: 751686 - DNA, 25 bp, Mus musculus
taggcccttgcgactgaaatataaa

SEQ ID NO: 751687 - DNA, 25 bp, Mus musculus
taggcccttgcgtctgaaatataaa

SEQ ID NO: 751688 - DNA, 25 bp, Mus musculus
taggccgacctacagtttctttggc

SEQ ID NO: 751689 - DNA, 25 bp, Mus musculus
taggccgacctagagtttctttggc

SEQ ID NO: 751690 - DNA, 25 bp, Mus musculus
taggccggcgtcatggagcccctat

SEQ ID NO: 751691 - DNA, 25 bp, Mus musculus
taggccggcgtcttggagcccctat

SEQ ID NO: 751692 - DNA, 25 bp, Mus musculus
taggccgtgggtatgcatcccctga

SEQ ID NO: 751693 - DNA, 25 bp, Mus musculus
taggccgtgggtttgcatcccctga

SEQ ID NO: 751694 - DNA, 25 bp, Mus musculus
taggccgttccaaatctcgctctcg

SEQ ID NO: 751695 - DNA, 25 bp, Mus musculus
taggccgttccatatctcgctctcg

SEQ ID NO: 751696 - DNA, 25 bp, Mus musculus
taggcctcaaatctgggactcaaag

SEQ ID NO: 751697 - DNA, 25 bp, Mus musculus
taggcctcaaatgtgggactcaaag

SEQ ID NO: 751698 - DNA, 25 bp, Mus musculus
taggcctgacccagaggtggcttca

SEQ ID NO: 751699 - DNA, 25 bp, Mus musculus
taggcctgaccctgaggtggcttca

SEQ ID NO: 751700 - DNA, 25 bp, Mus musculus
taggcctgagctcagaacttcccag

SEQ ID NO: 751701 - DNA, 25 bp, Mus musculus
taggcctgagctgagaacttcccag

SEQ ID NO: 751702 - DNA, 25 bp, Mus musculus
taggcctgccgtcatacatgctgca

SEQ ID NO: 751703 - DNA, 25 bp, Mus musculus
taggcctgccgtgatacatgctgca

SEQ ID NO: 751704 - DNA, 25 bp, Mus musculus
taggcctgctcccagtctgcttcgt

SEQ ID NO: 751705 - DNA, 25 bp, Mus musculus
taggcctgctccgagtctgcttcgt

SEQ ID NO: 751706 - DNA, 25 bp, Mus musculus
taggcctggttcctaagcatactga

SEQ ID NO: 751707 - DNA, 25 bp, Mus musculus
taggcctggttcgtaagcatactga

SEQ ID NO: 751708 - DNA, 25 bp, Mus musculus
taggcctggttgatggaaacagtca

SEQ ID NO: 751709 - DNA, 25 bp, Mus musculus
taggcctggttgttggaaacagtca

SEQ ID NO: 751710 - DNA, 25 bp, Mus musculus
taggccttgttacaagtcctcctgg

SEQ ID NO: 751711 - DNA, 25 bp, Mus musculus
taggccttgttagaagtcctcctgg

SEQ ID NO: 751712 - DNA, 25 bp, Mus musculus
taggccttttgaaaacagggactgg

SEQ ID NO: 751713 - DNA, 25 bp, Mus musculus
taggccttttgataacagggactgg

SEQ ID NO: 751714 - DNA, 25 bp, Mus musculus
taggcgagttcaatttggctcacag

SEQ ID NO: 751715 - DNA, 25 bp, Mus musculus
taggcgagttcattttggctcacag

SEQ ID NO: 751716 - DNA, 25 bp, Mus musculus
taggcgcgatgcattccactgctgc

SEQ ID NO: 751717 - DNA, 25 bp, Mus musculus
taggcgcgatgctttccactgctgc

SEQ ID NO: 751718 - DNA, 25 bp, Mus musculus
taggcggttcttactcactgcgggt

SEQ ID NO: 751719 - DNA, 25 bp, Mus musculus
taggcggttctttctcactgcgggt

SEQ ID NO: 751720 - DNA, 25 bp, Mus musculus
taggcggtttggaggccctgtacac

SEQ ID NO: 751721 - DNA, 25 bp, Mus musculus
taggcggtttggtggccctgtacac

SEQ ID NO: 751722 - DNA, 25 bp, Mus musculus
taggcgtaaaatacagcattccaag

SEQ ID NO: 751723 - DNA, 25 bp, Mus musculus
taggcgtaaaattcagcattccaag

SEQ ID NO: 751724 - DNA, 25 bp, Mus musculus
taggcgtacaagagcccacgtactg

SEQ ID NO: 751725 - DNA, 25 bp, Mus musculus
taggcgtacaagtgcccacgtactg

SEQ ID NO: 751726 - DNA, 25 bp, Mus musculus
taggcgtcacccagtatcttttgta

SEQ ID NO: 751727 - DNA, 25 bp, Mus musculus
taggcgtcaccctgtatcttttgta

SEQ ID NO: 751728 - DNA, 25 bp, Mus musculus
taggcgttctgtagagccacaaatg

SEQ ID NO: 751729 - DNA, 25 bp, Mus musculus
taggcgttctgttgagccacaaatg

SEQ ID NO: 751730 - DNA, 25 bp, Mus musculus
taggcgttgttcactacactggcag

SEQ ID NO: 751731 - DNA, 25 bp, Mus musculus
taggcgttgttctctacactggcag

SEQ ID NO: 751732 - DNA, 25 bp, Mus musculus
taggctaaaggcacggactctcaag

SEQ ID NO: 751733 - DNA, 25 bp, Mus musculus
taggctaaaggctcggactctcaag

SEQ ID NO: 751734 - DNA, 25 bp, Mus musculus
taggctaacaagagcctcccatact

SEQ ID NO: 751735 - DNA, 25 bp, Mus musculus
taggctaacaagtgcctcccatact

SEQ ID NO: 751736 - DNA, 25 bp, Mus musculus
taggctaagagtctacagagaagca

SEQ ID NO: 751737 - DNA, 25 bp, Mus musculus
taggctaagagtgtacagagaagca

SEQ ID NO: 751738 - DNA, 25 bp, Mus musculus
taggctaagtttatcggtctagcca

SEQ ID NO: 751739 - DNA, 25 bp, Mus musculus
taggctaagtttttcggtctagcca

SEQ ID NO: 751740 - DNA, 25 bp, Mus musculus
taggctagggaactatggtgtccac

SEQ ID NO: 751741 - DNA, 25 bp, Mus musculus
taggctagggaagtatggtgtccac

SEQ ID NO: 751742 - DNA, 25 bp, Mus musculus
taggctagggctctgtggtcaatac

SEQ ID NO: 751743 - DNA, 25 bp, Mus musculus
taggctagggctgtgtggtcaatac

SEQ ID NO: 751744 - DNA, 25 bp, Mus musculus
taggctatctgcacttcaccaaccg

SEQ ID NO: 751745 - DNA, 25 bp, Mus musculus
taggctatctgctcttcaccaaccg

SEQ ID NO: 751746 - DNA, 25 bp, Mus musculus
taggctattcacacagctctgctgc

SEQ ID NO: 751747 - DNA, 25 bp, Mus musculus
taggctattcactcagctctgctgc

SEQ ID NO: 751748 - DNA, 25 bp, Mus musculus
taggctcacacccacaagcacaaat

SEQ ID NO: 751749 - DNA, 25 bp, Mus musculus
taggctcacaccgacaagcacaaat

SEQ ID NO: 751750 - DNA, 25 bp, Mus musculus
taggctcacagtacagatctgcatg

SEQ ID NO: 751751 - DNA, 25 bp, Mus musculus
taggctcacagttcagatctgcatg

SEQ ID NO: 751752 - DNA, 25 bp, Mus musculus
taggctccaacgaaactgcaattta

SEQ ID NO: 751753 - DNA, 25 bp, Mus musculus
taggctccaacgtaactgcaattta

SEQ ID NO: 751754 - DNA, 25 bp, Mus musculus
taggctccaggcaaacactgggagg

SEQ ID NO: 751755 - DNA, 25 bp, Mus musculus
taggctccaggctaacactgggagg

SEQ ID NO: 751756 - DNA, 25 bp, Mus musculus
taggctcctacaagtgccactgccg

SEQ ID NO: 751757 - DNA, 25 bp, Mus musculus
taggctcctacatgtgccactgccg

SEQ ID NO: 751758 - DNA, 25 bp, Mus musculus
taggctcgtcagagtagaatatttg

SEQ ID NO: 751759 - DNA, 25 bp, Mus musculus
taggctcgtcagtgtagaatatttg

SEQ ID NO: 751760 - DNA, 25 bp, Mus musculus
taggctctcccaaccacctggtgtt

SEQ ID NO: 751761 - DNA, 25 bp, Mus musculus
taggctctcccatccacctggtgtt

SEQ ID NO: 751762 - DNA, 25 bp, Mus musculus
taggctctgcttagccgacccagag

SEQ ID NO: 751763 - DNA, 25 bp, Mus musculus
taggctctgctttgccgacccagag

SEQ ID NO: 751764 - DNA, 25 bp, Mus musculus
taggctgagaccaagccgcctgtgt

SEQ ID NO: 751765 - DNA, 25 bp, Mus musculus
taggctgagacctagccgcctgtgt

SEQ ID NO: 751766 - DNA, 25 bp, Mus musculus
taggctgcaagccatacctggacag

SEQ ID NO: 751767 - DNA, 25 bp, Mus musculus
taggctgcaagcgatacctggacag

SEQ ID NO: 751768 - DNA, 25 bp, Mus musculus
taggctgcgaaccagtttgggctcc

SEQ ID NO: 751769 - DNA, 25 bp, Mus musculus
taggctgcgaacgagtttgggctcc

SEQ ID NO: 751770 - DNA, 25 bp, Mus musculus
taggctgcgctaccggaatgtcatc

SEQ ID NO: 751771 - DNA, 25 bp, Mus musculus
taggctgcgctagcggaatgtcatc

SEQ ID NO: 751772 - DNA, 25 bp, Mus musculus
taggctgctgggagcacatctcatt

SEQ ID NO: 751773 - DNA, 25 bp, Mus musculus
taggctgctgggtgcacatctcatt

SEQ ID NO: 751774 - DNA, 25 bp, Mus musculus
taggctgcttcacacctcagagtcg

SEQ ID NO: 751775 - DNA, 25 bp, Mus musculus
taggctgcttcagacctcagagtcg

SEQ ID NO: 751776 - DNA, 25 bp, Mus musculus
taggctgcttctacaggctgccttc

SEQ ID NO: 751777 - DNA, 25 bp, Mus musculus
taggctgcttcttcaggctgccttc

SEQ ID NO: 751778 - DNA, 25 bp, Mus musculus
taggctgtagcgctgcctttctgga

SEQ ID NO: 751779 - DNA, 25 bp, Mus musculus
taggctgtagcggtgcctttctgga

SEQ ID NO: 751780 - DNA, 25 bp, Mus musculus
taggctgtgtgcagcccagtcttgg

SEQ ID NO: 751781 - DNA, 25 bp, Mus musculus
taggctgtgtgcattatgccatgat

SEQ ID NO: 751782 - DNA, 25 bp, Mus musculus
taggctgtgtgctgcccagtcttgg

SEQ ID NO: 751783 - DNA, 25 bp, Mus musculus
taggctgtgtgctttatgccatgat

SEQ ID NO: 751784 - DNA, 25 bp, Mus musculus
taggcttaaataatctacccaccac

SEQ ID NO: 751785 - DNA, 25 bp, Mus musculus
taggcttaaatattctacccaccac

SEQ ID NO: 751786 - DNA, 25 bp, Mus musculus
taggcttatttccagctgtttgtga

SEQ ID NO: 751787 - DNA, 25 bp, Mus musculus
taggcttatttcgagctgtttgtga

SEQ ID NO: 751788 - DNA, 25 bp, Mus musculus
taggcttcaatgactagggaaaagg

SEQ ID NO: 751789 - DNA, 25 bp, Mus musculus
taggcttcaatgtctagggaaaagg

SEQ ID NO: 751790 - DNA, 25 bp, Mus musculus
taggcttcagcaagaacgacttcgt

SEQ ID NO: 751791 - DNA, 25 bp, Mus musculus
taggcttcagcatgaacgacttcgt

SEQ ID NO: 751792 - DNA, 25 bp, Mus musculus
taggcttccctgaggagctgagcac

SEQ ID NO: 751793 - DNA, 25 bp, Mus musculus
taggcttccctgtggagctgagcac

SEQ ID NO: 751794 - DNA, 25 bp, Mus musculus
taggcttcgagtacaggaagtcgtg

SEQ ID NO: 751795 - DNA, 25 bp, Mus musculus
taggcttcgagttcaggaagtcgtg

SEQ ID NO: 751796 - DNA, 25 bp, Mus musculus
taggcttcgcagagaactcagcagt

SEQ ID NO: 751797 - DNA, 25 bp, Mus musculus
taggcttcgcagtgaactcagcagt

SEQ ID NO: 751798 - DNA, 25 bp, Mus musculus
taggcttgactccatcgggagttgt

SEQ ID NO: 751799 - DNA, 25 bp, Mus musculus
taggcttgactcgatcgggagttgt

SEQ ID NO: 751800 - DNA, 25 bp, Mus musculus
taggcttgacttctgctccaagagc

SEQ ID NO: 751801 - DNA, 25 bp, Mus musculus
taggcttgacttgtgctccaagagc

SEQ ID NO: 751802 - DNA, 25 bp, Mus musculus
taggctttcaaaactggttagggtc

SEQ ID NO: 751803 - DNA, 25 bp, Mus musculus
taggctttcaaatctggttagggtc

SEQ ID NO: 751804 - DNA, 25 bp, Mus musculus
taggctttctgacgtattctttagc

SEQ ID NO: 751805 - DNA, 25 bp, Mus musculus
taggctttctgaggtattctttagc

SEQ ID NO: 751806 - DNA, 25 bp, Mus musculus
taggctttgaccctcatgtttggga

SEQ ID NO: 751807 - DNA, 25 bp, Mus musculus
taggctttgaccgtcatgtttggga

SEQ ID NO: 751808 - DNA, 25 bp, Mus musculus
taggctttgatacccagctaggata

SEQ ID NO: 751809 - DNA, 25 bp, Mus musculus
taggctttgatagccagctaggata

SEQ ID NO: 751810 - DNA, 25 bp, Mus musculus
tagggaaactccatgctctgaggca

SEQ ID NO: 751811 - DNA, 25 bp, Mus musculus
tagggaaactccttgctctgaggca

SEQ ID NO: 751812 - DNA, 25 bp, Mus musculus
tagggaaagacgactaaaagacagg

SEQ ID NO: 751813 - DNA, 25 bp, Mus musculus
tagggaaagacgtctaaaagacagg

SEQ ID NO: 751814 - DNA, 25 bp, Mus musculus
tagggaaagaggagatccaggagcg

SEQ ID NO: 751815 - DNA, 25 bp, Mus musculus
tagggaaagaggtgatccaggagcg

SEQ ID NO: 751816 - DNA, 25 bp, Mus musculus
tagggaaagatgacccaagcctctt

SEQ ID NO: 751817 - DNA, 25 bp, Mus musculus
tagggaaagatgtcccaagcctctt

SEQ ID NO: 751818 - DNA, 25 bp, Mus musculus
tagggaaagctaaggtcaggactgt

SEQ ID NO: 751819 - DNA, 25 bp, Mus musculus
tagggaaagctatggtcaggactgt

SEQ ID NO: 751820 - DNA, 25 bp, Mus musculus
tagggaacatccatccttacagcca

SEQ ID NO: 751821 - DNA, 25 bp, Mus musculus
tagggaacatccttccttacagcca

SEQ ID NO: 751822 - DNA, 25 bp, Mus musculus
tagggaactcaacgtgaccacagag

SEQ ID NO: 751823 - DNA, 25 bp, Mus musculus
tagggaactcaaggtgaccacagag

SEQ ID NO: 751824 - DNA, 25 bp, Mus musculus
tagggaagaagtcagcctcagcaat

SEQ ID NO: 751825 - DNA, 25 bp, Mus musculus
tagggaagaagtgagcctcagcaat

SEQ ID NO: 751826 - DNA, 25 bp, Mus musculus
tagggaagacaacccaagctgctaa

SEQ ID NO: 751827 - DNA, 25 bp, Mus musculus
tagggaagacaacgtagctctctcc

SEQ ID NO: 751828 - DNA, 25 bp, Mus musculus
tagggaagacaagccaagctgctaa

SEQ ID NO: 751829 - DNA, 25 bp, Mus musculus
tagggaagacaaggtagctctctcc

SEQ ID NO: 751830 - DNA, 25 bp, Mus musculus
tagggaaggctgaaaagcagccatc

SEQ ID NO: 751831 - DNA, 25 bp, Mus musculus
tagggaaggctgtaaagcagccatc

SEQ ID NO: 751832 - DNA, 25 bp, Mus musculus
tagggaaggtatatatgaagcacac

SEQ ID NO: 751833 - DNA, 25 bp, Mus musculus
tagggaaggtatttatgaagcacac

SEQ ID NO: 751834 - DNA, 25 bp, Mus musculus
tagggaatacctctcaccttctcgg

SEQ ID NO: 751835 - DNA, 25 bp, Mus musculus
tagggaatacctgtcaccttctcgg

SEQ ID NO: 751836 - DNA, 25 bp, Mus musculus
tagggaatagcccagtcccaagaag

SEQ ID NO: 751837 - DNA, 25 bp, Mus musculus
tagggaatagccgagtcccaagaag

SEQ ID NO: 751838 - DNA, 25 bp, Mus musculus
tagggaatcaggaaaggccatggct

SEQ ID NO: 751839 - DNA, 25 bp, Mus musculus
tagggaatcaggtaaggccatggct

SEQ ID NO: 751840 - DNA, 25 bp, Mus musculus
tagggaatttctaacatgtgcttgt

SEQ ID NO: 751841 - DNA, 25 bp, Mus musculus
tagggaatttcttacatgtgcttgt

SEQ ID NO: 751842 - DNA, 25 bp, Mus musculus
tagggacaactcaaccttaagcaaa

SEQ ID NO: 751843 - DNA, 25 bp, Mus musculus
tagggacaactctaccttaagcaaa

SEQ ID NO: 751844 - DNA, 25 bp, Mus musculus
tagggacacagcaactgtcacctgt

SEQ ID NO: 751845 - DNA, 25 bp, Mus musculus
tagggacacagctactgtcacctgt

SEQ ID NO: 751846 - DNA, 25 bp, Mus musculus
tagggacagcacagttggccctggt

SEQ ID NO: 751847 - DNA, 25 bp, Mus musculus
tagggacagcactgttggccctggt

SEQ ID NO: 751848 - DNA, 25 bp, Mus musculus
tagggacccgataggagcagtctcc

SEQ ID NO: 751849 - DNA, 25 bp, Mus musculus
tagggacccgattggagcagtctcc

SEQ ID NO: 751850 - DNA, 25 bp, Mus musculus
tagggacgacaaaacagcagcactg

SEQ ID NO: 751851 - DNA, 25 bp, Mus musculus
tagggacgacaatacagcagcactg

SEQ ID NO: 751852 - DNA, 25 bp, Mus musculus
tagggactatggacaagatgatctc

SEQ ID NO: 751853 - DNA, 25 bp, Mus musculus
tagggactatggtcaagatgatctc

SEQ ID NO: 751854 - DNA, 25 bp, Mus musculus
tagggactccacagcttctggcaag

SEQ ID NO: 751855 - DNA, 25 bp, Mus musculus
tagggactccactgcttctggcaag

SEQ ID NO: 751856 - DNA, 25 bp, Mus musculus
tagggagatacgaaccagctagcag

SEQ ID NO: 751857 - DNA, 25 bp, Mus musculus
tagggagatacgtaccagctagcag

SEQ ID NO: 751858 - DNA, 25 bp, Mus musculus
tagggagcagttcctgtggtaccta

SEQ ID NO: 751859 - DNA, 25 bp, Mus musculus
tagggagcagttgctgtggtaccta

SEQ ID NO: 751860 - DNA, 25 bp, Mus musculus
tagggagctgccatcgcgggcttca

SEQ ID NO: 751861 - DNA, 25 bp, Mus musculus
tagggagctgccttcgcgggcttca

SEQ ID NO: 751862 - DNA, 25 bp, Mus musculus
tagggagctggcatttcagatcagc

SEQ ID NO: 751863 - DNA, 25 bp, Mus musculus
tagggagctggcttttcagatcagc

SEQ ID NO: 751864 - DNA, 25 bp, Mus musculus
tagggagcttcaagggatagaatag

SEQ ID NO: 751865 - DNA, 25 bp, Mus musculus
tagggagcttcatgggatagaatag

SEQ ID NO: 751866 - DNA, 25 bp, Mus musculus
tagggagcttgaaccccaacatcgg

SEQ ID NO: 751867 - DNA, 25 bp, Mus musculus
tagggagcttgatccccaacatcgg

SEQ ID NO: 751868 - DNA, 25 bp, Mus musculus
tagggaggacgcaccatgtcctgga

SEQ ID NO: 751869 - DNA, 25 bp, Mus musculus
tagggaggacgctccatgtcctgga

SEQ ID NO: 751870 - DNA, 25 bp, Mus musculus
tagggagtaagaaagtgctgctgac

SEQ ID NO: 751871 - DNA, 25 bp, Mus musculus
tagggagtaagatagtgctgctgac

SEQ ID NO: 751872 - DNA, 25 bp, Mus musculus
tagggatagctcctgtctgaccaag

SEQ ID NO: 751873 - DNA, 25 bp, Mus musculus
tagggatagctcgtgtctgaccaag

SEQ ID NO: 751874 - DNA, 25 bp, Mus musculus
tagggatatgttagccacagtttct

SEQ ID NO: 751875 - DNA, 25 bp, Mus musculus
tagggatatgtttgccacagtttct

SEQ ID NO: 751876 - DNA, 25 bp, Mus musculus
tagggatcacaaacggaactctcaa

SEQ ID NO: 751877 - DNA, 25 bp, Mus musculus
tagggatcacaatcggaactctcaa

SEQ ID NO: 751878 - DNA, 25 bp, Mus musculus
tagggatcccagagctcctgaacat

SEQ ID NO: 751879 - DNA, 25 bp, Mus musculus
tagggatcccagtgctcctgaacat

SEQ ID NO: 751880 - DNA, 25 bp, Mus musculus
tagggatcccgtccctgtcaaagag

SEQ ID NO: 751881 - DNA, 25 bp, Mus musculus
tagggatcccgtgcctgtcaaagag

SEQ ID NO: 751882 - DNA, 25 bp, Mus musculus
tagggatgctctcgctcaggagtat

SEQ ID NO: 751883 - DNA, 25 bp, Mus musculus
tagggatgctctggctcaggagtat

SEQ ID NO: 751884 - DNA, 25 bp, Mus musculus
tagggatggaaacaggtctgccacc

SEQ ID NO: 751885 - DNA, 25 bp, Mus musculus
tagggatggaaagaggtctgccacc

SEQ ID NO: 751886 - DNA, 25 bp, Mus musculus
tagggcaaggtcacaaagtttctaa

SEQ ID NO: 751887 - DNA, 25 bp, Mus musculus
tagggcaaggtctcaaagtttctaa

SEQ ID NO: 751888 - DNA, 25 bp, Mus musculus
tagggcactgcaagtcatccatcac

SEQ ID NO: 751889 - DNA, 25 bp, Mus musculus
tagggcactgcatgtcatccatcac

SEQ ID NO: 751890 - DNA, 25 bp, Mus musculus
tagggcagaaggagttgccttctcc

SEQ ID NO: 751891 - DNA, 25 bp, Mus musculus
tagggcagaaggtgttgccttctcc

SEQ ID NO: 751892 - DNA, 25 bp, Mus musculus
tagggcagggccattttcctgagac

SEQ ID NO: 751893 - DNA, 25 bp, Mus musculus
tagggcagggcctttttcctgagac

SEQ ID NO: 751894 - DNA, 25 bp, Mus musculus
tagggccacgggacgaattccggag

SEQ ID NO: 751895 - DNA, 25 bp, Mus musculus
tagggccacgggtcgaattccggag

SEQ ID NO: 751896 - DNA, 25 bp, Mus musculus
tagggccaggctagtcttctctgtc

SEQ ID NO: 751897 - DNA, 25 bp, Mus musculus
tagggccaggcttgtcttctctgtc

SEQ ID NO: 751898 - DNA, 25 bp, Mus musculus
tagggcccaaagcaatgtagtgttc

SEQ ID NO: 751899 - DNA, 25 bp, Mus musculus
tagggcccaaaggaatgtagtgttc

SEQ ID NO: 751900 - DNA, 25 bp, Mus musculus
tagggcctgcggctctcagcggcgc

SEQ ID NO: 751901 - DNA, 25 bp, Mus musculus
tagggcctgcgggtctcagcggcgc

SEQ ID NO: 751902 - DNA, 25 bp, Mus musculus
tagggccttgaacgctttccccgtg

SEQ ID NO: 751903 - DNA, 25 bp, Mus musculus
tagggccttgaaggctttccccgtg

SEQ ID NO: 751904 - DNA, 25 bp, Mus musculus
tagggcggacctaagtcaaaggcaa

SEQ ID NO: 751905 - DNA, 25 bp, Mus musculus
tagggcggaccttagtcaaaggcaa

SEQ ID NO: 751906 - DNA, 25 bp, Mus musculus
tagggcgtgctacacaaggaaccac

SEQ ID NO: 751907 - DNA, 25 bp, Mus musculus
tagggcgtgctagacaaggaaccac

SEQ ID NO: 751908 - DNA, 25 bp, Mus musculus
tagggctacagccaataatgatcac

SEQ ID NO: 751909 - DNA, 25 bp, Mus musculus
tagggctacagcgaataatgatcac

SEQ ID NO: 751910 - DNA, 25 bp, Mus musculus
tagggctacatactccaaggtgacc

SEQ ID NO: 751911 - DNA, 25 bp, Mus musculus
tagggctacatagtccaaggtgacc

SEQ ID NO: 751912 - DNA, 25 bp, Mus musculus
tagggctagattcggaaaccagcct

SEQ ID NO: 751913 - DNA, 25 bp, Mus musculus
tagggctagattgggaaaccagcct

SEQ ID NO: 751914 - DNA, 25 bp, Mus musculus
tagggctagtggataaacatcaccc

SEQ ID NO: 751915 - DNA, 25 bp, Mus musculus
tagggctagtggttaaacatcaccc

SEQ ID NO: 751916 - DNA, 25 bp, Mus musculus
tagggctcatgcaacggtgctggca

SEQ ID NO: 751917 - DNA, 25 bp, Mus musculus
tagggctcatgctacggtgctggca

SEQ ID NO: 751918 - DNA, 25 bp, Mus musculus
tagggctcccacaaacggtttatcg

SEQ ID NO: 751919 - DNA, 25 bp, Mus musculus
tagggctcccactaacggtttatcg

SEQ ID NO: 751920 - DNA, 25 bp, Mus musculus
tagggctccttcacaggagtgacaa

SEQ ID NO: 751921 - DNA, 25 bp, Mus musculus
tagggctccttctcaggagtgacaa

SEQ ID NO: 751922 - DNA, 25 bp, Mus musculus
tagggctcggccaccttatactgta

SEQ ID NO: 751923 - DNA, 25 bp, Mus musculus
tagggctcggcctccttatactgta

SEQ ID NO: 751924 - DNA, 25 bp, Mus musculus
tagggctgctggacctttaccgagc

SEQ ID NO: 751925 - DNA, 25 bp, Mus musculus
tagggctgctggtcctttaccgagc

SEQ ID NO: 751926 - DNA, 25 bp, Mus musculus
tagggctgtaccacactggcaagtg

SEQ ID NO: 751927 - DNA, 25 bp, Mus musculus
tagggctgtacctcactggcaagtg

SEQ ID NO: 751928 - DNA, 25 bp, Mus musculus
tagggcttaaggagatgtctctgga

SEQ ID NO: 751929 - DNA, 25 bp, Mus musculus
tagggcttaaggtgatgtctctgga

SEQ ID NO: 751930 - DNA, 25 bp, Mus musculus
tagggcttgtcccaaagaatccatg

SEQ ID NO: 751931 - DNA, 25 bp, Mus musculus
tagggcttgtccgaaagaatccatg

SEQ ID NO: 751932 - DNA, 25 bp, Mus musculus
tagggctttcaaccgaatatatgtg

SEQ ID NO: 751933 - DNA, 25 bp, Mus musculus
tagggctttcaagcgaatatatgtg

SEQ ID NO: 751934 - DNA, 25 bp, Mus musculus
tagggtaaaggcaaaaccatgtagc

SEQ ID NO: 751935 - DNA, 25 bp, Mus musculus
tagggtaaaggctaaaccatgtagc

SEQ ID NO: 751936 - DNA, 25 bp, Mus musculus
tagggtatttcaaaactgccaaggg

SEQ ID NO: 751937 - DNA, 25 bp, Mus musculus
tagggtatttcataactgccaaggg

SEQ ID NO: 751938 - DNA, 25 bp, Mus musculus
tagggtcacactccagaaaccgttg

SEQ ID NO: 751939 - DNA, 25 bp, Mus musculus
tagggtcacactgcagaaaccgttg

SEQ ID NO: 751940 - DNA, 25 bp, Mus musculus
tagggtcacagcagtaaacgaagtc

SEQ ID NO: 751941 - DNA, 25 bp, Mus musculus
tagggtcacagctgtaaacgaagtc

SEQ ID NO: 751942 - DNA, 25 bp, Mus musculus
tagggtcacggcaagcaaagtcacg

SEQ ID NO: 751943 - DNA, 25 bp, Mus musculus
tagggtcacggctagcaaagtcacg

SEQ ID NO: 751944 - DNA, 25 bp, Mus musculus
tagggtcccctgagaacttgacatc

SEQ ID NO: 751945 - DNA, 25 bp, Mus musculus
tagggtcccctgtgaacttgacatc

SEQ ID NO: 751946 - DNA, 25 bp, Mus musculus
tagggtcctagacaacactcttcac

SEQ ID NO: 751947 - DNA, 25 bp, Mus musculus
tagggtcctagagaacactcttcac

SEQ ID NO: 751948 - DNA, 25 bp, Mus musculus
tagggtcctctcacagcaggtctgt

SEQ ID NO: 751949 - DNA, 25 bp, Mus musculus
tagggtcctctcaccagttccaagg

SEQ ID NO: 751950 - DNA, 25 bp, Mus musculus
tagggtcctctctcagcaggtctgt

SEQ ID NO: 751951 - DNA, 25 bp, Mus musculus
tagggtcctctctccagttccaagg

SEQ ID NO: 751952 - DNA, 25 bp, Mus musculus
tagggtctaggcaccttccctggga

SEQ ID NO: 751953 - DNA, 25 bp, Mus musculus
tagggtctaggctccttccctggga

SEQ ID NO: 751954 - DNA, 25 bp, Mus musculus
tagggtgagtacactctgcacctga

SEQ ID NO: 751955 - DNA, 25 bp, Mus musculus
tagggtgagtactctctgcacctga

SEQ ID NO: 751956 - DNA, 25 bp, Mus musculus
tagggtgagtgcaaagtcacaccag

SEQ ID NO: 751957 - DNA, 25 bp, Mus musculus
tagggtgagtgctaagtcacaccag

SEQ ID NO: 751958 - DNA, 25 bp, Mus musculus
tagggtgccagaaggaatctaagac

SEQ ID NO: 751959 - DNA, 25 bp, Mus musculus
tagggtgccagatggaatctaagac

SEQ ID NO: 751960 - DNA, 25 bp, Mus musculus
tagggtgctcctactcagccaggac

SEQ ID NO: 751961 - DNA, 25 bp, Mus musculus
tagggtgctccttctcagccaggac

SEQ ID NO: 751962 - DNA, 25 bp, Mus musculus
tagggtggccgtatagtgcagctct

SEQ ID NO: 751963 - DNA, 25 bp, Mus musculus
tagggtggccgtttagtgcagctct

SEQ ID NO: 751964 - DNA, 25 bp, Mus musculus
tagggtggcctgagctctctgccat

SEQ ID NO: 751965 - DNA, 25 bp, Mus musculus
tagggtggcctgtgctctctgccat

SEQ ID NO: 751966 - DNA, 25 bp, Mus musculus
tagggtggcgctaaagtcagtttgc

SEQ ID NO: 751967 - DNA, 25 bp, Mus musculus
tagggtggcgcttaagtcagtttgc

SEQ ID NO: 751968 - DNA, 25 bp, Mus musculus
tagggttaagccctagctgctggca

SEQ ID NO: 751969 - DNA, 25 bp, Mus musculus
tagggttaagccgtagctgctggca

SEQ ID NO: 751970 - DNA, 25 bp, Mus musculus
tagggttatctacggtcgctctgtc

SEQ ID NO: 751971 - DNA, 25 bp, Mus musculus
tagggttatctagggtcgctctgtc

SEQ ID NO: 751972 - DNA, 25 bp, Mus musculus
tagggttcacggctcagagttgact

SEQ ID NO: 751973 - DNA, 25 bp, Mus musculus
tagggttcacgggtcagagttgact

SEQ ID NO: 751974 - DNA, 25 bp, Mus musculus
tagggttgacccacgtatgaacaga

SEQ ID NO: 751975 - DNA, 25 bp, Mus musculus
tagggttgaccctcgtatgaacaga

SEQ ID NO: 751976 - DNA, 25 bp, Mus musculus
tagggttgactgatcccgatcccaa

SEQ ID NO: 751977 - DNA, 25 bp, Mus musculus
tagggttgactgttcccgatcccaa

SEQ ID NO: 751978 - DNA, 25 bp, Mus musculus
tagggttggcgtctcagtctctgcc

SEQ ID NO: 751979 - DNA, 25 bp, Mus musculus
tagggttggcgtgtcagtctctgcc

SEQ ID NO: 751980 - DNA, 25 bp, Mus musculus
tagggttggctcagactctggagaa

SEQ ID NO: 751981 - DNA, 25 bp, Mus musculus
tagggttggctctgactctggagaa

SEQ ID NO: 751982 - DNA, 25 bp, Mus musculus
taggtaaccattactgtttgccaca

SEQ ID NO: 751983 - DNA, 25 bp, Mus musculus
taggtaaccatttctgtttgccaca

SEQ ID NO: 751984 - DNA, 25 bp, Mus musculus
taggtaacctctccagagatgtgac

SEQ ID NO: 751985 - DNA, 25 bp, Mus musculus
taggtaacctctgcagagatgtgac

SEQ ID NO: 751986 - DNA, 25 bp, Mus musculus
taggtaaggacaaggctatgtttcc

SEQ ID NO: 751987 - DNA, 25 bp, Mus musculus
taggtaaggacatggctatgtttcc

SEQ ID NO: 751988 - DNA, 25 bp, Mus musculus
taggtaatccccattctgagacgag

SEQ ID NO: 751989 - DNA, 25 bp, Mus musculus
taggtaatcccctttctgagacgag

SEQ ID NO: 751990 - DNA, 25 bp, Mus musculus
taggtaatttatcgtggcccagacg

SEQ ID NO: 751991 - DNA, 25 bp, Mus musculus
taggtaatttatggtggcccagacg

SEQ ID NO: 751992 - DNA, 25 bp, Mus musculus
taggtacctgtacgtagaagagctt

SEQ ID NO: 751993 - DNA, 25 bp, Mus musculus
taggtacctgtaggtagaagagctt

SEQ ID NO: 751994 - DNA, 25 bp, Mus musculus
taggtacgaggaccgtagcaccaca

SEQ ID NO: 751995 - DNA, 25 bp, Mus musculus
taggtacgaggagcgtagcaccaca

SEQ ID NO: 751996 - DNA, 25 bp, Mus musculus
taggtactctgaaccccaagtcaaa

SEQ ID NO: 751997 - DNA, 25 bp, Mus musculus
taggtactctgatccccaagtcaaa

SEQ ID NO: 751998 - DNA, 25 bp, Mus musculus
taggtagagctgacctctgcccgcc

SEQ ID NO: 751999 - DNA, 25 bp, Mus musculus
taggtagagctgtcctctgcccgcc

SEQ ID NO: 752000 - DNA, 25 bp, Mus musculus
taggtagaggatatagaccgcatcc

SEQ ID NO: 752001 - DNA, 25 bp, Mus musculus
taggtagaggatttagaccgcatcc

SEQ ID NO: 752002 - DNA, 25 bp, Mus musculus
taggtagaggctaggacacggacta

SEQ ID NO: 752003 - DNA, 25 bp, Mus musculus
taggtagaggcttggacacggacta

SEQ ID NO: 752004 - DNA, 25 bp, Mus musculus
taggtagccgttcctgagggcttca

SEQ ID NO: 752005 - DNA, 25 bp, Mus musculus
taggtagccgttgctgagggcttca

SEQ ID NO: 752006 - DNA, 25 bp, Mus musculus
taggtagcctcaaaccagggagcgt

SEQ ID NO: 752007 - DNA, 25 bp, Mus musculus
taggtagcctcataccagggagcgt

SEQ ID NO: 752008 - DNA, 25 bp, Mus musculus
taggtagtcccgcagaaggtctgca

SEQ ID NO: 752009 - DNA, 25 bp, Mus musculus
taggtagtcccggagaaggtctgca

SEQ ID NO: 752010 - DNA, 25 bp, Mus musculus
taggtatctttcagaagttgcatcc

SEQ ID NO: 752011 - DNA, 25 bp, Mus musculus
taggtatctttctgaagttgcatcc

SEQ ID NO: 752012 - DNA, 25 bp, Mus musculus
taggtatggagcacaaaggacagta

SEQ ID NO: 752013 - DNA, 25 bp, Mus musculus
taggtatggagctcaaaggacagta

SEQ ID NO: 752014 - DNA, 25 bp, Mus musculus
taggtatgggctcacacacgtttcc

SEQ ID NO: 752015 - DNA, 25 bp, Mus musculus
taggtatgggctgacacacgtttcc

SEQ ID NO: 752016 - DNA, 25 bp, Mus musculus
taggtatttctccattgatgttggc

SEQ ID NO: 752017 - DNA, 25 bp, Mus musculus
taggtatttctcgattgatgttggc

SEQ ID NO: 752018 - DNA, 25 bp, Mus musculus
taggtcaaagacaggtggcctcctt

SEQ ID NO: 752019 - DNA, 25 bp, Mus musculus
taggtcaaagactggtggcctcctt

SEQ ID NO: 752020 - DNA, 25 bp, Mus musculus
taggtcaagtctctcttagaccggt

SEQ ID NO: 752021 - DNA, 25 bp, Mus musculus
taggtcaagtctgtcttagaccggt

SEQ ID NO: 752022 - DNA, 25 bp, Mus musculus
taggtcacaatcagattcggatgat

SEQ ID NO: 752023 - DNA, 25 bp, Mus musculus
taggtcacaatctgattcggatgat

SEQ ID NO: 752024 - DNA, 25 bp, Mus musculus
taggtcactgccatcttaatttagg

SEQ ID NO: 752025 - DNA, 25 bp, Mus musculus
taggtcactgccttcttaatttagg

SEQ ID NO: 752026 - DNA, 25 bp, Mus musculus
taggtcagagaccatactgattcac

SEQ ID NO: 752027 - DNA, 25 bp, Mus musculus
taggtcagagacgatactgattcac

SEQ ID NO: 752028 - DNA, 25 bp, Mus musculus
taggtcagcctaagctcggcgagag

SEQ ID NO: 752029 - DNA, 25 bp, Mus musculus
taggtcagcctatgctcggcgagag

SEQ ID NO: 752030 - DNA, 25 bp, Mus musculus
taggtcagcgcaaccaaaggatgga

SEQ ID NO: 752031 - DNA, 25 bp, Mus musculus
taggtcagcgcatccaaaggatgga

SEQ ID NO: 752032 - DNA, 25 bp, Mus musculus
taggtcagtaagagagcccctctgt

SEQ ID NO: 752033 - DNA, 25 bp, Mus musculus
taggtcagtaagtgagcccctctgt

SEQ ID NO: 752034 - DNA, 25 bp, Mus musculus
taggtcagtagaacagtgacagtgc

SEQ ID NO: 752035 - DNA, 25 bp, Mus musculus
taggtcagtagatcagtgacagtgc

SEQ ID NO: 752036 - DNA, 25 bp, Mus musculus
taggtcatcgtgcagggtcgtctca

SEQ ID NO: 752037 - DNA, 25 bp, Mus musculus
taggtcatcgtggagggtcgtctca

SEQ ID NO: 752038 - DNA, 25 bp, Mus musculus
taggtcatttccctgttaccacagc

SEQ ID NO: 752039 - DNA, 25 bp, Mus musculus
taggtcatttccgtgttaccacagc

SEQ ID NO: 752040 - DNA, 25 bp, Mus musculus
taggtccaagacaggctccttgcaa

SEQ ID NO: 752041 - DNA, 25 bp, Mus musculus
taggtccaagactggctccttgcaa

SEQ ID NO: 752042 - DNA, 25 bp, Mus musculus
taggtccaggacaggtcatttcttc

SEQ ID NO: 752043 - DNA, 25 bp, Mus musculus
taggtccaggactggtcatttcttc

SEQ ID NO: 752044 - DNA, 25 bp, Mus musculus
taggtccagtgtatctaaggtgccc

SEQ ID NO: 752045 - DNA, 25 bp, Mus musculus
taggtccagtgtttctaaggtgccc

SEQ ID NO: 752046 - DNA, 25 bp, Mus musculus
taggtcccacgtacagacaagatgt

SEQ ID NO: 752047 - DNA, 25 bp, Mus musculus
taggtcccacgttcagacaagatgt

SEQ ID NO: 752048 - DNA, 25 bp, Mus musculus
taggtccggaggactggagaccaca

SEQ ID NO: 752049 - DNA, 25 bp, Mus musculus
taggtccggaggtctggagaccaca

SEQ ID NO: 752050 - DNA, 25 bp, Mus musculus
taggtcctccttcgtctgcaattag

SEQ ID NO: 752051 - DNA, 25 bp, Mus musculus
taggtcctccttggtctgcaattag

SEQ ID NO: 752052 - DNA, 25 bp, Mus musculus
taggtcctgcaactctcctttgcta

SEQ ID NO: 752053 - DNA, 25 bp, Mus musculus
taggtcctgcaagtctcctttgcta

SEQ ID NO: 752054 - DNA, 25 bp, Mus musculus
taggtccttcctagctcattgttct

SEQ ID NO: 752055 - DNA, 25 bp, Mus musculus
taggtccttccttgctcattgttct

SEQ ID NO: 752056 - DNA, 25 bp, Mus musculus
taggtccttggtactcattgatgta

SEQ ID NO: 752057 - DNA, 25 bp, Mus musculus
taggtccttggttctcattgatgta

SEQ ID NO: 752058 - DNA, 25 bp, Mus musculus
taggtcctttgcaactgcaacaagg

SEQ ID NO: 752059 - DNA, 25 bp, Mus musculus
taggtcctttgctactgcaacaagg

SEQ ID NO: 752060 - DNA, 25 bp, Mus musculus
taggtctaggaaatgctctggagtc

SEQ ID NO: 752061 - DNA, 25 bp, Mus musculus
taggtctaggaattgctctggagtc

SEQ ID NO: 752062 - DNA, 25 bp, Mus musculus
taggtctcaatgaaattcctggcac

SEQ ID NO: 752063 - DNA, 25 bp, Mus musculus
taggtctcaatgtaattcctggcac

SEQ ID NO: 752064 - DNA, 25 bp, Mus musculus
taggtctcagggacaaagattcccc

SEQ ID NO: 752065 - DNA, 25 bp, Mus musculus
taggtctcagggtcaaagattcccc

SEQ ID NO: 752066 - DNA, 25 bp, Mus musculus
taggtctccaggcagcctgccagag

SEQ ID NO: 752067 - DNA, 25 bp, Mus musculus
taggtctccagggagcctgccagag

SEQ ID NO: 752068 - DNA, 25 bp, Mus musculus
taggtctgacgtcgcactgaaacag

SEQ ID NO: 752069 - DNA, 25 bp, Mus musculus
taggtctgacgtggcactgaaacag

SEQ ID NO: 752070 - DNA, 25 bp, Mus musculus
taggtctgagatctggttatgccac

SEQ ID NO: 752071 - DNA, 25 bp, Mus musculus
taggtctgagatgtggttatgccac

SEQ ID NO: 752072 - DNA, 25 bp, Mus musculus
taggtcttatagaggaagaggcaga

SEQ ID NO: 752073 - DNA, 25 bp, Mus musculus
taggtcttatagtggaagaggcaga

SEQ ID NO: 752074 - DNA, 25 bp, Mus musculus
taggtgaacaccatctcctgaaatg

SEQ ID NO: 752075 - DNA, 25 bp, Mus musculus
taggtgaacaccttctcctgaaatg

SEQ ID NO: 752076 - DNA, 25 bp, Mus musculus
taggtgaagtcaaccctggtgacac

SEQ ID NO: 752077 - DNA, 25 bp, Mus musculus
taggtgaagtcatccctggtgacac

SEQ ID NO: 752078 - DNA, 25 bp, Mus musculus
taggtgaagtgcaaaaacagttaac

SEQ ID NO: 752079 - DNA, 25 bp, Mus musculus
taggtgaagtgctaaaacagttaac

SEQ ID NO: 752080 - DNA, 25 bp, Mus musculus
taggtgacagcacgatcgggcacca

SEQ ID NO: 752081 - DNA, 25 bp, Mus musculus
taggtgacagcaggatcgggcacca

SEQ ID NO: 752082 - DNA, 25 bp, Mus musculus
taggtgacgcaactaagccaagtca

SEQ ID NO: 752083 - DNA, 25 bp, Mus musculus
taggtgacgcaagtaagccaagtca

SEQ ID NO: 752084 - DNA, 25 bp, Mus musculus
taggtgacggccagtggcattctgt

SEQ ID NO: 752085 - DNA, 25 bp, Mus musculus
taggtgacggcctgtggcattctgt

SEQ ID NO: 752086 - DNA, 25 bp, Mus musculus
taggtgactagaccttcctactctg

SEQ ID NO: 752087 - DNA, 25 bp, Mus musculus
taggtgactagagcttcctactctg

SEQ ID NO: 752088 - DNA, 25 bp, Mus musculus
taggtgagaagcagagcctccagaa

SEQ ID NO: 752089 - DNA, 25 bp, Mus musculus
taggtgagaagctgagcctccagaa

SEQ ID NO: 752090 - DNA, 25 bp, Mus musculus
taggtgagacagaagccaaacagga

SEQ ID NO: 752091 - DNA, 25 bp, Mus musculus
taggtgagacagtagccaaacagga

SEQ ID NO: 752092 - DNA, 25 bp, Mus musculus
taggtgagccctactgagcatgtac

SEQ ID NO: 752093 - DNA, 25 bp, Mus musculus
taggtgagcccttctgagcatgtac

SEQ ID NO: 752094 - DNA, 25 bp, Mus musculus
taggtgatgggaagatcagaaagtc

SEQ ID NO: 752095 - DNA, 25 bp, Mus musculus
taggtgatgggatgatcagaaagtc

SEQ ID NO: 752096 - DNA, 25 bp, Mus musculus
taggtgatttgaccctgaactggcc

SEQ ID NO: 752097 - DNA, 25 bp, Mus musculus
taggtgatttgagcctgaactggcc

SEQ ID NO: 752098 - DNA, 25 bp, Mus musculus
taggtgcacccacatccgagttgga

SEQ ID NO: 752099 - DNA, 25 bp, Mus musculus
taggtgcacccagatccgagttgga

SEQ ID NO: 752100 - DNA, 25 bp, Mus musculus
taggtgcactgaactgctagagctg

SEQ ID NO: 752101 - DNA, 25 bp, Mus musculus
taggtgcactgatctgctagagctg

SEQ ID NO: 752102 - DNA, 25 bp, Mus musculus
taggtgcagtcaagacgtccaccag

SEQ ID NO: 752103 - DNA, 25 bp, Mus musculus
taggtgcagtcatgacgtccaccag

SEQ ID NO: 752104 - DNA, 25 bp, Mus musculus
taggtgcatggacagcaactcgcct

SEQ ID NO: 752105 - DNA, 25 bp, Mus musculus
taggtgcatggagagcaactcgcct

SEQ ID NO: 752106 - DNA, 25 bp, Mus musculus
taggtgccatgcagccccggacgct

SEQ ID NO: 752107 - DNA, 25 bp, Mus musculus
taggtgccatgctgccccggacgct

SEQ ID NO: 752108 - DNA, 25 bp, Mus musculus
taggtgccctccatgccatctgctg

SEQ ID NO: 752109 - DNA, 25 bp, Mus musculus
taggtgccctccttgccatctgctg

SEQ ID NO: 752110 - DNA, 25 bp, Mus musculus
taggtgccgtacctcacagtggcat

SEQ ID NO: 752111 - DNA, 25 bp, Mus musculus
taggtgccgtacgtcacagtggcat

SEQ ID NO: 752112 - DNA, 25 bp, Mus musculus
taggtgcgctcaccgtcctcgtaag

SEQ ID NO: 752113 - DNA, 25 bp, Mus musculus
taggtgcgctcagcgtcctcgtaag

SEQ ID NO: 752114 - DNA, 25 bp, Mus musculus
taggtgcggcacaagtgaatgtgca

SEQ ID NO: 752115 - DNA, 25 bp, Mus musculus
taggtgcggcactagtgaatgtgca

SEQ ID NO: 752116 - DNA, 25 bp, Mus musculus
taggtgctacagcaaacagcgtccc

SEQ ID NO: 752117 - DNA, 25 bp, Mus musculus
taggtgctacaggaaacagcgtccc

SEQ ID NO: 752118 - DNA, 25 bp, Mus musculus
taggtgctctaaacctctctagggc

SEQ ID NO: 752119 - DNA, 25 bp, Mus musculus
taggtgctctaatcctctctagggc

SEQ ID NO: 752120 - DNA, 25 bp, Mus musculus
taggtgctgcacagacttgtcaagg

SEQ ID NO: 752121 - DNA, 25 bp, Mus musculus
taggtgctgcactgacttgtcaagg

SEQ ID NO: 752122 - DNA, 25 bp, Mus musculus
taggtgctttccacttgctcctcag

SEQ ID NO: 752123 - DNA, 25 bp, Mus musculus
taggtgctttcctcttgctcctcag

SEQ ID NO: 752124 - DNA, 25 bp, Mus musculus
taggtggataggaaatccccattct

SEQ ID NO: 752125 - DNA, 25 bp, Mus musculus
taggtggataggtaatccccattct

SEQ ID NO: 752126 - DNA, 25 bp, Mus musculus
taggtggcaacactgacacctgttt

SEQ ID NO: 752127 - DNA, 25 bp, Mus musculus
taggtggcaacagtgacacctgttt

SEQ ID NO: 752128 - DNA, 25 bp, Mus musculus
taggtggcatggcttccagcctcta

SEQ ID NO: 752129 - DNA, 25 bp, Mus musculus
taggtggcatgggttccagcctcta

SEQ ID NO: 752130 - DNA, 25 bp, Mus musculus
taggtggccaggacaagattcggcc

SEQ ID NO: 752131 - DNA, 25 bp, Mus musculus
taggtggccaggtcaagattcggcc

SEQ ID NO: 752132 - DNA, 25 bp, Mus musculus
taggtgggaagcaaaggtttcgata

SEQ ID NO: 752133 - DNA, 25 bp, Mus musculus
taggtgggaagctaaggtttcgata

SEQ ID NO: 752134 - DNA, 25 bp, Mus musculus
taggtgggaccaattttgcctattg

SEQ ID NO: 752135 - DNA, 25 bp, Mus musculus
taggtgggaccatttttgcctattg

SEQ ID NO: 752136 - DNA, 25 bp, Mus musculus
taggtgtaacttcacttgcttgtcc

SEQ ID NO: 752137 - DNA, 25 bp, Mus musculus
taggtgtaacttgacttgcttgtcc

SEQ ID NO: 752138 - DNA, 25 bp, Mus musculus
taggtgtagctcagtggttgcgtca

SEQ ID NO: 752139 - DNA, 25 bp, Mus musculus
taggtgtagctctgtggttgcgtca

SEQ ID NO: 752140 - DNA, 25 bp, Mus musculus
taggtgtcgctcactatcaacatct

SEQ ID NO: 752141 - DNA, 25 bp, Mus musculus
taggtgtcgctctctatcaacatct

SEQ ID NO: 752142 - DNA, 25 bp, Mus musculus
taggtgtgcaacacacggtcataca

SEQ ID NO: 752143 - DNA, 25 bp, Mus musculus
taggtgtgcaactcacggtcataca

SEQ ID NO: 752144 - DNA, 25 bp, Mus musculus
taggtgtgttgaccacggtagccaa

SEQ ID NO: 752145 - DNA, 25 bp, Mus musculus
taggtgtgttgagcacggtagccaa

SEQ ID NO: 752146 - DNA, 25 bp, Mus musculus
taggtgttccgtctacaatggattt

SEQ ID NO: 752147 - DNA, 25 bp, Mus musculus
taggtgttccgtgtacaatggattt

SEQ ID NO: 752148 - DNA, 25 bp, Mus musculus
taggtgtttacactagggtcaggcc

SEQ ID NO: 752149 - DNA, 25 bp, Mus musculus
taggtgtttacagtagggtcaggcc

SEQ ID NO: 752150 - DNA, 25 bp, Mus musculus
taggttaatagtaagcaaggtgccg

SEQ ID NO: 752151 - DNA, 25 bp, Mus musculus
taggttaatagttagcaaggtgccg

SEQ ID NO: 752152 - DNA, 25 bp, Mus musculus
taggttacagaaacgaaaacctctg

SEQ ID NO: 752153 - DNA, 25 bp, Mus musculus
taggttacagaatcgaaaacctctg

SEQ ID NO: 752154 - DNA, 25 bp, Mus musculus
taggttacattgctggctccaaagt

SEQ ID NO: 752155 - DNA, 25 bp, Mus musculus
taggttacattggtggctccaaagt

SEQ ID NO: 752156 - DNA, 25 bp, Mus musculus
taggttacctatcggactggactaa

SEQ ID NO: 752157 - DNA, 25 bp, Mus musculus
taggttacctatgggactggactaa

SEQ ID NO: 752158 - DNA, 25 bp, Mus musculus
taggttagttacaaatcagccatcc

SEQ ID NO: 752159 - DNA, 25 bp, Mus musculus
taggttagttactaatcagccatcc

SEQ ID NO: 752160 - DNA, 25 bp, Mus musculus
taggttataaggaagactgaacagc

SEQ ID NO: 752161 - DNA, 25 bp, Mus musculus
taggttataaggtagactgaacagc

SEQ ID NO: 752162 - DNA, 25 bp, Mus musculus
taggttatgagtctgattgtgcagc

SEQ ID NO: 752163 - DNA, 25 bp, Mus musculus
taggttatgagtgtgattgtgcagc

SEQ ID NO: 752164 - DNA, 25 bp, Mus musculus
taggttcaagcccacgtatctctga

SEQ ID NO: 752165 - DNA, 25 bp, Mus musculus
taggttcaagccgacgtatctctga

SEQ ID NO: 752166 - DNA, 25 bp, Mus musculus
taggttcaggctccctgtcagggct

SEQ ID NO: 752167 - DNA, 25 bp, Mus musculus
taggttcaggctgcctgtcagggct

SEQ ID NO: 752168 - DNA, 25 bp, Mus musculus
taggttcatccacggttcccctgtg

SEQ ID NO: 752169 - DNA, 25 bp, Mus musculus
taggttcatccagggttcccctgtg

SEQ ID NO: 752170 - DNA, 25 bp, Mus musculus
taggttccacaaaggtacaggcagc

SEQ ID NO: 752171 - DNA, 25 bp, Mus musculus
taggttccacaatggtacaggcagc

SEQ ID NO: 752172 - DNA, 25 bp, Mus musculus
taggttcgtgcaaggcaaagactgg

SEQ ID NO: 752173 - DNA, 25 bp, Mus musculus
taggttcgtgcatggcaaagactgg

SEQ ID NO: 752174 - DNA, 25 bp, Mus musculus
taggttctatgtacacgttccgatg

SEQ ID NO: 752175 - DNA, 25 bp, Mus musculus
taggttctatgttcacgttccgatg

SEQ ID NO: 752176 - DNA, 25 bp, Mus musculus
taggttctcggaagccaaaccagcc

SEQ ID NO: 752177 - DNA, 25 bp, Mus musculus
taggttctcggatgccaaaccagcc

SEQ ID NO: 752178 - DNA, 25 bp, Mus musculus
taggtttaactgcatcccagacagc

SEQ ID NO: 752179 - DNA, 25 bp, Mus musculus
taggtttaactggatcccagacagc

SEQ ID NO: 752180 - DNA, 25 bp, Mus musculus
taggtttctgcgctcgcgtcatttt

SEQ ID NO: 752181 - DNA, 25 bp, Mus musculus
taggtttctgcggtcgcgtcatttt

SEQ ID NO: 752182 - DNA, 25 bp, Mus musculus
taggtttgacccacgtgcgggattc

SEQ ID NO: 752183 - DNA, 25 bp, Mus musculus
taggtttgaccctcgtgcgggattc

SEQ ID NO: 752184 - DNA, 25 bp, Mus musculus
taggtttggcctatggttacaactc

SEQ ID NO: 752185 - DNA, 25 bp, Mus musculus
taggtttggcctttggttacaactc

SEQ ID NO: 752186 - DNA, 25 bp, Mus musculus
taggttttagtgatggctatagcac

SEQ ID NO: 752187 - DNA, 25 bp, Mus musculus
taggttttagtgttggctatagcac

SEQ ID NO: 752188 - DNA, 25 bp, Mus musculus
taggttttctgtcactgtcatccgt

SEQ ID NO: 752189 - DNA, 25 bp, Mus musculus
taggttttctgtgactgtcatccgt

SEQ ID NO: 752190 - DNA, 25 bp, Mus musculus
tagtaaaagatacttctgctgccag

SEQ ID NO: 752191 - DNA, 25 bp, Mus musculus
tagtaaaagatagttctgctgccag

SEQ ID NO: 752192 - DNA, 25 bp, Mus musculus
tagtaaacataaagaggacctacac

SEQ ID NO: 752193 - DNA, 25 bp, Mus musculus
tagtaaacataatgaggacctacac

SEQ ID NO: 752194 - DNA, 25 bp, Mus musculus
tagtaaagacagctctggcaccaag

SEQ ID NO: 752195 - DNA, 25 bp, Mus musculus
tagtaaagacaggtctggcaccaag

SEQ ID NO: 752196 - DNA, 25 bp, Mus musculus
tagtaacaaccaatcaacctgagtc

SEQ ID NO: 752197 - DNA, 25 bp, Mus musculus
tagtaacaaccattcaacctgagtc

SEQ ID NO: 752198 - DNA, 25 bp, Mus musculus
tagtaacagagacgaaaattgtgga

SEQ ID NO: 752199 - DNA, 25 bp, Mus musculus
tagtaacagagaggaaaattgtgga

SEQ ID NO: 752200 - DNA, 25 bp, Mus musculus
tagtaaccattcaataccgcctggg

SEQ ID NO: 752201 - DNA, 25 bp, Mus musculus
tagtaaccattctataccgcctggg

SEQ ID NO: 752202 - DNA, 25 bp, Mus musculus
tagtaagccctaagtcagggtgact

SEQ ID NO: 752203 - DNA, 25 bp, Mus musculus
tagtaagccctatgtcagggtgact

SEQ ID NO: 752204 - DNA, 25 bp, Mus musculus
tagtaatcatcaccatcacacaggg

SEQ ID NO: 752205 - DNA, 25 bp, Mus musculus
tagtaatcatcagcatcacacaggg

SEQ ID NO: 752206 - DNA, 25 bp, Mus musculus
tagtaatccactccatcaatgagct

SEQ ID NO: 752207 - DNA, 25 bp, Mus musculus
tagtaatccactgcatcaatgagct

SEQ ID NO: 752208 - DNA, 25 bp, Mus musculus
tagtaatccaggcaggacgcgactg

SEQ ID NO: 752209 - DNA, 25 bp, Mus musculus
tagtaatccagggaggacgcgactg

SEQ ID NO: 752210 - DNA, 25 bp, Mus musculus
tagtaatctggcattctggacctgg

SEQ ID NO: 752211 - DNA, 25 bp, Mus musculus
tagtaatctggctttctggacctgg

SEQ ID NO: 752212 - DNA, 25 bp, Mus musculus
tagtaatctgtgatcgacacccgag

SEQ ID NO: 752213 - DNA, 25 bp, Mus musculus
tagtaatctgtgttcgacacccgag

SEQ ID NO: 752214 - DNA, 25 bp, Mus musculus
tagtaatgctgtctctcacgtaacc

SEQ ID NO: 752215 - DNA, 25 bp, Mus musculus
tagtaatgctgtgtctcacgtaacc

SEQ ID NO: 752216 - DNA, 25 bp, Mus musculus
tagtaatgggagctaccaatcgccc

SEQ ID NO: 752217 - DNA, 25 bp, Mus musculus
tagtaatgggaggtaccaatcgccc

SEQ ID NO: 752218 - DNA, 25 bp, Mus musculus
tagtaattggtaacctggagctgct

SEQ ID NO: 752219 - DNA, 25 bp, Mus musculus
tagtaattggtatcctggagctgct

SEQ ID NO: 752220 - DNA, 25 bp, Mus musculus
tagtaatttactccaggccctgaga

SEQ ID NO: 752221 - DNA, 25 bp, Mus musculus
tagtaatttactgcaggccctgaga

SEQ ID NO: 752222 - DNA, 25 bp, Mus musculus
tagtacaactcgagaaataaaggcc

SEQ ID NO: 752223 - DNA, 25 bp, Mus musculus
tagtacaactcgtgaaataaaggcc

SEQ ID NO: 752224 - DNA, 25 bp, Mus musculus
tagtacacagatcctgaaccagcag

SEQ ID NO: 752225 - DNA, 25 bp, Mus musculus
tagtacacagatgctgaaccagcag

SEQ ID NO: 752226 - DNA, 25 bp, Mus musculus
tagtacaccctcaaggtaggactgc

SEQ ID NO: 752227 - DNA, 25 bp, Mus musculus
tagtacaccctctaggtaggactgc

SEQ ID NO: 752228 - DNA, 25 bp, Mus musculus
tagtacagatacagtgctcaacctc

SEQ ID NO: 752229 - DNA, 25 bp, Mus musculus
tagtacagatactgtgctcaacctc

SEQ ID NO: 752230 - DNA, 25 bp, Mus musculus
tagtacagccccagtgatccagcgt

SEQ ID NO: 752231 - DNA, 25 bp, Mus musculus
tagtacagcccctgtgatccagcgt

SEQ ID NO: 752232 - DNA, 25 bp, Mus musculus
tagtaccactgtcttcaacaactcc

SEQ ID NO: 752233 - DNA, 25 bp, Mus musculus
tagtaccactgtgttcaacaactcc

SEQ ID NO: 752234 - DNA, 25 bp, Mus musculus
tagtaccagaaacgtggtggcttgt

SEQ ID NO: 752235 - DNA, 25 bp, Mus musculus
tagtaccagaaaggtggtggcttgt

SEQ ID NO: 752236 - DNA, 25 bp, Mus musculus
tagtaccagcctacctcttaattgg

SEQ ID NO: 752237 - DNA, 25 bp, Mus musculus
tagtaccagccttcctcttaattgg

SEQ ID NO: 752238 - DNA, 25 bp, Mus musculus
tagtaccgttgtcagcacacagcgt

SEQ ID NO: 752239 - DNA, 25 bp, Mus musculus
tagtaccgttgtgagcacacagcgt

SEQ ID NO: 752240 - DNA, 25 bp, Mus musculus
tagtactactgccatattttccagt

SEQ ID NO: 752241 - DNA, 25 bp, Mus musculus
tagtactactgcgatattttccagt

SEQ ID NO: 752242 - DNA, 25 bp, Mus musculus
tagtactcaagacccatgactgccc

SEQ ID NO: 752243 - DNA, 25 bp, Mus musculus
tagtactcaagagccatgactgccc

SEQ ID NO: 752244 - DNA, 25 bp, Mus musculus
tagtactcagagacgtcagtcggtc

SEQ ID NO: 752245 - DNA, 25 bp, Mus musculus
tagtactcagagtcgtcagtcggtc

SEQ ID NO: 752246 - DNA, 25 bp, Mus musculus
tagtactgaagaccagctaaggcgc

SEQ ID NO: 752247 - DNA, 25 bp, Mus musculus
tagtactgaagagcagctaaggcgc

SEQ ID NO: 752248 - DNA, 25 bp, Mus musculus
tagtactggagtcggcttctcccag

SEQ ID NO: 752249 - DNA, 25 bp, Mus musculus
tagtactggagtgggcttctcccag

SEQ ID NO: 752250 - DNA, 25 bp, Mus musculus
tagtacttgcatcggtgtctccggg

SEQ ID NO: 752251 - DNA, 25 bp, Mus musculus
tagtacttgcatgggtgtctccggg

SEQ ID NO: 752252 - DNA, 25 bp, Mus musculus
tagtacttgccgcacacatgagttc

SEQ ID NO: 752253 - DNA, 25 bp, Mus musculus
tagtacttgccggacacatgagttc

SEQ ID NO: 752254 - DNA, 25 bp, Mus musculus
tagtactttccccaagcgatggtgg

SEQ ID NO: 752255 - DNA, 25 bp, Mus musculus
tagtactttcccgaagcgatggtgg

SEQ ID NO: 752256 - DNA, 25 bp, Mus musculus
tagtagaaatgcagttagcagtcaa

SEQ ID NO: 752257 - DNA, 25 bp, Mus musculus
tagtagaaatgctgttagcagtcaa

SEQ ID NO: 752258 - DNA, 25 bp, Mus musculus
tagtagaactcccagccctcagctg

SEQ ID NO: 752259 - DNA, 25 bp, Mus musculus
tagtagaactccgagccctcagctg

SEQ ID NO: 752260 - DNA, 25 bp, Mus musculus
tagtagaagagcctcgacggaagac

SEQ ID NO: 752261 - DNA, 25 bp, Mus musculus
tagtagaagagcgtcgacggaagac

SEQ ID NO: 752262 - DNA, 25 bp, Mus musculus
tagtagacacttacctccagaagct

SEQ ID NO: 752263 - DNA, 25 bp, Mus musculus
tagtagacactttcctccagaagct

SEQ ID NO: 752264 - DNA, 25 bp, Mus musculus
tagtagagatgaccggcttgagccc

SEQ ID NO: 752265 - DNA, 25 bp, Mus musculus
tagtagagatgagcggcttgagccc

SEQ ID NO: 752266 - DNA, 25 bp, Mus musculus
tagtagataccaagtccccaggagc

SEQ ID NO: 752267 - DNA, 25 bp, Mus musculus
tagtagataccatgtccccaggagc

SEQ ID NO: 752268 - DNA, 25 bp, Mus musculus
tagtagatcaagaccaaaagctgac

SEQ ID NO: 752269 - DNA, 25 bp, Mus musculus
tagtagatcaagtccaaaagctgac

SEQ ID NO: 752270 - DNA, 25 bp, Mus musculus
tagtagatgcttatgggatcggcac

SEQ ID NO: 752271 - DNA, 25 bp, Mus musculus
tagtagatgcttttgggatcggcac

SEQ ID NO: 752272 - DNA, 25 bp, Mus musculus
tagtagcacgttaagataataaaga

SEQ ID NO: 752273 - DNA, 25 bp, Mus musculus
tagtagcacgtttagataataaaga

SEQ ID NO: 752274 - DNA, 25 bp, Mus musculus
tagtagcagagacaccaggctcttg

SEQ ID NO: 752275 - DNA, 25 bp, Mus musculus
tagtagcagagagaccaggctcttg

SEQ ID NO: 752276 - DNA, 25 bp, Mus musculus
tagtagcagtttatcgggacaaccg

SEQ ID NO: 752277 - DNA, 25 bp, Mus musculus
tagtagcagtttttcgggacaaccg

SEQ ID NO: 752278 - DNA, 25 bp, Mus musculus
tagtagccagtgcagcgtcatctac

SEQ ID NO: 752279 - DNA, 25 bp, Mus musculus
tagtagccagtggagcgtcatctac

SEQ ID NO: 752280 - DNA, 25 bp, Mus musculus
tagtagctagctatgacggcagagg

SEQ ID NO: 752281 - DNA, 25 bp, Mus musculus
tagtagctagctttgacggcagagg

SEQ ID NO: 752282 - DNA, 25 bp, Mus musculus
tagtagctggctcggaccaatgtga

SEQ ID NO: 752283 - DNA, 25 bp, Mus musculus
tagtagctggctgggaccaatgtga

SEQ ID NO: 752284 - DNA, 25 bp, Mus musculus
tagtaggagaccatgcagatgatgt

SEQ ID NO: 752285 - DNA, 25 bp, Mus musculus
tagtaggagaccttgcagatgatgt

SEQ ID NO: 752286 - DNA, 25 bp, Mus musculus
tagtaggaggacagctctccctcag

SEQ ID NO: 752287 - DNA, 25 bp, Mus musculus
tagtaggaggactgctctccctcag

SEQ ID NO: 752288 - DNA, 25 bp, Mus musculus
tagtagggacacacaaagtaagcct

SEQ ID NO: 752289 - DNA, 25 bp, Mus musculus
tagtagggacactcaaagtaagcct

SEQ ID NO: 752290 - DNA, 25 bp, Mus musculus
tagtaggtatggaacttctccggag

SEQ ID NO: 752291 - DNA, 25 bp, Mus musculus
tagtaggtatggtacttctccggag

SEQ ID NO: 752292 - DNA, 25 bp, Mus musculus
tagtaggtgttcaacaggctgtccc

SEQ ID NO: 752293 - DNA, 25 bp, Mus musculus
tagtaggtgttctacaggctgtccc

SEQ ID NO: 752294 - DNA, 25 bp, Mus musculus
tagtaggttctaagccacgtgtgga

SEQ ID NO: 752295 - DNA, 25 bp, Mus musculus
tagtaggttctatgccacgtgtgga

SEQ ID NO: 752296 - DNA, 25 bp, Mus musculus
tagtagtagctgcatgggcttcacg

SEQ ID NO: 752297 - DNA, 25 bp, Mus musculus
tagtagtagctggatgggcttcacg

SEQ ID NO: 752298 - DNA, 25 bp, Mus musculus
tagtagtctatgcacttgccgtttc

SEQ ID NO: 752299 - DNA, 25 bp, Mus musculus
tagtagtctatggacttgccgtttc

SEQ ID NO: 752300 - DNA, 25 bp, Mus musculus
tagtagtctgtcaggattgcatccc

SEQ ID NO: 752301 - DNA, 25 bp, Mus musculus
tagtagtctgtctggattgcatccc

SEQ ID NO: 752302 - DNA, 25 bp, Mus musculus
tagtagtgaggcctagtcacgagcc

SEQ ID NO: 752303 - DNA, 25 bp, Mus musculus
tagtagtgaggcgtagtcacgagcc

SEQ ID NO: 752304 - DNA, 25 bp, Mus musculus
tagtagtggcagcagtaaaacaggc

SEQ ID NO: 752305 - DNA, 25 bp, Mus musculus
tagtagtggcaggagtaaaacaggc

SEQ ID NO: 752306 - DNA, 25 bp, Mus musculus
tagtagtggttgatgaatccagcgg

SEQ ID NO: 752307 - DNA, 25 bp, Mus musculus
tagtagtggttgttgaatccagcgg

SEQ ID NO: 752308 - DNA, 25 bp, Mus musculus
tagtagttctcaccttttcattgaa

SEQ ID NO: 752309 - DNA, 25 bp, Mus musculus
tagtagttctcagcttttcattgaa

SEQ ID NO: 752310 - DNA, 25 bp, Mus musculus
tagtagttgcagcatctcaaaacca

SEQ ID NO: 752311 - DNA, 25 bp, Mus musculus
tagtagttgcaggatctcaaaacca

SEQ ID NO: 752312 - DNA, 25 bp, Mus musculus
tagtagtttccacggcgctgacgca

SEQ ID NO: 752313 - DNA, 25 bp, Mus musculus
tagtagtttccagggcgctgacgca

SEQ ID NO: 752314 - DNA, 25 bp, Mus musculus
tagtataccctactttctcagtcct

SEQ ID NO: 752315 - DNA, 25 bp, Mus musculus
tagtataccctagtttctcagtcct

SEQ ID NO: 752316 - DNA, 25 bp, Mus musculus
tagtatatcggacgcaaatctcaca

SEQ ID NO: 752317 - DNA, 25 bp, Mus musculus
tagtatatcggaggcaaatctcaca

SEQ ID NO: 752318 - DNA, 25 bp, Mus musculus
tagtatatgtgaccaggtgtcgtcc

SEQ ID NO: 752319 - DNA, 25 bp, Mus musculus
tagtatatgtgagcaggtgtcgtcc

SEQ ID NO: 752320 - DNA, 25 bp, Mus musculus
tagtatatttctaggaacacccagt

SEQ ID NO: 752321 - DNA, 25 bp, Mus musculus
tagtatatttcttggaacacccagt

SEQ ID NO: 752322 - DNA, 25 bp, Mus musculus
tagtatcaccctcaccctgcggatg

SEQ ID NO: 752323 - DNA, 25 bp, Mus musculus
tagtatcaccctgaccctgcggatg

SEQ ID NO: 752324 - DNA, 25 bp, Mus musculus
tagtatccttacaatactagagctc

SEQ ID NO: 752325 - DNA, 25 bp, Mus musculus
tagtatccttactatactagagctc

SEQ ID NO: 752326 - DNA, 25 bp, Mus musculus
tagtatcgaagcactgaccagcgat

SEQ ID NO: 752327 - DNA, 25 bp, Mus musculus
tagtatcgaagctctgaccagcgat

SEQ ID NO: 752328 - DNA, 25 bp, Mus musculus
tagtatcgccaaaggcctcatcaat

SEQ ID NO: 752329 - DNA, 25 bp, Mus musculus
tagtatcgccaatggcctcatcaat

SEQ ID NO: 752330 - DNA, 25 bp, Mus musculus
tagtatcggtgaatgccagaagccc

SEQ ID NO: 752331 - DNA, 25 bp, Mus musculus
tagtatcggtgattgccagaagccc

SEQ ID NO: 752332 - DNA, 25 bp, Mus musculus
tagtatcttctgaccctccagcagc

SEQ ID NO: 752333 - DNA, 25 bp, Mus musculus
tagtatcttctgtccctccagcagc

SEQ ID NO: 752334 - DNA, 25 bp, Mus musculus
tagtatgaagagaagcatccaggga

SEQ ID NO: 752335 - DNA, 25 bp, Mus musculus
tagtatgaagagtagcatccaggga

SEQ ID NO: 752336 - DNA, 25 bp, Mus musculus
tagtatgcgtgtatggagatgccca

SEQ ID NO: 752337 - DNA, 25 bp, Mus musculus
tagtatgcgtgtttggagatgccca

SEQ ID NO: 752338 - DNA, 25 bp, Mus musculus
tagtatggccaaagaagaagatgac

SEQ ID NO: 752339 - DNA, 25 bp, Mus musculus
tagtatggccaatgaagaagatgac

SEQ ID NO: 752340 - DNA, 25 bp, Mus musculus
tagtatggctccaccgctcatgcct

SEQ ID NO: 752341 - DNA, 25 bp, Mus musculus
tagtatggctcctccgctcatgcct

SEQ ID NO: 752342 - DNA, 25 bp, Mus musculus
tagtatgtggccagcttatcaaagt

SEQ ID NO: 752343 - DNA, 25 bp, Mus musculus
tagtatgtggcctgcttatcaaagt

SEQ ID NO: 752344 - DNA, 25 bp, Mus musculus
tagtatgtttctcagtggtctctcc

SEQ ID NO: 752345 - DNA, 25 bp, Mus musculus
tagtatgtttctgagtggtctctcc

SEQ ID NO: 752346 - DNA, 25 bp, Mus musculus
tagtattaactcactctatcaggtt

SEQ ID NO: 752347 - DNA, 25 bp, Mus musculus
tagtattaactctctctatcaggtt

SEQ ID NO: 752348 - DNA, 25 bp, Mus musculus
tagtattggacacttggccccaaac

SEQ ID NO: 752349 - DNA, 25 bp, Mus musculus
tagtattggacagttggccccaaac

SEQ ID NO: 752350 - DNA, 25 bp, Mus musculus
tagtatttctggatttgtgcagcca

SEQ ID NO: 752351 - DNA, 25 bp, Mus musculus
tagtatttctggttttgtgcagcca

SEQ ID NO: 752352 - DNA, 25 bp, Mus musculus
tagtcaaagatcaggagctgccctg

SEQ ID NO: 752353 - DNA, 25 bp, Mus musculus
tagtcaaagatctggagctgccctg

SEQ ID NO: 752354 - DNA, 25 bp, Mus musculus
tagtcaaagcacacgtacactggtg

SEQ ID NO: 752355 - DNA, 25 bp, Mus musculus
tagtcaaagcactcgtacactggtg

SEQ ID NO: 752356 - DNA, 25 bp, Mus musculus
tagtcaaagttaagacactttgccc

SEQ ID NO: 752357 - DNA, 25 bp, Mus musculus
tagtcaaagttatgacactttgccc

SEQ ID NO: 752358 - DNA, 25 bp, Mus musculus
tagtcaaatataaccggctgggatg

SEQ ID NO: 752359 - DNA, 25 bp, Mus musculus
tagtcaaatatatccggctgggatg

SEQ ID NO: 752360 - DNA, 25 bp, Mus musculus
tagtcaaatctaccatagcgcgctg

SEQ ID NO: 752361 - DNA, 25 bp, Mus musculus
tagtcaaatctagcatagcgcgctg

SEQ ID NO: 752362 - DNA, 25 bp, Mus musculus
tagtcaaattccaatcaaagactga

SEQ ID NO: 752363 - DNA, 25 bp, Mus musculus
tagtcaaattcctatcaaagactga

SEQ ID NO: 752364 - DNA, 25 bp, Mus musculus
tagtcaacaacacctttcagaacag

SEQ ID NO: 752365 - DNA, 25 bp, Mus musculus
tagtcaacaacagctttcagaacag

SEQ ID NO: 752366 - DNA, 25 bp, Mus musculus
tagtcaacaagtagaagaagacacc

SEQ ID NO: 752367 - DNA, 25 bp, Mus musculus
tagtcaacaagttgaagaagacacc

SEQ ID NO: 752368 - DNA, 25 bp, Mus musculus
tagtcaacaataagctgctgactgc

SEQ ID NO: 752369 - DNA, 25 bp, Mus musculus
tagtcaacaatatgctgctgactgc

SEQ ID NO: 752370 - DNA, 25 bp, Mus musculus
tagtcaaccgggaaggatcctgctg

SEQ ID NO: 752371 - DNA, 25 bp, Mus musculus
tagtcaaccgggtaggatcctgctg

SEQ ID NO: 752372 - DNA, 25 bp, Mus musculus
tagtcaactagtacagcctgttccc

SEQ ID NO: 752373 - DNA, 25 bp, Mus musculus
tagtcaactagttcagcctgttccc

SEQ ID NO: 752374 - DNA, 25 bp, Mus musculus
tagtcaagaccccaccatgattggt

SEQ ID NO: 752375 - DNA, 25 bp, Mus musculus
tagtcaagacccgaccatgattggt

SEQ ID NO: 752376 - DNA, 25 bp, Mus musculus
tagtcaagcaaacgctgtgcacagc

SEQ ID NO: 752377 - DNA, 25 bp, Mus musculus
tagtcaagcaaaggctgtgcacagc

SEQ ID NO: 752378 - DNA, 25 bp, Mus musculus
tagtcaagccgaagttgtcgacagt

SEQ ID NO: 752379 - DNA, 25 bp, Mus musculus
tagtcaagccgatgttgtcgacagt

SEQ ID NO: 752380 - DNA, 25 bp, Mus musculus
tagtcaagctagcagagcagtatgc

SEQ ID NO: 752381 - DNA, 25 bp, Mus musculus
tagtcaagctaggagagcagtatgc

SEQ ID NO: 752382 - DNA, 25 bp, Mus musculus
tagtcaagcttacggtcagcgtccc

SEQ ID NO: 752383 - DNA, 25 bp, Mus musculus
tagtcaagcttagggtcagcgtccc

SEQ ID NO: 752384 - DNA, 25 bp, Mus musculus
tagtcaatagcgcatgtggcttccc

SEQ ID NO: 752385 - DNA, 25 bp, Mus musculus
tagtcaatagcggatgtggcttccc

SEQ ID NO: 752386 - DNA, 25 bp, Mus musculus
tagtcacaattcaaggacagctgtc

SEQ ID NO: 752387 - DNA, 25 bp, Mus musculus
tagtcacaattctaggacagctgtc

SEQ ID NO: 752388 - DNA, 25 bp, Mus musculus
tagtcacagctacaatacgacgaag

SEQ ID NO: 752389 - DNA, 25 bp, Mus musculus
tagtcacagctagaatacgacgaag

SEQ ID NO: 752390 - DNA, 25 bp, Mus musculus
tagtcacagttacttggcagcagag

SEQ ID NO: 752391 - DNA, 25 bp, Mus musculus
tagtcacagttagttggcagcagag

SEQ ID NO: 752392 - DNA, 25 bp, Mus musculus
tagtcacatccgattgggcttgggc

SEQ ID NO: 752393 - DNA, 25 bp, Mus musculus
tagtcacatccgtttgggcttgggc

SEQ ID NO: 752394 - DNA, 25 bp, Mus musculus
tagtcacatgctcgattcaaaaaga

SEQ ID NO: 752395 - DNA, 25 bp, Mus musculus
tagtcacatgctggattcaaaaaga

SEQ ID NO: 752396 - DNA, 25 bp, Mus musculus
tagtcacattccaatcagcagcagc

SEQ ID NO: 752397 - DNA, 25 bp, Mus musculus
tagtcacattcctatcagcagcagc

SEQ ID NO: 752398 - DNA, 25 bp, Mus musculus
tagtcaccagtaaggtctacagtgc

SEQ ID NO: 752399 - DNA, 25 bp, Mus musculus
tagtcaccagtatggtctacagtgc

SEQ ID NO: 752400 - DNA, 25 bp, Mus musculus
tagtcaccattaaacgcacagaagc

SEQ ID NO: 752401 - DNA, 25 bp, Mus musculus
tagtcaccattatacgcacagaagc

SEQ ID NO: 752402 - DNA, 25 bp, Mus musculus
tagtcaccccagctagagaaggcaa

SEQ ID NO: 752403 - DNA, 25 bp, Mus musculus
tagtcaccccaggtagagaaggcaa

SEQ ID NO: 752404 - DNA, 25 bp, Mus musculus
tagtcaccctctacaagcttttggg

SEQ ID NO: 752405 - DNA, 25 bp, Mus musculus
tagtcaccctcttcaagcttttggg

SEQ ID NO: 752406 - DNA, 25 bp, Mus musculus
tagtcaccgagaaatccccgaccga

SEQ ID NO: 752407 - DNA, 25 bp, Mus musculus
tagtcaccgagatatccccgaccga

SEQ ID NO: 752408 - DNA, 25 bp, Mus musculus
tagtcacgagccatggagtgcgctc

SEQ ID NO: 752409 - DNA, 25 bp, Mus musculus
tagtcacgagccttggagtgcgctc

SEQ ID NO: 752410 - DNA, 25 bp, Mus musculus
tagtcacgggatcgcgaccaagtct

SEQ ID NO: 752411 - DNA, 25 bp, Mus musculus
tagtcacgggatggcgaccaagtct

SEQ ID NO: 752412 - DNA, 25 bp, Mus musculus
tagtcactaggtatttgaatgccac

SEQ ID NO: 752413 - DNA, 25 bp, Mus musculus
tagtcactaggtttttgaatgccac

SEQ ID NO: 752414 - DNA, 25 bp, Mus musculus
tagtcactcccgagaatccacagga

SEQ ID NO: 752415 - DNA, 25 bp, Mus musculus
tagtcactcccgtgaatccacagga

SEQ ID NO: 752416 - DNA, 25 bp, Mus musculus
tagtcacttgagaaacttggccgct

SEQ ID NO: 752417 - DNA, 25 bp, Mus musculus
tagtcacttgagtaacttggccgct

SEQ ID NO: 752418 - DNA, 25 bp, Mus musculus
tagtcagaccttcctcttacaccga

SEQ ID NO: 752419 - DNA, 25 bp, Mus musculus
tagtcagaccttgctcttacaccga

SEQ ID NO: 752420 - DNA, 25 bp, Mus musculus
tagtcagagatactccgttctgggc

SEQ ID NO: 752421 - DNA, 25 bp, Mus musculus
tagtcagagatagtccgttctgggc

SEQ ID NO: 752422 - DNA, 25 bp, Mus musculus
tagtcagagatgcatccagcaagat

SEQ ID NO: 752423 - DNA, 25 bp, Mus musculus
tagtcagagatggatccagcaagat

SEQ ID NO: 752424 - DNA, 25 bp, Mus musculus
tagtcagagcagaaacgcatctcgg

SEQ ID NO: 752425 - DNA, 25 bp, Mus musculus
tagtcagagcagtaacgcatctcgg

SEQ ID NO: 752426 - DNA, 25 bp, Mus musculus
tagtcagaggctacagaaacaacca

SEQ ID NO: 752427 - DNA, 25 bp, Mus musculus
tagtcagaggcttcagaaacaacca

SEQ ID NO: 752428 - DNA, 25 bp, Mus musculus
tagtcagcacatatccagtccgggc

SEQ ID NO: 752429 - DNA, 25 bp, Mus musculus
tagtcagcacatttccagtccgggc

SEQ ID NO: 752430 - DNA, 25 bp, Mus musculus
tagtcagtcgaccaaaaccttcacc

SEQ ID NO: 752431 - DNA, 25 bp, Mus musculus
tagtcagtcgacgaaaaccttcacc

SEQ ID NO: 752432 - DNA, 25 bp, Mus musculus
tagtcagtgaaaagctgaaaatcat

SEQ ID NO: 752433 - DNA, 25 bp, Mus musculus
tagtcagtgaaatgctgaaaatcat

SEQ ID NO: 752434 - DNA, 25 bp, Mus musculus
tagtcagtgcttcgcaagatggaaa

SEQ ID NO: 752435 - DNA, 25 bp, Mus musculus
tagtcagtgcttggcaagatggaaa

SEQ ID NO: 752436 - DNA, 25 bp, Mus musculus
tagtcagtgggtcgcttccctttga

SEQ ID NO: 752437 - DNA, 25 bp, Mus musculus
tagtcagtgggtggcttccctttga

SEQ ID NO: 752438 - DNA, 25 bp, Mus musculus
tagtcagtgtgcactgctctgccca

SEQ ID NO: 752439 - DNA, 25 bp, Mus musculus
tagtcagtgtgctctgctctgccca

SEQ ID NO: 752440 - DNA, 25 bp, Mus musculus
tagtcatagctgagacgtataaccg

SEQ ID NO: 752441 - DNA, 25 bp, Mus musculus
tagtcatagctgtgacgtataaccg

SEQ ID NO: 752442 - DNA, 25 bp, Mus musculus
tagtcataggatcacatcgacagga

SEQ ID NO: 752443 - DNA, 25 bp, Mus musculus
tagtcataggatgacatcgacagga

SEQ ID NO: 752444 - DNA, 25 bp, Mus musculus
tagtcatagtgaagcccaccctaag

SEQ ID NO: 752445 - DNA, 25 bp, Mus musculus
tagtcatagtgatgcccaccctaag

SEQ ID NO: 752446 - DNA, 25 bp, Mus musculus
tagtcatatgctaaataatccagat

SEQ ID NO: 752447 - DNA, 25 bp, Mus musculus
tagtcatatgcttaataatccagat

SEQ ID NO: 752448 - DNA, 25 bp, Mus musculus
tagtcatcaattccatgggccgccg

SEQ ID NO: 752449 - DNA, 25 bp, Mus musculus
tagtcatcaattgcatgggccgccg

SEQ ID NO: 752450 - DNA, 25 bp, Mus musculus
tagtcatcatggactcctacggcag

SEQ ID NO: 752451 - DNA, 25 bp, Mus musculus
tagtcatcatggtctcctacggcag

SEQ ID NO: 752452 - DNA, 25 bp, Mus musculus
tagtcatggaaacagccctgctgtc

SEQ ID NO: 752453 - DNA, 25 bp, Mus musculus
tagtcatggaaagagccctgctgtc

SEQ ID NO: 752454 - DNA, 25 bp, Mus musculus
tagtcatggccgactgctgctgtgg

SEQ ID NO: 752455 - DNA, 25 bp, Mus musculus
tagtcatggccgtctgctgctgtgg

SEQ ID NO: 752456 - DNA, 25 bp, Mus musculus
tagtcatgtgctacaattctgtggc

SEQ ID NO: 752457 - DNA, 25 bp, Mus musculus
tagtcatgtgcttcaattctgtggc

SEQ ID NO: 752458 - DNA, 25 bp, Mus musculus
tagtcattcaagcttaggcacaggc

SEQ ID NO: 752459 - DNA, 25 bp, Mus musculus
tagtcattcaaggttaggcacaggc

SEQ ID NO: 752460 - DNA, 25 bp, Mus musculus
tagtcattctcgagggcatggtgga

SEQ ID NO: 752461 - DNA, 25 bp, Mus musculus
tagtcattctcgtgggcatggtgga

SEQ ID NO: 752462 - DNA, 25 bp, Mus musculus
tagtcattgctcagccttttactgg

SEQ ID NO: 752463 - DNA, 25 bp, Mus musculus
tagtcattgctctgccttttactgg

SEQ ID NO: 752464 - DNA, 25 bp, Mus musculus
tagtcatttggcagaagcatgtgaa

SEQ ID NO: 752465 - DNA, 25 bp, Mus musculus
tagtcatttggctgaagcatgtgaa

SEQ ID NO: 752466 - DNA, 25 bp, Mus musculus
tagtccaagatcctccactgttggc

SEQ ID NO: 752467 - DNA, 25 bp, Mus musculus
tagtccaagatcgtccactgttggc

SEQ ID NO: 752468 - DNA, 25 bp, Mus musculus
tagtccagatgacacagccctcagt

SEQ ID NO: 752469 - DNA, 25 bp, Mus musculus
tagtccagatgagacagccctcagt

SEQ ID NO: 752470 - DNA, 25 bp, Mus musculus
tagtccagccaaacaccaaacggtt

SEQ ID NO: 752471 - DNA, 25 bp, Mus musculus
tagtccagccaatcaccaaacggtt

SEQ ID NO: 752472 - DNA, 25 bp, Mus musculus
tagtccagccgtcaagcgattgttg

SEQ ID NO: 752473 - DNA, 25 bp, Mus musculus
tagtccagccgtgaagcgattgttg

SEQ ID NO: 752474 - DNA, 25 bp, Mus musculus
tagtccaggacaagttcacgggcat

SEQ ID NO: 752475 - DNA, 25 bp, Mus musculus
tagtccaggacatgttcacgggcat

SEQ ID NO: 752476 - DNA, 25 bp, Mus musculus
tagtccatagaaagtccatttagca

SEQ ID NO: 752477 - DNA, 25 bp, Mus musculus
tagtccatagaatgtccatttagca

SEQ ID NO: 752478 - DNA, 25 bp, Mus musculus
tagtccatctaactgtcttctaaca

SEQ ID NO: 752479 - DNA, 25 bp, Mus musculus
tagtccatctaagtgtcttctaaca

SEQ ID NO: 752480 - DNA, 25 bp, Mus musculus
tagtcccaacaactgcactgtgtac

SEQ ID NO: 752481 - DNA, 25 bp, Mus musculus
tagtcccaacaagtgcactgtgtac

SEQ ID NO: 752482 - DNA, 25 bp, Mus musculus
tagtcccagggtattgcagccatct

SEQ ID NO: 752483 - DNA, 25 bp, Mus musculus
tagtcccagggttttgcagccatct

SEQ ID NO: 752484 - DNA, 25 bp, Mus musculus
tagtcccattccacttttgtttcac

SEQ ID NO: 752485 - DNA, 25 bp, Mus musculus
tagtcccattcctcttttgtttcac

SEQ ID NO: 752486 - DNA, 25 bp, Mus musculus
tagtccccgaagattgagataagtc

SEQ ID NO: 752487 - DNA, 25 bp, Mus musculus
tagtccccgaagtttgagataagtc

SEQ ID NO: 752488 - DNA, 25 bp, Mus musculus
tagtcccgatgacctggaagtcaaa

SEQ ID NO: 752489 - DNA, 25 bp, Mus musculus
tagtcccgatgagctggaagtcaaa

SEQ ID NO: 752490 - DNA, 25 bp, Mus musculus
tagtcccggcctccgtgctagtgtt

SEQ ID NO: 752491 - DNA, 25 bp, Mus musculus
tagtcccggcctgcgtgctagtgtt

SEQ ID NO: 752492 - DNA, 25 bp, Mus musculus
tagtcccgtagtcctgtagtcctgt

SEQ ID NO: 752493 - DNA, 25 bp, Mus musculus
tagtcccgtagtgctgtagtcctgt

SEQ ID NO: 752494 - DNA, 25 bp, Mus musculus
tagtccctaaggcagcgtgtgtccg

SEQ ID NO: 752495 - DNA, 25 bp, Mus musculus
tagtccctaagggagcgtgtgtccg

SEQ ID NO: 752496 - DNA, 25 bp, Mus musculus
tagtccctatgactggtataatcca

SEQ ID NO: 752497 - DNA, 25 bp, Mus musculus
tagtccctatgagtggtataatcca

SEQ ID NO: 752498 - DNA, 25 bp, Mus musculus
tagtcccttctcatggtgaccggga

SEQ ID NO: 752499 - DNA, 25 bp, Mus musculus
tagtcccttctcttggtgaccggga

SEQ ID NO: 752500 - DNA, 25 bp, Mus musculus
tagtccggtacacagaagtccagct

SEQ ID NO: 752501 - DNA, 25 bp, Mus musculus
tagtccggtacagagaagtccagct

SEQ ID NO: 752502 - DNA, 25 bp, Mus musculus
tagtccggtcagagtcttcacgcag

SEQ ID NO: 752503 - DNA, 25 bp, Mus musculus
tagtccggtcagtgtcttcacgcag

SEQ ID NO: 752504 - DNA, 25 bp, Mus musculus
tagtccggttttccacatgggaagg

SEQ ID NO: 752505 - DNA, 25 bp, Mus musculus
tagtccggttttgcacatgggaagg

SEQ ID NO: 752506 - DNA, 25 bp, Mus musculus
tagtccgtacaacctgagcaaattc

SEQ ID NO: 752507 - DNA, 25 bp, Mus musculus
tagtccgtacaagctgagcaaattc

SEQ ID NO: 752508 - DNA, 25 bp, Mus musculus
tagtccgtgagaatcggcagcataa

SEQ ID NO: 752509 - DNA, 25 bp, Mus musculus
tagtccgtgagattcggcagcataa

SEQ ID NO: 752510 - DNA, 25 bp, Mus musculus
tagtccgtgctactgaggtacctgt

SEQ ID NO: 752511 - DNA, 25 bp, Mus musculus
tagtccgtgctagtgaggtacctgt

SEQ ID NO: 752512 - DNA, 25 bp, Mus musculus
tagtcctacccacagccgtattagc

SEQ ID NO: 752513 - DNA, 25 bp, Mus musculus
tagtcctacccagagccgtattagc

SEQ ID NO: 752514 - DNA, 25 bp, Mus musculus
tagtcctcacatacttaggactgga

SEQ ID NO: 752515 - DNA, 25 bp, Mus musculus
tagtcctcacattcttaggactgga

SEQ ID NO: 752516 - DNA, 25 bp, Mus musculus
tagtcctcgaggaagtatgctacac

SEQ ID NO: 752517 - DNA, 25 bp, Mus musculus
tagtcctcgaggtagtatgctacac

SEQ ID NO: 752518 - DNA, 25 bp, Mus musculus
tagtcctcgtgcatctggtctcctg

SEQ ID NO: 752519 - DNA, 25 bp, Mus musculus
tagtcctcgtgcttctggtctcctg

SEQ ID NO: 752520 - DNA, 25 bp, Mus musculus
tagtcctctgccagtctgttggaga

SEQ ID NO: 752521 - DNA, 25 bp, Mus musculus
tagtcctctgcctgtctgttggaga

SEQ ID NO: 752522 - DNA, 25 bp, Mus musculus
tagtcctcttaactatctggctctg

SEQ ID NO: 752523 - DNA, 25 bp, Mus musculus
tagtcctcttaagtatctggctctg

SEQ ID NO: 752524 - DNA, 25 bp, Mus musculus
tagtcctgagttagcttaaggctgg

SEQ ID NO: 752525 - DNA, 25 bp, Mus musculus
tagtcctgagtttgcttaaggctgg

SEQ ID NO: 752526 - DNA, 25 bp, Mus musculus
tagtcctgcccacatcttgatttcc

SEQ ID NO: 752527 - DNA, 25 bp, Mus musculus
tagtcctgcccagatcttgatttcc

SEQ ID NO: 752528 - DNA, 25 bp, Mus musculus
tagtcctggctacacgatatcgtca

SEQ ID NO: 752529 - DNA, 25 bp, Mus musculus
tagtcctggctagacgatatcgtca

SEQ ID NO: 752530 - DNA, 25 bp, Mus musculus
tagtccttatgactgagtacttggg

SEQ ID NO: 752531 - DNA, 25 bp, Mus musculus
tagtccttatgagtgagtacttggg

SEQ ID NO: 752532 - DNA, 25 bp, Mus musculus
tagtcgacatggatgttgcttcaag

SEQ ID NO: 752533 - DNA, 25 bp, Mus musculus
tagtcgacatggttgttgcttcaag

SEQ ID NO: 752534 - DNA, 25 bp, Mus musculus
tagtcgacccagcatctccaaaata

SEQ ID NO: 752535 - DNA, 25 bp, Mus musculus
tagtcgacccaggatctccaaaata

SEQ ID NO: 752536 - DNA, 25 bp, Mus musculus
tagtcgatagcgacagacccgaagg

SEQ ID NO: 752537 - DNA, 25 bp, Mus musculus
tagtcgatagcgtcagacccgaagg

SEQ ID NO: 752538 - DNA, 25 bp, Mus musculus
tagtcgatctcaacaccaggctgaa

SEQ ID NO: 752539 - DNA, 25 bp, Mus musculus
tagtcgatctcatcaccaggctgaa

SEQ ID NO: 752540 - DNA, 25 bp, Mus musculus
tagtcgcaacagcagtcatgtcggg

SEQ ID NO: 752541 - DNA, 25 bp, Mus musculus
tagtcgcaacaggagtcatgtcggg

SEQ ID NO: 752542 - DNA, 25 bp, Mus musculus
tagtcgcccctgacactatgcagga

SEQ ID NO: 752543 - DNA, 25 bp, Mus musculus
tagtcgcccctgtcactatgcagga

SEQ ID NO: 752544 - DNA, 25 bp, Mus musculus
tagtcgcgccaaagttgacacggag

SEQ ID NO: 752545 - DNA, 25 bp, Mus musculus
tagtcgcgccaatgttgacacggag

SEQ ID NO: 752546 - DNA, 25 bp, Mus musculus
tagtcgcgtggacacactgttctca

SEQ ID NO: 752547 - DNA, 25 bp, Mus musculus
tagtcgcgtggagacactgttctca

SEQ ID NO: 752548 - DNA, 25 bp, Mus musculus
tagtcgctgtgtaagtcaggcatcg

SEQ ID NO: 752549 - DNA, 25 bp, Mus musculus
tagtcgctgtgttagtcaggcatcg

SEQ ID NO: 752550 - DNA, 25 bp, Mus musculus
tagtcggaccaaatttcgggctcca

SEQ ID NO: 752551 - DNA, 25 bp, Mus musculus
tagtcggaccaattttcgggctcca

SEQ ID NO: 752552 - DNA, 25 bp, Mus musculus
tagtcggaggcacttctgtttacca

SEQ ID NO: 752553 - DNA, 25 bp, Mus musculus
tagtcggaggcagttctgtttacca

SEQ ID NO: 752554 - DNA, 25 bp, Mus musculus
tagtcggcccttaagtgctgtctcg

SEQ ID NO: 752555 - DNA, 25 bp, Mus musculus
tagtcggccctttagtgctgtctcg

SEQ ID NO: 752556 - DNA, 25 bp, Mus musculus
tagtcgggcaagatgcagccgagaa

SEQ ID NO: 752557 - DNA, 25 bp, Mus musculus
tagtcgggcaagttgcagccgagaa

SEQ ID NO: 752558 - DNA, 25 bp, Mus musculus
tagtcggtgcctctttcttgcctct

SEQ ID NO: 752559 - DNA, 25 bp, Mus musculus
tagtcggtgcctgtttcttgcctct

SEQ ID NO: 752560 - DNA, 25 bp, Mus musculus
tagtcgtatctaatggccagacatg

SEQ ID NO: 752561 - DNA, 25 bp, Mus musculus
tagtcgtatctattggccagacatg

SEQ ID NO: 752562 - DNA, 25 bp, Mus musculus
tagtcgtcatttctagcccgcctgc

SEQ ID NO: 752563 - DNA, 25 bp, Mus musculus
tagtcgtcatttgtagcccgcctgc

SEQ ID NO: 752564 - DNA, 25 bp, Mus musculus
tagtcgtcctgaagtatcgcttgtc

SEQ ID NO: 752565 - DNA, 25 bp, Mus musculus
tagtcgtcctgatgtatcgcttgtc

SEQ ID NO: 752566 - DNA, 25 bp, Mus musculus
tagtcgtcgcgtattaagttgctgc

SEQ ID NO: 752567 - DNA, 25 bp, Mus musculus
tagtcgtcgcgttttaagttgctgc

SEQ ID NO: 752568 - DNA, 25 bp, Mus musculus
tagtcgtctcccaggaattctaact

SEQ ID NO: 752569 - DNA, 25 bp, Mus musculus
tagtcgtctccctggaattctaact

SEQ ID NO: 752570 - DNA, 25 bp, Mus musculus
tagtcgtgacctcctgcttctgtgt

SEQ ID NO: 752571 - DNA, 25 bp, Mus musculus
tagtcgtgacctgctgcttctgtgt

SEQ ID NO: 752572 - DNA, 25 bp, Mus musculus
tagtctaaacccagttccaaagcag

SEQ ID NO: 752573 - DNA, 25 bp, Mus musculus
tagtctaaaccctgttccaaagcag

SEQ ID NO: 752574 - DNA, 25 bp, Mus musculus
tagtctaaagagagagacttttccc

SEQ ID NO: 752575 - DNA, 25 bp, Mus musculus
tagtctaaagagtgagacttttccc

SEQ ID NO: 752576 - DNA, 25 bp, Mus musculus
tagtctaatagcatgacatctgttc

SEQ ID NO: 752577 - DNA, 25 bp, Mus musculus
tagtctaatagcttgacatctgttc

SEQ ID NO: 752578 - DNA, 25 bp, Mus musculus
tagtctacatgaagtatgacacacc

SEQ ID NO: 752579 - DNA, 25 bp, Mus musculus
tagtctacatgatgtatgacacacc

SEQ ID NO: 752580 - DNA, 25 bp, Mus musculus
tagtctacttaaccctgagttaaat

SEQ ID NO: 752581 - DNA, 25 bp, Mus musculus
tagtctacttaagcctgagttaaat

SEQ ID NO: 752582 - DNA, 25 bp, Mus musculus
tagtctagactaagataatgttggg

SEQ ID NO: 752583 - DNA, 25 bp, Mus musculus
tagtctagactatgataatgttggg

SEQ ID NO: 752584 - DNA, 25 bp, Mus musculus
tagtctagtcctcgcaagtgtgtag

SEQ ID NO: 752585 - DNA, 25 bp, Mus musculus
tagtctagtcctggcaagtgtgtag

SEQ ID NO: 752586 - DNA, 25 bp, Mus musculus
tagtctatggacatgccgtttctct

SEQ ID NO: 752587 - DNA, 25 bp, Mus musculus
tagtctatggacttgccgtttctct

SEQ ID NO: 752588 - DNA, 25 bp, Mus musculus
tagtctatggctcgcagctgacact

SEQ ID NO: 752589 - DNA, 25 bp, Mus musculus
tagtctatggctggcagctgacact

SEQ ID NO: 752590 - DNA, 25 bp, Mus musculus
tagtctcaccgtagctcctgctagc

SEQ ID NO: 752591 - DNA, 25 bp, Mus musculus
tagtctcaccgttgctcctgctagc

SEQ ID NO: 752592 - DNA, 25 bp, Mus musculus
tagtctcactacatggctggcctag

SEQ ID NO: 752593 - DNA, 25 bp, Mus musculus
tagtctcactacttggctggcctag

SEQ ID NO: 752594 - DNA, 25 bp, Mus musculus
tagtctcataggatcgtcacagtgg

SEQ ID NO: 752595 - DNA, 25 bp, Mus musculus
tagtctcataggttcgtcacagtgg

SEQ ID NO: 752596 - DNA, 25 bp, Mus musculus
tagtctccaactcggaacgcatccg

SEQ ID NO: 752597 - DNA, 25 bp, Mus musculus
tagtctccaactgggaacgcatccg

SEQ ID NO: 752598 - DNA, 25 bp, Mus musculus
tagtctccctgacgaagcagttcca

SEQ ID NO: 752599 - DNA, 25 bp, Mus musculus
tagtctccctgaggaagcagttcca

SEQ ID NO: 752600 - DNA, 25 bp, Mus musculus
tagtctcctgaaaaatcctgtagca

SEQ ID NO: 752601 - DNA, 25 bp, Mus musculus
tagtctcctgaataatcctgtagca

SEQ ID NO: 752602 - DNA, 25 bp, Mus musculus
tagtctctccagaaagtatacgcga

SEQ ID NO: 752603 - DNA, 25 bp, Mus musculus
tagtctctccagtaagtatacgcga

SEQ ID NO: 752604 - DNA, 25 bp, Mus musculus
tagtctctctggatgaggtctcggg

SEQ ID NO: 752605 - DNA, 25 bp, Mus musculus
tagtctctctggttgaggtctcggg

SEQ ID NO: 752606 - DNA, 25 bp, Mus musculus
tagtctctgagtccccagggaaaat

SEQ ID NO: 752607 - DNA, 25 bp, Mus musculus
tagtctctgagtgcccagggaaaat

SEQ ID NO: 752608 - DNA, 25 bp, Mus musculus
tagtctgaagctcgatctgggaaag

SEQ ID NO: 752609 - DNA, 25 bp, Mus musculus
tagtctgaagctggatctgggaaag

SEQ ID NO: 752610 - DNA, 25 bp, Mus musculus
tagtctgactaaatttgttggttcc

SEQ ID NO: 752611 - DNA, 25 bp, Mus musculus
tagtctgactaattttgttggttcc

SEQ ID NO: 752612 - DNA, 25 bp, Mus musculus
tagtctgagggcctttgcctgctga

SEQ ID NO: 752613 - DNA, 25 bp, Mus musculus
tagtctgagggcgtttgcctgctga

SEQ ID NO: 752614 - DNA, 25 bp, Mus musculus
tagtctgcaggtacgggtcgttctg

SEQ ID NO: 752615 - DNA, 25 bp, Mus musculus
tagtctgcaggtagagtttctcttc

SEQ ID NO: 752616 - DNA, 25 bp, Mus musculus
tagtctgcaggttcgggtcgttctg

SEQ ID NO: 752617 - DNA, 25 bp, Mus musculus
tagtctgcaggttgagtttctcttc

SEQ ID NO: 752618 - DNA, 25 bp, Mus musculus
tagtctgcatttaaccacacttgtc

SEQ ID NO: 752619 - DNA, 25 bp, Mus musculus
tagtctgcattttaccacacttgtc

SEQ ID NO: 752620 - DNA, 25 bp, Mus musculus
tagtctgcggtaagctgggcttccc

SEQ ID NO: 752621 - DNA, 25 bp, Mus musculus
tagtctgcggtatgctgggcttccc

SEQ ID NO: 752622 - DNA, 25 bp, Mus musculus
tagtctgcgtgtccgcgttgaatca

SEQ ID NO: 752623 - DNA, 25 bp, Mus musculus
tagtctgcgtgtgcgcgttgaatca

SEQ ID NO: 752624 - DNA, 25 bp, Mus musculus
tagtctgctccgagacagctacggg

SEQ ID NO: 752625 - DNA, 25 bp, Mus musculus
tagtctgctccgtgacagctacggg

SEQ ID NO: 752626 - DNA, 25 bp, Mus musculus
tagtctgctgaaacataccaagtgt

SEQ ID NO: 752627 - DNA, 25 bp, Mus musculus
tagtctgctgaatcataccaagtgt

SEQ ID NO: 752628 - DNA, 25 bp, Mus musculus
tagtctgctgcaaatgtctcttctc

SEQ ID NO: 752629 - DNA, 25 bp, Mus musculus
tagtctgctgcatatgtctcttctc

SEQ ID NO: 752630 - DNA, 25 bp, Mus musculus
tagtctgctgctaggaaagttgagc

SEQ ID NO: 752631 - DNA, 25 bp, Mus musculus
tagtctgctgcttggaaagttgagc

SEQ ID NO: 752632 - DNA, 25 bp, Mus musculus
tagtctgctggcctcaagcacttac

SEQ ID NO: 752633 - DNA, 25 bp, Mus musculus
tagtctgctggcgtcaagcacttac

SEQ ID NO: 752634 - DNA, 25 bp, Mus musculus
tagtctgggactagcaagtccacca

SEQ ID NO: 752635 - DNA, 25 bp, Mus musculus
tagtctgggacttgcaagtccacca

SEQ ID NO: 752636 - DNA, 25 bp, Mus musculus
tagtctgggtcgctgtcattcgcta

SEQ ID NO: 752637 - DNA, 25 bp, Mus musculus
tagtctgggtcggtgtcattcgcta

SEQ ID NO: 752638 - DNA, 25 bp, Mus musculus
tagtctgggtgaatcgctgcccacc

SEQ ID NO: 752639 - DNA, 25 bp, Mus musculus
tagtctgggtgattcgctgcccacc

SEQ ID NO: 752640 - DNA, 25 bp, Mus musculus
tagtctggtgatcgtgaacttcttc

SEQ ID NO: 752641 - DNA, 25 bp, Mus musculus
tagtctggtgatggtgaacttcttc

SEQ ID NO: 752642 - DNA, 25 bp, Mus musculus
tagtctgtaatcagtggccacctct

SEQ ID NO: 752643 - DNA, 25 bp, Mus musculus
tagtctgtaatctgtggccacctct

SEQ ID NO: 752644 - DNA, 25 bp, Mus musculus
tagtctgtccgcaggtctgagggct

SEQ ID NO: 752645 - DNA, 25 bp, Mus musculus
tagtctgtccgctggtctgagggct

SEQ ID NO: 752646 - DNA, 25 bp, Mus musculus
tagtctgttaagcaaagtctcacag

SEQ ID NO: 752647 - DNA, 25 bp, Mus musculus
tagtctgttaaggaaagtctcacag

SEQ ID NO: 752648 - DNA, 25 bp, Mus musculus
tagtctgttgagatatgttctggcc

SEQ ID NO: 752649 - DNA, 25 bp, Mus musculus
tagtctgttgagttatgttctggcc

SEQ ID NO: 752650 - DNA, 25 bp, Mus musculus
tagtcttgctggctcagcaagcccg

SEQ ID NO: 752651 - DNA, 25 bp, Mus musculus
tagtcttgctgggtcagcaagcccg

SEQ ID NO: 752652 - DNA, 25 bp, Mus musculus
tagtcttggtgtcgacatggatgat

SEQ ID NO: 752653 - DNA, 25 bp, Mus musculus
tagtcttggtgtggacatggatgat

SEQ ID NO: 752654 - DNA, 25 bp, Mus musculus
tagtcttgtgccctcatacgtagct

SEQ ID NO: 752655 - DNA, 25 bp, Mus musculus
tagtcttgtgccgtcatacgtagct

SEQ ID NO: 752656 - DNA, 25 bp, Mus musculus
tagtcttgttttctcaggttccttc

SEQ ID NO: 752657 - DNA, 25 bp, Mus musculus
tagtcttgttttgtcaggttccttc

SEQ ID NO: 752658 - DNA, 25 bp, Mus musculus
tagtctttccccagctgctcgatag

SEQ ID NO: 752659 - DNA, 25 bp, Mus musculus
tagtctttcccctgctgctcgatag

SEQ ID NO: 752660 - DNA, 25 bp, Mus musculus
tagtctttgaagatgaaatctctgc

SEQ ID NO: 752661 - DNA, 25 bp, Mus musculus
tagtctttgaagttgaaatctctgc

SEQ ID NO: 752662 - DNA, 25 bp, Mus musculus
tagtctttgactacgagggcagcgg

SEQ ID NO: 752663 - DNA, 25 bp, Mus musculus
tagtctttgacttcgagggcagcgg

SEQ ID NO: 752664 - DNA, 25 bp, Mus musculus
tagtctttgcccattatctgcctgg

SEQ ID NO: 752665 - DNA, 25 bp, Mus musculus
tagtctttgccctttatctgcctgg

SEQ ID NO: 752666 - DNA, 25 bp, Mus musculus
tagtctttgctcacagcattggtgc

SEQ ID NO: 752667 - DNA, 25 bp, Mus musculus
tagtctttgctctcagcattggtgc

SEQ ID NO: 752668 - DNA, 25 bp, Mus musculus
tagtgaaaagccagacctgcgtgca

SEQ ID NO: 752669 - DNA, 25 bp, Mus musculus
tagtgaaaagcctgacctgcgtgca

SEQ ID NO: 752670 - DNA, 25 bp, Mus musculus
tagtgaaactagctcagagaatgag

SEQ ID NO: 752671 - DNA, 25 bp, Mus musculus
tagtgaaactaggtcagagaatgag

SEQ ID NO: 752672 - DNA, 25 bp, Mus musculus
tagtgaaagaagaatcgaaaggctg

SEQ ID NO: 752673 - DNA, 25 bp, Mus musculus
tagtgaaagaagtatcgaaaggctg

SEQ ID NO: 752674 - DNA, 25 bp, Mus musculus
tagtgaaagtgaaacagatccttgg

SEQ ID NO: 752675 - DNA, 25 bp, Mus musculus
tagtgaaagtgatacagatccttgg

SEQ ID NO: 752676 - DNA, 25 bp, Mus musculus
tagtgaaatccactgtaatcccagc

SEQ ID NO: 752677 - DNA, 25 bp, Mus musculus
tagtgaaatccagtgtaatcccagc

SEQ ID NO: 752678 - DNA, 25 bp, Mus musculus
tagtgaacagggagtgcaagtcgtc

SEQ ID NO: 752679 - DNA, 25 bp, Mus musculus
tagtgaacagggtgtgcaagtcgtc

SEQ ID NO: 752680 - DNA, 25 bp, Mus musculus
tagtgaacaggtacctgggccccaa

SEQ ID NO: 752681 - DNA, 25 bp, Mus musculus
tagtgaacaggttcctgggccccaa

SEQ ID NO: 752682 - DNA, 25 bp, Mus musculus
tagtgaacgctcatcaagctcacaa

SEQ ID NO: 752683 - DNA, 25 bp, Mus musculus
tagtgaacgctcttcaagctcacaa

SEQ ID NO: 752684 - DNA, 25 bp, Mus musculus
tagtgaacgggcagatccattcagt

SEQ ID NO: 752685 - DNA, 25 bp, Mus musculus
tagtgaacgggctgatccattcagt

SEQ ID NO: 752686 - DNA, 25 bp, Mus musculus
tagtgaagccagagtgtctgccgaa

SEQ ID NO: 752687 - DNA, 25 bp, Mus musculus
tagtgaagccagtgtgtctgccgaa

SEQ ID NO: 752688 - DNA, 25 bp, Mus musculus
tagtgaagctaacaaactactggga

SEQ ID NO: 752689 - DNA, 25 bp, Mus musculus
tagtgaagctaagaaactactggga

SEQ ID NO: 752690 - DNA, 25 bp, Mus musculus
tagtgaagcttaccgctgtacagtt

SEQ ID NO: 752691 - DNA, 25 bp, Mus musculus
tagtgaagcttagcgctgtacagtt

SEQ ID NO: 752692 - DNA, 25 bp, Mus musculus
tagtgaagggctctccatcgatggc

SEQ ID NO: 752693 - DNA, 25 bp, Mus musculus
tagtgaagggctgtccatcgatggc

SEQ ID NO: 752694 - DNA, 25 bp, Mus musculus
tagtgaagtcagacacctgagtgcc

SEQ ID NO: 752695 - DNA, 25 bp, Mus musculus
tagtgaagtcagtcacctgagtgcc

SEQ ID NO: 752696 - DNA, 25 bp, Mus musculus
tagtgaatacatatgtgccaagtgg

SEQ ID NO: 752697 - DNA, 25 bp, Mus musculus
tagtgaatacatttgtgccaagtgg

SEQ ID NO: 752698 - DNA, 25 bp, Mus musculus
tagtgaattccaaaacgagtttagt

SEQ ID NO: 752699 - DNA, 25 bp, Mus musculus
tagtgaattccataacgagtttagt

SEQ ID NO: 752700 - DNA, 25 bp, Mus musculus
tagtgacaatataatttctggaggc

SEQ ID NO: 752701 - DNA, 25 bp, Mus musculus
tagtgacaatattatttctggaggc

SEQ ID NO: 752702 - DNA, 25 bp, Mus musculus
tagtgacaatgccagagcagatgca

SEQ ID NO: 752703 - DNA, 25 bp, Mus musculus
tagtgacaatgcgagagcagatgca

SEQ ID NO: 752704 - DNA, 25 bp, Mus musculus
tagtgacagcgaagacagagtcggt

SEQ ID NO: 752705 - DNA, 25 bp, Mus musculus
tagtgacagcgatgacagagtcggt

SEQ ID NO: 752706 - DNA, 25 bp, Mus musculus
tagtgacaggttagtttggagacaa

SEQ ID NO: 752707 - DNA, 25 bp, Mus musculus
tagtgacaggtttgtttggagacaa

SEQ ID NO: 752708 - DNA, 25 bp, Mus musculus
tagtgaccaggtaatattgcaggca

SEQ ID NO: 752709 - DNA, 25 bp, Mus musculus
tagtgaccaggttatattgcaggca

SEQ ID NO: 752710 - DNA, 25 bp, Mus musculus
tagtgaccgtttcagagactccagg

SEQ ID NO: 752711 - DNA, 25 bp, Mus musculus
tagtgaccgtttgagagactccagg

SEQ ID NO: 752712 - DNA, 25 bp, Mus musculus
tagtgacgctgtcggtgctggacga

SEQ ID NO: 752713 - DNA, 25 bp, Mus musculus
tagtgacgctgtgggtgctggacga

SEQ ID NO: 752714 - DNA, 25 bp, Mus musculus
tagtgacggataagaaataatgctc

SEQ ID NO: 752715 - DNA, 25 bp, Mus musculus
tagtgacggatatgaaataatgctc

SEQ ID NO: 752716 - DNA, 25 bp, Mus musculus
tagtgacgtgtgagaccaacaccgg

SEQ ID NO: 752717 - DNA, 25 bp, Mus musculus
tagtgacgtgtgtgaccaacaccgg

SEQ ID NO: 752718 - DNA, 25 bp, Mus musculus
tagtgactacaaccccaattgccgc

SEQ ID NO: 752719 - DNA, 25 bp, Mus musculus
tagtgactacaagcccaattgccgc

SEQ ID NO: 752720 - DNA, 25 bp, Mus musculus
tagtgactaccaaaagatcaccgca

SEQ ID NO: 752721 - DNA, 25 bp, Mus musculus
tagtgactaccataagatcaccgca

SEQ ID NO: 752722 - DNA, 25 bp, Mus musculus
tagtgactccacaaggtgcgctcag

SEQ ID NO: 752723 - DNA, 25 bp, Mus musculus
tagtgactccactaggtgcgctcag

SEQ ID NO: 752724 - DNA, 25 bp, Mus musculus
tagtgactgtgcaatcgagaaggcc

SEQ ID NO: 752725 - DNA, 25 bp, Mus musculus
tagtgactgtgctatcgagaaggcc

SEQ ID NO: 752726 - DNA, 25 bp, Mus musculus
tagtgacttacaagacgaagacaac

SEQ ID NO: 752727 - DNA, 25 bp, Mus musculus
tagtgacttacatgacgaagacaac

SEQ ID NO: 752728 - DNA, 25 bp, Mus musculus
tagtgacttctgatctaagaacctc

SEQ ID NO: 752729 - DNA, 25 bp, Mus musculus
tagtgacttctgttctaagaacctc

SEQ ID NO: 752730 - DNA, 25 bp, Mus musculus
tagtgagagaccacttacaggaccg

SEQ ID NO: 752731 - DNA, 25 bp, Mus musculus
tagtgagagacctcttacaggaccg

SEQ ID NO: 752732 - DNA, 25 bp, Mus musculus
tagtgagagattaacaagggaaagg

SEQ ID NO: 752733 - DNA, 25 bp, Mus musculus
tagtgagagatttacaagggaaagg

SEQ ID NO: 752734 - DNA, 25 bp, Mus musculus
tagtgagagtgtcgttgaactgccc

SEQ ID NO: 752735 - DNA, 25 bp, Mus musculus
tagtgagagtgtggttgaactgccc

SEQ ID NO: 752736 - DNA, 25 bp, Mus musculus
tagtgagcagtcaactcagccttcc

SEQ ID NO: 752737 - DNA, 25 bp, Mus musculus
tagtgagcagtctactcagccttcc

SEQ ID NO: 752738 - DNA, 25 bp, Mus musculus
tagtgagccactattcttgtgcaaa

SEQ ID NO: 752739 - DNA, 25 bp, Mus musculus
tagtgagccacttttcttgtgcaaa

SEQ ID NO: 752740 - DNA, 25 bp, Mus musculus
tagtgagcccacagataagcatgac

SEQ ID NO: 752741 - DNA, 25 bp, Mus musculus
tagtgagcccactgataagcatgac

SEQ ID NO: 752742 - DNA, 25 bp, Mus musculus
tagtgagcccgaataattaggcttg

SEQ ID NO: 752743 - DNA, 25 bp, Mus musculus
tagtgagcccgattaattaggcttg

SEQ ID NO: 752744 - DNA, 25 bp, Mus musculus
tagtgagctcgtaggtacctgtagg

SEQ ID NO: 752745 - DNA, 25 bp, Mus musculus
tagtgagctcgttggtacctgtagg

SEQ ID NO: 752746 - DNA, 25 bp, Mus musculus
tagtgaggaggacgcaaagtttcca

SEQ ID NO: 752747 - DNA, 25 bp, Mus musculus
tagtgaggaggaggcaaagtttcca

SEQ ID NO: 752748 - DNA, 25 bp, Mus musculus
tagtgagtatggactacacacagtc

SEQ ID NO: 752749 - DNA, 25 bp, Mus musculus
tagtgagtatggtctacacacagtc

SEQ ID NO: 752750 - DNA, 25 bp, Mus musculus
tagtgagtgccccagaccgcagcag

SEQ ID NO: 752751 - DNA, 25 bp, Mus musculus
tagtgagtgcccgagaccgcagcag

SEQ ID NO: 752752 - DNA, 25 bp, Mus musculus
tagtgagtgcttctccaagccccac

SEQ ID NO: 752753 - DNA, 25 bp, Mus musculus
tagtgagtgcttgtccaagccccac

SEQ ID NO: 752754 - DNA, 25 bp, Mus musculus
tagtgagtgggcagattgtaccacc

SEQ ID NO: 752755 - DNA, 25 bp, Mus musculus
tagtgagtgggctgattgtaccacc

SEQ ID NO: 752756 - DNA, 25 bp, Mus musculus
tagtgataatagacggaattgcttt

SEQ ID NO: 752757 - DNA, 25 bp, Mus musculus
tagtgataatagtcggaattgcttt

SEQ ID NO: 752758 - DNA, 25 bp, Mus musculus
tagtgataccgcagtgaaaccaaag

SEQ ID NO: 752759 - DNA, 25 bp, Mus musculus
tagtgataccgctgtgaaaccaaag

SEQ ID NO: 752760 - DNA, 25 bp, Mus musculus
tagtgatcaaagatgttggaatgac

SEQ ID NO: 752761 - DNA, 25 bp, Mus musculus
tagtgatcaaagttgttggaatgac

SEQ ID NO: 752762 - DNA, 25 bp, Mus musculus
tagtgatcgctcaagagaagtaact

SEQ ID NO: 752763 - DNA, 25 bp, Mus musculus
tagtgatcgctctagagaagtaact

SEQ ID NO: 752764 - DNA, 25 bp, Mus musculus
tagtgatcggcaactttggcctcag

SEQ ID NO: 752765 - DNA, 25 bp, Mus musculus
tagtgatcggcatctttggcctcag

SEQ ID NO: 752766 - DNA, 25 bp, Mus musculus
tagtgatctactacctagctttcag

SEQ ID NO: 752767 - DNA, 25 bp, Mus musculus
tagtgatctacttcctagctttcag

SEQ ID NO: 752768 - DNA, 25 bp, Mus musculus
tagtgatgatgacctagcagatctg

SEQ ID NO: 752769 - DNA, 25 bp, Mus musculus
tagtgatgatgagctagcagatctg

SEQ ID NO: 752770 - DNA, 25 bp, Mus musculus
tagtgatgcaccagttgaacaagaa

SEQ ID NO: 752771 - DNA, 25 bp, Mus musculus
tagtgatgcacctgttgaacaagaa

SEQ ID NO: 752772 - DNA, 25 bp, Mus musculus
tagtgatgcccaccttgcgacaggc

SEQ ID NO: 752773 - DNA, 25 bp, Mus musculus
tagtgatgcccagcttgcgacaggc

SEQ ID NO: 752774 - DNA, 25 bp, Mus musculus
tagtgatggcctctcatatgcaaga

SEQ ID NO: 752775 - DNA, 25 bp, Mus musculus
tagtgatggcctgtcatatgcaaga

SEQ ID NO: 752776 - DNA, 25 bp, Mus musculus
tagtgatggctcaaaataactgaag

SEQ ID NO: 752777 - DNA, 25 bp, Mus musculus
tagtgatggctctaaataactgaag

SEQ ID NO: 752778 - DNA, 25 bp, Mus musculus
tagtgatgttggagattatgaaggc

SEQ ID NO: 752779 - DNA, 25 bp, Mus musculus
tagtgatgttggtgattatgaaggc

SEQ ID NO: 752780 - DNA, 25 bp, Mus musculus
tagtgattcaagatcatccacagaa

SEQ ID NO: 752781 - DNA, 25 bp, Mus musculus
tagtgattcaagttcatccacagaa

SEQ ID NO: 752782 - DNA, 25 bp, Mus musculus
tagtgattcctaaagttccctcagc

SEQ ID NO: 752783 - DNA, 25 bp, Mus musculus
tagtgattcctatagttccctcagc

SEQ ID NO: 752784 - DNA, 25 bp, Mus musculus
tagtgattccttaagcagcaagtgg

SEQ ID NO: 752785 - DNA, 25 bp, Mus musculus
tagtgattcctttagcagcaagtgg

SEQ ID NO: 752786 - DNA, 25 bp, Mus musculus
tagtgattgacccagcgaagaggat

SEQ ID NO: 752787 - DNA, 25 bp, Mus musculus
tagtgattgaccgagcgaagaggat

SEQ ID NO: 752788 - DNA, 25 bp, Mus musculus
tagtgattggagcaaaccccgtgtc

SEQ ID NO: 752789 - DNA, 25 bp, Mus musculus
tagtgattggaggaaaccccgtgtc

SEQ ID NO: 752790 - DNA, 25 bp, Mus musculus
tagtgattgtaactaagtatcgctg

SEQ ID NO: 752791 - DNA, 25 bp, Mus musculus
tagtgattgtaagtaagtatcgctg

SEQ ID NO: 752792 - DNA, 25 bp, Mus musculus
tagtgcaaaggaagactttgggcac

SEQ ID NO: 752793 - DNA, 25 bp, Mus musculus
tagtgcaaaggatgactttgggcac

SEQ ID NO: 752794 - DNA, 25 bp, Mus musculus
tagtgcaacggactctgatggcagc

SEQ ID NO: 752795 - DNA, 25 bp, Mus musculus
tagtgcaacggagtctgatggcagc

SEQ ID NO: 752796 - DNA, 25 bp, Mus musculus
tagtgcaccgagacctgaagatcca

SEQ ID NO: 752797 - DNA, 25 bp, Mus musculus
tagtgcaccgagtcctgaagatcca

SEQ ID NO: 752798 - DNA, 25 bp, Mus musculus
tagtgcacgatcctctacagcgcca

SEQ ID NO: 752799 - DNA, 25 bp, Mus musculus
tagtgcacgatcgtctacagcgcca

SEQ ID NO: 752800 - DNA, 25 bp, Mus musculus
tagtgcagaacccttaggaacaacc

SEQ ID NO: 752801 - DNA, 25 bp, Mus musculus
tagtgcagaaccgttaggaacaacc

SEQ ID NO: 752802 - DNA, 25 bp, Mus musculus
tagtgcagcatcattgaccagtgaa

SEQ ID NO: 752803 - DNA, 25 bp, Mus musculus
tagtgcagcatctttgaccagtgaa

SEQ ID NO: 752804 - DNA, 25 bp, Mus musculus
tagtgcaggttcatagaaacatggt

SEQ ID NO: 752805 - DNA, 25 bp, Mus musculus
tagtgcaggttcttagaaacatggt

SEQ ID NO: 752806 - DNA, 25 bp, Mus musculus
tagtgcagttccagagtcgaaacgg

SEQ ID NO: 752807 - DNA, 25 bp, Mus musculus
tagtgcagttcctgagtcgaaacgg

SEQ ID NO: 752808 - DNA, 25 bp, Mus musculus
tagtgcatatggctggactagagct

SEQ ID NO: 752809 - DNA, 25 bp, Mus musculus
tagtgcatatgggtggactagagct

SEQ ID NO: 752810 - DNA, 25 bp, Mus musculus
tagtgcatgcttagtgccgggtacc

SEQ ID NO: 752811 - DNA, 25 bp, Mus musculus
tagtgcatgctttgtgccgggtacc

SEQ ID NO: 752812 - DNA, 25 bp, Mus musculus
tagtgccaaataaggccctggaaca

SEQ ID NO: 752813 - DNA, 25 bp, Mus musculus
tagtgccaaatatggccctggaaca

SEQ ID NO: 752814 - DNA, 25 bp, Mus musculus
tagtgccaaattagcctcctgtttc

SEQ ID NO: 752815 - DNA, 25 bp, Mus musculus
tagtgccaaatttgcctcctgtttc

SEQ ID NO: 752816 - DNA, 25 bp, Mus musculus
tagtgccacaagcagagagtctcta

SEQ ID NO: 752817 - DNA, 25 bp, Mus musculus
tagtgccacaaggagagagtctcta

SEQ ID NO: 752818 - DNA, 25 bp, Mus musculus
tagtgccacttgagacctcgtagag

SEQ ID NO: 752819 - DNA, 25 bp, Mus musculus
tagtgccacttgtgacctcgtagag

SEQ ID NO: 752820 - DNA, 25 bp, Mus musculus
tagtgccagtttatgctccagcgaa

SEQ ID NO: 752821 - DNA, 25 bp, Mus musculus
tagtgccagtttttgctccagcgaa

SEQ ID NO: 752822 - DNA, 25 bp, Mus musculus
tagtgccattcgcagcgacgcactg

SEQ ID NO: 752823 - DNA, 25 bp, Mus musculus
tagtgccattcggagcgacgcactg

SEQ ID NO: 752824 - DNA, 25 bp, Mus musculus
tagtgcccacttcagagagagaaaa

SEQ ID NO: 752825 - DNA, 25 bp, Mus musculus
tagtgcccacttgagagagagaaaa

SEQ ID NO: 752826 - DNA, 25 bp, Mus musculus
tagtgccccgatcagcgatacagag

SEQ ID NO: 752827 - DNA, 25 bp, Mus musculus
tagtgccccgatgagcgatacagag

SEQ ID NO: 752828 - DNA, 25 bp, Mus musculus
tagtgccctgccatatctctacgaa

SEQ ID NO: 752829 - DNA, 25 bp, Mus musculus
tagtgccctgccttatctctacgaa

SEQ ID NO: 752830 - DNA, 25 bp, Mus musculus
tagtgccctgttaggtcgagatccg

SEQ ID NO: 752831 - DNA, 25 bp, Mus musculus
tagtgccctgtttggtcgagatccg

SEQ ID NO: 752832 - DNA, 25 bp, Mus musculus
tagtgcctatgtagtcccgaccatc

SEQ ID NO: 752833 - DNA, 25 bp, Mus musculus
tagtgcctatgttgtcccgaccatc

SEQ ID NO: 752834 - DNA, 25 bp, Mus musculus
tagtgcctccaccactgaaagacaa

SEQ ID NO: 752835 - DNA, 25 bp, Mus musculus
tagtgcctccacgactgaaagacaa

SEQ ID NO: 752836 - DNA, 25 bp, Mus musculus
tagtgcctggctacatttgcctgtg

SEQ ID NO: 752837 - DNA, 25 bp, Mus musculus
tagtgcctggcttcatttgcctgtg

SEQ ID NO: 752838 - DNA, 25 bp, Mus musculus
tagtgcctggtgaacatgtcctgcc

SEQ ID NO: 752839 - DNA, 25 bp, Mus musculus
tagtgcctggtgtacatgtcctgcc

SEQ ID NO: 752840 - DNA, 25 bp, Mus musculus
tagtgcctgtcacccctggtagaga

SEQ ID NO: 752841 - DNA, 25 bp, Mus musculus
tagtgcctgtcagccctggtagaga

SEQ ID NO: 752842 - DNA, 25 bp, Mus musculus
tagtgcgagacaaggcggtagaatc

SEQ ID NO: 752843 - DNA, 25 bp, Mus musculus
tagtgcgagacatggcggtagaatc

SEQ ID NO: 752844 - DNA, 25 bp, Mus musculus
tagtgcgggcttcctatctggagat

SEQ ID NO: 752845 - DNA, 25 bp, Mus musculus
tagtgcgggcttgctatctggagat

SEQ ID NO: 752846 - DNA, 25 bp, Mus musculus
tagtgcgtataaattaaatacctgc

SEQ ID NO: 752847 - DNA, 25 bp, Mus musculus
tagtgcgtataatttaaatacctgc

SEQ ID NO: 752848 - DNA, 25 bp, Mus musculus
tagtgctacccactcaaggctgcag

SEQ ID NO: 752849 - DNA, 25 bp, Mus musculus
tagtgctacccagtcaaggctgcag

SEQ ID NO: 752850 - DNA, 25 bp, Mus musculus
tagtgctaggaacatggcgcacccg

SEQ ID NO: 752851 - DNA, 25 bp, Mus musculus
tagtgctaggaagatggcgcacccg

SEQ ID NO: 752852 - DNA, 25 bp, Mus musculus
tagtgctcgcccaggctatcctgcg

SEQ ID NO: 752853 - DNA, 25 bp, Mus musculus
tagtgctcgccctggctatcctgcg

SEQ ID NO: 752854 - DNA, 25 bp, Mus musculus
tagtgctctgctcagaactcttggg

SEQ ID NO: 752855 - DNA, 25 bp, Mus musculus
tagtgctctgctgagaactcttggg

SEQ ID NO: 752856 - DNA, 25 bp, Mus musculus
tagtgctgaagacaccagccctgcc

SEQ ID NO: 752857 - DNA, 25 bp, Mus musculus
tagtgctgaagagaccagccctgcc

SEQ ID NO: 752858 - DNA, 25 bp, Mus musculus
tagtgctgatgaaccaatgacaaca

SEQ ID NO: 752859 - DNA, 25 bp, Mus musculus
tagtgctgatgatccaatgacaaca

SEQ ID NO: 752860 - DNA, 25 bp, Mus musculus
tagtgctgctccaaactccctgtgt

SEQ ID NO: 752861 - DNA, 25 bp, Mus musculus
tagtgctgctcctaactccctgtgt

SEQ ID NO: 752862 - DNA, 25 bp, Mus musculus
tagtgctggcctctactacacaggg

SEQ ID NO: 752863 - DNA, 25 bp, Mus musculus
tagtgctggcctgtactacacaggg

SEQ ID NO: 752864 - DNA, 25 bp, Mus musculus
tagtgctggctgaggcatcaggttt

SEQ ID NO: 752865 - DNA, 25 bp, Mus musculus
tagtgctggctgtggcatcaggttt

SEQ ID NO: 752866 - DNA, 25 bp, Mus musculus
tagtgctgtcccaagcaccgtggct

SEQ ID NO: 752867 - DNA, 25 bp, Mus musculus
tagtgctgtcccacttgctaggaga

SEQ ID NO: 752868 - DNA, 25 bp, Mus musculus
tagtgctgtccctagcaccgtggct

SEQ ID NO: 752869 - DNA, 25 bp, Mus musculus
tagtgctgtccctcttgctaggaga

SEQ ID NO: 752870 - DNA, 25 bp, Mus musculus
tagtgcttagtaacagaaatagtcc

SEQ ID NO: 752871 - DNA, 25 bp, Mus musculus
tagtgcttagtatcagaaatagtcc

SEQ ID NO: 752872 - DNA, 25 bp, Mus musculus
tagtgcttcgccaatgcgcctggcc

SEQ ID NO: 752873 - DNA, 25 bp, Mus musculus
tagtgcttcgcctatgcgcctggcc

SEQ ID NO: 752874 - DNA, 25 bp, Mus musculus
tagtgcttgcttcagacagcttgga

SEQ ID NO: 752875 - DNA, 25 bp, Mus musculus
tagtgcttgcttgagacagcttgga

SEQ ID NO: 752876 - DNA, 25 bp, Mus musculus
tagtgcttttgtcccacctcgtagg

SEQ ID NO: 752877 - DNA, 25 bp, Mus musculus
tagtgcttttgtgccacctcgtagg

SEQ ID NO: 752878 - DNA, 25 bp, Mus musculus
tagtggaacaagaacgtttgaagtc

SEQ ID NO: 752879 - DNA, 25 bp, Mus musculus
tagtggaacaagtacgtttgaagtc

SEQ ID NO: 752880 - DNA, 25 bp, Mus musculus
tagtggaacattaacaagccggtgg

SEQ ID NO: 752881 - DNA, 25 bp, Mus musculus
tagtggaacatttacaagccggtgg

SEQ ID NO: 752882 - DNA, 25 bp, Mus musculus
tagtggacaccccattcaccaaggg

SEQ ID NO: 752883 - DNA, 25 bp, Mus musculus
tagtggacacccgattcaccaaggg

SEQ ID NO: 752884 - DNA, 25 bp, Mus musculus
tagtggacctataatcctagatgct

SEQ ID NO: 752885 - DNA, 25 bp, Mus musculus
tagtggacctattatcctagatgct

SEQ ID NO: 752886 - DNA, 25 bp, Mus musculus
tagtggagaacaagaccaggacaca

SEQ ID NO: 752887 - DNA, 25 bp, Mus musculus
tagtggagaacatgaccaggacaca

SEQ ID NO: 752888 - DNA, 25 bp, Mus musculus
tagtggagatacctggagcgttcca

SEQ ID NO: 752889 - DNA, 25 bp, Mus musculus
tagtggagatacgtggagcgttcca

SEQ ID NO: 752890 - DNA, 25 bp, Mus musculus
tagtggagatcccttctgtccgtgt

SEQ ID NO: 752891 - DNA, 25 bp, Mus musculus
tagtggagatccgttctgtccgtgt

SEQ ID NO: 752892 - DNA, 25 bp, Mus musculus
tagtggagctgcaacagaagaatgt

SEQ ID NO: 752893 - DNA, 25 bp, Mus musculus
tagtggagctgctacagaagaatgt

SEQ ID NO: 752894 - DNA, 25 bp, Mus musculus
tagtggagctggagcctcagtatcc

SEQ ID NO: 752895 - DNA, 25 bp, Mus musculus
tagtggagctggtgcctcagtatcc

SEQ ID NO: 752896 - DNA, 25 bp, Mus musculus
tagtggagttccaggacacgatttt

SEQ ID NO: 752897 - DNA, 25 bp, Mus musculus
tagtggagttcctggacacgatttt

SEQ ID NO: 752898 - DNA, 25 bp, Mus musculus
tagtggatacagcaaagaaactctg

SEQ ID NO: 752899 - DNA, 25 bp, Mus musculus
tagtggatacaggaaagaaactctg

SEQ ID NO: 752900 - DNA, 25 bp, Mus musculus
tagtggatgagacagctcccgacaa

SEQ ID NO: 752901 - DNA, 25 bp, Mus musculus
tagtggatgagagagctcccgacaa

SEQ ID NO: 752902 - DNA, 25 bp, Mus musculus
tagtggattgctacgtgtcgcggcc

SEQ ID NO: 752903 - DNA, 25 bp, Mus musculus
tagtggattgcttcgtgtcgcggcc

SEQ ID NO: 752904 - DNA, 25 bp, Mus musculus
tagtggcactccactcacatggtgt

SEQ ID NO: 752905 - DNA, 25 bp, Mus musculus
tagtggcactcctctcacatggtgt

SEQ ID NO: 752906 - DNA, 25 bp, Mus musculus
tagtggcagaagcaaagcaaacttg

SEQ ID NO: 752907 - DNA, 25 bp, Mus musculus
tagtggcagaaggaaagcaaacttg

SEQ ID NO: 752908 - DNA, 25 bp, Mus musculus
tagtggcagccgatttgaaactggg

SEQ ID NO: 752909 - DNA, 25 bp, Mus musculus
tagtggcagccgttttgaaactggg

SEQ ID NO: 752910 - DNA, 25 bp, Mus musculus
tagtggcagctaagaccctacagga

SEQ ID NO: 752911 - DNA, 25 bp, Mus musculus
tagtggcagctatgaccctacagga

SEQ ID NO: 752912 - DNA, 25 bp, Mus musculus
tagtggcagctgaagtttagagaaa

SEQ ID NO: 752913 - DNA, 25 bp, Mus musculus
tagtggcagctgtagtttagagaaa

SEQ ID NO: 752914 - DNA, 25 bp, Mus musculus
tagtggcagttaccaaggcatccgg

SEQ ID NO: 752915 - DNA, 25 bp, Mus musculus
tagtggcagttagcaaggcatccgg

SEQ ID NO: 752916 - DNA, 25 bp, Mus musculus
tagtggcccaagaaaatgggcccat

SEQ ID NO: 752917 - DNA, 25 bp, Mus musculus
tagtggcccaagtaaatgggcccat

SEQ ID NO: 752918 - DNA, 25 bp, Mus musculus
tagtggcccattccagtgtattccg

SEQ ID NO: 752919 - DNA, 25 bp, Mus musculus
tagtggcccattgcagtgtattccg

SEQ ID NO: 752920 - DNA, 25 bp, Mus musculus
tagtggcccgggatctgagtttcag

SEQ ID NO: 752921 - DNA, 25 bp, Mus musculus
tagtggcccgggttctgagtttcag

SEQ ID NO: 752922 - DNA, 25 bp, Mus musculus
tagtggccctctacttggccagttg

SEQ ID NO: 752923 - DNA, 25 bp, Mus musculus
tagtggccctcttcttggccagttg

SEQ ID NO: 752924 - DNA, 25 bp, Mus musculus
tagtggcccttcagtaggagtaatg

SEQ ID NO: 752925 - DNA, 25 bp, Mus musculus
tagtggcccttctgtaggagtaatg

SEQ ID NO: 752926 - DNA, 25 bp, Mus musculus
tagtggcctgtgacgtctgcttgtg

SEQ ID NO: 752927 - DNA, 25 bp, Mus musculus
tagtggcctgtgtcgtctgcttgtg

SEQ ID NO: 752928 - DNA, 25 bp, Mus musculus
tagtggccttacctaagctctcagc

SEQ ID NO: 752929 - DNA, 25 bp, Mus musculus
tagtggccttacgtaagctctcagc

SEQ ID NO: 752930 - DNA, 25 bp, Mus musculus
tagtggccttcactccggtcacaga

SEQ ID NO: 752931 - DNA, 25 bp, Mus musculus
tagtggccttcagtccggtcacaga

SEQ ID NO: 752932 - DNA, 25 bp, Mus musculus
tagtggcttataatgaaaggctttc

SEQ ID NO: 752933 - DNA, 25 bp, Mus musculus
tagtggcttatattgaaaggctttc

SEQ ID NO: 752934 - DNA, 25 bp, Mus musculus
tagtggcttcgacgttctcagaccc

SEQ ID NO: 752935 - DNA, 25 bp, Mus musculus
tagtggcttcgaggttctcagaccc

SEQ ID NO: 752936 - DNA, 25 bp, Mus musculus
tagtgggaacagctggaatccttca

SEQ ID NO: 752937 - DNA, 25 bp, Mus musculus
tagtgggaacaggtggaatccttca

SEQ ID NO: 752938 - DNA, 25 bp, Mus musculus
tagtgggacacccatcaaaattgaa

SEQ ID NO: 752939 - DNA, 25 bp, Mus musculus
tagtgggacaccgatcaaaattgaa

SEQ ID NO: 752940 - DNA, 25 bp, Mus musculus
tagtgggacgacagtgacttccgtg

SEQ ID NO: 752941 - DNA, 25 bp, Mus musculus
tagtgggacgactgtgacttccgtg

SEQ ID NO: 752942 - DNA, 25 bp, Mus musculus
tagtgggacgccactcacacctgca

SEQ ID NO: 752943 - DNA, 25 bp, Mus musculus
tagtgggacgcctctcacacctgca

SEQ ID NO: 752944 - DNA, 25 bp, Mus musculus
tagtgggatctgcagctgcatcagt

SEQ ID NO: 752945 - DNA, 25 bp, Mus musculus
tagtgggatctggagctgcatcagt

SEQ ID NO: 752946 - DNA, 25 bp, Mus musculus
tagtgggccactacatcaagaagag

SEQ ID NO: 752947 - DNA, 25 bp, Mus musculus
tagtgggccacttcatcaagaagag

SEQ ID NO: 752948 - DNA, 25 bp, Mus musculus
tagtgggcgttcctctttgcgtctc

SEQ ID NO: 752949 - DNA, 25 bp, Mus musculus
tagtgggcgttcgtctttgcgtctc

SEQ ID NO: 752950 - DNA, 25 bp, Mus musculus
tagtgggctaataggcccattgatt

SEQ ID NO: 752951 - DNA, 25 bp, Mus musculus
tagtgggctaattggcccattgatt

SEQ ID NO: 752952 - DNA, 25 bp, Mus musculus
tagtgggctccaagccaagaaggga

SEQ ID NO: 752953 - DNA, 25 bp, Mus musculus
tagtgggctccaattcctgatttga

SEQ ID NO: 752954 - DNA, 25 bp, Mus musculus
tagtgggctccatgccaagaaggga

SEQ ID NO: 752955 - DNA, 25 bp, Mus musculus
tagtgggctccatttcctgatttga

SEQ ID NO: 752956 - DNA, 25 bp, Mus musculus
tagtgggcttcgctgccctgatgac

SEQ ID NO: 752957 - DNA, 25 bp, Mus musculus
tagtgggcttcggtgccctgatgac

SEQ ID NO: 752958 - DNA, 25 bp, Mus musculus
tagtggtacaccataagaagttgga

SEQ ID NO: 752959 - DNA, 25 bp, Mus musculus
tagtggtacaccttaagaagttgga

SEQ ID NO: 752960 - DNA, 25 bp, Mus musculus
tagtggtcaaagaggccagtggccc

SEQ ID NO: 752961 - DNA, 25 bp, Mus musculus
tagtggtcaaagtggccagtggccc

SEQ ID NO: 752962 - DNA, 25 bp, Mus musculus
tagtggtcacctccctggtagtgcg

SEQ ID NO: 752963 - DNA, 25 bp, Mus musculus
tagtggtcacctgcctggtagtgcg

SEQ ID NO: 752964 - DNA, 25 bp, Mus musculus
tagtggtcagcgagttggcaagccc

SEQ ID NO: 752965 - DNA, 25 bp, Mus musculus
tagtggtcagcgtgttggcaagccc

SEQ ID NO: 752966 - DNA, 25 bp, Mus musculus
tagtggtcggagacactttaaaagg

SEQ ID NO: 752967 - DNA, 25 bp, Mus musculus
tagtggtcggagtcactttaaaagg

SEQ ID NO: 752968 - DNA, 25 bp, Mus musculus
tagtggtcggtaaatctctgcagca

SEQ ID NO: 752969 - DNA, 25 bp, Mus musculus
tagtggtcggtatatctctgcagca

SEQ ID NO: 752970 - DNA, 25 bp, Mus musculus
tagtggtgattgacctgttcatggc

SEQ ID NO: 752971 - DNA, 25 bp, Mus musculus
tagtggtgattgtcctgttcatggc

SEQ ID NO: 752972 - DNA, 25 bp, Mus musculus
tagtggtgctcgaggggcataccaa

SEQ ID NO: 752973 - DNA, 25 bp, Mus musculus
tagtggtgctcgtggggcataccaa

SEQ ID NO: 752974 - DNA, 25 bp, Mus musculus
tagtggtgctttcattccggacacg

SEQ ID NO: 752975 - DNA, 25 bp, Mus musculus
tagtggtgctttgattccggacacg

SEQ ID NO: 752976 - DNA, 25 bp, Mus musculus
tagtggtggcaaccctgtctttctt

SEQ ID NO: 752977 - DNA, 25 bp, Mus musculus
tagtggtggcaagcctgtctttctt

SEQ ID NO: 752978 - DNA, 25 bp, Mus musculus
tagtggtggcagatacaagaggcct

SEQ ID NO: 752979 - DNA, 25 bp, Mus musculus
tagtggtggcagttacaagaggcct

SEQ ID NO: 752980 - DNA, 25 bp, Mus musculus
tagtggtggtgaatcattacctggc

SEQ ID NO: 752981 - DNA, 25 bp, Mus musculus
tagtggtggtgattcattacctggc

SEQ ID NO: 752982 - DNA, 25 bp, Mus musculus
tagtggttagaccatccaagatggc

SEQ ID NO: 752983 - DNA, 25 bp, Mus musculus
tagtggttagacgatccaagatggc

SEQ ID NO: 752984 - DNA, 25 bp, Mus musculus
tagtgtaactggcttcacagatggc

SEQ ID NO: 752985 - DNA, 25 bp, Mus musculus
tagtgtaactgggttcacagatggc

SEQ ID NO: 752986 - DNA, 25 bp, Mus musculus
tagtgtaatagcacacgctccaccc

SEQ ID NO: 752987 - DNA, 25 bp, Mus musculus
tagtgtaatagctcacgctccaccc

SEQ ID NO: 752988 - DNA, 25 bp, Mus musculus
tagtgtacgatgagcaaagagtcct

SEQ ID NO: 752989 - DNA, 25 bp, Mus musculus
tagtgtacgatgtgcaaagagtcct

SEQ ID NO: 752990 - DNA, 25 bp, Mus musculus
tagtgtacgtggaagagaaagccat

SEQ ID NO: 752991 - DNA, 25 bp, Mus musculus
tagtgtacgtggtagagaaagccat

SEQ ID NO: 752992 - DNA, 25 bp, Mus musculus
tagtgtactttcaaatagggcgggt

SEQ ID NO: 752993 - DNA, 25 bp, Mus musculus
tagtgtactttctaatagggcgggt

SEQ ID NO: 752994 - DNA, 25 bp, Mus musculus
tagtgtagctatcgccagcatccag

SEQ ID NO: 752995 - DNA, 25 bp, Mus musculus
tagtgtagctatggccagcatccag

SEQ ID NO: 752996 - DNA, 25 bp, Mus musculus
tagtgtatagcaaccttgaaggaca

SEQ ID NO: 752997 - DNA, 25 bp, Mus musculus
tagtgtatagcatccttgaaggaca

SEQ ID NO: 752998 - DNA, 25 bp, Mus musculus
tagtgtcaaacgagctgggtggcca

SEQ ID NO: 752999 - DNA, 25 bp, Mus musculus
tagtgtcaaacgtgctgggtggcca

SEQ ID NO: 753000 - DNA, 25 bp, Mus musculus
tagtgtcagaacatggcccaatagt

SEQ ID NO: 753001 - DNA, 25 bp, Mus musculus
tagtgtcagaacttggcccaatagt

SEQ ID NO: 753002 - DNA, 25 bp, Mus musculus
tagtgtcatggcaccctacttcctg

SEQ ID NO: 753003 - DNA, 25 bp, Mus musculus
tagtgtcatggctccctacttcctg

SEQ ID NO: 753004 - DNA, 25 bp, Mus musculus
tagtgtccactgcagtgatcctggt

SEQ ID NO: 753005 - DNA, 25 bp, Mus musculus
tagtgtccactggagtgatcctggt

SEQ ID NO: 753006 - DNA, 25 bp, Mus musculus
tagtgtccagagctaatagcatcgg

SEQ ID NO: 753007 - DNA, 25 bp, Mus musculus
tagtgtccagaggtaatagcatcgg

SEQ ID NO: 753008 - DNA, 25 bp, Mus musculus
tagtgtcccgggaagccagcgataa

SEQ ID NO: 753009 - DNA, 25 bp, Mus musculus
tagtgtcccgggtagccagcgataa

SEQ ID NO: 753010 - DNA, 25 bp, Mus musculus
tagtgtccggtaagcctgaaacttg

SEQ ID NO: 753011 - DNA, 25 bp, Mus musculus
tagtgtccggtatgcctgaaacttg

SEQ ID NO: 753012 - DNA, 25 bp, Mus musculus
tagtgtcctccacctacatgagcag

SEQ ID NO: 753013 - DNA, 25 bp, Mus musculus
tagtgtcctccagctacatgagcag

SEQ ID NO: 753014 - DNA, 25 bp, Mus musculus
tagtgtctcgctcccttgaactcgg

SEQ ID NO: 753015 - DNA, 25 bp, Mus musculus
tagtgtctcgctgccttgaactcgg

SEQ ID NO: 753016 - DNA, 25 bp, Mus musculus
tagtgtctggacagagtgtagtgat

SEQ ID NO: 753017 - DNA, 25 bp, Mus musculus
tagtgtctggactgagtgtagtgat

SEQ ID NO: 753018 - DNA, 25 bp, Mus musculus
tagtgtcttcttcagctgctcagtt

SEQ ID NO: 753019 - DNA, 25 bp, Mus musculus
tagtgtcttcttgagctgctcagtt

SEQ ID NO: 753020 - DNA, 25 bp, Mus musculus
tagtgtgaactaagacgaggagcct

SEQ ID NO: 753021 - DNA, 25 bp, Mus musculus
tagtgtgaactatgacgaggagcct

SEQ ID NO: 753022 - DNA, 25 bp, Mus musculus
tagtgtgagctaatcccatcgtgtg

SEQ ID NO: 753023 - DNA, 25 bp, Mus musculus
tagtgtgagctattcccatcgtgtg

SEQ ID NO: 753024 - DNA, 25 bp, Mus musculus
tagtgtgatcccaactgtcagtgcc

SEQ ID NO: 753025 - DNA, 25 bp, Mus musculus
tagtgtgatccctactgtcagtgcc

SEQ ID NO: 753026 - DNA, 25 bp, Mus musculus
tagtgtgatggcctactgcctgacg

SEQ ID NO: 753027 - DNA, 25 bp, Mus musculus
tagtgtgatggcgtactgcctgacg

SEQ ID NO: 753028 - DNA, 25 bp, Mus musculus
tagtgtgcaacgaacgcttctggga

SEQ ID NO: 753029 - DNA, 25 bp, Mus musculus
tagtgtgcaacgtacgcttctggga

SEQ ID NO: 753030 - DNA, 25 bp, Mus musculus
tagtgtgccaccactggagctcagt

SEQ ID NO: 753031 - DNA, 25 bp, Mus musculus
tagtgtgccacctctggagctcagt

SEQ ID NO: 753032 - DNA, 25 bp, Mus musculus
tagtgtgcgcctcgcgcttctgtcc

SEQ ID NO: 753033 - DNA, 25 bp, Mus musculus
tagtgtgcgcctggcgcttctgtcc

SEQ ID NO: 753034 - DNA, 25 bp, Mus musculus
tagtgtggcagtccataggcaccgt

SEQ ID NO: 753035 - DNA, 25 bp, Mus musculus
tagtgtggcagtgcataggcaccgt

SEQ ID NO: 753036 - DNA, 25 bp, Mus musculus
tagtgtgggctcatcttcaccacgg

SEQ ID NO: 753037 - DNA, 25 bp, Mus musculus
tagtgtgggctcttcttcaccacgg

SEQ ID NO: 753038 - DNA, 25 bp, Mus musculus
tagtgtgggttcattctcaggctgg

SEQ ID NO: 753039 - DNA, 25 bp, Mus musculus
tagtgtgggttctttctcaggctgg

SEQ ID NO: 753040 - DNA, 25 bp, Mus musculus
tagtgtggtctacgaattgtttctc

SEQ ID NO: 753041 - DNA, 25 bp, Mus musculus
tagtgtggtctaggaattgtttctc

SEQ ID NO: 753042 - DNA, 25 bp, Mus musculus
tagtgtggtttcacagcactcagcc

SEQ ID NO: 753043 - DNA, 25 bp, Mus musculus
tagtgtggtttctcagcactcagcc

SEQ ID NO: 753044 - DNA, 25 bp, Mus musculus
tagtgtgtactgcatccaatcccat

SEQ ID NO: 753045 - DNA, 25 bp, Mus musculus
tagtgtgtactggatccaatcccat

SEQ ID NO: 753046 - DNA, 25 bp, Mus musculus
tagtgtgtgaaaaaccatgttttgc

SEQ ID NO: 753047 - DNA, 25 bp, Mus musculus
tagtgtgtgaaataccatgttttgc

SEQ ID NO: 753048 - DNA, 25 bp, Mus musculus
tagtgtgtgccaagtgctctgacta

SEQ ID NO: 753049 - DNA, 25 bp, Mus musculus
tagtgtgtgccatgtgctctgacta

SEQ ID NO: 753050 - DNA, 25 bp, Mus musculus
tagtgtgttctcacttgccattgaa

SEQ ID NO: 753051 - DNA, 25 bp, Mus musculus
tagtgtgttctctcttgccattgaa

SEQ ID NO: 753052 - DNA, 25 bp, Mus musculus
tagtgttagaacatggagtcctttc

SEQ ID NO: 753053 - DNA, 25 bp, Mus musculus
tagtgttagaacttggagtcctttc

SEQ ID NO: 753054 - DNA, 25 bp, Mus musculus
tagtgttcagttcttgatgtgcccc

SEQ ID NO: 753055 - DNA, 25 bp, Mus musculus
tagtgttcagttgttgatgtgcccc

SEQ ID NO: 753056 - DNA, 25 bp, Mus musculus
tagtgttcccggctgcgatgagctc

SEQ ID NO: 753057 - DNA, 25 bp, Mus musculus
tagtgttcccgggtgcgatgagctc

SEQ ID NO: 753058 - DNA, 25 bp, Mus musculus
tagtgttctgcgaggcggtcgtggc

SEQ ID NO: 753059 - DNA, 25 bp, Mus musculus
tagtgttctgcgtggcggtcgtggc

SEQ ID NO: 753060 - DNA, 25 bp, Mus musculus
tagtgttgacaacggctattgtgga

SEQ ID NO: 753061 - DNA, 25 bp, Mus musculus
tagtgttgacaagggctattgtgga

SEQ ID NO: 753062 - DNA, 25 bp, Mus musculus
tagtgttgcacaaagaccccaatgt

SEQ ID NO: 753063 - DNA, 25 bp, Mus musculus
tagtgttgcacatagaccccaatgt

SEQ ID NO: 753064 - DNA, 25 bp, Mus musculus
tagtgttgctctacgtctccaccat

SEQ ID NO: 753065 - DNA, 25 bp, Mus musculus
tagtgttgctcttcgtctccaccat

SEQ ID NO: 753066 - DNA, 25 bp, Mus musculus
tagtgttggaagcattaaagatttt

SEQ ID NO: 753067 - DNA, 25 bp, Mus musculus
tagtgttggaaggattaaagatttt

SEQ ID NO: 753068 - DNA, 25 bp, Mus musculus
tagtgttgtaaaaagtgtgagtcca

SEQ ID NO: 753069 - DNA, 25 bp, Mus musculus
tagtgttgtaaatagtgtgagtcca

SEQ ID NO: 753070 - DNA, 25 bp, Mus musculus
tagtgtttgaaaagtgaggctacca

SEQ ID NO: 753071 - DNA, 25 bp, Mus musculus
tagtgtttgaaatgtgaggctacca

SEQ ID NO: 753072 - DNA, 25 bp, Mus musculus
tagtgtttgagcatatagaccagga

SEQ ID NO: 753073 - DNA, 25 bp, Mus musculus
tagtgtttgagcttatagaccagga

SEQ ID NO: 753074 - DNA, 25 bp, Mus musculus
tagtgttttcggcttgagctaccac

SEQ ID NO: 753075 - DNA, 25 bp, Mus musculus
tagtgttttcgggttgagctaccac

SEQ ID NO: 753076 - DNA, 25 bp, Mus musculus
tagttaactcacctaattggagagc

SEQ ID NO: 753077 - DNA, 25 bp, Mus musculus
tagttaactcacgtaattggagagc

SEQ ID NO: 753078 - DNA, 25 bp, Mus musculus
tagttaattctgaaccagccagtgc

SEQ ID NO: 753079 - DNA, 25 bp, Mus musculus
tagttaattctgtaccagccagtgc

SEQ ID NO: 753080 - DNA, 25 bp, Mus musculus
tagttacaaaccacacactacgtgt

SEQ ID NO: 753081 - DNA, 25 bp, Mus musculus
tagttacaaacctcacactacgtgt

SEQ ID NO: 753082 - DNA, 25 bp, Mus musculus
tagttacacgtactccactgctcca

SEQ ID NO: 753083 - DNA, 25 bp, Mus musculus
tagttacacgtagtccactgctcca

SEQ ID NO: 753084 - DNA, 25 bp, Mus musculus
tagttacagatgcaatccagctggg

SEQ ID NO: 753085 - DNA, 25 bp, Mus musculus
tagttacagatggaatccagctggg

SEQ ID NO: 753086 - DNA, 25 bp, Mus musculus
tagttacagccaccagactggaccc

SEQ ID NO: 753087 - DNA, 25 bp, Mus musculus
tagttacagccagcagactggaccc

SEQ ID NO: 753088 - DNA, 25 bp, Mus musculus
tagttacagctacggttagggccca

SEQ ID NO: 753089 - DNA, 25 bp, Mus musculus
tagttacagctagggttagggccca

SEQ ID NO: 753090 - DNA, 25 bp, Mus musculus
tagttacattacacatttagcaaga

SEQ ID NO: 753091 - DNA, 25 bp, Mus musculus
tagttacattactcatttagcaaga

SEQ ID NO: 753092 - DNA, 25 bp, Mus musculus
tagttaccacataaaccaggcgtgg

SEQ ID NO: 753093 - DNA, 25 bp, Mus musculus
tagttaccacattaaccaggcgtgg

SEQ ID NO: 753094 - DNA, 25 bp, Mus musculus
tagttaccagcacgtgtttccttgg

SEQ ID NO: 753095 - DNA, 25 bp, Mus musculus
tagttaccagcaggtgtttccttgg

SEQ ID NO: 753096 - DNA, 25 bp, Mus musculus
tagttaccagttctggagacaccac

SEQ ID NO: 753097 - DNA, 25 bp, Mus musculus
tagttaccagttgtggagacaccac

SEQ ID NO: 753098 - DNA, 25 bp, Mus musculus
tagttaccctcacagccttcagttt

SEQ ID NO: 753099 - DNA, 25 bp, Mus musculus
tagttaccctcagagccttcagttt

SEQ ID NO: 753100 - DNA, 25 bp, Mus musculus
tagttactgagcagatgtcctgcca

SEQ ID NO: 753101 - DNA, 25 bp, Mus musculus
tagttactgagctgatgtcctgcca

SEQ ID NO: 753102 - DNA, 25 bp, Mus musculus
tagttagccttgatgtagccccgag

SEQ ID NO: 753103 - DNA, 25 bp, Mus musculus
tagttagccttgttgtagccccgag

SEQ ID NO: 753104 - DNA, 25 bp, Mus musculus
tagttaggccacatgaagaatcgag

SEQ ID NO: 753105 - DNA, 25 bp, Mus musculus
tagttaggccacttgaagaatcgag

SEQ ID NO: 753106 - DNA, 25 bp, Mus musculus
tagttaggcctcagcagatgaccgt

SEQ ID NO: 753107 - DNA, 25 bp, Mus musculus
tagttaggcctctgcagatgaccgt

SEQ ID NO: 753108 - DNA, 25 bp, Mus musculus
tagttataggcacagcttgcacatg

SEQ ID NO: 753109 - DNA, 25 bp, Mus musculus
tagttataggcagagcttgcacatg

SEQ ID NO: 753110 - DNA, 25 bp, Mus musculus
tagttatcagtacctggttcacggc

SEQ ID NO: 753111 - DNA, 25 bp, Mus musculus
tagttatcagtagctggttcacggc

SEQ ID NO: 753112 - DNA, 25 bp, Mus musculus
tagttatcctgtccaccgatctcgg

SEQ ID NO: 753113 - DNA, 25 bp, Mus musculus
tagttatcctgtgcaccgatctcgg

SEQ ID NO: 753114 - DNA, 25 bp, Mus musculus
tagttatgcagcactctcgtgtccc

SEQ ID NO: 753115 - DNA, 25 bp, Mus musculus
tagttatgcagctctctcgtgtccc

SEQ ID NO: 753116 - DNA, 25 bp, Mus musculus
tagttatggcagcaaccaatagacc

SEQ ID NO: 753117 - DNA, 25 bp, Mus musculus
tagttatggcaggaaccaatagacc

SEQ ID NO: 753118 - DNA, 25 bp, Mus musculus
tagttatgggaaaagcctatcgaac

SEQ ID NO: 753119 - DNA, 25 bp, Mus musculus
tagttatgggaatagcctatcgaac

SEQ ID NO: 753120 - DNA, 25 bp, Mus musculus
tagttatgggctatgctggacaatc

SEQ ID NO: 753121 - DNA, 25 bp, Mus musculus
tagttatgggctttgctggacaatc

SEQ ID NO: 753122 - DNA, 25 bp, Mus musculus
tagttcaaaagtatcaagaaggagc

SEQ ID NO: 753123 - DNA, 25 bp, Mus musculus
tagttcaaaagtttcaagaaggagc

SEQ ID NO: 753124 - DNA, 25 bp, Mus musculus
tagttcactagtccgcttccttctg

SEQ ID NO: 753125 - DNA, 25 bp, Mus musculus
tagttcactagtgcgcttccttctg

SEQ ID NO: 753126 - DNA, 25 bp, Mus musculus
tagttcagaataacctggccttgct

SEQ ID NO: 753127 - DNA, 25 bp, Mus musculus
tagttcagaatatcctggccttgct

SEQ ID NO: 753128 - DNA, 25 bp, Mus musculus
tagttcagattaaaaatcttgagcc

SEQ ID NO: 753129 - DNA, 25 bp, Mus musculus
tagttcagattataaatcttgagcc

SEQ ID NO: 753130 - DNA, 25 bp, Mus musculus
tagttcagcctacctcaacacacat

SEQ ID NO: 753131 - DNA, 25 bp, Mus musculus
tagttcagcctagctcaacacacat

SEQ ID NO: 753132 - DNA, 25 bp, Mus musculus
tagttcagctgcaggattccgtgtc

SEQ ID NO: 753133 - DNA, 25 bp, Mus musculus
tagttcagctgctggattccgtgtc

SEQ ID NO: 753134 - DNA, 25 bp, Mus musculus
tagttcatgtgtacagccttgctgc

SEQ ID NO: 753135 - DNA, 25 bp, Mus musculus
tagttcatgtgttcagccttgctgc

SEQ ID NO: 753136 - DNA, 25 bp, Mus musculus
tagttccacaagacgcattaccttg

SEQ ID NO: 753137 - DNA, 25 bp, Mus musculus
tagttccacaagtcgcattaccttg

SEQ ID NO: 753138 - DNA, 25 bp, Mus musculus
tagttccacaggctgctgtacagac

SEQ ID NO: 753139 - DNA, 25 bp, Mus musculus
tagttccacagggtgctgtacagac

SEQ ID NO: 753140 - DNA, 25 bp, Mus musculus
tagttcccggatagcagatgtgttc

SEQ ID NO: 753141 - DNA, 25 bp, Mus musculus
tagttcccggattgcagatgtgttc

SEQ ID NO: 753142 - DNA, 25 bp, Mus musculus
tagttccgtggacactgcgagttcc

SEQ ID NO: 753143 - DNA, 25 bp, Mus musculus
tagttccgtggagactgcgagttcc

SEQ ID NO: 753144 - DNA, 25 bp, Mus musculus
tagttccgtggcaacgaggagaacc

SEQ ID NO: 753145 - DNA, 25 bp, Mus musculus
tagttccgtggctacgaggagaacc

SEQ ID NO: 753146 - DNA, 25 bp, Mus musculus
tagttccgttggctagactctgact

SEQ ID NO: 753147 - DNA, 25 bp, Mus musculus
tagttccgttgggtagactctgact

SEQ ID NO: 753148 - DNA, 25 bp, Mus musculus
tagttcctacagctgaccagtgtcc

SEQ ID NO: 753149 - DNA, 25 bp, Mus musculus
tagttcctacaggtgaccagtgtcc

SEQ ID NO: 753150 - DNA, 25 bp, Mus musculus
tagttcctctttagacttccccaag

SEQ ID NO: 753151 - DNA, 25 bp, Mus musculus
tagttcctcttttgacttccccaag

SEQ ID NO: 753152 - DNA, 25 bp, Mus musculus
tagttcctggaaccgagcactcctt

SEQ ID NO: 753153 - DNA, 25 bp, Mus musculus
tagttcctggaagcgagcactcctt

SEQ ID NO: 753154 - DNA, 25 bp, Mus musculus
tagttccttgtcatacaagtctcgg

SEQ ID NO: 753155 - DNA, 25 bp, Mus musculus
tagttccttgtcttacaagtctcgg

SEQ ID NO: 753156 - DNA, 25 bp, Mus musculus
tagttcgccacgaacgcatcgaggc

SEQ ID NO: 753157 - DNA, 25 bp, Mus musculus
tagttcgccacgtacgcatcgaggc

SEQ ID NO: 753158 - DNA, 25 bp, Mus musculus
tagttcggaagcacaaatgccgtcg

SEQ ID NO: 753159 - DNA, 25 bp, Mus musculus
tagttcggaagctcaaatgccgtcg

SEQ ID NO: 753160 - DNA, 25 bp, Mus musculus
tagttcgggattagcgtaggagccc

SEQ ID NO: 753161 - DNA, 25 bp, Mus musculus
tagttcgggatttgcgtaggagccc

SEQ ID NO: 753162 - DNA, 25 bp, Mus musculus
tagttctagtccattgacatgggca

SEQ ID NO: 753163 - DNA, 25 bp, Mus musculus
tagttctagtcctttgacatgggca

SEQ ID NO: 753164 - DNA, 25 bp, Mus musculus
tagttctatccaagcggtggagccc

SEQ ID NO: 753165 - DNA, 25 bp, Mus musculus
tagttctatccatgcggtggagccc

SEQ ID NO: 753166 - DNA, 25 bp, Mus musculus
tagttctcaccgacctttcagtgcg

SEQ ID NO: 753167 - DNA, 25 bp, Mus musculus
tagttctcaccgtcctttcagtgcg

SEQ ID NO: 753168 - DNA, 25 bp, Mus musculus
tagttctcagcaccagtgttactgg

SEQ ID NO: 753169 - DNA, 25 bp, Mus musculus
tagttctcagcagcagtgttactgg

SEQ ID NO: 753170 - DNA, 25 bp, Mus musculus
tagttctccctgacctgagtgatca

SEQ ID NO: 753171 - DNA, 25 bp, Mus musculus
tagttctccctgtcctgagtgatca

SEQ ID NO: 753172 - DNA, 25 bp, Mus musculus
tagttctcctcacgatttgccctat

SEQ ID NO: 753173 - DNA, 25 bp, Mus musculus
tagttctcctcaggatttgccctat

SEQ ID NO: 753174 - DNA, 25 bp, Mus musculus
tagttctgctgccagaaacggcctc

SEQ ID NO: 753175 - DNA, 25 bp, Mus musculus
tagttctgctgcgagaaacggcctc

SEQ ID NO: 753176 - DNA, 25 bp, Mus musculus
tagttctggaagacaaggagctgga

SEQ ID NO: 753177 - DNA, 25 bp, Mus musculus
tagttctggaagtcaaggagctgga

SEQ ID NO: 753178 - DNA, 25 bp, Mus musculus
tagttctggcaaccataaccaaaag

SEQ ID NO: 753179 - DNA, 25 bp, Mus musculus
tagttctggcaagcataaccaaaag

SEQ ID NO: 753180 - DNA, 25 bp, Mus musculus
tagttcttcaggagcctcttcccca

SEQ ID NO: 753181 - DNA, 25 bp, Mus musculus
tagttcttcaggtgcctcttcccca

SEQ ID NO: 753182 - DNA, 25 bp, Mus musculus
tagttcttcgagcttctacagacaa

SEQ ID NO: 753183 - DNA, 25 bp, Mus musculus
tagttcttcgaggttctacagacaa

SEQ ID NO: 753184 - DNA, 25 bp, Mus musculus
tagttcttctctatttgacacactg

SEQ ID NO: 753185 - DNA, 25 bp, Mus musculus
tagttcttctctttttgacacactg

SEQ ID NO: 753186 - DNA, 25 bp, Mus musculus
tagttcttgcagaaccagagcctgg

SEQ ID NO: 753187 - DNA, 25 bp, Mus musculus
tagttcttgcagtaccagagcctgg

SEQ ID NO: 753188 - DNA, 25 bp, Mus musculus
tagttcttggagcttccccgatcct

SEQ ID NO: 753189 - DNA, 25 bp, Mus musculus
tagttcttggaggttccccgatcct

SEQ ID NO: 753190 - DNA, 25 bp, Mus musculus
tagttcttgtctccctcgtgctcag

SEQ ID NO: 753191 - DNA, 25 bp, Mus musculus
tagttcttgtctgcctcgtgctcag

SEQ ID NO: 753192 - DNA, 25 bp, Mus musculus
tagttgacaatgattccagccctga

SEQ ID NO: 753193 - DNA, 25 bp, Mus musculus
tagttgacaatgtttccagccctga

SEQ ID NO: 753194 - DNA, 25 bp, Mus musculus
tagttgacttaaccgcatgagacac

SEQ ID NO: 753195 - DNA, 25 bp, Mus musculus
tagttgacttaagcgcatgagacac

SEQ ID NO: 753196 - DNA, 25 bp, Mus musculus
tagttgagtagcattttggtccctg

SEQ ID NO: 753197 - DNA, 25 bp, Mus musculus
tagttgagtagctttttggtccctg

SEQ ID NO: 753198 - DNA, 25 bp, Mus musculus
tagttgatcaacacaaagggaaaaa

SEQ ID NO: 753199 - DNA, 25 bp, Mus musculus
tagttgatcaactcaaagggaaaaa

SEQ ID NO: 753200 - DNA, 25 bp, Mus musculus
tagttgattgtgatggaaaaggagc

SEQ ID NO: 753201 - DNA, 25 bp, Mus musculus
tagttgattgtgttggaaaaggagc

SEQ ID NO: 753202 - DNA, 25 bp, Mus musculus
tagttgcaaccactctataagctct

SEQ ID NO: 753203 - DNA, 25 bp, Mus musculus
tagttgcaaccagtctataagctct

SEQ ID NO: 753204 - DNA, 25 bp, Mus musculus
tagttgcagcttacaaaaagtttca

SEQ ID NO: 753205 - DNA, 25 bp, Mus musculus
tagttgcagctttcaaaaagtttca

SEQ ID NO: 753206 - DNA, 25 bp, Mus musculus
tagttgccagcccaaactttccggg

SEQ ID NO: 753207 - DNA, 25 bp, Mus musculus
tagttgccagccgaaactttccggg

SEQ ID NO: 753208 - DNA, 25 bp, Mus musculus
tagttgcctgcaaaggagccggtcc

SEQ ID NO: 753209 - DNA, 25 bp, Mus musculus
tagttgcctgcataggagccggtcc

SEQ ID NO: 753210 - DNA, 25 bp, Mus musculus
tagttgcggacaccttcagactccc

SEQ ID NO: 753211 - DNA, 25 bp, Mus musculus
tagttgcggacagcttcagactccc

SEQ ID NO: 753212 - DNA, 25 bp, Mus musculus
tagttgcggctccttcatcaagacg

SEQ ID NO: 753213 - DNA, 25 bp, Mus musculus
tagttgcggctcgttcatcaagacg

SEQ ID NO: 753214 - DNA, 25 bp, Mus musculus
tagttgcggtccatctagtcgtgac

SEQ ID NO: 753215 - DNA, 25 bp, Mus musculus
tagttgcggtccttctagtcgtgac

SEQ ID NO: 753216 - DNA, 25 bp, Mus musculus
tagttgctacggcttcttcaggcgt

SEQ ID NO: 753217 - DNA, 25 bp, Mus musculus
tagttgctacgggttcttcaggcgt

SEQ ID NO: 753218 - DNA, 25 bp, Mus musculus
tagttgctcagaagggtccttacag

SEQ ID NO: 753219 - DNA, 25 bp, Mus musculus
tagttgctcagatgggtccttacag

SEQ ID NO: 753220 - DNA, 25 bp, Mus musculus
tagttggacttgactggacagtggc

SEQ ID NO: 753221 - DNA, 25 bp, Mus musculus
tagttggacttgtctggacagtggc

SEQ ID NO: 753222 - DNA, 25 bp, Mus musculus
tagttggagctgagtgggacttcac

SEQ ID NO: 753223 - DNA, 25 bp, Mus musculus
tagttggagctgtgtgggacttcac

SEQ ID NO: 753224 - DNA, 25 bp, Mus musculus
tagttggagtggcaagatcccacct

SEQ ID NO: 753225 - DNA, 25 bp, Mus musculus
tagttggagtgggaagatcccacct

SEQ ID NO: 753226 - DNA, 25 bp, Mus musculus
tagttggcacctacagctgcttctg

SEQ ID NO: 753227 - DNA, 25 bp, Mus musculus
tagttggcaccttcagctgcttctg

SEQ ID NO: 753228 - DNA, 25 bp, Mus musculus
tagttgggatagactacagaaattg

SEQ ID NO: 753229 - DNA, 25 bp, Mus musculus
tagttgggatagtctacagaaattg

SEQ ID NO: 753230 - DNA, 25 bp, Mus musculus
tagttgggccaactgaaagccctgc

SEQ ID NO: 753231 - DNA, 25 bp, Mus musculus
tagttgggccaagtgaaagccctgc

SEQ ID NO: 753232 - DNA, 25 bp, Mus musculus
tagttgggcccacatgaatattgtc

SEQ ID NO: 753233 - DNA, 25 bp, Mus musculus
tagttgggcccagatgaatattgtc

SEQ ID NO: 753234 - DNA, 25 bp, Mus musculus
tagttgggtgcaaggtctagcctaa

SEQ ID NO: 753235 - DNA, 25 bp, Mus musculus
tagttgggtgcatggtctagcctaa

SEQ ID NO: 753236 - DNA, 25 bp, Mus musculus
tagttggtcgacagattggcaagca

SEQ ID NO: 753237 - DNA, 25 bp, Mus musculus
tagttggtcgactgattggcaagca

SEQ ID NO: 753238 - DNA, 25 bp, Mus musculus
tagttggtgacacccctgaaaaagt

SEQ ID NO: 753239 - DNA, 25 bp, Mus musculus
tagttggtgacagccctgaaaaagt

SEQ ID NO: 753240 - DNA, 25 bp, Mus musculus
tagttgtactccaagactgtagaag

SEQ ID NO: 753241 - DNA, 25 bp, Mus musculus
tagttgtactcctagactgtagaag

SEQ ID NO: 753242 - DNA, 25 bp, Mus musculus
tagttgtataaccatcctggcagtg

SEQ ID NO: 753243 - DNA, 25 bp, Mus musculus
tagttgtataacgatcctggcagtg

SEQ ID NO: 753244 - DNA, 25 bp, Mus musculus
tagttgtcgctgaaggccttcgctg

SEQ ID NO: 753245 - DNA, 25 bp, Mus musculus
tagttgtcgctgtaggccttcgctg

SEQ ID NO: 753246 - DNA, 25 bp, Mus musculus
tagttgtgccttcgaaattgggctg

SEQ ID NO: 753247 - DNA, 25 bp, Mus musculus
tagttgtgccttggaaattgggctg

SEQ ID NO: 753248 - DNA, 25 bp, Mus musculus
tagttgtggacaaccttgagatcaa

SEQ ID NO: 753249 - DNA, 25 bp, Mus musculus
tagttgtggacatccttgagatcaa

SEQ ID NO: 753250 - DNA, 25 bp, Mus musculus
tagttgtggcggacacagttgttgt

SEQ ID NO: 753251 - DNA, 25 bp, Mus musculus
tagttgtggcggtcacagttgttgt

SEQ ID NO: 753252 - DNA, 25 bp, Mus musculus
tagttgtgttgaacaggctgctctg

SEQ ID NO: 753253 - DNA, 25 bp, Mus musculus
tagttgtgttgatcaggctgctctg

SEQ ID NO: 753254 - DNA, 25 bp, Mus musculus
tagttgttgctgaggatagccaaga

SEQ ID NO: 753255 - DNA, 25 bp, Mus musculus
tagttgttgctgtggatagccaaga

SEQ ID NO: 753256 - DNA, 25 bp, Mus musculus
tagtttaaccaaccagcccgaggaa

SEQ ID NO: 753257 - DNA, 25 bp, Mus musculus
tagtttaaccaagcagcccgaggaa

SEQ ID NO: 753258 - DNA, 25 bp, Mus musculus
tagtttacagagaatccactgccgg

SEQ ID NO: 753259 - DNA, 25 bp, Mus musculus
tagtttacagagcaaccaggtgcca

SEQ ID NO: 753260 - DNA, 25 bp, Mus musculus
tagtttacagaggaaccaggtgcca

SEQ ID NO: 753261 - DNA, 25 bp, Mus musculus
tagtttacagagtatccactgccgg

SEQ ID NO: 753262 - DNA, 25 bp, Mus musculus
tagtttaccgagagcctaggcttcg

SEQ ID NO: 753263 - DNA, 25 bp, Mus musculus
tagtttaccgagtgcctaggcttcg

SEQ ID NO: 753264 - DNA, 25 bp, Mus musculus
tagtttagacctagaactgcctata

SEQ ID NO: 753265 - DNA, 25 bp, Mus musculus
tagtttagaccttgaactgcctata

SEQ ID NO: 753266 - DNA, 25 bp, Mus musculus
tagtttagcaaacgtgtccccacct

SEQ ID NO: 753267 - DNA, 25 bp, Mus musculus
tagtttagcaaaggtgtccccacct

SEQ ID NO: 753268 - DNA, 25 bp, Mus musculus
tagtttagtcttactgtggagaggc

SEQ ID NO: 753269 - DNA, 25 bp, Mus musculus
tagtttagtctttctgtggagaggc

SEQ ID NO: 753270 - DNA, 25 bp, Mus musculus
tagtttcacttgatactctccagga

SEQ ID NO: 753271 - DNA, 25 bp, Mus musculus
tagtttcacttgttactctccagga

SEQ ID NO: 753272 - DNA, 25 bp, Mus musculus
tagtttcagaaacaatgcattccct

SEQ ID NO: 753273 - DNA, 25 bp, Mus musculus
tagtttcagaaagaatgcattccct

SEQ ID NO: 753274 - DNA, 25 bp, Mus musculus
tagtttccccaccaatgggccttca

SEQ ID NO: 753275 - DNA, 25 bp, Mus musculus
tagtttccccacgaatgggccttca

SEQ ID NO: 753276 - DNA, 25 bp, Mus musculus
tagtttccgcaaaacaacgcaacac

SEQ ID NO: 753277 - DNA, 25 bp, Mus musculus
tagtttccgcaatacaacgcaacac

SEQ ID NO: 753278 - DNA, 25 bp, Mus musculus
tagtttccgggcaggatcagccagg

SEQ ID NO: 753279 - DNA, 25 bp, Mus musculus
tagtttccgggctggatcagccagg

SEQ ID NO: 753280 - DNA, 25 bp, Mus musculus
tagtttcggccaaggacttgaagga

SEQ ID NO: 753281 - DNA, 25 bp, Mus musculus
tagtttcggccatggacttgaagga

SEQ ID NO: 753282 - DNA, 25 bp, Mus musculus
tagtttcgtcaaacctgacacacca

SEQ ID NO: 753283 - DNA, 25 bp, Mus musculus
tagtttcgtcaatcctgacacacca

SEQ ID NO: 753284 - DNA, 25 bp, Mus musculus
tagtttcgtcctctcttcccttggc

SEQ ID NO: 753285 - DNA, 25 bp, Mus musculus
tagtttcgtcctgtcttcccttggc

SEQ ID NO: 753286 - DNA, 25 bp, Mus musculus
tagtttctcactcattcaactgctc

SEQ ID NO: 753287 - DNA, 25 bp, Mus musculus
tagtttctcactgattcaactgctc

SEQ ID NO: 753288 - DNA, 25 bp, Mus musculus
tagtttctcagcatccctttcagtt

SEQ ID NO: 753289 - DNA, 25 bp, Mus musculus
tagtttctcagcttccctttcagtt

SEQ ID NO: 753290 - DNA, 25 bp, Mus musculus
tagtttcttcaaacggcctatgtcg

SEQ ID NO: 753291 - DNA, 25 bp, Mus musculus
tagtttcttcaatcggcctatgtcg

SEQ ID NO: 753292 - DNA, 25 bp, Mus musculus
tagtttcttcccctatgcctggacc

SEQ ID NO: 753293 - DNA, 25 bp, Mus musculus
tagtttcttcccgtatgcctggacc

SEQ ID NO: 753294 - DNA, 25 bp, Mus musculus
tagtttcttgcccttgtgtgcagga

SEQ ID NO: 753295 - DNA, 25 bp, Mus musculus
tagtttcttgccgttgtgtgcagga

SEQ ID NO: 753296 - DNA, 25 bp, Mus musculus
tagtttgagacacctcacgtacttg

SEQ ID NO: 753297 - DNA, 25 bp, Mus musculus
tagtttgagacagctcacgtacttg

SEQ ID NO: 753298 - DNA, 25 bp, Mus musculus
tagtttgcaaaacgccaagctgtct

SEQ ID NO: 753299 - DNA, 25 bp, Mus musculus
tagtttgcaaaaggccaagctgtct

SEQ ID NO: 753300 - DNA, 25 bp, Mus musculus
tagtttgcagcaacactgcccttgg

SEQ ID NO: 753301 - DNA, 25 bp, Mus musculus
tagtttgcagcatcactgcccttgg

SEQ ID NO: 753302 - DNA, 25 bp, Mus musculus
tagtttgcgaacagaagttaaggcc

SEQ ID NO: 753303 - DNA, 25 bp, Mus musculus
tagtttgcgaactgaagttaaggcc

SEQ ID NO: 753304 - DNA, 25 bp, Mus musculus
tagtttggaccccttaaatgccaat

SEQ ID NO: 753305 - DNA, 25 bp, Mus musculus
tagtttggacccgttaaatgccaat

SEQ ID NO: 753306 - DNA, 25 bp, Mus musculus
tagtttggagccacctgtcagacag

SEQ ID NO: 753307 - DNA, 25 bp, Mus musculus
tagtttggagcctcctgtcagacag

SEQ ID NO: 753308 - DNA, 25 bp, Mus musculus
tagtttggccaacgagcagcgactc

SEQ ID NO: 753309 - DNA, 25 bp, Mus musculus
tagtttggccaaggagcagcgactc

SEQ ID NO: 753310 - DNA, 25 bp, Mus musculus
tagttttcaaagcatatgtcttcag

SEQ ID NO: 753311 - DNA, 25 bp, Mus musculus
tagttttcaaaggatatgtcttcag

SEQ ID NO: 753312 - DNA, 25 bp, Mus musculus
tagttttgaaagctacacaggtgaa

SEQ ID NO: 753313 - DNA, 25 bp, Mus musculus
tagttttgaaaggtacacaggtgaa

SEQ ID NO: 753314 - DNA, 25 bp, Mus musculus
tagttttgactcagccccatgcatc

SEQ ID NO: 753315 - DNA, 25 bp, Mus musculus
tagttttgactctgccccatgcatc

SEQ ID NO: 753316 - DNA, 25 bp, Mus musculus
tagttttgatcacccacccttgcga

SEQ ID NO: 753317 - DNA, 25 bp, Mus musculus
tagttttgatcagccacccttgcga

SEQ ID NO: 753318 - DNA, 25 bp, Mus musculus
tagttttgcgcaagactccacctct

SEQ ID NO: 753319 - DNA, 25 bp, Mus musculus
tagttttgcgcatgactccacctct

SEQ ID NO: 753320 - DNA, 25 bp, Mus musculus
tagttttgctgtactgggcctagat

SEQ ID NO: 753321 - DNA, 25 bp, Mus musculus
tagttttgctgttctgggcctagat

SEQ ID NO: 753322 - DNA, 25 bp, Mus musculus
tagttttggatccattcaagagaca

SEQ ID NO: 753323 - DNA, 25 bp, Mus musculus
tagttttggatcgattcaagagaca

SEQ ID NO: 753324 - DNA, 25 bp, Mus musculus
tagtttttacgcagttccccaccag

SEQ ID NO: 753325 - DNA, 25 bp, Mus musculus
tagtttttacgctgttccccaccag

SEQ ID NO: 753326 - DNA, 25 bp, Mus musculus
tagtttttgtagatatgggacattc

SEQ ID NO: 753327 - DNA, 25 bp, Mus musculus
tagtttttgtagttatgggacattc

SEQ ID NO: 753328 - DNA, 25 bp, Mus musculus
tataaaaaagttccgagatgaggcc

SEQ ID NO: 753329 - DNA, 25 bp, Mus musculus
tataaaaaagttgcgagatgaggcc

SEQ ID NO: 753330 - DNA, 25 bp, Mus musculus
tataaaaacctaactgcttctgaag

SEQ ID NO: 753331 - DNA, 25 bp, Mus musculus
tataaaaacctatctgcttctgaag

SEQ ID NO: 753332 - DNA, 25 bp, Mus musculus
tataaaaactgaagtgacaaaattg

SEQ ID NO: 753333 - DNA, 25 bp, Mus musculus
tataaaaactgatgtgacaaaattg

SEQ ID NO: 753334 - DNA, 25 bp, Mus musculus
tataaaaagagacccacgggactgt

SEQ ID NO: 753335 - DNA, 25 bp, Mus musculus
tataaaaagagagccacgggactgt

SEQ ID NO: 753336 - DNA, 25 bp, Mus musculus
tataaaaagcagagcactgaggcgg

SEQ ID NO: 753337 - DNA, 25 bp, Mus musculus
tataaaaagcagtgcactgaggcgg

SEQ ID NO: 753338 - DNA, 25 bp, Mus musculus
tataaaacacatccctgctacgagc

SEQ ID NO: 753339 - DNA, 25 bp, Mus musculus
tataaaacacatgcctgctacgagc

SEQ ID NO: 753340 - DNA, 25 bp, Mus musculus
tataaaacagccaatggacatgggt

SEQ ID NO: 753341 - DNA, 25 bp, Mus musculus
tataaaacagcctatggacatgggt

SEQ ID NO: 753342 - DNA, 25 bp, Mus musculus
tataaaacgccacccaatctgaaag

SEQ ID NO: 753343 - DNA, 25 bp, Mus musculus
tataaaacgccagccaatctgaaag

SEQ ID NO: 753344 - DNA, 25 bp, Mus musculus
tataaaactcagagcccaacttgtt

SEQ ID NO: 753345 - DNA, 25 bp, Mus musculus
tataaaactcagtgcccaacttgtt

SEQ ID NO: 753346 - DNA, 25 bp, Mus musculus
tataaaagaaagaagacagagacac

SEQ ID NO: 753347 - DNA, 25 bp, Mus musculus
tataaaagaaagtagacagagacac

SEQ ID NO: 753348 - DNA, 25 bp, Mus musculus
tataaaagaatcaccgaagaggcca

SEQ ID NO: 753349 - DNA, 25 bp, Mus musculus
tataaaagaatctccgaagaggcca

SEQ ID NO: 753350 - DNA, 25 bp, Mus musculus
tataaaagacaaattgcaacaaatc

SEQ ID NO: 753351 - DNA, 25 bp, Mus musculus
tataaaagacaatttgcaacaaatc

SEQ ID NO: 753352 - DNA, 25 bp, Mus musculus
tataaaagccctacaggaccaggtg

SEQ ID NO: 753353 - DNA, 25 bp, Mus musculus
tataaaagcccttcaggaccaggtg

SEQ ID NO: 753354 - DNA, 25 bp, Mus musculus
tataaaagccggacggtgcgacccg

SEQ ID NO: 753355 - DNA, 25 bp, Mus musculus
tataaaagccggtcggtgcgacccg

SEQ ID NO: 753356 - DNA, 25 bp, Mus musculus
tataaaagcgggactggagtaaaca

SEQ ID NO: 753357 - DNA, 25 bp, Mus musculus
tataaaagcgggtctggagtaaaca

SEQ ID NO: 753358 - DNA, 25 bp, Mus musculus
tataaaaggcttcccatgtgaaggc

SEQ ID NO: 753359 - DNA, 25 bp, Mus musculus
tataaaaggcttgccatgtgaaggc

SEQ ID NO: 753360 - DNA, 25 bp, Mus musculus
tataaaatagtacccattaaggata

SEQ ID NO: 753361 - DNA, 25 bp, Mus musculus
tataaaatagtagccattaaggata

SEQ ID NO: 753362 - DNA, 25 bp, Mus musculus
tataaaatatatcatctcaagagta

SEQ ID NO: 753363 - DNA, 25 bp, Mus musculus
tataaaatatatgatctcaagagta

SEQ ID NO: 753364 - DNA, 25 bp, Mus musculus
tataaaattttgcagtgctgagcac

SEQ ID NO: 753365 - DNA, 25 bp, Mus musculus
tataaaattttggagtgctgagcac

SEQ ID NO: 753366 - DNA, 25 bp, Mus musculus
tataaacaacaactgaagaaactgg

SEQ ID NO: 753367 - DNA, 25 bp, Mus musculus
tataaacaacaagtgaagaaactgg

SEQ ID NO: 753368 - DNA, 25 bp, Mus musculus
tataaacaagacagggacatcgcac

SEQ ID NO: 753369 - DNA, 25 bp, Mus musculus
tataaacaagactgggacatcgcac

SEQ ID NO: 753370 - DNA, 25 bp, Mus musculus
tataaacaagccatcgtgagaagac

SEQ ID NO: 753371 - DNA, 25 bp, Mus musculus
tataaacaagccttcgtgagaagac

SEQ ID NO: 753372 - DNA, 25 bp, Mus musculus
tataaacaaggacaacactggctgg

SEQ ID NO: 753373 - DNA, 25 bp, Mus musculus
tataaacaaggagaacactggctgg

SEQ ID NO: 753374 - DNA, 25 bp, Mus musculus
tataaacaatcaagagtcggcccac

SEQ ID NO: 753375 - DNA, 25 bp, Mus musculus
tataaacaatcatgagtcggcccac

SEQ ID NO: 753376 - DNA, 25 bp, Mus musculus
tataaacacgtgcaggcccaagtcc

SEQ ID NO: 753377 - DNA, 25 bp, Mus musculus
tataaacacgtggaggcccaagtcc

SEQ ID NO: 753378 - DNA, 25 bp, Mus musculus
tataaacactctcactctggccact

SEQ ID NO: 753379 - DNA, 25 bp, Mus musculus
tataaacactctgactctggccact

SEQ ID NO: 753380 - DNA, 25 bp, Mus musculus
tataaacactggcattagcatggct

SEQ ID NO: 753381 - DNA, 25 bp, Mus musculus
tataaacactgggattagcatggct

SEQ ID NO: 753382 - DNA, 25 bp, Mus musculus
tataaacagcagagcaaaagcagct

SEQ ID NO: 753383 - DNA, 25 bp, Mus musculus
tataaacagcagtgcaaaagcagct

SEQ ID NO: 753384 - DNA, 25 bp, Mus musculus
tataaacagcctaggtagcgcatgc

SEQ ID NO: 753385 - DNA, 25 bp, Mus musculus
tataaacagccttggtagcgcatgc

SEQ ID NO: 753386 - DNA, 25 bp, Mus musculus
tataaaccaatgattcaagaaatgg

SEQ ID NO: 753387 - DNA, 25 bp, Mus musculus
tataaaccaatgtttcaagaaatgg

SEQ ID NO: 753388 - DNA, 25 bp, Mus musculus
tataaacctaggatcatattcttat

SEQ ID NO: 753389 - DNA, 25 bp, Mus musculus
tataaacctaggttcatattcttat

SEQ ID NO: 753390 - DNA, 25 bp, Mus musculus
tataaacgatgcagtgctctgtgcg

SEQ ID NO: 753391 - DNA, 25 bp, Mus musculus
tataaacgatgctgtgctctgtgcg

SEQ ID NO: 753392 - DNA, 25 bp, Mus musculus
tataaactgtggcttaaagtgcagc

SEQ ID NO: 753393 - DNA, 25 bp, Mus musculus
tataaactgtgggttaaagtgcagc

SEQ ID NO: 753394 - DNA, 25 bp, Mus musculus
tataaagacaccagcacagtggacc

SEQ ID NO: 753395 - DNA, 25 bp, Mus musculus
tataaagacacctgcacagtggacc

SEQ ID NO: 753396 - DNA, 25 bp, Mus musculus
tataaagaggtcctgctgacactgg

SEQ ID NO: 753397 - DNA, 25 bp, Mus musculus
tataaagaggtcgtgctgacactgg

SEQ ID NO: 753398 - DNA, 25 bp, Mus musculus
tataaagcaagaatattcctggagg

SEQ ID NO: 753399 - DNA, 25 bp, Mus musculus
tataaagcaagattattcctggagg

SEQ ID NO: 753400 - DNA, 25 bp, Mus musculus
tataaagcaccaatcattgcagaga

SEQ ID NO: 753401 - DNA, 25 bp, Mus musculus
tataaagcaccattcattgcagaga

SEQ ID NO: 753402 - DNA, 25 bp, Mus musculus
tataaagcgtccaacctgaatctga

SEQ ID NO: 753403 - DNA, 25 bp, Mus musculus
tataaagcgtcctacctgaatctga

SEQ ID NO: 753404 - DNA, 25 bp, Mus musculus
tataaagctaccaatacacacagag

SEQ ID NO: 753405 - DNA, 25 bp, Mus musculus
tataaagctacctatacacacagag

SEQ ID NO: 753406 - DNA, 25 bp, Mus musculus
tataaaggaatgaagggcaggcagc

SEQ ID NO: 753407 - DNA, 25 bp, Mus musculus
tataaaggaatgtagggcaggcagc

SEQ ID NO: 753408 - DNA, 25 bp, Mus musculus
tataaaggaggtcaatgtgagccca

SEQ ID NO: 753409 - DNA, 25 bp, Mus musculus
tataaaggaggtgaatgtgagccca

SEQ ID NO: 753410 - DNA, 25 bp, Mus musculus
tataaaggcagacagacgggttctc

SEQ ID NO: 753411 - DNA, 25 bp, Mus musculus
tataaaggcagagagacgggttctc

SEQ ID NO: 753412 - DNA, 25 bp, Mus musculus
tataaaggcataaggtgctgggctc

SEQ ID NO: 753413 - DNA, 25 bp, Mus musculus
tataaaggcatatggtgctgggctc

SEQ ID NO: 753414 - DNA, 25 bp, Mus musculus
tataaagggcttacgtgcatcagta

SEQ ID NO: 753415 - DNA, 25 bp, Mus musculus
tataaagggctttcgtgcatcagta

SEQ ID NO: 753416 - DNA, 25 bp, Mus musculus
tataaaggtggtaacactcgcacgg

SEQ ID NO: 753417 - DNA, 25 bp, Mus musculus
tataaaggtggttacactcgcacgg

SEQ ID NO: 753418 - DNA, 25 bp, Mus musculus
tataaagtatctctcaccactgttg

SEQ ID NO: 753419 - DNA, 25 bp, Mus musculus
tataaagtatctgtcaccactgttg

SEQ ID NO: 753420 - DNA, 25 bp, Mus musculus
tataaagtgactagggagaagccac

SEQ ID NO: 753421 - DNA, 25 bp, Mus musculus
tataaagtgacttgggagaagccac

SEQ ID NO: 753422 - DNA, 25 bp, Mus musculus
tataaagtttctaaagagtcatgca

SEQ ID NO: 753423 - DNA, 25 bp, Mus musculus
tataaagtttcttaagagtcatgca

SEQ ID NO: 753424 - DNA, 25 bp, Mus musculus
tataaataacacaggaacaatggca

SEQ ID NO: 753425 - DNA, 25 bp, Mus musculus
tataaataacactggaacaatggca

SEQ ID NO: 753426 - DNA, 25 bp, Mus musculus
tataaataactcattgggcgaccag

SEQ ID NO: 753427 - DNA, 25 bp, Mus musculus
tataaataactctttgggcgaccag

SEQ ID NO: 753428 - DNA, 25 bp, Mus musculus
tataaataataacacttgggttgtc

SEQ ID NO: 753429 - DNA, 25 bp, Mus musculus
tataaataataagacttgggttgtc

SEQ ID NO: 753430 - DNA, 25 bp, Mus musculus
tataaatacgagcacttggtgcgcg

SEQ ID NO: 753431 - DNA, 25 bp, Mus musculus
tataaatacgaggacttggtgcgcg

SEQ ID NO: 753432 - DNA, 25 bp, Mus musculus
tataaatgacgaaaatcaagatggt

SEQ ID NO: 753433 - DNA, 25 bp, Mus musculus
tataaatgacgataatcaagatggt

SEQ ID NO: 753434 - DNA, 25 bp, Mus musculus
tataaatgccacctcatcctcagca

SEQ ID NO: 753435 - DNA, 25 bp, Mus musculus
tataaatgccacgtcatcctcagca

SEQ ID NO: 753436 - DNA, 25 bp, Mus musculus
tataaatggcttcacaataagaatc

SEQ ID NO: 753437 - DNA, 25 bp, Mus musculus
tataaatggcttgacaataagaatc

SEQ ID NO: 753438 - DNA, 25 bp, Mus musculus
tataacaacagcacttctattcagg

SEQ ID NO: 753439 - DNA, 25 bp, Mus musculus
tataacaacagctcttctattcagg

SEQ ID NO: 753440 - DNA, 25 bp, Mus musculus
tataacaaggtgaatagtgtctttc

SEQ ID NO: 753441 - DNA, 25 bp, Mus musculus
tataacaaggtgtatagtgtctttc

SEQ ID NO: 753442 - DNA, 25 bp, Mus musculus
tataacaccagtcaaagattccttg

SEQ ID NO: 753443 - DNA, 25 bp, Mus musculus
tataacaccagtgaaagattccttg

SEQ ID NO: 753444 - DNA, 25 bp, Mus musculus
tataacagacatagatgaagacggc

SEQ ID NO: 753445 - DNA, 25 bp, Mus musculus
tataacagacattgatgaagacggc

SEQ ID NO: 753446 - DNA, 25 bp, Mus musculus
tataacagcaggcagaagcactgcc

SEQ ID NO: 753447 - DNA, 25 bp, Mus musculus
tataacagcagggagaagcactgcc

SEQ ID NO: 753448 - DNA, 25 bp, Mus musculus
tataacagtgtcaggtgcaatgccg

SEQ ID NO: 753449 - DNA, 25 bp, Mus musculus
tataacagtgtctggtgcaatgccg

SEQ ID NO: 753450 - DNA, 25 bp, Mus musculus
tataacagtttgagtacccagccta

SEQ ID NO: 753451 - DNA, 25 bp, Mus musculus
tataacagtttgtgtacccagccta

SEQ ID NO: 753452 - DNA, 25 bp, Mus musculus
tataacatgcgactggaagactacg

SEQ ID NO: 753453 - DNA, 25 bp, Mus musculus
tataacatgcgagtggaagactacg

SEQ ID NO: 753454 - DNA, 25 bp, Mus musculus
tataaccaaacaaatagctccatgg

SEQ ID NO: 753455 - DNA, 25 bp, Mus musculus
tataaccaaacatatagctccatgg

SEQ ID NO: 753456 - DNA, 25 bp, Mus musculus
tataaccacagacgatgagcaagcc

SEQ ID NO: 753457 - DNA, 25 bp, Mus musculus
tataaccacagaggatgagcaagcc

SEQ ID NO: 753458 - DNA, 25 bp, Mus musculus
tataaccagctaaagaagcaggagc

SEQ ID NO: 753459 - DNA, 25 bp, Mus musculus
tataaccagctatagaagcaggagc

SEQ ID NO: 753460 - DNA, 25 bp, Mus musculus
tataaccaggccatgagaacagcaa

SEQ ID NO: 753461 - DNA, 25 bp, Mus musculus
tataaccaggccttgagaacagcaa

SEQ ID NO: 753462 - DNA, 25 bp, Mus musculus
tataacccaaatcacacctgtccag

SEQ ID NO: 753463 - DNA, 25 bp, Mus musculus
tataacccaaatgacacctgtccag

SEQ ID NO: 753464 - DNA, 25 bp, Mus musculus
tataacccagggactggcgcactca

SEQ ID NO: 753465 - DNA, 25 bp, Mus musculus
tataacccagggtctggcgcactca

SEQ ID NO: 753466 - DNA, 25 bp, Mus musculus
tataaccccgatcttcagtttctat

SEQ ID NO: 753467 - DNA, 25 bp, Mus musculus
tataaccccgatgttcagtttctat

SEQ ID NO: 753468 - DNA, 25 bp, Mus musculus
tataaccccgcaatcatatgtgaga

SEQ ID NO: 753469 - DNA, 25 bp, Mus musculus
tataaccccgcattcatatgtgaga

SEQ ID NO: 753470 - DNA, 25 bp, Mus musculus
tataaccctaccaggcattgtatcg

SEQ ID NO: 753471 - DNA, 25 bp, Mus musculus
tataaccctacctggcattgtatcg

SEQ ID NO: 753472 - DNA, 25 bp, Mus musculus
tataaccctgaacgatgggctttgt

SEQ ID NO: 753473 - DNA, 25 bp, Mus musculus
tataaccctgaaggatgggctttgt

SEQ ID NO: 753474 - DNA, 25 bp, Mus musculus
tataaccctggcactatgaccattg

SEQ ID NO: 753475 - DNA, 25 bp, Mus musculus
tataaccctggctctatgaccattg

SEQ ID NO: 753476 - DNA, 25 bp, Mus musculus
tataaccctttacccatacctgctg

SEQ ID NO: 753477 - DNA, 25 bp, Mus musculus
tataaccctttagccatacctgctg

SEQ ID NO: 753478 - DNA, 25 bp, Mus musculus
tataaccgcgaacgagaccttctct

SEQ ID NO: 753479 - DNA, 25 bp, Mus musculus
tataaccgcgaaggagaccttctct

SEQ ID NO: 753480 - DNA, 25 bp, Mus musculus
tataaccggctcatccattattggg

SEQ ID NO: 753481 - DNA, 25 bp, Mus musculus
tataaccggctcttccattattggg

SEQ ID NO: 753482 - DNA, 25 bp, Mus musculus
tataaccgtgacacagaggcagctg

SEQ ID NO: 753483 - DNA, 25 bp, Mus musculus
tataaccgtgactcagaggcagctg

SEQ ID NO: 753484 - DNA, 25 bp, Mus musculus
tataacctgtttcagggacggcctc

SEQ ID NO: 753485 - DNA, 25 bp, Mus musculus
tataacctgtttgagggacggcctc

SEQ ID NO: 753486 - DNA, 25 bp, Mus musculus
tataacctttatagagtcagatgac

SEQ ID NO: 753487 - DNA, 25 bp, Mus musculus
tataacctttattgagtcagatgac

SEQ ID NO: 753488 - DNA, 25 bp, Mus musculus
tataactaagaaaactaggacatgg

SEQ ID NO: 753489 - DNA, 25 bp, Mus musculus
tataactaagaatactaggacatgg

SEQ ID NO: 753490 - DNA, 25 bp, Mus musculus
tataactacaaaccaatacaaagca

SEQ ID NO: 753491 - DNA, 25 bp, Mus musculus
tataactacaaagcaatacaaagca

SEQ ID NO: 753492 - DNA, 25 bp, Mus musculus
tataactacatgagccccaccttct

SEQ ID NO: 753493 - DNA, 25 bp, Mus musculus
tataactacatgtgccccaccttct

SEQ ID NO: 753494 - DNA, 25 bp, Mus musculus
tataactactttctttggacacact

SEQ ID NO: 753495 - DNA, 25 bp, Mus musculus
tataactactttgtttggacacact

SEQ ID NO: 753496 - DNA, 25 bp, Mus musculus
tataactccaacatcagggactcca

SEQ ID NO: 753497 - DNA, 25 bp, Mus musculus
tataactccaacttcagggactcca

SEQ ID NO: 753498 - DNA, 25 bp, Mus musculus
tataactgacacatccgttctggct

SEQ ID NO: 753499 - DNA, 25 bp, Mus musculus
tataactgacacttccgttctggct

SEQ ID NO: 753500 - DNA, 25 bp, Mus musculus
tataactggcggcagaacctagacc

SEQ ID NO: 753501 - DNA, 25 bp, Mus musculus
tataactggcgggagaacctagacc

SEQ ID NO: 753502 - DNA, 25 bp, Mus musculus
tataactggtttagcactgaaaaca

SEQ ID NO: 753503 - DNA, 25 bp, Mus musculus
tataactggttttgcactgaaaaca

SEQ ID NO: 753504 - DNA, 25 bp, Mus musculus
tataagaaactcaaagatgccattg

SEQ ID NO: 753505 - DNA, 25 bp, Mus musculus
tataagaaactctaagatgccattg

SEQ ID NO: 753506 - DNA, 25 bp, Mus musculus
tataagaaagcccacaagaatgccc

SEQ ID NO: 753507 - DNA, 25 bp, Mus musculus
tataagaaagccgacaagaatgccc

SEQ ID NO: 753508 - DNA, 25 bp, Mus musculus
tataagaaatccatatggaaccacg

SEQ ID NO: 753509 - DNA, 25 bp, Mus musculus
tataagaaatccttatggaaccacg

SEQ ID NO: 753510 - DNA, 25 bp, Mus musculus
tataagaacttgctgcctaagcctg

SEQ ID NO: 753511 - DNA, 25 bp, Mus musculus
tataagaacttggtgcctaagcctg

SEQ ID NO: 753512 - DNA, 25 bp, Mus musculus
tataagaagaagatggtacgccgtg

SEQ ID NO: 753513 - DNA, 25 bp, Mus musculus
tataagaagaagttggtacgccgtg

SEQ ID NO: 753514 - DNA, 25 bp, Mus musculus
tataagaagaccaagcataccttcc

SEQ ID NO: 753515 - DNA, 25 bp, Mus musculus
tataagaagacctagcataccttcc

SEQ ID NO: 753516 - DNA, 25 bp, Mus musculus
tataagaatgccaatagaccacccg

SEQ ID NO: 753517 - DNA, 25 bp, Mus musculus
tataagaatgcctatagaccacccg

SEQ ID NO: 753518 - DNA, 25 bp, Mus musculus
tataagacaactcacgactatgagg

SEQ ID NO: 753519 - DNA, 25 bp, Mus musculus
tataagacaactgacgactatgagg

SEQ ID NO: 753520 - DNA, 25 bp, Mus musculus
tataagacctacaacgggaccaact

SEQ ID NO: 753521 - DNA, 25 bp, Mus musculus
tataagacctactacgggaccaact

SEQ ID NO: 753522 - DNA, 25 bp, Mus musculus
tataagactgtacaagagaaagaga

SEQ ID NO: 753523 - DNA, 25 bp, Mus musculus
tataagactgtagaagagaaagaga

SEQ ID NO: 753524 - DNA, 25 bp, Mus musculus
tataagagagctagacaatcttcag

SEQ ID NO: 753525 - DNA, 25 bp, Mus musculus
tataagagagcttgacaatcttcag

SEQ ID NO: 753526 - DNA, 25 bp, Mus musculus
tataagagagtgaaagtcgacgtgc

SEQ ID NO: 753527 - DNA, 25 bp, Mus musculus
tataagagagtgtaagtcgacgtgc

SEQ ID NO: 753528 - DNA, 25 bp, Mus musculus
tataagaggagcagcttggccccac

SEQ ID NO: 753529 - DNA, 25 bp, Mus musculus
tataagaggagctgcttggccccac

SEQ ID NO: 753530 - DNA, 25 bp, Mus musculus
tataagaggataaggcttgagatca

SEQ ID NO: 753531 - DNA, 25 bp, Mus musculus
tataagaggatatggcttgagatca

SEQ ID NO: 753532 - DNA, 25 bp, Mus musculus
tataagagtctccatgccctacagt

SEQ ID NO: 753533 - DNA, 25 bp, Mus musculus
tataagagtctcgatgccctacagt

SEQ ID NO: 753534 - DNA, 25 bp, Mus musculus
tataagagtgtaatcgccaacaagc

SEQ ID NO: 753535 - DNA, 25 bp, Mus musculus
tataagagtgtattcgccaacaagc

SEQ ID NO: 753536 - DNA, 25 bp, Mus musculus
tataagatcatcagcgacaaagatg

SEQ ID NO: 753537 - DNA, 25 bp, Mus musculus
tataagatcatctgcgacaaagatg

SEQ ID NO: 753538 - DNA, 25 bp, Mus musculus
tataagatccggatccgcattgatg

SEQ ID NO: 753539 - DNA, 25 bp, Mus musculus
tataagatccggttccgcattgatg

SEQ ID NO: 753540 - DNA, 25 bp, Mus musculus
tataagatgattcttgagaaaggca

SEQ ID NO: 753541 - DNA, 25 bp, Mus musculus
tataagatgattgttgagaaaggca

SEQ ID NO: 753542 - DNA, 25 bp, Mus musculus
tataagatgccgatagaggtgctag

SEQ ID NO: 753543 - DNA, 25 bp, Mus musculus
tataagatgccgttagaggtgctag

SEQ ID NO: 753544 - DNA, 25 bp, Mus musculus
tataagcaaaaacggagtgaggcca

SEQ ID NO: 753545 - DNA, 25 bp, Mus musculus
tataagcaaaaagggagtgaggcca

SEQ ID NO: 753546 - DNA, 25 bp, Mus musculus
tataagcaagaaaataaccacgttt

SEQ ID NO: 753547 - DNA, 25 bp, Mus musculus
tataagcaagaatataaccacgttt

SEQ ID NO: 753548 - DNA, 25 bp, Mus musculus
tataagccattaaaatatcatcctg

SEQ ID NO: 753549 - DNA, 25 bp, Mus musculus
tataagccattataatatcatcctg

SEQ ID NO: 753550 - DNA, 25 bp, Mus musculus
tataagcgagatcgttttgcaaaca

SEQ ID NO: 753551 - DNA, 25 bp, Mus musculus
tataagcgagatggttttgcaaaca

SEQ ID NO: 753552 - DNA, 25 bp, Mus musculus
tataagcggcgtcttcgaacgcgcc

SEQ ID NO: 753553 - DNA, 25 bp, Mus musculus
tataagcggcgtgttcgaacgcgcc

SEQ ID NO: 753554 - DNA, 25 bp, Mus musculus
tataagctggagacttacctgaaga

SEQ ID NO: 753555 - DNA, 25 bp, Mus musculus
tataagctggagtcttacctgaaga

SEQ ID NO: 753556 - DNA, 25 bp, Mus musculus
tataagcttgataggcatcgcttta

SEQ ID NO: 753557 - DNA, 25 bp, Mus musculus
tataagcttgattggcatcgcttta

SEQ ID NO: 753558 - DNA, 25 bp, Mus musculus
tataaggaaaaaccaagcactcagc

SEQ ID NO: 753559 - DNA, 25 bp, Mus musculus
tataaggaaaaagcaagcactcagc

SEQ ID NO: 753560 - DNA, 25 bp, Mus musculus
tataaggaatttcccatacaaaatc

SEQ ID NO: 753561 - DNA, 25 bp, Mus musculus
tataaggaatttgccatacaaaatc

SEQ ID NO: 753562 - DNA, 25 bp, Mus musculus
tataaggactttcacaagcctacgg

SEQ ID NO: 753563 - DNA, 25 bp, Mus musculus
tataaggactttgacaagcctacgg

SEQ ID NO: 753564 - DNA, 25 bp, Mus musculus
tataaggagcttcggaagccactgg

SEQ ID NO: 753565 - DNA, 25 bp, Mus musculus
tataaggagcttgggaagccactgg

SEQ ID NO: 753566 - DNA, 25 bp, Mus musculus
tataaggcagtaaggcttatcttct

SEQ ID NO: 753567 - DNA, 25 bp, Mus musculus
tataaggcagtatggcttatcttct

SEQ ID NO: 753568 - DNA, 25 bp, Mus musculus
tataaggctattcgataaaataacc

SEQ ID NO: 753569 - DNA, 25 bp, Mus musculus
tataaggctattggataaaataacc

SEQ ID NO: 753570 - DNA, 25 bp, Mus musculus
tataaggctggaaggccttgtgctg

SEQ ID NO: 753571 - DNA, 25 bp, Mus musculus
tataaggctggatggccttgtgctg

SEQ ID NO: 753572 - DNA, 25 bp, Mus musculus
tataagggaagtagcactgaacact

SEQ ID NO: 753573 - DNA, 25 bp, Mus musculus
tataagggaagttgcactgaacact

SEQ ID NO: 753574 - DNA, 25 bp, Mus musculus
tataagggcgcacaagacgctctct

SEQ ID NO: 753575 - DNA, 25 bp, Mus musculus
tataagggcgcagaagacgctctct

SEQ ID NO: 753576 - DNA, 25 bp, Mus musculus
tataagggtgaactagcctcctatg

SEQ ID NO: 753577 - DNA, 25 bp, Mus musculus
tataagggtgaagtagcctcctatg

SEQ ID NO: 753578 - DNA, 25 bp, Mus musculus
tataagggtgacctagccaggtaca

SEQ ID NO: 753579 - DNA, 25 bp, Mus musculus
tataagggtgacgtagccaggtaca

SEQ ID NO: 753580 - DNA, 25 bp, Mus musculus
tataagggtgtgatccaagctatcc

SEQ ID NO: 753581 - DNA, 25 bp, Mus musculus
tataagggtgtgttccaagctatcc

SEQ ID NO: 753582 - DNA, 25 bp, Mus musculus
tataaggtcgatcggcagtcatgcc

SEQ ID NO: 753583 - DNA, 25 bp, Mus musculus
tataaggtcgatgggcagtcatgcc

SEQ ID NO: 753584 - DNA, 25 bp, Mus musculus
tataaggtgaacatcatggcgtcac

SEQ ID NO: 753585 - DNA, 25 bp, Mus musculus
tataaggtgaacttcatggcgtcac

SEQ ID NO: 753586 - DNA, 25 bp, Mus musculus
tataaggttcatagatgggcgtggt

SEQ ID NO: 753587 - DNA, 25 bp, Mus musculus
tataaggttcattgatgggcgtggt

SEQ ID NO: 753588 - DNA, 25 bp, Mus musculus
tataaggttcctcaccactggtacc

SEQ ID NO: 753589 - DNA, 25 bp, Mus musculus
tataaggttcctgaccactggtacc

SEQ ID NO: 753590 - DNA, 25 bp, Mus musculus
tataagtattaaaagaagccttcct

SEQ ID NO: 753591 - DNA, 25 bp, Mus musculus
tataagtattaatagaagccttcct

SEQ ID NO: 753592 - DNA, 25 bp, Mus musculus
tataagtcagatacagggaagcctt

SEQ ID NO: 753593 - DNA, 25 bp, Mus musculus
tataagtcagattcagggaagcctt

SEQ ID NO: 753594 - DNA, 25 bp, Mus musculus
tataagtcgctgaaggtgtggtcca

SEQ ID NO: 753595 - DNA, 25 bp, Mus musculus
tataagtcgctgtaggtgtggtcca

SEQ ID NO: 753596 - DNA, 25 bp, Mus musculus
tataagtgatttcctggccagagcg

SEQ ID NO: 753597 - DNA, 25 bp, Mus musculus
tataagtgatttgctggccagagcg

SEQ ID NO: 753598 - DNA, 25 bp, Mus musculus
tataagtgcaacctgtgcgaccacg

SEQ ID NO: 753599 - DNA, 25 bp, Mus musculus
tataagtgcaacgtgtgcgaccacg

SEQ ID NO: 753600 - DNA, 25 bp, Mus musculus
tataagtgcttgaggaaacctgact

SEQ ID NO: 753601 - DNA, 25 bp, Mus musculus
tataagtgcttgtggaaacctgact

SEQ ID NO: 753602 - DNA, 25 bp, Mus musculus
tataagtggttgcaagctaaccctt

SEQ ID NO: 753603 - DNA, 25 bp, Mus musculus
tataagtggttggaagctaaccctt

SEQ ID NO: 753604 - DNA, 25 bp, Mus musculus
tataagtgtgacaacgggttttcac

SEQ ID NO: 753605 - DNA, 25 bp, Mus musculus
tataagtgtgactacgggttttcac

SEQ ID NO: 753606 - DNA, 25 bp, Mus musculus
tataagttctgaccagtgggctgac

SEQ ID NO: 753607 - DNA, 25 bp, Mus musculus
tataagttctgagcagtgggctgac

SEQ ID NO: 753608 - DNA, 25 bp, Mus musculus
tataagttggcgctgagcttccagc

SEQ ID NO: 753609 - DNA, 25 bp, Mus musculus
tataagttggcggtgagcttccagc

SEQ ID NO: 753610 - DNA, 25 bp, Mus musculus
tataagtttgaactggacacctctg

SEQ ID NO: 753611 - DNA, 25 bp, Mus musculus
tataagtttgaagtggacacctctg

SEQ ID NO: 753612 - DNA, 25 bp, Mus musculus
tataataaaaggatcgatggtgtct

SEQ ID NO: 753613 - DNA, 25 bp, Mus musculus
tataataaaaggttcgatggtgtct

SEQ ID NO: 753614 - DNA, 25 bp, Mus musculus
tataataagtgtaaacaactcttgc

SEQ ID NO: 753615 - DNA, 25 bp, Mus musculus
tataataagtgttaacaactcttgc

SEQ ID NO: 753616 - DNA, 25 bp, Mus musculus
tataataattcccagaggcctctct

SEQ ID NO: 753617 - DNA, 25 bp, Mus musculus
tataataattccgagaggcctctct

SEQ ID NO: 753618 - DNA, 25 bp, Mus musculus
tataatacctgcactgtgtttgggc

SEQ ID NO: 753619 - DNA, 25 bp, Mus musculus
tataatacctgctctgtgtttgggc

SEQ ID NO: 753620 - DNA, 25 bp, Mus musculus
tataatagacataaggaaaattgct

SEQ ID NO: 753621 - DNA, 25 bp, Mus musculus
tataatagacattaggaaaattgct

SEQ ID NO: 753622 - DNA, 25 bp, Mus musculus
tataatagctttactgaggctaggc

SEQ ID NO: 753623 - DNA, 25 bp, Mus musculus
tataatagcttttctgaggctaggc

SEQ ID NO: 753624 - DNA, 25 bp, Mus musculus
tataataggaccagccagtgctcag

SEQ ID NO: 753625 - DNA, 25 bp, Mus musculus
tataataggacctgccagtgctcag

SEQ ID NO: 753626 - DNA, 25 bp, Mus musculus
tataatatcaagattgcacccctgt

SEQ ID NO: 753627 - DNA, 25 bp, Mus musculus
tataatatcaagtttgcacccctgt

SEQ ID NO: 753628 - DNA, 25 bp, Mus musculus
tataatcacatacgctatgggcaca

SEQ ID NO: 753629 - DNA, 25 bp, Mus musculus
tataatcacataggctatgggcaca

SEQ ID NO: 753630 - DNA, 25 bp, Mus musculus
tataatcagataaaatagctcttcc

SEQ ID NO: 753631 - DNA, 25 bp, Mus musculus
tataatcagatataatagctcttcc

SEQ ID NO: 753632 - DNA, 25 bp, Mus musculus
tataatcccgagcgaaaagttgcca

SEQ ID NO: 753633 - DNA, 25 bp, Mus musculus
tataatcccgagggaaaagttgcca

SEQ ID NO: 753634 - DNA, 25 bp, Mus musculus
tataatccggtgcaagtgtccatgc

SEQ ID NO: 753635 - DNA, 25 bp, Mus musculus
tataatccggtggaagtgtccatgc

SEQ ID NO: 753636 - DNA, 25 bp, Mus musculus
tataatcctagtcccaacatgtacg

SEQ ID NO: 753637 - DNA, 25 bp, Mus musculus
tataatcctagtgccaacatgtacg

SEQ ID NO: 753638 - DNA, 25 bp, Mus musculus
tataatcctcttcatgagccaggcc

SEQ ID NO: 753639 - DNA, 25 bp, Mus musculus
tataatcctcttgatgagccaggcc

SEQ ID NO: 753640 - DNA, 25 bp, Mus musculus
tataatctcgtaaaagaaaccatgc

SEQ ID NO: 753641 - DNA, 25 bp, Mus musculus
tataatctcgtataagaaaccatgc

SEQ ID NO: 753642 - DNA, 25 bp, Mus musculus
tataatctctataccgccacacacg

SEQ ID NO: 753643 - DNA, 25 bp, Mus musculus
tataatctctattccgccacacacg

SEQ ID NO: 753644 - DNA, 25 bp, Mus musculus
tataatctgattagagctaaggcct

SEQ ID NO: 753645 - DNA, 25 bp, Mus musculus
tataatctgatttgagctaaggcct

SEQ ID NO: 753646 - DNA, 25 bp, Mus musculus
tataatgaaattaagcggctcactc

SEQ ID NO: 753647 - DNA, 25 bp, Mus musculus
tataatgaaatttagcggctcactc

SEQ ID NO: 753648 - DNA, 25 bp, Mus musculus
tataatgaagtcagtcccaggtggg

SEQ ID NO: 753649 - DNA, 25 bp, Mus musculus
tataatgaagtctgtcccaggtggg

SEQ ID NO: 753650 - DNA, 25 bp, Mus musculus
tataatgacgtgcatgtgcagaaga

SEQ ID NO: 753651 - DNA, 25 bp, Mus musculus
tataatgacgtggatgtgcagaaga

SEQ ID NO: 753652 - DNA, 25 bp, Mus musculus
tataatgacttcataaacaaggaac

SEQ ID NO: 753653 - DNA, 25 bp, Mus musculus
tataatgacttcttaaacaaggaac

SEQ ID NO: 753654 - DNA, 25 bp, Mus musculus
tataatgattacctgcgggcagctc

SEQ ID NO: 753655 - DNA, 25 bp, Mus musculus
tataatgattacgtgcgggcagctc

SEQ ID NO: 753656 - DNA, 25 bp, Mus musculus
tataatgcacaaagaattgaactgc

SEQ ID NO: 753657 - DNA, 25 bp, Mus musculus
tataatgcacaatgaattgaactgc

SEQ ID NO: 753658 - DNA, 25 bp, Mus musculus
tataatgccaccacacctctagagc

SEQ ID NO: 753659 - DNA, 25 bp, Mus musculus
tataatgccacctcacctctagagc

SEQ ID NO: 753660 - DNA, 25 bp, Mus musculus
tataatgcccagagcgatgctttgc

SEQ ID NO: 753661 - DNA, 25 bp, Mus musculus
tataatgcccagtgcgatgctttgc

SEQ ID NO: 753662 - DNA, 25 bp, Mus musculus
tataatgcccatctgtaaaaactgg

SEQ ID NO: 753663 - DNA, 25 bp, Mus musculus
tataatgcccatgtgtaaaaactgg

SEQ ID NO: 753664 - DNA, 25 bp, Mus musculus
tataatgccgacaacgatctgtcag

SEQ ID NO: 753665 - DNA, 25 bp, Mus musculus
tataatgccgactacgatctgtcag

SEQ ID NO: 753666 - DNA, 25 bp, Mus musculus
tataatgcgaagaatgcctacacga

SEQ ID NO: 753667 - DNA, 25 bp, Mus musculus
tataatgcgaagtatgcctacacga

SEQ ID NO: 753668 - DNA, 25 bp, Mus musculus
tataatgctaccatccttgcttctg

SEQ ID NO: 753669 - DNA, 25 bp, Mus musculus
tataatgctaccttccttgcttctg

SEQ ID NO: 753670 - DNA, 25 bp, Mus musculus
tataatggaataactgactgggttt

SEQ ID NO: 753671 - DNA, 25 bp, Mus musculus
tataatggaatatctgactgggttt

SEQ ID NO: 753672 - DNA, 25 bp, Mus musculus
tataatggactacctctctctgccc

SEQ ID NO: 753673 - DNA, 25 bp, Mus musculus
tataatggactagctctctctgccc

SEQ ID NO: 753674 - DNA, 25 bp, Mus musculus
tataatggcgtacatgtcattggct

SEQ ID NO: 753675 - DNA, 25 bp, Mus musculus
tataatggcgtagatgtcattggct

SEQ ID NO: 753676 - DNA, 25 bp, Mus musculus
tataatgggctactatgctgtcgac

SEQ ID NO: 753677 - DNA, 25 bp, Mus musculus
tataatgggctagtatgctgtcgac

SEQ ID NO: 753678 - DNA, 25 bp, Mus musculus
tataatggtgggactcgtcctgccc

SEQ ID NO: 753679 - DNA, 25 bp, Mus musculus
tataatggtgggtctcgtcctgccc

SEQ ID NO: 753680 - DNA, 25 bp, Mus musculus
tataatgtcgtgctcttagcctgcc

SEQ ID NO: 753681 - DNA, 25 bp, Mus musculus
tataatgtcgtggtcttagcctgcc

SEQ ID NO: 753682 - DNA, 25 bp, Mus musculus
tataatgtggagatttttcgacagt

SEQ ID NO: 753683 - DNA, 25 bp, Mus musculus
tataatgtggagttttttcgacagt

SEQ ID NO: 753684 - DNA, 25 bp, Mus musculus
tataattactgaaccactgactgtg

SEQ ID NO: 753685 - DNA, 25 bp, Mus musculus
tataattactgatccactgactgtg

SEQ ID NO: 753686 - DNA, 25 bp, Mus musculus
tataattatcaaacatccagctttc

SEQ ID NO: 753687 - DNA, 25 bp, Mus musculus
tataattatcaatcatccagctttc

SEQ ID NO: 753688 - DNA, 25 bp, Mus musculus
tataattccattctgagttctgtat

SEQ ID NO: 753689 - DNA, 25 bp, Mus musculus
tataattccattgtgagttctgtat

SEQ ID NO: 753690 - DNA, 25 bp, Mus musculus
tataattcttctatccaccatggta

SEQ ID NO: 753691 - DNA, 25 bp, Mus musculus
tataattcttctttccaccatggta

SEQ ID NO: 753692 - DNA, 25 bp, Mus musculus
tataattggcctcatgaatcatttg

SEQ ID NO: 753693 - DNA, 25 bp, Mus musculus
tataattggcctgatgaatcatttg

SEQ ID NO: 753694 - DNA, 25 bp, Mus musculus
tataattttcttcatccagcctcat

SEQ ID NO: 753695 - DNA, 25 bp, Mus musculus
tataattttcttgatccagcctcat

SEQ ID NO: 753696 - DNA, 25 bp, Mus musculus
tatacaaaagccctcacaagggtga

SEQ ID NO: 753697 - DNA, 25 bp, Mus musculus
tatacaaaagccgtcacaagggtga

SEQ ID NO: 753698 - DNA, 25 bp, Mus musculus
tatacaaaagctctcccgtttccct

SEQ ID NO: 753699 - DNA, 25 bp, Mus musculus
tatacaaaagctgtcccgtttccct

SEQ ID NO: 753700 - DNA, 25 bp, Mus musculus
tatacaaacgaaacgtagggctgga

SEQ ID NO: 753701 - DNA, 25 bp, Mus musculus
tatacaaacgaatcgtagggctgga

SEQ ID NO: 753702 - DNA, 25 bp, Mus musculus
tatacaaatctgacacaaggagcaa

SEQ ID NO: 753703 - DNA, 25 bp, Mus musculus
tatacaaatctgtcacaaggagcaa

SEQ ID NO: 753704 - DNA, 25 bp, Mus musculus
tatacaaatgagaacgtggctatca

SEQ ID NO: 753705 - DNA, 25 bp, Mus musculus
tatacaaatgagtacgtggctatca

SEQ ID NO: 753706 - DNA, 25 bp, Mus musculus
tatacaacaaccaaatcacaccagc

SEQ ID NO: 753707 - DNA, 25 bp, Mus musculus
tatacaacaacctaatcacaccagc

SEQ ID NO: 753708 - DNA, 25 bp, Mus musculus
tatacaacacacagccctgcgggaa

SEQ ID NO: 753709 - DNA, 25 bp, Mus musculus
tatacaacacactgccctgcgggaa

SEQ ID NO: 753710 - DNA, 25 bp, Mus musculus
tatacaacatctacgccaaacacac

SEQ ID NO: 753711 - DNA, 25 bp, Mus musculus
tatacaacatctagcgatgtctgga

SEQ ID NO: 753712 - DNA, 25 bp, Mus musculus
tatacaacatcttcgccaaacacac

SEQ ID NO: 753713 - DNA, 25 bp, Mus musculus
tatacaacatcttgcgatgtctgga

SEQ ID NO: 753714 - DNA, 25 bp, Mus musculus
tatacaacctaaagacccgagaggg

SEQ ID NO: 753715 - DNA, 25 bp, Mus musculus
tatacaacctaatgacccgagaggg

SEQ ID NO: 753716 - DNA, 25 bp, Mus musculus
tatacaacctggcagatgtagcctg

SEQ ID NO: 753717 - DNA, 25 bp, Mus musculus
tatacaacctgggagatgtagcctg

SEQ ID NO: 753718 - DNA, 25 bp, Mus musculus
tatacaactcaaactctagctagtg

SEQ ID NO: 753719 - DNA, 25 bp, Mus musculus
tatacaactcaatctctagctagtg

SEQ ID NO: 753720 - DNA, 25 bp, Mus musculus
tatacaaggaggaaatggatttgga

SEQ ID NO: 753721 - DNA, 25 bp, Mus musculus
tatacaaggaggtaatggatttgga

SEQ ID NO: 753722 - DNA, 25 bp, Mus musculus
tatacaagtacaattctccaacggc

SEQ ID NO: 753723 - DNA, 25 bp, Mus musculus
tatacaagtacatttctccaacggc

SEQ ID NO: 753724 - DNA, 25 bp, Mus musculus
tatacaagtattagggtgagaccca

SEQ ID NO: 753725 - DNA, 25 bp, Mus musculus
tatacaagtatttgggtgagaccca

SEQ ID NO: 753726 - DNA, 25 bp, Mus musculus
tatacaagtgctctccctgagccag

SEQ ID NO: 753727 - DNA, 25 bp, Mus musculus
tatacaagtgctgtccctgagccag

SEQ ID NO: 753728 - DNA, 25 bp, Mus musculus
tatacaagtgttcagagcacgtgca

SEQ ID NO: 753729 - DNA, 25 bp, Mus musculus
tatacaagtgttgagagcacgtgca

SEQ ID NO: 753730 - DNA, 25 bp, Mus musculus
tatacaagttatacgatcggttgag

SEQ ID NO: 753731 - DNA, 25 bp, Mus musculus
tatacaagttattcgatcggttgag

SEQ ID NO: 753732 - DNA, 25 bp, Mus musculus
tatacaatgacaaatggaggcagca

SEQ ID NO: 753733 - DNA, 25 bp, Mus musculus
tatacaatgacatatggaggcagca

SEQ ID NO: 753734 - DNA, 25 bp, Mus musculus
tatacaatgccactcgtgtgcctga

SEQ ID NO: 753735 - DNA, 25 bp, Mus musculus
tatacaatgccagtcgtgtgcctga

SEQ ID NO: 753736 - DNA, 25 bp, Mus musculus
tatacaatgtggaatgaataaatca

SEQ ID NO: 753737 - DNA, 25 bp, Mus musculus
tatacaatgtggtatgaataaatca

SEQ ID NO: 753738 - DNA, 25 bp, Mus musculus
tatacaatttccatgcatatgccac

SEQ ID NO: 753739 - DNA, 25 bp, Mus musculus
tatacaatttccttgcatatgccac

SEQ ID NO: 753740 - DNA, 25 bp, Mus musculus
tatacacaaccactttccggcagaa

SEQ ID NO: 753741 - DNA, 25 bp, Mus musculus
tatacacaaccagtttccggcagaa

SEQ ID NO: 753742 - DNA, 25 bp, Mus musculus
tatacacacaccagtgcaagaagca

SEQ ID NO: 753743 - DNA, 25 bp, Mus musculus
tatacacacacctgtgcaagaagca

SEQ ID NO: 753744 - DNA, 25 bp, Mus musculus
tatacacactgaatgtgcggccaga

SEQ ID NO: 753745 - DNA, 25 bp, Mus musculus
tatacacactgattgtgcggccaga

SEQ ID NO: 753746 - DNA, 25 bp, Mus musculus
tatacacactgtatgagtggccgtg

SEQ ID NO: 753747 - DNA, 25 bp, Mus musculus
tatacacactgtttgagtggccgtg

SEQ ID NO: 753748 - DNA, 25 bp, Mus musculus
tatacacagataaggacacaggatg

SEQ ID NO: 753749 - DNA, 25 bp, Mus musculus
tatacacagatatggacacaggatg

SEQ ID NO: 753750 - DNA, 25 bp, Mus musculus
tatacaccatgaagaaggatcagta

SEQ ID NO: 753751 - DNA, 25 bp, Mus musculus
tatacaccatgatgaaggatcagta

SEQ ID NO: 753752 - DNA, 25 bp, Mus musculus
tatacacccagcagtagtcatattt

SEQ ID NO: 753753 - DNA, 25 bp, Mus musculus
tatacacccagctgtagtcatattt

SEQ ID NO: 753754 - DNA, 25 bp, Mus musculus
tatacacctgtgattcttgccctga

SEQ ID NO: 753755 - DNA, 25 bp, Mus musculus
tatacacctgtgtttcttgccctga

SEQ ID NO: 753756 - DNA, 25 bp, Mus musculus
tatacactccgtccatcatgacagt

SEQ ID NO: 753757 - DNA, 25 bp, Mus musculus
tatacactccgtgcatcatgacagt

SEQ ID NO: 753758 - DNA, 25 bp, Mus musculus
tatacactgctcacgtcccagcgtg

SEQ ID NO: 753759 - DNA, 25 bp, Mus musculus
tatacactgctctcgtcccagcgtg

SEQ ID NO: 753760 - DNA, 25 bp, Mus musculus
tatacactggtccacggaccaagtc

SEQ ID NO: 753761 - DNA, 25 bp, Mus musculus
tatacactggtcgacggaccaagtc

SEQ ID NO: 753762 - DNA, 25 bp, Mus musculus
tatacactgtccaaggtagccggtg

SEQ ID NO: 753763 - DNA, 25 bp, Mus musculus
tatacactgtcctaggtagccggtg

SEQ ID NO: 753764 - DNA, 25 bp, Mus musculus
tatacacttgagcttctgattagag

SEQ ID NO: 753765 - DNA, 25 bp, Mus musculus
tatacacttgaggttctgattagag

SEQ ID NO: 753766 - DNA, 25 bp, Mus musculus
tatacagaaaaccaagtcctcagag

SEQ ID NO: 753767 - DNA, 25 bp, Mus musculus
tatacagaaaacgaagtcctcagag

SEQ ID NO: 753768 - DNA, 25 bp, Mus musculus
tatacagatatccaatattactgca

SEQ ID NO: 753769 - DNA, 25 bp, Mus musculus
tatacagatatcgaatattactgca

SEQ ID NO: 753770 - DNA, 25 bp, Mus musculus
tatacagcaaagacaagtccattct

SEQ ID NO: 753771 - DNA, 25 bp, Mus musculus
tatacagcaaagtcaagtccattct

SEQ ID NO: 753772 - DNA, 25 bp, Mus musculus
tatacagcatctccctaaaggagtt

SEQ ID NO: 753773 - DNA, 25 bp, Mus musculus
tatacagcatctgcctaaaggagtt

SEQ ID NO: 753774 - DNA, 25 bp, Mus musculus
tatacagcctacatcaccctcaatg

SEQ ID NO: 753775 - DNA, 25 bp, Mus musculus
tatacagcctacttcaccctcaatg

SEQ ID NO: 753776 - DNA, 25 bp, Mus musculus
tatacagcgtttcgagatctggaaa

SEQ ID NO: 753777 - DNA, 25 bp, Mus musculus
tatacagcgtttggagatctggaaa

SEQ ID NO: 753778 - DNA, 25 bp, Mus musculus
tatacagctcctcatgctaaactga

SEQ ID NO: 753779 - DNA, 25 bp, Mus musculus
tatacagctcctgatgctaaactga

SEQ ID NO: 753780 - DNA, 25 bp, Mus musculus
tatacaggaaacaggcaacaggtca

SEQ ID NO: 753781 - DNA, 25 bp, Mus musculus
tatacaggaaactggcaacaggtca

SEQ ID NO: 753782 - DNA, 25 bp, Mus musculus
tatacaggattgcttgaagatttgc

SEQ ID NO: 753783 - DNA, 25 bp, Mus musculus
tatacaggattggttgaagatttgc

SEQ ID NO: 753784 - DNA, 25 bp, Mus musculus
tatacaggcctgcttcagagctggc

SEQ ID NO: 753785 - DNA, 25 bp, Mus musculus
tatacaggcctggttcagagctggc

SEQ ID NO: 753786 - DNA, 25 bp, Mus musculus
tatacaggtgacagcaacagcacag

SEQ ID NO: 753787 - DNA, 25 bp, Mus musculus
tatacaggtgactgcaacagcacag

SEQ ID NO: 753788 - DNA, 25 bp, Mus musculus
tatacaggtggccaggactgcacag

SEQ ID NO: 753789 - DNA, 25 bp, Mus musculus
tatacaggtggcgaggactgcacag

SEQ ID NO: 753790 - DNA, 25 bp, Mus musculus
tatacagttaggcatttgttttctc

SEQ ID NO: 753791 - DNA, 25 bp, Mus musculus
tatacagttagggatttgttttctc

SEQ ID NO: 753792 - DNA, 25 bp, Mus musculus
tatacagttctgatgtctttgacct

SEQ ID NO: 753793 - DNA, 25 bp, Mus musculus
tatacagttctgttgtctttgacct

SEQ ID NO: 753794 - DNA, 25 bp, Mus musculus
tatacatatcatacacgggcacatg

SEQ ID NO: 753795 - DNA, 25 bp, Mus musculus
tatacatatcattcacgggcacatg

SEQ ID NO: 753796 - DNA, 25 bp, Mus musculus
tatacatcatgtaggccccgagttg

SEQ ID NO: 753797 - DNA, 25 bp, Mus musculus
tatacatcatgttggccccgagttg

SEQ ID NO: 753798 - DNA, 25 bp, Mus musculus
tatacatgctgtactcaagagatgg

SEQ ID NO: 753799 - DNA, 25 bp, Mus musculus
tatacatgctgttctcaagagatgg

SEQ ID NO: 753800 - DNA, 25 bp, Mus musculus
tatacatgtatcaccttccagcctg

SEQ ID NO: 753801 - DNA, 25 bp, Mus musculus
tatacatgtatctccttccagcctg

SEQ ID NO: 753802 - DNA, 25 bp, Mus musculus
tatacattagatagaaccatggtcc

SEQ ID NO: 753803 - DNA, 25 bp, Mus musculus
tatacattagattgaaccatggtcc

SEQ ID NO: 753804 - DNA, 25 bp, Mus musculus
tatacattcggcagacataattcac

SEQ ID NO: 753805 - DNA, 25 bp, Mus musculus
tatacattcggctgacataattcac

SEQ ID NO: 753806 - DNA, 25 bp, Mus musculus
tatacattgatgctccatttggaag

SEQ ID NO: 753807 - DNA, 25 bp, Mus musculus
tatacattgatggtccatttggaag

SEQ ID NO: 753808 - DNA, 25 bp, Mus musculus
tatacattgcgaaccaccctgtcct

SEQ ID NO: 753809 - DNA, 25 bp, Mus musculus
tatacattgcgatccaccctgtcct

SEQ ID NO: 753810 - DNA, 25 bp, Mus musculus
tatacatttgctctcatgctgagct

SEQ ID NO: 753811 - DNA, 25 bp, Mus musculus
tatacatttgctgtcatgctgagct

SEQ ID NO: 753812 - DNA, 25 bp, Mus musculus
tatacatttggaagcctcccagggc

SEQ ID NO: 753813 - DNA, 25 bp, Mus musculus
tatacatttggatgcctcccagggc

SEQ ID NO: 753814 - DNA, 25 bp, Mus musculus
tataccaagatcatcttgaacccgg

SEQ ID NO: 753815 - DNA, 25 bp, Mus musculus
tataccaagatcttcttgaacccgg

SEQ ID NO: 753816 - DNA, 25 bp, Mus musculus
tataccaagccaaatggtgacaaag

SEQ ID NO: 753817 - DNA, 25 bp, Mus musculus
tataccaagccatatggtgacaaag

SEQ ID NO: 753818 - DNA, 25 bp, Mus musculus
tataccacagataccaaaggctggc

SEQ ID NO: 753819 - DNA, 25 bp, Mus musculus
tataccacagattccaaaggctggc

SEQ ID NO: 753820 - DNA, 25 bp, Mus musculus
tataccacttgcagagcaagaacgg

SEQ ID NO: 753821 - DNA, 25 bp, Mus musculus
tataccacttgctgagcaagaacgg

SEQ ID NO: 753822 - DNA, 25 bp, Mus musculus
tataccagatgaagaagttcaacaa

SEQ ID NO: 753823 - DNA, 25 bp, Mus musculus
tataccagatgatgaagttcaacaa

SEQ ID NO: 753824 - DNA, 25 bp, Mus musculus
tataccagatttacaggcgccccac

SEQ ID NO: 753825 - DNA, 25 bp, Mus musculus
tataccagattttcaggcgccccac

SEQ ID NO: 753826 - DNA, 25 bp, Mus musculus
tataccagcgttataagatcaagat

SEQ ID NO: 753827 - DNA, 25 bp, Mus musculus
tataccagcgttttaagatcaagat

SEQ ID NO: 753828 - DNA, 25 bp, Mus musculus
tataccaggaatcagatagctgcca

SEQ ID NO: 753829 - DNA, 25 bp, Mus musculus
tataccaggaatgagatagctgcca

SEQ ID NO: 753830 - DNA, 25 bp, Mus musculus
tataccagggatcgaaaaggcctta

SEQ ID NO: 753831 - DNA, 25 bp, Mus musculus
tataccagggatggaaaaggcctta

SEQ ID NO: 753832 - DNA, 25 bp, Mus musculus
tataccaggtggaagaatacagcga

SEQ ID NO: 753833 - DNA, 25 bp, Mus musculus
tataccaggtggtagaatacagcga

SEQ ID NO: 753834 - DNA, 25 bp, Mus musculus
tataccagttggcaaactggtttta

SEQ ID NO: 753835 - DNA, 25 bp, Mus musculus
tataccagttgggaaactggtttta

SEQ ID NO: 753836 - DNA, 25 bp, Mus musculus
tataccataaagaggaggccccagc

SEQ ID NO: 753837 - DNA, 25 bp, Mus musculus
tataccataaagtggaggccccagc

SEQ ID NO: 753838 - DNA, 25 bp, Mus musculus
tataccatccataaagctagccaaa

SEQ ID NO: 753839 - DNA, 25 bp, Mus musculus
tataccatccattaagctagccaaa

SEQ ID NO: 753840 - DNA, 25 bp, Mus musculus
tataccatggagctgtgttgcctca

SEQ ID NO: 753841 - DNA, 25 bp, Mus musculus
tataccatggaggtgtgttgcctca

SEQ ID NO: 753842 - DNA, 25 bp, Mus musculus
tataccattcgcagatctccgtgca

SEQ ID NO: 753843 - DNA, 25 bp, Mus musculus
tataccattcgctgatctccgtgca

SEQ ID NO: 753844 - DNA, 25 bp, Mus musculus
tatacccaatacctatgacgcccat

SEQ ID NO: 753845 - DNA, 25 bp, Mus musculus
tatacccaatacgtatgacgcccat

SEQ ID NO: 753846 - DNA, 25 bp, Mus musculus
tatacccaccatcagtcactttggc

SEQ ID NO: 753847 - DNA, 25 bp, Mus musculus
tatacccaccatgagtcactttggc

SEQ ID NO: 753848 - DNA, 25 bp, Mus musculus
tatacccagggaaacttaggattcc

SEQ ID NO: 753849 - DNA, 25 bp, Mus musculus
tatacccagggatacttaggattcc

SEQ ID NO: 753850 - DNA, 25 bp, Mus musculus
tatacccagtgtcggctggaactgc

SEQ ID NO: 753851 - DNA, 25 bp, Mus musculus
tatacccagtgtgggctggaactgc

SEQ ID NO: 753852 - DNA, 25 bp, Mus musculus
tataccccaatgcagtataagggtg

SEQ ID NO: 753853 - DNA, 25 bp, Mus musculus
tataccccaatggagtataagggtg

SEQ ID NO: 753854 - DNA, 25 bp, Mus musculus
tatacccgagtgacatcctaccgga

SEQ ID NO: 753855 - DNA, 25 bp, Mus musculus
tatacccgagtgactgaccacaagc

SEQ ID NO: 753856 - DNA, 25 bp, Mus musculus
tatacccgagtgtcatcctaccgga

SEQ ID NO: 753857 - DNA, 25 bp, Mus musculus
tatacccgagtgtctgaccacaagc

SEQ ID NO: 753858 - DNA, 25 bp, Mus musculus
tatacccggtgtcttttgctgcagc

SEQ ID NO: 753859 - DNA, 25 bp, Mus musculus
tatacccggtgtgttttgctgcagc

SEQ ID NO: 753860 - DNA, 25 bp, Mus musculus
tataccctctgaacagccgaagacg

SEQ ID NO: 753861 - DNA, 25 bp, Mus musculus
tataccctctgatcagccgaagacg

SEQ ID NO: 753862 - DNA, 25 bp, Mus musculus
tataccctgcgcaggtaccatcgag

SEQ ID NO: 753863 - DNA, 25 bp, Mus musculus
tataccctgcgctggtaccatcgag

SEQ ID NO: 753864 - DNA, 25 bp, Mus musculus
tatacccttgatatgacctgtgtgg

SEQ ID NO: 753865 - DNA, 25 bp, Mus musculus
tatacccttgatttgacctgtgtgg

SEQ ID NO: 753866 - DNA, 25 bp, Mus musculus
tataccgaaaagaagttctacagaa

SEQ ID NO: 753867 - DNA, 25 bp, Mus musculus
tataccgaaaagtagttctacagaa

SEQ ID NO: 753868 - DNA, 25 bp, Mus musculus
tataccgaggtgaccagattctgag

SEQ ID NO: 753869 - DNA, 25 bp, Mus musculus
tataccgaggtgtccagattctgag

SEQ ID NO: 753870 - DNA, 25 bp, Mus musculus
tataccgcagttatgagcgcttccg

SEQ ID NO: 753871 - DNA, 25 bp, Mus musculus
tataccgcagttttgagcgcttccg

SEQ ID NO: 753872 - DNA, 25 bp, Mus musculus
tataccgctcatagtattgggcgga

SEQ ID NO: 753873 - DNA, 25 bp, Mus musculus
tataccgctcattgtattgggcgga

SEQ ID NO: 753874 - DNA, 25 bp, Mus musculus
tataccggtgaacgagacaccgtgc

SEQ ID NO: 753875 - DNA, 25 bp, Mus musculus
tataccggtgaaggagacaccgtgc

SEQ ID NO: 753876 - DNA, 25 bp, Mus musculus
tataccgttaagattgactcattgc

SEQ ID NO: 753877 - DNA, 25 bp, Mus musculus
tataccgttaagtttgactcattgc

SEQ ID NO: 753878 - DNA, 25 bp, Mus musculus
tatacctaattaaatagtctgtgca

SEQ ID NO: 753879 - DNA, 25 bp, Mus musculus
tatacctaattatatagtctgtgca

SEQ ID NO: 753880 - DNA, 25 bp, Mus musculus
tatacctactgaatctttggtggac

SEQ ID NO: 753881 - DNA, 25 bp, Mus musculus
tatacctactgattctttggtggac

SEQ ID NO: 753882 - DNA, 25 bp, Mus musculus
tatacctccatcatcgcagatgatt

SEQ ID NO: 753883 - DNA, 25 bp, Mus musculus
tatacctccatcttcgcagatgatt

SEQ ID NO: 753884 - DNA, 25 bp, Mus musculus
tatacctccggaagctgtcggatga

SEQ ID NO: 753885 - DNA, 25 bp, Mus musculus
tatacctccggatgctgtcggatga

SEQ ID NO: 753886 - DNA, 25 bp, Mus musculus
tatacctcgcccacaaggatgtgga

SEQ ID NO: 753887 - DNA, 25 bp, Mus musculus
tatacctcgccctcaaggatgtgga

SEQ ID NO: 753888 - DNA, 25 bp, Mus musculus
tatacctcgtgcatgatggctttga

SEQ ID NO: 753889 - DNA, 25 bp, Mus musculus
tatacctcgtgcttgatggctttga

SEQ ID NO: 753890 - DNA, 25 bp, Mus musculus
tatacctcttcaagatcatatggca

SEQ ID NO: 753891 - DNA, 25 bp, Mus musculus
tatacctcttcatgatcatatggca

SEQ ID NO: 753892 - DNA, 25 bp, Mus musculus
tatacctgagcaaaatccctaccgc

SEQ ID NO: 753893 - DNA, 25 bp, Mus musculus
tatacctgagcataatccctaccgc

SEQ ID NO: 753894 - DNA, 25 bp, Mus musculus
tatacctggaggatgacgatcccgt

SEQ ID NO: 753895 - DNA, 25 bp, Mus musculus
tatacctggaggttgacgatcccgt

SEQ ID NO: 753896 - DNA, 25 bp, Mus musculus
tatacctggttaacagtggatgtgc

SEQ ID NO: 753897 - DNA, 25 bp, Mus musculus
tatacctggttatcagtggatgtgc

SEQ ID NO: 753898 - DNA, 25 bp, Mus musculus
tatacctgtgatcccggcttcaggc

SEQ ID NO: 753899 - DNA, 25 bp, Mus musculus
tatacctgtgatgccggcttcaggc

SEQ ID NO: 753900 - DNA, 25 bp, Mus musculus
tatacctgtgcaaagatacgaagtc

SEQ ID NO: 753901 - DNA, 25 bp, Mus musculus
tatacctgtgcatagatacgaagtc

SEQ ID NO: 753902 - DNA, 25 bp, Mus musculus
tataccttaggactacttttgagga

SEQ ID NO: 753903 - DNA, 25 bp, Mus musculus
tataccttaggagtacttttgagga

SEQ ID NO: 753904 - DNA, 25 bp, Mus musculus
tataccttgggcaacagtgtttctc

SEQ ID NO: 753905 - DNA, 25 bp, Mus musculus
tataccttgggctacagtgtttctc

SEQ ID NO: 753906 - DNA, 25 bp, Mus musculus
tatacgaagcagagccgcaacccct

SEQ ID NO: 753907 - DNA, 25 bp, Mus musculus
tatacgaagcagtgccgcaacccct

SEQ ID NO: 753908 - DNA, 25 bp, Mus musculus
tatacgaattagctgttgccaatac

SEQ ID NO: 753909 - DNA, 25 bp, Mus musculus
tatacgaattaggtgttgccaatac

SEQ ID NO: 753910 - DNA, 25 bp, Mus musculus
tatacgatgtagacccaggaggatt

SEQ ID NO: 753911 - DNA, 25 bp, Mus musculus
tatacgatgtagtcccaggaggatt

SEQ ID NO: 753912 - DNA, 25 bp, Mus musculus
tatacgcactacatttcttcagccc

SEQ ID NO: 753913 - DNA, 25 bp, Mus musculus
tatacgcactacttttcttcagccc

SEQ ID NO: 753914 - DNA, 25 bp, Mus musculus
tatacgcaggcaatcgacctctggt

SEQ ID NO: 753915 - DNA, 25 bp, Mus musculus
tatacgcaggcattcgacctctggt

SEQ ID NO: 753916 - DNA, 25 bp, Mus musculus
tatacgcctcgcagggcgctctgct

SEQ ID NO: 753917 - DNA, 25 bp, Mus musculus
tatacgcctcgctgggcgctctgct

SEQ ID NO: 753918 - DNA, 25 bp, Mus musculus
tatacgcggtgaagcacttctctgt

SEQ ID NO: 753919 - DNA, 25 bp, Mus musculus
tatacgcggtgatgcacttctctgt

SEQ ID NO: 753920 - DNA, 25 bp, Mus musculus
tatacgctgctgagaaggtcatggg

SEQ ID NO: 753921 - DNA, 25 bp, Mus musculus
tatacgctgctgtgaaggtcatggg

SEQ ID NO: 753922 - DNA, 25 bp, Mus musculus
tatacggcatggaatagtcatcacc

SEQ ID NO: 753923 - DNA, 25 bp, Mus musculus
tatacggcatggtatagtcatcacc

SEQ ID NO: 753924 - DNA, 25 bp, Mus musculus
tatacggcgatgctgctgctaatca

SEQ ID NO: 753925 - DNA, 25 bp, Mus musculus
tatacggcgatggtgctgctaatca

SEQ ID NO: 753926 - DNA, 25 bp, Mus musculus
tatacgggaaaaagtacatacgtgt

SEQ ID NO: 753927 - DNA, 25 bp, Mus musculus
tatacgggaaaatgtacatacgtgt

SEQ ID NO: 753928 - DNA, 25 bp, Mus musculus
tatacggtacgtcagaagatacagt

SEQ ID NO: 753929 - DNA, 25 bp, Mus musculus
tatacggtacgtgagaagatacagt

SEQ ID NO: 753930 - DNA, 25 bp, Mus musculus
tatacggtcacacatcagaggaaca

SEQ ID NO: 753931 - DNA, 25 bp, Mus musculus
tatacggtcacagatcagaggaaca

SEQ ID NO: 753932 - DNA, 25 bp, Mus musculus
tatacgtcaccaaggtgatgagcaa

SEQ ID NO: 753933 - DNA, 25 bp, Mus musculus
tatacgtcaccatggtgatgagcaa

SEQ ID NO: 753934 - DNA, 25 bp, Mus musculus
tatacgtcgtgcatgtgatgagcaa

SEQ ID NO: 753935 - DNA, 25 bp, Mus musculus
tatacgtcgtgcttgtgatgagcaa

SEQ ID NO: 753936 - DNA, 25 bp, Mus musculus
tatactaatcatattctgctgtgcc

SEQ ID NO: 753937 - DNA, 25 bp, Mus musculus
tatactaatcattttctgctgtgcc

SEQ ID NO: 753938 - DNA, 25 bp, Mus musculus
tatactataggcagtttgcggccgc

SEQ ID NO: 753939 - DNA, 25 bp, Mus musculus
tatactataggctgtttgcggccgc

SEQ ID NO: 753940 - DNA, 25 bp, Mus musculus
tatactatgcgacccttccacgagg

SEQ ID NO: 753941 - DNA, 25 bp, Mus musculus
tatactatgcgagccttccacgagg

SEQ ID NO: 753942 - DNA, 25 bp, Mus musculus
tatactcaatgcagtccaagtcctc

SEQ ID NO: 753943 - DNA, 25 bp, Mus musculus
tatactcaatgctgtccaagtcctc

SEQ ID NO: 753944 - DNA, 25 bp, Mus musculus
tatactcccgttaggtgcatgagac

SEQ ID NO: 753945 - DNA, 25 bp, Mus musculus
tatactcccgtttggtgcatgagac

SEQ ID NO: 753946 - DNA, 25 bp, Mus musculus
tatactcctgagcttaccaaagcct

SEQ ID NO: 753947 - DNA, 25 bp, Mus musculus
tatactcctgaggttaccaaagcct

SEQ ID NO: 753948 - DNA, 25 bp, Mus musculus
tatactcctgcaacctagtcactgg

SEQ ID NO: 753949 - DNA, 25 bp, Mus musculus
tatactcctgcatcctagtcactgg

SEQ ID NO: 753950 - DNA, 25 bp, Mus musculus
tatactcctgtgagtggccacttta

SEQ ID NO: 753951 - DNA, 25 bp, Mus musculus
tatactcctgtgtgtggccacttta

SEQ ID NO: 753952 - DNA, 25 bp, Mus musculus
tatactcgaaatcttgtggatcaag

SEQ ID NO: 753953 - DNA, 25 bp, Mus musculus
tatactcgaaatgttgtggatcaag

SEQ ID NO: 753954 - DNA, 25 bp, Mus musculus
tatactcgaggcagttgcgggaacg

SEQ ID NO: 753955 - DNA, 25 bp, Mus musculus
tatactcgaggctgttgcgggaacg

SEQ ID NO: 753956 - DNA, 25 bp, Mus musculus
tatactcgcattctgccctctgtac

SEQ ID NO: 753957 - DNA, 25 bp, Mus musculus
tatactcgcattgtgccctctgtac

SEQ ID NO: 753958 - DNA, 25 bp, Mus musculus
tatactctagagactcggcccaacc

SEQ ID NO: 753959 - DNA, 25 bp, Mus musculus
tatactctagagtctcggcccaacc

SEQ ID NO: 753960 - DNA, 25 bp, Mus musculus
tatactctatatatgggcaggaagc

SEQ ID NO: 753961 - DNA, 25 bp, Mus musculus
tatactctatatttgggcaggaagc

SEQ ID NO: 753962 - DNA, 25 bp, Mus musculus
tatactctggagcatcgtgatggtt

SEQ ID NO: 753963 - DNA, 25 bp, Mus musculus
tatactctggaggatcgtgatggtt

SEQ ID NO: 753964 - DNA, 25 bp, Mus musculus
tatactctgggaagcaaccgacatg

SEQ ID NO: 753965 - DNA, 25 bp, Mus musculus
tatactctgggatgcaaccgacatg

SEQ ID NO: 753966 - DNA, 25 bp, Mus musculus
tatactctgtgacaaatttagtggc

SEQ ID NO: 753967 - DNA, 25 bp, Mus musculus
tatactctgtgagaaatttagtggc

SEQ ID NO: 753968 - DNA, 25 bp, Mus musculus
tatactcttcagaggcgtctcagac

SEQ ID NO: 753969 - DNA, 25 bp, Mus musculus
tatactcttcagtggcgtctcagac

SEQ ID NO: 753970 - DNA, 25 bp, Mus musculus
tatactgacagaaaccaggtgcctt

SEQ ID NO: 753971 - DNA, 25 bp, Mus musculus
tatactgacagataccaggtgcctt

SEQ ID NO: 753972 - DNA, 25 bp, Mus musculus
tatactgagtacaaatgttcaaaag

SEQ ID NO: 753973 - DNA, 25 bp, Mus musculus
tatactgagtactaatgttcaaaag

SEQ ID NO: 753974 - DNA, 25 bp, Mus musculus
tatactgatgctccacctgcatatt

SEQ ID NO: 753975 - DNA, 25 bp, Mus musculus
tatactgatgctgcacctgcatatt

SEQ ID NO: 753976 - DNA, 25 bp, Mus musculus
tatactgcatgtagagagctcgcca

SEQ ID NO: 753977 - DNA, 25 bp, Mus musculus
tatactgcatgttgagagctcgcca

SEQ ID NO: 753978 - DNA, 25 bp, Mus musculus
tatactgcccgtctctttgatatct

SEQ ID NO: 753979 - DNA, 25 bp, Mus musculus
tatactgcccgtgtctttgatatct

SEQ ID NO: 753980 - DNA, 25 bp, Mus musculus
tatactgcgaaacccagtgtgactc

SEQ ID NO: 753981 - DNA, 25 bp, Mus musculus
tatactgcgaaagccagtgtgactc

SEQ ID NO: 753982 - DNA, 25 bp, Mus musculus
tatactgcttttatgaagcgggtgc

SEQ ID NO: 753983 - DNA, 25 bp, Mus musculus
tatactgcttttttgaagcgggtgc

SEQ ID NO: 753984 - DNA, 25 bp, Mus musculus
tatactggaaatcctcagattgctg

SEQ ID NO: 753985 - DNA, 25 bp, Mus musculus
tatactggaaatgctcagattgctg

SEQ ID NO: 753986 - DNA, 25 bp, Mus musculus
tatactggcatcctgatctacgcac

SEQ ID NO: 753987 - DNA, 25 bp, Mus musculus
tatactggcatcgtgatctacgcac

SEQ ID NO: 753988 - DNA, 25 bp, Mus musculus
tatactggctggagttacgtgtcaa

SEQ ID NO: 753989 - DNA, 25 bp, Mus musculus
tatactggctggctagaccactggg

SEQ ID NO: 753990 - DNA, 25 bp, Mus musculus
tatactggctgggtagaccactggg

SEQ ID NO: 753991 - DNA, 25 bp, Mus musculus
tatactggctggtgttacgtgtcaa

SEQ ID NO: 753992 - DNA, 25 bp, Mus musculus
tatactgggacaccatttagtctga

SEQ ID NO: 753993 - DNA, 25 bp, Mus musculus
tatactgggacagcatttagtctga

SEQ ID NO: 753994 - DNA, 25 bp, Mus musculus
tatactgggagaacaaaatcgtgcg

SEQ ID NO: 753995 - DNA, 25 bp, Mus musculus
tatactgggagatcaaaatcgtgcg

SEQ ID NO: 753996 - DNA, 25 bp, Mus musculus
tatactgggccaaaatgataacaga

SEQ ID NO: 753997 - DNA, 25 bp, Mus musculus
tatactgggccataatgataacaga

SEQ ID NO: 753998 - DNA, 25 bp, Mus musculus
tatactgggttaactttgggaaatg

SEQ ID NO: 753999 - DNA, 25 bp, Mus musculus
tatactgggttatctttgggaaatg

SEQ ID NO: 754000 - DNA, 25 bp, Mus musculus
tatactggttgaaggactgtctgca

SEQ ID NO: 754001 - DNA, 25 bp, Mus musculus
tatactggttgacctttgctgtggg

SEQ ID NO: 754002 - DNA, 25 bp, Mus musculus
tatactggttgagctttgctgtggg

SEQ ID NO: 754003 - DNA, 25 bp, Mus musculus
tatactggttgatggactgtctgca

SEQ ID NO: 754004 - DNA, 25 bp, Mus musculus
tatactgtaaagaccgcgtgcacgc

SEQ ID NO: 754005 - DNA, 25 bp, Mus musculus
tatactgtaaagtccgcgtgcacgc

SEQ ID NO: 754006 - DNA, 25 bp, Mus musculus
tatactgtctacagcattttccggc

SEQ ID NO: 754007 - DNA, 25 bp, Mus musculus
tatactgtctactgcattttccggc

SEQ ID NO: 754008 - DNA, 25 bp, Mus musculus
tatactgtggtcctgtgcattggac

SEQ ID NO: 754009 - DNA, 25 bp, Mus musculus
tatactgtggtcgtgtgcattggac

SEQ ID NO: 754010 - DNA, 25 bp, Mus musculus
tatacttagtggaagaacatgggtc

SEQ ID NO: 754011 - DNA, 25 bp, Mus musculus
tatacttagtggtagaacatgggtc

SEQ ID NO: 754012 - DNA, 25 bp, Mus musculus
tatacttgaaggctcccatgattct

SEQ ID NO: 754013 - DNA, 25 bp, Mus musculus
tatacttgaagggtcccatgattct

SEQ ID NO: 754014 - DNA, 25 bp, Mus musculus
tatacttggtcgaagcctgtgacac

SEQ ID NO: 754015 - DNA, 25 bp, Mus musculus
tatacttggtcgtagcctgtgacac

SEQ ID NO: 754016 - DNA, 25 bp, Mus musculus
tatacttgtgacagttgacagttcg

SEQ ID NO: 754017 - DNA, 25 bp, Mus musculus
tatacttgtgactgttgacagttcg

SEQ ID NO: 754018 - DNA, 25 bp, Mus musculus
tatactttaagtccctgaaaggtgg

SEQ ID NO: 754019 - DNA, 25 bp, Mus musculus
tatactttaagtgcctgaaaggtgg

SEQ ID NO: 754020 - DNA, 25 bp, Mus musculus
tatactttcagactagctcagtgat

SEQ ID NO: 754021 - DNA, 25 bp, Mus musculus
tatactttcagagtagctcagtgat

SEQ ID NO: 754022 - DNA, 25 bp, Mus musculus
tatactttcattaaccctgcactgt

SEQ ID NO: 754023 - DNA, 25 bp, Mus musculus
tatactttcatttaccctgcactgt

SEQ ID NO: 754024 - DNA, 25 bp, Mus musculus
tatactttgaagactggcgggtacc

SEQ ID NO: 754025 - DNA, 25 bp, Mus musculus
tatactttgaagtctggcgggtacc

SEQ ID NO: 754026 - DNA, 25 bp, Mus musculus
tatagaaaatcacgacagcatccac

SEQ ID NO: 754027 - DNA, 25 bp, Mus musculus
tatagaaaatcaggacagcatccac

SEQ ID NO: 754028 - DNA, 25 bp, Mus musculus
tatagaaacctcagacttggaaacc

SEQ ID NO: 754029 - DNA, 25 bp, Mus musculus
tatagaaacctctgacttggaaacc

SEQ ID NO: 754030 - DNA, 25 bp, Mus musculus
tatagaaactggctctgtgtgtacc

SEQ ID NO: 754031 - DNA, 25 bp, Mus musculus
tatagaaactgggtctgtgtgtacc

SEQ ID NO: 754032 - DNA, 25 bp, Mus musculus
tatagaaactttcactaccggaagc

SEQ ID NO: 754033 - DNA, 25 bp, Mus musculus
tatagaaactttgactaccggaagc

SEQ ID NO: 754034 - DNA, 25 bp, Mus musculus
tatagaaagcatctaggagactggt

SEQ ID NO: 754035 - DNA, 25 bp, Mus musculus
tatagaaagcatgtaggagactggt

SEQ ID NO: 754036 - DNA, 25 bp, Mus musculus
tatagaaagtctctaggccaaacct

SEQ ID NO: 754037 - DNA, 25 bp, Mus musculus
tatagaaagtctgtaggccaaacct

SEQ ID NO: 754038 - DNA, 25 bp, Mus musculus
tatagaaatatacaggcctgcaagg

SEQ ID NO: 754039 - DNA, 25 bp, Mus musculus
tatagaaatatagaggcctgcaagg

SEQ ID NO: 754040 - DNA, 25 bp, Mus musculus
tatagaaattggagtgtcagatccg

SEQ ID NO: 754041 - DNA, 25 bp, Mus musculus
tatagaaattggtgtgtcagatccg

SEQ ID NO: 754042 - DNA, 25 bp, Mus musculus
tatagaacggcccatcctgcgcatc

SEQ ID NO: 754043 - DNA, 25 bp, Mus musculus
tatagaacggccgatcctgcgcatc

SEQ ID NO: 754044 - DNA, 25 bp, Mus musculus
tatagaacttatagaatgcaggccc

SEQ ID NO: 754045 - DNA, 25 bp, Mus musculus
tatagaacttattgaatgcaggccc

SEQ ID NO: 754046 - DNA, 25 bp, Mus musculus
tatagaagagcgcatgtctgtggtc

SEQ ID NO: 754047 - DNA, 25 bp, Mus musculus
tatagaagagcggatgtctgtggtc

SEQ ID NO: 754048 - DNA, 25 bp, Mus musculus
tatagaagccaaatcaccaggaggt

SEQ ID NO: 754049 - DNA, 25 bp, Mus musculus
tatagaagccaattcaccaggaggt

SEQ ID NO: 754050 - DNA, 25 bp, Mus musculus
tatagaaggctgactggtgaagaat

SEQ ID NO: 754051 - DNA, 25 bp, Mus musculus
tatagaaggctgtctggtgaagaat

SEQ ID NO: 754052 - DNA, 25 bp, Mus musculus
tatagaagggaaccacagagcattg

SEQ ID NO: 754053 - DNA, 25 bp, Mus musculus
tatagaagggaagcacagagcattg

SEQ ID NO: 754054 - DNA, 25 bp, Mus musculus
tatagaaggtatcaagggccaaact

SEQ ID NO: 754055 - DNA, 25 bp, Mus musculus
tatagaaggtatgaagggccaaact

SEQ ID NO: 754056 - DNA, 25 bp, Mus musculus
tatagaagtggaatggtttgccctg

SEQ ID NO: 754057 - DNA, 25 bp, Mus musculus
tatagaagtggattggtttgccctg

SEQ ID NO: 754058 - DNA, 25 bp, Mus musculus
tatagaatgcatcagatacatagca

SEQ ID NO: 754059 - DNA, 25 bp, Mus musculus
tatagaatgcatgagatacatagca

SEQ ID NO: 754060 - DNA, 25 bp, Mus musculus
tatagacaagatcgatgtgtgcccc

SEQ ID NO: 754061 - DNA, 25 bp, Mus musculus
tatagacaagatggatgtgtgcccc

SEQ ID NO: 754062 - DNA, 25 bp, Mus musculus
tatagacaccctacactcaaagtcc

SEQ ID NO: 754063 - DNA, 25 bp, Mus musculus
tatagacacccttcactcaaagtcc

SEQ ID NO: 754064 - DNA, 25 bp, Mus musculus
tatagacagaatcagcaccagtgct

SEQ ID NO: 754065 - DNA, 25 bp, Mus musculus
tatagacagaatgagcaccagtgct

SEQ ID NO: 754066 - DNA, 25 bp, Mus musculus
tatagacattgccattaggccacac

SEQ ID NO: 754067 - DNA, 25 bp, Mus musculus
tatagacattgcgattaggccacac

SEQ ID NO: 754068 - DNA, 25 bp, Mus musculus
tatagaccagcccaaggaagaatat

SEQ ID NO: 754069 - DNA, 25 bp, Mus musculus
tatagaccagccgaaggaagaatat

SEQ ID NO: 754070 - DNA, 25 bp, Mus musculus
tatagaccaggcatcgtttgccagc

SEQ ID NO: 754071 - DNA, 25 bp, Mus musculus
tatagaccaggcttcgtttgccagc

SEQ ID NO: 754072 - DNA, 25 bp, Mus musculus
tatagaccaggtcagcgaggacgat

SEQ ID NO: 754073 - DNA, 25 bp, Mus musculus
tatagaccaggtgagcgaggacgat

SEQ ID NO: 754074 - DNA, 25 bp, Mus musculus
tatagaccccagcttactacagatc

SEQ ID NO: 754075 - DNA, 25 bp, Mus musculus
tatagaccccaggttactacagatc

SEQ ID NO: 754076 - DNA, 25 bp, Mus musculus
tatagacgaactccttctgtggccg

SEQ ID NO: 754077 - DNA, 25 bp, Mus musculus
tatagacgaactgcttctgtggccg

SEQ ID NO: 754078 - DNA, 25 bp, Mus musculus
tatagacttcggacacattcttggg

SEQ ID NO: 754079 - DNA, 25 bp, Mus musculus
tatagacttcggtcacattcttggg

SEQ ID NO: 754080 - DNA, 25 bp, Mus musculus
tatagagaggatagcctggagcaca

SEQ ID NO: 754081 - DNA, 25 bp, Mus musculus
tatagagaggattgcctggagcaca

SEQ ID NO: 754082 - DNA, 25 bp, Mus musculus
tatagagatcacatatcgagcgaag

SEQ ID NO: 754083 - DNA, 25 bp, Mus musculus
tatagagatcacttatcgagcgaag

SEQ ID NO: 754084 - DNA, 25 bp, Mus musculus
tatagagatgagcagtccgtgtccc

SEQ ID NO: 754085 - DNA, 25 bp, Mus musculus
tatagagatgaggagtccgtgtccc

SEQ ID NO: 754086 - DNA, 25 bp, Mus musculus
tatagagcaaggaactgtcacaaga

SEQ ID NO: 754087 - DNA, 25 bp, Mus musculus
tatagagcaaggtactgtcacaaga

SEQ ID NO: 754088 - DNA, 25 bp, Mus musculus
tatagagcacaaaggaggcttcctg

SEQ ID NO: 754089 - DNA, 25 bp, Mus musculus
tatagagcacaatggaggcttcctg

SEQ ID NO: 754090 - DNA, 25 bp, Mus musculus
tatagagcatcaaagactgtgccca

SEQ ID NO: 754091 - DNA, 25 bp, Mus musculus
tatagagcatcatagactgtgccca

SEQ ID NO: 754092 - DNA, 25 bp, Mus musculus
tatagagcgcttaatcctaaaatca

SEQ ID NO: 754093 - DNA, 25 bp, Mus musculus
tatagagcgctttatcctaaaatca

SEQ ID NO: 754094 - DNA, 25 bp, Mus musculus
tatagagctactaacaacatctggt

SEQ ID NO: 754095 - DNA, 25 bp, Mus musculus
tatagagctacttacaacatctggt

SEQ ID NO: 754096 - DNA, 25 bp, Mus musculus
tatagaggaccacttccgtggcaca

SEQ ID NO: 754097 - DNA, 25 bp, Mus musculus
tatagaggaccagttccgtggcaca

SEQ ID NO: 754098 - DNA, 25 bp, Mus musculus
tatagaggcacaatctgaacgaact

SEQ ID NO: 754099 - DNA, 25 bp, Mus musculus
tatagaggcacattctgaacgaact

SEQ ID NO: 754100 - DNA, 25 bp, Mus musculus
tatagagtttctccgccccctgaaa

SEQ ID NO: 754101 - DNA, 25 bp, Mus musculus
tatagagtttctgcgccccctgaaa

SEQ ID NO: 754102 - DNA, 25 bp, Mus musculus
tatagataaaagctcagagccgggc

SEQ ID NO: 754103 - DNA, 25 bp, Mus musculus
tatagataaaaggtcagagccgggc

SEQ ID NO: 754104 - DNA, 25 bp, Mus musculus
tatagatacccgactcctgatgggc

SEQ ID NO: 754105 - DNA, 25 bp, Mus musculus
tatagatacccgtctcctgatgggc

SEQ ID NO: 754106 - DNA, 25 bp, Mus musculus
tatagatatagccaccctttgccca

SEQ ID NO: 754107 - DNA, 25 bp, Mus musculus
tatagatatagcgaccctttgccca

SEQ ID NO: 754108 - DNA, 25 bp, Mus musculus
tatagatcaaagaaaggcagatgtc

SEQ ID NO: 754109 - DNA, 25 bp, Mus musculus
tatagatcaaagtaaggcagatgtc

SEQ ID NO: 754110 - DNA, 25 bp, Mus musculus
tatagatgacgaagtcagcagcggc

SEQ ID NO: 754111 - DNA, 25 bp, Mus musculus
tatagatgacgatgtcagcagcggc

SEQ ID NO: 754112 - DNA, 25 bp, Mus musculus
tatagatgtggccatactcactgca

SEQ ID NO: 754113 - DNA, 25 bp, Mus musculus
tatagatgtggcgatactcactgca

SEQ ID NO: 754114 - DNA, 25 bp, Mus musculus
tatagattacgtccccatgttggac

SEQ ID NO: 754115 - DNA, 25 bp, Mus musculus
tatagattacgtgcccatgttggac

SEQ ID NO: 754116 - DNA, 25 bp, Mus musculus
tatagattagctctaacccgactgt

SEQ ID NO: 754117 - DNA, 25 bp, Mus musculus
tatagattagctgtaacccgactgt

SEQ ID NO: 754118 - DNA, 25 bp, Mus musculus
tatagattgtgtcggtgttggcctt

SEQ ID NO: 754119 - DNA, 25 bp, Mus musculus
tatagattgtgtgggtgttggcctt

SEQ ID NO: 754120 - DNA, 25 bp, Mus musculus
tatagcaacaatcaggatttccagg

SEQ ID NO: 754121 - DNA, 25 bp, Mus musculus
tatagcaacaatgaggatttccagg

SEQ ID NO: 754122 - DNA, 25 bp, Mus musculus
tatagcaacactcaagagtaactgg

SEQ ID NO: 754123 - DNA, 25 bp, Mus musculus
tatagcaacactgaagagtaactgg

SEQ ID NO: 754124 - DNA, 25 bp, Mus musculus
tatagcaaccttatcgctcaacatg

SEQ ID NO: 754125 - DNA, 25 bp, Mus musculus
tatagcaaccttttcgctcaacatg

SEQ ID NO: 754126 - DNA, 25 bp, Mus musculus
tatagcaatatgatccacaatggcc

SEQ ID NO: 754127 - DNA, 25 bp, Mus musculus
tatagcaatatgttccacaatggcc

SEQ ID NO: 754128 - DNA, 25 bp, Mus musculus
tatagcacatgaaggcttccagcag

SEQ ID NO: 754129 - DNA, 25 bp, Mus musculus
tatagcacatgatggcttccagcag

SEQ ID NO: 754130 - DNA, 25 bp, Mus musculus
tatagcaccacacgctctgtgagca

SEQ ID NO: 754131 - DNA, 25 bp, Mus musculus
tatagcaccacaggctctgtgagca

SEQ ID NO: 754132 - DNA, 25 bp, Mus musculus
tatagcacgtgtatgctggtggttc

SEQ ID NO: 754133 - DNA, 25 bp, Mus musculus
tatagcacgtgtttgctggtggttc

SEQ ID NO: 754134 - DNA, 25 bp, Mus musculus
tatagcactatgagaggccaaagag

SEQ ID NO: 754135 - DNA, 25 bp, Mus musculus
tatagcactatgtgaggccaaagag

SEQ ID NO: 754136 - DNA, 25 bp, Mus musculus
tatagcactgagctagcacctggcc

SEQ ID NO: 754137 - DNA, 25 bp, Mus musculus
tatagcactgaggtagcacctggcc

SEQ ID NO: 754138 - DNA, 25 bp, Mus musculus
tatagcagagaactcggtgctgttc

SEQ ID NO: 754139 - DNA, 25 bp, Mus musculus
tatagcagagaagtcggtgctgttc

SEQ ID NO: 754140 - DNA, 25 bp, Mus musculus
tatagcagagctaggtgtcccactg

SEQ ID NO: 754141 - DNA, 25 bp, Mus musculus
tatagcagagcttggtgtcccactg

SEQ ID NO: 754142 - DNA, 25 bp, Mus musculus
tatagcagcacgcttgtccaggagg

SEQ ID NO: 754143 - DNA, 25 bp, Mus musculus
tatagcagcacggttgtccaggagg

SEQ ID NO: 754144 - DNA, 25 bp, Mus musculus
tatagcagccggatgaggatgcgtc

SEQ ID NO: 754145 - DNA, 25 bp, Mus musculus
tatagcagccggttgaggatgcgtc

SEQ ID NO: 754146 - DNA, 25 bp, Mus musculus
tatagcagccttagctattcctcct

SEQ ID NO: 754147 - DNA, 25 bp, Mus musculus
tatagcagcctttgctattcctcct

SEQ ID NO: 754148 - DNA, 25 bp, Mus musculus
tatagcaggcagataggttccccag

SEQ ID NO: 754149 - DNA, 25 bp, Mus musculus
tatagcaggcagttaggttccccag

SEQ ID NO: 754150 - DNA, 25 bp, Mus musculus
tatagcatccttcaaggacaaccct

SEQ ID NO: 754151 - DNA, 25 bp, Mus musculus
tatagcatccttgaaggacaaccct

SEQ ID NO: 754152 - DNA, 25 bp, Mus musculus
tatagcatggaccttaccgggcaga

SEQ ID NO: 754153 - DNA, 25 bp, Mus musculus
tatagcatggacgttaccgggcaga

SEQ ID NO: 754154 - DNA, 25 bp, Mus musculus
tatagcatgttgaagaagcctgcct

SEQ ID NO: 754155 - DNA, 25 bp, Mus musculus
tatagcatgttgtagaagcctgcct

SEQ ID NO: 754156 - DNA, 25 bp, Mus musculus
tatagcattttgagggacttgaagt

SEQ ID NO: 754157 - DNA, 25 bp, Mus musculus
tatagcattttgtgggacttgaagt

SEQ ID NO: 754158 - DNA, 25 bp, Mus musculus
tatagccaaaaccaatagaacttgg

SEQ ID NO: 754159 - DNA, 25 bp, Mus musculus
tatagccaaaacgaatagaacttgg

SEQ ID NO: 754160 - DNA, 25 bp, Mus musculus
tatagccagaaacatgagggccctt

SEQ ID NO: 754161 - DNA, 25 bp, Mus musculus
tatagccagaaagatgagggccctt

SEQ ID NO: 754162 - DNA, 25 bp, Mus musculus
tatagccagatgagccaccaagacc

SEQ ID NO: 754163 - DNA, 25 bp, Mus musculus
tatagccagatgtgccaccaagacc

SEQ ID NO: 754164 - DNA, 25 bp, Mus musculus
tatagccctccgcaatgatgccgag

SEQ ID NO: 754165 - DNA, 25 bp, Mus musculus
tatagccctccggaatgatgccgag

SEQ ID NO: 754166 - DNA, 25 bp, Mus musculus
tatagccctgaaccaaagtttgtag

SEQ ID NO: 754167 - DNA, 25 bp, Mus musculus
tatagccctgaagcaaagtttgtag

SEQ ID NO: 754168 - DNA, 25 bp, Mus musculus
tatagcccttggatgcaggtagtgc

SEQ ID NO: 754169 - DNA, 25 bp, Mus musculus
tatagcccttggttgcaggtagtgc

SEQ ID NO: 754170 - DNA, 25 bp, Mus musculus
tatagccgacatcgaagtggatggc

SEQ ID NO: 754171 - DNA, 25 bp, Mus musculus
tatagccgacatggaagtggatggc

SEQ ID NO: 754172 - DNA, 25 bp, Mus musculus
tatagccgaggcagaaaccgttcat

SEQ ID NO: 754173 - DNA, 25 bp, Mus musculus
tatagccgaggctgaaaccgttcat

SEQ ID NO: 754174 - DNA, 25 bp, Mus musculus
tatagcctagacagctacctttcaa

SEQ ID NO: 754175 - DNA, 25 bp, Mus musculus
tatagcctagactgctacctttcaa

SEQ ID NO: 754176 - DNA, 25 bp, Mus musculus
tatagcctgtaaaggtcccatagcc

SEQ ID NO: 754177 - DNA, 25 bp, Mus musculus
tatagcctgtaatggtcccatagcc

SEQ ID NO: 754178 - DNA, 25 bp, Mus musculus
tatagcgaatctaggcgacattgac

SEQ ID NO: 754179 - DNA, 25 bp, Mus musculus
tatagcgaatcttggcgacattgac

SEQ ID NO: 754180 - DNA, 25 bp, Mus musculus
tatagcggcattaactagcgaggag

SEQ ID NO: 754181 - DNA, 25 bp, Mus musculus
tatagcggcatttactagcgaggag

SEQ ID NO: 754182 - DNA, 25 bp, Mus musculus
tatagcggctctacttaatgtagcc

SEQ ID NO: 754183 - DNA, 25 bp, Mus musculus
tatagcggctcttcttaatgtagcc

SEQ ID NO: 754184 - DNA, 25 bp, Mus musculus
tatagctcagcaaggaagatgtaaa

SEQ ID NO: 754185 - DNA, 25 bp, Mus musculus
tatagctcagcatggaagatgtaaa

SEQ ID NO: 754186 - DNA, 25 bp, Mus musculus
tatagctcatctctgataccccgga

SEQ ID NO: 754187 - DNA, 25 bp, Mus musculus
tatagctcatctgtgataccccgga

SEQ ID NO: 754188 - DNA, 25 bp, Mus musculus
tatagctccccccaggagtttgctc

SEQ ID NO: 754189 - DNA, 25 bp, Mus musculus
tatagctcccccgaggagtttgctc

SEQ ID NO: 754190 - DNA, 25 bp, Mus musculus
tatagctctcgtaagtgagtccctc

SEQ ID NO: 754191 - DNA, 25 bp, Mus musculus
tatagctctcgttagtgagtccctc

SEQ ID NO: 754192 - DNA, 25 bp, Mus musculus
tatagctgccaaatagttcctctgt

SEQ ID NO: 754193 - DNA, 25 bp, Mus musculus
tatagctgccaattagttcctctgt

SEQ ID NO: 754194 - DNA, 25 bp, Mus musculus
tatagctgctataggacctgagagc

SEQ ID NO: 754195 - DNA, 25 bp, Mus musculus
tatagctgctattggacctgagagc

SEQ ID NO: 754196 - DNA, 25 bp, Mus musculus
tatagctgctttaggagggaatcct

SEQ ID NO: 754197 - DNA, 25 bp, Mus musculus
tatagctgcttttggagggaatcct

SEQ ID NO: 754198 - DNA, 25 bp, Mus musculus
tatagctggcgcacagaaaaggacc

SEQ ID NO: 754199 - DNA, 25 bp, Mus musculus
tatagctggcgctcagaaaaggacc

SEQ ID NO: 754200 - DNA, 25 bp, Mus musculus
tatagctgggccatcaggcagtgct

SEQ ID NO: 754201 - DNA, 25 bp, Mus musculus
tatagctgggccttcaggcagtgct

SEQ ID NO: 754202 - DNA, 25 bp, Mus musculus
tatagctgtcttatgcaacctcgtc

SEQ ID NO: 754203 - DNA, 25 bp, Mus musculus
tatagctgtcttttgcaacctcgtc

SEQ ID NO: 754204 - DNA, 25 bp, Mus musculus
tatagctgtggaattcacctggcag

SEQ ID NO: 754205 - DNA, 25 bp, Mus musculus
tatagctgtggatttcacctggcag

SEQ ID NO: 754206 - DNA, 25 bp, Mus musculus
tataggaattggcagcaggtatcca

SEQ ID NO: 754207 - DNA, 25 bp, Mus musculus
tataggaattgggagcaggtatcca

SEQ ID NO: 754208 - DNA, 25 bp, Mus musculus
tataggacagataggtggaaatgtg

SEQ ID NO: 754209 - DNA, 25 bp, Mus musculus
tataggacagattggtggaaatgtg

SEQ ID NO: 754210 - DNA, 25 bp, Mus musculus
tataggacatagctcccagtgttac

SEQ ID NO: 754211 - DNA, 25 bp, Mus musculus
tataggacataggtcccagtgttac

SEQ ID NO: 754212 - DNA, 25 bp, Mus musculus
tataggacctgcaggaagatttact

SEQ ID NO: 754213 - DNA, 25 bp, Mus musculus
tataggacctgctggaagatttact

SEQ ID NO: 754214 - DNA, 25 bp, Mus musculus
tataggactatgcagccgccttgtg

SEQ ID NO: 754215 - DNA, 25 bp, Mus musculus
tataggactatggagccgccttgtg

SEQ ID NO: 754216 - DNA, 25 bp, Mus musculus
tataggactgccaatgaagcctggc

SEQ ID NO: 754217 - DNA, 25 bp, Mus musculus
tataggactgccatgaagctcagaa

SEQ ID NO: 754218 - DNA, 25 bp, Mus musculus
tataggactgcctatgaagcctggc

SEQ ID NO: 754219 - DNA, 25 bp, Mus musculus
tataggactgccttgaagctcagaa

SEQ ID NO: 754220 - DNA, 25 bp, Mus musculus
tataggacttaaaatgtcaaaagca

SEQ ID NO: 754221 - DNA, 25 bp, Mus musculus
tataggacttaatatgtcaaaagca

SEQ ID NO: 754222 - DNA, 25 bp, Mus musculus
tataggacttgtcattgagtatctc

SEQ ID NO: 754223 - DNA, 25 bp, Mus musculus
tataggacttgtgattgagtatctc

SEQ ID NO: 754224 - DNA, 25 bp, Mus musculus
tataggagacatcaaaacaggagca

SEQ ID NO: 754225 - DNA, 25 bp, Mus musculus
tataggagacatgaaaacaggagca

SEQ ID NO: 754226 - DNA, 25 bp, Mus musculus
tataggagctttactgaagactgga

SEQ ID NO: 754227 - DNA, 25 bp, Mus musculus
tataggagcttttctgaagactgga

SEQ ID NO: 754228 - DNA, 25 bp, Mus musculus
tataggagggatagctagcatgcca

SEQ ID NO: 754229 - DNA, 25 bp, Mus musculus
tataggagggattgctagcatgcca

SEQ ID NO: 754230 - DNA, 25 bp, Mus musculus
tataggcaaacgctaaagaggtcac

SEQ ID NO: 754231 - DNA, 25 bp, Mus musculus
tataggcaaacggtaaagaggtcac

SEQ ID NO: 754232 - DNA, 25 bp, Mus musculus
tataggccagccaaccctctggtag

SEQ ID NO: 754233 - DNA, 25 bp, Mus musculus
tataggccagcctaccctctggtag

SEQ ID NO: 754234 - DNA, 25 bp, Mus musculus
tataggcccagcatggaaggctacc

SEQ ID NO: 754235 - DNA, 25 bp, Mus musculus
tataggcccagcttggaaggctacc

SEQ ID NO: 754236 - DNA, 25 bp, Mus musculus
tataggcccttccaagaatccagag

SEQ ID NO: 754237 - DNA, 25 bp, Mus musculus
tataggcccttcgaagaatccagag

SEQ ID NO: 754238 - DNA, 25 bp, Mus musculus
tataggccgttccaaatctcgctct

SEQ ID NO: 754239 - DNA, 25 bp, Mus musculus
tataggccgttcgaaatctcgctct

SEQ ID NO: 754240 - DNA, 25 bp, Mus musculus
tataggcggaaacagagaaacccag

SEQ ID NO: 754241 - DNA, 25 bp, Mus musculus
tataggcggaaagagagaaacccag

SEQ ID NO: 754242 - DNA, 25 bp, Mus musculus
tataggcgtgtgcacaagccgccca

SEQ ID NO: 754243 - DNA, 25 bp, Mus musculus
tataggcgtgtggacaagccgccca

SEQ ID NO: 754244 - DNA, 25 bp, Mus musculus
tataggctgggaatctcaagaggac

SEQ ID NO: 754245 - DNA, 25 bp, Mus musculus
tataggctgggattctcaagaggac

SEQ ID NO: 754246 - DNA, 25 bp, Mus musculus
tataggctggtgagcacacgttggc

SEQ ID NO: 754247 - DNA, 25 bp, Mus musculus
tataggctggtgtgcacacgttggc

SEQ ID NO: 754248 - DNA, 25 bp, Mus musculus
tataggcttactcgatgcagaagac

SEQ ID NO: 754249 - DNA, 25 bp, Mus musculus
tataggcttactggatgcagaagac

SEQ ID NO: 754250 - DNA, 25 bp, Mus musculus
tatagggcaggccaaccagtctgcc

SEQ ID NO: 754251 - DNA, 25 bp, Mus musculus
tatagggcaggcgaaccagtctgcc

SEQ ID NO: 754252 - DNA, 25 bp, Mus musculus
tatagggcccctcagtggtgagttt

SEQ ID NO: 754253 - DNA, 25 bp, Mus musculus
tatagggcccctgagtggtgagttt

SEQ ID NO: 754254 - DNA, 25 bp, Mus musculus
tatagggtaggtcctctaggattcc

SEQ ID NO: 754255 - DNA, 25 bp, Mus musculus
tatagggtaggtgctctaggattcc

SEQ ID NO: 754256 - DNA, 25 bp, Mus musculus
tatagggtggttctagttccccagg

SEQ ID NO: 754257 - DNA, 25 bp, Mus musculus
tatagggtggttgtagttccccagg

SEQ ID NO: 754258 - DNA, 25 bp, Mus musculus
tataggtacttcactatctctcagc

SEQ ID NO: 754259 - DNA, 25 bp, Mus musculus
tataggtacttctctatctctcagc

SEQ ID NO: 754260 - DNA, 25 bp, Mus musculus
tataggtgcatgcacagcaactcgc

SEQ ID NO: 754261 - DNA, 25 bp, Mus musculus
tataggtgcatggacagcaactcgc

SEQ ID NO: 754262 - DNA, 25 bp, Mus musculus
tataggtgctttcctgcttacttaa

SEQ ID NO: 754263 - DNA, 25 bp, Mus musculus
tataggtgctttgctgcttacttaa

SEQ ID NO: 754264 - DNA, 25 bp, Mus musculus
tataggtgggaccaattttgcctat

SEQ ID NO: 754265 - DNA, 25 bp, Mus musculus
tataggtgggacgaattttgcctat

SEQ ID NO: 754266 - DNA, 25 bp, Mus musculus
tataggttcgtgcaaggcaaagact

SEQ ID NO: 754267 - DNA, 25 bp, Mus musculus
tataggttcgtggaaggcaaagact

SEQ ID NO: 754268 - DNA, 25 bp, Mus musculus
tataggttctgactcatgggcccgc

SEQ ID NO: 754269 - DNA, 25 bp, Mus musculus
tataggttctgagtcatgggcccgc

SEQ ID NO: 754270 - DNA, 25 bp, Mus musculus
tataggttgaacacagggccacttt

SEQ ID NO: 754271 - DNA, 25 bp, Mus musculus
tataggttgaactcagggccacttt

SEQ ID NO: 754272 - DNA, 25 bp, Mus musculus
tataggttgcatcctgatgggagaa

SEQ ID NO: 754273 - DNA, 25 bp, Mus musculus
tataggttgcatgctgatgggagaa

SEQ ID NO: 754274 - DNA, 25 bp, Mus musculus
tatagtaacaacatgaacatcagtg

SEQ ID NO: 754275 - DNA, 25 bp, Mus musculus
tatagtaacaacttgaacatcagtg

SEQ ID NO: 754276 - DNA, 25 bp, Mus musculus
tatagtaacctcagtcacctgcccg

SEQ ID NO: 754277 - DNA, 25 bp, Mus musculus
tatagtaacctctgtcacctgcccg

SEQ ID NO: 754278 - DNA, 25 bp, Mus musculus
tatagtaagactccaactggctcct

SEQ ID NO: 754279 - DNA, 25 bp, Mus musculus
tatagtaagactgcaactggctcct

SEQ ID NO: 754280 - DNA, 25 bp, Mus musculus
tatagtaagagtctagaaccttggg

SEQ ID NO: 754281 - DNA, 25 bp, Mus musculus
tatagtaagagtgtagaaccttggg

SEQ ID NO: 754282 - DNA, 25 bp, Mus musculus
tatagtaatgggagctaccaatcgc

SEQ ID NO: 754283 - DNA, 25 bp, Mus musculus
tatagtaatgggtgctaccaatcgc

SEQ ID NO: 754284 - DNA, 25 bp, Mus musculus
tatagtacccagaagaacaccggca

SEQ ID NO: 754285 - DNA, 25 bp, Mus musculus
tatagtacccagtagaacaccggca

SEQ ID NO: 754286 - DNA, 25 bp, Mus musculus
tatagtagaagacaggaaaaggcct

SEQ ID NO: 754287 - DNA, 25 bp, Mus musculus
tatagtagaagagaggaaaaggcct

SEQ ID NO: 754288 - DNA, 25 bp, Mus musculus
tatagtatagtgcacagcagagtgg

SEQ ID NO: 754289 - DNA, 25 bp, Mus musculus
tatagtatagtggacagcagagtgg

SEQ ID NO: 754290 - DNA, 25 bp, Mus musculus
tatagtatcaacactctggagatgg

SEQ ID NO: 754291 - DNA, 25 bp, Mus musculus
tatagtatcaactctctggagatgg

SEQ ID NO: 754292 - DNA, 25 bp, Mus musculus
tatagtatctacagcaccgaggacc

SEQ ID NO: 754293 - DNA, 25 bp, Mus musculus
tatagtatctactgcaccgaggacc

SEQ ID NO: 754294 - DNA, 25 bp, Mus musculus
tatagtcaaagcagggtcatgtggt

SEQ ID NO: 754295 - DNA, 25 bp, Mus musculus
tatagtcaaagctgggtcatgtggt

SEQ ID NO: 754296 - DNA, 25 bp, Mus musculus
tatagtcaacaactctcatgaagca

SEQ ID NO: 754297 - DNA, 25 bp, Mus musculus
tatagtcaacaagtctcatgaagca

SEQ ID NO: 754298 - DNA, 25 bp, Mus musculus
tatagtcaagctagcagagcagtat

SEQ ID NO: 754299 - DNA, 25 bp, Mus musculus
tatagtcaagcttgcagagcagtat

SEQ ID NO: 754300 - DNA, 25 bp, Mus musculus
tatagtcactggaatctgatcctca

SEQ ID NO: 754301 - DNA, 25 bp, Mus musculus
tatagtcactggtatctgatcctca

SEQ ID NO: 754302 - DNA, 25 bp, Mus musculus
tatagtccatttcccaggtctgaga

SEQ ID NO: 754303 - DNA, 25 bp, Mus musculus
tatagtccatttgccaggtctgaga

SEQ ID NO: 754304 - DNA, 25 bp, Mus musculus
tatagtccctacaagagggaggagg

SEQ ID NO: 754305 - DNA, 25 bp, Mus musculus
tatagtccctactagagggaggagg

SEQ ID NO: 754306 - DNA, 25 bp, Mus musculus
tatagtcctagcactcacgaagtgg

SEQ ID NO: 754307 - DNA, 25 bp, Mus musculus
tatagtcctagctctcacgaagtgg

SEQ ID NO: 754308 - DNA, 25 bp, Mus musculus
tatagtcctgatcagcacttctggg

SEQ ID NO: 754309 - DNA, 25 bp, Mus musculus
tatagtcctgatgagcacttctggg

SEQ ID NO: 754310 - DNA, 25 bp, Mus musculus
tatagtcgagttatctcaagaccag

SEQ ID NO: 754311 - DNA, 25 bp, Mus musculus
tatagtcgagttttctcaagaccag

SEQ ID NO: 754312 - DNA, 25 bp, Mus musculus
tatagtgaaagaagcctggctcggc

SEQ ID NO: 754313 - DNA, 25 bp, Mus musculus
tatagtgaaagatgcctggctcggc

SEQ ID NO: 754314 - DNA, 25 bp, Mus musculus
tatagtgacattagtggagctgggc

SEQ ID NO: 754315 - DNA, 25 bp, Mus musculus
tatagtgacatttgtggagctgggc

SEQ ID NO: 754316 - DNA, 25 bp, Mus musculus
tatagtgacgagatgcaagcatgtc

SEQ ID NO: 754317 - DNA, 25 bp, Mus musculus
tatagtgacgagttgcaagcatgtc

SEQ ID NO: 754318 - DNA, 25 bp, Mus musculus
tatagtgactccaaagagaagcgct

SEQ ID NO: 754319 - DNA, 25 bp, Mus musculus
tatagtgactcctaagagaagcgct

SEQ ID NO: 754320 - DNA, 25 bp, Mus musculus
tatagtgccaaaattgcctcctgtt

SEQ ID NO: 754321 - DNA, 25 bp, Mus musculus
tatagtgccaaatttgcctcctgtt

SEQ ID NO: 754322 - DNA, 25 bp, Mus musculus
tatagtggacagcagagtggctcca

SEQ ID NO: 754323 - DNA, 25 bp, Mus musculus
tatagtggacaggagagtggctcca

SEQ ID NO: 754324 - DNA, 25 bp, Mus musculus
tatagtggtaagatccacttcatga

SEQ ID NO: 754325 - DNA, 25 bp, Mus musculus
tatagtggtaagttccacttcatga

SEQ ID NO: 754326 - DNA, 25 bp, Mus musculus
tatagttcttcgaggttctacagac

SEQ ID NO: 754327 - DNA, 25 bp, Mus musculus
tatagttcttcgtggttctacagac

SEQ ID NO: 754328 - DNA, 25 bp, Mus musculus
tatagttgagaacccaaacatggtg

SEQ ID NO: 754329 - DNA, 25 bp, Mus musculus
tatagttgagaagccaaacatggtg

SEQ ID NO: 754330 - DNA, 25 bp, Mus musculus
tatagttgcaagagggaggccagcc

SEQ ID NO: 754331 - DNA, 25 bp, Mus musculus
tatagttgcaagtgggaggccagcc

SEQ ID NO: 754332 - DNA, 25 bp, Mus musculus
tatagttggcgtactcactctaact

SEQ ID NO: 754333 - DNA, 25 bp, Mus musculus
tatagttggcgttctcactctaact

SEQ ID NO: 754334 - DNA, 25 bp, Mus musculus
tatagttggtgcaggtctttcaggc

SEQ ID NO: 754335 - DNA, 25 bp, Mus musculus
tatagttggtgctggtctttcaggc

SEQ ID NO: 754336 - DNA, 25 bp, Mus musculus
tatagttgtcaacagagctgagcct

SEQ ID NO: 754337 - DNA, 25 bp, Mus musculus
tatagttgtcaagagagctgagcct

SEQ ID NO: 754338 - DNA, 25 bp, Mus musculus
tatagtttggccaaggagcagcgac

SEQ ID NO: 754339 - DNA, 25 bp, Mus musculus
tatagtttggcctaggagcagcgac

SEQ ID NO: 754340 - DNA, 25 bp, Mus musculus
tatataaaataacctgccctgctgg

SEQ ID NO: 754341 - DNA, 25 bp, Mus musculus
tatataaaataagctgccctgctgg

SEQ ID NO: 754342 - DNA, 25 bp, Mus musculus
tatataaacaagacagggacatcgc

SEQ ID NO: 754343 - DNA, 25 bp, Mus musculus
tatataaacaagtcagggacatcgc

SEQ ID NO: 754344 - DNA, 25 bp, Mus musculus
tatataaagagacgccgggcgtgcc

SEQ ID NO: 754345 - DNA, 25 bp, Mus musculus
tatataaagagaggccgggcgtgcc

SEQ ID NO: 754346 - DNA, 25 bp, Mus musculus
tatataacaggcaatctctctgctc

SEQ ID NO: 754347 - DNA, 25 bp, Mus musculus
tatataacaggctatctctctgctc

SEQ ID NO: 754348 - DNA, 25 bp, Mus musculus
tatataaccggcacatccattattg

SEQ ID NO: 754349 - DNA, 25 bp, Mus musculus
tatataaccggctcatccattattg

SEQ ID NO: 754350 - DNA, 25 bp, Mus musculus
tatataaggcaaagccctagaacct

SEQ ID NO: 754351 - DNA, 25 bp, Mus musculus
tatataaggcaatgccctagaacct

SEQ ID NO: 754352 - DNA, 25 bp, Mus musculus
tatataaggtgtaaagtcagcgaac

SEQ ID NO: 754353 - DNA, 25 bp, Mus musculus
tatataaggtgttaagtcagcgaac

SEQ ID NO: 754354 - DNA, 25 bp, Mus musculus
tatataagttctaccaagccaaggc

SEQ ID NO: 754355 - DNA, 25 bp, Mus musculus
tatataagttcttccaagccaaggc

SEQ ID NO: 754356 - DNA, 25 bp, Mus musculus
tatataatagatagagcctgtttcc

SEQ ID NO: 754357 - DNA, 25 bp, Mus musculus
tatataatagattgagcctgtttcc

SEQ ID NO: 754358 - DNA, 25 bp, Mus musculus
tatataatagttaactaatgagcct

SEQ ID NO: 754359 - DNA, 25 bp, Mus musculus
tatataatagtttactaatgagcct

SEQ ID NO: 754360 - DNA, 25 bp, Mus musculus
tatatacaggaaacaccgcgtcctt

SEQ ID NO: 754361 - DNA, 25 bp, Mus musculus
tatatacaggaatcaccgcgtcctt

SEQ ID NO: 754362 - DNA, 25 bp, Mus musculus
tatatacatttgagaatctagccaa

SEQ ID NO: 754363 - DNA, 25 bp, Mus musculus
tatatacatttgtgaatctagccaa

SEQ ID NO: 754364 - DNA, 25 bp, Mus musculus
tatatacccacgaatagacacgcat

SEQ ID NO: 754365 - DNA, 25 bp, Mus musculus
tatatacccacgtatagacacgcat

SEQ ID NO: 754366 - DNA, 25 bp, Mus musculus
tatataccctggaggagcaagatgc

SEQ ID NO: 754367 - DNA, 25 bp, Mus musculus
tatataccctggtggagcaagatgc

SEQ ID NO: 754368 - DNA, 25 bp, Mus musculus
tatatacgtggcagcaagatccgat

SEQ ID NO: 754369 - DNA, 25 bp, Mus musculus
tatatacgtggctgcaagatccgat

SEQ ID NO: 754370 - DNA, 25 bp, Mus musculus
tatatactgactaagcaatgtggcc

SEQ ID NO: 754371 - DNA, 25 bp, Mus musculus
tatatactgacttagcaatgtggcc

SEQ ID NO: 754372 - DNA, 25 bp, Mus musculus
tatatactgaggcaagtgaccctcc

SEQ ID NO: 754373 - DNA, 25 bp, Mus musculus
tatatactgagggaagtgaccctcc

SEQ ID NO: 754374 - DNA, 25 bp, Mus musculus
tatatactgtaaagtccgcgtgcac

SEQ ID NO: 754375 - DNA, 25 bp, Mus musculus
tatatactgtaatgtccgcgtgcac

SEQ ID NO: 754376 - DNA, 25 bp, Mus musculus
tatatagactccacagtccctgcag

SEQ ID NO: 754377 - DNA, 25 bp, Mus musculus
tatatagactcctcagtccctgcag

SEQ ID NO: 754378 - DNA, 25 bp, Mus musculus
tatatagccccacattcaattcgtg

SEQ ID NO: 754379 - DNA, 25 bp, Mus musculus
tatatagccccagattcaattcgtg

SEQ ID NO: 754380 - DNA, 25 bp, Mus musculus
tatatagctgaaatgctggctcaca

SEQ ID NO: 754381 - DNA, 25 bp, Mus musculus
tatatagctgaattgctggctcaca

SEQ ID NO: 754382 - DNA, 25 bp, Mus musculus
tatataggcaacaaggagacagagc

SEQ ID NO: 754383 - DNA, 25 bp, Mus musculus
tatataggcaactaggagacagagc

SEQ ID NO: 754384 - DNA, 25 bp, Mus musculus
tatataggcttcctggtgcggctgc

SEQ ID NO: 754385 - DNA, 25 bp, Mus musculus
tatataggcttcgtggtgcggctgc

SEQ ID NO: 754386 - DNA, 25 bp, Mus musculus
tatatagtgcgtctgagaacccacg

SEQ ID NO: 754387 - DNA, 25 bp, Mus musculus
tatatagtgcgtgtgagaacccacg

SEQ ID NO: 754388 - DNA, 25 bp, Mus musculus
tatatatactgtaaagtccgcgtgc

SEQ ID NO: 754389 - DNA, 25 bp, Mus musculus
tatatatactgttaagtccgcgtgc

SEQ ID NO: 754390 - DNA, 25 bp, Mus musculus
tatatatagagcatcctggactcca

SEQ ID NO: 754391 - DNA, 25 bp, Mus musculus
tatatatagagcttcctggactcca

SEQ ID NO: 754392 - DNA, 25 bp, Mus musculus
tatatatatactctaaagtccgcgt

SEQ ID NO: 754393 - DNA, 25 bp, Mus musculus
tatatatatactgtaaagtccgcgt

SEQ ID NO: 754394 - DNA, 25 bp, Mus musculus
tatatatcctcgacacgtccaacac

SEQ ID NO: 754395 - DNA, 25 bp, Mus musculus
tatatatcctcgtcacgtccaacac

SEQ ID NO: 754396 - DNA, 25 bp, Mus musculus
tatatatgcaggaggatttgggctg

SEQ ID NO: 754397 - DNA, 25 bp, Mus musculus
tatatatgcaggtggatttgggctg

SEQ ID NO: 754398 - DNA, 25 bp, Mus musculus
tatatatgccttacggagcccagag

SEQ ID NO: 754399 - DNA, 25 bp, Mus musculus
tatatatgcctttcggagcccagag

SEQ ID NO: 754400 - DNA, 25 bp, Mus musculus
tatatatggcccaagaacattttcc

SEQ ID NO: 754401 - DNA, 25 bp, Mus musculus
tatatatggccctagaacattttcc

SEQ ID NO: 754402 - DNA, 25 bp, Mus musculus
tatatatgtaccaaagccccttatg

SEQ ID NO: 754403 - DNA, 25 bp, Mus musculus
tatatatgtacctaagccccttatg

SEQ ID NO: 754404 - DNA, 25 bp, Mus musculus
tatatattgagaccacctatctctt

SEQ ID NO: 754405 - DNA, 25 bp, Mus musculus
tatatattgagagcacctatctctt

SEQ ID NO: 754406 - DNA, 25 bp, Mus musculus
tatatcaactgaaccttaaccaagg

SEQ ID NO: 754407 - DNA, 25 bp, Mus musculus
tatatcaactgatccttaaccaagg

SEQ ID NO: 754408 - DNA, 25 bp, Mus musculus
tatatcaaggagactccaaaccacc

SEQ ID NO: 754409 - DNA, 25 bp, Mus musculus
tatatcaaggagtctccaaaccacc

SEQ ID NO: 754410 - DNA, 25 bp, Mus musculus
tatatcaatactctgttcccaacag

SEQ ID NO: 754411 - DNA, 25 bp, Mus musculus
tatatcaatactgtgttcccaacag

SEQ ID NO: 754412 - DNA, 25 bp, Mus musculus
tatatcagcagacactccagtttgc

SEQ ID NO: 754413 - DNA, 25 bp, Mus musculus
tatatcagcagagactccagtttgc

SEQ ID NO: 754414 - DNA, 25 bp, Mus musculus
tatatcaggtacagctgtgatgatc

SEQ ID NO: 754415 - DNA, 25 bp, Mus musculus
tatatcaggtactgctgtgatgatc

SEQ ID NO: 754416 - DNA, 25 bp, Mus musculus
tatatcatctggattacgtggctgt

SEQ ID NO: 754417 - DNA, 25 bp, Mus musculus
tatatcatctggtttacgtggctgt

SEQ ID NO: 754418 - DNA, 25 bp, Mus musculus
tatatccacaagaagtgctcgaacg

SEQ ID NO: 754419 - DNA, 25 bp, Mus musculus
tatatccacaagtagtgctcgaacg

SEQ ID NO: 754420 - DNA, 25 bp, Mus musculus
tatatccacatcagcgatggctccg

SEQ ID NO: 754421 - DNA, 25 bp, Mus musculus
tatatccacatctgcgatggctccg

SEQ ID NO: 754422 - DNA, 25 bp, Mus musculus
tatatccagagcctgatggatttgg

SEQ ID NO: 754423 - DNA, 25 bp, Mus musculus
tatatccagagcgtgatggatttgg

SEQ ID NO: 754424 - DNA, 25 bp, Mus musculus
tatatccagtggcaggtccatctca

SEQ ID NO: 754425 - DNA, 25 bp, Mus musculus
tatatccagtgggaggtccatctca

SEQ ID NO: 754426 - DNA, 25 bp, Mus musculus
tatatccatagcaacccagtgatgt

SEQ ID NO: 754427 - DNA, 25 bp, Mus musculus
tatatccatagctacccagtgatgt

SEQ ID NO: 754428 - DNA, 25 bp, Mus musculus
tatatccatgccatcgtctcactgg

SEQ ID NO: 754429 - DNA, 25 bp, Mus musculus
tatatccatgccttcgtctcactgg

SEQ ID NO: 754430 - DNA, 25 bp, Mus musculus
tatatcccatagagtagagctctcg

SEQ ID NO: 754431 - DNA, 25 bp, Mus musculus
tatatcccatagtgtagagctctcg

SEQ ID NO: 754432 - DNA, 25 bp, Mus musculus
tatatcccctgaccctgcgttggga

SEQ ID NO: 754433 - DNA, 25 bp, Mus musculus
tatatcccctgagcctgcgttggga

SEQ ID NO: 754434 - DNA, 25 bp, Mus musculus
tatatccctatcactgctgcactga

SEQ ID NO: 754435 - DNA, 25 bp, Mus musculus
tatatccctatctctgctgcactga

SEQ ID NO: 754436 - DNA, 25 bp, Mus musculus
tatatccctgcgctcaagtgggacc

SEQ ID NO: 754437 - DNA, 25 bp, Mus musculus
tatatccctgcggtcaagtgggacc

SEQ ID NO: 754438 - DNA, 25 bp, Mus musculus
tatatccgcagtcgccacttcgaaa

SEQ ID NO: 754439 - DNA, 25 bp, Mus musculus
tatatccgcagtggccacttcgaaa

SEQ ID NO: 754440 - DNA, 25 bp, Mus musculus
tatatccggtcgaatcagacaatgg

SEQ ID NO: 754441 - DNA, 25 bp, Mus musculus
tatatccggtcgtatcagacaatgg

SEQ ID NO: 754442 - DNA, 25 bp, Mus musculus
tatatccgtgaactctcgtgtctgt

SEQ ID NO: 754443 - DNA, 25 bp, Mus musculus
tatatccgtgaagtctcgtgtctgt

SEQ ID NO: 754444 - DNA, 25 bp, Mus musculus
tatatcctatcccaagtgtcagcag

SEQ ID NO: 754445 - DNA, 25 bp, Mus musculus
tatatcctatccgaagtgtcagcag

SEQ ID NO: 754446 - DNA, 25 bp, Mus musculus
tatatcctcagaccttacatcttcc

SEQ ID NO: 754447 - DNA, 25 bp, Mus musculus
tatatcctcagagcttacatcttcc

SEQ ID NO: 754448 - DNA, 25 bp, Mus musculus
tatatcctgggaaaatatggacaga

SEQ ID NO: 754449 - DNA, 25 bp, Mus musculus
tatatcctgggataatatggacaga

SEQ ID NO: 754450 - DNA, 25 bp, Mus musculus
tatatccttgcccacaaagatgcca

SEQ ID NO: 754451 - DNA, 25 bp, Mus musculus
tatatccttgccgacaaagatgcca

SEQ ID NO: 754452 - DNA, 25 bp, Mus musculus
tatatcgacaccacctggagctgtg

SEQ ID NO: 754453 - DNA, 25 bp, Mus musculus
tatatcgacacctcctggagctgtg

SEQ ID NO: 754454 - DNA, 25 bp, Mus musculus
tatatcgagccaagggaccttacaa

SEQ ID NO: 754455 - DNA, 25 bp, Mus musculus
tatatcgagccatgggaccttacaa

SEQ ID NO: 754456 - DNA, 25 bp, Mus musculus
tatatcgctgtaacccctaaaagaa

SEQ ID NO: 754457 - DNA, 25 bp, Mus musculus
tatatcgctgtatcccctaaaagaa

SEQ ID NO: 754458 - DNA, 25 bp, Mus musculus
tatatctaggtgatttcagtacagg

SEQ ID NO: 754459 - DNA, 25 bp, Mus musculus
tatatctaggtgttttcagtacagg

SEQ ID NO: 754460 - DNA, 25 bp, Mus musculus
tatatctcagaacagggacactact

SEQ ID NO: 754461 - DNA, 25 bp, Mus musculus
tatatctcagaagagggacactact

SEQ ID NO: 754462 - DNA, 25 bp, Mus musculus
tatatctctgccagacaagaagccc

SEQ ID NO: 754463 - DNA, 25 bp, Mus musculus
tatatctctgcctgacaagaagccc

SEQ ID NO: 754464 - DNA, 25 bp, Mus musculus
tatatctgaatgatgctttccttga

SEQ ID NO: 754465 - DNA, 25 bp, Mus musculus
tatatctgaatgttgctttccttga

SEQ ID NO: 754466 - DNA, 25 bp, Mus musculus
tatatctgcagaaaggtgggctgca

SEQ ID NO: 754467 - DNA, 25 bp, Mus musculus
tatatctgcagataggtgggctgca

SEQ ID NO: 754468 - DNA, 25 bp, Mus musculus
tatatctgccataaccgcactgtca

SEQ ID NO: 754469 - DNA, 25 bp, Mus musculus
tatatctgccattaccgcactgtca

SEQ ID NO: 754470 - DNA, 25 bp, Mus musculus
tatatctggagaataggcacggacg

SEQ ID NO: 754471 - DNA, 25 bp, Mus musculus
tatatctggagattaggcacggacg

SEQ ID NO: 754472 - DNA, 25 bp, Mus musculus
tatatctggtagctctttgctctgg

SEQ ID NO: 754473 - DNA, 25 bp, Mus musculus
tatatctggtaggtctttgctctgg

SEQ ID NO: 754474 - DNA, 25 bp, Mus musculus
tatatctgtgaaaattgtgctcggg

SEQ ID NO: 754475 - DNA, 25 bp, Mus musculus
tatatctgtgaatattgtgctcggg

SEQ ID NO: 754476 - DNA, 25 bp, Mus musculus
tatatcttattcatctgaatgacca

SEQ ID NO: 754477 - DNA, 25 bp, Mus musculus
tatatcttattcttctgaatgacca

SEQ ID NO: 754478 - DNA, 25 bp, Mus musculus
tatatcttcaggatgatctacctag

SEQ ID NO: 754479 - DNA, 25 bp, Mus musculus
tatatcttcaggttgatctacctag

SEQ ID NO: 754480 - DNA, 25 bp, Mus musculus
tatatcttgaacagagacgctgcag

SEQ ID NO: 754481 - DNA, 25 bp, Mus musculus
tatatcttgaactgagacgctgcag

SEQ ID NO: 754482 - DNA, 25 bp, Mus musculus
tatatgaaaaccatggtgggcctcc

SEQ ID NO: 754483 - DNA, 25 bp, Mus musculus
tatatgaaaaccttggtgggcctcc

SEQ ID NO: 754484 - DNA, 25 bp, Mus musculus
tatatgaacatcctgcggttcctgg

SEQ ID NO: 754485 - DNA, 25 bp, Mus musculus
tatatgaacatcgtgcggttcctgg

SEQ ID NO: 754486 - DNA, 25 bp, Mus musculus
tatatgacttcgagcaggagggttc

SEQ ID NO: 754487 - DNA, 25 bp, Mus musculus
tatatgacttcgtgcaggagggttc

SEQ ID NO: 754488 - DNA, 25 bp, Mus musculus
tatatgagaggaaatttccagttcc

SEQ ID NO: 754489 - DNA, 25 bp, Mus musculus
tatatgagaggatatttccagttcc

SEQ ID NO: 754490 - DNA, 25 bp, Mus musculus
tatatgaggataatggctcctccag

SEQ ID NO: 754491 - DNA, 25 bp, Mus musculus
tatatgaggatattggctcctccag

SEQ ID NO: 754492 - DNA, 25 bp, Mus musculus
tatatgaggtgcacagagccggccg

SEQ ID NO: 754493 - DNA, 25 bp, Mus musculus
tatatgaggtgctcagagccggccg

SEQ ID NO: 754494 - DNA, 25 bp, Mus musculus
tatatgagtatcaactgcatgtggg

SEQ ID NO: 754495 - DNA, 25 bp, Mus musculus
tatatgagtatctactgcatgtggg

SEQ ID NO: 754496 - DNA, 25 bp, Mus musculus
tatatgagtgaccatattagccgtg

SEQ ID NO: 754497 - DNA, 25 bp, Mus musculus
tatatgagtgacgatattagccgtg

SEQ ID NO: 754498 - DNA, 25 bp, Mus musculus
tatatgatatgaacatcctttatgc

SEQ ID NO: 754499 - DNA, 25 bp, Mus musculus
tatatgatatgatcatcctttatgc

SEQ ID NO: 754500 - DNA, 25 bp, Mus musculus
tatatgatgacgctggtcatcctgt

SEQ ID NO: 754501 - DNA, 25 bp, Mus musculus
tatatgatgacggtggtcatcctgt

SEQ ID NO: 754502 - DNA, 25 bp, Mus musculus
tatatgcagaaacactgggtgcccc

SEQ ID NO: 754503 - DNA, 25 bp, Mus musculus
tatatgcagaaagactgggtgcccc

SEQ ID NO: 754504 - DNA, 25 bp, Mus musculus
tatatgcagctacatgagggaagcc

SEQ ID NO: 754505 - DNA, 25 bp, Mus musculus
tatatgcagctagatgagggaagcc

SEQ ID NO: 754506 - DNA, 25 bp, Mus musculus
tatatgcaggtgcatttgggctgta

SEQ ID NO: 754507 - DNA, 25 bp, Mus musculus
tatatgcaggtggatttgggctgta

SEQ ID NO: 754508 - DNA, 25 bp, Mus musculus
tatatgccacagaatcctcacatca

SEQ ID NO: 754509 - DNA, 25 bp, Mus musculus
tatatgccacagtatcctcacatca

SEQ ID NO: 754510 - DNA, 25 bp, Mus musculus
tatatgccagtgatattcctaagtc

SEQ ID NO: 754511 - DNA, 25 bp, Mus musculus
tatatgccagtgttattcctaagtc

SEQ ID NO: 754512 - DNA, 25 bp, Mus musculus
tatatgcctggaagtggctaacggc

SEQ ID NO: 754513 - DNA, 25 bp, Mus musculus
tatatgcctggatgtggctaacggc

SEQ ID NO: 754514 - DNA, 25 bp, Mus musculus
tatatgcggatcctgattgcctgcc

SEQ ID NO: 754515 - DNA, 25 bp, Mus musculus
tatatgcggatcgtgattgcctgcc

SEQ ID NO: 754516 - DNA, 25 bp, Mus musculus
tatatgcgtttcatctacacctaca

SEQ ID NO: 754517 - DNA, 25 bp, Mus musculus
tatatgcgtttcttctacacctaca

SEQ ID NO: 754518 - DNA, 25 bp, Mus musculus
tatatgctactcaggcggctgctcg

SEQ ID NO: 754519 - DNA, 25 bp, Mus musculus
tatatgctactctggcggctgctcg

SEQ ID NO: 754520 - DNA, 25 bp, Mus musculus
tatatgctcagtacagcccatcgag

SEQ ID NO: 754521 - DNA, 25 bp, Mus musculus
tatatgctcagtagagcttttgccc

SEQ ID NO: 754522 - DNA, 25 bp, Mus musculus
tatatgctcagttcagcccatcgag

SEQ ID NO: 754523 - DNA, 25 bp, Mus musculus
tatatgctcagttgagcttttgccc

SEQ ID NO: 754524 - DNA, 25 bp, Mus musculus
tatatgctggggacccttctgcagc

SEQ ID NO: 754525 - DNA, 25 bp, Mus musculus
tatatgctggggtcccttctgcagc

SEQ ID NO: 754526 - DNA, 25 bp, Mus musculus
tatatgcttgaaacagattggaaga

SEQ ID NO: 754527 - DNA, 25 bp, Mus musculus
tatatgcttgaatcagattggaaga

SEQ ID NO: 754528 - DNA, 25 bp, Mus musculus
tatatgcttgtcctcccagtgatgg

SEQ ID NO: 754529 - DNA, 25 bp, Mus musculus
tatatgcttgtcgtcccagtgatgg

SEQ ID NO: 754530 - DNA, 25 bp, Mus musculus
tatatggaaccaagggagggatgct

SEQ ID NO: 754531 - DNA, 25 bp, Mus musculus
tatatggaaccatgggagggatgct

SEQ ID NO: 754532 - DNA, 25 bp, Mus musculus
tatatggaagaaatcgaagactcgg

SEQ ID NO: 754533 - DNA, 25 bp, Mus musculus
tatatggaagaattcgaagactcgg

SEQ ID NO: 754534 - DNA, 25 bp, Mus musculus
tatatggactaaagccatgtgatcc

SEQ ID NO: 754535 - DNA, 25 bp, Mus musculus
tatatggactaatgccatgtgatcc

SEQ ID NO: 754536 - DNA, 25 bp, Mus musculus
tatatggatacactcctttgatgga

SEQ ID NO: 754537 - DNA, 25 bp, Mus musculus
tatatggatacagtcctttgatgga

SEQ ID NO: 754538 - DNA, 25 bp, Mus musculus
tatatggatagacgatgaagcatca

SEQ ID NO: 754539 - DNA, 25 bp, Mus musculus
tatatggatagaggatgaagcatca

SEQ ID NO: 754540 - DNA, 25 bp, Mus musculus
tatatggatgggattaaaatgcagt

SEQ ID NO: 754541 - DNA, 25 bp, Mus musculus
tatatggatgggtttaaaatgcagt

SEQ ID NO: 754542 - DNA, 25 bp, Mus musculus
tatatggccaagcagaacttccaca

SEQ ID NO: 754543 - DNA, 25 bp, Mus musculus
tatatggccaaggagaacttccaca

SEQ ID NO: 754544 - DNA, 25 bp, Mus musculus
tatatggccatgatacagtttgcca

SEQ ID NO: 754545 - DNA, 25 bp, Mus musculus
tatatggccatgttacagtttgcca

SEQ ID NO: 754546 - DNA, 25 bp, Mus musculus
tatatgggaacgctggcttatggca

SEQ ID NO: 754547 - DNA, 25 bp, Mus musculus
tatatgggaacggtggcttatggca

SEQ ID NO: 754548 - DNA, 25 bp, Mus musculus
tatatgggctctccttgctctagtc

SEQ ID NO: 754549 - DNA, 25 bp, Mus musculus
tatatgggctctgcttgctctagtc

SEQ ID NO: 754550 - DNA, 25 bp, Mus musculus
tatatgggtggccagtagcatcaga

SEQ ID NO: 754551 - DNA, 25 bp, Mus musculus
tatatgggtggcgagtagcatcaga

SEQ ID NO: 754552 - DNA, 25 bp, Mus musculus
tatatggtctcaccttggcagcgcc

SEQ ID NO: 754553 - DNA, 25 bp, Mus musculus
tatatggtctcagcttggcagcgcc

SEQ ID NO: 754554 - DNA, 25 bp, Mus musculus
tatatgtaggccatgagcgctcata

SEQ ID NO: 754555 - DNA, 25 bp, Mus musculus
tatatgtaggccttgagcgctcata

SEQ ID NO: 754556 - DNA, 25 bp, Mus musculus
tatatgtcagataaatgcagagctg

SEQ ID NO: 754557 - DNA, 25 bp, Mus musculus
tatatgtcagattaatgcagagctg

SEQ ID NO: 754558 - DNA, 25 bp, Mus musculus
tatatgtgcaacaaagagcaggtgc

SEQ ID NO: 754559 - DNA, 25 bp, Mus musculus
tatatgtgcaactaagagcaggtgc

SEQ ID NO: 754560 - DNA, 25 bp, Mus musculus
tatatgtgggccattctcgagtgtc

SEQ ID NO: 754561 - DNA, 25 bp, Mus musculus
tatatgtgggcctttctcgagtgtc

SEQ ID NO: 754562 - DNA, 25 bp, Mus musculus
tatatgtgtgggaacccgtgaaggc

SEQ ID NO: 754563 - DNA, 25 bp, Mus musculus
tatatgtgtgggtacccgtgaaggc

SEQ ID NO: 754564 - DNA, 25 bp, Mus musculus
tatattaaaaccaggcggccacgct

SEQ ID NO: 754565 - DNA, 25 bp, Mus musculus
tatattaaaacctggcggccacgct

SEQ ID NO: 754566 - DNA, 25 bp, Mus musculus
tatattaatgccactgtgtgttggt

SEQ ID NO: 754567 - DNA, 25 bp, Mus musculus
tatattaatgcctctgtgtgttggt

SEQ ID NO: 754568 - DNA, 25 bp, Mus musculus
tatattacatgaaatctctctagcc

SEQ ID NO: 754569 - DNA, 25 bp, Mus musculus
tatattacatgatatctctctagcc

SEQ ID NO: 754570 - DNA, 25 bp, Mus musculus
tatattacctgcaacggagccagcc

SEQ ID NO: 754571 - DNA, 25 bp, Mus musculus
tatattacctgctacggagccagcc

SEQ ID NO: 754572 - DNA, 25 bp, Mus musculus
tatattagcgctcccgagctgcgtc

SEQ ID NO: 754573 - DNA, 25 bp, Mus musculus
tatattagcgctgccgagctgcgtc

SEQ ID NO: 754574 - DNA, 25 bp, Mus musculus
tatattataccaagctccaaagacc

SEQ ID NO: 754575 - DNA, 25 bp, Mus musculus
tatattataccatgctccaaagacc

SEQ ID NO: 754576 - DNA, 25 bp, Mus musculus
tatattatcccaacagactgggagg

SEQ ID NO: 754577 - DNA, 25 bp, Mus musculus
tatattatcccatcagactgggagg

SEQ ID NO: 754578 - DNA, 25 bp, Mus musculus
tatattatgtctcccagcgtgggta

SEQ ID NO: 754579 - DNA, 25 bp, Mus musculus
tatattatgtctgccagcgtgggta

SEQ ID NO: 754580 - DNA, 25 bp, Mus musculus
tatattcaacccagagtggagacct

SEQ ID NO: 754581 - DNA, 25 bp, Mus musculus
tatattcaaccctgagtggagacct

SEQ ID NO: 754582 - DNA, 25 bp, Mus musculus
tatattcagacacacctgcgtggca

SEQ ID NO: 754583 - DNA, 25 bp, Mus musculus
tatattcagacacacgggtatcgcg

SEQ ID NO: 754584 - DNA, 25 bp, Mus musculus
tatattcagacagacctgcgtggca

SEQ ID NO: 754585 - DNA, 25 bp, Mus musculus
tatattcagacagacgggtatcgcg

SEQ ID NO: 754586 - DNA, 25 bp, Mus musculus
tatattcaggagattaaggcagtgg

SEQ ID NO: 754587 - DNA, 25 bp, Mus musculus
tatattcaggagtttaaggcagtgg

SEQ ID NO: 754588 - DNA, 25 bp, Mus musculus
tatattccagggatatgtgtggcca

SEQ ID NO: 754589 - DNA, 25 bp, Mus musculus
tatattccagggttatgtgtggcca

SEQ ID NO: 754590 - DNA, 25 bp, Mus musculus
tatattccagtcatcagggctgctc

SEQ ID NO: 754591 - DNA, 25 bp, Mus musculus
tatattccagtcttcagggctgctc

SEQ ID NO: 754592 - DNA, 25 bp, Mus musculus
tatattccgggaacccgacactcgc

SEQ ID NO: 754593 - DNA, 25 bp, Mus musculus
tatattccgggatcccgacactcgc

SEQ ID NO: 754594 - DNA, 25 bp, Mus musculus
tatattcctgcccaacacaagtgag

SEQ ID NO: 754595 - DNA, 25 bp, Mus musculus
tatattcctgccctcggatggccaa

SEQ ID NO: 754596 - DNA, 25 bp, Mus musculus
tatattcctgccgaacacaagtgag

SEQ ID NO: 754597 - DNA, 25 bp, Mus musculus
tatattcctgccgtcggatggccaa

SEQ ID NO: 754598 - DNA, 25 bp, Mus musculus
tatattcctttcaatttgggagccc

SEQ ID NO: 754599 - DNA, 25 bp, Mus musculus
tatattcctttctatttgggagccc

SEQ ID NO: 754600 - DNA, 25 bp, Mus musculus
tatattcgccggagaaagtggaaga

SEQ ID NO: 754601 - DNA, 25 bp, Mus musculus
tatattcgccggtgaaagtggaaga

SEQ ID NO: 754602 - DNA, 25 bp, Mus musculus
tatattctaaatcgtatctacacac

SEQ ID NO: 754603 - DNA, 25 bp, Mus musculus
tatattctaaatggtatctacacac

SEQ ID NO: 754604 - DNA, 25 bp, Mus musculus
tatattctcgaactacggccaggct

SEQ ID NO: 754605 - DNA, 25 bp, Mus musculus
tatattctcgaagtacggccaggct

SEQ ID NO: 754606 - DNA, 25 bp, Mus musculus
tatattctgacgcacaaaggaggca

SEQ ID NO: 754607 - DNA, 25 bp, Mus musculus
tatattctgacggacaaaggaggca

SEQ ID NO: 754608 - DNA, 25 bp, Mus musculus
tatattcttggtcccattgaaatct

SEQ ID NO: 754609 - DNA, 25 bp, Mus musculus
tatattcttggtgccattgaaatct

SEQ ID NO: 754610 - DNA, 25 bp, Mus musculus
tatattgaaaatccacgcaggacct

SEQ ID NO: 754611 - DNA, 25 bp, Mus musculus
tatattgaaaatgcacgcaggacct

SEQ ID NO: 754612 - DNA, 25 bp, Mus musculus
tatattgcaagcactgtcgtccctc

SEQ ID NO: 754613 - DNA, 25 bp, Mus musculus
tatattgcaagctctgtcgtccctc

SEQ ID NO: 754614 - DNA, 25 bp, Mus musculus
tatattgccaccatcttgcgggaga

SEQ ID NO: 754615 - DNA, 25 bp, Mus musculus
tatattgccaccttcttgcgggaga

SEQ ID NO: 754616 - DNA, 25 bp, Mus musculus
tatattgggacccaagaggacacag

SEQ ID NO: 754617 - DNA, 25 bp, Mus musculus
tatattgggaccgaagaggacacag

SEQ ID NO: 754618 - DNA, 25 bp, Mus musculus
tatattgtacccctgatggcagctg

SEQ ID NO: 754619 - DNA, 25 bp, Mus musculus
tatattgtacccgtgatggcagctg

SEQ ID NO: 754620 - DNA, 25 bp, Mus musculus
tatattgtctctacggtgtgggcag

SEQ ID NO: 754621 - DNA, 25 bp, Mus musculus
tatattgtctcttcggtgtgggcag

SEQ ID NO: 754622 - DNA, 25 bp, Mus musculus
tatattgttggacggctcctggcct

SEQ ID NO: 754623 - DNA, 25 bp, Mus musculus
tatattgttggagggctcctggcct

SEQ ID NO: 754624 - DNA, 25 bp, Mus musculus
tatatttaaaagctcacacagggac

SEQ ID NO: 754625 - DNA, 25 bp, Mus musculus
tatatttaaaaggtcacacagggac

SEQ ID NO: 754626 - DNA, 25 bp, Mus musculus
tatatttaaagacgacaagagtccc

SEQ ID NO: 754627 - DNA, 25 bp, Mus musculus
tatatttaaagaggacaagagtccc

SEQ ID NO: 754628 - DNA, 25 bp, Mus musculus
tatatttaagacatcctggacagtc

SEQ ID NO: 754629 - DNA, 25 bp, Mus musculus
tatatttaagacttcctggacagtc

SEQ ID NO: 754630 - DNA, 25 bp, Mus musculus
tatatttcaccccaaagcctagttg

SEQ ID NO: 754631 - DNA, 25 bp, Mus musculus
tatatttcacccgaaagcctagttg

SEQ ID NO: 754632 - DNA, 25 bp, Mus musculus
tatatttccccacggagctacaccg

SEQ ID NO: 754633 - DNA, 25 bp, Mus musculus
tatatttccccagggagctacaccg

SEQ ID NO: 754634 - DNA, 25 bp, Mus musculus
tatatttcggagcaggcaggtgtcc

SEQ ID NO: 754635 - DNA, 25 bp, Mus musculus
tatatttcggaggaggcaggtgtcc

SEQ ID NO: 754636 - DNA, 25 bp, Mus musculus
tatatttctagacctgagtctcaga

SEQ ID NO: 754637 - DNA, 25 bp, Mus musculus
tatatttctagagctgagtctcaga

SEQ ID NO: 754638 - DNA, 25 bp, Mus musculus
tatatttctattctctctcctaaag

SEQ ID NO: 754639 - DNA, 25 bp, Mus musculus
tatatttctattgtctctcctaaag

SEQ ID NO: 754640 - DNA, 25 bp, Mus musculus
tatatttcttacatgtcctgcacgc

SEQ ID NO: 754641 - DNA, 25 bp, Mus musculus
tatatttcttacttgtcctgcacgc

SEQ ID NO: 754642 - DNA, 25 bp, Mus musculus
tatatttgcttcagagcagaattcc

SEQ ID NO: 754643 - DNA, 25 bp, Mus musculus
tatatttgcttctgagcagaattcc

SEQ ID NO: 754644 - DNA, 25 bp, Mus musculus
tatatttggagtcgccgtgatggct

SEQ ID NO: 754645 - DNA, 25 bp, Mus musculus
tatatttggagtggccgtgatggct

SEQ ID NO: 754646 - DNA, 25 bp, Mus musculus
tatatttggattacaccctcatgga

SEQ ID NO: 754647 - DNA, 25 bp, Mus musculus
tatatttggatttcaccctcatgga

SEQ ID NO: 754648 - DNA, 25 bp, Mus musculus
tatatttgggcacgaagcccactgt

SEQ ID NO: 754649 - DNA, 25 bp, Mus musculus
tatatttgggcaggaagcccactgt

SEQ ID NO: 754650 - DNA, 25 bp, Mus musculus
tatatttgtaacaagggtacaacct

SEQ ID NO: 754651 - DNA, 25 bp, Mus musculus
tatatttgtaactagggtacaacct

SEQ ID NO: 754652 - DNA, 25 bp, Mus musculus
tatattttttgcaggaggcataacg

SEQ ID NO: 754653 - DNA, 25 bp, Mus musculus
tatattttttgctggaggcataacg

SEQ ID NO: 754654 - DNA, 25 bp, Mus musculus
tatcaaaaacaccatgtaggaacca

SEQ ID NO: 754655 - DNA, 25 bp, Mus musculus
tatcaaaaacacgatgtaggaacca

SEQ ID NO: 754656 - DNA, 25 bp, Mus musculus
tatcaaaaattgcacaccctgtccc

SEQ ID NO: 754657 - DNA, 25 bp, Mus musculus
tatcaaaaattggacaccctgtccc

SEQ ID NO: 754658 - DNA, 25 bp, Mus musculus
tatcaaaaggaaagtcgacacggga

SEQ ID NO: 754659 - DNA, 25 bp, Mus musculus
tatcaaaaggaatgtcgacacggga

SEQ ID NO: 754660 - DNA, 25 bp, Mus musculus
tatcaaacaccgaggctcctggaga

SEQ ID NO: 754661 - DNA, 25 bp, Mus musculus
tatcaaacaccgtggctcctggaga

SEQ ID NO: 754662 - DNA, 25 bp, Mus musculus
tatcaaacacgtcccgggtggaggc

SEQ ID NO: 754663 - DNA, 25 bp, Mus musculus
tatcaaacacgtgccgggtggaggc

SEQ ID NO: 754664 - DNA, 25 bp, Mus musculus
tatcaaacgatgcttagaataattc

SEQ ID NO: 754665 - DNA, 25 bp, Mus musculus
tatcaaacgatggttagaataattc

SEQ ID NO: 754666 - DNA, 25 bp, Mus musculus
tatcaaactcaaaggagactgctcc

SEQ ID NO: 754667 - DNA, 25 bp, Mus musculus
tatcaaactcaatggagactgctcc

SEQ ID NO: 754668 - DNA, 25 bp, Mus musculus
tatcaaacttgacctggaaatctta

SEQ ID NO: 754669 - DNA, 25 bp, Mus musculus
tatcaaacttgagctggaaatctta

SEQ ID NO: 754670 - DNA, 25 bp, Mus musculus
tatcaaagacgacaagggcaatctc

SEQ ID NO: 754671 - DNA, 25 bp, Mus musculus
tatcaaagacgagaagggcaatctc

SEQ ID NO: 754672 - DNA, 25 bp, Mus musculus
tatcaaagactacttccatcgtggt

SEQ ID NO: 754673 - DNA, 25 bp, Mus musculus
tatcaaagactagttccatcgtggt

SEQ ID NO: 754674 - DNA, 25 bp, Mus musculus
tatcaaagatgtccacgaagactcc

SEQ ID NO: 754675 - DNA, 25 bp, Mus musculus
tatcaaagatgtgcacgaagactcc

SEQ ID NO: 754676 - DNA, 25 bp, Mus musculus
tatcaaagcacacactgagggtcgc

SEQ ID NO: 754677 - DNA, 25 bp, Mus musculus
tatcaaagcacagactgagggtcgc

SEQ ID NO: 754678 - DNA, 25 bp, Mus musculus
tatcaaagcccaactcgttgaaaca

SEQ ID NO: 754679 - DNA, 25 bp, Mus musculus
tatcaaagcccatctcgttgaaaca

SEQ ID NO: 754680 - DNA, 25 bp, Mus musculus
tatcaaagcgcacagtaggccctgt

SEQ ID NO: 754681 - DNA, 25 bp, Mus musculus
tatcaaagcgcagagtaggccctgt

SEQ ID NO: 754682 - DNA, 25 bp, Mus musculus
tatcaaagttctctagaaacccgga

SEQ ID NO: 754683 - DNA, 25 bp, Mus musculus
tatcaaagttctgtagaaacccgga

SEQ ID NO: 754684 - DNA, 25 bp, Mus musculus
tatcaaatgacgacaatggccagct

SEQ ID NO: 754685 - DNA, 25 bp, Mus musculus
tatcaaatgacgtcaatggccagct

SEQ ID NO: 754686 - DNA, 25 bp, Mus musculus
tatcaaatggagcagtggcaatctc

SEQ ID NO: 754687 - DNA, 25 bp, Mus musculus
tatcaaatggaggagtggcaatctc

SEQ ID NO: 754688 - DNA, 25 bp, Mus musculus
tatcaaatgggtattgtctcatggg

SEQ ID NO: 754689 - DNA, 25 bp, Mus musculus
tatcaaatgggttttgtctcatggg

SEQ ID NO: 754690 - DNA, 25 bp, Mus musculus
tatcaaattgcccatctcggagatg

SEQ ID NO: 754691 - DNA, 25 bp, Mus musculus
tatcaaattgccgatctcggagatg

SEQ ID NO: 754692 - DNA, 25 bp, Mus musculus
tatcaaatttgtagaacatcatgga

SEQ ID NO: 754693 - DNA, 25 bp, Mus musculus
tatcaaatttgttgaacatcatgga

SEQ ID NO: 754694 - DNA, 25 bp, Mus musculus
tatcaacaacccagtggacagagca

SEQ ID NO: 754695 - DNA, 25 bp, Mus musculus
tatcaacaaccctgtggacagagca

SEQ ID NO: 754696 - DNA, 25 bp, Mus musculus
tatcaacaacgactggcacgaatcc

SEQ ID NO: 754697 - DNA, 25 bp, Mus musculus
tatcaacaacgagtggcacgaatcc

SEQ ID NO: 754698 - DNA, 25 bp, Mus musculus
tatcaacaatcacacgtgcatctgt

SEQ ID NO: 754699 - DNA, 25 bp, Mus musculus
tatcaacaatcagacgtgcatctgt

SEQ ID NO: 754700 - DNA, 25 bp, Mus musculus
tatcaacaccaactgtcggagccct

SEQ ID NO: 754701 - DNA, 25 bp, Mus musculus
tatcaacaccaagtgtcggagccct

SEQ ID NO: 754702 - DNA, 25 bp, Mus musculus
tatcaacactctagaagtggcgggt

SEQ ID NO: 754703 - DNA, 25 bp, Mus musculus
tatcaacactcttgaagtggcgggt

SEQ ID NO: 754704 - DNA, 25 bp, Mus musculus
tatcaacactgaaggaggttacacc

SEQ ID NO: 754705 - DNA, 25 bp, Mus musculus
tatcaacactgatggaggttacacc

SEQ ID NO: 754706 - DNA, 25 bp, Mus musculus
tatcaacagtgacaatgtattcaag

SEQ ID NO: 754707 - DNA, 25 bp, Mus musculus
tatcaacagtgagaatgtattcaag

SEQ ID NO: 754708 - DNA, 25 bp, Mus musculus
tatcaacatcatccgggtgcttgcc

SEQ ID NO: 754709 - DNA, 25 bp, Mus musculus
tatcaacatcatgcgggtgcttgcc

SEQ ID NO: 754710 - DNA, 25 bp, Mus musculus
tatcaaccccatcaatggaacggtg

SEQ ID NO: 754711 - DNA, 25 bp, Mus musculus
tatcaaccccatgaatggaacggtg

SEQ ID NO: 754712 - DNA, 25 bp, Mus musculus
tatcaaccctctcagctatctggac

SEQ ID NO: 754713 - DNA, 25 bp, Mus musculus
tatcaaccctctgagctatctggac

SEQ ID NO: 754714 - DNA, 25 bp, Mus musculus
tatcaacctctccttcgcgtatgtg

SEQ ID NO: 754715 - DNA, 25 bp, Mus musculus
tatcaacctctcgttcgcgtatgtg

SEQ ID NO: 754716 - DNA, 25 bp, Mus musculus
tatcaacgaatgagcgatgcctggc

SEQ ID NO: 754717 - DNA, 25 bp, Mus musculus
tatcaacgaatgtgcgatgcctggc

SEQ ID NO: 754718 - DNA, 25 bp, Mus musculus
tatcaacggcacactcagttcaggc

SEQ ID NO: 754719 - DNA, 25 bp, Mus musculus
tatcaacggcactctcagttcaggc

SEQ ID NO: 754720 - DNA, 25 bp, Mus musculus
tatcaactagagataaaaataccag

SEQ ID NO: 754721 - DNA, 25 bp, Mus musculus
tatcaactagagttaaaaataccag

SEQ ID NO: 754722 - DNA, 25 bp, Mus musculus
tatcaactcaagctggacagcagca

SEQ ID NO: 754723 - DNA, 25 bp, Mus musculus
tatcaactcaaggtggacagcagca

SEQ ID NO: 754724 - DNA, 25 bp, Mus musculus
tatcaactgccgcttggcctactcg

SEQ ID NO: 754725 - DNA, 25 bp, Mus musculus
tatcaactgccggttggcctactcg

SEQ ID NO: 754726 - DNA, 25 bp, Mus musculus
tatcaactgtggatctggcaaacaa

SEQ ID NO: 754727 - DNA, 25 bp, Mus musculus
tatcaactgtggttctggcaaacaa

SEQ ID NO: 754728 - DNA, 25 bp, Mus musculus
tatcaacttaaaaggcggttacaag

SEQ ID NO: 754729 - DNA, 25 bp, Mus musculus
tatcaacttaaatggcggttacaag

SEQ ID NO: 754730 - DNA, 25 bp, Mus musculus
tatcaagaaaaacagggcgaagagg

SEQ ID NO: 754731 - DNA, 25 bp, Mus musculus
tatcaagaaaaagagggcgaagagg

SEQ ID NO: 754732 - DNA, 25 bp, Mus musculus
tatcaagaaaacacagcaagtttgg

SEQ ID NO: 754733 - DNA, 25 bp, Mus musculus
tatcaagaaaactcagcaagtttgg

SEQ ID NO: 754734 - DNA, 25 bp, Mus musculus
tatcaagaaattcgaagagcatgag

SEQ ID NO: 754735 - DNA, 25 bp, Mus musculus
tatcaagaaattggaagagcatgag

SEQ ID NO: 754736 - DNA, 25 bp, Mus musculus
tatcaagaagacaacgtagaaggac

SEQ ID NO: 754737 - DNA, 25 bp, Mus musculus
tatcaagaagactacgtagaaggac

SEQ ID NO: 754738 - DNA, 25 bp, Mus musculus
tatcaagaagcaaccagatgtggtc

SEQ ID NO: 754739 - DNA, 25 bp, Mus musculus
tatcaagaagcatccagatgtggtc

SEQ ID NO: 754740 - DNA, 25 bp, Mus musculus
tatcaagaaggtccgcaagtctctg

SEQ ID NO: 754741 - DNA, 25 bp, Mus musculus
tatcaagaaggtgcgcaagtctctg

SEQ ID NO: 754742 - DNA, 25 bp, Mus musculus
tatcaagaatttagcgctgcaccct

SEQ ID NO: 754743 - DNA, 25 bp, Mus musculus
tatcaagaattttgcgctgcaccct

SEQ ID NO: 754744 - DNA, 25 bp, Mus musculus
tatcaagaccttcgtgcaggcccag

SEQ ID NO: 754745 - DNA, 25 bp, Mus musculus
tatcaagaccttggtgcaggcccag

SEQ ID NO: 754746 - DNA, 25 bp, Mus musculus
tatcaagacttcaactccaaaaagg

SEQ ID NO: 754747 - DNA, 25 bp, Mus musculus
tatcaagacttctactccaaaaagg

SEQ ID NO: 754748 - DNA, 25 bp, Mus musculus
tatcaagccgccactaggcctcaat

SEQ ID NO: 754749 - DNA, 25 bp, Mus musculus
tatcaagccgcctctaggcctcaat

SEQ ID NO: 754750 - DNA, 25 bp, Mus musculus
tatcaagcgagacctcaggtttcct

SEQ ID NO: 754751 - DNA, 25 bp, Mus musculus
tatcaagcgagagctcaggtttcct

SEQ ID NO: 754752 - DNA, 25 bp, Mus musculus
tatcaagctagtcgtggcagataca

SEQ ID NO: 754753 - DNA, 25 bp, Mus musculus
tatcaagctagtggtggcagataca

SEQ ID NO: 754754 - DNA, 25 bp, Mus musculus
tatcaaggaacaaattatgggacca

SEQ ID NO: 754755 - DNA, 25 bp, Mus musculus
tatcaaggaacatattatgggacca

SEQ ID NO: 754756 - DNA, 25 bp, Mus musculus
tatcaaggagcgagaaggctatgcc

SEQ ID NO: 754757 - DNA, 25 bp, Mus musculus
tatcaaggagcgtgaaggctatgcc

SEQ ID NO: 754758 - DNA, 25 bp, Mus musculus
tatcaaggagtaccacatcctgctg

SEQ ID NO: 754759 - DNA, 25 bp, Mus musculus
tatcaaggagtagcacatcctgctg

SEQ ID NO: 754760 - DNA, 25 bp, Mus musculus
tatcaaggctggctgacattggccg

SEQ ID NO: 754761 - DNA, 25 bp, Mus musculus
tatcaaggctgggtgacattggccg

SEQ ID NO: 754762 - DNA, 25 bp, Mus musculus
tatcaaggtcatagtccaggacaag

SEQ ID NO: 754763 - DNA, 25 bp, Mus musculus
tatcaaggtcattgtccaggacaag

SEQ ID NO: 754764 - DNA, 25 bp, Mus musculus
tatcaagtaattcccttcagcagct

SEQ ID NO: 754765 - DNA, 25 bp, Mus musculus
tatcaagtaattgccttcagcagct

SEQ ID NO: 754766 - DNA, 25 bp, Mus musculus
tatcaagtacatcttgggccagcgc

SEQ ID NO: 754767 - DNA, 25 bp, Mus musculus
tatcaagtacatgttgggccagcgc

SEQ ID NO: 754768 - DNA, 25 bp, Mus musculus
tatcaagtactacctccaactgcct

SEQ ID NO: 754769 - DNA, 25 bp, Mus musculus
tatcaagtactagctccaactgcct

SEQ ID NO: 754770 - DNA, 25 bp, Mus musculus
tatcaagtattcaacacctccttgg

SEQ ID NO: 754771 - DNA, 25 bp, Mus musculus
tatcaagtattctacacctccttgg

SEQ ID NO: 754772 - DNA, 25 bp, Mus musculus
tatcaagttatgaatccaatggtgg

SEQ ID NO: 754773 - DNA, 25 bp, Mus musculus
tatcaagttatgtatccaatggtgg

SEQ ID NO: 754774 - DNA, 25 bp, Mus musculus
tatcaagttggacctggtatgctgg

SEQ ID NO: 754775 - DNA, 25 bp, Mus musculus
tatcaagttggagctggtatgctgg

SEQ ID NO: 754776 - DNA, 25 bp, Mus musculus
tatcaataaagcaatcctggacgac

SEQ ID NO: 754777 - DNA, 25 bp, Mus musculus
tatcaataaagctatcctggacgac

SEQ ID NO: 754778 - DNA, 25 bp, Mus musculus
tatcaatatgatcatggctgtgaac

SEQ ID NO: 754779 - DNA, 25 bp, Mus musculus
tatcaatatgatgatggctgtgaac

SEQ ID NO: 754780 - DNA, 25 bp, Mus musculus
tatcaatcacatcagagccgtgtcc

SEQ ID NO: 754781 - DNA, 25 bp, Mus musculus
tatcaatcacatgagagccgtgtcc

SEQ ID NO: 754782 - DNA, 25 bp, Mus musculus
tatcaatgccatcctactgggtgcc

SEQ ID NO: 754783 - DNA, 25 bp, Mus musculus
tatcaatgccatgctactgggtgcc

SEQ ID NO: 754784 - DNA, 25 bp, Mus musculus
tatcaatgctccaaagccaaagaag

SEQ ID NO: 754785 - DNA, 25 bp, Mus musculus
tatcaatgctcctaagccaaagaag

SEQ ID NO: 754786 - DNA, 25 bp, Mus musculus
tatcaatggattcggtctgcttgca

SEQ ID NO: 754787 - DNA, 25 bp, Mus musculus
tatcaatggattgggtctgcttgca

SEQ ID NO: 754788 - DNA, 25 bp, Mus musculus
tatcaatgtggaatatgggatggaa

SEQ ID NO: 754789 - DNA, 25 bp, Mus musculus
tatcaatgtggattatgggatggaa

SEQ ID NO: 754790 - DNA, 25 bp, Mus musculus
tatcacaaaattctggagaacattg

SEQ ID NO: 754791 - DNA, 25 bp, Mus musculus
tatcacaaaattgtggagaacattg

SEQ ID NO: 754792 - DNA, 25 bp, Mus musculus
tatcacaacggtcccattgtgcgtg

SEQ ID NO: 754793 - DNA, 25 bp, Mus musculus
tatcacaacggtgccattgtgcgtg

SEQ ID NO: 754794 - DNA, 25 bp, Mus musculus
tatcacaagtaaccaccagagagct

SEQ ID NO: 754795 - DNA, 25 bp, Mus musculus
tatcacaagtaagcaccagagagct

SEQ ID NO: 754796 - DNA, 25 bp, Mus musculus
tatcacaatacgacctcttttcaag

SEQ ID NO: 754797 - DNA, 25 bp, Mus musculus
tatcacaatacgtcctcttttcaag

SEQ ID NO: 754798 - DNA, 25 bp, Mus musculus
tatcacaatcttcatgaaaatggcc

SEQ ID NO: 754799 - DNA, 25 bp, Mus musculus
tatcacaatcttgatgaaaatggcc

SEQ ID NO: 754800 - DNA, 25 bp, Mus musculus
tatcacagccagaggttcagacagg

SEQ ID NO: 754801 - DNA, 25 bp, Mus musculus
tatcacagccagcatttcgataggc

SEQ ID NO: 754802 - DNA, 25 bp, Mus musculus
tatcacagccaggatttcgataggc

SEQ ID NO: 754803 - DNA, 25 bp, Mus musculus
tatcacagccagtggttcagacagg

SEQ ID NO: 754804 - DNA, 25 bp, Mus musculus
tatcacagcctacagcgcatacaga

SEQ ID NO: 754805 - DNA, 25 bp, Mus musculus
tatcacagcctagagcgcatacaga

SEQ ID NO: 754806 - DNA, 25 bp, Mus musculus
tatcacaggcgacatggccatcacg

SEQ ID NO: 754807 - DNA, 25 bp, Mus musculus
tatcacaggcgagatggccatcacg

SEQ ID NO: 754808 - DNA, 25 bp, Mus musculus
tatcacagtccgcatggtcaccggt

SEQ ID NO: 754809 - DNA, 25 bp, Mus musculus
tatcacagtccggatggtcaccggt

SEQ ID NO: 754810 - DNA, 25 bp, Mus musculus
tatcacatattcaatgcactgctgg

SEQ ID NO: 754811 - DNA, 25 bp, Mus musculus
tatcacatattctatgcactgctgg

SEQ ID NO: 754812 - DNA, 25 bp, Mus musculus
tatcacatcattctggcccagctct

SEQ ID NO: 754813 - DNA, 25 bp, Mus musculus
tatcacatcattgtggcccagctct

SEQ ID NO: 754814 - DNA, 25 bp, Mus musculus
tatcacatgttgcaagcctgctcaa

SEQ ID NO: 754815 - DNA, 25 bp, Mus musculus
tatcacatgttggaagcctgctcaa

SEQ ID NO: 754816 - DNA, 25 bp, Mus musculus
tatcaccaagaacttaagtgaggac

SEQ ID NO: 754817 - DNA, 25 bp, Mus musculus
tatcaccaagaagttaagtgaggac

SEQ ID NO: 754818 - DNA, 25 bp, Mus musculus
tatcaccaaggaatcagtgcatttg

SEQ ID NO: 754819 - DNA, 25 bp, Mus musculus
tatcaccaaggattcagtgcatttg

SEQ ID NO: 754820 - DNA, 25 bp, Mus musculus
tatcaccaatgacaccctgagctgg

SEQ ID NO: 754821 - DNA, 25 bp, Mus musculus
tatcaccaatgagaccctgagctgg

SEQ ID NO: 754822 - DNA, 25 bp, Mus musculus
tatcaccacagtattgtctctggcc

SEQ ID NO: 754823 - DNA, 25 bp, Mus musculus
tatcaccacagttttgtctctggcc

SEQ ID NO: 754824 - DNA, 25 bp, Mus musculus
tatcaccacgcgaccatgttcaaca

SEQ ID NO: 754825 - DNA, 25 bp, Mus musculus
tatcaccacgcgtccatgttcaaca

SEQ ID NO: 754826 - DNA, 25 bp, Mus musculus
tatcaccagatactccaaggcaaag

SEQ ID NO: 754827 - DNA, 25 bp, Mus musculus
tatcaccagatagtccaaggcaaag

SEQ ID NO: 754828 - DNA, 25 bp, Mus musculus
tatcacccacgtccctggaggaggg

SEQ ID NO: 754829 - DNA, 25 bp, Mus musculus
tatcacccacgtgcctggaggaggg

SEQ ID NO: 754830 - DNA, 25 bp, Mus musculus
tatcacccgctcaccatattgggac

SEQ ID NO: 754831 - DNA, 25 bp, Mus musculus
tatcacccgctctccatattgggac

SEQ ID NO: 754832 - DNA, 25 bp, Mus musculus
tatcaccctgaaagagctggacggc

SEQ ID NO: 754833 - DNA, 25 bp, Mus musculus
tatcaccctgaatgagctggacggc

SEQ ID NO: 754834 - DNA, 25 bp, Mus musculus
tatcaccctgtcatgtgcacagagt

SEQ ID NO: 754835 - DNA, 25 bp, Mus musculus
tatcaccctgtcttgtgcacagagt

SEQ ID NO: 754836 - DNA, 25 bp, Mus musculus
tatcacccttgactgatggctgacg

SEQ ID NO: 754837 - DNA, 25 bp, Mus musculus
tatcacccttgagtgatggctgacg

SEQ ID NO: 754838 - DNA, 25 bp, Mus musculus
tatcaccgtccaagacccggcagta

SEQ ID NO: 754839 - DNA, 25 bp, Mus musculus
tatcaccgtccatgacccggcagta

SEQ ID NO: 754840 - DNA, 25 bp, Mus musculus
tatcacctgcggctcttcaaggatg

SEQ ID NO: 754841 - DNA, 25 bp, Mus musculus
tatcacctgcgggtcttcaaggatg

SEQ ID NO: 754842 - DNA, 25 bp, Mus musculus
tatcacctgcttacaaagtcagaga

SEQ ID NO: 754843 - DNA, 25 bp, Mus musculus
tatcacctgctttcaaagtcagaga

SEQ ID NO: 754844 - DNA, 25 bp, Mus musculus
tatcacgaacctcatgtcatcagct

SEQ ID NO: 754845 - DNA, 25 bp, Mus musculus
tatcacgaacctgatgtcatcagct

SEQ ID NO: 754846 - DNA, 25 bp, Mus musculus
tatcacggcctaaaagagtgaggga

SEQ ID NO: 754847 - DNA, 25 bp, Mus musculus
tatcacggcctataagagtgaggga

SEQ ID NO: 754848 - DNA, 25 bp, Mus musculus
tatcacggttgactttgaacgggaa

SEQ ID NO: 754849 - DNA, 25 bp, Mus musculus
tatcacggttgagtttgaacgggaa

SEQ ID NO: 754850 - DNA, 25 bp, Mus musculus
tatcacgtatggactaaaggccatg

SEQ ID NO: 754851 - DNA, 25 bp, Mus musculus
tatcacgtatggtctaaaggccatg

SEQ ID NO: 754852 - DNA, 25 bp, Mus musculus
tatcacgtccaaatgctgtagtagg

SEQ ID NO: 754853 - DNA, 25 bp, Mus musculus
tatcacgtccaattgctgtagtagg

SEQ ID NO: 754854 - DNA, 25 bp, Mus musculus
tatcactccagcatgattgcagatg

SEQ ID NO: 754855 - DNA, 25 bp, Mus musculus
tatcactccagcttgattgcagatg

SEQ ID NO: 754856 - DNA, 25 bp, Mus musculus
tatcactcgatcagttctggaaaac

SEQ ID NO: 754857 - DNA, 25 bp, Mus musculus
tatcactcgatctgttctggaaaac

SEQ ID NO: 754858 - DNA, 25 bp, Mus musculus
tatcactgacgtctctctcggtcga

SEQ ID NO: 754859 - DNA, 25 bp, Mus musculus
tatcactgacgtgtctctcggtcga

SEQ ID NO: 754860 - DNA, 25 bp, Mus musculus
tatcactgagaaccacgcactctgg

SEQ ID NO: 754861 - DNA, 25 bp, Mus musculus
tatcactgagaagcacgcactctgg

SEQ ID NO: 754862 - DNA, 25 bp, Mus musculus
tatcactgatgtcgtaccatatcca

SEQ ID NO: 754863 - DNA, 25 bp, Mus musculus
tatcactgatgtggtaccatatcca

SEQ ID NO: 754864 - DNA, 25 bp, Mus musculus
tatcactgggttctcaacttctgca

SEQ ID NO: 754865 - DNA, 25 bp, Mus musculus
tatcactgggttgtcaacttctgca

SEQ ID NO: 754866 - DNA, 25 bp, Mus musculus
tatcactgtcagctctaggtagcca

SEQ ID NO: 754867 - DNA, 25 bp, Mus musculus
tatcactgtcaggtctaggtagcca

SEQ ID NO: 754868 - DNA, 25 bp, Mus musculus
tatcacttaaagcatatggttgtct

SEQ ID NO: 754869 - DNA, 25 bp, Mus musculus
tatcacttaaaggatatggttgtct

SEQ ID NO: 754870 - DNA, 25 bp, Mus musculus
tatcacttccgtctatgttagcccc

SEQ ID NO: 754871 - DNA, 25 bp, Mus musculus
tatcacttccgtgtatgttagcccc

SEQ ID NO: 754872 - DNA, 25 bp, Mus musculus
tatcacttgcacagtggaacacgac

SEQ ID NO: 754873 - DNA, 25 bp, Mus musculus
tatcacttgcactgtggaacacgac

SEQ ID NO: 754874 - DNA, 25 bp, Mus musculus
tatcactttaaacatcaagccccgg

SEQ ID NO: 754875 - DNA, 25 bp, Mus musculus
tatcactttaaagatcaagccccgg

SEQ ID NO: 754876 - DNA, 25 bp, Mus musculus
tatcacttttcacgctctgaactag

SEQ ID NO: 754877 - DNA, 25 bp, Mus musculus
tatcacttttcaggctctgaactag

SEQ ID NO: 754878 - DNA, 25 bp, Mus musculus
tatcacttttggacaccctgtggtt

SEQ ID NO: 754879 - DNA, 25 bp, Mus musculus
tatcacttttggtcaccctgtggtt

SEQ ID NO: 754880 - DNA, 25 bp, Mus musculus
tatcagaaatggacaaagagggcca

SEQ ID NO: 754881 - DNA, 25 bp, Mus musculus
tatcagaaatggtcaaagagggcca

SEQ ID NO: 754882 - DNA, 25 bp, Mus musculus
tatcagaactcactgcggagcagca

SEQ ID NO: 754883 - DNA, 25 bp, Mus musculus
tatcagaactcagtgcggagcagca

SEQ ID NO: 754884 - DNA, 25 bp, Mus musculus
tatcagaatcatcgacacacctcag

SEQ ID NO: 754885 - DNA, 25 bp, Mus musculus
tatcagaatcatggacacacctcag

SEQ ID NO: 754886 - DNA, 25 bp, Mus musculus
tatcagacaagccaaagctcctgcc

SEQ ID NO: 754887 - DNA, 25 bp, Mus musculus
tatcagacaagcgaaagctcctgcc

SEQ ID NO: 754888 - DNA, 25 bp, Mus musculus
tatcagacagaacgcccgcttcaag

SEQ ID NO: 754889 - DNA, 25 bp, Mus musculus
tatcagacagaacttggcactcgga

SEQ ID NO: 754890 - DNA, 25 bp, Mus musculus
tatcagacagaaggcccgcttcaag

SEQ ID NO: 754891 - DNA, 25 bp, Mus musculus
tatcagacagaagttggcactcgga

SEQ ID NO: 754892 - DNA, 25 bp, Mus musculus
tatcagaccctcaaatccatacttg

SEQ ID NO: 754893 - DNA, 25 bp, Mus musculus
tatcagaccctctaatccatacttg

SEQ ID NO: 754894 - DNA, 25 bp, Mus musculus
tatcagacctctctttatcaacaag

SEQ ID NO: 754895 - DNA, 25 bp, Mus musculus
tatcagacctctgtttatcaacaag

SEQ ID NO: 754896 - DNA, 25 bp, Mus musculus
tatcagacggctactggatggagag

SEQ ID NO: 754897 - DNA, 25 bp, Mus musculus
tatcagacggcttctggatggagag

SEQ ID NO: 754898 - DNA, 25 bp, Mus musculus
tatcagacttggcttgacctcagag

SEQ ID NO: 754899 - DNA, 25 bp, Mus musculus
tatcagacttgggttgacctcagag

SEQ ID NO: 754900 - DNA, 25 bp, Mus musculus
tatcagagatcaacactacggtgcc

SEQ ID NO: 754901 - DNA, 25 bp, Mus musculus
tatcagagatcatcactacggtgcc

SEQ ID NO: 754902 - DNA, 25 bp, Mus musculus
tatcagagccaacagcaattaaaag

SEQ ID NO: 754903 - DNA, 25 bp, Mus musculus
tatcagagccaagagcaattaaaag

SEQ ID NO: 754904 - DNA, 25 bp, Mus musculus
tatcagagtcgcagctttcgttccg

SEQ ID NO: 754905 - DNA, 25 bp, Mus musculus
tatcagagtcgctgctttcgttccg

SEQ ID NO: 754906 - DNA, 25 bp, Mus musculus
tatcagagtttgaaattccaagtgt

SEQ ID NO: 754907 - DNA, 25 bp, Mus musculus
tatcagagtttgtaattccaagtgt

SEQ ID NO: 754908 - DNA, 25 bp, Mus musculus
tatcagatgccacaatgctggcgag

SEQ ID NO: 754909 - DNA, 25 bp, Mus musculus
tatcagatgccagaatgctggcgag

SEQ ID NO: 754910 - DNA, 25 bp, Mus musculus
tatcagattgagcattactccatgg

SEQ ID NO: 754911 - DNA, 25 bp, Mus musculus
tatcagattgaggattactccatgg

SEQ ID NO: 754912 - DNA, 25 bp, Mus musculus
tatcagcaagatctggacagagagc

SEQ ID NO: 754913 - DNA, 25 bp, Mus musculus
tatcagcaagatgtggacagagagc

SEQ ID NO: 754914 - DNA, 25 bp, Mus musculus
tatcagcaagccctcctaagctagg

SEQ ID NO: 754915 - DNA, 25 bp, Mus musculus
tatcagcaagccgtcctaagctagg

SEQ ID NO: 754916 - DNA, 25 bp, Mus musculus
tatcagcaatttcccgacaaccctg

SEQ ID NO: 754917 - DNA, 25 bp, Mus musculus
tatcagcaatttgccgacaaccctg

SEQ ID NO: 754918 - DNA, 25 bp, Mus musculus
tatcagcaccacactggacctcttt

SEQ ID NO: 754919 - DNA, 25 bp, Mus musculus
tatcagcaccactctggacctcttt

SEQ ID NO: 754920 - DNA, 25 bp, Mus musculus
tatcagcactttatggaagcaagca

SEQ ID NO: 754921 - DNA, 25 bp, Mus musculus
tatcagcactttttggaagcaagca

SEQ ID NO: 754922 - DNA, 25 bp, Mus musculus
tatcagcagcaccaccacggttagt

SEQ ID NO: 754923 - DNA, 25 bp, Mus musculus
tatcagcagcacgaccacggttagt

SEQ ID NO: 754924 - DNA, 25 bp, Mus musculus
tatcagcagcatcgccgggccctgg

SEQ ID NO: 754925 - DNA, 25 bp, Mus musculus
tatcagcagcatggccgggccctgg

SEQ ID NO: 754926 - DNA, 25 bp, Mus musculus
tatcagcaggtaagggcctggacag

SEQ ID NO: 754927 - DNA, 25 bp, Mus musculus
tatcagcaggtatgggcctggacag

SEQ ID NO: 754928 - DNA, 25 bp, Mus musculus
tatcagcatgcactggtttagagaa

SEQ ID NO: 754929 - DNA, 25 bp, Mus musculus
tatcagcatgcagtggtttagagaa

SEQ ID NO: 754930 - DNA, 25 bp, Mus musculus
tatcagcatggaccggtacattgcc

SEQ ID NO: 754931 - DNA, 25 bp, Mus musculus
tatcagcatggagcggtacattgcc

SEQ ID NO: 754932 - DNA, 25 bp, Mus musculus
tatcagcattagaaaaccacccatt

SEQ ID NO: 754933 - DNA, 25 bp, Mus musculus
tatcagcattagtaaaccacccatt

SEQ ID NO: 754934 - DNA, 25 bp, Mus musculus
tatcagccagagagaggagacggct

SEQ ID NO: 754935 - DNA, 25 bp, Mus musculus
tatcagccagagtgaggagacggct

SEQ ID NO: 754936 - DNA, 25 bp, Mus musculus
tatcagccaggcagagcccatccag

SEQ ID NO: 754937 - DNA, 25 bp, Mus musculus
tatcagccaggctgagcccatccag

SEQ ID NO: 754938 - DNA, 25 bp, Mus musculus
tatcagccatatcagatcccagcgg

SEQ ID NO: 754939 - DNA, 25 bp, Mus musculus
tatcagccatatgagatcccagcgg

SEQ ID NO: 754940 - DNA, 25 bp, Mus musculus
tatcagcccgagattggccagaacc

SEQ ID NO: 754941 - DNA, 25 bp, Mus musculus
tatcagcccgagtttggccagaacc

SEQ ID NO: 754942 - DNA, 25 bp, Mus musculus
tatcagcccggtcaaaacctgtgag

SEQ ID NO: 754943 - DNA, 25 bp, Mus musculus
tatcagcccggtgaaaacctgtgag

SEQ ID NO: 754944 - DNA, 25 bp, Mus musculus
tatcagcctgcccagggcccaatgg

SEQ ID NO: 754945 - DNA, 25 bp, Mus musculus
tatcagcctgccgagggcccaatgg

SEQ ID NO: 754946 - DNA, 25 bp, Mus musculus
tatcagcctggaccatcgctgccga

SEQ ID NO: 754947 - DNA, 25 bp, Mus musculus
tatcagcctggagcatcgctgccga

SEQ ID NO: 754948 - DNA, 25 bp, Mus musculus
tatcagcgaagtcctggccaggcgg

SEQ ID NO: 754949 - DNA, 25 bp, Mus musculus
tatcagcgaagtgctggccaggcgg

SEQ ID NO: 754950 - DNA, 25 bp, Mus musculus
tatcagcgcacaagggtagctgtgg

SEQ ID NO: 754951 - DNA, 25 bp, Mus musculus
tatcagcgcacatgggtagctgtgg

SEQ ID NO: 754952 - DNA, 25 bp, Mus musculus
tatcagcgcggtagggattaagtct

SEQ ID NO: 754953 - DNA, 25 bp, Mus musculus
tatcagcgcggttgggattaagtct

SEQ ID NO: 754954 - DNA, 25 bp, Mus musculus
tatcagcggctgctggagttcatga

SEQ ID NO: 754955 - DNA, 25 bp, Mus musculus
tatcagcggctggtggagttcatga

SEQ ID NO: 754956 - DNA, 25 bp, Mus musculus
tatcagcgtgggacatcgtcccagc

SEQ ID NO: 754957 - DNA, 25 bp, Mus musculus
tatcagcgtgggtcatcgtcccagc

SEQ ID NO: 754958 - DNA, 25 bp, Mus musculus
tatcagctaaaccaggagtcctgcg

SEQ ID NO: 754959 - DNA, 25 bp, Mus musculus
tatcagctaaacgaggagtcctgcg

SEQ ID NO: 754960 - DNA, 25 bp, Mus musculus
tatcagctaaggaaatgaccacacc

SEQ ID NO: 754961 - DNA, 25 bp, Mus musculus
tatcagctaaggtaatgaccacacc

SEQ ID NO: 754962 - DNA, 25 bp, Mus musculus
tatcagctaatgcacaatatcaagg

SEQ ID NO: 754963 - DNA, 25 bp, Mus musculus
tatcagctaatggacaatatcaagg

SEQ ID NO: 754964 - DNA, 25 bp, Mus musculus
tatcagctcccgattacaaacaaaa

SEQ ID NO: 754965 - DNA, 25 bp, Mus musculus
tatcagctcccgtttacaaacaaaa

SEQ ID NO: 754966 - DNA, 25 bp, Mus musculus
tatcagctgaatcaggctggactgg

SEQ ID NO: 754967 - DNA, 25 bp, Mus musculus
tatcagctgaatgaggctggactgg

SEQ ID NO: 754968 - DNA, 25 bp, Mus musculus
tatcagctgacaatggaatggcccc

SEQ ID NO: 754969 - DNA, 25 bp, Mus musculus
tatcagctgacattggaatggcccc

SEQ ID NO: 754970 - DNA, 25 bp, Mus musculus
tatcagctgctcagcagtgcacatg

SEQ ID NO: 754971 - DNA, 25 bp, Mus musculus
tatcagctgctctgcagtgcacatg

SEQ ID NO: 754972 - DNA, 25 bp, Mus musculus
tatcagctgtttcaaacgtcatggg

SEQ ID NO: 754973 - DNA, 25 bp, Mus musculus
tatcagctgtttgaaacgtcatggg

SEQ ID NO: 754974 - DNA, 25 bp, Mus musculus
tatcaggaagatcccatttattgga

SEQ ID NO: 754975 - DNA, 25 bp, Mus musculus
tatcaggaagatgccatttattgga

SEQ ID NO: 754976 - DNA, 25 bp, Mus musculus
tatcaggaaggaactagccaaactc

SEQ ID NO: 754977 - DNA, 25 bp, Mus musculus
tatcaggaaggatctagccaaactc

SEQ ID NO: 754978 - DNA, 25 bp, Mus musculus
tatcaggacagcagtaagaccacac

SEQ ID NO: 754979 - DNA, 25 bp, Mus musculus
tatcaggacagctgtaagaccacac

SEQ ID NO: 754980 - DNA, 25 bp, Mus musculus
tatcaggaccgacaccagtttgcca

SEQ ID NO: 754981 - DNA, 25 bp, Mus musculus
tatcaggaccgagaccagtttgcca

SEQ ID NO: 754982 - DNA, 25 bp, Mus musculus
tatcaggataaacggatggccagcc

SEQ ID NO: 754983 - DNA, 25 bp, Mus musculus
tatcaggataaagggatggccagcc

SEQ ID NO: 754984 - DNA, 25 bp, Mus musculus
tatcaggatcttatagaccgaggat

SEQ ID NO: 754985 - DNA, 25 bp, Mus musculus
tatcaggatcttttagaccgaggat

SEQ ID NO: 754986 - DNA, 25 bp, Mus musculus
tatcaggattcaacgtttgtaacag

SEQ ID NO: 754987 - DNA, 25 bp, Mus musculus
tatcaggattcatcgtttgtaacag

SEQ ID NO: 754988 - DNA, 25 bp, Mus musculus
tatcaggcaagacatgggaatgctc

SEQ ID NO: 754989 - DNA, 25 bp, Mus musculus
tatcaggcaagagatgggaatgctc

SEQ ID NO: 754990 - DNA, 25 bp, Mus musculus
tatcaggcaatgacttgccagatgc

SEQ ID NO: 754991 - DNA, 25 bp, Mus musculus
tatcaggcaatgtcttgccagatgc

SEQ ID NO: 754992 - DNA, 25 bp, Mus musculus
tatcaggccataaccccagtgacct

SEQ ID NO: 754993 - DNA, 25 bp, Mus musculus
tatcaggccatatccccagtgacct

SEQ ID NO: 754994 - DNA, 25 bp, Mus musculus
tatcaggcgtgacccacagagagtc

SEQ ID NO: 754995 - DNA, 25 bp, Mus musculus
tatcaggcgtgagccacagagagtc

SEQ ID NO: 754996 - DNA, 25 bp, Mus musculus
tatcaggctcacaggttctgcttgt

SEQ ID NO: 754997 - DNA, 25 bp, Mus musculus
tatcaggctcactggttctgcttgt

SEQ ID NO: 754998 - DNA, 25 bp, Mus musculus
tatcaggctccgagttcgggcggaa

SEQ ID NO: 754999 - DNA, 25 bp, Mus musculus
tatcaggctccgtgttcgggcggaa

SEQ ID NO: 755000 - DNA, 25 bp, Mus musculus
tatcaggctgcaaagggaggagact

SEQ ID NO: 755001 - DNA, 25 bp, Mus musculus
tatcaggctgcatagggaggagact

SEQ ID NO: 755002 - DNA, 25 bp, Mus musculus
tatcaggcttgcatcagatgcgcag

SEQ ID NO: 755003 - DNA, 25 bp, Mus musculus
tatcaggcttgcttcagatgcgcag

SEQ ID NO: 755004 - DNA, 25 bp, Mus musculus
tatcagggacctcaccctaagagaa

SEQ ID NO: 755005 - DNA, 25 bp, Mus musculus
tatcagggacctgaccctaagagaa

SEQ ID NO: 755006 - DNA, 25 bp, Mus musculus
tatcagggcattcttgagcaccttg

SEQ ID NO: 755007 - DNA, 25 bp, Mus musculus
tatcagggcattgttgagcaccttg

SEQ ID NO: 755008 - DNA, 25 bp, Mus musculus
tatcagggccagaccttgaggccta

SEQ ID NO: 755009 - DNA, 25 bp, Mus musculus
tatcagggccagtccttgaggccta

SEQ ID NO: 755010 - DNA, 25 bp, Mus musculus
tatcagggctcgcaagacttatcca

SEQ ID NO: 755011 - DNA, 25 bp, Mus musculus
tatcagggctcggaagacttatcca

SEQ ID NO: 755012 - DNA, 25 bp, Mus musculus
tatcagggctgcagaaaagcagggc

SEQ ID NO: 755013 - DNA, 25 bp, Mus musculus
tatcagggctgctgaaaagcagggc

SEQ ID NO: 755014 - DNA, 25 bp, Mus musculus
tatcagggtcagagcctgtccctca

SEQ ID NO: 755015 - DNA, 25 bp, Mus musculus
tatcagggtcagtgcctgtccctca

SEQ ID NO: 755016 - DNA, 25 bp, Mus musculus
tatcagggttggcttcccctgccag

SEQ ID NO: 755017 - DNA, 25 bp, Mus musculus
tatcagggttgggttcccctgccag

SEQ ID NO: 755018 - DNA, 25 bp, Mus musculus
tatcaggtaccaacgactatgtgca

SEQ ID NO: 755019 - DNA, 25 bp, Mus musculus
tatcaggtaccatcgactatgtgca

SEQ ID NO: 755020 - DNA, 25 bp, Mus musculus
tatcaggtacctcaacctctacgac

SEQ ID NO: 755021 - DNA, 25 bp, Mus musculus
tatcaggtacctgaacctctacgac

SEQ ID NO: 755022 - DNA, 25 bp, Mus musculus
tatcaggtatgccatttttacaggg

SEQ ID NO: 755023 - DNA, 25 bp, Mus musculus
tatcaggtatgcgatttttacaggg

SEQ ID NO: 755024 - DNA, 25 bp, Mus musculus
tatcaggtatggcatacaatctgcc

SEQ ID NO: 755025 - DNA, 25 bp, Mus musculus
tatcaggtatgggatacaatctgcc

SEQ ID NO: 755026 - DNA, 25 bp, Mus musculus
tatcaggttttcctatgtacataca

SEQ ID NO: 755027 - DNA, 25 bp, Mus musculus
tatcaggttttcgtatgtacataca

SEQ ID NO: 755028 - DNA, 25 bp, Mus musculus
tatcagtaaaagaagtatgtaaccc

SEQ ID NO: 755029 - DNA, 25 bp, Mus musculus
tatcagtaaaagtagtatgtaaccc

SEQ ID NO: 755030 - DNA, 25 bp, Mus musculus
tatcagtatagcagtgggcctggtc

SEQ ID NO: 755031 - DNA, 25 bp, Mus musculus
tatcagtatagctgtgggcctggtc

SEQ ID NO: 755032 - DNA, 25 bp, Mus musculus
tatcagtctgtcaaatcaagccagt

SEQ ID NO: 755033 - DNA, 25 bp, Mus musculus
tatcagtctgtctaatcaagccagt

SEQ ID NO: 755034 - DNA, 25 bp, Mus musculus
tatcagtgacacataaagccattga

SEQ ID NO: 755035 - DNA, 25 bp, Mus musculus
tatcagtgacacttaaagccattga

SEQ ID NO: 755036 - DNA, 25 bp, Mus musculus
tatcagtgcaaactctaatggctcc

SEQ ID NO: 755037 - DNA, 25 bp, Mus musculus
tatcagtgcaaagtctaatggctcc

SEQ ID NO: 755038 - DNA, 25 bp, Mus musculus
tatcagtgcagactgtagagcgtgt

SEQ ID NO: 755039 - DNA, 25 bp, Mus musculus
tatcagtgcagagtgtagagcgtgt

SEQ ID NO: 755040 - DNA, 25 bp, Mus musculus
tatcagtgcagcctatgagagacga

SEQ ID NO: 755041 - DNA, 25 bp, Mus musculus
tatcagtgcagcgtatgagagacga

SEQ ID NO: 755042 - DNA, 25 bp, Mus musculus
tatcagtgccaccaaggtctgggtc

SEQ ID NO: 755043 - DNA, 25 bp, Mus musculus
tatcagtgccacgaaggtctgggtc

SEQ ID NO: 755044 - DNA, 25 bp, Mus musculus
tatcagtgctacagccgtcagggct

SEQ ID NO: 755045 - DNA, 25 bp, Mus musculus
tatcagtgctactgccgtcagggct

SEQ ID NO: 755046 - DNA, 25 bp, Mus musculus
tatcagtgggaccactcagaactca

SEQ ID NO: 755047 - DNA, 25 bp, Mus musculus
tatcagtgggacgactcagaactca

SEQ ID NO: 755048 - DNA, 25 bp, Mus musculus
tatcagtggtgtcgctctggcagca

SEQ ID NO: 755049 - DNA, 25 bp, Mus musculus
tatcagtggtgtggctctggcagca

SEQ ID NO: 755050 - DNA, 25 bp, Mus musculus
tatcagtgtcagaaggtggtccaga

SEQ ID NO: 755051 - DNA, 25 bp, Mus musculus
tatcagtgtcagtaggtggtccaga

SEQ ID NO: 755052 - DNA, 25 bp, Mus musculus
tatcagtgtgatccctctctcagga

SEQ ID NO: 755053 - DNA, 25 bp, Mus musculus
tatcagtgtgatgcctctctcagga

SEQ ID NO: 755054 - DNA, 25 bp, Mus musculus
tatcagtgtggacgaatcagtggat

SEQ ID NO: 755055 - DNA, 25 bp, Mus musculus
tatcagtgtggaggaatcagtggat

SEQ ID NO: 755056 - DNA, 25 bp, Mus musculus
tatcagttatgtcgcagcattgccc

SEQ ID NO: 755057 - DNA, 25 bp, Mus musculus
tatcagttatgtggcagcattgccc

SEQ ID NO: 755058 - DNA, 25 bp, Mus musculus
tatcagttcagtctccttgctcaga

SEQ ID NO: 755059 - DNA, 25 bp, Mus musculus
tatcagttcagtgtccttgctcaga

SEQ ID NO: 755060 - DNA, 25 bp, Mus musculus
tatcagttccgcaatctggcagaat

SEQ ID NO: 755061 - DNA, 25 bp, Mus musculus
tatcagttccgctatctggcagaat

SEQ ID NO: 755062 - DNA, 25 bp, Mus musculus
tatcagttgcttatacagtacaagg

SEQ ID NO: 755063 - DNA, 25 bp, Mus musculus
tatcagttgcttttacagtacaagg

SEQ ID NO: 755064 - DNA, 25 bp, Mus musculus
tatcataaacttagacaccagtctg

SEQ ID NO: 755065 - DNA, 25 bp, Mus musculus
tatcataaactttgacaccagtctg

SEQ ID NO: 755066 - DNA, 25 bp, Mus musculus
tatcataccaggatctgaaaagatc

SEQ ID NO: 755067 - DNA, 25 bp, Mus musculus
tatcataccaggttctgaaaagatc

SEQ ID NO: 755068 - DNA, 25 bp, Mus musculus
tatcatacgaagcaaactcacgtca

SEQ ID NO: 755069 - DNA, 25 bp, Mus musculus
tatcatacgaaggaaactcacgtca

SEQ ID NO: 755070 - DNA, 25 bp, Mus musculus
tatcatacttttagtgtgggccttg

SEQ ID NO: 755071 - DNA, 25 bp, Mus musculus
tatcatactttttgtgtgggccttg

SEQ ID NO: 755072 - DNA, 25 bp, Mus musculus
tatcatagcggtcacaatgatcgct

SEQ ID NO: 755073 - DNA, 25 bp, Mus musculus
tatcatagcggtgacaatgatcgct

SEQ ID NO: 755074 - DNA, 25 bp, Mus musculus
tatcataggaaaaggcctgctgggt

SEQ ID NO: 755075 - DNA, 25 bp, Mus musculus
tatcataggaaatggcctgctgggt

SEQ ID NO: 755076 - DNA, 25 bp, Mus musculus
tatcataggtgcacagcctctctgc

SEQ ID NO: 755077 - DNA, 25 bp, Mus musculus
tatcataggtgctcagcctctctgc

SEQ ID NO: 755078 - DNA, 25 bp, Mus musculus
tatcatcaaacaaccaggtgctgtg

SEQ ID NO: 755079 - DNA, 25 bp, Mus musculus
tatcatcaaacatccaggtgctgtg

SEQ ID NO: 755080 - DNA, 25 bp, Mus musculus
tatcatcaacctactgggagcgtgc

SEQ ID NO: 755081 - DNA, 25 bp, Mus musculus
tatcatcaaccttctgggagcgtgc

SEQ ID NO: 755082 - DNA, 25 bp, Mus musculus
tatcatcaattcatcctccatgagc

SEQ ID NO: 755083 - DNA, 25 bp, Mus musculus
tatcatcaattcttcctccatgagc

SEQ ID NO: 755084 - DNA, 25 bp, Mus musculus
tatcatcacagtacagtagcccgtc

SEQ ID NO: 755085 - DNA, 25 bp, Mus musculus
tatcatcacagttcagtagcccgtc

SEQ ID NO: 755086 - DNA, 25 bp, Mus musculus
tatcatcacgggattctcctacgcc

SEQ ID NO: 755087 - DNA, 25 bp, Mus musculus
tatcatcacgggtttctcctacgcc

SEQ ID NO: 755088 - DNA, 25 bp, Mus musculus
tatcatcatcgtagcttctgagcag

SEQ ID NO: 755089 - DNA, 25 bp, Mus musculus
tatcatcatcgttgcttctgagcag

SEQ ID NO: 755090 - DNA, 25 bp, Mus musculus
tatcatcatgtaaggtgtgaccagc

SEQ ID NO: 755091 - DNA, 25 bp, Mus musculus
tatcatcatgtatggtgtgaccagc

SEQ ID NO: 755092 - DNA, 25 bp, Mus musculus
tatcatcattgtctccaggtactgg

SEQ ID NO: 755093 - DNA, 25 bp, Mus musculus
tatcatcattgtgtccaggtactgg

SEQ ID NO: 755094 - DNA, 25 bp, Mus musculus
tatcatccatgtccagacgctaacc

SEQ ID NO: 755095 - DNA, 25 bp, Mus musculus
tatcatccatgtgcagacgctaacc

SEQ ID NO: 755096 - DNA, 25 bp, Mus musculus
tatcatcccaacatggcaagcactg

SEQ ID NO: 755097 - DNA, 25 bp, Mus musculus
tatcatcccaacttggcaagcactg

SEQ ID NO: 755098 - DNA, 25 bp, Mus musculus
tatcatccggacacggaagtccctg

SEQ ID NO: 755099 - DNA, 25 bp, Mus musculus
tatcatccggactcggaagtccctg

SEQ ID NO: 755100 - DNA, 25 bp, Mus musculus
tatcatcctgagagatgacctggac

SEQ ID NO: 755101 - DNA, 25 bp, Mus musculus
tatcatcctgagtgatgacctggac

SEQ ID NO: 755102 - DNA, 25 bp, Mus musculus
tatcatcctggacatcgcggccatc

SEQ ID NO: 755103 - DNA, 25 bp, Mus musculus
tatcatcctggagatcgcggccatc

SEQ ID NO: 755104 - DNA, 25 bp, Mus musculus
tatcatcgaaggcagtcaggcaggc

SEQ ID NO: 755105 - DNA, 25 bp, Mus musculus
tatcatcgaagggagtcaggcaggc

SEQ ID NO: 755106 - DNA, 25 bp, Mus musculus
tatcatcggcagacaattgctagca

SEQ ID NO: 755107 - DNA, 25 bp, Mus musculus
tatcatcggcagtcaattgctagca

SEQ ID NO: 755108 - DNA, 25 bp, Mus musculus
tatcatcggcttagccgtgacagtg

SEQ ID NO: 755109 - DNA, 25 bp, Mus musculus
tatcatcggctttgccgtgacagtg

SEQ ID NO: 755110 - DNA, 25 bp, Mus musculus
tatcatcgtctcctgcggatgggac

SEQ ID NO: 755111 - DNA, 25 bp, Mus musculus
tatcatcgtctcgtgcggatgggac

SEQ ID NO: 755112 - DNA, 25 bp, Mus musculus
tatcatctacaaagttgggaacggg

SEQ ID NO: 755113 - DNA, 25 bp, Mus musculus
tatcatctacaatgttgggaacggg

SEQ ID NO: 755114 - DNA, 25 bp, Mus musculus
tatcatctacagcagtggaggtcaa

SEQ ID NO: 755115 - DNA, 25 bp, Mus musculus
tatcatctacaggagtggaggtcaa

SEQ ID NO: 755116 - DNA, 25 bp, Mus musculus
tatcatctcagacttacaggatgac

SEQ ID NO: 755117 - DNA, 25 bp, Mus musculus
tatcatctcagagttacaggatgac

SEQ ID NO: 755118 - DNA, 25 bp, Mus musculus
tatcatctcatgaaggacgccacag

SEQ ID NO: 755119 - DNA, 25 bp, Mus musculus
tatcatctcatgtaggacgccacag

SEQ ID NO: 755120 - DNA, 25 bp, Mus musculus
tatcatctcttgactgacctcacaa

SEQ ID NO: 755121 - DNA, 25 bp, Mus musculus
tatcatctcttgtctgacctcacaa

SEQ ID NO: 755122 - DNA, 25 bp, Mus musculus
tatcatctgatacctgtgggatggc

SEQ ID NO: 755123 - DNA, 25 bp, Mus musculus
tatcatctgatagctgtgggatggc

SEQ ID NO: 755124 - DNA, 25 bp, Mus musculus
tatcatctgcctcttattgcccagc

SEQ ID NO: 755125 - DNA, 25 bp, Mus musculus
tatcatctgcctgttattgcccagc

SEQ ID NO: 755126 - DNA, 25 bp, Mus musculus
tatcatctgcttaaaccgacgaggg

SEQ ID NO: 755127 - DNA, 25 bp, Mus musculus
tatcatctgctttaaccgacgaggg

SEQ ID NO: 755128 - DNA, 25 bp, Mus musculus
tatcatctggataacgtggctgtat

SEQ ID NO: 755129 - DNA, 25 bp, Mus musculus
tatcatctggatagatcctgatgac

SEQ ID NO: 755130 - DNA, 25 bp, Mus musculus
tatcatctggattacgtggctgtat

SEQ ID NO: 755131 - DNA, 25 bp, Mus musculus
tatcatctggattgatcctgatgac

SEQ ID NO: 755132 - DNA, 25 bp, Mus musculus
tatcatctgtcaaaaatgggagccc

SEQ ID NO: 755133 - DNA, 25 bp, Mus musculus
tatcatctgtcaagggatcggagcc

SEQ ID NO: 755134 - DNA, 25 bp, Mus musculus
tatcatctgtcataaatgggagccc

SEQ ID NO: 755135 - DNA, 25 bp, Mus musculus
tatcatctgtcatgggatcggagcc

SEQ ID NO: 755136 - DNA, 25 bp, Mus musculus
tatcatgagcatcgatcccttttcg

SEQ ID NO: 755137 - DNA, 25 bp, Mus musculus
tatcatgagcatggatcccttttcg

SEQ ID NO: 755138 - DNA, 25 bp, Mus musculus
tatcatgagctcaaacacattgtgt

SEQ ID NO: 755139 - DNA, 25 bp, Mus musculus
tatcatgagctctaacacattgtgt

SEQ ID NO: 755140 - DNA, 25 bp, Mus musculus
tatcatgcatatcgtgaggtttgca

SEQ ID NO: 755141 - DNA, 25 bp, Mus musculus
tatcatgcatatggtgaggtttgca

SEQ ID NO: 755142 - DNA, 25 bp, Mus musculus
tatcatgcggggctggcaccaacac

SEQ ID NO: 755143 - DNA, 25 bp, Mus musculus
tatcatgcgggggtggcaccaacac

SEQ ID NO: 755144 - DNA, 25 bp, Mus musculus
tatcatgctggtcgctctacgcaga

SEQ ID NO: 755145 - DNA, 25 bp, Mus musculus
tatcatgctggtggctctacgcaga

SEQ ID NO: 755146 - DNA, 25 bp, Mus musculus
tatcatggacataggcttggatcac

SEQ ID NO: 755147 - DNA, 25 bp, Mus musculus
tatcatggacattggcttggatcac

SEQ ID NO: 755148 - DNA, 25 bp, Mus musculus
tatcatggatgacgaacactctcgc

SEQ ID NO: 755149 - DNA, 25 bp, Mus musculus
tatcatggatgaggaacactctcgc

SEQ ID NO: 755150 - DNA, 25 bp, Mus musculus
tatcatggcattacagaggaggaca

SEQ ID NO: 755151 - DNA, 25 bp, Mus musculus
tatcatggcatttcagaggaggaca

SEQ ID NO: 755152 - DNA, 25 bp, Mus musculus
tatcatggccctagtgccagagagt

SEQ ID NO: 755153 - DNA, 25 bp, Mus musculus
tatcatggcccttgtgccagagagt

SEQ ID NO: 755154 - DNA, 25 bp, Mus musculus
tatcatggctggctcaaacagatct

SEQ ID NO: 755155 - DNA, 25 bp, Mus musculus
tatcatggctgggtcaaacagatct

SEQ ID NO: 755156 - DNA, 25 bp, Mus musculus
tatcatggctgtcatcctgggcatc

SEQ ID NO: 755157 - DNA, 25 bp, Mus musculus
tatcatggctgtgatcctgggcatc

SEQ ID NO: 755158 - DNA, 25 bp, Mus musculus
tatcatgggtaaagccaaagtgaag

SEQ ID NO: 755159 - DNA, 25 bp, Mus musculus
tatcatgggtaatgccaaagtgaag

SEQ ID NO: 755160 - DNA, 25 bp, Mus musculus
tatcatggtaatcggagccatgctg

SEQ ID NO: 755161 - DNA, 25 bp, Mus musculus
tatcatggtaatgggagccatgctg

SEQ ID NO: 755162 - DNA, 25 bp, Mus musculus
tatcatgtttgtacaggaagaggcc

SEQ ID NO: 755163 - DNA, 25 bp, Mus musculus
tatcatgtttgttcaggaagaggcc

SEQ ID NO: 755164 - DNA, 25 bp, Mus musculus
tatcattacaagatatggcaagccg

SEQ ID NO: 755165 - DNA, 25 bp, Mus musculus
tatcattacaagttatggcaagccg

SEQ ID NO: 755166 - DNA, 25 bp, Mus musculus
tatcattactctccattcaagtcct

SEQ ID NO: 755167 - DNA, 25 bp, Mus musculus
tatcattactctgcattcaagtcct

SEQ ID NO: 755168 - DNA, 25 bp, Mus musculus
tatcattagcaacgccaggtggcag

SEQ ID NO: 755169 - DNA, 25 bp, Mus musculus
tatcattagcaaggccaggtggcag

SEQ ID NO: 755170 - DNA, 25 bp, Mus musculus
tatcattatctgagctggcctatct

SEQ ID NO: 755171 - DNA, 25 bp, Mus musculus
tatcattatctgtgctggcctatct

SEQ ID NO: 755172 - DNA, 25 bp, Mus musculus
tatcattcagtgacacctgaccgac

SEQ ID NO: 755173 - DNA, 25 bp, Mus musculus
tatcattcagtgtcacctgaccgac

SEQ ID NO: 755174 - DNA, 25 bp, Mus musculus
tatcattcgaagagccttttattct

SEQ ID NO: 755175 - DNA, 25 bp, Mus musculus
tatcattcgaagtgccttttattct

SEQ ID NO: 755176 - DNA, 25 bp, Mus musculus
tatcattcggctacggaacaagacg

SEQ ID NO: 755177 - DNA, 25 bp, Mus musculus
tatcattcggcttcggaacaagacg

SEQ ID NO: 755178 - DNA, 25 bp, Mus musculus
tatcattgacaactgtaagcttgtt

SEQ ID NO: 755179 - DNA, 25 bp, Mus musculus
tatcattgacaagtgtaagcttgtt

SEQ ID NO: 755180 - DNA, 25 bp, Mus musculus
tatcattgactgctggattgacaat

SEQ ID NO: 755181 - DNA, 25 bp, Mus musculus
tatcattgactggtggattgacaat

SEQ ID NO: 755182 - DNA, 25 bp, Mus musculus
tatcattgagcaagttcgagacggc

SEQ ID NO: 755183 - DNA, 25 bp, Mus musculus
tatcattgagcatgttcgagacggc

SEQ ID NO: 755184 - DNA, 25 bp, Mus musculus
tatcattgagccctttgacgacagg

SEQ ID NO: 755185 - DNA, 25 bp, Mus musculus
tatcattgagccgtttgacgacagg

SEQ ID NO: 755186 - DNA, 25 bp, Mus musculus
tatcattgatgaagactgtgggccc

SEQ ID NO: 755187 - DNA, 25 bp, Mus musculus
tatcattgatgatgactgtgggccc

SEQ ID NO: 755188 - DNA, 25 bp, Mus musculus
tatcattgctgacgtcaaagcccag

SEQ ID NO: 755189 - DNA, 25 bp, Mus musculus
tatcattgctgaggtcaaagcccag

SEQ ID NO: 755190 - DNA, 25 bp, Mus musculus
tatcatttacctcagccgtgctggg

SEQ ID NO: 755191 - DNA, 25 bp, Mus musculus
tatcatttacctgagccgtgctggg

SEQ ID NO: 755192 - DNA, 25 bp, Mus musculus
tatcattttgtcagcgctcctaaag

SEQ ID NO: 755193 - DNA, 25 bp, Mus musculus
tatcattttgtctgcgctcctaaag

SEQ ID NO: 755194 - DNA, 25 bp, Mus musculus
tatccaaaatgacggtgccagtccc

SEQ ID NO: 755195 - DNA, 25 bp, Mus musculus
tatccaaaatgagggtgccagtccc

SEQ ID NO: 755196 - DNA, 25 bp, Mus musculus
tatccaaacaaacgcacttactgtc

SEQ ID NO: 755197 - DNA, 25 bp, Mus musculus
tatccaaacaaaggcacttactgtc

SEQ ID NO: 755198 - DNA, 25 bp, Mus musculus
tatccaaacctgaggctggtacccg

SEQ ID NO: 755199 - DNA, 25 bp, Mus musculus
tatccaaacctgtggctggtacccg

SEQ ID NO: 755200 - DNA, 25 bp, Mus musculus
tatccaaactagagccttcagagag

SEQ ID NO: 755201 - DNA, 25 bp, Mus musculus
tatccaaactagtgccttcagagag

SEQ ID NO: 755202 - DNA, 25 bp, Mus musculus
tatccaaaggagcttggctcggagc

SEQ ID NO: 755203 - DNA, 25 bp, Mus musculus
tatccaaaggaggttggctcggagc

SEQ ID NO: 755204 - DNA, 25 bp, Mus musculus
tatccaacaaaacaacttaagagag

SEQ ID NO: 755205 - DNA, 25 bp, Mus musculus
tatccaacaaaagaacttaagagag

SEQ ID NO: 755206 - DNA, 25 bp, Mus musculus
tatccaacaccaaacccagatgagc

SEQ ID NO: 755207 - DNA, 25 bp, Mus musculus
tatccaacaccatacccagatgagc

SEQ ID NO: 755208 - DNA, 25 bp, Mus musculus
tatccaagacacctgcctctatgag

SEQ ID NO: 755209 - DNA, 25 bp, Mus musculus
tatccaagacacgtgcctctatgag

SEQ ID NO: 755210 - DNA, 25 bp, Mus musculus
tatccaagaggtcagagactcccac

SEQ ID NO: 755211 - DNA, 25 bp, Mus musculus
tatccaagaggtgagagactcccac

SEQ ID NO: 755212 - DNA, 25 bp, Mus musculus
tatccaagatcacagggaattctgg

SEQ ID NO: 755213 - DNA, 25 bp, Mus musculus
tatccaagatcagagggaattctgg

SEQ ID NO: 755214 - DNA, 25 bp, Mus musculus
tatccaaggctgctaaatccaacta

SEQ ID NO: 755215 - DNA, 25 bp, Mus musculus
tatccaaggctggtaaatccaacta

SEQ ID NO: 755216 - DNA, 25 bp, Mus musculus
tatccaagtagacaacacaaaggtc

SEQ ID NO: 755217 - DNA, 25 bp, Mus musculus
tatccaagtagagaacacaaaggtc

SEQ ID NO: 755218 - DNA, 25 bp, Mus musculus
tatccaagtgagaagagcccgtgtg

SEQ ID NO: 755219 - DNA, 25 bp, Mus musculus
tatccaagtgagtagagcccgtgtg

SEQ ID NO: 755220 - DNA, 25 bp, Mus musculus
tatccaatcacaccttgcagcaaga

SEQ ID NO: 755221 - DNA, 25 bp, Mus musculus
tatccaatcacagcttgcagcaaga

SEQ ID NO: 755222 - DNA, 25 bp, Mus musculus
tatccaatgacaatggcactttctg

SEQ ID NO: 755223 - DNA, 25 bp, Mus musculus
tatccaatgacattggcactttctg

SEQ ID NO: 755224 - DNA, 25 bp, Mus musculus
tatccaatggaacctgttcctctgc

SEQ ID NO: 755225 - DNA, 25 bp, Mus musculus
tatccaatggaagctgttcctctgc

SEQ ID NO: 755226 - DNA, 25 bp, Mus musculus
tatccaatttcgatcagcagcagct

SEQ ID NO: 755227 - DNA, 25 bp, Mus musculus
tatccaatttcgttcagcagcagct

SEQ ID NO: 755228 - DNA, 25 bp, Mus musculus
tatccacacttcacacaaggctagc

SEQ ID NO: 755229 - DNA, 25 bp, Mus musculus
tatccacacttctcacaaggctagc

SEQ ID NO: 755230 - DNA, 25 bp, Mus musculus
tatccacagagacctgaagtcaccc

SEQ ID NO: 755231 - DNA, 25 bp, Mus musculus
tatccacagagagctgaagtcaccc

SEQ ID NO: 755232 - DNA, 25 bp, Mus musculus
tatccacaggaacctttcacaacag

SEQ ID NO: 755233 - DNA, 25 bp, Mus musculus
tatccacaggaagctttcacaacag

SEQ ID NO: 755234 - DNA, 25 bp, Mus musculus
tatccacagggtcgttaccctcaag

SEQ ID NO: 755235 - DNA, 25 bp, Mus musculus
tatccacagggtggttaccctcaag

SEQ ID NO: 755236 - DNA, 25 bp, Mus musculus
tatccacaggttaacgtcatcaact

SEQ ID NO: 755237 - DNA, 25 bp, Mus musculus
tatccacaggtttacgtcatcaact

SEQ ID NO: 755238 - DNA, 25 bp, Mus musculus
tatccacagttcaaaaagatgtctg

SEQ ID NO: 755239 - DNA, 25 bp, Mus musculus
tatccacagttctaaaagatgtctg

SEQ ID NO: 755240 - DNA, 25 bp, Mus musculus
tatccacatttcatacctcagcaag

SEQ ID NO: 755241 - DNA, 25 bp, Mus musculus
tatccacatttcttacctcagcaag

SEQ ID NO: 755242 - DNA, 25 bp, Mus musculus
tatccaccaacaaatggccagtggg

SEQ ID NO: 755243 - DNA, 25 bp, Mus musculus
tatccaccaacatatggccagtggg

SEQ ID NO: 755244 - DNA, 25 bp, Mus musculus
tatccaccctggagaggacttcctg

SEQ ID NO: 755245 - DNA, 25 bp, Mus musculus
tatccaccctggtgaggacttcctg

SEQ ID NO: 755246 - DNA, 25 bp, Mus musculus
tatccaccggctctaatcgatgcat

SEQ ID NO: 755247 - DNA, 25 bp, Mus musculus
tatccaccggctgtaatcgatgcat

SEQ ID NO: 755248 - DNA, 25 bp, Mus musculus
tatccacctggaattgaaccgcaag

SEQ ID NO: 755249 - DNA, 25 bp, Mus musculus
tatccacctggatttgaaccgcaag

SEQ ID NO: 755250 - DNA, 25 bp, Mus musculus
tatccacgatgccttttctggccgc

SEQ ID NO: 755251 - DNA, 25 bp, Mus musculus
tatccacgatgcgttttctggccgc

SEQ ID NO: 755252 - DNA, 25 bp, Mus musculus
tatccacggattcaactttacaaga

SEQ ID NO: 755253 - DNA, 25 bp, Mus musculus
tatccacggattgaactttacaaga

SEQ ID NO: 755254 - DNA, 25 bp, Mus musculus
tatccagaaaagagtcatcattgtg

SEQ ID NO: 755255 - DNA, 25 bp, Mus musculus
tatccagaaaagtgtcatcattgtg

SEQ ID NO: 755256 - DNA, 25 bp, Mus musculus
tatccagaataacgaaaaaggttag

SEQ ID NO: 755257 - DNA, 25 bp, Mus musculus
tatccagaataaggaaaaaggttag

SEQ ID NO: 755258 - DNA, 25 bp, Mus musculus
tatccagacccacaggacgctttca

SEQ ID NO: 755259 - DNA, 25 bp, Mus musculus
tatccagacccagaggacgctttca

SEQ ID NO: 755260 - DNA, 25 bp, Mus musculus
tatccagagcggagtacgaggttct

SEQ ID NO: 755261 - DNA, 25 bp, Mus musculus
tatccagagcggtgtacgaggttct

SEQ ID NO: 755262 - DNA, 25 bp, Mus musculus
tatccagagggaacttacggtaacc

SEQ ID NO: 755263 - DNA, 25 bp, Mus musculus
tatccagagggatcttacggtaacc

SEQ ID NO: 755264 - DNA, 25 bp, Mus musculus
tatccagatcagactacagctgagg

SEQ ID NO: 755265 - DNA, 25 bp, Mus musculus
tatccagatcagtctacagctgagg

SEQ ID NO: 755266 - DNA, 25 bp, Mus musculus
tatccagatgaaatccaaaggccac

SEQ ID NO: 755267 - DNA, 25 bp, Mus musculus
tatccagatgaattccaaaggccac

SEQ ID NO: 755268 - DNA, 25 bp, Mus musculus
tatccagattgtcctgatgcgggca

SEQ ID NO: 755269 - DNA, 25 bp, Mus musculus
tatccagattgtgctgatgcgggca

SEQ ID NO: 755270 - DNA, 25 bp, Mus musculus
tatccagccgttcaggagaatgcag

SEQ ID NO: 755271 - DNA, 25 bp, Mus musculus
tatccagccgttgaggagaatgcag

SEQ ID NO: 755272 - DNA, 25 bp, Mus musculus
tatccagctctgagggcttatccgg

SEQ ID NO: 755273 - DNA, 25 bp, Mus musculus
tatccagctctgtgggcttatccgg

SEQ ID NO: 755274 - DNA, 25 bp, Mus musculus
tatccagctgacacctgtgcctgtg

SEQ ID NO: 755275 - DNA, 25 bp, Mus musculus
tatccagctgactcctgtgcctgtg

SEQ ID NO: 755276 - DNA, 25 bp, Mus musculus
tatccagcttctcatcgccatcgag

SEQ ID NO: 755277 - DNA, 25 bp, Mus musculus
tatccagcttctgatcgccatcgag

SEQ ID NO: 755278 - DNA, 25 bp, Mus musculus
tatccaggagccaatgctgaatgct

SEQ ID NO: 755279 - DNA, 25 bp, Mus musculus
tatccaggagcctatgctgaatgct

SEQ ID NO: 755280 - DNA, 25 bp, Mus musculus
tatccaggagggaatatgtgggacc

SEQ ID NO: 755281 - DNA, 25 bp, Mus musculus
tatccaggagggtatatgtgggacc

SEQ ID NO: 755282 - DNA, 25 bp, Mus musculus
tatccaggagtaagagtaagcgcta

SEQ ID NO: 755283 - DNA, 25 bp, Mus musculus
tatccaggagtatgagtaagcgcta

SEQ ID NO: 755284 - DNA, 25 bp, Mus musculus
tatccaggcaatcggctcgggtacg

SEQ ID NO: 755285 - DNA, 25 bp, Mus musculus
tatccaggcaatgggctcgggtacg

SEQ ID NO: 755286 - DNA, 25 bp, Mus musculus
tatccaggcctgcaagtgtacacct

SEQ ID NO: 755287 - DNA, 25 bp, Mus musculus
tatccaggcctggaagtgtacacct

SEQ ID NO: 755288 - DNA, 25 bp, Mus musculus
tatccaggtgacaccgcaggagaag

SEQ ID NO: 755289 - DNA, 25 bp, Mus musculus
tatccaggtgactccgcaggagaag

SEQ ID NO: 755290 - DNA, 25 bp, Mus musculus
tatccaggtgatattcggcgctgtg

SEQ ID NO: 755291 - DNA, 25 bp, Mus musculus
tatccaggtgattttcggcgctgtg

SEQ ID NO: 755292 - DNA, 25 bp, Mus musculus
tatccaggtggtattcgacgccgtc

SEQ ID NO: 755293 - DNA, 25 bp, Mus musculus
tatccaggtggttttcgacgccgtc

SEQ ID NO: 755294 - DNA, 25 bp, Mus musculus
tatccagtccttcagtgccatggcg

SEQ ID NO: 755295 - DNA, 25 bp, Mus musculus
tatccagtccttgagtgccatggcg

SEQ ID NO: 755296 - DNA, 25 bp, Mus musculus
tatccagttggtcccatctatccac

SEQ ID NO: 755297 - DNA, 25 bp, Mus musculus
tatccagttggtgccatctatccac

SEQ ID NO: 755298 - DNA, 25 bp, Mus musculus
tatccagtttaaaaaacacgaggag

SEQ ID NO: 755299 - DNA, 25 bp, Mus musculus
tatccagtttaataaacacgaggag

SEQ ID NO: 755300 - DNA, 25 bp, Mus musculus
tatccagtttgcacggaaccaccct

SEQ ID NO: 755301 - DNA, 25 bp, Mus musculus
tatccagtttgctcggaaccaccct

SEQ ID NO: 755302 - DNA, 25 bp, Mus musculus
tatccatagccacaagagaaaccca

SEQ ID NO: 755303 - DNA, 25 bp, Mus musculus
tatccatagccagaagagaaaccca

SEQ ID NO: 755304 - DNA, 25 bp, Mus musculus
tatccatccacactccaaagattgg

SEQ ID NO: 755305 - DNA, 25 bp, Mus musculus
tatccatccacagtccaaagattgg

SEQ ID NO: 755306 - DNA, 25 bp, Mus musculus
tatccatcgagaattggctgccaga

SEQ ID NO: 755307 - DNA, 25 bp, Mus musculus
tatccatcgagatttggctgccaga

SEQ ID NO: 755308 - DNA, 25 bp, Mus musculus
tatccatcgcagctgggtctgtgac

SEQ ID NO: 755309 - DNA, 25 bp, Mus musculus
tatccatcgcaggtgggtctgtgac

SEQ ID NO: 755310 - DNA, 25 bp, Mus musculus
tatccatcgctgaggcgagcaacac

SEQ ID NO: 755311 - DNA, 25 bp, Mus musculus
tatccatcgctgtggcgagcaacac

SEQ ID NO: 755312 - DNA, 25 bp, Mus musculus
tatccatcttatagctagttgcagc

SEQ ID NO: 755313 - DNA, 25 bp, Mus musculus
tatccatcttattgctagttgcagc

SEQ ID NO: 755314 - DNA, 25 bp, Mus musculus
tatccatgacaaagggcacattgct

SEQ ID NO: 755315 - DNA, 25 bp, Mus musculus
tatccatgacaatgggcacattgct

SEQ ID NO: 755316 - DNA, 25 bp, Mus musculus
tatccatgccatagccacactaaag

SEQ ID NO: 755317 - DNA, 25 bp, Mus musculus
tatccatgccattgccacactaaag

SEQ ID NO: 755318 - DNA, 25 bp, Mus musculus
tatccatgcggtcagatactccacg

SEQ ID NO: 755319 - DNA, 25 bp, Mus musculus
tatccatgcggtgagatactccacg

SEQ ID NO: 755320 - DNA, 25 bp, Mus musculus
tatccatggagcaaaaaatactttc

SEQ ID NO: 755321 - DNA, 25 bp, Mus musculus
tatccatggagctaaaaatactttc

SEQ ID NO: 755322 - DNA, 25 bp, Mus musculus
tatccatgggcccaaaatttttcaa

SEQ ID NO: 755323 - DNA, 25 bp, Mus musculus
tatccatgggccgaaaatttttcaa

SEQ ID NO: 755324 - DNA, 25 bp, Mus musculus
tatccatgtgcaacgggactgggat

SEQ ID NO: 755325 - DNA, 25 bp, Mus musculus
tatccatgtgcatcgggactgggat

SEQ ID NO: 755326 - DNA, 25 bp, Mus musculus
tatccattgaaaaataggcttgaac

SEQ ID NO: 755327 - DNA, 25 bp, Mus musculus
tatccattgaaatataggcttgaac

SEQ ID NO: 755328 - DNA, 25 bp, Mus musculus
tatccattgcatcgtatgggccaag

SEQ ID NO: 755329 - DNA, 25 bp, Mus musculus
tatccattgcatggtatgggccaag

SEQ ID NO: 755330 - DNA, 25 bp, Mus musculus
tatcccaaactcattctgcagaaca

SEQ ID NO: 755331 - DNA, 25 bp, Mus musculus
tatcccaaactctttctgcagaaca

SEQ ID NO: 755332 - DNA, 25 bp, Mus musculus
tatcccaaagataccgacttggtgg

SEQ ID NO: 755333 - DNA, 25 bp, Mus musculus
tatcccaaagattccgacttggtgg

SEQ ID NO: 755334 - DNA, 25 bp, Mus musculus
tatcccaagaccaaaagcccagaga

SEQ ID NO: 755335 - DNA, 25 bp, Mus musculus
tatcccaagacctaaagcccagaga

SEQ ID NO: 755336 - DNA, 25 bp, Mus musculus
tatcccacaagacacagtgactgag

SEQ ID NO: 755337 - DNA, 25 bp, Mus musculus
tatcccacaagagacagtgactgag

SEQ ID NO: 755338 - DNA, 25 bp, Mus musculus
tatcccacagggataaagagtcaca

SEQ ID NO: 755339 - DNA, 25 bp, Mus musculus
tatcccacagggttaaagagtcaca

SEQ ID NO: 755340 - DNA, 25 bp, Mus musculus
tatcccacgagtaatgcttgcttca

SEQ ID NO: 755341 - DNA, 25 bp, Mus musculus
tatcccacgagttatgcttgcttca

SEQ ID NO: 755342 - DNA, 25 bp, Mus musculus
tatcccacgcatctccaatgagcag

SEQ ID NO: 755343 - DNA, 25 bp, Mus musculus
tatcccacgcatgtccaatgagcag

SEQ ID NO: 755344 - DNA, 25 bp, Mus musculus
tatcccactactcctccggaaattg

SEQ ID NO: 755345 - DNA, 25 bp, Mus musculus
tatcccactactgctccggaaattg

SEQ ID NO: 755346 - DNA, 25 bp, Mus musculus
tatcccactagtagaagaggtctct

SEQ ID NO: 755347 - DNA, 25 bp, Mus musculus
tatcccactagttgaagaggtctct

SEQ ID NO: 755348 - DNA, 25 bp, Mus musculus
tatcccagaatcacctaccaacttt

SEQ ID NO: 755349 - DNA, 25 bp, Mus musculus
tatcccagaatctcctaccaacttt

SEQ ID NO: 755350 - DNA, 25 bp, Mus musculus
tatcccagagggatattgtggatat

SEQ ID NO: 755351 - DNA, 25 bp, Mus musculus
tatcccagagggttattgtggatat

SEQ ID NO: 755352 - DNA, 25 bp, Mus musculus
tatcccaggtggagtttgtcagcaa

SEQ ID NO: 755353 - DNA, 25 bp, Mus musculus
tatcccaggtggtgtttgtcagcaa

SEQ ID NO: 755354 - DNA, 25 bp, Mus musculus
tatcccagttcgcacagagaatggt

SEQ ID NO: 755355 - DNA, 25 bp, Mus musculus
tatcccagttcggacagagaatggt

SEQ ID NO: 755356 - DNA, 25 bp, Mus musculus
tatcccatgcttccgggatttgggc

SEQ ID NO: 755357 - DNA, 25 bp, Mus musculus
tatcccatgcttgcgggatttgggc

SEQ ID NO: 755358 - DNA, 25 bp, Mus musculus
tatcccatgggcatattactcaact

SEQ ID NO: 755359 - DNA, 25 bp, Mus musculus
tatcccatgggcttattactcaact

SEQ ID NO: 755360 - DNA, 25 bp, Mus musculus
tatcccatgtggcaaacccaatacg

SEQ ID NO: 755361 - DNA, 25 bp, Mus musculus
tatcccatgtgggaaacccaatacg

SEQ ID NO: 755362 - DNA, 25 bp, Mus musculus
tatcccattatccagagcacttgaa

SEQ ID NO: 755363 - DNA, 25 bp, Mus musculus
tatcccattatcgagagcacttgaa

SEQ ID NO: 755364 - DNA, 25 bp, Mus musculus
tatccccacgatcgtaaagatgacc

SEQ ID NO: 755365 - DNA, 25 bp, Mus musculus
tatccccacgatggtaaagatgacc

SEQ ID NO: 755366 - DNA, 25 bp, Mus musculus
tatccccagagtctgaaatagagca

SEQ ID NO: 755367 - DNA, 25 bp, Mus musculus
tatccccagagtgtgaaatagagca

SEQ ID NO: 755368 - DNA, 25 bp, Mus musculus
tatccccataagcagcgcttgcatg

SEQ ID NO: 755369 - DNA, 25 bp, Mus musculus
tatccccataaggagcgcttgcatg

SEQ ID NO: 755370 - DNA, 25 bp, Mus musculus
tatccccgtgtcctggagatgcgat

SEQ ID NO: 755371 - DNA, 25 bp, Mus musculus
tatccccgtgtcgtggagatgcgat

SEQ ID NO: 755372 - DNA, 25 bp, Mus musculus
tatcccctgcgcattgaacgtgcca

SEQ ID NO: 755373 - DNA, 25 bp, Mus musculus
tatcccctgcgctttgaacgtgcca

SEQ ID NO: 755374 - DNA, 25 bp, Mus musculus
tatcccctggctatccagatatgcg

SEQ ID NO: 755375 - DNA, 25 bp, Mus musculus
tatcccctggctttccagatatgcg

SEQ ID NO: 755376 - DNA, 25 bp, Mus musculus
tatcccgatgtgcagtatgatatac

SEQ ID NO: 755377 - DNA, 25 bp, Mus musculus
tatcccgatgtggagtatgatatac

SEQ ID NO: 755378 - DNA, 25 bp, Mus musculus
tatcccggcaatcgcagttttttcc

SEQ ID NO: 755379 - DNA, 25 bp, Mus musculus
tatcccggcaatggcagttttttcc

SEQ ID NO: 755380 - DNA, 25 bp, Mus musculus
tatcccgggactacagtaccagggc

SEQ ID NO: 755381 - DNA, 25 bp, Mus musculus
tatcccgggacttcagtaccagggc

SEQ ID NO: 755382 - DNA, 25 bp, Mus musculus
tatcccgggcatccatgggttccaa

SEQ ID NO: 755383 - DNA, 25 bp, Mus musculus
tatcccgggcatgcatgggttccaa

SEQ ID NO: 755384 - DNA, 25 bp, Mus musculus
tatccctagaagcagctagctactc

SEQ ID NO: 755385 - DNA, 25 bp, Mus musculus
tatccctagaaggagctagctactc

SEQ ID NO: 755386 - DNA, 25 bp, Mus musculus
tatccctatctcagctgcactgagc

SEQ ID NO: 755387 - DNA, 25 bp, Mus musculus
tatccctatctctgctgcactgagc

SEQ ID NO: 755388 - DNA, 25 bp, Mus musculus
tatccctccagaagaggtcatccct

SEQ ID NO: 755389 - DNA, 25 bp, Mus musculus
tatccctccagatgaggtcatccct

SEQ ID NO: 755390 - DNA, 25 bp, Mus musculus
tatccctcgaataagccgagtcagg

SEQ ID NO: 755391 - DNA, 25 bp, Mus musculus
tatccctcgaattagccgagtcagg

SEQ ID NO: 755392 - DNA, 25 bp, Mus musculus
tatccctgagagcaccgtgtggaag

SEQ ID NO: 755393 - DNA, 25 bp, Mus musculus
tatccctgagaggaccgtgtggaag

SEQ ID NO: 755394 - DNA, 25 bp, Mus musculus
tatccctgagcgcaagaaaagccct

SEQ ID NO: 755395 - DNA, 25 bp, Mus musculus
tatccctgagcggaagaaaagccct

SEQ ID NO: 755396 - DNA, 25 bp, Mus musculus
tatccctgcaaccatgtcatgctct

SEQ ID NO: 755397 - DNA, 25 bp, Mus musculus
tatccctgcaacgatgtcatgctct

SEQ ID NO: 755398 - DNA, 25 bp, Mus musculus
tatccctgcgctcactgaggctggg

SEQ ID NO: 755399 - DNA, 25 bp, Mus musculus
tatccctgcgctgactgaggctggg

SEQ ID NO: 755400 - DNA, 25 bp, Mus musculus
tatccctgctcgcttgtgggcaact

SEQ ID NO: 755401 - DNA, 25 bp, Mus musculus
tatccctgctcggttgtgggcaact

SEQ ID NO: 755402 - DNA, 25 bp, Mus musculus
tatccctggagtatttggtggcccg

SEQ ID NO: 755403 - DNA, 25 bp, Mus musculus
tatccctggagtttttggtggcccg

SEQ ID NO: 755404 - DNA, 25 bp, Mus musculus
tatccctggcacaccacagggagag

SEQ ID NO: 755405 - DNA, 25 bp, Mus musculus
tatccctggcactccacagggagag

SEQ ID NO: 755406 - DNA, 25 bp, Mus musculus
tatccctggtgtatctgcagtgccg

SEQ ID NO: 755407 - DNA, 25 bp, Mus musculus
tatccctggtgtttctgcagtgccg

SEQ ID NO: 755408 - DNA, 25 bp, Mus musculus
tatcccttcaggactaggtgcagaa

SEQ ID NO: 755409 - DNA, 25 bp, Mus musculus
tatcccttcaggtctaggtgcagaa

SEQ ID NO: 755410 - DNA, 25 bp, Mus musculus
tatccctttaagaaataccatcctc

SEQ ID NO: 755411 - DNA, 25 bp, Mus musculus
tatccctttaagtaataccatcctc

SEQ ID NO: 755412 - DNA, 25 bp, Mus musculus
tatccctttaatcacccatactgag

SEQ ID NO: 755413 - DNA, 25 bp, Mus musculus
tatccctttaatgacccatactgag

SEQ ID NO: 755414 - DNA, 25 bp, Mus musculus
tatccctttggaacgcaatggcaag

SEQ ID NO: 755415 - DNA, 25 bp, Mus musculus
tatccctttggatcgcaatggcaag

SEQ ID NO: 755416 - DNA, 25 bp, Mus musculus
tatccgaaaaaacgaagaatagctg

SEQ ID NO: 755417 - DNA, 25 bp, Mus musculus
tatccgaaaaaaggaagaatagctg

SEQ ID NO: 755418 - DNA, 25 bp, Mus musculus
tatccgaaaataccagggcagcgac

SEQ ID NO: 755419 - DNA, 25 bp, Mus musculus
tatccgaaaatagcagggcagcgac

SEQ ID NO: 755420 - DNA, 25 bp, Mus musculus
tatccgaagtacctggagcacctct

SEQ ID NO: 755421 - DNA, 25 bp, Mus musculus
tatccgaagtacgtggagcacctct

SEQ ID NO: 755422 - DNA, 25 bp, Mus musculus
tatccgacagggaagcgtaagctgg

SEQ ID NO: 755423 - DNA, 25 bp, Mus musculus
tatccgacagggtagcgtaagctgg

SEQ ID NO: 755424 - DNA, 25 bp, Mus musculus
tatccgaggaataacattgagtatg

SEQ ID NO: 755425 - DNA, 25 bp, Mus musculus
tatccgaggaattacattgagtatg

SEQ ID NO: 755426 - DNA, 25 bp, Mus musculus
tatccgaggatgaactctctacggg

SEQ ID NO: 755427 - DNA, 25 bp, Mus musculus
tatccgaggatgtactctctacggg

SEQ ID NO: 755428 - DNA, 25 bp, Mus musculus
tatccgagggctcgtcacctccaag

SEQ ID NO: 755429 - DNA, 25 bp, Mus musculus
tatccgagggctggtcacctccaag

SEQ ID NO: 755430 - DNA, 25 bp, Mus musculus
tatccgatgcccactagggacatac

SEQ ID NO: 755431 - DNA, 25 bp, Mus musculus
tatccgatgccctctagggacatac

SEQ ID NO: 755432 - DNA, 25 bp, Mus musculus
tatccgatttggcaagctggatgct

SEQ ID NO: 755433 - DNA, 25 bp, Mus musculus
tatccgatttgggaagctggatgct

SEQ ID NO: 755434 - DNA, 25 bp, Mus musculus
tatccgcaaagtccccaagggcgtg

SEQ ID NO: 755435 - DNA, 25 bp, Mus musculus
tatccgcaaagtgcccaagggcgtg

SEQ ID NO: 755436 - DNA, 25 bp, Mus musculus
tatccgcaactcataagcgtcgtgc

SEQ ID NO: 755437 - DNA, 25 bp, Mus musculus
tatccgcaactcttaagcgtcgtgc

SEQ ID NO: 755438 - DNA, 25 bp, Mus musculus
tatccgcatggtcttcaatgggcct

SEQ ID NO: 755439 - DNA, 25 bp, Mus musculus
tatccgcatggtgttcaatgggcct

SEQ ID NO: 755440 - DNA, 25 bp, Mus musculus
tatccgcatgtaagatctcaactcc

SEQ ID NO: 755441 - DNA, 25 bp, Mus musculus
tatccgcatgtatgatctcaactcc

SEQ ID NO: 755442 - DNA, 25 bp, Mus musculus
tatccgcgctctaccgatttgtgcg

SEQ ID NO: 755443 - DNA, 25 bp, Mus musculus
tatccgcgctcttccgatttgtgcg

SEQ ID NO: 755444 - DNA, 25 bp, Mus musculus
tatccgctcataagcctctgtggtg

SEQ ID NO: 755445 - DNA, 25 bp, Mus musculus
tatccgctcatatgcctctgtggtg

SEQ ID NO: 755446 - DNA, 25 bp, Mus musculus
tatccgctggagctgaccaaactta

SEQ ID NO: 755447 - DNA, 25 bp, Mus musculus
tatccgctggaggtgaccaaactta

SEQ ID NO: 755448 - DNA, 25 bp, Mus musculus
tatccgctgtctccagcggtgcgcg

SEQ ID NO: 755449 - DNA, 25 bp, Mus musculus
tatccgctgtctgcagcggtgcgcg

SEQ ID NO: 755450 - DNA, 25 bp, Mus musculus
tatccggaacacatataaccagacg

SEQ ID NO: 755451 - DNA, 25 bp, Mus musculus
tatccggaacacttataaccagacg

SEQ ID NO: 755452 - DNA, 25 bp, Mus musculus
tatccggactgtcgtaagaggtcag

SEQ ID NO: 755453 - DNA, 25 bp, Mus musculus
tatccggactgtggtaagaggtcag

SEQ ID NO: 755454 - DNA, 25 bp, Mus musculus
tatccggcaggcaggagtttatcac

SEQ ID NO: 755455 - DNA, 25 bp, Mus musculus
tatccggcaggctggagtttatcac

SEQ ID NO: 755456 - DNA, 25 bp, Mus musculus
tatccggcatagcttcggaaaggaa

SEQ ID NO: 755457 - DNA, 25 bp, Mus musculus
tatccggcataggttcggaaaggaa

SEQ ID NO: 755458 - DNA, 25 bp, Mus musculus
tatccggcattaaattaccctgagc

SEQ ID NO: 755459 - DNA, 25 bp, Mus musculus
tatccggcattatattaccctgagc

SEQ ID NO: 755460 - DNA, 25 bp, Mus musculus
tatccggctcctagtggagggctct

SEQ ID NO: 755461 - DNA, 25 bp, Mus musculus
tatccggctccttgtggagggctct

SEQ ID NO: 755462 - DNA, 25 bp, Mus musculus
tatccgggaattccaccgcgtcaag

SEQ ID NO: 755463 - DNA, 25 bp, Mus musculus
tatccgggaattgcaccgcgtcaag

SEQ ID NO: 755464 - DNA, 25 bp, Mus musculus
tatccgggagtcagtgcagtgacca

SEQ ID NO: 755465 - DNA, 25 bp, Mus musculus
tatccgggagtctgtgcagtgacca

SEQ ID NO: 755466 - DNA, 25 bp, Mus musculus
tatccgggctgcacctgacatttgc

SEQ ID NO: 755467 - DNA, 25 bp, Mus musculus
tatccgggctgctcctgacatttgc

SEQ ID NO: 755468 - DNA, 25 bp, Mus musculus
tatccggtgaaccaagagctgtact

SEQ ID NO: 755469 - DNA, 25 bp, Mus musculus
tatccggtgaacgaagagctgtact

SEQ ID NO: 755470 - DNA, 25 bp, Mus musculus
tatccggtgcaaatgcatctgtccg

SEQ ID NO: 755471 - DNA, 25 bp, Mus musculus
tatccggtgcaattgcatctgtccg

SEQ ID NO: 755472 - DNA, 25 bp, Mus musculus
tatccgtaccttacactttgtggag

SEQ ID NO: 755473 - DNA, 25 bp, Mus musculus
tatccgtacctttcactttgtggag

SEQ ID NO: 755474 - DNA, 25 bp, Mus musculus
tatccgtatgagaacctgggaggcc

SEQ ID NO: 755475 - DNA, 25 bp, Mus musculus
tatccgtatgagtacctgggaggcc

SEQ ID NO: 755476 - DNA, 25 bp, Mus musculus
tatccgtcgaggaatagcaagggaa

SEQ ID NO: 755477 - DNA, 25 bp, Mus musculus
tatccgtcgaggtatagcaagggaa

SEQ ID NO: 755478 - DNA, 25 bp, Mus musculus
tatccgtcggacaatgacggaggtg

SEQ ID NO: 755479 - DNA, 25 bp, Mus musculus
tatccgtcggactatgacggaggtg

SEQ ID NO: 755480 - DNA, 25 bp, Mus musculus
tatccgtgaactctcgtgtctgttt

SEQ ID NO: 755481 - DNA, 25 bp, Mus musculus
tatccgtgaactgtcgtgtctgttt

SEQ ID NO: 755482 - DNA, 25 bp, Mus musculus
tatccgtgaggacaccctttgaaag

SEQ ID NO: 755483 - DNA, 25 bp, Mus musculus
tatccgtgaggagaccctttgaaag

SEQ ID NO: 755484 - DNA, 25 bp, Mus musculus
tatccgtgatctaagaaagcctggt

SEQ ID NO: 755485 - DNA, 25 bp, Mus musculus
tatccgtgatcttagaaagcctggt

SEQ ID NO: 755486 - DNA, 25 bp, Mus musculus
tatccgtgccagaaccagggtgtct

SEQ ID NO: 755487 - DNA, 25 bp, Mus musculus
tatccgtgccagtaccagggtgtct

SEQ ID NO: 755488 - DNA, 25 bp, Mus musculus
tatccgtggcacaccggcggtgact

SEQ ID NO: 755489 - DNA, 25 bp, Mus musculus
tatccgtggcactccggcggtgact

SEQ ID NO: 755490 - DNA, 25 bp, Mus musculus
tatccgtgggctctcgctcagtgca

SEQ ID NO: 755491 - DNA, 25 bp, Mus musculus
tatccgtgggctgtcgctcagtgca

SEQ ID NO: 755492 - DNA, 25 bp, Mus musculus
tatccgttgtcactgtcagctcagc

SEQ ID NO: 755493 - DNA, 25 bp, Mus musculus
tatccgttgtcagtgtcagctcagc

SEQ ID NO: 755494 - DNA, 25 bp, Mus musculus
tatcctaaagatcaagcacatgtct

SEQ ID NO: 755495 - DNA, 25 bp, Mus musculus
tatcctaaagatgaagcacatgtct

SEQ ID NO: 755496 - DNA, 25 bp, Mus musculus
tatcctacaggaaggtggttccgtg

SEQ ID NO: 755497 - DNA, 25 bp, Mus musculus
tatcctacaggatggtggttccgtg

SEQ ID NO: 755498 - DNA, 25 bp, Mus musculus
tatcctacatctataccctgctcaa

SEQ ID NO: 755499 - DNA, 25 bp, Mus musculus
tatcctacatctttaccctgctcaa

SEQ ID NO: 755500 - DNA, 25 bp, Mus musculus
tatcctactattccacataaggcca

SEQ ID NO: 755501 - DNA, 25 bp, Mus musculus
tatcctactattgcacataaggcca

SEQ ID NO: 755502 - DNA, 25 bp, Mus musculus
tatcctagaatgcatgttcggaagg

SEQ ID NO: 755503 - DNA, 25 bp, Mus musculus
tatcctagaatggatgttcggaagg

SEQ ID NO: 755504 - DNA, 25 bp, Mus musculus
tatcctatagaccaagagttgcttc

SEQ ID NO: 755505 - DNA, 25 bp, Mus musculus
tatcctatagacgaagagttgcttc

SEQ ID NO: 755506 - DNA, 25 bp, Mus musculus
tatcctatggatatttggctgctgc

SEQ ID NO: 755507 - DNA, 25 bp, Mus musculus
tatcctatggatttttggctgctgc

SEQ ID NO: 755508 - DNA, 25 bp, Mus musculus
tatcctcaacagcatccaggagcat

SEQ ID NO: 755509 - DNA, 25 bp, Mus musculus
tatcctcaacaggatccaggagcat

SEQ ID NO: 755510 - DNA, 25 bp, Mus musculus
tatcctcaacgaacaggagagcctt

SEQ ID NO: 755511 - DNA, 25 bp, Mus musculus
tatcctcaacgatcaggagagcctt

SEQ ID NO: 755512 - DNA, 25 bp, Mus musculus
tatcctcactgcataaggtgcccag

SEQ ID NO: 755513 - DNA, 25 bp, Mus musculus
tatcctcactgcttaaggtgcccag

SEQ ID NO: 755514 - DNA, 25 bp, Mus musculus
tatcctcagagaaccgctaccgaaa

SEQ ID NO: 755515 - DNA, 25 bp, Mus musculus
tatcctcagagatccgctaccgaaa

SEQ ID NO: 755516 - DNA, 25 bp, Mus musculus
tatcctcagggaaggacaccagcat

SEQ ID NO: 755517 - DNA, 25 bp, Mus musculus
tatcctcagggatggacaccagcat

SEQ ID NO: 755518 - DNA, 25 bp, Mus musculus
tatcctccacggcaaagaagacatc

SEQ ID NO: 755519 - DNA, 25 bp, Mus musculus
tatcctccacgggaaagaagacatc

SEQ ID NO: 755520 - DNA, 25 bp, Mus musculus
tatcctccagaaccgccatgatttc

SEQ ID NO: 755521 - DNA, 25 bp, Mus musculus
tatcctccagaagcgccatgatttc

SEQ ID NO: 755522 - DNA, 25 bp, Mus musculus
tatcctccagatcggtatggccgac

SEQ ID NO: 755523 - DNA, 25 bp, Mus musculus
tatcctccagatgggtatggccgac

SEQ ID NO: 755524 - DNA, 25 bp, Mus musculus
tatcctccagttagcagaagtgtgt

SEQ ID NO: 755525 - DNA, 25 bp, Mus musculus
tatcctccagtttgcagaagtgtgt

SEQ ID NO: 755526 - DNA, 25 bp, Mus musculus
tatcctcccaagcagtttattctaa

SEQ ID NO: 755527 - DNA, 25 bp, Mus musculus
tatcctcccaaggagtttattctaa

SEQ ID NO: 755528 - DNA, 25 bp, Mus musculus
tatcctccccaacacggatgggatg

SEQ ID NO: 755529 - DNA, 25 bp, Mus musculus
tatcctccccaagacggatgggatg

SEQ ID NO: 755530 - DNA, 25 bp, Mus musculus
tatcctccgttactctgttgggctc

SEQ ID NO: 755531 - DNA, 25 bp, Mus musculus
tatcctccgttagtctgttgggctc

SEQ ID NO: 755532 - DNA, 25 bp, Mus musculus
tatcctccttatccaagttcaccag

SEQ ID NO: 755533 - DNA, 25 bp, Mus musculus
tatcctccttatgcaagttcaccag

SEQ ID NO: 755534 - DNA, 25 bp, Mus musculus
tatcctcctttgaataccattcgag

SEQ ID NO: 755535 - DNA, 25 bp, Mus musculus
tatcctcctttgtataccattcgag

SEQ ID NO: 755536 - DNA, 25 bp, Mus musculus
tatcctcggcgtaaagacaagagca

SEQ ID NO: 755537 - DNA, 25 bp, Mus musculus
tatcctcggcgttaagacaagagca

SEQ ID NO: 755538 - DNA, 25 bp, Mus musculus
tatcctctgaacactgcttgattga

SEQ ID NO: 755539 - DNA, 25 bp, Mus musculus
tatcctctgaactctgcttgattga

SEQ ID NO: 755540 - DNA, 25 bp, Mus musculus
tatcctctgaggctagacttgccac

SEQ ID NO: 755541 - DNA, 25 bp, Mus musculus
tatcctctgagggtagacttgccac

SEQ ID NO: 755542 - DNA, 25 bp, Mus musculus
tatcctctggccagagccttggcaa

SEQ ID NO: 755543 - DNA, 25 bp, Mus musculus
tatcctctggcctgagccttggcaa

SEQ ID NO: 755544 - DNA, 25 bp, Mus musculus
tatcctcttagaccaagggaaggct

SEQ ID NO: 755545 - DNA, 25 bp, Mus musculus
tatcctcttagagcaagggaaggct

SEQ ID NO: 755546 - DNA, 25 bp, Mus musculus
tatcctcttcttctgggtggcccgg

SEQ ID NO: 755547 - DNA, 25 bp, Mus musculus
tatcctcttcttgtgggtggcccgg

SEQ ID NO: 755548 - DNA, 25 bp, Mus musculus
tatcctcttgttaactgttgccggg

SEQ ID NO: 755549 - DNA, 25 bp, Mus musculus
tatcctcttgtttactgttgccggg

SEQ ID NO: 755550 - DNA, 25 bp, Mus musculus
tatcctctttaaaaaaccctgcaga

SEQ ID NO: 755551 - DNA, 25 bp, Mus musculus
tatcctctttaataaaccctgcaga

SEQ ID NO: 755552 - DNA, 25 bp, Mus musculus
tatcctgaaggtcatcgtgtctggg

SEQ ID NO: 755553 - DNA, 25 bp, Mus musculus
tatcctgaaggtgatcgtgtctggg

SEQ ID NO: 755554 - DNA, 25 bp, Mus musculus
tatcctgacagtcccctgggtggaa

SEQ ID NO: 755555 - DNA, 25 bp, Mus musculus
tatcctgacagtgccctgggtggaa

SEQ ID NO: 755556 - DNA, 25 bp, Mus musculus
tatcctgacataccacgacattggg

SEQ ID NO: 755557 - DNA, 25 bp, Mus musculus
tatcctgacatagcacgacattggg

SEQ ID NO: 755558 - DNA, 25 bp, Mus musculus
tatcctgactgacggagactcagca

SEQ ID NO: 755559 - DNA, 25 bp, Mus musculus
tatcctgactgagggagactcagca

SEQ ID NO: 755560 - DNA, 25 bp, Mus musculus
tatcctgagagcatccgggagctgg

SEQ ID NO: 755561 - DNA, 25 bp, Mus musculus
tatcctgagagcttccgggagctgg

SEQ ID NO: 755562 - DNA, 25 bp, Mus musculus
tatcctgatcagcattaaatcctct

SEQ ID NO: 755563 - DNA, 25 bp, Mus musculus
tatcctgatcaggattaaatcctct

SEQ ID NO: 755564 - DNA, 25 bp, Mus musculus
tatcctgcatgtactaggttgtgct

SEQ ID NO: 755565 - DNA, 25 bp, Mus musculus
tatcctgcatgttctaggttgtgct

SEQ ID NO: 755566 - DNA, 25 bp, Mus musculus
tatcctgcatttagaggagatccag

SEQ ID NO: 755567 - DNA, 25 bp, Mus musculus
tatcctgcattttgaggagatccag

SEQ ID NO: 755568 - DNA, 25 bp, Mus musculus
tatcctgccatgatcctcctagggc

SEQ ID NO: 755569 - DNA, 25 bp, Mus musculus
tatcctgccatgttcctcctagggc

SEQ ID NO: 755570 - DNA, 25 bp, Mus musculus
tatcctgcctagcaggtcgctcagc

SEQ ID NO: 755571 - DNA, 25 bp, Mus musculus
tatcctgcctaggaggtcgctcagc

SEQ ID NO: 755572 - DNA, 25 bp, Mus musculus
tatcctgcgaaaaacccagcagttt

SEQ ID NO: 755573 - DNA, 25 bp, Mus musculus
tatcctgcgaaatacccagcagttt

SEQ ID NO: 755574 - DNA, 25 bp, Mus musculus
tatcctgctcggagagccaggtacc

SEQ ID NO: 755575 - DNA, 25 bp, Mus musculus
tatcctgctcggtgagccaggtacc

SEQ ID NO: 755576 - DNA, 25 bp, Mus musculus
tatcctgctcttcgagctgctgaca

SEQ ID NO: 755577 - DNA, 25 bp, Mus musculus
tatcctgctcttggagctgctgaca

SEQ ID NO: 755578 - DNA, 25 bp, Mus musculus
tatcctgctgatcatggagggcctc

SEQ ID NO: 755579 - DNA, 25 bp, Mus musculus
tatcctgctgatgatggagggcctc

SEQ ID NO: 755580 - DNA, 25 bp, Mus musculus
tatcctgctgctcgtctataagcag

SEQ ID NO: 755581 - DNA, 25 bp, Mus musculus
tatcctgctgctggtctataagcag

SEQ ID NO: 755582 - DNA, 25 bp, Mus musculus
tatcctggagatagttgtgtctgtg

SEQ ID NO: 755583 - DNA, 25 bp, Mus musculus
tatcctggagattgttgtgtctgtg

SEQ ID NO: 755584 - DNA, 25 bp, Mus musculus
tatcctggagctatcaatctgacca

SEQ ID NO: 755585 - DNA, 25 bp, Mus musculus
tatcctggagctttcaatctgacca

SEQ ID NO: 755586 - DNA, 25 bp, Mus musculus
tatcctggaggtactcgtgaactag

SEQ ID NO: 755587 - DNA, 25 bp, Mus musculus
tatcctggaggttctcgtgaactag

SEQ ID NO: 755588 - DNA, 25 bp, Mus musculus
tatcctggccatccccgtgggtgat

SEQ ID NO: 755589 - DNA, 25 bp, Mus musculus
tatcctggccatgcccgtgggtgat

SEQ ID NO: 755590 - DNA, 25 bp, Mus musculus
tatcctggctaacaaataagattct

SEQ ID NO: 755591 - DNA, 25 bp, Mus musculus
tatcctggctaagaaataagattct

SEQ ID NO: 755592 - DNA, 25 bp, Mus musculus
tatcctggctgacccttagagctcc

SEQ ID NO: 755593 - DNA, 25 bp, Mus musculus
tatcctggctgagccttagagctcc

SEQ ID NO: 755594 - DNA, 25 bp, Mus musculus
tatcctgggattaatagcagcagac

SEQ ID NO: 755595 - DNA, 25 bp, Mus musculus
tatcctgggatttatagcagcagac

SEQ ID NO: 755596 - DNA, 25 bp, Mus musculus
tatcctggtttcctctgcaagtggc

SEQ ID NO: 755597 - DNA, 25 bp, Mus musculus
tatcctggtttcgtctgcaagtggc

SEQ ID NO: 755598 - DNA, 25 bp, Mus musculus
tatcctgtaaagagtctatccggac

SEQ ID NO: 755599 - DNA, 25 bp, Mus musculus
tatcctgtaaagtgtctatccggac

SEQ ID NO: 755600 - DNA, 25 bp, Mus musculus
tatcctgtagtgagtgccgtctggg

SEQ ID NO: 755601 - DNA, 25 bp, Mus musculus
tatcctgtagtgtgtgccgtctggg

SEQ ID NO: 755602 - DNA, 25 bp, Mus musculus
tatcctgtcaatcttctgcgaaacg

SEQ ID NO: 755603 - DNA, 25 bp, Mus musculus
tatcctgtcaatgttctgcgaaacg

SEQ ID NO: 755604 - DNA, 25 bp, Mus musculus
tatcctgtgcctatcaggtggctcg

SEQ ID NO: 755605 - DNA, 25 bp, Mus musculus
tatcctgtgcctttcaggtggctcg

SEQ ID NO: 755606 - DNA, 25 bp, Mus musculus
tatcctgtgcgtcctgcttcaatga

SEQ ID NO: 755607 - DNA, 25 bp, Mus musculus
tatcctgtgcgtgctgcttcaatga

SEQ ID NO: 755608 - DNA, 25 bp, Mus musculus
tatcctgtggaaaggtattactcag

SEQ ID NO: 755609 - DNA, 25 bp, Mus musculus
tatcctgtggaatggtattactcag

SEQ ID NO: 755610 - DNA, 25 bp, Mus musculus
tatcctgtggatcacggctgtcgca

SEQ ID NO: 755611 - DNA, 25 bp, Mus musculus
tatcctgtggatgacggctgtcgca

SEQ ID NO: 755612 - DNA, 25 bp, Mus musculus
tatcctgtgggtagagcggtgtact

SEQ ID NO: 755613 - DNA, 25 bp, Mus musculus
tatcctgtgggttgagcggtgtact

SEQ ID NO: 755614 - DNA, 25 bp, Mus musculus
tatcctgttagaattggattctccg

SEQ ID NO: 755615 - DNA, 25 bp, Mus musculus
tatcctgttagatttggattctccg

SEQ ID NO: 755616 - DNA, 25 bp, Mus musculus
tatcctgttatgatcaaagcagtcc

SEQ ID NO: 755617 - DNA, 25 bp, Mus musculus
tatcctgttatgttcaaagcagtcc

SEQ ID NO: 755618 - DNA, 25 bp, Mus musculus
tatccttaaaggatctatagtccac

SEQ ID NO: 755619 - DNA, 25 bp, Mus musculus
tatccttaaaggttctatagtccac

SEQ ID NO: 755620 - DNA, 25 bp, Mus musculus
tatccttacaatactagagctcttt

SEQ ID NO: 755621 - DNA, 25 bp, Mus musculus
tatccttacaattctagagctcttt

SEQ ID NO: 755622 - DNA, 25 bp, Mus musculus
tatccttagagaccacacgaaagga

SEQ ID NO: 755623 - DNA, 25 bp, Mus musculus
tatccttagagagcacacgaaagga

SEQ ID NO: 755624 - DNA, 25 bp, Mus musculus
tatccttatgtgctccaatggcagc

SEQ ID NO: 755625 - DNA, 25 bp, Mus musculus
tatccttatgtggtccaatggcagc

SEQ ID NO: 755626 - DNA, 25 bp, Mus musculus
tatccttcaagaacaaacactgagc

SEQ ID NO: 755627 - DNA, 25 bp, Mus musculus
tatccttcaagatcaaacactgagc

SEQ ID NO: 755628 - DNA, 25 bp, Mus musculus
tatccttcacaacaggcagactgtg

SEQ ID NO: 755629 - DNA, 25 bp, Mus musculus
tatccttcacaagaggcagactgtg

SEQ ID NO: 755630 - DNA, 25 bp, Mus musculus
tatccttcacgtatcgttacctggc

SEQ ID NO: 755631 - DNA, 25 bp, Mus musculus
tatccttcacgtttcgttacctggc

SEQ ID NO: 755632 - DNA, 25 bp, Mus musculus
tatccttcagaaagcaggaacccga

SEQ ID NO: 755633 - DNA, 25 bp, Mus musculus
tatccttcagaatgcaggaacccga

SEQ ID NO: 755634 - DNA, 25 bp, Mus musculus
tatccttcagatcaatgtgaaggac

SEQ ID NO: 755635 - DNA, 25 bp, Mus musculus
tatccttcagatgaatgtgaaggac

SEQ ID NO: 755636 - DNA, 25 bp, Mus musculus
tatccttcaggaagagccggcaggt

SEQ ID NO: 755637 - DNA, 25 bp, Mus musculus
tatccttcaggatgagccggcaggt

SEQ ID NO: 755638 - DNA, 25 bp, Mus musculus
tatccttcccagctttgtggagtcg

SEQ ID NO: 755639 - DNA, 25 bp, Mus musculus
tatccttcccaggtttgtggagtcg

SEQ ID NO: 755640 - DNA, 25 bp, Mus musculus
tatccttcggttcacattgatgcac

SEQ ID NO: 755641 - DNA, 25 bp, Mus musculus
tatccttcggttgacattgatgcac

SEQ ID NO: 755642 - DNA, 25 bp, Mus musculus
tatccttctgtgaatcatcatcctg

SEQ ID NO: 755643 - DNA, 25 bp, Mus musculus
tatccttctgtgtatcatcatcctg

SEQ ID NO: 755644 - DNA, 25 bp, Mus musculus
tatccttcttggcaccagtggacag

SEQ ID NO: 755645 - DNA, 25 bp, Mus musculus
tatccttcttgggaccagtggacag

SEQ ID NO: 755646 - DNA, 25 bp, Mus musculus
tatccttgacccatgtgcctctggg

SEQ ID NO: 755647 - DNA, 25 bp, Mus musculus
tatccttgacccttgtgcctctggg

SEQ ID NO: 755648 - DNA, 25 bp, Mus musculus
tatccttgctcaattctggttcccg

SEQ ID NO: 755649 - DNA, 25 bp, Mus musculus
tatccttgctcatttctggttcccg

SEQ ID NO: 755650 - DNA, 25 bp, Mus musculus
tatccttgctggctgcttttctgga

SEQ ID NO: 755651 - DNA, 25 bp, Mus musculus
tatccttgctgggtgcttttctgga

SEQ ID NO: 755652 - DNA, 25 bp, Mus musculus
tatccttggtctatctcaagaaaaa

SEQ ID NO: 755653 - DNA, 25 bp, Mus musculus
tatccttggtctttctcaagaaaaa

SEQ ID NO: 755654 - DNA, 25 bp, Mus musculus
tatccttgtgctcatcggctacgtg

SEQ ID NO: 755655 - DNA, 25 bp, Mus musculus
tatccttgtgctgatcggctacgtg

SEQ ID NO: 755656 - DNA, 25 bp, Mus musculus
tatcctttaaacaagactctgagcg

SEQ ID NO: 755657 - DNA, 25 bp, Mus musculus
tatcctttaaactagactctgagcg

SEQ ID NO: 755658 - DNA, 25 bp, Mus musculus
tatcctttggacacgttagatgcca

SEQ ID NO: 755659 - DNA, 25 bp, Mus musculus
tatcctttggactcgttagatgcca

SEQ ID NO: 755660 - DNA, 25 bp, Mus musculus
tatcctttggtcatctgagtcaggg

SEQ ID NO: 755661 - DNA, 25 bp, Mus musculus
tatcctttggtcttctgagtcaggg

SEQ ID NO: 755662 - DNA, 25 bp, Mus musculus
tatccttttcctccgtctgacctgg

SEQ ID NO: 755663 - DNA, 25 bp, Mus musculus
tatccttttcctgcgtctgacctgg

SEQ ID NO: 755664 - DNA, 25 bp, Mus musculus
tatcgaaaagccaacaagtcctctg

SEQ ID NO: 755665 - DNA, 25 bp, Mus musculus
tatcgaaaagcctacaagtcctctg

SEQ ID NO: 755666 - DNA, 25 bp, Mus musculus
tatcgaaaccgcatcgccatggaat

SEQ ID NO: 755667 - DNA, 25 bp, Mus musculus
tatcgaaaccgcttcgccatggaat

SEQ ID NO: 755668 - DNA, 25 bp, Mus musculus
tatcgaacaaccatctaaagaagct

SEQ ID NO: 755669 - DNA, 25 bp, Mus musculus
tatcgaacaaccttctaaagaagct

SEQ ID NO: 755670 - DNA, 25 bp, Mus musculus
tatcgaagctgtcactctaggaact

SEQ ID NO: 755671 - DNA, 25 bp, Mus musculus
tatcgaagctgtgactctaggaact

SEQ ID NO: 755672 - DNA, 25 bp, Mus musculus
tatcgaagtgggatgggaagatacc

SEQ ID NO: 755673 - DNA, 25 bp, Mus musculus
tatcgaagtgggttgggaagatacc

SEQ ID NO: 755674 - DNA, 25 bp, Mus musculus
tatcgaatccatccacaagatggcc

SEQ ID NO: 755675 - DNA, 25 bp, Mus musculus
tatcgaatccatgcacaagatggcc

SEQ ID NO: 755676 - DNA, 25 bp, Mus musculus
tatcgaatgtcacgccaaccaggcg

SEQ ID NO: 755677 - DNA, 25 bp, Mus musculus
tatcgaatgtcaggccaaccaggcg

SEQ ID NO: 755678 - DNA, 25 bp, Mus musculus
tatcgacaacaaaatagagcaagct

SEQ ID NO: 755679 - DNA, 25 bp, Mus musculus
tatcgacaacaatatagagcaagct

SEQ ID NO: 755680 - DNA, 25 bp, Mus musculus
tatcgacacacacactgggtacgct

SEQ ID NO: 755681 - DNA, 25 bp, Mus musculus
tatcgacacacagactgggtacgct

SEQ ID NO: 755682 - DNA, 25 bp, Mus musculus
tatcgacaggacagaaagagtgtgc

SEQ ID NO: 755683 - DNA, 25 bp, Mus musculus
tatcgacaggactgaaagagtgtgc

SEQ ID NO: 755684 - DNA, 25 bp, Mus musculus
tatcgacatccaaatgaaccagatc

SEQ ID NO: 755685 - DNA, 25 bp, Mus musculus
tatcgacatccatatgaaccagatc

SEQ ID NO: 755686 - DNA, 25 bp, Mus musculus
tatcgaccaggtctacgtcctacaa

SEQ ID NO: 755687 - DNA, 25 bp, Mus musculus
tatcgaccaggtgtacgtcctacaa

SEQ ID NO: 755688 - DNA, 25 bp, Mus musculus
tatcgactctggatgcccgagccag

SEQ ID NO: 755689 - DNA, 25 bp, Mus musculus
tatcgactctggttgcccgagccag

SEQ ID NO: 755690 - DNA, 25 bp, Mus musculus
tatcgagacaaaatcaccatagcca

SEQ ID NO: 755691 - DNA, 25 bp, Mus musculus
tatcgagacaaattcaccatagcca

SEQ ID NO: 755692 - DNA, 25 bp, Mus musculus
tatcgagactaccacaggaaccgaa

SEQ ID NO: 755693 - DNA, 25 bp, Mus musculus
tatcgagactacgacaggaaccgaa

SEQ ID NO: 755694 - DNA, 25 bp, Mus musculus
tatcgagaggcacatcacggttttc

SEQ ID NO: 755695 - DNA, 25 bp, Mus musculus
tatcgagaggcagatcacggttttc

SEQ ID NO: 755696 - DNA, 25 bp, Mus musculus
tatcgagatctactgggattgcaac

SEQ ID NO: 755697 - DNA, 25 bp, Mus musculus
tatcgagatctagtgggattgcaac

SEQ ID NO: 755698 - DNA, 25 bp, Mus musculus
tatcgagatgttcctgacagccaaa

SEQ ID NO: 755699 - DNA, 25 bp, Mus musculus
tatcgagatgttgctgacagccaaa

SEQ ID NO: 755700 - DNA, 25 bp, Mus musculus
tatcgagcacatcgcttcaccttca

SEQ ID NO: 755701 - DNA, 25 bp, Mus musculus
tatcgagcacatggcttcaccttca

SEQ ID NO: 755702 - DNA, 25 bp, Mus musculus
tatcgagccaaaaggatatcacagg

SEQ ID NO: 755703 - DNA, 25 bp, Mus musculus
tatcgagccaaatggatatcacagg

SEQ ID NO: 755704 - DNA, 25 bp, Mus musculus
tatcgagcctttcctggagccttcc

SEQ ID NO: 755705 - DNA, 25 bp, Mus musculus
tatcgagcctttgctggagccttcc

SEQ ID NO: 755706 - DNA, 25 bp, Mus musculus
tatcgagcttgtcgctgagcattgc

SEQ ID NO: 755707 - DNA, 25 bp, Mus musculus
tatcgagcttgtggctgagcattgc

SEQ ID NO: 755708 - DNA, 25 bp, Mus musculus
tatcgaggatggaaatgccgtacac

SEQ ID NO: 755709 - DNA, 25 bp, Mus musculus
tatcgaggatggtaatgccgtacac

SEQ ID NO: 755710 - DNA, 25 bp, Mus musculus
tatcgaggcacaaccaataccacct

SEQ ID NO: 755711 - DNA, 25 bp, Mus musculus
tatcgaggcacatccaataccacct

SEQ ID NO: 755712 - DNA, 25 bp, Mus musculus
tatcgagggcagaactgcatgagaa

SEQ ID NO: 755713 - DNA, 25 bp, Mus musculus
tatcgagggcagtactgcatgagaa

SEQ ID NO: 755714 - DNA, 25 bp, Mus musculus
tatcgataaggacgttcagccacac

SEQ ID NO: 755715 - DNA, 25 bp, Mus musculus
tatcgataaggaggttcagccacac

SEQ ID NO: 755716 - DNA, 25 bp, Mus musculus
tatcgatattcgagccggtttagcg

SEQ ID NO: 755717 - DNA, 25 bp, Mus musculus
tatcgatattcgtgccggtttagcg

SEQ ID NO: 755718 - DNA, 25 bp, Mus musculus
tatcgatgaagactttaaacgggag

SEQ ID NO: 755719 - DNA, 25 bp, Mus musculus
tatcgatgaagagtttaaacgggag

SEQ ID NO: 755720 - DNA, 25 bp, Mus musculus
tatcgatgtcagcaacctcaacagg

SEQ ID NO: 755721 - DNA, 25 bp, Mus musculus
tatcgatgtcaggaacctcaacagg

SEQ ID NO: 755722 - DNA, 25 bp, Mus musculus
tatcgatgtcatagaaaagagaatg

SEQ ID NO: 755723 - DNA, 25 bp, Mus musculus
tatcgatgtcattgaaaagagaatg

SEQ ID NO: 755724 - DNA, 25 bp, Mus musculus
tatcgatgttgaacaggtgtctgtc

SEQ ID NO: 755725 - DNA, 25 bp, Mus musculus
tatcgatgttgatcaggtgtctgtc

SEQ ID NO: 755726 - DNA, 25 bp, Mus musculus
tatcgatttaccaaatgaacaagca

SEQ ID NO: 755727 - DNA, 25 bp, Mus musculus
tatcgatttacctaatgaacaagca

SEQ ID NO: 755728 - DNA, 25 bp, Mus musculus
tatcgatttgaaagactgacccggg

SEQ ID NO: 755729 - DNA, 25 bp, Mus musculus
tatcgatttgaatgactgacccggg

SEQ ID NO: 755730 - DNA, 25 bp, Mus musculus
tatcgcaccaacaggcaagaaggct

SEQ ID NO: 755731 - DNA, 25 bp, Mus musculus
tatcgcaccaactggcaagaaggct

SEQ ID NO: 755732 - DNA, 25 bp, Mus musculus
tatcgcagggtgcaaagacaatctg

SEQ ID NO: 755733 - DNA, 25 bp, Mus musculus
tatcgcagggtggaaagacaatctg

SEQ ID NO: 755734 - DNA, 25 bp, Mus musculus
tatcgccaaggaagcaaacacctga

SEQ ID NO: 755735 - DNA, 25 bp, Mus musculus
tatcgccaaggatgcaaacacctga

SEQ ID NO: 755736 - DNA, 25 bp, Mus musculus
tatcgccgagtcctgccactcagga

SEQ ID NO: 755737 - DNA, 25 bp, Mus musculus
tatcgccgagtcgtgccactcagga

SEQ ID NO: 755738 - DNA, 25 bp, Mus musculus
tatcgccgggcacgtgtccatagat

SEQ ID NO: 755739 - DNA, 25 bp, Mus musculus
tatcgccgggcaggtgtccatagat

SEQ ID NO: 755740 - DNA, 25 bp, Mus musculus
tatcgccttcttatataaccggagt

SEQ ID NO: 755741 - DNA, 25 bp, Mus musculus
tatcgccttcttttataaccggagt

SEQ ID NO: 755742 - DNA, 25 bp, Mus musculus
tatcgcgccaccataatcaacgact

SEQ ID NO: 755743 - DNA, 25 bp, Mus musculus
tatcgcgccaccttaatcaacgact

SEQ ID NO: 755744 - DNA, 25 bp, Mus musculus
tatcgcgccctcatggctgctagtt

SEQ ID NO: 755745 - DNA, 25 bp, Mus musculus
tatcgcgccctcttggctgctagtt

SEQ ID NO: 755746 - DNA, 25 bp, Mus musculus
tatcgctaccctagtggaggacaaa

SEQ ID NO: 755747 - DNA, 25 bp, Mus musculus
tatcgctacccttgtggaggacaaa

SEQ ID NO: 755748 - DNA, 25 bp, Mus musculus
tatcgctcagaaagttcgaggtgtg

SEQ ID NO: 755749 - DNA, 25 bp, Mus musculus
tatcgctcagaatgttcgaggtgtg

SEQ ID NO: 755750 - DNA, 25 bp, Mus musculus
tatcgctgatgtcaaaccactgccc

SEQ ID NO: 755751 - DNA, 25 bp, Mus musculus
tatcgctgatgtgaaaccactgccc

SEQ ID NO: 755752 - DNA, 25 bp, Mus musculus
tatcgctgcaccagtttcgatggct

SEQ ID NO: 755753 - DNA, 25 bp, Mus musculus
tatcgctgcacctgtttcgatggct

SEQ ID NO: 755754 - DNA, 25 bp, Mus musculus
tatcgctgctccagcgggtccgcag

SEQ ID NO: 755755 - DNA, 25 bp, Mus musculus
tatcgctgctcctgcgggtccgcag

SEQ ID NO: 755756 - DNA, 25 bp, Mus musculus
tatcgctggatgatcgactccagag

SEQ ID NO: 755757 - DNA, 25 bp, Mus musculus
tatcgctggatgttcgactccagag

SEQ ID NO: 755758 - DNA, 25 bp, Mus musculus
tatcgctgttatagttacagctcag

SEQ ID NO: 755759 - DNA, 25 bp, Mus musculus
tatcgctgttattgttacagctcag

SEQ ID NO: 755760 - DNA, 25 bp, Mus musculus
tatcgcttgggcctcgaatcatggc

SEQ ID NO: 755761 - DNA, 25 bp, Mus musculus
tatcgcttgggcgtcgaatcatggc

SEQ ID NO: 755762 - DNA, 25 bp, Mus musculus
tatcggaagctgatctacactgttg

SEQ ID NO: 755763 - DNA, 25 bp, Mus musculus
tatcggaagctgttctacactgttg

SEQ ID NO: 755764 - DNA, 25 bp, Mus musculus
tatcggaatcatcagtggagtcacc

SEQ ID NO: 755765 - DNA, 25 bp, Mus musculus
tatcggaatcatgagtggagtcacc

SEQ ID NO: 755766 - DNA, 25 bp, Mus musculus
tatcggaatcttagcctacagaaac

SEQ ID NO: 755767 - DNA, 25 bp, Mus musculus
tatcggaatctttgcctacagaaac

SEQ ID NO: 755768 - DNA, 25 bp, Mus musculus
tatcggacagcgcaaagaacggcga

SEQ ID NO: 755769 - DNA, 25 bp, Mus musculus
tatcggacagcggaaagaacggcga

SEQ ID NO: 755770 - DNA, 25 bp, Mus musculus
tatcggacagtgaaggcgaaactgg

SEQ ID NO: 755771 - DNA, 25 bp, Mus musculus
tatcggacagtgtaggcgaaactgg

SEQ ID NO: 755772 - DNA, 25 bp, Mus musculus
tatcggacttcaactcatcagcttc

SEQ ID NO: 755773 - DNA, 25 bp, Mus musculus
tatcggacttcatctcatcagcttc

SEQ ID NO: 755774 - DNA, 25 bp, Mus musculus
tatcggaggctacatccattcccac

SEQ ID NO: 755775 - DNA, 25 bp, Mus musculus
tatcggaggctagatccattcccac

SEQ ID NO: 755776 - DNA, 25 bp, Mus musculus
tatcggagttgcagtattatctcac

SEQ ID NO: 755777 - DNA, 25 bp, Mus musculus
tatcggagttgctgtattatctcac

SEQ ID NO: 755778 - DNA, 25 bp, Mus musculus
tatcggatgcctaagtcatcttcca

SEQ ID NO: 755779 - DNA, 25 bp, Mus musculus
tatcggatgccttagtcatcttcca

SEQ ID NO: 755780 - DNA, 25 bp, Mus musculus
tatcggatttggatgaaggccctcc

SEQ ID NO: 755781 - DNA, 25 bp, Mus musculus
tatcggatttggttgaaggccctcc

SEQ ID NO: 755782 - DNA, 25 bp, Mus musculus
tatcggcagcagagtgccgcagaga

SEQ ID NO: 755783 - DNA, 25 bp, Mus musculus
tatcggcagcagtgtgccgcagaga

SEQ ID NO: 755784 - DNA, 25 bp, Mus musculus
tatcggcattctattgacacttaag

SEQ ID NO: 755785 - DNA, 25 bp, Mus musculus
tatcggcattcttttgacacttaag

SEQ ID NO: 755786 - DNA, 25 bp, Mus musculus
tatcggccactactcagtcctgaca

SEQ ID NO: 755787 - DNA, 25 bp, Mus musculus
tatcggccactagtcagtcctgaca

SEQ ID NO: 755788 - DNA, 25 bp, Mus musculus
tatcggccccaacgtaggtgatgtc

SEQ ID NO: 755789 - DNA, 25 bp, Mus musculus
tatcggccccaaggtaggtgatgtc

SEQ ID NO: 755790 - DNA, 25 bp, Mus musculus
tatcggccccagaacagatctgact

SEQ ID NO: 755791 - DNA, 25 bp, Mus musculus
tatcggccccagtacagatctgact

SEQ ID NO: 755792 - DNA, 25 bp, Mus musculus
tatcggccttagaccaggcaggttg

SEQ ID NO: 755793 - DNA, 25 bp, Mus musculus
tatcggccttagtccaggcaggttg

SEQ ID NO: 755794 - DNA, 25 bp, Mus musculus
tatcggcggtgcacgcgtcctcgct

SEQ ID NO: 755795 - DNA, 25 bp, Mus musculus
tatcggcggtgctcgcgtcctcgct

SEQ ID NO: 755796 - DNA, 25 bp, Mus musculus
tatcggctgcatctacaagtcagga

SEQ ID NO: 755797 - DNA, 25 bp, Mus musculus
tatcggctgcatgtacaagtcagga

SEQ ID NO: 755798 - DNA, 25 bp, Mus musculus
tatcggcttcatcaaagccacaaag

SEQ ID NO: 755799 - DNA, 25 bp, Mus musculus
tatcggcttcatgaaagccacaaag

SEQ ID NO: 755800 - DNA, 25 bp, Mus musculus
tatcggctttacctcacactgaatg

SEQ ID NO: 755801 - DNA, 25 bp, Mus musculus
tatcggctttacgtcacactgaatg

SEQ ID NO: 755802 - DNA, 25 bp, Mus musculus
tatcgggatatcctttcactctgca

SEQ ID NO: 755803 - DNA, 25 bp, Mus musculus
tatcgggatatcgtttcactctgca

SEQ ID NO: 755804 - DNA, 25 bp, Mus musculus
tatcgggatattatactcgcactta

SEQ ID NO: 755805 - DNA, 25 bp, Mus musculus
tatcgggatattttactcgcactta

SEQ ID NO: 755806 - DNA, 25 bp, Mus musculus
tatcgggcaccacaggtcatcttga

SEQ ID NO: 755807 - DNA, 25 bp, Mus musculus
tatcgggcaccagaggtcatcttga

SEQ ID NO: 755808 - DNA, 25 bp, Mus musculus
tatcgggcacggagcaaagagtcca

SEQ ID NO: 755809 - DNA, 25 bp, Mus musculus
tatcgggcacggtgcaaagagtcca

SEQ ID NO: 755810 - DNA, 25 bp, Mus musculus
tatcgggcagctacaagtgatcgtc

SEQ ID NO: 755811 - DNA, 25 bp, Mus musculus
tatcgggcagcttcaagtgatcgtc

SEQ ID NO: 755812 - DNA, 25 bp, Mus musculus
tatcggggctacacacctcctagtg

SEQ ID NO: 755813 - DNA, 25 bp, Mus musculus
tatcggggctactcacctcctagtg

SEQ ID NO: 755814 - DNA, 25 bp, Mus musculus
tatcgggtaccaaatatagctcaga

SEQ ID NO: 755815 - DNA, 25 bp, Mus musculus
tatcgggtaccatatatagctcaga

SEQ ID NO: 755816 - DNA, 25 bp, Mus musculus
tatcgggtctgcaatagtccttggg

SEQ ID NO: 755817 - DNA, 25 bp, Mus musculus
tatcgggtctgctatagtccttggg

SEQ ID NO: 755818 - DNA, 25 bp, Mus musculus
tatcgggtctggaactgggatcctg

SEQ ID NO: 755819 - DNA, 25 bp, Mus musculus
tatcgggtctggtactgggatcctg

SEQ ID NO: 755820 - DNA, 25 bp, Mus musculus
tatcggtcacttcatccaagagaag

SEQ ID NO: 755821 - DNA, 25 bp, Mus musculus
tatcggtcacttgatccaagagaag

SEQ ID NO: 755822 - DNA, 25 bp, Mus musculus
tatcggtcagtccattgtgtatgtg

SEQ ID NO: 755823 - DNA, 25 bp, Mus musculus
tatcggtcagtcgattgtgtatgtg

SEQ ID NO: 755824 - DNA, 25 bp, Mus musculus
tatcggtgctgtcaatgaggtccgc

SEQ ID NO: 755825 - DNA, 25 bp, Mus musculus
tatcggtgctgtgaatgaggtccgc

SEQ ID NO: 755826 - DNA, 25 bp, Mus musculus
tatcggtgggaaatacactccggcc

SEQ ID NO: 755827 - DNA, 25 bp, Mus musculus
tatcggtgggaattacactccggcc

SEQ ID NO: 755828 - DNA, 25 bp, Mus musculus
tatcggtgtcaaatggagcagaccc

SEQ ID NO: 755829 - DNA, 25 bp, Mus musculus
tatcggtgtcaattggagcagaccc

SEQ ID NO: 755830 - DNA, 25 bp, Mus musculus
tatcgtaaccacagggtctaccatg

SEQ ID NO: 755831 - DNA, 25 bp, Mus musculus
tatcgtaaccactgggtctaccatg

SEQ ID NO: 755832 - DNA, 25 bp, Mus musculus
tatcgtacacgtagtcacggagcca

SEQ ID NO: 755833 - DNA, 25 bp, Mus musculus
tatcgtacacgttgtcacggagcca

SEQ ID NO: 755834 - DNA, 25 bp, Mus musculus
tatcgtagttgtcaatattctggca

SEQ ID NO: 755835 - DNA, 25 bp, Mus musculus
tatcgtagttgtgaatattctggca

SEQ ID NO: 755836 - DNA, 25 bp, Mus musculus
tatcgtccgctgagaacacgatggt

SEQ ID NO: 755837 - DNA, 25 bp, Mus musculus
tatcgtccgctgtgaacacgatggt

SEQ ID NO: 755838 - DNA, 25 bp, Mus musculus
tatcgtcgggaaatcttcatagcca

SEQ ID NO: 755839 - DNA, 25 bp, Mus musculus
tatcgtcgggaattcttcatagcca

SEQ ID NO: 755840 - DNA, 25 bp, Mus musculus
tatcgtcggtgacatctgcattggg

SEQ ID NO: 755841 - DNA, 25 bp, Mus musculus
tatcgtcggtgagatctgcattggg

SEQ ID NO: 755842 - DNA, 25 bp, Mus musculus
tatcgtctgcaacacggcgaggcga

SEQ ID NO: 755843 - DNA, 25 bp, Mus musculus
tatcgtctgcaagacggcgaggcga

SEQ ID NO: 755844 - DNA, 25 bp, Mus musculus
tatcgtgacctacagggtgtgccac

SEQ ID NO: 755845 - DNA, 25 bp, Mus musculus
tatcgtgacctagagggtgtgccac

SEQ ID NO: 755846 - DNA, 25 bp, Mus musculus
tatcgtgagagaatcgagacacttg

SEQ ID NO: 755847 - DNA, 25 bp, Mus musculus
tatcgtgagagattcgagacacttg

SEQ ID NO: 755848 - DNA, 25 bp, Mus musculus
tatcgtgagtacacagatggttcct

SEQ ID NO: 755849 - DNA, 25 bp, Mus musculus
tatcgtgagtactcagatggttcct

SEQ ID NO: 755850 - DNA, 25 bp, Mus musculus
tatcgtgccatgctctgatagaaac

SEQ ID NO: 755851 - DNA, 25 bp, Mus musculus
tatcgtgccatggtctgatagaaac

SEQ ID NO: 755852 - DNA, 25 bp, Mus musculus
tatcgtgcctcacaagtcatggcta

SEQ ID NO: 755853 - DNA, 25 bp, Mus musculus
tatcgtgcctcagaagtcatggcta

SEQ ID NO: 755854 - DNA, 25 bp, Mus musculus
tatcgtgcgcccaagctctggaacc

SEQ ID NO: 755855 - DNA, 25 bp, Mus musculus
tatcgtgcgccctagctctggaacc

SEQ ID NO: 755856 - DNA, 25 bp, Mus musculus
tatcgtggaggcctttcggtttgcc

SEQ ID NO: 755857 - DNA, 25 bp, Mus musculus
tatcgtggaggcgtttcggtttgcc

SEQ ID NO: 755858 - DNA, 25 bp, Mus musculus
tatcgtggccttcgtggctcaagtg

SEQ ID NO: 755859 - DNA, 25 bp, Mus musculus
tatcgtggccttggtggctcaagtg

SEQ ID NO: 755860 - DNA, 25 bp, Mus musculus
tatcgtgggcacacagaagttctcc

SEQ ID NO: 755861 - DNA, 25 bp, Mus musculus
tatcgtgggcactcagaagttctcc

SEQ ID NO: 755862 - DNA, 25 bp, Mus musculus
tatcgtgggccgcaattttggcagc

SEQ ID NO: 755863 - DNA, 25 bp, Mus musculus
tatcgtgggccggaattttggcagc

SEQ ID NO: 755864 - DNA, 25 bp, Mus musculus
tatcgtggttggcactatcccagtc

SEQ ID NO: 755865 - DNA, 25 bp, Mus musculus
tatcgtggttgggactatcccagtc

SEQ ID NO: 755866 - DNA, 25 bp, Mus musculus
tatcgttactctactcactcctttg

SEQ ID NO: 755867 - DNA, 25 bp, Mus musculus
tatcgttactcttctcactcctttg

SEQ ID NO: 755868 - DNA, 25 bp, Mus musculus
tatcgttccggaaccaggatacctg

SEQ ID NO: 755869 - DNA, 25 bp, Mus musculus
tatcgttccggatccaggatacctg

SEQ ID NO: 755870 - DNA, 25 bp, Mus musculus
tatcgttgtgttcgctgcggtcctt

SEQ ID NO: 755871 - DNA, 25 bp, Mus musculus
tatcgttgtgttggctgcggtcctt

SEQ ID NO: 755872 - DNA, 25 bp, Mus musculus
tatctaaatgatagcatctctccta

SEQ ID NO: 755873 - DNA, 25 bp, Mus musculus
tatctaaatgattgcatctctccta

SEQ ID NO: 755874 - DNA, 25 bp, Mus musculus
tatctaagcactaccctgaggatgg

SEQ ID NO: 755875 - DNA, 25 bp, Mus musculus
tatctaagcacttccctgaggatgg

SEQ ID NO: 755876 - DNA, 25 bp, Mus musculus
tatctaagcccaagcggaagagaga

SEQ ID NO: 755877 - DNA, 25 bp, Mus musculus
tatctaagcccatgcggaagagaga

SEQ ID NO: 755878 - DNA, 25 bp, Mus musculus
tatctaaggacgaggttttcctgag

SEQ ID NO: 755879 - DNA, 25 bp, Mus musculus
tatctaaggacgtggttttcctgag

SEQ ID NO: 755880 - DNA, 25 bp, Mus musculus
tatctaagtggaagcctcctaggcc

SEQ ID NO: 755881 - DNA, 25 bp, Mus musculus
tatctaagtggatgcctcctaggcc

SEQ ID NO: 755882 - DNA, 25 bp, Mus musculus
tatctaatacccagaagaaacccaa

SEQ ID NO: 755883 - DNA, 25 bp, Mus musculus
tatctaataccctgaagaaacccaa

SEQ ID NO: 755884 - DNA, 25 bp, Mus musculus
tatctaatattcaatccctgtggga

SEQ ID NO: 755885 - DNA, 25 bp, Mus musculus
tatctaatattctatccctgtggga

SEQ ID NO: 755886 - DNA, 25 bp, Mus musculus
tatctaatgaatctcaagccttcta

SEQ ID NO: 755887 - DNA, 25 bp, Mus musculus
tatctaatgaatgtcaagccttcta

SEQ ID NO: 755888 - DNA, 25 bp, Mus musculus
tatctaatttttaggaaccagagtt

SEQ ID NO: 755889 - DNA, 25 bp, Mus musculus
tatctaattttttggaaccagagtt

SEQ ID NO: 755890 - DNA, 25 bp, Mus musculus
tatctacaagatagacttcgtcagg

SEQ ID NO: 755891 - DNA, 25 bp, Mus musculus
tatctacaagattgacttcgtcagg

SEQ ID NO: 755892 - DNA, 25 bp, Mus musculus
tatctaccgtccagcctgtctcagg

SEQ ID NO: 755893 - DNA, 25 bp, Mus musculus
tatctaccgtcctgcctgtctcagg

SEQ ID NO: 755894 - DNA, 25 bp, Mus musculus
tatctacctgcgcagtgaagccgtg

SEQ ID NO: 755895 - DNA, 25 bp, Mus musculus
tatctacctgcggagtgaagccgtg

SEQ ID NO: 755896 - DNA, 25 bp, Mus musculus
tatctacctggaagctagctctgga

SEQ ID NO: 755897 - DNA, 25 bp, Mus musculus
tatctacctggatgctagctctgga

SEQ ID NO: 755898 - DNA, 25 bp, Mus musculus
tatctaccttgcagcccggacactg

SEQ ID NO: 755899 - DNA, 25 bp, Mus musculus
tatctaccttgctgcccggacactg

SEQ ID NO: 755900 - DNA, 25 bp, Mus musculus
tatctacggtataaccaagaagagc

SEQ ID NO: 755901 - DNA, 25 bp, Mus musculus
tatctacggtattaccaagaagagc

SEQ ID NO: 755902 - DNA, 25 bp, Mus musculus
tatctactctgcagggatcatggca

SEQ ID NO: 755903 - DNA, 25 bp, Mus musculus
tatctactctgctgggatcatggca

SEQ ID NO: 755904 - DNA, 25 bp, Mus musculus
tatctactgaccattgcctggaacg

SEQ ID NO: 755905 - DNA, 25 bp, Mus musculus
tatctactgacctttgcctggaacg

SEQ ID NO: 755906 - DNA, 25 bp, Mus musculus
tatctactgctcacggaccgtgcca

SEQ ID NO: 755907 - DNA, 25 bp, Mus musculus
tatctactgctctcggaccgtgcca

SEQ ID NO: 755908 - DNA, 25 bp, Mus musculus
tatctactggacacagctcaacatg

SEQ ID NO: 755909 - DNA, 25 bp, Mus musculus
tatctactggactcagctcaacatg

SEQ ID NO: 755910 - DNA, 25 bp, Mus musculus
tatctactggtgcaaggcttgtgcc

SEQ ID NO: 755911 - DNA, 25 bp, Mus musculus
tatctactggtggaaggcttgtgcc

SEQ ID NO: 755912 - DNA, 25 bp, Mus musculus
tatctacttacacaagcggtcaggc

SEQ ID NO: 755913 - DNA, 25 bp, Mus musculus
tatctacttacagaagcggtcaggc

SEQ ID NO: 755914 - DNA, 25 bp, Mus musculus
tatctacttggtccgtggccttaca

SEQ ID NO: 755915 - DNA, 25 bp, Mus musculus
tatctacttggtgcgtggccttaca

SEQ ID NO: 755916 - DNA, 25 bp, Mus musculus
tatctagcctgtcggagactgtccc

SEQ ID NO: 755917 - DNA, 25 bp, Mus musculus
tatctagcctgtgggagactgtccc

SEQ ID NO: 755918 - DNA, 25 bp, Mus musculus
tatctagctcctcagaagccctgct

SEQ ID NO: 755919 - DNA, 25 bp, Mus musculus
tatctagctcctgagaagccctgct

SEQ ID NO: 755920 - DNA, 25 bp, Mus musculus
tatctaggacttccaaacaagagcg

SEQ ID NO: 755921 - DNA, 25 bp, Mus musculus
tatctaggacttgcaaacaagagcg

SEQ ID NO: 755922 - DNA, 25 bp, Mus musculus
tatctagggccacggatgcaggcac

SEQ ID NO: 755923 - DNA, 25 bp, Mus musculus
tatctagggccagggatgcaggcac

SEQ ID NO: 755924 - DNA, 25 bp, Mus musculus
tatctaggtgagagtgaatttctct

SEQ ID NO: 755925 - DNA, 25 bp, Mus musculus
tatctaggtgagtgtgaatttctct

SEQ ID NO: 755926 - DNA, 25 bp, Mus musculus
tatctagtacataaaaggtgaccag

SEQ ID NO: 755927 - DNA, 25 bp, Mus musculus
tatctagtacattaaaggtgaccag

SEQ ID NO: 755928 - DNA, 25 bp, Mus musculus
tatctagtataaacatcctgatcct

SEQ ID NO: 755929 - DNA, 25 bp, Mus musculus
tatctagtataatcatcctgatcct

SEQ ID NO: 755930 - DNA, 25 bp, Mus musculus
tatctagtttgaaccaggctgctgg

SEQ ID NO: 755931 - DNA, 25 bp, Mus musculus
tatctagtttgatccaggctgctgg

SEQ ID NO: 755932 - DNA, 25 bp, Mus musculus
tatctatcagtactggtggtatcct

SEQ ID NO: 755933 - DNA, 25 bp, Mus musculus
tatctatcagtagtggtggtatcct

SEQ ID NO: 755934 - DNA, 25 bp, Mus musculus
tatctatcagtgctgtggctctggc

SEQ ID NO: 755935 - DNA, 25 bp, Mus musculus
tatctatcagtggtgtggctctggc

SEQ ID NO: 755936 - DNA, 25 bp, Mus musculus
tatctatcggagagactgtggaaga

SEQ ID NO: 755937 - DNA, 25 bp, Mus musculus
tatctatcggagtgactgtggaaga

SEQ ID NO: 755938 - DNA, 25 bp, Mus musculus
tatctatgaagcactggaactccga

SEQ ID NO: 755939 - DNA, 25 bp, Mus musculus
tatctatgaagctctggaactccga

SEQ ID NO: 755940 - DNA, 25 bp, Mus musculus
tatctatgcttcactctgcgtcacc

SEQ ID NO: 755941 - DNA, 25 bp, Mus musculus
tatctatgcttctctctgcgtcacc

SEQ ID NO: 755942 - DNA, 25 bp, Mus musculus
tatctatggaaacggagacttgcag

SEQ ID NO: 755943 - DNA, 25 bp, Mus musculus
tatctatggaaagggagacttgcag

SEQ ID NO: 755944 - DNA, 25 bp, Mus musculus
tatctatggcccagctgcgtacatt

SEQ ID NO: 755945 - DNA, 25 bp, Mus musculus
tatctatggccctgctgcgtacatt

SEQ ID NO: 755946 - DNA, 25 bp, Mus musculus
tatctatgttcaagcaaaacacgtt

SEQ ID NO: 755947 - DNA, 25 bp, Mus musculus
tatctatgttcatgcaaaacacgtt

SEQ ID NO: 755948 - DNA, 25 bp, Mus musculus
tatctattacctcaatcagaactgg

SEQ ID NO: 755949 - DNA, 25 bp, Mus musculus
tatctattacctgaatcagaactgg

SEQ ID NO: 755950 - DNA, 25 bp, Mus musculus
tatctattcgagctgcacttcgggc

SEQ ID NO: 755951 - DNA, 25 bp, Mus musculus
tatctattcgaggtgcacttcgggc

SEQ ID NO: 755952 - DNA, 25 bp, Mus musculus
tatctattggagcaatttagacccg

SEQ ID NO: 755953 - DNA, 25 bp, Mus musculus
tatctattggaggaatttagacccg

SEQ ID NO: 755954 - DNA, 25 bp, Mus musculus
tatctatttttgcatcaagtcctac

SEQ ID NO: 755955 - DNA, 25 bp, Mus musculus
tatctatttttggatcaagtcctac

SEQ ID NO: 755956 - DNA, 25 bp, Mus musculus
tatctcaaagggagggttgttgcga

SEQ ID NO: 755957 - DNA, 25 bp, Mus musculus
tatctcaaagggtgggttgttgcga

SEQ ID NO: 755958 - DNA, 25 bp, Mus musculus
tatctcaacaatatctctacaccgg

SEQ ID NO: 755959 - DNA, 25 bp, Mus musculus
tatctcaacaatttctctacaccgg

SEQ ID NO: 755960 - DNA, 25 bp, Mus musculus
tatctcaagagcagcagtactggcg

SEQ ID NO: 755961 - DNA, 25 bp, Mus musculus
tatctcaagagctgcagtactggcg

SEQ ID NO: 755962 - DNA, 25 bp, Mus musculus
tatctcaagagtcccctggaggtcc

SEQ ID NO: 755963 - DNA, 25 bp, Mus musculus
tatctcaagagtgccctggaggtcc

SEQ ID NO: 755964 - DNA, 25 bp, Mus musculus
tatctcaagcttagtaagactctgg

SEQ ID NO: 755965 - DNA, 25 bp, Mus musculus
tatctcaagctttgtaagactctgg

SEQ ID NO: 755966 - DNA, 25 bp, Mus musculus
tatctcaagtctcaactgaactgcc

SEQ ID NO: 755967 - DNA, 25 bp, Mus musculus
tatctcaagtctgaactgaactgcc

SEQ ID NO: 755968 - DNA, 25 bp, Mus musculus
tatctcaccaggctcattgctgctg

SEQ ID NO: 755969 - DNA, 25 bp, Mus musculus
tatctcaccagggtcattgctgctg

SEQ ID NO: 755970 - DNA, 25 bp, Mus musculus
tatctcaccgttcgcttcattggag

SEQ ID NO: 755971 - DNA, 25 bp, Mus musculus
tatctcaccgttggcttcattggag

SEQ ID NO: 755972 - DNA, 25 bp, Mus musculus
tatctcacgaggattccagggctgg

SEQ ID NO: 755973 - DNA, 25 bp, Mus musculus
tatctcacgaggtttccagggctgg

SEQ ID NO: 755974 - DNA, 25 bp, Mus musculus
tatctcactcctagctggtgcagaa

SEQ ID NO: 755975 - DNA, 25 bp, Mus musculus
tatctcactccttgctggtgcagaa

SEQ ID NO: 755976 - DNA, 25 bp, Mus musculus
tatctcagaaacatcaaagtgccag

SEQ ID NO: 755977 - DNA, 25 bp, Mus musculus
tatctcagaaacttcaaagtgccag

SEQ ID NO: 755978 - DNA, 25 bp, Mus musculus
tatctcagaactctggtcccgggtg

SEQ ID NO: 755979 - DNA, 25 bp, Mus musculus
tatctcagaactgtggtcccgggtg

SEQ ID NO: 755980 - DNA, 25 bp, Mus musculus
tatctcagaagacggacactactgg

SEQ ID NO: 755981 - DNA, 25 bp, Mus musculus
tatctcagaagagggacactactgg

SEQ ID NO: 755982 - DNA, 25 bp, Mus musculus
tatctcagatgtcgtccttgtccgc

SEQ ID NO: 755983 - DNA, 25 bp, Mus musculus
tatctcagatgtggtccttgtccgc

SEQ ID NO: 755984 - DNA, 25 bp, Mus musculus
tatctcagctcaccaatgaaattaa

SEQ ID NO: 755985 - DNA, 25 bp, Mus musculus
tatctcagctcagcaatgaaattaa

SEQ ID NO: 755986 - DNA, 25 bp, Mus musculus
tatctcaggaatccaccgaagctgg

SEQ ID NO: 755987 - DNA, 25 bp, Mus musculus
tatctcaggaatgcaccgaagctgg

SEQ ID NO: 755988 - DNA, 25 bp, Mus musculus
tatctcagtcatcgaagctcagtga

SEQ ID NO: 755989 - DNA, 25 bp, Mus musculus
tatctcagtcatggaagctcagtga

SEQ ID NO: 755990 - DNA, 25 bp, Mus musculus
tatctcagtctccttacttgaggac

SEQ ID NO: 755991 - DNA, 25 bp, Mus musculus
tatctcagtctcgttacttgaggac

SEQ ID NO: 755992 - DNA, 25 bp, Mus musculus
tatctcagttgcaatatttgctggg

SEQ ID NO: 755993 - DNA, 25 bp, Mus musculus
tatctcagttgctatatttgctggg

SEQ ID NO: 755994 - DNA, 25 bp, Mus musculus
tatctcatagatacagacaaggccg

SEQ ID NO: 755995 - DNA, 25 bp, Mus musculus
tatctcatagattcagacaaggccg

SEQ ID NO: 755996 - DNA, 25 bp, Mus musculus
tatctcatcaggcatcagagggtcc

SEQ ID NO: 755997 - DNA, 25 bp, Mus musculus
tatctcatcagggatcagagggtcc

SEQ ID NO: 755998 - DNA, 25 bp, Mus musculus
tatctcatccagctacgtgaaggat

SEQ ID NO: 755999 - DNA, 25 bp, Mus musculus
tatctcatccaggtacgtgaaggat

SEQ ID NO: 756000 - DNA, 25 bp, Mus musculus
tatctcattaacaggatgccaagcc

SEQ ID NO: 756001 - DNA, 25 bp, Mus musculus
tatctcattaactggatgccaagcc

SEQ ID NO: 756002 - DNA, 25 bp, Mus musculus
tatctccaacaactgacgtcagcgt

SEQ ID NO: 756003 - DNA, 25 bp, Mus musculus
tatctccaacaagtgacgtcagcgt

SEQ ID NO: 756004 - DNA, 25 bp, Mus musculus
tatctccaagaaaccctgtaatcct

SEQ ID NO: 756005 - DNA, 25 bp, Mus musculus
tatctccaagaatccctgtaatcct

SEQ ID NO: 756006 - DNA, 25 bp, Mus musculus
tatctccacggaagtcatcgttctg

SEQ ID NO: 756007 - DNA, 25 bp, Mus musculus
tatctccacggatgtcatcgttctg

SEQ ID NO: 756008 - DNA, 25 bp, Mus musculus
tatctccagcatcgatgtcaatggg

SEQ ID NO: 756009 - DNA, 25 bp, Mus musculus
tatctccagcatggatgtcaatggg

SEQ ID NO: 756010 - DNA, 25 bp, Mus musculus
tatctccaggacatcgagaatgcgt

SEQ ID NO: 756011 - DNA, 25 bp, Mus musculus
tatctccaggacttcgagaatgcgt

SEQ ID NO: 756012 - DNA, 25 bp, Mus musculus
tatctccagtccattgcacgggtgg

SEQ ID NO: 756013 - DNA, 25 bp, Mus musculus
tatctccagtcctttgcacgggtgg

SEQ ID NO: 756014 - DNA, 25 bp, Mus musculus
tatctccagtggagtgatgaagcta

SEQ ID NO: 756015 - DNA, 25 bp, Mus musculus
tatctccagtggtgtgatgaagcta

SEQ ID NO: 756016 - DNA, 25 bp, Mus musculus
tatctccatcggcagtctgcgcggg

SEQ ID NO: 756017 - DNA, 25 bp, Mus musculus
tatctccatcgggagtctgcgcggg

SEQ ID NO: 756018 - DNA, 25 bp, Mus musculus
tatctccatgcaatcgtgcgtgatg

SEQ ID NO: 756019 - DNA, 25 bp, Mus musculus
tatctccatgcattcgtgcgtgatg

SEQ ID NO: 756020 - DNA, 25 bp, Mus musculus
tatctccattcgagaaccaagtgtt

SEQ ID NO: 756021 - DNA, 25 bp, Mus musculus
tatctccattcgtgaaccaagtgtt

SEQ ID NO: 756022 - DNA, 25 bp, Mus musculus
tatctcccaaaactcacagacccag

SEQ ID NO: 756023 - DNA, 25 bp, Mus musculus
tatctcccaaaagtcacagacccag

SEQ ID NO: 756024 - DNA, 25 bp, Mus musculus
tatctcccaggaatttgttctttag

SEQ ID NO: 756025 - DNA, 25 bp, Mus musculus
tatctcccaggattttgttctttag

SEQ ID NO: 756026 - DNA, 25 bp, Mus musculus
tatctccggaacagggcagttcagg

SEQ ID NO: 756027 - DNA, 25 bp, Mus musculus
tatctccggaactgggcagttcagg

SEQ ID NO: 756028 - DNA, 25 bp, Mus musculus
tatctcctagagagaaccactgaca

SEQ ID NO: 756029 - DNA, 25 bp, Mus musculus
tatctcctagagtgaaccactgaca

SEQ ID NO: 756030 - DNA, 25 bp, Mus musculus
tatctcctagttctccgctgctcgg

SEQ ID NO: 756031 - DNA, 25 bp, Mus musculus
tatctcctagttgtccgctgctcgg

SEQ ID NO: 756032 - DNA, 25 bp, Mus musculus
tatctcctatgaccggcatctgtgg

SEQ ID NO: 756033 - DNA, 25 bp, Mus musculus
tatctcctatgagcggcatctgtgg

SEQ ID NO: 756034 - DNA, 25 bp, Mus musculus
tatctcctcaaacctgataggagca

SEQ ID NO: 756035 - DNA, 25 bp, Mus musculus
tatctcctcaaagctgataggagca

SEQ ID NO: 756036 - DNA, 25 bp, Mus musculus
tatctcctgagcctatggcagcggc

SEQ ID NO: 756037 - DNA, 25 bp, Mus musculus
tatctcctgagcgtatggcagcggc

SEQ ID NO: 756038 - DNA, 25 bp, Mus musculus
tatctcctgcccaactggatccttt

SEQ ID NO: 756039 - DNA, 25 bp, Mus musculus
tatctcctgccctactggatccttt

SEQ ID NO: 756040 - DNA, 25 bp, Mus musculus
tatctcctgggcatctcaaagtggt

SEQ ID NO: 756041 - DNA, 25 bp, Mus musculus
tatctcctgggcttctcaaagtggt

SEQ ID NO: 756042 - DNA, 25 bp, Mus musculus
tatctcctgttaatggacctgcaag

SEQ ID NO: 756043 - DNA, 25 bp, Mus musculus
tatctcctgttattggacctgcaag

SEQ ID NO: 756044 - DNA, 25 bp, Mus musculus
tatctcgagaatcctggccagagga

SEQ ID NO: 756045 - DNA, 25 bp, Mus musculus
tatctcgagaatgctggccagagga

SEQ ID NO: 756046 - DNA, 25 bp, Mus musculus
tatctcgagagcaagaactgcattc

SEQ ID NO: 756047 - DNA, 25 bp, Mus musculus
tatctcgagagctagaactgcattc

SEQ ID NO: 756048 - DNA, 25 bp, Mus musculus
tatctcggagctagacggtatcatc

SEQ ID NO: 756049 - DNA, 25 bp, Mus musculus
tatctcggagctcggtatttttgga

SEQ ID NO: 756050 - DNA, 25 bp, Mus musculus
tatctcggagctgggtatttttgga

SEQ ID NO: 756051 - DNA, 25 bp, Mus musculus
tatctcggagcttgacggtatcatc

SEQ ID NO: 756052 - DNA, 25 bp, Mus musculus
tatctcggctctcggccatgaagga

SEQ ID NO: 756053 - DNA, 25 bp, Mus musculus
tatctcggctctgggccatgaagga

SEQ ID NO: 756054 - DNA, 25 bp, Mus musculus
tatctcgttggcaacaggctgagca

SEQ ID NO: 756055 - DNA, 25 bp, Mus musculus
tatctcgttggctacaggctgagca

SEQ ID NO: 756056 - DNA, 25 bp, Mus musculus
tatctctaacacctagaaagaaaca

SEQ ID NO: 756057 - DNA, 25 bp, Mus musculus
tatctctaacacgtagaaagaaaca

SEQ ID NO: 756058 - DNA, 25 bp, Mus musculus
tatctctacagccaatgctacgagc

SEQ ID NO: 756059 - DNA, 25 bp, Mus musculus
tatctctacagcgaatgctacgagc

SEQ ID NO: 756060 - DNA, 25 bp, Mus musculus
tatctctacctcacctcagtggtca

SEQ ID NO: 756061 - DNA, 25 bp, Mus musculus
tatctctacctccaggagcctttgc

SEQ ID NO: 756062 - DNA, 25 bp, Mus musculus
tatctctacctcgaggagcctttgc

SEQ ID NO: 756063 - DNA, 25 bp, Mus musculus
tatctctacctctcctcagtggtca

SEQ ID NO: 756064 - DNA, 25 bp, Mus musculus
tatctctatgatcccagctatggta

SEQ ID NO: 756065 - DNA, 25 bp, Mus musculus
tatctctatgatgccagctatggta

SEQ ID NO: 756066 - DNA, 25 bp, Mus musculus
tatctctcagacctagagcgtctgg

SEQ ID NO: 756067 - DNA, 25 bp, Mus musculus
tatctctcagacgtagagcgtctgg

SEQ ID NO: 756068 - DNA, 25 bp, Mus musculus
tatctctccagtcccttcgtgggtc

SEQ ID NO: 756069 - DNA, 25 bp, Mus musculus
tatctctccagtgccttcgtgggtc

SEQ ID NO: 756070 - DNA, 25 bp, Mus musculus
tatctctctagccttggcttctggg

SEQ ID NO: 756071 - DNA, 25 bp, Mus musculus
tatctctctagcgttggcttctggg

SEQ ID NO: 756072 - DNA, 25 bp, Mus musculus
tatctctgactacgccttcctgggt

SEQ ID NO: 756073 - DNA, 25 bp, Mus musculus
tatctctgactaggccttcctgggt

SEQ ID NO: 756074 - DNA, 25 bp, Mus musculus
tatctctgagtcaatggctgcctgc

SEQ ID NO: 756075 - DNA, 25 bp, Mus musculus
tatctctgagtctatggctgcctgc

SEQ ID NO: 756076 - DNA, 25 bp, Mus musculus
tatctctgatgactatataaccccg

SEQ ID NO: 756077 - DNA, 25 bp, Mus musculus
tatctctgatgagtatataaccccg

SEQ ID NO: 756078 - DNA, 25 bp, Mus musculus
tatctctgctgaatacgctgacatc

SEQ ID NO: 756079 - DNA, 25 bp, Mus musculus
tatctctgctgattacgctgacatc

SEQ ID NO: 756080 - DNA, 25 bp, Mus musculus
tatctctgtgaccaagatcactaag

SEQ ID NO: 756081 - DNA, 25 bp, Mus musculus
tatctctgtgacgaagatcactaag

SEQ ID NO: 756082 - DNA, 25 bp, Mus musculus
tatctctgttaacaacgtgcttccg

SEQ ID NO: 756083 - DNA, 25 bp, Mus musculus
tatctctgttaagaacgtgcttccg

SEQ ID NO: 756084 - DNA, 25 bp, Mus musculus
tatctctgttggctatgtggactca

SEQ ID NO: 756085 - DNA, 25 bp, Mus musculus
tatctctgttgggtatgtggactca

SEQ ID NO: 756086 - DNA, 25 bp, Mus musculus
tatctcttacaccaggaacatgact

SEQ ID NO: 756087 - DNA, 25 bp, Mus musculus
tatctcttacacgaggaacatgact

SEQ ID NO: 756088 - DNA, 25 bp, Mus musculus
tatctcttcattatggagagcctca

SEQ ID NO: 756089 - DNA, 25 bp, Mus musculus
tatctcttcattttggagagcctca

SEQ ID NO: 756090 - DNA, 25 bp, Mus musculus
tatctcttccatactagagtggtaa

SEQ ID NO: 756091 - DNA, 25 bp, Mus musculus
tatctcttccattctagagtggtaa

SEQ ID NO: 756092 - DNA, 25 bp, Mus musculus
tatctcttcggtagggaccgacttc

SEQ ID NO: 756093 - DNA, 25 bp, Mus musculus
tatctcttcggttgggaccgacttc

SEQ ID NO: 756094 - DNA, 25 bp, Mus musculus
tatctcttggttactctactgcatg

SEQ ID NO: 756095 - DNA, 25 bp, Mus musculus
tatctcttggtttctctactgcatg

SEQ ID NO: 756096 - DNA, 25 bp, Mus musculus
tatctcttttatcttttagcacgca

SEQ ID NO: 756097 - DNA, 25 bp, Mus musculus
tatctcttttatgttttagcacgca

SEQ ID NO: 756098 - DNA, 25 bp, Mus musculus
tatctgaacctgattcacttcccac

SEQ ID NO: 756099 - DNA, 25 bp, Mus musculus
tatctgaacctgtttcacttcccac

SEQ ID NO: 756100 - DNA, 25 bp, Mus musculus
tatctgaacggtcgcgggagctgtt

SEQ ID NO: 756101 - DNA, 25 bp, Mus musculus
tatctgaacggtggcgggagctgtt

SEQ ID NO: 756102 - DNA, 25 bp, Mus musculus
tatctgaagacccacgtgggacctg

SEQ ID NO: 756103 - DNA, 25 bp, Mus musculus
tatctgaagaccgacgtgggacctg

SEQ ID NO: 756104 - DNA, 25 bp, Mus musculus
tatctgactatgatgagctctcagg

SEQ ID NO: 756105 - DNA, 25 bp, Mus musculus
tatctgactatgttgagctctcagg

SEQ ID NO: 756106 - DNA, 25 bp, Mus musculus
tatctgagacatcttgaggagatgg

SEQ ID NO: 756107 - DNA, 25 bp, Mus musculus
tatctgagacatgttgaggagatgg

SEQ ID NO: 756108 - DNA, 25 bp, Mus musculus
tatctgagatacagctgtgagagtc

SEQ ID NO: 756109 - DNA, 25 bp, Mus musculus
tatctgagatactgctgtgagagtc

SEQ ID NO: 756110 - DNA, 25 bp, Mus musculus
tatctgagatggctttgcacttaag

SEQ ID NO: 756111 - DNA, 25 bp, Mus musculus
tatctgagatgggtttgcacttaag

SEQ ID NO: 756112 - DNA, 25 bp, Mus musculus
tatctgagcaccctgtggaagaccc

SEQ ID NO: 756113 - DNA, 25 bp, Mus musculus
tatctgagcaccgtgtggaagaccc

SEQ ID NO: 756114 - DNA, 25 bp, Mus musculus
tatctgagcattattcaattcctga

SEQ ID NO: 756115 - DNA, 25 bp, Mus musculus
tatctgagcatttttcaattcctga

SEQ ID NO: 756116 - DNA, 25 bp, Mus musculus
tatctgaggcctccaggtaggcaca

SEQ ID NO: 756117 - DNA, 25 bp, Mus musculus
tatctgaggcctgcaggtaggcaca

SEQ ID NO: 756118 - DNA, 25 bp, Mus musculus
tatctgagttagcaactgtgaaacg

SEQ ID NO: 756119 - DNA, 25 bp, Mus musculus
tatctgagttaggaactgtgaaacg

SEQ ID NO: 756120 - DNA, 25 bp, Mus musculus
tatctgagttccctcaagaacaagt

SEQ ID NO: 756121 - DNA, 25 bp, Mus musculus
tatctgagttccgtcaagaacaagt

SEQ ID NO: 756122 - DNA, 25 bp, Mus musculus
tatctgatccagcagctccgaagac

SEQ ID NO: 756123 - DNA, 25 bp, Mus musculus
tatctgatccaggagctccgaagac

SEQ ID NO: 756124 - DNA, 25 bp, Mus musculus
tatctgcaaagacctagttataggt

SEQ ID NO: 756125 - DNA, 25 bp, Mus musculus
tatctgcaaagagctagttataggt

SEQ ID NO: 756126 - DNA, 25 bp, Mus musculus
tatctgcacaagcactgtggcttcc

SEQ ID NO: 756127 - DNA, 25 bp, Mus musculus
tatctgcacaaggactgtggcttcc

SEQ ID NO: 756128 - DNA, 25 bp, Mus musculus
tatctgcaccccatgttgaggcggc

SEQ ID NO: 756129 - DNA, 25 bp, Mus musculus
tatctgcaccccttgttgaggcggc

SEQ ID NO: 756130 - DNA, 25 bp, Mus musculus
tatctgcagaaaagtctctttatcc

SEQ ID NO: 756131 - DNA, 25 bp, Mus musculus
tatctgcagaaatgtctctttatcc

SEQ ID NO: 756132 - DNA, 25 bp, Mus musculus
tatctgcaggaacgccaagagtgtc

SEQ ID NO: 756133 - DNA, 25 bp, Mus musculus
tatctgcaggaaggccaagagtgtc

SEQ ID NO: 756134 - DNA, 25 bp, Mus musculus
tatctgcaggacatagtctaagacc

SEQ ID NO: 756135 - DNA, 25 bp, Mus musculus
tatctgcaggacttagtctaagacc

SEQ ID NO: 756136 - DNA, 25 bp, Mus musculus
tatctgcaggagaggtgtaaagcct

SEQ ID NO: 756137 - DNA, 25 bp, Mus musculus
tatctgcaggagtggtgtaaagcct

SEQ ID NO: 756138 - DNA, 25 bp, Mus musculus
tatctgcagtccatcgaggaccggg

SEQ ID NO: 756139 - DNA, 25 bp, Mus musculus
tatctgcagtccttcgaggaccggg

SEQ ID NO: 756140 - DNA, 25 bp, Mus musculus
tatctgcatcagagccatgtgctgc

SEQ ID NO: 756141 - DNA, 25 bp, Mus musculus
tatctgcatcagtgccatgtgctgc

SEQ ID NO: 756142 - DNA, 25 bp, Mus musculus
tatctgcatcttaaggctggttctg

SEQ ID NO: 756143 - DNA, 25 bp, Mus musculus
tatctgcatctttaggctggttctg

SEQ ID NO: 756144 - DNA, 25 bp, Mus musculus
tatctgccaagactgtaagactgac

SEQ ID NO: 756145 - DNA, 25 bp, Mus musculus
tatctgccaagagtgtaagactgac

SEQ ID NO: 756146 - DNA, 25 bp, Mus musculus
tatctgccagtcaaacatcatgttc

SEQ ID NO: 756147 - DNA, 25 bp, Mus musculus
tatctgccagtctaacatcatgttc

SEQ ID NO: 756148 - DNA, 25 bp, Mus musculus
tatctgcccggcactgatctataag

SEQ ID NO: 756149 - DNA, 25 bp, Mus musculus
tatctgcccggctctgatctataag

SEQ ID NO: 756150 - DNA, 25 bp, Mus musculus
tatctgccctacctactgtgtgtgg

SEQ ID NO: 756151 - DNA, 25 bp, Mus musculus
tatctgccctacgtactgtgtgtgg

SEQ ID NO: 756152 - DNA, 25 bp, Mus musculus
tatctgcgagtcctcatggccatct

SEQ ID NO: 756153 - DNA, 25 bp, Mus musculus
tatctgcgagtcgtcatggccatct

SEQ ID NO: 756154 - DNA, 25 bp, Mus musculus
tatctgctagttaaaaatcttaggc

SEQ ID NO: 756155 - DNA, 25 bp, Mus musculus
tatctgctagtttaaaatcttaggc

SEQ ID NO: 756156 - DNA, 25 bp, Mus musculus
tatctgctcagaaaagacaggcaca

SEQ ID NO: 756157 - DNA, 25 bp, Mus musculus
tatctgctcagataagacaggcaca

SEQ ID NO: 756158 - DNA, 25 bp, Mus musculus
tatctgctgaggactacctggtcca

SEQ ID NO: 756159 - DNA, 25 bp, Mus musculus
tatctgctgaggtctacctggtcca

SEQ ID NO: 756160 - DNA, 25 bp, Mus musculus
tatctgctgcaaactagagcctgaa

SEQ ID NO: 756161 - DNA, 25 bp, Mus musculus
tatctgctgcaatctagagcctgaa

SEQ ID NO: 756162 - DNA, 25 bp, Mus musculus
tatctggaaactctaagaaggactg

SEQ ID NO: 756163 - DNA, 25 bp, Mus musculus
tatctggaaactgtaagaaggactg

SEQ ID NO: 756164 - DNA, 25 bp, Mus musculus
tatctggaacaaatcctcatggata

SEQ ID NO: 756165 - DNA, 25 bp, Mus musculus
tatctggaacaattcctcatggata

SEQ ID NO: 756166 - DNA, 25 bp, Mus musculus
tatctggaagtgacacaaggaagaa

SEQ ID NO: 756167 - DNA, 25 bp, Mus musculus
tatctggaagtgtcacaaggaagaa

SEQ ID NO: 756168 - DNA, 25 bp, Mus musculus
tatctggaatacaagagggtcccca

SEQ ID NO: 756169 - DNA, 25 bp, Mus musculus
tatctggaatactagagggtcccca

SEQ ID NO: 756170 - DNA, 25 bp, Mus musculus
tatctggaatgtattctcgtgctgg

SEQ ID NO: 756171 - DNA, 25 bp, Mus musculus
tatctggaatgttttctcgtgctgg

SEQ ID NO: 756172 - DNA, 25 bp, Mus musculus
tatctggacaggctactcggtcaag

SEQ ID NO: 756173 - DNA, 25 bp, Mus musculus
tatctggacagggtactcggtcaag

SEQ ID NO: 756174 - DNA, 25 bp, Mus musculus
tatctggactagaacagaaaactta

SEQ ID NO: 756175 - DNA, 25 bp, Mus musculus
tatctggactagtacagaaaactta

SEQ ID NO: 756176 - DNA, 25 bp, Mus musculus
tatctggagatacctatttactgca

SEQ ID NO: 756177 - DNA, 25 bp, Mus musculus
tatctggagatagctatttactgca

SEQ ID NO: 756178 - DNA, 25 bp, Mus musculus
tatctggagattattctaatgctgg

SEQ ID NO: 756179 - DNA, 25 bp, Mus musculus
tatctggagatttttctaatgctgg

SEQ ID NO: 756180 - DNA, 25 bp, Mus musculus
tatctggagcagattggaacttcct

SEQ ID NO: 756181 - DNA, 25 bp, Mus musculus
tatctggagcagtttggaacttcct

SEQ ID NO: 756182 - DNA, 25 bp, Mus musculus
tatctggaggaaacatcaattcgct

SEQ ID NO: 756183 - DNA, 25 bp, Mus musculus
tatctggaggaatcatcaattcgct

SEQ ID NO: 756184 - DNA, 25 bp, Mus musculus
tatctggatgtgcagtcaccccttc

SEQ ID NO: 756185 - DNA, 25 bp, Mus musculus
tatctggatgtggagtcaccccttc

SEQ ID NO: 756186 - DNA, 25 bp, Mus musculus
tatctggatgttctgcacagggagc

SEQ ID NO: 756187 - DNA, 25 bp, Mus musculus
tatctggatgttgtgcacagggagc

SEQ ID NO: 756188 - DNA, 25 bp, Mus musculus
tatctggcaccaattctggccccat

SEQ ID NO: 756189 - DNA, 25 bp, Mus musculus
tatctggcaccatttctggccccat

SEQ ID NO: 756190 - DNA, 25 bp, Mus musculus
tatctgggacagaacaactagaagc

SEQ ID NO: 756191 - DNA, 25 bp, Mus musculus
tatctgggacagtacaactagaagc

SEQ ID NO: 756192 - DNA, 25 bp, Mus musculus
tatctgggtaagcatcaaagaatcc

SEQ ID NO: 756193 - DNA, 25 bp, Mus musculus
tatctgggtaaggatcaaagaatcc

SEQ ID NO: 756194 - DNA, 25 bp, Mus musculus
tatctgggtgaacacactcaggtca

SEQ ID NO: 756195 - DNA, 25 bp, Mus musculus
tatctgggtgaagacactcaggtca

SEQ ID NO: 756196 - DNA, 25 bp, Mus musculus
tatctgggtgtgcagagacatccaa

SEQ ID NO: 756197 - DNA, 25 bp, Mus musculus
tatctgggtgtggagagacatccaa

SEQ ID NO: 756198 - DNA, 25 bp, Mus musculus
tatctggtcctgatcaccctgctaa

SEQ ID NO: 756199 - DNA, 25 bp, Mus musculus
tatctggtcctgttcaccctgctaa

SEQ ID NO: 756200 - DNA, 25 bp, Mus musculus
tatctggtctccctccctgatggga

SEQ ID NO: 756201 - DNA, 25 bp, Mus musculus
tatctggtctccgtccctgatggga

SEQ ID NO: 756202 - DNA, 25 bp, Mus musculus
tatctggtgcatagacctggaggta

SEQ ID NO: 756203 - DNA, 25 bp, Mus musculus
tatctggtgcattgacctggaggta

SEQ ID NO: 756204 - DNA, 25 bp, Mus musculus
tatctggtgtggaactgagtgctgc

SEQ ID NO: 756205 - DNA, 25 bp, Mus musculus
tatctggtgtggtactgagtgctgc

SEQ ID NO: 756206 - DNA, 25 bp, Mus musculus
tatctggtgtttcacttctgtgagc

SEQ ID NO: 756207 - DNA, 25 bp, Mus musculus
tatctggtgtttgacttctgtgagc

SEQ ID NO: 756208 - DNA, 25 bp, Mus musculus
tatctggttaatcgcctatatcccc

SEQ ID NO: 756209 - DNA, 25 bp, Mus musculus
tatctggttaatggcctatatcccc

SEQ ID NO: 756210 - DNA, 25 bp, Mus musculus
tatctggttgccctacacctctggg

SEQ ID NO: 756211 - DNA, 25 bp, Mus musculus
tatctggttgccgtacacctctggg

SEQ ID NO: 756212 - DNA, 25 bp, Mus musculus
tatctgtaaggcagtccgtcatcct

SEQ ID NO: 756213 - DNA, 25 bp, Mus musculus
tatctgtaaggctgtccgtcatcct

SEQ ID NO: 756214 - DNA, 25 bp, Mus musculus
tatctgtacacacccgtgctgtgcg

SEQ ID NO: 756215 - DNA, 25 bp, Mus musculus
tatctgtacacagccgtgctgtgcg

SEQ ID NO: 756216 - DNA, 25 bp, Mus musculus
tatctgtcaaaacaacaactcatca

SEQ ID NO: 756217 - DNA, 25 bp, Mus musculus
tatctgtcaaaagaacaactcatca

SEQ ID NO: 756218 - DNA, 25 bp, Mus musculus
tatctgtcacccaattccaagagga

SEQ ID NO: 756219 - DNA, 25 bp, Mus musculus
tatctgtcaccctattccaagagga

SEQ ID NO: 756220 - DNA, 25 bp, Mus musculus
tatctgtcacggaaaccctgtggac

SEQ ID NO: 756221 - DNA, 25 bp, Mus musculus
tatctgtcacggtaaccctgtggac

SEQ ID NO: 756222 - DNA, 25 bp, Mus musculus
tatctgtcactacggggcttccgaa

SEQ ID NO: 756223 - DNA, 25 bp, Mus musculus
tatctgtcactagggggcttccgaa

SEQ ID NO: 756224 - DNA, 25 bp, Mus musculus
tatctgtcatgaactcttgggacat

SEQ ID NO: 756225 - DNA, 25 bp, Mus musculus
tatctgtcatgatctcttgggacat

SEQ ID NO: 756226 - DNA, 25 bp, Mus musculus
tatctgtccagaaaccagatcaagt

SEQ ID NO: 756227 - DNA, 25 bp, Mus musculus
tatctgtccagataccagatcaagt

SEQ ID NO: 756228 - DNA, 25 bp, Mus musculus
tatctgtctaacaaaaggtctccca

SEQ ID NO: 756229 - DNA, 25 bp, Mus musculus
tatctgtctaactaaaggtctccca

SEQ ID NO: 756230 - DNA, 25 bp, Mus musculus
tatctgtctgcgaacagcaagtgcc

SEQ ID NO: 756231 - DNA, 25 bp, Mus musculus
tatctgtctgcgtacagcaagtgcc

SEQ ID NO: 756232 - DNA, 25 bp, Mus musculus
tatctgtgaactatcggctaaggta

SEQ ID NO: 756233 - DNA, 25 bp, Mus musculus
tatctgtgaactttcggctaaggta

SEQ ID NO: 756234 - DNA, 25 bp, Mus musculus
tatctgtgaataatgtgctcgggcc

SEQ ID NO: 756235 - DNA, 25 bp, Mus musculus
tatctgtgaatattgtgctcgggcc

SEQ ID NO: 756236 - DNA, 25 bp, Mus musculus
tatctgtgagaacaaccgctatggc

SEQ ID NO: 756237 - DNA, 25 bp, Mus musculus
tatctgtgagaagaaccgctatggc

SEQ ID NO: 756238 - DNA, 25 bp, Mus musculus
tatctgtgcagccaaccacacaaga

SEQ ID NO: 756239 - DNA, 25 bp, Mus musculus
tatctgtgcagcgaaccacacaaga

SEQ ID NO: 756240 - DNA, 25 bp, Mus musculus
tatctgtgcatcctgagaggcaccg

SEQ ID NO: 756241 - DNA, 25 bp, Mus musculus
tatctgtgcatcgtgagaggcaccg

SEQ ID NO: 756242 - DNA, 25 bp, Mus musculus
tatctgtgcgacaattgcgtttgga

SEQ ID NO: 756243 - DNA, 25 bp, Mus musculus
tatctgtgcgactattgcgtttgga

SEQ ID NO: 756244 - DNA, 25 bp, Mus musculus
tatctgtgcgttacagcagcggcac

SEQ ID NO: 756245 - DNA, 25 bp, Mus musculus
tatctgtgcgtttcagcagcggcac

SEQ ID NO: 756246 - DNA, 25 bp, Mus musculus
tatctgtggcctctcctgtgatgaa

SEQ ID NO: 756247 - DNA, 25 bp, Mus musculus
tatctgtggcctgtcctgtgatgaa

SEQ ID NO: 756248 - DNA, 25 bp, Mus musculus
tatctgtgggctccttaggtccaca

SEQ ID NO: 756249 - DNA, 25 bp, Mus musculus
tatctgtgggctgcttaggtccaca

SEQ ID NO: 756250 - DNA, 25 bp, Mus musculus
tatctgtggtatcacatctgtttcc

SEQ ID NO: 756251 - DNA, 25 bp, Mus musculus
tatctgtggtatgacatctgtttcc

SEQ ID NO: 756252 - DNA, 25 bp, Mus musculus
tatctgtggtctcattaaaggaggc

SEQ ID NO: 756253 - DNA, 25 bp, Mus musculus
tatctgtggtctgattaaaggaggc

SEQ ID NO: 756254 - DNA, 25 bp, Mus musculus
tatctgtgtgtacgactgtagaact

SEQ ID NO: 756255 - DNA, 25 bp, Mus musculus
tatctgtgtgtaggactgtagaact

SEQ ID NO: 756256 - DNA, 25 bp, Mus musculus
tatctgttcaagcaaacaaacagca

SEQ ID NO: 756257 - DNA, 25 bp, Mus musculus
tatctgttcaaggaaacaaacagca

SEQ ID NO: 756258 - DNA, 25 bp, Mus musculus
tatctgttcatgcatcaccggcctt

SEQ ID NO: 756259 - DNA, 25 bp, Mus musculus
tatctgttcatggatcaccggcctt

SEQ ID NO: 756260 - DNA, 25 bp, Mus musculus
tatctgttgaggagggtcccaggtc

SEQ ID NO: 756261 - DNA, 25 bp, Mus musculus
tatctgttgaggtgggtcccaggtc

SEQ ID NO: 756262 - DNA, 25 bp, Mus musculus
tatctgttggcgaccagaggcctgg

SEQ ID NO: 756263 - DNA, 25 bp, Mus musculus
tatctgttggcgtccagaggcctgg

SEQ ID NO: 756264 - DNA, 25 bp, Mus musculus
tatctgtttcttaccgaaatggcac

SEQ ID NO: 756265 - DNA, 25 bp, Mus musculus
tatctgtttctttccgaaatggcac

SEQ ID NO: 756266 - DNA, 25 bp, Mus musculus
tatcttaacaagcaaaccagcctgt

SEQ ID NO: 756267 - DNA, 25 bp, Mus musculus
tatcttaacaaggaaaccagcctgt

SEQ ID NO: 756268 - DNA, 25 bp, Mus musculus
tatcttaatgctacagccactggcc

SEQ ID NO: 756269 - DNA, 25 bp, Mus musculus
tatcttaatgcttcagccactggcc

SEQ ID NO: 756270 - DNA, 25 bp, Mus musculus
tatcttacagatcactggagattgc

SEQ ID NO: 756271 - DNA, 25 bp, Mus musculus
tatcttacagatgactggagattgc

SEQ ID NO: 756272 - DNA, 25 bp, Mus musculus
tatcttacttttccgagaaaccagc

SEQ ID NO: 756273 - DNA, 25 bp, Mus musculus
tatcttacttttgcgagaaaccagc

SEQ ID NO: 756274 - DNA, 25 bp, Mus musculus
tatcttagagcactgcacggcagag

SEQ ID NO: 756275 - DNA, 25 bp, Mus musculus
tatcttagagcagtgcacggcagag

SEQ ID NO: 756276 - DNA, 25 bp, Mus musculus
tatcttagtagacttcctggaggca

SEQ ID NO: 756277 - DNA, 25 bp, Mus musculus
tatcttagtagagttcctggaggca

SEQ ID NO: 756278 - DNA, 25 bp, Mus musculus
tatcttattgttcgaaggccaggag

SEQ ID NO: 756279 - DNA, 25 bp, Mus musculus
tatcttattgttggaaggccaggag

SEQ ID NO: 756280 - DNA, 25 bp, Mus musculus
tatcttcaacagctacatagtcagc

SEQ ID NO: 756281 - DNA, 25 bp, Mus musculus
tatcttcaacaggtacatagtcagc

SEQ ID NO: 756282 - DNA, 25 bp, Mus musculus
tatcttcaaggactggtgtgaggtt

SEQ ID NO: 756283 - DNA, 25 bp, Mus musculus
tatcttcaaggagtggtgtgaggtt

SEQ ID NO: 756284 - DNA, 25 bp, Mus musculus
tatcttcagcacacgagctcatgtc

SEQ ID NO: 756285 - DNA, 25 bp, Mus musculus
tatcttcagcactcgagctcatgtc

SEQ ID NO: 756286 - DNA, 25 bp, Mus musculus
tatcttcaggaaaacaagtttgccc

SEQ ID NO: 756287 - DNA, 25 bp, Mus musculus
tatcttcaggaatacaagtttgccc

SEQ ID NO: 756288 - DNA, 25 bp, Mus musculus
tatcttcaggacatagctggtattg

SEQ ID NO: 756289 - DNA, 25 bp, Mus musculus
tatcttcaggaccagaacggtgtgg

SEQ ID NO: 756290 - DNA, 25 bp, Mus musculus
tatcttcaggacgagaacggtgtgg

SEQ ID NO: 756291 - DNA, 25 bp, Mus musculus
tatcttcaggacttagctggtattg

SEQ ID NO: 756292 - DNA, 25 bp, Mus musculus
tatcttcaggttaaaacggccctag

SEQ ID NO: 756293 - DNA, 25 bp, Mus musculus
tatcttcaggtttaaacggccctag

SEQ ID NO: 756294 - DNA, 25 bp, Mus musculus
tatcttcatcagattaatgtgccga

SEQ ID NO: 756295 - DNA, 25 bp, Mus musculus
tatcttcatcagtttaatgtgccga

SEQ ID NO: 756296 - DNA, 25 bp, Mus musculus
tatcttccatataaatgaggtagtg

SEQ ID NO: 756297 - DNA, 25 bp, Mus musculus
tatcttccatattaatgaggtagtg

SEQ ID NO: 756298 - DNA, 25 bp, Mus musculus
tatcttccgtaacgccttcacgtct

SEQ ID NO: 756299 - DNA, 25 bp, Mus musculus
tatcttccgtaaggccttcacgtct

SEQ ID NO: 756300 - DNA, 25 bp, Mus musculus
tatcttcctgcacttggctactcaa

SEQ ID NO: 756301 - DNA, 25 bp, Mus musculus
tatcttcctgcagttggctactcaa

SEQ ID NO: 756302 - DNA, 25 bp, Mus musculus
tatcttcgaccgagaggaccagacc

SEQ ID NO: 756303 - DNA, 25 bp, Mus musculus
tatcttcgaccgtgaggaccagacc

SEQ ID NO: 756304 - DNA, 25 bp, Mus musculus
tatcttcgatcacgtggtcgttcgg

SEQ ID NO: 756305 - DNA, 25 bp, Mus musculus
tatcttcgatcaggtggtcgttcgg

SEQ ID NO: 756306 - DNA, 25 bp, Mus musculus
tatcttcggcaccaagtttgacctg

SEQ ID NO: 756307 - DNA, 25 bp, Mus musculus
tatcttcggcacgaagtttgacctg

SEQ ID NO: 756308 - DNA, 25 bp, Mus musculus
tatcttcgtcgacaactggtagaac

SEQ ID NO: 756309 - DNA, 25 bp, Mus musculus
tatcttcgtcgagaactggtagaac

SEQ ID NO: 756310 - DNA, 25 bp, Mus musculus
tatcttcgtggcatgaactctaccc

SEQ ID NO: 756311 - DNA, 25 bp, Mus musculus
tatcttcgtggcttgaactctaccc

SEQ ID NO: 756312 - DNA, 25 bp, Mus musculus
tatcttctacctcagtgactacatc

SEQ ID NO: 756313 - DNA, 25 bp, Mus musculus
tatcttctacctgagtgactacatc

SEQ ID NO: 756314 - DNA, 25 bp, Mus musculus
tatcttctcacccaacatgcaaaag

SEQ ID NO: 756315 - DNA, 25 bp, Mus musculus
tatcttctcaccgaacatgcaaaag

SEQ ID NO: 756316 - DNA, 25 bp, Mus musculus
tatcttctcagtaggtgggctgaga

SEQ ID NO: 756317 - DNA, 25 bp, Mus musculus
tatcttctcagttggtgggctgaga

SEQ ID NO: 756318 - DNA, 25 bp, Mus musculus
tatcttctcgaaaaaatagatgcag

SEQ ID NO: 756319 - DNA, 25 bp, Mus musculus
tatcttctcgaataaatagatgcag

SEQ ID NO: 756320 - DNA, 25 bp, Mus musculus
tatcttctgtaccagaacactaaat

SEQ ID NO: 756321 - DNA, 25 bp, Mus musculus
tatcttctgtacgagaacactaaat

SEQ ID NO: 756322 - DNA, 25 bp, Mus musculus
tatcttctgtgaagcggtggccatc

SEQ ID NO: 756323 - DNA, 25 bp, Mus musculus
tatcttctgtgatgcggtggccatc

SEQ ID NO: 756324 - DNA, 25 bp, Mus musculus
tatcttgaacgactttagagccacg

SEQ ID NO: 756325 - DNA, 25 bp, Mus musculus
tatcttgaacgagtttagagccacg

SEQ ID NO: 756326 - DNA, 25 bp, Mus musculus
tatcttgacatgcttcccttggcat

SEQ ID NO: 756327 - DNA, 25 bp, Mus musculus
tatcttgacatggttcccttggcat

SEQ ID NO: 756328 - DNA, 25 bp, Mus musculus
tatcttgagagcagaggctaggtcc

SEQ ID NO: 756329 - DNA, 25 bp, Mus musculus
tatcttgagagctgaggctaggtcc

SEQ ID NO: 756330 - DNA, 25 bp, Mus musculus
tatcttgcgccaagacaattcaggg

SEQ ID NO: 756331 - DNA, 25 bp, Mus musculus
tatcttgcgccatgacaattcaggg

SEQ ID NO: 756332 - DNA, 25 bp, Mus musculus
tatcttgctctacctggcacacaag

SEQ ID NO: 756333 - DNA, 25 bp, Mus musculus
tatcttgctctagctggcacacaag

SEQ ID NO: 756334 - DNA, 25 bp, Mus musculus
tatcttgctgctcaggtagcggcct

SEQ ID NO: 756335 - DNA, 25 bp, Mus musculus
tatcttgctgctgaggtagcggcct

SEQ ID NO: 756336 - DNA, 25 bp, Mus musculus
tatcttggaaatctctggaaaaacc

SEQ ID NO: 756337 - DNA, 25 bp, Mus musculus
tatcttggaaatgtctggaaaaacc

SEQ ID NO: 756338 - DNA, 25 bp, Mus musculus
tatcttggatgaagccaccagtgcc

SEQ ID NO: 756339 - DNA, 25 bp, Mus musculus
tatcttggatgatgccaccagtgcc

SEQ ID NO: 756340 - DNA, 25 bp, Mus musculus
tatcttggatgcaggatttaactcc

SEQ ID NO: 756341 - DNA, 25 bp, Mus musculus
tatcttggatgctggatttaactcc

SEQ ID NO: 756342 - DNA, 25 bp, Mus musculus
tatcttggctcactgatgcagaagg

SEQ ID NO: 756343 - DNA, 25 bp, Mus musculus
tatcttggctcagtgatgcagaagg

SEQ ID NO: 756344 - DNA, 25 bp, Mus musculus
tatcttggtcatctaattgggcacg

SEQ ID NO: 756345 - DNA, 25 bp, Mus musculus
tatcttggtcatgtaattgggcacg

SEQ ID NO: 756346 - DNA, 25 bp, Mus musculus
tatcttgtgcgtccgagaggcaaca

SEQ ID NO: 756347 - DNA, 25 bp, Mus musculus
tatcttgtgcgtgcgagaggcaaca

SEQ ID NO: 756348 - DNA, 25 bp, Mus musculus
tatctttactggattgcgagggccc

SEQ ID NO: 756349 - DNA, 25 bp, Mus musculus
tatctttactggtttgcgagggccc

SEQ ID NO: 756350 - DNA, 25 bp, Mus musculus
tatctttagttgatgaggcttcggg

SEQ ID NO: 756351 - DNA, 25 bp, Mus musculus
tatctttagttgttgaggcttcggg

SEQ ID NO: 756352 - DNA, 25 bp, Mus musculus
tatctttatgaaaggaacaatgtcc

SEQ ID NO: 756353 - DNA, 25 bp, Mus musculus
tatctttatgaatggaacaatgtcc

SEQ ID NO: 756354 - DNA, 25 bp, Mus musculus
tatctttatgctacaatgctttccc

SEQ ID NO: 756355 - DNA, 25 bp, Mus musculus
tatctttatgcttcaatgctttccc

SEQ ID NO: 756356 - DNA, 25 bp, Mus musculus
tatctttatgtcctgaatcacccca

SEQ ID NO: 756357 - DNA, 25 bp, Mus musculus
tatctttatgtcgtgaatcacccca

SEQ ID NO: 756358 - DNA, 25 bp, Mus musculus
tatctttctgaacttgcatccggag

SEQ ID NO: 756359 - DNA, 25 bp, Mus musculus
tatctttctgaagttgcatccggag

SEQ ID NO: 756360 - DNA, 25 bp, Mus musculus
tatctttcttagacgagctcacctg

SEQ ID NO: 756361 - DNA, 25 bp, Mus musculus
tatctttcttagtcgagctcacctg

SEQ ID NO: 756362 - DNA, 25 bp, Mus musculus
tatctttgagttaatggagccagct

SEQ ID NO: 756363 - DNA, 25 bp, Mus musculus
tatctttgagtttatggagccagct

SEQ ID NO: 756364 - DNA, 25 bp, Mus musculus
tatctttgcagcattagtcggtgcc

SEQ ID NO: 756365 - DNA, 25 bp, Mus musculus
tatctttgcagctttagtcggtgcc

SEQ ID NO: 756366 - DNA, 25 bp, Mus musculus
tatctttgcgatcgaattctccagc

SEQ ID NO: 756367 - DNA, 25 bp, Mus musculus
tatctttgcgatggaattctccagc

SEQ ID NO: 756368 - DNA, 25 bp, Mus musculus
tatctttgctgtcaccggtgcaaca

SEQ ID NO: 756369 - DNA, 25 bp, Mus musculus
tatctttgctgtgaccggtgcaaca

SEQ ID NO: 756370 - DNA, 25 bp, Mus musculus
tatctttggacaaagcttaggcagc

SEQ ID NO: 756371 - DNA, 25 bp, Mus musculus
tatctttggacatagcttaggcagc

SEQ ID NO: 756372 - DNA, 25 bp, Mus musculus
tatctttgggtcatcgtggagtgta

SEQ ID NO: 756373 - DNA, 25 bp, Mus musculus
tatctttgggtcttcgtggagtgta

SEQ ID NO: 756374 - DNA, 25 bp, Mus musculus
tatctttgtctgctaatcatgcaca

SEQ ID NO: 756375 - DNA, 25 bp, Mus musculus
tatctttgtctggtaatcatgcaca

SEQ ID NO: 756376 - DNA, 25 bp, Mus musculus
tatcttttaacaccataggccctga

SEQ ID NO: 756377 - DNA, 25 bp, Mus musculus
tatcttttaacagcataggccctga

SEQ ID NO: 756378 - DNA, 25 bp, Mus musculus
tatgaaaaagagatcactcccaaag

SEQ ID NO: 756379 - DNA, 25 bp, Mus musculus
tatgaaaaagagttcactcccaaag

SEQ ID NO: 756380 - DNA, 25 bp, Mus musculus
tatgaaaaagatcaaactgcacaat

SEQ ID NO: 756381 - DNA, 25 bp, Mus musculus
tatgaaaaagatgaaactgcacaat

SEQ ID NO: 756382 - DNA, 25 bp, Mus musculus
tatgaaaaattacctcctcccgatc

SEQ ID NO: 756383 - DNA, 25 bp, Mus musculus
tatgaaaaattagctcctcccgatc

SEQ ID NO: 756384 - DNA, 25 bp, Mus musculus
tatgaaaaccttccacatgtcccac

SEQ ID NO: 756385 - DNA, 25 bp, Mus musculus
tatgaaaaccttgcacatgtcccac

SEQ ID NO: 756386 - DNA, 25 bp, Mus musculus
tatgaaaagcctcatggatcacacc

SEQ ID NO: 756387 - DNA, 25 bp, Mus musculus
tatgaaaagcctgatggatcacacc

SEQ ID NO: 756388 - DNA, 25 bp, Mus musculus
tatgaaaataagaagccattctacc

SEQ ID NO: 756389 - DNA, 25 bp, Mus musculus
tatgaaaataagtagccattctacc

SEQ ID NO: 756390 - DNA, 25 bp, Mus musculus
tatgaaacaccgcatactcccagga

SEQ ID NO: 756391 - DNA, 25 bp, Mus musculus
tatgaaacaccggatactcccagga

SEQ ID NO: 756392 - DNA, 25 bp, Mus musculus
tatgaaacagttcccaaggatgcgg

SEQ ID NO: 756393 - DNA, 25 bp, Mus musculus
tatgaaacagttgccaaggatgcgg

SEQ ID NO: 756394 - DNA, 25 bp, Mus musculus
tatgaaactctcacaaaagggcccc

SEQ ID NO: 756395 - DNA, 25 bp, Mus musculus
tatgaaactctctcaaaagggcccc

SEQ ID NO: 756396 - DNA, 25 bp, Mus musculus
tatgaaacttatccttgtctgtggg

SEQ ID NO: 756397 - DNA, 25 bp, Mus musculus
tatgaaacttatgcttgtctgtggg

SEQ ID NO: 756398 - DNA, 25 bp, Mus musculus
tatgaaagaaaacctctatcagcta

SEQ ID NO: 756399 - DNA, 25 bp, Mus musculus
tatgaaagaaaagctctatcagcta

SEQ ID NO: 756400 - DNA, 25 bp, Mus musculus
tatgaaagatcgctggatgaacgtg

SEQ ID NO: 756401 - DNA, 25 bp, Mus musculus
tatgaaagatcggtggatgaacgtg

SEQ ID NO: 756402 - DNA, 25 bp, Mus musculus
tatgaaagcatcaaggagatgggcc

SEQ ID NO: 756403 - DNA, 25 bp, Mus musculus
tatgaaagcatctaggagatgggcc

SEQ ID NO: 756404 - DNA, 25 bp, Mus musculus
tatgaaagccatccccacctggatg

SEQ ID NO: 756405 - DNA, 25 bp, Mus musculus
tatgaaagccatgcccacctggatg

SEQ ID NO: 756406 - DNA, 25 bp, Mus musculus
tatgaaagcctgaagcatccgaagg

SEQ ID NO: 756407 - DNA, 25 bp, Mus musculus
tatgaaagcctgtagcatccgaagg

SEQ ID NO: 756408 - DNA, 25 bp, Mus musculus
tatgaaaggctgagccacccattgg

SEQ ID NO: 756409 - DNA, 25 bp, Mus musculus
tatgaaaggctgtgccacccattgg

SEQ ID NO: 756410 - DNA, 25 bp, Mus musculus
tatgaaagggcgcgaaccctcggtt

SEQ ID NO: 756411 - DNA, 25 bp, Mus musculus
tatgaaagggcgggaaccctcggtt

SEQ ID NO: 756412 - DNA, 25 bp, Mus musculus
tatgaaagtgagctctacccaacct

SEQ ID NO: 756413 - DNA, 25 bp, Mus musculus
tatgaaagtgaggtctacccaacct

SEQ ID NO: 756414 - DNA, 25 bp, Mus musculus
tatgaaatagctagcaaaaaagctc

SEQ ID NO: 756415 - DNA, 25 bp, Mus musculus
tatgaaatagcttgcaaaaaagctc

SEQ ID NO: 756416 - DNA, 25 bp, Mus musculus
tatgaaatgcacacagcaaggcttg

SEQ ID NO: 756417 - DNA, 25 bp, Mus musculus
tatgaaatgcactcagcaaggcttg

SEQ ID NO: 756418 - DNA, 25 bp, Mus musculus
tatgaaatggcgagtgcaattgcag

SEQ ID NO: 756419 - DNA, 25 bp, Mus musculus
tatgaaatggcgtgtgcaattgcag

SEQ ID NO: 756420 - DNA, 25 bp, Mus musculus
tatgaaatgtacaagtggccagcct

SEQ ID NO: 756421 - DNA, 25 bp, Mus musculus
tatgaaatgtactagtggccagcct

SEQ ID NO: 756422 - DNA, 25 bp, Mus musculus
tatgaaattccccttgtgctagtgg

SEQ ID NO: 756423 - DNA, 25 bp, Mus musculus
tatgaaattcccgttgtgctagtgg

SEQ ID NO: 756424 - DNA, 25 bp, Mus musculus
tatgaaattcgaataaagtctgaag

SEQ ID NO: 756425 - DNA, 25 bp, Mus musculus
tatgaaattcgattaaagtctgaag

SEQ ID NO: 756426 - DNA, 25 bp, Mus musculus
tatgaaatttaaagcttgaacacgg

SEQ ID NO: 756427 - DNA, 25 bp, Mus musculus
tatgaaatttaatgcttgaacacgg

SEQ ID NO: 756428 - DNA, 25 bp, Mus musculus
tatgaaatttacacagactttgccc

SEQ ID NO: 756429 - DNA, 25 bp, Mus musculus
tatgaaatttactcagactttgccc

SEQ ID NO: 756430 - DNA, 25 bp, Mus musculus
tatgaacaagttcggacagcccagt

SEQ ID NO: 756431 - DNA, 25 bp, Mus musculus
tatgaacaagttgggacagcccagt

SEQ ID NO: 756432 - DNA, 25 bp, Mus musculus
tatgaacacagaaacaacgcctatc

SEQ ID NO: 756433 - DNA, 25 bp, Mus musculus
tatgaacacagatacaacgcctatc

SEQ ID NO: 756434 - DNA, 25 bp, Mus musculus
tatgaacaccgtcgattttggccac

SEQ ID NO: 756435 - DNA, 25 bp, Mus musculus
tatgaacaccgtggattttggccac

SEQ ID NO: 756436 - DNA, 25 bp, Mus musculus
tatgaacacgcactctcgagcgtcg

SEQ ID NO: 756437 - DNA, 25 bp, Mus musculus
tatgaacacgcagtctcgagcgtcg

SEQ ID NO: 756438 - DNA, 25 bp, Mus musculus
tatgaacacttgcatgctgctgacg

SEQ ID NO: 756439 - DNA, 25 bp, Mus musculus
tatgaacacttggatgctgctgacg

SEQ ID NO: 756440 - DNA, 25 bp, Mus musculus
tatgaacaggacagagatcagcggt

SEQ ID NO: 756441 - DNA, 25 bp, Mus musculus
tatgaacaggactgagatcagcggt

SEQ ID NO: 756442 - DNA, 25 bp, Mus musculus
tatgaacaggccaccaaggtggacc

SEQ ID NO: 756443 - DNA, 25 bp, Mus musculus
tatgaacaggcctccaaggtggacc

SEQ ID NO: 756444 - DNA, 25 bp, Mus musculus
tatgaacaggctcacagacaaggct

SEQ ID NO: 756445 - DNA, 25 bp, Mus musculus
tatgaacaggctgacagacaaggct

SEQ ID NO: 756446 - DNA, 25 bp, Mus musculus
tatgaacatcctccggttcctggcc

SEQ ID NO: 756447 - DNA, 25 bp, Mus musculus
tatgaacatcctgcggttcctggcc

SEQ ID NO: 756448 - DNA, 25 bp, Mus musculus
tatgaacatgtgatgggtgctctcc

SEQ ID NO: 756449 - DNA, 25 bp, Mus musculus
tatgaacatgtgttgggtgctctcc

SEQ ID NO: 756450 - DNA, 25 bp, Mus musculus
tatgaacatttgacgggctggcctc

SEQ ID NO: 756451 - DNA, 25 bp, Mus musculus
tatgaacatttgtcgggctggcctc

SEQ ID NO: 756452 - DNA, 25 bp, Mus musculus
tatgaaccagatcaccttcgagcgg

SEQ ID NO: 756453 - DNA, 25 bp, Mus musculus
tatgaaccagatgaccttcgagcgg

SEQ ID NO: 756454 - DNA, 25 bp, Mus musculus
tatgaacccaacagtagcagcaaga

SEQ ID NO: 756455 - DNA, 25 bp, Mus musculus
tatgaacccaactgtagcagcaaga

SEQ ID NO: 756456 - DNA, 25 bp, Mus musculus
tatgaacccactaacactcctgagg

SEQ ID NO: 756457 - DNA, 25 bp, Mus musculus
tatgaacccacttacactcctgagg

SEQ ID NO: 756458 - DNA, 25 bp, Mus musculus
tatgaacccttcctctgcatctata

SEQ ID NO: 756459 - DNA, 25 bp, Mus musculus
tatgaacccttcgtctgcatctata

SEQ ID NO: 756460 - DNA, 25 bp, Mus musculus
tatgaacctcagatgcagcaccatg

SEQ ID NO: 756461 - DNA, 25 bp, Mus musculus
tatgaacctcagttgcagcaccatg

SEQ ID NO: 756462 - DNA, 25 bp, Mus musculus
tatgaacctgggacccttgtttaag

SEQ ID NO: 756463 - DNA, 25 bp, Mus musculus
tatgaacctgggtcccttgtttaag

SEQ ID NO: 756464 - DNA, 25 bp, Mus musculus
tatgaacctttcactatggtggccg

SEQ ID NO: 756465 - DNA, 25 bp, Mus musculus
tatgaacctttctctatggtggccg

SEQ ID NO: 756466 - DNA, 25 bp, Mus musculus
tatgaacgaggcctcaaagtgcgcc

SEQ ID NO: 756467 - DNA, 25 bp, Mus musculus
tatgaacgaggcgtcaaagtgcgcc

SEQ ID NO: 756468 - DNA, 25 bp, Mus musculus
tatgaacggctgcagtccctgtcta

SEQ ID NO: 756469 - DNA, 25 bp, Mus musculus
tatgaacggctggagtccctgtcta

SEQ ID NO: 756470 - DNA, 25 bp, Mus musculus
tatgaacgggctccccgcgactgag

SEQ ID NO: 756471 - DNA, 25 bp, Mus musculus
tatgaacgggctgcccgcgactgag

SEQ ID NO: 756472 - DNA, 25 bp, Mus musculus
tatgaactactcagtgaaacaccct

SEQ ID NO: 756473 - DNA, 25 bp, Mus musculus
tatgaactactctgtgaaacaccct

SEQ ID NO: 756474 - DNA, 25 bp, Mus musculus
tatgaactagagctaagtttggccc

SEQ ID NO: 756475 - DNA, 25 bp, Mus musculus
tatgaactagaggtaagtttggccc

SEQ ID NO: 756476 - DNA, 25 bp, Mus musculus
tatgaactagatcatacatgtgccc

SEQ ID NO: 756477 - DNA, 25 bp, Mus musculus
tatgaactagatgatacatgtgccc

SEQ ID NO: 756478 - DNA, 25 bp, Mus musculus
tatgaactatggcaccagtgtggtg

SEQ ID NO: 756479 - DNA, 25 bp, Mus musculus
tatgaactatgggaccagtgtggtg

SEQ ID NO: 756480 - DNA, 25 bp, Mus musculus
tatgaactccacatctactgtaaga

SEQ ID NO: 756481 - DNA, 25 bp, Mus musculus
tatgaactccacttctactgtaaga

SEQ ID NO: 756482 - DNA, 25 bp, Mus musculus
tatgaactcgtcaaagtcaccaagg

SEQ ID NO: 756483 - DNA, 25 bp, Mus musculus
tatgaactcgtctaagtcaccaagg

SEQ ID NO: 756484 - DNA, 25 bp, Mus musculus
tatgaactgagtcagccagatgacg

SEQ ID NO: 756485 - DNA, 25 bp, Mus musculus
tatgaactgagtgagccagatgacg

SEQ ID NO: 756486 - DNA, 25 bp, Mus musculus
tatgaactgatcatcgaagctcaag

SEQ ID NO: 756487 - DNA, 25 bp, Mus musculus
tatgaactgatcttcgaagctcaag

SEQ ID NO: 756488 - DNA, 25 bp, Mus musculus
tatgaactgcagacgtgggctgaca

SEQ ID NO: 756489 - DNA, 25 bp, Mus musculus
tatgaactgcagtcgtgggctgaca

SEQ ID NO: 756490 - DNA, 25 bp, Mus musculus
tatgaactggatccggaccccaaga

SEQ ID NO: 756491 - DNA, 25 bp, Mus musculus
tatgaactggatgcggaccccaaga

SEQ ID NO: 756492 - DNA, 25 bp, Mus musculus
tatgaacttggaaagacaggagtcc

SEQ ID NO: 756493 - DNA, 25 bp, Mus musculus
tatgaacttggatagacaggagtcc

SEQ ID NO: 756494 - DNA, 25 bp, Mus musculus
tatgaagaacctcctctctagagag

SEQ ID NO: 756495 - DNA, 25 bp, Mus musculus
tatgaagaacctgctctctagagag

SEQ ID NO: 756496 - DNA, 25 bp, Mus musculus
tatgaagaacgaattccttctctcc

SEQ ID NO: 756497 - DNA, 25 bp, Mus musculus
tatgaagaacgatttccttctctcc

SEQ ID NO: 756498 - DNA, 25 bp, Mus musculus
tatgaagaacggcaacaggtgaccc

SEQ ID NO: 756499 - DNA, 25 bp, Mus musculus
tatgaagaacgggaacaggtgaccc

SEQ ID NO: 756500 - DNA, 25 bp, Mus musculus
tatgaagaaggacacgaatattttg

SEQ ID NO: 756501 - DNA, 25 bp, Mus musculus
tatgaagaaggagacgaatattttg

SEQ ID NO: 756502 - DNA, 25 bp, Mus musculus
tatgaagaatacacacggacctccc

SEQ ID NO: 756503 - DNA, 25 bp, Mus musculus
tatgaagaatactcacggacctccc

SEQ ID NO: 756504 - DNA, 25 bp, Mus musculus
tatgaagacaacatcggcctcatgt

SEQ ID NO: 756505 - DNA, 25 bp, Mus musculus
tatgaagacaacttcggcctcatgt

SEQ ID NO: 756506 - DNA, 25 bp, Mus musculus
tatgaagacattctgcggaacgccg

SEQ ID NO: 756507 - DNA, 25 bp, Mus musculus
tatgaagacattgtgcggaacgccg

SEQ ID NO: 756508 - DNA, 25 bp, Mus musculus
tatgaagaccacatggcggaagact

SEQ ID NO: 756509 - DNA, 25 bp, Mus musculus
tatgaagaccaccagagcgggcatg

SEQ ID NO: 756510 - DNA, 25 bp, Mus musculus
tatgaagaccacgagagcgggcatg

SEQ ID NO: 756511 - DNA, 25 bp, Mus musculus
tatgaagaccacttggcggaagact

SEQ ID NO: 756512 - DNA, 25 bp, Mus musculus
tatgaagaccataggcagtgtgtgc

SEQ ID NO: 756513 - DNA, 25 bp, Mus musculus
tatgaagaccatcccgatgagtaca

SEQ ID NO: 756514 - DNA, 25 bp, Mus musculus
tatgaagaccatgccgatgagtaca

SEQ ID NO: 756515 - DNA, 25 bp, Mus musculus
tatgaagaccattggcagtgtgtgc

SEQ ID NO: 756516 - DNA, 25 bp, Mus musculus
tatgaagaccgaagaagccatcatt

SEQ ID NO: 756517 - DNA, 25 bp, Mus musculus
tatgaagaccgatgaagccatcatt

SEQ ID NO: 756518 - DNA, 25 bp, Mus musculus
tatgaagacctgatcaataagattg

SEQ ID NO: 756519 - DNA, 25 bp, Mus musculus
tatgaagacctgttcaataagattg

SEQ ID NO: 756520 - DNA, 25 bp, Mus musculus
tatgaagactatagtgtccttgaac

SEQ ID NO: 756521 - DNA, 25 bp, Mus musculus
tatgaagactattgtgtccttgaac

SEQ ID NO: 756522 - DNA, 25 bp, Mus musculus
tatgaagactccctgctggaccctg

SEQ ID NO: 756523 - DNA, 25 bp, Mus musculus
tatgaagactccgtgctggaccctg

SEQ ID NO: 756524 - DNA, 25 bp, Mus musculus
tatgaagagacacaatgtagtgacg

SEQ ID NO: 756525 - DNA, 25 bp, Mus musculus
tatgaagagacagaatgtagtgacg

SEQ ID NO: 756526 - DNA, 25 bp, Mus musculus
tatgaagagcagctttgatataaaa

SEQ ID NO: 756527 - DNA, 25 bp, Mus musculus
tatgaagagcaggtttgatataaaa

SEQ ID NO: 756528 - DNA, 25 bp, Mus musculus
tatgaagagttcatcttcgctcctc

SEQ ID NO: 756529 - DNA, 25 bp, Mus musculus
tatgaagagttcttcttcgctcctc

SEQ ID NO: 756530 - DNA, 25 bp, Mus musculus
tatgaagatgtcaacaactgccatg

SEQ ID NO: 756531 - DNA, 25 bp, Mus musculus
tatgaagatgtctacaactgccatg

SEQ ID NO: 756532 - DNA, 25 bp, Mus musculus
tatgaagcaattctaaagctttcag

SEQ ID NO: 756533 - DNA, 25 bp, Mus musculus
tatgaagcaattgtaaagctttcag

SEQ ID NO: 756534 - DNA, 25 bp, Mus musculus
tatgaagcacggacggaagatgacc

SEQ ID NO: 756535 - DNA, 25 bp, Mus musculus
tatgaagcacggtcggaagatgacc

SEQ ID NO: 756536 - DNA, 25 bp, Mus musculus
tatgaagccagcaaccagcctcttg

SEQ ID NO: 756537 - DNA, 25 bp, Mus musculus
tatgaagccagctaccagcctcttg

SEQ ID NO: 756538 - DNA, 25 bp, Mus musculus
tatgaagcccaaactgatgtaccag

SEQ ID NO: 756539 - DNA, 25 bp, Mus musculus
tatgaagcccaatctgatgtaccag

SEQ ID NO: 756540 - DNA, 25 bp, Mus musculus
tatgaagcccacatccatctgaatg

SEQ ID NO: 756541 - DNA, 25 bp, Mus musculus
tatgaagcccacttccatctgaatg

SEQ ID NO: 756542 - DNA, 25 bp, Mus musculus
tatgaagctaaaatacagtggttac

SEQ ID NO: 756543 - DNA, 25 bp, Mus musculus
tatgaagctaaattacagtggttac

SEQ ID NO: 756544 - DNA, 25 bp, Mus musculus
tatgaagctctacattatgcaaaaa

SEQ ID NO: 756545 - DNA, 25 bp, Mus musculus
tatgaagctctagattatgcaaaaa

SEQ ID NO: 756546 - DNA, 25 bp, Mus musculus
tatgaagctgaaagtgagctcaggc

SEQ ID NO: 756547 - DNA, 25 bp, Mus musculus
tatgaagctgaatgtgagctcaggc

SEQ ID NO: 756548 - DNA, 25 bp, Mus musculus
tatgaaggagaacgctaagcatggt

SEQ ID NO: 756549 - DNA, 25 bp, Mus musculus
tatgaaggagaaggctaagcatggt

SEQ ID NO: 756550 - DNA, 25 bp, Mus musculus
tatgaaggcaacagcaatgacatcc

SEQ ID NO: 756551 - DNA, 25 bp, Mus musculus
tatgaaggcaactgcaatgacatcc

SEQ ID NO: 756552 - DNA, 25 bp, Mus musculus
tatgaaggccgtaacagagcaggga

SEQ ID NO: 756553 - DNA, 25 bp, Mus musculus
tatgaaggccgtcgtctggacagat

SEQ ID NO: 756554 - DNA, 25 bp, Mus musculus
tatgaaggccgtcttatccagattg

SEQ ID NO: 756555 - DNA, 25 bp, Mus musculus
tatgaaggccgtggtctggacagat

SEQ ID NO: 756556 - DNA, 25 bp, Mus musculus
tatgaaggccgtgttatccagattg

SEQ ID NO: 756557 - DNA, 25 bp, Mus musculus
tatgaaggccgttacagagcaggga

SEQ ID NO: 756558 - DNA, 25 bp, Mus musculus
tatgaaggtattaaatcaatggctg

SEQ ID NO: 756559 - DNA, 25 bp, Mus musculus
tatgaaggtatttaatcaatggctg

SEQ ID NO: 756560 - DNA, 25 bp, Mus musculus
tatgaaggtggtctagacttgaaca

SEQ ID NO: 756561 - DNA, 25 bp, Mus musculus
tatgaaggtggtgtagacttgaaca

SEQ ID NO: 756562 - DNA, 25 bp, Mus musculus
tatgaaggttttatctgtgagagcg

SEQ ID NO: 756563 - DNA, 25 bp, Mus musculus
tatgaaggttttttctgtgagagcg

SEQ ID NO: 756564 - DNA, 25 bp, Mus musculus
tatgaagtcaaaccgtccgagccag

SEQ ID NO: 756565 - DNA, 25 bp, Mus musculus
tatgaagtcaaagcgtccgagccag

SEQ ID NO: 756566 - DNA, 25 bp, Mus musculus
tatgaagtcggacatggcccagata

SEQ ID NO: 756567 - DNA, 25 bp, Mus musculus
tatgaagtcggagatggcccagata

SEQ ID NO: 756568 - DNA, 25 bp, Mus musculus
tatgaagtgactagaaaggactgcg

SEQ ID NO: 756569 - DNA, 25 bp, Mus musculus
tatgaagtgacttgaaaggactgcg

SEQ ID NO: 756570 - DNA, 25 bp, Mus musculus
tatgaagtgatcactgctgggccca

SEQ ID NO: 756571 - DNA, 25 bp, Mus musculus
tatgaagtgatctctgctgggccca

SEQ ID NO: 756572 - DNA, 25 bp, Mus musculus
tatgaagtgcttaccgcagggcggt

SEQ ID NO: 756573 - DNA, 25 bp, Mus musculus
tatgaagtgctttccgcagggcggt

SEQ ID NO: 756574 - DNA, 25 bp, Mus musculus
tatgaagtggctcctcagcacgagg

SEQ ID NO: 756575 - DNA, 25 bp, Mus musculus
tatgaagtggctgctcagcacgagg

SEQ ID NO: 756576 - DNA, 25 bp, Mus musculus
tatgaagtgtgtaaatcacaaaaat

SEQ ID NO: 756577 - DNA, 25 bp, Mus musculus
tatgaagtgtgttaatcacaaaaat

SEQ ID NO: 756578 - DNA, 25 bp, Mus musculus
tatgaagttataatccgggaacccg

SEQ ID NO: 756579 - DNA, 25 bp, Mus musculus
tatgaagttatattccgggaacccg

SEQ ID NO: 756580 - DNA, 25 bp, Mus musculus
tatgaagtttgtagccccattcaat

SEQ ID NO: 756581 - DNA, 25 bp, Mus musculus
tatgaagtttgttgccccattcaat

SEQ ID NO: 756582 - DNA, 25 bp, Mus musculus
tatgaataacggagactacaccctg

SEQ ID NO: 756583 - DNA, 25 bp, Mus musculus
tatgaataacggtgactacaccctg

SEQ ID NO: 756584 - DNA, 25 bp, Mus musculus
tatgaataagatcaggcccaggaga

SEQ ID NO: 756585 - DNA, 25 bp, Mus musculus
tatgaataagatgaggcccaggaga

SEQ ID NO: 756586 - DNA, 25 bp, Mus musculus
tatgaatatacaagttggaaaaggg

SEQ ID NO: 756587 - DNA, 25 bp, Mus musculus
tatgaatatacatgttggaaaaggg

SEQ ID NO: 756588 - DNA, 25 bp, Mus musculus
tatgaatcagatcagcagtgtttcc

SEQ ID NO: 756589 - DNA, 25 bp, Mus musculus
tatgaatcagatgagcagtgtttcc

SEQ ID NO: 756590 - DNA, 25 bp, Mus musculus
tatgaatcgccgaagaagaaatgga

SEQ ID NO: 756591 - DNA, 25 bp, Mus musculus
tatgaatcgccgtagaagaaatgga

SEQ ID NO: 756592 - DNA, 25 bp, Mus musculus
tatgaatgaaccaagactgtctgac

SEQ ID NO: 756593 - DNA, 25 bp, Mus musculus
tatgaatgaacctagactgtctgac

SEQ ID NO: 756594 - DNA, 25 bp, Mus musculus
tatgaatgaactccataaaatccca

SEQ ID NO: 756595 - DNA, 25 bp, Mus musculus
tatgaatgaactgcataaaatccca

SEQ ID NO: 756596 - DNA, 25 bp, Mus musculus
tatgaatgacagcacagctctgtgg

SEQ ID NO: 756597 - DNA, 25 bp, Mus musculus
tatgaatgacaggacagctctgtgg

SEQ ID NO: 756598 - DNA, 25 bp, Mus musculus
tatgaatgattgatacagaactgaa

SEQ ID NO: 756599 - DNA, 25 bp, Mus musculus
tatgaatgattgttacagaactgaa

SEQ ID NO: 756600 - DNA, 25 bp, Mus musculus
tatgaatgcaggaatgagaaaatac

SEQ ID NO: 756601 - DNA, 25 bp, Mus musculus
tatgaatgcaggtatgagaaaatac

SEQ ID NO: 756602 - DNA, 25 bp, Mus musculus
tatgaatgcttgcacatccaggaac

SEQ ID NO: 756603 - DNA, 25 bp, Mus musculus
tatgaatgcttggacatccaggaac

SEQ ID NO: 756604 - DNA, 25 bp, Mus musculus
tatgaatggacacctcagagacttt

SEQ ID NO: 756605 - DNA, 25 bp, Mus musculus
tatgaatggacagctcagagacttt

SEQ ID NO: 756606 - DNA, 25 bp, Mus musculus
tatgaatgggaccagcaatccagac

SEQ ID NO: 756607 - DNA, 25 bp, Mus musculus
tatgaatgggacgagcaatccagac

SEQ ID NO: 756608 - DNA, 25 bp, Mus musculus
tatgaatgggatacggaattcccag

SEQ ID NO: 756609 - DNA, 25 bp, Mus musculus
tatgaatgggattcggaattcccag

SEQ ID NO: 756610 - DNA, 25 bp, Mus musculus
tatgaattcagcacagaacttggaa

SEQ ID NO: 756611 - DNA, 25 bp, Mus musculus
tatgaattcagctcagaacttggaa

SEQ ID NO: 756612 - DNA, 25 bp, Mus musculus
tatgaattccagagcagggctgggc

SEQ ID NO: 756613 - DNA, 25 bp, Mus musculus
tatgaattccagtgcagggctgggc

SEQ ID NO: 756614 - DNA, 25 bp, Mus musculus
tatgacaaaaccaacgccggcggta

SEQ ID NO: 756615 - DNA, 25 bp, Mus musculus
tatgacaaaacctacgccggcggta

SEQ ID NO: 756616 - DNA, 25 bp, Mus musculus
tatgacaaatacatccggcctgaaa

SEQ ID NO: 756617 - DNA, 25 bp, Mus musculus
tatgacaaatacttccggcctgaaa

SEQ ID NO: 756618 - DNA, 25 bp, Mus musculus
tatgacaacaaacggatcacctacc

SEQ ID NO: 756619 - DNA, 25 bp, Mus musculus
tatgacaacaaagggatcacctacc

SEQ ID NO: 756620 - DNA, 25 bp, Mus musculus
tatgacaacatcagggtctggatca

SEQ ID NO: 756621 - DNA, 25 bp, Mus musculus
tatgacaacatctgggtctggatca

SEQ ID NO: 756622 - DNA, 25 bp, Mus musculus
tatgacaactggagagtcccctcag

SEQ ID NO: 756623 - DNA, 25 bp, Mus musculus
tatgacaactggtgagtcccctcag

SEQ ID NO: 756624 - DNA, 25 bp, Mus musculus
tatgacaacttaacacagtgattgg

SEQ ID NO: 756625 - DNA, 25 bp, Mus musculus
tatgacaacttatcacagtgattgg

SEQ ID NO: 756626 - DNA, 25 bp, Mus musculus
tatgacaacttcaccgtctacaacc

SEQ ID NO: 756627 - DNA, 25 bp, Mus musculus
tatgacaacttctccgtctacaacc

SEQ ID NO: 756628 - DNA, 25 bp, Mus musculus
tatgacaagcgtcgcattgtgcgca

SEQ ID NO: 756629 - DNA, 25 bp, Mus musculus
tatgacaagcgtggcattgtgcgca

SEQ ID NO: 756630 - DNA, 25 bp, Mus musculus
tatgacaagttacagaagatccatc

SEQ ID NO: 756631 - DNA, 25 bp, Mus musculus
tatgacaagttagagaagatccatc

SEQ ID NO: 756632 - DNA, 25 bp, Mus musculus
tatgacaatgacaagcactctgctc

SEQ ID NO: 756633 - DNA, 25 bp, Mus musculus
tatgacaatgactagcactctgctc

SEQ ID NO: 756634 - DNA, 25 bp, Mus musculus
tatgacaatgcaccggggtatggac

SEQ ID NO: 756635 - DNA, 25 bp, Mus musculus
tatgacaatgcagcggggtatggac

SEQ ID NO: 756636 - DNA, 25 bp, Mus musculus
tatgacacacggcatgatgaccgga

SEQ ID NO: 756637 - DNA, 25 bp, Mus musculus
tatgacacacgggatgatgaccgga

SEQ ID NO: 756638 - DNA, 25 bp, Mus musculus
tatgacaccatcagccagaactttg

SEQ ID NO: 756639 - DNA, 25 bp, Mus musculus
tatgacaccatctgccagaactttg

SEQ ID NO: 756640 - DNA, 25 bp, Mus musculus
tatgacaccggtaagagaacgaatc

SEQ ID NO: 756641 - DNA, 25 bp, Mus musculus
tatgacaccggttagagaacgaatc

SEQ ID NO: 756642 - DNA, 25 bp, Mus musculus
tatgacacctatccggcagacatag

SEQ ID NO: 756643 - DNA, 25 bp, Mus musculus
tatgacacctatgcggcagacatag

SEQ ID NO: 756644 - DNA, 25 bp, Mus musculus
tatgacacgttcatgctgaagcacc

SEQ ID NO: 756645 - DNA, 25 bp, Mus musculus
tatgacacgttcttgctgaagcacc

SEQ ID NO: 756646 - DNA, 25 bp, Mus musculus
tatgacagcagtccaacttgtgacc

SEQ ID NO: 756647 - DNA, 25 bp, Mus musculus
tatgacagcagtgcaacttgtgacc

SEQ ID NO: 756648 - DNA, 25 bp, Mus musculus
tatgacagccccagacatggtaggt

SEQ ID NO: 756649 - DNA, 25 bp, Mus musculus
tatgacagcccctgacatggtaggt

SEQ ID NO: 756650 - DNA, 25 bp, Mus musculus
tatgacagccgtactgcacgagcgt

SEQ ID NO: 756651 - DNA, 25 bp, Mus musculus
tatgacagccgtcatgactttcccc

SEQ ID NO: 756652 - DNA, 25 bp, Mus musculus
tatgacagccgtgatgactttcccc

SEQ ID NO: 756653 - DNA, 25 bp, Mus musculus
tatgacagccgttctgcacgagcgt

SEQ ID NO: 756654 - DNA, 25 bp, Mus musculus
tatgacagcctaaccggcctcatga

SEQ ID NO: 756655 - DNA, 25 bp, Mus musculus
tatgacagcctatccggcctcatga

SEQ ID NO: 756656 - DNA, 25 bp, Mus musculus
tatgacagcgggatcccaccctact

SEQ ID NO: 756657 - DNA, 25 bp, Mus musculus
tatgacagcgggttcccaccctact

SEQ ID NO: 756658 - DNA, 25 bp, Mus musculus
tatgacagctataacaacggaggag

SEQ ID NO: 756659 - DNA, 25 bp, Mus musculus
tatgacagctattacaacggaggag

SEQ ID NO: 756660 - DNA, 25 bp, Mus musculus
tatgacagtaacctctggcgccatt

SEQ ID NO: 756661 - DNA, 25 bp, Mus musculus
tatgacagtaacgtctggcgccatt

SEQ ID NO: 756662 - DNA, 25 bp, Mus musculus
tatgacagttcccaaggacgacggc

SEQ ID NO: 756663 - DNA, 25 bp, Mus musculus
tatgacagttccgaaggacgacggc

SEQ ID NO: 756664 - DNA, 25 bp, Mus musculus
tatgacataaaacagggacagatgc

SEQ ID NO: 756665 - DNA, 25 bp, Mus musculus
tatgacataaaagagggacagatgc

SEQ ID NO: 756666 - DNA, 25 bp, Mus musculus
tatgacatatacacgaggctgttgc

SEQ ID NO: 756667 - DNA, 25 bp, Mus musculus
tatgacatatactcgaggctgttgc

SEQ ID NO: 756668 - DNA, 25 bp, Mus musculus
tatgacatcaccaaccagtcctctt

SEQ ID NO: 756669 - DNA, 25 bp, Mus musculus
tatgacatcacctaccagtcctctt

SEQ ID NO: 756670 - DNA, 25 bp, Mus musculus
tatgacatcagcagtcaggatgagc

SEQ ID NO: 756671 - DNA, 25 bp, Mus musculus
tatgacatcagctgtcaggatgagc

SEQ ID NO: 756672 - DNA, 25 bp, Mus musculus
tatgacatccagagtatattcagag

SEQ ID NO: 756673 - DNA, 25 bp, Mus musculus
tatgacatccagtgtatattcagag

SEQ ID NO: 756674 - DNA, 25 bp, Mus musculus
tatgacatccccaacatgtttgagg

SEQ ID NO: 756675 - DNA, 25 bp, Mus musculus
tatgacatcccctacatgtttgagg

SEQ ID NO: 756676 - DNA, 25 bp, Mus musculus
tatgacatccgacctgatgtgtgga

SEQ ID NO: 756677 - DNA, 25 bp, Mus musculus
tatgacatccgagctgatgtgtgga

SEQ ID NO: 756678 - DNA, 25 bp, Mus musculus
tatgacatcgctcttatccaagagg

SEQ ID NO: 756679 - DNA, 25 bp, Mus musculus
tatgacatcgctgttatccaagagg

SEQ ID NO: 756680 - DNA, 25 bp, Mus musculus
tatgacatcggaatgcaaacggcac

SEQ ID NO: 756681 - DNA, 25 bp, Mus musculus
tatgacatcggattgcaaacggcac

SEQ ID NO: 756682 - DNA, 25 bp, Mus musculus
tatgacatctggcactgtgccccat

SEQ ID NO: 756683 - DNA, 25 bp, Mus musculus
tatgacatctgggactgtgccccat

SEQ ID NO: 756684 - DNA, 25 bp, Mus musculus
tatgacatgaacacacccaatgcac

SEQ ID NO: 756685 - DNA, 25 bp, Mus musculus
tatgacatgaactcacccaatgcac

SEQ ID NO: 756686 - DNA, 25 bp, Mus musculus
tatgacatggaaagcggcaccaaga

SEQ ID NO: 756687 - DNA, 25 bp, Mus musculus
tatgacatggaatgcggcaccaaga

SEQ ID NO: 756688 - DNA, 25 bp, Mus musculus
tatgacatggagctgccagactcgg

SEQ ID NO: 756689 - DNA, 25 bp, Mus musculus
tatgacatggaggtgccagactcgg

SEQ ID NO: 756690 - DNA, 25 bp, Mus musculus
tatgacatggtaccctgtgtggagg

SEQ ID NO: 756691 - DNA, 25 bp, Mus musculus
tatgacatggtagcctgtgtggagg

SEQ ID NO: 756692 - DNA, 25 bp, Mus musculus
tatgacatgttgcagctgcggtgca

SEQ ID NO: 756693 - DNA, 25 bp, Mus musculus
tatgacatgttggagctgcggtgca

SEQ ID NO: 756694 - DNA, 25 bp, Mus musculus
tatgaccaaggcctgttgaaccagt

SEQ ID NO: 756695 - DNA, 25 bp, Mus musculus
tatgaccaaggcgtgttgaaccagt

SEQ ID NO: 756696 - DNA, 25 bp, Mus musculus
tatgaccaaggtcaaagtaggtaaa

SEQ ID NO: 756697 - DNA, 25 bp, Mus musculus
tatgaccaaggtgaaagtaggtaaa

SEQ ID NO: 756698 - DNA, 25 bp, Mus musculus
tatgaccacacgctgcgcttttggc

SEQ ID NO: 756699 - DNA, 25 bp, Mus musculus
tatgaccacacggtgcgcttttggc

SEQ ID NO: 756700 - DNA, 25 bp, Mus musculus
tatgaccacaggctactgctacgat

SEQ ID NO: 756701 - DNA, 25 bp, Mus musculus
tatgaccacagggtactgctacgat

SEQ ID NO: 756702 - DNA, 25 bp, Mus musculus
tatgaccacgagagaaactgtaaga

SEQ ID NO: 756703 - DNA, 25 bp, Mus musculus
tatgaccacgagtgaaactgtaaga

SEQ ID NO: 756704 - DNA, 25 bp, Mus musculus
tatgaccaggataaactgtatggct

SEQ ID NO: 756705 - DNA, 25 bp, Mus musculus
tatgaccaggattaactgtatggct

SEQ ID NO: 756706 - DNA, 25 bp, Mus musculus
tatgaccagtccattgaaagcaggg

SEQ ID NO: 756707 - DNA, 25 bp, Mus musculus
tatgaccagtcctttgaaagcaggg

SEQ ID NO: 756708 - DNA, 25 bp, Mus musculus
tatgaccatcctctgtcgctgtgag

SEQ ID NO: 756709 - DNA, 25 bp, Mus musculus
tatgaccatcctgtgtcgctgtgag

SEQ ID NO: 756710 - DNA, 25 bp, Mus musculus
tatgacccaaggcatcgggctgcct

SEQ ID NO: 756711 - DNA, 25 bp, Mus musculus
tatgacccaagggatcgggctgcct

SEQ ID NO: 756712 - DNA, 25 bp, Mus musculus
tatgacccatctctcaaactatgga

SEQ ID NO: 756713 - DNA, 25 bp, Mus musculus
tatgacccatctgtcaaactatgga

SEQ ID NO: 756714 - DNA, 25 bp, Mus musculus
tatgaccccactatcttgctggagc

SEQ ID NO: 756715 - DNA, 25 bp, Mus musculus
tatgaccccactttcttgctggagc

SEQ ID NO: 756716 - DNA, 25 bp, Mus musculus
tatgacccctacactcaaagggttg

SEQ ID NO: 756717 - DNA, 25 bp, Mus musculus
tatgacccctactctcaaagggttg

SEQ ID NO: 756718 - DNA, 25 bp, Mus musculus
tatgacccggtaagaaaggactctg

SEQ ID NO: 756719 - DNA, 25 bp, Mus musculus
tatgacccggtatgaaaggactctg

SEQ ID NO: 756720 - DNA, 25 bp, Mus musculus
tatgaccctgaacctggctcggtga

SEQ ID NO: 756721 - DNA, 25 bp, Mus musculus
tatgaccctgaagctggctcggtga

SEQ ID NO: 756722 - DNA, 25 bp, Mus musculus
tatgaccctgacaatcccctgatat

SEQ ID NO: 756723 - DNA, 25 bp, Mus musculus
tatgaccctgactatcccctgatat

SEQ ID NO: 756724 - DNA, 25 bp, Mus musculus
tatgaccgaatgaggctggaactgt

SEQ ID NO: 756725 - DNA, 25 bp, Mus musculus
tatgaccgaatgtggctggaactgt

SEQ ID NO: 756726 - DNA, 25 bp, Mus musculus
tatgaccgagatagtggtggaaaca

SEQ ID NO: 756727 - DNA, 25 bp, Mus musculus
tatgaccgagattgtggtggaaaca

SEQ ID NO: 756728 - DNA, 25 bp, Mus musculus
tatgaccgcaagcacattgaggagc

SEQ ID NO: 756729 - DNA, 25 bp, Mus musculus
tatgaccgcaaggacattgaggagc

SEQ ID NO: 756730 - DNA, 25 bp, Mus musculus
tatgaccgttctatcactgtggatg

SEQ ID NO: 756731 - DNA, 25 bp, Mus musculus
tatgaccgttctttcactgtggatg

SEQ ID NO: 756732 - DNA, 25 bp, Mus musculus
tatgaccgtttcagccgcaatgacc

SEQ ID NO: 756733 - DNA, 25 bp, Mus musculus
tatgaccgtttctgccgcaatgacc

SEQ ID NO: 756734 - DNA, 25 bp, Mus musculus
tatgacctaccacagaaactccctg

SEQ ID NO: 756735 - DNA, 25 bp, Mus musculus
tatgacctaccagagaaactccctg

SEQ ID NO: 756736 - DNA, 25 bp, Mus musculus
tatgacctcagtctcagatggtgga

SEQ ID NO: 756737 - DNA, 25 bp, Mus musculus
tatgacctcagtgtcagatggtgga

SEQ ID NO: 756738 - DNA, 25 bp, Mus musculus
tatgacctgctgaaggctggaaagc

SEQ ID NO: 756739 - DNA, 25 bp, Mus musculus
tatgacctgctgctctacttcgaga

SEQ ID NO: 756740 - DNA, 25 bp, Mus musculus
tatgacctgctggtctacttcgaga

SEQ ID NO: 756741 - DNA, 25 bp, Mus musculus
tatgacctgctgtaggctggaaagc

SEQ ID NO: 756742 - DNA, 25 bp, Mus musculus
tatgacctggacacggtacccatga

SEQ ID NO: 756743 - DNA, 25 bp, Mus musculus
tatgacctggactcggtacccatga

SEQ ID NO: 756744 - DNA, 25 bp, Mus musculus
tatgacgaattcctggaacgcagcg

SEQ ID NO: 756745 - DNA, 25 bp, Mus musculus
tatgacgaattcgtggaacgcagcg

SEQ ID NO: 756746 - DNA, 25 bp, Mus musculus
tatgacgactccattgatgatgtag

SEQ ID NO: 756747 - DNA, 25 bp, Mus musculus
tatgacgactcctttgatgatgtag

SEQ ID NO: 756748 - DNA, 25 bp, Mus musculus
tatgacgacttgaatgacgacgaca

SEQ ID NO: 756749 - DNA, 25 bp, Mus musculus
tatgacgacttgtatgacgacgaca

SEQ ID NO: 756750 - DNA, 25 bp, Mus musculus
tatgacgagagccatgtgatcactg

SEQ ID NO: 756751 - DNA, 25 bp, Mus musculus
tatgacgagagcgatgtgatcactg

SEQ ID NO: 756752 - DNA, 25 bp, Mus musculus
tatgacgcctggacaggatggcttg

SEQ ID NO: 756753 - DNA, 25 bp, Mus musculus
tatgacgcctggtcaggatggcttg

SEQ ID NO: 756754 - DNA, 25 bp, Mus musculus
tatgacgcgcacaccaaggagattg

SEQ ID NO: 756755 - DNA, 25 bp, Mus musculus
tatgacgcgcactccaaggagattg

SEQ ID NO: 756756 - DNA, 25 bp, Mus musculus
tatgacgcttctaacagcgagtggc

SEQ ID NO: 756757 - DNA, 25 bp, Mus musculus
tatgacgcttcttacagcgagtggc

SEQ ID NO: 756758 - DNA, 25 bp, Mus musculus
tatgacggatacactggctccagga

SEQ ID NO: 756759 - DNA, 25 bp, Mus musculus
tatgacggatactctggctccagga

SEQ ID NO: 756760 - DNA, 25 bp, Mus musculus
tatgacggcagtcaggattcagcct

SEQ ID NO: 756761 - DNA, 25 bp, Mus musculus
tatgacggcagtgaggattcagcct

SEQ ID NO: 756762 - DNA, 25 bp, Mus musculus
tatgacggctctatatgtgcttcca

SEQ ID NO: 756763 - DNA, 25 bp, Mus musculus
tatgacggctctttatgtgcttcca

SEQ ID NO: 756764 - DNA, 25 bp, Mus musculus
tatgacgggcaacatcacctggaat

SEQ ID NO: 756765 - DNA, 25 bp, Mus musculus
tatgacgggcaagatcacctggaat

SEQ ID NO: 756766 - DNA, 25 bp, Mus musculus
tatgacgggccacaagtcgacgtgt

SEQ ID NO: 756767 - DNA, 25 bp, Mus musculus
tatgacgggccagaagtcgacgtgt

SEQ ID NO: 756768 - DNA, 25 bp, Mus musculus
tatgacgggcttctagagttagcca

SEQ ID NO: 756769 - DNA, 25 bp, Mus musculus
tatgacgggcttgtagagttagcca

SEQ ID NO: 756770 - DNA, 25 bp, Mus musculus
tatgacgtgaagctgtccacactgc

SEQ ID NO: 756771 - DNA, 25 bp, Mus musculus
tatgacgtgaaggtgtccacactgc

SEQ ID NO: 756772 - DNA, 25 bp, Mus musculus
tatgacgtgaccctgaacttcagag

SEQ ID NO: 756773 - DNA, 25 bp, Mus musculus
tatgacgtgaccgtgaacttcagag

SEQ ID NO: 756774 - DNA, 25 bp, Mus musculus
tatgacgtggtgattgcctcgggac

SEQ ID NO: 756775 - DNA, 25 bp, Mus musculus
tatgacgtggtgtttgcctcgggac

SEQ ID NO: 756776 - DNA, 25 bp, Mus musculus
tatgactacagaaacacaaatggcc

SEQ ID NO: 756777 - DNA, 25 bp, Mus musculus
tatgactacagatacacaaatggcc

SEQ ID NO: 756778 - DNA, 25 bp, Mus musculus
tatgactaggcaagctggaccctgt

SEQ ID NO: 756779 - DNA, 25 bp, Mus musculus
tatgactaggcatgctggaccctgt

SEQ ID NO: 756780 - DNA, 25 bp, Mus musculus
tatgactatctcagcatagatgact

SEQ ID NO: 756781 - DNA, 25 bp, Mus musculus
tatgactatctctgcatagatgact

SEQ ID NO: 756782 - DNA, 25 bp, Mus musculus
tatgactatgaaccacggacggaag

SEQ ID NO: 756783 - DNA, 25 bp, Mus musculus
tatgactatgaagcacggacggaag

SEQ ID NO: 756784 - DNA, 25 bp, Mus musculus
tatgactatgacaccagtggaaagc

SEQ ID NO: 756785 - DNA, 25 bp, Mus musculus
tatgactatgactccagtggaaagc

SEQ ID NO: 756786 - DNA, 25 bp, Mus musculus
tatgactcatttcaccgggaggcca

SEQ ID NO: 756787 - DNA, 25 bp, Mus musculus
tatgactcatttgaccgggaggcca

SEQ ID NO: 756788 - DNA, 25 bp, Mus musculus
tatgactccaacaaggaaccctgct

SEQ ID NO: 756789 - DNA, 25 bp, Mus musculus
tatgactccaactaggaaccctgct

SEQ ID NO: 756790 - DNA, 25 bp, Mus musculus
tatgactcggaacagagcgattggc

SEQ ID NO: 756791 - DNA, 25 bp, Mus musculus
tatgactcggaagagagcgattggc

SEQ ID NO: 756792 - DNA, 25 bp, Mus musculus
tatgactctatccaggaggaagtga

SEQ ID NO: 756793 - DNA, 25 bp, Mus musculus
tatgactctatcgaggaggaagtga

SEQ ID NO: 756794 - DNA, 25 bp, Mus musculus
tatgactctcggctgaaggccatgg

SEQ ID NO: 756795 - DNA, 25 bp, Mus musculus
tatgactctcgggtgaaggccatgg

SEQ ID NO: 756796 - DNA, 25 bp, Mus musculus
tatgactctgagaatatcgctgcta

SEQ ID NO: 756797 - DNA, 25 bp, Mus musculus
tatgactctgagtatatcgctgcta

SEQ ID NO: 756798 - DNA, 25 bp, Mus musculus
tatgactctgatctctgctgcacga

SEQ ID NO: 756799 - DNA, 25 bp, Mus musculus
tatgactctgatgtctgctgcacga

SEQ ID NO: 756800 - DNA, 25 bp, Mus musculus
tatgactgagttcgaaaacaccaag

SEQ ID NO: 756801 - DNA, 25 bp, Mus musculus
tatgactgagttggaaaacaccaag

SEQ ID NO: 756802 - DNA, 25 bp, Mus musculus
tatgactgcaaacatgtcaaaagac

SEQ ID NO: 756803 - DNA, 25 bp, Mus musculus
tatgactgcaaagatgtcaaaagac

SEQ ID NO: 756804 - DNA, 25 bp, Mus musculus
tatgactgcactaacggtggtggag

SEQ ID NO: 756805 - DNA, 25 bp, Mus musculus
tatgactgcacttacggtggtggag

SEQ ID NO: 756806 - DNA, 25 bp, Mus musculus
tatgactgcggacaggatttctacc

SEQ ID NO: 756807 - DNA, 25 bp, Mus musculus
tatgactgcggagaggatttctacc

SEQ ID NO: 756808 - DNA, 25 bp, Mus musculus
tatgactggaaaccagacaggactc

SEQ ID NO: 756809 - DNA, 25 bp, Mus musculus
tatgactggaaagcagacaggactc

SEQ ID NO: 756810 - DNA, 25 bp, Mus musculus
tatgactggaaccagagcatctgca

SEQ ID NO: 756811 - DNA, 25 bp, Mus musculus
tatgactggaacgagagcatctgca

SEQ ID NO: 756812 - DNA, 25 bp, Mus musculus
tatgactgggctcttctccccacaa

SEQ ID NO: 756813 - DNA, 25 bp, Mus musculus
tatgactgggctgttctccccacaa

SEQ ID NO: 756814 - DNA, 25 bp, Mus musculus
tatgactgtgaacaatgaaattgga

SEQ ID NO: 756815 - DNA, 25 bp, Mus musculus
tatgactgtgaagaatgaaattgga

SEQ ID NO: 756816 - DNA, 25 bp, Mus musculus
tatgacttcaccacgtgcatgggcg

SEQ ID NO: 756817 - DNA, 25 bp, Mus musculus
tatgacttcacctcgtgcatgggcg

SEQ ID NO: 756818 - DNA, 25 bp, Mus musculus
tatgacttcaggagtggttctttgt

SEQ ID NO: 756819 - DNA, 25 bp, Mus musculus
tatgacttcaggtgtggttctttgt

SEQ ID NO: 756820 - DNA, 25 bp, Mus musculus
tatgacttctctctccgagttgaag

SEQ ID NO: 756821 - DNA, 25 bp, Mus musculus
tatgacttctctgtccgagttgaag

SEQ ID NO: 756822 - DNA, 25 bp, Mus musculus
tatgactttcgacctgagatctctg

SEQ ID NO: 756823 - DNA, 25 bp, Mus musculus
tatgactttcgagctgagatctctg

SEQ ID NO: 756824 - DNA, 25 bp, Mus musculus
tatgactttgacaacagtgggaaag

SEQ ID NO: 756825 - DNA, 25 bp, Mus musculus
tatgactttgactacagtgggaaag

SEQ ID NO: 756826 - DNA, 25 bp, Mus musculus
tatgagaaaatgagcctgcgagatc

SEQ ID NO: 756827 - DNA, 25 bp, Mus musculus
tatgagaaaatgtgcctgcgagatc

SEQ ID NO: 756828 - DNA, 25 bp, Mus musculus
tatgagaaacagatcaagcatttcg

SEQ ID NO: 756829 - DNA, 25 bp, Mus musculus
tatgagaaacagttcaagcatttcg

SEQ ID NO: 756830 - DNA, 25 bp, Mus musculus
tatgagaaagttcgagaagctaccg

SEQ ID NO: 756831 - DNA, 25 bp, Mus musculus
tatgagaaagttggagaagctaccg

SEQ ID NO: 756832 - DNA, 25 bp, Mus musculus
tatgagaactgcacccgcctcagtt

SEQ ID NO: 756833 - DNA, 25 bp, Mus musculus
tatgagaactgctcccgcctcagtt

SEQ ID NO: 756834 - DNA, 25 bp, Mus musculus
tatgagaagaagctgtgcatctggc

SEQ ID NO: 756835 - DNA, 25 bp, Mus musculus
tatgagaagaaggtgtgcatctggc

SEQ ID NO: 756836 - DNA, 25 bp, Mus musculus
tatgagaagacaagcgcgctccttg

SEQ ID NO: 756837 - DNA, 25 bp, Mus musculus
tatgagaagacatgcgcgctccttg

SEQ ID NO: 756838 - DNA, 25 bp, Mus musculus
tatgagaagacgctaatgatggagc

SEQ ID NO: 756839 - DNA, 25 bp, Mus musculus
tatgagaagacggtaatgatggagc

SEQ ID NO: 756840 - DNA, 25 bp, Mus musculus
tatgagaagatcatgaagcttactg

SEQ ID NO: 756841 - DNA, 25 bp, Mus musculus
tatgagaagatcttgaagcttactg

SEQ ID NO: 756842 - DNA, 25 bp, Mus musculus
tatgagaaggacaacacctatttag

SEQ ID NO: 756843 - DNA, 25 bp, Mus musculus
tatgagaaggactacacctatttag

SEQ ID NO: 756844 - DNA, 25 bp, Mus musculus
tatgagaaggcccagtcgtcccagg

SEQ ID NO: 756845 - DNA, 25 bp, Mus musculus
tatgagaaggccgagtcgtcccagg

SEQ ID NO: 756846 - DNA, 25 bp, Mus musculus
tatgagaagttacacactggtcagc

SEQ ID NO: 756847 - DNA, 25 bp, Mus musculus
tatgagaagttagacactggtcagc

SEQ ID NO: 756848 - DNA, 25 bp, Mus musculus
tatgagaattcaaagggaaacctgt

SEQ ID NO: 756849 - DNA, 25 bp, Mus musculus
tatgagaattcatagggaaacctgt

SEQ ID NO: 756850 - DNA, 25 bp, Mus musculus
tatgagacaaacaaagtcacccgga

SEQ ID NO: 756851 - DNA, 25 bp, Mus musculus
tatgagacaaactaagtcacccgga

SEQ ID NO: 756852 - DNA, 25 bp, Mus musculus
tatgagacaagaagatgttagtgag

SEQ ID NO: 756853 - DNA, 25 bp, Mus musculus
tatgagacaagatgatgttagtgag

SEQ ID NO: 756854 - DNA, 25 bp, Mus musculus
tatgagacagtgaaggcctggctcc

SEQ ID NO: 756855 - DNA, 25 bp, Mus musculus
tatgagacagtgtaggcctggctcc

SEQ ID NO: 756856 - DNA, 25 bp, Mus musculus
tatgagaccctgcaatttgcatcgg

SEQ ID NO: 756857 - DNA, 25 bp, Mus musculus
tatgagaccctggaatttgcatcgg

SEQ ID NO: 756858 - DNA, 25 bp, Mus musculus
tatgagactattctgggcaagacag

SEQ ID NO: 756859 - DNA, 25 bp, Mus musculus
tatgagactattgtgggcaagacag

SEQ ID NO: 756860 - DNA, 25 bp, Mus musculus
tatgagactgagaagaacaatggag

SEQ ID NO: 756861 - DNA, 25 bp, Mus musculus
tatgagactgagtagaacaatggag

SEQ ID NO: 756862 - DNA, 25 bp, Mus musculus
tatgagactgataggtagaggctag

SEQ ID NO: 756863 - DNA, 25 bp, Mus musculus
tatgagactgattggtagaggctag

SEQ ID NO: 756864 - DNA, 25 bp, Mus musculus
tatgagagacgaatcaataagaagt

SEQ ID NO: 756865 - DNA, 25 bp, Mus musculus
tatgagagacgattcaataagaagt

SEQ ID NO: 756866 - DNA, 25 bp, Mus musculus
tatgagagccagacgtcttttgggt

SEQ ID NO: 756867 - DNA, 25 bp, Mus musculus
tatgagagccagtcgtcttttgggt

SEQ ID NO: 756868 - DNA, 25 bp, Mus musculus
tatgagagcccactccatttatctg

SEQ ID NO: 756869 - DNA, 25 bp, Mus musculus
tatgagagcccagtccatttatctg

SEQ ID NO: 756870 - DNA, 25 bp, Mus musculus
tatgagagccctcatccatttggct

SEQ ID NO: 756871 - DNA, 25 bp, Mus musculus
tatgagagccctgatccatttggct

SEQ ID NO: 756872 - DNA, 25 bp, Mus musculus
tatgagagctctaaactgggacgtg

SEQ ID NO: 756873 - DNA, 25 bp, Mus musculus
tatgagagctcttaactgggacgtg

SEQ ID NO: 756874 - DNA, 25 bp, Mus musculus
tatgagaggaccacgccggatggca

SEQ ID NO: 756875 - DNA, 25 bp, Mus musculus
tatgagaggacctcgccggatggca

SEQ ID NO: 756876 - DNA, 25 bp, Mus musculus
tatgagaggttcaccaacggaggac

SEQ ID NO: 756877 - DNA, 25 bp, Mus musculus
tatgagaggttctccaacggaggac

SEQ ID NO: 756878 - DNA, 25 bp, Mus musculus
tatgagagtgatcgtactgaagaca

SEQ ID NO: 756879 - DNA, 25 bp, Mus musculus
tatgagagtgatggtactgaagaca

SEQ ID NO: 756880 - DNA, 25 bp, Mus musculus
tatgagagtttgaagtgaatccagt

SEQ ID NO: 756881 - DNA, 25 bp, Mus musculus
tatgagagtttgtagtgaatccagt

SEQ ID NO: 756882 - DNA, 25 bp, Mus musculus
tatgagatactcattcttggacggt

SEQ ID NO: 756883 - DNA, 25 bp, Mus musculus
tatgagatactctttcttggacggt

SEQ ID NO: 756884 - DNA, 25 bp, Mus musculus
tatgagatccagatttcccagaaag

SEQ ID NO: 756885 - DNA, 25 bp, Mus musculus
tatgagatccagttttcccagaaag

SEQ ID NO: 756886 - DNA, 25 bp, Mus musculus
tatgagatccggcactacggaccgg

SEQ ID NO: 756887 - DNA, 25 bp, Mus musculus
tatgagatccgggactacggaccgg

SEQ ID NO: 756888 - DNA, 25 bp, Mus musculus
tatgagatgagacacaagcttagtg

SEQ ID NO: 756889 - DNA, 25 bp, Mus musculus
tatgagatgagagacaagcttagtg

SEQ ID NO: 756890 - DNA, 25 bp, Mus musculus
tatgagatgcaccttcgagcagcca

SEQ ID NO: 756891 - DNA, 25 bp, Mus musculus
tatgagatgcacgttcgagcagcca

SEQ ID NO: 756892 - DNA, 25 bp, Mus musculus
tatgagatggaacttgacacactgg

SEQ ID NO: 756893 - DNA, 25 bp, Mus musculus
tatgagatggaagttgacacactgg

SEQ ID NO: 756894 - DNA, 25 bp, Mus musculus
tatgagatgtccaacggattgaaca

SEQ ID NO: 756895 - DNA, 25 bp, Mus musculus
tatgagatgtcctacggattgaaca

SEQ ID NO: 756896 - DNA, 25 bp, Mus musculus
tatgagatgtcgactctcggagcct

SEQ ID NO: 756897 - DNA, 25 bp, Mus musculus
tatgagatgtcgtctctcggagcct

SEQ ID NO: 756898 - DNA, 25 bp, Mus musculus
tatgagatgtggcttgtaagtgaca

SEQ ID NO: 756899 - DNA, 25 bp, Mus musculus
tatgagatgtgggttgtaagtgaca

SEQ ID NO: 756900 - DNA, 25 bp, Mus musculus
tatgagatgttacccggatgtgttc

SEQ ID NO: 756901 - DNA, 25 bp, Mus musculus
tatgagatgttagccggatgtgttc

SEQ ID NO: 756902 - DNA, 25 bp, Mus musculus
tatgagattaccatcactctgcctc

SEQ ID NO: 756903 - DNA, 25 bp, Mus musculus
tatgagattaccttcactctgcctc

SEQ ID NO: 756904 - DNA, 25 bp, Mus musculus
tatgagcagaaccacaactccctgg

SEQ ID NO: 756905 - DNA, 25 bp, Mus musculus
tatgagcagaacgacaactccctgg

SEQ ID NO: 756906 - DNA, 25 bp, Mus musculus
tatgagcagcacaaccgggagagct

SEQ ID NO: 756907 - DNA, 25 bp, Mus musculus
tatgagcagcactaccgggagagct

SEQ ID NO: 756908 - DNA, 25 bp, Mus musculus
tatgagcagctaaagaacgagctgg

SEQ ID NO: 756909 - DNA, 25 bp, Mus musculus
tatgagcagctatagaacgagctgg

SEQ ID NO: 756910 - DNA, 25 bp, Mus musculus
tatgagcagtttcagagcaccatcg

SEQ ID NO: 756911 - DNA, 25 bp, Mus musculus
tatgagcagtttgagagcaccatcg

SEQ ID NO: 756912 - DNA, 25 bp, Mus musculus
tatgagcatcacctctgtgtgctcc

SEQ ID NO: 756913 - DNA, 25 bp, Mus musculus
tatgagcatcacgtctgtgtgctcc

SEQ ID NO: 756914 - DNA, 25 bp, Mus musculus
tatgagcatcatcactgagatcgga

SEQ ID NO: 756915 - DNA, 25 bp, Mus musculus
tatgagcatcatgactgagatcgga

SEQ ID NO: 756916 - DNA, 25 bp, Mus musculus
tatgagccactcattggtgcaacag

SEQ ID NO: 756917 - DNA, 25 bp, Mus musculus
tatgagccactctttggtgcaacag

SEQ ID NO: 756918 - DNA, 25 bp, Mus musculus
tatgagccacttcgcttggaggctg

SEQ ID NO: 756919 - DNA, 25 bp, Mus musculus
tatgagccacttggcttggaggctg

SEQ ID NO: 756920 - DNA, 25 bp, Mus musculus
tatgagccagatcctaatatagtca

SEQ ID NO: 756921 - DNA, 25 bp, Mus musculus
tatgagccagatgctaatatagtca

SEQ ID NO: 756922 - DNA, 25 bp, Mus musculus
tatgagccatcaaagaagcccagcc

SEQ ID NO: 756923 - DNA, 25 bp, Mus musculus
tatgagccatcatagaagcccagcc

SEQ ID NO: 756924 - DNA, 25 bp, Mus musculus
tatgagcccaccaaagctgacagtt

SEQ ID NO: 756925 - DNA, 25 bp, Mus musculus
tatgagcccacctaagctgacagtt

SEQ ID NO: 756926 - DNA, 25 bp, Mus musculus
tatgagcccatgagacaagttccgg

SEQ ID NO: 756927 - DNA, 25 bp, Mus musculus
tatgagcccatgtgacaagttccgg

SEQ ID NO: 756928 - DNA, 25 bp, Mus musculus
tatgagcccgctaagtgtgaaacta

SEQ ID NO: 756929 - DNA, 25 bp, Mus musculus
tatgagcccgcttagtgtgaaacta

SEQ ID NO: 756930 - DNA, 25 bp, Mus musculus
tatgagcccgtgcttattgccagcc

SEQ ID NO: 756931 - DNA, 25 bp, Mus musculus
tatgagcccgtggttattgccagcc

SEQ ID NO: 756932 - DNA, 25 bp, Mus musculus
tatgagccgaggagactacaaggcc

SEQ ID NO: 756933 - DNA, 25 bp, Mus musculus
tatgagccgaggtgactacaaggcc

SEQ ID NO: 756934 - DNA, 25 bp, Mus musculus
tatgagccgtccattctacagttgg

SEQ ID NO: 756935 - DNA, 25 bp, Mus musculus
tatgagccgtcctttctacagttgg

SEQ ID NO: 756936 - DNA, 25 bp, Mus musculus
tatgagcctcaacacagagatgatc

SEQ ID NO: 756937 - DNA, 25 bp, Mus musculus
tatgagcctcaagacagagatgatc

SEQ ID NO: 756938 - DNA, 25 bp, Mus musculus
tatgagcctctcaaaatgggttcca

SEQ ID NO: 756939 - DNA, 25 bp, Mus musculus
tatgagcctctctaaatgggttcca

SEQ ID NO: 756940 - DNA, 25 bp, Mus musculus
tatgagcctgaaatgggcaaagtgt

SEQ ID NO: 756941 - DNA, 25 bp, Mus musculus
tatgagcctgaattgggcaaagtgt

SEQ ID NO: 756942 - DNA, 25 bp, Mus musculus
tatgagcgacggcttctcatcatgg

SEQ ID NO: 756943 - DNA, 25 bp, Mus musculus
tatgagcgacgggttctcatcatgg

SEQ ID NO: 756944 - DNA, 25 bp, Mus musculus
tatgagcgcagaagaaacggagcat

SEQ ID NO: 756945 - DNA, 25 bp, Mus musculus
tatgagcgcagatgaaacggagcat

SEQ ID NO: 756946 - DNA, 25 bp, Mus musculus
tatgagcgccatagagctagtcggg

SEQ ID NO: 756947 - DNA, 25 bp, Mus musculus
tatgagcgccattgagctagtcggg

SEQ ID NO: 756948 - DNA, 25 bp, Mus musculus
tatgagcgcttcactaagtacatgc

SEQ ID NO: 756949 - DNA, 25 bp, Mus musculus
tatgagcgcttctctaagtacatgc

SEQ ID NO: 756950 - DNA, 25 bp, Mus musculus
tatgagcggcccatcgcctttacct

SEQ ID NO: 756951 - DNA, 25 bp, Mus musculus
tatgagcggcccttcgcctttacct

SEQ ID NO: 756952 - DNA, 25 bp, Mus musculus
tatgagcgggcactcaaactgcttc

SEQ ID NO: 756953 - DNA, 25 bp, Mus musculus
tatgagcgggcagtcaaactgcttc

SEQ ID NO: 756954 - DNA, 25 bp, Mus musculus
tatgagctacagatgctgcggcacc

SEQ ID NO: 756955 - DNA, 25 bp, Mus musculus
tatgagctacagttgctgcggcacc

SEQ ID NO: 756956 - DNA, 25 bp, Mus musculus
tatgagctcagcctttgccacgtgg

SEQ ID NO: 756957 - DNA, 25 bp, Mus musculus
tatgagctcagcgtttgccacgtgg

SEQ ID NO: 756958 - DNA, 25 bp, Mus musculus
tatgagctcatgcttggatgctggc

SEQ ID NO: 756959 - DNA, 25 bp, Mus musculus
tatgagctcatggttggatgctggc

SEQ ID NO: 756960 - DNA, 25 bp, Mus musculus
tatgagctcattcagaaccgaggcc

SEQ ID NO: 756961 - DNA, 25 bp, Mus musculus
tatgagctcattgagaaccgaggcc

SEQ ID NO: 756962 - DNA, 25 bp, Mus musculus
tatgagctcctcatcactggcggaa

SEQ ID NO: 756963 - DNA, 25 bp, Mus musculus
tatgagctcctcttcactggcggaa

SEQ ID NO: 756964 - DNA, 25 bp, Mus musculus
tatgagctctcacctccctattgaa

SEQ ID NO: 756965 - DNA, 25 bp, Mus musculus
tatgagctctcagctccctattgaa

SEQ ID NO: 756966 - DNA, 25 bp, Mus musculus
tatgagctggcaatacaaactggaa

SEQ ID NO: 756967 - DNA, 25 bp, Mus musculus
tatgagctggcattacaaactggaa

SEQ ID NO: 756968 - DNA, 25 bp, Mus musculus
tatgagctgggcaccctgcaagttg

SEQ ID NO: 756969 - DNA, 25 bp, Mus musculus
tatgagctgggctccctgcaagttg

SEQ ID NO: 756970 - DNA, 25 bp, Mus musculus
tatgaggaaattccccagaaggaat

SEQ ID NO: 756971 - DNA, 25 bp, Mus musculus
tatgaggaaattgcccagaaggaat

SEQ ID NO: 756972 - DNA, 25 bp, Mus musculus
tatgaggaatttactctttcccgca

SEQ ID NO: 756973 - DNA, 25 bp, Mus musculus
tatgaggaattttctctttcccgca

SEQ ID NO: 756974 - DNA, 25 bp, Mus musculus
tatgaggacacacttgtagtccagg

SEQ ID NO: 756975 - DNA, 25 bp, Mus musculus
tatgaggacacagttgtagtccagg

SEQ ID NO: 756976 - DNA, 25 bp, Mus musculus
tatgaggaccagactccaagacagc

SEQ ID NO: 756977 - DNA, 25 bp, Mus musculus
tatgaggaccagtctccaagacagc

SEQ ID NO: 756978 - DNA, 25 bp, Mus musculus
tatgaggactatatcccagagatca

SEQ ID NO: 756979 - DNA, 25 bp, Mus musculus
tatgaggactatttcccagagatca

SEQ ID NO: 756980 - DNA, 25 bp, Mus musculus
tatgaggagacaatcgtcaccaaga

SEQ ID NO: 756981 - DNA, 25 bp, Mus musculus
tatgaggagacattcgtcaccaaga

SEQ ID NO: 756982 - DNA, 25 bp, Mus musculus
tatgaggagcccaaacactggtgtt

SEQ ID NO: 756983 - DNA, 25 bp, Mus musculus
tatgaggagccctaacactggtgtt

SEQ ID NO: 756984 - DNA, 25 bp, Mus musculus
tatgaggagctcatcccggccttct

SEQ ID NO: 756985 - DNA, 25 bp, Mus musculus
tatgaggagctcttcccggccttct

SEQ ID NO: 756986 - DNA, 25 bp, Mus musculus
tatgaggatcccaggaagataacag

SEQ ID NO: 756987 - DNA, 25 bp, Mus musculus
tatgaggatccctggaagataacag

SEQ ID NO: 756988 - DNA, 25 bp, Mus musculus
tatgaggatgagatgggtagccacc

SEQ ID NO: 756989 - DNA, 25 bp, Mus musculus
tatgaggatgagttgggtagccacc

SEQ ID NO: 756990 - DNA, 25 bp, Mus musculus
tatgaggatgtgaccaaagtggaga

SEQ ID NO: 756991 - DNA, 25 bp, Mus musculus
tatgaggatgtgtccaaagtggaga

SEQ ID NO: 756992 - DNA, 25 bp, Mus musculus
tatgaggcaatcaagtctgggagga

SEQ ID NO: 756993 - DNA, 25 bp, Mus musculus
tatgaggcaatctagtctgggagga

SEQ ID NO: 756994 - DNA, 25 bp, Mus musculus
tatgaggcacttcggtacccctgtg

SEQ ID NO: 756995 - DNA, 25 bp, Mus musculus
tatgaggcacttgggtacccctgtg

SEQ ID NO: 756996 - DNA, 25 bp, Mus musculus
tatgaggccaatcacccctgggtac

SEQ ID NO: 756997 - DNA, 25 bp, Mus musculus
tatgaggccaatgacccctgggtac

SEQ ID NO: 756998 - DNA, 25 bp, Mus musculus
tatgaggccatacaactggagttac

SEQ ID NO: 756999 - DNA, 25 bp, Mus musculus
tatgaggccatagaactggagttac

SEQ ID NO: 757000 - DNA, 25 bp, Mus musculus
tatgaggcccacatgagagacatcc

SEQ ID NO: 757001 - DNA, 25 bp, Mus musculus
tatgaggcccacttgagagacatcc

SEQ ID NO: 757002 - DNA, 25 bp, Mus musculus
tatgaggcctaccatctctatccgg

SEQ ID NO: 757003 - DNA, 25 bp, Mus musculus
tatgaggcctacgatctctatccgg

SEQ ID NO: 757004 - DNA, 25 bp, Mus musculus
tatgaggccttacctgagagtgtca

SEQ ID NO: 757005 - DNA, 25 bp, Mus musculus
tatgaggccttagctgagagtgtca

SEQ ID NO: 757006 - DNA, 25 bp, Mus musculus
tatgaggcgagcaatgacatgtctg

SEQ ID NO: 757007 - DNA, 25 bp, Mus musculus
tatgaggcgagctatgacatgtctg

SEQ ID NO: 757008 - DNA, 25 bp, Mus musculus
tatgagggatggaattcaggccatc

SEQ ID NO: 757009 - DNA, 25 bp, Mus musculus
tatgagggatggtattcaggccatc

SEQ ID NO: 757010 - DNA, 25 bp, Mus musculus
tatgagggcaaactctgtaactgca

SEQ ID NO: 757011 - DNA, 25 bp, Mus musculus
tatgagggcaaagtctgtaactgca

SEQ ID NO: 757012 - DNA, 25 bp, Mus musculus
tatgagggcaggagaaggattcatc

SEQ ID NO: 757013 - DNA, 25 bp, Mus musculus
tatgagggcaggtgaaggattcatc

SEQ ID NO: 757014 - DNA, 25 bp, Mus musculus
tatgagggccagcagttccggtcat

SEQ ID NO: 757015 - DNA, 25 bp, Mus musculus
tatgagggccaggagttccggtcat

SEQ ID NO: 757016 - DNA, 25 bp, Mus musculus
tatgagggtcctcagctagtagctg

SEQ ID NO: 757017 - DNA, 25 bp, Mus musculus
tatgagggtcctgagctagtagctg

SEQ ID NO: 757018 - DNA, 25 bp, Mus musculus
tatgagggtgtccttcagtgcagca

SEQ ID NO: 757019 - DNA, 25 bp, Mus musculus
tatgagggtgtcgttcagtgcagca

SEQ ID NO: 757020 - DNA, 25 bp, Mus musculus
tatgaggtgaaactccggctgctgc

SEQ ID NO: 757021 - DNA, 25 bp, Mus musculus
tatgaggtgaaagtccggctgctgc

SEQ ID NO: 757022 - DNA, 25 bp, Mus musculus
tatgaggtgatcactgttgctctgc

SEQ ID NO: 757023 - DNA, 25 bp, Mus musculus
tatgaggtgatctctgttgctctgc

SEQ ID NO: 757024 - DNA, 25 bp, Mus musculus
tatgaggtgcttatcctgggcacag

SEQ ID NO: 757025 - DNA, 25 bp, Mus musculus
tatgaggtgcttttcctgggcacag

SEQ ID NO: 757026 - DNA, 25 bp, Mus musculus
tatgaggtggacaacgccagcttcc

SEQ ID NO: 757027 - DNA, 25 bp, Mus musculus
tatgaggtggactacgccagcttcc

SEQ ID NO: 757028 - DNA, 25 bp, Mus musculus
tatgaggtgtgcagataaactgagt

SEQ ID NO: 757029 - DNA, 25 bp, Mus musculus
tatgaggtgtgctgataaactgagt

SEQ ID NO: 757030 - DNA, 25 bp, Mus musculus
tatgaggttatgctgactgttcatg

SEQ ID NO: 757031 - DNA, 25 bp, Mus musculus
tatgaggttatggtgactgttcatg

SEQ ID NO: 757032 - DNA, 25 bp, Mus musculus
tatgagtactcacacagtgctttga

SEQ ID NO: 757033 - DNA, 25 bp, Mus musculus
tatgagtactcagacagtgctttga

SEQ ID NO: 757034 - DNA, 25 bp, Mus musculus
tatgagtattttcaggtgggcgacc

SEQ ID NO: 757035 - DNA, 25 bp, Mus musculus
tatgagtattttgaggtgggcgacc

SEQ ID NO: 757036 - DNA, 25 bp, Mus musculus
tatgagtcagaaacagaggaaatgg

SEQ ID NO: 757037 - DNA, 25 bp, Mus musculus
tatgagtcagaatcagaggaaatgg

SEQ ID NO: 757038 - DNA, 25 bp, Mus musculus
tatgagtcatctaggaccccacctg

SEQ ID NO: 757039 - DNA, 25 bp, Mus musculus
tatgagtcatcttggaccccacctg

SEQ ID NO: 757040 - DNA, 25 bp, Mus musculus
tatgagtccctcaaacttcagcagc

SEQ ID NO: 757041 - DNA, 25 bp, Mus musculus
tatgagtccctctaacttcagcagc

SEQ ID NO: 757042 - DNA, 25 bp, Mus musculus
tatgagtcctctcatcgcattgccc

SEQ ID NO: 757043 - DNA, 25 bp, Mus musculus
tatgagtcctctgatcgcattgccc

SEQ ID NO: 757044 - DNA, 25 bp, Mus musculus
tatgagtgacgaaattagccgtgac

SEQ ID NO: 757045 - DNA, 25 bp, Mus musculus
tatgagtgacgatattagccgtgac

SEQ ID NO: 757046 - DNA, 25 bp, Mus musculus
tatgagtgagttccggtatttcagg

SEQ ID NO: 757047 - DNA, 25 bp, Mus musculus
tatgagtgagttgcggtatttcagg

SEQ ID NO: 757048 - DNA, 25 bp, Mus musculus
tatgagtgatgacgacaagatccga

SEQ ID NO: 757049 - DNA, 25 bp, Mus musculus
tatgagtgatgaggacaagatccga

SEQ ID NO: 757050 - DNA, 25 bp, Mus musculus
tatgagtgcactcgaatatataaag

SEQ ID NO: 757051 - DNA, 25 bp, Mus musculus
tatgagtgcactggaatatataaag

SEQ ID NO: 757052 - DNA, 25 bp, Mus musculus
tatgagtgccatatcctgcagccag

SEQ ID NO: 757053 - DNA, 25 bp, Mus musculus
tatgagtgccatttcctgcagccag

SEQ ID NO: 757054 - DNA, 25 bp, Mus musculus
tatgagtgcgccaactttggagagc

SEQ ID NO: 757055 - DNA, 25 bp, Mus musculus
tatgagtgcgcctactttggagagc

SEQ ID NO: 757056 - DNA, 25 bp, Mus musculus
tatgagtgggaaccaggacaaaaca

SEQ ID NO: 757057 - DNA, 25 bp, Mus musculus
tatgagtgggaagcaggacaaaaca

SEQ ID NO: 757058 - DNA, 25 bp, Mus musculus
tatgagttctacaagattatcccac

SEQ ID NO: 757059 - DNA, 25 bp, Mus musculus
tatgagttctactagattatcccac

SEQ ID NO: 757060 - DNA, 25 bp, Mus musculus
tatgagtttcgcctcgtggccttcg

SEQ ID NO: 757061 - DNA, 25 bp, Mus musculus
tatgagtttcgcgtcgtggccttcg

SEQ ID NO: 757062 - DNA, 25 bp, Mus musculus
tatgataaaattcttctctttcgcc

SEQ ID NO: 757063 - DNA, 25 bp, Mus musculus
tatgataaaattgttctctttcgcc

SEQ ID NO: 757064 - DNA, 25 bp, Mus musculus
tatgataaagctccgtccaagagca

SEQ ID NO: 757065 - DNA, 25 bp, Mus musculus
tatgataaagctgcgtccaagagca

SEQ ID NO: 757066 - DNA, 25 bp, Mus musculus
tatgataagataccagaaatttggg

SEQ ID NO: 757067 - DNA, 25 bp, Mus musculus
tatgataagatagcagaaatttggg

SEQ ID NO: 757068 - DNA, 25 bp, Mus musculus
tatgataagatcaacctaacgtgga

SEQ ID NO: 757069 - DNA, 25 bp, Mus musculus
tatgataagatctacctaacgtgga

SEQ ID NO: 757070 - DNA, 25 bp, Mus musculus
tatgatacagggattgcacccataa

SEQ ID NO: 757071 - DNA, 25 bp, Mus musculus
tatgatacagggtttgcacccataa

SEQ ID NO: 757072 - DNA, 25 bp, Mus musculus
tatgatacatccagcaagcctaggc

SEQ ID NO: 757073 - DNA, 25 bp, Mus musculus
tatgatacatcctgcaagcctaggc

SEQ ID NO: 757074 - DNA, 25 bp, Mus musculus
tatgataccacacttcctctgctgc

SEQ ID NO: 757075 - DNA, 25 bp, Mus musculus
tatgataccacagttcctctgctgc

SEQ ID NO: 757076 - DNA, 25 bp, Mus musculus
tatgatacctctccaatccagctgt

SEQ ID NO: 757077 - DNA, 25 bp, Mus musculus
tatgatacctctgcaatccagctgt

SEQ ID NO: 757078 - DNA, 25 bp, Mus musculus
tatgatagaggccacagattttccc

SEQ ID NO: 757079 - DNA, 25 bp, Mus musculus
tatgatagaggcgacagattttccc

SEQ ID NO: 757080 - DNA, 25 bp, Mus musculus
tatgatagccccactggtgaaaatc

SEQ ID NO: 757081 - DNA, 25 bp, Mus musculus
tatgatagcccctctggtgaaaatc

SEQ ID NO: 757082 - DNA, 25 bp, Mus musculus
tatgatagctgtcccagtaggagat

SEQ ID NO: 757083 - DNA, 25 bp, Mus musculus
tatgatagctgtgccagtaggagat

SEQ ID NO: 757084 - DNA, 25 bp, Mus musculus
tatgatataatacctgatactctac

SEQ ID NO: 757085 - DNA, 25 bp, Mus musculus
tatgatataatagctgatactctac

SEQ ID NO: 757086 - DNA, 25 bp, Mus musculus
tatgatatacggagtcacaagaaag

SEQ ID NO: 757087 - DNA, 25 bp, Mus musculus
tatgatatacggtgtcacaagaaag

SEQ ID NO: 757088 - DNA, 25 bp, Mus musculus
tatgatatcaaacacagcgacctgg

SEQ ID NO: 757089 - DNA, 25 bp, Mus musculus
tatgatatcaaagacagcgacctgg

SEQ ID NO: 757090 - DNA, 25 bp, Mus musculus
tatgatatctgacgaggcttgatgg

SEQ ID NO: 757091 - DNA, 25 bp, Mus musculus
tatgatatctgaggaggcttgatgg

SEQ ID NO: 757092 - DNA, 25 bp, Mus musculus
tatgatatgcgcatcgcggagcttg

SEQ ID NO: 757093 - DNA, 25 bp, Mus musculus
tatgatatgcgcttcgcggagcttg

SEQ ID NO: 757094 - DNA, 25 bp, Mus musculus
tatgatattgttcacatgcacgcag

SEQ ID NO: 757095 - DNA, 25 bp, Mus musculus
tatgatattgttgacatgcacgcag

SEQ ID NO: 757096 - DNA, 25 bp, Mus musculus
tatgatcaactcacatcttgggaga

SEQ ID NO: 757097 - DNA, 25 bp, Mus musculus
tatgatcaactctcatcttgggaga

SEQ ID NO: 757098 - DNA, 25 bp, Mus musculus
tatgatcaccgtagttccagagcac

SEQ ID NO: 757099 - DNA, 25 bp, Mus musculus
tatgatcaccgttgttccagagcac

SEQ ID NO: 757100 - DNA, 25 bp, Mus musculus
tatgatcacctcaaatatgtttggc

SEQ ID NO: 757101 - DNA, 25 bp, Mus musculus
tatgatcacctctaatatgtttggc

SEQ ID NO: 757102 - DNA, 25 bp, Mus musculus
tatgatcagagactctttaatggta

SEQ ID NO: 757103 - DNA, 25 bp, Mus musculus
tatgatcagagagtctttaatggta

SEQ ID NO: 757104 - DNA, 25 bp, Mus musculus
tatgatccatctctgtgagaagact

SEQ ID NO: 757105 - DNA, 25 bp, Mus musculus
tatgatccatctgtgtgagaagact

SEQ ID NO: 757106 - DNA, 25 bp, Mus musculus
tatgatcccaggatcagaccaaact

SEQ ID NO: 757107 - DNA, 25 bp, Mus musculus
tatgatcccaggttcagaccaaact

SEQ ID NO: 757108 - DNA, 25 bp, Mus musculus
tatgatcctggactaaaagccggta

SEQ ID NO: 757109 - DNA, 25 bp, Mus musculus
tatgatcctggagtaaaagccggta

SEQ ID NO: 757110 - DNA, 25 bp, Mus musculus
tatgatctagggaatagcggcacct

SEQ ID NO: 757111 - DNA, 25 bp, Mus musculus
tatgatctagggtatagcggcacct

SEQ ID NO: 757112 - DNA, 25 bp, Mus musculus
tatgatctcaacaccaataacccca

SEQ ID NO: 757113 - DNA, 25 bp, Mus musculus
tatgatctcaactccaataacccca

SEQ ID NO: 757114 - DNA, 25 bp, Mus musculus
tatgatctgccacttttggtgccca

SEQ ID NO: 757115 - DNA, 25 bp, Mus musculus
tatgatctgccagttttggtgccca

SEQ ID NO: 757116 - DNA, 25 bp, Mus musculus
tatgatctgcccaaaaaagaagacg

SEQ ID NO: 757117 - DNA, 25 bp, Mus musculus
tatgatctgccctaaaaagaagacg

SEQ ID NO: 757118 - DNA, 25 bp, Mus musculus
tatgatctgtaaagtccgagggcgg

SEQ ID NO: 757119 - DNA, 25 bp, Mus musculus
tatgatctgtaatgtccgagggcgg

SEQ ID NO: 757120 - DNA, 25 bp, Mus musculus
tatgatgaatatatgatggacaccg

SEQ ID NO: 757121 - DNA, 25 bp, Mus musculus
tatgatgaatatttgatggacaccg

SEQ ID NO: 757122 - DNA, 25 bp, Mus musculus
tatgatgaccatacgtccgatcggc

SEQ ID NO: 757123 - DNA, 25 bp, Mus musculus
tatgatgaccattcgtccgatcggc

SEQ ID NO: 757124 - DNA, 25 bp, Mus musculus
tatgatgacctcaactgcaagtact

SEQ ID NO: 757125 - DNA, 25 bp, Mus musculus
tatgatgacctctactgcaagtact

SEQ ID NO: 757126 - DNA, 25 bp, Mus musculus
tatgatgactcaatgtggatttgtg

SEQ ID NO: 757127 - DNA, 25 bp, Mus musculus
tatgatgactcattgtggatttgtg

SEQ ID NO: 757128 - DNA, 25 bp, Mus musculus
tatgatgagtttcgtttccgtgtgg

SEQ ID NO: 757129 - DNA, 25 bp, Mus musculus
tatgatgagtttggtttccgtgtgg

SEQ ID NO: 757130 - DNA, 25 bp, Mus musculus
tatgatgatcgaattcaatctgctg

SEQ ID NO: 757131 - DNA, 25 bp, Mus musculus
tatgatgatcgatttcaatctgctg

SEQ ID NO: 757132 - DNA, 25 bp, Mus musculus
tatgatgatggactgggtttccctt

SEQ ID NO: 757133 - DNA, 25 bp, Mus musculus
tatgatgatggagtgggtttccctt

SEQ ID NO: 757134 - DNA, 25 bp, Mus musculus
tatgatgccaagaagaaagcagctc

SEQ ID NO: 757135 - DNA, 25 bp, Mus musculus
tatgatgccaagtagaaagcagctc

SEQ ID NO: 757136 - DNA, 25 bp, Mus musculus
tatgatgccattaaggaagtgaacc

SEQ ID NO: 757137 - DNA, 25 bp, Mus musculus
tatgatgccatttaggaagtgaacc

SEQ ID NO: 757138 - DNA, 25 bp, Mus musculus
tatgatgctgacaacaagactgacc

SEQ ID NO: 757139 - DNA, 25 bp, Mus musculus
tatgatgctgactacaagactgacc

SEQ ID NO: 757140 - DNA, 25 bp, Mus musculus
tatgatgctggaagggacggcttta

SEQ ID NO: 757141 - DNA, 25 bp, Mus musculus
tatgatgctggatgggacggcttta

SEQ ID NO: 757142 - DNA, 25 bp, Mus musculus
tatgatgcttttcgaggccaaggcg

SEQ ID NO: 757143 - DNA, 25 bp, Mus musculus
tatgatgcttttggaggccaaggcg

SEQ ID NO: 757144 - DNA, 25 bp, Mus musculus
tatgatggaaataggttcgtgggaa

SEQ ID NO: 757145 - DNA, 25 bp, Mus musculus
tatgatggaaattggttcgtgggaa

SEQ ID NO: 757146 - DNA, 25 bp, Mus musculus
tatgatggatcacaagagcgctgca

SEQ ID NO: 757147 - DNA, 25 bp, Mus musculus
tatgatggatcagaagagcgctgca

SEQ ID NO: 757148 - DNA, 25 bp, Mus musculus
tatgatggcaaccacgacactttcc

SEQ ID NO: 757149 - DNA, 25 bp, Mus musculus
tatgatggcaacgacgacactttcc

SEQ ID NO: 757150 - DNA, 25 bp, Mus musculus
tatgatgtaccacgaaggcaaattc

SEQ ID NO: 757151 - DNA, 25 bp, Mus musculus
tatgatgtaccaggaaggcaaattc

SEQ ID NO: 757152 - DNA, 25 bp, Mus musculus
tatgatgtactgcaagtcagttggc

SEQ ID NO: 757153 - DNA, 25 bp, Mus musculus
tatgatgtactggaagtcagttggc

SEQ ID NO: 757154 - DNA, 25 bp, Mus musculus
tatgatgtcaccatacagaggaaag

SEQ ID NO: 757155 - DNA, 25 bp, Mus musculus
tatgatgtcaccttacagaggaaag

SEQ ID NO: 757156 - DNA, 25 bp, Mus musculus
tatgatgtcatgagctccaaacacc

SEQ ID NO: 757157 - DNA, 25 bp, Mus musculus
tatgatgtcatgtgctccaaacacc

SEQ ID NO: 757158 - DNA, 25 bp, Mus musculus
tatgatgtccagcacttgcagactg

SEQ ID NO: 757159 - DNA, 25 bp, Mus musculus
tatgatgtccaggacttgcagactg

SEQ ID NO: 757160 - DNA, 25 bp, Mus musculus
tatgatgtcctaacaacaaaacctg

SEQ ID NO: 757161 - DNA, 25 bp, Mus musculus
tatgatgtcctatcaacaaaacctg

SEQ ID NO: 757162 - DNA, 25 bp, Mus musculus
tatgatgtctgcagtattctcttgg

SEQ ID NO: 757163 - DNA, 25 bp, Mus musculus
tatgatgtctgctgtattctcttgg

SEQ ID NO: 757164 - DNA, 25 bp, Mus musculus
tatgatgtgctgaagccctatgtgg

SEQ ID NO: 757165 - DNA, 25 bp, Mus musculus
tatgatgtgctgtagccctatgtgg

SEQ ID NO: 757166 - DNA, 25 bp, Mus musculus
tatgatgtggacatccagacctggg

SEQ ID NO: 757167 - DNA, 25 bp, Mus musculus
tatgatgtggaccagtccatcgcgg

SEQ ID NO: 757168 - DNA, 25 bp, Mus musculus
tatgatgtggacgagtccatcgcgg

SEQ ID NO: 757169 - DNA, 25 bp, Mus musculus
tatgatgtggacttccagacctggg

SEQ ID NO: 757170 - DNA, 25 bp, Mus musculus
tatgatgtgtatccaagacggaacc

SEQ ID NO: 757171 - DNA, 25 bp, Mus musculus
tatgatgtgtatgcaagacggaacc

SEQ ID NO: 757172 - DNA, 25 bp, Mus musculus
tatgatgttgctctggaagcaatcc

SEQ ID NO: 757173 - DNA, 25 bp, Mus musculus
tatgatgttgctgtggaagcaatcc

SEQ ID NO: 757174 - DNA, 25 bp, Mus musculus
tatgattacaacagctttgtgttca

SEQ ID NO: 757175 - DNA, 25 bp, Mus musculus
tatgattacaactgctttgtgttca

SEQ ID NO: 757176 - DNA, 25 bp, Mus musculus
tatgattagccaaggcccactgggc

SEQ ID NO: 757177 - DNA, 25 bp, Mus musculus
tatgattagccatggcccactgggc

SEQ ID NO: 757178 - DNA, 25 bp, Mus musculus
tatgattagggccttcaccattacc

SEQ ID NO: 757179 - DNA, 25 bp, Mus musculus
tatgattagggcgttcaccattacc

SEQ ID NO: 757180 - DNA, 25 bp, Mus musculus
tatgattccgtcaaatgactgtgaa

SEQ ID NO: 757181 - DNA, 25 bp, Mus musculus
tatgattccgtctaatgactgtgaa

SEQ ID NO: 757182 - DNA, 25 bp, Mus musculus
tatgattcctgccaaatgccttcag

SEQ ID NO: 757183 - DNA, 25 bp, Mus musculus
tatgattcctgcgaaatgccttcag

SEQ ID NO: 757184 - DNA, 25 bp, Mus musculus
tatgattcctggcaaagcataaaga

SEQ ID NO: 757185 - DNA, 25 bp, Mus musculus
tatgattcctgggaaagcataaaga

SEQ ID NO: 757186 - DNA, 25 bp, Mus musculus
tatgattccttgagagaaggtgtcc

SEQ ID NO: 757187 - DNA, 25 bp, Mus musculus
tatgattccttgtgagaaggtgtcc

SEQ ID NO: 757188 - DNA, 25 bp, Mus musculus
tatgattgaacaagcacagaaagag

SEQ ID NO: 757189 - DNA, 25 bp, Mus musculus
tatgattgaacatgcacagaaagag

SEQ ID NO: 757190 - DNA, 25 bp, Mus musculus
tatgattgctccctactctgcaagc

SEQ ID NO: 757191 - DNA, 25 bp, Mus musculus
tatgattgctccgtactctgcaagc

SEQ ID NO: 757192 - DNA, 25 bp, Mus musculus
tatgattgggctctctcagcgcttg

SEQ ID NO: 757193 - DNA, 25 bp, Mus musculus
tatgattgggctgtctcagcgcttg

SEQ ID NO: 757194 - DNA, 25 bp, Mus musculus
tatgattggtgtaaaggagctgaga

SEQ ID NO: 757195 - DNA, 25 bp, Mus musculus
tatgattggtgttaaggagctgaga

SEQ ID NO: 757196 - DNA, 25 bp, Mus musculus
tatgattgtaggaaaagaccgggaa

SEQ ID NO: 757197 - DNA, 25 bp, Mus musculus
tatgattgtaggtaaagaccgggaa

SEQ ID NO: 757198 - DNA, 25 bp, Mus musculus
tatgattgtattagacacagtgtcc

SEQ ID NO: 757199 - DNA, 25 bp, Mus musculus
tatgattgtatttgacacagtgtcc

SEQ ID NO: 757200 - DNA, 25 bp, Mus musculus
tatgatttaaaacgcctgaaccaaa

SEQ ID NO: 757201 - DNA, 25 bp, Mus musculus
tatgatttaaaaggcctgaaccaaa

SEQ ID NO: 757202 - DNA, 25 bp, Mus musculus
tatgatttaccccactgggatcggg

SEQ ID NO: 757203 - DNA, 25 bp, Mus musculus
tatgatttacccgactgggatcggg

SEQ ID NO: 757204 - DNA, 25 bp, Mus musculus
tatgatttgagactgtctatagcaa

SEQ ID NO: 757205 - DNA, 25 bp, Mus musculus
tatgatttgagagtgtctatagcaa

SEQ ID NO: 757206 - DNA, 25 bp, Mus musculus
tatgatttgattcggcaaacagttt

SEQ ID NO: 757207 - DNA, 25 bp, Mus musculus
tatgatttgattgggcaaacagttt

SEQ ID NO: 757208 - DNA, 25 bp, Mus musculus
tatgatttgccacatctgaggaaca

SEQ ID NO: 757209 - DNA, 25 bp, Mus musculus
tatgatttgccagatctgaggaaca

SEQ ID NO: 757210 - DNA, 25 bp, Mus musculus
tatgatttggttcatgggtccagcc

SEQ ID NO: 757211 - DNA, 25 bp, Mus musculus
tatgatttggttgatgggtccagcc

SEQ ID NO: 757212 - DNA, 25 bp, Mus musculus
tatgcaaaaaccacacttggacgcc

SEQ ID NO: 757213 - DNA, 25 bp, Mus musculus
tatgcaaaaacctcacttggacgcc

SEQ ID NO: 757214 - DNA, 25 bp, Mus musculus
tatgcaaaacggactcagaggatgg

SEQ ID NO: 757215 - DNA, 25 bp, Mus musculus
tatgcaaaacggtctcagaggatgg

SEQ ID NO: 757216 - DNA, 25 bp, Mus musculus
tatgcaaacctaagacccggagatc

SEQ ID NO: 757217 - DNA, 25 bp, Mus musculus
tatgcaaacctatgacccggagatc

SEQ ID NO: 757218 - DNA, 25 bp, Mus musculus
tatgcaaagcacacatcccgtgttc

SEQ ID NO: 757219 - DNA, 25 bp, Mus musculus
tatgcaaagcactcatcccgtgttc

SEQ ID NO: 757220 - DNA, 25 bp, Mus musculus
tatgcaaagcctacacgttagagga

SEQ ID NO: 757221 - DNA, 25 bp, Mus musculus
tatgcaaagccttcacgttagagga

SEQ ID NO: 757222 - DNA, 25 bp, Mus musculus
tatgcaaagctgaaggcttcttatg

SEQ ID NO: 757223 - DNA, 25 bp, Mus musculus
tatgcaaagctgatgggcctgctgg

SEQ ID NO: 757224 - DNA, 25 bp, Mus musculus
tatgcaaagctgtaggcttcttatg

SEQ ID NO: 757225 - DNA, 25 bp, Mus musculus
tatgcaaagctgttgggcctgctgg

SEQ ID NO: 757226 - DNA, 25 bp, Mus musculus
tatgcaaccactacttcacccgagg

SEQ ID NO: 757227 - DNA, 25 bp, Mus musculus
tatgcaaccacttcttcacccgagg

SEQ ID NO: 757228 - DNA, 25 bp, Mus musculus
tatgcaaccctgaagcaggcgctct

SEQ ID NO: 757229 - DNA, 25 bp, Mus musculus
tatgcaaccctgtagcaggcgctct

SEQ ID NO: 757230 - DNA, 25 bp, Mus musculus
tatgcaactagaaaccttgagcacg

SEQ ID NO: 757231 - DNA, 25 bp, Mus musculus
tatgcaactagataccttgagcacg

SEQ ID NO: 757232 - DNA, 25 bp, Mus musculus
tatgcaagacggaacctacagaggg

SEQ ID NO: 757233 - DNA, 25 bp, Mus musculus
tatgcaagacggtacctacagaggg

SEQ ID NO: 757234 - DNA, 25 bp, Mus musculus
tatgcaagagatcacccagcacttt

SEQ ID NO: 757235 - DNA, 25 bp, Mus musculus
tatgcaagagatgacccagcacttt

SEQ ID NO: 757236 - DNA, 25 bp, Mus musculus
tatgcaagctgccagatgccctact

SEQ ID NO: 757237 - DNA, 25 bp, Mus musculus
tatgcaagctgcgagatgccctact

SEQ ID NO: 757238 - DNA, 25 bp, Mus musculus
tatgcaaggcagaactacatgcaat

SEQ ID NO: 757239 - DNA, 25 bp, Mus musculus
tatgcaaggcagtactacatgcaat

SEQ ID NO: 757240 - DNA, 25 bp, Mus musculus
tatgcaaggcatacctggagggcgt

SEQ ID NO: 757241 - DNA, 25 bp, Mus musculus
tatgcaaggcattcctggagggcgt

SEQ ID NO: 757242 - DNA, 25 bp, Mus musculus
tatgcaagtaagagaggacggtcac

SEQ ID NO: 757243 - DNA, 25 bp, Mus musculus
tatgcaagtaagtgaggacggtcac

SEQ ID NO: 757244 - DNA, 25 bp, Mus musculus
tatgcaagtcacctgtaaaccggct

SEQ ID NO: 757245 - DNA, 25 bp, Mus musculus
tatgcaagtcacgtgtaaaccggct

SEQ ID NO: 757246 - DNA, 25 bp, Mus musculus
tatgcaatcagcactctgaccacct

SEQ ID NO: 757247 - DNA, 25 bp, Mus musculus
tatgcaatcagctctctgaccacct

SEQ ID NO: 757248 - DNA, 25 bp, Mus musculus
tatgcaatcctcactgcgcattgga

SEQ ID NO: 757249 - DNA, 25 bp, Mus musculus
tatgcaatcctctctgcgcattgga

SEQ ID NO: 757250 - DNA, 25 bp, Mus musculus
tatgcaatgactagggctcagaggg

SEQ ID NO: 757251 - DNA, 25 bp, Mus musculus
tatgcaatgacttgggctcagaggg

SEQ ID NO: 757252 - DNA, 25 bp, Mus musculus
tatgcaattggcagtagatgtgcag

SEQ ID NO: 757253 - DNA, 25 bp, Mus musculus
tatgcaattggctgtagatgtgcag

SEQ ID NO: 757254 - DNA, 25 bp, Mus musculus
tatgcacaacctcctctgggtagcc

SEQ ID NO: 757255 - DNA, 25 bp, Mus musculus
tatgcacaacctgctctgggtagcc

SEQ ID NO: 757256 - DNA, 25 bp, Mus musculus
tatgcacaatggacacagcaagggt

SEQ ID NO: 757257 - DNA, 25 bp, Mus musculus
tatgcacaatggtcacagcaagggt

SEQ ID NO: 757258 - DNA, 25 bp, Mus musculus
tatgcacacatcctctcagttcctg

SEQ ID NO: 757259 - DNA, 25 bp, Mus musculus
tatgcacacatcgtctcagttcctg

SEQ ID NO: 757260 - DNA, 25 bp, Mus musculus
tatgcacagcccctcgtgggaggaa

SEQ ID NO: 757261 - DNA, 25 bp, Mus musculus
tatgcacagcccgtcgtgggaggaa

SEQ ID NO: 757262 - DNA, 25 bp, Mus musculus
tatgcacagcttactgcgcaaggca

SEQ ID NO: 757263 - DNA, 25 bp, Mus musculus
tatgcacagctttctgcgcaaggca

SEQ ID NO: 757264 - DNA, 25 bp, Mus musculus
tatgcacagttgatgacaaacaatg

SEQ ID NO: 757265 - DNA, 25 bp, Mus musculus
tatgcacagttgttgacaaacaatg

SEQ ID NO: 757266 - DNA, 25 bp, Mus musculus
tatgcacatgatcgtgtctaggcca

SEQ ID NO: 757267 - DNA, 25 bp, Mus musculus
tatgcacatgatggtgtctaggcca

SEQ ID NO: 757268 - DNA, 25 bp, Mus musculus
tatgcacattcgctgagtactgcgc

SEQ ID NO: 757269 - DNA, 25 bp, Mus musculus
tatgcacattcggtgagtactgcgc

SEQ ID NO: 757270 - DNA, 25 bp, Mus musculus
tatgcaccaaccatgctgattgtgg

SEQ ID NO: 757271 - DNA, 25 bp, Mus musculus
tatgcaccaaccttgctgattgtgg

SEQ ID NO: 757272 - DNA, 25 bp, Mus musculus
tatgcaccagcaccgatgtagggag

SEQ ID NO: 757273 - DNA, 25 bp, Mus musculus
tatgcaccagcagcgatgtagggag

SEQ ID NO: 757274 - DNA, 25 bp, Mus musculus
tatgcaccaggaaccccagtcaatt

SEQ ID NO: 757275 - DNA, 25 bp, Mus musculus
tatgcaccaggatccccagtcaatt

SEQ ID NO: 757276 - DNA, 25 bp, Mus musculus
tatgcaccagtgagtccaggaatgc

SEQ ID NO: 757277 - DNA, 25 bp, Mus musculus
tatgcaccagtgtgtccaggaatgc

SEQ ID NO: 757278 - DNA, 25 bp, Mus musculus
tatgcacccaggcactggtggtccc

SEQ ID NO: 757279 - DNA, 25 bp, Mus musculus
tatgcacccagggactggtggtccc

SEQ ID NO: 757280 - DNA, 25 bp, Mus musculus
tatgcacggccccttctcctttaga

SEQ ID NO: 757281 - DNA, 25 bp, Mus musculus
tatgcacggcccgttctcctttaga

SEQ ID NO: 757282 - DNA, 25 bp, Mus musculus
tatgcactcacaccagagggtctgg

SEQ ID NO: 757283 - DNA, 25 bp, Mus musculus
tatgcactcacagcagagggtctgg

SEQ ID NO: 757284 - DNA, 25 bp, Mus musculus
tatgcactctatccgggagacagcc

SEQ ID NO: 757285 - DNA, 25 bp, Mus musculus
tatgcactctatgcgggagacagcc

SEQ ID NO: 757286 - DNA, 25 bp, Mus musculus
tatgcactctgcacattcgctctca

SEQ ID NO: 757287 - DNA, 25 bp, Mus musculus
tatgcactctgctcattcgctctca

SEQ ID NO: 757288 - DNA, 25 bp, Mus musculus
tatgcactgaccacagaaagtcgag

SEQ ID NO: 757289 - DNA, 25 bp, Mus musculus
tatgcactgacctcagaaagtcgag

SEQ ID NO: 757290 - DNA, 25 bp, Mus musculus
tatgcagaaccacagcgtggaggct

SEQ ID NO: 757291 - DNA, 25 bp, Mus musculus
tatgcagaaccagagcgtggaggct

SEQ ID NO: 757292 - DNA, 25 bp, Mus musculus
tatgcagaacgcagaaataatcaga

SEQ ID NO: 757293 - DNA, 25 bp, Mus musculus
tatgcagaacgctgaaataatcaga

SEQ ID NO: 757294 - DNA, 25 bp, Mus musculus
tatgcagaatgtagagcacgtcccc

SEQ ID NO: 757295 - DNA, 25 bp, Mus musculus
tatgcagaatgttgagcacgtcccc

SEQ ID NO: 757296 - DNA, 25 bp, Mus musculus
tatgcagaccagatgttcctgctga

SEQ ID NO: 757297 - DNA, 25 bp, Mus musculus
tatgcagaccagttgttcctgctga

SEQ ID NO: 757298 - DNA, 25 bp, Mus musculus
tatgcagaccgacccgcgggtacct

SEQ ID NO: 757299 - DNA, 25 bp, Mus musculus
tatgcagaccgagccgcgggtacct

SEQ ID NO: 757300 - DNA, 25 bp, Mus musculus
tatgcagacgttcaaagactttgga

SEQ ID NO: 757301 - DNA, 25 bp, Mus musculus
tatgcagacgttgaaagactttgga

SEQ ID NO: 757302 - DNA, 25 bp, Mus musculus
tatgcagactttatcgcacatccag

SEQ ID NO: 757303 - DNA, 25 bp, Mus musculus
tatgcagactttttcgcacatccag

SEQ ID NO: 757304 - DNA, 25 bp, Mus musculus
tatgcagagaccataaccgaaggtg

SEQ ID NO: 757305 - DNA, 25 bp, Mus musculus
tatgcagagaccttaaccgaaggtg

SEQ ID NO: 757306 - DNA, 25 bp, Mus musculus
tatgcagaggctatgccctttcccc

SEQ ID NO: 757307 - DNA, 25 bp, Mus musculus
tatgcagaggctttgccctttcccc

SEQ ID NO: 757308 - DNA, 25 bp, Mus musculus
tatgcagagggaatgaaccgagcta

SEQ ID NO: 757309 - DNA, 25 bp, Mus musculus
tatgcagagggattgaaccgagcta

SEQ ID NO: 757310 - DNA, 25 bp, Mus musculus
tatgcagatggacattataccagat

SEQ ID NO: 757311 - DNA, 25 bp, Mus musculus
tatgcagatggagattataccagat

SEQ ID NO: 757312 - DNA, 25 bp, Mus musculus
tatgcagatgttcggaataaaacct

SEQ ID NO: 757313 - DNA, 25 bp, Mus musculus
tatgcagatgttgggaataaaacct

SEQ ID NO: 757314 - DNA, 25 bp, Mus musculus
tatgcagcaataaatggatccacgg

SEQ ID NO: 757315 - DNA, 25 bp, Mus musculus
tatgcagcaatatatggatccacgg

SEQ ID NO: 757316 - DNA, 25 bp, Mus musculus
tatgcagcaatgacaacaagacctt

SEQ ID NO: 757317 - DNA, 25 bp, Mus musculus
tatgcagcaatgtcaacaagacctt

SEQ ID NO: 757318 - DNA, 25 bp, Mus musculus
tatgcagcagcaacattgacggccg

SEQ ID NO: 757319 - DNA, 25 bp, Mus musculus
tatgcagcagcatcattgacggccg

SEQ ID NO: 757320 - DNA, 25 bp, Mus musculus
tatgcagcaggtaggccaaggtctt

SEQ ID NO: 757321 - DNA, 25 bp, Mus musculus
tatgcagcaggttggccaaggtctt

SEQ ID NO: 757322 - DNA, 25 bp, Mus musculus
tatgcagccacactgcttgaatctg

SEQ ID NO: 757323 - DNA, 25 bp, Mus musculus
tatgcagccacagtgcttgaatctg

SEQ ID NO: 757324 - DNA, 25 bp, Mus musculus
tatgcagccagactgggcaaacctc

SEQ ID NO: 757325 - DNA, 25 bp, Mus musculus
tatgcagccagagtgggcaaacctc

SEQ ID NO: 757326 - DNA, 25 bp, Mus musculus
tatgcagccatcacctatgaagagt

SEQ ID NO: 757327 - DNA, 25 bp, Mus musculus
tatgcagccatctcctatgaagagt

SEQ ID NO: 757328 - DNA, 25 bp, Mus musculus
tatgcagcctggcttgtactctggg

SEQ ID NO: 757329 - DNA, 25 bp, Mus musculus
tatgcagcctgggttgtactctggg

SEQ ID NO: 757330 - DNA, 25 bp, Mus musculus
tatgcagccttcctgcgctcatcgg

SEQ ID NO: 757331 - DNA, 25 bp, Mus musculus
tatgcagccttcgtgcgctcatcgg

SEQ ID NO: 757332 - DNA, 25 bp, Mus musculus
tatgcagcgcaacgtgctctatcgc

SEQ ID NO: 757333 - DNA, 25 bp, Mus musculus
tatgcagcgcaaggtgctctatcgc

SEQ ID NO: 757334 - DNA, 25 bp, Mus musculus
tatgcagcgtctcacctgaggaagg

SEQ ID NO: 757335 - DNA, 25 bp, Mus musculus
tatgcagcgtctgacctgaggaagg

SEQ ID NO: 757336 - DNA, 25 bp, Mus musculus
tatgcagcgtgtcacaagatacccg

SEQ ID NO: 757337 - DNA, 25 bp, Mus musculus
tatgcagcgtgtgacaagatacccg

SEQ ID NO: 757338 - DNA, 25 bp, Mus musculus
tatgcagctagaagagggaagcctc

SEQ ID NO: 757339 - DNA, 25 bp, Mus musculus
tatgcagctagatgagggaagcctc

SEQ ID NO: 757340 - DNA, 25 bp, Mus musculus
tatgcagctggtacagacacctgcc

SEQ ID NO: 757341 - DNA, 25 bp, Mus musculus
tatgcagctggttcagacacctgcc

SEQ ID NO: 757342 - DNA, 25 bp, Mus musculus
tatgcagcttttcgcagagacattc

SEQ ID NO: 757343 - DNA, 25 bp, Mus musculus
tatgcagcttttggcagagacattc

SEQ ID NO: 757344 - DNA, 25 bp, Mus musculus
tatgcaggagctcagacacaagcag

SEQ ID NO: 757345 - DNA, 25 bp, Mus musculus
tatgcaggagctgagacacaagcag

SEQ ID NO: 757346 - DNA, 25 bp, Mus musculus
tatgcaggcaggagattaccagagc

SEQ ID NO: 757347 - DNA, 25 bp, Mus musculus
tatgcaggcaggtgattaccagagc

SEQ ID NO: 757348 - DNA, 25 bp, Mus musculus
tatgcaggcttcatcatgctcattg

SEQ ID NO: 757349 - DNA, 25 bp, Mus musculus
tatgcaggcttcttcatgctcattg

SEQ ID NO: 757350 - DNA, 25 bp, Mus musculus
tatgcaggtgctaccctggccaagc

SEQ ID NO: 757351 - DNA, 25 bp, Mus musculus
tatgcaggtgcttccctggccaagc

SEQ ID NO: 757352 - DNA, 25 bp, Mus musculus
tatgcaggtggaattgggctgtaac

SEQ ID NO: 757353 - DNA, 25 bp, Mus musculus
tatgcaggtggatttgggctgtaac

SEQ ID NO: 757354 - DNA, 25 bp, Mus musculus
tatgcagtaaatatgtccttagagc

SEQ ID NO: 757355 - DNA, 25 bp, Mus musculus
tatgcagtaaatttgtccttagagc

SEQ ID NO: 757356 - DNA, 25 bp, Mus musculus
tatgcagtctctacttggccagggc

SEQ ID NO: 757357 - DNA, 25 bp, Mus musculus
tatgcagtctcttcttggccagggc

SEQ ID NO: 757358 - DNA, 25 bp, Mus musculus
tatgcagtctggcctgaagctggct

SEQ ID NO: 757359 - DNA, 25 bp, Mus musculus
tatgcagtctgggctgaagctggct

SEQ ID NO: 757360 - DNA, 25 bp, Mus musculus
tatgcagtgaacagactcttagccc

SEQ ID NO: 757361 - DNA, 25 bp, Mus musculus
tatgcagtgaactgactcttagccc

SEQ ID NO: 757362 - DNA, 25 bp, Mus musculus
tatgcagtttgaagacagcatcggg

SEQ ID NO: 757363 - DNA, 25 bp, Mus musculus
tatgcagtttgatgacagcatcggg

SEQ ID NO: 757364 - DNA, 25 bp, Mus musculus
tatgcatatactcctggatgcccaa

SEQ ID NO: 757365 - DNA, 25 bp, Mus musculus
tatgcatatactgctggatgcccaa

SEQ ID NO: 757366 - DNA, 25 bp, Mus musculus
tatgcatatcctcaagcctggctgt

SEQ ID NO: 757367 - DNA, 25 bp, Mus musculus
tatgcatatcctgaagcctggctgt

SEQ ID NO: 757368 - DNA, 25 bp, Mus musculus
tatgcatatgccaactccgagatct

SEQ ID NO: 757369 - DNA, 25 bp, Mus musculus
tatgcatatgcctactccgagatct

SEQ ID NO: 757370 - DNA, 25 bp, Mus musculus
tatgcatcaatcaatgctcatcgga

SEQ ID NO: 757371 - DNA, 25 bp, Mus musculus
tatgcatcaatctatgctcatcgga

SEQ ID NO: 757372 - DNA, 25 bp, Mus musculus
tatgcatccttccatccttagtaac

SEQ ID NO: 757373 - DNA, 25 bp, Mus musculus
tatgcatccttcgatccttagtaac

SEQ ID NO: 757374 - DNA, 25 bp, Mus musculus
tatgcatgagataatgtacaaactg

SEQ ID NO: 757375 - DNA, 25 bp, Mus musculus
tatgcatgagattatgtacaaactg

SEQ ID NO: 757376 - DNA, 25 bp, Mus musculus
tatgcatggaatctcagtctcttca

SEQ ID NO: 757377 - DNA, 25 bp, Mus musculus
tatgcatggaatgtcagtctcttca

SEQ ID NO: 757378 - DNA, 25 bp, Mus musculus
tatgcatggaccattgcccagtgca

SEQ ID NO: 757379 - DNA, 25 bp, Mus musculus
tatgcatggacctttgcccagtgca

SEQ ID NO: 757380 - DNA, 25 bp, Mus musculus
tatgcatggcgtatgtcgcgaaggc

SEQ ID NO: 757381 - DNA, 25 bp, Mus musculus
tatgcatggcgtttgtcgcgaaggc

SEQ ID NO: 757382 - DNA, 25 bp, Mus musculus
tatgcatgggcaccgaagccatatc

SEQ ID NO: 757383 - DNA, 25 bp, Mus musculus
tatgcatgggcagcgaagccatatc

SEQ ID NO: 757384 - DNA, 25 bp, Mus musculus
tatgcatgggcgctgtgcctcctat

SEQ ID NO: 757385 - DNA, 25 bp, Mus musculus
tatgcatgggcggtgtgcctcctat

SEQ ID NO: 757386 - DNA, 25 bp, Mus musculus
tatgcatggttgatgtgggacacac

SEQ ID NO: 757387 - DNA, 25 bp, Mus musculus
tatgcatggttgttgtgggacacac

SEQ ID NO: 757388 - DNA, 25 bp, Mus musculus
tatgcattagcaccagctcagcagc

SEQ ID NO: 757389 - DNA, 25 bp, Mus musculus
tatgcattagcagcagctcagcagc

SEQ ID NO: 757390 - DNA, 25 bp, Mus musculus
tatgcattctaaccaaacattctgc

SEQ ID NO: 757391 - DNA, 25 bp, Mus musculus
tatgcattctaagcaaacattctgc

SEQ ID NO: 757392 - DNA, 25 bp, Mus musculus
tatgcattgcttcgtgagcgccatg

SEQ ID NO: 757393 - DNA, 25 bp, Mus musculus
tatgcattgcttggtgagcgccatg

SEQ ID NO: 757394 - DNA, 25 bp, Mus musculus
tatgcattggctagacagaagaatt

SEQ ID NO: 757395 - DNA, 25 bp, Mus musculus
tatgcattggcttgacagaagaatt

SEQ ID NO: 757396 - DNA, 25 bp, Mus musculus
tatgcatttaccaccaaatctctgt

SEQ ID NO: 757397 - DNA, 25 bp, Mus musculus
tatgcatttacctccaaatctctgt

SEQ ID NO: 757398 - DNA, 25 bp, Mus musculus
tatgcatttcaaatcttcatccgcc

SEQ ID NO: 757399 - DNA, 25 bp, Mus musculus
tatgcatttcaattcttcatccgcc

SEQ ID NO: 757400 - DNA, 25 bp, Mus musculus
tatgcatttgagaagtattcggacg

SEQ ID NO: 757401 - DNA, 25 bp, Mus musculus
tatgcatttgagtagtattcggacg

SEQ ID NO: 757402 - DNA, 25 bp, Mus musculus
tatgcatttgctccggccacattag

SEQ ID NO: 757403 - DNA, 25 bp, Mus musculus
tatgcatttgctgcggccacattag

SEQ ID NO: 757404 - DNA, 25 bp, Mus musculus
tatgcattttgtcgtggtggcttaa

SEQ ID NO: 757405 - DNA, 25 bp, Mus musculus
tatgcattttgtggtggtggcttaa

SEQ ID NO: 757406 - DNA, 25 bp, Mus musculus
tatgccaaagaaattgaccttctca

SEQ ID NO: 757407 - DNA, 25 bp, Mus musculus
tatgccaaagaatttgaccttctca

SEQ ID NO: 757408 - DNA, 25 bp, Mus musculus
tatgccaaagacacgcgctatagca

SEQ ID NO: 757409 - DNA, 25 bp, Mus musculus
tatgccaaagactcgcgctatagca

SEQ ID NO: 757410 - DNA, 25 bp, Mus musculus
tatgccaacagcatcggggaggccg

SEQ ID NO: 757411 - DNA, 25 bp, Mus musculus
tatgccaacagcttcggggaggccg

SEQ ID NO: 757412 - DNA, 25 bp, Mus musculus
tatgccaagaggaccatgctcggtg

SEQ ID NO: 757413 - DNA, 25 bp, Mus musculus
tatgccaagaggcatcaccatgaag

SEQ ID NO: 757414 - DNA, 25 bp, Mus musculus
tatgccaagagggatcaccatgaag

SEQ ID NO: 757415 - DNA, 25 bp, Mus musculus
tatgccaagaggtccatgctcggtg

SEQ ID NO: 757416 - DNA, 25 bp, Mus musculus
tatgccaaggaacagattgctgctc

SEQ ID NO: 757417 - DNA, 25 bp, Mus musculus
tatgccaaggaagagattgctgctc

SEQ ID NO: 757418 - DNA, 25 bp, Mus musculus
tatgccaaggagaccgtaggcttcg

SEQ ID NO: 757419 - DNA, 25 bp, Mus musculus
tatgccaaggagtccgtaggcttcg

SEQ ID NO: 757420 - DNA, 25 bp, Mus musculus
tatgccaagtacaataaggagaaca

SEQ ID NO: 757421 - DNA, 25 bp, Mus musculus
tatgccaagtactataaggagaaca

SEQ ID NO: 757422 - DNA, 25 bp, Mus musculus
tatgccaagtggatgaacctgactc

SEQ ID NO: 757423 - DNA, 25 bp, Mus musculus
tatgccaagtggttgaacctgactc

SEQ ID NO: 757424 - DNA, 25 bp, Mus musculus
tatgccaccacccttcaagtgaaag

SEQ ID NO: 757425 - DNA, 25 bp, Mus musculus
tatgccaccaccgttcaagtgaaag

SEQ ID NO: 757426 - DNA, 25 bp, Mus musculus
tatgccaccattcataagacacagg

SEQ ID NO: 757427 - DNA, 25 bp, Mus musculus
tatgccaccattgataagacacagg

SEQ ID NO: 757428 - DNA, 25 bp, Mus musculus
tatgccacctgaagatcagatggcc

SEQ ID NO: 757429 - DNA, 25 bp, Mus musculus
tatgccacctgatgatcagatggcc

SEQ ID NO: 757430 - DNA, 25 bp, Mus musculus
tatgccacctttactggtcagaaga

SEQ ID NO: 757431 - DNA, 25 bp, Mus musculus
tatgccaccttttctggtcagaaga

SEQ ID NO: 757432 - DNA, 25 bp, Mus musculus
tatgccagaaatatctgtcagaatt

SEQ ID NO: 757433 - DNA, 25 bp, Mus musculus
tatgccagaaatttctgtcagaatt

SEQ ID NO: 757434 - DNA, 25 bp, Mus musculus
tatgccagacacagggctgcgagtc

SEQ ID NO: 757435 - DNA, 25 bp, Mus musculus
tatgccagacacattcgacactttg

SEQ ID NO: 757436 - DNA, 25 bp, Mus musculus
tatgccagacactgggctgcgagtc

SEQ ID NO: 757437 - DNA, 25 bp, Mus musculus
tatgccagacactttcgacactttg

SEQ ID NO: 757438 - DNA, 25 bp, Mus musculus
tatgccagaccacagaggtgagaca

SEQ ID NO: 757439 - DNA, 25 bp, Mus musculus
tatgccagaccagagaggtgagaca

SEQ ID NO: 757440 - DNA, 25 bp, Mus musculus
tatgccagcagtatgctgaagcacg

SEQ ID NO: 757441 - DNA, 25 bp, Mus musculus
tatgccagcagtttgctgaagcacg

SEQ ID NO: 757442 - DNA, 25 bp, Mus musculus
tatgccagccaacgtatcagtcccg

SEQ ID NO: 757443 - DNA, 25 bp, Mus musculus
tatgccagccaaggtatcagtcccg

SEQ ID NO: 757444 - DNA, 25 bp, Mus musculus
tatgccaggagaatcagtggctccg

SEQ ID NO: 757445 - DNA, 25 bp, Mus musculus
tatgccaggagattcagtggctccg

SEQ ID NO: 757446 - DNA, 25 bp, Mus musculus
tatgccaggataatgtgaacccctg

SEQ ID NO: 757447 - DNA, 25 bp, Mus musculus
tatgccaggatattgtgaacccctg

SEQ ID NO: 757448 - DNA, 25 bp, Mus musculus
tatgccatcagaacaggtacctggg

SEQ ID NO: 757449 - DNA, 25 bp, Mus musculus
tatgccatcagatcaggtacctggg

SEQ ID NO: 757450 - DNA, 25 bp, Mus musculus
tatgccatgcgtctatcccacaggt

SEQ ID NO: 757451 - DNA, 25 bp, Mus musculus
tatgccatgcgtgtatcccacaggt

SEQ ID NO: 757452 - DNA, 25 bp, Mus musculus
tatgccattgctaggctcagacacc

SEQ ID NO: 757453 - DNA, 25 bp, Mus musculus
tatgccattgcttggctcagacacc

SEQ ID NO: 757454 - DNA, 25 bp, Mus musculus
tatgccattggtcgctctgacacgg

SEQ ID NO: 757455 - DNA, 25 bp, Mus musculus
tatgccattggtggctctgacacgg

SEQ ID NO: 757456 - DNA, 25 bp, Mus musculus
tatgcccagaaaaatggctaccggt

SEQ ID NO: 757457 - DNA, 25 bp, Mus musculus
tatgcccagaaatatggctaccggt

SEQ ID NO: 757458 - DNA, 25 bp, Mus musculus
tatgcccagagacacgtggtgatta

SEQ ID NO: 757459 - DNA, 25 bp, Mus musculus
tatgcccagagagacgtggtgatta

SEQ ID NO: 757460 - DNA, 25 bp, Mus musculus
tatgcccagtttaacgacacaggag

SEQ ID NO: 757461 - DNA, 25 bp, Mus musculus
tatgcccagttttacgacacaggag

SEQ ID NO: 757462 - DNA, 25 bp, Mus musculus
tatgcccatcacctgtctagagctg

SEQ ID NO: 757463 - DNA, 25 bp, Mus musculus
tatgcccatcacgtgtctagagctg

SEQ ID NO: 757464 - DNA, 25 bp, Mus musculus
tatgccccaatcaacaggaggccgt

SEQ ID NO: 757465 - DNA, 25 bp, Mus musculus
tatgccccaatctacaggaggccgt

SEQ ID NO: 757466 - DNA, 25 bp, Mus musculus
tatgccccagctatcatgatggtgg

SEQ ID NO: 757467 - DNA, 25 bp, Mus musculus
tatgccccagctttcatgatggtgg

SEQ ID NO: 757468 - DNA, 25 bp, Mus musculus
tatgcccctgtactaactgtagcca

SEQ ID NO: 757469 - DNA, 25 bp, Mus musculus
tatgcccctgtagtaactgtagcca

SEQ ID NO: 757470 - DNA, 25 bp, Mus musculus
tatgcccgacgtcgagggttcagtc

SEQ ID NO: 757471 - DNA, 25 bp, Mus musculus
tatgcccgacgtggagggttcagtc

SEQ ID NO: 757472 - DNA, 25 bp, Mus musculus
tatgcccgggccatgctgggcatga

SEQ ID NO: 757473 - DNA, 25 bp, Mus musculus
tatgcccgggccttgctgggcatga

SEQ ID NO: 757474 - DNA, 25 bp, Mus musculus
tatgcccggtgtaacaacatacatg

SEQ ID NO: 757475 - DNA, 25 bp, Mus musculus
tatgcccggtgttacaacatacatg

SEQ ID NO: 757476 - DNA, 25 bp, Mus musculus
tatgcccgtcacctgaatggtgcca

SEQ ID NO: 757477 - DNA, 25 bp, Mus musculus
tatgcccgtcacgtgaatggtgcca

SEQ ID NO: 757478 - DNA, 25 bp, Mus musculus
tatgcccgtgatcccctggctaaaa

SEQ ID NO: 757479 - DNA, 25 bp, Mus musculus
tatgcccgtgatgccctggctaaaa

SEQ ID NO: 757480 - DNA, 25 bp, Mus musculus
tatgcccgtgtcaaccacaacaagt

SEQ ID NO: 757481 - DNA, 25 bp, Mus musculus
tatgcccgtgtctaccacaacaagt

SEQ ID NO: 757482 - DNA, 25 bp, Mus musculus
tatgcccgtgttccttaaagccaag

SEQ ID NO: 757483 - DNA, 25 bp, Mus musculus
tatgcccgtgttgcttaaagccaag

SEQ ID NO: 757484 - DNA, 25 bp, Mus musculus
tatgccctcaggaaaggtgacccca

SEQ ID NO: 757485 - DNA, 25 bp, Mus musculus
tatgccctcaggtaaggtgacccca

SEQ ID NO: 757486 - DNA, 25 bp, Mus musculus
tatgccctccatcggaacagtgctg

SEQ ID NO: 757487 - DNA, 25 bp, Mus musculus
tatgccctccatgggaacagtgctg

SEQ ID NO: 757488 - DNA, 25 bp, Mus musculus
tatgcccttcccaagatagctatcc

SEQ ID NO: 757489 - DNA, 25 bp, Mus musculus
tatgcccttcccaggaagtgcaata

SEQ ID NO: 757490 - DNA, 25 bp, Mus musculus
tatgcccttccctagatagctatcc

SEQ ID NO: 757491 - DNA, 25 bp, Mus musculus
tatgcccttccctggaagtgcaata

SEQ ID NO: 757492 - DNA, 25 bp, Mus musculus
tatgccgaagctcgctgacacattg

SEQ ID NO: 757493 - DNA, 25 bp, Mus musculus
tatgccgaagctggctgacacattg

SEQ ID NO: 757494 - DNA, 25 bp, Mus musculus
tatgccgacaaacctctcgggcagc

SEQ ID NO: 757495 - DNA, 25 bp, Mus musculus
tatgccgacaaagctctcgggcagc

SEQ ID NO: 757496 - DNA, 25 bp, Mus musculus
tatgccgacgatacctttacatctg

SEQ ID NO: 757497 - DNA, 25 bp, Mus musculus
tatgccgacgatcgtgagaagacac

SEQ ID NO: 757498 - DNA, 25 bp, Mus musculus
tatgccgacgatggtgagaagacac

SEQ ID NO: 757499 - DNA, 25 bp, Mus musculus
tatgccgacgattcctttacatctg

SEQ ID NO: 757500 - DNA, 25 bp, Mus musculus
tatgccgacgttagtggaaaacaat

SEQ ID NO: 757501 - DNA, 25 bp, Mus musculus
tatgccgacgtttgtggaaaacaat

SEQ ID NO: 757502 - DNA, 25 bp, Mus musculus
tatgccgagaccatagccacattgg

SEQ ID NO: 757503 - DNA, 25 bp, Mus musculus
tatgccgagaccttagccacattgg

SEQ ID NO: 757504 - DNA, 25 bp, Mus musculus
tatgccgagtgcagtctgactgtgg

SEQ ID NO: 757505 - DNA, 25 bp, Mus musculus
tatgccgagtgctgtctgactgtgg

SEQ ID NO: 757506 - DNA, 25 bp, Mus musculus
tatgccgagtggctacaggaattca

SEQ ID NO: 757507 - DNA, 25 bp, Mus musculus
tatgccgagtgggtacaggaattca

SEQ ID NO: 757508 - DNA, 25 bp, Mus musculus
tatgccgccaatcgcaggctgtgtc

SEQ ID NO: 757509 - DNA, 25 bp, Mus musculus
tatgccgccaatggcaggctgtgtc

SEQ ID NO: 757510 - DNA, 25 bp, Mus musculus
tatgccgctagtctggccaatgcag

SEQ ID NO: 757511 - DNA, 25 bp, Mus musculus
tatgccgctagtgtggccaatgcag

SEQ ID NO: 757512 - DNA, 25 bp, Mus musculus
tatgccgctataaaggcttgttttg

SEQ ID NO: 757513 - DNA, 25 bp, Mus musculus
tatgccgctatataggcttgttttg

SEQ ID NO: 757514 - DNA, 25 bp, Mus musculus
tatgccgggaacacaacgtgtgcac

SEQ ID NO: 757515 - DNA, 25 bp, Mus musculus
tatgccgggaactcaacgtgtgcac

SEQ ID NO: 757516 - DNA, 25 bp, Mus musculus
tatgccggtcgcacttcgaattgga

SEQ ID NO: 757517 - DNA, 25 bp, Mus musculus
tatgccggtcgctcttcgaattgga

SEQ ID NO: 757518 - DNA, 25 bp, Mus musculus
tatgccgtcagaagaccctttcagg

SEQ ID NO: 757519 - DNA, 25 bp, Mus musculus
tatgccgtcagatgaccctttcagg

SEQ ID NO: 757520 - DNA, 25 bp, Mus musculus
tatgccgtgagtacctagatgacag

SEQ ID NO: 757521 - DNA, 25 bp, Mus musculus
tatgccgtgagttcctagatgacag

SEQ ID NO: 757522 - DNA, 25 bp, Mus musculus
tatgccgtggaacttcttttggaac

SEQ ID NO: 757523 - DNA, 25 bp, Mus musculus
tatgccgtggaagttcttttggaac

SEQ ID NO: 757524 - DNA, 25 bp, Mus musculus
tatgccgtggacatcaaccacaaga

SEQ ID NO: 757525 - DNA, 25 bp, Mus musculus
tatgccgtggacttcaaccacaaga

SEQ ID NO: 757526 - DNA, 25 bp, Mus musculus
tatgccgtggtgctgattgcatctg

SEQ ID NO: 757527 - DNA, 25 bp, Mus musculus
tatgccgtggtggtgattgcatctg

SEQ ID NO: 757528 - DNA, 25 bp, Mus musculus
tatgccgttcctcagtggcgctggc

SEQ ID NO: 757529 - DNA, 25 bp, Mus musculus
tatgccgttcctgagtggcgctggc

SEQ ID NO: 757530 - DNA, 25 bp, Mus musculus
tatgccgttggtatgcggcgcacgc

SEQ ID NO: 757531 - DNA, 25 bp, Mus musculus
tatgccgttggtttgcggcgcacgc

SEQ ID NO: 757532 - DNA, 25 bp, Mus musculus
tatgcctaaacaatctctcctcaga

SEQ ID NO: 757533 - DNA, 25 bp, Mus musculus
tatgcctaaacattctctcctcaga

SEQ ID NO: 757534 - DNA, 25 bp, Mus musculus
tatgcctacagtcacaacagcctgg

SEQ ID NO: 757535 - DNA, 25 bp, Mus musculus
tatgcctacagtgacaacagcctgg

SEQ ID NO: 757536 - DNA, 25 bp, Mus musculus
tatgcctacctcacggacacacagt

SEQ ID NO: 757537 - DNA, 25 bp, Mus musculus
tatgcctacctctcggacacacagt

SEQ ID NO: 757538 - DNA, 25 bp, Mus musculus
tatgcctagaaaaaaccgaagatgg

SEQ ID NO: 757539 - DNA, 25 bp, Mus musculus
tatgcctagaaataaccgaagatgg

SEQ ID NO: 757540 - DNA, 25 bp, Mus musculus
tatgcctcatcaactgtgctgttgg

SEQ ID NO: 757541 - DNA, 25 bp, Mus musculus
tatgcctcatcatctgtgctgttgg

SEQ ID NO: 757542 - DNA, 25 bp, Mus musculus
tatgcctcctataaggtcccagcca

SEQ ID NO: 757543 - DNA, 25 bp, Mus musculus
tatgcctcctattaggtcccagcca

SEQ ID NO: 757544 - DNA, 25 bp, Mus musculus
tatgcctcctcaactgtgccattgg

SEQ ID NO: 757545 - DNA, 25 bp, Mus musculus
tatgcctcctcacctgcataacggt

SEQ ID NO: 757546 - DNA, 25 bp, Mus musculus
tatgcctcctcagctgcataacggt

SEQ ID NO: 757547 - DNA, 25 bp, Mus musculus
tatgcctcctcatctgtgccattgg

SEQ ID NO: 757548 - DNA, 25 bp, Mus musculus
tatgcctcctgaaatgcagcttaag

SEQ ID NO: 757549 - DNA, 25 bp, Mus musculus
tatgcctcctgatatgcagcttaag

SEQ ID NO: 757550 - DNA, 25 bp, Mus musculus
tatgcctctcaaagggacggacagc

SEQ ID NO: 757551 - DNA, 25 bp, Mus musculus
tatgcctctcaatgggacggacagc

SEQ ID NO: 757552 - DNA, 25 bp, Mus musculus
tatgcctctctaatgaaaagcgagc

SEQ ID NO: 757553 - DNA, 25 bp, Mus musculus
tatgcctctctattgaaaagcgagc

SEQ ID NO: 757554 - DNA, 25 bp, Mus musculus
tatgcctctgaaaaacagtcgtcct

SEQ ID NO: 757555 - DNA, 25 bp, Mus musculus
tatgcctctgaataacagtcgtcct

SEQ ID NO: 757556 - DNA, 25 bp, Mus musculus
tatgcctcttctacatggaactgag

SEQ ID NO: 757557 - DNA, 25 bp, Mus musculus
tatgcctcttcttcatggaactgag

SEQ ID NO: 757558 - DNA, 25 bp, Mus musculus
tatgcctggaaacgaacgatgagcg

SEQ ID NO: 757559 - DNA, 25 bp, Mus musculus
tatgcctggaaaggaacgatgagcg

SEQ ID NO: 757560 - DNA, 25 bp, Mus musculus
tatgcctggcccacagctgagattg

SEQ ID NO: 757561 - DNA, 25 bp, Mus musculus
tatgcctggccctcagctgagattg

SEQ ID NO: 757562 - DNA, 25 bp, Mus musculus
tatgcctgggtcaaagcgttttctc

SEQ ID NO: 757563 - DNA, 25 bp, Mus musculus
tatgcctgggtctaagcgttttctc

SEQ ID NO: 757564 - DNA, 25 bp, Mus musculus
tatgcctggtacagaaaacctatcc

SEQ ID NO: 757565 - DNA, 25 bp, Mus musculus
tatgcctggtactgaaaacctatcc

SEQ ID NO: 757566 - DNA, 25 bp, Mus musculus
tatgcctggtagatgctgacaagaa

SEQ ID NO: 757567 - DNA, 25 bp, Mus musculus
tatgcctggtagttgctgacaagaa

SEQ ID NO: 757568 - DNA, 25 bp, Mus musculus
tatgcctggtttaagtacctccaag

SEQ ID NO: 757569 - DNA, 25 bp, Mus musculus
tatgcctggttttagtacctccaag

SEQ ID NO: 757570 - DNA, 25 bp, Mus musculus
tatgcctgtaacaagagcatcacag

SEQ ID NO: 757571 - DNA, 25 bp, Mus musculus
tatgcctgtaactagagcatcacag

SEQ ID NO: 757572 - DNA, 25 bp, Mus musculus
tatgcctgtgctcccttgggacact

SEQ ID NO: 757573 - DNA, 25 bp, Mus musculus
tatgcctgtgctgccttgggacact

SEQ ID NO: 757574 - DNA, 25 bp, Mus musculus
tatgccttagaactctcatatttca

SEQ ID NO: 757575 - DNA, 25 bp, Mus musculus
tatgccttagaagtctcatatttca

SEQ ID NO: 757576 - DNA, 25 bp, Mus musculus
tatgccttcaacatagccagccggg

SEQ ID NO: 757577 - DNA, 25 bp, Mus musculus
tatgccttcaacttagccagccggg

SEQ ID NO: 757578 - DNA, 25 bp, Mus musculus
tatgccttcacacaggctgcttatg

SEQ ID NO: 757579 - DNA, 25 bp, Mus musculus
tatgccttcacagaggctgcttatg

SEQ ID NO: 757580 - DNA, 25 bp, Mus musculus
tatgccttcaggcaggcctatgaac

SEQ ID NO: 757581 - DNA, 25 bp, Mus musculus
tatgccttcagggaggcctatgaac

SEQ ID NO: 757582 - DNA, 25 bp, Mus musculus
tatgccttcgttcgttttgactgta

SEQ ID NO: 757583 - DNA, 25 bp, Mus musculus
tatgccttcgttggttttgactgta

SEQ ID NO: 757584 - DNA, 25 bp, Mus musculus
tatgccttctccaaacagttctctg

SEQ ID NO: 757585 - DNA, 25 bp, Mus musculus
tatgccttctcctaacagttctctg

SEQ ID NO: 757586 - DNA, 25 bp, Mus musculus
tatgccttgcagagctcaagttggg

SEQ ID NO: 757587 - DNA, 25 bp, Mus musculus
tatgccttgcagctaactcacctca

SEQ ID NO: 757588 - DNA, 25 bp, Mus musculus
tatgccttgcaggtaactcacctca

SEQ ID NO: 757589 - DNA, 25 bp, Mus musculus
tatgccttgcagtgctcaagttggg

SEQ ID NO: 757590 - DNA, 25 bp, Mus musculus
tatgcctttaggaaccctatggagg

SEQ ID NO: 757591 - DNA, 25 bp, Mus musculus
tatgcctttaggtaccctatggagg

SEQ ID NO: 757592 - DNA, 25 bp, Mus musculus
tatgcctttcatcaagagatttacc

SEQ ID NO: 757593 - DNA, 25 bp, Mus musculus
tatgcctttcatgaagagatttacc

SEQ ID NO: 757594 - DNA, 25 bp, Mus musculus
tatgcctttgatctgcatctgaacg

SEQ ID NO: 757595 - DNA, 25 bp, Mus musculus
tatgcctttgatgtgcatctgaacg

SEQ ID NO: 757596 - DNA, 25 bp, Mus musculus
tatgcctttggaattctatctgagc

SEQ ID NO: 757597 - DNA, 25 bp, Mus musculus
tatgcctttggatttctatctgagc

SEQ ID NO: 757598 - DNA, 25 bp, Mus musculus
tatgccttttatcatgcaccaattg

SEQ ID NO: 757599 - DNA, 25 bp, Mus musculus
tatgccttttatgatgcaccaattg

SEQ ID NO: 757600 - DNA, 25 bp, Mus musculus
tatgccttttcaatgcaaggcccca

SEQ ID NO: 757601 - DNA, 25 bp, Mus musculus
tatgccttttcattgcaaggcccca

SEQ ID NO: 757602 - DNA, 25 bp, Mus musculus
tatgcgaaaaatatccagccatttg

SEQ ID NO: 757603 - DNA, 25 bp, Mus musculus
tatgcgaaaaatttccagccatttg

SEQ ID NO: 757604 - DNA, 25 bp, Mus musculus
tatgcgaaggcactcaggaacttcc

SEQ ID NO: 757605 - DNA, 25 bp, Mus musculus
tatgcgaaggcagtcaggaacttcc

SEQ ID NO: 757606 - DNA, 25 bp, Mus musculus
tatgcgaatccacccaactatggga

SEQ ID NO: 757607 - DNA, 25 bp, Mus musculus
tatgcgaatccagccaactatggga

SEQ ID NO: 757608 - DNA, 25 bp, Mus musculus
tatgcgaggcagcacgagcagctac

SEQ ID NO: 757609 - DNA, 25 bp, Mus musculus
tatgcgaggcaggacgagcagctac

SEQ ID NO: 757610 - DNA, 25 bp, Mus musculus
tatgcgagtcctcttcctgattccc

SEQ ID NO: 757611 - DNA, 25 bp, Mus musculus
tatgcgagtcctgttcctgattccc

SEQ ID NO: 757612 - DNA, 25 bp, Mus musculus
tatgcgagtggcactgtcagagccc

SEQ ID NO: 757613 - DNA, 25 bp, Mus musculus
tatgcgagtggctctgtcagagccc

SEQ ID NO: 757614 - DNA, 25 bp, Mus musculus
tatgcgagtgtcctggaggctttca

SEQ ID NO: 757615 - DNA, 25 bp, Mus musculus
tatgcgagtgtcgtggaggctttca

SEQ ID NO: 757616 - DNA, 25 bp, Mus musculus
tatgcgatggaacacctgagggacc

SEQ ID NO: 757617 - DNA, 25 bp, Mus musculus
tatgcgatggaagacctgagggacc

SEQ ID NO: 757618 - DNA, 25 bp, Mus musculus
tatgcgcccagtccttaaagtggag

SEQ ID NO: 757619 - DNA, 25 bp, Mus musculus
tatgcgcccagtgcttaaagtggag

SEQ ID NO: 757620 - DNA, 25 bp, Mus musculus
tatgcgcctctgacagccctgatag

SEQ ID NO: 757621 - DNA, 25 bp, Mus musculus
tatgcgcctctgtcagccctgatag

SEQ ID NO: 757622 - DNA, 25 bp, Mus musculus
tatgcgcgtgtccttgattacagaa

SEQ ID NO: 757623 - DNA, 25 bp, Mus musculus
tatgcgcgtgtcgttgattacagaa

SEQ ID NO: 757624 - DNA, 25 bp, Mus musculus
tatgcgctgacaatttattacaagc

SEQ ID NO: 757625 - DNA, 25 bp, Mus musculus
tatgcgctgacattttattacaagc

SEQ ID NO: 757626 - DNA, 25 bp, Mus musculus
tatgcgcttaagcagcgctggaacc

SEQ ID NO: 757627 - DNA, 25 bp, Mus musculus
tatgcgcttaaggagcgctggaacc

SEQ ID NO: 757628 - DNA, 25 bp, Mus musculus
tatgcggaatcacatagacatgctg

SEQ ID NO: 757629 - DNA, 25 bp, Mus musculus
tatgcggaatcagatagacatgctg

SEQ ID NO: 757630 - DNA, 25 bp, Mus musculus
tatgcggatggaatatttgacttgt

SEQ ID NO: 757631 - DNA, 25 bp, Mus musculus
tatgcggatggattatttgacttgt

SEQ ID NO: 757632 - DNA, 25 bp, Mus musculus
tatgcggcaccgcactgaagttcga

SEQ ID NO: 757633 - DNA, 25 bp, Mus musculus
tatgcggcaccggactgaagttcga

SEQ ID NO: 757634 - DNA, 25 bp, Mus musculus
tatgcggccttcactcagtgcaagg

SEQ ID NO: 757635 - DNA, 25 bp, Mus musculus
tatgcggccttctctcagtgcaagg

SEQ ID NO: 757636 - DNA, 25 bp, Mus musculus
tatgcggctccaacaaactgaagga

SEQ ID NO: 757637 - DNA, 25 bp, Mus musculus
tatgcggctccatcaaactgaagga

SEQ ID NO: 757638 - DNA, 25 bp, Mus musculus
tatgcggctgtccaaaacagagcga

SEQ ID NO: 757639 - DNA, 25 bp, Mus musculus
tatgcggctgtcgaaaacagagcga

SEQ ID NO: 757640 - DNA, 25 bp, Mus musculus
tatgcgggccttccacgtacacttt

SEQ ID NO: 757641 - DNA, 25 bp, Mus musculus
tatgcgggccttgcacgtacacttt

SEQ ID NO: 757642 - DNA, 25 bp, Mus musculus
tatgcgggctcaataccaaacaggt

SEQ ID NO: 757643 - DNA, 25 bp, Mus musculus
tatgcgggctcattaccaaacaggt

SEQ ID NO: 757644 - DNA, 25 bp, Mus musculus
tatgcggtagagatctctgaccatc

SEQ ID NO: 757645 - DNA, 25 bp, Mus musculus
tatgcggtagagttctctgaccatc

SEQ ID NO: 757646 - DNA, 25 bp, Mus musculus
tatgcggtgcaacatcagcagcgtc

SEQ ID NO: 757647 - DNA, 25 bp, Mus musculus
tatgcggtgcaagatcagcagcgtc

SEQ ID NO: 757648 - DNA, 25 bp, Mus musculus
tatgcggtggtgataagccgtacat

SEQ ID NO: 757649 - DNA, 25 bp, Mus musculus
tatgcggtggtgttaagccgtacat

SEQ ID NO: 757650 - DNA, 25 bp, Mus musculus
tatgcggttgaaactgattgcaaac

SEQ ID NO: 757651 - DNA, 25 bp, Mus musculus
tatgcggttgaatctgattgcaaac

SEQ ID NO: 757652 - DNA, 25 bp, Mus musculus
tatgcgtcactacaagcgtactgca

SEQ ID NO: 757653 - DNA, 25 bp, Mus musculus
tatgcgtcactagaagcgtactgca

SEQ ID NO: 757654 - DNA, 25 bp, Mus musculus
tatgcgtctcgtacagaatctgatc

SEQ ID NO: 757655 - DNA, 25 bp, Mus musculus
tatgcgtctcgttcagaatctgatc

SEQ ID NO: 757656 - DNA, 25 bp, Mus musculus
tatgcgtgatagaggcagtaaggcc

SEQ ID NO: 757657 - DNA, 25 bp, Mus musculus
tatgcgtgatagtggcagtaaggcc

SEQ ID NO: 757658 - DNA, 25 bp, Mus musculus
tatgcgtgccctcgaattagggtac

SEQ ID NO: 757659 - DNA, 25 bp, Mus musculus
tatgcgtgccctggaattagggtac

SEQ ID NO: 757660 - DNA, 25 bp, Mus musculus
tatgcgttgcttaggaaactcctgg

SEQ ID NO: 757661 - DNA, 25 bp, Mus musculus
tatgcgttgctttggaaactcctgg

SEQ ID NO: 757662 - DNA, 25 bp, Mus musculus
tatgcgtttgatcgttctcagcctc

SEQ ID NO: 757663 - DNA, 25 bp, Mus musculus
tatgcgtttgatggttctcagcctc

SEQ ID NO: 757664 - DNA, 25 bp, Mus musculus
tatgctaaatcacccgatgtgcgcc

SEQ ID NO: 757665 - DNA, 25 bp, Mus musculus
tatgctaaatcagccgatgtgcgcc

SEQ ID NO: 757666 - DNA, 25 bp, Mus musculus
tatgctaacagaacacgcggcaggc

SEQ ID NO: 757667 - DNA, 25 bp, Mus musculus
tatgctaacagatcacgcggcaggc

SEQ ID NO: 757668 - DNA, 25 bp, Mus musculus
tatgctaaggatatgggtgtacccg

SEQ ID NO: 757669 - DNA, 25 bp, Mus musculus
tatgctaaggatttgggtgtacccg

SEQ ID NO: 757670 - DNA, 25 bp, Mus musculus
tatgctaatgaacactcgggtgaaa

SEQ ID NO: 757671 - DNA, 25 bp, Mus musculus
tatgctaatgaagactcgggtgaaa

SEQ ID NO: 757672 - DNA, 25 bp, Mus musculus
tatgctacactacaaaggagctttg

SEQ ID NO: 757673 - DNA, 25 bp, Mus musculus
tatgctacactagaaaggagctttg

SEQ ID NO: 757674 - DNA, 25 bp, Mus musculus
tatgctagcaaaccatcctttcaaa

SEQ ID NO: 757675 - DNA, 25 bp, Mus musculus
tatgctagcaaagcatcctttcaaa

SEQ ID NO: 757676 - DNA, 25 bp, Mus musculus
tatgctagcactactgggaaagagc

SEQ ID NO: 757677 - DNA, 25 bp, Mus musculus
tatgctagcacttctgggaaagagc

SEQ ID NO: 757678 - DNA, 25 bp, Mus musculus
tatgctaggaggctatgtccccagc

SEQ ID NO: 757679 - DNA, 25 bp, Mus musculus
tatgctaggagggtatgtccccagc

SEQ ID NO: 757680 - DNA, 25 bp, Mus musculus
tatgctaggtgtaactgggcagcat

SEQ ID NO: 757681 - DNA, 25 bp, Mus musculus
tatgctaggtgttactgggcagcat

SEQ ID NO: 757682 - DNA, 25 bp, Mus musculus
tatgctatgtaactgcctcgaaggc

SEQ ID NO: 757683 - DNA, 25 bp, Mus musculus
tatgctatgtaagtgcctcgaaggc

SEQ ID NO: 757684 - DNA, 25 bp, Mus musculus
tatgctattaagaagtttgctgaag

SEQ ID NO: 757685 - DNA, 25 bp, Mus musculus
tatgctattaagtagtttgctgaag

SEQ ID NO: 757686 - DNA, 25 bp, Mus musculus
tatgctattgaacttgatcctgttc

SEQ ID NO: 757687 - DNA, 25 bp, Mus musculus
tatgctattgaagttgatcctgttc

SEQ ID NO: 757688 - DNA, 25 bp, Mus musculus
tatgctcaaatacccagatgctgtg

SEQ ID NO: 757689 - DNA, 25 bp, Mus musculus
tatgctcaaatagccagatgctgtg

SEQ ID NO: 757690 - DNA, 25 bp, Mus musculus
tatgctcaagatcatttctccttgg

SEQ ID NO: 757691 - DNA, 25 bp, Mus musculus
tatgctcaagatgatttctccttgg

SEQ ID NO: 757692 - DNA, 25 bp, Mus musculus
tatgctcactacactcttcacctgg

SEQ ID NO: 757693 - DNA, 25 bp, Mus musculus
tatgctcactactctcttcacctgg

SEQ ID NO: 757694 - DNA, 25 bp, Mus musculus
tatgctcaggacactatagagctac

SEQ ID NO: 757695 - DNA, 25 bp, Mus musculus
tatgctcaggactctatagagctac

SEQ ID NO: 757696 - DNA, 25 bp, Mus musculus
tatgctcatgtaatcttgacaggga

SEQ ID NO: 757697 - DNA, 25 bp, Mus musculus
tatgctcatgtattcttgacaggga

SEQ ID NO: 757698 - DNA, 25 bp, Mus musculus
tatgctccaaaacatgactacaaac

SEQ ID NO: 757699 - DNA, 25 bp, Mus musculus
tatgctccaaaagatgactacaaac

SEQ ID NO: 757700 - DNA, 25 bp, Mus musculus
tatgctccagaaaatttaaccaaac

SEQ ID NO: 757701 - DNA, 25 bp, Mus musculus
tatgctccagaatatttaaccaaac

SEQ ID NO: 757702 - DNA, 25 bp, Mus musculus
tatgctccgaggattacaacgcaag

SEQ ID NO: 757703 - DNA, 25 bp, Mus musculus
tatgctccgaggtttacaacgcaag

SEQ ID NO: 757704 - DNA, 25 bp, Mus musculus
tatgctccggcaaactagaacagaa

SEQ ID NO: 757705 - DNA, 25 bp, Mus musculus
tatgctccggcatactagaacagaa

SEQ ID NO: 757706 - DNA, 25 bp, Mus musculus
tatgctcggagaatctgaaccttac

SEQ ID NO: 757707 - DNA, 25 bp, Mus musculus
tatgctcggagattctgaaccttac

SEQ ID NO: 757708 - DNA, 25 bp, Mus musculus
tatgctcggcctcccgagccggaga

SEQ ID NO: 757709 - DNA, 25 bp, Mus musculus
tatgctcggcctgccgagccggaga

SEQ ID NO: 757710 - DNA, 25 bp, Mus musculus
tatgctcggggaccaattcatggtt

SEQ ID NO: 757711 - DNA, 25 bp, Mus musculus
tatgctcggggagcaattcatggtt

SEQ ID NO: 757712 - DNA, 25 bp, Mus musculus
tatgctctacataacgagcgccaca

SEQ ID NO: 757713 - DNA, 25 bp, Mus musculus
tatgctctacattacgagcgccaca

SEQ ID NO: 757714 - DNA, 25 bp, Mus musculus
tatgctctgaagacgccagttacat

SEQ ID NO: 757715 - DNA, 25 bp, Mus musculus
tatgctctgaagtcgccagttacat

SEQ ID NO: 757716 - DNA, 25 bp, Mus musculus
tatgctctggcacggaacaagggct

SEQ ID NO: 757717 - DNA, 25 bp, Mus musculus
tatgctctggcagggaacaagggct

SEQ ID NO: 757718 - DNA, 25 bp, Mus musculus
tatgctgaaccccaattctacaaca

SEQ ID NO: 757719 - DNA, 25 bp, Mus musculus
tatgctgaacccgaattctacaaca

SEQ ID NO: 757720 - DNA, 25 bp, Mus musculus
tatgctgaatgcagctcaagaacag

SEQ ID NO: 757721 - DNA, 25 bp, Mus musculus
tatgctgaatgctgctcaagaacag

SEQ ID NO: 757722 - DNA, 25 bp, Mus musculus
tatgctgacattaccgtctcagagg

SEQ ID NO: 757723 - DNA, 25 bp, Mus musculus
tatgctgacatttccgtctcagagg

SEQ ID NO: 757724 - DNA, 25 bp, Mus musculus
tatgctgaccggctggagactgaga

SEQ ID NO: 757725 - DNA, 25 bp, Mus musculus
tatgctgaccgggtggagactgaga

SEQ ID NO: 757726 - DNA, 25 bp, Mus musculus
tatgctgagcagcaatgactcctgg

SEQ ID NO: 757727 - DNA, 25 bp, Mus musculus
tatgctgagcaggaatgactcctgg

SEQ ID NO: 757728 - DNA, 25 bp, Mus musculus
tatgctgatgagactccctaacatg

SEQ ID NO: 757729 - DNA, 25 bp, Mus musculus
tatgctgatgagtctccctaacatg

SEQ ID NO: 757730 - DNA, 25 bp, Mus musculus
tatgctgatgccctacactggtaca

SEQ ID NO: 757731 - DNA, 25 bp, Mus musculus
tatgctgatgccgtacactggtaca

SEQ ID NO: 757732 - DNA, 25 bp, Mus musculus
tatgctgattcgaattgctagtcgc

SEQ ID NO: 757733 - DNA, 25 bp, Mus musculus
tatgctgattcgtattgctagtcgc

SEQ ID NO: 757734 - DNA, 25 bp, Mus musculus
tatgctgcaaaaacagccgtgacag

SEQ ID NO: 757735 - DNA, 25 bp, Mus musculus
tatgctgcaaaatcagccgtgacag

SEQ ID NO: 757736 - DNA, 25 bp, Mus musculus
tatgctgcaccgaggatatgggagt

SEQ ID NO: 757737 - DNA, 25 bp, Mus musculus
tatgctgcaccgtggatatgggagt

SEQ ID NO: 757738 - DNA, 25 bp, Mus musculus
tatgctgcattgcaatgatcttggc

SEQ ID NO: 757739 - DNA, 25 bp, Mus musculus
tatgctgcattggaatgatcttggc

SEQ ID NO: 757740 - DNA, 25 bp, Mus musculus
tatgctgccagacacaagggtcgtc

SEQ ID NO: 757741 - DNA, 25 bp, Mus musculus
tatgctgccagagacaagggtcgtc

SEQ ID NO: 757742 - DNA, 25 bp, Mus musculus
tatgctgccccacaacttttccagg

SEQ ID NO: 757743 - DNA, 25 bp, Mus musculus
tatgctgccccagaacttttccagg

SEQ ID NO: 757744 - DNA, 25 bp, Mus musculus
tatgctgcccgacacggtcatactc

SEQ ID NO: 757745 - DNA, 25 bp, Mus musculus
tatgctgcccgagacggtcatactc

SEQ ID NO: 757746 - DNA, 25 bp, Mus musculus
tatgctgcccgtattcctccagaaa

SEQ ID NO: 757747 - DNA, 25 bp, Mus musculus
tatgctgcccgttttcctccagaaa

SEQ ID NO: 757748 - DNA, 25 bp, Mus musculus
tatgctgcctgtactgtctcctatg

SEQ ID NO: 757749 - DNA, 25 bp, Mus musculus
tatgctgcctgttctgtctcctatg

SEQ ID NO: 757750 - DNA, 25 bp, Mus musculus
tatgctgcgctgacttacaacctcc

SEQ ID NO: 757751 - DNA, 25 bp, Mus musculus
tatgctgcgctgtcttacaacctcc

SEQ ID NO: 757752 - DNA, 25 bp, Mus musculus
tatgctgcggatacagctggttccc

SEQ ID NO: 757753 - DNA, 25 bp, Mus musculus
tatgctgcggattcagctggttccc

SEQ ID NO: 757754 - DNA, 25 bp, Mus musculus
tatgctgctgttcattttttccgac

SEQ ID NO: 757755 - DNA, 25 bp, Mus musculus
tatgctgctgttgattttttccgac

SEQ ID NO: 757756 - DNA, 25 bp, Mus musculus
tatgctggaaacatatactcctgag

SEQ ID NO: 757757 - DNA, 25 bp, Mus musculus
tatgctggaaacttatactcctgag

SEQ ID NO: 757758 - DNA, 25 bp, Mus musculus
tatgctggacctacgcacagctgga

SEQ ID NO: 757759 - DNA, 25 bp, Mus musculus
tatgctggaccttcgcacagctgga

SEQ ID NO: 757760 - DNA, 25 bp, Mus musculus
tatgctggactgagcaaaccttggc

SEQ ID NO: 757761 - DNA, 25 bp, Mus musculus
tatgctggactgtgcaaaccttggc

SEQ ID NO: 757762 - DNA, 25 bp, Mus musculus
tatgctggagacacatgccaacatc

SEQ ID NO: 757763 - DNA, 25 bp, Mus musculus
tatgctggagactcatgccaacatc

SEQ ID NO: 757764 - DNA, 25 bp, Mus musculus
tatgctggatttagccaagatcatt

SEQ ID NO: 757765 - DNA, 25 bp, Mus musculus
tatgctggattttgccaagatcatt

SEQ ID NO: 757766 - DNA, 25 bp, Mus musculus
tatgctgggcacagctaccctgtgg

SEQ ID NO: 757767 - DNA, 25 bp, Mus musculus
tatgctgggcactgctaccctgtgg

SEQ ID NO: 757768 - DNA, 25 bp, Mus musculus
tatgctgggcggatctgtaacattg

SEQ ID NO: 757769 - DNA, 25 bp, Mus musculus
tatgctgggcggttctgtaacattg

SEQ ID NO: 757770 - DNA, 25 bp, Mus musculus
tatgctgggcttccccggagaaaag

SEQ ID NO: 757771 - DNA, 25 bp, Mus musculus
tatgctgggcttgcccggagaaaag

SEQ ID NO: 757772 - DNA, 25 bp, Mus musculus
tatgctgggtttcaaatgcagccca

SEQ ID NO: 757773 - DNA, 25 bp, Mus musculus
tatgctgggtttgaaatgcagccca

SEQ ID NO: 757774 - DNA, 25 bp, Mus musculus
tatgctggtataatgctgaccaaag

SEQ ID NO: 757775 - DNA, 25 bp, Mus musculus
tatgctggtatattgctgaccaaag

SEQ ID NO: 757776 - DNA, 25 bp, Mus musculus
tatgctggtctgatctaccccacag

SEQ ID NO: 757777 - DNA, 25 bp, Mus musculus
tatgctggtctgttctaccccacag

SEQ ID NO: 757778 - DNA, 25 bp, Mus musculus
tatgctggtgtcatcaagacagcct

SEQ ID NO: 757779 - DNA, 25 bp, Mus musculus
tatgctggtgtcttcaagacagcct

SEQ ID NO: 757780 - DNA, 25 bp, Mus musculus
tatgctggttaacaaaattcagcct

SEQ ID NO: 757781 - DNA, 25 bp, Mus musculus
tatgctggttaagaaaattcagcct

SEQ ID NO: 757782 - DNA, 25 bp, Mus musculus
tatgctgtaaacaccatcaagaaga

SEQ ID NO: 757783 - DNA, 25 bp, Mus musculus
tatgctgtaaactccatcaagaaga

SEQ ID NO: 757784 - DNA, 25 bp, Mus musculus
tatgctgtcaagctcctttaattcc

SEQ ID NO: 757785 - DNA, 25 bp, Mus musculus
tatgctgtcaaggtcctttaattcc

SEQ ID NO: 757786 - DNA, 25 bp, Mus musculus
tatgctgtcaccaaagagttactat

SEQ ID NO: 757787 - DNA, 25 bp, Mus musculus
tatgctgtcacctaagagttactat

SEQ ID NO: 757788 - DNA, 25 bp, Mus musculus
tatgctgtctataacagggtgtgtc

SEQ ID NO: 757789 - DNA, 25 bp, Mus musculus
tatgctgtctattacagggtgtgtc

SEQ ID NO: 757790 - DNA, 25 bp, Mus musculus
tatgctgtgggaactcaatgaaggc

SEQ ID NO: 757791 - DNA, 25 bp, Mus musculus
tatgctgtgggatctcaatgaaggc

SEQ ID NO: 757792 - DNA, 25 bp, Mus musculus
tatgctgtgtctacaaaatggaaga

SEQ ID NO: 757793 - DNA, 25 bp, Mus musculus
tatgctgtgtcttcaaaatggaaga

SEQ ID NO: 757794 - DNA, 25 bp, Mus musculus
tatgctgtgtgcacaccacaccctg

SEQ ID NO: 757795 - DNA, 25 bp, Mus musculus
tatgctgtgtgctcaccacaccctg

SEQ ID NO: 757796 - DNA, 25 bp, Mus musculus
tatgctgtttttcggaaccaagaaa

SEQ ID NO: 757797 - DNA, 25 bp, Mus musculus
tatgctgtttttgggaaccaagaaa

SEQ ID NO: 757798 - DNA, 25 bp, Mus musculus
tatgcttaagggacacctgatctct

SEQ ID NO: 757799 - DNA, 25 bp, Mus musculus
tatgcttaagggtcacctgatctct

SEQ ID NO: 757800 - DNA, 25 bp, Mus musculus
tatgcttagcgcatgtacttagagg

SEQ ID NO: 757801 - DNA, 25 bp, Mus musculus
tatgcttagcgcttgtacttagagg

SEQ ID NO: 757802 - DNA, 25 bp, Mus musculus
tatgcttatgaacttcaatggccag

SEQ ID NO: 757803 - DNA, 25 bp, Mus musculus
tatgcttatgaagttcaatggccag

SEQ ID NO: 757804 - DNA, 25 bp, Mus musculus
tatgcttcagctctttattgacaag

SEQ ID NO: 757805 - DNA, 25 bp, Mus musculus
tatgcttcagctgtttattgacaag

SEQ ID NO: 757806 - DNA, 25 bp, Mus musculus
tatgcttccatcctttcttcagaaa

SEQ ID NO: 757807 - DNA, 25 bp, Mus musculus
tatgcttccatcgtttcttcagaaa

SEQ ID NO: 757808 - DNA, 25 bp, Mus musculus
tatgcttctagtcaacttgctggcc

SEQ ID NO: 757809 - DNA, 25 bp, Mus musculus
tatgcttctagtgaacttgctggcc

SEQ ID NO: 757810 - DNA, 25 bp, Mus musculus
tatgcttctgccattcaaggtcatg

SEQ ID NO: 757811 - DNA, 25 bp, Mus musculus
tatgcttctgcctttcaaggtcatg

SEQ ID NO: 757812 - DNA, 25 bp, Mus musculus
tatgcttgctcaacattctgggccg

SEQ ID NO: 757813 - DNA, 25 bp, Mus musculus
tatgcttgctcatcattctgggccg

SEQ ID NO: 757814 - DNA, 25 bp, Mus musculus
tatgcttggaacctggtactcctgg

SEQ ID NO: 757815 - DNA, 25 bp, Mus musculus
tatgcttggaacgtggtactcctgg

SEQ ID NO: 757816 - DNA, 25 bp, Mus musculus
tatgcttggagacctccggacctct

SEQ ID NO: 757817 - DNA, 25 bp, Mus musculus
tatgcttggagagctccggacctct

SEQ ID NO: 757818 - DNA, 25 bp, Mus musculus
tatgcttgggtgaaacgccagcttg

SEQ ID NO: 757819 - DNA, 25 bp, Mus musculus
tatgcttgggtgtaacgccagcttg

SEQ ID NO: 757820 - DNA, 25 bp, Mus musculus
tatgcttgtcatcaccgaagcctga

SEQ ID NO: 757821 - DNA, 25 bp, Mus musculus
tatgcttgtcatgaccgaagcctga

SEQ ID NO: 757822 - DNA, 25 bp, Mus musculus
tatgcttgtgaaaatggacatacag

SEQ ID NO: 757823 - DNA, 25 bp, Mus musculus
tatgcttgtgaatatggacatacag

SEQ ID NO: 757824 - DNA, 25 bp, Mus musculus
tatgcttgttgaaggatctcagtga

SEQ ID NO: 757825 - DNA, 25 bp, Mus musculus
tatgcttgttgatggatctcagtga

SEQ ID NO: 757826 - DNA, 25 bp, Mus musculus
tatgctttaaacagctactgggtgc

SEQ ID NO: 757827 - DNA, 25 bp, Mus musculus
tatgctttaaactgctactgggtgc

SEQ ID NO: 757828 - DNA, 25 bp, Mus musculus
tatgctttacagagtcttcatttga

SEQ ID NO: 757829 - DNA, 25 bp, Mus musculus
tatgctttacagtgtcttcatttga

SEQ ID NO: 757830 - DNA, 25 bp, Mus musculus
tatgctttccccacttacgctgatc

SEQ ID NO: 757831 - DNA, 25 bp, Mus musculus
tatgctttcccctcttacgctgatc

SEQ ID NO: 757832 - DNA, 25 bp, Mus musculus
tatgctttccctaaagatcggaggg

SEQ ID NO: 757833 - DNA, 25 bp, Mus musculus
tatgctttcccttaagatcggaggg

SEQ ID NO: 757834 - DNA, 25 bp, Mus musculus
tatgctttgcttaactctgacaaaa

SEQ ID NO: 757835 - DNA, 25 bp, Mus musculus
tatgctttgctttactctgacaaaa

SEQ ID NO: 757836 - DNA, 25 bp, Mus musculus
tatgctttggccaacgttatgacca

SEQ ID NO: 757837 - DNA, 25 bp, Mus musculus
tatgctttggcctacgttatgacca

SEQ ID NO: 757838 - DNA, 25 bp, Mus musculus
tatgctttgtcaatgacagcggcag

SEQ ID NO: 757839 - DNA, 25 bp, Mus musculus
tatgctttgtcattgacagcggcag

SEQ ID NO: 757840 - DNA, 25 bp, Mus musculus
tatgcttttgcactcaattgggaaa

SEQ ID NO: 757841 - DNA, 25 bp, Mus musculus
tatgcttttgcagtcaattgggaaa

SEQ ID NO: 757842 - DNA, 25 bp, Mus musculus
tatggaaaagcaccaatctgacttg

SEQ ID NO: 757843 - DNA, 25 bp, Mus musculus
tatggaaaagcagcaatctgacttg

SEQ ID NO: 757844 - DNA, 25 bp, Mus musculus
tatggaaaaggacttaagtagattt

SEQ ID NO: 757845 - DNA, 25 bp, Mus musculus
tatggaaaaggagttaagtagattt

SEQ ID NO: 757846 - DNA, 25 bp, Mus musculus
tatggaaaagttcaggccactcgca

SEQ ID NO: 757847 - DNA, 25 bp, Mus musculus
tatggaaaagttgaggccactcgca

SEQ ID NO: 757848 - DNA, 25 bp, Mus musculus
tatggaaaatatacatcatcacagt

SEQ ID NO: 757849 - DNA, 25 bp, Mus musculus
tatggaaaatattcatcatcacagt

SEQ ID NO: 757850 - DNA, 25 bp, Mus musculus
tatggaaacagccttctcttgacag

SEQ ID NO: 757851 - DNA, 25 bp, Mus musculus
tatggaaacagcgttctcttgacag

SEQ ID NO: 757852 - DNA, 25 bp, Mus musculus
tatggaaacggacgctgtcagcaca

SEQ ID NO: 757853 - DNA, 25 bp, Mus musculus
tatggaaacggaggctgtcagcaca

SEQ ID NO: 757854 - DNA, 25 bp, Mus musculus
tatggaaagcagagaaagtatacta

SEQ ID NO: 757855 - DNA, 25 bp, Mus musculus
tatggaaagcagtgaaagtatacta

SEQ ID NO: 757856 - DNA, 25 bp, Mus musculus
tatggaaagctaccaagaagttggc

SEQ ID NO: 757857 - DNA, 25 bp, Mus musculus
tatggaaagctagcaagaagttggc

SEQ ID NO: 757858 - DNA, 25 bp, Mus musculus
tatggaaagggaagggaagcacatt

SEQ ID NO: 757859 - DNA, 25 bp, Mus musculus
tatggaaagggatgggaagcacatt

SEQ ID NO: 757860 - DNA, 25 bp, Mus musculus
tatggaaagtgtcgtcccgtcagac

SEQ ID NO: 757861 - DNA, 25 bp, Mus musculus
tatggaaagtgtggtcccgtcagac

SEQ ID NO: 757862 - DNA, 25 bp, Mus musculus
tatggaaataatagagagccgggtg

SEQ ID NO: 757863 - DNA, 25 bp, Mus musculus
tatggaaataattgagagccgggtg

SEQ ID NO: 757864 - DNA, 25 bp, Mus musculus
tatggaaatcatccctcactgggcc

SEQ ID NO: 757865 - DNA, 25 bp, Mus musculus
tatggaaatcatgcctcactgggcc

SEQ ID NO: 757866 - DNA, 25 bp, Mus musculus
tatggaaatgcacaacagattggcc

SEQ ID NO: 757867 - DNA, 25 bp, Mus musculus
tatggaaatgcagaacagattggcc

SEQ ID NO: 757868 - DNA, 25 bp, Mus musculus
tatggaaattatctaatccaacatg

SEQ ID NO: 757869 - DNA, 25 bp, Mus musculus
tatggaaattatgtaatccaacatg

SEQ ID NO: 757870 - DNA, 25 bp, Mus musculus
tatggaacaactcaacatcctaacc

SEQ ID NO: 757871 - DNA, 25 bp, Mus musculus
tatggaacaactgaacatcctaacc

SEQ ID NO: 757872 - DNA, 25 bp, Mus musculus
tatggaacagaaccacagattggcg

SEQ ID NO: 757873 - DNA, 25 bp, Mus musculus
tatggaacagaagcacagattggcg

SEQ ID NO: 757874 - DNA, 25 bp, Mus musculus
tatggaacagcaccagtaaatctta

SEQ ID NO: 757875 - DNA, 25 bp, Mus musculus
tatggaacagcagcagtaaatctta

SEQ ID NO: 757876 - DNA, 25 bp, Mus musculus
tatggaaccacgatgtccacaagtt

SEQ ID NO: 757877 - DNA, 25 bp, Mus musculus
tatggaaccacgttgtccacaagtt

SEQ ID NO: 757878 - DNA, 25 bp, Mus musculus
tatggaaccattcaagggagcaccc

SEQ ID NO: 757879 - DNA, 25 bp, Mus musculus
tatggaaccattgaagggagcaccc

SEQ ID NO: 757880 - DNA, 25 bp, Mus musculus
tatggaaccgagaaagataaaaatt

SEQ ID NO: 757881 - DNA, 25 bp, Mus musculus
tatggaaccgagtaagataaaaatt

SEQ ID NO: 757882 - DNA, 25 bp, Mus musculus
tatggaacctgtcctccagtgacca

SEQ ID NO: 757883 - DNA, 25 bp, Mus musculus
tatggaacctgtgctccagtgacca

SEQ ID NO: 757884 - DNA, 25 bp, Mus musculus
tatggaacgccaacccttttaggac

SEQ ID NO: 757885 - DNA, 25 bp, Mus musculus
tatggaacgccatcccttttaggac

SEQ ID NO: 757886 - DNA, 25 bp, Mus musculus
tatggaacggttccaaccgcccatt

SEQ ID NO: 757887 - DNA, 25 bp, Mus musculus
tatggaacggttgcaaccgcccatt

SEQ ID NO: 757888 - DNA, 25 bp, Mus musculus
tatggaagacatcacatttgcggag

SEQ ID NO: 757889 - DNA, 25 bp, Mus musculus
tatggaagacatgacatttgcggag

SEQ ID NO: 757890 - DNA, 25 bp, Mus musculus
tatggaagacctagggttatggagc

SEQ ID NO: 757891 - DNA, 25 bp, Mus musculus
tatggaagaccttgggttatggagc

SEQ ID NO: 757892 - DNA, 25 bp, Mus musculus
tatggaagatgcaacctaaaacgag

SEQ ID NO: 757893 - DNA, 25 bp, Mus musculus
tatggaagatgctacctaaaacgag

SEQ ID NO: 757894 - DNA, 25 bp, Mus musculus
tatggaagcccgattccgagtgtct

SEQ ID NO: 757895 - DNA, 25 bp, Mus musculus
tatggaagcccgtttccgagtgtct

SEQ ID NO: 757896 - DNA, 25 bp, Mus musculus
tatggaagcttcacttacaagaaga

SEQ ID NO: 757897 - DNA, 25 bp, Mus musculus
tatggaagcttctcttacaagaaga

SEQ ID NO: 757898 - DNA, 25 bp, Mus musculus
tatggaaggttcacaatcaagtctg

SEQ ID NO: 757899 - DNA, 25 bp, Mus musculus
tatggaaggttctcaatcaagtctg

SEQ ID NO: 757900 - DNA, 25 bp, Mus musculus
tatggaagttacaccaggtgcagag

SEQ ID NO: 757901 - DNA, 25 bp, Mus musculus
tatggaagttactccaggtgcagag

SEQ ID NO: 757902 - DNA, 25 bp, Mus musculus
tatggaatactcagggtgtctgcaa

SEQ ID NO: 757903 - DNA, 25 bp, Mus musculus
tatggaatactctgggtgtctgcaa

SEQ ID NO: 757904 - DNA, 25 bp, Mus musculus
tatggaatatatcgctgtatcccct

SEQ ID NO: 757905 - DNA, 25 bp, Mus musculus
tatggaatatatggctgtatcccct

SEQ ID NO: 757906 - DNA, 25 bp, Mus musculus
tatggaatccctcaaccatggaatt

SEQ ID NO: 757907 - DNA, 25 bp, Mus musculus
tatggaatccctgaaccatggaatt

SEQ ID NO: 757908 - DNA, 25 bp, Mus musculus
tatggaatggcaagcttcccgacac

SEQ ID NO: 757909 - DNA, 25 bp, Mus musculus
tatggaatggcatgcttcccgacac

SEQ ID NO: 757910 - DNA, 25 bp, Mus musculus
tatggaattcctagaccccagcaag

SEQ ID NO: 757911 - DNA, 25 bp, Mus musculus
tatggaattccttgaccccagcaag

SEQ ID NO: 757912 - DNA, 25 bp, Mus musculus
tatggaattcgtagaaactaacctc

SEQ ID NO: 757913 - DNA, 25 bp, Mus musculus
tatggaattcgttgaaactaacctc

SEQ ID NO: 757914 - DNA, 25 bp, Mus musculus
tatggaattttgactgcccgctccc

SEQ ID NO: 757915 - DNA, 25 bp, Mus musculus
tatggaattttgtctgcccgctccc

SEQ ID NO: 757916 - DNA, 25 bp, Mus musculus
tatggacaaagcacttcgtacctga

SEQ ID NO: 757917 - DNA, 25 bp, Mus musculus
tatggacaaagctcttcgtacctga

SEQ ID NO: 757918 - DNA, 25 bp, Mus musculus
tatggacaacaaccgaatgagcgcc

SEQ ID NO: 757919 - DNA, 25 bp, Mus musculus
tatggacaacaagcgaatgagcgcc

SEQ ID NO: 757920 - DNA, 25 bp, Mus musculus
tatggacaagacacccattgctgtg

SEQ ID NO: 757921 - DNA, 25 bp, Mus musculus
tatggacaagactcccattgctgtg

SEQ ID NO: 757922 - DNA, 25 bp, Mus musculus
tatggacacacaaggaactttttgc

SEQ ID NO: 757923 - DNA, 25 bp, Mus musculus
tatggacacacatggaactttttgc

SEQ ID NO: 757924 - DNA, 25 bp, Mus musculus
tatggacaccggagaaaacccagag

SEQ ID NO: 757925 - DNA, 25 bp, Mus musculus
tatggacaccggtgaaaacccagag

SEQ ID NO: 757926 - DNA, 25 bp, Mus musculus
tatggacagcaaagtgagcaggcag

SEQ ID NO: 757927 - DNA, 25 bp, Mus musculus
tatggacagcaatgtgagcaggcag

SEQ ID NO: 757928 - DNA, 25 bp, Mus musculus
tatggacagcttacctttggattca

SEQ ID NO: 757929 - DNA, 25 bp, Mus musculus
tatggacagctttcctttggattca

SEQ ID NO: 757930 - DNA, 25 bp, Mus musculus
tatggacagtatatggcaaatgggt

SEQ ID NO: 757931 - DNA, 25 bp, Mus musculus
tatggacagtatttggcaaatgggt

SEQ ID NO: 757932 - DNA, 25 bp, Mus musculus
tatggacatgggaactatcaagagg

SEQ ID NO: 757933 - DNA, 25 bp, Mus musculus
tatggacatgggtactatcaagagg

SEQ ID NO: 757934 - DNA, 25 bp, Mus musculus
tatggacattacacatgagggacct

SEQ ID NO: 757935 - DNA, 25 bp, Mus musculus
tatggacattactcatgagggacct

SEQ ID NO: 757936 - DNA, 25 bp, Mus musculus
tatggacattgacacgctcatgacc

SEQ ID NO: 757937 - DNA, 25 bp, Mus musculus
tatggacattgagacgctcatgacc

SEQ ID NO: 757938 - DNA, 25 bp, Mus musculus
tatggacattgtaggagctaccagg

SEQ ID NO: 757939 - DNA, 25 bp, Mus musculus
tatggacattgttggagctaccagg

SEQ ID NO: 757940 - DNA, 25 bp, Mus musculus
tatggaccaaacagtgggcagacgg

SEQ ID NO: 757941 - DNA, 25 bp, Mus musculus
tatggaccaaactgtgggcagacgg

SEQ ID NO: 757942 - DNA, 25 bp, Mus musculus
tatggaccagtgctttctctgcttg

SEQ ID NO: 757943 - DNA, 25 bp, Mus musculus
tatggaccagtggtttctctgcttg

SEQ ID NO: 757944 - DNA, 25 bp, Mus musculus
tatggaccattgcatgtggtcacgc

SEQ ID NO: 757945 - DNA, 25 bp, Mus musculus
tatggaccattggatgtggtcacgc

SEQ ID NO: 757946 - DNA, 25 bp, Mus musculus
tatggacccttactgccgtctgcgt

SEQ ID NO: 757947 - DNA, 25 bp, Mus musculus
tatggacccttagtgccgtctgcgt

SEQ ID NO: 757948 - DNA, 25 bp, Mus musculus
tatggaccgagaccccatggaacac

SEQ ID NO: 757949 - DNA, 25 bp, Mus musculus
tatggaccgagagcccatggaacac

SEQ ID NO: 757950 - DNA, 25 bp, Mus musculus
tatggaccgccaagaaatcccaact

SEQ ID NO: 757951 - DNA, 25 bp, Mus musculus
tatggaccgccatgaaatcccaact

SEQ ID NO: 757952 - DNA, 25 bp, Mus musculus
tatggaccggacaacatgttgcccc

SEQ ID NO: 757953 - DNA, 25 bp, Mus musculus
tatggaccggactacatgttgcccc

SEQ ID NO: 757954 - DNA, 25 bp, Mus musculus
tatggacctagcagtagctttgggc

SEQ ID NO: 757955 - DNA, 25 bp, Mus musculus
tatggacctagctgtagctttgggc

SEQ ID NO: 757956 - DNA, 25 bp, Mus musculus
tatggacctattcgtcaaatcagag

SEQ ID NO: 757957 - DNA, 25 bp, Mus musculus
tatggacctattggtcaaatcagag

SEQ ID NO: 757958 - DNA, 25 bp, Mus musculus
tatggacctgacagaagtgattact

SEQ ID NO: 757959 - DNA, 25 bp, Mus musculus
tatggacctgactgaagtgattact

SEQ ID NO: 757960 - DNA, 25 bp, Mus musculus
tatggacgaatgcttggagaacaat

SEQ ID NO: 757961 - DNA, 25 bp, Mus musculus
tatggacgaatggttggagaacaat

SEQ ID NO: 757962 - DNA, 25 bp, Mus musculus
tatggacgcctccttggccatcaag

SEQ ID NO: 757963 - DNA, 25 bp, Mus musculus
tatggacgcctcgttggccatcaag

SEQ ID NO: 757964 - DNA, 25 bp, Mus musculus
tatggacggttccttcgtgcagcac

SEQ ID NO: 757965 - DNA, 25 bp, Mus musculus
tatggacggttcgttcgtgcagcac

SEQ ID NO: 757966 - DNA, 25 bp, Mus musculus
tatggacgtatgctgcaatggtcag

SEQ ID NO: 757967 - DNA, 25 bp, Mus musculus
tatggacgtatggtgcaatggtcag

SEQ ID NO: 757968 - DNA, 25 bp, Mus musculus
tatggactaaggaattactggattc

SEQ ID NO: 757969 - DNA, 25 bp, Mus musculus
tatggactaaggtattactggattc

SEQ ID NO: 757970 - DNA, 25 bp, Mus musculus
tatggactagaacttaataaggatg

SEQ ID NO: 757971 - DNA, 25 bp, Mus musculus
tatggactagaagttaataaggatg

SEQ ID NO: 757972 - DNA, 25 bp, Mus musculus
tatggactagaccttgggaaataca

SEQ ID NO: 757973 - DNA, 25 bp, Mus musculus
tatggactagacgttgggaaataca

SEQ ID NO: 757974 - DNA, 25 bp, Mus musculus
tatggactataaagccaccacacct

SEQ ID NO: 757975 - DNA, 25 bp, Mus musculus
tatggactataatgccaccacacct

SEQ ID NO: 757976 - DNA, 25 bp, Mus musculus
tatggactatcacttaagattggaa

SEQ ID NO: 757977 - DNA, 25 bp, Mus musculus
tatggactatcagttaagattggaa

SEQ ID NO: 757978 - DNA, 25 bp, Mus musculus
tatggactatctctatggtgcccca

SEQ ID NO: 757979 - DNA, 25 bp, Mus musculus
tatggactatctgtatggtgcccca

SEQ ID NO: 757980 - DNA, 25 bp, Mus musculus
tatggactcatcacccgcgaactct

SEQ ID NO: 757981 - DNA, 25 bp, Mus musculus
tatggactcatctcccgcgaactct

SEQ ID NO: 757982 - DNA, 25 bp, Mus musculus
tatggactccaacggactctgcctc

SEQ ID NO: 757983 - DNA, 25 bp, Mus musculus
tatggactccaagggactctgcctc

SEQ ID NO: 757984 - DNA, 25 bp, Mus musculus
tatggactggctagtacctgccacc

SEQ ID NO: 757985 - DNA, 25 bp, Mus musculus
tatggactggcttgtacctgccacc

SEQ ID NO: 757986 - DNA, 25 bp, Mus musculus
tatggactgggcagccactgtctgg

SEQ ID NO: 757987 - DNA, 25 bp, Mus musculus
tatggactgggctgccactgtctgg

SEQ ID NO: 757988 - DNA, 25 bp, Mus musculus
tatggacttgtacatgatgaactgt

SEQ ID NO: 757989 - DNA, 25 bp, Mus musculus
tatggacttgtagatgatgaactgt

SEQ ID NO: 757990 - DNA, 25 bp, Mus musculus
tatggactttgccacagggccaggc

SEQ ID NO: 757991 - DNA, 25 bp, Mus musculus
tatggactttgcgacagggccaggc

SEQ ID NO: 757992 - DNA, 25 bp, Mus musculus
tatggagaacataggagcaatacag

SEQ ID NO: 757993 - DNA, 25 bp, Mus musculus
tatggagaacattggagcaatacag

SEQ ID NO: 757994 - DNA, 25 bp, Mus musculus
tatggagaaccaattgcagcgggtc

SEQ ID NO: 757995 - DNA, 25 bp, Mus musculus
tatggagaaccatttgcagcgggtc

SEQ ID NO: 757996 - DNA, 25 bp, Mus musculus
tatggagaacggctctttccttcac

SEQ ID NO: 757997 - DNA, 25 bp, Mus musculus
tatggagaacgggtctttccttcac

SEQ ID NO: 757998 - DNA, 25 bp, Mus musculus
tatggagaagcgactggtgagaaac

SEQ ID NO: 757999 - DNA, 25 bp, Mus musculus
tatggagaagcgtctggtgagaaac

SEQ ID NO: 758000 - DNA, 25 bp, Mus musculus
tatggagaattcacgtggagcaatc

SEQ ID NO: 758001 - DNA, 25 bp, Mus musculus
tatggagaattctcgtggagcaatc

SEQ ID NO: 758002 - DNA, 25 bp, Mus musculus
tatggagactcacctgttggaagac

SEQ ID NO: 758003 - DNA, 25 bp, Mus musculus
tatggagactcagctgttggaagac

SEQ ID NO: 758004 - DNA, 25 bp, Mus musculus
tatggagagactatgtgcctcccac

SEQ ID NO: 758005 - DNA, 25 bp, Mus musculus
tatggagagactttgtgcctcccac

SEQ ID NO: 758006 - DNA, 25 bp, Mus musculus
tatggagagcaccaagtctggccag

SEQ ID NO: 758007 - DNA, 25 bp, Mus musculus
tatggagagcacgaagtctggccag

SEQ ID NO: 758008 - DNA, 25 bp, Mus musculus
tatggagatcacaacagccaaagga

SEQ ID NO: 758009 - DNA, 25 bp, Mus musculus
tatggagatcactacagccaaagga

SEQ ID NO: 758010 - DNA, 25 bp, Mus musculus
tatggagatttgagccccacagagc

SEQ ID NO: 758011 - DNA, 25 bp, Mus musculus
tatggagatttgtgccccacagagc

SEQ ID NO: 758012 - DNA, 25 bp, Mus musculus
tatggagcatgaccagaagtcagga

SEQ ID NO: 758013 - DNA, 25 bp, Mus musculus
tatggagcatgagcagaagtcagga

SEQ ID NO: 758014 - DNA, 25 bp, Mus musculus
tatggagccatacctgtccacagtg

SEQ ID NO: 758015 - DNA, 25 bp, Mus musculus
tatggagccatagctgtccacagtg

SEQ ID NO: 758016 - DNA, 25 bp, Mus musculus
tatggagcccaaagagatgatgcgg

SEQ ID NO: 758017 - DNA, 25 bp, Mus musculus
tatggagcccaatgagatgatgcgg

SEQ ID NO: 758018 - DNA, 25 bp, Mus musculus
tatggagccgaactggatgcagacc

SEQ ID NO: 758019 - DNA, 25 bp, Mus musculus
tatggagccgaagtggatgcagacc

SEQ ID NO: 758020 - DNA, 25 bp, Mus musculus
tatggagccgtacatctttgggaac

SEQ ID NO: 758021 - DNA, 25 bp, Mus musculus
tatggagccgtagatctttgggaac

SEQ ID NO: 758022 - DNA, 25 bp, Mus musculus
tatggagcctctcttttacctaaag

SEQ ID NO: 758023 - DNA, 25 bp, Mus musculus
tatggagcctctgttttacctaaag

SEQ ID NO: 758024 - DNA, 25 bp, Mus musculus
tatggagctaatccaaggaggtttc

SEQ ID NO: 758025 - DNA, 25 bp, Mus musculus
tatggagctaatgcaaggaggtttc

SEQ ID NO: 758026 - DNA, 25 bp, Mus musculus
tatggagctcagactgctgctgcgg

SEQ ID NO: 758027 - DNA, 25 bp, Mus musculus
tatggagctcagtctgctgctgcgg

SEQ ID NO: 758028 - DNA, 25 bp, Mus musculus
tatggaggcaggattgactgctgct

SEQ ID NO: 758029 - DNA, 25 bp, Mus musculus
tatggaggcaggtttgactgctgct

SEQ ID NO: 758030 - DNA, 25 bp, Mus musculus
tatggaggctatcgcgtttgtaact

SEQ ID NO: 758031 - DNA, 25 bp, Mus musculus
tatggaggctatggcgtttgtaact

SEQ ID NO: 758032 - DNA, 25 bp, Mus musculus
tatggagggatgagtggctgcaggc

SEQ ID NO: 758033 - DNA, 25 bp, Mus musculus
tatggagggatgtgtggctgcaggc

SEQ ID NO: 758034 - DNA, 25 bp, Mus musculus
tatggagggtgcaggctcttaacca

SEQ ID NO: 758035 - DNA, 25 bp, Mus musculus
tatggagggtgctggctcttaacca

SEQ ID NO: 758036 - DNA, 25 bp, Mus musculus
tatggaggttctcccagccaagaaa

SEQ ID NO: 758037 - DNA, 25 bp, Mus musculus
tatggaggttctgccagccaagaaa

SEQ ID NO: 758038 - DNA, 25 bp, Mus musculus
tatggagtaaagaaggctgacttcg

SEQ ID NO: 758039 - DNA, 25 bp, Mus musculus
tatggagtaaagtaggctgacttcg

SEQ ID NO: 758040 - DNA, 25 bp, Mus musculus
tatggagtaatgcaaggagctctca

SEQ ID NO: 758041 - DNA, 25 bp, Mus musculus
tatggagtaatggaaggagctctca

SEQ ID NO: 758042 - DNA, 25 bp, Mus musculus
tatggagtccttcctcattgtggcc

SEQ ID NO: 758043 - DNA, 25 bp, Mus musculus
tatggagtccttgctcattgtggcc

SEQ ID NO: 758044 - DNA, 25 bp, Mus musculus
tatggagtctccaaccaaggaaatt

SEQ ID NO: 758045 - DNA, 25 bp, Mus musculus
tatggagtctcctaccaaggaaatt

SEQ ID NO: 758046 - DNA, 25 bp, Mus musculus
tatggagtgaggctgccagatggca

SEQ ID NO: 758047 - DNA, 25 bp, Mus musculus
tatggagtgagggtgccagatggca

SEQ ID NO: 758048 - DNA, 25 bp, Mus musculus
tatggagtgctcaggttacaggcag

SEQ ID NO: 758049 - DNA, 25 bp, Mus musculus
tatggagtgctctggttacaggcag

SEQ ID NO: 758050 - DNA, 25 bp, Mus musculus
tatggagttcctatgggcccctctc

SEQ ID NO: 758051 - DNA, 25 bp, Mus musculus
tatggagttcctttgggcccctctc

SEQ ID NO: 758052 - DNA, 25 bp, Mus musculus
tatggagttcttcatattcatggtt

SEQ ID NO: 758053 - DNA, 25 bp, Mus musculus
tatggagttcttgatattcatggtt

SEQ ID NO: 758054 - DNA, 25 bp, Mus musculus
tatggagttttaacctatgggctaa

SEQ ID NO: 758055 - DNA, 25 bp, Mus musculus
tatggagttttatcctatgggctaa

SEQ ID NO: 758056 - DNA, 25 bp, Mus musculus
tatggataaggcactgcaaggccag

SEQ ID NO: 758057 - DNA, 25 bp, Mus musculus
tatggataaggctctgcaaggccag

SEQ ID NO: 758058 - DNA, 25 bp, Mus musculus
tatggatactgacgtcaactgtgtc

SEQ ID NO: 758059 - DNA, 25 bp, Mus musculus
tatggatactgaggtcaactgtgtc

SEQ ID NO: 758060 - DNA, 25 bp, Mus musculus
tatggatcacacaccttcaagttgg

SEQ ID NO: 758061 - DNA, 25 bp, Mus musculus
tatggatcacactccttcaagttgg

SEQ ID NO: 758062 - DNA, 25 bp, Mus musculus
tatggatcatagctaagcagcctct

SEQ ID NO: 758063 - DNA, 25 bp, Mus musculus
tatggatcataggtaagcagcctct

SEQ ID NO: 758064 - DNA, 25 bp, Mus musculus
tatggatcatttcaacgaggcaact

SEQ ID NO: 758065 - DNA, 25 bp, Mus musculus
tatggatcatttgaacgaggcaact

SEQ ID NO: 758066 - DNA, 25 bp, Mus musculus
tatggatccgctacagtcagtacct

SEQ ID NO: 758067 - DNA, 25 bp, Mus musculus
tatggatccgcttcagtcagtacct

SEQ ID NO: 758068 - DNA, 25 bp, Mus musculus
tatggatctagccaagaaaacgagc

SEQ ID NO: 758069 - DNA, 25 bp, Mus musculus
tatggatctagcgaagaaaacgagc

SEQ ID NO: 758070 - DNA, 25 bp, Mus musculus
tatggatctgagcactccctgggcg

SEQ ID NO: 758071 - DNA, 25 bp, Mus musculus
tatggatctgaggactccctgggcg

SEQ ID NO: 758072 - DNA, 25 bp, Mus musculus
tatggatctgggagtgaactacctt

SEQ ID NO: 758073 - DNA, 25 bp, Mus musculus
tatggatctgggtgtgaactacctt

SEQ ID NO: 758074 - DNA, 25 bp, Mus musculus
tatggatgaccgcaatctgtaccgt

SEQ ID NO: 758075 - DNA, 25 bp, Mus musculus
tatggatgaccggaatctgtaccgt

SEQ ID NO: 758076 - DNA, 25 bp, Mus musculus
tatggatgccaacaagcctgccaag

SEQ ID NO: 758077 - DNA, 25 bp, Mus musculus
tatggatgccaagaagcctgccaag

SEQ ID NO: 758078 - DNA, 25 bp, Mus musculus
tatggatggacacgcttgtccactc

SEQ ID NO: 758079 - DNA, 25 bp, Mus musculus
tatggatggacaggcttgtccactc

SEQ ID NO: 758080 - DNA, 25 bp, Mus musculus
tatggatggcaaccagctgattctg

SEQ ID NO: 758081 - DNA, 25 bp, Mus musculus
tatggatggcaagcagctgattctg

SEQ ID NO: 758082 - DNA, 25 bp, Mus musculus
tatggatgggttaaaaatgcagtgg

SEQ ID NO: 758083 - DNA, 25 bp, Mus musculus
tatggatgggtttaaaatgcagtgg

SEQ ID NO: 758084 - DNA, 25 bp, Mus musculus
tatggatggtgtcagcacagccatc

SEQ ID NO: 758085 - DNA, 25 bp, Mus musculus
tatggatggtgtgagcacagccatc

SEQ ID NO: 758086 - DNA, 25 bp, Mus musculus
tatggatgtattctcgcttataccg

SEQ ID NO: 758087 - DNA, 25 bp, Mus musculus
tatggatgtattgtcgcttataccg

SEQ ID NO: 758088 - DNA, 25 bp, Mus musculus
tatggatgtgacctttcttgggaca

SEQ ID NO: 758089 - DNA, 25 bp, Mus musculus
tatggatgtgacgtttcttgggaca

SEQ ID NO: 758090 - DNA, 25 bp, Mus musculus
tatggattataaccgaagcgaagcc

SEQ ID NO: 758091 - DNA, 25 bp, Mus musculus
tatggattataagcgaagcgaagcc

SEQ ID NO: 758092 - DNA, 25 bp, Mus musculus
tatggattatgtcgccagcacggca

SEQ ID NO: 758093 - DNA, 25 bp, Mus musculus
tatggattatgtggccagcacggca

SEQ ID NO: 758094 - DNA, 25 bp, Mus musculus
tatggattcagtcatcaccagctgg

SEQ ID NO: 758095 - DNA, 25 bp, Mus musculus
tatggattcagtgatcaccagctgg

SEQ ID NO: 758096 - DNA, 25 bp, Mus musculus
tatggattcgtacaacaaacagaga

SEQ ID NO: 758097 - DNA, 25 bp, Mus musculus
tatggattcgtagaacaaacagaga

SEQ ID NO: 758098 - DNA, 25 bp, Mus musculus
tatggattctgccaggctgacaatg

SEQ ID NO: 758099 - DNA, 25 bp, Mus musculus
tatggattctgcgaggctgacaatg

SEQ ID NO: 758100 - DNA, 25 bp, Mus musculus
tatggattggcaacctggatcccaa

SEQ ID NO: 758101 - DNA, 25 bp, Mus musculus
tatggattggcatcctggatcccaa

SEQ ID NO: 758102 - DNA, 25 bp, Mus musculus
tatggcaacataattgacaatctgg

SEQ ID NO: 758103 - DNA, 25 bp, Mus musculus
tatggcaacatatttgacaatctgg

SEQ ID NO: 758104 - DNA, 25 bp, Mus musculus
tatggcaaccctaactcagcacagg

SEQ ID NO: 758105 - DNA, 25 bp, Mus musculus
tatggcaacccttactcagcacagg

SEQ ID NO: 758106 - DNA, 25 bp, Mus musculus
tatggcaacctcctgctggagatgt

SEQ ID NO: 758107 - DNA, 25 bp, Mus musculus
tatggcaacctcgtgctggagatgt

SEQ ID NO: 758108 - DNA, 25 bp, Mus musculus
tatggcaacgtgcaaatcataaacc

SEQ ID NO: 758109 - DNA, 25 bp, Mus musculus
tatggcaacgtggaaatcataaacc

SEQ ID NO: 758110 - DNA, 25 bp, Mus musculus
tatggcaagaagaagctgaaatacc

SEQ ID NO: 758111 - DNA, 25 bp, Mus musculus
tatggcaagaagtagctgaaatacc

SEQ ID NO: 758112 - DNA, 25 bp, Mus musculus
tatggcaagccgagtacagttatct

SEQ ID NO: 758113 - DNA, 25 bp, Mus musculus
tatggcaagccgtgtacagttatct

SEQ ID NO: 758114 - DNA, 25 bp, Mus musculus
tatggcaaggttagcctgcgctccc

SEQ ID NO: 758115 - DNA, 25 bp, Mus musculus
tatggcaaggtttgcctgcgctccc

SEQ ID NO: 758116 - DNA, 25 bp, Mus musculus
tatggcaatggtagtcagcacgtgg

SEQ ID NO: 758117 - DNA, 25 bp, Mus musculus
tatggcaatggttgtcagcacgtgg

SEQ ID NO: 758118 - DNA, 25 bp, Mus musculus
tatggcacaactcgagtacattggc

SEQ ID NO: 758119 - DNA, 25 bp, Mus musculus
tatggcacaactggagtacattggc

SEQ ID NO: 758120 - DNA, 25 bp, Mus musculus
tatggcacaattaggaggaaccttc

SEQ ID NO: 758121 - DNA, 25 bp, Mus musculus
tatggcacaatttggaggaaccttc

SEQ ID NO: 758122 - DNA, 25 bp, Mus musculus
tatggcacagacatggtaaatggcc

SEQ ID NO: 758123 - DNA, 25 bp, Mus musculus
tatggcacagacttggtaaatggcc

SEQ ID NO: 758124 - DNA, 25 bp, Mus musculus
tatggcaccaaacagtggacgctga

SEQ ID NO: 758125 - DNA, 25 bp, Mus musculus
tatggcaccaaagagtggacgctga

SEQ ID NO: 758126 - DNA, 25 bp, Mus musculus
tatggcaccctaatattagttccgt

SEQ ID NO: 758127 - DNA, 25 bp, Mus musculus
tatggcaccctattattagttccgt

SEQ ID NO: 758128 - DNA, 25 bp, Mus musculus
tatggcaccgagcatacctagaggc

SEQ ID NO: 758129 - DNA, 25 bp, Mus musculus
tatggcaccgaggatacctagaggc

SEQ ID NO: 758130 - DNA, 25 bp, Mus musculus
tatggcaccgcacctgaggtgaagc

SEQ ID NO: 758131 - DNA, 25 bp, Mus musculus
tatggcaccgcagctgaggtgaagc

SEQ ID NO: 758132 - DNA, 25 bp, Mus musculus
tatggcacgccacagtttgtagcac

SEQ ID NO: 758133 - DNA, 25 bp, Mus musculus
tatggcacgccagagtttgtagcac

SEQ ID NO: 758134 - DNA, 25 bp, Mus musculus
tatggcactcccagctcgcgagtgg

SEQ ID NO: 758135 - DNA, 25 bp, Mus musculus
tatggcactccctgctcgcgagtgg

SEQ ID NO: 758136 - DNA, 25 bp, Mus musculus
tatggcacttctagctagactcggg

SEQ ID NO: 758137 - DNA, 25 bp, Mus musculus
tatggcacttcttgctagactcggg

SEQ ID NO: 758138 - DNA, 25 bp, Mus musculus
tatggcagacttatctctccagcag

SEQ ID NO: 758139 - DNA, 25 bp, Mus musculus
tatggcagacttttctctccagcag

SEQ ID NO: 758140 - DNA, 25 bp, Mus musculus
tatggcagatacatccgctctgctc

SEQ ID NO: 758141 - DNA, 25 bp, Mus musculus
tatggcagatacttccgctctgctc

SEQ ID NO: 758142 - DNA, 25 bp, Mus musculus
tatggcagatcacaaccgtctgtta

SEQ ID NO: 758143 - DNA, 25 bp, Mus musculus
tatggcagatcagaaccgtctgtta

SEQ ID NO: 758144 - DNA, 25 bp, Mus musculus
tatggcagattcatcaatgacttca

SEQ ID NO: 758145 - DNA, 25 bp, Mus musculus
tatggcagattcttcaatgacttca

SEQ ID NO: 758146 - DNA, 25 bp, Mus musculus
tatggcagcatgctgaagaatcaat

SEQ ID NO: 758147 - DNA, 25 bp, Mus musculus
tatggcagcatggtgaagaatcaat

SEQ ID NO: 758148 - DNA, 25 bp, Mus musculus
tatggcagccacattcaagggaacc

SEQ ID NO: 758149 - DNA, 25 bp, Mus musculus
tatggcagccactttcaagggaacc

SEQ ID NO: 758150 - DNA, 25 bp, Mus musculus
tatggcagccctcgacctcctaatt

SEQ ID NO: 758151 - DNA, 25 bp, Mus musculus
tatggcagccctggacctcctaatt

SEQ ID NO: 758152 - DNA, 25 bp, Mus musculus
tatggcagcctactgtaccacacgg

SEQ ID NO: 758153 - DNA, 25 bp, Mus musculus
tatggcagcctagtgtaccacacgg

SEQ ID NO: 758154 - DNA, 25 bp, Mus musculus
tatggcaggtaactattggtacccg

SEQ ID NO: 758155 - DNA, 25 bp, Mus musculus
tatggcaggtaagtattggtacccg

SEQ ID NO: 758156 - DNA, 25 bp, Mus musculus
tatggcagtcaaaggccccaatggc

SEQ ID NO: 758157 - DNA, 25 bp, Mus musculus
tatggcagtcaatggccccaatggc

SEQ ID NO: 758158 - DNA, 25 bp, Mus musculus
tatggcatcagccatggccggagca

SEQ ID NO: 758159 - DNA, 25 bp, Mus musculus
tatggcatcagcgatggccggagca

SEQ ID NO: 758160 - DNA, 25 bp, Mus musculus
tatggcatcatcatggcaattgtca

SEQ ID NO: 758161 - DNA, 25 bp, Mus musculus
tatggcatcatcttggcaattgtca

SEQ ID NO: 758162 - DNA, 25 bp, Mus musculus
tatggcatcgagcagaatggagacc

SEQ ID NO: 758163 - DNA, 25 bp, Mus musculus
tatggcatcgaggagaatggagacc

SEQ ID NO: 758164 - DNA, 25 bp, Mus musculus
tatggcatcttgcatgaggagctta

SEQ ID NO: 758165 - DNA, 25 bp, Mus musculus
tatggcatcttggatgaggagctta

SEQ ID NO: 758166 - DNA, 25 bp, Mus musculus
tatggcatgaggctgtttacaactg

SEQ ID NO: 758167 - DNA, 25 bp, Mus musculus
tatggcatgagggtgtttacaactg

SEQ ID NO: 758168 - DNA, 25 bp, Mus musculus
tatggcatggcccaggcaaccattg

SEQ ID NO: 758169 - DNA, 25 bp, Mus musculus
tatggcatggccgaggcaaccattg

SEQ ID NO: 758170 - DNA, 25 bp, Mus musculus
tatggccaaaataagagatcggagc

SEQ ID NO: 758171 - DNA, 25 bp, Mus musculus
tatggccaaaattagagatcggagc

SEQ ID NO: 758172 - DNA, 25 bp, Mus musculus
tatggccaagtaagccctcaagtgg

SEQ ID NO: 758173 - DNA, 25 bp, Mus musculus
tatggccaagtatgccctcaagtgg

SEQ ID NO: 758174 - DNA, 25 bp, Mus musculus
tatggccaccttactgtctataaga

SEQ ID NO: 758175 - DNA, 25 bp, Mus musculus
tatggccacctttctgtctataaga

SEQ ID NO: 758176 - DNA, 25 bp, Mus musculus
tatggccactcacgcaagacgctgt

SEQ ID NO: 758177 - DNA, 25 bp, Mus musculus
tatggccactcaggcaagacgctgt

SEQ ID NO: 758178 - DNA, 25 bp, Mus musculus
tatggccactgacgccacatggagg

SEQ ID NO: 758179 - DNA, 25 bp, Mus musculus
tatggccactgaggccacatggagg

SEQ ID NO: 758180 - DNA, 25 bp, Mus musculus
tatggccacttcacactcttgggaa

SEQ ID NO: 758181 - DNA, 25 bp, Mus musculus
tatggccacttctcactcttgggaa

SEQ ID NO: 758182 - DNA, 25 bp, Mus musculus
tatggccagaagactcttgacagca

SEQ ID NO: 758183 - DNA, 25 bp, Mus musculus
tatggccagaagtctcttgacagca

SEQ ID NO: 758184 - DNA, 25 bp, Mus musculus
tatggccagcaaccagggtcgccat

SEQ ID NO: 758185 - DNA, 25 bp, Mus musculus
tatggccagcaagcagggtcgccat

SEQ ID NO: 758186 - DNA, 25 bp, Mus musculus
tatggccaggataacaccaccaact

SEQ ID NO: 758187 - DNA, 25 bp, Mus musculus
tatggccaggattacaccaccaact

SEQ ID NO: 758188 - DNA, 25 bp, Mus musculus
tatggccagtacacagttggtggca

SEQ ID NO: 758189 - DNA, 25 bp, Mus musculus
tatggccagtactcagttggtggca

SEQ ID NO: 758190 - DNA, 25 bp, Mus musculus
tatggccagtggactctgggtgata

SEQ ID NO: 758191 - DNA, 25 bp, Mus musculus
tatggccagtggtctctgggtgata

SEQ ID NO: 758192 - DNA, 25 bp, Mus musculus
tatggccatggtcgccggcagttct

SEQ ID NO: 758193 - DNA, 25 bp, Mus musculus
tatggccatggtggccggcagttct

SEQ ID NO: 758194 - DNA, 25 bp, Mus musculus
tatggcccaatgctgtcacacacga

SEQ ID NO: 758195 - DNA, 25 bp, Mus musculus
tatggcccaatggtgtcacacacga

SEQ ID NO: 758196 - DNA, 25 bp, Mus musculus
tatggcccagacatgagtggtcccc

SEQ ID NO: 758197 - DNA, 25 bp, Mus musculus
tatggcccagacttgagtggtcccc

SEQ ID NO: 758198 - DNA, 25 bp, Mus musculus
tatggcccagctccgtacattgcct

SEQ ID NO: 758199 - DNA, 25 bp, Mus musculus
tatggcccagctgcgtacattgcct

SEQ ID NO: 758200 - DNA, 25 bp, Mus musculus
tatggcccgggaactctctggtgtc

SEQ ID NO: 758201 - DNA, 25 bp, Mus musculus
tatggcccgggatctctctggtgtc

SEQ ID NO: 758202 - DNA, 25 bp, Mus musculus
tatggcccgtctcatgtgcactggg

SEQ ID NO: 758203 - DNA, 25 bp, Mus musculus
tatggcccgtctgatgtgcactggg

SEQ ID NO: 758204 - DNA, 25 bp, Mus musculus
tatggccctcagctctcgttcttca

SEQ ID NO: 758205 - DNA, 25 bp, Mus musculus
tatggccctcaggtctcgttcttca

SEQ ID NO: 758206 - DNA, 25 bp, Mus musculus
tatggccgagaacacgcttgtggcc

SEQ ID NO: 758207 - DNA, 25 bp, Mus musculus
tatggccgagaagacgcttgtggcc

SEQ ID NO: 758208 - DNA, 25 bp, Mus musculus
tatggccggcctctgttaacactga

SEQ ID NO: 758209 - DNA, 25 bp, Mus musculus
tatggccggcctgtgttaacactga

SEQ ID NO: 758210 - DNA, 25 bp, Mus musculus
tatggcctcctgaacgtctatgagc

SEQ ID NO: 758211 - DNA, 25 bp, Mus musculus
tatggcctcctgtacgtctatgagc

SEQ ID NO: 758212 - DNA, 25 bp, Mus musculus
tatggcctgatgaagctggttctga

SEQ ID NO: 758213 - DNA, 25 bp, Mus musculus
tatggcctgatgtagctggttctga

SEQ ID NO: 758214 - DNA, 25 bp, Mus musculus
tatggcctgattccagaagagactg

SEQ ID NO: 758215 - DNA, 25 bp, Mus musculus
tatggcctgattgcagaagagactg

SEQ ID NO: 758216 - DNA, 25 bp, Mus musculus
tatggcgacacgacgacctgacgct

SEQ ID NO: 758217 - DNA, 25 bp, Mus musculus
tatggcgacacgtcgacctgacgct

SEQ ID NO: 758218 - DNA, 25 bp, Mus musculus
tatggcgccctcaagaggatcatgc

SEQ ID NO: 758219 - DNA, 25 bp, Mus musculus
tatggcgccctctagaggatcatgc

SEQ ID NO: 758220 - DNA, 25 bp, Mus musculus
tatggcgcgtctaccaactctgagc

SEQ ID NO: 758221 - DNA, 25 bp, Mus musculus
tatggcgcgtcttccaactctgagc

SEQ ID NO: 758222 - DNA, 25 bp, Mus musculus
tatggcggctgtaccttcaataaag

SEQ ID NO: 758223 - DNA, 25 bp, Mus musculus
tatggcggctgttccttcaataaag

SEQ ID NO: 758224 - DNA, 25 bp, Mus musculus
tatggcggtggcctatggactcatc

SEQ ID NO: 758225 - DNA, 25 bp, Mus musculus
tatggcggtggcgtatggactcatc

SEQ ID NO: 758226 - DNA, 25 bp, Mus musculus
tatggcggttctcaggtggctaccc

SEQ ID NO: 758227 - DNA, 25 bp, Mus musculus
tatggcggttctgaggtggctaccc

SEQ ID NO: 758228 - DNA, 25 bp, Mus musculus
tatggcgtagatctcctgtctgagg

SEQ ID NO: 758229 - DNA, 25 bp, Mus musculus
tatggcgtagatgtcctgtctgagg

SEQ ID NO: 758230 - DNA, 25 bp, Mus musculus
tatggcgtcacccacactcgtggca

SEQ ID NO: 758231 - DNA, 25 bp, Mus musculus
tatggcgtcaccgacactcgtggca

SEQ ID NO: 758232 - DNA, 25 bp, Mus musculus
tatggcgtgataactctggccggcg

SEQ ID NO: 758233 - DNA, 25 bp, Mus musculus
tatggcgtgatatctctggccggcg

SEQ ID NO: 758234 - DNA, 25 bp, Mus musculus
tatggcgttatgcaaagcctacacg

SEQ ID NO: 758235 - DNA, 25 bp, Mus musculus
tatggcgttatggaaagcctacacg

SEQ ID NO: 758236 - DNA, 25 bp, Mus musculus
tatggcgttcctacttctggttgta

SEQ ID NO: 758237 - DNA, 25 bp, Mus musculus
tatggcgttccttcttctggttgta

SEQ ID NO: 758238 - DNA, 25 bp, Mus musculus
tatggcgtttgtcagaacctgcgga

SEQ ID NO: 758239 - DNA, 25 bp, Mus musculus
tatggcgtttgtgagaacctgcgga

SEQ ID NO: 758240 - DNA, 25 bp, Mus musculus
tatggctaacaaagcatctcttgag

SEQ ID NO: 758241 - DNA, 25 bp, Mus musculus
tatggctaacaatgcatctcttgag

SEQ ID NO: 758242 - DNA, 25 bp, Mus musculus
tatggctaagagacctgcagagacg

SEQ ID NO: 758243 - DNA, 25 bp, Mus musculus
tatggctaagagtcctgcagagacg

SEQ ID NO: 758244 - DNA, 25 bp, Mus musculus
tatggctacagtaaccgagtggtcg

SEQ ID NO: 758245 - DNA, 25 bp, Mus musculus
tatggctacagttaccgagtggtcg

SEQ ID NO: 758246 - DNA, 25 bp, Mus musculus
tatggctaggtaaatgttgcttcag

SEQ ID NO: 758247 - DNA, 25 bp, Mus musculus
tatggctaggtatatgttgcttcag

SEQ ID NO: 758248 - DNA, 25 bp, Mus musculus
tatggctatgaaaaatcccttcgac

SEQ ID NO: 758249 - DNA, 25 bp, Mus musculus
tatggctatgaataatcccttcgac

SEQ ID NO: 758250 - DNA, 25 bp, Mus musculus
tatggctatggccaggataacacca

SEQ ID NO: 758251 - DNA, 25 bp, Mus musculus
tatggctatggcgaggataacacca

SEQ ID NO: 758252 - DNA, 25 bp, Mus musculus
tatggctatttcagatgaactgcac

SEQ ID NO: 758253 - DNA, 25 bp, Mus musculus
tatggctatttctgatgaactgcac

SEQ ID NO: 758254 - DNA, 25 bp, Mus musculus
tatggctcaaccagcctcactgtgg

SEQ ID NO: 758255 - DNA, 25 bp, Mus musculus
tatggctcaacctgcctcactgtgg

SEQ ID NO: 758256 - DNA, 25 bp, Mus musculus
tatggctcagttcgagcaccaggcg

SEQ ID NO: 758257 - DNA, 25 bp, Mus musculus
tatggctcagttggagcaccaggcg

SEQ ID NO: 758258 - DNA, 25 bp, Mus musculus
tatggctcatcacctgcctcagtat

SEQ ID NO: 758259 - DNA, 25 bp, Mus musculus
tatggctcatcagctgcctcagtat

SEQ ID NO: 758260 - DNA, 25 bp, Mus musculus
tatggctccattccaggcctagcag

SEQ ID NO: 758261 - DNA, 25 bp, Mus musculus
tatggctccattgcaggcctagcag

SEQ ID NO: 758262 - DNA, 25 bp, Mus musculus
tatggctcctacatagtctggaaag

SEQ ID NO: 758263 - DNA, 25 bp, Mus musculus
tatggctcctacttagtctggaaag

SEQ ID NO: 758264 - DNA, 25 bp, Mus musculus
tatggctcctgacaccaaagggcac

SEQ ID NO: 758265 - DNA, 25 bp, Mus musculus
tatggctcctgagaccaaagggcac

SEQ ID NO: 758266 - DNA, 25 bp, Mus musculus
tatggctcctgtctttgagcagaag

SEQ ID NO: 758267 - DNA, 25 bp, Mus musculus
tatggctcctgtgtttgagcagaag

SEQ ID NO: 758268 - DNA, 25 bp, Mus musculus
tatggctcgggcaagtgatagtcac

SEQ ID NO: 758269 - DNA, 25 bp, Mus musculus
tatggctcgggctagtgatagtcac

SEQ ID NO: 758270 - DNA, 25 bp, Mus musculus
tatggctcgggtctccgtcagtcag

SEQ ID NO: 758271 - DNA, 25 bp, Mus musculus
tatggctcgggtgtccgtcagtcag

SEQ ID NO: 758272 - DNA, 25 bp, Mus musculus
tatggctctcatcaagtatggcagg

SEQ ID NO: 758273 - DNA, 25 bp, Mus musculus
tatggctctcatgaagtatggcagg

SEQ ID NO: 758274 - DNA, 25 bp, Mus musculus
tatggctctctcaaaggtcttaccc

SEQ ID NO: 758275 - DNA, 25 bp, Mus musculus
tatggctctctctaaggtcttaccc

SEQ ID NO: 758276 - DNA, 25 bp, Mus musculus
tatggctctgcaagatctgccttga

SEQ ID NO: 758277 - DNA, 25 bp, Mus musculus
tatggctctgcatgatctgccttga

SEQ ID NO: 758278 - DNA, 25 bp, Mus musculus
tatggctctttcatctgccgctgtg

SEQ ID NO: 758279 - DNA, 25 bp, Mus musculus
tatggctctttcttctgccgctgtg

SEQ ID NO: 758280 - DNA, 25 bp, Mus musculus
tatggctgacgtctcccagtatcat

SEQ ID NO: 758281 - DNA, 25 bp, Mus musculus
tatggctgacgtgtcccagtatcat

SEQ ID NO: 758282 - DNA, 25 bp, Mus musculus
tatggctgcaaaccaacaaatccgg

SEQ ID NO: 758283 - DNA, 25 bp, Mus musculus
tatggctgcaaagcaacaaatccgg

SEQ ID NO: 758284 - DNA, 25 bp, Mus musculus
tatggctgcagcatctattgccaac

SEQ ID NO: 758285 - DNA, 25 bp, Mus musculus
tatggctgcagcttctattgccaac

SEQ ID NO: 758286 - DNA, 25 bp, Mus musculus
tatggctgcatacatagaaaatgcc

SEQ ID NO: 758287 - DNA, 25 bp, Mus musculus
tatggctgcatagatagaaaatgcc

SEQ ID NO: 758288 - DNA, 25 bp, Mus musculus
tatggctgccgtcttattcaaaagg

SEQ ID NO: 758289 - DNA, 25 bp, Mus musculus
tatggctgccgtgttattcaaaagg

SEQ ID NO: 758290 - DNA, 25 bp, Mus musculus
tatggctggactagagctgagaacc

SEQ ID NO: 758291 - DNA, 25 bp, Mus musculus
tatggctggacttgagctgagaacc

SEQ ID NO: 758292 - DNA, 25 bp, Mus musculus
tatggctgggagaaaatagaggacc

SEQ ID NO: 758293 - DNA, 25 bp, Mus musculus
tatggctgggagtaaatagaggacc

SEQ ID NO: 758294 - DNA, 25 bp, Mus musculus
tatggctgtcctagctgacagtgct

SEQ ID NO: 758295 - DNA, 25 bp, Mus musculus
tatggctgtccttgctgacagtgct

SEQ ID NO: 758296 - DNA, 25 bp, Mus musculus
tatggcttatctactttgtgctggg

SEQ ID NO: 758297 - DNA, 25 bp, Mus musculus
tatggcttatcttctttgtgctggg

SEQ ID NO: 758298 - DNA, 25 bp, Mus musculus
tatggcttccatcctcaggagttca

SEQ ID NO: 758299 - DNA, 25 bp, Mus musculus
tatggcttccatgctcaggagttca

SEQ ID NO: 758300 - DNA, 25 bp, Mus musculus
tatggcttctccaccatagccagtg

SEQ ID NO: 758301 - DNA, 25 bp, Mus musculus
tatggcttctcctccatagccagtg

SEQ ID NO: 758302 - DNA, 25 bp, Mus musculus
tatggcttgcaaatggccacaggtg

SEQ ID NO: 758303 - DNA, 25 bp, Mus musculus
tatggcttgcaattggccacaggtg

SEQ ID NO: 758304 - DNA, 25 bp, Mus musculus
tatggcttgtggaacgtcgtcaccc

SEQ ID NO: 758305 - DNA, 25 bp, Mus musculus
tatggcttgtggtacgtcgtcaccc

SEQ ID NO: 758306 - DNA, 25 bp, Mus musculus
tatgggaaaagcctatcgaacagca

SEQ ID NO: 758307 - DNA, 25 bp, Mus musculus
tatgggaaaagcgtatcgaacagca

SEQ ID NO: 758308 - DNA, 25 bp, Mus musculus
tatgggaaaggactcagtaccctgt

SEQ ID NO: 758309 - DNA, 25 bp, Mus musculus
tatgggaaaggagtcagtaccctgt

SEQ ID NO: 758310 - DNA, 25 bp, Mus musculus
tatgggaaatacatcgagctgtgcc

SEQ ID NO: 758311 - DNA, 25 bp, Mus musculus
tatgggaaatacttcgagctgtgcc

SEQ ID NO: 758312 - DNA, 25 bp, Mus musculus
tatgggaaccgtaatgagaatcgag

SEQ ID NO: 758313 - DNA, 25 bp, Mus musculus
tatgggaaccgttatgagaatcgag

SEQ ID NO: 758314 - DNA, 25 bp, Mus musculus
tatgggaagatcatgattatgacag

SEQ ID NO: 758315 - DNA, 25 bp, Mus musculus
tatgggaagatcctgtccacaaagg

SEQ ID NO: 758316 - DNA, 25 bp, Mus musculus
tatgggaagatcgtgtccacaaagg

SEQ ID NO: 758317 - DNA, 25 bp, Mus musculus
tatgggaagatcttgattatgacag

SEQ ID NO: 758318 - DNA, 25 bp, Mus musculus
tatgggaatgatcacagaatactac

SEQ ID NO: 758319 - DNA, 25 bp, Mus musculus
tatgggaatgatgacagaatactac

SEQ ID NO: 758320 - DNA, 25 bp, Mus musculus
tatgggaatgtaattagtctggagt

SEQ ID NO: 758321 - DNA, 25 bp, Mus musculus
tatgggaatgtatttagtctggagt

SEQ ID NO: 758322 - DNA, 25 bp, Mus musculus
tatgggaccaccaataacaccagtc

SEQ ID NO: 758323 - DNA, 25 bp, Mus musculus
tatgggaccacctataacaccagtc

SEQ ID NO: 758324 - DNA, 25 bp, Mus musculus
tatgggacccttaggacctcaggac

SEQ ID NO: 758325 - DNA, 25 bp, Mus musculus
tatgggaccctttggacctcaggac

SEQ ID NO: 758326 - DNA, 25 bp, Mus musculus
tatgggacctatccggactacttag

SEQ ID NO: 758327 - DNA, 25 bp, Mus musculus
tatgggacctatgcggactacttag

SEQ ID NO: 758328 - DNA, 25 bp, Mus musculus
tatgggacgcctcgctggaatccta

SEQ ID NO: 758329 - DNA, 25 bp, Mus musculus
tatgggacgcctggctggaatccta

SEQ ID NO: 758330 - DNA, 25 bp, Mus musculus
tatgggactctgctacaggaaggag

SEQ ID NO: 758331 - DNA, 25 bp, Mus musculus
tatgggactctggtacaggaaggag

SEQ ID NO: 758332 - DNA, 25 bp, Mus musculus
tatgggagacatactacttcctgcc

SEQ ID NO: 758333 - DNA, 25 bp, Mus musculus
tatgggagacattctacttcctgcc

SEQ ID NO: 758334 - DNA, 25 bp, Mus musculus
tatgggagacccaggtgtggccaaa

SEQ ID NO: 758335 - DNA, 25 bp, Mus musculus
tatgggagaccctggtgtggccaaa

SEQ ID NO: 758336 - DNA, 25 bp, Mus musculus
tatgggagcatcaaatgggaatcag

SEQ ID NO: 758337 - DNA, 25 bp, Mus musculus
tatgggagcatctaatgggaatcag

SEQ ID NO: 758338 - DNA, 25 bp, Mus musculus
tatgggagccacagtcatgacacag

SEQ ID NO: 758339 - DNA, 25 bp, Mus musculus
tatgggagccactgtcatgacacag

SEQ ID NO: 758340 - DNA, 25 bp, Mus musculus
tatgggagctcaaaagctgaggcag

SEQ ID NO: 758341 - DNA, 25 bp, Mus musculus
tatgggagctcataagctgaggcag

SEQ ID NO: 758342 - DNA, 25 bp, Mus musculus
tatgggaggactacagggtaatgcc

SEQ ID NO: 758343 - DNA, 25 bp, Mus musculus
tatgggaggacttcagggtaatgcc

SEQ ID NO: 758344 - DNA, 25 bp, Mus musculus
tatgggaggagccactctaactacc

SEQ ID NO: 758345 - DNA, 25 bp, Mus musculus
tatgggaggagcgactctaactacc

SEQ ID NO: 758346 - DNA, 25 bp, Mus musculus
tatgggaggctaagcaagcttaccc

SEQ ID NO: 758347 - DNA, 25 bp, Mus musculus
tatgggaggctatgcaagcttaccc

SEQ ID NO: 758348 - DNA, 25 bp, Mus musculus
tatgggagtagaagaatttggagtc

SEQ ID NO: 758349 - DNA, 25 bp, Mus musculus
tatgggagtagatgaatttggagtc

SEQ ID NO: 758350 - DNA, 25 bp, Mus musculus
tatgggagtcacaactcttctccag

SEQ ID NO: 758351 - DNA, 25 bp, Mus musculus
tatgggagtcactactcttctccag

SEQ ID NO: 758352 - DNA, 25 bp, Mus musculus
tatgggatacaaactgccacagtcc

SEQ ID NO: 758353 - DNA, 25 bp, Mus musculus
tatgggatacaatctgccacagtcc

SEQ ID NO: 758354 - DNA, 25 bp, Mus musculus
tatgggatcaacaatttcgagatca

SEQ ID NO: 758355 - DNA, 25 bp, Mus musculus
tatgggatcaactatttcgagatca

SEQ ID NO: 758356 - DNA, 25 bp, Mus musculus
tatgggatccaacacagtatgaaag

SEQ ID NO: 758357 - DNA, 25 bp, Mus musculus
tatgggatccaagacagtatgaaag

SEQ ID NO: 758358 - DNA, 25 bp, Mus musculus
tatgggatcggcacttaccgagaga

SEQ ID NO: 758359 - DNA, 25 bp, Mus musculus
tatgggatcggctcttaccgagaga

SEQ ID NO: 758360 - DNA, 25 bp, Mus musculus
tatgggatgatcaacctaggaaaag

SEQ ID NO: 758361 - DNA, 25 bp, Mus musculus
tatgggatgatctacctaggaaaag

SEQ ID NO: 758362 - DNA, 25 bp, Mus musculus
tatgggatgtcgaggctgtctgcct

SEQ ID NO: 758363 - DNA, 25 bp, Mus musculus
tatgggatgtcgtggctgtctgcct

SEQ ID NO: 758364 - DNA, 25 bp, Mus musculus
tatgggattcttcaattccagggtg

SEQ ID NO: 758365 - DNA, 25 bp, Mus musculus
tatgggattcttgaattccagggtg

SEQ ID NO: 758366 - DNA, 25 bp, Mus musculus
tatgggcaaactatgacggtgagca

SEQ ID NO: 758367 - DNA, 25 bp, Mus musculus
tatgggcaaactttgacggtgagca

SEQ ID NO: 758368 - DNA, 25 bp, Mus musculus
tatgggcagctgagcccacaaaacc

SEQ ID NO: 758369 - DNA, 25 bp, Mus musculus
tatgggcagctgtgcccacaaaacc

SEQ ID NO: 758370 - DNA, 25 bp, Mus musculus
tatgggcatttcactaccacagagg

SEQ ID NO: 758371 - DNA, 25 bp, Mus musculus
tatgggcatttctctaccacagagg

SEQ ID NO: 758372 - DNA, 25 bp, Mus musculus
tatgggcccaaaagatgcatcacca

SEQ ID NO: 758373 - DNA, 25 bp, Mus musculus
tatgggcccaaatgatgcatcacca

SEQ ID NO: 758374 - DNA, 25 bp, Mus musculus
tatgggcccaagattgtgccccggg

SEQ ID NO: 758375 - DNA, 25 bp, Mus musculus
tatgggcccaagtttgtgccccggg

SEQ ID NO: 758376 - DNA, 25 bp, Mus musculus
tatgggcgaaccatccgccgtttcg

SEQ ID NO: 758377 - DNA, 25 bp, Mus musculus
tatgggcgaaccttccgccgtttcg

SEQ ID NO: 758378 - DNA, 25 bp, Mus musculus
tatgggcgcacaacctagacatctg

SEQ ID NO: 758379 - DNA, 25 bp, Mus musculus
tatgggcgcacatcctagacatctg

SEQ ID NO: 758380 - DNA, 25 bp, Mus musculus
tatgggcgcatgagggaagatccca

SEQ ID NO: 758381 - DNA, 25 bp, Mus musculus
tatgggcgcatgtgggaagatccca

SEQ ID NO: 758382 - DNA, 25 bp, Mus musculus
tatgggctaaacaggacaatcggtc

SEQ ID NO: 758383 - DNA, 25 bp, Mus musculus
tatgggctaaactggacaatcggtc

SEQ ID NO: 758384 - DNA, 25 bp, Mus musculus
tatgggctacacaacccagacgtgg

SEQ ID NO: 758385 - DNA, 25 bp, Mus musculus
tatgggctacactacccagacgtgg

SEQ ID NO: 758386 - DNA, 25 bp, Mus musculus
tatgggctctggaggtttcatgcct

SEQ ID NO: 758387 - DNA, 25 bp, Mus musculus
tatgggctctggtggtttcatgcct

SEQ ID NO: 758388 - DNA, 25 bp, Mus musculus
tatgggctgcaccaggatgtgcatc

SEQ ID NO: 758389 - DNA, 25 bp, Mus musculus
tatgggctgcacgaggatgtgcatc

SEQ ID NO: 758390 - DNA, 25 bp, Mus musculus
tatgggctgtggacatattcacagc

SEQ ID NO: 758391 - DNA, 25 bp, Mus musculus
tatgggctgtggtcatattcacagc

SEQ ID NO: 758392 - DNA, 25 bp, Mus musculus
tatgggcttctaagcatcttgggtg

SEQ ID NO: 758393 - DNA, 25 bp, Mus musculus
tatgggcttctatgcatcttgggtg

SEQ ID NO: 758394 - DNA, 25 bp, Mus musculus
tatgggtaccacaggcgctttgcgt

SEQ ID NO: 758395 - DNA, 25 bp, Mus musculus
tatgggtaccactggcgctttgcgt

SEQ ID NO: 758396 - DNA, 25 bp, Mus musculus
tatgggtcaccaaaagatgtggcag

SEQ ID NO: 758397 - DNA, 25 bp, Mus musculus
tatgggtcaccataagatgtggcag

SEQ ID NO: 758398 - DNA, 25 bp, Mus musculus
tatgggtcacgaactgtcacgtcgg

SEQ ID NO: 758399 - DNA, 25 bp, Mus musculus
tatgggtcacgatctgtcacgtcgg

SEQ ID NO: 758400 - DNA, 25 bp, Mus musculus
tatgggtccctcatctggaaggtgg

SEQ ID NO: 758401 - DNA, 25 bp, Mus musculus
tatgggtccctcttctggaaggtgg

SEQ ID NO: 758402 - DNA, 25 bp, Mus musculus
tatgggtcggtgatcacggtgtacc

SEQ ID NO: 758403 - DNA, 25 bp, Mus musculus
tatgggtcggtgttcacggtgtacc

SEQ ID NO: 758404 - DNA, 25 bp, Mus musculus
tatgggtgacctagtaagtgtgcct

SEQ ID NO: 758405 - DNA, 25 bp, Mus musculus
tatgggtgaccttgtaagtgtgcct

SEQ ID NO: 758406 - DNA, 25 bp, Mus musculus
tatgggtgtagaaactgcttgcagc

SEQ ID NO: 758407 - DNA, 25 bp, Mus musculus
tatgggtgtagatactgcttgcagc

SEQ ID NO: 758408 - DNA, 25 bp, Mus musculus
tatgggttcatacaaagaaatgtgg

SEQ ID NO: 758409 - DNA, 25 bp, Mus musculus
tatgggttcatagaaagaaatgtgg

SEQ ID NO: 758410 - DNA, 25 bp, Mus musculus
tatggtaaagctacacctcaatggt

SEQ ID NO: 758411 - DNA, 25 bp, Mus musculus
tatggtaaagcttcacctcaatggt

SEQ ID NO: 758412 - DNA, 25 bp, Mus musculus
tatggtaaccaaaccgactatagaa

SEQ ID NO: 758413 - DNA, 25 bp, Mus musculus
tatggtaaccaatccgactatagaa

SEQ ID NO: 758414 - DNA, 25 bp, Mus musculus
tatggtaaccgacctctctgttttc

SEQ ID NO: 758415 - DNA, 25 bp, Mus musculus
tatggtaaccgagctctctgttttc

SEQ ID NO: 758416 - DNA, 25 bp, Mus musculus
tatggtaatagcaggcatgatctac

SEQ ID NO: 758417 - DNA, 25 bp, Mus musculus
tatggtaatagctggcatgatctac

SEQ ID NO: 758418 - DNA, 25 bp, Mus musculus
tatggtacaagaacagtctgccctt

SEQ ID NO: 758419 - DNA, 25 bp, Mus musculus
tatggtacaagatcagtctgccctt

SEQ ID NO: 758420 - DNA, 25 bp, Mus musculus
tatggtaccaagcaattcagctttg

SEQ ID NO: 758421 - DNA, 25 bp, Mus musculus
tatggtaccaaggaattcagctttg

SEQ ID NO: 758422 - DNA, 25 bp, Mus musculus
tatggtacctagaccggtggagacg

SEQ ID NO: 758423 - DNA, 25 bp, Mus musculus
tatggtacctagtccggtggagacg

SEQ ID NO: 758424 - DNA, 25 bp, Mus musculus
tatggtagaaaaccgaatgcttatg

SEQ ID NO: 758425 - DNA, 25 bp, Mus musculus
tatggtagaaaagcgaatgcttatg

SEQ ID NO: 758426 - DNA, 25 bp, Mus musculus
tatggtagaggcctagtctgcttcc

SEQ ID NO: 758427 - DNA, 25 bp, Mus musculus
tatggtagaggcgtagtctgcttcc

SEQ ID NO: 758428 - DNA, 25 bp, Mus musculus
tatggtagcatcagaagagcatggt

SEQ ID NO: 758429 - DNA, 25 bp, Mus musculus
tatggtagcatctgaagagcatggt

SEQ ID NO: 758430 - DNA, 25 bp, Mus musculus
tatggtatcaacaacacagacagaa

SEQ ID NO: 758431 - DNA, 25 bp, Mus musculus
tatggtatcaactacacagacagaa

SEQ ID NO: 758432 - DNA, 25 bp, Mus musculus
tatggtcaactgaaagcttcccagg

SEQ ID NO: 758433 - DNA, 25 bp, Mus musculus
tatggtcaactgtaagcttcccagg

SEQ ID NO: 758434 - DNA, 25 bp, Mus musculus
tatggtcacattctctactcagtgc

SEQ ID NO: 758435 - DNA, 25 bp, Mus musculus
tatggtcacattgtctactcagtgc

SEQ ID NO: 758436 - DNA, 25 bp, Mus musculus
tatggtcactcacagctcagttatg

SEQ ID NO: 758437 - DNA, 25 bp, Mus musculus
tatggtcactcagagctcagttatg

SEQ ID NO: 758438 - DNA, 25 bp, Mus musculus
tatggtcagccacgatatccccatg

SEQ ID NO: 758439 - DNA, 25 bp, Mus musculus
tatggtcagccaggatatccccatg

SEQ ID NO: 758440 - DNA, 25 bp, Mus musculus
tatggtcccattcccttgtttggag

SEQ ID NO: 758441 - DNA, 25 bp, Mus musculus
tatggtcccattgccttgtttggag

SEQ ID NO: 758442 - DNA, 25 bp, Mus musculus
tatggtcctgctatggaatttgtgc

SEQ ID NO: 758443 - DNA, 25 bp, Mus musculus
tatggtcctgctttggaatttgtgc

SEQ ID NO: 758444 - DNA, 25 bp, Mus musculus
tatggtctcgaacccgacactaacc

SEQ ID NO: 758445 - DNA, 25 bp, Mus musculus
tatggtctcgaagccgacactaacc

SEQ ID NO: 758446 - DNA, 25 bp, Mus musculus
tatggtctgaaccaagcttccagtg

SEQ ID NO: 758447 - DNA, 25 bp, Mus musculus
tatggtctgaacgaagcttccagtg

SEQ ID NO: 758448 - DNA, 25 bp, Mus musculus
tatggtctgcacatgatactcagcc

SEQ ID NO: 758449 - DNA, 25 bp, Mus musculus
tatggtctgcacttgatactcagcc

SEQ ID NO: 758450 - DNA, 25 bp, Mus musculus
tatggtcttcggcaaagcattgcct

SEQ ID NO: 758451 - DNA, 25 bp, Mus musculus
tatggtcttcgggaaagcattgcct

SEQ ID NO: 758452 - DNA, 25 bp, Mus musculus
tatggtctttccaggaattctaatc

SEQ ID NO: 758453 - DNA, 25 bp, Mus musculus
tatggtctttcctggaattctaatc

SEQ ID NO: 758454 - DNA, 25 bp, Mus musculus
tatggtgaaaagcttcacagggcac

SEQ ID NO: 758455 - DNA, 25 bp, Mus musculus
tatggtgaaaaggttcacagggcac

SEQ ID NO: 758456 - DNA, 25 bp, Mus musculus
tatggtgaaacacaagctgccctgg

SEQ ID NO: 758457 - DNA, 25 bp, Mus musculus
tatggtgaaacagaagctgccctgg

SEQ ID NO: 758458 - DNA, 25 bp, Mus musculus
tatggtgaaatcatttgtgcagtgg

SEQ ID NO: 758459 - DNA, 25 bp, Mus musculus
tatggtgaaatcttttgtgcagtgg

SEQ ID NO: 758460 - DNA, 25 bp, Mus musculus
tatggtgaccacaagggaacaaatc

SEQ ID NO: 758461 - DNA, 25 bp, Mus musculus
tatggtgaccactagggaacaaatc

SEQ ID NO: 758462 - DNA, 25 bp, Mus musculus
tatggtgacttccttcgtgtctgca

SEQ ID NO: 758463 - DNA, 25 bp, Mus musculus
tatggtgacttcgttcgtgtctgca

SEQ ID NO: 758464 - DNA, 25 bp, Mus musculus
tatggtgatgttatccagggctcct

SEQ ID NO: 758465 - DNA, 25 bp, Mus musculus
tatggtgatgttttccagggctcct

SEQ ID NO: 758466 - DNA, 25 bp, Mus musculus
tatggtgattacattgcggtgaatc

SEQ ID NO: 758467 - DNA, 25 bp, Mus musculus
tatggtgattactttgcggtgaatc

SEQ ID NO: 758468 - DNA, 25 bp, Mus musculus
tatggtgcaccaactcctgagtgtg

SEQ ID NO: 758469 - DNA, 25 bp, Mus musculus
tatggtgcaccatctcctgagtgtg

SEQ ID NO: 758470 - DNA, 25 bp, Mus musculus
tatggtgcctgcaccagccacacag

SEQ ID NO: 758471 - DNA, 25 bp, Mus musculus
tatggtgcctgcagactcttagaca

SEQ ID NO: 758472 - DNA, 25 bp, Mus musculus
tatggtgcctgctccagccacacag

SEQ ID NO: 758473 - DNA, 25 bp, Mus musculus
tatggtgcctgctgactcttagaca

SEQ ID NO: 758474 - DNA, 25 bp, Mus musculus
tatggtgctccacgatcttttgcag

SEQ ID NO: 758475 - DNA, 25 bp, Mus musculus
tatggtgctccaggatcttttgcag

SEQ ID NO: 758476 - DNA, 25 bp, Mus musculus
tatggtgctgagatccccggtagag

SEQ ID NO: 758477 - DNA, 25 bp, Mus musculus
tatggtgctgagttccccggtagag

SEQ ID NO: 758478 - DNA, 25 bp, Mus musculus
tatggtgctttcattaagaagagcc

SEQ ID NO: 758479 - DNA, 25 bp, Mus musculus
tatggtgctttctttaagaagagcc

SEQ ID NO: 758480 - DNA, 25 bp, Mus musculus
tatggtggataccatgttggaagaa

SEQ ID NO: 758481 - DNA, 25 bp, Mus musculus
tatggtggatacgatgttggaagaa

SEQ ID NO: 758482 - DNA, 25 bp, Mus musculus
tatggtggcaccagatgtccaaatt

SEQ ID NO: 758483 - DNA, 25 bp, Mus musculus
tatggtggcacctgatgtccaaatt

SEQ ID NO: 758484 - DNA, 25 bp, Mus musculus
tatggtggcatcagacactagtgac

SEQ ID NO: 758485 - DNA, 25 bp, Mus musculus
tatggtggcatctgacactagtgac

SEQ ID NO: 758486 - DNA, 25 bp, Mus musculus
tatggtggccatcagaaagctgtcg
